United States Patent 7,655,785 (BIOINFORMATICALLY DETECTABLE GROUP OF NOVEL REGULATORY OLIGONUCLEOTIDES AND USES THEREOF) - sequence listing, part 18

SEQ ID NO: 709764 - RNA, 19 nt, Homo sapiens
uuauuccccccuacuugag

SEQ ID NO: 709765 - RNA, 16 nt, Homo sapiens
uuauuguugcauuaaa

SEQ ID NO: 709766 - RNA, 15 nt, Homo sapiens
uuauuuuucuaugaa

SEQ ID NO: 709767 - RNA, 14 nt, Homo sapiens
uucaaaacauugug

SEQ ID NO: 709768 - RNA, 22 nt, Homo sapiens
uucaaaacauugugccauguca

SEQ ID NO: 709769 - RNA, 21 nt, Homo sapiens
uucaaaagcacuuugugcugu

SEQ ID NO: 709770 - RNA, 18 nt, Homo sapiens
uucaaacuaauagaauua

SEQ ID NO: 709771 - RNA, 17 nt, Homo sapiens
uucaaacugcaugauuc

SEQ ID NO: 709772 - RNA, 18 nt, Homo sapiens
uucaaucuguaaacugug

SEQ ID NO: 709773 - RNA, 21 nt, Homo sapiens
uucacaaggucuuuaaaguga

SEQ ID NO: 709774 - RNA, 20 nt, Homo sapiens
uucacuguagaaugauuuca

SEQ ID NO: 709775 - RNA, 12 nt, Homo sapiens
uucagaugugaa

SEQ ID NO: 709776 - RNA, 18 nt, Homo sapiens
uucaggcaacgcacaaaa

SEQ ID NO: 709777 - RNA, 21 nt, Homo sapiens
uuccacagaauacaagccacu

SEQ ID NO: 709778 - RNA, 20 nt, Homo sapiens
uuccagaaauacuacugugu

SEQ ID NO: 709779 - RNA, 16 nt, Homo sapiens
uuccaugggaccacaa

SEQ ID NO: 709780 - RNA, 23 nt, Homo sapiens
uucccuacugaagcccuugugaa

SEQ ID NO: 709781 - RNA, 21 nt, Homo sapiens
uuccuaugcuuugaaacagaa

SEQ ID NO: 709782 - RNA, 11 nt, Homo sapiens
uuccuuugaac

SEQ ID NO: 709783 - RNA, 16 nt, Homo sapiens
uuccuuugaacuuuga

SEQ ID NO: 709784 - RNA, 17 nt, Homo sapiens
uuccuuugaacuuugaa

SEQ ID NO: 709785 - RNA, 21 nt, Homo sapiens
uucguagauauuggacaaaga

SEQ ID NO: 709786 - RNA, 21 nt, Homo sapiens
uucuguaggaugugucacugu

SEQ ID NO: 709787 - RNA, 19 nt, Homo sapiens
uucuguggagguauugccu

SEQ ID NO: 709788 - RNA, 12 nt, Homo sapiens
uucuucagcucu

SEQ ID NO: 709789 - RNA, 15 nt, Homo sapiens
uucuucagcucugaa

SEQ ID NO: 709790 - RNA, 13 nt, Homo sapiens
uucuuccaucuga

SEQ ID NO: 709791 - RNA, 14 nt, Homo sapiens
uucuuccaucugau

SEQ ID NO: 709792 - RNA, 13 nt, Homo sapiens
uucuucuauucca

SEQ ID NO: 709793 - RNA, 15 nt, Homo sapiens
uucuugaggggacca

SEQ ID NO: 709794 - RNA, 22 nt, Homo sapiens
uucuuuaaaauguaaagccaug

SEQ ID NO: 709795 - RNA, 14 nt, Homo sapiens
uugaaaucacugau

SEQ ID NO: 709796 - RNA, 16 nt, Homo sapiens
uugaacugauucacau

SEQ ID NO: 709797 - RNA, 16 nt, Homo sapiens
uugaagcuagugcauu

SEQ ID NO: 709798 - RNA, 20 nt, Homo sapiens
uugaagggcaggugcuucag

SEQ ID NO: 709799 - RNA, 19 nt, Homo sapiens
uugagaccuaaucucugua

SEQ ID NO: 709800 - RNA, 22 nt, Homo sapiens
uugagaccuaaucucuguaaag

SEQ ID NO: 709801 - RNA, 21 nt, Homo sapiens
uugaggacaaccauuccagac

SEQ ID NO: 709802 - RNA, 23 nt, Homo sapiens
uugauauuucaauguuagccuca

SEQ ID NO: 709803 - RNA, 14 nt, Homo sapiens
uugcaccuuucuag

SEQ ID NO: 709804 - RNA, 23 nt, Homo sapiens
uugcccaucauacgcaugguccu

SEQ ID NO: 709805 - RNA, 14 nt, Homo sapiens
uugccuaaauacuu

SEQ ID NO: 709806 - RNA, 18 nt, Homo sapiens
uugccuccuuauuuauca

SEQ ID NO: 709807 - RNA, 14 nt, Homo sapiens
uugcucacaaaagu

SEQ ID NO: 709808 - RNA, 13 nt, Homo sapiens
uugcucuuuggua

SEQ ID NO: 709809 - RNA, 14 nt, Homo sapiens
uuggaaagcagucc

SEQ ID NO: 709810 - RNA, 18 nt, Homo sapiens
uuggcugcaggaaucuuu

SEQ ID NO: 709811 - RNA, 14 nt, Homo sapiens
uugguccaaaauaa

SEQ ID NO: 709812 - RNA, 17 nt, Homo sapiens
uuguaacuuaugaaccu

SEQ ID NO: 709813 - RNA, 17 nt, Homo sapiens
uuguaaguugaagcaaa

SEQ ID NO: 709814 - RNA, 20 nt, Homo sapiens
uuguucuuuggaaauacaca

SEQ ID NO: 709815 - RNA, 16 nt, Homo sapiens
uuuaaaaaagcuuaaa

SEQ ID NO: 709816 - RNA, 15 nt, Homo sapiens
uuuaaaccgcuaaaa

SEQ ID NO: 709817 - RNA, 15 nt, Homo sapiens
uuuaacaucugagaa

SEQ ID NO: 709818 - RNA, 21 nt, Homo sapiens
uuuaagggaaggggaaggaua

SEQ ID NO: 709819 - RNA, 12 nt, Homo sapiens
uuuacagaauuu

SEQ ID NO: 709820 - RNA, 14 nt, Homo sapiens
uuuacagaauuuua

SEQ ID NO: 709821 - RNA, 10 nt, Homo sapiens
uuuaccucag

SEQ ID NO: 709822 - RNA, 19 nt, Homo sapiens
uuuaggaagcaagcuuaau

SEQ ID NO: 709823 - RNA, 17 nt, Homo sapiens
ucucuaggaaauauacu

SEQ ID NO: 709824 - RNA, 14 nt, Homo sapiens
ucucucuguuuauc

SEQ ID NO: 709825 - RNA, 15 nt, Homo sapiens
ucucugccuugguau

SEQ ID NO: 709826 - RNA, 14 nt, Homo sapiens
ucucuucugagcua

SEQ ID NO: 709827 - RNA, 17 nt, Homo sapiens
ucucuugccucaaccuc

SEQ ID NO: 709828 - RNA, 15 nt, Homo sapiens
ucugagcuauuucau

SEQ ID NO: 709829 - RNA, 18 nt, Homo sapiens
ucugcaaggucuuugguu

SEQ ID NO: 709830 - RNA, 21 nt, Homo sapiens
ucugcaggcuucagccaucca

SEQ ID NO: 709831 - RNA, 13 nt, Homo sapiens
ucugccaagcccu

SEQ ID NO: 709832 - RNA, 16 nt, Homo sapiens
ucugcuuuaauuucau

SEQ ID NO: 709833 - RNA, 14 nt, Homo sapiens
ucuggaaagugaug

SEQ ID NO: 709834 - RNA, 17 nt, Homo sapiens
ucuggaaagugauguca

SEQ ID NO: 709835 - RNA, 16 nt, Homo sapiens
ucuggaucuccugacc

SEQ ID NO: 709836 - RNA, 22 nt, Homo sapiens
ucuguaagaaaccuacugccca

SEQ ID NO: 709837 - RNA, 14 nt, Homo sapiens
ucuguagugucacu

SEQ ID NO: 709838 - RNA, 18 nt, Homo sapiens
ucuguguccuuccuugaa

SEQ ID NO: 709839 - RNA, 18 nt, Homo sapiens
ucuguuaugcugugacac

SEQ ID NO: 709840 - RNA, 13 nt, Homo sapiens
ucuguucacuuuu

SEQ ID NO: 709841 - RNA, 19 nt, Homo sapiens
ucuuacaauaauucuauga

SEQ ID NO: 709842 - RNA, 19 nt, Homo sapiens
ucuuaccuguaugucucca

SEQ ID NO: 709843 - RNA, 12 nt, Homo sapiens
ucuuauugccuc

SEQ ID NO: 709844 - RNA, 22 nt, Homo sapiens
ucuucaaaugccugacuaggga

SEQ ID NO: 709845 - RNA, 13 nt, Homo sapiens
ucuuccaucugau

SEQ ID NO: 709846 - RNA, 19 nt, Homo sapiens
ucuucuggacugguuuuca

SEQ ID NO: 709847 - RNA, 16 nt, Homo sapiens
ucuucuuuuaaaccau

SEQ ID NO: 709848 - RNA, 14 nt, Homo sapiens
ucuugaaaguacca

SEQ ID NO: 709849 - RNA, 16 nt, Homo sapiens
ucuugguuugccuucc

SEQ ID NO: 709850 - RNA, 21 nt, Homo sapiens
ucuuuugggggucaacaguuu

SEQ ID NO: 709851 - RNA, 13 nt, Homo sapiens
ucuuuuuccuccc

SEQ ID NO: 709852 - RNA, 21 nt, Homo sapiens
ugaaaaacuauuaacaacuug

SEQ ID NO: 709853 - RNA, 22 nt, Homo sapiens
ugaaaaaugguaauuguugcua

SEQ ID NO: 709854 - RNA, 17 nt, Homo sapiens
ugaaacuaaaauuuucu

SEQ ID NO: 709855 - RNA, 11 nt, Homo sapiens
ugaaagccaug

SEQ ID NO: 709856 - RNA, 20 nt, Homo sapiens
ugaaaguaccaggugaacaa

SEQ ID NO: 709857 - RNA, 14 nt, Homo sapiens
ugaacagaauuuau

SEQ ID NO: 709858 - RNA, 23 nt, Homo sapiens
ugaaccuauuucuuaaacacuug

SEQ ID NO: 709859 - RNA, 20 nt, Homo sapiens
ugaaccucaagcugcaucua

SEQ ID NO: 709860 - RNA, 19 nt, Homo sapiens
ugaacucuucacucuucaa

SEQ ID NO: 709861 - RNA, 18 nt, Homo sapiens
ugaagaccagccugggca

SEQ ID NO: 709862 - RNA, 13 nt, Homo sapiens
ugaagagguguuu

SEQ ID NO: 709863 - RNA, 15 nt, Homo sapiens
ugaagcauccaggca

SEQ ID NO: 709864 - RNA, 16 nt, Homo sapiens
ugaagcuuuacuuuag

SEQ ID NO: 709865 - RNA, 18 nt, Homo sapiens
ugaauccaaacuaaucca

SEQ ID NO: 709866 - RNA, 16 nt, Homo sapiens
ugaaugccacucugua

SEQ ID NO: 709867 - RNA, 16 nt, Homo sapiens
ugaauuucccacauac

SEQ ID NO: 709868 - RNA, 19 nt, Homo sapiens
ugacaaaaaauuaaagcau

SEQ ID NO: 709869 - RNA, 21 nt, Homo sapiens
ugacaaaaaauuaaagcauuu

SEQ ID NO: 709870 - RNA, 19 nt, Homo sapiens
ugacaacauuucuauagcc

SEQ ID NO: 709871 - RNA, 18 nt, Homo sapiens
ugacacuuuaauuaccaa

SEQ ID NO: 709872 - RNA, 20 nt, Homo sapiens
ugacaguggaacuacauuag

SEQ ID NO: 709873 - RNA, 20 nt, Homo sapiens
ugaccaagauacuuaagugc

SEQ ID NO: 709874 - RNA, 18 nt, Homo sapiens
ugaccaggacuaaugcau

SEQ ID NO: 709875 - RNA, 22 nt, Homo sapiens
ugaccauaaaggcauggcauuu

SEQ ID NO: 709876 - RNA, 15 nt, Homo sapiens
ugaccuaguuuucca

SEQ ID NO: 709877 - RNA, 21 nt, Homo sapiens
ugacucacaccugaacugaac

SEQ ID NO: 709878 - RNA, 21 nt, Homo sapiens
ugacuggcacccaauguuuga

SEQ ID NO: 709879 - RNA, 17 nt, Homo sapiens
ugagaaaagcuuugaac

SEQ ID NO: 709880 - RNA, 19 nt, Homo sapiens
ugagaaaagcuuugaaccc

SEQ ID NO: 709881 - RNA, 18 nt, Homo sapiens
ugagaaauuuaaacuaua

SEQ ID NO: 709882 - RNA, 20 nt, Homo sapiens
ugagaccuccacccacugug

SEQ ID NO: 709883 - RNA, 19 nt, Homo sapiens
ugagacuaaucuuauucau

SEQ ID NO: 709884 - RNA, 14 nt, Homo sapiens
ugagauacauacag

SEQ ID NO: 709885 - RNA, 20 nt, Homo sapiens
ugagccaccaugcccggcua

SEQ ID NO: 709886 - RNA, 17 nt, Homo sapiens
ugagccccugagcccaa

SEQ ID NO: 709887 - RNA, 21 nt, Homo sapiens
ugagcucuucauguuucagga

SEQ ID NO: 709888 - RNA, 13 nt, Homo sapiens
ugaguacagaauu

SEQ ID NO: 709889 - RNA, 13 nt, Homo sapiens
ugauaugacuguu

SEQ ID NO: 709890 - RNA, 18 nt, Homo sapiens
ugauauuuucucuaggaa

SEQ ID NO: 709891 - RNA, 15 nt, Homo sapiens
ugaugugaguugcac

SEQ ID NO: 709892 - RNA, 17 nt, Homo sapiens
ugauucauuuucugccu

SEQ ID NO: 709893 - RNA, 16 nt, Homo sapiens
ugauuccgcagcucag

SEQ ID NO: 709894 - RNA, 11 nt, Homo sapiens
ugcaagcuuuu

SEQ ID NO: 709895 - RNA, 20 nt, Homo sapiens
ugcaccaaagagaaugcccu

SEQ ID NO: 709896 - RNA, 23 nt, Homo sapiens
ugcaccaugucaaggguucaaga

SEQ ID NO: 709897 - RNA, 15 nt, Homo sapiens
ugcagacucacugug

SEQ ID NO: 709898 - RNA, 20 nt, Homo sapiens
ugcagcaaccagagcacugu

SEQ ID NO: 709899 - RNA, 16 nt, Homo sapiens
ugcaggaucucaccag

SEQ ID NO: 709900 - RNA, 18 nt, Homo sapiens
ugcauaaaugugguacaa

SEQ ID NO: 709901 - RNA, 21 nt, Homo sapiens
gaacuuugaagcuagugcauu

SEQ ID NO: 709902 - RNA, 14 nt, Homo sapiens
gaagaaauucugca

SEQ ID NO: 709903 - RNA, 23 nt, Homo sapiens
gaagaagguaggagaaagggcgg

SEQ ID NO: 709904 - RNA, 14 nt, Homo sapiens
gaagagcuuggaaa

SEQ ID NO: 709905 - RNA, 17 nt, Homo sapiens
gaagcguuguccucagc

SEQ ID NO: 709906 - RNA, 20 nt, Homo sapiens
gaagcuuuggugagaaccug

SEQ ID NO: 709907 - RNA, 21 nt, Homo sapiens
gaagcuuuggugagaaccugg

SEQ ID NO: 709908 - RNA, 12 nt, Homo sapiens
gaaggaucccau

SEQ ID NO: 709909 - RNA, 13 nt, Homo sapiens
gaaggcuggacua

SEQ ID NO: 709910 - RNA, 14 nt, Homo sapiens
gaaguaaaagcaaa

SEQ ID NO: 709911 - RNA, 15 nt, Homo sapiens
gaauccaguuugcaa

SEQ ID NO: 709912 - RNA, 17 nt, Homo sapiens
gaaugcaaaccauagca

SEQ ID NO: 709913 - RNA, 21 nt, Homo sapiens
gacaaagguuuuccucuucua

SEQ ID NO: 709914 - RNA, 12 nt, Homo sapiens
gacacacuguaa

SEQ ID NO: 709915 - RNA, 18 nt, Homo sapiens
gacagaaugagaccaaac

SEQ ID NO: 709916 - RNA, 23 nt, Homo sapiens
gacagaugaggcuuuccauggga

SEQ ID NO: 709917 - RNA, 16 nt, Homo sapiens
gacagggucaaagugu

SEQ ID NO: 709918 - RNA, 19 nt, Homo sapiens
gacauggagaccgugacca

SEQ ID NO: 709919 - RNA, 13 nt, Homo sapiens
gaccacaacuauu

SEQ ID NO: 709920 - RNA, 22 nt, Homo sapiens
gaccuuuguagccacuucacuu

SEQ ID NO: 709921 - RNA, 22 nt, Homo sapiens
gaccuuuuuuaggaagcaagcu

SEQ ID NO: 709922 - RNA, 13 nt, Homo sapiens
gacuaauaauacu

SEQ ID NO: 709923 - RNA, 20 nt, Homo sapiens
gacuaucuuacuauuucaca

SEQ ID NO: 709924 - RNA, 22 nt, Homo sapiens
gacucaagccccggacucaggc

SEQ ID NO: 709925 - RNA, 12 nt, Homo sapiens
gacucacugugg

SEQ ID NO: 709926 - RNA, 13 nt, Homo sapiens
gacuccaugccuc

SEQ ID NO: 709927 - RNA, 18 nt, Homo sapiens
gacucuuuaugcuugcaa

SEQ ID NO: 709928 - RNA, 16 nt, Homo sapiens
gacuggaacuugaacu

SEQ ID NO: 709929 - RNA, 20 nt, Homo sapiens
gacuuguauaucccacuggg

SEQ ID NO: 709930 - RNA, 14 nt, Homo sapiens
gagaaaaagggagg

SEQ ID NO: 709931 - RNA, 20 nt, Homo sapiens
gagaaagggcggugaacucu

SEQ ID NO: 709932 - RNA, 15 nt, Homo sapiens
gagacauacaccuau

SEQ ID NO: 709933 - RNA, 21 nt, Homo sapiens
gagacauacaccuaugucauu

SEQ ID NO: 709934 - RNA, 12 nt, Homo sapiens
gagacugaguca

SEQ ID NO: 709935 - RNA, 18 nt, Homo sapiens
gagagcacgccuguacua

SEQ ID NO: 709936 - RNA, 20 nt, Homo sapiens
gagaguccaucagccuccau

SEQ ID NO: 709937 - RNA, 22 nt, Homo sapiens
gagcaccuacuuacaugcauua

SEQ ID NO: 709938 - RNA, 14 nt, Homo sapiens
gagcaggaggccaa

SEQ ID NO: 709939 - RNA, 19 nt, Homo sapiens
gagcaucacagaaugugau

SEQ ID NO: 709940 - RNA, 14 nt, Homo sapiens
gagccugacccuca

SEQ ID NO: 709941 - RNA, 23 nt, Homo sapiens
gagcuacugccgucagugcugug

SEQ ID NO: 709942 - RNA, 17 nt, Homo sapiens
gaggccauucuuuccca

SEQ ID NO: 709943 - RNA, 22 nt, Homo sapiens
gaggccgcuaugcaggguagca

SEQ ID NO: 709944 - RNA, 16 nt, Homo sapiens
gagggaggagaaugag

SEQ ID NO: 709945 - RNA, 13 nt, Homo sapiens
gagucacugagac

SEQ ID NO: 709946 - RNA, 13 nt, Homo sapiens
gagugacucacua

SEQ ID NO: 709947 - RNA, 15 nt, Homo sapiens
gagugcaccaaagag

SEQ ID NO: 709948 - RNA, 16 nt, Homo sapiens
gagugcaguggcgcga

SEQ ID NO: 709949 - RNA, 14 nt, Homo sapiens
gaguuuacuaccug

SEQ ID NO: 709950 - RNA, 16 nt, Homo sapiens
gaguuuugcaaagugc

SEQ ID NO: 709951 - RNA, 20 nt, Homo sapiens
gauacgacaguacacuguca

SEQ ID NO: 709952 - RNA, 13 nt, Homo sapiens
gauagaaaugcca

SEQ ID NO: 709953 - RNA, 20 nt, Homo sapiens
gauagucagcuguaccaagc

SEQ ID NO: 709954 - RNA, 23 nt, Homo sapiens
gauagucagcuguaccaagcccc

SEQ ID NO: 709955 - RNA, 14 nt, Homo sapiens
gauaucucaucucu

SEQ ID NO: 709956 - RNA, 12 nt, Homo sapiens
gauauggcuuuu

SEQ ID NO: 709957 - RNA, 20 nt, Homo sapiens
gauauuuucucuaggaaaua

SEQ ID NO: 709958 - RNA, 13 nt, Homo sapiens
gaucccuagcugu

SEQ ID NO: 709959 - RNA, 15 nt, Homo sapiens
gaucgggagcaaacc

SEQ ID NO: 709960 - RNA, 23 nt, Homo sapiens
gaucucggcucacugcaaccucc

SEQ ID NO: 709961 - RNA, 21 nt, Homo sapiens
gaugccccagggaccuuugua

SEQ ID NO: 709962 - RNA, 19 nt, Homo sapiens
gauuacaggcgugagccac

SEQ ID NO: 709963 - RNA, 14 nt, Homo sapiens
gauucaugccaauu

SEQ ID NO: 709964 - RNA, 15 nt, Homo sapiens
gauuccccaucucag

SEQ ID NO: 709965 - RNA, 21 nt, Homo sapiens
gauuccccaucucaggccaga

SEQ ID NO: 709966 - RNA, 21 nt, Homo sapiens
gauucucuugccucaaccucc

SEQ ID NO: 709967 - RNA, 16 nt, Homo sapiens
gauucuuccaucugau

SEQ ID NO: 709968 - RNA, 22 nt, Homo sapiens
gcaaacaguguucugugacaaa

SEQ ID NO: 709969 - RNA, 21 nt, Homo sapiens
gcaaaggggaggcaucagugu

SEQ ID NO: 709970 - RNA, 16 nt, Homo sapiens
gcaaccagagcacugu

SEQ ID NO: 709971 - RNA, 18 nt, Homo sapiens
gcaaccagagcacuguau

SEQ ID NO: 709972 - RNA, 21 nt, Homo sapiens
gcaagguauuacacucuguaa

SEQ ID NO: 709973 - RNA, 13 nt, Homo sapiens
gcacagccuggcu

SEQ ID NO: 709974 - RNA, 16 nt, Homo sapiens
gcacagcuaugaaggc

SEQ ID NO: 709975 - RNA, 18 nt, Homo sapiens
gcaccuacuuacaugcau

SEQ ID NO: 709976 - RNA, 15 nt, Homo sapiens
gcacgaauggaagag

SEQ ID NO: 709977 - RNA, 21 nt, Homo sapiens
gcacuugucuuugacuugugu

SEQ ID NO: 709978 - RNA, 17 nt, Homo sapiens
gcagacucacuguggga

SEQ ID NO: 709979 - RNA, 23 nt, Homo sapiens
gcagaggauguucuggaccuccc

SEQ ID NO: 709980 - RNA, 21 nt, Homo sapiens
gcagccccucccagccuaccc

SEQ ID NO: 709981 - RNA, 19 nt, Homo sapiens
gcaggaucucaccaggcag

SEQ ID NO: 709982 - RNA, 18 nt, Homo sapiens
gcagugcagcaaccagag

SEQ ID NO: 709983 - RNA, 18 nt, Homo sapiens
gcaucacagaaugugaua

SEQ ID NO: 709984 - RNA, 21 nt, Homo sapiens
gcauccagagucccugccugg

SEQ ID NO: 709985 - RNA, 22 nt, Homo sapiens
gcaugcacuucuuacaauaauu

SEQ ID NO: 709986 - RNA, 14 nt, Homo sapiens
gccaaaaauagcua

SEQ ID NO: 709987 - RNA, 14 nt, Homo sapiens
gccaagacugcugu

SEQ ID NO: 709988 - RNA, 19 nt, Homo sapiens
gccaagacugcuguggcca

SEQ ID NO: 709989 - RNA, 19 nt, Homo sapiens
gccaaggagucacugagac

SEQ ID NO: 709990 - RNA, 21 nt, Homo sapiens
gccaccacccacaaucacaag

SEQ ID NO: 709991 - RNA, 23 nt, Homo sapiens
gccaccucccuauacugcuugga

SEQ ID NO: 709992 - RNA, 20 nt, Homo sapiens
gccacuaccuucugaccucc

SEQ ID NO: 709993 - RNA, 20 nt, Homo sapiens
gccacucuguaauugcaaaa

SEQ ID NO: 709994 - RNA, 13 nt, Homo sapiens
gccagaaauaucu

SEQ ID NO: 709995 - RNA, 12 nt, Homo sapiens
gccagacuuccc

SEQ ID NO: 709996 - RNA, 18 nt, Homo sapiens
gccagacuucccacggcu

SEQ ID NO: 709997 - RNA, 22 nt, Homo sapiens
gccagauuuuuuaaaauuuaua

SEQ ID NO: 709998 - RNA, 16 nt, Homo sapiens
gcccaguguccccuuu

SEQ ID NO: 709999 - RNA, 16 nt, Homo sapiens
gccccagagccuggga

SEQ ID NO: 710000 - RNA, 21 nt, Homo sapiens
gcccccucccuggaugacauu

SEQ ID NO: 710001 - RNA, 16 nt, Homo sapiens
gccgagaguccaucag

SEQ ID NO: 710002 - RNA, 21 nt, Homo sapiens
gccgagaguccaucagccucc

SEQ ID NO: 710003 - RNA, 17 nt, Homo sapiens
gccgauuacacccaaau

SEQ ID NO: 710004 - RNA, 14 nt, Homo sapiens
gccuacuccaaaau

SEQ ID NO: 710005 - RNA, 14 nt, Homo sapiens
gccucaaagcaagc

SEQ ID NO: 710006 - RNA, 14 nt, Homo sapiens
gccucaaccuccca

SEQ ID NO: 710007 - RNA, 21 nt, Homo sapiens
gccucaaccucccaagcaguu

SEQ ID NO: 710008 - RNA, 12 nt, Homo sapiens
gccucacuuuua

SEQ ID NO: 710009 - RNA, 14 nt, Homo sapiens
gccucccaccacuc

SEQ ID NO: 710010 - RNA, 20 nt, Homo sapiens
gccuccugugacuggcagca

SEQ ID NO: 710011 - RNA, 22 nt, Homo sapiens
gccugcuauuugaaguguaauu

SEQ ID NO: 710012 - RNA, 18 nt, Homo sapiens
gccuucucuguucauuuc

SEQ ID NO: 710013 - RNA, 13 nt, Homo sapiens
gccuuugagcuca

SEQ ID NO: 710014 - RNA, 16 nt, Homo sapiens
gcgauuacaggcauga

SEQ ID NO: 710015 - RNA, 12 nt, Homo sapiens
gcgucacuguga

SEQ ID NO: 710016 - RNA, 19 nt, Homo sapiens
gcuaaucuucuuaugcaau

SEQ ID NO: 710017 - RNA, 14 nt, Homo sapiens
gcuacuauauguca

SEQ ID NO: 710018 - RNA, 14 nt, Homo sapiens
gcuagagugacuca

SEQ ID NO: 710019 - RNA, 15 nt, Homo sapiens
gcuaggaugugcauu

SEQ ID NO: 710020 - RNA, 19 nt, Homo sapiens
gcucacaaaccaugcaaau

SEQ ID NO: 710021 - RNA, 16 nt, Homo sapiens
gcucagcccuagcccu

SEQ ID NO: 710022 - RNA, 21 nt, Homo sapiens
gcuccccacgucagcugggac

SEQ ID NO: 710023 - RNA, 18 nt, Homo sapiens
gcucuggagcccacugua

SEQ ID NO: 710024 - RNA, 13 nt, Homo sapiens
gcugagggcauua

SEQ ID NO: 710025 - RNA, 16 nt, Homo sapiens
gcugcuccugagagag

SEQ ID NO: 710026 - RNA, 13 nt, Homo sapiens
gcuggggaaauca

SEQ ID NO: 710027 - RNA, 16 nt, Homo sapiens
gcuguaccaagccccu

SEQ ID NO: 710028 - RNA, 12 nt, Homo sapiens
gcugucugcuca

SEQ ID NO: 710029 - RNA, 19 nt, Homo sapiens
gcuguggccuaaccugccg

SEQ ID NO: 710030 - RNA, 19 nt, Homo sapiens
gcuguuauuuaauuagcca

SEQ ID NO: 710031 - RNA, 15 nt, Homo sapiens
ugguagccucacuuu

SEQ ID NO: 710032 - RNA, 19 nt, Homo sapiens
ugguccaaaauaaaaccuc

SEQ ID NO: 710033 - RNA, 20 nt, Homo sapiens
uggucuuguggaauugggag

SEQ ID NO: 710034 - RNA, 19 nt, Homo sapiens
uggugauaaguacuuccuc

SEQ ID NO: 710035 - RNA, 16 nt, Homo sapiens
ugguggcagugcagca

SEQ ID NO: 710036 - RNA, 16 nt, Homo sapiens
ugguguauaagccauc

SEQ ID NO: 710037 - RNA, 23 nt, Homo sapiens
ugguuacucaaaagaacaagagu

SEQ ID NO: 710038 - RNA, 17 nt, Homo sapiens
uguaagguggucacugu

SEQ ID NO: 710039 - RNA, 21 nt, Homo sapiens
uguaauuuugaguacagaauu

SEQ ID NO: 710040 - RNA, 17 nt, Homo sapiens
uguagccacuucacuuu

SEQ ID NO: 710041 - RNA, 14 nt, Homo sapiens
uguagccccaguga

SEQ ID NO: 710042 - RNA, 23 nt, Homo sapiens
uguagcuuugcucuuugguagaa

SEQ ID NO: 710043 - RNA, 21 nt, Homo sapiens
uguauauuaagguguggcuuu

SEQ ID NO: 710044 - RNA, 18 nt, Homo sapiens
ugucacuguuccuuguca

SEQ ID NO: 710045 - RNA, 21 nt, Homo sapiens
uguccccuuuccccagugaca

SEQ ID NO: 710046 - RNA, 16 nt, Homo sapiens
ugucccgggacaccua

SEQ ID NO: 710047 - RNA, 13 nt, Homo sapiens
uguccuucuacuc

SEQ ID NO: 710048 - RNA, 19 nt, Homo sapiens
ugucgccaggcuagagugc

SEQ ID NO: 710049 - RNA, 16 nt, Homo sapiens
ugucucuucugagcua

SEQ ID NO: 710050 - RNA, 18 nt, Homo sapiens
ugucugcuaucauuauuc

SEQ ID NO: 710051 - RNA, 15 nt, Homo sapiens
ugucuggugguggca

SEQ ID NO: 710052 - RNA, 18 nt, Homo sapiens
ugugaccaaaaguuacau

SEQ ID NO: 710053 - RNA, 15 nt, Homo sapiens
ugugacucuuuccaa

SEQ ID NO: 710054 - RNA, 14 nt, Homo sapiens
ugugauucugccuu

SEQ ID NO: 710055 - RNA, 21 nt, Homo sapiens
ugugcaagguauuacacucug

SEQ ID NO: 710056 - RNA, 11 nt, Homo sapiens
ugugcugcuua

SEQ ID NO: 710057 - RNA, 13 nt, Homo sapiens
ugugguacaagca

SEQ ID NO: 710058 - RNA, 16 nt, Homo sapiens
uguguccuuccuugaa

SEQ ID NO: 710059 - RNA, 21 nt, Homo sapiens
uguguccuucuacuccagcau

SEQ ID NO: 710060 - RNA, 12 nt, Homo sapiens
uguguguaaaaa

SEQ ID NO: 710061 - RNA, 14 nt, Homo sapiens
uguuaacugaaugc

SEQ ID NO: 710062 - RNA, 15 nt, Homo sapiens
uguuaagacuugaca

SEQ ID NO: 710063 - RNA, 14 nt, Homo sapiens
uguuacuacaugca

SEQ ID NO: 710064 - RNA, 13 nt, Homo sapiens
uguugcuuuucac

SEQ ID NO: 710065 - RNA, 19 nt, Homo sapiens
uguuggauagucagcugua

SEQ ID NO: 710066 - RNA, 21 nt, Homo sapiens
uguuuaugaauaguuuccaaa

SEQ ID NO: 710067 - RNA, 17 nt, Homo sapiens
uguuucaaacaaaaagu

SEQ ID NO: 710068 - RNA, 16 nt, Homo sapiens
uuaaaacagacacugg

SEQ ID NO: 710069 - RNA, 17 nt, Homo sapiens
uuaaaccguacacugug

SEQ ID NO: 710070 - RNA, 15 nt, Homo sapiens
uuaaagaaggguuga

SEQ ID NO: 710071 - RNA, 13 nt, Homo sapiens
uuaaagcuguuau

SEQ ID NO: 710072 - RNA, 13 nt, Homo sapiens
uuaaauuauaucu

SEQ ID NO: 710073 - RNA, 12 nt, Homo sapiens
uuaagacuuuaa

SEQ ID NO: 710074 - RNA, 15 nt, Homo sapiens
uuaauacucaccucc

SEQ ID NO: 710075 - RNA, 12 nt, Homo sapiens
uuaauggugccu

SEQ ID NO: 710076 - RNA, 18 nt, Homo sapiens
uuaauggugccuucauuu

SEQ ID NO: 710077 - RNA, 22 nt, Homo sapiens
uuacacauguaucuaugcauuu

SEQ ID NO: 710078 - RNA, 14 nt, Homo sapiens
uuacaugauucauu

SEQ ID NO: 710079 - RNA, 15 nt, Homo sapiens
uuacaugauucauuu

SEQ ID NO: 710080 - RNA, 19 nt, Homo sapiens
uuacauuuuaaacacauua

SEQ ID NO: 710081 - RNA, 20 nt, Homo sapiens
uuacauuuuaaacacauuag

SEQ ID NO: 710082 - RNA, 16 nt, Homo sapiens
uuaccagagaaaaagg

SEQ ID NO: 710083 - RNA, 20 nt, Homo sapiens
uuaccaggcaccaaaagaag

SEQ ID NO: 710084 - RNA, 20 nt, Homo sapiens
uuaccaucacugaguuuucc

SEQ ID NO: 710085 - RNA, 16 nt, Homo sapiens
uuacuaaggaagauua

SEQ ID NO: 710086 - RNA, 19 nt, Homo sapiens
uuagaacacacacacuuac

SEQ ID NO: 710087 - RNA, 19 nt, Homo sapiens
uuagauuugugugcaucag

SEQ ID NO: 710088 - RNA, 14 nt, Homo sapiens
uuagccauuugacu

SEQ ID NO: 710089 - RNA, 21 nt, Homo sapiens
uuaggucagcagccucccuga

SEQ ID NO: 710090 - RNA, 22 nt, Homo sapiens
uuaguauuauuguugcauuaaa

SEQ ID NO: 710091 - RNA, 17 nt, Homo sapiens
uuagugcacagcacaaa

SEQ ID NO: 710092 - RNA, 14 nt, Homo sapiens
uuaugaaaaagaag

SEQ ID NO: 710093 - RNA, 15 nt, Homo sapiens
uuaugaaaaagaaga

SEQ ID NO: 710094 - RNA, 11 nt, Homo sapiens
uuaugaaucuc

SEQ ID NO: 710095 - RNA, 23 nt, Homo sapiens
uuaugccaccugaauaaagaaug

SEQ ID NO: 710096 - RNA, 17 nt, Homo sapiens
uuaugcuaccuacugau

SEQ ID NO: 710097 - RNA, 20 nt, Homo sapiens
uuaugguaccagaugcagcu

SEQ ID NO: 710098 - RNA, 14 nt, Homo sapiens
uuauggugcauuac

SEQ ID NO: 710099 - RNA, 17 nt, Homo sapiens
uuauuccuccugcucau

SEQ ID NO: 710100 - RNA, 19 nt, Homo sapiens
uuauuggcugagauaugaa

SEQ ID NO: 710101 - RNA, 14 nt, Homo sapiens
uuauuguugcauua

SEQ ID NO: 710102 - RNA, 19 nt, Homo sapiens
uucaaacugcaugauucau

SEQ ID NO: 710103 - RNA, 15 nt, Homo sapiens
uucaagaaagcuuca

SEQ ID NO: 710104 - RNA, 20 nt, Homo sapiens
uucaagcgauucucuugccu

SEQ ID NO: 710105 - RNA, 18 nt, Homo sapiens
uucacaaaucaugguaau

SEQ ID NO: 710106 - RNA, 18 nt, Homo sapiens
uucacaucgcagauucuc

SEQ ID NO: 710107 - RNA, 13 nt, Homo sapiens
uucaccuguaaac

SEQ ID NO: 710108 - RNA, 17 nt, Homo sapiens
uucagaagguugcucua

SEQ ID NO: 710109 - RNA, 13 nt, Homo sapiens
uucagcucugaaa

SEQ ID NO: 710110 - RNA, 14 nt, Homo sapiens
uucagguauaccuc

SEQ ID NO: 710111 - RNA, 20 nt, Homo sapiens
uucagguauaccucacuuua

SEQ ID NO: 710112 - RNA, 21 nt, Homo sapiens
uucaugaaaagauuaugaucu

SEQ ID NO: 710113 - RNA, 20 nt, Homo sapiens
uucauuuuaacaucugagaa

SEQ ID NO: 710114 - RNA, 22 nt, Homo sapiens
uuccaacaagaagggacugaga

SEQ ID NO: 710115 - RNA, 23 nt, Homo sapiens
uuccaacaagaagggacugagag

SEQ ID NO: 710116 - RNA, 15 nt, Homo sapiens
uuccaauaaagcagc

SEQ ID NO: 710117 - RNA, 23 nt, Homo sapiens
uuccaaucuguccuguuacaaaa

SEQ ID NO: 710118 - RNA, 20 nt, Homo sapiens
uuccacagaauacaagccac

SEQ ID NO: 710119 - RNA, 17 nt, Homo sapiens
uuccccaaguacaacca

SEQ ID NO: 710120 - RNA, 11 nt, Homo sapiens
uuccccaguga

SEQ ID NO: 710121 - RNA, 13 nt, Homo sapiens
uuccgcagcucag

SEQ ID NO: 710122 - RNA, 23 nt, Homo sapiens
uuccucucugaguggacuggccu

SEQ ID NO: 710123 - RNA, 15 nt, Homo sapiens
uuccuggacaguuuu

SEQ ID NO: 710124 - RNA, 13 nt, Homo sapiens
uuccuugaacugu

SEQ ID NO: 710125 - RNA, 22 nt, Homo sapiens
uucuacaccuguugcaccucag

SEQ ID NO: 710126 - RNA, 19 nt, Homo sapiens
uucuaguucugccaggaga

SEQ ID NO: 710127 - RNA, 22 nt, Homo sapiens
uucucuaauauggcaaccauua

SEQ ID NO: 710128 - RNA, 22 nt, Homo sapiens
uucucugccuugguauagcaua

SEQ ID NO: 710129 - RNA, 15 nt, Homo sapiens
uucugaccuccccac

SEQ ID NO: 710130 - RNA, 19 nt, Homo sapiens
uucugaggccugagugauc

SEQ ID NO: 710131 - RNA, 17 nt, Homo sapiens
uucugcaagcuuuucaa

SEQ ID NO: 710132 - RNA, 23 nt, Homo sapiens
uucugccuaucuucuuucacaua

SEQ ID NO: 710133 - RNA, 13 nt, Homo sapiens
uucuggacaggau

SEQ ID NO: 710134 - RNA, 20 nt, Homo sapiens
uucuggacccguucaacuuu

SEQ ID NO: 710135 - RNA, 19 nt, Homo sapiens
uucuggauuccccaucuca

SEQ ID NO: 710136 - RNA, 13 nt, Homo sapiens
uucuguuuccaua

SEQ ID NO: 710137 - RNA, 14 nt, Homo sapiens
uucuguuuccauag

SEQ ID NO: 710138 - RNA, 14 nt, Homo sapiens
uucuuaacaagaua

SEQ ID NO: 710139 - RNA, 17 nt, Homo sapiens
uucuuccaugucuauua

SEQ ID NO: 710140 - RNA, 19 nt, Homo sapiens
uucuugaaauuuuaaccua

SEQ ID NO: 710141 - RNA, 17 nt, Homo sapiens
uucuuucccaacaccuc

SEQ ID NO: 710142 - RNA, 12 nt, Homo sapiens
uugaaaauguuc

SEQ ID NO: 710143 - RNA, 14 nt, Homo sapiens
uugaaaauguucag

SEQ ID NO: 710144 - RNA, 22 nt, Homo sapiens
uugaaacccguggcgcuuucug

SEQ ID NO: 710145 - RNA, 18 nt, Homo sapiens
uugaagugacuucacaga

SEQ ID NO: 710146 - RNA, 21 nt, Homo sapiens
uugaggccacccgcacaaaau

SEQ ID NO: 710147 - RNA, 23 nt, Homo sapiens
uugauagaaaugccaagcacuuc

SEQ ID NO: 710148 - RNA, 15 nt, Homo sapiens
uugcaccaacuuuga

SEQ ID NO: 710149 - RNA, 13 nt, Homo sapiens
uugcagacaggaa

SEQ ID NO: 710150 - RNA, 22 nt, Homo sapiens
uugcauuaaaaaugcauauacu

SEQ ID NO: 710151 - RNA, 12 nt, Homo sapiens
uugcccaugccu

SEQ ID NO: 710152 - RNA, 14 nt, Homo sapiens
uugcuggacuguca

SEQ ID NO: 710153 - RNA, 13 nt, Homo sapiens
uuggcaugaaggu

SEQ ID NO: 710154 - RNA, 22 nt, Homo sapiens
uuggcugcauaaaugugguaca

SEQ ID NO: 710155 - RNA, 10 nt, Homo sapiens
uugggcuccg

SEQ ID NO: 710156 - RNA, 16 nt, Homo sapiens
uugguuagcuggacau

SEQ ID NO: 710157 - RNA, 17 nt, Homo sapiens
uuguaaguuuaugcaua

SEQ ID NO: 710158 - RNA, 18 nt, Homo sapiens
uuguagccacuucacuuu

SEQ ID NO: 710159 - RNA, 13 nt, Homo sapiens
uugucuacacucu

SEQ ID NO: 710160 - RNA, 17 nt, Homo sapiens
uugucuuugcuguaaac

SEQ ID NO: 710161 - RNA, 12 nt, Homo sapiens
uuguucugauaa

SEQ ID NO: 710162 - RNA, 21 nt, Homo sapiens
aaaaagugaaaacaauguaag

SEQ ID NO: 710163 - RNA, 21 nt, Homo sapiens
aaaaauaagauaucaacugcc

SEQ ID NO: 710164 - RNA, 22 nt, Homo sapiens
aaaaauauguaccaagaaucuu

SEQ ID NO: 710165 - RNA, 12 nt, Homo sapiens
aaaaaugccaaa

SEQ ID NO: 710166 - RNA, 18 nt, Homo sapiens
aaaagcagcuauuugccu

SEQ ID NO: 710167 - RNA, 22 nt, Homo sapiens
aaaagggccaaagaaccaaaga

SEQ ID NO: 710168 - RNA, 14 nt, Homo sapiens
aaaagucacucuga

SEQ ID NO: 710169 - RNA, 14 nt, Homo sapiens
aaaagucagcauuu

SEQ ID NO: 710170 - RNA, 20 nt, Homo sapiens
aaaauaaucaguguuuccaa

SEQ ID NO: 710171 - RNA, 15 nt, Homo sapiens
aaaauaguaagccuc

SEQ ID NO: 710172 - RNA, 22 nt, Homo sapiens
aaaauaugacacucuagucaaa

SEQ ID NO: 710173 - RNA, 17 nt, Homo sapiens
aaaaugaauacaauuaa

SEQ ID NO: 710174 - RNA, 18 nt, Homo sapiens
aaaaugcauauacuuuaa

SEQ ID NO: 710175 - RNA, 12 nt, Homo sapiens
aaaaugccaaaa

SEQ ID NO: 710176 - RNA, 18 nt, Homo sapiens
aaaaugguaauuguugcu

SEQ ID NO: 710177 - RNA, 16 nt, Homo sapiens
aaaauguaaagccaug

SEQ ID NO: 710178 - RNA, 23 nt, Homo sapiens
aaaauuauuuaaaccgcuaaaag

SEQ ID NO: 710179 - RNA, 14 nt, Homo sapiens
aaacaaguauuugu

SEQ ID NO: 710180 - RNA, 14 nt, Homo sapiens
aaacaaucuuguca

SEQ ID NO: 710181 - RNA, 18 nt, Homo sapiens
aaacauguuugcacuugu

SEQ ID NO: 710182 - RNA, 19 nt, Homo sapiens
aaacauugugccaugucaa

SEQ ID NO: 710183 - RNA, 20 nt, Homo sapiens
aaacccccacccuucugccu

SEQ ID NO: 710184 - RNA, 19 nt, Homo sapiens
aaaccucagcuagcucugc

SEQ ID NO: 710185 - RNA, 14 nt, Homo sapiens
aaagaaguaaaagc

SEQ ID NO: 710186 - RNA, 19 nt, Homo sapiens
aaagcccuuuuauaccucc

SEQ ID NO: 710187 - RNA, 16 nt, Homo sapiens
aaagcuaaaauaaaga

SEQ ID NO: 710188 - RNA, 14 nt, Homo sapiens
aaagcuuugaaccc

SEQ ID NO: 710189 - RNA, 11 nt, Homo sapiens
aaaguacuggg

SEQ ID NO: 710190 - RNA, 18 nt, Homo sapiens
aaagucuacuuuaccuaa

SEQ ID NO: 710191 - RNA, 23 nt, Homo sapiens
aaagucuuugaagugacuucaca

SEQ ID NO: 710192 - RNA, 14 nt, Homo sapiens
aaagugacuaccag

SEQ ID NO: 710193 - RNA, 12 nt, Homo sapiens
aaaguuaugaaa

SEQ ID NO: 710194 - RNA, 15 nt, Homo sapiens
aaaguuguuugugcc

SEQ ID NO: 710195 - RNA, 19 nt, Homo sapiens
aaaguuuagccccugaaag

SEQ ID NO: 710196 - RNA, 15 nt, Homo sapiens
aaauaagagcucagg

SEQ ID NO: 710197 - RNA, 14 nt, Homo sapiens
aaauacuacugugu

SEQ ID NO: 710198 - RNA, 17 nt, Homo sapiens
aaauagcaaaagaagaa

SEQ ID NO: 710199 - RNA, 16 nt, Homo sapiens
aaauaucuucacuugu

SEQ ID NO: 710200 - RNA, 13 nt, Homo sapiens
aaaucaacuugcu

SEQ ID NO: 710201 - RNA, 21 nt, Homo sapiens
aaauccuuagaucuggcaugu

SEQ ID NO: 710202 - RNA, 17 nt, Homo sapiens
aaaugaacauaaugaac

SEQ ID NO: 710203 - RNA, 16 nt, Homo sapiens
aaaugauuacuaagga

SEQ ID NO: 710204 - RNA, 17 nt, Homo sapiens
aaaugggaaaaccagac

SEQ ID NO: 710205 - RNA, 18 nt, Homo sapiens
aaaugggaaaaccagacu

SEQ ID NO: 710206 - RNA, 19 nt, Homo sapiens
aaauguucagaagguugcu

SEQ ID NO: 710207 - RNA, 21 nt, Homo sapiens
aaauguucuccuuagauguga

SEQ ID NO: 710208 - RNA, 15 nt, Homo sapiens
aaauuaugauaagga

SEQ ID NO: 710209 - RNA, 15 nt, Homo sapiens
aaauugccugacgaa

SEQ ID NO: 710210 - RNA, 12 nt, Homo sapiens
aaauuggacuua

SEQ ID NO: 710211 - RNA, 22 nt, Homo sapiens
aaauuugggggacuuacaugau

SEQ ID NO: 710212 - RNA, 12 nt, Homo sapiens
aacaaacuggag

SEQ ID NO: 710213 - RNA, 23 nt, Homo sapiens
aacaacuugucuauuaccuguua

SEQ ID NO: 710214 - RNA, 12 nt, Homo sapiens
aacaagaucugc

SEQ ID NO: 710215 - RNA, 14 nt, Homo sapiens
aacacacagaagaa

SEQ ID NO: 710216 - RNA, 19 nt, Homo sapiens
aacacgugacacaaacaca

SEQ ID NO: 710217 - RNA, 16 nt, Homo sapiens
aacagaaaaauaugua

SEQ ID NO: 710218 - RNA, 13 nt, Homo sapiens
aacagauaauccc

SEQ ID NO: 710219 - RNA, 19 nt, Homo sapiens
aacauaccuaagaaguaca

SEQ ID NO: 710220 - RNA, 23 nt, Homo sapiens
aacauaguauucaugacuaugga

SEQ ID NO: 710221 - RNA, 22 nt, Homo sapiens
aacauugugccaugucaaacaa

SEQ ID NO: 710222 - RNA, 11 nt, Homo sapiens
aaccacugugg

SEQ ID NO: 710223 - RNA, 15 nt, Homo sapiens
aaccagcuacuugau

SEQ ID NO: 710224 - RNA, 16 nt, Homo sapiens
aaccaggacucugccc

SEQ ID NO: 710225 - RNA, 21 nt, Homo sapiens
aaccguaugagggaacugugu

SEQ ID NO: 710226 - RNA, 15 nt, Homo sapiens
aaccucaagcugcau

SEQ ID NO: 710227 - RNA, 23 nt, Homo sapiens
aaccucaguaauuuagaaaucau

SEQ ID NO: 710228 - RNA, 21 nt, Homo sapiens
aacgcacacaguaucuaguca

SEQ ID NO: 710229 - RNA, 23 nt, Homo sapiens
aacucuucacucuucaaaugccu

SEQ ID NO: 710230 - RNA, 16 nt, Homo sapiens
aacuugaaauauccug

SEQ ID NO: 710231 - RNA, 15 nt, Homo sapiens
aacuugaacugauuc

SEQ ID NO: 710232 - RNA, 12 nt, Homo sapiens
aacuuggcugca

SEQ ID NO: 710233 - RNA, 17 nt, Homo sapiens
aagaaaauaagagcuca

SEQ ID NO: 710234 - RNA, 12 nt, Homo sapiens
aagaaccaaaga

SEQ ID NO: 710235 - RNA, 13 nt, Homo sapiens
aagaaccaaagaa

SEQ ID NO: 710236 - RNA, 18 nt, Homo sapiens
aagagaaguuuucuugac

SEQ ID NO: 710237 - RNA, 19 nt, Homo sapiens
aagaucuuuuauuuugcca

SEQ ID NO: 710238 - RNA, 17 nt, Homo sapiens
aagcaggaaucagagac

SEQ ID NO: 710239 - RNA, 15 nt, Homo sapiens
aagcaggguacccuu

SEQ ID NO: 710240 - RNA, 16 nt, Homo sapiens
aagcagguucuuguua

SEQ ID NO: 710241 - RNA, 24 nt, Homo sapiens
aagcaguugggacuacaggcguga

SEQ ID NO: 710242 - RNA, 21 nt, Homo sapiens
ugccacucuguaauugcaaaa

SEQ ID NO: 710243 - RNA, 21 nt, Homo sapiens
ugcccagugcacuugcuggaa

SEQ ID NO: 710244 - RNA, 16 nt, Homo sapiens
ugccccagagccuggg

SEQ ID NO: 710245 - RNA, 16 nt, Homo sapiens
ugccccagggaccuuu

SEQ ID NO: 710246 - RNA, 20 nt, Homo sapiens
ugcccccaaccauuuccuca

SEQ ID NO: 710247 - RNA, 19 nt, Homo sapiens
ugccccuugacaacuggca

SEQ ID NO: 710248 - RNA, 17 nt, Homo sapiens
ugcccugcccaugggag

SEQ ID NO: 710249 - RNA, 23 nt, Homo sapiens
ugccucacuucagguauaccuca

SEQ ID NO: 710250 - RNA, 14 nt, Homo sapiens
ugccucccaugccu

SEQ ID NO: 710251 - RNA, 12 nt, Homo sapiens
ugccucucugca

SEQ ID NO: 710252 - RNA, 15 nt, Homo sapiens
ugccuggucccaaga

SEQ ID NO: 710253 - RNA, 14 nt, Homo sapiens
ugccuucucaugau

SEQ ID NO: 710254 - RNA, 21 nt, Homo sapiens
ugccuugugaauuugcugcua

SEQ ID NO: 710255 - RNA, 22 nt, Homo sapiens
ugccuugugaauuugcugcuau

SEQ ID NO: 710256 - RNA, 13 nt, Homo sapiens
ugcgucacuguga

SEQ ID NO: 710257 - RNA, 23 nt, Homo sapiens
ugcuaaacgcacacaguaucuag

SEQ ID NO: 710258 - RNA, 20 nt, Homo sapiens
ugcuaaucuucuuaugcaau

SEQ ID NO: 710259 - RNA, 16 nt, Homo sapiens
ugcuacucuaguauuc

SEQ ID NO: 710260 - RNA, 23 nt, Homo sapiens
ugcuaugguuuucuccaagagcu

SEQ ID NO: 710261 - RNA, 18 nt, Homo sapiens
ugcucagauagaaugaca

SEQ ID NO: 710262 - RNA, 17 nt, Homo sapiens
ugcucauauugugauuc

SEQ ID NO: 710263 - RNA, 14 nt, Homo sapiens
ugcucccacagaac

SEQ ID NO: 710264 - RNA, 15 nt, Homo sapiens
ugcucuuguguuucc

SEQ ID NO: 710265 - RNA, 18 nt, Homo sapiens
ugcugaccagacagccuc

SEQ ID NO: 710266 - RNA, 20 nt, Homo sapiens
ugcuggggacagguccucag

SEQ ID NO: 710267 - RNA, 15 nt, Homo sapiens
ugcuucagugcugcu

SEQ ID NO: 710268 - RNA, 16 nt, Homo sapiens
ugcuuuucacaaauca

SEQ ID NO: 710269 - RNA, 23 nt, Homo sapiens
ugcuuuuuuuuuuugguccaaaa

SEQ ID NO: 710270 - RNA, 14 nt, Homo sapiens
uggaacaagcacag

SEQ ID NO: 710271 - RNA, 17 nt, Homo sapiens
uggaacaagcacagaug

SEQ ID NO: 710272 - RNA, 18 nt, Homo sapiens
uggaacuugaacugauuc

SEQ ID NO: 710273 - RNA, 17 nt, Homo sapiens
uggaagacuaucuuacu

SEQ ID NO: 710274 - RNA, 19 nt, Homo sapiens
uggaagcauuuguuucuac

SEQ ID NO: 710275 - RNA, 18 nt, Homo sapiens
uggaauauguaaauagaa

SEQ ID NO: 710276 - RNA, 14 nt, Homo sapiens
uggaaucagcucag

SEQ ID NO: 710277 - RNA, 22 nt, Homo sapiens
uggaccaauagggcugagcucu

SEQ ID NO: 710278 - RNA, 13 nt, Homo sapiens
uggagauucucau

SEQ ID NO: 710279 - RNA, 21 nt, Homo sapiens
uggcaagugaauuugccugua

SEQ ID NO: 710280 - RNA, 15 nt, Homo sapiens
uggcauuuucacuuu

SEQ ID NO: 710281 - RNA, 12 nt, Homo sapiens
uggcuagucaua

SEQ ID NO: 710282 - RNA, 12 nt, Homo sapiens
uggcuguggcau

SEQ ID NO: 710283 - RNA, 15 nt, Homo sapiens
ugggaaaaccagacu

SEQ ID NO: 710284 - RNA, 21 nt, Homo sapiens
ugggaaggaggccgcuaugca

SEQ ID NO: 710285 - RNA, 23 nt, Homo sapiens
ugggacuacaggcgugagccacc

SEQ ID NO: 710286 - RNA, 16 nt, Homo sapiens
ugggagaaaucuggcu

SEQ ID NO: 710287 - RNA, 23 nt, Homo sapiens
ugggauuacaggcgugagccacc

SEQ ID NO: 710288 - RNA, 14 nt, Homo sapiens
ugggcaacacagug

SEQ ID NO: 710289 - RNA, 15 nt, Homo sapiens
ugggggagaagcaag

SEQ ID NO: 710290 - RNA, 13 nt, Homo sapiens
uggucccaagaca

SEQ ID NO: 710291 - RNA, 22 nt, Homo sapiens
ugguuuauguggacaagccauu

SEQ ID NO: 710292 - RNA, 21 nt, Homo sapiens
ugguuuuuugcauacugcuau

SEQ ID NO: 710293 - RNA, 22 nt, Homo sapiens
uguaaaauggaggccauugugu

SEQ ID NO: 710294 - RNA, 17 nt, Homo sapiens
uguaaguuuaugcauac

SEQ ID NO: 710295 - RNA, 16 nt, Homo sapiens
uguacauauguaaaau

SEQ ID NO: 710296 - RNA, 15 nt, Homo sapiens
uguagaaugauuuca

SEQ ID NO: 710297 - RNA, 22 nt, Homo sapiens
uguagagagagaaaaguaacug

SEQ ID NO: 710298 - RNA, 21 nt, Homo sapiens
uguaggaugugucacuguugg

SEQ ID NO: 710299 - RNA, 20 nt, Homo sapiens
uguaguauaauaauuacugg

SEQ ID NO: 710300 - RNA, 15 nt, Homo sapiens
uguaucuaugcauuu

SEQ ID NO: 710301 - RNA, 16 nt, Homo sapiens
uguauuucaagaccuc

SEQ ID NO: 710302 - RNA, 20 nt, Homo sapiens
ugucagcagggacuguaaac

SEQ ID NO: 710303 - RNA, 18 nt, Homo sapiens
ugucaguaguuuuacuga

SEQ ID NO: 710304 - RNA, 23 nt, Homo sapiens
ugucauuaaauggggcucacaaa

SEQ ID NO: 710305 - RNA, 19 nt, Homo sapiens
uguccgacucuucugagca

SEQ ID NO: 710306 - RNA, 17 nt, Homo sapiens
ugugaauuagacuugua

SEQ ID NO: 710307 - RNA, 21 nt, Homo sapiens
ugugcccccaaccauuuccuc

SEQ ID NO: 710308 - RNA, 21 nt, Homo sapiens
ugugccccuugacaacuggca

SEQ ID NO: 710309 - RNA, 17 nt, Homo sapiens
uguggacuccaugccuc

SEQ ID NO: 710310 - RNA, 17 nt, Homo sapiens
uguggcauuuucacuuu

SEQ ID NO: 710311 - RNA, 16 nt, Homo sapiens
ugugguacaagcauuc

SEQ ID NO: 710312 - RNA, 13 nt, Homo sapiens
ugugguagccuca

SEQ ID NO: 710313 - RNA, 16 nt, Homo sapiens
uguguacugcaguugg

SEQ ID NO: 710314 - RNA, 16 nt, Homo sapiens
uguguggcauuuucac

SEQ ID NO: 710315 - RNA, 21 nt, Homo sapiens
uguguuuauccuaaacugaga

SEQ ID NO: 710316 - RNA, 13 nt, Homo sapiens
uguuaccuacuuu

SEQ ID NO: 710317 - RNA, 12 nt, Homo sapiens
uguucauuuccu

SEQ ID NO: 710318 - RNA, 18 nt, Homo sapiens
uguugacauucugaaugc

SEQ ID NO: 710319 - RNA, 14 nt, Homo sapiens
uguuuacuuuaugu

SEQ ID NO: 710320 - RNA, 14 nt, Homo sapiens
uguuuagaacacac

SEQ ID NO: 710321 - RNA, 17 nt, Homo sapiens
uguuucagggggccuuu

SEQ ID NO: 710322 - RNA, 14 nt, Homo sapiens
uguuugagguuaaa

SEQ ID NO: 710323 - RNA, 20 nt, Homo sapiens
uuaaaaucuaauucaaacua

SEQ ID NO: 710324 - RNA, 18 nt, Homo sapiens
uuaaacuauaagcaagaa

SEQ ID NO: 710325 - RNA, 19 nt, Homo sapiens
uuaaaguuguuugugccuu

SEQ ID NO: 710326 - RNA, 20 nt, Homo sapiens
uuaaauuugggggacuuaca

SEQ ID NO: 710327 - RNA, 14 nt, Homo sapiens
uuaacauaccuaag

SEQ ID NO: 710328 - RNA, 21 nt, Homo sapiens
uuaacuagguugcuacuuuau

SEQ ID NO: 710329 - RNA, 14 nt, Homo sapiens
uuaauaaauguaua

SEQ ID NO: 710330 - RNA, 20 nt, Homo sapiens
uuaauugaucgacuugccaa

SEQ ID NO: 710331 - RNA, 13 nt, Homo sapiens
uuaauugugaauu

SEQ ID NO: 710332 - RNA, 20 nt, Homo sapiens
uuacaauaauucuaugagau

SEQ ID NO: 710333 - RNA, 12 nt, Homo sapiens
uuacuacaugca

SEQ ID NO: 710334 - RNA, 19 nt, Homo sapiens
uuacugauuaggacuuuua

SEQ ID NO: 710335 - RNA, 15 nt, Homo sapiens
uuacuuaaaggaaua

SEQ ID NO: 710336 - RNA, 19 nt, Homo sapiens
uuacuuuaauacucaccuc

SEQ ID NO: 710337 - RNA, 16 nt, Homo sapiens
uuacuuuauguuacua

SEQ ID NO: 710338 - RNA, 18 nt, Homo sapiens
uuagaauauccaugaccu

SEQ ID NO: 710339 - RNA, 19 nt, Homo sapiens
uuaggacuuuuauugugaa

SEQ ID NO: 710340 - RNA, 12 nt, Homo sapiens
uuaggcauuaaa

SEQ ID NO: 710341 - RNA, 20 nt, Homo sapiens
uuaguacacagcaccagaau

SEQ ID NO: 710342 - RNA, 14 nt, Homo sapiens
uuauacuaccaagu

SEQ ID NO: 710343 - RNA, 16 nt, Homo sapiens
uuauaguuugcuguug

SEQ ID NO: 710344 - RNA, 21 nt, Homo sapiens
uuaucaugcauguccuguaaa

SEQ ID NO: 710345 - RNA, 15 nt, Homo sapiens
uuaugaauaguuucc

SEQ ID NO: 710346 - RNA, 17 nt, Homo sapiens
uuaugaauaguuuccaa

SEQ ID NO: 710347 - RNA, 22 nt, Homo sapiens
uuaugagcucuucauguuucag

SEQ ID NO: 710348 - RNA, 14 nt, Homo sapiens
uuauggcaaauuca

SEQ ID NO: 710349 - RNA, 17 nt, Homo sapiens
uuauguggacaagccau

SEQ ID NO: 710350 - RNA, 13 nt, Homo sapiens
uuauuaaaaacug

SEQ ID NO: 710351 - RNA, 19 nt, Homo sapiens
uuauuaauauauauuaucu

SEQ ID NO: 710352 - RNA, 18 nt, Homo sapiens
uuauuccccccuacuuga

SEQ ID NO: 710353 - RNA, 17 nt, Homo sapiens
uuauugccucacuucag

SEQ ID NO: 710354 - RNA, 15 nt, Homo sapiens
uuauuggcugagaua

SEQ ID NO: 710355 - RNA, 12 nt, Homo sapiens
uuauugugaauu

SEQ ID NO: 710356 - RNA, 16 nt, Homo sapiens
uucaaaauuggacuua

SEQ ID NO: 710357 - RNA, 18 nt, Homo sapiens
uucccacggccuuucuag

SEQ ID NO: 710358 - RNA, 16 nt, Homo sapiens
uuccccccuacuugag

SEQ ID NO: 710359 - RNA, 17 nt, Homo sapiens
uucgcguauuucaggau

SEQ ID NO: 710360 - RNA, 16 nt, Homo sapiens
uucuaauuggcaugaa

SEQ ID NO: 710361 - RNA, 15 nt, Homo sapiens
uucuaguucugccag

SEQ ID NO: 710362 - RNA, 12 nt, Homo sapiens
uucuccaucucc

SEQ ID NO: 710363 - RNA, 14 nt, Homo sapiens
uucucugaacacau

SEQ ID NO: 710364 - RNA, 13 nt, Homo sapiens
uucugcaagcuuu

SEQ ID NO: 710365 - RNA, 22 nt, Homo sapiens
uucugcaggcuucagccaucca

SEQ ID NO: 710366 - RNA, 18 nt, Homo sapiens
uucugguuuguaaggugg

SEQ ID NO: 710367 - RNA, 22 nt, Homo sapiens
uucuuacaauaauucuaugaga

SEQ ID NO: 710368 - RNA, 17 nt, Homo sapiens
uucuuccaaacaggcuc

SEQ ID NO: 710369 - RNA, 21 nt, Homo sapiens
uucuuuaaaauguaaagccau

SEQ ID NO: 710370 - RNA, 18 nt, Homo sapiens
uucuuucaugcuccuuac

SEQ ID NO: 710371 - RNA, 15 nt, Homo sapiens
uucuuuuaaaccauu

SEQ ID NO: 710372 - RNA, 13 nt, Homo sapiens
uucuuuugcucuu

SEQ ID NO: 710373 - RNA, 14 nt, Homo sapiens
uugaaccuaaacau

SEQ ID NO: 710374 - RNA, 13 nt, Homo sapiens
uugacaacaguua

SEQ ID NO: 710375 - RNA, 16 nt, Homo sapiens
uugacauucugaaugc

SEQ ID NO: 710376 - RNA, 20 nt, Homo sapiens
uugagcaucacagaauguga

SEQ ID NO: 710377 - RNA, 10 nt, Homo sapiens
uugagcccag

SEQ ID NO: 710378 - RNA, 16 nt, Homo sapiens
uugauguaacugagaa

SEQ ID NO: 710379 - RNA, 19 nt, Homo sapiens
uugauuuugaaccugauga

SEQ ID NO: 710380 - RNA, 15 nt, Homo sapiens
uugcaaaaacuacaa

SEQ ID NO: 710381 - RNA, 18 nt, Homo sapiens
uugcauuaaaaaugcaua

SEQ ID NO: 710382 - RNA, 22 nt, Homo sapiens
uugccuugugaauuugcugcua

SEQ ID NO: 710383 - RNA, 20 nt, Homo sapiens
uuggaagaggacuccuuaaa

SEQ ID NO: 710384 - RNA, 19 nt, Homo sapiens
uuggacaaaccuugaaaau

SEQ ID NO: 710385 - RNA, 19 nt, Homo sapiens
uuggcagcccugaugacug

SEQ ID NO: 710386 - RNA, 15 nt, Homo sapiens
uuggcccucucccau

SEQ ID NO: 710387 - RNA, 17 nt, Homo sapiens
uugguuuugcucacaaa

SEQ ID NO: 710388 - RNA, 18 nt, Homo sapiens
uuguaagguggucacugu

SEQ ID NO: 710389 - RNA, 20 nt, Homo sapiens
uuguaguuuuggcuaguccu

SEQ ID NO: 710390 - RNA, 14 nt, Homo sapiens
uugucuuugcugua

SEQ ID NO: 710391 - RNA, 15 nt, Homo sapiens
uuguugagaguguga

SEQ ID NO: 710392 - RNA, 14 nt, Homo sapiens
uuuaaaauagcaaa

SEQ ID NO: 710393 - RNA, 20 nt, Homo sapiens
uuuaagaguaaaaagaaaua

SEQ ID NO: 710394 - RNA, 17 nt, Homo sapiens
uuuaauacucaccuccu

SEQ ID NO: 710395 - RNA, 12 nt, Homo sapiens
uuuaauagcaaa

SEQ ID NO: 710396 - RNA, 18 nt, Homo sapiens
uuuaccccucuaccaagc

SEQ ID NO: 710397 - RNA, 22 nt, Homo sapiens
uuuagagugaaauauaugcuau

SEQ ID NO: 710398 - RNA, 13 nt, Homo sapiens
uuuaggaagcaag

SEQ ID NO: 710399 - RNA, 23 nt, Homo sapiens
uuuauagagcagaacccuagucu

SEQ ID NO: 710400 - RNA, 16 nt, Homo sapiens
uuuaucuuuauaugaa

SEQ ID NO: 710401 - RNA, 14 nt, Homo sapiens
uuuaugagcucuuc

SEQ ID NO: 710402 - RNA, 13 nt, Homo sapiens
uuuaugcauacag

SEQ ID NO: 710403 - RNA, 23 nt, Homo sapiens
uuucagaagccccauuugcacag

SEQ ID NO: 710404 - RNA, 19 nt, Homo sapiens
uuucagaugugaaccauua

SEQ ID NO: 710405 - RNA, 15 nt, Homo sapiens
uuucaugcuccuuac

SEQ ID NO: 710406 - RNA, 15 nt, Homo sapiens
uuuccauuacaugau

SEQ ID NO: 710407 - RNA, 19 nt, Homo sapiens
uuuccccagugacaccuca

SEQ ID NO: 710408 - RNA, 18 nt, Homo sapiens
uuucuaauuggcaugaag

SEQ ID NO: 710409 - RNA, 17 nt, Homo sapiens
uuucucauuaauuuugg

SEQ ID NO: 710410 - RNA, 13 nt, Homo sapiens
uuucugccuaucu

SEQ ID NO: 710411 - RNA, 12 nt, Homo sapiens
uuucugcuuuaa

SEQ ID NO: 710412 - RNA, 20 nt, Homo sapiens
uuucuugucuauaaagcauu

SEQ ID NO: 710413 - RNA, 17 nt, Homo sapiens
uuucuuuuuuauacuca

SEQ ID NO: 710414 - RNA, 18 nt, Homo sapiens
uuucuuuuuuauacucaa

SEQ ID NO: 710415 - RNA, 22 nt, Homo sapiens
uuucuuuuuuuuuuaauuguga

SEQ ID NO: 710416 - RNA, 16 nt, Homo sapiens
uuugaaaaagcgaaaa

SEQ ID NO: 710417 - RNA, 17 nt, Homo sapiens
uuugagagaaauaugaa

SEQ ID NO: 710418 - RNA, 14 nt, Homo sapiens
uuugaugauugcua

SEQ ID NO: 710419 - RNA, 16 nt, Homo sapiens
uuugcaaagugcaagg

SEQ ID NO: 710420 - RNA, 19 nt, Homo sapiens
uuugcacuugucuuugacu

SEQ ID NO: 710421 - RNA, 17 nt, Homo sapiens
uuugcuguaaacuugua

SEQ ID NO: 710422 - RNA, 19 nt, Homo sapiens
uuuggaagaggacuccuua

SEQ ID NO: 710423 - RNA, 15 nt, Homo sapiens
uuuggauuacuuaaa

SEQ ID NO: 710424 - RNA, 19 nt, Homo sapiens
uuuguagccacuucacuuu

SEQ ID NO: 710425 - RNA, 12 nt, Homo sapiens
uuuguuuaccag

SEQ ID NO: 710426 - RNA, 18 nt, Homo sapiens
uuuuaugaaacauuacag

SEQ ID NO: 710427 - RNA, 15 nt, Homo sapiens
uuuuauuaacauuga

SEQ ID NO: 710428 - RNA, 17 nt, Homo sapiens
uuuuccaacuuggcugc

SEQ ID NO: 710429 - RNA, 22 nt, Homo sapiens
uuuugagauggagucuugcucu

SEQ ID NO: 710430 - RNA, 21 nt, Homo sapiens
uuuuuaaacaaaaaaagcauu

SEQ ID NO: 710431 - RNA, 19 nt, Homo sapiens
uuuuuccuuugaacuuuga

SEQ ID NO: 710432 - RNA, 19 nt, Homo sapiens
aaaaacuauuaacaacuug

SEQ ID NO: 710433 - RNA, 17 nt, Homo sapiens
aaaaagaagcaaccuca

SEQ ID NO: 710434 - RNA, 16 nt, Homo sapiens
aaaaaguaaaugugau

SEQ ID NO: 710435 - RNA, 16 nt, Homo sapiens
aaaaaugcauauacuu

SEQ ID NO: 710436 - RNA, 20 nt, Homo sapiens
aaaacauugugccaugucaa

SEQ ID NO: 710437 - RNA, 23 nt, Homo sapiens
aaaaccguaugagggaacugugu

SEQ ID NO: 710438 - RNA, 16 nt, Homo sapiens
aaaacugcauuucacu

SEQ ID NO: 710439 - RNA, 23 nt, Homo sapiens
aaaacuucaacguaagacugugu

SEQ ID NO: 710440 - RNA, 22 nt, Homo sapiens
aaaagauucccacccaauucaa

SEQ ID NO: 710441 - RNA, 15 nt, Homo sapiens
aaaaguuacauguuu

SEQ ID NO: 710442 - RNA, 16 nt, Homo sapiens
aaaaguuauguagaaa

SEQ ID NO: 710443 - RNA, 18 nt, Homo sapiens
aaaauaguaagccucccu

SEQ ID NO: 710444 - RNA, 19 nt, Homo sapiens
aaaauggaggccauugugu

SEQ ID NO: 710445 - RNA, 16 nt, Homo sapiens
aaaauggccauuugcu

SEQ ID NO: 710446 - RNA, 18 nt, Homo sapiens
aaacaaauagucuaucaa

SEQ ID NO: 710447 - RNA, 16 nt, Homo sapiens
aaacaaauguguaauu

SEQ ID NO: 710448 - RNA, 13 nt, Homo sapiens
aaacacuugcaac

SEQ ID NO: 710449 - RNA, 16 nt, Homo sapiens
aaacaucauuacuaua

SEQ ID NO: 710450 - RNA, 17 nt, Homo sapiens
aaacaucauuacuauaa

SEQ ID NO: 710451 - RNA, 15 nt, Homo sapiens
aaacauugugccaug

SEQ ID NO: 710452 - RNA, 11 nt, Homo sapiens
aaacucuguca

SEQ ID NO: 710453 - RNA, 21 nt, Homo sapiens
aaacugaggaauuucaccugu

SEQ ID NO: 710454 - RNA, 13 nt, Homo sapiens
aaagaaccaaaga

SEQ ID NO: 710455 - RNA, 14 nt, Homo sapiens
aaagacugcauuua

SEQ ID NO: 710456 - RNA, 16 nt, Homo sapiens
aaagagggagugcauu

SEQ ID NO: 710457 - RNA, 21 nt, Homo sapiens
aaagauucccacccaauucaa

SEQ ID NO: 710458 - RNA, 13 nt, Homo sapiens
uuuaggcauuaaa

SEQ ID NO: 710459 - RNA, 13 nt, Homo sapiens
uuuaucugugauu

SEQ ID NO: 710460 - RNA, 14 nt, Homo sapiens
uuuaucugugauua

SEQ ID NO: 710461 - RNA, 21 nt, Homo sapiens
uuuauuaacauugauuggcau

SEQ ID NO: 710462 - RNA, 14 nt, Homo sapiens
uuuauuaauauaua

SEQ ID NO: 710463 - RNA, 21 nt, Homo sapiens
uuucaugauaaugaacagaac

SEQ ID NO: 710464 - RNA, 22 nt, Homo sapiens
uuuccaugcacccucauacaca

SEQ ID NO: 710465 - RNA, 15 nt, Homo sapiens
uuucccaacaccucu

SEQ ID NO: 710466 - RNA, 17 nt, Homo sapiens
uuucccauuacuuuaau

SEQ ID NO: 710467 - RNA, 16 nt, Homo sapiens
uuuccuccaaacuccu

SEQ ID NO: 710468 - RNA, 15 nt, Homo sapiens
uuucuauagccaaaa

SEQ ID NO: 710469 - RNA, 17 nt, Homo sapiens
uuucucuagggagaaaa

SEQ ID NO: 710470 - RNA, 14 nt, Homo sapiens
uuucuucaccaaau

SEQ ID NO: 710471 - RNA, 12 nt, Homo sapiens
uuugagcccagg

SEQ ID NO: 710472 - RNA, 18 nt, Homo sapiens
uuugauacuaagcauuga

SEQ ID NO: 710473 - RNA, 14 nt, Homo sapiens
uuugcagaaagcca

SEQ ID NO: 710474 - RNA, 17 nt, Homo sapiens
uuugcuguugcauugua

SEQ ID NO: 710475 - RNA, 19 nt, Homo sapiens
uuuggggagcaggaggcca

SEQ ID NO: 710476 - RNA, 21 nt, Homo sapiens
uuuggggagcaggaggccaau

SEQ ID NO: 710477 - RNA, 22 nt, Homo sapiens
uuugggggacuuacaugauuca

SEQ ID NO: 710478 - RNA, 17 nt, Homo sapiens
uuugguuacugugccau

SEQ ID NO: 710479 - RNA, 18 nt, Homo sapiens
uuugguuacugugccaug

SEQ ID NO: 710480 - RNA, 16 nt, Homo sapiens
uuuguaauauggaaug

SEQ ID NO: 710481 - RNA, 17 nt, Homo sapiens
uuugugugcgucacugu

SEQ ID NO: 710482 - RNA, 22 nt, Homo sapiens
uuuuaaacugguuuuuugcaua

SEQ ID NO: 710483 - RNA, 18 nt, Homo sapiens
uuuuagcgugcucacuga

SEQ ID NO: 710484 - RNA, 15 nt, Homo sapiens
uuuuauacuaccaag

SEQ ID NO: 710485 - RNA, 21 nt, Homo sapiens
uuuuauaugcuuacugauaua

SEQ ID NO: 710486 - RNA, 14 nt, Homo sapiens
uuuucagaugugaa

SEQ ID NO: 710487 - RNA, 14 nt, Homo sapiens
uuuucucuucaaua

SEQ ID NO: 710488 - RNA, 19 nt, Homo sapiens
uuuucuggaauacaugaaa

SEQ ID NO: 710489 - RNA, 14 nt, Homo sapiens
uuuucugugccuga

SEQ ID NO: 710490 - RNA, 21 nt, Homo sapiens
uuuuuacacauguaucuaugc

SEQ ID NO: 710491 - RNA, 15 nt, Homo sapiens
uuuuuacuuccacag

SEQ ID NO: 710492 - RNA, 22 nt, Homo sapiens
uuuuuccucccuuucccugaga

SEQ ID NO: 710493 - RNA, 18 nt, Homo sapiens
uuuuuuaaaaaagcuuaa

SEQ ID NO: 710494 - RNA, 13 nt, Homo sapiens
aagauacacuccu

SEQ ID NO: 710495 - RNA, 18 nt, Homo sapiens
aagaucuuuuauuuugcc

SEQ ID NO: 710496 - RNA, 15 nt, Homo sapiens
aagauuaacugguag

SEQ ID NO: 710497 - RNA, 15 nt, Homo sapiens
aagauuaugaucuca

SEQ ID NO: 710498 - RNA, 16 nt, Homo sapiens
aagcaggguacccuuu

SEQ ID NO: 710499 - RNA, 23 nt, Homo sapiens
aagccccuuggcccucucccaug

SEQ ID NO: 710500 - RNA, 20 nt, Homo sapiens
aagccuuggggauucuucca

SEQ ID NO: 710501 - RNA, 13 nt, Homo sapiens
aagccuugguaaa

SEQ ID NO: 710502 - RNA, 15 nt, Homo sapiens
aagcguuugcacaga

SEQ ID NO: 710503 - RNA, 18 nt, Homo sapiens
aagcuaaaauaaagaaau

SEQ ID NO: 710504 - RNA, 19 nt, Homo sapiens
aagcuccugccucuuugug

SEQ ID NO: 710505 - RNA, 21 nt, Homo sapiens
aagcuuuuuauuccuccugcu

SEQ ID NO: 710506 - RNA, 16 nt, Homo sapiens
aaggacuaugaaaagc

SEQ ID NO: 710507 - RNA, 15 nt, Homo sapiens
aaggagucacugaga

SEQ ID NO: 710508 - RNA, 15 nt, Homo sapiens
aaggccuccugugac

SEQ ID NO: 710509 - RNA, 16 nt, Homo sapiens
aaggccuccugugacu

SEQ ID NO: 710510 - RNA, 14 nt, Homo sapiens
aaggcucuuuugua

SEQ ID NO: 710511 - RNA, 19 nt, Homo sapiens
aaggguucaagauuguucc

SEQ ID NO: 710512 - RNA, 14 nt, Homo sapiens
aagguaaaaugcca

SEQ ID NO: 710513 - RNA, 16 nt, Homo sapiens
aaggugucauacagau

SEQ ID NO: 710514 - RNA, 19 nt, Homo sapiens
aaguacuagcuuacuuuug

SEQ ID NO: 710515 - RNA, 20 nt, Homo sapiens
aagugcugugcaagguauua

SEQ ID NO: 710516 - RNA, 12 nt, Homo sapiens
aaguguuuucuc

SEQ ID NO: 710517 - RNA, 17 nt, Homo sapiens
aaguuaaauguguguaa

SEQ ID NO: 710518 - RNA, 18 nt, Homo sapiens
aaguuaaauguguguaaa

SEQ ID NO: 710519 - RNA, 19 nt, Homo sapiens
aaguugcaccaacuuugaa

SEQ ID NO: 710520 - RNA, 12 nt, Homo sapiens
aaguuuaugcau

SEQ ID NO: 710521 - RNA, 23 nt, Homo sapiens
aaguuucuucuuuaggcauuaaa

SEQ ID NO: 710522 - RNA, 15 nt, Homo sapiens
aauaaaaaguucaga

SEQ ID NO: 710523 - RNA, 17 nt, Homo sapiens
aauaaaaaguucagagu

SEQ ID NO: 710524 - RNA, 15 nt, Homo sapiens
aauaaacccuuccug

SEQ ID NO: 710525 - RNA, 15 nt, Homo sapiens
aauaaccauugucau

SEQ ID NO: 710526 - RNA, 15 nt, Homo sapiens
aauaagguacaagaa

SEQ ID NO: 710527 - RNA, 17 nt, Homo sapiens
aauacaagccacuaccu

SEQ ID NO: 710528 - RNA, 20 nt, Homo sapiens
aauacaagccacuaccuucu

SEQ ID NO: 710529 - RNA, 17 nt, Homo sapiens
aauagcuaaauaccuca

SEQ ID NO: 710530 - RNA, 23 nt, Homo sapiens
aauauguaaauagaaacguguau

SEQ ID NO: 710531 - RNA, 15 nt, Homo sapiens
aauauuauuccucaa

SEQ ID NO: 710532 - RNA, 18 nt, Homo sapiens
aauauuauuccucaaaaa

SEQ ID NO: 710533 - RNA, 18 nt, Homo sapiens
aaucaaccaaacaaagaa

SEQ ID NO: 710534 - RNA, 11 nt, Homo sapiens
aaucacaagaa

SEQ ID NO: 710535 - RNA, 20 nt, Homo sapiens
aaucagagaccuuccagaaa

SEQ ID NO: 710536 - RNA, 15 nt, Homo sapiens
aaucaguguuuccaa

SEQ ID NO: 710537 - RNA, 16 nt, Homo sapiens
aauccaaacuaaucca

SEQ ID NO: 710538 - RNA, 20 nt, Homo sapiens
aauccaguaggauccaguga

SEQ ID NO: 710539 - RNA, 21 nt, Homo sapiens
aauccugucgauuagacugga

SEQ ID NO: 710540 - RNA, 14 nt, Homo sapiens
aaugaauacaauua

SEQ ID NO: 710541 - RNA, 15 nt, Homo sapiens
aaugaauacaauuaa

SEQ ID NO: 710542 - RNA, 16 nt, Homo sapiens
aauguaucauagaaau

SEQ ID NO: 710543 - RNA, 15 nt, Homo sapiens
aaugugguacaagca

SEQ ID NO: 710544 - RNA, 18 nt, Homo sapiens
aauuaaaguggaccaaua

SEQ ID NO: 710545 - RNA, 21 nt, Homo sapiens
aauuacaguugaaagcuguau

SEQ ID NO: 710546 - RNA, 12 nt, Homo sapiens
aauuagcaauug

SEQ ID NO: 710547 - RNA, 17 nt, Homo sapiens
aauuccagacuuucuau

SEQ ID NO: 710548 - RNA, 15 nt, Homo sapiens
aauucugcaagcuuu

SEQ ID NO: 710549 - RNA, 17 nt, Homo sapiens
aauucugcucagauaga

SEQ ID NO: 710550 - RNA, 16 nt, Homo sapiens
aauugaucgacuugcc

SEQ ID NO: 710551 - RNA, 14 nt, Homo sapiens
aauugauguugcug

SEQ ID NO: 710552 - RNA, 11 nt, Homo sapiens
aauugauucaa

SEQ ID NO: 710553 - RNA, 16 nt, Homo sapiens
aauuguacuaaagcca

SEQ ID NO: 710554 - RNA, 17 nt, Homo sapiens
aauuguacuaaagccaa

SEQ ID NO: 710555 - RNA, 11 nt, Homo sapiens
aauuguugcua

SEQ ID NO: 710556 - RNA, 21 nt, Homo sapiens
aauuuaacagaaguugugaaa

SEQ ID NO: 710557 - RNA, 15 nt, Homo sapiens
aauuuaacugccuaa

SEQ ID NO: 710558 - RNA, 19 nt, Homo sapiens
aauuuauuauuaacauacc

SEQ ID NO: 710559 - RNA, 19 nt, Homo sapiens
aauuuccucaucccuccau

SEQ ID NO: 710560 - RNA, 15 nt, Homo sapiens
aauuucuacuuugau

SEQ ID NO: 710561 - RNA, 13 nt, Homo sapiens
aauuugcugcuau

SEQ ID NO: 710562 - RNA, 21 nt, Homo sapiens
aauuugggggacuuacaugau

SEQ ID NO: 710563 - RNA, 13 nt, Homo sapiens
aauuuuaaccuau

SEQ ID NO: 710564 - RNA, 21 nt, Homo sapiens
acaaaaaaagcauuguaacuu

SEQ ID NO: 710565 - RNA, 16 nt, Homo sapiens
acaaauagucuaucaa

SEQ ID NO: 710566 - RNA, 23 nt, Homo sapiens
acaaauagucuaucaaccccaga

SEQ ID NO: 710567 - RNA, 15 nt, Homo sapiens
acaagaccucagugc

SEQ ID NO: 710568 - RNA, 17 nt, Homo sapiens
acaagccagaacuugac

SEQ ID NO: 710569 - RNA, 21 nt, Homo sapiens
acaauagaauuauaacuggaa

SEQ ID NO: 710570 - RNA, 17 nt, Homo sapiens
acacaaaccagccucaa

SEQ ID NO: 710571 - RNA, 16 nt, Homo sapiens
acacauguaucuaugc

SEQ ID NO: 710572 - RNA, 14 nt, Homo sapiens
acaccguucauuca

SEQ ID NO: 710573 - RNA, 16 nt, Homo sapiens
acaccugacagaauga

SEQ ID NO: 710574 - RNA, 21 nt, Homo sapiens
acagccuauaaccagacacau

SEQ ID NO: 710575 - RNA, 13 nt, Homo sapiens
acagggcgggggu

SEQ ID NO: 710576 - RNA, 19 nt, Homo sapiens
acaggguuucaccauguua

SEQ ID NO: 710577 - RNA, 19 nt, Homo sapiens
acagguuuucagcaacuca

SEQ ID NO: 710578 - RNA, 18 nt, Homo sapiens
acaguguucugugacaaa

SEQ ID NO: 710579 - RNA, 19 nt, Homo sapiens
acaguguugaaaauguuca

SEQ ID NO: 710580 - RNA, 18 nt, Homo sapiens
acaguugaaagcuguauu

SEQ ID NO: 710581 - RNA, 21 nt, Homo sapiens
acauacaccuaugucauuuca

SEQ ID NO: 710582 - RNA, 22 nt, Homo sapiens
acauacaccuaugucauuucau

SEQ ID NO: 710583 - RNA, 18 nt, Homo sapiens
acauacccucccuuugaa

SEQ ID NO: 710584 - RNA, 15 nt, Homo sapiens
acaucauuacuauaa

SEQ ID NO: 710585 - RNA, 16 nt, Homo sapiens
acaucgcagauucucc

SEQ ID NO: 710586 - RNA, 19 nt, Homo sapiens
acaugcuucagugcugcuc

SEQ ID NO: 710587 - RNA, 15 nt, Homo sapiens
acaugugcacuugaa

SEQ ID NO: 710588 - RNA, 20 nt, Homo sapiens
acauuacaguuagagauuuu

SEQ ID NO: 710589 - RNA, 17 nt, Homo sapiens
acauugauuggcauauu

SEQ ID NO: 710590 - RNA, 13 nt, Homo sapiens
accaaccuguuac

SEQ ID NO: 710591 - RNA, 13 nt, Homo sapiens
accacaacuauuu

SEQ ID NO: 710592 - RNA, 24 nt, Homo sapiens
accacacccacacucagauccucc

SEQ ID NO: 710593 - RNA, 14 nt, Homo sapiens
accagagcacugua

SEQ ID NO: 710594 - RNA, 12 nt, Homo sapiens
accagauuugcu

SEQ ID NO: 710595 - RNA, 22 nt, Homo sapiens
accaggacuaaugcauguggua

SEQ ID NO: 710596 - RNA, 13 nt, Homo sapiens
accagugcugcug

SEQ ID NO: 710597 - RNA, 22 nt, Homo sapiens
acccaauucaaaacauugugcc

SEQ ID NO: 710598 - RNA, 13 nt, Homo sapiens
acccccaucuuuu

SEQ ID NO: 710599 - RNA, 17 nt, Homo sapiens
acccguucaacuuuucc

SEQ ID NO: 710600 - RNA, 20 nt, Homo sapiens
acccuacuucuuuugcucuu

SEQ ID NO: 710601 - RNA, 14 nt, Homo sapiens
acccucaauucaua

SEQ ID NO: 710602 - RNA, 18 nt, Homo sapiens
acccucaucuuucuucca

SEQ ID NO: 710603 - RNA, 23 nt, Homo sapiens
acccuguugcuuuucacaaauca

SEQ ID NO: 710604 - RNA, 16 nt, Homo sapiens
accgugaccagugcug

SEQ ID NO: 710605 - RNA, 23 nt, Homo sapiens
accguucauucaggcaacgcaca

SEQ ID NO: 710606 - RNA, 22 nt, Homo sapiens
accuaaacauagaaauugccug

SEQ ID NO: 710607 - RNA, 15 nt, Homo sapiens
accuacuuacaugca

SEQ ID NO: 710608 - RNA, 18 nt, Homo sapiens
accuacuuacaugcauua

SEQ ID NO: 710609 - RNA, 18 nt, Homo sapiens
accucaggcagaggaugu

SEQ ID NO: 710610 - RNA, 21 nt, Homo sapiens
accucccccugaacacuguga

SEQ ID NO: 710611 - RNA, 20 nt, Homo sapiens
accucgugauccaccugccu

SEQ ID NO: 710612 - RNA, 17 nt, Homo sapiens
accucuauauaccaaag

SEQ ID NO: 710613 - RNA, 23 nt, Homo sapiens
accugaggcucagcccuagcccu

SEQ ID NO: 710614 - RNA, 17 nt, Homo sapiens
acgacaguacacuguca

SEQ ID NO: 710615 - RNA, 20 nt, Homo sapiens
acgcagccugcagacucacu

SEQ ID NO: 710616 - RNA, 23 nt, Homo sapiens
acgcagccugcagacucacugug

SEQ ID NO: 710617 - RNA, 20 nt, Homo sapiens
acgguggcucacgccuguaa

SEQ ID NO: 710618 - RNA, 14 nt, Homo sapiens
acguaagacugugu

SEQ ID NO: 710619 - RNA, 11 nt, Homo sapiens
acuaaagccaa

SEQ ID NO: 710620 - RNA, 21 nt, Homo sapiens
acuacacacuguguacugcag

SEQ ID NO: 710621 - RNA, 16 nt, Homo sapiens
acuacaggcaccugcc

SEQ ID NO: 710622 - RNA, 15 nt, Homo sapiens
acuagggagccaugu

SEQ ID NO: 710623 - RNA, 19 nt, Homo sapiens
acuauggagugcaccaaag

SEQ ID NO: 710624 - RNA, 22 nt, Homo sapiens
auuuuuagcucuguacuccuaa

SEQ ID NO: 710625 - RNA, 21 nt, Homo sapiens
auuuuuuaugaaacauuacag

SEQ ID NO: 710626 - RNA, 22 nt, Homo sapiens
auuuuuuuuuuaaaacuaucca

SEQ ID NO: 710627 - RNA, 17 nt, Homo sapiens
caaaacagaaaaugaag

SEQ ID NO: 710628 - RNA, 15 nt, Homo sapiens
caaaagcgaaacaca

SEQ ID NO: 710629 - RNA, 16 nt, Homo sapiens
caaaagucuggccuuu

SEQ ID NO: 710630 - RNA, 19 nt, Homo sapiens
caaaaguuacauguuugca

SEQ ID NO: 710631 - RNA, 14 nt, Homo sapiens
caaaccaaagacca

SEQ ID NO: 710632 - RNA, 23 nt, Homo sapiens
caaagaaccuucucuauggggca

SEQ ID NO: 710633 - RNA, 16 nt, Homo sapiens
caaagccaagcaaaau

SEQ ID NO: 710634 - RNA, 17 nt, Homo sapiens
caaagugcugcgauuac

SEQ ID NO: 710635 - RNA, 13 nt, Homo sapiens
caaaugcaccaug

SEQ ID NO: 710636 - RNA, 18 nt, Homo sapiens
caacagaaucagaucuga

SEQ ID NO: 710637 - RNA, 14 nt, Homo sapiens
caacaguuaccucc

SEQ ID NO: 710638 - RNA, 16 nt, Homo sapiens
caacauaguauucaug

SEQ ID NO: 710639 - RNA, 15 nt, Homo sapiens
caaccaaacaaagaa

SEQ ID NO: 710640 - RNA, 16 nt, Homo sapiens
caaccagagcacugua

SEQ ID NO: 710641 - RNA, 17 nt, Homo sapiens
caaccagagcacuguau

SEQ ID NO: 710642 - RNA, 16 nt, Homo sapiens
caaccccagacacugg

SEQ ID NO: 710643 - RNA, 20 nt, Homo sapiens
caaccccuccccuccauccc

SEQ ID NO: 710644 - RNA, 14 nt, Homo sapiens
caacggaugaaugu

SEQ ID NO: 710645 - RNA, 18 nt, Homo sapiens
caacuaaugccuuacucu

SEQ ID NO: 710646 - RNA, 18 nt, Homo sapiens
caacucagaaugcucuac

SEQ ID NO: 710647 - RNA, 15 nt, Homo sapiens
caacuuaaugcucug

SEQ ID NO: 710648 - RNA, 18 nt, Homo sapiens
caagaaaauaagagcuca

SEQ ID NO: 710649 - RNA, 16 nt, Homo sapiens
caagaccucugugcac

SEQ ID NO: 710650 - RNA, 18 nt, Homo sapiens
caagaccucugugcacuu

SEQ ID NO: 710651 - RNA, 15 nt, Homo sapiens
caagccacuaccuuc

SEQ ID NO: 710652 - RNA, 20 nt, Homo sapiens
caagcuuuucaaaauuggac

SEQ ID NO: 710653 - RNA, 18 nt, Homo sapiens
caaguaagaauguuaaaa

SEQ ID NO: 710654 - RNA, 21 nt, Homo sapiens
caagucaggcccuuauuuuca

SEQ ID NO: 710655 - RNA, 21 nt, Homo sapiens
caaguuagaaaacauaaucuu

SEQ ID NO: 710656 - RNA, 15 nt, Homo sapiens
caauaaaaaguucag

SEQ ID NO: 710657 - RNA, 19 nt, Homo sapiens
caaucucaaucccucaaaa

SEQ ID NO: 710658 - RNA, 21 nt, Homo sapiens
caaucuguccuguuacaaaag

SEQ ID NO: 710659 - RNA, 20 nt, Homo sapiens
caaugauccuguauucagac

SEQ ID NO: 710660 - RNA, 20 nt, Homo sapiens
caaugcaccuaaagaaaaac

SEQ ID NO: 710661 - RNA, 23 nt, Homo sapiens
caauguaagagccuaacuccauc

SEQ ID NO: 710662 - RNA, 15 nt, Homo sapiens
caauguuagccucaa

SEQ ID NO: 710663 - RNA, 18 nt, Homo sapiens
caauuaaaggcaaaggca

SEQ ID NO: 710664 - RNA, 20 nt, Homo sapiens
caauuuuuuuauacuaccaa

SEQ ID NO: 710665 - RNA, 17 nt, Homo sapiens
cacaaaagucuacuuua

SEQ ID NO: 710666 - RNA, 19 nt, Homo sapiens
cacaaggucuuuaaaguga

SEQ ID NO: 710667 - RNA, 14 nt, Homo sapiens
cacaaugaaagaau

SEQ ID NO: 710668 - RNA, 16 nt, Homo sapiens
cacacaaacaccuccu

SEQ ID NO: 710669 - RNA, 20 nt, Homo sapiens
cacagaacacagcaauuccu

SEQ ID NO: 710670 - RNA, 12 nt, Homo sapiens
cacagaauguga

SEQ ID NO: 710671 - RNA, 16 nt, Homo sapiens
cacagacugcgauuug

SEQ ID NO: 710672 - RNA, 21 nt, Homo sapiens
cacaguacaauguuucagaag

SEQ ID NO: 710673 - RNA, 24 nt, Homo sapiens
caccaacccuucauuuaacaagua

SEQ ID NO: 710674 - RNA, 17 nt, Homo sapiens
caccuacuuacaugcau

SEQ ID NO: 710675 - RNA, 17 nt, Homo sapiens
caccuaugucauuucau

SEQ ID NO: 710676 - RNA, 16 nt, Homo sapiens
caccuggcucaccuug

SEQ ID NO: 710677 - RNA, 19 nt, Homo sapiens
caccugggagaaaucuggc

SEQ ID NO: 710678 - RNA, 19 nt, Homo sapiens
caccuuuuuucaacaguga

SEQ ID NO: 710679 - RNA, 21 nt, Homo sapiens
cacuaauucauuaaucugccu

SEQ ID NO: 710680 - RNA, 16 nt, Homo sapiens
cacuagacaagccaga

SEQ ID NO: 710681 - RNA, 18 nt, Homo sapiens
cacucuucaaaugccuga

SEQ ID NO: 710682 - RNA, 14 nt, Homo sapiens
cacuguaucuaggc

SEQ ID NO: 710683 - RNA, 15 nt, Homo sapiens
cacugugaaaccccc

SEQ ID NO: 710684 - RNA, 20 nt, Homo sapiens
cacuucuuacaauaauucua

SEQ ID NO: 710685 - RNA, 21 nt, Homo sapiens
cacuucuuacaauaauucuau

SEQ ID NO: 710686 - RNA, 18 nt, Homo sapiens
cagaaaacaaaacugcau

SEQ ID NO: 710687 - RNA, 17 nt, Homo sapiens
cagaaccccuacaugaa

SEQ ID NO: 710688 - RNA, 15 nt, Homo sapiens
cagaagguugcucua

SEQ ID NO: 710689 - RNA, 16 nt, Homo sapiens
cagaauacaagccacu

SEQ ID NO: 710690 - RNA, 13 nt, Homo sapiens
cagaauuacugua

SEQ ID NO: 710691 - RNA, 22 nt, Homo sapiens
cagacaccagauuuuuagcucu

SEQ ID NO: 710692 - RNA, 14 nt, Homo sapiens
cagacucacugugg

SEQ ID NO: 710693 - RNA, 15 nt, Homo sapiens
cagacucacuguggg

SEQ ID NO: 710694 - RNA, 16 nt, Homo sapiens
cagacucacuguggga

SEQ ID NO: 710695 - RNA, 16 nt, Homo sapiens
cagacuucccacggcu

SEQ ID NO: 710696 - RNA, 19 nt, Homo sapiens
cagagaccuuccagaaaua

SEQ ID NO: 710697 - RNA, 22 nt, Homo sapiens
cagagacgcagacaugugcacu

SEQ ID NO: 710698 - RNA, 19 nt, Homo sapiens
cagauucucccuugcucug

SEQ ID NO: 710699 - RNA, 21 nt, Homo sapiens
cagauuugcaaaguuuaaugg

SEQ ID NO: 710700 - RNA, 18 nt, Homo sapiens
cagcaaccagagcacugu

SEQ ID NO: 710701 - RNA, 23 nt, Homo sapiens
cagcaaggccagaugcacauccc

SEQ ID NO: 710702 - RNA, 11 nt, Homo sapiens
cagcauuuccc

SEQ ID NO: 710703 - RNA, 19 nt, Homo sapiens
cagccagaucgggagcaaa

SEQ ID NO: 710704 - RNA, 21 nt, Homo sapiens
cagccagguuugccagaacca

SEQ ID NO: 710705 - RNA, 18 nt, Homo sapiens
cagccaucaagagacuga

SEQ ID NO: 710706 - RNA, 17 nt, Homo sapiens
cagccugcagacucacu

SEQ ID NO: 710707 - RNA, 18 nt, Homo sapiens
cagccugcagacucacug

SEQ ID NO: 710708 - RNA, 13 nt, Homo sapiens
cagcuaaguugca

SEQ ID NO: 710709 - RNA, 15 nt, Homo sapiens
cagcuagcucugcca

SEQ ID NO: 710710 - RNA, 17 nt, Homo sapiens
cagcuaggaugugcauu

SEQ ID NO: 710711 - RNA, 12 nt, Homo sapiens
cagcugggacac

SEQ ID NO: 710712 - RNA, 18 nt, Homo sapiens
cagcuggggaaaucaaaa

SEQ ID NO: 710713 - RNA, 19 nt, Homo sapiens
caggaacccaccaaaccaa

SEQ ID NO: 710714 - RNA, 16 nt, Homo sapiens
caggacucugccccuu

SEQ ID NO: 710715 - RNA, 14 nt, Homo sapiens
caggagacaguuca

SEQ ID NO: 710716 - RNA, 17 nt, Homo sapiens
caggaggccaauaaaaa

SEQ ID NO: 710717 - RNA, 19 nt, Homo sapiens
caggauaccauauacagcu

SEQ ID NO: 710718 - RNA, 14 nt, Homo sapiens
caggcaacgcacaa

SEQ ID NO: 710719 - RNA, 15 nt, Homo sapiens
caggcaacgcacaaa

SEQ ID NO: 710720 - RNA, 16 nt, Homo sapiens
caggccuuugagcuca

SEQ ID NO: 710721 - RNA, 14 nt, Homo sapiens
cagggaacccacag

SEQ ID NO: 710722 - RNA, 16 nt, Homo sapiens
cagggaauugauucaa

SEQ ID NO: 710723 - RNA, 22 nt, Homo sapiens
caggggccugcccagugcacuu

SEQ ID NO: 710724 - RNA, 14 nt, Homo sapiens
caggugaacaaagu

SEQ ID NO: 710725 - RNA, 13 nt, Homo sapiens
caggugcuucagg

SEQ ID NO: 710726 - RNA, 20 nt, Homo sapiens
cagguguaagccaccgugcc

SEQ ID NO: 710727 - RNA, 17 nt, Homo sapiens
cagguuaccacucuggc

SEQ ID NO: 710728 - RNA, 15 nt, Homo sapiens
caguagcacaaguua

SEQ ID NO: 710729 - RNA, 16 nt, Homo sapiens
cagugcccucauuuua

SEQ ID NO: 710730 - RNA, 16 nt, Homo sapiens
cagugccucaugccug

SEQ ID NO: 710731 - RNA, 17 nt, Homo sapiens
caguuaucuaaguuaau

SEQ ID NO: 710732 - RNA, 17 nt, Homo sapiens
caguugggacuacaggc

SEQ ID NO: 710733 - RNA, 12 nt, Homo sapiens
caguuugcaauu

SEQ ID NO: 710734 - RNA, 21 nt, Homo sapiens
cauaaagucuuugaagugacu

SEQ ID NO: 710735 - RNA, 17 nt, Homo sapiens
cauacacccauuucucu

SEQ ID NO: 710736 - RNA, 21 nt, Homo sapiens
cauacggcucuaacagauuag

SEQ ID NO: 710737 - RNA, 18 nt, Homo sapiens
caucauggcuaucugugg

SEQ ID NO: 710738 - RNA, 16 nt, Homo sapiens
cauccaagcaaacuga

SEQ ID NO: 710739 - RNA, 24 nt, Homo sapiens
cauccauguuccgagaagaacaga

SEQ ID NO: 710740 - RNA, 22 nt, Homo sapiens
caucgcuuuauuggcugagaua

SEQ ID NO: 710741 - RNA, 16 nt, Homo sapiens
caucugaggaaugaga

SEQ ID NO: 710742 - RNA, 21 nt, Homo sapiens
caucuuucuuccaaacaggcu

SEQ ID NO: 710743 - RNA, 14 nt, Homo sapiens
caugcacacaaaca

SEQ ID NO: 710744 - RNA, 18 nt, Homo sapiens
caugcacccucauacaca

SEQ ID NO: 710745 - RNA, 23 nt, Homo sapiens
caugguuauuccccccuacuuga

SEQ ID NO: 710746 - RNA, 17 nt, Homo sapiens
cauguaucuaugcauuu

SEQ ID NO: 710747 - RNA, 21 nt, Homo sapiens
caugucuauuagcuccacaaa

SEQ ID NO: 710748 - RNA, 16 nt, Homo sapiens
cauguguuuacuuuau

SEQ ID NO: 710749 - RNA, 24 nt, Homo sapiens
cauguuagccaggcuggucucaaa

SEQ ID NO: 710750 - RNA, 17 nt, Homo sapiens
cauguuggauagucagc

SEQ ID NO: 710751 - RNA, 13 nt, Homo sapiens
cauuacugcaugc

SEQ ID NO: 710752 - RNA, 18 nt, Homo sapiens
cauuguaaaugaacauaa

SEQ ID NO: 710753 - RNA, 18 nt, Homo sapiens
cauuguagaaaagcuaua

SEQ ID NO: 710754 - RNA, 16 nt, Homo sapiens
gccuugguauagcaua

SEQ ID NO: 710755 - RNA, 20 nt, Homo sapiens
gccuugucacgccagacuuc

SEQ ID NO: 710756 - RNA, 19 nt, Homo sapiens
gcgaagcguuguccucagc

SEQ ID NO: 710757 - RNA, 22 nt, Homo sapiens
gcguguuucugacucugagcua

SEQ ID NO: 710758 - RNA, 15 nt, Homo sapiens
gcuaccuacugauaa

SEQ ID NO: 710759 - RNA, 23 nt, Homo sapiens
gcuacugccgucagugcugugcu

SEQ ID NO: 710760 - RNA, 21 nt, Homo sapiens
gcuagguggguugaaagccaa

SEQ ID NO: 710761 - RNA, 23 nt, Homo sapiens
gcuaugcaggguagcacugggaa

SEQ ID NO: 710762 - RNA, 22 nt, Homo sapiens
gcuauuucaucuauuuuuggca

SEQ ID NO: 710763 - RNA, 22 nt, Homo sapiens
gcucccacaggcaccagcaaaa

SEQ ID NO: 710764 - RNA, 13 nt, Homo sapiens
gcuccuguuucca

SEQ ID NO: 710765 - RNA, 20 nt, Homo sapiens
gcugcuagagugacucacua

SEQ ID NO: 710766 - RNA, 17 nt, Homo sapiens
gcugcuuauaguuugcu

SEQ ID NO: 710767 - RNA, 21 nt, Homo sapiens
gcugguuucuuucaugcuccu

SEQ ID NO: 710768 - RNA, 14 nt, Homo sapiens
gcuguacacugcac

SEQ ID NO: 710769 - RNA, 17 nt, Homo sapiens
gcuguggccaggaggug

SEQ ID NO: 710770 - RNA, 16 nt, Homo sapiens
gcuguuugaaaugcca

SEQ ID NO: 710771 - RNA, 18 nt, Homo sapiens
gcuuccuucauuuccucc

SEQ ID NO: 710772 - RNA, 16 nt, Homo sapiens
gcuucuggccaggaag

SEQ ID NO: 710773 - RNA, 16 nt, Homo sapiens
gcuuguugugcuuuua

SEQ ID NO: 710774 - RNA, 16 nt, Homo sapiens
gcuuuaauuucaugaa

SEQ ID NO: 710775 - RNA, 12 nt, Homo sapiens
gcuuuguggcac

SEQ ID NO: 710776 - RNA, 16 nt, Homo sapiens
ggaacaaaagcgaaac

SEQ ID NO: 710777 - RNA, 15 nt, Homo sapiens
ggaacaggagaccca

SEQ ID NO: 710778 - RNA, 15 nt, Homo sapiens
ggaacccaccaaacc

SEQ ID NO: 710779 - RNA, 12 nt, Homo sapiens
ggaaucacuguu

SEQ ID NO: 710780 - RNA, 21 nt, Homo sapiens
ggaaucacuguuuagaacaca

SEQ ID NO: 710781 - RNA, 22 nt, Homo sapiens
ggacaggauguguuugcuuucu

SEQ ID NO: 710782 - RNA, 18 nt, Homo sapiens
ggacaugcuuuggcaauu

SEQ ID NO: 710783 - RNA, 16 nt, Homo sapiens
ggaccagccucuccac

SEQ ID NO: 710784 - RNA, 23 nt, Homo sapiens
ggacuauggagugcaccaaagag

SEQ ID NO: 710785 - RNA, 15 nt, Homo sapiens
ggagauguccugaau

SEQ ID NO: 710786 - RNA, 14 nt, Homo sapiens
ggaggccauugugu

SEQ ID NO: 710787 - RNA, 13 nt, Homo sapiens
ggagggcaggcau

SEQ ID NO: 710788 - RNA, 14 nt, Homo sapiens
ggagugcaccaaag

SEQ ID NO: 710789 - RNA, 20 nt, Homo sapiens
ggauacgacaguacacuguc

SEQ ID NO: 710790 - RNA, 20 nt, Homo sapiens
ggauagucagcuguaccaag

SEQ ID NO: 710791 - RNA, 21 nt, Homo sapiens
ggaugagggaaaagaaaaaga

SEQ ID NO: 710792 - RNA, 16 nt, Homo sapiens
ggaugugcauucucca

SEQ ID NO: 710793 - RNA, 16 nt, Homo sapiens
ggauuaccaguagaug

SEQ ID NO: 710794 - RNA, 16 nt, Homo sapiens
ggcaacgcacaaaaca

SEQ ID NO: 710795 - RNA, 23 nt, Homo sapiens
ggcacugagaccuccacccacug

SEQ ID NO: 710796 - RNA, 22 nt, Homo sapiens
ggcagccucugggggguggcca

SEQ ID NO: 710797 - RNA, 19 nt, Homo sapiens
ggcaugaaggugucauaca

SEQ ID NO: 710798 - RNA, 22 nt, Homo sapiens
ggcuccaccccauccaguucau

SEQ ID NO: 710799 - RNA, 21 nt, Homo sapiens
ggcuccucgagaucccaacac

SEQ ID NO: 710800 - RNA, 19 nt, Homo sapiens
ggcuggagugcaguggcgu

SEQ ID NO: 710801 - RNA, 22 nt, Homo sapiens
ggcugucagauauaaguaacuu

SEQ ID NO: 710802 - RNA, 17 nt, Homo sapiens
ggcuuccuucauuuccu

SEQ ID NO: 710803 - RNA, 23 nt, Homo sapiens
gggaagagagccugcaggaucuc

SEQ ID NO: 710804 - RNA, 16 nt, Homo sapiens
gggaaggggaaggaua

SEQ ID NO: 710805 - RNA, 15 nt, Homo sapiens
gggaauggauccugg

SEQ ID NO: 710806 - RNA, 15 nt, Homo sapiens
gggagccauguuuca

SEQ ID NO: 710807 - RNA, 23 nt, Homo sapiens
gggaggcucuggagcccacugua

SEQ ID NO: 710808 - RNA, 19 nt, Homo sapiens
gggcacugucuguguccuu

SEQ ID NO: 710809 - RNA, 15 nt, Homo sapiens
gggccucuucugcuu

SEQ ID NO: 710810 - RNA, 23 nt, Homo sapiens
gggcucaggaggggaaguccagc

SEQ ID NO: 710811 - RNA, 18 nt, Homo sapiens
gggcuccgugugggagac

SEQ ID NO: 710812 - RNA, 14 nt, Homo sapiens
gguaauuguugcua

SEQ ID NO: 710813 - RNA, 18 nt, Homo sapiens
gguacuuguaaauuauua

SEQ ID NO: 710814 - RNA, 14 nt, Homo sapiens
gguauuagcaccuc

SEQ ID NO: 710815 - RNA, 12 nt, Homo sapiens
gguauuuagcca

SEQ ID NO: 710816 - RNA, 13 nt, Homo sapiens
ggucaggccuuug

SEQ ID NO: 710817 - RNA, 12 nt, Homo sapiens
ggucccaagaca

SEQ ID NO: 710818 - RNA, 18 nt, Homo sapiens
ggugaacaaaguuuacca

SEQ ID NO: 710819 - RNA, 22 nt, Homo sapiens
ggugucauacagauuugcaaag

SEQ ID NO: 710820 - RNA, 14 nt, Homo sapiens
gguucaacuuauua

SEQ ID NO: 710821 - RNA, 19 nt, Homo sapiens
gguucagcuaagcuaggaa

SEQ ID NO: 710822 - RNA, 21 nt, Homo sapiens
guaacaaaaauaaaaacucuu

SEQ ID NO: 710823 - RNA, 14 nt, Homo sapiens
guaacaagccagau

SEQ ID NO: 710824 - RNA, 16 nt, Homo sapiens
guaacucaucugucac

SEQ ID NO: 710825 - RNA, 16 nt, Homo sapiens
guaauaaaacaaguua

SEQ ID NO: 710826 - RNA, 22 nt, Homo sapiens
guaauuuguuuaaaaaguaaua

SEQ ID NO: 710827 - RNA, 15 nt, Homo sapiens
guacaagcauucugu

SEQ ID NO: 710828 - RNA, 16 nt, Homo sapiens
guacacagcaccagaa

SEQ ID NO: 710829 - RNA, 13 nt, Homo sapiens
guacuaaagccaa

SEQ ID NO: 710830 - RNA, 23 nt, Homo sapiens
guagauauuggacaaagaaccuu

SEQ ID NO: 710831 - RNA, 13 nt, Homo sapiens
guagcacugggaa

SEQ ID NO: 710832 - RNA, 20 nt, Homo sapiens
guauaagccaucaauauuca

SEQ ID NO: 710833 - RNA, 13 nt, Homo sapiens
guauauccaaaag

SEQ ID NO: 710834 - RNA, 18 nt, Homo sapiens
guauuaugucucuucuga

SEQ ID NO: 710835 - RNA, 22 nt, Homo sapiens
guccaaaauaaaaccucagcua

SEQ ID NO: 710836 - RNA, 14 nt, Homo sapiens
guccuuccuugaac

SEQ ID NO: 710837 - RNA, 18 nt, Homo sapiens
guccuuccuugaacuguc

SEQ ID NO: 710838 - RNA, 21 nt, Homo sapiens
gucuacuugcucagguacuug

SEQ ID NO: 710839 - RNA, 21 nt, Homo sapiens
gucucucaugaaccucaagcu

SEQ ID NO: 710840 - RNA, 20 nt, Homo sapiens
gucuucuuuuugaaacaauu

SEQ ID NO: 710841 - RNA, 23 nt, Homo sapiens
gucuuugaagugacuucacagag

SEQ ID NO: 710842 - RNA, 22 nt, Homo sapiens
gugaccuguaaaaaguacucaa

SEQ ID NO: 710843 - RNA, 19 nt, Homo sapiens
gugacuaauggcaugagaa

SEQ ID NO: 710844 - RNA, 14 nt, Homo sapiens
gugacucuuuccaa

SEQ ID NO: 710845 - RNA, 17 nt, Homo sapiens
gugaguugcacagcuau

SEQ ID NO: 710846 - RNA, 18 nt, Homo sapiens
gugauacuguacauagcu

SEQ ID NO: 710847 - RNA, 20 nt, Homo sapiens
gugauacuguacauagcugu

SEQ ID NO: 710848 - RNA, 20 nt, Homo sapiens
gugcugggauuacaggugua

SEQ ID NO: 710849 - RNA, 15 nt, Homo sapiens
guggaacaagcacag

SEQ ID NO: 710850 - RNA, 21 nt, Homo sapiens
guggagguauugccuugugaa

SEQ ID NO: 710851 - RNA, 15 nt, Homo sapiens
guggcauuuucacuu

SEQ ID NO: 710852 - RNA, 20 nt, Homo sapiens
guggcccuuaugacugccaa

SEQ ID NO: 710853 - RNA, 14 nt, Homo sapiens
guggugugcugcuu

SEQ ID NO: 710854 - RNA, 16 nt, Homo sapiens
gugguguuucuguaag

SEQ ID NO: 710855 - RNA, 17 nt, Homo sapiens
gugucuggcaguuuaua

SEQ ID NO: 710856 - RNA, 19 nt, Homo sapiens
guguuacccaguaacucau

SEQ ID NO: 710857 - RNA, 16 nt, Homo sapiens
guguuccccacuguau

SEQ ID NO: 710858 - RNA, 15 nt, Homo sapiens
guuaccuacuuugac

SEQ ID NO: 710859 - RNA, 18 nt, Homo sapiens
guuagauaugugccaaag

SEQ ID NO: 710860 - RNA, 19 nt, Homo sapiens
guuaguggauuacugccau

SEQ ID NO: 710861 - RNA, 19 nt, Homo sapiens
guucaacuuuuccuuugaa

SEQ ID NO: 710862 - RNA, 11 nt, Homo sapiens
guucuuaccug

SEQ ID NO: 710863 - RNA, 12 nt, Homo sapiens
guugaaagccaa

SEQ ID NO: 710864 - RNA, 16 nt, Homo sapiens
guugaauuucccacau

SEQ ID NO: 710865 - RNA, 17 nt, Homo sapiens
guugauuacagugcagu

SEQ ID NO: 710866 - RNA, 18 nt, Homo sapiens
guugauuacagugcagug

SEQ ID NO: 710867 - RNA, 16 nt, Homo sapiens
guugcuggacugucau

SEQ ID NO: 710868 - RNA, 13 nt, Homo sapiens
guuggaacauccu

SEQ ID NO: 710869 - RNA, 24 nt, Homo sapiens
guuuccauaggaaucauguuggau

SEQ ID NO: 710870 - RNA, 12 nt, Homo sapiens
guuuucucugaa

SEQ ID NO: 710871 - RNA, 19 nt, Homo sapiens
guuuucugcuuuaauuuca

SEQ ID NO: 710872 - RNA, 20 nt, Homo sapiens
guuuuuaauuuaucagagac

SEQ ID NO: 710873 - RNA, 22 nt, Homo sapiens
acuccuccagccaccacccaca

SEQ ID NO: 710874 - RNA, 15 nt, Homo sapiens
acugaggaauuucac

SEQ ID NO: 710875 - RNA, 17 nt, Homo sapiens
acugcugauauuuucuc

SEQ ID NO: 710876 - RNA, 14 nt, Homo sapiens
acuggucucuggcu

SEQ ID NO: 710877 - RNA, 21 nt, Homo sapiens
acuggucuuguggaauuggga

SEQ ID NO: 710878 - RNA, 14 nt, Homo sapiens
acugucucucauga

SEQ ID NO: 710879 - RNA, 19 nt, Homo sapiens
acuguggacuccaugccuc

SEQ ID NO: 710880 - RNA, 16 nt, Homo sapiens
acuguguauuccaaga

SEQ ID NO: 710881 - RNA, 23 nt, Homo sapiens
acuuaggaaauggcuuugugauu

SEQ ID NO: 710882 - RNA, 14 nt, Homo sapiens
acuucccacggcuc

SEQ ID NO: 710883 - RNA, 12 nt, Homo sapiens
acuugacagugg

SEQ ID NO: 710884 - RNA, 15 nt, Homo sapiens
acuugagauaaucua

SEQ ID NO: 710885 - RNA, 14 nt, Homo sapiens
acuugucccgggac

SEQ ID NO: 710886 - RNA, 19 nt, Homo sapiens
acuugucccgggacaccua

SEQ ID NO: 710887 - RNA, 23 nt, Homo sapiens
acuuguguuuuauuaacauugau

SEQ ID NO: 710888 - RNA, 19 nt, Homo sapiens
acuuuaaagcguuugcaca

SEQ ID NO: 710889 - RNA, 18 nt, Homo sapiens
acuuuauguuacuacaug

SEQ ID NO: 710890 - RNA, 16 nt, Homo sapiens
acuuuauuugccuaaa

SEQ ID NO: 710891 - RNA, 17 nt, Homo sapiens
acuuucucaguuuucau

SEQ ID NO: 710892 - RNA, 16 nt, Homo sapiens
acuuugagcuacugcc

SEQ ID NO: 710893 - RNA, 14 nt, Homo sapiens
acuuuuccuuugaa

SEQ ID NO: 710894 - RNA, 15 nt, Homo sapiens
acuuuuggcuuguaa

SEQ ID NO: 710895 - RNA, 15 nt, Homo sapiens
acuuuuugcauuuaa

SEQ ID NO: 710896 - RNA, 15 nt, Homo sapiens
agaaaacauaaucuu

SEQ ID NO: 710897 - RNA, 21 nt, Homo sapiens
agaaaauaguuuggauuacuu

SEQ ID NO: 710898 - RNA, 12 nt, Homo sapiens
agaaaggcauga

SEQ ID NO: 710899 - RNA, 18 nt, Homo sapiens
agaaauauuugugacaaa

SEQ ID NO: 710900 - RNA, 13 nt, Homo sapiens
agaaguuugcacu

SEQ ID NO: 710901 - RNA, 17 nt, Homo sapiens
agaauccaguuugcaau

SEQ ID NO: 710902 - RNA, 22 nt, Homo sapiens
agaauccaguuugcaauuacuu

SEQ ID NO: 710903 - RNA, 23 nt, Homo sapiens
agaauccaguuugcaauuacuuu

SEQ ID NO: 710904 - RNA, 16 nt, Homo sapiens
agaauucaacaguuac

SEQ ID NO: 710905 - RNA, 14 nt, Homo sapiens
agacagugagacag

SEQ ID NO: 710906 - RNA, 15 nt, Homo sapiens
agacaguucaagaaa

SEQ ID NO: 710907 - RNA, 23 nt, Homo sapiens
agacauuaacucauuagacugga

SEQ ID NO: 710908 - RNA, 22 nt, Homo sapiens
agaccucucaacagaucugugg

SEQ ID NO: 710909 - RNA, 16 nt, Homo sapiens
agaccucugugcacuu

SEQ ID NO: 710910 - RNA, 23 nt, Homo sapiens
agaccuguugguuagcuggacau

SEQ ID NO: 710911 - RNA, 21 nt, Homo sapiens
agacuaucuuacuauuucaca

SEQ ID NO: 710912 - RNA, 16 nt, Homo sapiens
agacucagcucugaca

SEQ ID NO: 710913 - RNA, 18 nt, Homo sapiens
agacuggaacuugaacug

SEQ ID NO: 710914 - RNA, 16 nt, Homo sapiens
agagacgcagacaugu

SEQ ID NO: 710915 - RNA, 20 nt, Homo sapiens
agagagccugcaggaucuca

SEQ ID NO: 710916 - RNA, 18 nt, Homo sapiens
agagcagaacccuagucu

SEQ ID NO: 710917 - RNA, 12 nt, Homo sapiens
agaguugaaccu

SEQ ID NO: 710918 - RNA, 13 nt, Homo sapiens
agauaaguuauuu

SEQ ID NO: 710919 - RNA, 14 nt, Homo sapiens
agauacauacagaa

SEQ ID NO: 710920 - RNA, 18 nt, Homo sapiens
agauagguacuauuaucc

SEQ ID NO: 710921 - RNA, 20 nt, Homo sapiens
agaucacuuucucaguuuuc

SEQ ID NO: 710922 - RNA, 13 nt, Homo sapiens
agaucccaacacu

SEQ ID NO: 710923 - RNA, 17 nt, Homo sapiens
agauccuccucauucac

SEQ ID NO: 710924 - RNA, 15 nt, Homo sapiens
agaucgggagcaaac

SEQ ID NO: 710925 - RNA, 20 nt, Homo sapiens
agaucugugggcccagucau

SEQ ID NO: 710926 - RNA, 21 nt, Homo sapiens
agauggagucuggcucugucu

SEQ ID NO: 710927 - RNA, 21 nt, Homo sapiens
agauguugaaaaaaauugucu

SEQ ID NO: 710928 - RNA, 18 nt, Homo sapiens
agauucccacccaauuca

SEQ ID NO: 710929 - RNA, 21 nt, Homo sapiens
agauucccacccaauucaaaa

SEQ ID NO: 710930 - RNA, 23 nt, Homo sapiens
agauuguuccugcuuuuccccaa

SEQ ID NO: 710931 - RNA, 17 nt, Homo sapiens
agcaaccagagcacugu

SEQ ID NO: 710932 - RNA, 17 nt, Homo sapiens
agcaacucagaaugcuc

SEQ ID NO: 710933 - RNA, 20 nt, Homo sapiens
agcaacucagaaugcucuac

SEQ ID NO: 710934 - RNA, 18 nt, Homo sapiens
agcaccuacuuacaugca

SEQ ID NO: 710935 - RNA, 15 nt, Homo sapiens
agcacugccaccagu

SEQ ID NO: 710936 - RNA, 20 nt, Homo sapiens
agcagagacgggguuucacc

SEQ ID NO: 710937 - RNA, 23 nt, Homo sapiens
agcaggaggccaauaaaaaguuc

SEQ ID NO: 710938 - RNA, 19 nt, Homo sapiens
agcagguuaccacucuggc

SEQ ID NO: 710939 - RNA, 22 nt, Homo sapiens
agcauauguuuuuguaaguuua

SEQ ID NO: 710940 - RNA, 21 nt, Homo sapiens
agcauugacucuguggcuuug

SEQ ID NO: 710941 - RNA, 20 nt, Homo sapiens
agccaaggagucacugagac

SEQ ID NO: 710942 - RNA, 15 nt, Homo sapiens
agccacaccaggaua

SEQ ID NO: 710943 - RNA, 14 nt, Homo sapiens
agccacuaccuucu

SEQ ID NO: 710944 - RNA, 14 nt, Homo sapiens
agccacuucacuuu

SEQ ID NO: 710945 - RNA, 23 nt, Homo sapiens
agccaucaauauucagcaaaaug

SEQ ID NO: 710946 - RNA, 17 nt, Homo sapiens
agccccagugacagcua

SEQ ID NO: 710947 - RNA, 20 nt, Homo sapiens
agcccucagcccaccugggg

SEQ ID NO: 710948 - RNA, 23 nt, Homo sapiens
agccuaccccuccugcgcugccc

SEQ ID NO: 710949 - RNA, 13 nt, Homo sapiens
agccucaacuuac

SEQ ID NO: 710950 - RNA, 18 nt, Homo sapiens
agccugcagacucacugu

SEQ ID NO: 710951 - RNA, 17 nt, Homo sapiens
agccuucaauguaccug

SEQ ID NO: 710952 - RNA, 15 nt, Homo sapiens
agcgaaacacacaaa

SEQ ID NO: 710953 - RNA, 16 nt, Homo sapiens
agcgaaacacacaaac

SEQ ID NO: 710954 - RNA, 18 nt, Homo sapiens
agcgaaacacacaaacca

SEQ ID NO: 710955 - RNA, 19 nt, Homo sapiens
agcgauucucuugccucaa

SEQ ID NO: 710956 - RNA, 13 nt, Homo sapiens
agcuacaaaacaa

SEQ ID NO: 710957 - RNA, 15 nt, Homo sapiens
agcuacuauauguca

SEQ ID NO: 710958 - RNA, 21 nt, Homo sapiens
agcuacuugauguaacugaga

SEQ ID NO: 710959 - RNA, 15 nt, Homo sapiens
agcuagugcauugga

SEQ ID NO: 710960 - RNA, 14 nt, Homo sapiens
agcucacaguacaa

SEQ ID NO: 710961 - RNA, 16 nt, Homo sapiens
agcucugacauucuga

SEQ ID NO: 710962 - RNA, 23 nt, Homo sapiens
agcuguauuuugaugauugcuau

SEQ ID NO: 710963 - RNA, 22 nt, Homo sapiens
agcugucaucaauuaaaggcaa

SEQ ID NO: 710964 - RNA, 16 nt, Homo sapiens
agcuuaucuacuucca

SEQ ID NO: 710965 - RNA, 15 nt, Homo sapiens
agcuuuggaccuaau

SEQ ID NO: 710966 - RNA, 19 nt, Homo sapiens
agcuuuggaccuaauccaa

SEQ ID NO: 710967 - RNA, 22 nt, Homo sapiens
agcuuuucaaaauuggacuuaa

SEQ ID NO: 710968 - RNA, 22 nt, Homo sapiens
aggaacugggccaacucaccug

SEQ ID NO: 710969 - RNA, 17 nt, Homo sapiens
aggacuuuuauugugaa

SEQ ID NO: 710970 - RNA, 14 nt, Homo sapiens
aggagggaggugcu

SEQ ID NO: 710971 - RNA, 18 nt, Homo sapiens
aggaggugccacuggagu

SEQ ID NO: 710972 - RNA, 15 nt, Homo sapiens
aggagucacugagac

SEQ ID NO: 710973 - RNA, 13 nt, Homo sapiens
aggaguuuugcaa

SEQ ID NO: 710974 - RNA, 20 nt, Homo sapiens
aggcacccaaaccccggggc

SEQ ID NO: 710975 - RNA, 21 nt, Homo sapiens
aggcagggaaggaucccauga

SEQ ID NO: 710976 - RNA, 13 nt, Homo sapiens
aggcaugaaauga

SEQ ID NO: 710977 - RNA, 20 nt, Homo sapiens
aggcaugagccaccgcgccu

SEQ ID NO: 710978 - RNA, 22 nt, Homo sapiens
aggccacccgcacaaaauucac

SEQ ID NO: 710979 - RNA, 15 nt, Homo sapiens
aggccagaugcacau

SEQ ID NO: 710980 - RNA, 12 nt, Homo sapiens
aggcccugagaa

SEQ ID NO: 710981 - RNA, 14 nt, Homo sapiens
aggcggugcuugau

SEQ ID NO: 710982 - RNA, 20 nt, Homo sapiens
aggcgugagccaccaugccc

SEQ ID NO: 710983 - RNA, 13 nt, Homo sapiens
aggcuggucucaa

SEQ ID NO: 710984 - RNA, 12 nt, Homo sapiens
agggccaaagaa

SEQ ID NO: 710985 - RNA, 21 nt, Homo sapiens
agggggccuuuaaagacuuaa

SEQ ID NO: 710986 - RNA, 15 nt, Homo sapiens
aggguagcacuggga

SEQ ID NO: 710987 - RNA, 17 nt, Homo sapiens
aggguuaaccacugugg

SEQ ID NO: 710988 - RNA, 23 nt, Homo sapiens
agguauuacacucuguaauugaa

SEQ ID NO: 710989 - RNA, 20 nt, Homo sapiens
aggucagcagccucccugaa

SEQ ID NO: 710990 - RNA, 16 nt, Homo sapiens
aggucagucuucuucc

SEQ ID NO: 710991 - RNA, 18 nt, Homo sapiens
aggugagcaggugaugcc

SEQ ID NO: 710992 - RNA, 16 nt, Homo sapiens
agguuacaagccugca

SEQ ID NO: 710993 - RNA, 18 nt, Homo sapiens
aguacauuguuaccucua

SEQ ID NO: 710994 - RNA, 14 nt, Homo sapiens
aguagaaucucagu

SEQ ID NO: 710995 - RNA, 19 nt, Homo sapiens
aguaucacaucacacaaaa

SEQ ID NO: 710996 - RNA, 16 nt, Homo sapiens
aguauucaugacuaug

SEQ ID NO: 710997 - RNA, 20 nt, Homo sapiens
agucagcuguaccaagcccc

SEQ ID NO: 710998 - RNA, 21 nt, Homo sapiens
agucccucaugcaaaucaauu

SEQ ID NO: 710999 - RNA, 19 nt, Homo sapiens
agucuaucaaccccagaca

SEQ ID NO: 711000 - RNA, 23 nt, Homo sapiens
agucuaucaaccccagacacugg

SEQ ID NO: 711001 - RNA, 14 nt, Homo sapiens
agucugaaccuauu

SEQ ID NO: 711002 - RNA, 14 nt, Homo sapiens
agucuuaauauaua

SEQ ID NO: 711003 - RNA, 19 nt, Homo sapiens
agucuuccugacacuuuaa

SEQ ID NO: 711004 - RNA, 13 nt, Homo sapiens
agugaacuugaaa

SEQ ID NO: 711005 - RNA, 22 nt, Homo sapiens
cuaggcuaggguggggagagac

SEQ ID NO: 711006 - RNA, 13 nt, Homo sapiens
cuagucauaaccu

SEQ ID NO: 711007 - RNA, 23 nt, Homo sapiens
cuagugcaguuuuuuucuugucu

SEQ ID NO: 711008 - RNA, 17 nt, Homo sapiens
cuaguucugccaggaga

SEQ ID NO: 711009 - RNA, 14 nt, Homo sapiens
cuauaaaaugaaua

SEQ ID NO: 711010 - RNA, 17 nt, Homo sapiens
cuauccuccuaccucca

SEQ ID NO: 711011 - RNA, 18 nt, Homo sapiens
cuaucuucuuucacauau

SEQ ID NO: 711012 - RNA, 22 nt, Homo sapiens
cuaugaaggcuguacacugcac

SEQ ID NO: 711013 - RNA, 22 nt, Homo sapiens
cuaugauauuuucugugccuga

SEQ ID NO: 711014 - RNA, 22 nt, Homo sapiens
cucaaagagggagugcauuuau

SEQ ID NO: 711015 - RNA, 23 nt, Homo sapiens
cucagacagaaccccuacaugaa

SEQ ID NO: 711016 - RNA, 23 nt, Homo sapiens
cucagagaauuucuaccauuuca

SEQ ID NO: 711017 - RNA, 14 nt, Homo sapiens
cucagagacauaca

SEQ ID NO: 711018 - RNA, 18 nt, Homo sapiens
cucagaggguguccugca

SEQ ID NO: 711019 - RNA, 23 nt, Homo sapiens
cucagauaagguaaaaugccaug

SEQ ID NO: 711020 - RNA, 21 nt, Homo sapiens
cucaggcaaucugcccgccug

SEQ ID NO: 711021 - RNA, 14 nt, Homo sapiens
cucauacacagaaa

SEQ ID NO: 711022 - RNA, 14 nt, Homo sapiens
cucaugaaccucaa

SEQ ID NO: 711023 - RNA, 18 nt, Homo sapiens
cucaugugacucuuucca

SEQ ID NO: 711024 - RNA, 13 nt, Homo sapiens
cucauuagacugg

SEQ ID NO: 711025 - RNA, 17 nt, Homo sapiens
cucauucugaggccuga

SEQ ID NO: 711026 - RNA, 14 nt, Homo sapiens
cucauuguagaaaa

SEQ ID NO: 711027 - RNA, 22 nt, Homo sapiens
cuccaaaaaagaaacauuguua

SEQ ID NO: 711028 - RNA, 16 nt, Homo sapiens
cuccacccacugugga

SEQ ID NO: 711029 - RNA, 13 nt, Homo sapiens
cucccagccuacc

SEQ ID NO: 711030 - RNA, 17 nt, Homo sapiens
cuccccuccaucccugg

SEQ ID NO: 711031 - RNA, 12 nt, Homo sapiens
cuccucagggac

SEQ ID NO: 711032 - RNA, 18 nt, Homo sapiens
cuccucagggacucaggu

SEQ ID NO: 711033 - RNA, 14 nt, Homo sapiens
cuccucauucacau

SEQ ID NO: 711034 - RNA, 21 nt, Homo sapiens
cuccucccaggaacugggcca

SEQ ID NO: 711035 - RNA, 22 nt, Homo sapiens
cuccuuuggaaugcuguauuaa

SEQ ID NO: 711036 - RNA, 16 nt, Homo sapiens
cucuaauacauuccaa

SEQ ID NO: 711037 - RNA, 20 nt, Homo sapiens
cucuauauaccaaagcacau

SEQ ID NO: 711038 - RNA, 12 nt, Homo sapiens
cucucucugugu

SEQ ID NO: 711039 - RNA, 12 nt, Homo sapiens
cucugaacacau

SEQ ID NO: 711040 - RNA, 13 nt, Homo sapiens
cucugauauggcu

SEQ ID NO: 711041 - RNA, 13 nt, Homo sapiens
cucugcccgggag

SEQ ID NO: 711042 - RNA, 14 nt, Homo sapiens
cucuucaaaugccu

SEQ ID NO: 711043 - RNA, 22 nt, Homo sapiens
cugaaagccauggagauucuca

SEQ ID NO: 711044 - RNA, 18 nt, Homo sapiens
cugaagaaucacaauaau

SEQ ID NO: 711045 - RNA, 19 nt, Homo sapiens
cugaaggcugaaagacagg

SEQ ID NO: 711046 - RNA, 15 nt, Homo sapiens
cugaauggcaaugaa

SEQ ID NO: 711047 - RNA, 17 nt, Homo sapiens
cugaccaagauacuuaa

SEQ ID NO: 711048 - RNA, 23 nt, Homo sapiens
cugaccucgugauccaccugccu

SEQ ID NO: 711049 - RNA, 14 nt, Homo sapiens
cugagagaggccau

SEQ ID NO: 711050 - RNA, 19 nt, Homo sapiens
cugagcaaaucaccacaaa

SEQ ID NO: 711051 - RNA, 17 nt, Homo sapiens
cugagcaccuacuuaca

SEQ ID NO: 711052 - RNA, 14 nt, Homo sapiens
cugagcccaaggca

SEQ ID NO: 711053 - RNA, 13 nt, Homo sapiens
cugagcuauuuca

SEQ ID NO: 711054 - RNA, 15 nt, Homo sapiens
cugagggcauuaaaa

SEQ ID NO: 711055 - RNA, 21 nt, Homo sapiens
cugaguaucacaucacacaaa

SEQ ID NO: 711056 - RNA, 22 nt, Homo sapiens
cugauaauauguuugagguuaa

SEQ ID NO: 711057 - RNA, 22 nt, Homo sapiens
cugauuaggacuuuuauuguga

SEQ ID NO: 711058 - RNA, 19 nt, Homo sapiens
cugcaccggggccugggca

SEQ ID NO: 711059 - RNA, 19 nt, Homo sapiens
cugcagacucacuguggga

SEQ ID NO: 711060 - RNA, 14 nt, Homo sapiens
cugcaggaucucac

SEQ ID NO: 711061 - RNA, 23 nt, Homo sapiens
cugcaugcacuucuuacaauaau

SEQ ID NO: 711062 - RNA, 15 nt, Homo sapiens
cugcccagugcacuu

SEQ ID NO: 711063 - RNA, 17 nt, Homo sapiens
cugccucccaugccugg

SEQ ID NO: 711064 - RNA, 22 nt, Homo sapiens
cugccugguaugaguugcccau

SEQ ID NO: 711065 - RNA, 13 nt, Homo sapiens
cuggaaagugaug

SEQ ID NO: 711066 - RNA, 14 nt, Homo sapiens
cuggaauacaugaa

SEQ ID NO: 711067 - RNA, 17 nt, Homo sapiens
cuggaaucagcucagga

SEQ ID NO: 711068 - RNA, 11 nt, Homo sapiens
cuggacuguca

SEQ ID NO: 711069 - RNA, 12 nt, Homo sapiens
cuggagcccacu

SEQ ID NO: 711070 - RNA, 14 nt, Homo sapiens
cuggaugacauuaa

SEQ ID NO: 711071 - RNA, 22 nt, Homo sapiens
cuggaugacauuaaagaagggu

SEQ ID NO: 711072 - RNA, 16 nt, Homo sapiens
cuggcucuuugcugug

SEQ ID NO: 711073 - RNA, 15 nt, Homo sapiens
cugggagcacuuugu

SEQ ID NO: 711074 - RNA, 15 nt, Homo sapiens
cuggggaguuuacua

SEQ ID NO: 711075 - RNA, 19 nt, Homo sapiens
cuggggcugagggcauuaa

SEQ ID NO: 711076 - RNA, 23 nt, Homo sapiens
cugggggccucuucugcuuucuc

SEQ ID NO: 711077 - RNA, 19 nt, Homo sapiens
cuggguaacugucaaguca

SEQ ID NO: 711078 - RNA, 17 nt, Homo sapiens
cugguaguucauuguaa

SEQ ID NO: 711079 - RNA, 13 nt, Homo sapiens
cuggucuugugga

SEQ ID NO: 711080 - RNA, 18 nt, Homo sapiens
cuggugguggcucgggag

SEQ ID NO: 711081 - RNA, 23 nt, Homo sapiens
cuguaaacuguguauuccaagac

SEQ ID NO: 711082 - RNA, 19 nt, Homo sapiens
cuguaauguuaauauugau

SEQ ID NO: 711083 - RNA, 15 nt, Homo sapiens
cugucaccaagccuu

SEQ ID NO: 711084 - RNA, 19 nt, Homo sapiens
cugucucucaugaaccuca

SEQ ID NO: 711085 - RNA, 22 nt, Homo sapiens
cugucuggauccuauccuccua

SEQ ID NO: 711086 - RNA, 22 nt, Homo sapiens
cugugccccuugacaacuggca

SEQ ID NO: 711087 - RNA, 22 nt, Homo sapiens
cuguguaagggccagaaauauc

SEQ ID NO: 711088 - RNA, 13 nt, Homo sapiens
cuguguauuccaa

SEQ ID NO: 711089 - RNA, 24 nt, Homo sapiens
cuguguuacccaguaacucaucug

SEQ ID NO: 711090 - RNA, 18 nt, Homo sapiens
cuguuauuuaauuagcca

SEQ ID NO: 711091 - RNA, 14 nt, Homo sapiens
cuguugcaccucag

SEQ ID NO: 711092 - RNA, 19 nt, Homo sapiens
cuguuuuugucuacacucu

SEQ ID NO: 711093 - RNA, 16 nt, Homo sapiens
cuuaaaaaugccaaaa

SEQ ID NO: 711094 - RNA, 14 nt, Homo sapiens
cuuaaaaucuaauu

SEQ ID NO: 711095 - RNA, 14 nt, Homo sapiens
cuuaaauccauccu

SEQ ID NO: 711096 - RNA, 22 nt, Homo sapiens
cuuacaauaauucuaugagaua

SEQ ID NO: 711097 - RNA, 15 nt, Homo sapiens
cuuacaugcauuacu

SEQ ID NO: 711098 - RNA, 19 nt, Homo sapiens
cuuauauggaaauucugcu

SEQ ID NO: 711099 - RNA, 13 nt, Homo sapiens
cuuaugaaccuuu

SEQ ID NO: 711100 - RNA, 20 nt, Homo sapiens
cuuaugguaccagaugcagc

SEQ ID NO: 711101 - RNA, 18 nt, Homo sapiens
cuuauugccucacuucag

SEQ ID NO: 711102 - RNA, 17 nt, Homo sapiens
cuuauuuuugacagugu

SEQ ID NO: 711103 - RNA, 13 nt, Homo sapiens
cuucagcucugaa

SEQ ID NO: 711104 - RNA, 14 nt, Homo sapiens
cuuccagaaaacaa

SEQ ID NO: 711105 - RNA, 18 nt, Homo sapiens
cuuccaucugauugugau

SEQ ID NO: 711106 - RNA, 21 nt, Homo sapiens
cuuccuaaauauuaugagaug

SEQ ID NO: 711107 - RNA, 16 nt, Homo sapiens
cuuccuugaacugucu

SEQ ID NO: 711108 - RNA, 17 nt, Homo sapiens
cuuccuugaacugucua

SEQ ID NO: 711109 - RNA, 18 nt, Homo sapiens
cuucuauuccauggcuaa

SEQ ID NO: 711110 - RNA, 21 nt, Homo sapiens
cuucucuguucauuuccucaa

SEQ ID NO: 711111 - RNA, 21 nt, Homo sapiens
cuucuggacugguuuucacau

SEQ ID NO: 711112 - RNA, 21 nt, Homo sapiens
cuucuuacaauaauucuauga

SEQ ID NO: 711113 - RNA, 18 nt, Homo sapiens
cuucuuuuggacaaaccu

SEQ ID NO: 711114 - RNA, 20 nt, Homo sapiens
cuucuuuuuuuuugagaugg

SEQ ID NO: 711115 - RNA, 22 nt, Homo sapiens
cuugaacugucuacccuguugc

SEQ ID NO: 711116 - RNA, 21 nt, Homo sapiens
cuugaagaggaaacucuguca

SEQ ID NO: 711117 - RNA, 19 nt, Homo sapiens
cuugacccugagcugacca

SEQ ID NO: 711118 - RNA, 14 nt, Homo sapiens
cuugauuuuagccu

SEQ ID NO: 711119 - RNA, 21 nt, Homo sapiens
cuugggaaaggugguguuucu

SEQ ID NO: 711120 - RNA, 15 nt, Homo sapiens
cuugguauagcauau

SEQ ID NO: 711121 - RNA, 17 nt, Homo sapiens
cuugucaugugacaggu

SEQ ID NO: 711122 - RNA, 21 nt, Homo sapiens
cuuguccccgggguauuagca

SEQ ID NO: 711123 - RNA, 15 nt, Homo sapiens
cuuuaaagugacuaa

SEQ ID NO: 711124 - RNA, 22 nt, Homo sapiens
cuuuaauuucaugaaaagauua

SEQ ID NO: 711125 - RNA, 15 nt, Homo sapiens
cuuuauuuugagaug

SEQ ID NO: 711126 - RNA, 16 nt, Homo sapiens
cuuuccaaccggcuuu

SEQ ID NO: 711127 - RNA, 19 nt, Homo sapiens
cuuuccaugggaccacaac

SEQ ID NO: 711128 - RNA, 13 nt, Homo sapiens
cuuucucuacuga

SEQ ID NO: 711129 - RNA, 22 nt, Homo sapiens
cuuuuccaugcacccucauaca

SEQ ID NO: 711130 - RNA, 12 nt, Homo sapiens
cuuuuuccagag

SEQ ID NO: 711131 - RNA, 17 nt, Homo sapiens
cuuuuuuaaaugaagaa

SEQ ID NO: 711132 - RNA, 22 nt, Homo sapiens
cuuuuuuuuuuuuuccuuugaa

SEQ ID NO: 711133 - RNA, 12 nt, Homo sapiens
gaaaaacuauua

SEQ ID NO: 711134 - RNA, 20 nt, Homo sapiens
gaaaagaaucggcaauguuu

SEQ ID NO: 711135 - RNA, 18 nt, Homo sapiens
gaaaagauuaugaucuca

SEQ ID NO: 711136 - RNA, 23 nt, Homo sapiens
gaaaagauucccacccaauucaa

SEQ ID NO: 711137 - RNA, 15 nt, Homo sapiens
gaaaaguaacuguuu

SEQ ID NO: 711138 - RNA, 16 nt, Homo sapiens
gaaaauugaaugcaaa

SEQ ID NO: 711139 - RNA, 14 nt, Homo sapiens
gaaagcccuaaaau

SEQ ID NO: 711140 - RNA, 12 nt, Homo sapiens
gaaagguggugu

SEQ ID NO: 711141 - RNA, 16 nt, Homo sapiens
gaaagugacuaccaga

SEQ ID NO: 711142 - RNA, 23 nt, Homo sapiens
gaaauacacagugcugaccagac

SEQ ID NO: 711143 - RNA, 20 nt, Homo sapiens
gaaaucucgucggaaggaca

SEQ ID NO: 711144 - RNA, 19 nt, Homo sapiens
gaaaucuggcuucuggcca

SEQ ID NO: 711145 - RNA, 10 nt, Homo sapiens
gaaccaaaga

SEQ ID NO: 711146 - RNA, 16 nt, Homo sapiens
gaacccaccaaaccaa

SEQ ID NO: 711147 - RNA, 13 nt, Homo sapiens
gaacuuaugcaaa

SEQ ID NO: 711148 - RNA, 14 nt, Homo sapiens
gaacuuugagcuac

SEQ ID NO: 711149 - RNA, 17 nt, Homo sapiens
gaagcaggguacccuuu

SEQ ID NO: 711150 - RNA, 18 nt, Homo sapiens
gaagccccauuugcacag

SEQ ID NO: 711151 - RNA, 12 nt, Homo sapiens
gaaggacacuca

SEQ ID NO: 711152 - RNA, 21 nt, Homo sapiens
gaaggacuaugaaaagcuaga

SEQ ID NO: 711153 - RNA, 16 nt, Homo sapiens
gaaggcuuguugugcu

SEQ ID NO: 711154 - RNA, 12 nt, Homo sapiens
gaaggugucaua

SEQ ID NO: 711155 - RNA, 13 nt, Homo sapiens
gaagguugcucua

SEQ ID NO: 711156 - RNA, 16 nt, Homo sapiens
gaaguuuucuugacuu

SEQ ID NO: 711157 - RNA, 13 nt, Homo sapiens
gaauagcuuccaa

SEQ ID NO: 711158 - RNA, 12 nt, Homo sapiens
gaaucacuguuu

SEQ ID NO: 711159 - RNA, 22 nt, Homo sapiens
gaaucacuguuuagaacacaca

SEQ ID NO: 711160 - RNA, 17 nt, Homo sapiens
gaauccgcccaucuggg

SEQ ID NO: 711161 - RNA, 23 nt, Homo sapiens
gaaucuuuaaaagaugcuuuuaa

SEQ ID NO: 711162 - RNA, 23 nt, Homo sapiens
gaauguagcccuuccaacaccug

SEQ ID NO: 711163 - RNA, 16 nt, Homo sapiens
gaauguuaagacuuga

SEQ ID NO: 711164 - RNA, 13 nt, Homo sapiens
gaauuaauggaau

SEQ ID NO: 711165 - RNA, 13 nt, Homo sapiens
gaauuucccacau

SEQ ID NO: 711166 - RNA, 16 nt, Homo sapiens
gaauuugccuguaaca

SEQ ID NO: 711167 - RNA, 18 nt, Homo sapiens
gacaacauuucuauagcc

SEQ ID NO: 711168 - RNA, 20 nt, Homo sapiens
gacaccugggagaaaucugg

SEQ ID NO: 711169 - RNA, 17 nt, Homo sapiens
gacacuuuaauuaccaa

SEQ ID NO: 711170 - RNA, 19 nt, Homo sapiens
gacagaaugagaccaaacg

SEQ ID NO: 711171 - RNA, 13 nt, Homo sapiens
gacaggauguguu

SEQ ID NO: 711172 - RNA, 23 nt, Homo sapiens
gacauacaccuaugucauuucau

SEQ ID NO: 711173 - RNA, 18 nt, Homo sapiens
gacauuccaaguuuuuca

SEQ ID NO: 711174 - RNA, 17 nt, Homo sapiens
gaccacugggcaaugau

SEQ ID NO: 711175 - RNA, 18 nt, Homo sapiens
gaccucccccucuugguc

SEQ ID NO: 711176 - RNA, 16 nt, Homo sapiens
gacuauggagugcacc

SEQ ID NO: 711177 - RNA, 22 nt, Homo sapiens
gacuauggagugcaccaaagag

SEQ ID NO: 711178 - RNA, 20 nt, Homo sapiens
gacuauggauaaacuaaaca

SEQ ID NO: 711179 - RNA, 13 nt, Homo sapiens
gacucacuguggg

SEQ ID NO: 711180 - RNA, 14 nt, Homo sapiens
gacucauuacuacu

SEQ ID NO: 711181 - RNA, 21 nt, Homo sapiens
gacucuaagaaagaacacgcu

SEQ ID NO: 711182 - RNA, 19 nt, Homo sapiens
gacucuuuaugcuugcaaa

SEQ ID NO: 711183 - RNA, 18 nt, Homo sapiens
gacucuuuccaaccggcu

SEQ ID NO: 711184 - RNA, 22 nt, Homo sapiens
gacuggcagcauugacucugug

SEQ ID NO: 711185 - RNA, 15 nt, Homo sapiens
gacuuaaaaucuaau

SEQ ID NO: 711186 - RNA, 20 nt, Homo sapiens
gacuugucccgggacaccua

SEQ ID NO: 711187 - RNA, 13 nt, Homo sapiens
gagaaaucuggcu

SEQ ID NO: 711188 - RNA, 21 nt, Homo sapiens
gagacagucuggaaagugaug

SEQ ID NO: 711189 - RNA, 18 nt, Homo sapiens
gagaggccuuuuggaaug

SEQ ID NO: 711190 - RNA, 14 nt, Homo sapiens
gagaguccaucagc

SEQ ID NO: 711191 - RNA, 16 nt, Homo sapiens
gagcaccgccugugaa

SEQ ID NO: 711192 - RNA, 18 nt, Homo sapiens
gagcaggaggccaauaaa

SEQ ID NO: 711193 - RNA, 23 nt, Homo sapiens
gagccaauugauuucaacagaau

SEQ ID NO: 711194 - RNA, 13 nt, Homo sapiens
gagccaccaugcc

SEQ ID NO: 711195 - RNA, 12 nt, Homo sapiens
gaggaugaccag

SEQ ID NO: 711196 - RNA, 23 nt, Homo sapiens
gaggccaauaaaaaguucagagu

SEQ ID NO: 711197 - RNA, 17 nt, Homo sapiens
gaggccacccgcacaaa

SEQ ID NO: 711198 - RNA, 18 nt, Homo sapiens
gagugagagacauuaacu

SEQ ID NO: 711199 - RNA, 21 nt, Homo sapiens
gaguuaguggauuacugccau

SEQ ID NO: 711200 - RNA, 21 nt, Homo sapiens
gaguuuacuaccuggggaccc

SEQ ID NO: 711201 - RNA, 12 nt, Homo sapiens
gaucccaugagc

SEQ ID NO: 711202 - RNA, 18 nt, Homo sapiens
gaucuucgugauacugua

SEQ ID NO: 711203 - RNA, 16 nt, Homo sapiens
gaugaaaaaugguccc

SEQ ID NO: 711204 - RNA, 21 nt, Homo sapiens
gaugacauuaaagaaggguug

SEQ ID NO: 711205 - RNA, 20 nt, Homo sapiens
gaugugucccaucuagggaa

SEQ ID NO: 711206 - RNA, 21 nt, Homo sapiens
gauuacugccauucacuucau

SEQ ID NO: 711207 - RNA, 21 nt, Homo sapiens
gauuaggacuuuuauugugaa

SEQ ID NO: 711208 - RNA, 20 nt, Homo sapiens
gauucauuuuaacaucugag

SEQ ID NO: 711209 - RNA, 14 nt, Homo sapiens
gauucgaaugacac

SEQ ID NO: 711210 - RNA, 15 nt, Homo sapiens
gauucucuugccuca

SEQ ID NO: 711211 - RNA, 21 nt, Homo sapiens
gauucuguggagguauugccu

SEQ ID NO: 711212 - RNA, 21 nt, Homo sapiens
gauuuacgcucauuguagaaa

SEQ ID NO: 711213 - RNA, 12 nt, Homo sapiens
gauuuuuacaca

SEQ ID NO: 711214 - RNA, 21 nt, Homo sapiens
gauuuuuacacauguaucuau

SEQ ID NO: 711215 - RNA, 23 nt, Homo sapiens
gcaaagugcaaggaccuaaaaca

SEQ ID NO: 711216 - RNA, 13 nt, Homo sapiens
gcaaauaucuuga

SEQ ID NO: 711217 - RNA, 17 nt, Homo sapiens
gcaaccauuauaaccuu

SEQ ID NO: 711218 - RNA, 21 nt, Homo sapiens
gcaaggaccuaaaacaucuca

SEQ ID NO: 711219 - RNA, 14 nt, Homo sapiens
gcaauugacuguca

SEQ ID NO: 711220 - RNA, 16 nt, Homo sapiens
gcacauuuaauaauca

SEQ ID NO: 711221 - RNA, 14 nt, Homo sapiens
gcaccaacuuugaa

SEQ ID NO: 711222 - RNA, 17 nt, Homo sapiens
gcaccccccaagcuguu

SEQ ID NO: 711223 - RNA, 17 nt, Homo sapiens
gcaccuacuuacaugca

SEQ ID NO: 711224 - RNA, 14 nt, Homo sapiens
gcacuugucuuuga

SEQ ID NO: 711225 - RNA, 21 nt, Homo sapiens
gcagaaauauuugugacaaaa

SEQ ID NO: 711226 - RNA, 14 nt, Homo sapiens
gcagaagcagggua

SEQ ID NO: 711227 - RNA, 20 nt, Homo sapiens
gcagaagcaggguacccuuu

SEQ ID NO: 711228 - RNA, 16 nt, Homo sapiens
gcagacucacuguggg

SEQ ID NO: 711229 - RNA, 19 nt, Homo sapiens
gcagcaaccagagcacugu

SEQ ID NO: 711230 - RNA, 23 nt, Homo sapiens
gcagcaaggaggaagaggacuca

SEQ ID NO: 711231 - RNA, 21 nt, Homo sapiens
gcaggugcuucaggauaccau

SEQ ID NO: 711232 - RNA, 14 nt, Homo sapiens
gcaucacagaaugu

SEQ ID NO: 711233 - RNA, 21 nt, Homo sapiens
gcaugccggugaucccuagcu

SEQ ID NO: 711234 - RNA, 14 nt, Homo sapiens
gcauuuaggagaua

SEQ ID NO: 711235 - RNA, 15 nt, Homo sapiens
gcauuuucacuuuug

SEQ ID NO: 711236 - RNA, 18 nt, Homo sapiens
gcauuuucuuagaccucu

SEQ ID NO: 711237 - RNA, 16 nt, Homo sapiens
gccaaagaaccaaaga

SEQ ID NO: 711238 - RNA, 14 nt, Homo sapiens
gccaauuagcaauu

SEQ ID NO: 711239 - RNA, 13 nt, Homo sapiens
gccagaacuugac

SEQ ID NO: 711240 - RNA, 21 nt, Homo sapiens
gccaggccgggaaaaagccca

SEQ ID NO: 711241 - RNA, 23 nt, Homo sapiens
gccaggcugggucgcccuggacu

SEQ ID NO: 711242 - RNA, 21 nt, Homo sapiens
gccauuacugcauaaaauaga

SEQ ID NO: 711243 - RNA, 20 nt, Homo sapiens
gccauuugacuaauaauacu

SEQ ID NO: 711244 - RNA, 16 nt, Homo sapiens
gcccagcgcagugccu

SEQ ID NO: 711245 - RNA, 13 nt, Homo sapiens
gccccagugacag

SEQ ID NO: 711246 - RNA, 18 nt, Homo sapiens
gcccccaaccauuuccuc

SEQ ID NO: 711247 - RNA, 17 nt, Homo sapiens
gcccccaccuggcucac

SEQ ID NO: 711248 - RNA, 15 nt, Homo sapiens
gccccugaaagccau

SEQ ID NO: 711249 - RNA, 22 nt, Homo sapiens
gccuaaauaaaaaguauacuuu

SEQ ID NO: 711250 - RNA, 12 nt, Homo sapiens
gccucaaccucc

SEQ ID NO: 711251 - RNA, 16 nt, Homo sapiens
gccucagccuccugag

SEQ ID NO: 711252 - RNA, 22 nt, Homo sapiens
gccucuuccgugacgucacugg

SEQ ID NO: 711253 - RNA, 15 nt, Homo sapiens
gccugcaggaucuca

SEQ ID NO: 711254 - RNA, 21 nt, Homo sapiens
gccugcccagugcacuugcug

SEQ ID NO: 711255 - RNA, 17 nt, Homo sapiens
gccuggaccagccucuc

SEQ ID NO: 711256 - RNA, 22 nt, Homo sapiens
gccuguacuagagcaagcagga

SEQ ID NO: 711257 - RNA, 17 nt, Homo sapiens
gccuguagccccaguga

SEQ ID NO: 711258 - RNA, 16 nt, Homo sapiens
gccugucuagcucaua

SEQ ID NO: 711259 - RNA, 18 nt, Homo sapiens
gccuguguuuguguggau

SEQ ID NO: 711260 - RNA, 22 nt, Homo sapiens
gccuucucuguucauuuccuca

SEQ ID NO: 711261 - RNA, 19 nt, Homo sapiens
caccauguuagccaggcug

SEQ ID NO: 711262 - RNA, 15 nt, Homo sapiens
cacccacaaucacaa

SEQ ID NO: 711263 - RNA, 15 nt, Homo sapiens
caccugacagaauga

SEQ ID NO: 711264 - RNA, 21 nt, Homo sapiens
cacgucugcagaaacagugca

SEQ ID NO: 711265 - RNA, 20 nt, Homo sapiens
cacuaauucauuaaucugcc

SEQ ID NO: 711266 - RNA, 13 nt, Homo sapiens
cacuagacaagcc

SEQ ID NO: 711267 - RNA, 15 nt, Homo sapiens
cacuagcccaaugaa

SEQ ID NO: 711268 - RNA, 21 nt, Homo sapiens
cacugugguggugugcugcuu

SEQ ID NO: 711269 - RNA, 12 nt, Homo sapiens
cacuucacuuuu

SEQ ID NO: 711270 - RNA, 21 nt, Homo sapiens
cacuuuaauuaccaaccuguu

SEQ ID NO: 711271 - RNA, 21 nt, Homo sapiens
cacuuuguaggcauugcauga

SEQ ID NO: 711272 - RNA, 15 nt, Homo sapiens
cagaaaguuaugaaa

SEQ ID NO: 711273 - RNA, 19 nt, Homo sapiens
cagaaguuucuucuuuagg

SEQ ID NO: 711274 - RNA, 21 nt, Homo sapiens
cagaauacaagccacuaccuu

SEQ ID NO: 711275 - RNA, 20 nt, Homo sapiens
cagaauagcuuccaauaaag

SEQ ID NO: 711276 - RNA, 22 nt, Homo sapiens
cagaaugagaccaaacgcagcc

SEQ ID NO: 711277 - RNA, 21 nt, Homo sapiens
cagaauguauauuaaggugug

SEQ ID NO: 711278 - RNA, 16 nt, Homo sapiens
cagacacaacacaguu

SEQ ID NO: 711279 - RNA, 13 nt, Homo sapiens
cagacucacugug

SEQ ID NO: 711280 - RNA, 17 nt, Homo sapiens
cagacuuucuacaccug

SEQ ID NO: 711281 - RNA, 16 nt, Homo sapiens
cagagauaaagaccuu

SEQ ID NO: 711282 - RNA, 17 nt, Homo sapiens
cagaggauguucuggac

SEQ ID NO: 711283 - RNA, 16 nt, Homo sapiens
cagagucccugccugg

SEQ ID NO: 711284 - RNA, 12 nt, Homo sapiens
cagauagcaucu

SEQ ID NO: 711285 - RNA, 19 nt, Homo sapiens
cagaucgggagcaaaccaa

SEQ ID NO: 711286 - RNA, 17 nt, Homo sapiens
cagaucuagucaaucaa

SEQ ID NO: 711287 - RNA, 15 nt, Homo sapiens
cagauucccagagca

SEQ ID NO: 711288 - RNA, 18 nt, Homo sapiens
cagcacuuguguugucug

SEQ ID NO: 711289 - RNA, 16 nt, Homo sapiens
cagcagccucccugaa

SEQ ID NO: 711290 - RNA, 17 nt, Homo sapiens
cagcagggacuguaaac

SEQ ID NO: 711291 - RNA, 17 nt, Homo sapiens
cagcaugcugagauuac

SEQ ID NO: 711292 - RNA, 16 nt, Homo sapiens
cagcauugacucugug

SEQ ID NO: 711293 - RNA, 16 nt, Homo sapiens
cagccucuccacucau

SEQ ID NO: 711294 - RNA, 19 nt, Homo sapiens
cagcuuguggcaagugaau

SEQ ID NO: 711295 - RNA, 21 nt, Homo sapiens
caggaacccaccaaaccaacc

SEQ ID NO: 711296 - RNA, 20 nt, Homo sapiens
caggcaacgcacaaaacaga

SEQ ID NO: 711297 - RNA, 14 nt, Homo sapiens
caggcacgucugca

SEQ ID NO: 711298 - RNA, 17 nt, Homo sapiens
caggccuuugagcucag

SEQ ID NO: 711299 - RNA, 19 nt, Homo sapiens
caggcucccagggacaccu

SEQ ID NO: 711300 - RNA, 19 nt, Homo sapiens
cagggacuguaaacacaga

SEQ ID NO: 711301 - RNA, 18 nt, Homo sapiens
caggggccugcccagugc

SEQ ID NO: 711302 - RNA, 21 nt, Homo sapiens
caggguacccuuuggggagca

SEQ ID NO: 711303 - RNA, 20 nt, Homo sapiens
caggugugagccacccugcc

SEQ ID NO: 711304 - RNA, 22 nt, Homo sapiens
caguaacggaacaguauccagu

SEQ ID NO: 711305 - RNA, 17 nt, Homo sapiens
caguagcacaaguuauu

SEQ ID NO: 711306 - RNA, 18 nt, Homo sapiens
cagugccucaugccugua

SEQ ID NO: 711307 - RNA, 15 nt, Homo sapiens
cagugcgcuguagua

SEQ ID NO: 711308 - RNA, 16 nt, Homo sapiens
caguguccucaggggc

SEQ ID NO: 711309 - RNA, 15 nt, Homo sapiens
caguuacauaauuca

SEQ ID NO: 711310 - RNA, 23 nt, Homo sapiens
caguugcagcuguuuuguugaca

SEQ ID NO: 711311 - RNA, 18 nt, Homo sapiens
caguugggacuacaggcg

SEQ ID NO: 711312 - RNA, 20 nt, Homo sapiens
cauaaaugugguacaagcau

SEQ ID NO: 711313 - RNA, 16 nt, Homo sapiens
cauaaugaacagaauu

SEQ ID NO: 711314 - RNA, 15 nt, Homo sapiens
cauacacagaaacca

SEQ ID NO: 711315 - RNA, 12 nt, Homo sapiens
cauacagaauua

SEQ ID NO: 711316 - RNA, 21 nt, Homo sapiens
cauagaaauuacacccaaaga

SEQ ID NO: 711317 - RNA, 12 nt, Homo sapiens
cauauacuuuaa

SEQ ID NO: 711318 - RNA, 13 nt, Homo sapiens
cauauguaaaaua

SEQ ID NO: 711319 - RNA, 17 nt, Homo sapiens
cauauugugauucugcc

SEQ ID NO: 711320 - RNA, 17 nt, Homo sapiens
caucaagagacugaguc

SEQ ID NO: 711321 - RNA, 16 nt, Homo sapiens
caucacagaaugugau

SEQ ID NO: 711322 - RNA, 13 nt, Homo sapiens
caucaggcuuucu

SEQ ID NO: 711323 - RNA, 17 nt, Homo sapiens
cauccaagcaaacugaa

SEQ ID NO: 711324 - RNA, 18 nt, Homo sapiens
cauccacuucaccaucca

SEQ ID NO: 711325 - RNA, 21 nt, Homo sapiens
cauccuacccccugugccuug

SEQ ID NO: 711326 - RNA, 16 nt, Homo sapiens
caucucagugaagaau

SEQ ID NO: 711327 - RNA, 14 nt, Homo sapiens
caucugaggaauga

SEQ ID NO: 711328 - RNA, 21 nt, Homo sapiens
caugaaggugucauacagauu

SEQ ID NO: 711329 - RNA, 17 nt, Homo sapiens
caugcuuuggcaauuuu

SEQ ID NO: 711330 - RNA, 21 nt, Homo sapiens
cauggacaugcuucagugcug

SEQ ID NO: 711331 - RNA, 23 nt, Homo sapiens
cauggacaugcuucagugcugcu

SEQ ID NO: 711332 - RNA, 17 nt, Homo sapiens
cauggagaccgugacca

SEQ ID NO: 711333 - RNA, 17 nt, Homo sapiens
caugucaaggguucaag

SEQ ID NO: 711334 - RNA, 17 nt, Homo sapiens
cauuaaaaaugcauaua

SEQ ID NO: 711335 - RNA, 21 nt, Homo sapiens
cauuacugcaugcacuucuua

SEQ ID NO: 711336 - RNA, 23 nt, Homo sapiens
cauuacuuuaauacucaccuccu

SEQ ID NO: 711337 - RNA, 15 nt, Homo sapiens
cauuccaacucguau

SEQ ID NO: 711338 - RNA, 16 nt, Homo sapiens
cauucugucuugaagg

SEQ ID NO: 711339 - RNA, 17 nt, Homo sapiens
cauuguuaccucuauau

SEQ ID NO: 711340 - RNA, 19 nt, Homo sapiens
cauuuaagcugccuguaca

SEQ ID NO: 711341 - RNA, 23 nt, Homo sapiens
cauuugcugaauagcuacuauau

SEQ ID NO: 711342 - RNA, 18 nt, Homo sapiens
cauuuguugugacuggca

SEQ ID NO: 711343 - RNA, 17 nt, Homo sapiens
cauuuuauguuaaggga

SEQ ID NO: 711344 - RNA, 23 nt, Homo sapiens
ccaaaaaaaaauacaugcuaaga

SEQ ID NO: 711345 - RNA, 16 nt, Homo sapiens
ccaagcccucaauaag

SEQ ID NO: 711346 - RNA, 19 nt, Homo sapiens
ccaaggaggggcuguaaaa

SEQ ID NO: 711347 - RNA, 21 nt, Homo sapiens
ccaaggcacugagaccuccac

SEQ ID NO: 711348 - RNA, 18 nt, Homo sapiens
ccaaggccuccugugacu

SEQ ID NO: 711349 - RNA, 14 nt, Homo sapiens
ccaaucaaccaaac

SEQ ID NO: 711350 - RNA, 23 nt, Homo sapiens
ccaauuuucuggaauacaugaaa

SEQ ID NO: 711351 - RNA, 14 nt, Homo sapiens
ccacaaacuguaau

SEQ ID NO: 711352 - RNA, 15 nt, Homo sapiens
ccacccacaaucaca

SEQ ID NO: 711353 - RNA, 21 nt, Homo sapiens
ccaccugacauguccuucuga

SEQ ID NO: 711354 - RNA, 13 nt, Homo sapiens
ccacuccuaauau

SEQ ID NO: 711355 - RNA, 15 nt, Homo sapiens
ccacuucaccaucca

SEQ ID NO: 711356 - RNA, 19 nt, Homo sapiens
ccagaaauacuacugugua

SEQ ID NO: 711357 - RNA, 14 nt, Homo sapiens
ccagagcaaaauaa

SEQ ID NO: 711358 - RNA, 14 nt, Homo sapiens
ccagagccugggaa

SEQ ID NO: 711359 - RNA, 15 nt, Homo sapiens
ccagauaaguuauuu

SEQ ID NO: 711360 - RNA, 12 nt, Homo sapiens
ccagccuacccc

SEQ ID NO: 711361 - RNA, 23 nt, Homo sapiens
ccagccugggcaacacagugaga

SEQ ID NO: 711362 - RNA, 11 nt, Homo sapiens
ccagcugucau

SEQ ID NO: 711363 - RNA, 23 nt, Homo sapiens
ccaggaagcuuuggugagaaccu

SEQ ID NO: 711364 - RNA, 13 nt, Homo sapiens
ccaggugaacaaa

SEQ ID NO: 711365 - RNA, 11 nt, Homo sapiens
ccagugacacc

SEQ ID NO: 711366 - RNA, 13 nt, Homo sapiens
ccaguuugcaauu

SEQ ID NO: 711367 - RNA, 23 nt, Homo sapiens
ccaucaauauucagcaaaaugau

SEQ ID NO: 711368 - RNA, 10 nt, Homo sapiens
ccaucugauu

SEQ ID NO: 711369 - RNA, 18 nt, Homo sapiens
ccaugaccuaguuuucca

SEQ ID NO: 711370 - RNA, 13 nt, Homo sapiens
ccaugcccggcua

SEQ ID NO: 711371 - RNA, 13 nt, Homo sapiens
ccauguuucacaa

SEQ ID NO: 711372 - RNA, 23 nt, Homo sapiens
ccauguuucacaaggucuuuaaa

SEQ ID NO: 711373 - RNA, 22 nt, Homo sapiens
ccauuaacaaauguaucacuag

SEQ ID NO: 711374 - RNA, 16 nt, Homo sapiens
ccauuacugcauaaaa

SEQ ID NO: 711375 - RNA, 20 nt, Homo sapiens
cccaaauccuuagaucuggc

SEQ ID NO: 711376 - RNA, 18 nt, Homo sapiens
cccagcaugcugagauua

SEQ ID NO: 711377 - RNA, 16 nt, Homo sapiens
cccagcccugcagcaa

SEQ ID NO: 711378 - RNA, 21 nt, Homo sapiens
cccaugccuggucccaagaca

SEQ ID NO: 711379 - RNA, 14 nt, Homo sapiens
ccccaccuggcuca

SEQ ID NO: 711380 - RNA, 13 nt, Homo sapiens
ccccagacacugg

SEQ ID NO: 711381 - RNA, 23 nt, Homo sapiens
ccccugagcccaaggcacugaga

SEQ ID NO: 711382 - RNA, 21 nt, Homo sapiens
ccccugcucaguaaagcacuu

SEQ ID NO: 711383 - RNA, 18 nt, Homo sapiens
aucugagaaaagcuuuga

SEQ ID NO: 711384 - RNA, 16 nt, Homo sapiens
aucugaggaaugagaa

SEQ ID NO: 711385 - RNA, 15 nt, Homo sapiens
aucuucuuaugcaau

SEQ ID NO: 711386 - RNA, 13 nt, Homo sapiens
aucuuucuuccaa

SEQ ID NO: 711387 - RNA, 13 nt, Homo sapiens
augaacagaauuu

SEQ ID NO: 711388 - RNA, 17 nt, Homo sapiens
augaacauauuguugaa

SEQ ID NO: 711389 - RNA, 18 nt, Homo sapiens
augaagaaaaucacuuag

SEQ ID NO: 711390 - RNA, 13 nt, Homo sapiens
augaauacaauua

SEQ ID NO: 711391 - RNA, 13 nt, Homo sapiens
augacaucacuug

SEQ ID NO: 711392 - RNA, 18 nt, Homo sapiens
augagcuccuuaaggcuc

SEQ ID NO: 711393 - RNA, 21 nt, Homo sapiens
augcaaaauaaauguuuuuau

SEQ ID NO: 711394 - RNA, 14 nt, Homo sapiens
augcacacaaacac

SEQ ID NO: 711395 - RNA, 20 nt, Homo sapiens
augcaggguagcacugggaa

SEQ ID NO: 711396 - RNA, 21 nt, Homo sapiens
augcaggguagcacugggaac

SEQ ID NO: 711397 - RNA, 15 nt, Homo sapiens
augccucgaccugcc

SEQ ID NO: 711398 - RNA, 23 nt, Homo sapiens
augccuggucccaagacagugag

SEQ ID NO: 711399 - RNA, 22 nt, Homo sapiens
augccuuuucccaaaauguuga

SEQ ID NO: 711400 - RNA, 15 nt, Homo sapiens
augcuaucucugugu

SEQ ID NO: 711401 - RNA, 11 nt, Homo sapiens
auggacaugcu

SEQ ID NO: 711402 - RNA, 16 nt, Homo sapiens
auggagugcaccaaag

SEQ ID NO: 711403 - RNA, 18 nt, Homo sapiens
auggcaugagaaauacaa

SEQ ID NO: 711404 - RNA, 23 nt, Homo sapiens
auggcggcccccccagcugucau

SEQ ID NO: 711405 - RNA, 18 nt, Homo sapiens
augguccuggaggaugac

SEQ ID NO: 711406 - RNA, 21 nt, Homo sapiens
auggugagagauaagaucuau

SEQ ID NO: 711407 - RNA, 14 nt, Homo sapiens
auguauagcugcuu

SEQ ID NO: 711408 - RNA, 19 nt, Homo sapiens
augucaacagaagggauac

SEQ ID NO: 711409 - RNA, 22 nt, Homo sapiens
augugaguugcacagcuaugaa

SEQ ID NO: 711410 - RNA, 15 nt, Homo sapiens
augugccaaagucca

SEQ ID NO: 711411 - RNA, 15 nt, Homo sapiens
augugguagccucac

SEQ ID NO: 711412 - RNA, 12 nt, Homo sapiens
auguguuuacuu

SEQ ID NO: 711413 - RNA, 18 nt, Homo sapiens
auguuacuacaugcacuu

SEQ ID NO: 711414 - RNA, 17 nt, Homo sapiens
auguuccgagaagaaca

SEQ ID NO: 711415 - RNA, 14 nt, Homo sapiens
auuacugcauaaaa

SEQ ID NO: 711416 - RNA, 13 nt, Homo sapiens
auuacugcaugca

SEQ ID NO: 711417 - RNA, 17 nt, Homo sapiens
auuacuuuaauacucac

SEQ ID NO: 711418 - RNA, 18 nt, Homo sapiens
auuaggcagacucuuuau

SEQ ID NO: 711419 - RNA, 21 nt, Homo sapiens
auuauaccaccagacugcaau

SEQ ID NO: 711420 - RNA, 20 nt, Homo sapiens
auuaugucucuucugagcua

SEQ ID NO: 711421 - RNA, 15 nt, Homo sapiens
auuaugugaaaugua

SEQ ID NO: 711422 - RNA, 16 nt, Homo sapiens
auuauuaacauaccua

SEQ ID NO: 711423 - RNA, 17 nt, Homo sapiens
auuauuguugcauuaaa

SEQ ID NO: 711424 - RNA, 16 nt, Homo sapiens
auuauuuucacuguag

SEQ ID NO: 711425 - RNA, 15 nt, Homo sapiens
auuauuuugugaugc

SEQ ID NO: 711426 - RNA, 23 nt, Homo sapiens
auucaaaagcacuuugugcugug

SEQ ID NO: 711427 - RNA, 17 nt, Homo sapiens
auucacaucgcagauuc

SEQ ID NO: 711428 - RNA, 18 nt, Homo sapiens
auucacccagagggaaau

SEQ ID NO: 711429 - RNA, 15 nt, Homo sapiens
auuccagacuuucua

SEQ ID NO: 711430 - RNA, 22 nt, Homo sapiens
auuccucaaaaaauugcacaua

SEQ ID NO: 711431 - RNA, 16 nt, Homo sapiens
auucgaaugacacugu

SEQ ID NO: 711432 - RNA, 15 nt, Homo sapiens
auucucccuugcucu

SEQ ID NO: 711433 - RNA, 13 nt, Homo sapiens
auucucuugccuc

SEQ ID NO: 711434 - RNA, 18 nt, Homo sapiens
auucugaggccugaguga

SEQ ID NO: 711435 - RNA, 15 nt, Homo sapiens
auucugcaagcuuuu

SEQ ID NO: 711436 - RNA, 17 nt, Homo sapiens
auucuuucccaacaccu

SEQ ID NO: 711437 - RNA, 19 nt, Homo sapiens
auucuuucccaacaccucu

SEQ ID NO: 711438 - RNA, 18 nt, Homo sapiens
auugaagcuuuacuuuag

SEQ ID NO: 711439 - RNA, 18 nt, Homo sapiens
auugacucuguggcuuug

SEQ ID NO: 711440 - RNA, 12 nt, Homo sapiens
auugauguugcu

SEQ ID NO: 711441 - RNA, 23 nt, Homo sapiens
auugccuugugaauuugcugcua

SEQ ID NO: 711442 - RNA, 14 nt, Homo sapiens
auuggcaugaaggu

SEQ ID NO: 711443 - RNA, 13 nt, Homo sapiens
auuggcugagaua

SEQ ID NO: 711444 - RNA, 14 nt, Homo sapiens
auuguugcauuaaa

SEQ ID NO: 711445 - RNA, 14 nt, Homo sapiens
auuuaugagcucuu

SEQ ID NO: 711446 - RNA, 19 nt, Homo sapiens
auuuauuauuaacauaccu

SEQ ID NO: 711447 - RNA, 13 nt, Homo sapiens
auuucaagaccuc

SEQ ID NO: 711448 - RNA, 21 nt, Homo sapiens
auuugccuguaacaagccaga

SEQ ID NO: 711449 - RNA, 12 nt, Homo sapiens
auuugcugcuau

SEQ ID NO: 711450 - RNA, 13 nt, Homo sapiens
auuugugugcauc

SEQ ID NO: 711451 - RNA, 19 nt, Homo sapiens
auuuuaaacacauuaggaa

SEQ ID NO: 711452 - RNA, 17 nt, Homo sapiens
auuuuaacaucugagaa

SEQ ID NO: 711453 - RNA, 21 nt, Homo sapiens
auuuuagcaaagauaucucau

SEQ ID NO: 711454 - RNA, 18 nt, Homo sapiens
auuuuagugaacuugaaa

SEQ ID NO: 711455 - RNA, 22 nt, Homo sapiens
auuuuauaugcuuacugauaua

SEQ ID NO: 711456 - RNA, 20 nt, Homo sapiens
auuuucacuuuuggcuugua

SEQ ID NO: 711457 - RNA, 16 nt, Homo sapiens
auuuuuacacauguau

SEQ ID NO: 711458 - RNA, 16 nt, Homo sapiens
auuuuuaucugaguua

SEQ ID NO: 711459 - RNA, 14 nt, Homo sapiens
caaaaaauugcaca

SEQ ID NO: 711460 - RNA, 14 nt, Homo sapiens
caaaacauugugcc

SEQ ID NO: 711461 - RNA, 19 nt, Homo sapiens
caaaagcacuuugugcugu

SEQ ID NO: 711462 - RNA, 15 nt, Homo sapiens
caaaagggccaaaga

SEQ ID NO: 711463 - RNA, 23 nt, Homo sapiens
caaaagggccaaagaaccaaaga

SEQ ID NO: 711464 - RNA, 14 nt, Homo sapiens
caaaaguuacaugu

SEQ ID NO: 711465 - RNA, 23 nt, Homo sapiens
caaaauauauuuuaucugugauu

SEQ ID NO: 711466 - RNA, 20 nt, Homo sapiens
caaacugaauggcaaugaaa

SEQ ID NO: 711467 - RNA, 22 nt, Homo sapiens
caaagcuucccacggccuuucu

SEQ ID NO: 711468 - RNA, 21 nt, Homo sapiens
caaaucuugguugaugccaaa

SEQ ID NO: 711469 - RNA, 18 nt, Homo sapiens
caaauucuucugaacuca

SEQ ID NO: 711470 - RNA, 18 nt, Homo sapiens
caacaguuacauaauuca

SEQ ID NO: 711471 - RNA, 12 nt, Homo sapiens
caacaguuuucc

SEQ ID NO: 711472 - RNA, 15 nt, Homo sapiens
caacauguuauuugu

SEQ ID NO: 711473 - RNA, 19 nt, Homo sapiens
caaccaauggaaugugaug

SEQ ID NO: 711474 - RNA, 15 nt, Homo sapiens
caaccagagcacugu

SEQ ID NO: 711475 - RNA, 18 nt, Homo sapiens
caaccggcuuuguggcac

SEQ ID NO: 711476 - RNA, 14 nt, Homo sapiens
caaccugaagacac

SEQ ID NO: 711477 - RNA, 17 nt, Homo sapiens
caacuuauuaacaauua

SEQ ID NO: 711478 - RNA, 20 nt, Homo sapiens
caacuuauuaacaauuaggc

SEQ ID NO: 711479 - RNA, 17 nt, Homo sapiens
caagaaauugccuccuu

SEQ ID NO: 711480 - RNA, 16 nt, Homo sapiens
caagaagggacugaga

SEQ ID NO: 711481 - RNA, 17 nt, Homo sapiens
caagaagggacugagag

SEQ ID NO: 711482 - RNA, 16 nt, Homo sapiens
caagccccacuuauuc

SEQ ID NO: 711483 - RNA, 19 nt, Homo sapiens
caagcuuuucaaaauugga

SEQ ID NO: 711484 - RNA, 23 nt, Homo sapiens
caaggagucacugagaccaaggc

SEQ ID NO: 711485 - RNA, 17 nt, Homo sapiens
caagucuguuuacugca

SEQ ID NO: 711486 - RNA, 20 nt, Homo sapiens
caauaaaaaguucagaguuc

SEQ ID NO: 711487 - RNA, 13 nt, Homo sapiens
caaucacaagaag

SEQ ID NO: 711488 - RNA, 13 nt, Homo sapiens
caaucccucaaaa

SEQ ID NO: 711489 - RNA, 12 nt, Homo sapiens
caaucuguaaac

SEQ ID NO: 711490 - RNA, 16 nt, Homo sapiens
caaugauggcaauuuu

SEQ ID NO: 711491 - RNA, 14 nt, Homo sapiens
caauuaaaggcaaa

SEQ ID NO: 711492 - RNA, 21 nt, Homo sapiens
caauucaaaacauugugccau

SEQ ID NO: 711493 - RNA, 20 nt, Homo sapiens
caauugacugucacuguucc

SEQ ID NO: 711494 - RNA, 18 nt, Homo sapiens
caauuuuuuaucaugcau

SEQ ID NO: 711495 - RNA, 12 nt, Homo sapiens
cacaaaacagaa

SEQ ID NO: 711496 - RNA, 15 nt, Homo sapiens
cacaacacaguucuc

SEQ ID NO: 711497 - RNA, 17 nt, Homo sapiens
cacacaaaagggaaccc

SEQ ID NO: 711498 - RNA, 15 nt, Homo sapiens
agaccaucugaggaa

SEQ ID NO: 711499 - RNA, 21 nt, Homo sapiens
agaccaucugaggaaugagaa

SEQ ID NO: 711500 - RNA, 20 nt, Homo sapiens
agaccgugaccagugcugcu

SEQ ID NO: 711501 - RNA, 21 nt, Homo sapiens
agaccgugaccagugcugcug

SEQ ID NO: 711502 - RNA, 20 nt, Homo sapiens
agacgcagacaugugcacuu

SEQ ID NO: 711503 - RNA, 17 nt, Homo sapiens
agacucacugugggaag

SEQ ID NO: 711504 - RNA, 18 nt, Homo sapiens
agacucuuuaugcuugca

SEQ ID NO: 711505 - RNA, 21 nt, Homo sapiens
agagaauauuggagauguccu

SEQ ID NO: 711506 - RNA, 23 nt, Homo sapiens
agagacgggcccuggugguggcu

SEQ ID NO: 711507 - RNA, 13 nt, Homo sapiens
agagacugaguca

SEQ ID NO: 711508 - RNA, 18 nt, Homo sapiens
gaccuccacccacugugg

SEQ ID NO: 711509 - RNA, 23 nt, Homo sapiens
gaccucucaacagaucugugggc

SEQ ID NO: 711510 - RNA, 21 nt, Homo sapiens
gaccuuuuuuaggaagcaagc

SEQ ID NO: 711511 - RNA, 22 nt, Homo sapiens
gacuacaggcgugagccaccau

SEQ ID NO: 711512 - RNA, 14 nt, Homo sapiens
gacuaugaaaagcu

SEQ ID NO: 711513 - RNA, 21 nt, Homo sapiens
gacuauggagugcaccaaaga

SEQ ID NO: 711514 - RNA, 17 nt, Homo sapiens
gacucuuuaugcuugca

SEQ ID NO: 711515 - RNA, 23 nt, Homo sapiens
gacuuucuacaccuguugcaccu

SEQ ID NO: 711516 - RNA, 16 nt, Homo sapiens
gagaaaucuggcuucu

SEQ ID NO: 711517 - RNA, 18 nt, Homo sapiens
gagacaggguuucaccau

SEQ ID NO: 711518 - RNA, 14 nt, Homo sapiens
gagacaguucaaga

SEQ ID NO: 711519 - RNA, 15 nt, Homo sapiens
gagaccuuccagaaa

SEQ ID NO: 711520 - RNA, 19 nt, Homo sapiens
gagaccuuccagaaauacu

SEQ ID NO: 711521 - RNA, 13 nt, Homo sapiens
gagaguccaucag

SEQ ID NO: 711522 - RNA, 17 nt, Homo sapiens
gagauagguacuauuau

SEQ ID NO: 711523 - RNA, 23 nt, Homo sapiens
gagcucacaguacaauguuucag

SEQ ID NO: 711524 - RNA, 15 nt, Homo sapiens
gaggaaacucuguca

SEQ ID NO: 711525 - RNA, 19 nt, Homo sapiens
gaggacuugugucucugug

SEQ ID NO: 711526 - RNA, 21 nt, Homo sapiens
gaggauacgacaguacacugu

SEQ ID NO: 711527 - RNA, 15 nt, Homo sapiens
gagggaacuguguag

SEQ ID NO: 711528 - RNA, 15 nt, Homo sapiens
gaggugccacuggag

SEQ ID NO: 711529 - RNA, 15 nt, Homo sapiens
gaguaauaugccugc

SEQ ID NO: 711530 - RNA, 17 nt, Homo sapiens
gagucacugagaccaag

SEQ ID NO: 711531 - RNA, 14 nt, Homo sapiens
gagugcaccaaaga

SEQ ID NO: 711532 - RNA, 16 nt, Homo sapiens
gagugcaccaaagaga

SEQ ID NO: 711533 - RNA, 18 nt, Homo sapiens
gaguguuuaaaguucaac

SEQ ID NO: 711534 - RNA, 13 nt, Homo sapiens
gauacauacagaa

SEQ ID NO: 711535 - RNA, 19 nt, Homo sapiens
gaucccuagcugugaccuc

SEQ ID NO: 711536 - RNA, 12 nt, Homo sapiens
gaugacaaagaa

SEQ ID NO: 711537 - RNA, 18 nt, Homo sapiens
gaugagggaaaagaaaaa

SEQ ID NO: 711538 - RNA, 19 nt, Homo sapiens
gaugcuacucuaguauucc

SEQ ID NO: 711539 - RNA, 15 nt, Homo sapiens
gaugugaguugcaca

SEQ ID NO: 711540 - RNA, 18 nt, Homo sapiens
gauguugcuggacuguca

SEQ ID NO: 711541 - RNA, 19 nt, Homo sapiens
gauuacaggcaugagccac

SEQ ID NO: 711542 - RNA, 20 nt, Homo sapiens
gauucacaucucauuuuucc

SEQ ID NO: 711543 - RNA, 16 nt, Homo sapiens
gauucucuugccucaa

SEQ ID NO: 711544 - RNA, 13 nt, Homo sapiens
gauuuuuacacau

SEQ ID NO: 711545 - RNA, 19 nt, Homo sapiens
gauuuuuaugccaccugaa

SEQ ID NO: 711546 - RNA, 22 nt, Homo sapiens
gauuuuuuuuucauacacuuau

SEQ ID NO: 711547 - RNA, 17 nt, Homo sapiens
gcaacaauuuaugaauu

SEQ ID NO: 711548 - RNA, 22 nt, Homo sapiens
gcaauaacguuuaagccaaaac

SEQ ID NO: 711549 - RNA, 23 nt, Homo sapiens
gcaauuuuuuuauacuaccaagu

SEQ ID NO: 711550 - RNA, 12 nt, Homo sapiens
gcaccagcaaaa

SEQ ID NO: 711551 - RNA, 13 nt, Homo sapiens
gcaccaucucuga

SEQ ID NO: 711552 - RNA, 20 nt, Homo sapiens
gcaccuacuuacaugcauua

SEQ ID NO: 711553 - RNA, 15 nt, Homo sapiens
gcaggucccuaauaa

SEQ ID NO: 711554 - RNA, 11 nt, Homo sapiens
gcagugcagca

SEQ ID NO: 711555 - RNA, 13 nt, Homo sapiens
gcauaaaugcauu

SEQ ID NO: 711556 - RNA, 16 nt, Homo sapiens
gcaucacagaauguga

SEQ ID NO: 711557 - RNA, 14 nt, Homo sapiens
gcauuaaaaaugca

SEQ ID NO: 711558 - RNA, 17 nt, Homo sapiens
gcauuaaauuuuagcaa

SEQ ID NO: 711559 - RNA, 15 nt, Homo sapiens
gccacuucacuuuuu

SEQ ID NO: 711560 - RNA, 21 nt, Homo sapiens
gccauucacuucauaauccag

SEQ ID NO: 711561 - RNA, 12 nt, Homo sapiens
gcccaaggcacu

SEQ ID NO: 711562 - RNA, 20 nt, Homo sapiens
gcccaccuggggaguuuacu

SEQ ID NO: 711563 - RNA, 21 nt, Homo sapiens
gcccaggaccccauggcagug

SEQ ID NO: 711564 - RNA, 18 nt, Homo sapiens
gcccaucauacgcauggu

SEQ ID NO: 711565 - RNA, 20 nt, Homo sapiens
gcccaugccuccagcuacaa

SEQ ID NO: 711566 - RNA, 20 nt, Homo sapiens
gcccaugcuggagugcagug

SEQ ID NO: 711567 - RNA, 23 nt, Homo sapiens
gcccccucccuggaugacauuaa

SEQ ID NO: 711568 - RNA, 20 nt, Homo sapiens
gccccucccagccuaccccu

SEQ ID NO: 711569 - RNA, 22 nt, Homo sapiens
gcccucaauaagccagcaaacc

SEQ ID NO: 711570 - RNA, 20 nt, Homo sapiens
gcccucagcccaccugggga

SEQ ID NO: 711571 - RNA, 23 nt, Homo sapiens
gcccuggacugugugcucaggag

SEQ ID NO: 711572 - RNA, 17 nt, Homo sapiens
gccgugagcauguuugg

SEQ ID NO: 711573 - RNA, 23 nt, Homo sapiens
gccucuuugugugcgucacugug

SEQ ID NO: 711574 - RNA, 13 nt, Homo sapiens
gccugagugaucc

SEQ ID NO: 711575 - RNA, 14 nt, Homo sapiens
gccugcagacucac

SEQ ID NO: 711576 - RNA, 15 nt, Homo sapiens
gccugucuagcucau

SEQ ID NO: 711577 - RNA, 18 nt, Homo sapiens
gccuuccagaaaacaaaa

SEQ ID NO: 711578 - RNA, 12 nt, Homo sapiens
gccuuggcagcc

SEQ ID NO: 711579 - RNA, 17 nt, Homo sapiens
gcgcgaucucggcucac

SEQ ID NO: 711580 - RNA, 16 nt, Homo sapiens
gcgugaccagcaguac

SEQ ID NO: 711581 - RNA, 19 nt, Homo sapiens
gcgugaccagcaguacuca

SEQ ID NO: 711582 - RNA, 23 nt, Homo sapiens
gcguggaacucgugucuggcaca

SEQ ID NO: 711583 - RNA, 20 nt, Homo sapiens
gcuaaguugcaccaacuuug

SEQ ID NO: 711584 - RNA, 19 nt, Homo sapiens
gcuacaaaacaauucaauu

SEQ ID NO: 711585 - RNA, 15 nt, Homo sapiens
gcuacucuaguauuc

SEQ ID NO: 711586 - RNA, 19 nt, Homo sapiens
gcuacuuuauuugccuaaa

SEQ ID NO: 711587 - RNA, 14 nt, Homo sapiens
gcuagcucugccaa

SEQ ID NO: 711588 - RNA, 11 nt, Homo sapiens
gcuaucucugu

SEQ ID NO: 711589 - RNA, 22 nt, Homo sapiens
gcuaugcaggguagcacuggga

SEQ ID NO: 711590 - RNA, 23 nt, Homo sapiens
gcuaugguuuucuccaagagcua

SEQ ID NO: 711591 - RNA, 17 nt, Homo sapiens
gcuaugucaggcuuuca

SEQ ID NO: 711592 - RNA, 14 nt, Homo sapiens
gcucaacauugugu

SEQ ID NO: 711593 - RNA, 19 nt, Homo sapiens
gcucacaguacaauguuuc

SEQ ID NO: 711594 - RNA, 16 nt, Homo sapiens
gcucacugcaaccucc

SEQ ID NO: 711595 - RNA, 16 nt, Homo sapiens
gcucaggaugagggaa

SEQ ID NO: 711596 - RNA, 15 nt, Homo sapiens
gcucugacauucuga

SEQ ID NO: 711597 - RNA, 21 nt, Homo sapiens
gcugaucaguuuuuucaccug

SEQ ID NO: 711598 - RNA, 20 nt, Homo sapiens
gcugccugguauauccaaaa

SEQ ID NO: 711599 - RNA, 15 nt, Homo sapiens
gcuguuuucuucuau

SEQ ID NO: 711600 - RNA, 16 nt, Homo sapiens
gcuucaggauaccaua

SEQ ID NO: 711601 - RNA, 17 nt, Homo sapiens
gcuuccuucauuuccuc

SEQ ID NO: 711602 - RNA, 23 nt, Homo sapiens
cucuguguuacccaguaacucau

SEQ ID NO: 711603 - RNA, 13 nt, Homo sapiens
cugaacacuguga

SEQ ID NO: 711604 - RNA, 15 nt, Homo sapiens
cugaauugucuuccg

SEQ ID NO: 711605 - RNA, 17 nt, Homo sapiens
cugaccucgugauccac

SEQ ID NO: 711606 - RNA, 22 nt, Homo sapiens
cugagagaggccauucuuuccc

SEQ ID NO: 711607 - RNA, 16 nt, Homo sapiens
cugagagcucacagua

SEQ ID NO: 711608 - RNA, 19 nt, Homo sapiens
cugagauacauacagaauu

SEQ ID NO: 711609 - RNA, 22 nt, Homo sapiens
cugagcaccuacuuacaugcau

SEQ ID NO: 711610 - RNA, 20 nt, Homo sapiens
cugagccuccacagcagugg

SEQ ID NO: 711611 - RNA, 13 nt, Homo sapiens
cugagugauccac

SEQ ID NO: 711612 - RNA, 19 nt, Homo sapiens
cugauauuuucucuaggaa

SEQ ID NO: 711613 - RNA, 17 nt, Homo sapiens
cugauguagcuuauaca

SEQ ID NO: 711614 - RNA, 13 nt, Homo sapiens
cugcaaacagugu

SEQ ID NO: 711615 - RNA, 20 nt, Homo sapiens
cugcaacuuaaugcucugau

SEQ ID NO: 711616 - RNA, 15 nt, Homo sapiens
cugcaagcuuuucaa

SEQ ID NO: 711617 - RNA, 15 nt, Homo sapiens
cugcauaaauguggu

SEQ ID NO: 711618 - RNA, 20 nt, Homo sapiens
cugccaacacgcccggcuaa

SEQ ID NO: 711619 - RNA, 13 nt, Homo sapiens
cugccaagcccuc

SEQ ID NO: 711620 - RNA, 22 nt, Homo sapiens
cugccaagcccucaauaagcca

SEQ ID NO: 711621 - RNA, 23 nt, Homo sapiens
cugccauuggacuauggagugca

SEQ ID NO: 711622 - RNA, 18 nt, Homo sapiens
cugcccaggcacugcaaa

SEQ ID NO: 711623 - RNA, 14 nt, Homo sapiens
cugccgagagucca

SEQ ID NO: 711624 - RNA, 18 nt, Homo sapiens
cugccgagaguccaucag

SEQ ID NO: 711625 - RNA, 20 nt, Homo sapiens
cugccgcagggguccgggau

SEQ ID NO: 711626 - RNA, 14 nt, Homo sapiens
cugccuguagcccc

SEQ ID NO: 711627 - RNA, 18 nt, Homo sapiens
cugccuucucaugaucca

SEQ ID NO: 711628 - RNA, 14 nt, Homo sapiens
cugcuuuaauuuca

SEQ ID NO: 711629 - RNA, 20 nt, Homo sapiens
cuggaacacuagacaagcca

SEQ ID NO: 711630 - RNA, 15 nt, Homo sapiens
cuggaccacugggca

SEQ ID NO: 711631 - RNA, 20 nt, Homo sapiens
cuggagugcaguggcgcgau

SEQ ID NO: 711632 - RNA, 23 nt, Homo sapiens
cugggauuacagguguaagccac

SEQ ID NO: 711633 - RNA, 18 nt, Homo sapiens
cuggugguggcaccaucu

SEQ ID NO: 711634 - RNA, 13 nt, Homo sapiens
cuguacacugcac

SEQ ID NO: 711635 - RNA, 22 nt, Homo sapiens
cuguagaaugauuucaugcuau

SEQ ID NO: 711636 - RNA, 17 nt, Homo sapiens
cuguauaaaaugcaaaa

SEQ ID NO: 711637 - RNA, 15 nt, Homo sapiens
cuguauaccccguga

SEQ ID NO: 711638 - RNA, 16 nt, Homo sapiens
cugucaccaagccuug

SEQ ID NO: 711639 - RNA, 21 nt, Homo sapiens
cuguccuuucuagagcacugc

SEQ ID NO: 711640 - RNA, 24 nt, Homo sapiens
cugugacuggcagcauugacucug

SEQ ID NO: 711641 - RNA, 15 nt, Homo sapiens
cugugauuagccauu

SEQ ID NO: 711642 - RNA, 12 nt, Homo sapiens
cuguuaguauua

SEQ ID NO: 711643 - RNA, 13 nt, Homo sapiens
cuguugcauugua

SEQ ID NO: 711644 - RNA, 16 nt, Homo sapiens
cuguugcauuguaaua

SEQ ID NO: 711645 - RNA, 13 nt, Homo sapiens
cuuacaugcauua

SEQ ID NO: 711646 - RNA, 17 nt, Homo sapiens
cuuagucccucaugcaa

SEQ ID NO: 711647 - RNA, 21 nt, Homo sapiens
cuuauacgaguaauaugccug

SEQ ID NO: 711648 - RNA, 23 nt, Homo sapiens
cuuauacgaguaauaugccugcu

SEQ ID NO: 711649 - RNA, 21 nt, Homo sapiens
cuuauuaacaauuaggcagac

SEQ ID NO: 711650 - RNA, 16 nt, Homo sapiens
cuuauuguaacccugu

SEQ ID NO: 711651 - RNA, 17 nt, Homo sapiens
cuucauuuaacaaguaa

SEQ ID NO: 711652 - RNA, 20 nt, Homo sapiens
cuuccacagaauacaagcca

SEQ ID NO: 711653 - RNA, 17 nt, Homo sapiens
cuuccagaaaacaaaac

SEQ ID NO: 711654 - RNA, 12 nt, Homo sapiens
cuucccacggcu

SEQ ID NO: 711655 - RNA, 17 nt, Homo sapiens
cuucuaaguaaauacaa

SEQ ID NO: 711656 - RNA, 16 nt, Homo sapiens
cuucuaguucugccag

SEQ ID NO: 711657 - RNA, 12 nt, Homo sapiens
cuucuccaucuc

SEQ ID NO: 711658 - RNA, 13 nt, Homo sapiens
cuucuguuuccau

SEQ ID NO: 711659 - RNA, 17 nt, Homo sapiens
cuucuuuaggcauuaaa

SEQ ID NO: 711660 - RNA, 16 nt, Homo sapiens
cuucuuuuaaaccauu

SEQ ID NO: 711661 - RNA, 22 nt, Homo sapiens
cuugaacugauucacaucucau

SEQ ID NO: 711662 - RNA, 15 nt, Homo sapiens
cuugaacugucuacc

SEQ ID NO: 711663 - RNA, 18 nt, Homo sapiens
cuugacuuuugaaaacaa

SEQ ID NO: 711664 - RNA, 19 nt, Homo sapiens
cuugaguaguuuuuaucug

SEQ ID NO: 711665 - RNA, 21 nt, Homo sapiens
cuugauagaaaugccaagcac

SEQ ID NO: 711666 - RNA, 19 nt, Homo sapiens
cuugcaaccuaccuguuga

SEQ ID NO: 711667 - RNA, 17 nt, Homo sapiens
cuugccaaauuuagauu

SEQ ID NO: 711668 - RNA, 18 nt, Homo sapiens
cuugcucagguacuugua

SEQ ID NO: 711669 - RNA, 21 nt, Homo sapiens
cuuggaaauuggaagagcaca

SEQ ID NO: 711670 - RNA, 17 nt, Homo sapiens
cuugggagcaccgccug

SEQ ID NO: 711671 - RNA, 16 nt, Homo sapiens
cuugguaaaauaauca

SEQ ID NO: 711672 - RNA, 23 nt, Homo sapiens
cuugguaauuguacuaaagccaa

SEQ ID NO: 711673 - RNA, 21 nt, Homo sapiens
cuugucacgccagacuuccca

SEQ ID NO: 711674 - RNA, 18 nt, Homo sapiens
cuugucuuugacuugugu

SEQ ID NO: 711675 - RNA, 21 nt, Homo sapiens
cuuguuagugcacagcacaaa

SEQ ID NO: 711676 - RNA, 20 nt, Homo sapiens
cuuuaaagcguuugcacaga

SEQ ID NO: 711677 - RNA, 20 nt, Homo sapiens
cuuuacacaauagaauuaua

SEQ ID NO: 711678 - RNA, 16 nt, Homo sapiens
cuuuauguuacuacau

SEQ ID NO: 711679 - RNA, 13 nt, Homo sapiens
cuuucaugcuccu

SEQ ID NO: 711680 - RNA, 15 nt, Homo sapiens
cuuucuacaccuguu

SEQ ID NO: 711681 - RNA, 16 nt, Homo sapiens
cuuucucgauuggugu

SEQ ID NO: 711682 - RNA, 16 nt, Homo sapiens
cuuucuucaccaaauc

SEQ ID NO: 711683 - RNA, 14 nt, Homo sapiens
cuuugaacuuugaa

SEQ ID NO: 711684 - RNA, 13 nt, Homo sapiens
cuuugaagucuga

SEQ ID NO: 711685 - RNA, 15 nt, Homo sapiens
cuuugaagucugauu

SEQ ID NO: 711686 - RNA, 22 nt, Homo sapiens
cuuugaagugacuucacagaga

SEQ ID NO: 711687 - RNA, 13 nt, Homo sapiens
cuuugacuugugu

SEQ ID NO: 711688 - RNA, 15 nt, Homo sapiens
cuuugcucuuuggua

SEQ ID NO: 711689 - RNA, 21 nt, Homo sapiens
cuuuuaguauuuuagugaacu

SEQ ID NO: 711690 - RNA, 16 nt, Homo sapiens
gaaaaauaagucacuu

SEQ ID NO: 711691 - RNA, 22 nt, Homo sapiens
gaaaagaaucggcaauguuuca

SEQ ID NO: 711692 - RNA, 23 nt, Homo sapiens
gaaaagaaucggcaauguuucaa

SEQ ID NO: 711693 - RNA, 17 nt, Homo sapiens
gaaaaguuauguagaaa

SEQ ID NO: 711694 - RNA, 13 nt, Homo sapiens
gaaaauaaagugu

SEQ ID NO: 711695 - RNA, 16 nt, Homo sapiens
gaaaauaaaguguaua

SEQ ID NO: 711696 - RNA, 16 nt, Homo sapiens
gaaaauaagagcucag

SEQ ID NO: 711697 - RNA, 21 nt, Homo sapiens
gaaaaugcuaucaaauaacua

SEQ ID NO: 711698 - RNA, 14 nt, Homo sapiens
gaaacaaacuggag

SEQ ID NO: 711699 - RNA, 18 nt, Homo sapiens
gaaacacguaucccaccu

SEQ ID NO: 711700 - RNA, 19 nt, Homo sapiens
gaaauaaguuuuuguuuca

SEQ ID NO: 711701 - RNA, 17 nt, Homo sapiens
gaaaucacugauagaau

SEQ ID NO: 711702 - RNA, 19 nt, Homo sapiens
ccuacccccugugccuugu

SEQ ID NO: 711703 - RNA, 16 nt, Homo sapiens
ccuagcugugaccucu

SEQ ID NO: 711704 - RNA, 14 nt, Homo sapiens
ccuauuucuuaaac

SEQ ID NO: 711705 - RNA, 19 nt, Homo sapiens
ccucaaaacaaucuuguca

SEQ ID NO: 711706 - RNA, 19 nt, Homo sapiens
ccucaaaugcaccauguca

SEQ ID NO: 711707 - RNA, 16 nt, Homo sapiens
ccucaauucauauuua

SEQ ID NO: 711708 - RNA, 14 nt, Homo sapiens
ccucacuuuacaca

SEQ ID NO: 711709 - RNA, 12 nt, Homo sapiens
ccucaguguccu

SEQ ID NO: 711710 - RNA, 14 nt, Homo sapiens
ccucauacacagaa

SEQ ID NO: 711711 - RNA, 16 nt, Homo sapiens
ccucaucuuucuucca

SEQ ID NO: 711712 - RNA, 14 nt, Homo sapiens
ccuccacagcagug

SEQ ID NO: 711713 - RNA, 20 nt, Homo sapiens
ccuccaccuccuggguucaa

SEQ ID NO: 711714 - RNA, 11 nt, Homo sapiens
ccuccaucuca

SEQ ID NO: 711715 - RNA, 24 nt, Homo sapiens
ccuccccuucuucuccaucuccau

SEQ ID NO: 711716 - RNA, 13 nt, Homo sapiens
ccucgagauccca

SEQ ID NO: 711717 - RNA, 16 nt, Homo sapiens
ccucgcccuccacaaa

SEQ ID NO: 711718 - RNA, 17 nt, Homo sapiens
ccucuauauaccaaagc

SEQ ID NO: 711719 - RNA, 21 nt, Homo sapiens
ccucuauauaccaaagcacau

SEQ ID NO: 711720 - RNA, 21 nt, Homo sapiens
ccucuuccgugacgucacugg

SEQ ID NO: 711721 - RNA, 12 nt, Homo sapiens
ccugaaagccau

SEQ ID NO: 711722 - RNA, 23 nt, Homo sapiens
ccugaauauuuguuauguagaua

SEQ ID NO: 711723 - RNA, 17 nt, Homo sapiens
ccugaauuuuguugcug

SEQ ID NO: 711724 - RNA, 16 nt, Homo sapiens
ccugacgaacuccuug

SEQ ID NO: 711725 - RNA, 21 nt, Homo sapiens
ccugagcccaaggcacugaga

SEQ ID NO: 711726 - RNA, 21 nt, Homo sapiens
ccugaugggguggaaggcaug

SEQ ID NO: 711727 - RNA, 17 nt, Homo sapiens
ccugccacccauuccau

SEQ ID NO: 711728 - RNA, 16 nt, Homo sapiens
ccugcccagugcacuu

SEQ ID NO: 711729 - RNA, 14 nt, Homo sapiens
ccugcuuuucccca

SEQ ID NO: 711730 - RNA, 17 nt, Homo sapiens
ccuggaacugucucuca

SEQ ID NO: 711731 - RNA, 18 nt, Homo sapiens
ccuggaugacauuaaaga

SEQ ID NO: 711732 - RNA, 17 nt, Homo sapiens
ccugggcaacacaguga

SEQ ID NO: 711733 - RNA, 19 nt, Homo sapiens
ccugggcaacacagugaga

SEQ ID NO: 711734 - RNA, 16 nt, Homo sapiens
ccugguauauccaaaa

SEQ ID NO: 711735 - RNA, 22 nt, Homo sapiens
ccugguugagcuucugcuaaaa

SEQ ID NO: 711736 - RNA, 18 nt, Homo sapiens
ccuguagccccagugaca

SEQ ID NO: 711737 - RNA, 22 nt, Homo sapiens
ccugucuggauccuauccuccu

SEQ ID NO: 711738 - RNA, 15 nt, Homo sapiens
ccuguugcaccucag

SEQ ID NO: 711739 - RNA, 17 nt, Homo sapiens
ccuguugcuuuucacaa

SEQ ID NO: 711740 - RNA, 16 nt, Homo sapiens
ccuguuuccauggguc

SEQ ID NO: 711741 - RNA, 16 nt, Homo sapiens
ccuuacaaguuagaaa

SEQ ID NO: 711742 - RNA, 23 nt, Homo sapiens
ccuucauuuccuccgucaccuca

SEQ ID NO: 711743 - RNA, 22 nt, Homo sapiens
ccuuccagaaauacuacugugu

SEQ ID NO: 711744 - RNA, 23 nt, Homo sapiens
ccuucuuuugggggucaacaguu

SEQ ID NO: 711745 - RNA, 16 nt, Homo sapiens
ccuuggggauucuucc

SEQ ID NO: 711746 - RNA, 22 nt, Homo sapiens
ccuugguuccuaacuggaauca

SEQ ID NO: 711747 - RNA, 21 nt, Homo sapiens
ccuugguucuugaggggacca

SEQ ID NO: 711748 - RNA, 22 nt, Homo sapiens
ccuugugaauuugcugcuauuu

SEQ ID NO: 711749 - RNA, 15 nt, Homo sapiens
ccuuugccugguaca

SEQ ID NO: 711750 - RNA, 22 nt, Homo sapiens
ccuuuggacuugucccgggaca

SEQ ID NO: 711751 - RNA, 16 nt, Homo sapiens
ccuuuuuuguuauuau

SEQ ID NO: 711752 - RNA, 13 nt, Homo sapiens
cgaaacacacaaa

SEQ ID NO: 711753 - RNA, 19 nt, Homo sapiens
cgaaacacacaaaccagcc

SEQ ID NO: 711754 - RNA, 16 nt, Homo sapiens
cgauucucuugccuca

SEQ ID NO: 711755 - RNA, 13 nt, Homo sapiens
cgcccuccacaaa

SEQ ID NO: 711756 - RNA, 19 nt, Homo sapiens
cgcggccuuucgcugagcc

SEQ ID NO: 711757 - RNA, 12 nt, Homo sapiens
cggaacaguauc

SEQ ID NO: 711758 - RNA, 19 nt, Homo sapiens
cggcucacugcaaccucca

SEQ ID NO: 711759 - RNA, 13 nt, Homo sapiens
cggcuccucaggg

SEQ ID NO: 711760 - RNA, 18 nt, Homo sapiens
cgguuuuucucuucaaua

SEQ ID NO: 711761 - RNA, 14 nt, Homo sapiens
cgucagcugggaca

SEQ ID NO: 711762 - RNA, 18 nt, Homo sapiens
cgucagugcugugcugug

SEQ ID NO: 711763 - RNA, 22 nt, Homo sapiens
cgugauacuguacauagcuguu

SEQ ID NO: 711764 - RNA, 14 nt, Homo sapiens
cguguccgacucuu

SEQ ID NO: 711765 - RNA, 15 nt, Homo sapiens
cuaaaguacugggau

SEQ ID NO: 711766 - RNA, 23 nt, Homo sapiens
cuaaauauaaaccagcuacuuga

SEQ ID NO: 711767 - RNA, 20 nt, Homo sapiens
cuaagaaacauuuauauuga

SEQ ID NO: 711768 - RNA, 20 nt, Homo sapiens
cuaagcugccgguucuuaaa

SEQ ID NO: 711769 - RNA, 20 nt, Homo sapiens
cuaaggaagauuacucagua

SEQ ID NO: 711770 - RNA, 19 nt, Homo sapiens
cuaauacagcaacaauuua

SEQ ID NO: 711771 - RNA, 18 nt, Homo sapiens
cuaauagaauuaauggaa

SEQ ID NO: 711772 - RNA, 20 nt, Homo sapiens
cuaaucuuaccagucugucu

SEQ ID NO: 711773 - RNA, 19 nt, Homo sapiens
cuaauucauuaaucugccu

SEQ ID NO: 711774 - RNA, 17 nt, Homo sapiens
cuacaaaacaauucaau

SEQ ID NO: 711775 - RNA, 18 nt, Homo sapiens
cuacaaaacaauucaauu

SEQ ID NO: 711776 - RNA, 12 nt, Homo sapiens
cuacaugcacuu

SEQ ID NO: 711777 - RNA, 18 nt, Homo sapiens
cuaccaagugaccauaaa

SEQ ID NO: 711778 - RNA, 21 nt, Homo sapiens
cuacuugagauaaucuaaaua

SEQ ID NO: 711779 - RNA, 12 nt, Homo sapiens
cuacuugaugua

SEQ ID NO: 711780 - RNA, 15 nt, Homo sapiens
cuagagcacugccac

SEQ ID NO: 711781 - RNA, 18 nt, Homo sapiens
cuagcccucucacauuua

SEQ ID NO: 711782 - RNA, 20 nt, Homo sapiens
cuagguggguugaaagccaa

SEQ ID NO: 711783 - RNA, 20 nt, Homo sapiens
cuaguucugccaggagacag

SEQ ID NO: 711784 - RNA, 19 nt, Homo sapiens
cuauauaaaaaacauaaua

SEQ ID NO: 711785 - RNA, 15 nt, Homo sapiens
cuauauaccaaagca

SEQ ID NO: 711786 - RNA, 13 nt, Homo sapiens
cuaugcaggguag

SEQ ID NO: 711787 - RNA, 19 nt, Homo sapiens
cuauggagugcaccaaaga

SEQ ID NO: 711788 - RNA, 19 nt, Homo sapiens
cuaugucauuucauuuccu

SEQ ID NO: 711789 - RNA, 23 nt, Homo sapiens
cuauuaaaaagguuuacagaauu

SEQ ID NO: 711790 - RNA, 16 nt, Homo sapiens
cuauuagcuccacaaa

SEQ ID NO: 711791 - RNA, 23 nt, Homo sapiens
cuauuucaucuauuuuuggcagu

SEQ ID NO: 711792 - RNA, 12 nt, Homo sapiens
cucaaaagaaca

SEQ ID NO: 711793 - RNA, 23 nt, Homo sapiens
cucaaacuccugaccucaggcaa

SEQ ID NO: 711794 - RNA, 13 nt, Homo sapiens
cucaacauugugu

SEQ ID NO: 711795 - RNA, 20 nt, Homo sapiens
cucaaccccuccccuccauc

SEQ ID NO: 711796 - RNA, 21 nt, Homo sapiens
cucaacugccuacuccaaaau

SEQ ID NO: 711797 - RNA, 19 nt, Homo sapiens
cucaagaaauugccuccuu

SEQ ID NO: 711798 - RNA, 16 nt, Homo sapiens
cucaauaagccagcaa

SEQ ID NO: 711799 - RNA, 12 nt, Homo sapiens
cucaauucauau

SEQ ID NO: 711800 - RNA, 22 nt, Homo sapiens
cucaauucauauuuaugaaucu

SEQ ID NO: 711801 - RNA, 20 nt, Homo sapiens
cucacaguacaauguuucag

SEQ ID NO: 711802 - RNA, 20 nt, Homo sapiens
cucaccuugugcuggggaca

SEQ ID NO: 711803 - RNA, 18 nt, Homo sapiens
cucacugcaaccuccacc

SEQ ID NO: 711804 - RNA, 21 nt, Homo sapiens
cucacuucagguauaccucac

SEQ ID NO: 711805 - RNA, 15 nt, Homo sapiens
cucagggacucaggu

SEQ ID NO: 711806 - RNA, 21 nt, Homo sapiens
cucaucaacugaaugagguca

SEQ ID NO: 711807 - RNA, 13 nt, Homo sapiens
aagucacucugag

SEQ ID NO: 711808 - RNA, 16 nt, Homo sapiens
aagucuguuuacugca

SEQ ID NO: 711809 - RNA, 18 nt, Homo sapiens
aagucuuugaagugacuu

SEQ ID NO: 711810 - RNA, 16 nt, Homo sapiens
aaguugcaccaacuuu

SEQ ID NO: 711811 - RNA, 14 nt, Homo sapiens
aaguugcuaauaca

SEQ ID NO: 711812 - RNA, 15 nt, Homo sapiens
aaguugcuauuugaa

SEQ ID NO: 711813 - RNA, 16 nt, Homo sapiens
aauaaaaacucuuaua

SEQ ID NO: 711814 - RNA, 16 nt, Homo sapiens
aauaaaaagaucacuu

SEQ ID NO: 711815 - RNA, 18 nt, Homo sapiens
aauaaaauucaacaaaca

SEQ ID NO: 711816 - RNA, 15 nt, Homo sapiens
aauaaauauccuuua

SEQ ID NO: 711817 - RNA, 19 nt, Homo sapiens
aauaacucaacuaacucca

SEQ ID NO: 711818 - RNA, 16 nt, Homo sapiens
aauaagagcucaggau

SEQ ID NO: 711819 - RNA, 17 nt, Homo sapiens
aauaauaucccacuggg

SEQ ID NO: 711820 - RNA, 20 nt, Homo sapiens
aauaaucacgcuuuccugaa

SEQ ID NO: 711821 - RNA, 15 nt, Homo sapiens
aauaauucuaugaga

SEQ ID NO: 711822 - RNA, 17 nt, Homo sapiens
aauacucaccuccuccc

SEQ ID NO: 711823 - RNA, 15 nt, Homo sapiens
aauauauuuuaucug

SEQ ID NO: 711824 - RNA, 19 nt, Homo sapiens
aauaucccuccuguuggga

SEQ ID NO: 711825 - RNA, 17 nt, Homo sapiens
aauauccuaaacaucau

SEQ ID NO: 711826 - RNA, 16 nt, Homo sapiens
aauauccuuuaauuga

SEQ ID NO: 711827 - RNA, 18 nt, Homo sapiens
aauaugacacucuaguca

SEQ ID NO: 711828 - RNA, 19 nt, Homo sapiens
aauauuuuguuuugugcag

SEQ ID NO: 711829 - RNA, 18 nt, Homo sapiens
aaucacaagaagauuccc

SEQ ID NO: 711830 - RNA, 22 nt, Homo sapiens
aaucaguguuuccaaucugucc

SEQ ID NO: 711831 - RNA, 17 nt, Homo sapiens
aaucauuauuacuuuug

SEQ ID NO: 711832 - RNA, 22 nt, Homo sapiens
aaucccagcaugcugagauuac

SEQ ID NO: 711833 - RNA, 24 nt, Homo sapiens
aaucccucaaaacaaucuugucau

SEQ ID NO: 711834 - RNA, 20 nt, Homo sapiens
aaucuggcuccuguuuccau

SEQ ID NO: 711835 - RNA, 15 nt, Homo sapiens
aaucuguagucacuu

SEQ ID NO: 711836 - RNA, 16 nt, Homo sapiens
aaucuuaccagucugu

SEQ ID NO: 711837 - RNA, 21 nt, Homo sapiens
aaucuucugccuucucaugau

SEQ ID NO: 711838 - RNA, 13 nt, Homo sapiens
aaugaacagaauu

SEQ ID NO: 711839 - RNA, 21 nt, Homo sapiens
aaugaggagacacaccugagg

SEQ ID NO: 711840 - RNA, 16 nt, Homo sapiens
aaugcauauacuuuaa

SEQ ID NO: 711841 - RNA, 16 nt, Homo sapiens
aaugccacucuguaau

SEQ ID NO: 711842 - RNA, 15 nt, Homo sapiens
aauguaaagccaugc

SEQ ID NO: 711843 - RNA, 23 nt, Homo sapiens
aauguuaagacuugacaguggaa

SEQ ID NO: 711844 - RNA, 22 nt, Homo sapiens
aauguuuaugaauaguuuccaa

SEQ ID NO: 711845 - RNA, 18 nt, Homo sapiens
aauuaauggaauauguaa

SEQ ID NO: 711846 - RNA, 16 nt, Homo sapiens
aauuaauuuacuagaa

SEQ ID NO: 711847 - RNA, 23 nt, Homo sapiens
aauuagcaauugacugucacugu

SEQ ID NO: 711848 - RNA, 19 nt, Homo sapiens
aauuauaagaggauaugaa

SEQ ID NO: 711849 - RNA, 18 nt, Homo sapiens
aauuauuuugugaugcaa

SEQ ID NO: 711850 - RNA, 16 nt, Homo sapiens
aauuuuagcgugcuca

SEQ ID NO: 711851 - RNA, 18 nt, Homo sapiens
acaaacauuugcugaaua

SEQ ID NO: 711852 - RNA, 17 nt, Homo sapiens
acaaagaaaaacagaga

SEQ ID NO: 711853 - RNA, 15 nt, Homo sapiens
acaaagccaaucuca

SEQ ID NO: 711854 - RNA, 14 nt, Homo sapiens
acaacacaguucuc

SEQ ID NO: 711855 - RNA, 15 nt, Homo sapiens
acaacggaugaaugu

SEQ ID NO: 711856 - RNA, 18 nt, Homo sapiens
acaagaagggacugagag

SEQ ID NO: 711857 - RNA, 19 nt, Homo sapiens
acaaguuagaaaacauaau

SEQ ID NO: 711858 - RNA, 18 nt, Homo sapiens
acaauaauuuucuaccug

SEQ ID NO: 711859 - RNA, 15 nt, Homo sapiens
acaaucuugucauac

SEQ ID NO: 711860 - RNA, 20 nt, Homo sapiens
acaauguuucagaagcccca

SEQ ID NO: 711861 - RNA, 23 nt, Homo sapiens
acacaaaaggaacaaaagcgaaa

SEQ ID NO: 711862 - RNA, 18 nt, Homo sapiens
acacaggcaaaauccuug

SEQ ID NO: 711863 - RNA, 22 nt, Homo sapiens
acacuagacaagccagaacuug

SEQ ID NO: 711864 - RNA, 22 nt, Homo sapiens
acacugucagcagggacuguaa

SEQ ID NO: 711865 - RNA, 15 nt, Homo sapiens
acacuugcaaccuac

SEQ ID NO: 711866 - RNA, 20 nt, Homo sapiens
acagaaaugauuacuaagga

SEQ ID NO: 711867 - RNA, 20 nt, Homo sapiens
acagacacuggcauggauau

SEQ ID NO: 711868 - RNA, 15 nt, Homo sapiens
acagauuguuugcaa

SEQ ID NO: 711869 - RNA, 22 nt, Homo sapiens
acagauuuuuuuaacgagaaaa

SEQ ID NO: 711870 - RNA, 20 nt, Homo sapiens
acagcucuagacacugccac

SEQ ID NO: 711871 - RNA, 13 nt, Homo sapiens
acaggcaccugcc

SEQ ID NO: 711872 - RNA, 17 nt, Homo sapiens
acaggcaccugccaaca

SEQ ID NO: 711873 - RNA, 20 nt, Homo sapiens
acagguuuucagcaacucag

SEQ ID NO: 711874 - RNA, 17 nt, Homo sapiens
acagugcagugcgcugu

SEQ ID NO: 711875 - RNA, 15 nt, Homo sapiens
acauacguacuuuuc

SEQ ID NO: 711876 - RNA, 20 nt, Homo sapiens
acaucacuuguacaaaauaa

SEQ ID NO: 711877 - RNA, 19 nt, Homo sapiens
acauccagauagguuacca

SEQ ID NO: 711878 - RNA, 15 nt, Homo sapiens
acauccauguuccga

SEQ ID NO: 711879 - RNA, 21 nt, Homo sapiens
acaugcacuuggcugcauaaa

SEQ ID NO: 711880 - RNA, 17 nt, Homo sapiens
acaugcauuacugcaug

SEQ ID NO: 711881 - RNA, 22 nt, Homo sapiens
acaugcauuacugcaugcacuu

SEQ ID NO: 711882 - RNA, 16 nt, Homo sapiens
acaugcuucagugcug

SEQ ID NO: 711883 - RNA, 22 nt, Homo sapiens
acauggacaugcuucagugcug

SEQ ID NO: 711884 - RNA, 18 nt, Homo sapiens
acauuagaagacaauuga

SEQ ID NO: 711885 - RNA, 23 nt, Homo sapiens
acauuguguucccauuucagcug

SEQ ID NO: 711886 - RNA, 23 nt, Homo sapiens
accaaaucuugguugaugccaaa

SEQ ID NO: 711887 - RNA, 19 nt, Homo sapiens
accaauagggcugagcucu

SEQ ID NO: 711888 - RNA, 16 nt, Homo sapiens
accaccagacugcaau

SEQ ID NO: 711889 - RNA, 13 nt, Homo sapiens
accagacugcaau

SEQ ID NO: 711890 - RNA, 15 nt, Homo sapiens
accagcaguacucag

SEQ ID NO: 711891 - RNA, 17 nt, Homo sapiens
accagccucuccacuca

SEQ ID NO: 711892 - RNA, 21 nt, Homo sapiens
accaggacucugccccuucug

SEQ ID NO: 711893 - RNA, 13 nt, Homo sapiens
accauauacagcu

SEQ ID NO: 711894 - RNA, 15 nt, Homo sapiens
accaugccaggcuaa

SEQ ID NO: 711895 - RNA, 16 nt, Homo sapiens
accaugggaugaugau

SEQ ID NO: 711896 - RNA, 17 nt, Homo sapiens
accauguuagccaggau

SEQ ID NO: 711897 - RNA, 14 nt, Homo sapiens
accauuucagagag

SEQ ID NO: 711898 - RNA, 16 nt, Homo sapiens
acccacacucagaucc

SEQ ID NO: 711899 - RNA, 22 nt, Homo sapiens
acccacuguggacuccaugccu

SEQ ID NO: 711900 - RNA, 15 nt, Homo sapiens
accccagacacuggu

SEQ ID NO: 711901 - RNA, 14 nt, Homo sapiens
accccccuugccca

SEQ ID NO: 711902 - RNA, 15 nt, Homo sapiens
accccccuugcccau

SEQ ID NO: 711903 - RNA, 22 nt, Homo sapiens
accccugcucaguaaagcacuu

SEQ ID NO: 711904 - RNA, 14 nt, Homo sapiens
acccucauacacag

SEQ ID NO: 711905 - RNA, 18 nt, Homo sapiens
acccuguugcuuuucaca

SEQ ID NO: 711906 - RNA, 22 nt, Homo sapiens
acccuucauuuaacaaguaaga

SEQ ID NO: 711907 - RNA, 19 nt, Homo sapiens
accgaggcagggaaggauc

SEQ ID NO: 711908 - RNA, 15 nt, Homo sapiens
accuaaaacaucuca

SEQ ID NO: 711909 - RNA, 14 nt, Homo sapiens
accuacuuacaugc

SEQ ID NO: 711910 - RNA, 22 nt, Homo sapiens
accucaacugccuacuccaaaa

SEQ ID NO: 711911 - RNA, 15 nt, Homo sapiens
accucaagcugcauc

SEQ ID NO: 711912 - RNA, 18 nt, Homo sapiens
accucagcaccuugcucu

SEQ ID NO: 711913 - RNA, 17 nt, Homo sapiens
accucccuauacugcuu

SEQ ID NO: 711914 - RNA, 21 nt, Homo sapiens
accugaggcugguuucuuuca

SEQ ID NO: 711915 - RNA, 15 nt, Homo sapiens
accuggggaguuuac

SEQ ID NO: 711916 - RNA, 17 nt, Homo sapiens
accuggggaguuuacua

SEQ ID NO: 711917 - RNA, 15 nt, Homo sapiens
accuucugaccuccc

SEQ ID NO: 711918 - RNA, 15 nt, Homo sapiens
accuuuuuauuugca

SEQ ID NO: 711919 - RNA, 16 nt, Homo sapiens
accuuuuuauuugcau

SEQ ID NO: 711920 - RNA, 16 nt, Homo sapiens
acguaagacuguguaa

SEQ ID NO: 711921 - RNA, 11 nt, Homo sapiens
acguaucccac

SEQ ID NO: 711922 - RNA, 18 nt, Homo sapiens
acgucagcugggacaccc

SEQ ID NO: 711923 - RNA, 22 nt, Homo sapiens
acgucugcagaaacagugcaag

SEQ ID NO: 711924 - RNA, 18 nt, Homo sapiens
acuaaacacgugacacaa

SEQ ID NO: 711925 - RNA, 21 nt, Homo sapiens
acuaaggaagauuacucagua

SEQ ID NO: 711926 - RNA, 20 nt, Homo sapiens
acuaauuuuuauuuuugcug

SEQ ID NO: 711927 - RNA, 21 nt, Homo sapiens
acuacaaccaauggaauguga

SEQ ID NO: 711928 - RNA, 17 nt, Homo sapiens
acuacaggcaccugcca

SEQ ID NO: 711929 - RNA, 21 nt, Homo sapiens
acuauggagugcaccaaagag

SEQ ID NO: 711930 - RNA, 16 nt, Homo sapiens
acucaaaagaacaaga

SEQ ID NO: 711931 - RNA, 20 nt, Homo sapiens
acucaugugacucuuuccaa

SEQ ID NO: 711932 - RNA, 16 nt, Homo sapiens
cucagggacucaggug

SEQ ID NO: 711933 - RNA, 20 nt, Homo sapiens
cucagguggcccuacuggga

SEQ ID NO: 711934 - RNA, 18 nt, Homo sapiens
cucauaacuugagaccua

SEQ ID NO: 711935 - RNA, 13 nt, Homo sapiens
cucauacacagaa

SEQ ID NO: 711936 - RNA, 13 nt, Homo sapiens
cucauauugugau

SEQ ID NO: 711937 - RNA, 17 nt, Homo sapiens
cucaucccuccaucuca

SEQ ID NO: 711938 - RNA, 15 nt, Homo sapiens
cucaucuuucuucca

SEQ ID NO: 711939 - RNA, 20 nt, Homo sapiens
cucauuacuacucagccuuc

SEQ ID NO: 711940 - RNA, 12 nt, Homo sapiens
cucauuagacug

SEQ ID NO: 711941 - RNA, 21 nt, Homo sapiens
cuccagcaucgucucauguaa

SEQ ID NO: 711942 - RNA, 23 nt, Homo sapiens
cuccagccaccacccacaaucac

SEQ ID NO: 711943 - RNA, 10 nt, Homo sapiens
cuccaucucc

SEQ ID NO: 711944 - RNA, 17 nt, Homo sapiens
cucccuggaugacauua

SEQ ID NO: 711945 - RNA, 11 nt, Homo sapiens
cucccuuugaa

SEQ ID NO: 711946 - RNA, 14 nt, Homo sapiens
cuccgucaccucag

SEQ ID NO: 711947 - RNA, 17 nt, Homo sapiens
cuccuaaaguacuggga

SEQ ID NO: 711948 - RNA, 19 nt, Homo sapiens
cuccucccaggaacugggc

SEQ ID NO: 711949 - RNA, 17 nt, Homo sapiens
cuccucgagaucccaac

SEQ ID NO: 711950 - RNA, 20 nt, Homo sapiens
cuccugaguaguugggauua

SEQ ID NO: 711951 - RNA, 17 nt, Homo sapiens
cuccugccggcuccuug

SEQ ID NO: 711952 - RNA, 23 nt, Homo sapiens
cuccuugguucuugaggggacca

SEQ ID NO: 711953 - RNA, 20 nt, Homo sapiens
cuccuuuggaaugcuguauu

SEQ ID NO: 711954 - RNA, 14 nt, Homo sapiens
cucuagauugagag

SEQ ID NO: 711955 - RNA, 24 nt, Homo sapiens
cucuaugaccucgcccuccacaaa

SEQ ID NO: 711956 - RNA, 20 nt, Homo sapiens
cucucccaugcacacaaaca

SEQ ID NO: 711957 - RNA, 15 nt, Homo sapiens
cucuguaauugcaaa

SEQ ID NO: 711958 - RNA, 14 nt, Homo sapiens
cucuuauugccuca

SEQ ID NO: 711959 - RNA, 23 nt, Homo sapiens
cucuucugagcaccuacuuacau

SEQ ID NO: 711960 - RNA, 18 nt, Homo sapiens
cucuugccucaaccuccc

SEQ ID NO: 711961 - RNA, 23 nt, Homo sapiens
cugaaaaaugguaauuguugcua

SEQ ID NO: 711962 - RNA, 20 nt, Homo sapiens
cugaaauuuaacugccuaaa

SEQ ID NO: 711963 - RNA, 23 nt, Homo sapiens
cugaauccaaacuaauccaucac

SEQ ID NO: 711964 - RNA, 22 nt, Homo sapiens
cugaauuuuuaaaacccauuua

SEQ ID NO: 711965 - RNA, 11 nt, Homo sapiens
cugacaugucc

SEQ ID NO: 711966 - RNA, 14 nt, Homo sapiens
cugacgaacuccuu

SEQ ID NO: 711967 - RNA, 15 nt, Homo sapiens
cugagagaguagcag

SEQ ID NO: 711968 - RNA, 14 nt, Homo sapiens
cugagauacauaca

SEQ ID NO: 711969 - RNA, 20 nt, Homo sapiens
cugagcaaaucaccacaaac

SEQ ID NO: 711970 - RNA, 16 nt, Homo sapiens
cugagcaccuacuuac

SEQ ID NO: 711971 - RNA, 21 nt, Homo sapiens
cugagcaccuacuuacaugca

SEQ ID NO: 711972 - RNA, 22 nt, Homo sapiens
cugaggaauuucaccuguaaac

SEQ ID NO: 711973 - RNA, 18 nt, Homo sapiens
cugaguaguugggauuac

SEQ ID NO: 711974 - RNA, 20 nt, Homo sapiens
cugauaaccacuccuaauau

SEQ ID NO: 711975 - RNA, 15 nt, Homo sapiens
cugcagaaacagugc

SEQ ID NO: 711976 - RNA, 14 nt, Homo sapiens
cugcagacucacug

SEQ ID NO: 711977 - RNA, 18 nt, Homo sapiens
cugcagacucacuguggg

SEQ ID NO: 711978 - RNA, 22 nt, Homo sapiens
cugcagggggugugucugcuca

SEQ ID NO: 711979 - RNA, 22 nt, Homo sapiens
cugcauccauucuccugaggau

SEQ ID NO: 711980 - RNA, 18 nt, Homo sapiens
cugcaugcacuucuuaca

SEQ ID NO: 711981 - RNA, 15 nt, Homo sapiens
cugccgagaguccau

SEQ ID NO: 711982 - RNA, 22 nt, Homo sapiens
cugcuccccacgucagcuggga

SEQ ID NO: 711983 - RNA, 16 nt, Homo sapiens
cuggaacugucucuca

SEQ ID NO: 711984 - RNA, 15 nt, Homo sapiens
cuggagcccacugua

SEQ ID NO: 711985 - RNA, 15 nt, Homo sapiens
cuggaugacauuaaa

SEQ ID NO: 711986 - RNA, 14 nt, Homo sapiens
cuggcaacaucuuu

SEQ ID NO: 711987 - RNA, 17 nt, Homo sapiens
cugggcaacacagugag

SEQ ID NO: 711988 - RNA, 16 nt, Homo sapiens
cuggucccaagacagu

SEQ ID NO: 711989 - RNA, 15 nt, Homo sapiens
cugguuagaaaugca

SEQ ID NO: 711990 - RNA, 15 nt, Homo sapiens
cuguaaacuguguau

SEQ ID NO: 711991 - RNA, 18 nt, Homo sapiens
cuguaaacuuguagcauu

SEQ ID NO: 711992 - RNA, 18 nt, Homo sapiens
cuguagccccagugacag

SEQ ID NO: 711993 - RNA, 21 nt, Homo sapiens
cuguauuuugaugauugcuau

SEQ ID NO: 711994 - RNA, 16 nt, Homo sapiens
cugucuacuugcucag

SEQ ID NO: 711995 - RNA, 15 nt, Homo sapiens
cugucucucaugaac

SEQ ID NO: 711996 - RNA, 17 nt, Homo sapiens
cugucucucaugaaccu

SEQ ID NO: 711997 - RNA, 18 nt, Homo sapiens
cugucucucaugaaccuc

SEQ ID NO: 711998 - RNA, 15 nt, Homo sapiens
cugugcuauggugcu

SEQ ID NO: 711999 - RNA, 19 nt, Homo sapiens
cugugcuauggugcucugu

SEQ ID NO: 712000 - RNA, 15 nt, Homo sapiens
cugugggcccaguca

SEQ ID NO: 712001 - RNA, 16 nt, Homo sapiens
cuguguacauaacuga

SEQ ID NO: 712002 - RNA, 22 nt, Homo sapiens
cuguugaguuggacacacugua

SEQ ID NO: 712003 - RNA, 17 nt, Homo sapiens
cuguuuuucggacaguu

SEQ ID NO: 712004 - RNA, 22 nt, Homo sapiens
cuuaaaagaaagagaaguuuuc

SEQ ID NO: 712005 - RNA, 21 nt, Homo sapiens
cuuaguguacaugaaagcgua

SEQ ID NO: 712006 - RNA, 19 nt, Homo sapiens
cuuaugcaaauaaccauug

SEQ ID NO: 712007 - RNA, 19 nt, Homo sapiens
cuucacucuucaaaugccu

SEQ ID NO: 712008 - RNA, 14 nt, Homo sapiens
cuucaguuaugauu

SEQ ID NO: 712009 - RNA, 21 nt, Homo sapiens
cuucaucuggcaacaucuuua

SEQ ID NO: 712010 - RNA, 19 nt, Homo sapiens
cuucccugguaccuagcaa

SEQ ID NO: 712011 - RNA, 15 nt, Homo sapiens
cuuccucuccugucu

SEQ ID NO: 712012 - RNA, 15 nt, Homo sapiens
cuuccugacacuuua

SEQ ID NO: 712013 - RNA, 23 nt, Homo sapiens
cuuccugguugagcuucugcuaa

SEQ ID NO: 712014 - RNA, 22 nt, Homo sapiens
cuucuauuccauggcuaacugg

SEQ ID NO: 712015 - RNA, 15 nt, Homo sapiens
cuucucaugauccaa

SEQ ID NO: 712016 - RNA, 13 nt, Homo sapiens
cuucuccaucucc

SEQ ID NO: 712017 - RNA, 21 nt, Homo sapiens
cuucugagcaccuacuuacau

SEQ ID NO: 712018 - RNA, 18 nt, Homo sapiens
cuucugcuuucucgggaa

SEQ ID NO: 712019 - RNA, 23 nt, Homo sapiens
cuucugcuuucucgggaauuuuc

SEQ ID NO: 712020 - RNA, 20 nt, Homo sapiens
cuugagaccuaaucucugua

SEQ ID NO: 712021 - RNA, 14 nt, Homo sapiens
cuugaggggaccag

SEQ ID NO: 712022 - RNA, 21 nt, Homo sapiens
cuugaguaguuuuuaucugaa

SEQ ID NO: 712023 - RNA, 22 nt, Homo sapiens
cuugcuuaugacaucacuugua

SEQ ID NO: 712024 - RNA, 22 nt, Homo sapiens
cuuggcugcaggaaucuuuaaa

SEQ ID NO: 712025 - RNA, 24 nt, Homo sapiens
cuugguaaaauaaucaguguuucc

SEQ ID NO: 712026 - RNA, 18 nt, Homo sapiens
cuuuaaaauguaaagcca

SEQ ID NO: 712027 - RNA, 14 nt, Homo sapiens
cuuuaaagacuuaa

SEQ ID NO: 712028 - RNA, 18 nt, Homo sapiens
cuuuaauacucaccuccu

SEQ ID NO: 712029 - RNA, 21 nt, Homo sapiens
cuuuaauacucaccuccuccc

SEQ ID NO: 712030 - RNA, 16 nt, Homo sapiens
cuuuccugaauccaaa

SEQ ID NO: 712031 - RNA, 21 nt, Homo sapiens
cuuucuacaccuguugcaccu

SEQ ID NO: 712032 - RNA, 17 nt, Homo sapiens
cuuucucgauugguguc

SEQ ID NO: 712033 - RNA, 16 nt, Homo sapiens
cuuucuuccaaacagg

SEQ ID NO: 712034 - RNA, 20 nt, Homo sapiens
cuuugaagcuagugcauugg

SEQ ID NO: 712035 - RNA, 23 nt, Homo sapiens
cuuuggggagcaggaggccaaua

SEQ ID NO: 712036 - RNA, 20 nt, Homo sapiens
cuuugugugcgucacuguga

SEQ ID NO: 712037 - RNA, 15 nt, Homo sapiens
cuuuuaaaugcauaa

SEQ ID NO: 712038 - RNA, 16 nt, Homo sapiens
cuuuuauugugaauua

SEQ ID NO: 712039 - RNA, 19 nt, Homo sapiens
cuuuucacaaaucauggua

SEQ ID NO: 712040 - RNA, 11 nt, Homo sapiens
cuuuucucugc

SEQ ID NO: 712041 - RNA, 15 nt, Homo sapiens
cuuuuggacaaaccu

SEQ ID NO: 712042 - RNA, 22 nt, Homo sapiens
cuuuuggcuuguaaaguacaga

SEQ ID NO: 712043 - RNA, 12 nt, Homo sapiens
cuuuuguuucag

SEQ ID NO: 712044 - RNA, 19 nt, Homo sapiens
cuuuuuuuuuuugguccaa

SEQ ID NO: 712045 - RNA, 20 nt, Homo sapiens
gaaaaauuaauuuacuagaa

SEQ ID NO: 712046 - RNA, 14 nt, Homo sapiens
gaaaaguugcuauu

SEQ ID NO: 712047 - RNA, 20 nt, Homo sapiens
gaaaauaguuuggauuacuu

SEQ ID NO: 712048 - RNA, 19 nt, Homo sapiens
gaaacacguaucccaccug

SEQ ID NO: 712049 - RNA, 15 nt, Homo sapiens
gaaacauuguuaaua

SEQ ID NO: 712050 - RNA, 18 nt, Homo sapiens
gaaagcuucaaacugcau

SEQ ID NO: 712051 - RNA, 19 nt, Homo sapiens
gaaaucaaaagggccaaag

SEQ ID NO: 712052 - RNA, 15 nt, Homo sapiens
gaaauuuuccauuac

SEQ ID NO: 712053 - RNA, 11 nt, Homo sapiens
gaacacuguga

SEQ ID NO: 712054 - RNA, 18 nt, Homo sapiens
gaacauaaugaacagaau

SEQ ID NO: 712055 - RNA, 18 nt, Homo sapiens
gaacaucucgaauacaau

SEQ ID NO: 712056 - RNA, 23 nt, Homo sapiens
gaacccugggacguggcuaguca

SEQ ID NO: 712057 - RNA, 21 nt, Homo sapiens
gaaccugcccugcucccacag

SEQ ID NO: 712058 - RNA, 16 nt, Homo sapiens
gaacgcuaucugggaa

SEQ ID NO: 712059 - RNA, 21 nt, Homo sapiens
gaacuaaguuuuuuacuucca

SEQ ID NO: 712060 - RNA, 19 nt, Homo sapiens
gaacucuucacucuucaaa

SEQ ID NO: 712061 - RNA, 23 nt, Homo sapiens
uccuagcguuuuggaagaggaaa

SEQ ID NO: 712062 - RNA, 18 nt, Homo sapiens
uccucgagaucccaacac

SEQ ID NO: 712063 - RNA, 20 nt, Homo sapiens
uccucugcccgggagcucag

SEQ ID NO: 712064 - RNA, 15 nt, Homo sapiens
uccugacacuuuaau

SEQ ID NO: 712065 - RNA, 13 nt, Homo sapiens
uccuggacaguuu

SEQ ID NO: 712066 - RNA, 18 nt, Homo sapiens
uccuggugccaauuucaa

SEQ ID NO: 712067 - RNA, 13 nt, Homo sapiens
uccuguugggaga

SEQ ID NO: 712068 - RNA, 22 nt, Homo sapiens
uccuuauuuaucaacaucuuuu

SEQ ID NO: 712069 - RNA, 19 nt, Homo sapiens
uccuugaguaguuuuuauc

SEQ ID NO: 712070 - RNA, 15 nt, Homo sapiens
uccuuggaaauugga

SEQ ID NO: 712071 - RNA, 20 nt, Homo sapiens
uccuuuggaaugcuguauua

SEQ ID NO: 712072 - RNA, 12 nt, Homo sapiens
ucgauuagacug

SEQ ID NO: 712073 - RNA, 20 nt, Homo sapiens
ucgauuagacuggacagcuu

SEQ ID NO: 712074 - RNA, 16 nt, Homo sapiens
ucuaaacuuuaauuca

SEQ ID NO: 712075 - RNA, 13 nt, Homo sapiens
ucuaauacauucc

SEQ ID NO: 712076 - RNA, 19 nt, Homo sapiens
ucuacaaacucccacuugu

SEQ ID NO: 712077 - RNA, 21 nt, Homo sapiens
ucuacaccuguugcaccucag

SEQ ID NO: 712078 - RNA, 17 nt, Homo sapiens
ucuaccaagcugugacc

SEQ ID NO: 712079 - RNA, 18 nt, Homo sapiens
ucuacuggucuuguggaa

SEQ ID NO: 712080 - RNA, 15 nt, Homo sapiens
ucuagaacacaggca

SEQ ID NO: 712081 - RNA, 22 nt, Homo sapiens
ucuagaacacaggcaaaauccu

SEQ ID NO: 712082 - RNA, 12 nt, Homo sapiens
ucuaggauuuua

SEQ ID NO: 712083 - RNA, 13 nt, Homo sapiens
ucuauauaccaaa

SEQ ID NO: 712084 - RNA, 22 nt, Homo sapiens
ucuaugagauagguacuauuau

SEQ ID NO: 712085 - RNA, 20 nt, Homo sapiens
ucucaaacuccugaccucag

SEQ ID NO: 712086 - RNA, 23 nt, Homo sapiens
ucucaguugauuuucuggauucc

SEQ ID NO: 712087 - RNA, 18 nt, Homo sapiens
ucucaucaguauccagug

SEQ ID NO: 712088 - RNA, 16 nt, Homo sapiens
ucuccucugauuauca

SEQ ID NO: 712089 - RNA, 18 nt, Homo sapiens
ucucgcuccucaaccccu

SEQ ID NO: 712090 - RNA, 16 nt, Homo sapiens
ucucucucucuacaaa

SEQ ID NO: 712091 - RNA, 15 nt, Homo sapiens
ucucucuugcaggaa

SEQ ID NO: 712092 - RNA, 16 nt, Homo sapiens
ucucugugugcacaaa

SEQ ID NO: 712093 - RNA, 18 nt, Homo sapiens
ucucuugccucaaccucc

SEQ ID NO: 712094 - RNA, 23 nt, Homo sapiens
ucugaaaaggagggguacauugg

SEQ ID NO: 712095 - RNA, 12 nt, Homo sapiens
ucugaacacauu

SEQ ID NO: 712096 - RNA, 19 nt, Homo sapiens
ucugaacucaaacugagga

SEQ ID NO: 712097 - RNA, 12 nt, Homo sapiens
ucugagcaccua

SEQ ID NO: 712098 - RNA, 19 nt, Homo sapiens
ucugagcaccuacuuacau

SEQ ID NO: 712099 - RNA, 24 nt, Homo sapiens
ucugagcaccuacuuacaugcauu

SEQ ID NO: 712100 - RNA, 16 nt, Homo sapiens
ucugcaagcuuuucaa

SEQ ID NO: 712101 - RNA, 23 nt, Homo sapiens
ucuggcugcaacuuaaugcucug

SEQ ID NO: 712102 - RNA, 21 nt, Homo sapiens
ucuuacaauaauucuaugaga

SEQ ID NO: 712103 - RNA, 16 nt, Homo sapiens
ucuuagcugucugcuc

SEQ ID NO: 712104 - RNA, 12 nt, Homo sapiens
ucuuccaaacag

SEQ ID NO: 712105 - RNA, 18 nt, Homo sapiens
ucuuccaaacaggcucag

SEQ ID NO: 712106 - RNA, 14 nt, Homo sapiens
ucuucuccaucucc

SEQ ID NO: 712107 - RNA, 15 nt, Homo sapiens
ucuucugagcaccua

SEQ ID NO: 712108 - RNA, 12 nt, Homo sapiens
ucuuuccuccaa

SEQ ID NO: 712109 - RNA, 19 nt, Homo sapiens
ucuuugcuucacagguuuu

SEQ ID NO: 712110 - RNA, 12 nt, Homo sapiens
ugaaaauguuca

SEQ ID NO: 712111 - RNA, 16 nt, Homo sapiens
ugaaacauuacaguua

SEQ ID NO: 712112 - RNA, 17 nt, Homo sapiens
ugaaagagaaacacgua

SEQ ID NO: 712113 - RNA, 24 nt, Homo sapiens
ugaaaugccagaaugacuucugac

SEQ ID NO: 712114 - RNA, 21 nt, Homo sapiens
ugaaauuuaacugccuaaaau

SEQ ID NO: 712115 - RNA, 16 nt, Homo sapiens
ugaacaaaguuuacca

SEQ ID NO: 712116 - RNA, 20 nt, Homo sapiens
ugaacauaaugaacagaauu

SEQ ID NO: 712117 - RNA, 13 nt, Homo sapiens
ugaaggcuguaca

SEQ ID NO: 712118 - RNA, 19 nt, Homo sapiens
ugaagguggaacaagcaca

SEQ ID NO: 712119 - RNA, 14 nt, Homo sapiens
ugaauaguuuccaa

SEQ ID NO: 712120 - RNA, 21 nt, Homo sapiens
ugaauccucucucuguguuac

SEQ ID NO: 712121 - RNA, 15 nt, Homo sapiens
ugaaugcaaaccaua

SEQ ID NO: 712122 - RNA, 15 nt, Homo sapiens
ugaaugccacucugu

SEQ ID NO: 712123 - RNA, 15 nt, Homo sapiens
ugaauuagacuugua

SEQ ID NO: 712124 - RNA, 14 nt, Homo sapiens
ugaccccugcucag

SEQ ID NO: 712125 - RNA, 15 nt, Homo sapiens
ugacuuguguuuuau

SEQ ID NO: 712126 - RNA, 16 nt, Homo sapiens
ugagaaaagcuuugaa

SEQ ID NO: 712127 - RNA, 14 nt, Homo sapiens
ugagaaaggauuaa

SEQ ID NO: 712128 - RNA, 17 nt, Homo sapiens
ugagcccaaggcacuga

SEQ ID NO: 712129 - RNA, 21 nt, Homo sapiens
ugagguuaaaauauaaauuaa

SEQ ID NO: 712130 - RNA, 21 nt, Homo sapiens
ugaguugcccaucauacgcau

SEQ ID NO: 712131 - RNA, 21 nt, Homo sapiens
ugauacuguacauagcuguuu

SEQ ID NO: 712132 - RNA, 14 nt, Homo sapiens
ugauagaaaugcca

SEQ ID NO: 712133 - RNA, 17 nt, Homo sapiens
ugaucagugggccucca

SEQ ID NO: 712134 - RNA, 14 nt, Homo sapiens
ugauuacuaaggaa

SEQ ID NO: 712135 - RNA, 15 nt, Homo sapiens
ugauuagccauuuga

SEQ ID NO: 712136 - RNA, 20 nt, Homo sapiens
ugcaagguucaacuuauuaa

SEQ ID NO: 712137 - RNA, 18 nt, Homo sapiens
ugcacacaaacaccuccu

SEQ ID NO: 712138 - RNA, 16 nt, Homo sapiens
ugcaccaacuuugaag

SEQ ID NO: 712139 - RNA, 15 nt, Homo sapiens
ugcacuugcuggaag

SEQ ID NO: 712140 - RNA, 14 nt, Homo sapiens
ugcauacaguaauu

SEQ ID NO: 712141 - RNA, 15 nt, Homo sapiens
ugcauuaaaaaugca

SEQ ID NO: 712142 - RNA, 23 nt, Homo sapiens
ugccaagcccucaauaagccagc

SEQ ID NO: 712143 - RNA, 15 nt, Homo sapiens
ugccaauuagcaauu

SEQ ID NO: 712144 - RNA, 19 nt, Homo sapiens
ugccccagagccugggaag

SEQ ID NO: 712145 - RNA, 14 nt, Homo sapiens
ugcccccaucuuuc

SEQ ID NO: 712146 - RNA, 14 nt, Homo sapiens
ugccccuugacaac

SEQ ID NO: 712147 - RNA, 14 nt, Homo sapiens
ugccuacuccaaaa

SEQ ID NO: 712148 - RNA, 18 nt, Homo sapiens
ugccuaucuucuuucaca

SEQ ID NO: 712149 - RNA, 12 nt, Homo sapiens
ugccucaugccu

SEQ ID NO: 712150 - RNA, 21 nt, Homo sapiens
ugccucaugccuguaauccca

SEQ ID NO: 712151 - RNA, 16 nt, Homo sapiens
ugcgcuguaguaggca

SEQ ID NO: 712152 - RNA, 17 nt, Homo sapiens
ugcggcuccucagggac

SEQ ID NO: 712153 - RNA, 19 nt, Homo sapiens
ugcuaugucaggcuuucau

SEQ ID NO: 712154 - RNA, 17 nt, Homo sapiens
ugcucagguacuuguaa

SEQ ID NO: 712155 - RNA, 14 nt, Homo sapiens
ugcuccuuacccug

SEQ ID NO: 712156 - RNA, 18 nt, Homo sapiens
ugcuuaaaaaugccaaaa

SEQ ID NO: 712157 - RNA, 17 nt, Homo sapiens
ugcuuagucccucaugc

SEQ ID NO: 712158 - RNA, 19 nt, Homo sapiens
ugcuuagucccucaugcaa

SEQ ID NO: 712159 - RNA, 17 nt, Homo sapiens
ugcuucaggauaccaua

SEQ ID NO: 712160 - RNA, 19 nt, Homo sapiens
ugcuucaggauaccauaua

SEQ ID NO: 712161 - RNA, 22 nt, Homo sapiens
ugcuucuaguucugccaggaga

SEQ ID NO: 712162 - RNA, 22 nt, Homo sapiens
uggaaaaaaaauaagauaucaa

SEQ ID NO: 712163 - RNA, 17 nt, Homo sapiens
uggaaagaaguugggga

SEQ ID NO: 712164 - RNA, 16 nt, Homo sapiens
uggaacaagcacagau

SEQ ID NO: 712165 - RNA, 21 nt, Homo sapiens
uggaacacuagacaagccaga

SEQ ID NO: 712166 - RNA, 23 nt, Homo sapiens
uggaacuacauuaguacacagca

SEQ ID NO: 712167 - RNA, 15 nt, Homo sapiens
uggaacugucucuca

SEQ ID NO: 712168 - RNA, 18 nt, Homo sapiens
uggaacugucucucauga

SEQ ID NO: 712169 - RNA, 16 nt, Homo sapiens
uggacaaagaaccuuc

SEQ ID NO: 712170 - RNA, 19 nt, Homo sapiens
uggacaagccauuauacca

SEQ ID NO: 712171 - RNA, 17 nt, Homo sapiens
uggacaugcgugaccag

SEQ ID NO: 712172 - RNA, 16 nt, Homo sapiens
uggacaugcuuuggca

SEQ ID NO: 712173 - RNA, 23 nt, Homo sapiens
uggacuauggagugcaccaaaga

SEQ ID NO: 712174 - RNA, 15 nt, Homo sapiens
uggacugucauagaa

SEQ ID NO: 712175 - RNA, 16 nt, Homo sapiens
uggacugugugcucag

SEQ ID NO: 712176 - RNA, 17 nt, Homo sapiens
uggagaccgugaccagu

SEQ ID NO: 712177 - RNA, 15 nt, Homo sapiens
uggagauucucauaa

SEQ ID NO: 712178 - RNA, 19 nt, Homo sapiens
uggagcccacuguacuugc

SEQ ID NO: 712179 - RNA, 16 nt, Homo sapiens
uggagugcaccaaaga

SEQ ID NO: 712180 - RNA, 21 nt, Homo sapiens
uggcccccucccuggaugaca

SEQ ID NO: 712181 - RNA, 24 nt, Homo sapiens
uggcccccucccuggaugacauua

SEQ ID NO: 712182 - RNA, 15 nt, Homo sapiens
uggcccuacugggag

SEQ ID NO: 712183 - RNA, 23 nt, Homo sapiens
uggcggcccccccagcugucauc

SEQ ID NO: 712184 - RNA, 20 nt, Homo sapiens
uggcuauguccuaauaauau

SEQ ID NO: 712185 - RNA, 22 nt, Homo sapiens
ugggaacaggagacccaccuga

SEQ ID NO: 712186 - RNA, 14 nt, Homo sapiens
ugggagcacuuugu

SEQ ID NO: 712187 - RNA, 16 nt, Homo sapiens
ugggccuugggcuccg

SEQ ID NO: 712188 - RNA, 18 nt, Homo sapiens
uggggagcaggaggccaa

SEQ ID NO: 712189 - RNA, 15 nt, Homo sapiens
ugggucaaagccggu

SEQ ID NO: 712190 - RNA, 21 nt, Homo sapiens
ugguaauuguacuaaagccaa

SEQ ID NO: 712191 - RNA, 12 nt, Homo sapiens
uuagaucuggca

SEQ ID NO: 712192 - RNA, 21 nt, Homo sapiens
uuagcaccucuuuuugaacag

SEQ ID NO: 712193 - RNA, 19 nt, Homo sapiens
uuaguacacagcaccagaa

SEQ ID NO: 712194 - RNA, 20 nt, Homo sapiens
uuaguauuauuguugcauua

SEQ ID NO: 712195 - RNA, 18 nt, Homo sapiens
uuaguggauuacugccau

SEQ ID NO: 712196 - RNA, 15 nt, Homo sapiens
uuaucuuuauaugaa

SEQ ID NO: 712197 - RNA, 16 nt, Homo sapiens
uuaugaaacauuacag

SEQ ID NO: 712198 - RNA, 18 nt, Homo sapiens
uuaugaaacauuacaguu

SEQ ID NO: 712199 - RNA, 16 nt, Homo sapiens
uuaugaaccuuuacau

SEQ ID NO: 712200 - RNA, 20 nt, Homo sapiens
uuaugaaccuuuacauccag

SEQ ID NO: 712201 - RNA, 22 nt, Homo sapiens
uuaugaagcaagccccacuuau

SEQ ID NO: 712202 - RNA, 12 nt, Homo sapiens
uuauugccucac

SEQ ID NO: 712203 - RNA, 14 nt, Homo sapiens
uuauuuuucuauga

SEQ ID NO: 712204 - RNA, 17 nt, Homo sapiens
uucacauuagaagacaa

SEQ ID NO: 712205 - RNA, 22 nt, Homo sapiens
uucaccaaaucuugguugaugc

SEQ ID NO: 712206 - RNA, 12 nt, Homo sapiens
uucaccauccac

SEQ ID NO: 712207 - RNA, 18 nt, Homo sapiens
uucagaagaaaaagaagc

SEQ ID NO: 712208 - RNA, 22 nt, Homo sapiens
uucagaagccccauuugcacag

SEQ ID NO: 712209 - RNA, 18 nt, Homo sapiens
uucagguccaggcugugu

SEQ ID NO: 712210 - RNA, 18 nt, Homo sapiens
uucauuuuaacaucugag

SEQ ID NO: 712211 - RNA, 19 nt, Homo sapiens
uuccaacaccugacagaau

SEQ ID NO: 712212 - RNA, 15 nt, Homo sapiens
uuccaaccggcuuug

SEQ ID NO: 712213 - RNA, 20 nt, Homo sapiens
uuccagaaaacaaaacugca

SEQ ID NO: 712214 - RNA, 13 nt, Homo sapiens
uuccagacugcuu

SEQ ID NO: 712215 - RNA, 15 nt, Homo sapiens
uuccaugacaacaga

SEQ ID NO: 712216 - RNA, 21 nt, Homo sapiens
uucccauuacuuuaauacuca

SEQ ID NO: 712217 - RNA, 22 nt, Homo sapiens
uucccuguagugaccuguaaaa

SEQ ID NO: 712218 - RNA, 19 nt, Homo sapiens
uuccucaucccuccaucuc

SEQ ID NO: 712219 - RNA, 20 nt, Homo sapiens
uuccuccgucaccucagaga

SEQ ID NO: 712220 - RNA, 15 nt, Homo sapiens
uucgaaugacacugu

SEQ ID NO: 712221 - RNA, 16 nt, Homo sapiens
uucgaaugacacuguu

SEQ ID NO: 712222 - RNA, 21 nt, Homo sapiens
uucgcugagccccugagccca

SEQ ID NO: 712223 - RNA, 17 nt, Homo sapiens
uucuaccuggucucucc

SEQ ID NO: 712224 - RNA, 18 nt, Homo sapiens
uucuagcuuaucuacuuc

SEQ ID NO: 712225 - RNA, 15 nt, Homo sapiens
uucuaugaauuccua

SEQ ID NO: 712226 - RNA, 13 nt, Homo sapiens
uucucaugaucca

SEQ ID NO: 712227 - RNA, 12 nt, Homo sapiens
uucucuacugau

SEQ ID NO: 712228 - RNA, 13 nt, Homo sapiens
uucucuugccuca

SEQ ID NO: 712229 - RNA, 20 nt, Homo sapiens
uucucuuuuccuuugguccu

SEQ ID NO: 712230 - RNA, 20 nt, Homo sapiens
uucugaaauuuaacugccua

SEQ ID NO: 712231 - RNA, 23 nt, Homo sapiens
uucugagcaccuacuuacaugca

SEQ ID NO: 712232 - RNA, 23 nt, Homo sapiens
uucugcaggcuucagccauccac

SEQ ID NO: 712233 - RNA, 19 nt, Homo sapiens
uucugccuucucaugaucc

SEQ ID NO: 712234 - RNA, 17 nt, Homo sapiens
uucugggcuucaucugg

SEQ ID NO: 712235 - RNA, 13 nt, Homo sapiens
uucugugacaaaa

SEQ ID NO: 712236 - RNA, 12 nt, Homo sapiens
uucuguuuccca

SEQ ID NO: 712237 - RNA, 15 nt, Homo sapiens
uucuuaaauaagaaa

SEQ ID NO: 712238 - RNA, 13 nt, Homo sapiens
uucuucuuuaggc

SEQ ID NO: 712239 - RNA, 16 nt, Homo sapiens
uucuuuuaaaccauuu

SEQ ID NO: 712240 - RNA, 20 nt, Homo sapiens
uugaacugauucacaucuca

SEQ ID NO: 712241 - RNA, 13 nt, Homo sapiens
uugacaacuggca

SEQ ID NO: 712242 - RNA, 23 nt, Homo sapiens
uugacugucacuguuccuuguca

SEQ ID NO: 712243 - RNA, 20 nt, Homo sapiens
uugagaccuaaucucuguaa

SEQ ID NO: 712244 - RNA, 22 nt, Homo sapiens
uugauauuucuagcuuaucuac

SEQ ID NO: 712245 - RNA, 24 nt, Homo sapiens
uugcaaccuaccuguugagcauca

SEQ ID NO: 712246 - RNA, 23 nt, Homo sapiens
uugcacagcucuccggucucucu

SEQ ID NO: 712247 - RNA, 18 nt, Homo sapiens
uugcacuaucuuucagcu

SEQ ID NO: 712248 - RNA, 12 nt, Homo sapiens
uugcacuugucu

SEQ ID NO: 712249 - RNA, 18 nt, Homo sapiens
uugcagacaggaaucuua

SEQ ID NO: 712250 - RNA, 14 nt, Homo sapiens
uugcccaugccucc

SEQ ID NO: 712251 - RNA, 16 nt, Homo sapiens
uugcccaugccuccag

SEQ ID NO: 712252 - RNA, 15 nt, Homo sapiens
uugccucaaccuccc

SEQ ID NO: 712253 - RNA, 14 nt, Homo sapiens
uugccuugugaauu

SEQ ID NO: 712254 - RNA, 21 nt, Homo sapiens
uugcuguaaacuuguagcauu

SEQ ID NO: 712255 - RNA, 15 nt, Homo sapiens
uuggaaugcuguauu

SEQ ID NO: 712256 - RNA, 18 nt, Homo sapiens
uuggcaugaaggugucau

SEQ ID NO: 712257 - RNA, 21 nt, Homo sapiens
uugggagcaccgccugugaaa

SEQ ID NO: 712258 - RNA, 16 nt, Homo sapiens
uugggauauucugaaa

SEQ ID NO: 712259 - RNA, 21 nt, Homo sapiens
uugggauauucugaaacuuga

SEQ ID NO: 712260 - RNA, 20 nt, Homo sapiens
uugggcuccgugugggagac

SEQ ID NO: 712261 - RNA, 19 nt, Homo sapiens
uuggggagcaggaggccaa

SEQ ID NO: 712262 - RNA, 20 nt, Homo sapiens
uuguaacgaagacacagacu

SEQ ID NO: 712263 - RNA, 17 nt, Homo sapiens
uugugucuggcaguuua

SEQ ID NO: 712264 - RNA, 18 nt, Homo sapiens
uuguuccuuaagucagaa

SEQ ID NO: 712265 - RNA, 15 nt, Homo sapiens
uccuccgucaccuca

SEQ ID NO: 712266 - RNA, 19 nt, Homo sapiens
uccuccgucaccucagaga

SEQ ID NO: 712267 - RNA, 11 nt, Homo sapiens
uccucuucuau

SEQ ID NO: 712268 - RNA, 19 nt, Homo sapiens
uccugaauccaaacuaauc

SEQ ID NO: 712269 - RNA, 20 nt, Homo sapiens
uccugaguaguugggauuac

SEQ ID NO: 712270 - RNA, 13 nt, Homo sapiens
uccugucugaaaa

SEQ ID NO: 712271 - RNA, 21 nt, Homo sapiens
uccuuccuugaacugucuacc

SEQ ID NO: 712272 - RNA, 14 nt, Homo sapiens
ucgauuagacugga

SEQ ID NO: 712273 - RNA, 18 nt, Homo sapiens
ucuaauauggcaaccauu

SEQ ID NO: 712274 - RNA, 11 nt, Homo sapiens
ucuaccaagcu

SEQ ID NO: 712275 - RNA, 16 nt, Homo sapiens
ucuagagcacugccac

SEQ ID NO: 712276 - RNA, 16 nt, Homo sapiens
ucuaggcaacauagua

SEQ ID NO: 712277 - RNA, 20 nt, Homo sapiens
ucuaguauuccagaccugaa

SEQ ID NO: 712278 - RNA, 23 nt, Homo sapiens
ucuaugaccucgcccuccacaaa

SEQ ID NO: 712279 - RNA, 21 nt, Homo sapiens
ucuaugagauagguacuauua

SEQ ID NO: 712280 - RNA, 21 nt, Homo sapiens
ucuauuaccuguuaguauuau

SEQ ID NO: 712281 - RNA, 23 nt, Homo sapiens
ucuauuuuguuagauuuugccuu

SEQ ID NO: 712282 - RNA, 15 nt, Homo sapiens
ucucaugaaccucaa

SEQ ID NO: 712283 - RNA, 22 nt, Homo sapiens
ucuccagccaucaagagacuga

SEQ ID NO: 712284 - RNA, 19 nt, Homo sapiens
ucuccuaaaguacugggau

SEQ ID NO: 712285 - RNA, 20 nt, Homo sapiens
ucucggcucacugcaaccuc

SEQ ID NO: 712286 - RNA, 15 nt, Homo sapiens
ucucuagagugagaa

SEQ ID NO: 712287 - RNA, 18 nt, Homo sapiens
ucucugccaagcccucaa

SEQ ID NO: 712288 - RNA, 19 nt, Homo sapiens
ucucuguguuacccaguaa

SEQ ID NO: 712289 - RNA, 19 nt, Homo sapiens
ucugaaauuuaacugccua

SEQ ID NO: 712290 - RNA, 15 nt, Homo sapiens
ucugacucugagcua

SEQ ID NO: 712291 - RNA, 20 nt, Homo sapiens
ucugauaaugaaaauuauga

SEQ ID NO: 712292 - RNA, 21 nt, Homo sapiens
ucugauucgaaugacacuguu

SEQ ID NO: 712293 - RNA, 21 nt, Homo sapiens
ucugauuuuccuggacaguuu

SEQ ID NO: 712294 - RNA, 18 nt, Homo sapiens
ucugccuugguauagcau

SEQ ID NO: 712295 - RNA, 21 nt, Homo sapiens
ucugccuuuggggacuuuucu

SEQ ID NO: 712296 - RNA, 18 nt, Homo sapiens
ucuggaaagugaugucag

SEQ ID NO: 712297 - RNA, 16 nt, Homo sapiens
ucuggaauacaugaaa

SEQ ID NO: 712298 - RNA, 16 nt, Homo sapiens
ucuguaaacuguguau

SEQ ID NO: 712299 - RNA, 16 nt, Homo sapiens
ucugucaccaagccuu

SEQ ID NO: 712300 - RNA, 14 nt, Homo sapiens
ucugugccugaaua

SEQ ID NO: 712301 - RNA, 19 nt, Homo sapiens
ucuguucauuuccucaaaa

SEQ ID NO: 712302 - RNA, 14 nt, Homo sapiens
ucuguuuacugcaa

SEQ ID NO: 712303 - RNA, 14 nt, Homo sapiens
ucuuauugccucac

SEQ ID NO: 712304 - RNA, 14 nt, Homo sapiens
ucuuccugacacuu

SEQ ID NO: 712305 - RNA, 16 nt, Homo sapiens
ucuucugagcaccuac

SEQ ID NO: 712306 - RNA, 16 nt, Homo sapiens
ucuugccucaaccucc

SEQ ID NO: 712307 - RNA, 13 nt, Homo sapiens
ucuuucccaacac

SEQ ID NO: 712308 - RNA, 14 nt, Homo sapiens
ucuuuuaaaccauu

SEQ ID NO: 712309 - RNA, 14 nt, Homo sapiens
ugaaaaaaauuguc

SEQ ID NO: 712310 - RNA, 21 nt, Homo sapiens
ugaaaaaugguaauuguugcu

SEQ ID NO: 712311 - RNA, 23 nt, Homo sapiens
ugaaaagaaucggcaauguuuca

SEQ ID NO: 712312 - RNA, 21 nt, Homo sapiens
ugaaaagcuagaauugagugu

SEQ ID NO: 712313 - RNA, 13 nt, Homo sapiens
aaaaagcaucaug

SEQ ID NO: 712314 - RNA, 19 nt, Homo sapiens
aaaaaugaauugggaacau

SEQ ID NO: 712315 - RNA, 11 nt, Homo sapiens
aaaaaugauuu

SEQ ID NO: 712316 - RNA, 14 nt, Homo sapiens
aaaaauguaucaaa

SEQ ID NO: 712317 - RNA, 20 nt, Homo sapiens
aaaacaauguaagagccuaa

SEQ ID NO: 712318 - RNA, 11 nt, Homo sapiens
aaaacugagug

SEQ ID NO: 712319 - RNA, 16 nt, Homo sapiens
aaaagaagcaaccuca

SEQ ID NO: 712320 - RNA, 14 nt, Homo sapiens
aaaagggccaaaga

SEQ ID NO: 712321 - RNA, 15 nt, Homo sapiens
aaaagguuuacagaa

SEQ ID NO: 712322 - RNA, 23 nt, Homo sapiens
aaaaguuuagccccugaaagcca

SEQ ID NO: 712323 - RNA, 20 nt, Homo sapiens
aaaauagcuaaauaccucaa

SEQ ID NO: 712324 - RNA, 19 nt, Homo sapiens
aaacagauuguuugcaaag

SEQ ID NO: 712325 - RNA, 20 nt, Homo sapiens
aaacagugcaaggaagggca

SEQ ID NO: 712326 - RNA, 18 nt, Homo sapiens
aaacauaaucuucugccu

SEQ ID NO: 712327 - RNA, 21 nt, Homo sapiens
aaaccucagcuagcucugcca

SEQ ID NO: 712328 - RNA, 19 nt, Homo sapiens
aaaccuucaguuaugauuu

SEQ ID NO: 712329 - RNA, 13 nt, Homo sapiens
aaacucaaaauau

SEQ ID NO: 712330 - RNA, 22 nt, Homo sapiens
aaagaaguuggggacacaugua

SEQ ID NO: 712331 - RNA, 22 nt, Homo sapiens
aaagaccuuuuccaugcacccu

SEQ ID NO: 712332 - RNA, 19 nt, Homo sapiens
aaagaugaaaaaugguccc

SEQ ID NO: 712333 - RNA, 15 nt, Homo sapiens
aaagcaccuuagcug

SEQ ID NO: 712334 - RNA, 23 nt, Homo sapiens
aaagcaggcuuuucuagacuuua

SEQ ID NO: 712335 - RNA, 17 nt, Homo sapiens
aaagcauuguaacuuau

SEQ ID NO: 712336 - RNA, 18 nt, Homo sapiens
aaagcccaccauuuggca

SEQ ID NO: 712337 - RNA, 22 nt, Homo sapiens
aaagccgguugcagagaaucug

SEQ ID NO: 712338 - RNA, 21 nt, Homo sapiens
aaagggccaaagaaccaaaga

SEQ ID NO: 712339 - RNA, 23 nt, Homo sapiens
aaagguauuaaauugauguugcu

SEQ ID NO: 712340 - RNA, 18 nt, Homo sapiens
aaagguuuaugaaaaaga

SEQ ID NO: 712341 - RNA, 14 nt, Homo sapiens
aaaguaccagguga

SEQ ID NO: 712342 - RNA, 15 nt, Homo sapiens
aaaguaccaggugaa

SEQ ID NO: 712343 - RNA, 18 nt, Homo sapiens
aaaguuacauguuugcac

SEQ ID NO: 712344 - RNA, 18 nt, Homo sapiens
aaaguuguuugugccuuu

SEQ ID NO: 712345 - RNA, 22 nt, Homo sapiens
aaauacacagugcugaccagac

SEQ ID NO: 712346 - RNA, 23 nt, Homo sapiens
aaauacacagugcugaccagaca

SEQ ID NO: 712347 - RNA, 22 nt, Homo sapiens
aaauauacuuuuacaaguaaca

SEQ ID NO: 712348 - RNA, 23 nt, Homo sapiens
aaauaucccuccuguugggagag

SEQ ID NO: 712349 - RNA, 19 nt, Homo sapiens
aaauauccuuuaauugauc

SEQ ID NO: 712350 - RNA, 13 nt, Homo sapiens
aaauauuaugaga

SEQ ID NO: 712351 - RNA, 14 nt, Homo sapiens
aaaugccaagcacu

SEQ ID NO: 712352 - RNA, 14 nt, Homo sapiens
aaauguaaagccau

SEQ ID NO: 712353 - RNA, 18 nt, Homo sapiens
aaauucucucucuugcag

SEQ ID NO: 712354 - RNA, 21 nt, Homo sapiens
aaauuugggggacuuacauga

SEQ ID NO: 712355 - RNA, 14 nt, Homo sapiens
aaauuuuaaccuau

SEQ ID NO: 712356 - RNA, 16 nt, Homo sapiens
aacaaaaaaagcauug

SEQ ID NO: 712357 - RNA, 23 nt, Homo sapiens
aacaccugacagaaugagaccaa

SEQ ID NO: 712358 - RNA, 16 nt, Homo sapiens
aacacuagacaagcca

SEQ ID NO: 712359 - RNA, 13 nt, Homo sapiens
aacagaagggaua

SEQ ID NO: 712360 - RNA, 12 nt, Homo sapiens
aacauagacaga

SEQ ID NO: 712361 - RNA, 16 nt, Homo sapiens
aacauagacagaagaa

SEQ ID NO: 712362 - RNA, 18 nt, Homo sapiens
aacauauauauacuauua

SEQ ID NO: 712363 - RNA, 19 nt, Homo sapiens
aacaucucaucaguaucca

SEQ ID NO: 712364 - RNA, 13 nt, Homo sapiens
aaccaaagaccau

SEQ ID NO: 712365 - RNA, 22 nt, Homo sapiens
aaccaaagaccaucugaggaau

SEQ ID NO: 712366 - RNA, 21 nt, Homo sapiens
aaccaaucaaccaaacaaaga

SEQ ID NO: 712367 - RNA, 12 nt, Homo sapiens
aaccaguuauuu

SEQ ID NO: 712368 - RNA, 14 nt, Homo sapiens
aaccauagcacagg

SEQ ID NO: 712369 - RNA, 16 nt, Homo sapiens
aaccccagacacuggu

SEQ ID NO: 712370 - RNA, 16 nt, Homo sapiens
aaccccuccccuccau

SEQ ID NO: 712371 - RNA, 15 nt, Homo sapiens
aaccguacacugugu

SEQ ID NO: 712372 - RNA, 17 nt, Homo sapiens
aaccguacacuguguuu

SEQ ID NO: 712373 - RNA, 12 nt, Homo sapiens
aacgcacaaaac

SEQ ID NO: 712374 - RNA, 23 nt, Homo sapiens
aacuaauuuuuauuuuugcugag

SEQ ID NO: 712375 - RNA, 19 nt, Homo sapiens
aacuacccccagcugugcu

SEQ ID NO: 712376 - RNA, 14 nt, Homo sapiens
aacuauaagcaaga

SEQ ID NO: 712377 - RNA, 15 nt, Homo sapiens
aacucaucugucacc

SEQ ID NO: 712378 - RNA, 16 nt, Homo sapiens
aacuccugaccucagg

SEQ ID NO: 712379 - RNA, 18 nt, Homo sapiens
aacucucuuauugccuca

SEQ ID NO: 712380 - RNA, 21 nt, Homo sapiens
aacuucaacguaagacugugu

SEQ ID NO: 712381 - RNA, 15 nt, Homo sapiens
aacuuguagcauuaa

SEQ ID NO: 712382 - RNA, 23 nt, Homo sapiens
aagaaaaccuuucuucaccaaau

SEQ ID NO: 712383 - RNA, 13 nt, Homo sapiens
aagaaauucugca

SEQ ID NO: 712384 - RNA, 14 nt, Homo sapiens
aagaaauucugcaa

SEQ ID NO: 712385 - RNA, 23 nt, Homo sapiens
aagaaauucugcaagcuuuucaa

SEQ ID NO: 712386 - RNA, 11 nt, Homo sapiens
aagaaggguug

SEQ ID NO: 712387 - RNA, 14 nt, Homo sapiens
aagacacagacugc

SEQ ID NO: 712388 - RNA, 17 nt, Homo sapiens
aagacagaaguuugcac

SEQ ID NO: 712389 - RNA, 15 nt, Homo sapiens
aagacucauuacuac

SEQ ID NO: 712390 - RNA, 20 nt, Homo sapiens
aagaugaaaaauggucccuu

SEQ ID NO: 712391 - RNA, 19 nt, Homo sapiens
aagcacagauguucuucaa

SEQ ID NO: 712392 - RNA, 21 nt, Homo sapiens
aagcacauuuuaaaagugcca

SEQ ID NO: 712393 - RNA, 22 nt, Homo sapiens
aagcacauuuuaaaagugccau

SEQ ID NO: 712394 - RNA, 16 nt, Homo sapiens
aagcacuuugugcugu

SEQ ID NO: 712395 - RNA, 15 nt, Homo sapiens
aagcaguugagacaa

SEQ ID NO: 712396 - RNA, 17 nt, Homo sapiens
aagcgauucucuugccu

SEQ ID NO: 712397 - RNA, 16 nt, Homo sapiens
aagcugugacccucaa

SEQ ID NO: 712398 - RNA, 12 nt, Homo sapiens
aaggacacucac

SEQ ID NO: 712399 - RNA, 21 nt, Homo sapiens
aaggaguuuugcaaagugcaa

SEQ ID NO: 712400 - RNA, 13 nt, Homo sapiens
aaggguugagcug

SEQ ID NO: 712401 - RNA, 20 nt, Homo sapiens
aaggugggaggaucguuuga

SEQ ID NO: 712402 - RNA, 14 nt, Homo sapiens
aagguggucacugu

SEQ ID NO: 712403 - RNA, 15 nt, Homo sapiens
aagguggucacuguu

SEQ ID NO: 712404 - RNA, 13 nt, Homo sapiens
aaguacuuccucu

SEQ ID NO: 712405 - RNA, 15 nt, Homo sapiens
aagugccauuaacaa

SEQ ID NO: 712406 - RNA, 20 nt, Homo sapiens
aagugcugcgauuacaggca

SEQ ID NO: 712407 - RNA, 22 nt, Homo sapiens
aagugcugggauuacaggugua

SEQ ID NO: 712408 - RNA, 17 nt, Homo sapiens
aaguuacauguuugcac

SEQ ID NO: 712409 - RNA, 18 nt, Homo sapiens
aaguuuaugcauacagua

SEQ ID NO: 712410 - RNA, 16 nt, Homo sapiens
aaguuuuauacuugau

SEQ ID NO: 712411 - RNA, 13 nt, Homo sapiens
aauaaaaccucag

SEQ ID NO: 712412 - RNA, 14 nt, Homo sapiens
aauaaaaccucagc

SEQ ID NO: 712413 - RNA, 17 nt, Homo sapiens
aauaaccauugucauaa

SEQ ID NO: 712414 - RNA, 17 nt, Homo sapiens
aauaagccagcaaacca

SEQ ID NO: 712415 - RNA, 19 nt, Homo sapiens
aauaaguguacauauguaa

SEQ ID NO: 712416 - RNA, 22 nt, Homo sapiens
aauaauauaucaaauaacucaa

SEQ ID NO: 712417 - RNA, 13 nt, Homo sapiens
aauaauaucccac

SEQ ID NO: 712418 - RNA, 18 nt, Homo sapiens
aauaauaucccacuggga

SEQ ID NO: 712419 - RNA, 22 nt, Homo sapiens
aauaauuuagacuucaagcaug

SEQ ID NO: 712420 - RNA, 17 nt, Homo sapiens
aauacaaugauccugua

SEQ ID NO: 712421 - RNA, 19 nt, Homo sapiens
aauacaauuaaagcuguua

SEQ ID NO: 712422 - RNA, 17 nt, Homo sapiens
aauaucuucacuuguca

SEQ ID NO: 712423 - RNA, 23 nt, Homo sapiens
aauauggcaaccauuauaaccuu

SEQ ID NO: 712424 - RNA, 11 nt, Homo sapiens
aauauugauuu

SEQ ID NO: 712425 - RNA, 19 nt, Homo sapiens
aaucaaaagggccaaagaa

SEQ ID NO: 712426 - RNA, 21 nt, Homo sapiens
aaucauguuggauagucagcu

SEQ ID NO: 712427 - RNA, 23 nt, Homo sapiens
aaucauguuggauagucagcugu

SEQ ID NO: 712428 - RNA, 23 nt, Homo sapiens
aaucccucaaaacaaucuuguca

SEQ ID NO: 712429 - RNA, 16 nt, Homo sapiens
aaucucaucucaguga

SEQ ID NO: 712430 - RNA, 14 nt, Homo sapiens
aaucucggcucacu

SEQ ID NO: 712431 - RNA, 14 nt, Homo sapiens
aaucuguagucacu

SEQ ID NO: 712432 - RNA, 20 nt, Homo sapiens
aaucuucugccuucucauga

SEQ ID NO: 712433 - RNA, 22 nt, Homo sapiens
aaugccacucuguaauugcaaa

SEQ ID NO: 712434 - RNA, 17 nt, Homo sapiens
aaugcccuucuccuuau

SEQ ID NO: 712435 - RNA, 17 nt, Homo sapiens
aauggaggccauugugu

SEQ ID NO: 712436 - RNA, 15 nt, Homo sapiens
aaugggaaaaccaga

SEQ ID NO: 712437 - RNA, 16 nt, Homo sapiens
aaugguaauuguugcu

SEQ ID NO: 712438 - RNA, 13 nt, Homo sapiens
aauguaaagccau

SEQ ID NO: 712439 - RNA, 14 nt, Homo sapiens
aauguauagcugcu

SEQ ID NO: 712440 - RNA, 22 nt, Homo sapiens
aauguuuugcccgguuuuucuc

SEQ ID NO: 712441 - RNA, 18 nt, Homo sapiens
aauuacuguaacugauua

SEQ ID NO: 712442 - RNA, 14 nt, Homo sapiens
aauucuaugagaua

SEQ ID NO: 712443 - RNA, 17 nt, Homo sapiens
aauucucucucuugcag

SEQ ID NO: 712444 - RNA, 13 nt, Homo sapiens
aauugacugucac

SEQ ID NO: 712445 - RNA, 23 nt, Homo sapiens
aauugauguugcuggacugucau

SEQ ID NO: 712446 - RNA, 20 nt, Homo sapiens
aauugucuguuuguuuucuc

SEQ ID NO: 712447 - RNA, 16 nt, Homo sapiens
aauugugguucccuaa

SEQ ID NO: 712448 - RNA, 15 nt, Homo sapiens
aauuuaacagaaguu

SEQ ID NO: 712449 - RNA, 13 nt, Homo sapiens
aaagcagugcucu

SEQ ID NO: 712450 - RNA, 14 nt, Homo sapiens
aaagcaguugagac

SEQ ID NO: 712451 - RNA, 14 nt, Homo sapiens
aaagccaaggaguc

SEQ ID NO: 712452 - RNA, 21 nt, Homo sapiens
aaagcuguguguuuggaagac

SEQ ID NO: 712453 - RNA, 23 nt, Homo sapiens
aaagcuugucugaucguucaaag

SEQ ID NO: 712454 - RNA, 21 nt, Homo sapiens
aaaggagccaauugauuucaa

SEQ ID NO: 712455 - RNA, 15 nt, Homo sapiens
aaaggaguuuugcaa

SEQ ID NO: 712456 - RNA, 16 nt, Homo sapiens
aaagguugagauguaa

SEQ ID NO: 712457 - RNA, 17 nt, Homo sapiens
aaagguuuacagaauuu

SEQ ID NO: 712458 - RNA, 24 nt, Homo sapiens
aaaguacugggauuacaggcguga

SEQ ID NO: 712459 - RNA, 22 nt, Homo sapiens
aaagucuuugaagugacuucac

SEQ ID NO: 712460 - RNA, 18 nt, Homo sapiens
aaauagagugcauuugaa

SEQ ID NO: 712461 - RNA, 14 nt, Homo sapiens
aaauagcaaaagaa

SEQ ID NO: 712462 - RNA, 19 nt, Homo sapiens
aaauaguaagccucccucc

SEQ ID NO: 712463 - RNA, 21 nt, Homo sapiens
aaauaguuuggauuacuuaaa

SEQ ID NO: 712464 - RNA, 20 nt, Homo sapiens
aaaucaaaagggccaaagaa

SEQ ID NO: 712465 - RNA, 16 nt, Homo sapiens
aaaucaacuugcuuau

SEQ ID NO: 712466 - RNA, 15 nt, Homo sapiens
aaauggagugacuua

SEQ ID NO: 712467 - RNA, 16 nt, Homo sapiens
aaauguauagcugcuu

SEQ ID NO: 712468 - RNA, 17 nt, Homo sapiens
aaaugugcuauacugca

SEQ ID NO: 712469 - RNA, 12 nt, Homo sapiens
aaauugccuccu

SEQ ID NO: 712470 - RNA, 17 nt, Homo sapiens
aacaaauagucuaucaa

SEQ ID NO: 712471 - RNA, 14 nt, Homo sapiens
aacaaauggccuuu

SEQ ID NO: 712472 - RNA, 14 nt, Homo sapiens
aacaagaauuggaa

SEQ ID NO: 712473 - RNA, 21 nt, Homo sapiens
aacaaguauuuguuaauuuag

SEQ ID NO: 712474 - RNA, 20 nt, Homo sapiens
aacagaacauagacagaaga

SEQ ID NO: 712475 - RNA, 22 nt, Homo sapiens
aacagauaaucccuguauuuca

SEQ ID NO: 712476 - RNA, 16 nt, Homo sapiens
aacagauuguuugcaa

SEQ ID NO: 712477 - RNA, 16 nt, Homo sapiens
aacagccugacaacau

SEQ ID NO: 712478 - RNA, 20 nt, Homo sapiens
aacauaccuaagaaguacau

SEQ ID NO: 712479 - RNA, 13 nt, Homo sapiens
aacauuugcugaa

SEQ ID NO: 712480 - RNA, 20 nt, Homo sapiens
aaccaaauggagugacuuag

SEQ ID NO: 712481 - RNA, 16 nt, Homo sapiens
aaccaauggaauguga

SEQ ID NO: 712482 - RNA, 20 nt, Homo sapiens
aaccagaucuagucaaucaa

SEQ ID NO: 712483 - RNA, 15 nt, Homo sapiens
aaccauuauaaccuu

SEQ ID NO: 712484 - RNA, 22 nt, Homo sapiens
aacccagcucuaauacauucca

SEQ ID NO: 712485 - RNA, 13 nt, Homo sapiens
aacccugggacgu

SEQ ID NO: 712486 - RNA, 22 nt, Homo sapiens
aaccguaugagggaacugugua

SEQ ID NO: 712487 - RNA, 14 nt, Homo sapiens
aaccuaaacauaga

SEQ ID NO: 712488 - RNA, 21 nt, Homo sapiens
aaccucaacugccuacuccaa

SEQ ID NO: 712489 - RNA, 17 nt, Homo sapiens
aaccucaagcugcaucu

SEQ ID NO: 712490 - RNA, 15 nt, Homo sapiens
aaccucagcuagcuc

SEQ ID NO: 712491 - RNA, 16 nt, Homo sapiens
aacggaacaguaucca

SEQ ID NO: 712492 - RNA, 16 nt, Homo sapiens
aacguaagacugugua

SEQ ID NO: 712493 - RNA, 21 nt, Homo sapiens
aacucagaaugcucuacuucu

SEQ ID NO: 712494 - RNA, 23 nt, Homo sapiens
aacuccggaaugaccagcaugau

SEQ ID NO: 712495 - RNA, 18 nt, Homo sapiens
aacugauucacaucucau

SEQ ID NO: 712496 - RNA, 12 nt, Homo sapiens
aacugucucuca

SEQ ID NO: 712497 - RNA, 22 nt, Homo sapiens
aacugucucucaugaaccucaa

SEQ ID NO: 712498 - RNA, 22 nt, Homo sapiens
aacuuaccaggcaccaaaagaa

SEQ ID NO: 712499 - RNA, 21 nt, Homo sapiens
aacuuguagcauuaaacaauc

SEQ ID NO: 712500 - RNA, 13 nt, Homo sapiens
aagaaaaucacuu

SEQ ID NO: 712501 - RNA, 14 nt, Homo sapiens
aagaagaaucucau

SEQ ID NO: 712502 - RNA, 15 nt, Homo sapiens
aagaagcuaccucag

SEQ ID NO: 712503 - RNA, 22 nt, Homo sapiens
aagaaguuggggacacauguau

SEQ ID NO: 712504 - RNA, 15 nt, Homo sapiens
aagaauacuucucau

SEQ ID NO: 712505 - RNA, 20 nt, Homo sapiens
aagaaucggcaauguuucaa

SEQ ID NO: 712506 - RNA, 15 nt, Homo sapiens
aagaauguuuaugaa

SEQ ID NO: 712507 - RNA, 13 nt, Homo sapiens
aagacuacugaag

SEQ ID NO: 712508 - RNA, 22 nt, Homo sapiens
aagagaucccaaguagaaucuc

SEQ ID NO: 712509 - RNA, 14 nt, Homo sapiens
aagaugacaaagaa

SEQ ID NO: 712510 - RNA, 12 nt, Homo sapiens
aagcacuuugug

SEQ ID NO: 712511 - RNA, 16 nt, Homo sapiens
aagccccggacucagg

SEQ ID NO: 712512 - RNA, 20 nt, Homo sapiens
aagccgguugcagagaaucu

SEQ ID NO: 712513 - RNA, 22 nt, Homo sapiens
aagccucccuccucguccccug

SEQ ID NO: 712514 - RNA, 18 nt, Homo sapiens
aagcucaacucucuuauu

SEQ ID NO: 712515 - RNA, 17 nt, Homo sapiens
aagcugccgguucuuaa

SEQ ID NO: 712516 - RNA, 16 nt, Homo sapiens
aagcuugucugaucgu

SEQ ID NO: 712517 - RNA, 12 nt, Homo sapiens
aagcuuugaacc

SEQ ID NO: 712518 - RNA, 19 nt, Homo sapiens
aaggagacaaaacuagaga

SEQ ID NO: 712519 - RNA, 24 nt, Homo sapiens
aaggagccaauugauuucaacaga

SEQ ID NO: 712520 - RNA, 16 nt, Homo sapiens
aaggagucacugagac

SEQ ID NO: 712521 - RNA, 19 nt, Homo sapiens
aaggaucccaugagcuccu

SEQ ID NO: 712522 - RNA, 20 nt, Homo sapiens
aaggauuaagauacacuccu

SEQ ID NO: 712523 - RNA, 13 nt, Homo sapiens
aagggacugagag

SEQ ID NO: 712524 - RNA, 19 nt, Homo sapiens
aagguggaacaagcacaga

SEQ ID NO: 712525 - RNA, 21 nt, Homo sapiens
aagguuaguaucaucagauag

SEQ ID NO: 712526 - RNA, 20 nt, Homo sapiens
aaguacaaccacacccacac

SEQ ID NO: 712527 - RNA, 13 nt, Homo sapiens
aaguacagacuuu

SEQ ID NO: 712528 - RNA, 15 nt, Homo sapiens
aagugacuucacaga

SEQ ID NO: 712529 - RNA, 17 nt, Homo sapiens
aaguuagaaaacauaau

SEQ ID NO: 712530 - RNA, 19 nt, Homo sapiens
aaguuuaugcauacaguaa

SEQ ID NO: 712531 - RNA, 12 nt, Homo sapiens
aauaaaguguau

SEQ ID NO: 712532 - RNA, 13 nt, Homo sapiens
aauaaccaguuaa

SEQ ID NO: 712533 - RNA, 21 nt, Homo sapiens
aauacugcugagauacauaca

SEQ ID NO: 712534 - RNA, 19 nt, Homo sapiens
aauagaauuauaacuggaa

SEQ ID NO: 712535 - RNA, 15 nt, Homo sapiens
aauauccugcuugau

SEQ ID NO: 712536 - RNA, 19 nt, Homo sapiens
aauauggaaugggcucagu

SEQ ID NO: 712537 - RNA, 18 nt, Homo sapiens
aaucaacuugcuuaucaa

SEQ ID NO: 712538 - RNA, 23 nt, Homo sapiens
aaucaccacaaacuguaauacaa

SEQ ID NO: 712539 - RNA, 18 nt, Homo sapiens
aaucagguccucagagaa

SEQ ID NO: 712540 - RNA, 23 nt, Homo sapiens
aaucaguguuuccaaucuguccu

SEQ ID NO: 712541 - RNA, 20 nt, Homo sapiens
aaucccagcaugcugagauu

SEQ ID NO: 712542 - RNA, 16 nt, Homo sapiens
aaucucggcucacugc

SEQ ID NO: 712543 - RNA, 18 nt, Homo sapiens
aaucucggcucacugcaa

SEQ ID NO: 712544 - RNA, 21 nt, Homo sapiens
agcagacucagcucugacauu

SEQ ID NO: 712545 - RNA, 15 nt, Homo sapiens
agcaggaggccaaua

SEQ ID NO: 712546 - RNA, 16 nt, Homo sapiens
agcagguaggaggcaa

SEQ ID NO: 712547 - RNA, 18 nt, Homo sapiens
agcagguuaccacucugg

SEQ ID NO: 712548 - RNA, 19 nt, Homo sapiens
agccaccacccacaaucac

SEQ ID NO: 712549 - RNA, 19 nt, Homo sapiens
agccaucaagagacugagu

SEQ ID NO: 712550 - RNA, 20 nt, Homo sapiens
agccaucaagagacugaguc

SEQ ID NO: 712551 - RNA, 21 nt, Homo sapiens
agccaucaauauucagcaaaa

SEQ ID NO: 712552 - RNA, 22 nt, Homo sapiens
agcccaaggcacugagaccucc

SEQ ID NO: 712553 - RNA, 22 nt, Homo sapiens
agcccgguaagagcaaaagaau

SEQ ID NO: 712554 - RNA, 14 nt, Homo sapiens
agcccuagcccuca

SEQ ID NO: 712555 - RNA, 20 nt, Homo sapiens
agccgacaccuuuuuucaac

SEQ ID NO: 712556 - RNA, 20 nt, Homo sapiens
agccucccugaagaccaaaa

SEQ ID NO: 712557 - RNA, 20 nt, Homo sapiens
agccugcagacucacugugg

SEQ ID NO: 712558 - RNA, 14 nt, Homo sapiens
agcggcaucaggcu

SEQ ID NO: 712559 - RNA, 14 nt, Homo sapiens
agcgugcucacuga

SEQ ID NO: 712560 - RNA, 16 nt, Homo sapiens
agcgugcucacugacc

SEQ ID NO: 712561 - RNA, 20 nt, Homo sapiens
agcguuuuggaagaggaaaa

SEQ ID NO: 712562 - RNA, 15 nt, Homo sapiens
agcuagcucugccaa

SEQ ID NO: 712563 - RNA, 16 nt, Homo sapiens
agcucagacccuuucu

SEQ ID NO: 712564 - RNA, 16 nt, Homo sapiens
agcucaggacugccau

SEQ ID NO: 712565 - RNA, 13 nt, Homo sapiens
agcuccugccucu

SEQ ID NO: 712566 - RNA, 17 nt, Homo sapiens
agcuguauuuugaugau

SEQ ID NO: 712567 - RNA, 12 nt, Homo sapiens
agcugucugcuc

SEQ ID NO: 712568 - RNA, 16 nt, Homo sapiens
agcuguuuuguugaca

SEQ ID NO: 712569 - RNA, 20 nt, Homo sapiens
agcuugucugaucguucaaa

SEQ ID NO: 712570 - RNA, 22 nt, Homo sapiens
agcuuucccugccucucaucaa

SEQ ID NO: 712571 - RNA, 12 nt, Homo sapiens
agcuuugcucuu

SEQ ID NO: 712572 - RNA, 19 nt, Homo sapiens
aggaaacucugucacuccu

SEQ ID NO: 712573 - RNA, 19 nt, Homo sapiens
aggaaggcuuguugugcuu

SEQ ID NO: 712574 - RNA, 18 nt, Homo sapiens
aggacaaccauuccagac

SEQ ID NO: 712575 - RNA, 21 nt, Homo sapiens
aggacaaccauuccagacugc

SEQ ID NO: 712576 - RNA, 12 nt, Homo sapiens
aggacuccuuaa

SEQ ID NO: 712577 - RNA, 18 nt, Homo sapiens
aggaugauaaaagcacuu

SEQ ID NO: 712578 - RNA, 16 nt, Homo sapiens
aggcaaauaucuugaa

SEQ ID NO: 712579 - RNA, 19 nt, Homo sapiens
aggcacgcaccaccaugcc

SEQ ID NO: 712580 - RNA, 21 nt, Homo sapiens
aggccaauaaaaaguucagag

SEQ ID NO: 712581 - RNA, 14 nt, Homo sapiens
aggccagagccaag

SEQ ID NO: 712582 - RNA, 20 nt, Homo sapiens
aggccuccugugacuggcag

SEQ ID NO: 712583 - RNA, 15 nt, Homo sapiens
aggcugaaagacagg

SEQ ID NO: 712584 - RNA, 23 nt, Homo sapiens
aggcugguuucuuucaugcuccu

SEQ ID NO: 712585 - RNA, 16 nt, Homo sapiens
aggcuguacacugcac

SEQ ID NO: 712586 - RNA, 17 nt, Homo sapiens
aggcuuguugugcuuuu

SEQ ID NO: 712587 - RNA, 16 nt, Homo sapiens
agggaaggaucccaug

SEQ ID NO: 712588 - RNA, 13 nt, Homo sapiens
agggccagaaaua

SEQ ID NO: 712589 - RNA, 19 nt, Homo sapiens
agggcggugaacucuggcu

SEQ ID NO: 712590 - RNA, 23 nt, Homo sapiens
aggggcuucagguccaggcugug

SEQ ID NO: 712591 - RNA, 18 nt, Homo sapiens
agggggugugucugcuca

SEQ ID NO: 712592 - RNA, 13 nt, Homo sapiens
aggguugagcugg

SEQ ID NO: 712593 - RNA, 16 nt, Homo sapiens
agguaaaaugccauga

SEQ ID NO: 712594 - RNA, 23 nt, Homo sapiens
agguuuggcccccucacuaucuc

SEQ ID NO: 712595 - RNA, 18 nt, Homo sapiens
aguaaaaagaaauauacc

SEQ ID NO: 712596 - RNA, 18 nt, Homo sapiens
aguaacucaucugucacc

SEQ ID NO: 712597 - RNA, 23 nt, Homo sapiens
aguaagaauguuaaaaagugaaa

SEQ ID NO: 712598 - RNA, 20 nt, Homo sapiens
aguaauuuuaaguaauuuca

SEQ ID NO: 712599 - RNA, 14 nt, Homo sapiens
aguacagacuuuuu

SEQ ID NO: 712600 - RNA, 19 nt, Homo sapiens
aguagagacaggguuucac

SEQ ID NO: 712601 - RNA, 20 nt, Homo sapiens
aguagaugcauuugggucca

SEQ ID NO: 712602 - RNA, 17 nt, Homo sapiens
aguaguuuuuaucugaa

SEQ ID NO: 712603 - RNA, 18 nt, Homo sapiens
aguauacuuuuguuucag

SEQ ID NO: 712604 - RNA, 21 nt, Homo sapiens
aguauuuuagugaacuugaaa

SEQ ID NO: 712605 - RNA, 20 nt, Homo sapiens
agucacuuauaauuaugcua

SEQ ID NO: 712606 - RNA, 21 nt, Homo sapiens
agucauuggguuuuaucagug

SEQ ID NO: 712607 - RNA, 15 nt, Homo sapiens
agucuggaaagugau

SEQ ID NO: 712608 - RNA, 19 nt, Homo sapiens
agucuggaaagugauguca

SEQ ID NO: 712609 - RNA, 15 nt, Homo sapiens
agucuguuuacugca

SEQ ID NO: 712610 - RNA, 13 nt, Homo sapiens
agucuucuuccau

SEQ ID NO: 712611 - RNA, 16 nt, Homo sapiens
agugaaauauaugcua

SEQ ID NO: 712612 - RNA, 23 nt, Homo sapiens
agugagagcacgccuguacuaga

SEQ ID NO: 712613 - RNA, 13 nt, Homo sapiens
agugcaccaaaga

SEQ ID NO: 712614 - RNA, 19 nt, Homo sapiens
agugcacuugcuggaagac

SEQ ID NO: 712615 - RNA, 16 nt, Homo sapiens
agugcagcaaccagag

SEQ ID NO: 712616 - RNA, 22 nt, Homo sapiens
agugcagcaaccagagcacugu

SEQ ID NO: 712617 - RNA, 21 nt, Homo sapiens
agugcaguuuuuuucuugucu

SEQ ID NO: 712618 - RNA, 13 nt, Homo sapiens
agugcugugcugu

SEQ ID NO: 712619 - RNA, 20 nt, Homo sapiens
aguggcgcgaucucggcuca

SEQ ID NO: 712620 - RNA, 15 nt, Homo sapiens
aguguaauugagaag

SEQ ID NO: 712621 - RNA, 23 nt, Homo sapiens
aguuaugaaaaauaagucacuua

SEQ ID NO: 712622 - RNA, 14 nt, Homo sapiens
aguucugggcccag

SEQ ID NO: 712623 - RNA, 23 nt, Homo sapiens
aguucuuuaaaauguaaagccau

SEQ ID NO: 712624 - RNA, 16 nt, Homo sapiens
aguugaagaccagccu

SEQ ID NO: 712625 - RNA, 13 nt, Homo sapiens
aguuuacuaccug

SEQ ID NO: 712626 - RNA, 20 nt, Homo sapiens
aguuuccaaauuauggcaaa

SEQ ID NO: 712627 - RNA, 22 nt, Homo sapiens
aguuucuucuuuaggcauuaaa

SEQ ID NO: 712628 - RNA, 20 nt, Homo sapiens
aguuuucugcuuuaauuuca

SEQ ID NO: 712629 - RNA, 17 nt, Homo sapiens
aguuuugcaaagugcaa

SEQ ID NO: 712630 - RNA, 13 nt, Homo sapiens
auaaaagcacuua

SEQ ID NO: 712631 - RNA, 16 nt, Homo sapiens
auaaaagcacuuacuu

SEQ ID NO: 712632 - RNA, 18 nt, Homo sapiens
auaauaucccacugggag

SEQ ID NO: 712633 - RNA, 16 nt, Homo sapiens
auacagaauuacugua

SEQ ID NO: 712634 - RNA, 22 nt, Homo sapiens
auaccaaccugaagacaccguu

SEQ ID NO: 712635 - RNA, 12 nt, Homo sapiens
auacuaccaagu

SEQ ID NO: 712636 - RNA, 14 nt, Homo sapiens
auagaaaugccaag

SEQ ID NO: 712637 - RNA, 17 nt, Homo sapiens
auaguucaugucugcua

SEQ ID NO: 712638 - RNA, 21 nt, Homo sapiens
auaguuugcuguugcauugua

SEQ ID NO: 712639 - RNA, 22 nt, Homo sapiens
auauacagcucagaaguuucuu

SEQ ID NO: 712640 - RNA, 13 nt, Homo sapiens
auauaccaaagca

SEQ ID NO: 712641 - RNA, 23 nt, Homo sapiens
auauauggaauaaguguacauau

SEQ ID NO: 712642 - RNA, 20 nt, Homo sapiens
auaucaguuuuuacuuucuc

SEQ ID NO: 712643 - RNA, 21 nt, Homo sapiens
auaucccacugggagcacuuu

SEQ ID NO: 712644 - RNA, 13 nt, Homo sapiens
auaucucaucucu

SEQ ID NO: 712645 - RNA, 20 nt, Homo sapiens
acacauguaucuaugcauuu

SEQ ID NO: 712646 - RNA, 17 nt, Homo sapiens
acaccauuuuccugccu

SEQ ID NO: 712647 - RNA, 18 nt, Homo sapiens
acaccuaugucauuucau

SEQ ID NO: 712648 - RNA, 12 nt, Homo sapiens
acaccuguugca

SEQ ID NO: 712649 - RNA, 20 nt, Homo sapiens
acacugcacgaauggaagag

SEQ ID NO: 712650 - RNA, 21 nt, Homo sapiens
acagaagggauaccgucuccu

SEQ ID NO: 712651 - RNA, 12 nt, Homo sapiens
acagaaugagac

SEQ ID NO: 712652 - RNA, 15 nt, Homo sapiens
acagaaugagaccaa

SEQ ID NO: 712653 - RNA, 20 nt, Homo sapiens
acagcuguucugaauugucu

SEQ ID NO: 712654 - RNA, 21 nt, Homo sapiens
acaggcgugagccaccaugcc

SEQ ID NO: 712655 - RNA, 22 nt, Homo sapiens
acagggcacugucuguguccuu

SEQ ID NO: 712656 - RNA, 18 nt, Homo sapiens
acagguccucaguguccu

SEQ ID NO: 712657 - RNA, 14 nt, Homo sapiens
acauaauucacucu

SEQ ID NO: 712658 - RNA, 19 nt, Homo sapiens
acauaccuaagaaguacau

SEQ ID NO: 712659 - RNA, 15 nt, Homo sapiens
acauagacagaagaa

SEQ ID NO: 712660 - RNA, 19 nt, Homo sapiens
acaugcacuuggcugcaua

SEQ ID NO: 712661 - RNA, 19 nt, Homo sapiens
acaugcgugaccagcagua

SEQ ID NO: 712662 - RNA, 22 nt, Homo sapiens
acauggucuccucugauuauca

SEQ ID NO: 712663 - RNA, 17 nt, Homo sapiens
acauugaguuggaauca

SEQ ID NO: 712664 - RNA, 19 nt, Homo sapiens
acauugaguuggaaucacu

SEQ ID NO: 712665 - RNA, 19 nt, Homo sapiens
acauugauuggcauauuaa

SEQ ID NO: 712666 - RNA, 19 nt, Homo sapiens
acauuuuaaaagugccauu

SEQ ID NO: 712667 - RNA, 19 nt, Homo sapiens
acauuuuggagugcuuaaa

SEQ ID NO: 712668 - RNA, 16 nt, Homo sapiens
accaaaaguuacaugu

SEQ ID NO: 712669 - RNA, 20 nt, Homo sapiens
accacugcugauauuuucuc

SEQ ID NO: 712670 - RNA, 23 nt, Homo sapiens
accacugugguggugugcugcuu

SEQ ID NO: 712671 - RNA, 15 nt, Homo sapiens
accagaaagcaguug

SEQ ID NO: 712672 - RNA, 21 nt, Homo sapiens
accagaaagugaggaagccua

SEQ ID NO: 712673 - RNA, 13 nt, Homo sapiens
accagagcacugu

SEQ ID NO: 712674 - RNA, 21 nt, Homo sapiens
accagauuuuuacacauguau

SEQ ID NO: 712675 - RNA, 14 nt, Homo sapiens
accagcuacuugau

SEQ ID NO: 712676 - RNA, 20 nt, Homo sapiens
accaggaguggguggggagu

SEQ ID NO: 712677 - RNA, 20 nt, Homo sapiens
accaggauagagacuggaac

SEQ ID NO: 712678 - RNA, 19 nt, Homo sapiens
accaguaacggaacaguau

SEQ ID NO: 712679 - RNA, 19 nt, Homo sapiens
accagucugucuucuguag

SEQ ID NO: 712680 - RNA, 17 nt, Homo sapiens
accauauacagcucaga

SEQ ID NO: 712681 - RNA, 16 nt, Homo sapiens
accaucugaggaauga

SEQ ID NO: 712682 - RNA, 9 nt, Homo sapiens
accaugcug

SEQ ID NO: 712683 - RNA, 20 nt, Homo sapiens
accauuaaccagaucuaguc

SEQ ID NO: 712684 - RNA, 17 nt, Homo sapiens
acccacuguggacucca

SEQ ID NO: 712685 - RNA, 22 nt, Homo sapiens
acccauuucucuuugcuucaca

SEQ ID NO: 712686 - RNA, 14 nt, Homo sapiens
acccucaucuuucu

SEQ ID NO: 712687 - RNA, 19 nt, Homo sapiens
acccucaucuuucuuccaa

SEQ ID NO: 712688 - RNA, 16 nt, Homo sapiens
accggggccugggcag

SEQ ID NO: 712689 - RNA, 14 nt, Homo sapiens
accguacacugugu

SEQ ID NO: 712690 - RNA, 18 nt, Homo sapiens
accuaaaacaucucauca

SEQ ID NO: 712691 - RNA, 20 nt, Homo sapiens
accuagcaaagcuccugccu

SEQ ID NO: 712692 - RNA, 12 nt, Homo sapiens
accuccaaagcu

SEQ ID NO: 712693 - RNA, 19 nt, Homo sapiens
accucgugauccaccugcc

SEQ ID NO: 712694 - RNA, 21 nt, Homo sapiens
accucuccccuggaacugucu

SEQ ID NO: 712695 - RNA, 15 nt, Homo sapiens
accuuaccagauuuu

SEQ ID NO: 712696 - RNA, 21 nt, Homo sapiens
accuucaguugucucugaugu

SEQ ID NO: 712697 - RNA, 19 nt, Homo sapiens
acgcaaaaaauaacuacag

SEQ ID NO: 712698 - RNA, 15 nt, Homo sapiens
acgccagacuuccca

SEQ ID NO: 712699 - RNA, 22 nt, Homo sapiens
acguaucccaccugacaugucc

SEQ ID NO: 712700 - RNA, 21 nt, Homo sapiens
acgugacacaaacacacacaa

SEQ ID NO: 712701 - RNA, 13 nt, Homo sapiens
acguuuaagccaa

SEQ ID NO: 712702 - RNA, 11 nt, Homo sapiens
acuacaugcac

SEQ ID NO: 712703 - RNA, 20 nt, Homo sapiens
acuacucagccuucaaugua

SEQ ID NO: 712704 - RNA, 21 nt, Homo sapiens
acuagcccaaugaaaugaauu

SEQ ID NO: 712705 - RNA, 20 nt, Homo sapiens
acuagcccuccuuuuuccaa

SEQ ID NO: 712706 - RNA, 23 nt, Homo sapiens
acuaucucuagagugagaaucug

SEQ ID NO: 712707 - RNA, 20 nt, Homo sapiens
acuaucuuucagcuccaguu

SEQ ID NO: 712708 - RNA, 20 nt, Homo sapiens
acuauggagugcaccaaaga

SEQ ID NO: 712709 - RNA, 14 nt, Homo sapiens
acucaaacugagga

SEQ ID NO: 712710 - RNA, 21 nt, Homo sapiens
acucaaagagggagugcauuu

SEQ ID NO: 712711 - RNA, 20 nt, Homo sapiens
acucagauccuccucauuca

SEQ ID NO: 712712 - RNA, 21 nt, Homo sapiens
acucagauccuccucauucac

SEQ ID NO: 712713 - RNA, 21 nt, Homo sapiens
acucagguggcccuacuggga

SEQ ID NO: 712714 - RNA, 21 nt, Homo sapiens
acucaucugucaccaagccuu

SEQ ID NO: 712715 - RNA, 19 nt, Homo sapiens
acucaugugacucuuucca

SEQ ID NO: 712716 - RNA, 16 nt, Homo sapiens
acuccaaaauguuggu

SEQ ID NO: 712717 - RNA, 20 nt, Homo sapiens
acuccagcaucgucucaugu

SEQ ID NO: 712718 - RNA, 14 nt, Homo sapiens
acucuaguauucca

SEQ ID NO: 712719 - RNA, 22 nt, Homo sapiens
acucugccccuucuguuuccau

SEQ ID NO: 712720 - RNA, 22 nt, Homo sapiens
acucugcuugauuuuugccucu

SEQ ID NO: 712721 - RNA, 14 nt, Homo sapiens
acugaaaaugugcu

SEQ ID NO: 712722 - RNA, 12 nt, Homo sapiens
acugcaaccucc

SEQ ID NO: 712723 - RNA, 13 nt, Homo sapiens
acugcaaccucca

SEQ ID NO: 712724 - RNA, 19 nt, Homo sapiens
acugcaaugccaguuuccu

SEQ ID NO: 712725 - RNA, 15 nt, Homo sapiens
acugcaugcacuucu

SEQ ID NO: 712726 - RNA, 20 nt, Homo sapiens
acuggagugugcgugguggu

SEQ ID NO: 712727 - RNA, 21 nt, Homo sapiens
acuggcuaacagauguugaaa

SEQ ID NO: 712728 - RNA, 12 nt, Homo sapiens
acugguccaaaa

SEQ ID NO: 712729 - RNA, 14 nt, Homo sapiens
acugucauagaaau

SEQ ID NO: 712730 - RNA, 18 nt, Homo sapiens
acuguguacauaacugaa

SEQ ID NO: 712731 - RNA, 21 nt, Homo sapiens
acuguuuugguuuugcucaca

SEQ ID NO: 712732 - RNA, 18 nt, Homo sapiens
acuuaaaaucuaauucaa

SEQ ID NO: 712733 - RNA, 14 nt, Homo sapiens
acuuacaugauuca

SEQ ID NO: 712734 - RNA, 22 nt, Homo sapiens
acuuauauggaaauucugcuca

SEQ ID NO: 712735 - RNA, 17 nt, Homo sapiens
acuuauuggaacucugc

SEQ ID NO: 712736 - RNA, 14 nt, Homo sapiens
acuucauaauccag

SEQ ID NO: 712737 - RNA, 23 nt, Homo sapiens
acuuccugguugagcuucugcua

SEQ ID NO: 712738 - RNA, 23 nt, Homo sapiens
acuucucauuuuuuaaaaaagcu

SEQ ID NO: 712739 - RNA, 24 nt, Homo sapiens
acuucuuacaauaauucuaugaga

SEQ ID NO: 712740 - RNA, 14 nt, Homo sapiens
acuugcucuugaug

SEQ ID NO: 712741 - RNA, 15 nt, Homo sapiens
acuugucuuugacuu

SEQ ID NO: 712742 - RNA, 23 nt, Homo sapiens
acuuuauguuacuacaugcacuu

SEQ ID NO: 712743 - RNA, 17 nt, Homo sapiens
auaucuugaaagggguu

SEQ ID NO: 712744 - RNA, 13 nt, Homo sapiens
auauuaugagaug

SEQ ID NO: 712745 - RNA, 18 nt, Homo sapiens
auauuuuguuuugugcag

SEQ ID NO: 712746 - RNA, 18 nt, Homo sapiens
aucaaaagggccaaagaa

SEQ ID NO: 712747 - RNA, 19 nt, Homo sapiens
aucacgcuuuccugaaucc

SEQ ID NO: 712748 - RNA, 15 nt, Homo sapiens
aucagcuaaguugca

SEQ ID NO: 712749 - RNA, 23 nt, Homo sapiens
auccaagcaucccuuugcccaga

SEQ ID NO: 712750 - RNA, 16 nt, Homo sapiens
auccagugauccuuac

SEQ ID NO: 712751 - RNA, 20 nt, Homo sapiens
aucccaaguagaaucucagu

SEQ ID NO: 712752 - RNA, 13 nt, Homo sapiens
aucccacugggag

SEQ ID NO: 712753 - RNA, 11 nt, Homo sapiens
aucccaugagc

SEQ ID NO: 712754 - RNA, 15 nt, Homo sapiens
aucccaugagcuccu

SEQ ID NO: 712755 - RNA, 22 nt, Homo sapiens
aucccucaaaacaaucuuguca

SEQ ID NO: 712756 - RNA, 14 nt, Homo sapiens
aucccuccaucuca

SEQ ID NO: 712757 - RNA, 15 nt, Homo sapiens
aucccuggaaggaca

SEQ ID NO: 712758 - RNA, 18 nt, Homo sapiens
aucuagaggcuuccuuca

SEQ ID NO: 712759 - RNA, 23 nt, Homo sapiens
aucuagaggcuuccuucauuucc

SEQ ID NO: 712760 - RNA, 15 nt, Homo sapiens
aucugaguuacagaa

SEQ ID NO: 712761 - RNA, 13 nt, Homo sapiens
aucuuuccuccaa

SEQ ID NO: 712762 - RNA, 20 nt, Homo sapiens
augaaaaauaagucacuuau

SEQ ID NO: 712763 - RNA, 18 nt, Homo sapiens
augaaaagauuaugaucu

SEQ ID NO: 712764 - RNA, 20 nt, Homo sapiens
augaaaagauuaugaucuca

SEQ ID NO: 712765 - RNA, 14 nt, Homo sapiens
augaaggcuguaca

SEQ ID NO: 712766 - RNA, 20 nt, Homo sapiens
augaaggcuguacacugcac

SEQ ID NO: 712767 - RNA, 18 nt, Homo sapiens
augaagguggaacaagca

SEQ ID NO: 712768 - RNA, 21 nt, Homo sapiens
augaagguggaacaagcacag

SEQ ID NO: 712769 - RNA, 23 nt, Homo sapiens
augaaggugucauacagauuugc

SEQ ID NO: 712770 - RNA, 16 nt, Homo sapiens
uaaaguacagacuuuu

SEQ ID NO: 712771 - RNA, 17 nt, Homo sapiens
uaaaguacagacuuuuu

SEQ ID NO: 712772 - RNA, 20 nt, Homo sapiens
uaaagugacuaauggcauga

SEQ ID NO: 712773 - RNA, 15 nt, Homo sapiens
uaaaguugauaaaga

SEQ ID NO: 712774 - RNA, 16 nt, Homo sapiens
uaaauguaucauagaa

SEQ ID NO: 712775 - RNA, 17 nt, Homo sapiens
uaaauguaucauagaaa

SEQ ID NO: 712776 - RNA, 17 nt, Homo sapiens
uaaaugugguacaagca

SEQ ID NO: 712777 - RNA, 15 nt, Homo sapiens
uaaauugauguugcu

SEQ ID NO: 712778 - RNA, 22 nt, Homo sapiens
uaacaaaaauaaaaacucuuau

SEQ ID NO: 712779 - RNA, 14 nt, Homo sapiens
uaacagauguugaa

SEQ ID NO: 712780 - RNA, 12 nt, Homo sapiens
uaaccacugugg

SEQ ID NO: 712781 - RNA, 22 nt, Homo sapiens
uaacgagaaaaacacacagaag

SEQ ID NO: 712782 - RNA, 22 nt, Homo sapiens
uaacuggguaaugaaacaaaga

SEQ ID NO: 712783 - RNA, 17 nt, Homo sapiens
uaacuuuuguaagacaa

SEQ ID NO: 712784 - RNA, 14 nt, Homo sapiens
uaagaaacauuuau

SEQ ID NO: 712785 - RNA, 14 nt, Homo sapiens
uaagauacacuccu

SEQ ID NO: 712786 - RNA, 15 nt, Homo sapiens
uaauaaauuucacca

SEQ ID NO: 712787 - RNA, 16 nt, Homo sapiens
uaaucaguguuuccaa

SEQ ID NO: 712788 - RNA, 15 nt, Homo sapiens
uaaugcucugauaug

SEQ ID NO: 712789 - RNA, 15 nt, Homo sapiens
uaauuggcaugaagg

SEQ ID NO: 712790 - RNA, 13 nt, Homo sapiens
uaauugugaauua

SEQ ID NO: 712791 - RNA, 21 nt, Homo sapiens
uaauuuauuauuaacauaccu

SEQ ID NO: 712792 - RNA, 13 nt, Homo sapiens
uaauuucaugaaa

SEQ ID NO: 712793 - RNA, 12 nt, Homo sapiens
uaauuucuacuu

SEQ ID NO: 712794 - RNA, 14 nt, Homo sapiens
uacaaaacaauuca

SEQ ID NO: 712795 - RNA, 21 nt, Homo sapiens
uacaaccaauggaaugugaug

SEQ ID NO: 712796 - RNA, 20 nt, Homo sapiens
uacaauaauucuaugagaua

SEQ ID NO: 712797 - RNA, 21 nt, Homo sapiens
uacagaaaugauuacuaagga

SEQ ID NO: 712798 - RNA, 17 nt, Homo sapiens
uaccaaccugaagacac

SEQ ID NO: 712799 - RNA, 18 nt, Homo sapiens
uaccaagccccuuggccc

SEQ ID NO: 712800 - RNA, 13 nt, Homo sapiens
uaccacucuggca

SEQ ID NO: 712801 - RNA, 17 nt, Homo sapiens
uaccauauacagcucag

SEQ ID NO: 712802 - RNA, 12 nt, Homo sapiens
uaccaugcugaa

SEQ ID NO: 712803 - RNA, 16 nt, Homo sapiens
uacccuuuggggagca

SEQ ID NO: 712804 - RNA, 15 nt, Homo sapiens
uaccucuauauacca

SEQ ID NO: 712805 - RNA, 20 nt, Homo sapiens
uacgauagguagaauugugg

SEQ ID NO: 712806 - RNA, 13 nt, Homo sapiens
uacugaagcccuu

SEQ ID NO: 712807 - RNA, 15 nt, Homo sapiens
uacugcaaacagugu

SEQ ID NO: 712808 - RNA, 17 nt, Homo sapiens
uacugcugagauacaua

SEQ ID NO: 712809 - RNA, 14 nt, Homo sapiens
uacuuaagugcugc

SEQ ID NO: 712810 - RNA, 13 nt, Homo sapiens
uacuuacaugcau

SEQ ID NO: 712811 - RNA, 17 nt, Homo sapiens
uagaauauccaugaccu

SEQ ID NO: 712812 - RNA, 23 nt, Homo sapiens
uagaauugugguucccuaaagac

SEQ ID NO: 712813 - RNA, 22 nt, Homo sapiens
uagagacgggguuucaccaugu

SEQ ID NO: 712814 - RNA, 14 nt, Homo sapiens
uagagacucaaaga

SEQ ID NO: 712815 - RNA, 12 nt, Homo sapiens
uagagcacugcc

SEQ ID NO: 712816 - RNA, 13 nt, Homo sapiens
uagcaaaagaaga

SEQ ID NO: 712817 - RNA, 21 nt, Homo sapiens
uagcaaagauaucucaucucu

SEQ ID NO: 712818 - RNA, 13 nt, Homo sapiens
uagcaacuacagu

SEQ ID NO: 712819 - RNA, 17 nt, Homo sapiens
uagccccugaaagccau

SEQ ID NO: 712820 - RNA, 22 nt, Homo sapiens
uagcgcuaucucccugccuccu

SEQ ID NO: 712821 - RNA, 23 nt, Homo sapiens
uagcugguucacacugaccaaga

SEQ ID NO: 712822 - RNA, 15 nt, Homo sapiens
uagcugucugcucag

SEQ ID NO: 712823 - RNA, 14 nt, Homo sapiens
uagggcugagcucu

SEQ ID NO: 712824 - RNA, 22 nt, Homo sapiens
uaguagagacaggguuucacca

SEQ ID NO: 712825 - RNA, 13 nt, Homo sapiens
uaguucugccagg

SEQ ID NO: 712826 - RNA, 21 nt, Homo sapiens
uaguucugggcccagcgcagu

SEQ ID NO: 712827 - RNA, 19 nt, Homo sapiens
uauaaaccagcuacuugau

SEQ ID NO: 712828 - RNA, 15 nt, Homo sapiens
uauaacuggaaagaa

SEQ ID NO: 712829 - RNA, 21 nt, Homo sapiens
uauaagcaagaaggcaaaaau

SEQ ID NO: 712830 - RNA, 19 nt, Homo sapiens
uauagcugcuuuugaugaa

SEQ ID NO: 712831 - RNA, 18 nt, Homo sapiens
uauaguuugcuguugcau

SEQ ID NO: 712832 - RNA, 18 nt, Homo sapiens
uauauaccaaagcacauu

SEQ ID NO: 712833 - RNA, 12 nt, Homo sapiens
uaucuaugcauu

SEQ ID NO: 712834 - RNA, 19 nt, Homo sapiens
uaugaaggcuguacacugc

SEQ ID NO: 712835 - RNA, 22 nt, Homo sapiens
uaugaaggcuguacacugcacg

SEQ ID NO: 712836 - RNA, 16 nt, Homo sapiens
uaugacaucacuugua

SEQ ID NO: 712837 - RNA, 20 nt, Homo sapiens
uaugauggguguuuuuagca

SEQ ID NO: 712838 - RNA, 16 nt, Homo sapiens
uaugcuaccuacugau

SEQ ID NO: 712839 - RNA, 17 nt, Homo sapiens
uauggagugcaccaaag

SEQ ID NO: 712840 - RNA, 23 nt, Homo sapiens
uauggauucagaauauacuaaau

SEQ ID NO: 712841 - RNA, 22 nt, Homo sapiens
uauguaaaauauuguuacuaga

SEQ ID NO: 712842 - RNA, 18 nt, Homo sapiens
uauguaccaagaaucuug

SEQ ID NO: 712843 - RNA, 14 nt, Homo sapiens
uauguccuaauaau

SEQ ID NO: 712844 - RNA, 19 nt, Homo sapiens
uauguuacuacaugcacuu

SEQ ID NO: 712845 - RNA, 22 nt, Homo sapiens
uauuacuuauuuuugacagugu

SEQ ID NO: 712846 - RNA, 17 nt, Homo sapiens
uauuccccccuacuuga

SEQ ID NO: 712847 - RNA, 18 nt, Homo sapiens
uauuccccccuacuugag

SEQ ID NO: 712848 - RNA, 13 nt, Homo sapiens
uauuccucaaaaa

SEQ ID NO: 712849 - RNA, 17 nt, Homo sapiens
uauugccuugugaauuu

SEQ ID NO: 712850 - RNA, 19 nt, Homo sapiens
uauugccuugugaauuugc

SEQ ID NO: 712851 - RNA, 14 nt, Homo sapiens
uauuuaauuagcca

SEQ ID NO: 712852 - RNA, 19 nt, Homo sapiens
uauuucaauguuagccuca

SEQ ID NO: 712853 - RNA, 15 nt, Homo sapiens
uauuugugacaaaaa

SEQ ID NO: 712854 - RNA, 17 nt, Homo sapiens
uauuuuauagagcagaa

SEQ ID NO: 712855 - RNA, 14 nt, Homo sapiens
uauuuuaucuguga

SEQ ID NO: 712856 - RNA, 23 nt, Homo sapiens
ucaaaaaauugcacauaguagaa

SEQ ID NO: 712857 - RNA, 15 nt, Homo sapiens
ucaaaagagucuuaa

SEQ ID NO: 712858 - RNA, 15 nt, Homo sapiens
ucaaaagcacuuugu

SEQ ID NO: 712859 - RNA, 21 nt, Homo sapiens
ucaaagcuuuuuccagaggcu

SEQ ID NO: 712860 - RNA, 12 nt, Homo sapiens
ucaaaugccuga

SEQ ID NO: 712861 - RNA, 19 nt, Homo sapiens
ucaacaaacauuugcugaa

SEQ ID NO: 712862 - RNA, 22 nt, Homo sapiens
ucaaccccuccccuccaucccu

SEQ ID NO: 712863 - RNA, 19 nt, Homo sapiens
ucaacuguuuuugucuaca

SEQ ID NO: 712864 - RNA, 16 nt, Homo sapiens
ucaacuugcuuaucaa

SEQ ID NO: 712865 - RNA, 15 nt, Homo sapiens
ucaagagacugaguc

SEQ ID NO: 712866 - RNA, 19 nt, Homo sapiens
ucaagcgauucucuugccu

SEQ ID NO: 712867 - RNA, 22 nt, Homo sapiens
ucaaggauagaaguauaccuga

SEQ ID NO: 712868 - RNA, 14 nt, Homo sapiens
ucaagggcuuuauu

SEQ ID NO: 712869 - RNA, 20 nt, Homo sapiens
ucaagggucaggccuuugag

SEQ ID NO: 712870 - RNA, 15 nt, Homo sapiens
ucaauaagccagcaa

SEQ ID NO: 712871 - RNA, 21 nt, Homo sapiens
ucaauauaagcuuuucuuuuc

SEQ ID NO: 712872 - RNA, 16 nt, Homo sapiens
ucacaucacacaaaag

SEQ ID NO: 712873 - RNA, 17 nt, Homo sapiens
ucaccacaaacuguaau

SEQ ID NO: 712874 - RNA, 14 nt, Homo sapiens
ucacccuaccugug

SEQ ID NO: 712875 - RNA, 16 nt, Homo sapiens
ucaccuguaaaccuga

SEQ ID NO: 712876 - RNA, 19 nt, Homo sapiens
ucacuaauucauuaaucug

SEQ ID NO: 712877 - RNA, 17 nt, Homo sapiens
ucacucugaguguuuua

SEQ ID NO: 712878 - RNA, 18 nt, Homo sapiens
ucacucuucaaaugccug

SEQ ID NO: 712879 - RNA, 13 nt, Homo sapiens
ucacugagaccaa

SEQ ID NO: 712880 - RNA, 23 nt, Homo sapiens
ucacuguagaaugauuucaugcu

SEQ ID NO: 712881 - RNA, 18 nt, Homo sapiens
ucacuuuuuuucuuuucu

SEQ ID NO: 712882 - RNA, 12 nt, Homo sapiens
ucagauaaggua

SEQ ID NO: 712883 - RNA, 21 nt, Homo sapiens
ucagauaagguaaaaugccau

SEQ ID NO: 712884 - RNA, 23 nt, Homo sapiens
ucagauaagguaaaaugccauga

SEQ ID NO: 712885 - RNA, 21 nt, Homo sapiens
ucagauccuccucauucacau

SEQ ID NO: 712886 - RNA, 19 nt, Homo sapiens
ucaggggccugcccagugc

SEQ ID NO: 712887 - RNA, 15 nt, Homo sapiens
ucagguauaccucac

SEQ ID NO: 712888 - RNA, 20 nt, Homo sapiens
ucagguauaccucacuuuac

SEQ ID NO: 712889 - RNA, 17 nt, Homo sapiens
ucagguggcccuacugg

SEQ ID NO: 712890 - RNA, 20 nt, Homo sapiens
ucagguggcccuacugggag

SEQ ID NO: 712891 - RNA, 15 nt, Homo sapiens
ucagguguuuuuacc

SEQ ID NO: 712892 - RNA, 22 nt, Homo sapiens
ucagguuugaggguuugcagaa

SEQ ID NO: 712893 - RNA, 17 nt, Homo sapiens
ucaguaguuuuacugau

SEQ ID NO: 712894 - RNA, 18 nt, Homo sapiens
ucauaaaagucacuuuau

SEQ ID NO: 712895 - RNA, 16 nt, Homo sapiens
ucauaaccuuaccaga

SEQ ID NO: 712896 - RNA, 22 nt, Homo sapiens
ucaucucuucuuuuaaaccauu

SEQ ID NO: 712897 - RNA, 15 nt, Homo sapiens
ucaucuuucuuccaa

SEQ ID NO: 712898 - RNA, 13 nt, Homo sapiens
ucaugaaccucaa

SEQ ID NO: 712899 - RNA, 18 nt, Homo sapiens
ucaugugacucuuuccaa

SEQ ID NO: 712900 - RNA, 16 nt, Homo sapiens
ucauguuggauaguca

SEQ ID NO: 712901 - RNA, 12 nt, Homo sapiens
uccacaaugaaa

SEQ ID NO: 712902 - RNA, 22 nt, Homo sapiens
ugauguucauggguauaguuca

SEQ ID NO: 712903 - RNA, 16 nt, Homo sapiens
ugauuaggacuuuuau

SEQ ID NO: 712904 - RNA, 23 nt, Homo sapiens
ugcaaggaccuaaaacaucucau

SEQ ID NO: 712905 - RNA, 21 nt, Homo sapiens
ugcaagguauuacacucugua

SEQ ID NO: 712906 - RNA, 22 nt, Homo sapiens
ugcaagguauuacacucuguaa

SEQ ID NO: 712907 - RNA, 15 nt, Homo sapiens
ugcacagcuaugaag

SEQ ID NO: 712908 - RNA, 22 nt, Homo sapiens
ugcacagguuuucagcaacuca

SEQ ID NO: 712909 - RNA, 15 nt, Homo sapiens
ugcagaaacagugca

SEQ ID NO: 712910 - RNA, 15 nt, Homo sapiens
ugcagaauguugauu

SEQ ID NO: 712911 - RNA, 23 nt, Homo sapiens
ugcagacaggaaucuuaaggugu

SEQ ID NO: 712912 - RNA, 19 nt, Homo sapiens
ugcaguuuuuuucuugucu

SEQ ID NO: 712913 - RNA, 20 nt, Homo sapiens
ugcaguuuuuuucuugucua

SEQ ID NO: 712914 - RNA, 21 nt, Homo sapiens
ugcauaaaauagagugcauuu

SEQ ID NO: 712915 - RNA, 21 nt, Homo sapiens
ugcauuaaaaaugcauauacu

SEQ ID NO: 712916 - RNA, 17 nt, Homo sapiens
ugcauuacugcaugcac

SEQ ID NO: 712917 - RNA, 17 nt, Homo sapiens
agagcacgccuguacua

SEQ ID NO: 712918 - RNA, 18 nt, Homo sapiens
agagccugcaggaucuca

SEQ ID NO: 712919 - RNA, 18 nt, Homo sapiens
agaggaaacucugucacu

SEQ ID NO: 712920 - RNA, 16 nt, Homo sapiens
agaggcaccuguccca

SEQ ID NO: 712921 - RNA, 19 nt, Homo sapiens
agaggcuuccuucauuucc

SEQ ID NO: 712922 - RNA, 20 nt, Homo sapiens
agaggcuuccuucauuuccu

SEQ ID NO: 712923 - RNA, 16 nt, Homo sapiens
agagucccugccugga

SEQ ID NO: 712924 - RNA, 13 nt, Homo sapiens
agauaaagaccuu

SEQ ID NO: 712925 - RNA, 17 nt, Homo sapiens
agauacauacagaauua

SEQ ID NO: 712926 - RNA, 17 nt, Homo sapiens
agauauuggacaaagaa

SEQ ID NO: 712927 - RNA, 20 nt, Homo sapiens
agaucuuuuauuuugccaag

SEQ ID NO: 712928 - RNA, 11 nt, Homo sapiens
agaugacaaag

SEQ ID NO: 712929 - RNA, 18 nt, Homo sapiens
agaugaggcuuuccaugg

SEQ ID NO: 712930 - RNA, 20 nt, Homo sapiens
agauuuuuacacauguaucu

SEQ ID NO: 712931 - RNA, 21 nt, Homo sapiens
agcaaaccaaagaccaucuga

SEQ ID NO: 712932 - RNA, 19 nt, Homo sapiens
agcaaccagagcacuguau

SEQ ID NO: 712933 - RNA, 21 nt, Homo sapiens
agcacauuuuaaaagugccau

SEQ ID NO: 712934 - RNA, 23 nt, Homo sapiens
agcacauuuuaaaagugccauua

SEQ ID NO: 712935 - RNA, 17 nt, Homo sapiens
agcaccuacuuacaugc

SEQ ID NO: 712936 - RNA, 22 nt, Homo sapiens
agcacugggaacaggagaccca

SEQ ID NO: 712937 - RNA, 14 nt, Homo sapiens
agcagggacuguaa

SEQ ID NO: 712938 - RNA, 16 nt, Homo sapiens
agcaggguacccuuug

SEQ ID NO: 712939 - RNA, 12 nt, Homo sapiens
agccaagcaaaa

SEQ ID NO: 712940 - RNA, 13 nt, Homo sapiens
agccaaggaguca

SEQ ID NO: 712941 - RNA, 18 nt, Homo sapiens
agccacuaccuucugacc

SEQ ID NO: 712942 - RNA, 22 nt, Homo sapiens
agcccaggaguugaagaccagc

SEQ ID NO: 712943 - RNA, 17 nt, Homo sapiens
agccccggacucaggcc

SEQ ID NO: 712944 - RNA, 18 nt, Homo sapiens
agcccucaauaagccagc

SEQ ID NO: 712945 - RNA, 16 nt, Homo sapiens
agccugcagacucacu

SEQ ID NO: 712946 - RNA, 11 nt, Homo sapiens
agccugggaag

SEQ ID NO: 712947 - RNA, 20 nt, Homo sapiens
agccuucucuguucauuucc

SEQ ID NO: 712948 - RNA, 22 nt, Homo sapiens
agccuucucuguucauuuccuc

SEQ ID NO: 712949 - RNA, 19 nt, Homo sapiens
agccuuggggauucuucca

SEQ ID NO: 712950 - RNA, 20 nt, Homo sapiens
agcgcagugccucaugccug

SEQ ID NO: 712951 - RNA, 20 nt, Homo sapiens
agcuacaaaacaauucaauu

SEQ ID NO: 712952 - RNA, 11 nt, Homo sapiens
agcuacuugau

SEQ ID NO: 712953 - RNA, 12 nt, Homo sapiens
agcuaugaaggc

SEQ ID NO: 712954 - RNA, 18 nt, Homo sapiens
agcuaugaaggcuguaca

SEQ ID NO: 712955 - RNA, 21 nt, Homo sapiens
agcucacaguacaauguuuca

SEQ ID NO: 712956 - RNA, 21 nt, Homo sapiens
agcucagaaaauaucccuccu

SEQ ID NO: 712957 - RNA, 15 nt, Homo sapiens
agcuccuuaaggcuc

SEQ ID NO: 712958 - RNA, 19 nt, Homo sapiens
agcuggacaugcuuuggca

SEQ ID NO: 712959 - RNA, 13 nt, Homo sapiens
agcugucugcuca

SEQ ID NO: 712960 - RNA, 14 nt, Homo sapiens
agcuucaaacugca

SEQ ID NO: 712961 - RNA, 21 nt, Homo sapiens
agcuuucccugccucucauca

SEQ ID NO: 712962 - RNA, 19 nt, Homo sapiens
aggaaauauacuuuuacaa

SEQ ID NO: 712963 - RNA, 19 nt, Homo sapiens
aggaaauggcuuugugauu

SEQ ID NO: 712964 - RNA, 17 nt, Homo sapiens
aggaagcuagguugaaa

SEQ ID NO: 712965 - RNA, 18 nt, Homo sapiens
aggaccuaaaacaucuca

SEQ ID NO: 712966 - RNA, 13 nt, Homo sapiens
aggacucaaaagu

SEQ ID NO: 712967 - RNA, 13 nt, Homo sapiens
aggacuccuuaaa

SEQ ID NO: 712968 - RNA, 19 nt, Homo sapiens
aggacuugugucucugugc

SEQ ID NO: 712969 - RNA, 13 nt, Homo sapiens
aggaggccaauaa

SEQ ID NO: 712970 - RNA, 18 nt, Homo sapiens
aggagggaggugcuucua

SEQ ID NO: 712971 - RNA, 22 nt, Homo sapiens
aggauacgacaguacacuguca

SEQ ID NO: 712972 - RNA, 22 nt, Homo sapiens
aggaugagggaaaagaaaaaga

SEQ ID NO: 712973 - RNA, 21 nt, Homo sapiens
aggaugauaaaagcacuuacu

SEQ ID NO: 712974 - RNA, 16 nt, Homo sapiens
aggaugugcauucucc

SEQ ID NO: 712975 - RNA, 17 nt, Homo sapiens
aggauuaagauacacuc

SEQ ID NO: 712976 - RNA, 20 nt, Homo sapiens
aggcagaggauguucuggac

SEQ ID NO: 712977 - RNA, 22 nt, Homo sapiens
aggcauuaaauuuuagcaaaga

SEQ ID NO: 712978 - RNA, 22 nt, Homo sapiens
aggcuucagccauccacuucac

SEQ ID NO: 712979 - RNA, 13 nt, Homo sapiens
aggcuuccuucau

SEQ ID NO: 712980 - RNA, 17 nt, Homo sapiens
aggcuuccuucauuucc

SEQ ID NO: 712981 - RNA, 19 nt, Homo sapiens
agggccaaagaaccaaaga

SEQ ID NO: 712982 - RNA, 16 nt, Homo sapiens
aggguuugcagaaagc

SEQ ID NO: 712983 - RNA, 22 nt, Homo sapiens
aggguuuuaguuuuuaauuuau

SEQ ID NO: 712984 - RNA, 15 nt, Homo sapiens
agguauuacacucug

SEQ ID NO: 712985 - RNA, 11 nt, Homo sapiens
aggucagccag

SEQ ID NO: 712986 - RNA, 16 nt, Homo sapiens
agguccucaguguccu

SEQ ID NO: 712987 - RNA, 18 nt, Homo sapiens
agguggaacaagcacaga

SEQ ID NO: 712988 - RNA, 21 nt, Homo sapiens
agguggguugaaagccaagga

SEQ ID NO: 712989 - RNA, 17 nt, Homo sapiens
aguaacggaacaguauc

SEQ ID NO: 712990 - RNA, 17 nt, Homo sapiens
aguaacucaucugucac

SEQ ID NO: 712991 - RNA, 13 nt, Homo sapiens
aguacagacuuuu

SEQ ID NO: 712992 - RNA, 16 nt, Homo sapiens
aguauaauaauuacug

SEQ ID NO: 712993 - RNA, 13 nt, Homo sapiens
aguauccacuuug

SEQ ID NO: 712994 - RNA, 17 nt, Homo sapiens
agucagcuguaccaagc

SEQ ID NO: 712995 - RNA, 20 nt, Homo sapiens
aguccuggaagccagcuuuc

SEQ ID NO: 712996 - RNA, 22 nt, Homo sapiens
agucuaucaaccccagacacug

SEQ ID NO: 712997 - RNA, 16 nt, Homo sapiens
agugaaaaacuauuaa

SEQ ID NO: 712998 - RNA, 21 nt, Homo sapiens
agugaacuugaaauauccugc

SEQ ID NO: 712999 - RNA, 21 nt, Homo sapiens
agugaccauaaaggcauggca

SEQ ID NO: 713000 - RNA, 22 nt, Homo sapiens
agugagccugaauuuuguugcu

SEQ ID NO: 713001 - RNA, 15 nt, Homo sapiens
agugccucaugccug

SEQ ID NO: 713002 - RNA, 18 nt, Homo sapiens
aguguaauugagaaggaa

SEQ ID NO: 713003 - RNA, 19 nt, Homo sapiens
aguuagauaugugccaaag

SEQ ID NO: 713004 - RNA, 19 nt, Homo sapiens
aguuucuucuuuaggcauu

SEQ ID NO: 713005 - RNA, 21 nt, Homo sapiens
aguuuuuaauuuaucagagac

SEQ ID NO: 713006 - RNA, 13 nt, Homo sapiens
auaaaaacucuua

SEQ ID NO: 713007 - RNA, 18 nt, Homo sapiens
auaaaaugaauacaauua

SEQ ID NO: 713008 - RNA, 15 nt, Homo sapiens
auaaagcagccucau

SEQ ID NO: 713009 - RNA, 15 nt, Homo sapiens
auaaaggcauggcau

SEQ ID NO: 713010 - RNA, 15 nt, Homo sapiens
auaaauuaagacuuu

SEQ ID NO: 713011 - RNA, 12 nt, Homo sapiens
auaauaucccac

SEQ ID NO: 713012 - RNA, 13 nt, Homo sapiens
auaaucuucugcc

SEQ ID NO: 713013 - RNA, 18 nt, Homo sapiens
auaaugaaaauuaugaua

SEQ ID NO: 713014 - RNA, 17 nt, Homo sapiens
auacaaaaauacucaga

SEQ ID NO: 713015 - RNA, 18 nt, Homo sapiens
auacaauuaaagcuguua

SEQ ID NO: 713016 - RNA, 15 nt, Homo sapiens
auacacagugcugac

SEQ ID NO: 713017 - RNA, 14 nt, Homo sapiens
auacccagucccag

SEQ ID NO: 713018 - RNA, 17 nt, Homo sapiens
auacuaccaagugacca

SEQ ID NO: 713019 - RNA, 17 nt, Homo sapiens
auacuggcuaacagaug

SEQ ID NO: 713020 - RNA, 22 nt, Homo sapiens
auacuggcuaacagauguugaa

SEQ ID NO: 713021 - RNA, 12 nt, Homo sapiens
auagaaaugcca

SEQ ID NO: 713022 - RNA, 19 nt, Homo sapiens
auagaauuauaacuggaaa

SEQ ID NO: 713023 - RNA, 21 nt, Homo sapiens
auagauuuucugcuacuuugc

SEQ ID NO: 713024 - RNA, 11 nt, Homo sapiens
auagcuuccaa

SEQ ID NO: 713025 - RNA, 18 nt, Homo sapiens
auaugacacucuagucaa

SEQ ID NO: 713026 - RNA, 15 nt, Homo sapiens
auauuagaaagggaa

SEQ ID NO: 713027 - RNA, 14 nt, Homo sapiens
auauuucaauguua

SEQ ID NO: 713028 - RNA, 23 nt, Homo sapiens
auauuuguguauauaaaccgauc

SEQ ID NO: 713029 - RNA, 18 nt, Homo sapiens
aucaaccaaacaaagaaa

SEQ ID NO: 713030 - RNA, 16 nt, Homo sapiens
aucaaccaaauggagu

SEQ ID NO: 713031 - RNA, 18 nt, Homo sapiens
aucaaccccagacacugg

SEQ ID NO: 713032 - RNA, 19 nt, Homo sapiens
aucaacuuccuaaauauua

SEQ ID NO: 713033 - RNA, 23 nt, Homo sapiens
aucaacuugcuuaucaacuuccu

SEQ ID NO: 713034 - RNA, 16 nt, Homo sapiens
aucaauuaaaggcaaa

SEQ ID NO: 713035 - RNA, 20 nt, Homo sapiens
aucaauuacugguccaaaag

SEQ ID NO: 713036 - RNA, 14 nt, Homo sapiens
cacagaaugugaua

SEQ ID NO: 713037 - RNA, 14 nt, Homo sapiens
cacagcuaugaagg

SEQ ID NO: 713038 - RNA, 15 nt, Homo sapiens
cacagcuaugaaggc

SEQ ID NO: 713039 - RNA, 21 nt, Homo sapiens
cacagcuaugaaggcuguaca

SEQ ID NO: 713040 - RNA, 13 nt, Homo sapiens
cacagguuuucag

SEQ ID NO: 713041 - RNA, 17 nt, Homo sapiens
cacaguacaauguuuca

SEQ ID NO: 713042 - RNA, 20 nt, Homo sapiens
cacaguacaauguuucagaa

SEQ ID NO: 713043 - RNA, 23 nt, Homo sapiens
cacaucccuggaaggacauccau

SEQ ID NO: 713044 - RNA, 18 nt, Homo sapiens
caccaaagagaaugcccu

SEQ ID NO: 713045 - RNA, 13 nt, Homo sapiens
caccacaaacugu

SEQ ID NO: 713046 - RNA, 11 nt, Homo sapiens
caccacuccac

SEQ ID NO: 713047 - RNA, 17 nt, Homo sapiens
caccacuccacuccucc

SEQ ID NO: 713048 - RNA, 18 nt, Homo sapiens
caccauuuuccugccuca

SEQ ID NO: 713049 - RNA, 14 nt, Homo sapiens
cacccacaaucaca

SEQ ID NO: 713050 - RNA, 22 nt, Homo sapiens
cacccuugguuccuaacuggaa

SEQ ID NO: 713051 - RNA, 17 nt, Homo sapiens
caccuccuggguucaag

SEQ ID NO: 713052 - RNA, 16 nt, Homo sapiens
caccucuuuuugaaca

SEQ ID NO: 713053 - RNA, 22 nt, Homo sapiens
caccuggggaguuuacuaccug

SEQ ID NO: 713054 - RNA, 16 nt, Homo sapiens
gaaaugaggagacaca

SEQ ID NO: 713055 - RNA, 22 nt, Homo sapiens
gaaaugugguagccucacuuuu

SEQ ID NO: 713056 - RNA, 22 nt, Homo sapiens
gaaauuuaaacuauaagcaaga

SEQ ID NO: 713057 - RNA, 17 nt, Homo sapiens
gaacuacauuaguacac

SEQ ID NO: 713058 - RNA, 18 nt, Homo sapiens
gaacugauucacaucuca

SEQ ID NO: 713059 - RNA, 14 nt, Homo sapiens
gaacugucuacccu

SEQ ID NO: 713060 - RNA, 17 nt, Homo sapiens
gaacuugaacugauuca

SEQ ID NO: 713061 - RNA, 22 nt, Homo sapiens
gaagaacagauaaucccuguau

SEQ ID NO: 713062 - RNA, 18 nt, Homo sapiens
gaagcaggguacccuuug

SEQ ID NO: 713063 - RNA, 11 nt, Homo sapiens
gaaguuucauc

SEQ ID NO: 713064 - RNA, 13 nt, Homo sapiens
gaauaguuuccaa

SEQ ID NO: 713065 - RNA, 20 nt, Homo sapiens
gaaucacuguuuagaacaca

SEQ ID NO: 713066 - RNA, 19 nt, Homo sapiens
gaaucuuaagguguagcca

SEQ ID NO: 713067 - RNA, 15 nt, Homo sapiens
gaaugacacuguuca

SEQ ID NO: 713068 - RNA, 15 nt, Homo sapiens
gaauuagacuuguau

SEQ ID NO: 713069 - RNA, 22 nt, Homo sapiens
gaauugauucaagauuggacau

SEQ ID NO: 713070 - RNA, 17 nt, Homo sapiens
gaauugucuuccgcuag

SEQ ID NO: 713071 - RNA, 20 nt, Homo sapiens
gaauugugguucccuaaaga

SEQ ID NO: 713072 - RNA, 16 nt, Homo sapiens
gaauuuucaucuagga

SEQ ID NO: 713073 - RNA, 13 nt, Homo sapiens
gaauuuuguugcu

SEQ ID NO: 713074 - RNA, 16 nt, Homo sapiens
gaauuuuuaaacaagu

SEQ ID NO: 713075 - RNA, 15 nt, Homo sapiens
gacaagccagaacuu

SEQ ID NO: 713076 - RNA, 16 nt, Homo sapiens
gacaccuaggcuaggg

SEQ ID NO: 713077 - RNA, 15 nt, Homo sapiens
gacaguuuucugcuu

SEQ ID NO: 713078 - RNA, 18 nt, Homo sapiens
gacauacaccuaugucau

SEQ ID NO: 713079 - RNA, 18 nt, Homo sapiens
gacaugcuucagugcugc

SEQ ID NO: 713080 - RNA, 13 nt, Homo sapiens
gacauuaacucau

SEQ ID NO: 713081 - RNA, 22 nt, Homo sapiens
gaccacaacuauuuucagaugu

SEQ ID NO: 713082 - RNA, 24 nt, Homo sapiens
gaccacugggcaaugauggcaauu

SEQ ID NO: 713083 - RNA, 23 nt, Homo sapiens
gaccauaaaggcauggcauuugu

SEQ ID NO: 713084 - RNA, 15 nt, Homo sapiens
gaccccccuugccca

SEQ ID NO: 713085 - RNA, 19 nt, Homo sapiens
gaccgugaccagugcugcu

SEQ ID NO: 713086 - RNA, 18 nt, Homo sapiens
cccacuguaucuaggcaa

SEQ ID NO: 713087 - RNA, 19 nt, Homo sapiens
cccagaaccacacuguuga

SEQ ID NO: 713088 - RNA, 17 nt, Homo sapiens
cccagacuuucuacacc

SEQ ID NO: 713089 - RNA, 18 nt, Homo sapiens
cccagagcaaaauaauuu

SEQ ID NO: 713090 - RNA, 13 nt, Homo sapiens
cccagcgcagugc

SEQ ID NO: 713091 - RNA, 13 nt, Homo sapiens
cccagcggcauca

SEQ ID NO: 713092 - RNA, 15 nt, Homo sapiens
cccaggcacugcaaa

SEQ ID NO: 713093 - RNA, 20 nt, Homo sapiens
cccauuugcacagguuuuca

SEQ ID NO: 713094 - RNA, 17 nt, Homo sapiens
ccccugugccuugucac

SEQ ID NO: 713095 - RNA, 23 nt, Homo sapiens
cccguggccauuacugcauaaaa

SEQ ID NO: 713096 - RNA, 11 nt, Homo sapiens
cccuacuggga

SEQ ID NO: 713097 - RNA, 22 nt, Homo sapiens
cccuacugggagaggggccuca

SEQ ID NO: 713098 - RNA, 18 nt, Homo sapiens
cccucccuggaugacauu

SEQ ID NO: 713099 - RNA, 14 nt, Homo sapiens
cccucccuuugaaa

SEQ ID NO: 713100 - RNA, 17 nt, Homo sapiens
cccucucccaugcacac

SEQ ID NO: 713101 - RNA, 13 nt, Homo sapiens
cccugaaagccau

SEQ ID NO: 713102 - RNA, 22 nt, Homo sapiens
cccugagagcucacaguacaau

SEQ ID NO: 713103 - RNA, 15 nt, Homo sapiens
cccuggaugacauua

SEQ ID NO: 713104 - RNA, 16 nt, Homo sapiens
cccuuauuuucaagaa

SEQ ID NO: 713105 - RNA, 22 nt, Homo sapiens
cccuuggcccucucccaugcac

SEQ ID NO: 713106 - RNA, 17 nt, Homo sapiens
ccgugaccagugcugcu

SEQ ID NO: 713107 - RNA, 13 nt, Homo sapiens
ccguucaacuuuu

SEQ ID NO: 713108 - RNA, 23 nt, Homo sapiens
ucagggggccuuuaaagacuuaa

SEQ ID NO: 713109 - RNA, 14 nt, Homo sapiens
ucagguauaccuca

SEQ ID NO: 713110 - RNA, 19 nt, Homo sapiens
ucagguggcccuacuggga

SEQ ID NO: 713111 - RNA, 12 nt, Homo sapiens
ucagugcugcuc

SEQ ID NO: 713112 - RNA, 22 nt, Homo sapiens
ucaguuaugauuuuuuuuucau

SEQ ID NO: 713113 - RNA, 13 nt, Homo sapiens
ucauacacuuauu

SEQ ID NO: 713114 - RNA, 15 nt, Homo sapiens
ucaucccuccaucuc

SEQ ID NO: 713115 - RNA, 21 nt, Homo sapiens
ucaucuauuuuuggcagucug

SEQ ID NO: 713116 - RNA, 16 nt, Homo sapiens
ucaugauggagacuuc

SEQ ID NO: 713117 - RNA, 22 nt, Homo sapiens
ucauuuccuccgucaccucaga

SEQ ID NO: 713118 - RNA, 17 nt, Homo sapiens
ucauuuuaacaucugag

SEQ ID NO: 713119 - RNA, 20 nt, Homo sapiens
uccaccuccuggguucaagc

SEQ ID NO: 713120 - RNA, 14 nt, Homo sapiens
uccacuguggaaaa

SEQ ID NO: 713121 - RNA, 16 nt, Homo sapiens
uccagggcaaggccau

SEQ ID NO: 713122 - RNA, 14 nt, Homo sapiens
uccaucuccaucca

SEQ ID NO: 713123 - RNA, 14 nt, Homo sapiens
uccauucuccugag

SEQ ID NO: 713124 - RNA, 18 nt, Homo sapiens
ucccaaguagaaucucag

SEQ ID NO: 713125 - RNA, 18 nt, Homo sapiens
ucccacuguuuaaggagu

SEQ ID NO: 713126 - RNA, 19 nt, Homo sapiens
ucccagcaugcugagauua

SEQ ID NO: 713127 - RNA, 21 nt, Homo sapiens
ucccaggucacacugauucau

SEQ ID NO: 713128 - RNA, 22 nt, Homo sapiens
uccccgggguauuagcaccucu

SEQ ID NO: 713129 - RNA, 20 nt, Homo sapiens
uccccuggaacugucucuca

SEQ ID NO: 713130 - RNA, 20 nt, Homo sapiens
ucccgggacaccuaggcuag

SEQ ID NO: 713131 - RNA, 13 nt, Homo sapiens
ucccucaaaacaa

SEQ ID NO: 713132 - RNA, 21 nt, Homo sapiens
ucccuccuuuggaaugcugua

SEQ ID NO: 713133 - RNA, 22 nt, Homo sapiens
ucccugagagcucacaguacaa

SEQ ID NO: 713134 - RNA, 24 nt, Homo sapiens
ucccugccucucaucaacugaaug

SEQ ID NO: 713135 - RNA, 16 nt, Homo sapiens
ucccuggaugacauua

SEQ ID NO: 713136 - RNA, 17 nt, Homo sapiens
ucccuggaugacauuaa

SEQ ID NO: 713137 - RNA, 23 nt, Homo sapiens
ucccuggaugacauuaaagaagg

SEQ ID NO: 713138 - RNA, 16 nt, Homo sapiens
uccgucaccucagaga

SEQ ID NO: 713139 - RNA, 23 nt, Homo sapiens
uccgucaccucagagacauacac

SEQ ID NO: 713140 - RNA, 13 nt, Homo sapiens
uccgugugggaga

SEQ ID NO: 713141 - RNA, 22 nt, Homo sapiens
uccuacccccugugccuuguca

SEQ ID NO: 713142 - RNA, 22 nt, Homo sapiens
uccucagagaauuucuaccauu

SEQ ID NO: 713143 - RNA, 14 nt, Homo sapiens
uccugucugaaaag

SEQ ID NO: 713144 - RNA, 15 nt, Homo sapiens
uccuguuacaaaaga

SEQ ID NO: 713145 - RNA, 16 nt, Homo sapiens
uccuuugaacuuugaa

SEQ ID NO: 713146 - RNA, 17 nt, Homo sapiens
uccuuugguccuucaaa

SEQ ID NO: 713147 - RNA, 16 nt, Homo sapiens
uccuuuuaauuuuccu

SEQ ID NO: 713148 - RNA, 21 nt, Homo sapiens
ucgcccuggacugugugcuca

SEQ ID NO: 713149 - RNA, 15 nt, Homo sapiens
ucgggagcaaaccaa

SEQ ID NO: 713150 - RNA, 12 nt, Homo sapiens
ucuaagaaagaa

SEQ ID NO: 713151 - RNA, 22 nt, Homo sapiens
ucuacgcaaaaaauaacuacag

SEQ ID NO: 713152 - RNA, 22 nt, Homo sapiens
ucuagacacugccacacagggu

SEQ ID NO: 713153 - RNA, 20 nt, Homo sapiens
ucuagccuggcuauguccua

SEQ ID NO: 713154 - RNA, 20 nt, Homo sapiens
ucuauauaccaaagcacauu

SEQ ID NO: 713155 - RNA, 22 nt, Homo sapiens
ucucaaacuccugaccucaggc

SEQ ID NO: 713156 - RNA, 15 nt, Homo sapiens
ucuccugaacuccca

SEQ ID NO: 713157 - RNA, 14 nt, Homo sapiens
ucucuaauauggca

SEQ ID NO: 713158 - RNA, 23 nt, Homo sapiens
ucucuacaaacucccacuuguca

SEQ ID NO: 713159 - RNA, 20 nt, Homo sapiens
ggcaacacagugagacuuca

SEQ ID NO: 713160 - RNA, 21 nt, Homo sapiens
ggcacagccuggcuguggccu

SEQ ID NO: 713161 - RNA, 16 nt, Homo sapiens
ggcacccaauguuuga

SEQ ID NO: 713162 - RNA, 16 nt, Homo sapiens
ggcacugagaccucca

SEQ ID NO: 713163 - RNA, 20 nt, Homo sapiens
ggcagucugagagaggccau

SEQ ID NO: 713164 - RNA, 23 nt, Homo sapiens
ggcauagaacuccggaaugacca

SEQ ID NO: 713165 - RNA, 16 nt, Homo sapiens
ggcauuuucacuuuug

SEQ ID NO: 713166 - RNA, 16 nt, Homo sapiens
ggccagagccaagggg

SEQ ID NO: 713167 - RNA, 16 nt, Homo sapiens
ggccauucuuucccaa

SEQ ID NO: 713168 - RNA, 18 nt, Homo sapiens
ggccgugacgucugggug

SEQ ID NO: 713169 - RNA, 11 nt, Homo sapiens
ggcgcuuucug

SEQ ID NO: 713170 - RNA, 22 nt, Homo sapiens
ggcuagguggguugaaagccaa

SEQ ID NO: 713171 - RNA, 20 nt, Homo sapiens
ggcucuggagcccacuguac

SEQ ID NO: 713172 - RNA, 18 nt, Homo sapiens
ggcuguggccuaaccugc

SEQ ID NO: 713173 - RNA, 14 nt, Homo sapiens
ggcuuuguggcacu

SEQ ID NO: 713174 - RNA, 18 nt, Homo sapiens
gggccaaagaaccaaaga

SEQ ID NO: 713175 - RNA, 15 nt, Homo sapiens
gggcccagcgcagug

SEQ ID NO: 713176 - RNA, 14 nt, Homo sapiens
gggccugcccagug

SEQ ID NO: 713177 - RNA, 21 nt, Homo sapiens
gggucaaagccgguugcagag

SEQ ID NO: 713178 - RNA, 15 nt, Homo sapiens
gguggaacaagcaca

SEQ ID NO: 713179 - RNA, 16 nt, Homo sapiens
gguuaaccacuguggu

SEQ ID NO: 713180 - RNA, 23 nt, Homo sapiens
gguuaccaguaacggaacaguau

SEQ ID NO: 713181 - RNA, 14 nt, Homo sapiens
guaaaagcaaaaaa

SEQ ID NO: 713182 - RNA, 12 nt, Homo sapiens
guaaagccaugc

SEQ ID NO: 713183 - RNA, 11 nt, Homo sapiens
guaaaugugau

SEQ ID NO: 713184 - RNA, 16 nt, Homo sapiens
guaacccugucuggau

SEQ ID NO: 713185 - RNA, 15 nt, Homo sapiens
guaacugucaaguca

SEQ ID NO: 713186 - RNA, 13 nt, Homo sapiens
guaagacugugua

SEQ ID NO: 713187 - RNA, 14 nt, Homo sapiens
guaaugaaacaaag

SEQ ID NO: 713188 - RNA, 21 nt, Homo sapiens
guaauuguacuaaagccaaac

SEQ ID NO: 713189 - RNA, 19 nt, Homo sapiens
guaauuuuaaguaauuuca

SEQ ID NO: 713190 - RNA, 17 nt, Homo sapiens
guacauuguuaccucua

SEQ ID NO: 713191 - RNA, 18 nt, Homo sapiens
guaccaggugaacaaagu

SEQ ID NO: 713192 - RNA, 18 nt, Homo sapiens
guacccuuuggggagcag

SEQ ID NO: 713193 - RNA, 21 nt, Homo sapiens
guacugguuuauguggacaag

SEQ ID NO: 713194 - RNA, 23 nt, Homo sapiens
guagcagguuaccacucuggcag

SEQ ID NO: 713195 - RNA, 16 nt, Homo sapiens
guagccacuucacuuu

SEQ ID NO: 713196 - RNA, 21 nt, Homo sapiens
guagugucacucaaggcggug

SEQ ID NO: 713197 - RNA, 23 nt, Homo sapiens
guagugucacucaaggcggugcu

SEQ ID NO: 713198 - RNA, 12 nt, Homo sapiens
guaucaucagau

SEQ ID NO: 713199 - RNA, 21 nt, Homo sapiens
guauugccuugugaauuugcu

SEQ ID NO: 713200 - RNA, 16 nt, Homo sapiens
guauuuuuaguagaga

SEQ ID NO: 713201 - RNA, 18 nt, Homo sapiens
gucaggccuuugagcuca

SEQ ID NO: 713202 - RNA, 10 nt, Homo sapiens
gucauagaaa

SEQ ID NO: 713203 - RNA, 23 nt, Homo sapiens
gucaucaauuaaaggcaaaggca

SEQ ID NO: 713204 - RNA, 19 nt, Homo sapiens
gucaugauggagacuucag

SEQ ID NO: 713205 - RNA, 14 nt, Homo sapiens
gucauuucauuucc

SEQ ID NO: 713206 - RNA, 14 nt, Homo sapiens
guccaucagccucc

SEQ ID NO: 713207 - RNA, 11 nt, Homo sapiens
gucccaagaca

SEQ ID NO: 713208 - RNA, 19 nt, Homo sapiens
gucccagaaccacacuguu

SEQ ID NO: 713209 - RNA, 23 nt, Homo sapiens
gucccuucuucccuaaucagcuc

SEQ ID NO: 713210 - RNA, 17 nt, Homo sapiens
guccuaauaauauccca

SEQ ID NO: 713211 - RNA, 19 nt, Homo sapiens
gucuaaaacauguuugcac

SEQ ID NO: 713212 - RNA, 16 nt, Homo sapiens
gucugaucguucaaag

SEQ ID NO: 713213 - RNA, 18 nt, Homo sapiens
gucuggaaagugauguca

SEQ ID NO: 713214 - RNA, 17 nt, Homo sapiens
gucuuugcuguaaacuu

SEQ ID NO: 713215 - RNA, 18 nt, Homo sapiens
gugaaauguauagcugcu

SEQ ID NO: 713216 - RNA, 20 nt, Homo sapiens
gugacaaaaaauuaaagcau

SEQ ID NO: 713217 - RNA, 16 nt, Homo sapiens
gugaccagugcugcug

SEQ ID NO: 713218 - RNA, 21 nt, Homo sapiens
gugacucuauauagcugauca

SEQ ID NO: 713219 - RNA, 21 nt, Homo sapiens
gugacuggcagcauugacucu

SEQ ID NO: 713220 - RNA, 16 nt, Homo sapiens
gugacuuaguguacau

SEQ ID NO: 713221 - RNA, 22 nt, Homo sapiens
gugaucccuagcugugaccucu

SEQ ID NO: 713222 - RNA, 19 nt, Homo sapiens
gugccuucauuugggaugc

SEQ ID NO: 713223 - RNA, 23 nt, Homo sapiens
gugcucugaguaucacaucacac

SEQ ID NO: 713224 - RNA, 21 nt, Homo sapiens
guggacaugcgugaccagcag

SEQ ID NO: 713225 - RNA, 13 nt, Homo sapiens
guggcauccagag

SEQ ID NO: 713226 - RNA, 16 nt, Homo sapiens
guggcauuuucacuuu

SEQ ID NO: 713227 - RNA, 15 nt, Homo sapiens
guggcgcuuucugca

SEQ ID NO: 713228 - RNA, 20 nt, Homo sapiens
gugggaggguaccagcagaa

SEQ ID NO: 713229 - RNA, 16 nt, Homo sapiens
guggugcgagugcgug

SEQ ID NO: 713230 - RNA, 16 nt, Homo sapiens
guguaagggccagaaa

SEQ ID NO: 713231 - RNA, 14 nt, Homo sapiens
gugugcaucaggcu

SEQ ID NO: 713232 - RNA, 11 nt, Homo sapiens
gugugggagac

SEQ ID NO: 713233 - RNA, 18 nt, Homo sapiens
guguuuucucugaacaca

SEQ ID NO: 713234 - RNA, 12 nt, Homo sapiens
guuacacagggu

SEQ ID NO: 713235 - RNA, 22 nt, Homo sapiens
guuaccaguaacggaacaguau

SEQ ID NO: 713236 - RNA, 20 nt, Homo sapiens
guuauuccccccuacuugag

SEQ ID NO: 713237 - RNA, 17 nt, Homo sapiens
guucccauuucagcuga

SEQ ID NO: 713238 - RNA, 14 nt, Homo sapiens
guuccuaacuggaa

SEQ ID NO: 713239 - RNA, 23 nt, Homo sapiens
guuccuaacuggaaucagcucag

SEQ ID NO: 713240 - RNA, 18 nt, Homo sapiens
guucucggggcucaggag

SEQ ID NO: 713241 - RNA, 22 nt, Homo sapiens
guucuuuaaaauguaaagccau

SEQ ID NO: 713242 - RNA, 13 nt, Homo sapiens
guuguuguuguug

SEQ ID NO: 713243 - RNA, 15 nt, Homo sapiens
guuuacuaccugggg

SEQ ID NO: 713244 - RNA, 21 nt, Homo sapiens
guuuagccccugaaagccaug

SEQ ID NO: 713245 - RNA, 15 nt, Homo sapiens
guuuccaaucugucc

SEQ ID NO: 713246 - RNA, 19 nt, Homo sapiens
guuuuuuacuuccacagaa

SEQ ID NO: 713247 - RNA, 16 nt, Homo sapiens
uaaaaaugaauuggga

SEQ ID NO: 713248 - RNA, 12 nt, Homo sapiens
uaaaaaugcaua

SEQ ID NO: 713249 - RNA, 19 nt, Homo sapiens
uaaaaauggccauuugcuu

SEQ ID NO: 713250 - RNA, 21 nt, Homo sapiens
uaaaacagguagaauuaucua

SEQ ID NO: 713251 - RNA, 17 nt, Homo sapiens
uaaaacgauuacugacu

SEQ ID NO: 713252 - RNA, 16 nt, Homo sapiens
uaaaagucacucugag

SEQ ID NO: 713253 - RNA, 21 nt, Homo sapiens
uaaaaugauuguaguaaucug

SEQ ID NO: 713254 - RNA, 19 nt, Homo sapiens
uaaaaugccaugaugccuc

SEQ ID NO: 713255 - RNA, 17 nt, Homo sapiens
uaaaccagcuacuugau

SEQ ID NO: 713256 - RNA, 10 nt, Homo sapiens
uaaagacuua

SEQ ID NO: 713257 - RNA, 19 nt, Homo sapiens
uaaaugugauuuacgcuca

SEQ ID NO: 713258 - RNA, 16 nt, Homo sapiens
uaaauguguguaaaaa

SEQ ID NO: 713259 - RNA, 20 nt, Homo sapiens
uaaauuugggggacuuacau

SEQ ID NO: 713260 - RNA, 22 nt, Homo sapiens
uaaauuugggggacuuacauga

SEQ ID NO: 713261 - RNA, 17 nt, Homo sapiens
uaacaagaccucagugc

SEQ ID NO: 713262 - RNA, 16 nt, Homo sapiens
uaacauaccuaagaag

SEQ ID NO: 713263 - RNA, 17 nt, Homo sapiens
uaacuuaugaaccuuua

SEQ ID NO: 713264 - RNA, 20 nt, Homo sapiens
uaagaagaaugcuuaaucag

SEQ ID NO: 713265 - RNA, 19 nt, Homo sapiens
uaagagccuaacuccaucc

SEQ ID NO: 713266 - RNA, 21 nt, Homo sapiens
uaagagcucaggaugagggaa

SEQ ID NO: 713267 - RNA, 22 nt, Homo sapiens
uaagcugccuguacacaacuca

SEQ ID NO: 713268 - RNA, 13 nt, Homo sapiens
uaagggccagaaa

SEQ ID NO: 713269 - RNA, 15 nt, Homo sapiens
uaagguaaaaugcca

SEQ ID NO: 713270 - RNA, 18 nt, Homo sapiens
uaaguugcaccaacuuug

SEQ ID NO: 713271 - RNA, 21 nt, Homo sapiens
uaaucuucugccuucucauga

SEQ ID NO: 713272 - RNA, 18 nt, Homo sapiens
uaaugaacagaacauaga

SEQ ID NO: 713273 - RNA, 14 nt, Homo sapiens
uaauucaaaagcac

SEQ ID NO: 713274 - RNA, 21 nt, Homo sapiens
uaauugugaauuagacuugua

SEQ ID NO: 713275 - RNA, 13 nt, Homo sapiens
uaauuucagaaga

SEQ ID NO: 713276 - RNA, 17 nt, Homo sapiens
uacaaacucccacuugu

SEQ ID NO: 713277 - RNA, 14 nt, Homo sapiens
uacacauguaucua

SEQ ID NO: 713278 - RNA, 18 nt, Homo sapiens
uacacauguaucuaugca

SEQ ID NO: 713279 - RNA, 19 nt, Homo sapiens
uacacauguaucuaugcau

SEQ ID NO: 713280 - RNA, 21 nt, Homo sapiens
uacacauguaucuaugcauuu

SEQ ID NO: 713281 - RNA, 15 nt, Homo sapiens
uacaccuaugucauu

SEQ ID NO: 713282 - RNA, 16 nt, Homo sapiens
uacaccuaugucauuu

SEQ ID NO: 713283 - RNA, 19 nt, Homo sapiens
uacaccuguugcaccucag

SEQ ID NO: 713284 - RNA, 22 nt, Homo sapiens
uacauaacugaaaaugugcuau

SEQ ID NO: 713285 - RNA, 14 nt, Homo sapiens
uacauagcuguuug

SEQ ID NO: 713286 - RNA, 14 nt, Homo sapiens
uacaugcauuacug

SEQ ID NO: 713287 - RNA, 20 nt, Homo sapiens
uacaugcauuacugcaugca

SEQ ID NO: 713288 - RNA, 13 nt, Homo sapiens
uacauuaguacac

SEQ ID NO: 713289 - RNA, 19 nt, Homo sapiens
uacauuuuaaacacauuag

SEQ ID NO: 713290 - RNA, 15 nt, Homo sapiens
uaccagaaagcaguu

SEQ ID NO: 713291 - RNA, 15 nt, Homo sapiens
cuuucccuccuuugg

SEQ ID NO: 713292 - RNA, 17 nt, Homo sapiens
cuuuccugaauccaaac

SEQ ID NO: 713293 - RNA, 14 nt, Homo sapiens
cuuucuucagcucu

SEQ ID NO: 713294 - RNA, 13 nt, Homo sapiens
cuuucuuccaaac

SEQ ID NO: 713295 - RNA, 14 nt, Homo sapiens
cuuugauaugacug

SEQ ID NO: 713296 - RNA, 16 nt, Homo sapiens
cuuuggaaauacacag

SEQ ID NO: 713297 - RNA, 19 nt, Homo sapiens
cuuuggaccuaauccaagc

SEQ ID NO: 713298 - RNA, 17 nt, Homo sapiens
cuuuguaggcauugcau

SEQ ID NO: 713299 - RNA, 16 nt, Homo sapiens
cuuuguggcacugggg

SEQ ID NO: 713300 - RNA, 19 nt, Homo sapiens
cuuuucaaaauuggacuua

SEQ ID NO: 713301 - RNA, 17 nt, Homo sapiens
cuuuuguuuaccagaga

SEQ ID NO: 713302 - RNA, 14 nt, Homo sapiens
cuuuuuuauacuca

SEQ ID NO: 713303 - RNA, 18 nt, Homo sapiens
cuuuuuuauacucaauca

SEQ ID NO: 713304 - RNA, 21 nt, Homo sapiens
cuuuuuuuuuuuuuccuuuga

SEQ ID NO: 713305 - RNA, 15 nt, Homo sapiens
gaaacaagguuuuca

SEQ ID NO: 713306 - RNA, 22 nt, Homo sapiens
gaaacauuguuaauauaauuua

SEQ ID NO: 713307 - RNA, 16 nt, Homo sapiens
gaaacucugucacucc

SEQ ID NO: 713308 - RNA, 22 nt, Homo sapiens
gaaaguaccaggugaacaaagu

SEQ ID NO: 713309 - RNA, 22 nt, Homo sapiens
gaaaguagaaauuuaccaaggu

SEQ ID NO: 713310 - RNA, 14 nt, Homo sapiens
gaaagugacuacca

SEQ ID NO: 713311 - RNA, 14 nt, Homo sapiens
gaaauauuuggaaa

SEQ ID NO: 713312 - RNA, 20 nt, Homo sapiens
gaaaucaacuugcuuaucaa

SEQ ID NO: 713313 - RNA, 16 nt, Homo sapiens
gaaccgaggcagggaa

SEQ ID NO: 713314 - RNA, 18 nt, Homo sapiens
gaaccugcccugcuccca

SEQ ID NO: 713315 - RNA, 18 nt, Homo sapiens
gaaccuggguugcagaca

SEQ ID NO: 713316 - RNA, 18 nt, Homo sapiens
gaacuccggaaugaccag

SEQ ID NO: 713317 - RNA, 17 nt, Homo sapiens
gaacugucuacccuguu

SEQ ID NO: 713318 - RNA, 17 nt, Homo sapiens
gaagaaucacaauaauu

SEQ ID NO: 713319 - RNA, 11 nt, Homo sapiens
gaaguguaauu

SEQ ID NO: 713320 - RNA, 19 nt, Homo sapiens
gaauauacuaaauuaacuu

SEQ ID NO: 713321 - RNA, 17 nt, Homo sapiens
gaauauguaaauagaaa

SEQ ID NO: 713322 - RNA, 13 nt, Homo sapiens
gaaugacacuguu

SEQ ID NO: 713323 - RNA, 13 nt, Homo sapiens
gaauuacuguaac

SEQ ID NO: 713324 - RNA, 23 nt, Homo sapiens
gaauuuccucaucccuccaucuc

SEQ ID NO: 713325 - RNA, 16 nt, Homo sapiens
gaauuugcugcuauuu

SEQ ID NO: 713326 - RNA, 17 nt, Homo sapiens
gacaaagguuuuccucu

SEQ ID NO: 713327 - RNA, 21 nt, Homo sapiens
gacaagccauuauaccaccag

SEQ ID NO: 713328 - RNA, 14 nt, Homo sapiens
gacacaaacacaca

SEQ ID NO: 713329 - RNA, 11 nt, Homo sapiens
gacacacugua

SEQ ID NO: 713330 - RNA, 20 nt, Homo sapiens
gacacauguauuuggugauu

SEQ ID NO: 713331 - RNA, 22 nt, Homo sapiens
gacagcuuguggcaagugaauu

SEQ ID NO: 713332 - RNA, 12 nt, Homo sapiens
gacagggcgggg

SEQ ID NO: 713333 - RNA, 20 nt, Homo sapiens
aggggccugcccagugcacu

SEQ ID NO: 713334 - RNA, 23 nt, Homo sapiens
aggggcuguugaauuucccacau

SEQ ID NO: 713335 - RNA, 15 nt, Homo sapiens
aggugccacuggagu

SEQ ID NO: 713336 - RNA, 17 nt, Homo sapiens
agguggguugaaagcca

SEQ ID NO: 713337 - RNA, 17 nt, Homo sapiens
agguuagcugcucccca

SEQ ID NO: 713338 - RNA, 15 nt, Homo sapiens
aguaggauccaguga

SEQ ID NO: 713339 - RNA, 23 nt, Homo sapiens
aguaguugggauuaccaguagau

SEQ ID NO: 713340 - RNA, 20 nt, Homo sapiens
aguauuauuguugcauuaaa

SEQ ID NO: 713341 - RNA, 20 nt, Homo sapiens
aguauuccagaccugaagaa

SEQ ID NO: 713342 - RNA, 17 nt, Homo sapiens
agucuggaaagugaugu

SEQ ID NO: 713343 - RNA, 13 nt, Homo sapiens
agucuggcucugu

SEQ ID NO: 713344 - RNA, 14 nt, Homo sapiens
agugcaccaaagag

SEQ ID NO: 713345 - RNA, 20 nt, Homo sapiens
agugcaguuuuuuucuuguc

SEQ ID NO: 713346 - RNA, 21 nt, Homo sapiens
agugcauuuaugagcucuuca

SEQ ID NO: 713347 - RNA, 19 nt, Homo sapiens
agugcugugcugugcuaug

SEQ ID NO: 713348 - RNA, 20 nt, Homo sapiens
aguggcguaaucucggcuca

SEQ ID NO: 713349 - RNA, 21 nt, Homo sapiens
agugggaggguaccagcagaa

SEQ ID NO: 713350 - RNA, 16 nt, Homo sapiens
agugggccuccaagga

SEQ ID NO: 713351 - RNA, 17 nt, Homo sapiens
aguguucugugacaaaa

SEQ ID NO: 713352 - RNA, 22 nt, Homo sapiens
aguucaaauucuucugaacuca

SEQ ID NO: 713353 - RNA, 23 nt, Homo sapiens
aguuuauuuguugagagugugac

SEQ ID NO: 713354 - RNA, 15 nt, Homo sapiens
aguuuuuguuucaca

SEQ ID NO: 713355 - RNA, 18 nt, Homo sapiens
auaaaaaguucagaguuc

SEQ ID NO: 713356 - RNA, 20 nt, Homo sapiens
auaaaaguacuagcuuacuu

SEQ ID NO: 713357 - RNA, 18 nt, Homo sapiens
auaaaccagcuacuugau

SEQ ID NO: 713358 - RNA, 18 nt, Homo sapiens
auaaaugugguacaagca

SEQ ID NO: 713359 - RNA, 14 nt, Homo sapiens
auaaccacuccuaa

SEQ ID NO: 713360 - RNA, 18 nt, Homo sapiens
auaacugaaaaugugcua

SEQ ID NO: 713361 - RNA, 14 nt, Homo sapiens
auaauucucugucu

SEQ ID NO: 713362 - RNA, 21 nt, Homo sapiens
auaauuuucuaccuggucucu

SEQ ID NO: 713363 - RNA, 19 nt, Homo sapiens
auacaagccacuaccuucu

SEQ ID NO: 713364 - RNA, 14 nt, Homo sapiens
auacaauuaaagcu

SEQ ID NO: 713365 - RNA, 14 nt, Homo sapiens
auacaccuauguca

SEQ ID NO: 713366 - RNA, 17 nt, Homo sapiens
auacagaauuacuguaa

SEQ ID NO: 713367 - RNA, 21 nt, Homo sapiens
auacccuccuuccaccaaguu

SEQ ID NO: 713368 - RNA, 14 nt, Homo sapiens
auacuacuguguaa

SEQ ID NO: 713369 - RNA, 15 nt, Homo sapiens
auagagugcauuuga

SEQ ID NO: 713370 - RNA, 23 nt, Homo sapiens
auagauauuccuauugugcaaug

SEQ ID NO: 713371 - RNA, 19 nt, Homo sapiens
auagcaugcaucuguuuau

SEQ ID NO: 713372 - RNA, 18 nt, Homo sapiens
auaguaagccucccuccu

SEQ ID NO: 713373 - RNA, 12 nt, Homo sapiens
auauaccaaagc

SEQ ID NO: 713374 - RNA, 20 nt, Homo sapiens
auauacuuuuacaaguaaca

SEQ ID NO: 713375 - RNA, 14 nt, Homo sapiens
auauauacuauuaa

SEQ ID NO: 713376 - RNA, 17 nt, Homo sapiens
auauccagauggcaugu

SEQ ID NO: 713377 - RNA, 23 nt, Homo sapiens
auauccagauggcauguguuuac

SEQ ID NO: 713378 - RNA, 16 nt, Homo sapiens
auauggaaauucugcu

SEQ ID NO: 713379 - RNA, 19 nt, Homo sapiens
auauuaaaagucacucuga

SEQ ID NO: 713380 - RNA, 14 nt, Homo sapiens
aucaguguuuccaa

SEQ ID NO: 713381 - RNA, 21 nt, Homo sapiens
aucccagcaugcugagauuac

SEQ ID NO: 713382 - RNA, 21 nt, Homo sapiens
auccuacccccugugccuugu

SEQ ID NO: 713383 - RNA, 23 nt, Homo sapiens
auccuacccccugugccuuguca

SEQ ID NO: 713384 - RNA, 20 nt, Homo sapiens
auccuauccuccuaccucca

SEQ ID NO: 713385 - RNA, 13 nt, Homo sapiens
auccucucucugu

SEQ ID NO: 713386 - RNA, 15 nt, Homo sapiens
aucuguccuguuaca

SEQ ID NO: 713387 - RNA, 14 nt, Homo sapiens
aucuuuuuccuccc

SEQ ID NO: 713388 - RNA, 22 nt, Homo sapiens
augaaaagauuaugaucucaga

SEQ ID NO: 713389 - RNA, 22 nt, Homo sapiens
augaaauccugcuucaguguau

SEQ ID NO: 713390 - RNA, 20 nt, Homo sapiens
augaaccugcccugcuccca

SEQ ID NO: 713391 - RNA, 20 nt, Homo sapiens
augaagcaagccccacuuau

SEQ ID NO: 713392 - RNA, 15 nt, Homo sapiens
augaauaguuuccaa

SEQ ID NO: 713393 - RNA, 16 nt, Homo sapiens
augacacucuagucaa

SEQ ID NO: 713394 - RNA, 21 nt, Homo sapiens
augacacucuagucaaagccu

SEQ ID NO: 713395 - RNA, 19 nt, Homo sapiens
augauuucaugcuaucucu

SEQ ID NO: 713396 - RNA, 21 nt, Homo sapiens
augcacacaaacaccuccuag

SEQ ID NO: 713397 - RNA, 14 nt, Homo sapiens
augcaccaugucaa

SEQ ID NO: 713398 - RNA, 19 nt, Homo sapiens
augcacuucuuacaauaau

SEQ ID NO: 713399 - RNA, 20 nt, Homo sapiens
augcacuuggcugcauaaau

SEQ ID NO: 713400 - RNA, 21 nt, Homo sapiens
augcagaaauauuugugacaa

SEQ ID NO: 713401 - RNA, 17 nt, Homo sapiens
augcaggguagcacugg

SEQ ID NO: 713402 - RNA, 15 nt, Homo sapiens
augccggugaucccu

SEQ ID NO: 713403 - RNA, 16 nt, Homo sapiens
augcuacucuaguauu

SEQ ID NO: 713404 - RNA, 22 nt, Homo sapiens
augcuggaaaauaauacugcug

SEQ ID NO: 713405 - RNA, 19 nt, Homo sapiens
augcuuagucccucaugca

SEQ ID NO: 713406 - RNA, 21 nt, Homo sapiens
auggaaauucugcucagauag

SEQ ID NO: 713407 - RNA, 19 nt, Homo sapiens
auggaaugugauguucaug

SEQ ID NO: 713408 - RNA, 23 nt, Homo sapiens
auggacaugcuucagugcugcuc

SEQ ID NO: 713409 - RNA, 16 nt, Homo sapiens
auggagucuugcucug

SEQ ID NO: 713410 - RNA, 14 nt, Homo sapiens
auggagugacuuag

SEQ ID NO: 713411 - RNA, 17 nt, Homo sapiens
auggagugcaccaaaga

SEQ ID NO: 713412 - RNA, 19 nt, Homo sapiens
auggcuuugugauucaauc

SEQ ID NO: 713413 - RNA, 23 nt, Homo sapiens
augguuauuccccccuacuugag

SEQ ID NO: 713414 - RNA, 22 nt, Homo sapiens
auguaaaauauuguuacuagag

SEQ ID NO: 713415 - RNA, 21 nt, Homo sapiens
auguaaagauauuuuuaucuu

SEQ ID NO: 713416 - RNA, 12 nt, Homo sapiens
auguaaagccau

SEQ ID NO: 713417 - RNA, 13 nt, Homo sapiens
auguaaagccaug

SEQ ID NO: 713418 - RNA, 16 nt, Homo sapiens
augucaacagaaggga

SEQ ID NO: 713419 - RNA, 17 nt, Homo sapiens
augucucuucugagcua

SEQ ID NO: 713420 - RNA, 15 nt, Homo sapiens
augugacucuuucca

SEQ ID NO: 713421 - RNA, 16 nt, Homo sapiens
auguggccuugccuag

SEQ ID NO: 713422 - RNA, 14 nt, Homo sapiens
augugguagccuca

SEQ ID NO: 713423 - RNA, 14 nt, Homo sapiens
auguguguaaaaaa

SEQ ID NO: 713424 - RNA, 16 nt, Homo sapiens
auguuaaaaagugaaa

SEQ ID NO: 713425 - RNA, 22 nt, Homo sapiens
auguuaagacuugacaguggaa

SEQ ID NO: 713426 - RNA, 18 nt, Homo sapiens
auguuacaccagccuuuc

SEQ ID NO: 713427 - RNA, 21 nt, Homo sapiens
auguuucaggagagaguugaa

SEQ ID NO: 713428 - RNA, 13 nt, Homo sapiens
auuaagacuuuaa

SEQ ID NO: 713429 - RNA, 16 nt, Homo sapiens
auuaagguguggcuuu

SEQ ID NO: 713430 - RNA, 14 nt, Homo sapiens
auuacacucuguaa

SEQ ID NO: 713431 - RNA, 16 nt, Homo sapiens
auuaccuguuaguauu

SEQ ID NO: 713432 - RNA, 17 nt, Homo sapiens
auuacuacucagccuuc

SEQ ID NO: 713433 - RNA, 16 nt, Homo sapiens
auuacugcaugcacuu

SEQ ID NO: 713434 - RNA, 16 nt, Homo sapiens
auuagaauauccauga

SEQ ID NO: 713435 - RNA, 13 nt, Homo sapiens
auuagccauuuga

SEQ ID NO: 713436 - RNA, 16 nt, Homo sapiens
auuagccauuugacua

SEQ ID NO: 713437 - RNA, 14 nt, Homo sapiens
auuaugcuaccuac

SEQ ID NO: 713438 - RNA, 12 nt, Homo sapiens
auucacaucuca

SEQ ID NO: 713439 - RNA, 16 nt, Homo sapiens
auucacuucauaaucc

SEQ ID NO: 713440 - RNA, 17 nt, Homo sapiens
auucaggcaacgcacaa

SEQ ID NO: 713441 - RNA, 15 nt, Homo sapiens
auucaugacuaugga

SEQ ID NO: 713442 - RNA, 21 nt, Homo sapiens
auucauuuuaacaucugagaa

SEQ ID NO: 713443 - RNA, 17 nt, Homo sapiens
auuccagaccugaagaa

SEQ ID NO: 713444 - RNA, 15 nt, Homo sapiens
auuccccaucucagg

SEQ ID NO: 713445 - RNA, 18 nt, Homo sapiens
auuccccccuacuugaga

SEQ ID NO: 713446 - RNA, 13 nt, Homo sapiens
auucuuaacaaga

SEQ ID NO: 713447 - RNA, 15 nt, Homo sapiens
auugaacuuaugcaa

SEQ ID NO: 713448 - RNA, 19 nt, Homo sapiens
auugaucgacuugccaaau

SEQ ID NO: 713449 - RNA, 14 nt, Homo sapiens
auuggaagagcaca

SEQ ID NO: 713450 - RNA, 16 nt, Homo sapiens
auugugaauuacaguu

SEQ ID NO: 713451 - RNA, 21 nt, Homo sapiens
auuuaaaacagacacuggcau

SEQ ID NO: 713452 - RNA, 20 nt, Homo sapiens
auuuaaauuuuuuuccuuac

SEQ ID NO: 713453 - RNA, 13 nt, Homo sapiens
auuuaguuucaua

SEQ ID NO: 713454 - RNA, 15 nt, Homo sapiens
auuucuagguaggaa

SEQ ID NO: 713455 - RNA, 16 nt, Homo sapiens
auuucuauagccaaaa

SEQ ID NO: 713456 - RNA, 21 nt, Homo sapiens
auuucuuuuuuaaaugaagaa

SEQ ID NO: 713457 - RNA, 12 nt, Homo sapiens
auuugcugaaua

SEQ ID NO: 713458 - RNA, 15 nt, Homo sapiens
auuuuaaccaguuau

SEQ ID NO: 713459 - RNA, 23 nt, Homo sapiens
auuuuacaauuuuuuaucaugca

SEQ ID NO: 713460 - RNA, 17 nt, Homo sapiens
auuuuagugaacuugaa

SEQ ID NO: 713461 - RNA, 13 nt, Homo sapiens
auuuucacuuuug

SEQ ID NO: 713462 - RNA, 19 nt, Homo sapiens
auuuucuggaauacaugaa

SEQ ID NO: 713463 - RNA, 22 nt, Homo sapiens
uaaucagguccucagagaauuu

SEQ ID NO: 713464 - RNA, 21 nt, Homo sapiens
uaaucccagcaugcugagauu

SEQ ID NO: 713465 - RNA, 14 nt, Homo sapiens
uaaugaaacaaaga

SEQ ID NO: 713466 - RNA, 22 nt, Homo sapiens
uaauggaauauguaaauagaaa

SEQ ID NO: 713467 - RNA, 16 nt, Homo sapiens
uaauuaccaaccuguu

SEQ ID NO: 713468 - RNA, 18 nt, Homo sapiens
uaauuaccaaccuguuac

SEQ ID NO: 713469 - RNA, 15 nt, Homo sapiens
uaauucaaacuaaua

SEQ ID NO: 713470 - RNA, 15 nt, Homo sapiens
uaauucuaugagaua

SEQ ID NO: 713471 - RNA, 23 nt, Homo sapiens
uaauuggcaugaaggugucauac

SEQ ID NO: 713472 - RNA, 18 nt, Homo sapiens
uaauuguacuaaagccaa

SEQ ID NO: 713473 - RNA, 10 nt, Homo sapiens
uaauugugaa

SEQ ID NO: 713474 - RNA, 15 nt, Homo sapiens
uaauuuaguuucaua

SEQ ID NO: 713475 - RNA, 18 nt, Homo sapiens
uaauuuuaaguaauuuca

SEQ ID NO: 713476 - RNA, 19 nt, Homo sapiens
uacaauaauucuaugagau

SEQ ID NO: 713477 - RNA, 18 nt, Homo sapiens
uacaauuuuuuaucaugc

SEQ ID NO: 713478 - RNA, 20 nt, Homo sapiens
uacaauuuuuuaucaugcau

SEQ ID NO: 713479 - RNA, 20 nt, Homo sapiens
uacacauguaucuaugcauu

SEQ ID NO: 713480 - RNA, 18 nt, Homo sapiens
uacaccuaugucauuuca

SEQ ID NO: 713481 - RNA, 16 nt, Homo sapiens
uacagcaacaauuuau

SEQ ID NO: 713482 - RNA, 16 nt, Homo sapiens
uacauacagaauuacu

SEQ ID NO: 713483 - RNA, 14 nt, Homo sapiens
uacauauguaaaau

SEQ ID NO: 713484 - RNA, 17 nt, Homo sapiens
uacaugcauuacugcau

SEQ ID NO: 713485 - RNA, 23 nt, Homo sapiens
uacaugcauuacugcaugcacuu

SEQ ID NO: 713486 - RNA, 21 nt, Homo sapiens
uacauuccaacucguauagca

SEQ ID NO: 713487 - RNA, 16 nt, Homo sapiens
uacauuguuaccucua

SEQ ID NO: 713488 - RNA, 15 nt, Homo sapiens
uaccaagcugugacc

SEQ ID NO: 713489 - RNA, 13 nt, Homo sapiens
uaccaagugacca

SEQ ID NO: 713490 - RNA, 21 nt, Homo sapiens
uaccaccagacugcaaugcca

SEQ ID NO: 713491 - RNA, 15 nt, Homo sapiens
uacccucccuuugaa

SEQ ID NO: 713492 - RNA, 12 nt, Homo sapiens
uaccucacuuua

SEQ ID NO: 713493 - RNA, 19 nt, Homo sapiens
uaccucuauauaccaaagc

SEQ ID NO: 713494 - RNA, 16 nt, Homo sapiens
uaccuguuaguauuau

SEQ ID NO: 713495 - RNA, 23 nt, Homo sapiens
uaccuguuaguauuauuguugca

SEQ ID NO: 713496 - RNA, 23 nt, Homo sapiens
uacgcgccauuagggcuuuuugc

SEQ ID NO: 713497 - RNA, 21 nt, Homo sapiens
uacgcucauuguagaaaagcu

SEQ ID NO: 713498 - RNA, 13 nt, Homo sapiens
uacuaaagccaaa

SEQ ID NO: 713499 - RNA, 17 nt, Homo sapiens
uacuagagcaagcagga

SEQ ID NO: 713500 - RNA, 23 nt, Homo sapiens
uacucagauaagguaaaaugcca

SEQ ID NO: 713501 - RNA, 19 nt, Homo sapiens
uacugauaaccacuccuaa

SEQ ID NO: 713502 - RNA, 14 nt, Homo sapiens
uacugcaugcacuu

SEQ ID NO: 713503 - RNA, 16 nt, Homo sapiens
uacuuacaugcauuac

SEQ ID NO: 713504 - RNA, 21 nt, Homo sapiens
uacuuuauguuacuacaugca

SEQ ID NO: 713505 - RNA, 20 nt, Homo sapiens
uacuuucucuagggagaaaa

SEQ ID NO: 713506 - RNA, 20 nt, Homo sapiens
uagaaaaguuauguagaaaa

SEQ ID NO: 713507 - RNA, 11 nt, Homo sapiens
uagaaaugcca

SEQ ID NO: 713508 - RNA, 15 nt, Homo sapiens
uagaauuaauggaau

SEQ ID NO: 713509 - RNA, 20 nt, Homo sapiens
uagaauugugguucccuaaa

SEQ ID NO: 713510 - RNA, 14 nt, Homo sapiens
uagacaagccagaa

SEQ ID NO: 713511 - RNA, 14 nt, Homo sapiens
uagagcacugccac

SEQ ID NO: 713512 - RNA, 20 nt, Homo sapiens
uagauuugugugcaucaggc

SEQ ID NO: 713513 - RNA, 13 nt, Homo sapiens
uagcacugggaac

SEQ ID NO: 713514 - RNA, 17 nt, Homo sapiens
uaguaagccucccuccu

SEQ ID NO: 713515 - RNA, 20 nt, Homo sapiens
uaguauaauaauuacugguu

SEQ ID NO: 713516 - RNA, 13 nt, Homo sapiens
uagugaacuugaa

SEQ ID NO: 713517 - RNA, 21 nt, Homo sapiens
uauaaccagacacauacucau

SEQ ID NO: 713518 - RNA, 22 nt, Homo sapiens
uauaggaucauuuguuggaaug

SEQ ID NO: 713519 - RNA, 13 nt, Homo sapiens
uauauaccaaagc

SEQ ID NO: 713520 - RNA, 20 nt, Homo sapiens
uauauccagauggcaugugu

SEQ ID NO: 713521 - RNA, 15 nt, Homo sapiens
uaucaaauaacucaa

SEQ ID NO: 713522 - RNA, 15 nt, Homo sapiens
uaucacaucacacaa

SEQ ID NO: 713523 - RNA, 17 nt, Homo sapiens
uaucugugauuagccau

SEQ ID NO: 713524 - RNA, 15 nt, Homo sapiens
uaucuuaguugguau

SEQ ID NO: 713525 - RNA, 22 nt, Homo sapiens
uaugcaggguagcacugggaac

SEQ ID NO: 713526 - RNA, 18 nt, Homo sapiens
uauggagugcaccaaaga

SEQ ID NO: 713527 - RNA, 19 nt, Homo sapiens
uauggcuuuuagcauuuau

SEQ ID NO: 713528 - RNA, 16 nt, Homo sapiens
uauguaccaagaaucu

SEQ ID NO: 713529 - RNA, 21 nt, Homo sapiens
uauguccuaauaauaucccac

SEQ ID NO: 713530 - RNA, 16 nt, Homo sapiens
uauuaacaauuaggca

SEQ ID NO: 713531 - RNA, 14 nt, Homo sapiens
uauuauuccucaaa

SEQ ID NO: 713532 - RNA, 22 nt, Homo sapiens
uauuccauggcuaacuggcgag

SEQ ID NO: 713533 - RNA, 22 nt, Homo sapiens
uauuuuuuaugaaacauuacag

SEQ ID NO: 713534 - RNA, 17 nt, Homo sapiens
ucaaaacaaucuuguca

SEQ ID NO: 713535 - RNA, 20 nt, Homo sapiens
ucaaacaaauagucuaucaa

SEQ ID NO: 713536 - RNA, 19 nt, Homo sapiens
ucaaagagggagugcauuu

SEQ ID NO: 713537 - RNA, 16 nt, Homo sapiens
ucaaagccuugguaaa

SEQ ID NO: 713538 - RNA, 22 nt, Homo sapiens
ucaacagaagggauaccgucuc

SEQ ID NO: 713539 - RNA, 17 nt, Homo sapiens
ucaaccccagacacugg

SEQ ID NO: 713540 - RNA, 21 nt, Homo sapiens
ucaaccccuccccuccauccc

SEQ ID NO: 713541 - RNA, 11 nt, Homo sapiens
ucaacugccua

SEQ ID NO: 713542 - RNA, 17 nt, Homo sapiens
ucaacuuauuaacaauu

SEQ ID NO: 713543 - RNA, 18 nt, Homo sapiens
ucaacuuuuccuuugaau

SEQ ID NO: 713544 - RNA, 22 nt, Homo sapiens
ucaagcgauucucuugccucaa

SEQ ID NO: 713545 - RNA, 19 nt, Homo sapiens
ucaagggcuuuauuacaga

SEQ ID NO: 713546 - RNA, 17 nt, Homo sapiens
ucaagugcugugcaagg

SEQ ID NO: 713547 - RNA, 18 nt, Homo sapiens
ucacauuuuccuuuucaa

SEQ ID NO: 713548 - RNA, 15 nt, Homo sapiens
ucaccagauuugcua

SEQ ID NO: 713549 - RNA, 22 nt, Homo sapiens
ucacuaauucauuaaucugccu

SEQ ID NO: 713550 - RNA, 19 nt, Homo sapiens
ucacucuucaaaugccuga

SEQ ID NO: 713551 - RNA, 17 nt, Homo sapiens
ucacuggaccacugggc

SEQ ID NO: 713552 - RNA, 18 nt, Homo sapiens
ucacuguuggauguuaca

SEQ ID NO: 713553 - RNA, 17 nt, Homo sapiens
ucacuuuuaaugaacaa

SEQ ID NO: 713554 - RNA, 23 nt, Homo sapiens
ucacuuuuuuucuuuucucugcc

SEQ ID NO: 713555 - RNA, 16 nt, Homo sapiens
ucagaagaaauucugc

SEQ ID NO: 713556 - RNA, 13 nt, Homo sapiens
ucagagacauaca

SEQ ID NO: 713557 - RNA, 14 nt, Homo sapiens
ucagagaccuucca

SEQ ID NO: 713558 - RNA, 15 nt, Homo sapiens
ucagauagaaugaca

SEQ ID NO: 713559 - RNA, 16 nt, Homo sapiens
ucagauagaaugacag

SEQ ID NO: 713560 - RNA, 14 nt, Homo sapiens
ucagauccuccuca

SEQ ID NO: 713561 - RNA, 15 nt, Homo sapiens
ucagcuguaccaagc

SEQ ID NO: 713562 - RNA, 15 nt, Homo sapiens
ucaggacugccauug

SEQ ID NO: 713563 - RNA, 13 nt, Homo sapiens
ucaggauaccaua

SEQ ID NO: 713564 - RNA, 13 nt, Homo sapiens
ucaguaguuuuac

SEQ ID NO: 713565 - RNA, 22 nt, Homo sapiens
ucaguguagaaccuaauucaau

SEQ ID NO: 713566 - RNA, 23 nt, Homo sapiens
ucauaaagucuuugaagugacuu

SEQ ID NO: 713567 - RNA, 19 nt, Homo sapiens
ucauaacuugagaccuaau

SEQ ID NO: 713568 - RNA, 20 nt, Homo sapiens
ucauacuugaaaauaugaca

SEQ ID NO: 713569 - RNA, 19 nt, Homo sapiens
ucaugcauguccuguaaag

SEQ ID NO: 713570 - RNA, 17 nt, Homo sapiens
ucaugugacucuuucca

SEQ ID NO: 713571 - RNA, 20 nt, Homo sapiens
uccaaggaggggcuguaaaa

SEQ ID NO: 713572 - RNA, 23 nt, Homo sapiens
uccacucaugugacucuuuccaa

SEQ ID NO: 713573 - RNA, 15 nt, Homo sapiens
uccacuucaccaucc

SEQ ID NO: 713574 - RNA, 22 nt, Homo sapiens
uccagccaccacccacaaucac

SEQ ID NO: 713575 - RNA, 12 nt, Homo sapiens
uccagcuacaaa

SEQ ID NO: 713576 - RNA, 21 nt, Homo sapiens
uccaggguauggccauggagu

SEQ ID NO: 713577 - RNA, 22 nt, Homo sapiens
uccaggguuaaccacuguggug

SEQ ID NO: 713578 - RNA, 15 nt, Homo sapiens
uccaguucaugagaa

SEQ ID NO: 713579 - RNA, 11 nt, Homo sapiens
uccaguuugca

SEQ ID NO: 713580 - RNA, 15 nt, Homo sapiens
uccaguuugcaauua

SEQ ID NO: 713581 - RNA, 18 nt, Homo sapiens
uccaucagccuccauccu

SEQ ID NO: 713582 - RNA, 13 nt, Homo sapiens
ucccagaaccaca

SEQ ID NO: 713583 - RNA, 14 nt, Homo sapiens
ucccagaaccacac

SEQ ID NO: 713584 - RNA, 15 nt, Homo sapiens
ucccaggaacugggc

SEQ ID NO: 713585 - RNA, 12 nt, Homo sapiens
uccccaucucag

SEQ ID NO: 713586 - RNA, 19 nt, Homo sapiens
uccccuucuucuccaucuc

SEQ ID NO: 713587 - RNA, 22 nt, Homo sapiens
ucccucaaaacaaucuugucau

SEQ ID NO: 713588 - RNA, 18 nt, Homo sapiens
ucccucucguaagauuuc

SEQ ID NO: 713589 - RNA, 12 nt, Homo sapiens
ucccuggaugac

SEQ ID NO: 713590 - RNA, 14 nt, Homo sapiens
ucccuggaugacau

SEQ ID NO: 713591 - RNA, 21 nt, Homo sapiens
uccuaauaauaucccacuggg

SEQ ID NO: 713592 - RNA, 19 nt, Homo sapiens
uccuaauauuuugauucau

SEQ ID NO: 713593 - RNA, 21 nt, Homo sapiens
gcuguuuugauuuguacugaa

SEQ ID NO: 713594 - RNA, 17 nt, Homo sapiens
gcuuaaaaaugccaaaa

SEQ ID NO: 713595 - RNA, 18 nt, Homo sapiens
gcuucagguccaggcugu

SEQ ID NO: 713596 - RNA, 13 nt, Homo sapiens
gcuucagugcugc

SEQ ID NO: 713597 - RNA, 22 nt, Homo sapiens
ggaaaauaauacugcugagaua

SEQ ID NO: 713598 - RNA, 19 nt, Homo sapiens
ggaaaguagaaauuuacca

SEQ ID NO: 713599 - RNA, 21 nt, Homo sapiens
ggaacacuagacaagccagaa

SEQ ID NO: 713600 - RNA, 23 nt, Homo sapiens
ggaacugggccaacucaccugag

SEQ ID NO: 713601 - RNA, 19 nt, Homo sapiens
ggaacugucucucaugaac

SEQ ID NO: 713602 - RNA, 17 nt, Homo sapiens
ggacaggauguguuugc

SEQ ID NO: 713603 - RNA, 16 nt, Homo sapiens
ggacuaugaaaagcua

SEQ ID NO: 713604 - RNA, 18 nt, Homo sapiens
ggacuuuuauugugaauu

SEQ ID NO: 713605 - RNA, 17 nt, Homo sapiens
ggagacaaaacuagaga

SEQ ID NO: 713606 - RNA, 15 nt, Homo sapiens
ggagcaaaccaaaga

SEQ ID NO: 713607 - RNA, 14 nt, Homo sapiens
ggagucuugcucug

SEQ ID NO: 713608 - RNA, 20 nt, Homo sapiens
ggauccuauccuccuaccuc

SEQ ID NO: 713609 - RNA, 22 nt, Homo sapiens
ggaucucaccaggcagccucug

SEQ ID NO: 713610 - RNA, 11 nt, Homo sapiens
ggaugacauua

SEQ ID NO: 713611 - RNA, 20 nt, Homo sapiens
ggcagacucuuuaugcuugc

SEQ ID NO: 713612 - RNA, 18 nt, Homo sapiens
ggcagcauccccuugaac

SEQ ID NO: 713613 - RNA, 10 nt, Homo sapiens
ggccaaagaa

SEQ ID NO: 713614 - RNA, 23 nt, Homo sapiens
ggccaggaggugccacuggagug

SEQ ID NO: 713615 - RNA, 15 nt, Homo sapiens
ggccuccugugacug

SEQ ID NO: 713616 - RNA, 18 nt, Homo sapiens
ggccucuucugcuuucuc

SEQ ID NO: 713617 - RNA, 18 nt, Homo sapiens
ggccuucuuuuggacaaa

SEQ ID NO: 713618 - RNA, 22 nt, Homo sapiens
ggcgcgaucucggcucacugca

SEQ ID NO: 713619 - RNA, 12 nt, Homo sapiens
ggcuagucauaa

SEQ ID NO: 713620 - RNA, 15 nt, Homo sapiens
ggcucaacauugugu

SEQ ID NO: 713621 - RNA, 21 nt, Homo sapiens
ggcucaccuugugcuggggac

SEQ ID NO: 713622 - RNA, 16 nt, Homo sapiens
ggcuccgugugggaga

SEQ ID NO: 713623 - RNA, 15 nt, Homo sapiens
ggcuguacacugcac

SEQ ID NO: 713624 - RNA, 15 nt, Homo sapiens
ggcuuccuucauuuc

SEQ ID NO: 713625 - RNA, 23 nt, Homo sapiens
gggaaaagaaaaagauugagaga

SEQ ID NO: 713626 - RNA, 17 nt, Homo sapiens
gggaccccccuugccca

SEQ ID NO: 713627 - RNA, 14 nt, Homo sapiens
gggacuuacaugau

SEQ ID NO: 713628 - RNA, 22 nt, Homo sapiens
gggaggaucguuugagcccagg

SEQ ID NO: 713629 - RNA, 15 nt, Homo sapiens
gggaguuuagggugg

SEQ ID NO: 713630 - RNA, 20 nt, Homo sapiens
gggauaccgucuccuugaag

SEQ ID NO: 713631 - RNA, 18 nt, Homo sapiens
ggggaagagagccugcag

SEQ ID NO: 713632 - RNA, 17 nt, Homo sapiens
gguaauuucuacuuuga

SEQ ID NO: 713633 - RNA, 20 nt, Homo sapiens
gguagaaaaggcuagguaca

SEQ ID NO: 713634 - RNA, 16 nt, Homo sapiens
gguaugaguugcccau

SEQ ID NO: 713635 - RNA, 18 nt, Homo sapiens
gguauugccuugugaauu

SEQ ID NO: 713636 - RNA, 9 nt, Homo sapiens
gguccaaaa

SEQ ID NO: 713637 - RNA, 16 nt, Homo sapiens
ggucucuaccacugcu

SEQ ID NO: 713638 - RNA, 12 nt, Homo sapiens
ggugcuucagga

SEQ ID NO: 713639 - RNA, 22 nt, Homo sapiens
gguuucccuacugaagcccuug

SEQ ID NO: 713640 - RNA, 16 nt, Homo sapiens
guaaaaaggccuccug

SEQ ID NO: 713641 - RNA, 22 nt, Homo sapiens
guaaaauaaucaguguuuccaa

SEQ ID NO: 713642 - RNA, 13 nt, Homo sapiens
guaaagaauuauu

SEQ ID NO: 713643 - RNA, 22 nt, Homo sapiens
guaacuguuuugguuuugcuca

SEQ ID NO: 713644 - RNA, 20 nt, Homo sapiens
guaagaaaccuacugcccag

SEQ ID NO: 713645 - RNA, 18 nt, Homo sapiens
guaaguuuaugcauacag

SEQ ID NO: 713646 - RNA, 18 nt, Homo sapiens
guaaucccagcacuuugg

SEQ ID NO: 713647 - RNA, 15 nt, Homo sapiens
guaaucucggcucac

SEQ ID NO: 713648 - RNA, 22 nt, Homo sapiens
guaauuuugaguacagaauuca

SEQ ID NO: 713649 - RNA, 18 nt, Homo sapiens
guaccagaugcagcucaa

SEQ ID NO: 713650 - RNA, 12 nt, Homo sapiens
guacuaaagcca

SEQ ID NO: 713651 - RNA, 20 nt, Homo sapiens
guacuauuauccccauuucu

SEQ ID NO: 713652 - RNA, 21 nt, Homo sapiens
guagagagagaaaaguaacug

SEQ ID NO: 713653 - RNA, 21 nt, Homo sapiens
guagucacuuuggagcuuuag

SEQ ID NO: 713654 - RNA, 14 nt, Homo sapiens
guagugucacucaa

SEQ ID NO: 713655 - RNA, 21 nt, Homo sapiens
guauaguuaaccacuaccgaa

SEQ ID NO: 713656 - RNA, 14 nt, Homo sapiens
guaucuaugcauuu

SEQ ID NO: 713657 - RNA, 17 nt, Homo sapiens
gucaaagccuugguaaa

SEQ ID NO: 713658 - RNA, 22 nt, Homo sapiens
guccgacucuucugagcaccua

SEQ ID NO: 713659 - RNA, 13 nt, Homo sapiens
gucuauuagcucc

SEQ ID NO: 713660 - RNA, 16 nt, Homo sapiens
gucucuguacaugugu

SEQ ID NO: 713661 - RNA, 22 nt, Homo sapiens
gucuuaauauauauauccagau

SEQ ID NO: 713662 - RNA, 18 nt, Homo sapiens
gucuuccugacacuuuaa

SEQ ID NO: 713663 - RNA, 19 nt, Homo sapiens
gucuuccugacacuuuaau

SEQ ID NO: 713664 - RNA, 18 nt, Homo sapiens
gugaaauauaugcuauau

SEQ ID NO: 713665 - RNA, 21 nt, Homo sapiens
gugaacaaaguuuaccagaaa

SEQ ID NO: 713666 - RNA, 14 nt, Homo sapiens
gugaacguguucaa

SEQ ID NO: 713667 - RNA, 16 nt, Homo sapiens
gugaauuugcugcuau

SEQ ID NO: 713668 - RNA, 14 nt, Homo sapiens
gugaccagugcugc

SEQ ID NO: 713669 - RNA, 18 nt, Homo sapiens
gugauuagccauuugacu

SEQ ID NO: 713670 - RNA, 15 nt, Homo sapiens
gugauuuacgcucau

SEQ ID NO: 713671 - RNA, 23 nt, Homo sapiens
gugcaaggaccuaaaacaucuca

SEQ ID NO: 713672 - RNA, 15 nt, Homo sapiens
gugcagcaaccagag

SEQ ID NO: 713673 - RNA, 16 nt, Homo sapiens
gugcauuuaugagcuc

SEQ ID NO: 713674 - RNA, 17 nt, Homo sapiens
gugcauuuaugagcucu

SEQ ID NO: 713675 - RNA, 18 nt, Homo sapiens
gugcauuuaugagcucuu

SEQ ID NO: 713676 - RNA, 22 nt, Homo sapiens
gugccuugucacgccagacuuc

SEQ ID NO: 713677 - RNA, 18 nt, Homo sapiens
gugcuaaacgcacacagu

SEQ ID NO: 713678 - RNA, 16 nt, Homo sapiens
gugcugugcugugcua

SEQ ID NO: 713679 - RNA, 16 nt, Homo sapiens
guggcucaacauugug

SEQ ID NO: 713680 - RNA, 15 nt, Homo sapiens
gugugcgucacugug

SEQ ID NO: 713681 - RNA, 23 nt, Homo sapiens
guguuacccaguaacucaucugu

SEQ ID NO: 713682 - RNA, 21 nt, Homo sapiens
guuaauauaauuuaacagaag

SEQ ID NO: 713683 - RNA, 14 nt, Homo sapiens
guuacuacaugcac

SEQ ID NO: 713684 - RNA, 11 nt, Homo sapiens
guucagaguuc

SEQ ID NO: 713685 - RNA, 15 nt, Homo sapiens
guuccgagaagaaca

SEQ ID NO: 713686 - RNA, 14 nt, Homo sapiens
guucugauaaugaa

SEQ ID NO: 713687 - RNA, 23 nt, Homo sapiens
guugaauuucccacauacccucc

SEQ ID NO: 713688 - RNA, 14 nt, Homo sapiens
guuggaaucacugu

SEQ ID NO: 713689 - RNA, 13 nt, Homo sapiens
guuuacagaauuu

SEQ ID NO: 713690 - RNA, 18 nt, Homo sapiens
guuucacagccuauaacc

SEQ ID NO: 713691 - RNA, 19 nt, Homo sapiens
guuucaccauguuagccag

SEQ ID NO: 713692 - RNA, 20 nt, Homo sapiens
guuucccuuagagauuuugu

SEQ ID NO: 713693 - RNA, 13 nt, Homo sapiens
guuuuacuuuuaa

SEQ ID NO: 713694 - RNA, 13 nt, Homo sapiens
uaaaaacugagug

SEQ ID NO: 713695 - RNA, 20 nt, Homo sapiens
uaaaaagguuuacagaauuu

SEQ ID NO: 713696 - RNA, 18 nt, Homo sapiens
uaaaaauggccauuugcu

SEQ ID NO: 713697 - RNA, 13 nt, Homo sapiens
uaaaacaucucau

SEQ ID NO: 713698 - RNA, 12 nt, Homo sapiens
uaaaacuaucca

SEQ ID NO: 713699 - RNA, 21 nt, Homo sapiens
uaaaauaaagaaauagaacaa

SEQ ID NO: 713700 - RNA, 14 nt, Homo sapiens
uaaacaaauaacaa

SEQ ID NO: 713701 - RNA, 11 nt, Homo sapiens
uaaacugugua

SEQ ID NO: 713702 - RNA, 14 nt, Homo sapiens
uaaaguacugggau

SEQ ID NO: 713703 - RNA, 19 nt, Homo sapiens
uaaaguuguuugugccuuu

SEQ ID NO: 713704 - RNA, 22 nt, Homo sapiens
uaaaugugguacaagcauucug

SEQ ID NO: 713705 - RNA, 23 nt, Homo sapiens
uaaauuugggggacuuacaugau

SEQ ID NO: 713706 - RNA, 23 nt, Homo sapiens
uaacaagaccucagugccuuccu

SEQ ID NO: 713707 - RNA, 13 nt, Homo sapiens
uaacagauguuga

SEQ ID NO: 713708 - RNA, 19 nt, Homo sapiens
uaaccagacacauacucau

SEQ ID NO: 713709 - RNA, 16 nt, Homo sapiens
uaacucaucugucacc

SEQ ID NO: 713710 - RNA, 13 nt, Homo sapiens
uaacugccuaaaa

SEQ ID NO: 713711 - RNA, 15 nt, Homo sapiens
uaacugucaagucau

SEQ ID NO: 713712 - RNA, 19 nt, Homo sapiens
uaacuuuuuaaaacacaac

SEQ ID NO: 713713 - RNA, 13 nt, Homo sapiens
uaagacuacugaa

SEQ ID NO: 713714 - RNA, 12 nt, Homo sapiens
uaagacugugua

SEQ ID NO: 713715 - RNA, 14 nt, Homo sapiens
uaagagcucaggau

SEQ ID NO: 713716 - RNA, 16 nt, Homo sapiens
uaagcuaggaaugaaa

SEQ ID NO: 713717 - RNA, 16 nt, Homo sapiens
uaagguguagccacac

SEQ ID NO: 713718 - RNA, 20 nt, Homo sapiens
uaaguugcaccaacuuugaa

SEQ ID NO: 713719 - RNA, 14 nt, Homo sapiens
uaauacucaccucc

SEQ ID NO: 713720 - RNA, 16 nt, Homo sapiens
uaauauauauuaucuu

SEQ ID NO: 713721 - RNA, 21 nt, Homo sapiens
uaauauccuaaacaucauuca

SEQ ID NO: 713722 - RNA, 14 nt, Homo sapiens
uaauauugauuuau

SEQ ID NO: 713723 - RNA, 13 nt, Homo sapiens
uuguuucuacuuu

SEQ ID NO: 713724 - RNA, 15 nt, Homo sapiens
uuuaaaaaacuaaaa

SEQ ID NO: 713725 - RNA, 14 nt, Homo sapiens
uuuaaaacuaucca

SEQ ID NO: 713726 - RNA, 14 nt, Homo sapiens
uuuaaacaguuuag

SEQ ID NO: 713727 - RNA, 18 nt, Homo sapiens
uuuaaacuauaagcaaga

SEQ ID NO: 713728 - RNA, 14 nt, Homo sapiens
uuuaaccuaugaua

SEQ ID NO: 713729 - RNA, 14 nt, Homo sapiens
uuuaauugugaauu

SEQ ID NO: 713730 - RNA, 19 nt, Homo sapiens
uuuaauugugaauuagacu

SEQ ID NO: 713731 - RNA, 20 nt, Homo sapiens
uuuacacauguaucuaugca

SEQ ID NO: 713732 - RNA, 12 nt, Homo sapiens
uuuacuaccugg

SEQ ID NO: 713733 - RNA, 16 nt, Homo sapiens
uuuacuagaaaggcau

SEQ ID NO: 713734 - RNA, 19 nt, Homo sapiens
uuuagccccugaaagccau

SEQ ID NO: 713735 - RNA, 12 nt, Homo sapiens
uuuaucugugau

SEQ ID NO: 713736 - RNA, 20 nt, Homo sapiens
uuuauuggcugagauaugaa

SEQ ID NO: 713737 - RNA, 21 nt, Homo sapiens
uuuauugugaauuacaguuga

SEQ ID NO: 713738 - RNA, 19 nt, Homo sapiens
uuuauuuuauagagcagaa

SEQ ID NO: 713739 - RNA, 14 nt, Homo sapiens
uuucacauaugugu

SEQ ID NO: 713740 - RNA, 13 nt, Homo sapiens
uuucaccuguaaa

SEQ ID NO: 713741 - RNA, 20 nt, Homo sapiens
uuucacuuuuggcuuguaaa

SEQ ID NO: 713742 - RNA, 17 nt, Homo sapiens
uuuccaaauuauggcaa

SEQ ID NO: 713743 - RNA, 22 nt, Homo sapiens
uuuccccaaguacaaccacacc

SEQ ID NO: 713744 - RNA, 15 nt, Homo sapiens
uuuccccagugacac

SEQ ID NO: 713745 - RNA, 18 nt, Homo sapiens
uuuccguaaaaaugauuu

SEQ ID NO: 713746 - RNA, 19 nt, Homo sapiens
uuuccucccuuucccugag

SEQ ID NO: 713747 - RNA, 18 nt, Homo sapiens
uuuccuuugguccuucaa

SEQ ID NO: 713748 - RNA, 21 nt, Homo sapiens
uuucuacaccuguugcaccuc

SEQ ID NO: 713749 - RNA, 15 nt, Homo sapiens
uuucuagagcacugc

SEQ ID NO: 713750 - RNA, 17 nt, Homo sapiens
uuucugacucugagcua

SEQ ID NO: 713751 - RNA, 19 nt, Homo sapiens
uuugaaacaauuaugugaa

SEQ ID NO: 713752 - RNA, 22 nt, Homo sapiens
uuugcucuuagcugucugcuca

SEQ ID NO: 713753 - RNA, 21 nt, Homo sapiens
uuugcuguaaacuuguagcau

SEQ ID NO: 713754 - RNA, 16 nt, Homo sapiens
uuugcuguugcauugu

SEQ ID NO: 713755 - RNA, 16 nt, Homo sapiens
uuugugaugcaaauaa

SEQ ID NO: 713756 - RNA, 14 nt, Homo sapiens
uuugugugcgucac

SEQ ID NO: 713757 - RNA, 18 nt, Homo sapiens
uuuuaaaagugccauuaa

SEQ ID NO: 713758 - RNA, 16 nt, Homo sapiens
uuuugaugauugcuau

SEQ ID NO: 713759 - RNA, 16 nt, Homo sapiens
uuuugucuuugcugua

SEQ ID NO: 713760 - RNA, 13 nt, Homo sapiens
uuuuuaauuguga

SEQ ID NO: 713761 - RNA, 21 nt, Homo sapiens
uuuuuuaggaagcaagcuuaa

SEQ ID NO: 713762 - RNA, 22 nt, Homo sapiens
uaaaaacucuuauaaauuucua

SEQ ID NO: 713763 - RNA, 12 nt, Homo sapiens
uaaaaaguucag

SEQ ID NO: 713764 - RNA, 14 nt, Homo sapiens
uaaaaaugccaaaa

SEQ ID NO: 713765 - RNA, 15 nt, Homo sapiens
uaaaacaucucauca

SEQ ID NO: 713766 - RNA, 20 nt, Homo sapiens
uaaaacauguuugcacuugu

SEQ ID NO: 713767 - RNA, 21 nt, Homo sapiens
uaaaacauguuugcacuuguc

SEQ ID NO: 713768 - RNA, 18 nt, Homo sapiens
uaaaauagagugcauuug

SEQ ID NO: 713769 - RNA, 14 nt, Homo sapiens
uaaaaucuaauuca

SEQ ID NO: 713770 - RNA, 17 nt, Homo sapiens
uaaacaaauaacaaugu

SEQ ID NO: 713771 - RNA, 17 nt, Homo sapiens
uaaacuaucuuggugaa

SEQ ID NO: 713772 - RNA, 11 nt, Homo sapiens
uaaacuuguag

SEQ ID NO: 713773 - RNA, 16 nt, Homo sapiens
uaaagccaaacauaua

SEQ ID NO: 713774 - RNA, 14 nt, Homo sapiens
uaaaguacagacuu

SEQ ID NO: 713775 - RNA, 19 nt, Homo sapiens
uccacagaauacaagccac

SEQ ID NO: 713776 - RNA, 20 nt, Homo sapiens
uccagaaaacaaaacugcau

SEQ ID NO: 713777 - RNA, 18 nt, Homo sapiens
uccagaaauacuacugug

SEQ ID NO: 713778 - RNA, 19 nt, Homo sapiens
uccagaaauacuacugugu

SEQ ID NO: 713779 - RNA, 13 nt, Homo sapiens
uccagccaccacc

SEQ ID NO: 713780 - RNA, 22 nt, Homo sapiens
uccaggcaggucugaagcucaa

SEQ ID NO: 713781 - RNA, 17 nt, Homo sapiens
uccaguauccacuuugc

SEQ ID NO: 713782 - RNA, 20 nt, Homo sapiens
uccauggcaggaaggcuugu

SEQ ID NO: 713783 - RNA, 16 nt, Homo sapiens
uccaugggaccacaac

SEQ ID NO: 713784 - RNA, 18 nt, Homo sapiens
uccaugggaccacaacua

SEQ ID NO: 713785 - RNA, 19 nt, Homo sapiens
ucccacaggcaccagcaaa

SEQ ID NO: 713786 - RNA, 18 nt, Homo sapiens
ucccagcaugcugagauu

SEQ ID NO: 713787 - RNA, 20 nt, Homo sapiens
ucccaggcuggagugcagug

SEQ ID NO: 713788 - RNA, 23 nt, Homo sapiens
ucccaugacauggagaccgugac

SEQ ID NO: 713789 - RNA, 10 nt, Homo sapiens
ucccaugagc

SEQ ID NO: 713790 - RNA, 15 nt, Homo sapiens
ucccuggaugacauu

SEQ ID NO: 713791 - RNA, 18 nt, Homo sapiens
ucccuggaugacauuaaa

SEQ ID NO: 713792 - RNA, 23 nt, Homo sapiens
ucccuggcccccucccuggauga

SEQ ID NO: 713793 - RNA, 14 nt, Homo sapiens
uccgucaccucaga

SEQ ID NO: 713794 - RNA, 18 nt, Homo sapiens
uccguccaggagccugug

SEQ ID NO: 713795 - RNA, 16 nt, Homo sapiens
uccuaaaguacuggga

SEQ ID NO: 713796 - RNA, 16 nt, Homo sapiens
uccuaauaauauccca

SEQ ID NO: 713797 - RNA, 14 nt, Homo sapiens
uccuaccuccaaag

SEQ ID NO: 713798 - RNA, 19 nt, Homo sapiens
uccuaugcuuugaaacaga

SEQ ID NO: 713799 - RNA, 21 nt, Homo sapiens
uccucaggggccugcccagug

SEQ ID NO: 713800 - RNA, 12 nt, Homo sapiens
uccucagugucc

SEQ ID NO: 713801 - RNA, 13 nt, Homo sapiens
uccucccagacuu

SEQ ID NO: 713802 - RNA, 19 nt, Homo sapiens
uccugaccucgugauccac

SEQ ID NO: 713803 - RNA, 20 nt, Homo sapiens
uccugccucagccuccugag

SEQ ID NO: 713804 - RNA, 21 nt, Homo sapiens
uccugguuccuaggugagcag

SEQ ID NO: 713805 - RNA, 21 nt, Homo sapiens
uccuguuuuucacauuuuccu

SEQ ID NO: 713806 - RNA, 12 nt, Homo sapiens
uccuucauuucc

SEQ ID NO: 713807 - RNA, 15 nt, Homo sapiens
ucgugcuaaacgcac

SEQ ID NO: 713808 - RNA, 22 nt, Homo sapiens
ucuaaaacauguuugcacuugu

SEQ ID NO: 713809 - RNA, 14 nt, Homo sapiens
ucuaaguaaauaca

SEQ ID NO: 713810 - RNA, 15 nt, Homo sapiens
ucuaauuggcaugaa

SEQ ID NO: 713811 - RNA, 21 nt, Homo sapiens
ucuacaaacucccacuuguca

SEQ ID NO: 713812 - RNA, 16 nt, Homo sapiens
ucuaccuggucucucc

SEQ ID NO: 713813 - RNA, 15 nt, Homo sapiens
ucuagagcacugcca

SEQ ID NO: 713814 - RNA, 22 nt, Homo sapiens
ucuaggaaauauacuuuuacaa

SEQ ID NO: 713815 - RNA, 19 nt, Homo sapiens
ucuagucaggggaaaagac

SEQ ID NO: 713816 - RNA, 14 nt, Homo sapiens
ucuauauaccaaag

SEQ ID NO: 713817 - RNA, 23 nt, Homo sapiens
ucucaugauccaacuaaugccuu

SEQ ID NO: 713818 - RNA, 13 nt, Homo sapiens
ucucauguaaaau

SEQ ID NO: 713819 - RNA, 18 nt, Homo sapiens
ucuccacucaugugacuc

SEQ ID NO: 713820 - RNA, 12 nt, Homo sapiens
ucucccaugcac

SEQ ID NO: 713821 - RNA, 16 nt, Homo sapiens
ucucccuccucugccc

SEQ ID NO: 713822 - RNA, 19 nt, Homo sapiens
ucucuaccacugcugauau

SEQ ID NO: 713823 - RNA, 15 nt, Homo sapiens
ucucuacgcaaaaaa

SEQ ID NO: 713824 - RNA, 14 nt, Homo sapiens
ucucucaugaaccu

SEQ ID NO: 713825 - RNA, 18 nt, Homo sapiens
ucucuccuuguucugaua

SEQ ID NO: 713826 - RNA, 16 nt, Homo sapiens
ucucuuugcuucacag

SEQ ID NO: 713827 - RNA, 19 nt, Homo sapiens
ucugagaaaagcuuugaac

SEQ ID NO: 713828 - RNA, 21 nt, Homo sapiens
ucugaggccugagugauccac

SEQ ID NO: 713829 - RNA, 18 nt, Homo sapiens
ucugaguuccugcaugcc

SEQ ID NO: 713830 - RNA, 18 nt, Homo sapiens
ucugauuuuccuggacag

SEQ ID NO: 713831 - RNA, 18 nt, Homo sapiens
ucugcaggcuucagccau

SEQ ID NO: 713832 - RNA, 21 nt, Homo sapiens
ucugcagggggugugucugcu

SEQ ID NO: 713833 - RNA, 23 nt, Homo sapiens
ucugcagggggugugucugcuca

SEQ ID NO: 713834 - RNA, 17 nt, Homo sapiens
ucugcccgggagcucag

SEQ ID NO: 713835 - RNA, 15 nt, Homo sapiens
ucugcuuuaauuuca

SEQ ID NO: 713836 - RNA, 12 nt, Homo sapiens
ucuggagcccac

SEQ ID NO: 713837 - RNA, 21 nt, Homo sapiens
ucuggucucuaccacugcuga

SEQ ID NO: 713838 - RNA, 22 nt, Homo sapiens
ucuuacaauaauucuaugagau

SEQ ID NO: 713839 - RNA, 11 nt, Homo sapiens
ucuuagcuguc

SEQ ID NO: 713840 - RNA, 17 nt, Homo sapiens
ucuuagcugucugcuca

SEQ ID NO: 713841 - RNA, 14 nt, Homo sapiens
ucuucagcucugaa

SEQ ID NO: 713842 - RNA, 18 nt, Homo sapiens
ucuucauguuucaggaga

SEQ ID NO: 713843 - RNA, 19 nt, Homo sapiens
ucuuccaucugauugugau

SEQ ID NO: 713844 - RNA, 20 nt, Homo sapiens
ucuucugaacucaaacugag

SEQ ID NO: 713845 - RNA, 21 nt, Homo sapiens
ucuugaagggcaggugcuuca

SEQ ID NO: 713846 - RNA, 18 nt, Homo sapiens
ucuugaggggaccaggag

SEQ ID NO: 713847 - RNA, 12 nt, Homo sapiens
ucuuucuuuauu

SEQ ID NO: 713848 - RNA, 11 nt, Homo sapiens
ucuuuugcucu

SEQ ID NO: 713849 - RNA, 17 nt, Homo sapiens
ugaaaaauaagucacuu

SEQ ID NO: 713850 - RNA, 14 nt, Homo sapiens
ugaaaacaauguaa

SEQ ID NO: 713851 - RNA, 19 nt, Homo sapiens
ugaaaagauuaugaucuca

SEQ ID NO: 713852 - RNA, 18 nt, Homo sapiens
ugaaaauaugacacucua

SEQ ID NO: 713853 - RNA, 16 nt, Homo sapiens
ugaaagggguugugaa

SEQ ID NO: 713854 - RNA, 23 nt, Homo sapiens
ugaaauaccaaccugaagacacc

SEQ ID NO: 713855 - RNA, 20 nt, Homo sapiens
ugaaaugccagaaugacuuc

SEQ ID NO: 713856 - RNA, 18 nt, Homo sapiens
ugaaauguauagcugcuu

SEQ ID NO: 713857 - RNA, 16 nt, Homo sapiens
ugaaccauuaaccaga

SEQ ID NO: 713858 - RNA, 18 nt, Homo sapiens
ugaaccuaaacauagaaa

SEQ ID NO: 713859 - RNA, 21 nt, Homo sapiens
ugaacuaaguuuuuuacuucc

SEQ ID NO: 713860 - RNA, 22 nt, Homo sapiens
ugaacuaaguuuuuuacuucca

SEQ ID NO: 713861 - RNA, 16 nt, Homo sapiens
ugaaguguaauugaga

SEQ ID NO: 713862 - RNA, 20 nt, Homo sapiens
ugaaguucugaaauuuaacu

SEQ ID NO: 713863 - RNA, 21 nt, Homo sapiens
ugaauauuuguuauguagaua

SEQ ID NO: 713864 - RNA, 22 nt, Homo sapiens
ugaauuacaguugaaagcugua

SEQ ID NO: 713865 - RNA, 19 nt, Homo sapiens
ugacaccauuuuccugccu

SEQ ID NO: 713866 - RNA, 20 nt, Homo sapiens
ugacacucuagucaaagccu

SEQ ID NO: 713867 - RNA, 14 nt, Homo sapiens
ugacaucacuugua

SEQ ID NO: 713868 - RNA, 21 nt, Homo sapiens
ugacauggagaccgugaccag

SEQ ID NO: 713869 - RNA, 22 nt, Homo sapiens
ugacauucugauucgaaugaca

SEQ ID NO: 713870 - RNA, 14 nt, Homo sapiens
ugaccagugcugcu

SEQ ID NO: 713871 - RNA, 15 nt, Homo sapiens
ugaccagugcugcug

SEQ ID NO: 713872 - RNA, 21 nt, Homo sapiens
ugacccucaucuuucuuccaa

SEQ ID NO: 713873 - RNA, 20 nt, Homo sapiens
ugaccucgcccuccacaaau

SEQ ID NO: 713874 - RNA, 13 nt, Homo sapiens
ugacucugagcua

SEQ ID NO: 713875 - RNA, 14 nt, Homo sapiens
ugacuggcacccaa

SEQ ID NO: 713876 - RNA, 12 nt, Homo sapiens
ugagaccaaacg

SEQ ID NO: 713877 - RNA, 18 nt, Homo sapiens
ugagagaugcagaaauau

SEQ ID NO: 713878 - RNA, 22 nt, Homo sapiens
ugagagcauugggauaucuccu

SEQ ID NO: 713879 - RNA, 14 nt, Homo sapiens
ugagcaccuacuua

SEQ ID NO: 713880 - RNA, 23 nt, Homo sapiens
ugagcaccuacuuacaugcauua

SEQ ID NO: 713881 - RNA, 18 nt, Homo sapiens
ugagcccgguaagagcaa

SEQ ID NO: 713882 - RNA, 23 nt, Homo sapiens
ugaggauacgacaguacacuguc

SEQ ID NO: 713883 - RNA, 24 nt, Homo sapiens
ugaggaugugucccaucuagggaa

SEQ ID NO: 713884 - RNA, 19 nt, Homo sapiens
ugaguugcacagcuaugaa

SEQ ID NO: 713885 - RNA, 22 nt, Homo sapiens
ugaguugcacagcuaugaaggc

SEQ ID NO: 713886 - RNA, 15 nt, Homo sapiens
ugaguugcccaucau

SEQ ID NO: 713887 - RNA, 15 nt, Homo sapiens
ugauaaaagcacuua

SEQ ID NO: 713888 - RNA, 23 nt, Homo sapiens
ugaugaaaagcagcuauuugccu

SEQ ID NO: 713889 - RNA, 14 nt, Homo sapiens
ugaugggguggaag

SEQ ID NO: 713890 - RNA, 20 nt, Homo sapiens
ugaugucagaauagcuucca

SEQ ID NO: 713891 - RNA, 17 nt, Homo sapiens
uucaaaauuggacuuaa

SEQ ID NO: 713892 - RNA, 18 nt, Homo sapiens
uucaaacugcaugauuca

SEQ ID NO: 713893 - RNA, 16 nt, Homo sapiens
uucaaagccaagcaaa

SEQ ID NO: 713894 - RNA, 20 nt, Homo sapiens
uucaaauucuucugaacuca

SEQ ID NO: 713895 - RNA, 17 nt, Homo sapiens
uucaacguaagacugug

SEQ ID NO: 713896 - RNA, 14 nt, Homo sapiens
uucaaucuguaaac

SEQ ID NO: 713897 - RNA, 16 nt, Homo sapiens
uucacacugaccaaga

SEQ ID NO: 713898 - RNA, 15 nt, Homo sapiens
uucaccagauuugcu

SEQ ID NO: 713899 - RNA, 16 nt, Homo sapiens
uucaccuggaagcauu

SEQ ID NO: 713900 - RNA, 18 nt, Homo sapiens
uucacuguagaaugauuu

SEQ ID NO: 713901 - RNA, 21 nt, Homo sapiens
uucagaagccccauuugcaca

SEQ ID NO: 713902 - RNA, 19 nt, Homo sapiens
uucaucuaaucuuaccagu

SEQ ID NO: 713903 - RNA, 21 nt, Homo sapiens
uucauucaggcaacgcacaaa

SEQ ID NO: 713904 - RNA, 17 nt, Homo sapiens
uucauuuucucuaauau

SEQ ID NO: 713905 - RNA, 19 nt, Homo sapiens
uuccaaacaggcucagagg

SEQ ID NO: 713906 - RNA, 21 nt, Homo sapiens
uuccaucuccauccaagcaaa

SEQ ID NO: 713907 - RNA, 21 nt, Homo sapiens
uuccaucugauugugauguga

SEQ ID NO: 713908 - RNA, 16 nt, Homo sapiens
aaucuucuuaugcaau

SEQ ID NO: 713909 - RNA, 13 nt, Homo sapiens
aaugauccuguau

SEQ ID NO: 713910 - RNA, 23 nt, Homo sapiens
aaugauuucaugcuaucucugug

SEQ ID NO: 713911 - RNA, 21 nt, Homo sapiens
aaugcauuauaggaucauuug

SEQ ID NO: 713912 - RNA, 23 nt, Homo sapiens
aaugccugacuagggagccaugu

SEQ ID NO: 713913 - RNA, 15 nt, Homo sapiens
aauuaaagcuguuau

SEQ ID NO: 713914 - RNA, 18 nt, Homo sapiens
aauuagaauauccaugac

SEQ ID NO: 713915 - RNA, 21 nt, Homo sapiens
aauuagccagugaaaaacuau

SEQ ID NO: 713916 - RNA, 20 nt, Homo sapiens
aauuauuuugugaugcaaau

SEQ ID NO: 713917 - RNA, 21 nt, Homo sapiens
aauucacucugaguguuuuau

SEQ ID NO: 713918 - RNA, 14 nt, Homo sapiens
aauuccacaaugaa

SEQ ID NO: 713919 - RNA, 15 nt, Homo sapiens
aauucuaugagauag

SEQ ID NO: 713920 - RNA, 15 nt, Homo sapiens
aauucugcucagaua

SEQ ID NO: 713921 - RNA, 17 nt, Homo sapiens
aauugaucgacuugcca

SEQ ID NO: 713922 - RNA, 22 nt, Homo sapiens
aauugauuuugaaccugaugaa

SEQ ID NO: 713923 - RNA, 14 nt, Homo sapiens
aauuucuacuuuga

SEQ ID NO: 713924 - RNA, 18 nt, Homo sapiens
aauuucuauuuuuaucug

SEQ ID NO: 713925 - RNA, 23 nt, Homo sapiens
aauuucugaacaccauagguaga

SEQ ID NO: 713926 - RNA, 18 nt, Homo sapiens
aauuugggggacuuacau

SEQ ID NO: 713927 - RNA, 17 nt, Homo sapiens
aauuuuccauuacauga

SEQ ID NO: 713928 - RNA, 13 nt, Homo sapiens
acaaaagcgaaac

SEQ ID NO: 713929 - RNA, 21 nt, Homo sapiens
acaaacauuugcugaauagcu

SEQ ID NO: 713930 - RNA, 18 nt, Homo sapiens
acaaaugggaaaaccaga

SEQ ID NO: 713931 - RNA, 18 nt, Homo sapiens
acaaauguguaauuuuga

SEQ ID NO: 713932 - RNA, 20 nt, Homo sapiens
acaacuauuuucagauguga

SEQ ID NO: 713933 - RNA, 18 nt, Homo sapiens
acaacuugucuauuaccu

SEQ ID NO: 713934 - RNA, 15 nt, Homo sapiens
acaagccacuaccuu

SEQ ID NO: 713935 - RNA, 15 nt, Homo sapiens
acaaggcugaggaua

SEQ ID NO: 713936 - RNA, 16 nt, Homo sapiens
acaauaauucuaugag

SEQ ID NO: 713937 - RNA, 12 nt, Homo sapiens
acaaucuuguca

SEQ ID NO: 713938 - RNA, 15 nt, Homo sapiens
acaauguaagagccu

SEQ ID NO: 713939 - RNA, 22 nt, Homo sapiens
acaauugacaacaguuacauaa

SEQ ID NO: 713940 - RNA, 14 nt, Homo sapiens
acacaggcaaaauc

SEQ ID NO: 713941 - RNA, 16 nt, Homo sapiens
acuuugggaggccaag

SEQ ID NO: 713942 - RNA, 17 nt, Homo sapiens
agaaaauaagagcucag

SEQ ID NO: 713943 - RNA, 19 nt, Homo sapiens
agaaaauaagagcucagga

SEQ ID NO: 713944 - RNA, 21 nt, Homo sapiens
agaaagggcggugaacucugg

SEQ ID NO: 713945 - RNA, 20 nt, Homo sapiens
agaauauacuaaauuaacuu

SEQ ID NO: 713946 - RNA, 12 nt, Homo sapiens
agaauuugugcc

SEQ ID NO: 713947 - RNA, 18 nt, Homo sapiens
agacaggguuucaccaug

SEQ ID NO: 713948 - RNA, 14 nt, Homo sapiens
agacaguucaagaa

SEQ ID NO: 713949 - RNA, 15 nt, Homo sapiens
agacaugugcacuug

SEQ ID NO: 713950 - RNA, 16 nt, Homo sapiens
agacaugugcacuuga

SEQ ID NO: 713951 - RNA, 19 nt, Homo sapiens
agaccuaaucucuguaaag

SEQ ID NO: 713952 - RNA, 22 nt, Homo sapiens
agaccucagugccuuccuguuu

SEQ ID NO: 713953 - RNA, 21 nt, Homo sapiens
agacgggcccuggugguggcu

SEQ ID NO: 713954 - RNA, 12 nt, Homo sapiens
agacucacugug

SEQ ID NO: 713955 - RNA, 20 nt, Homo sapiens
agacugggugaaagugacua

SEQ ID NO: 713956 - RNA, 18 nt, Homo sapiens
agagacaggguuucacca

SEQ ID NO: 713957 - RNA, 14 nt, Homo sapiens
agaggacuccuuaa

SEQ ID NO: 713958 - RNA, 22 nt, Homo sapiens
agaggcuauuauuuucacugua

SEQ ID NO: 713959 - RNA, 17 nt, Homo sapiens
agaggguguccugcacc

SEQ ID NO: 713960 - RNA, 20 nt, Homo sapiens
agagugagagacauuaacuc

SEQ ID NO: 713961 - RNA, 17 nt, Homo sapiens
agauagguuaccaguaa

SEQ ID NO: 713962 - RNA, 19 nt, Homo sapiens
agaucuuuuauuuugccaa

SEQ ID NO: 713963 - RNA, 16 nt, Homo sapiens
agauggcauguguuua

SEQ ID NO: 713964 - RNA, 13 nt, Homo sapiens
agauuaugaucuc

SEQ ID NO: 713965 - RNA, 15 nt, Homo sapiens
agcaaaccaaagacc

SEQ ID NO: 713966 - RNA, 22 nt, Homo sapiens
agcaaacugaauggcaaugaaa

SEQ ID NO: 713967 - RNA, 19 nt, Homo sapiens
agcaccuacuuacaugcau

SEQ ID NO: 713968 - RNA, 21 nt, Homo sapiens
agcaccuacuuacaugcauua

SEQ ID NO: 713969 - RNA, 23 nt, Homo sapiens
agcaccucuuuuugaacagggaa

SEQ ID NO: 713970 - RNA, 22 nt, Homo sapiens
agcacuugcaaccgucuguuau

SEQ ID NO: 713971 - RNA, 17 nt, Homo sapiens
augagggaacuguguag

SEQ ID NO: 713972 - RNA, 13 nt, Homo sapiens
augauaaaagcac

SEQ ID NO: 713973 - RNA, 22 nt, Homo sapiens
augauucauuuuaacaucugag

SEQ ID NO: 713974 - RNA, 22 nt, Homo sapiens
augauugcuaugucaggcuuuc

SEQ ID NO: 713975 - RNA, 19 nt, Homo sapiens
augauuuuuuuuucauaca

SEQ ID NO: 713976 - RNA, 19 nt, Homo sapiens
augcacacaaacaccuccu

SEQ ID NO: 713977 - RNA, 19 nt, Homo sapiens
augcacuuggcugcauaaa

SEQ ID NO: 713978 - RNA, 22 nt, Homo sapiens
augcagcucaagagaucccaag

SEQ ID NO: 713979 - RNA, 13 nt, Homo sapiens
augcauacaguaa

SEQ ID NO: 713980 - RNA, 15 nt, Homo sapiens
augcauauacuuuaa

SEQ ID NO: 713981 - RNA, 14 nt, Homo sapiens
augcauuacugcau

SEQ ID NO: 713982 - RNA, 16 nt, Homo sapiens
augcauuuggguccag

SEQ ID NO: 713983 - RNA, 21 nt, Homo sapiens
augccugacuagggagccaug

SEQ ID NO: 713984 - RNA, 19 nt, Homo sapiens
augccuggucccaagacag

SEQ ID NO: 713985 - RNA, 12 nt, Homo sapiens
augccuuacucu

SEQ ID NO: 713986 - RNA, 16 nt, Homo sapiens
augcuucagugcugcu

SEQ ID NO: 713987 - RNA, 15 nt, Homo sapiens
auggagaccgugacc

SEQ ID NO: 713988 - RNA, 18 nt, Homo sapiens
auggagugcaccaaagag

SEQ ID NO: 713989 - RNA, 22 nt, Homo sapiens
auggcggcccccccagcuguca

SEQ ID NO: 713990 - RNA, 15 nt, Homo sapiens
auggcuuugugauuc

SEQ ID NO: 713991 - RNA, 14 nt, Homo sapiens
augggucaaagccg

SEQ ID NO: 713992 - RNA, 13 nt, Homo sapiens
auguaaaauaaga

SEQ ID NO: 713993 - RNA, 16 nt, Homo sapiens
auguaucuaugcauuu

SEQ ID NO: 713994 - RNA, 18 nt, Homo sapiens
auguauguggccuugccu

SEQ ID NO: 713995 - RNA, 17 nt, Homo sapiens
augucauuucauuuccu

SEQ ID NO: 713996 - RNA, 16 nt, Homo sapiens
augucuauucagcuuc

SEQ ID NO: 713997 - RNA, 19 nt, Homo sapiens
augucuguucuacauagau

SEQ ID NO: 713998 - RNA, 20 nt, Homo sapiens
augugaaccauuaaccagau

SEQ ID NO: 713999 - RNA, 16 nt, Homo sapiens
augugacucuuuccaa

SEQ ID NO: 714000 - RNA, 16 nt, Homo sapiens
auguguuuuuuuacau

SEQ ID NO: 714001 - RNA, 22 nt, Homo sapiens
auguuaaaaaaauaagaagaau

SEQ ID NO: 714002 - RNA, 14 nt, Homo sapiens
auguuaagacuuga

SEQ ID NO: 714003 - RNA, 19 nt, Homo sapiens
auguuaagacuugacagug

SEQ ID NO: 714004 - RNA, 16 nt, Homo sapiens
auguuacuacaugcac

SEQ ID NO: 714005 - RNA, 15 nt, Homo sapiens
auuaaaaacugagug

SEQ ID NO: 714006 - RNA, 13 nt, Homo sapiens
auuaaagcuguua

SEQ ID NO: 714007 - RNA, 13 nt, Homo sapiens
auuaacauaccua

SEQ ID NO: 714008 - RNA, 21 nt, Homo sapiens
auuaacuuuuuaaaacacaac

SEQ ID NO: 714009 - RNA, 19 nt, Homo sapiens
auuaauuuuggucuaaaac

SEQ ID NO: 714010 - RNA, 21 nt, Homo sapiens
auuacuaaggaagauuacuca

SEQ ID NO: 714011 - RNA, 15 nt, Homo sapiens
auuacugcaugcacu

SEQ ID NO: 714012 - RNA, 15 nt, Homo sapiens
auuacugguccaaaa

SEQ ID NO: 714013 - RNA, 16 nt, Homo sapiens
auuacugguccaaaag

SEQ ID NO: 714014 - RNA, 22 nt, Homo sapiens
auuacuuuugcuguaauguuaa

SEQ ID NO: 714015 - RNA, 17 nt, Homo sapiens
auuagaauauccaugac

SEQ ID NO: 714016 - RNA, 14 nt, Homo sapiens
auuagccauuugac

SEQ ID NO: 714017 - RNA, 18 nt, Homo sapiens
auuagcuccacaaagcca

SEQ ID NO: 714018 - RNA, 23 nt, Homo sapiens
auuauuccucaaaaaauugcaca

SEQ ID NO: 714019 - RNA, 16 nt, Homo sapiens
auucaagauuggacau

SEQ ID NO: 714020 - RNA, 18 nt, Homo sapiens
auucauauuuaugaaucu

SEQ ID NO: 714021 - RNA, 18 nt, Homo sapiens
auucauuuuaacaucuga

SEQ ID NO: 714022 - RNA, 17 nt, Homo sapiens
auucauuuucugccuau

SEQ ID NO: 714023 - RNA, 15 nt, Homo sapiens
auucgaaugacacug

SEQ ID NO: 714024 - RNA, 17 nt, Homo sapiens
auucugcaagcuuuuca

SEQ ID NO: 714025 - RNA, 22 nt, Homo sapiens
auucugcucagauagaaugaca

SEQ ID NO: 714026 - RNA, 13 nt, Homo sapiens
auucuuucccaac

SEQ ID NO: 714027 - RNA, 17 nt, Homo sapiens
auugacugucacuguuc

SEQ ID NO: 714028 - RNA, 13 nt, Homo sapiens
auugauguugcug

SEQ ID NO: 714029 - RNA, 23 nt, Homo sapiens
auuggacuuaaaaucuaauucaa

SEQ ID NO: 714030 - RNA, 14 nt, Homo sapiens
auugggaauccgcc

SEQ ID NO: 714031 - RNA, 15 nt, Homo sapiens
auuguaacuuaugaa

SEQ ID NO: 714032 - RNA, 15 nt, Homo sapiens
auuguacuaaagcca

SEQ ID NO: 714033 - RNA, 16 nt, Homo sapiens
auuguacuaaagccaa

SEQ ID NO: 714034 - RNA, 18 nt, Homo sapiens
auuguagaaaagcuauaa

SEQ ID NO: 714035 - RNA, 20 nt, Homo sapiens
auuguugaaagguaauuuga

SEQ ID NO: 714036 - RNA, 19 nt, Homo sapiens
auuguuguuaauaggucuu

SEQ ID NO: 714037 - RNA, 21 nt, Homo sapiens
auuuaaaguuguuugugccuu

SEQ ID NO: 714038 - RNA, 23 nt, Homo sapiens
auuuaacugccuaaaauguucuc

SEQ ID NO: 714039 - RNA, 15 nt, Homo sapiens
auuuaugagcucuuc

SEQ ID NO: 714040 - RNA, 19 nt, Homo sapiens
auuuccuccgucaccucag

SEQ ID NO: 714041 - RNA, 14 nt, Homo sapiens
auuugacuaauaau

SEQ ID NO: 714042 - RNA, 14 nt, Homo sapiens
auuuggguccagga

SEQ ID NO: 714043 - RNA, 17 nt, Homo sapiens
auuuguugagaguguga

SEQ ID NO: 714044 - RNA, 13 nt, Homo sapiens
auuuuaaaaguca

SEQ ID NO: 714045 - RNA, 19 nt, Homo sapiens
auuuucaagaaacugagga

SEQ ID NO: 714046 - RNA, 24 nt, Homo sapiens
auuuucaagaauaaucacgcuuuc

SEQ ID NO: 714047 - RNA, 21 nt, Homo sapiens
auuuuccuggugccaauuuca

SEQ ID NO: 714048 - RNA, 15 nt, Homo sapiens
auuuucuaagauuaa

SEQ ID NO: 714049 - RNA, 23 nt, Homo sapiens
auuuugagauggagucuugcucu

SEQ ID NO: 714050 - RNA, 17 nt, Homo sapiens
auuuugaguacagaauu

SEQ ID NO: 714051 - RNA, 19 nt, Homo sapiens
auuuuguaacgaagacaca

SEQ ID NO: 714052 - RNA, 21 nt, Homo sapiens
auuuuuagcucuguacuccua

SEQ ID NO: 714053 - RNA, 23 nt, Homo sapiens
auuuuuggaagaggacuccuuaa

SEQ ID NO: 714054 - RNA, 18 nt, Homo sapiens
auuuuuuuauacuaccaa

SEQ ID NO: 714055 - RNA, 21 nt, Homo sapiens
caaaacauugugccaugucaa

SEQ ID NO: 714056 - RNA, 12 nt, Homo sapiens
caaaacauuugu

SEQ ID NO: 714057 - RNA, 20 nt, Homo sapiens
caaaagcgaaacacacaaac

SEQ ID NO: 714058 - RNA, 16 nt, Homo sapiens
caaaagggccaaagaa

SEQ ID NO: 714059 - RNA, 20 nt, Homo sapiens
caaaaguuacauguuugcac

SEQ ID NO: 714060 - RNA, 22 nt, Homo sapiens
caaaauauauuuuaucugugau

SEQ ID NO: 714061 - RNA, 21 nt, Homo sapiens
caaaaugguaauuucuacuuu

SEQ ID NO: 714062 - RNA, 19 nt, Homo sapiens
caaaccaaagaccaucuga

SEQ ID NO: 714063 - RNA, 21 nt, Homo sapiens
caaacuccugaccucaggcaa

SEQ ID NO: 714064 - RNA, 15 nt, Homo sapiens
caaagcaagcauuca

SEQ ID NO: 714065 - RNA, 12 nt, Homo sapiens
caaagccaagca

SEQ ID NO: 714066 - RNA, 14 nt, Homo sapiens
caaaucaccacaaa

SEQ ID NO: 714067 - RNA, 22 nt, Homo sapiens
caaauccuuagaucuggcaugu

SEQ ID NO: 714068 - RNA, 17 nt, Homo sapiens
caaaugcaccaugucaa

SEQ ID NO: 714069 - RNA, 20 nt, Homo sapiens
caacagccugacaacauuuc

SEQ ID NO: 714070 - RNA, 20 nt, Homo sapiens
caaccaaauggagugacuua

SEQ ID NO: 714071 - RNA, 15 nt, Homo sapiens
caacccuucauuuaa

SEQ ID NO: 714072 - RNA, 16 nt, Homo sapiens
caaccuguuaccuacu

SEQ ID NO: 714073 - RNA, 16 nt, Homo sapiens
caacucguauagcaug

SEQ ID NO: 714074 - RNA, 18 nt, Homo sapiens
caagaagggacugagaga

SEQ ID NO: 714075 - RNA, 18 nt, Homo sapiens
caaggagucacugagacc

SEQ ID NO: 714076 - RNA, 14 nt, Homo sapiens
uuguuuaccagaga

SEQ ID NO: 714077 - RNA, 12 nt, Homo sapiens
uuuaaacaguga

SEQ ID NO: 714078 - RNA, 16 nt, Homo sapiens
uuuaaacuauaagcaa

SEQ ID NO: 714079 - RNA, 12 nt, Homo sapiens
uuuaaauucucu

SEQ ID NO: 714080 - RNA, 14 nt, Homo sapiens
uuuaaguaauuuca

SEQ ID NO: 714081 - RNA, 14 nt, Homo sapiens
uuuaauagcaaaga

SEQ ID NO: 714082 - RNA, 15 nt, Homo sapiens
uuuaauugugaauua

SEQ ID NO: 714083 - RNA, 11 nt, Homo sapiens
uuuacuaccug

SEQ ID NO: 714084 - RNA, 17 nt, Homo sapiens
uuuacuuuuaaacugug

SEQ ID NO: 714085 - RNA, 16 nt, Homo sapiens
uuuagagaaguucaau

SEQ ID NO: 714086 - RNA, 19 nt, Homo sapiens
uuuagcgugcucacugacc

SEQ ID NO: 714087 - RNA, 19 nt, Homo sapiens
uuuagcuucucugccaagc

SEQ ID NO: 714088 - RNA, 12 nt, Homo sapiens
uuuaguggcuca

SEQ ID NO: 714089 - RNA, 13 nt, Homo sapiens
uuucauacacuua

SEQ ID NO: 714090 - RNA, 22 nt, Homo sapiens
uuucaugaaaagauuaugaucu

SEQ ID NO: 714091 - RNA, 14 nt, Homo sapiens
uuuccaaccggcuu

SEQ ID NO: 714092 - RNA, 23 nt, Homo sapiens
uuuccaugggaccacaacuauuu

SEQ ID NO: 714093 - RNA, 16 nt, Homo sapiens
uuucccaacaccucuu

SEQ ID NO: 714094 - RNA, 11 nt, Homo sapiens
uuuccuuugaa

SEQ ID NO: 714095 - RNA, 17 nt, Homo sapiens
uuucuuucucacuaaau

SEQ ID NO: 714096 - RNA, 22 nt, Homo sapiens
uuugaaauuuuccauuacauga

SEQ ID NO: 714097 - RNA, 12 nt, Homo sapiens
uuuggggagcag

SEQ ID NO: 714098 - RNA, 18 nt, Homo sapiens
uuuggggggaguaaagaa

SEQ ID NO: 714099 - RNA, 16 nt, Homo sapiens
uuuguaggcauugcau

SEQ ID NO: 714100 - RNA, 18 nt, Homo sapiens
uuuguaggcauugcauga

SEQ ID NO: 714101 - RNA, 22 nt, Homo sapiens
uuugugcagagauaaagaccuu

SEQ ID NO: 714102 - RNA, 17 nt, Homo sapiens
uuuuaaaacccauuuaa

SEQ ID NO: 714103 - RNA, 13 nt, Homo sapiens
uuuuaacaucuga

SEQ ID NO: 714104 - RNA, 15 nt, Homo sapiens
uuuuaaguaauuuca

SEQ ID NO: 714105 - RNA, 18 nt, Homo sapiens
uuuuacaaguaacaaaaa

SEQ ID NO: 714106 - RNA, 16 nt, Homo sapiens
uuuuauacuaccaagu

SEQ ID NO: 714107 - RNA, 16 nt, Homo sapiens
uuuucuaaacuuuaau

SEQ ID NO: 714108 - RNA, 19 nt, Homo sapiens
uuuucuaauaccguggaug

SEQ ID NO: 714109 - RNA, 14 nt, Homo sapiens
uuuucuugucuaua

SEQ ID NO: 714110 - RNA, 18 nt, Homo sapiens
uuuugaaaaagcgaaaaa

SEQ ID NO: 714111 - RNA, 22 nt, Homo sapiens
ugaaacccccacccuucugccu

SEQ ID NO: 714112 - RNA, 12 nt, Homo sapiens
ugaaacuaaaau

SEQ ID NO: 714113 - RNA, 20 nt, Homo sapiens
ugaaauuuuaaccuaugaua

SEQ ID NO: 714114 - RNA, 16 nt, Homo sapiens
ugaacaaauggccuuu

SEQ ID NO: 714115 - RNA, 12 nt, Homo sapiens
ugaacacuguga

SEQ ID NO: 714116 - RNA, 13 nt, Homo sapiens
ugaacacugugac

SEQ ID NO: 714117 - RNA, 11 nt, Homo sapiens
ugaacuuugaa

SEQ ID NO: 714118 - RNA, 22 nt, Homo sapiens
ugaacuuuuuuuuuuuaagagu

SEQ ID NO: 714119 - RNA, 15 nt, Homo sapiens
ugaauagcuacuaua

SEQ ID NO: 714120 - RNA, 21 nt, Homo sapiens
ugaaucaagggucaggccuuu

SEQ ID NO: 714121 - RNA, 18 nt, Homo sapiens
ugaauccucucucugugu

SEQ ID NO: 714122 - RNA, 16 nt, Homo sapiens
ugaauuagacuuguau

SEQ ID NO: 714123 - RNA, 18 nt, Homo sapiens
ugaauuuccucaucccuc

SEQ ID NO: 714124 - RNA, 14 nt, Homo sapiens
ugaauuuuguugcu

SEQ ID NO: 714125 - RNA, 13 nt, Homo sapiens
ugacccugaugaa

SEQ ID NO: 714126 - RNA, 20 nt, Homo sapiens
ugaccucaggcaaucugccc

SEQ ID NO: 714127 - RNA, 22 nt, Homo sapiens
ugacgucacuggaccacugggc

SEQ ID NO: 714128 - RNA, 18 nt, Homo sapiens
ugacuuaguguacaugaa

SEQ ID NO: 714129 - RNA, 18 nt, Homo sapiens
ugagaccaaggcuuucuc

SEQ ID NO: 714130 - RNA, 13 nt, Homo sapiens
ugagauuacaggu

SEQ ID NO: 714131 - RNA, 18 nt, Homo sapiens
ugagcccaaggcacugag

SEQ ID NO: 714132 - RNA, 14 nt, Homo sapiens
ugaggaagccuaaa

SEQ ID NO: 714133 - RNA, 20 nt, Homo sapiens
ugaggaagccuaaauaaaaa

SEQ ID NO: 714134 - RNA, 23 nt, Homo sapiens
ugauaagaucuuuuauuuugcca

SEQ ID NO: 714135 - RNA, 15 nt, Homo sapiens
ugauaaggaugauaa

SEQ ID NO: 714136 - RNA, 17 nt, Homo sapiens
ugaucccuagcugugac

SEQ ID NO: 714137 - RNA, 11 nt, Homo sapiens
ugauguugcug

SEQ ID NO: 714138 - RNA, 16 nt, Homo sapiens
ugauuagccauuugac

SEQ ID NO: 714139 - RNA, 14 nt, Homo sapiens
ugauucgaaugaca

SEQ ID NO: 714140 - RNA, 18 nt, Homo sapiens
ugcaaaccauagcacagg

SEQ ID NO: 714141 - RNA, 22 nt, Homo sapiens
ugcaaccuaccuguugagcauc

SEQ ID NO: 714142 - RNA, 12 nt, Homo sapiens
ugcaccaaagag

SEQ ID NO: 714143 - RNA, 18 nt, Homo sapiens
ugcagaaauauuugugac

SEQ ID NO: 714144 - RNA, 16 nt, Homo sapiens
ugcagacucacugugg

SEQ ID NO: 714145 - RNA, 17 nt, Homo sapiens
ugcagacucacuguggg

SEQ ID NO: 714146 - RNA, 19 nt, Homo sapiens
ugcagagaaucuguaguca

SEQ ID NO: 714147 - RNA, 15 nt, Homo sapiens
ugcagcaaccagagc

SEQ ID NO: 714148 - RNA, 19 nt, Homo sapiens
ugcaggaucucaccaggca

SEQ ID NO: 714149 - RNA, 21 nt, Homo sapiens
ugcagggggugugucugcuca

SEQ ID NO: 714150 - RNA, 16 nt, Homo sapiens
ugcaugcacuucuuac

SEQ ID NO: 714151 - RNA, 17 nt, Homo sapiens
ugcaugcacuucuuaca

SEQ ID NO: 714152 - RNA, 20 nt, Homo sapiens
ugcauuacugcaugcacuuc

SEQ ID NO: 714153 - RNA, 24 nt, Homo sapiens
ugccaagcccucaauaagccagca

SEQ ID NO: 714154 - RNA, 14 nt, Homo sapiens
ugccagcauuuccc

SEQ ID NO: 714155 - RNA, 18 nt, Homo sapiens
ugccaucguuuccaugac

SEQ ID NO: 714156 - RNA, 15 nt, Homo sapiens
ugccauguguuuauc

SEQ ID NO: 714157 - RNA, 20 nt, Homo sapiens
ugccauuggacuauggagug

SEQ ID NO: 714158 - RNA, 22 nt, Homo sapiens
ugcccaauuagggccuagccuu

SEQ ID NO: 714159 - RNA, 15 nt, Homo sapiens
ugcccaggcacugca

SEQ ID NO: 714160 - RNA, 15 nt, Homo sapiens
ugcccaucauacgca

SEQ ID NO: 714161 - RNA, 21 nt, Homo sapiens
ugcccgguuuuucucuucaau

SEQ ID NO: 714162 - RNA, 22 nt, Homo sapiens
ugccucagccuccugaguaguu

SEQ ID NO: 714163 - RNA, 18 nt, Homo sapiens
ugccuugguauagcauau

SEQ ID NO: 714164 - RNA, 11 nt, Homo sapiens
ugcgucacugu

SEQ ID NO: 714165 - RNA, 18 nt, Homo sapiens
ugcuauacugcauacuuu

SEQ ID NO: 714166 - RNA, 14 nt, Homo sapiens
ugcuauaucaguuu

SEQ ID NO: 714167 - RNA, 20 nt, Homo sapiens
ugcucacugaccugccugua

SEQ ID NO: 714168 - RNA, 16 nt, Homo sapiens
ugcucauauugugauu

SEQ ID NO: 714169 - RNA, 13 nt, Homo sapiens
ugcucccacagaa

SEQ ID NO: 714170 - RNA, 15 nt, Homo sapiens
ugcucuuagcugucu

SEQ ID NO: 714171 - RNA, 21 nt, Homo sapiens
ugcugagauacauacagaauu

SEQ ID NO: 714172 - RNA, 13 nt, Homo sapiens
ugcuggacuguca

SEQ ID NO: 714173 - RNA, 15 nt, Homo sapiens
ugcuguaaacuugua

SEQ ID NO: 714174 - RNA, 16 nt, Homo sapiens
ugcuucagugcugcuc

SEQ ID NO: 714175 - RNA, 14 nt, Homo sapiens
ugcuuuuaaaugca

SEQ ID NO: 714176 - RNA, 21 nt, Homo sapiens
uggaccaauagggcugagcuc

SEQ ID NO: 714177 - RNA, 17 nt, Homo sapiens
uggaccagccucuccac

SEQ ID NO: 714178 - RNA, 14 nt, Homo sapiens
uggacugguuuuca

SEQ ID NO: 714179 - RNA, 12 nt, Homo sapiens
uggacuuguccc

SEQ ID NO: 714180 - RNA, 14 nt, Homo sapiens
uggagcccacugua

SEQ ID NO: 714181 - RNA, 21 nt, Homo sapiens
uggaugacauuaaagaagggu

SEQ ID NO: 714182 - RNA, 21 nt, Homo sapiens
uggcaaccauuauaaccuuaa

SEQ ID NO: 714183 - RNA, 18 nt, Homo sapiens
uggcagcauugacucugu

SEQ ID NO: 714184 - RNA, 19 nt, Homo sapiens
uggcagucugaauuuuuaa

SEQ ID NO: 714185 - RNA, 20 nt, Homo sapiens
uggcagugcagcaaccagag

SEQ ID NO: 714186 - RNA, 17 nt, Homo sapiens
uggcaugagaaauacaa

SEQ ID NO: 714187 - RNA, 14 nt, Homo sapiens
uggcuaacuggcga

SEQ ID NO: 714188 - RNA, 16 nt, Homo sapiens
uggcucaacauugugu

SEQ ID NO: 714189 - RNA, 15 nt, Homo sapiens
ugggagcaccgccug

SEQ ID NO: 714190 - RNA, 21 nt, Homo sapiens
ugggagcacuuuguaggcauu

SEQ ID NO: 714191 - RNA, 19 nt, Homo sapiens
ugggaggguaccagcagaa

SEQ ID NO: 714192 - RNA, 22 nt, Homo sapiens
uggguugcagacaggaaucuua

SEQ ID NO: 714193 - RNA, 18 nt, Homo sapiens
uggucccaagacagugag

SEQ ID NO: 714194 - RNA, 22 nt, Homo sapiens
uggucucaaacuccugaccuca

SEQ ID NO: 714195 - RNA, 17 nt, Homo sapiens
ugguuaagacuacugaa

SEQ ID NO: 714196 - RNA, 18 nt, Homo sapiens
ugguuucccaagagcuac

SEQ ID NO: 714197 - RNA, 21 nt, Homo sapiens
ugguuuugcucacaaaagucu

SEQ ID NO: 714198 - RNA, 21 nt, Homo sapiens
uguaaaauauuguuacuagag

SEQ ID NO: 714199 - RNA, 13 nt, Homo sapiens
uguaaacugugua

SEQ ID NO: 714200 - RNA, 12 nt, Homo sapiens
uguaaacuugua

SEQ ID NO: 714201 - RNA, 15 nt, Homo sapiens
uguaacaagccagau

SEQ ID NO: 714202 - RNA, 15 nt, Homo sapiens
uguaacugagaauuu

SEQ ID NO: 714203 - RNA, 22 nt, Homo sapiens
uguaaguuuaugcauacaguaa

SEQ ID NO: 714204 - RNA, 12 nt, Homo sapiens
uguaauugcaaa

SEQ ID NO: 714205 - RNA, 17 nt, Homo sapiens
uguagccccagugacag

SEQ ID NO: 714206 - RNA, 19 nt, Homo sapiens
ugucacgccagacuuccca

SEQ ID NO: 714207 - RNA, 16 nt, Homo sapiens
ugucccagaaaaagca

SEQ ID NO: 714208 - RNA, 12 nt, Homo sapiens
uguccucagggg

SEQ ID NO: 714209 - RNA, 15 nt, Homo sapiens
uguccuguuacaaaa

SEQ ID NO: 714210 - RNA, 13 nt, Homo sapiens
ugucucucaugaa

SEQ ID NO: 714211 - RNA, 19 nt, Homo sapiens
ugugauucaaucuguaaac

SEQ ID NO: 714212 - RNA, 16 nt, Homo sapiens
uguggacuccaugccu

SEQ ID NO: 714213 - RNA, 19 nt, Homo sapiens
uguguggcauuuucacuuu

SEQ ID NO: 714214 - RNA, 17 nt, Homo sapiens
uguguuuggaagacuau

SEQ ID NO: 714215 - RNA, 16 nt, Homo sapiens
uguuacaccagccuuu

SEQ ID NO: 714216 - RNA, 20 nt, Homo sapiens
uguuauuauaaaaguacuag

SEQ ID NO: 714217 - RNA, 22 nt, Homo sapiens
uguuccccacuguaucuaggca

SEQ ID NO: 714218 - RNA, 19 nt, Homo sapiens
uguuccuugucacugguag

SEQ ID NO: 714219 - RNA, 12 nt, Homo sapiens
uguugcaccuca

SEQ ID NO: 714220 - RNA, 21 nt, Homo sapiens
uguugcuggacugucauagaa

SEQ ID NO: 714221 - RNA, 16 nt, Homo sapiens
uguugcuuuucacaaa

SEQ ID NO: 714222 - RNA, 19 nt, Homo sapiens
uguugcuuuucacaaauca

SEQ ID NO: 714223 - RNA, 16 nt, Homo sapiens
uguuuauucuauaguu

SEQ ID NO: 714224 - RNA, 15 nt, Homo sapiens
uguuucccauuacuu

SEQ ID NO: 714225 - RNA, 17 nt, Homo sapiens
uuaaaaaaauaagaaga

SEQ ID NO: 714226 - RNA, 14 nt, Homo sapiens
uuaaaauagcaaaa

SEQ ID NO: 714227 - RNA, 17 nt, Homo sapiens
uuaaagaaggguugagc

SEQ ID NO: 714228 - RNA, 15 nt, Homo sapiens
uuaacauaccuaaga

SEQ ID NO: 714229 - RNA, 13 nt, Homo sapiens
uuaaccacugugg

SEQ ID NO: 714230 - RNA, 20 nt, Homo sapiens
uuaacuagguugcuacuuua

SEQ ID NO: 714231 - RNA, 14 nt, Homo sapiens
uuaagacuacugaa

SEQ ID NO: 714232 - RNA, 13 nt, Homo sapiens
uuaagacuuuaaa

SEQ ID NO: 714233 - RNA, 20 nt, Homo sapiens
uuaaugaacaaauggccuuu

SEQ ID NO: 714234 - RNA, 15 nt, Homo sapiens
uuaauggugccuuca

SEQ ID NO: 714235 - RNA, 19 nt, Homo sapiens
uuaauuuuugauacuaagc

SEQ ID NO: 714236 - RNA, 11 nt, Homo sapiens
uuacagaauuu

SEQ ID NO: 714237 - RNA, 20 nt, Homo sapiens
uuacaguugaaagcuguauu

SEQ ID NO: 714238 - RNA, 17 nt, Homo sapiens
uuaccucuauauaccaa

SEQ ID NO: 714239 - RNA, 15 nt, Homo sapiens
uuacuacaugcacuu

SEQ ID NO: 714240 - RNA, 18 nt, Homo sapiens
uuacuauuucacaacagc

SEQ ID NO: 714241 - RNA, 10 nt, Homo sapiens
uuacuguaac

SEQ ID NO: 714242 - RNA, 14 nt, Homo sapiens
uuacuuccacagaa

SEQ ID NO: 714243 - RNA, 23 nt, Homo sapiens
uuagaauauccaugaccuaguuu

SEQ ID NO: 714244 - RNA, 21 nt, Homo sapiens
uaggacuuuuauugugaauua

SEQ ID NO: 714245 - RNA, 22 nt, Homo sapiens
uaggugaacguguucaaagcca

SEQ ID NO: 714246 - RNA, 12 nt, Homo sapiens
uaguauucauga

SEQ ID NO: 714247 - RNA, 20 nt, Homo sapiens
uaguauuccagaccugaaga

SEQ ID NO: 714248 - RNA, 14 nt, Homo sapiens
uaguuuuacuuuua

SEQ ID NO: 714249 - RNA, 15 nt, Homo sapiens
uaguuuuacuuuuaa

SEQ ID NO: 714250 - RNA, 18 nt, Homo sapiens
uauaaaccagcuacuuga

SEQ ID NO: 714251 - RNA, 20 nt, Homo sapiens
uauaaaccgaucuucgugau

SEQ ID NO: 714252 - RNA, 23 nt, Homo sapiens
uauaaaccgaucuucgugauacu

SEQ ID NO: 714253 - RNA, 21 nt, Homo sapiens
uauaaccuuaauuuauuauua

SEQ ID NO: 714254 - RNA, 11 nt, Homo sapiens
uauaccaaagc

SEQ ID NO: 714255 - RNA, 16 nt, Homo sapiens
uauacugcuuggagcu

SEQ ID NO: 714256 - RNA, 19 nt, Homo sapiens
uaucaaccccagacacugg

SEQ ID NO: 714257 - RNA, 13 nt, Homo sapiens
uaucaacuuccua

SEQ ID NO: 714258 - RNA, 12 nt, Homo sapiens
uaucucaucucu

SEQ ID NO: 714259 - RNA, 21 nt, Homo sapiens
uaugaaaaagaagaaucucau

SEQ ID NO: 714260 - RNA, 16 nt, Homo sapiens
uaugaauaguuuccaa

SEQ ID NO: 714261 - RNA, 17 nt, Homo sapiens
uaugacacucuagucaa

SEQ ID NO: 714262 - RNA, 23 nt, Homo sapiens
uaugaccucgcccuccacaaaug

SEQ ID NO: 714263 - RNA, 16 nt, Homo sapiens
uaugcuuacugauaua

SEQ ID NO: 714264 - RNA, 13 nt, Homo sapiens
uauggcaaccauu

SEQ ID NO: 714265 - RNA, 12 nt, Homo sapiens
uaugugccaaag

SEQ ID NO: 714266 - RNA, 17 nt, Homo sapiens
uauguuacuacaugcac

SEQ ID NO: 714267 - RNA, 17 nt, Homo sapiens
uauuaagguguggcuuu

SEQ ID NO: 714268 - RNA, 16 nt, Homo sapiens
uauuauaaaaguacua

SEQ ID NO: 714269 - RNA, 18 nt, Homo sapiens
uauuauuguugcauuaaa

SEQ ID NO: 714270 - RNA, 19 nt, Homo sapiens
ucaaaacaaucuugucaua

SEQ ID NO: 714271 - RNA, 18 nt, Homo sapiens
ucaaaacauugugccaug

SEQ ID NO: 714272 - RNA, 22 nt, Homo sapiens
ucaaaagcacuuugugcugugu

SEQ ID NO: 714273 - RNA, 19 nt, Homo sapiens
ucaaaagucuggccuuuca

SEQ ID NO: 714274 - RNA, 16 nt, Homo sapiens
ucaaacaaaaagucau

SEQ ID NO: 714275 - RNA, 17 nt, Homo sapiens
ucaaacuccugaccuca

SEQ ID NO: 714276 - RNA, 21 nt, Homo sapiens
ucaaagagggagugcauuuau

SEQ ID NO: 714277 - RNA, 17 nt, Homo sapiens
ucaacagugaagacaga

SEQ ID NO: 714278 - RNA, 11 nt, Homo sapiens
ucaaccaaaca

SEQ ID NO: 714279 - RNA, 18 nt, Homo sapiens
ucaaccucccaagcaguu

SEQ ID NO: 714280 - RNA, 17 nt, Homo sapiens
ucaacugaaugagguca

SEQ ID NO: 714281 - RNA, 15 nt, Homo sapiens
ucaagaaacugagga

SEQ ID NO: 714282 - RNA, 15 nt, Homo sapiens
ucaauauucagcaaa

SEQ ID NO: 714283 - RNA, 16 nt, Homo sapiens
ucacaaaccaugcaaa

SEQ ID NO: 714284 - RNA, 14 nt, Homo sapiens
ucacaucacacaaa

SEQ ID NO: 714285 - RNA, 15 nt, Homo sapiens
ucaccacaaacugua

SEQ ID NO: 714286 - RNA, 21 nt, Homo sapiens
ucaccucagagacauacaccu

SEQ ID NO: 714287 - RNA, 14 nt, Homo sapiens
ucacugcaaccucc

SEQ ID NO: 714288 - RNA, 16 nt, Homo sapiens
ucacugcaaccuccac

SEQ ID NO: 714289 - RNA, 15 nt, Homo sapiens
ucacuucauaaucca

SEQ ID NO: 714290 - RNA, 18 nt, Homo sapiens
ucagaaguuucuucuuua

SEQ ID NO: 714291 - RNA, 22 nt, Homo sapiens
ucagaguugcugcaaaccugac

SEQ ID NO: 714292 - RNA, 22 nt, Homo sapiens
ucagcccaccuggggaguuuac

SEQ ID NO: 714293 - RNA, 19 nt, Homo sapiens
ucagcccuagcccucagcc

SEQ ID NO: 714294 - RNA, 19 nt, Homo sapiens
ucaggagagaguugaaccu

SEQ ID NO: 714295 - RNA, 15 nt, Homo sapiens
ucaggauaccauaua

SEQ ID NO: 714296 - RNA, 21 nt, Homo sapiens
ucagugaagaauacuucucau

SEQ ID NO: 714297 - RNA, 15 nt, Homo sapiens
ucauacagauuugca

SEQ ID NO: 714298 - RNA, 16 nt, Homo sapiens
ucaucccuccaucuca

SEQ ID NO: 714299 - RNA, 17 nt, Homo sapiens
ucaugauccaacuaaug

SEQ ID NO: 714300 - RNA, 16 nt, Homo sapiens
ucaugugacucuuucc

SEQ ID NO: 714301 - RNA, 16 nt, Homo sapiens
ucauuguuguuaauag

SEQ ID NO: 714302 - RNA, 21 nt, Homo sapiens
ucauuuccuccgucaccucag

SEQ ID NO: 714303 - RNA, 18 nt, Homo sapiens
ucauuuuaacaucugaga

SEQ ID NO: 714304 - RNA, 19 nt, Homo sapiens
ucauuuuaacaucugagaa

SEQ ID NO: 714305 - RNA, 18 nt, Homo sapiens
uccaaaauaaaaccucag

SEQ ID NO: 714306 - RNA, 17 nt, Homo sapiens
uccaaguugcuaauaca

SEQ ID NO: 714307 - RNA, 13 nt, Homo sapiens
uccacaaagccaa

SEQ ID NO: 714308 - RNA, 19 nt, Homo sapiens
uccagaaaacaaaacugca

SEQ ID NO: 714309 - RNA, 18 nt, Homo sapiens
uccagagucccugccugg

SEQ ID NO: 714310 - RNA, 16 nt, Homo sapiens
uccagauggcaugugu

SEQ ID NO: 714311 - RNA, 22 nt, Homo sapiens
uccagcaucgucucauguaaaa

SEQ ID NO: 714312 - RNA, 23 nt, Homo sapiens
uccagcaucgucucauguaaaau

SEQ ID NO: 714313 - RNA, 22 nt, Homo sapiens
uccagucuuccugacacuuuaa

SEQ ID NO: 714314 - RNA, 12 nt, Homo sapiens
uccaguuugcaa

SEQ ID NO: 714315 - RNA, 19 nt, Homo sapiens
uccaucccccguggccauu

SEQ ID NO: 714316 - RNA, 19 nt, Homo sapiens
uccaugaccuaguuuucca

SEQ ID NO: 714317 - RNA, 19 nt, Homo sapiens
ucccaccugacauguccuu

SEQ ID NO: 714318 - RNA, 20 nt, Homo sapiens
ucccacugggagcacuuugu

SEQ ID NO: 714319 - RNA, 22 nt, Homo sapiens
ucccacugggagcacuuuguag

SEQ ID NO: 714320 - RNA, 15 nt, Homo sapiens
ucccacuugucaugu

SEQ ID NO: 714321 - RNA, 20 nt, Homo sapiens
ucccagcaugcugagauuac

SEQ ID NO: 714322 - RNA, 19 nt, Homo sapiens
ucccaggcuggagugcagu

SEQ ID NO: 714323 - RNA, 18 nt, Homo sapiens
ucccaugccuggucccaa

SEQ ID NO: 714324 - RNA, 19 nt, Homo sapiens
ucccuaauaaagcugugug

SEQ ID NO: 714325 - RNA, 19 nt, Homo sapiens
ucccucucguaagauuucc

SEQ ID NO: 714326 - RNA, 15 nt, Homo sapiens
uccucaguguccuca

SEQ ID NO: 714327 - RNA, 19 nt, Homo sapiens
uccucaucccuccaucuca

SEQ ID NO: 714328 - RNA, 18 nt, Homo sapiens
uaaauaaaaaguauacuu

SEQ ID NO: 714329 - RNA, 11 nt, Homo sapiens
uaaaugugauu

SEQ ID NO: 714330 - RNA, 14 nt, Homo sapiens
uaacaagccagauu

SEQ ID NO: 714331 - RNA, 15 nt, Homo sapiens
uaacagaaguuguga

SEQ ID NO: 714332 - RNA, 14 nt, Homo sapiens
uaaccauugucaua

SEQ ID NO: 714333 - RNA, 19 nt, Homo sapiens
uaacuagguugcuacuuua

SEQ ID NO: 714334 - RNA, 21 nt, Homo sapiens
uaagaaagcccuaaaauacua

SEQ ID NO: 714335 - RNA, 23 nt, Homo sapiens
uaagaacuuugagcuacugccgu

SEQ ID NO: 714336 - RNA, 18 nt, Homo sapiens
uaagguaaaaugccauga

SEQ ID NO: 714337 - RNA, 13 nt, Homo sapiens
uaaguaauuucag

SEQ ID NO: 714338 - RNA, 22 nt, Homo sapiens
uaaguuuuauacuugauuguau

SEQ ID NO: 714339 - RNA, 18 nt, Homo sapiens
uaaucuucugccuucuca

SEQ ID NO: 714340 - RNA, 19 nt, Homo sapiens
uaaucuucuuaugcaauuu

SEQ ID NO: 714341 - RNA, 16 nt, Homo sapiens
uaauuggcaugaaggu

SEQ ID NO: 714342 - RNA, 14 nt, Homo sapiens
uaauugugaauuag

SEQ ID NO: 714343 - RNA, 14 nt, Homo sapiens
uaauuuaugcagaa

SEQ ID NO: 714344 - RNA, 20 nt, Homo sapiens
uaauuugagagaaauaugaa

SEQ ID NO: 714345 - RNA, 20 nt, Homo sapiens
uaauuuuuauuuuugcugag

SEQ ID NO: 714346 - RNA, 19 nt, Homo sapiens
uacaagcauucugucuuga

SEQ ID NO: 714347 - RNA, 22 nt, Homo sapiens
uacaauuuuuuaucaugcaugu

SEQ ID NO: 714348 - RNA, 18 nt, Homo sapiens
uacaguuagagauuuuua

SEQ ID NO: 714349 - RNA, 18 nt, Homo sapiens
uacaguugaaagcuguau

SEQ ID NO: 714350 - RNA, 13 nt, Homo sapiens
uaccaacuuuuag

SEQ ID NO: 714351 - RNA, 13 nt, Homo sapiens
uaccaagcuguga

SEQ ID NO: 714352 - RNA, 21 nt, Homo sapiens
uaccuagcaaagcuccugccu

SEQ ID NO: 714353 - RNA, 12 nt, Homo sapiens
uacuaaagccaa

SEQ ID NO: 714354 - RNA, 20 nt, Homo sapiens
uacuacuguguaagggccag

SEQ ID NO: 714355 - RNA, 22 nt, Homo sapiens
uacugcaagguucaacuuauua

SEQ ID NO: 714356 - RNA, 15 nt, Homo sapiens
uacugcaugcacuuc

SEQ ID NO: 714357 - RNA, 19 nt, Homo sapiens
uacugcugagauacauaca

SEQ ID NO: 714358 - RNA, 17 nt, Homo sapiens
uacuuugacuuuuugca

SEQ ID NO: 714359 - RNA, 21 nt, Homo sapiens
uacuuuuucuggucucuacca

SEQ ID NO: 714360 - RNA, 20 nt, Homo sapiens
uagacuuuaaagaauaaagu

SEQ ID NO: 714361 - RNA, 18 nt, Homo sapiens
uagaugcauuugggucca

SEQ ID NO: 714362 - RNA, 16 nt, Homo sapiens
uagcaaagauaucuca

SEQ ID NO: 714363 - RNA, 16 nt, Homo sapiens
uagcaauugacuguca

SEQ ID NO: 714364 - RNA, 17 nt, Homo sapiens
uagccuggcuauguccu

SEQ ID NO: 714365 - RNA, 14 nt, Homo sapiens
uagcuccacaaagc

SEQ ID NO: 714366 - RNA, 16 nt, Homo sapiens
uagcuuauacaaaaca

SEQ ID NO: 714367 - RNA, 17 nt, Homo sapiens
uagcuuauacaaaacau

SEQ ID NO: 714368 - RNA, 21 nt, Homo sapiens
ugcauaaaugugguacaagca

SEQ ID NO: 714369 - RNA, 23 nt, Homo sapiens
ugcaucuguuuauucuauaguua

SEQ ID NO: 714370 - RNA, 20 nt, Homo sapiens
ugcauuuaaaacagacacug

SEQ ID NO: 714371 - RNA, 18 nt, Homo sapiens
ugccacccauuccaucuc

SEQ ID NO: 714372 - RNA, 15 nt, Homo sapiens
ugccagcauuucccu

SEQ ID NO: 714373 - RNA, 21 nt, Homo sapiens
ugccaguuuccucuacugcaa

SEQ ID NO: 714374 - RNA, 13 nt, Homo sapiens
ugcccagugcacu

SEQ ID NO: 714375 - RNA, 15 nt, Homo sapiens
ugcccgggagcucag

SEQ ID NO: 714376 - RNA, 13 nt, Homo sapiens
ugccucaaccucc

SEQ ID NO: 714377 - RNA, 15 nt, Homo sapiens
ugccucaaccuccca

SEQ ID NO: 714378 - RNA, 13 nt, Homo sapiens
ugccucaugccug

SEQ ID NO: 714379 - RNA, 12 nt, Homo sapiens
ugccuccagcua

SEQ ID NO: 714380 - RNA, 14 nt, Homo sapiens
ugccugacuaggga

SEQ ID NO: 714381 - RNA, 18 nt, Homo sapiens
ugccuucucaugauccaa

SEQ ID NO: 714382 - RNA, 17 nt, Homo sapiens
ugccuuuggacuugucc

SEQ ID NO: 714383 - RNA, 22 nt, Homo sapiens
ugcuacuuuauuugccuaaaua

SEQ ID NO: 714384 - RNA, 13 nt, Homo sapiens
ugcucacaaaagu

SEQ ID NO: 714385 - RNA, 23 nt, Homo sapiens
ugcucagguacuuguaaauuauu

SEQ ID NO: 714386 - RNA, 13 nt, Homo sapiens
ugcugugcuaugg

SEQ ID NO: 714387 - RNA, 16 nt, Homo sapiens
ugcuuaugacaucacu

SEQ ID NO: 714388 - RNA, 15 nt, Homo sapiens
ugcuucaggauacca

SEQ ID NO: 714389 - RNA, 18 nt, Homo sapiens
ugcuucaggauaccauau

SEQ ID NO: 714390 - RNA, 18 nt, Homo sapiens
ugcuuggagcugagcaaa

SEQ ID NO: 714391 - RNA, 21 nt, Homo sapiens
uggaaagaaguuggggacaca

SEQ ID NO: 714392 - RNA, 15 nt, Homo sapiens
uggaaagugauguca

SEQ ID NO: 714393 - RNA, 13 nt, Homo sapiens
uggaacaagcaca

SEQ ID NO: 714394 - RNA, 16 nt, Homo sapiens
uggaagagcacaagag

SEQ ID NO: 714395 - RNA, 17 nt, Homo sapiens
uggaagaggcaccuguc

SEQ ID NO: 714396 - RNA, 18 nt, Homo sapiens
uggaagaggcaccugucc

SEQ ID NO: 714397 - RNA, 20 nt, Homo sapiens
uggaagaggcaccuguccca

SEQ ID NO: 714398 - RNA, 16 nt, Homo sapiens
uggaaucagcucagga

SEQ ID NO: 714399 - RNA, 13 nt, Homo sapiens
uggaaugcuguau

SEQ ID NO: 714400 - RNA, 21 nt, Homo sapiens
uggacaguuuucugcuuuaau

SEQ ID NO: 714401 - RNA, 22 nt, Homo sapiens
uggacaugcuucagugcugcuc

SEQ ID NO: 714402 - RNA, 22 nt, Homo sapiens
uggacugguuuucacauuagaa

SEQ ID NO: 714403 - RNA, 23 nt, Homo sapiens
uggagaccgugaccagugcugcu

SEQ ID NO: 714404 - RNA, 23 nt, Homo sapiens
uggagauucucauaacuugagac

SEQ ID NO: 714405 - RNA, 13 nt, Homo sapiens
uggaugacauuaa

SEQ ID NO: 714406 - RNA, 13 nt, Homo sapiens
uggauucagaaua

SEQ ID NO: 714407 - RNA, 18 nt, Homo sapiens
uggauuccccaucucagg

SEQ ID NO: 714408 - RNA, 13 nt, Homo sapiens
uggcaagugaauu

SEQ ID NO: 714409 - RNA, 15 nt, Homo sapiens
uggcaaugaaacaaa

SEQ ID NO: 714410 - RNA, 22 nt, Homo sapiens
uggcaauuuuuuuauacuacca

SEQ ID NO: 714411 - RNA, 20 nt, Homo sapiens
uggcaggccccagcccugca

SEQ ID NO: 714412 - RNA, 17 nt, Homo sapiens
uggcauuuguugugacu

SEQ ID NO: 714413 - RNA, 14 nt, Homo sapiens
uggcccuacuggga

SEQ ID NO: 714414 - RNA, 16 nt, Homo sapiens
uggcuagucauaaccu

SEQ ID NO: 714415 - RNA, 14 nt, Homo sapiens
ugggaaaaccagac

SEQ ID NO: 714416 - RNA, 23 nt, Homo sapiens
ugggaaggaggccgcuaugcagg

SEQ ID NO: 714417 - RNA, 19 nt, Homo sapiens
ugggagaccggccugccag

SEQ ID NO: 714418 - RNA, 16 nt, Homo sapiens
ugggaggguaccagca

SEQ ID NO: 714419 - RNA, 11 nt, Homo sapiens
ugggaugcuac

SEQ ID NO: 714420 - RNA, 16 nt, Homo sapiens
ugggcaacacagugag

SEQ ID NO: 714421 - RNA, 14 nt, Homo sapiens
uggggaguuuacua

SEQ ID NO: 714422 - RNA, 20 nt, Homo sapiens
uggggggaguaaagaauuau

SEQ ID NO: 714423 - RNA, 13 nt, Homo sapiens
aaaaaauugcaca

SEQ ID NO: 714424 - RNA, 15 nt, Homo sapiens
aaaacaaucuuguca

SEQ ID NO: 714425 - RNA, 18 nt, Homo sapiens
aaaacagauuguuugcaa

SEQ ID NO: 714426 - RNA, 16 nt, Homo sapiens
aaaacauguuugcacu

SEQ ID NO: 714427 - RNA, 19 nt, Homo sapiens
aaaacuacaaccaauggaa

SEQ ID NO: 714428 - RNA, 22 nt, Homo sapiens
aaaagcgaaacacacaaaccag

SEQ ID NO: 714429 - RNA, 19 nt, Homo sapiens
aaaaguuacauguuugcac

SEQ ID NO: 714430 - RNA, 15 nt, Homo sapiens
aaaauaaccaguuaa

SEQ ID NO: 714431 - RNA, 13 nt, Homo sapiens
aaaauagcaaaag

SEQ ID NO: 714432 - RNA, 22 nt, Homo sapiens
aaaauaguuuggauuacuuaaa

SEQ ID NO: 714433 - RNA, 23 nt, Homo sapiens
aaaaugaagguggaacaagcaca

SEQ ID NO: 714434 - RNA, 19 nt, Homo sapiens
aaaaugugcuauacugcau

SEQ ID NO: 714435 - RNA, 18 nt, Homo sapiens
aaaauuaaggucugggag

SEQ ID NO: 714436 - RNA, 14 nt, Homo sapiens
aaacaaauguguaa

SEQ ID NO: 714437 - RNA, 19 nt, Homo sapiens
aaaccagcuacuugaugua

SEQ ID NO: 714438 - RNA, 17 nt, Homo sapiens
aaaccaggacucugccc

SEQ ID NO: 714439 - RNA, 16 nt, Homo sapiens
aaaccugaccccugcu

SEQ ID NO: 714440 - RNA, 21 nt, Homo sapiens
aaaccugaccccugcucagua

SEQ ID NO: 714441 - RNA, 19 nt, Homo sapiens
aaagaacacgcucucucca

SEQ ID NO: 714442 - RNA, 20 nt, Homo sapiens
aaagcaagcauucagaagaa

SEQ ID NO: 714443 - RNA, 22 nt, Homo sapiens
aaagccaaucucaaucccucaa

SEQ ID NO: 714444 - RNA, 21 nt, Homo sapiens
aaaggagggguacauugguaa

SEQ ID NO: 714445 - RNA, 21 nt, Homo sapiens
aaaggcuagguacacagcucu

SEQ ID NO: 714446 - RNA, 18 nt, Homo sapiens
aaaggugguguuucugua

SEQ ID NO: 714447 - RNA, 19 nt, Homo sapiens
aaaggugguguuucuguaa

SEQ ID NO: 714448 - RNA, 21 nt, Homo sapiens
aaagugacuaauggcaugaga

SEQ ID NO: 714449 - RNA, 22 nt, Homo sapiens
aaaguguucuguguccuucuac

SEQ ID NO: 714450 - RNA, 15 nt, Homo sapiens
aaaguuuaccagaaa

SEQ ID NO: 714451 - RNA, 14 nt, Homo sapiens
aaauaagucacuua

SEQ ID NO: 714452 - RNA, 17 nt, Homo sapiens
aaauaaucaguguuucc

SEQ ID NO: 714453 - RNA, 14 nt, Homo sapiens
aaauagucuaucaa

SEQ ID NO: 714454 - RNA, 16 nt, Homo sapiens
aaauaguuuggauuac

SEQ ID NO: 714455 - RNA, 18 nt, Homo sapiens
aaauaucuucacuuguca

SEQ ID NO: 714456 - RNA, 19 nt, Homo sapiens
aaaucaaaagggccaaaga

SEQ ID NO: 714457 - RNA, 21 nt, Homo sapiens
aaaucuguuuuucuaacuggg

SEQ ID NO: 714458 - RNA, 22 nt, Homo sapiens
aaaucuugguugaugccaaaaa

SEQ ID NO: 714459 - RNA, 15 nt, Homo sapiens
aaaugcaccauguca

SEQ ID NO: 714460 - RNA, 16 nt, Homo sapiens
aaaugguaauuucuac

SEQ ID NO: 714461 - RNA, 13 nt, Homo sapiens
aacaaaaugguaa

SEQ ID NO: 714462 - RNA, 21 nt, Homo sapiens
aacaacuugucuauuaccugu

SEQ ID NO: 714463 - RNA, 21 nt, Homo sapiens
aacaaucuugucauacuugaa

SEQ ID NO: 714464 - RNA, 16 nt, Homo sapiens
aacaucauucuugaga

SEQ ID NO: 714465 - RNA, 20 nt, Homo sapiens
aacauuucuauagccaaaaa

SEQ ID NO: 714466 - RNA, 17 nt, Homo sapiens
aaccaaagaccaucuga

SEQ ID NO: 714467 - RNA, 21 nt, Homo sapiens
aaccacacccacacucagauc

SEQ ID NO: 714468 - RNA, 14 nt, Homo sapiens
aaccagcuacuuga

SEQ ID NO: 714469 - RNA, 17 nt, Homo sapiens
aaccccuccccuccauc

SEQ ID NO: 714470 - RNA, 14 nt, Homo sapiens
aaccggcuuugugg

SEQ ID NO: 714471 - RNA, 21 nt, Homo sapiens
aaccggcuuuguggcacuggg

SEQ ID NO: 714472 - RNA, 23 nt, Homo sapiens
aaccuaugauauuuucugugccu

SEQ ID NO: 714473 - RNA, 11 nt, Homo sapiens
aaccucagcua

SEQ ID NO: 714474 - RNA, 20 nt, Homo sapiens
aaccuccaccuccuggguuc

SEQ ID NO: 714475 - RNA, 15 nt, Homo sapiens
aaccuuuacauccag

SEQ ID NO: 714476 - RNA, 17 nt, Homo sapiens
aacgcacacaguaucua

SEQ ID NO: 714477 - RNA, 14 nt, Homo sapiens
aacuaaacacguga

SEQ ID NO: 714478 - RNA, 17 nt, Homo sapiens
aacuacauuaguacaca

SEQ ID NO: 714479 - RNA, 13 nt, Homo sapiens
aacuauaagcaag

SEQ ID NO: 714480 - RNA, 17 nt, Homo sapiens
aacucauuagacuggaa

SEQ ID NO: 714481 - RNA, 23 nt, Homo sapiens
aacucugcuugauuuuugccucu

SEQ ID NO: 714482 - RNA, 15 nt, Homo sapiens
aacucugucacuccu

SEQ ID NO: 714483 - RNA, 13 nt, Homo sapiens
aacucuucacucu

SEQ ID NO: 714484 - RNA, 19 nt, Homo sapiens
aacugaaugccacucugua

SEQ ID NO: 714485 - RNA, 16 nt, Homo sapiens
aacuuuuuauugauuu

SEQ ID NO: 714486 - RNA, 13 nt, Homo sapiens
aagaaacauuuau

SEQ ID NO: 714487 - RNA, 12 nt, Homo sapiens
aagaaaguccac

SEQ ID NO: 714488 - RNA, 13 nt, Homo sapiens
aagaaauugccuc

SEQ ID NO: 714489 - RNA, 23 nt, Homo sapiens
aagaagcaaccucaguaauuuag

SEQ ID NO: 714490 - RNA, 18 nt, Homo sapiens
aagaaguacauuguuacc

SEQ ID NO: 714491 - RNA, 16 nt, Homo sapiens
aagaauguuuaugaau

SEQ ID NO: 714492 - RNA, 22 nt, Homo sapiens
aagaauuauuuugugaugcaaa

SEQ ID NO: 714493 - RNA, 17 nt, Homo sapiens
aagacaccguucauuca

SEQ ID NO: 714494 - RNA, 13 nt, Homo sapiens
aagacuugacagu

SEQ ID NO: 714495 - RNA, 13 nt, Homo sapiens
aagagacugaguc

SEQ ID NO: 714496 - RNA, 22 nt, Homo sapiens
aagagcucaggaugagggaaaa

SEQ ID NO: 714497 - RNA, 22 nt, Homo sapiens
aagagucuuaauauauauaucc

SEQ ID NO: 714498 - RNA, 22 nt, Homo sapiens
acuauuaaaaagguuuacagaa

SEQ ID NO: 714499 - RNA, 23 nt, Homo sapiens
acuauuaacaacuugucuauuac

SEQ ID NO: 714500 - RNA, 14 nt, Homo sapiens
acucaaucauuucu

SEQ ID NO: 714501 - RNA, 17 nt, Homo sapiens
acucacuaauucauuaa

SEQ ID NO: 714502 - RNA, 14 nt, Homo sapiens
acucacugugggaa

SEQ ID NO: 714503 - RNA, 21 nt, Homo sapiens
acucguauagcaugcaucugu

SEQ ID NO: 714504 - RNA, 15 nt, Homo sapiens
acucgugucuggcac

SEQ ID NO: 714505 - RNA, 23 nt, Homo sapiens
acugaaaaaugguaauuguugcu

SEQ ID NO: 714506 - RNA, 14 nt, Homo sapiens
acugaaugagguca

SEQ ID NO: 714507 - RNA, 16 nt, Homo sapiens
acugagugacucuaua

SEQ ID NO: 714508 - RNA, 14 nt, Homo sapiens
acugauaaccacuc

SEQ ID NO: 714509 - RNA, 23 nt, Homo sapiens
acugcaaacaguguucugugaca

SEQ ID NO: 714510 - RNA, 14 nt, Homo sapiens
acugcaaaccgcca

SEQ ID NO: 714511 - RNA, 18 nt, Homo sapiens
acugcaugcacuucuuac

SEQ ID NO: 714512 - RNA, 18 nt, Homo sapiens
acugcuauauaauucucu

SEQ ID NO: 714513 - RNA, 18 nt, Homo sapiens
acugcugagauacauaca

SEQ ID NO: 714514 - RNA, 13 nt, Homo sapiens
acuggaaucagcu

SEQ ID NO: 714515 - RNA, 12 nt, Homo sapiens
acugucaaguca

SEQ ID NO: 714516 - RNA, 20 nt, Homo sapiens
acugucaagucaugauggag

SEQ ID NO: 714517 - RNA, 20 nt, Homo sapiens
acugugccauguguuuaucc

SEQ ID NO: 714518 - RNA, 12 nt, Homo sapiens
acugugugcuca

SEQ ID NO: 714519 - RNA, 11 nt, Homo sapiens
acuuacaugau

SEQ ID NO: 714520 - RNA, 16 nt, Homo sapiens
acuuaguguacaugaa

SEQ ID NO: 714521 - RNA, 18 nt, Homo sapiens
acuuaugaaccuuuacau

SEQ ID NO: 714522 - RNA, 16 nt, Homo sapiens
acuuauuaacaauuag

SEQ ID NO: 714523 - RNA, 16 nt, Homo sapiens
acuucccacggcuccu

SEQ ID NO: 714524 - RNA, 19 nt, Homo sapiens
acuucguguccgacucuuc

SEQ ID NO: 714525 - RNA, 22 nt, Homo sapiens
acuugaacugauucacaucuca

SEQ ID NO: 714526 - RNA, 22 nt, Homo sapiens
acuugagaccuaaucucuguaa

SEQ ID NO: 714527 - RNA, 19 nt, Homo sapiens
acuugcuuaucaacuuccu

SEQ ID NO: 714528 - RNA, 20 nt, Homo sapiens
acuuguagcauuaaacaauc

SEQ ID NO: 714529 - RNA, 14 nt, Homo sapiens
acuuuauuugccua

SEQ ID NO: 714530 - RNA, 15 nt, Homo sapiens
acuuugcacagcucu

SEQ ID NO: 714531 - RNA, 23 nt, Homo sapiens
acuuuuucuggucucuaccacug

SEQ ID NO: 714532 - RNA, 21 nt, Homo sapiens
agaaaaaauuccacaaugaaa

SEQ ID NO: 714533 - RNA, 13 nt, Homo sapiens
agaaacagugcaa

SEQ ID NO: 714534 - RNA, 15 nt, Homo sapiens
agaaauacuacugug

SEQ ID NO: 714535 - RNA, 17 nt, Homo sapiens
agaaauacuacugugua

SEQ ID NO: 714536 - RNA, 15 nt, Homo sapiens
agaacagcagacuca

SEQ ID NO: 714537 - RNA, 11 nt, Homo sapiens
agaaccaaaga

SEQ ID NO: 714538 - RNA, 14 nt, Homo sapiens
agaagguugcucua

SEQ ID NO: 714539 - RNA, 15 nt, Homo sapiens
agaauaaagucuuug

SEQ ID NO: 714540 - RNA, 15 nt, Homo sapiens
agaauacaagccacu

SEQ ID NO: 714541 - RNA, 13 nt, Homo sapiens
agaauauacuaaa

SEQ ID NO: 714542 - RNA, 17 nt, Homo sapiens
agaaucuugguuugccu

SEQ ID NO: 714543 - RNA, 19 nt, Homo sapiens
agaauguuaaaaagugaaa

SEQ ID NO: 714544 - RNA, 21 nt, Homo sapiens
agaauuauuuugugaugcaaa

SEQ ID NO: 714545 - RNA, 22 nt, Homo sapiens
agacaggguuucaccauguuag

SEQ ID NO: 714546 - RNA, 22 nt, Homo sapiens
agaccuuccagaaauacuacug

SEQ ID NO: 714547 - RNA, 23 nt, Homo sapiens
agacucaaagagggagugcauuu

SEQ ID NO: 714548 - RNA, 13 nt, Homo sapiens
agacucacugugg

SEQ ID NO: 714549 - RNA, 15 nt, Homo sapiens
agacucacuguggga

SEQ ID NO: 714550 - RNA, 15 nt, Homo sapiens
agacuugacagugga

SEQ ID NO: 714551 - RNA, 18 nt, Homo sapiens
agagacgcagacaugugc

SEQ ID NO: 714552 - RNA, 22 nt, Homo sapiens
agagagaaaaguaacuguuuug

SEQ ID NO: 714553 - RNA, 17 nt, Homo sapiens
agagaucccaaguagaa

SEQ ID NO: 714554 - RNA, 13 nt, Homo sapiens
agagccugggaag

SEQ ID NO: 714555 - RNA, 15 nt, Homo sapiens
agaggcuuccuucau

SEQ ID NO: 714556 - RNA, 13 nt, Homo sapiens
agagggagugcau

SEQ ID NO: 714557 - RNA, 17 nt, Homo sapiens
agagggcugccuuugga

SEQ ID NO: 714558 - RNA, 16 nt, Homo sapiens
agagucuuaauauaua

SEQ ID NO: 714559 - RNA, 14 nt, Homo sapiens
agagugacucacua

SEQ ID NO: 714560 - RNA, 22 nt, Homo sapiens
agagugguuaagacuacugaag

SEQ ID NO: 714561 - RNA, 23 nt, Homo sapiens
agauagauauuccuauugugcaa

SEQ ID NO: 714562 - RNA, 21 nt, Homo sapiens
agauagcaucuuauacgagua

SEQ ID NO: 714563 - RNA, 15 nt, Homo sapiens
agauaucucaucucu

SEQ ID NO: 714564 - RNA, 15 nt, Homo sapiens
agauaugugccaaag

SEQ ID NO: 714565 - RNA, 20 nt, Homo sapiens
agauuuuuuuaacgagaaaa

SEQ ID NO: 714566 - RNA, 18 nt, Homo sapiens
agcaaaacaacggaugaa

SEQ ID NO: 714567 - RNA, 17 nt, Homo sapiens
agcaaagcuccugccuc

SEQ ID NO: 714568 - RNA, 11 nt, Homo sapiens
agcaaccagag

SEQ ID NO: 714569 - RNA, 21 nt, Homo sapiens
agcaaggguugggcccagugu

SEQ ID NO: 714570 - RNA, 20 nt, Homo sapiens
agcaauugacugucacuguu

SEQ ID NO: 714571 - RNA, 20 nt, Homo sapiens
agcaccuacuuacaugcauu

SEQ ID NO: 714572 - RNA, 20 nt, Homo sapiens
agcagguuaccacucuggca

SEQ ID NO: 714573 - RNA, 17 nt, Homo sapiens
agcaucuuauacgagua

SEQ ID NO: 714574 - RNA, 16 nt, Homo sapiens
agcauucugucuugaa

SEQ ID NO: 714575 - RNA, 14 nt, Homo sapiens
agccaagcaaaaug

SEQ ID NO: 714576 - RNA, 19 nt, Homo sapiens
agccaaggagucacugaga

SEQ ID NO: 714577 - RNA, 15 nt, Homo sapiens
agccacuaccuucug

SEQ ID NO: 714578 - RNA, 16 nt, Homo sapiens
agccacuucacuuuuu

SEQ ID NO: 714579 - RNA, 13 nt, Homo sapiens
agccagaacuuga

SEQ ID NO: 714580 - RNA, 14 nt, Homo sapiens
agccagaacuugac

SEQ ID NO: 714581 - RNA, 22 nt, Homo sapiens
agccagagagugagagacauua

SEQ ID NO: 714582 - RNA, 13 nt, Homo sapiens
agccagcaaacca

SEQ ID NO: 714583 - RNA, 16 nt, Homo sapiens
agccaucaagagacug

SEQ ID NO: 714584 - RNA, 16 nt, Homo sapiens
agccccugaaagccau

SEQ ID NO: 714585 - RNA, 17 nt, Homo sapiens
agccgggagccugaccc

SEQ ID NO: 714586 - RNA, 16 nt, Homo sapiens
agccuaacuccauccc

SEQ ID NO: 714587 - RNA, 14 nt, Homo sapiens
agccucauucugag

SEQ ID NO: 714588 - RNA, 18 nt, Homo sapiens
agccuccauccuaccccc

SEQ ID NO: 714589 - RNA, 19 nt, Homo sapiens
agccugaauuuuguugcug

SEQ ID NO: 714590 - RNA, 18 nt, Homo sapiens
agccugggcaacacagug

SEQ ID NO: 714591 - RNA, 23 nt, Homo sapiens
agcuaaguugcaccaacuuugaa

SEQ ID NO: 714592 - RNA, 23 nt, Homo sapiens
agcuacguauuuaauagcaaaga

SEQ ID NO: 714593 - RNA, 21 nt, Homo sapiens
agcuacugccgucagugcugu

SEQ ID NO: 714594 - RNA, 12 nt, Homo sapiens
agcuacuugaug

SEQ ID NO: 714595 - RNA, 22 nt, Homo sapiens
agcuaugaaggcuguacacugc

SEQ ID NO: 714596 - RNA, 22 nt, Homo sapiens
agcucaacucucuuauugccuc

SEQ ID NO: 714597 - RNA, 22 nt, Homo sapiens
agcucaggaaccgaggcaggga

SEQ ID NO: 714598 - RNA, 18 nt, Homo sapiens
agcucaggacugccauug

SEQ ID NO: 714599 - RNA, 16 nt, Homo sapiens
agcugaccagccguga

SEQ ID NO: 714600 - RNA, 11 nt, Homo sapiens
agcugaucagu

SEQ ID NO: 714601 - RNA, 13 nt, Homo sapiens
agcugccugguau

SEQ ID NO: 714602 - RNA, 15 nt, Homo sapiens
agcugccuguacaca

SEQ ID NO: 714603 - RNA, 11 nt, Homo sapiens
agcugucauca

SEQ ID NO: 714604 - RNA, 20 nt, Homo sapiens
agcuuuagcuucucugccaa

SEQ ID NO: 714605 - RNA, 11 nt, Homo sapiens
aggaagcaagc

SEQ ID NO: 714606 - RNA, 22 nt, Homo sapiens
aggaaucggaauccugucgauu

SEQ ID NO: 714607 - RNA, 19 nt, Homo sapiens
aggaauuucaccuguaaac

SEQ ID NO: 714608 - RNA, 18 nt, Homo sapiens
aggagcuuuggaccuaau

SEQ ID NO: 714609 - RNA, 15 nt, Homo sapiens
aggagggcaggcauc

SEQ ID NO: 714610 - RNA, 18 nt, Homo sapiens
aggauacgacaguacacu

SEQ ID NO: 714611 - RNA, 13 nt, Homo sapiens
aggcaaaggcaau

SEQ ID NO: 714612 - RNA, 13 nt, Homo sapiens
aggcaaucugccc

SEQ ID NO: 714613 - RNA, 16 nt, Homo sapiens
aggcaccagcaaaaca

SEQ ID NO: 714614 - RNA, 16 nt, Homo sapiens
aggcacgucugcagaa

SEQ ID NO: 714615 - RNA, 15 nt, Homo sapiens
aggcagacucuuuau

SEQ ID NO: 714616 - RNA, 18 nt, Homo sapiens
aggcaggucugaagcuca

SEQ ID NO: 714617 - RNA, 18 nt, Homo sapiens
aggccaauaaaaaguuca

SEQ ID NO: 714618 - RNA, 19 nt, Homo sapiens
aggccauucuuucccaaca

SEQ ID NO: 714619 - RNA, 21 nt, Homo sapiens
aggccauugggauauucugaa

SEQ ID NO: 714620 - RNA, 19 nt, Homo sapiens
aggcccuuauuuucaagaa

SEQ ID NO: 714621 - RNA, 13 nt, Homo sapiens
aggccgcuaugca

SEQ ID NO: 714622 - RNA, 20 nt, Homo sapiens
aggccgggcacgguggcuca

SEQ ID NO: 714623 - RNA, 22 nt, Homo sapiens
aggccuccugugacuggcagca

SEQ ID NO: 714624 - RNA, 23 nt, Homo sapiens
aggcuagguggguugaaagccaa

SEQ ID NO: 714625 - RNA, 16 nt, Homo sapiens
aggcuuucucuacuga

SEQ ID NO: 714626 - RNA, 18 nt, Homo sapiens
agggccaaagaaccaaag

SEQ ID NO: 714627 - RNA, 15 nt, Homo sapiens
agggcugccuuugga

SEQ ID NO: 714628 - RNA, 21 nt, Homo sapiens
cauuguuaccucuauauacca

SEQ ID NO: 714629 - RNA, 19 nt, Homo sapiens
cauuuccucagacucuaag

SEQ ID NO: 714630 - RNA, 23 nt, Homo sapiens
cauuuccuccgucaccucagaga

SEQ ID NO: 714631 - RNA, 20 nt, Homo sapiens
cauuucucuuugcuucacag

SEQ ID NO: 714632 - RNA, 19 nt, Homo sapiens
cauuugcacagguuuucag

SEQ ID NO: 714633 - RNA, 21 nt, Homo sapiens
cauuuguuggaaugaauuaaa

SEQ ID NO: 714634 - RNA, 18 nt, Homo sapiens
cauuuuaaaagugccauu

SEQ ID NO: 714635 - RNA, 17 nt, Homo sapiens
cauuuuaacaucugaga

SEQ ID NO: 714636 - RNA, 18 nt, Homo sapiens
cauuuuaacaucugagaa

SEQ ID NO: 714637 - RNA, 14 nt, Homo sapiens
cauuuucugccuau

SEQ ID NO: 714638 - RNA, 18 nt, Homo sapiens
ccaaaauaaaaccagcuc

SEQ ID NO: 714639 - RNA, 12 nt, Homo sapiens
ccaaacuccugc

SEQ ID NO: 714640 - RNA, 14 nt, Homo sapiens
ccaaagaccaucug

SEQ ID NO: 714641 - RNA, 15 nt, Homo sapiens
ccaaagugcugcgau

SEQ ID NO: 714642 - RNA, 15 nt, Homo sapiens
ccaaccauuuccuca

SEQ ID NO: 714643 - RNA, 21 nt, Homo sapiens
ccaacuaaugccuuacucuuc

SEQ ID NO: 714644 - RNA, 20 nt, Homo sapiens
ccaagccuuggggauucuuc

SEQ ID NO: 714645 - RNA, 18 nt, Homo sapiens
ccaaggagucacugagac

SEQ ID NO: 714646 - RNA, 16 nt, Homo sapiens
ccaauaaaaaguucag

SEQ ID NO: 714647 - RNA, 20 nt, Homo sapiens
ccaauaaaaaguucagaguu

SEQ ID NO: 714648 - RNA, 16 nt, Homo sapiens
ccaauggaaugugaug

SEQ ID NO: 714649 - RNA, 22 nt, Homo sapiens
ccacaaacuguaauacaaugau

SEQ ID NO: 714650 - RNA, 17 nt, Homo sapiens
ccacacucagauccucc

SEQ ID NO: 714651 - RNA, 22 nt, Homo sapiens
ccaccuggggaguuuacuaccu

SEQ ID NO: 714652 - RNA, 22 nt, Homo sapiens
ccagaucgggagcaaaccaaag

SEQ ID NO: 714653 - RNA, 19 nt, Homo sapiens
ccagcaucgucucauguaa

SEQ ID NO: 714654 - RNA, 12 nt, Homo sapiens
ccagcuacuuga

SEQ ID NO: 714655 - RNA, 16 nt, Homo sapiens
ccaucucugauuuuca

SEQ ID NO: 714656 - RNA, 23 nt, Homo sapiens
ccaugagcuccuuaaggcucuuu

SEQ ID NO: 714657 - RNA, 21 nt, Homo sapiens
ccaugcguguuucugacucug

SEQ ID NO: 714658 - RNA, 15 nt, Homo sapiens
ccaugggaccacaac

SEQ ID NO: 714659 - RNA, 19 nt, Homo sapiens
cccaggcuggagugcagug

SEQ ID NO: 714660 - RNA, 19 nt, Homo sapiens
cccaguaacucaucuguca

SEQ ID NO: 714661 - RNA, 13 nt, Homo sapiens
cccaucuuuccuc

SEQ ID NO: 714662 - RNA, 20 nt, Homo sapiens
ccccaacuacccccagcugu

SEQ ID NO: 714663 - RNA, 10 nt, Homo sapiens
ccccagcugu

SEQ ID NO: 714664 - RNA, 14 nt, Homo sapiens
ccccccagcuguca

SEQ ID NO: 714665 - RNA, 13 nt, Homo sapiens
cccccucccugga

SEQ ID NO: 714666 - RNA, 17 nt, Homo sapiens
cccccugaacacuguga

SEQ ID NO: 714667 - RNA, 22 nt, Homo sapiens
ccccuaaguuuuauacuugauu

SEQ ID NO: 714668 - RNA, 19 nt, Homo sapiens
ccccuggaacugucucuca

SEQ ID NO: 714669 - RNA, 18 nt, Homo sapiens
ccccuggguaacugucaa

SEQ ID NO: 714670 - RNA, 13 nt, Homo sapiens
cccuaaguuuuau

SEQ ID NO: 714671 - RNA, 21 nt, Homo sapiens
cccuacugaagcccuugugaa

SEQ ID NO: 714672 - RNA, 17 nt, Homo sapiens
cccuagucuuuuaaaca

SEQ ID NO: 714673 - RNA, 23 nt, Homo sapiens
cccucccuggaugacauuaaaga

SEQ ID NO: 714674 - RNA, 22 nt, Homo sapiens
cccugagcccaaggcacugaga

SEQ ID NO: 714675 - RNA, 15 nt, Homo sapiens
cccugccucaagaaa

SEQ ID NO: 714676 - RNA, 16 nt, Homo sapiens
cccugccucucugcag

SEQ ID NO: 714677 - RNA, 21 nt, Homo sapiens
cccuggaugacauuaaagaag

SEQ ID NO: 714678 - RNA, 11 nt, Homo sapiens
cccuguugcuu

SEQ ID NO: 714679 - RNA, 18 nt, Homo sapiens
cccuguugcuuuucacaa

SEQ ID NO: 714680 - RNA, 15 nt, Homo sapiens
cccuucgcguauuuc

SEQ ID NO: 714681 - RNA, 22 nt, Homo sapiens
ccgucaccucagagacauacac

SEQ ID NO: 714682 - RNA, 19 nt, Homo sapiens
ccuaaguuuuauacuugau

SEQ ID NO: 714683 - RNA, 20 nt, Homo sapiens
ccuaauuaagggacauguau

SEQ ID NO: 714684 - RNA, 17 nt, Homo sapiens
ccuacuuacaugcauua

SEQ ID NO: 714685 - RNA, 20 nt, Homo sapiens
ccuagucuuuuaaacaguuu

SEQ ID NO: 714686 - RNA, 20 nt, Homo sapiens
ccuaucagaguugcugcaaa

SEQ ID NO: 714687 - RNA, 16 nt, Homo sapiens
ccuauuuuuggaagag

SEQ ID NO: 714688 - RNA, 20 nt, Homo sapiens
ccucaaaaaauugcacauag

SEQ ID NO: 714689 - RNA, 14 nt, Homo sapiens
ccucacuucaggua

SEQ ID NO: 714690 - RNA, 15 nt, Homo sapiens
ccucagcuagcucug

SEQ ID NO: 714691 - RNA, 19 nt, Homo sapiens
ccucagcuagcucugccaa

SEQ ID NO: 714692 - RNA, 16 nt, Homo sapiens
ccuccaccuccugggu

SEQ ID NO: 714693 - RNA, 19 nt, Homo sapiens
ccucccuggaugacauuaa

SEQ ID NO: 714694 - RNA, 16 nt, Homo sapiens
ccuccuggcugucuga

SEQ ID NO: 714695 - RNA, 13 nt, Homo sapiens
ccucuccacucau

SEQ ID NO: 714696 - RNA, 14 nt, Homo sapiens
ccugaacacuguga

SEQ ID NO: 714697 - RNA, 13 nt, Homo sapiens
ccugacauguccu

SEQ ID NO: 714698 - RNA, 14 nt, Homo sapiens
ccugcucccacaga

SEQ ID NO: 714699 - RNA, 12 nt, Homo sapiens
ccuggacugugu

SEQ ID NO: 714700 - RNA, 16 nt, Homo sapiens
ccuggaugacauuaaa

SEQ ID NO: 714701 - RNA, 15 nt, Homo sapiens
ccugguauauccaaa

SEQ ID NO: 714702 - RNA, 17 nt, Homo sapiens
ccugucgauuagacugg

SEQ ID NO: 714703 - RNA, 13 nt, Homo sapiens
ccugugacuggca

SEQ ID NO: 714704 - RNA, 18 nt, Homo sapiens
ccuguugagcaucacaga

SEQ ID NO: 714705 - RNA, 12 nt, Homo sapiens
ccuguugggaga

SEQ ID NO: 714706 - RNA, 13 nt, Homo sapiens
ccuguugggagag

SEQ ID NO: 714707 - RNA, 18 nt, Homo sapiens
ccuuccuugaacugucua

SEQ ID NO: 714708 - RNA, 16 nt, Homo sapiens
ccuugccuagcccuuu

SEQ ID NO: 714709 - RNA, 15 nt, Homo sapiens
ccuuuacauccagau

SEQ ID NO: 714710 - RNA, 20 nt, Homo sapiens
ccuuuauuaaaaacugagug

SEQ ID NO: 714711 - RNA, 16 nt, Homo sapiens
ccuuucuucaccaaau

SEQ ID NO: 714712 - RNA, 22 nt, Homo sapiens
cgaauggaagaggcaccugucc

SEQ ID NO: 714713 - RNA, 14 nt, Homo sapiens
cgccagacuuccca

SEQ ID NO: 714714 - RNA, 15 nt, Homo sapiens
cgggacaccuaggcu

SEQ ID NO: 714715 - RNA, 18 nt, Homo sapiens
cgggagccugacccucau

SEQ ID NO: 714716 - RNA, 17 nt, Homo sapiens
cgugacacaaacacaca

SEQ ID NO: 714717 - RNA, 14 nt, Homo sapiens
cgugaccagcagua

SEQ ID NO: 714718 - RNA, 16 nt, Homo sapiens
cgugaccagugcugcu

SEQ ID NO: 714719 - RNA, 22 nt, Homo sapiens
cgugugggagaccggccugcca

SEQ ID NO: 714720 - RNA, 17 nt, Homo sapiens
cuaaaggaugaacaugu

SEQ ID NO: 714721 - RNA, 22 nt, Homo sapiens
cuaaccugccgagaguccauca

SEQ ID NO: 714722 - RNA, 13 nt, Homo sapiens
cuaaguaaauaca

SEQ ID NO: 714723 - RNA, 21 nt, Homo sapiens
cuaauuuauccugaaauuuca

SEQ ID NO: 714724 - RNA, 13 nt, Homo sapiens
cuacaccuguugc

SEQ ID NO: 714725 - RNA, 22 nt, Homo sapiens
cuacagagucuggugaagcuca

SEQ ID NO: 714726 - RNA, 23 nt, Homo sapiens
cuacauuaguacacagcaccaga

SEQ ID NO: 714727 - RNA, 19 nt, Homo sapiens
cuaccaggcacgucugcag

SEQ ID NO: 714728 - RNA, 21 nt, Homo sapiens
cuacccccugugccuugucac

SEQ ID NO: 714729 - RNA, 15 nt, Homo sapiens
cuacugaagcccuug

SEQ ID NO: 714730 - RNA, 12 nt, Homo sapiens
cuacuugagaua

SEQ ID NO: 714731 - RNA, 14 nt, Homo sapiens
cuacuugggagcac

SEQ ID NO: 714732 - RNA, 20 nt, Homo sapiens
cuacuuuauuugccuaaaua

SEQ ID NO: 714733 - RNA, 19 nt, Homo sapiens
cuagagcaagcaggaauca

SEQ ID NO: 714734 - RNA, 15 nt, Homo sapiens
cuagcugugaccucu

SEQ ID NO: 714735 - RNA, 16 nt, Homo sapiens
cuaggauuuuaaggga

SEQ ID NO: 714736 - RNA, 23 nt, Homo sapiens
cuagguggguugaaagccaagga

SEQ ID NO: 714737 - RNA, 15 nt, Homo sapiens
cuagucauaaccuua

SEQ ID NO: 714738 - RNA, 13 nt, Homo sapiens
cuaguucugccag

SEQ ID NO: 714739 - RNA, 23 nt, Homo sapiens
cuauaguuauuaaguucuuuaaa

SEQ ID NO: 714740 - RNA, 18 nt, Homo sapiens
cuauauaauucucugucu

SEQ ID NO: 714741 - RNA, 18 nt, Homo sapiens
cuauauaccaaagcacau

SEQ ID NO: 714742 - RNA, 21 nt, Homo sapiens
cuaugcaggguagcacuggga

SEQ ID NO: 714743 - RNA, 14 nt, Homo sapiens
cuauggugcucugu

SEQ ID NO: 714744 - RNA, 18 nt, Homo sapiens
cuaugucauuucauuucc

SEQ ID NO: 714745 - RNA, 19 nt, Homo sapiens
cuauuaccuguuaguauua

SEQ ID NO: 714746 - RNA, 22 nt, Homo sapiens
cuauuccauggcuaacuggcga

SEQ ID NO: 714747 - RNA, 13 nt, Homo sapiens
cuauuugaagugu

SEQ ID NO: 714748 - RNA, 22 nt, Homo sapiens
cucaaacuccugaccucaggca

SEQ ID NO: 714749 - RNA, 23 nt, Homo sapiens
cucaacauuguguucccauuuca

SEQ ID NO: 714750 - RNA, 14 nt, Homo sapiens
cucaacuaacucca

SEQ ID NO: 714751 - RNA, 14 nt, Homo sapiens
cucaagggcuuuau

SEQ ID NO: 714752 - RNA, 18 nt, Homo sapiens
cucacaaaccaugcaaau

SEQ ID NO: 714753 - RNA, 23 nt, Homo sapiens
cucacccccagcuuugcuaccaa

SEQ ID NO: 714754 - RNA, 13 nt, Homo sapiens
cucacuucaggua

SEQ ID NO: 714755 - RNA, 14 nt, Homo sapiens
cucagcccuagccc

SEQ ID NO: 714756 - RNA, 13 nt, Homo sapiens
cucagcuagcucu

SEQ ID NO: 714757 - RNA, 15 nt, Homo sapiens
cucaggaugagggaa

SEQ ID NO: 714758 - RNA, 16 nt, Homo sapiens
agugacuaauggcaug

SEQ ID NO: 714759 - RNA, 21 nt, Homo sapiens
agugacucacuaauucauuaa

SEQ ID NO: 714760 - RNA, 17 nt, Homo sapiens
agugacuucacagagac

SEQ ID NO: 714761 - RNA, 15 nt, Homo sapiens
agugcugaccagaca

SEQ ID NO: 714762 - RNA, 16 nt, Homo sapiens
aguggauuacugccau

SEQ ID NO: 714763 - RNA, 17 nt, Homo sapiens
aguucugggcccagcgc

SEQ ID NO: 714764 - RNA, 22 nt, Homo sapiens
aguucuuuaaaauguaaagcca

SEQ ID NO: 714765 - RNA, 20 nt, Homo sapiens
aguuguuccuuaagucagaa

SEQ ID NO: 714766 - RNA, 18 nt, Homo sapiens
aguuuaugcauacaguaa

SEQ ID NO: 714767 - RNA, 18 nt, Homo sapiens
aguuuccucuacugcaaa

SEQ ID NO: 714768 - RNA, 19 nt, Homo sapiens
aguuuugucuuugcuguaa

SEQ ID NO: 714769 - RNA, 14 nt, Homo sapiens
auaaaaaacauaau

SEQ ID NO: 714770 - RNA, 12 nt, Homo sapiens
auaaaaccucag

SEQ ID NO: 714771 - RNA, 17 nt, Homo sapiens
auaaaagcacuuacuuc

SEQ ID NO: 714772 - RNA, 20 nt, Homo sapiens
auaaacaaauaacaaugugc

SEQ ID NO: 714773 - RNA, 16 nt, Homo sapiens
auaacuugagaccuaa

SEQ ID NO: 714774 - RNA, 15 nt, Homo sapiens
auaagaggauaugaa

SEQ ID NO: 714775 - RNA, 23 nt, Homo sapiens
auaagaucuuuuauuuugccaag

SEQ ID NO: 714776 - RNA, 19 nt, Homo sapiens
auaagguaaaaugccauga

SEQ ID NO: 714777 - RNA, 14 nt, Homo sapiens
auaauucuaugaga

SEQ ID NO: 714778 - RNA, 23 nt, Homo sapiens
auaauuuucuaccuggucucucc

SEQ ID NO: 714779 - RNA, 19 nt, Homo sapiens
auaccaccagacugcaaug

SEQ ID NO: 714780 - RNA, 17 nt, Homo sapiens
auaccauauacagcuca

SEQ ID NO: 714781 - RNA, 20 nt, Homo sapiens
auacccagucccagaaccac

SEQ ID NO: 714782 - RNA, 20 nt, Homo sapiens
auacggcucuaacagauuag

SEQ ID NO: 714783 - RNA, 17 nt, Homo sapiens
auacuguacauagcugu

SEQ ID NO: 714784 - RNA, 18 nt, Homo sapiens
auagaauccaguuugcaa

SEQ ID NO: 714785 - RNA, 10 nt, Homo sapiens
auagaauuau

SEQ ID NO: 714786 - RNA, 14 nt, Homo sapiens
auagcuguuugaaa

SEQ ID NO: 714787 - RNA, 23 nt, Homo sapiens
auaguagaacgcuaucugggaag

SEQ ID NO: 714788 - RNA, 20 nt, Homo sapiens
auaguauucaugacuaugga

SEQ ID NO: 714789 - RNA, 11 nt, Homo sapiens
auaguuuccaa

SEQ ID NO: 714790 - RNA, 17 nt, Homo sapiens
auaguuugcuguugcau

SEQ ID NO: 714791 - RNA, 16 nt, Homo sapiens
auauaccaaagcacau

SEQ ID NO: 714792 - RNA, 16 nt, Homo sapiens
auauccagauggcaug

SEQ ID NO: 714793 - RNA, 17 nt, Homo sapiens
auaugaagaacugagga

SEQ ID NO: 714794 - RNA, 17 nt, Homo sapiens
auaugacacucuaguca

SEQ ID NO: 714795 - RNA, 13 nt, Homo sapiens
auaugugccaaag

SEQ ID NO: 714796 - RNA, 16 nt, Homo sapiens
auauugugauucugcc

SEQ ID NO: 714797 - RNA, 14 nt, Homo sapiens
auauuuucugugcc

SEQ ID NO: 714798 - RNA, 23 nt, Homo sapiens
auauuuuuuaugaaacauuacag

SEQ ID NO: 714799 - RNA, 16 nt, Homo sapiens
aucaaccaaacaaaga

SEQ ID NO: 714800 - RNA, 14 nt, Homo sapiens
aucaaccaaaugga

SEQ ID NO: 714801 - RNA, 15 nt, Homo sapiens
aucaagucuguuuac

SEQ ID NO: 714802 - RNA, 16 nt, Homo sapiens
aucacaucacacaaaa

SEQ ID NO: 714803 - RNA, 20 nt, Homo sapiens
aucacugauagaauccaguu

SEQ ID NO: 714804 - RNA, 20 nt, Homo sapiens
aucacuuucucaguuuucau

SEQ ID NO: 714805 - RNA, 12 nt, Homo sapiens
aucagaguugcu

SEQ ID NO: 714806 - RNA, 19 nt, Homo sapiens
auccagauagguuaccagu

SEQ ID NO: 714807 - RNA, 21 nt, Homo sapiens
aucccacugggagcacuuugu

SEQ ID NO: 714808 - RNA, 15 nt, Homo sapiens
aucccuccaucucaa

SEQ ID NO: 714809 - RNA, 15 nt, Homo sapiens
auccuccuaccucca

SEQ ID NO: 714810 - RNA, 19 nt, Homo sapiens
auccuccuaccuccaaagc

SEQ ID NO: 714811 - RNA, 16 nt, Homo sapiens
aucucuagagugagaa

SEQ ID NO: 714812 - RNA, 19 nt, Homo sapiens
aucucuagagugagaaucu

SEQ ID NO: 714813 - RNA, 19 nt, Homo sapiens
aucucuucuuuuaaaccau

SEQ ID NO: 714814 - RNA, 19 nt, Homo sapiens
aucugagaaaagcuuugaa

SEQ ID NO: 714815 - RNA, 21 nt, Homo sapiens
aucuuucuuccaaacaggcuc

SEQ ID NO: 714816 - RNA, 15 nt, Homo sapiens
augaaacaaacugga

SEQ ID NO: 714817 - RNA, 23 nt, Homo sapiens
augaaccugcccugcucccacag

SEQ ID NO: 714818 - RNA, 20 nt, Homo sapiens
augacaucacuuguacaaaa

SEQ ID NO: 714819 - RNA, 17 nt, Homo sapiens
augacuggucucuggcu

SEQ ID NO: 714820 - RNA, 22 nt, Homo sapiens
augacuguuuuucggacaguuu

SEQ ID NO: 714821 - RNA, 22 nt, Homo sapiens
augaggacuugugucucugugc

SEQ ID NO: 714822 - RNA, 16 nt, Homo sapiens
augagggaacugugua

SEQ ID NO: 714823 - RNA, 15 nt, Homo sapiens
augauaaaagcacuu

SEQ ID NO: 714824 - RNA, 17 nt, Homo sapiens
augauaaaagcacuuac

SEQ ID NO: 714825 - RNA, 15 nt, Homo sapiens
augcaaaucaauuac

SEQ ID NO: 714826 - RNA, 20 nt, Homo sapiens
augccagaaugacuucugac

SEQ ID NO: 714827 - RNA, 13 nt, Homo sapiens
augccuccagcua

SEQ ID NO: 714828 - RNA, 20 nt, Homo sapiens
augcuaucaaauaacuaagg

SEQ ID NO: 714829 - RNA, 21 nt, Homo sapiens
auggaagaggcaccuguccca

SEQ ID NO: 714830 - RNA, 18 nt, Homo sapiens
auggcuuuuagcauuuau

SEQ ID NO: 714831 - RNA, 15 nt, Homo sapiens
augggaugaugauuc

SEQ ID NO: 714832 - RNA, 19 nt, Homo sapiens
augguaauaaaacaaguua

SEQ ID NO: 714833 - RNA, 22 nt, Homo sapiens
augguaauaaaacaaguuauuc

SEQ ID NO: 714834 - RNA, 16 nt, Homo sapiens
augguaauuguugcua

SEQ ID NO: 714835 - RNA, 21 nt, Homo sapiens
augguuuucuccaagagcuac

SEQ ID NO: 714836 - RNA, 20 nt, Homo sapiens
augucauuuugguacuuugg

SEQ ID NO: 714837 - RNA, 15 nt, Homo sapiens
augucuauucagcuu

SEQ ID NO: 714838 - RNA, 16 nt, Homo sapiens
auguguggcauuuuca

SEQ ID NO: 714839 - RNA, 12 nt, Homo sapiens
auguuagccuca

SEQ ID NO: 714840 - RNA, 17 nt, Homo sapiens
auuaaaaaugcauauac

SEQ ID NO: 714841 - RNA, 17 nt, Homo sapiens
auuaaaagucacucuga

SEQ ID NO: 714842 - RNA, 16 nt, Homo sapiens
auuaagauacacuccu

SEQ ID NO: 714843 - RNA, 13 nt, Homo sapiens
auuaaucugccuc

SEQ ID NO: 714844 - RNA, 13 nt, Homo sapiens
auuacacucugua

SEQ ID NO: 714845 - RNA, 13 nt, Homo sapiens
auuacagguguga

SEQ ID NO: 714846 - RNA, 21 nt, Homo sapiens
auuaccaaccuguuaccuacu

SEQ ID NO: 714847 - RNA, 17 nt, Homo sapiens
auuacuauaagaacuuu

SEQ ID NO: 714848 - RNA, 18 nt, Homo sapiens
auuacugcaugcacuucu

SEQ ID NO: 714849 - RNA, 20 nt, Homo sapiens
auuacugcaugcacuucuua

SEQ ID NO: 714850 - RNA, 22 nt, Homo sapiens
auuagacuggaacuugaacuga

SEQ ID NO: 714851 - RNA, 19 nt, Homo sapiens
auuagcaauugacugucac

SEQ ID NO: 714852 - RNA, 19 nt, Homo sapiens
auuaggacuuuuauuguga

SEQ ID NO: 714853 - RNA, 20 nt, Homo sapiens
auuauaucugaggcacugau

SEQ ID NO: 714854 - RNA, 17 nt, Homo sapiens
auuaucuuuucauacau

SEQ ID NO: 714855 - RNA, 13 nt, Homo sapiens
auuauuagucugu

SEQ ID NO: 714856 - RNA, 12 nt, Homo sapiens
auuauuguugca

SEQ ID NO: 714857 - RNA, 18 nt, Homo sapiens
auucaacaaacauuugcu

SEQ ID NO: 714858 - RNA, 15 nt, Homo sapiens
auucacccagaggga

SEQ ID NO: 714859 - RNA, 21 nt, Homo sapiens
auuccucaaaaaauugcacau

SEQ ID NO: 714860 - RNA, 15 nt, Homo sapiens
auucucuugccucaa

SEQ ID NO: 714861 - RNA, 18 nt, Homo sapiens
auucugauucgaaugaca

SEQ ID NO: 714862 - RNA, 16 nt, Homo sapiens
auugaaguauuuugcu

SEQ ID NO: 714863 - RNA, 13 nt, Homo sapiens
auugaauuaucuu

SEQ ID NO: 714864 - RNA, 18 nt, Homo sapiens
auugaucgacuugccaaa

SEQ ID NO: 714865 - RNA, 18 nt, Homo sapiens
auugauuucaacagaauc

SEQ ID NO: 714866 - RNA, 19 nt, Homo sapiens
auugccuccuuauuuauca

SEQ ID NO: 714867 - RNA, 17 nt, Homo sapiens
auuguaacuuaugaacc

SEQ ID NO: 714868 - RNA, 19 nt, Homo sapiens
auuguauuauuagucuguu

SEQ ID NO: 714869 - RNA, 18 nt, Homo sapiens
auuguuguuaauaggucu

SEQ ID NO: 714870 - RNA, 15 nt, Homo sapiens
auuuauuauuaacau

SEQ ID NO: 714871 - RNA, 15 nt, Homo sapiens
auuucagcugaucag

SEQ ID NO: 714872 - RNA, 15 nt, Homo sapiens
auuucuacuuugaua

SEQ ID NO: 714873 - RNA, 21 nt, Homo sapiens
auuucuacuuugauaaaguaa

SEQ ID NO: 714874 - RNA, 20 nt, Homo sapiens
auuucuuaaacacuugcaac

SEQ ID NO: 714875 - RNA, 20 nt, Homo sapiens
auuugggggacuuacaugau

SEQ ID NO: 714876 - RNA, 16 nt, Homo sapiens
auuuuaaguaauuuca

SEQ ID NO: 714877 - RNA, 18 nt, Homo sapiens
auuuuaaguaauuucaga

SEQ ID NO: 714878 - RNA, 16 nt, Homo sapiens
auuuuugcugagacua

SEQ ID NO: 714879 - RNA, 13 nt, Homo sapiens
auuuuuggaagag

SEQ ID NO: 714880 - RNA, 18 nt, Homo sapiens
caaaacagauuguuugca

SEQ ID NO: 714881 - RNA, 15 nt, Homo sapiens
caaaacugcauuuca

SEQ ID NO: 714882 - RNA, 23 nt, Homo sapiens
caaaagcgaaacacacaaaccag

SEQ ID NO: 714883 - RNA, 13 nt, Homo sapiens
caaaauucaccca

SEQ ID NO: 714884 - RNA, 23 nt, Homo sapiens
caaacaccuccuagcaagaccug

SEQ ID NO: 714885 - RNA, 16 nt, Homo sapiens
caaacuccugaccuca

SEQ ID NO: 714886 - RNA, 15 nt, Homo sapiens
caaacugaggaauuu

SEQ ID NO: 714887 - RNA, 23 nt, Homo sapiens
caaagaaaaaauuccacaaugaa

SEQ ID NO: 714888 - RNA, 14 nt, Homo sapiens
caaagaaccaaaga

SEQ ID NO: 714889 - RNA, 14 nt, Homo sapiens
caaagagguauuua

SEQ ID NO: 714890 - RNA, 12 nt, Homo sapiens
caaagugcaagg

SEQ ID NO: 714891 - RNA, 15 nt, Homo sapiens
caaauagucuaucaa

SEQ ID NO: 714892 - RNA, 16 nt, Homo sapiens
caaauaucuugaaagg

SEQ ID NO: 714893 - RNA, 17 nt, Homo sapiens
caaauauuauucuuaau

SEQ ID NO: 714894 - RNA, 18 nt, Homo sapiens
caaaugggaaaaccagac

SEQ ID NO: 714895 - RNA, 20 nt, Homo sapiens
caacaucuuuuuccucccuu

SEQ ID NO: 714896 - RNA, 11 nt, Homo sapiens
caacauugugu

SEQ ID NO: 714897 - RNA, 13 nt, Homo sapiens
caaccaaauggag

SEQ ID NO: 714898 - RNA, 17 nt, Homo sapiens
caaccaauggaauguga

SEQ ID NO: 714899 - RNA, 18 nt, Homo sapiens
caaccaauggaaugugau

SEQ ID NO: 714900 - RNA, 14 nt, Homo sapiens
caacuaaugccuua

SEQ ID NO: 714901 - RNA, 19 nt, Homo sapiens
caacuuccuaaauauuaug

SEQ ID NO: 714902 - RNA, 18 nt, Homo sapiens
caacuuuuccuuugaauc

SEQ ID NO: 714903 - RNA, 19 nt, Homo sapiens
caagaaaauaagagcucag

SEQ ID NO: 714904 - RNA, 14 nt, Homo sapiens
caagagacugaguc

SEQ ID NO: 714905 - RNA, 21 nt, Homo sapiens
caagcauucagaagaaaaaga

SEQ ID NO: 714906 - RNA, 17 nt, Homo sapiens
caagcugugacccucaa

SEQ ID NO: 714907 - RNA, 14 nt, Homo sapiens
caaggucuuugguu

SEQ ID NO: 714908 - RNA, 22 nt, Homo sapiens
caaguuagaaaacauaaucuuc

SEQ ID NO: 714909 - RNA, 19 nt, Homo sapiens
caauaauucuaugagauag

SEQ ID NO: 714910 - RNA, 17 nt, Homo sapiens
caaucuguccuguuaca

SEQ ID NO: 714911 - RNA, 13 nt, Homo sapiens
caauggaauguga

SEQ ID NO: 714912 - RNA, 19 nt, Homo sapiens
caauucaaaacauugugcc

SEQ ID NO: 714913 - RNA, 18 nt, Homo sapiens
cacaaaucaugguaauaa

SEQ ID NO: 714914 - RNA, 15 nt, Homo sapiens
cacaaauuaguugua

SEQ ID NO: 714915 - RNA, 13 nt, Homo sapiens
cacagcuaugaag

SEQ ID NO: 714916 - RNA, 24 nt, Homo sapiens
cacagcuaugaaggcuguacacug

SEQ ID NO: 714917 - RNA, 16 nt, Homo sapiens
cacagguuuucagcaa

SEQ ID NO: 714918 - RNA, 19 nt, Homo sapiens
cacauguaucuaugcauuu

SEQ ID NO: 714919 - RNA, 20 nt, Homo sapiens
caccaugucaaggguucaag

SEQ ID NO: 714920 - RNA, 14 nt, Homo sapiens
cacccaauguuuga

SEQ ID NO: 714921 - RNA, 18 nt, Homo sapiens
caccuacuuacaugcauu

SEQ ID NO: 714922 - RNA, 16 nt, Homo sapiens
caccuaugucauuuca

SEQ ID NO: 714923 - RNA, 20 nt, Homo sapiens
caccucagagacauacaccu

SEQ ID NO: 714924 - RNA, 14 nt, Homo sapiens
caccugacaugucc

SEQ ID NO: 714925 - RNA, 16 nt, Homo sapiens
caccuguugcaccuca

SEQ ID NO: 714926 - RNA, 16 nt, Homo sapiens
cacgccuguaauccca

SEQ ID NO: 714927 - RNA, 19 nt, Homo sapiens
cacuaccuucugaccuccc

SEQ ID NO: 714928 - RNA, 19 nt, Homo sapiens
cacucaaggcggugcuuga

SEQ ID NO: 714929 - RNA, 16 nt, Homo sapiens
cacugaccugccugua

SEQ ID NO: 714930 - RNA, 14 nt, Homo sapiens
cacuguauaccccg

SEQ ID NO: 714931 - RNA, 19 nt, Homo sapiens
cacuguauaccccgugaag

SEQ ID NO: 714932 - RNA, 19 nt, Homo sapiens
cacuguguuuuuuuguaua

SEQ ID NO: 714933 - RNA, 16 nt, Homo sapiens
cacuugaagaugcugc

SEQ ID NO: 714934 - RNA, 15 nt, Homo sapiens
cacuugguaauugua

SEQ ID NO: 714935 - RNA, 18 nt, Homo sapiens
cagaaacaaaaacacuaa

SEQ ID NO: 714936 - RNA, 17 nt, Homo sapiens
cagaaagguuaguauca

SEQ ID NO: 714937 - RNA, 19 nt, Homo sapiens
cagaaauacuacuguguaa

SEQ ID NO: 714938 - RNA, 20 nt, Homo sapiens
cagaaaugauuacuaaggaa

SEQ ID NO: 714939 - RNA, 15 nt, Homo sapiens
cagaaauuguaucuu

SEQ ID NO: 714940 - RNA, 18 nt, Homo sapiens
cagaaccccuacaugaaa

SEQ ID NO: 714941 - RNA, 14 nt, Homo sapiens
cagaauauacuaaa

SEQ ID NO: 714942 - RNA, 14 nt, Homo sapiens
cagaaugagaccaa

SEQ ID NO: 714943 - RNA, 18 nt, Homo sapiens
cagaaugcucuacuucuu

SEQ ID NO: 714944 - RNA, 21 nt, Homo sapiens
cagaauuuaugacuccacugu

SEQ ID NO: 714945 - RNA, 20 nt, Homo sapiens
cagacacuggcauggauaua

SEQ ID NO: 714946 - RNA, 20 nt, Homo sapiens
cagagacauacaccuauguc

SEQ ID NO: 714947 - RNA, 22 nt, Homo sapiens
cagagacauacaccuaugucau

SEQ ID NO: 714948 - RNA, 14 nt, Homo sapiens
cagagcacuguaua

SEQ ID NO: 714949 - RNA, 15 nt, Homo sapiens
cagagcacuguauac

SEQ ID NO: 714950 - RNA, 16 nt, Homo sapiens
cagagcacuguauacc

SEQ ID NO: 714951 - RNA, 22 nt, Homo sapiens
cagauagcaucuuauacgagua

SEQ ID NO: 714952 - RNA, 13 nt, Homo sapiens
cagauccuccuca

SEQ ID NO: 714953 - RNA, 20 nt, Homo sapiens
cagauccuccucauucacau

SEQ ID NO: 714954 - RNA, 19 nt, Homo sapiens
cagauuuuuacacauguau

SEQ ID NO: 714955 - RNA, 15 nt, Homo sapiens
cagcagaaagguuag

SEQ ID NO: 714956 - RNA, 20 nt, Homo sapiens
cagcagaaagguuaguauca

SEQ ID NO: 714957 - RNA, 24 nt, Homo sapiens
cagcagaaagguuaguaucaucag

SEQ ID NO: 714958 - RNA, 19 nt, Homo sapiens
cagcauugacucuguggcu

SEQ ID NO: 714959 - RNA, 22 nt, Homo sapiens
cagccagaucgggagcaaacca

SEQ ID NO: 714960 - RNA, 21 nt, Homo sapiens
cagccaucaagagacugaguc

SEQ ID NO: 714961 - RNA, 20 nt, Homo sapiens
cagccucugggggguggcca

SEQ ID NO: 714962 - RNA, 21 nt, Homo sapiens
cagccugcagacucacugugg

SEQ ID NO: 714963 - RNA, 16 nt, Homo sapiens
cagcuagcucugccaa

SEQ ID NO: 714964 - RNA, 11 nt, Homo sapiens
cagcugucauc

SEQ ID NO: 714965 - RNA, 16 nt, Homo sapiens
caggaaggacuaugaa

SEQ ID NO: 714966 - RNA, 18 nt, Homo sapiens
caggacugccauuggacu

SEQ ID NO: 714967 - RNA, 13 nt, Homo sapiens
caggaggccaaua

SEQ ID NO: 714968 - RNA, 14 nt, Homo sapiens
caggauaccauaua

SEQ ID NO: 714969 - RNA, 22 nt, Homo sapiens
caggauucuccuuuuuaccccu

SEQ ID NO: 714970 - RNA, 18 nt, Homo sapiens
caggcaacgcacaaaaca

SEQ ID NO: 714971 - RNA, 19 nt, Homo sapiens
caggcagccucuggggggu

SEQ ID NO: 714972 - RNA, 20 nt, Homo sapiens
caggcgugagccaccaugcc

SEQ ID NO: 714973 - RNA, 13 nt, Homo sapiens
cagguacuuguaa

SEQ ID NO: 714974 - RNA, 13 nt, Homo sapiens
cagguauaccuca

SEQ ID NO: 714975 - RNA, 17 nt, Homo sapiens
cagguccucaguguccu

SEQ ID NO: 714976 - RNA, 22 nt, Homo sapiens
caguaaagcacuugcaaccguc

SEQ ID NO: 714977 - RNA, 17 nt, Homo sapiens
caguaacucaucuguca

SEQ ID NO: 714978 - RNA, 15 nt, Homo sapiens
caguauccaguacuc

SEQ ID NO: 714979 - RNA, 10 nt, Homo sapiens
cagugacacc

SEQ ID NO: 714980 - RNA, 19 nt, Homo sapiens
caguuaaaccagcuacuca

SEQ ID NO: 714981 - RNA, 17 nt, Homo sapiens
cauaaaauagagugcau

SEQ ID NO: 714982 - RNA, 18 nt, Homo sapiens
cauaaaauagagugcauu

SEQ ID NO: 714983 - RNA, 19 nt, Homo sapiens
cauaaaggcauggcauuug

SEQ ID NO: 714984 - RNA, 20 nt, Homo sapiens
cauaacugaaaaugugcuau

SEQ ID NO: 714985 - RNA, 21 nt, Homo sapiens
cauacaccuaugucauuucau

SEQ ID NO: 714986 - RNA, 15 nt, Homo sapiens
cauacagauuugcaa

SEQ ID NO: 714987 - RNA, 14 nt, Homo sapiens
caucaggcuuucuu

SEQ ID NO: 714988 - RNA, 21 nt, Homo sapiens
caucauucauuuuuguuguug

SEQ ID NO: 714989 - RNA, 21 nt, Homo sapiens
cauccagagucccugccugga

SEQ ID NO: 714990 - RNA, 17 nt, Homo sapiens
cauccaguucaugagaa

SEQ ID NO: 714991 - RNA, 15 nt, Homo sapiens
caucccuccaucuca

SEQ ID NO: 714992 - RNA, 15 nt, Homo sapiens
caucccuggaaggac

SEQ ID NO: 714993 - RNA, 19 nt, Homo sapiens
caucgucucauguaaaaua

SEQ ID NO: 714994 - RNA, 19 nt, Homo sapiens
caucuagaggcuuccuuca

SEQ ID NO: 714995 - RNA, 20 nt, Homo sapiens
caucuagaggcuuccuucau

SEQ ID NO: 714996 - RNA, 13 nt, Homo sapiens
caucugauuguga

SEQ ID NO: 714997 - RNA, 13 nt, Homo sapiens
caugaaagcguaa

SEQ ID NO: 714998 - RNA, 19 nt, Homo sapiens
caugaaauggauacuuaua

SEQ ID NO: 714999 - RNA, 20 nt, Homo sapiens
caugaaccucaagcugcauc

SEQ ID NO: 715000 - RNA, 22 nt, Homo sapiens
caugaaccucaagcugcaucua

SEQ ID NO: 715001 - RNA, 13 nt, Homo sapiens
caugcacuucuua

SEQ ID NO: 715002 - RNA, 19 nt, Homo sapiens
caugcacuuggcugcauaa

SEQ ID NO: 715003 - RNA, 20 nt, Homo sapiens
caugcacuuggcugcauaaa

SEQ ID NO: 715004 - RNA, 18 nt, Homo sapiens
caugcauguccuguaaag

SEQ ID NO: 715005 - RNA, 16 nt, Homo sapiens
caugcauuacugcaug

SEQ ID NO: 715006 - RNA, 21 nt, Homo sapiens
caugguccuggaggaugacca

SEQ ID NO: 715007 - RNA, 15 nt, Homo sapiens
cauguaucuaugcau

SEQ ID NO: 715008 - RNA, 14 nt, Homo sapiens
caugugcacuugaa

SEQ ID NO: 715009 - RNA, 23 nt, Homo sapiens
cauuaaaaaugcauauacuuuaa

SEQ ID NO: 715010 - RNA, 12 nt, Homo sapiens
cauuacugcaua

SEQ ID NO: 715011 - RNA, 17 nt, Homo sapiens
cauuacugcauaaaaua

SEQ ID NO: 715012 - RNA, 15 nt, Homo sapiens
cauuacugcaugcac

SEQ ID NO: 715013 - RNA, 17 nt, Homo sapiens
cauuacuuuaauacuca

SEQ ID NO: 715014 - RNA, 19 nt, Homo sapiens
cauucaggcaacgcacaaa

SEQ ID NO: 715015 - RNA, 18 nt, Homo sapiens
cauuccagacugcuucca

SEQ ID NO: 715016 - RNA, 20 nt, Homo sapiens
cauucugauucgaaugacac

SEQ ID NO: 715017 - RNA, 20 nt, Homo sapiens
cauucuuucccaacaccucu

SEQ ID NO: 715018 - RNA, 21 nt, Homo sapiens
cauucuuucccaacaccucuu

SEQ ID NO: 715019 - RNA, 19 nt, Homo sapiens
cauugacucuguggcuuug

SEQ ID NO: 715020 - RNA, 14 nt, Homo sapiens
cauugggauauucu

SEQ ID NO: 715021 - RNA, 23 nt, Homo sapiens
cauuucagagaggccuuuuggaa

SEQ ID NO: 715022 - RNA, 18 nt, Homo sapiens
aagcauccaggcacccaa

SEQ ID NO: 715023 - RNA, 16 nt, Homo sapiens
aagccauuauucacua

SEQ ID NO: 715024 - RNA, 22 nt, Homo sapiens
aagccuugguaaaauaaucagu

SEQ ID NO: 715025 - RNA, 16 nt, Homo sapiens
aagggcaggugcuuca

SEQ ID NO: 715026 - RNA, 13 nt, Homo sapiens
aagggccaaagaa

SEQ ID NO: 715027 - RNA, 16 nt, Homo sapiens
aagguaaaaugccaug

SEQ ID NO: 715028 - RNA, 14 nt, Homo sapiens
cuagagcacugcca

SEQ ID NO: 715029 - RNA, 21 nt, Homo sapiens
cuagaggcuuccuucauuucc

SEQ ID NO: 715030 - RNA, 22 nt, Homo sapiens
cuagaggcuuccuucauuuccu

SEQ ID NO: 715031 - RNA, 17 nt, Homo sapiens
cuagcaagaccuguugg

SEQ ID NO: 715032 - RNA, 19 nt, Homo sapiens
cuagccuggcuauguccua

SEQ ID NO: 715033 - RNA, 17 nt, Homo sapiens
cuuucuucagcucugaa

SEQ ID NO: 715034 - RNA, 18 nt, Homo sapiens
cuuugauaaaguaaaaaa

SEQ ID NO: 715035 - RNA, 22 nt, Homo sapiens
cuuuggacuugucccgggacac

SEQ ID NO: 715036 - RNA, 22 nt, Homo sapiens
cuuuggggagcaggaggccaau

SEQ ID NO: 715037 - RNA, 16 nt, Homo sapiens
cuuuuaaaugcauaaa

SEQ ID NO: 715038 - RNA, 17 nt, Homo sapiens
cuuuuaaugaacaaaug

SEQ ID NO: 715039 - RNA, 14 nt, Homo sapiens
cuuuucacaaauca

SEQ ID NO: 715040 - RNA, 18 nt, Homo sapiens
cacgcuuuuugaaaaagc

SEQ ID NO: 715041 - RNA, 12 nt, Homo sapiens
cacguaucccac

SEQ ID NO: 715042 - RNA, 22 nt, Homo sapiens
cacgucugcagaaacagugcaa

SEQ ID NO: 715043 - RNA, 18 nt, Homo sapiens
cacucuguaauugcaaaa

SEQ ID NO: 715044 - RNA, 18 nt, Homo sapiens
cacugauaauauguuuga

SEQ ID NO: 715045 - RNA, 14 nt, Homo sapiens
cacuguggaaaaug

SEQ ID NO: 715046 - RNA, 19 nt, Homo sapiens
cagaaacagugcaaggaag

SEQ ID NO: 715047 - RNA, 21 nt, Homo sapiens
cagaaauaucuucacuuguca

SEQ ID NO: 715048 - RNA, 21 nt, Homo sapiens
cagaacacagcaauuccucag

SEQ ID NO: 715049 - RNA, 23 nt, Homo sapiens
cagaagaaauucugcaagcuuuu

SEQ ID NO: 715050 - RNA, 20 nt, Homo sapiens
cagaagcaggguacccuuug

SEQ ID NO: 715051 - RNA, 15 nt, Homo sapiens
cagaaucagaucuga

SEQ ID NO: 715052 - RNA, 22 nt, Homo sapiens
cagaaucagaucugagcuucau

SEQ ID NO: 715053 - RNA, 17 nt, Homo sapiens
cagaaugacuucugaca

SEQ ID NO: 715054 - RNA, 19 nt, Homo sapiens
cagaaugagaccaaacgca

SEQ ID NO: 715055 - RNA, 19 nt, Homo sapiens
cagaaugcucuacuucuuu

SEQ ID NO: 715056 - RNA, 14 nt, Homo sapiens
cagacaccagauuu

SEQ ID NO: 715057 - RNA, 22 nt, Homo sapiens
cagauaagguaaaaugccauga

SEQ ID NO: 715058 - RNA, 22 nt, Homo sapiens
cagaucgggagcaaaccaaaga

SEQ ID NO: 715059 - RNA, 17 nt, Homo sapiens
cagaugugaaccauuaa

SEQ ID NO: 715060 - RNA, 15 nt, Homo sapiens
cagauuauuauugaa

SEQ ID NO: 715061 - RNA, 18 nt, Homo sapiens
cagauucucccuugcucu

SEQ ID NO: 715062 - RNA, 15 nt, Homo sapiens
cagauuuucagcaaa

SEQ ID NO: 715063 - RNA, 19 nt, Homo sapiens
cagcaaaacaacggaugaa

SEQ ID NO: 715064 - RNA, 16 nt, Homo sapiens
cagcacuuguguuguc

SEQ ID NO: 715065 - RNA, 21 nt, Homo sapiens
cagccaccacccacaaucaca

SEQ ID NO: 715066 - RNA, 13 nt, Homo sapiens
cagcuaugaaggc

SEQ ID NO: 715067 - RNA, 17 nt, Homo sapiens
cagcucuaauacauucc

SEQ ID NO: 715068 - RNA, 19 nt, Homo sapiens
cagcugaagaacaucucga

SEQ ID NO: 715069 - RNA, 19 nt, Homo sapiens
cagcuuugcuaccaaagca

SEQ ID NO: 715070 - RNA, 22 nt, Homo sapiens
caggaggccaauaaaaaguuca

SEQ ID NO: 715071 - RNA, 24 nt, Homo sapiens
caggauagagacuggaacacuaga

SEQ ID NO: 715072 - RNA, 12 nt, Homo sapiens
caggauucuccu

SEQ ID NO: 715073 - RNA, 19 nt, Homo sapiens
caggcaaucugcccgccug

SEQ ID NO: 715074 - RNA, 12 nt, Homo sapiens
caggcaccugcc

SEQ ID NO: 715075 - RNA, 13 nt, Homo sapiens
caggcaccugcca

SEQ ID NO: 715076 - RNA, 16 nt, Homo sapiens
caggcuggagugcagu

SEQ ID NO: 715077 - RNA, 20 nt, Homo sapiens
caggggccugcccagugcac

SEQ ID NO: 715078 - RNA, 21 nt, Homo sapiens
caggggccugcccagugcacu

SEQ ID NO: 715079 - RNA, 20 nt, Homo sapiens
cagggggugugucugcucag

SEQ ID NO: 715080 - RNA, 17 nt, Homo sapiens
caggguagcacugggaa

SEQ ID NO: 715081 - RNA, 15 nt, Homo sapiens
caggucugaagcuca

SEQ ID NO: 715082 - RNA, 12 nt, Homo sapiens
caggugaacaaa

SEQ ID NO: 715083 - RNA, 19 nt, Homo sapiens
cagguguaagccaccgugc

SEQ ID NO: 715084 - RNA, 21 nt, Homo sapiens
caguaauuuuaaguaauuuca

SEQ ID NO: 715085 - RNA, 13 nt, Homo sapiens
caguacaauguuu

SEQ ID NO: 715086 - RNA, 17 nt, Homo sapiens
cagucauuggguuuuau

SEQ ID NO: 715087 - RNA, 17 nt, Homo sapiens
cagucccccaacuaccc

SEQ ID NO: 715088 - RNA, 22 nt, Homo sapiens
cagucuucuuccaugucuauua

SEQ ID NO: 715089 - RNA, 13 nt, Homo sapiens
cagugaagacaga

SEQ ID NO: 715090 - RNA, 14 nt, Homo sapiens
caguguccucaggg

SEQ ID NO: 715091 - RNA, 12 nt, Homo sapiens
caguguuuccaa

SEQ ID NO: 715092 - RNA, 21 nt, Homo sapiens
cauaaaugugguacaagcauu

SEQ ID NO: 715093 - RNA, 21 nt, Homo sapiens
cauaacugaaaaugugcuaua

SEQ ID NO: 715094 - RNA, 16 nt, Homo sapiens
cauaaguauuaugucu

SEQ ID NO: 715095 - RNA, 20 nt, Homo sapiens
cauacaccuaugucauuuca

SEQ ID NO: 715096 - RNA, 16 nt, Homo sapiens
cauacacuuauuggaa

SEQ ID NO: 715097 - RNA, 15 nt, Homo sapiens
cauacgcaugguccu

SEQ ID NO: 715098 - RNA, 19 nt, Homo sapiens
cauagaaauuacacccaaa

SEQ ID NO: 715099 - RNA, 21 nt, Homo sapiens
cauagaacuccggaaugacca

SEQ ID NO: 715100 - RNA, 20 nt, Homo sapiens
cauauguuuuuguaaguuua

SEQ ID NO: 715101 - RNA, 19 nt, Homo sapiens
caucaauauucagcaaaau

SEQ ID NO: 715102 - RNA, 15 nt, Homo sapiens
cauccagauagguua

SEQ ID NO: 715103 - RNA, 24 nt, Homo sapiens
cauccuuggaaauuggaagagcac

SEQ ID NO: 715104 - RNA, 14 nt, Homo sapiens
caucugauugugau

SEQ ID NO: 715105 - RNA, 14 nt, Homo sapiens
caugaaaagauuau

SEQ ID NO: 715106 - RNA, 21 nt, Homo sapiens
caugagcuccuuaaggcucuu

SEQ ID NO: 715107 - RNA, 18 nt, Homo sapiens
caugcauuacugcaugca

SEQ ID NO: 715108 - RNA, 21 nt, Homo sapiens
caugcauuacugcaugcacuu

SEQ ID NO: 715109 - RNA, 17 nt, Homo sapiens
caugcuucagugcugcu

SEQ ID NO: 715110 - RNA, 18 nt, Homo sapiens
caugcuucagugcugcuc

SEQ ID NO: 715111 - RNA, 14 nt, Homo sapiens
cauguaucuaugca

SEQ ID NO: 715112 - RNA, 16 nt, Homo sapiens
caugucuauucagcuu

SEQ ID NO: 715113 - RNA, 14 nt, Homo sapiens
cauuaaaaaugcau

SEQ ID NO: 715114 - RNA, 18 nt, Homo sapiens
cauuaaagaaggguugag

SEQ ID NO: 715115 - RNA, 17 nt, Homo sapiens
cauuacugcaugcacuu

SEQ ID NO: 715116 - RNA, 22 nt, Homo sapiens
cauuacuuuaauacucaccucc

SEQ ID NO: 715117 - RNA, 23 nt, Homo sapiens
cauucagaagaaaaagaagcaac

SEQ ID NO: 715118 - RNA, 16 nt, Homo sapiens
cauuucuauagccaaa

SEQ ID NO: 715119 - RNA, 12 nt, Homo sapiens
cauuuucacuuu

SEQ ID NO: 715120 - RNA, 15 nt, Homo sapiens
cauuuucucuaauau

SEQ ID NO: 715121 - RNA, 21 nt, Homo sapiens
cauuuuguaaguugaagcaaa

SEQ ID NO: 715122 - RNA, 12 nt, Homo sapiens
ccaaagaaccaa

SEQ ID NO: 715123 - RNA, 14 nt, Homo sapiens
ccaaagaaccaaag

SEQ ID NO: 715124 - RNA, 15 nt, Homo sapiens
ccaaagaaccaaaga

SEQ ID NO: 715125 - RNA, 13 nt, Homo sapiens
ccaaagugcugcg

SEQ ID NO: 715126 - RNA, 19 nt, Homo sapiens
ccaaauauugugcacauuu

SEQ ID NO: 715127 - RNA, 14 nt, Homo sapiens
ccaaauuauggcaa

SEQ ID NO: 715128 - RNA, 15 nt, Homo sapiens
ccaaauuauggcaaa

SEQ ID NO: 715129 - RNA, 16 nt, Homo sapiens
ccaaccugaagacacc

SEQ ID NO: 715130 - RNA, 20 nt, Homo sapiens
ccaacuuugaagucugauuu

SEQ ID NO: 715131 - RNA, 13 nt, Homo sapiens
ccaagacagugag

SEQ ID NO: 715132 - RNA, 17 nt, Homo sapiens
ccaagcaguugggacua

SEQ ID NO: 715133 - RNA, 15 nt, Homo sapiens
ccaauaaaaaguuca

SEQ ID NO: 715134 - RNA, 18 nt, Homo sapiens
ccaauagggcugagcucu

SEQ ID NO: 715135 - RNA, 21 nt, Homo sapiens
ccacaaaugggaaaaccagac

SEQ ID NO: 715136 - RNA, 23 nt, Homo sapiens
ccacagaacacagcaauuccuca

SEQ ID NO: 715137 - RNA, 18 nt, Homo sapiens
ccacuaccuucugaccuc

SEQ ID NO: 715138 - RNA, 18 nt, Homo sapiens
ccacucaugugacucuuu

SEQ ID NO: 715139 - RNA, 13 nt, Homo sapiens
ccagaaagcaguu

SEQ ID NO: 715140 - RNA, 20 nt, Homo sapiens
ccagacuucccacggcuccu

SEQ ID NO: 715141 - RNA, 14 nt, Homo sapiens
ccagacuuucuaca

SEQ ID NO: 715142 - RNA, 12 nt, Homo sapiens
ccagagcacugu

SEQ ID NO: 715143 - RNA, 19 nt, Homo sapiens
ccagaggcuauuauuuuca

SEQ ID NO: 715144 - RNA, 13 nt, Homo sapiens
ccaggagacaguu

SEQ ID NO: 715145 - RNA, 19 nt, Homo sapiens
ccagucuuccugacacuuu

SEQ ID NO: 715146 - RNA, 21 nt, Homo sapiens
ccagucuuccugacacuuuaa

SEQ ID NO: 715147 - RNA, 17 nt, Homo sapiens
ccaucuuuuaauaugcu

SEQ ID NO: 715148 - RNA, 23 nt, Homo sapiens
ccaugcacccucauacacagaaa

SEQ ID NO: 715149 - RNA, 12 nt, Homo sapiens
cccaagcaguug

SEQ ID NO: 715150 - RNA, 16 nt, Homo sapiens
cucaucuuucuuccaa

SEQ ID NO: 715151 - RNA, 13 nt, Homo sapiens
cucaugauccaac

SEQ ID NO: 715152 - RNA, 20 nt, Homo sapiens
cucaugccuguaaucccagc

SEQ ID NO: 715153 - RNA, 19 nt, Homo sapiens
cuccacaaagccaaucuca

SEQ ID NO: 715154 - RNA, 20 nt, Homo sapiens
cuccacaaaugggaaaacca

SEQ ID NO: 715155 - RNA, 15 nt, Homo sapiens
cuccaccuccugggu

SEQ ID NO: 715156 - RNA, 23 nt, Homo sapiens
cuccacucaugugacucuuucca

SEQ ID NO: 715157 - RNA, 12 nt, Homo sapiens
cucccacagaac

SEQ ID NO: 715158 - RNA, 23 nt, Homo sapiens
cuccccuccaucccuggcccccu

SEQ ID NO: 715159 - RNA, 14 nt, Homo sapiens
cucccuggaugaca

SEQ ID NO: 715160 - RNA, 16 nt, Homo sapiens
cucccuggaugacauu

SEQ ID NO: 715161 - RNA, 18 nt, Homo sapiens
cucccuggaugacauuaa

SEQ ID NO: 715162 - RNA, 12 nt, Homo sapiens
cucccuuugaaa

SEQ ID NO: 715163 - RNA, 22 nt, Homo sapiens
cuccucaaccccuccccuccau

SEQ ID NO: 715164 - RNA, 13 nt, Homo sapiens
cuccucauucaca

SEQ ID NO: 715165 - RNA, 14 nt, Homo sapiens
cuccuggguucaag

SEQ ID NO: 715166 - RNA, 13 nt, Homo sapiens
cuccuguuuccau

SEQ ID NO: 715167 - RNA, 13 nt, Homo sapiens
cucgagaucccaa

SEQ ID NO: 715168 - RNA, 17 nt, Homo sapiens
cucgcccagcggcauca

SEQ ID NO: 715169 - RNA, 20 nt, Homo sapiens
cucgcccagcggcaucaggc

SEQ ID NO: 715170 - RNA, 19 nt, Homo sapiens
cucgucggaaggacacuca

SEQ ID NO: 715171 - RNA, 15 nt, Homo sapiens
cucuaauacauucca

SEQ ID NO: 715172 - RNA, 15 nt, Homo sapiens
cucucaucaacugaa

SEQ ID NO: 715173 - RNA, 21 nt, Homo sapiens
cucugauguagcuuauacaaa

SEQ ID NO: 715174 - RNA, 19 nt, Homo sapiens
cucugcaggucccuaauaa

SEQ ID NO: 715175 - RNA, 20 nt, Homo sapiens
cucugccccuucuguuucca

SEQ ID NO: 715176 - RNA, 18 nt, Homo sapiens
cucuggagcccacuguac

SEQ ID NO: 715177 - RNA, 15 nt, Homo sapiens
gacaguacacuguca

SEQ ID NO: 715178 - RNA, 18 nt, Homo sapiens
gacagucuggaaagugau

SEQ ID NO: 715179 - RNA, 19 nt, Homo sapiens
gacaugcuucagugcugcu

SEQ ID NO: 715180 - RNA, 20 nt, Homo sapiens
gaccauaaaggcauggcauu

SEQ ID NO: 715181 - RNA, 21 nt, Homo sapiens
gacccuacuucuuuugcucuu

SEQ ID NO: 715182 - RNA, 18 nt, Homo sapiens
gaccucaggcaaucugcc

SEQ ID NO: 715183 - RNA, 15 nt, Homo sapiens
gacuaaugcaugugg

SEQ ID NO: 715184 - RNA, 20 nt, Homo sapiens
gacucaaagagggagugcau

SEQ ID NO: 715185 - RNA, 17 nt, Homo sapiens
gacucauuacuacucag

SEQ ID NO: 715186 - RNA, 17 nt, Homo sapiens
gacugagagaugcagaa

SEQ ID NO: 715187 - RNA, 19 nt, Homo sapiens
gacuggccucaaagcaagc

SEQ ID NO: 715188 - RNA, 14 nt, Homo sapiens
gacuuucuacaccu

SEQ ID NO: 715189 - RNA, 15 nt, Homo sapiens
gagaaaaacacacag

SEQ ID NO: 715190 - RNA, 21 nt, Homo sapiens
gagaaauuuaaacuauaagca

SEQ ID NO: 715191 - RNA, 15 nt, Homo sapiens
gagaagcaaggguug

SEQ ID NO: 715192 - RNA, 19 nt, Homo sapiens
gagacauacaccuauguca

SEQ ID NO: 715193 - RNA, 18 nt, Homo sapiens
gagauaagaucuauagcc

SEQ ID NO: 715194 - RNA, 11 nt, Homo sapiens
gagaucccaac

SEQ ID NO: 715195 - RNA, 16 nt, Homo sapiens
gagaucccaacacugc

SEQ ID NO: 715196 - RNA, 23 nt, Homo sapiens
gagcagugggaggguaccagcag

SEQ ID NO: 715197 - RNA, 14 nt, Homo sapiens
gagccaccaugccc

SEQ ID NO: 715198 - RNA, 16 nt, Homo sapiens
gagccgggagccugac

SEQ ID NO: 715199 - RNA, 15 nt, Homo sapiens
gaggacccagggcuc

SEQ ID NO: 715200 - RNA, 13 nt, Homo sapiens
gaggacuccuuaa

SEQ ID NO: 715201 - RNA, 23 nt, Homo sapiens
gaggauacgacaguacacuguca

SEQ ID NO: 715202 - RNA, 23 nt, Homo sapiens
gaggauguguggcauuuucacuu

SEQ ID NO: 715203 - RNA, 16 nt, Homo sapiens
gagggcgcaggccgug

SEQ ID NO: 715204 - RNA, 21 nt, Homo sapiens
gaggggaaguccagccuacca

SEQ ID NO: 715205 - RNA, 14 nt, Homo sapiens
gaggggaccaggag

SEQ ID NO: 715206 - RNA, 14 nt, Homo sapiens
gaggguuugcagaa

SEQ ID NO: 715207 - RNA, 16 nt, Homo sapiens
gaguaucacaucacac

SEQ ID NO: 715208 - RNA, 22 nt, Homo sapiens
gagucuuaauauauauauccag

SEQ ID NO: 715209 - RNA, 20 nt, Homo sapiens
gagugacuuaguguacauga

SEQ ID NO: 715210 - RNA, 20 nt, Homo sapiens
gaguuagauaugugccaaag

SEQ ID NO: 715211 - RNA, 12 nt, Homo sapiens
gaguuggaauca

SEQ ID NO: 715212 - RNA, 23 nt, Homo sapiens
gauagcaucuuauacgaguaaua

SEQ ID NO: 715213 - RNA, 21 nt, Homo sapiens
gauagguuaccaguaacggaa

SEQ ID NO: 715214 - RNA, 14 nt, Homo sapiens
gauaugugccaaag

SEQ ID NO: 715215 - RNA, 21 nt, Homo sapiens
gaucauuuguuggaaugaauu

SEQ ID NO: 715216 - RNA, 16 nt, Homo sapiens
gaucccaacacugcca

SEQ ID NO: 715217 - RNA, 17 nt, Homo sapiens
gaugacauuaaagaagg

SEQ ID NO: 715218 - RNA, 14 nt, Homo sapiens
gaugacuggucucu

SEQ ID NO: 715219 - RNA, 15 nt, Homo sapiens
gaugaggcuuuccau

SEQ ID NO: 715220 - RNA, 17 nt, Homo sapiens
gauguucuggaccuccc

SEQ ID NO: 715221 - RNA, 19 nt, Homo sapiens
gauuaagauacacuccugc

SEQ ID NO: 715222 - RNA, 12 nt, Homo sapiens
gauuagacugga

SEQ ID NO: 715223 - RNA, 14 nt, Homo sapiens
gauucacaucucau

SEQ ID NO: 715224 - RNA, 14 nt, Homo sapiens
gauucauuuuaaca

SEQ ID NO: 715225 - RNA, 23 nt, Homo sapiens
gauuuuuuuuuuaaaacuaucca

SEQ ID NO: 715226 - RNA, 14 nt, Homo sapiens
gcaaauaaauaucc

SEQ ID NO: 715227 - RNA, 14 nt, Homo sapiens
gcaacacagugaga

SEQ ID NO: 715228 - RNA, 20 nt, Homo sapiens
gcaaccuccaccuccugggu

SEQ ID NO: 715229 - RNA, 14 nt, Homo sapiens
gcacugagaccucc

SEQ ID NO: 715230 - RNA, 19 nt, Homo sapiens
gcagaaagguuaguaucau

SEQ ID NO: 715231 - RNA, 17 nt, Homo sapiens
gcagccugcagacucac

SEQ ID NO: 715232 - RNA, 20 nt, Homo sapiens
gcagggaaggaucccaugag

SEQ ID NO: 715233 - RNA, 13 nt, Homo sapiens
gcagggacuguaa

SEQ ID NO: 715234 - RNA, 20 nt, Homo sapiens
gcagggggugugucugcuca

SEQ ID NO: 715235 - RNA, 18 nt, Homo sapiens
gcaggucugaagcucaac

SEQ ID NO: 715236 - RNA, 16 nt, Homo sapiens
gcaguugagacaagaa

SEQ ID NO: 715237 - RNA, 18 nt, Homo sapiens
gcaguuuuuuucuugucu

SEQ ID NO: 715238 - RNA, 20 nt, Homo sapiens
gcauaaaugugguacaagca

SEQ ID NO: 715239 - RNA, 15 nt, Homo sapiens
gcauauuaaaaguca

SEQ ID NO: 715240 - RNA, 22 nt, Homo sapiens
gcauccucuuuuuccaacuugg

SEQ ID NO: 715241 - RNA, 18 nt, Homo sapiens
gcauuaaaaaugcauaua

SEQ ID NO: 715242 - RNA, 17 nt, Homo sapiens
gcauuguaacuuaugaa

SEQ ID NO: 715243 - RNA, 16 nt, Homo sapiens
gccaagcccucaauaa

SEQ ID NO: 715244 - RNA, 21 nt, Homo sapiens
gccaauaaaaaguucagaguu

SEQ ID NO: 715245 - RNA, 18 nt, Homo sapiens
gccagaucgggagcaaac

SEQ ID NO: 715246 - RNA, 21 nt, Homo sapiens
gccagcauuucccuuccuucc

SEQ ID NO: 715247 - RNA, 21 nt, Homo sapiens
gccagccuggagaaggugaca

SEQ ID NO: 715248 - RNA, 22 nt, Homo sapiens
gccagggaacccacagagucac

SEQ ID NO: 715249 - RNA, 20 nt, Homo sapiens
gccaucaauauucagcaaaa

SEQ ID NO: 715250 - RNA, 14 nt, Homo sapiens
gccauucuuuccca

SEQ ID NO: 715251 - RNA, 16 nt, Homo sapiens
gcccaaggcacugaga

SEQ ID NO: 715252 - RNA, 14 nt, Homo sapiens
gcccagugcacuug

SEQ ID NO: 715253 - RNA, 21 nt, Homo sapiens
gcccaugccuccagcuacaaa

SEQ ID NO: 715254 - RNA, 18 nt, Homo sapiens
gcccccccagcugucauc

SEQ ID NO: 715255 - RNA, 16 nt, Homo sapiens
gcccgggagcucagga

SEQ ID NO: 715256 - RNA, 19 nt, Homo sapiens
gcccucagcccaccugggg

SEQ ID NO: 715257 - RNA, 21 nt, Homo sapiens
gccgccucccaccacuccacu

SEQ ID NO: 715258 - RNA, 16 nt, Homo sapiens
gccuccuuauuuauca

SEQ ID NO: 715259 - RNA, 18 nt, Homo sapiens
gccugacgaacuccuuga

SEQ ID NO: 715260 - RNA, 14 nt, Homo sapiens
gccugagugaucca

SEQ ID NO: 715261 - RNA, 22 nt, Homo sapiens
gccugaugggguggaaggcaug

SEQ ID NO: 715262 - RNA, 15 nt, Homo sapiens
gccugcagacucacu

SEQ ID NO: 715263 - RNA, 22 nt, Homo sapiens
ccacagcaucgggagcacccag

SEQ ID NO: 715264 - RNA, 21 nt, Homo sapiens
ccacagccgccugaaagccac

SEQ ID NO: 715265 - RNA, 15 nt, Homo sapiens
ccacagcugugcaug

SEQ ID NO: 715266 - RNA, 19 nt, Homo sapiens
ccacaggccugagauuuca

SEQ ID NO: 715267 - RNA, 17 nt, Homo sapiens
ccacaggucaucagaug

SEQ ID NO: 715268 - RNA, 16 nt, Homo sapiens
ccacaguaauugguca

SEQ ID NO: 715269 - RNA, 15 nt, Homo sapiens
ccacagucaguggag

SEQ ID NO: 715270 - RNA, 18 nt, Homo sapiens
ccacauaauucuguuacu

SEQ ID NO: 715271 - RNA, 18 nt, Homo sapiens
ccacauccaacuccagca

SEQ ID NO: 715272 - RNA, 23 nt, Homo sapiens
ccacaucugccuuaaaaccaaag

SEQ ID NO: 715273 - RNA, 24 nt, Homo sapiens
ccacaugacuuauuaugcauaaag

SEQ ID NO: 715274 - RNA, 21 nt, Homo sapiens
ccacauggggcguacuauuuu

SEQ ID NO: 715275 - RNA, 19 nt, Homo sapiens
ccacaugggugcauuugua

SEQ ID NO: 715276 - RNA, 23 nt, Homo sapiens
ccacauuuagauccugguuucau

SEQ ID NO: 715277 - RNA, 16 nt, Homo sapiens
ccaccaaaacugcucc

SEQ ID NO: 715278 - RNA, 18 nt, Homo sapiens
ccaccaaagcugcccacu

SEQ ID NO: 715279 - RNA, 13 nt, Homo sapiens
ccaccaacauaaa

SEQ ID NO: 715280 - RNA, 13 nt, Homo sapiens
ccaccaccugucc

SEQ ID NO: 715281 - RNA, 15 nt, Homo sapiens
ccaccacugccugac

SEQ ID NO: 715282 - RNA, 17 nt, Homo sapiens
ccaccagcaaggggacc

SEQ ID NO: 715283 - RNA, 16 nt, Homo sapiens
ccaccagccugcacua

SEQ ID NO: 715284 - RNA, 16 nt, Homo sapiens
ccaccaggcugcucag

SEQ ID NO: 715285 - RNA, 16 nt, Homo sapiens
ccaccagggacaccuc

SEQ ID NO: 715286 - RNA, 17 nt, Homo sapiens
ccaccauccagguggag

SEQ ID NO: 715287 - RNA, 16 nt, Homo sapiens
ccaccauccuauugca

SEQ ID NO: 715288 - RNA, 15 nt, Homo sapiens
ccacccaacaagcca

SEQ ID NO: 715289 - RNA, 19 nt, Homo sapiens
ccacccaacccuaucuccu

SEQ ID NO: 715290 - RNA, 20 nt, Homo sapiens
ccacccauaauaagagaaug

SEQ ID NO: 715291 - RNA, 13 nt, Homo sapiens
ccaccccacacuu

SEQ ID NO: 715292 - RNA, 17 nt, Homo sapiens
ccacccgcccacagcca

SEQ ID NO: 715293 - RNA, 20 nt, Homo sapiens
ccacccguaggcagccucuc

SEQ ID NO: 715294 - RNA, 13 nt, Homo sapiens
ccacccugcucau

SEQ ID NO: 715295 - RNA, 18 nt, Homo sapiens
ccaccgagccccugaccc

SEQ ID NO: 715296 - RNA, 23 nt, Homo sapiens
aauccuauuuaucagacucugua

SEQ ID NO: 715297 - RNA, 19 nt, Homo sapiens
aauccucccacuucagccu

SEQ ID NO: 715298 - RNA, 22 nt, Homo sapiens
aauccuggaaggacacagugau

SEQ ID NO: 715299 - RNA, 22 nt, Homo sapiens
aauccuucccugcucuugcagu

SEQ ID NO: 715300 - RNA, 18 nt, Homo sapiens
aauccuuggggagcacuu

SEQ ID NO: 715301 - RNA, 22 nt, Homo sapiens
aauccuuucacccgcuccuaca

SEQ ID NO: 715302 - RNA, 22 nt, Homo sapiens
aaucggcuggggacugcuaccu

SEQ ID NO: 715303 - RNA, 12 nt, Homo sapiens
aaucguccuccc

SEQ ID NO: 715304 - RNA, 19 nt, Homo sapiens
aaucuaacgggcauucaca

SEQ ID NO: 715305 - RNA, 19 nt, Homo sapiens
aaucuacagaacuacauau

SEQ ID NO: 715306 - RNA, 15 nt, Homo sapiens
aaucuaccacuguau

SEQ ID NO: 715307 - RNA, 17 nt, Homo sapiens
aaucuaccucugaaaaa

SEQ ID NO: 715308 - RNA, 22 nt, Homo sapiens
aaucuacugaauuggcuuccag

SEQ ID NO: 715309 - RNA, 18 nt, Homo sapiens
aaucuagaaaaucagauc

SEQ ID NO: 715310 - RNA, 13 nt, Homo sapiens
aaucuaggugugg

SEQ ID NO: 715311 - RNA, 22 nt, Homo sapiens
aaucuagguucaggaagaccac

SEQ ID NO: 715312 - RNA, 15 nt, Homo sapiens
aaucuauccauugaa

SEQ ID NO: 715313 - RNA, 21 nt, Homo sapiens
aaucuauuuuugugugcugug

SEQ ID NO: 715314 - RNA, 18 nt, Homo sapiens
aaucucaaauaacuaaaa

SEQ ID NO: 715315 - RNA, 19 nt, Homo sapiens
aaucucaaugaagccagcu

SEQ ID NO: 715316 - RNA, 14 nt, Homo sapiens
aaucucaauuccau

SEQ ID NO: 715317 - RNA, 13 nt, Homo sapiens
aaucucaccugcu

SEQ ID NO: 715318 - RNA, 13 nt, Homo sapiens
aaucucagcacuu

SEQ ID NO: 715319 - RNA, 14 nt, Homo sapiens
aaucucauucccag

SEQ ID NO: 715320 - RNA, 14 nt, Homo sapiens
aaucuccaguuuuc

SEQ ID NO: 715321 - RNA, 16 nt, Homo sapiens
aaucuccaucucaaaa

SEQ ID NO: 715322 - RNA, 13 nt, Homo sapiens
aaucucccaguga

SEQ ID NO: 715323 - RNA, 22 nt, Homo sapiens
aaucuccucucucuuuccucca

SEQ ID NO: 715324 - RNA, 23 nt, Homo sapiens
aaucuccucuuuuagcugaugaa

SEQ ID NO: 715325 - RNA, 14 nt, Homo sapiens
aaucucggcucacu

SEQ ID NO: 715326 - RNA, 14 nt, Homo sapiens
aaucucuaagccaa

SEQ ID NO: 715327 - RNA, 20 nt, Homo sapiens
aaucucugaaggaucaucua

SEQ ID NO: 715328 - RNA, 17 nt, Homo sapiens
aaucugaaucagccagu

SEQ ID NO: 715329 - RNA, 20 nt, Homo sapiens
aaucugacgucaucuugucu

SEQ ID NO: 715330 - RNA, 22 nt, Homo sapiens
aaucugaggccuccucucucag

SEQ ID NO: 715331 - RNA, 15 nt, Homo sapiens
aaucugaguauauau

SEQ ID NO: 715332 - RNA, 14 nt, Homo sapiens
aaucugcugcaccu

SEQ ID NO: 715333 - RNA, 19 nt, Homo sapiens
aaucuguaaucagcaauaa

SEQ ID NO: 715334 - RNA, 20 nt, Homo sapiens
aaucuguauauguuguaaua

SEQ ID NO: 715335 - RNA, 21 nt, Homo sapiens
aaucuguccguucacaugugu

SEQ ID NO: 715336 - RNA, 20 nt, Homo sapiens
aaucugugccugcacugaga

SEQ ID NO: 715337 - RNA, 18 nt, Homo sapiens
aaucuguugauaaaucca

SEQ ID NO: 715338 - RNA, 18 nt, Homo sapiens
aaucuguuucucugcugu

SEQ ID NO: 715339 - RNA, 21 nt, Homo sapiens
aaucuuaaugaacacacaagc

SEQ ID NO: 715340 - RNA, 14 nt, Homo sapiens
aaucuuaugcucuc

SEQ ID NO: 715341 - RNA, 14 nt, Homo sapiens
aaucuuauuuauac

SEQ ID NO: 715342 - RNA, 21 nt, Homo sapiens
aaucuuccuuuguugcacaaa

SEQ ID NO: 715343 - RNA, 15 nt, Homo sapiens
aaucuucuacuuuaa

SEQ ID NO: 715344 - RNA, 19 nt, Homo sapiens
aaucuucucuuugacaauu

SEQ ID NO: 715345 - RNA, 23 nt, Homo sapiens
aaucuucucuuugacaauuccua

SEQ ID NO: 715346 - RNA, 21 nt, Homo sapiens
aaucuucugccuucucaugau

SEQ ID NO: 715347 - RNA, 16 nt, Homo sapiens
aaucuucuuaugcaau

SEQ ID NO: 715348 - RNA, 13 nt, Homo sapiens
aaucuugaacuuu

SEQ ID NO: 715349 - RNA, 15 nt, Homo sapiens
aaucuugaacuuuau

SEQ ID NO: 715350 - RNA, 13 nt, Homo sapiens
aaucuugggucuu

SEQ ID NO: 715351 - RNA, 23 nt, Homo sapiens
aaucuugggucuuggggacuaac

SEQ ID NO: 715352 - RNA, 17 nt, Homo sapiens
aaucuuguuaaugucau

SEQ ID NO: 715353 - RNA, 16 nt, Homo sapiens
aaucuuucacuugaaa

SEQ ID NO: 715354 - RNA, 16 nt, Homo sapiens
aaugaaaauucuaacc

SEQ ID NO: 715355 - RNA, 22 nt, Homo sapiens
aaugaaagcccucaugugcagu

SEQ ID NO: 715356 - RNA, 18 nt, Homo sapiens
aaugaaauaauacuucag

SEQ ID NO: 715357 - RNA, 18 nt, Homo sapiens
aaugaaauccagugagca

SEQ ID NO: 715358 - RNA, 18 nt, Homo sapiens
aaugaacacaucuugagu

SEQ ID NO: 715359 - RNA, 13 nt, Homo sapiens
aaugaacacuccc

SEQ ID NO: 715360 - RNA, 16 nt, Homo sapiens
aaugaaccuucugcaa

SEQ ID NO: 715361 - RNA, 22 nt, Homo sapiens
aaugaagcagaaauguacuuag

SEQ ID NO: 715362 - RNA, 23 nt, Homo sapiens
aaugaagccaagugggauuugca

SEQ ID NO: 715363 - RNA, 21 nt, Homo sapiens
aaugaagguuaggauuuaaca

SEQ ID NO: 715364 - RNA, 19 nt, Homo sapiens
aaugaauuauaacaguuau

SEQ ID NO: 715365 - RNA, 17 nt, Homo sapiens
aaugaauuccucauuug

SEQ ID NO: 715366 - RNA, 14 nt, Homo sapiens
aaugaauuuaucuu

SEQ ID NO: 715367 - RNA, 14 nt, Homo sapiens
aaugaauuugcuaa

SEQ ID NO: 715368 - RNA, 17 nt, Homo sapiens
aaugacaacagaaaaac

SEQ ID NO: 715369 - RNA, 20 nt, Homo sapiens
aaugacaauaaaaauuccaa

SEQ ID NO: 715370 - RNA, 15 nt, Homo sapiens
aaugacaaugaugau

SEQ ID NO: 715371 - RNA, 13 nt, Homo sapiens
aaugacaguuuuu

SEQ ID NO: 715372 - RNA, 21 nt, Homo sapiens
aaugacaguuuuuauuugaag

SEQ ID NO: 715373 - RNA, 13 nt, Homo sapiens
aaugacauuugua

SEQ ID NO: 715374 - RNA, 19 nt, Homo sapiens
aaugacuaaaaaacaaaga

SEQ ID NO: 715375 - RNA, 16 nt, Homo sapiens
aaugacuuaaccauau

SEQ ID NO: 715376 - RNA, 18 nt, Homo sapiens
aaugacuucuaguguaga

SEQ ID NO: 715377 - RNA, 21 nt, Homo sapiens
aaugagacauaggccaugaaa

SEQ ID NO: 715378 - RNA, 19 nt, Homo sapiens
aaugagcucugaaaucuuc

SEQ ID NO: 715379 - RNA, 19 nt, Homo sapiens
aaugagcugguuugucaaa

SEQ ID NO: 715380 - RNA, 22 nt, Homo sapiens
aaugaggauuauugauaguacu

SEQ ID NO: 715381 - RNA, 16 nt, Homo sapiens
aaugaggcacuuauca

SEQ ID NO: 715382 - RNA, 20 nt, Homo sapiens
aaugaggcagauagcacugg

SEQ ID NO: 715383 - RNA, 13 nt, Homo sapiens
aaugagugcaccu

SEQ ID NO: 715384 - RNA, 12 nt, Homo sapiens
aaugagugcuua

SEQ ID NO: 715385 - RNA, 19 nt, Homo sapiens
aaugaguuagaacuauuaa

SEQ ID NO: 715386 - RNA, 22 nt, Homo sapiens
aaugauaaacucagaucugauc

SEQ ID NO: 715387 - RNA, 14 nt, Homo sapiens
aaugaucagaugaa

SEQ ID NO: 715388 - RNA, 21 nt, Homo sapiens
aaugaugguuuaauagguaaa

SEQ ID NO: 715389 - RNA, 21 nt, Homo sapiens
aaugauuauauaaaauacaua

SEQ ID NO: 715390 - RNA, 23 nt, Homo sapiens
aaugauuucaugcuaucucugug

SEQ ID NO: 715391 - RNA, 14 nt, Homo sapiens
aaugcaaagcugaa

SEQ ID NO: 715392 - RNA, 23 nt, Homo sapiens
aaugcaaagcuugagcugcucug

SEQ ID NO: 715393 - RNA, 21 nt, Homo sapiens
aaugcaccucuuguuacuccc

SEQ ID NO: 715394 - RNA, 22 nt, Homo sapiens
aaugcaccucuuguuacucccu

SEQ ID NO: 715395 - RNA, 22 nt, Homo sapiens
aaugcaguacauuaauauucau

SEQ ID NO: 715396 - RNA, 10 nt, Homo sapiens
aaugcagugg

SEQ ID NO: 715397 - RNA, 18 nt, Homo sapiens
aaugcaugcuucuucuca

SEQ ID NO: 715398 - RNA, 18 nt, Homo sapiens
aaugcauuuguaauucau

SEQ ID NO: 715399 - RNA, 21 nt, Homo sapiens
aaugccaagggggugacugga

SEQ ID NO: 715400 - RNA, 17 nt, Homo sapiens
aaugccaugaacaaauu

SEQ ID NO: 715401 - RNA, 19 nt, Homo sapiens
aaugccgcugucucugagg

SEQ ID NO: 715402 - RNA, 17 nt, Homo sapiens
aaugccuaucugaccaa

SEQ ID NO: 715403 - RNA, 14 nt, Homo sapiens
aaugccugugccaa

SEQ ID NO: 715404 - RNA, 17 nt, Homo sapiens
aaugcuacauacuccaa

SEQ ID NO: 715405 - RNA, 19 nt, Homo sapiens
aaugcuacugucucacuga

SEQ ID NO: 715406 - RNA, 23 nt, Homo sapiens
aaugcuagacagaaaccaagcca

SEQ ID NO: 715407 - RNA, 14 nt, Homo sapiens
aaugcuaucacugu

SEQ ID NO: 715408 - RNA, 16 nt, Homo sapiens
aaugcucuaacuggac

SEQ ID NO: 715409 - RNA, 13 nt, Homo sapiens
aaugcucuugucc

SEQ ID NO: 715410 - RNA, 14 nt, Homo sapiens
aauaaaugugcuua

SEQ ID NO: 715411 - RNA, 15 nt, Homo sapiens
aauaaauuugaugaa

SEQ ID NO: 715412 - RNA, 19 nt, Homo sapiens
aauaacaacagaucugcag

SEQ ID NO: 715413 - RNA, 12 nt, Homo sapiens
aauaacacuguc

SEQ ID NO: 715414 - RNA, 16 nt, Homo sapiens
aauaacaucaccacug

SEQ ID NO: 715415 - RNA, 23 nt, Homo sapiens
aauaaccggauauauacauagca

SEQ ID NO: 715416 - RNA, 14 nt, Homo sapiens
aauaacuaugcuuu

SEQ ID NO: 715417 - RNA, 21 nt, Homo sapiens
aauaacuuuucaccaaugagc

SEQ ID NO: 715418 - RNA, 15 nt, Homo sapiens
aauaagauauuuagu

SEQ ID NO: 715419 - RNA, 21 nt, Homo sapiens
aauaagauauuuaguaauauu

SEQ ID NO: 715420 - RNA, 13 nt, Homo sapiens
aauaagccuucaa

SEQ ID NO: 715421 - RNA, 18 nt, Homo sapiens
aauaaggaaacgaugaaa

SEQ ID NO: 715422 - RNA, 15 nt, Homo sapiens
aauaaggcccagagc

SEQ ID NO: 715423 - RNA, 19 nt, Homo sapiens
aauaagggccuagaaacuc

SEQ ID NO: 715424 - RNA, 20 nt, Homo sapiens
aauaagucccgcauauacuu

SEQ ID NO: 715425 - RNA, 14 nt, Homo sapiens
aauaauacaaagca

SEQ ID NO: 715426 - RNA, 13 nt, Homo sapiens
aauaaucacuugg

SEQ ID NO: 715427 - RNA, 16 nt, Homo sapiens
aauaaugaauacauuu

SEQ ID NO: 715428 - RNA, 22 nt, Homo sapiens
aauaaugaguuagaacuauuaa

SEQ ID NO: 715429 - RNA, 14 nt, Homo sapiens
aauaaugcacugag

SEQ ID NO: 715430 - RNA, 16 nt, Homo sapiens
aauaaugucucuguga

SEQ ID NO: 715431 - RNA, 21 nt, Homo sapiens
aauaauuaaccaccaauccaa

SEQ ID NO: 715432 - RNA, 22 nt, Homo sapiens
aauaauuacccacaaaugccac

SEQ ID NO: 715433 - RNA, 18 nt, Homo sapiens
aauaauucaugauucaac

SEQ ID NO: 715434 - RNA, 17 nt, Homo sapiens
aauaauucuucaccuaa

SEQ ID NO: 715435 - RNA, 14 nt, Homo sapiens
aauaauugauuuca

SEQ ID NO: 715436 - RNA, 22 nt, Homo sapiens
aauaauuuuaagaaaucaaaga

SEQ ID NO: 715437 - RNA, 18 nt, Homo sapiens
aauaauuuuauuaugcaa

SEQ ID NO: 715438 - RNA, 13 nt, Homo sapiens
aauacaaaaaagu

SEQ ID NO: 715439 - RNA, 12 nt, Homo sapiens
aauacaaaaaug

SEQ ID NO: 715440 - RNA, 16 nt, Homo sapiens
aauacaaaaaugagcu

SEQ ID NO: 715441 - RNA, 15 nt, Homo sapiens
aauacaaacaaugga

SEQ ID NO: 715442 - RNA, 15 nt, Homo sapiens
aauacaacacugaua

SEQ ID NO: 715443 - RNA, 21 nt, Homo sapiens
aauacaaucagcccagugcaa

SEQ ID NO: 715444 - RNA, 20 nt, Homo sapiens
aauacaauggguaucgcuga

SEQ ID NO: 715445 - RNA, 17 nt, Homo sapiens
aauacaauucacagcac

SEQ ID NO: 715446 - RNA, 20 nt, Homo sapiens
aauacacaauccuccaagaa

SEQ ID NO: 715447 - RNA, 11 nt, Homo sapiens
aauacacaauu

SEQ ID NO: 715448 - RNA, 14 nt, Homo sapiens
aauacacacaagua

SEQ ID NO: 715449 - RNA, 23 nt, Homo sapiens
aauacagaguuuuagaaaugaga

SEQ ID NO: 715450 - RNA, 21 nt, Homo sapiens
aauacagauaaguguucuuca

SEQ ID NO: 715451 - RNA, 21 nt, Homo sapiens
aauauuucuguugucaauaaa

SEQ ID NO: 715452 - RNA, 15 nt, Homo sapiens
aauauuugagaauaa

SEQ ID NO: 715453 - RNA, 15 nt, Homo sapiens
aauauuugcuaugaa

SEQ ID NO: 715454 - RNA, 18 nt, Homo sapiens
aauauuugcugacagcug

SEQ ID NO: 715455 - RNA, 12 nt, Homo sapiens
aauauuuuccau

SEQ ID NO: 715456 - RNA, 23 nt, Homo sapiens
aauauuuugcuaaaaaagcauau

SEQ ID NO: 715457 - RNA, 19 nt, Homo sapiens
aauauuuuguaaugcugca

SEQ ID NO: 715458 - RNA, 21 nt, Homo sapiens
aauauuuuguaaugcugcaca

SEQ ID NO: 715459 - RNA, 13 nt, Homo sapiens
aaucaaauagcau

SEQ ID NO: 715460 - RNA, 22 nt, Homo sapiens
aaucaaaucucuuccacauggg

SEQ ID NO: 715461 - RNA, 18 nt, Homo sapiens
aaucaacaaaauggucau

SEQ ID NO: 715462 - RNA, 21 nt, Homo sapiens
aaucaacaaaauggucaucca

SEQ ID NO: 715463 - RNA, 12 nt, Homo sapiens
aaucaacuuuac

SEQ ID NO: 715464 - RNA, 21 nt, Homo sapiens
aaucaaguucuagcauuuuag

SEQ ID NO: 715465 - RNA, 20 nt, Homo sapiens
aaucaaguuguaacuuauau

SEQ ID NO: 715466 - RNA, 13 nt, Homo sapiens
aaucaaucuuuaa

SEQ ID NO: 715467 - RNA, 17 nt, Homo sapiens
aaucaaugguagcauuu

SEQ ID NO: 715468 - RNA, 20 nt, Homo sapiens
aaucacagcccucaugauca

SEQ ID NO: 715469 - RNA, 23 nt, Homo sapiens
aaucacagcccucaugaucauuc

SEQ ID NO: 715470 - RNA, 18 nt, Homo sapiens
aaucaccauguaagcacu

SEQ ID NO: 715471 - RNA, 15 nt, Homo sapiens
aaucacggugguaaa

SEQ ID NO: 715472 - RNA, 12 nt, Homo sapiens
aaucacuugaau

SEQ ID NO: 715473 - RNA, 19 nt, Homo sapiens
aaucacuugccaaaaucca

SEQ ID NO: 715474 - RNA, 20 nt, Homo sapiens
aaucagacuucacacugcaa

SEQ ID NO: 715475 - RNA, 15 nt, Homo sapiens
aaucagaucauuuca

SEQ ID NO: 715476 - RNA, 19 nt, Homo sapiens
aaucagauguguguucuca

SEQ ID NO: 715477 - RNA, 13 nt, Homo sapiens
aaucagcaauaaa

SEQ ID NO: 715478 - RNA, 14 nt, Homo sapiens
aaucagcauucuca

SEQ ID NO: 715479 - RNA, 16 nt, Homo sapiens
aaucagccacauucua

SEQ ID NO: 715480 - RNA, 20 nt, Homo sapiens
aaucagcugcuacuacuccu

SEQ ID NO: 715481 - RNA, 19 nt, Homo sapiens
aaucagcugcugacuggca

SEQ ID NO: 715482 - RNA, 19 nt, Homo sapiens
aaucagcuuaaaauccaaa

SEQ ID NO: 715483 - RNA, 21 nt, Homo sapiens
aaucagcuuaaaauccaaagu

SEQ ID NO: 715484 - RNA, 19 nt, Homo sapiens
aaucaggaauauuuuccaa

SEQ ID NO: 715485 - RNA, 18 nt, Homo sapiens
aaucaguaaauaguguca

SEQ ID NO: 715486 - RNA, 17 nt, Homo sapiens
aaucauaugauucugcu

SEQ ID NO: 715487 - RNA, 19 nt, Homo sapiens
aaucauauucauaugcaga

SEQ ID NO: 715488 - RNA, 14 nt, Homo sapiens
aaucaucaaaaaga

SEQ ID NO: 715489 - RNA, 14 nt, Homo sapiens
aaucaucuaaguca

SEQ ID NO: 715490 - RNA, 15 nt, Homo sapiens
aaucaucuuacauuu

SEQ ID NO: 715491 - RNA, 17 nt, Homo sapiens
aaucaugagcaagugaa

SEQ ID NO: 715492 - RNA, 18 nt, Homo sapiens
aaucaugagcaagugaac

SEQ ID NO: 715493 - RNA, 20 nt, Homo sapiens
aaucaugauccuuguguuca

SEQ ID NO: 715494 - RNA, 21 nt, Homo sapiens
aaucaugugaaauuuaggcag

SEQ ID NO: 715495 - RNA, 18 nt, Homo sapiens
aaucauguguugcagcuu

SEQ ID NO: 715496 - RNA, 21 nt, Homo sapiens
aaucauguugaucauguacuu

SEQ ID NO: 715497 - RNA, 20 nt, Homo sapiens
aaucauuguagaaacacagu

SEQ ID NO: 715498 - RNA, 17 nt, Homo sapiens
aaucauuuuaauuauua

SEQ ID NO: 715499 - RNA, 20 nt, Homo sapiens
aaucauuuucauuccuaaag

SEQ ID NO: 715500 - RNA, 16 nt, Homo sapiens
aaucauuuugccucuu

SEQ ID NO: 715501 - RNA, 11 nt, Homo sapiens
aauccaaaaaa

SEQ ID NO: 715502 - RNA, 12 nt, Homo sapiens
aauccaaaaaga

SEQ ID NO: 715503 - RNA, 16 nt, Homo sapiens
aauccaaaagacaaaa

SEQ ID NO: 715504 - RNA, 16 nt, Homo sapiens
aauccaaacuaaucca

SEQ ID NO: 715505 - RNA, 20 nt, Homo sapiens
aauccaaacuauuuccuaaa

SEQ ID NO: 715506 - RNA, 13 nt, Homo sapiens
aauccaacaucca

SEQ ID NO: 715507 - RNA, 14 nt, Homo sapiens
aauccaacuuucac

SEQ ID NO: 715508 - RNA, 17 nt, Homo sapiens
aauccaagauucugcug

SEQ ID NO: 715509 - RNA, 16 nt, Homo sapiens
aauccacccauguuau

SEQ ID NO: 715510 - RNA, 16 nt, Homo sapiens
aauccacuuugcucug

SEQ ID NO: 715511 - RNA, 20 nt, Homo sapiens
aauccaggcgugguggcaca

SEQ ID NO: 715512 - RNA, 16 nt, Homo sapiens
aauccagugagcacua

SEQ ID NO: 715513 - RNA, 19 nt, Homo sapiens
aauccauccaaaguucccu

SEQ ID NO: 715514 - RNA, 21 nt, Homo sapiens
aauccauccaaaguucccuau

SEQ ID NO: 715515 - RNA, 20 nt, Homo sapiens
aauccauguaaauugcaaau

SEQ ID NO: 715516 - RNA, 22 nt, Homo sapiens
aaucccaacguuuuacauaaaa

SEQ ID NO: 715517 - RNA, 17 nt, Homo sapiens
aaucccacccacaugug

SEQ ID NO: 715518 - RNA, 20 nt, Homo sapiens
aaucccuccccgugacugca

SEQ ID NO: 715519 - RNA, 21 nt, Homo sapiens
aaucccucccugacccacugu

SEQ ID NO: 715520 - RNA, 23 nt, Homo sapiens
aaucccucccugacccacugugc

SEQ ID NO: 715521 - RNA, 17 nt, Homo sapiens
aaucccuggcaaaggga

SEQ ID NO: 715522 - RNA, 17 nt, Homo sapiens
aauccuaaauaauguua

SEQ ID NO: 715523 - RNA, 15 nt, Homo sapiens
aauccuaacauucag

SEQ ID NO: 715524 - RNA, 18 nt, Homo sapiens
aauccuaguaugccaaaa

SEQ ID NO: 715525 - RNA, 17 nt, Homo sapiens
aauccuauuaaaacaca

SEQ ID NO: 715526 - RNA, 16 nt, Homo sapiens
aaggcagucauaucaa

SEQ ID NO: 715527 - RNA, 23 nt, Homo sapiens
aaggcauguggccuuuaucucaa

SEQ ID NO: 715528 - RNA, 18 nt, Homo sapiens
aaggcauuuauugccaua

SEQ ID NO: 715529 - RNA, 19 nt, Homo sapiens
aaggccacugcuacaucuc

SEQ ID NO: 715530 - RNA, 22 nt, Homo sapiens
aaggccagcgccagaacccaga

SEQ ID NO: 715531 - RNA, 14 nt, Homo sapiens
aaggcccucaguga

SEQ ID NO: 715532 - RNA, 17 nt, Homo sapiens
aaggcccugcugaguca

SEQ ID NO: 715533 - RNA, 14 nt, Homo sapiens
aaggcccuucagcc

SEQ ID NO: 715534 - RNA, 22 nt, Homo sapiens
aaggccucuuguugagugccag

SEQ ID NO: 715535 - RNA, 21 nt, Homo sapiens
aaggcgaguggauaauuccaa

SEQ ID NO: 715536 - RNA, 17 nt, Homo sapiens
aaggcggcaggugggac

SEQ ID NO: 715537 - RNA, 17 nt, Homo sapiens
aaggcguccauguuuau

SEQ ID NO: 715538 - RNA, 13 nt, Homo sapiens
aaggcucagucuc

SEQ ID NO: 715539 - RNA, 15 nt, Homo sapiens
aaggcucccuguccu

SEQ ID NO: 715540 - RNA, 21 nt, Homo sapiens
aaggcucuuacccccuuuuaa

SEQ ID NO: 715541 - RNA, 17 nt, Homo sapiens
aaggcugaccaagagag

SEQ ID NO: 715542 - RNA, 20 nt, Homo sapiens
aaggcugagacagugaauuu

SEQ ID NO: 715543 - RNA, 22 nt, Homo sapiens
aaggcugaggcaggaggaucau

SEQ ID NO: 715544 - RNA, 13 nt, Homo sapiens
aaggcugcuguga

SEQ ID NO: 715545 - RNA, 20 nt, Homo sapiens
aaggcuggauggcaccucag

SEQ ID NO: 715546 - RNA, 15 nt, Homo sapiens
aagggaaaacccuca

SEQ ID NO: 715547 - RNA, 13 nt, Homo sapiens
aagggaaacuauu

SEQ ID NO: 715548 - RNA, 16 nt, Homo sapiens
aagggaaauuguuuau

SEQ ID NO: 715549 - RNA, 22 nt, Homo sapiens
aagggaacuugagcgugaaucu

SEQ ID NO: 715550 - RNA, 14 nt, Homo sapiens
aagggaauugcuca

SEQ ID NO: 715551 - RNA, 15 nt, Homo sapiens
aagggaauugcucag

SEQ ID NO: 715552 - RNA, 16 nt, Homo sapiens
aagggacaaguauuaa

SEQ ID NO: 715553 - RNA, 19 nt, Homo sapiens
aagggacaccaagccuugg

SEQ ID NO: 715554 - RNA, 22 nt, Homo sapiens
aagggacagcaagugagcagag

SEQ ID NO: 715555 - RNA, 21 nt, Homo sapiens
aagggagaacuugaaacagau

SEQ ID NO: 715556 - RNA, 16 nt, Homo sapiens
aagggagguggcaaga

SEQ ID NO: 715557 - RNA, 13 nt, Homo sapiens
aagggagugcaug

SEQ ID NO: 715558 - RNA, 15 nt, Homo sapiens
aagggauaguccaaa

SEQ ID NO: 715559 - RNA, 16 nt, Homo sapiens
aagggaucuuccuugg

SEQ ID NO: 715560 - RNA, 17 nt, Homo sapiens
aagggauguucacugua

SEQ ID NO: 715561 - RNA, 12 nt, Homo sapiens
aagggauugcuu

SEQ ID NO: 715562 - RNA, 23 nt, Homo sapiens
aagggauuugaggugaggguugg

SEQ ID NO: 715563 - RNA, 13 nt, Homo sapiens
aagggcacuccca

SEQ ID NO: 715564 - RNA, 14 nt, Homo sapiens
aagggcuggcugca

SEQ ID NO: 715565 - RNA, 14 nt, Homo sapiens
aaggggaaggaaga

SEQ ID NO: 715566 - RNA, 21 nt, Homo sapiens
aaggggacaccuguacauucu

SEQ ID NO: 715567 - RNA, 17 nt, Homo sapiens
aagggggguugcagugg

SEQ ID NO: 715568 - RNA, 14 nt, Homo sapiens
aagggggugacugg

SEQ ID NO: 715569 - RNA, 22 nt, Homo sapiens
aaggguaccuugaacacugggg

SEQ ID NO: 715570 - RNA, 23 nt, Homo sapiens
aaggguaccuugaacacuggggg

SEQ ID NO: 715571 - RNA, 21 nt, Homo sapiens
aagggugcccuuugggguccc

SEQ ID NO: 715572 - RNA, 21 nt, Homo sapiens
aagggugugggccaccagaga

SEQ ID NO: 715573 - RNA, 18 nt, Homo sapiens
aaggguuaggacucucca

SEQ ID NO: 715574 - RNA, 13 nt, Homo sapiens
aaggguucuuucc

SEQ ID NO: 715575 - RNA, 18 nt, Homo sapiens
aagguacuauauuugcua

SEQ ID NO: 715576 - RNA, 17 nt, Homo sapiens
aagguauauugugaacc

SEQ ID NO: 715577 - RNA, 16 nt, Homo sapiens
aagguaugcaaucaaa

SEQ ID NO: 715578 - RNA, 14 nt, Homo sapiens
aaggucaguuugau

SEQ ID NO: 715579 - RNA, 18 nt, Homo sapiens
aaggucaucaugcuccac

SEQ ID NO: 715580 - RNA, 23 nt, Homo sapiens
aagguccaacaagaaugcauucc

SEQ ID NO: 715581 - RNA, 17 nt, Homo sapiens
aagguccucacaggugu

SEQ ID NO: 715582 - RNA, 18 nt, Homo sapiens
aagguccugcuguggaaa

SEQ ID NO: 715583 - RNA, 19 nt, Homo sapiens
aaggucuccuaaaacuggg

SEQ ID NO: 715584 - RNA, 17 nt, Homo sapiens
aaggucuuggugccucu

SEQ ID NO: 715585 - RNA, 15 nt, Homo sapiens
aaggugaaccaaaga

SEQ ID NO: 715586 - RNA, 16 nt, Homo sapiens
aaggugaagagaccaa

SEQ ID NO: 715587 - RNA, 17 nt, Homo sapiens
aaggugaguuugagcug

SEQ ID NO: 715588 - RNA, 16 nt, Homo sapiens
aaggugccucauagca

SEQ ID NO: 715589 - RNA, 20 nt, Homo sapiens
aaggugcuggacuguuacug

SEQ ID NO: 715590 - RNA, 23 nt, Homo sapiens
aagguggcuuuuagcauucugug

SEQ ID NO: 715591 - RNA, 22 nt, Homo sapiens
aaggugggccuugcuaccucaa

SEQ ID NO: 715592 - RNA, 17 nt, Homo sapiens
aagguggucaucugcca

SEQ ID NO: 715593 - RNA, 23 nt, Homo sapiens
aaggugucccugccuucacugug

SEQ ID NO: 715594 - RNA, 17 nt, Homo sapiens
aagguguuuccauuucu

SEQ ID NO: 715595 - RNA, 13 nt, Homo sapiens
aagguuaaaccca

SEQ ID NO: 715596 - RNA, 13 nt, Homo sapiens
aagguuaucagug

SEQ ID NO: 715597 - RNA, 18 nt, Homo sapiens
aagguugcagugcugagc

SEQ ID NO: 715598 - RNA, 20 nt, Homo sapiens
aagguuggaggaucauuuga

SEQ ID NO: 715599 - RNA, 19 nt, Homo sapiens
aagguuggugaauuucaca

SEQ ID NO: 715600 - RNA, 23 nt, Homo sapiens
aaguaaaaacacuaccucuuuug

SEQ ID NO: 715601 - RNA, 15 nt, Homo sapiens
aaguaaaaccacagc

SEQ ID NO: 715602 - RNA, 14 nt, Homo sapiens
aaguaagacuuuua

SEQ ID NO: 715603 - RNA, 15 nt, Homo sapiens
aaguaaggcaugguu

SEQ ID NO: 715604 - RNA, 15 nt, Homo sapiens
aaguaaguaccacuc

SEQ ID NO: 715605 - RNA, 14 nt, Homo sapiens
aaguaaugcuucaa

SEQ ID NO: 715606 - RNA, 24 nt, Homo sapiens
aaguaauuccuguauucuacagca

SEQ ID NO: 715607 - RNA, 14 nt, Homo sapiens
aaguaauugugaaa

SEQ ID NO: 715608 - RNA, 11 nt, Homo sapiens
aaguacaucuc

SEQ ID NO: 715609 - RNA, 20 nt, Homo sapiens
aaguaccacacauauugcac

SEQ ID NO: 715610 - RNA, 15 nt, Homo sapiens
aaguaccacucaggc

SEQ ID NO: 715611 - RNA, 15 nt, Homo sapiens
aaguaccuguaguga

SEQ ID NO: 715612 - RNA, 18 nt, Homo sapiens
aaguaccuguagugagaa

SEQ ID NO: 715613 - RNA, 15 nt, Homo sapiens
aaguacuguuuugaa

SEQ ID NO: 715614 - RNA, 12 nt, Homo sapiens
aaguacuuccac

SEQ ID NO: 715615 - RNA, 11 nt, Homo sapiens
aaguacuuuac

SEQ ID NO: 715616 - RNA, 20 nt, Homo sapiens
aaguagaagucauauguugu

SEQ ID NO: 715617 - RNA, 18 nt, Homo sapiens
aaguagauuuuaaaagau

SEQ ID NO: 715618 - RNA, 20 nt, Homo sapiens
aaguagcaaaaaguauugaa

SEQ ID NO: 715619 - RNA, 12 nt, Homo sapiens
aaguagcaauuu

SEQ ID NO: 715620 - RNA, 17 nt, Homo sapiens
aaguagcacccuggauu

SEQ ID NO: 715621 - RNA, 18 nt, Homo sapiens
aaguagcucuggugaccu

SEQ ID NO: 715622 - RNA, 14 nt, Homo sapiens
aaguagcugggacu

SEQ ID NO: 715623 - RNA, 21 nt, Homo sapiens
aaguagcugucagaugucaca

SEQ ID NO: 715624 - RNA, 22 nt, Homo sapiens
aaguagucucuccccuggccac

SEQ ID NO: 715625 - RNA, 12 nt, Homo sapiens
aaguagugugaa

SEQ ID NO: 715626 - RNA, 19 nt, Homo sapiens
aaguauaaucagcacuuug

SEQ ID NO: 715627 - RNA, 19 nt, Homo sapiens
aaguaugccuuaagcagaa

SEQ ID NO: 715628 - RNA, 16 nt, Homo sapiens
aaguaugguauuacaa

SEQ ID NO: 715629 - RNA, 19 nt, Homo sapiens
aaguauuauuuauuugaau

SEQ ID NO: 715630 - RNA, 18 nt, Homo sapiens
aaguauugcaccuuugaa

SEQ ID NO: 715631 - RNA, 19 nt, Homo sapiens
aagucaaagaagacucagu

SEQ ID NO: 715632 - RNA, 13 nt, Homo sapiens
aagucaagcacau

SEQ ID NO: 715633 - RNA, 17 nt, Homo sapiens
aagucaaguuuguggcu

SEQ ID NO: 715634 - RNA, 17 nt, Homo sapiens
aagucacucacacuggc

SEQ ID NO: 715635 - RNA, 19 nt, Homo sapiens
aagucacucacacuggcca

SEQ ID NO: 715636 - RNA, 15 nt, Homo sapiens
aagucacugaacaaa

SEQ ID NO: 715637 - RNA, 15 nt, Homo sapiens
aagucacuggccagu

SEQ ID NO: 715638 - RNA, 19 nt, Homo sapiens
aagucagaggagauguggu

SEQ ID NO: 715639 - RNA, 22 nt, Homo sapiens
aagucagcuccagcuuucugcc

SEQ ID NO: 715640 - RNA, 20 nt, Homo sapiens
aagucaguacccaccaccuu

SEQ ID NO: 715641 - RNA, 19 nt, Homo sapiens
aacacuuggcauacaaaau

SEQ ID NO: 715642 - RNA, 18 nt, Homo sapiens
aacagaaaacaucccacu

SEQ ID NO: 715643 - RNA, 12 nt, Homo sapiens
aacagaaaccau

SEQ ID NO: 715644 - RNA, 18 nt, Homo sapiens
aacagaaauagacuuaau

SEQ ID NO: 715645 - RNA, 14 nt, Homo sapiens
aacagaagcuucca

SEQ ID NO: 715646 - RNA, 21 nt, Homo sapiens
aacagacucauaccacacuua

SEQ ID NO: 715647 - RNA, 13 nt, Homo sapiens
aacagaggccaug

SEQ ID NO: 715648 - RNA, 14 nt, Homo sapiens
aacagauauuguca

SEQ ID NO: 715649 - RNA, 18 nt, Homo sapiens
aacagcaacacagccacu

SEQ ID NO: 715650 - RNA, 21 nt, Homo sapiens
aacagcaccuccccgcuggga

SEQ ID NO: 715651 - RNA, 20 nt, Homo sapiens
aacagcagugaucucagggc

SEQ ID NO: 715652 - RNA, 16 nt, Homo sapiens
aacagcauaacuaaau

SEQ ID NO: 715653 - RNA, 16 nt, Homo sapiens
aacagcaucaauuuuc

SEQ ID NO: 715654 - RNA, 14 nt, Homo sapiens
aacagcaugaauaa

SEQ ID NO: 715655 - RNA, 21 nt, Homo sapiens
aacagcauucuugucacaaua

SEQ ID NO: 715656 - RNA, 11 nt, Homo sapiens
aacagcauuua

SEQ ID NO: 715657 - RNA, 12 nt, Homo sapiens
aacagcauuuag

SEQ ID NO: 715658 - RNA, 14 nt, Homo sapiens
aacagccacaaaau

SEQ ID NO: 715659 - RNA, 18 nt, Homo sapiens
aacagcccuccucugcac

SEQ ID NO: 715660 - RNA, 16 nt, Homo sapiens
aacagcugcauuagaa

SEQ ID NO: 715661 - RNA, 17 nt, Homo sapiens
aacagcuugcugucacu

SEQ ID NO: 715662 - RNA, 20 nt, Homo sapiens
aacaggaauccuuacugaua

SEQ ID NO: 715663 - RNA, 15 nt, Homo sapiens
aacaggaaucucaga

SEQ ID NO: 715664 - RNA, 21 nt, Homo sapiens
aacaggcaguggaagcaguuu

SEQ ID NO: 715665 - RNA, 12 nt, Homo sapiens
aacaggcauuug

SEQ ID NO: 715666 - RNA, 18 nt, Homo sapiens
aacaggcucaauauuccu

SEQ ID NO: 715667 - RNA, 13 nt, Homo sapiens
aacagggcauuuu

SEQ ID NO: 715668 - RNA, 18 nt, Homo sapiens
aacagguauauacuuuga

SEQ ID NO: 715669 - RNA, 19 nt, Homo sapiens
aacagguauauacuuugaa

SEQ ID NO: 715670 - RNA, 14 nt, Homo sapiens
aacagucucaggaa

SEQ ID NO: 715671 - RNA, 13 nt, Homo sapiens
aacaguguaccuu

SEQ ID NO: 715672 - RNA, 18 nt, Homo sapiens
aacaguuguauguuugcu

SEQ ID NO: 715673 - RNA, 16 nt, Homo sapiens
aacaguuuuugcuaau

SEQ ID NO: 715674 - RNA, 21 nt, Homo sapiens
aacauaaaaaauaaaguacca

SEQ ID NO: 715675 - RNA, 19 nt, Homo sapiens
aacauaaagagaacucugg

SEQ ID NO: 715676 - RNA, 15 nt, Homo sapiens
aacauaaucuaguuu

SEQ ID NO: 715677 - RNA, 16 nt, Homo sapiens
aacauaauucacuuuc

SEQ ID NO: 715678 - RNA, 15 nt, Homo sapiens
aacauaauucucuca

SEQ ID NO: 715679 - RNA, 19 nt, Homo sapiens
aacauaugaggaaucugca

SEQ ID NO: 715680 - RNA, 12 nt, Homo sapiens
aacaucaaagag

SEQ ID NO: 715681 - RNA, 22 nt, Homo sapiens
aacaucagcugaauucacuuaa

SEQ ID NO: 715682 - RNA, 17 nt, Homo sapiens
aacaucauggacugagc

SEQ ID NO: 715683 - RNA, 19 nt, Homo sapiens
aacauccacaauaaccaag

SEQ ID NO: 715684 - RNA, 23 nt, Homo sapiens
aacauccuggcuuuugagcacuu

SEQ ID NO: 715685 - RNA, 16 nt, Homo sapiens
aacaucucaauaacaa

SEQ ID NO: 715686 - RNA, 19 nt, Homo sapiens
aacaucuuaagauccacaa

SEQ ID NO: 715687 - RNA, 18 nt, Homo sapiens
aacaucuuuuacauucug

SEQ ID NO: 715688 - RNA, 23 nt, Homo sapiens
aacaucuuuucuugccucugucc

SEQ ID NO: 715689 - RNA, 16 nt, Homo sapiens
aacaugaaacuuguca

SEQ ID NO: 715690 - RNA, 19 nt, Homo sapiens
aacaugaccacucuuggcu

SEQ ID NO: 715691 - RNA, 15 nt, Homo sapiens
aacaugcacauuuau

SEQ ID NO: 715692 - RNA, 12 nt, Homo sapiens
aacaugcacggu

SEQ ID NO: 715693 - RNA, 13 nt, Homo sapiens
caggagucccugc

SEQ ID NO: 715694 - RNA, 21 nt, Homo sapiens
caggaguguccuggcugugaa

SEQ ID NO: 715695 - RNA, 15 nt, Homo sapiens
caggauacucuguca

SEQ ID NO: 715696 - RNA, 22 nt, Homo sapiens
caggauacuggcacagagguag

SEQ ID NO: 715697 - RNA, 17 nt, Homo sapiens
caggauaucacauugga

SEQ ID NO: 715698 - RNA, 16 nt, Homo sapiens
caggauauugacaaga

SEQ ID NO: 715699 - RNA, 13 nt, Homo sapiens
caggaucaccucc

SEQ ID NO: 715700 - RNA, 23 nt, Homo sapiens
caggaucagaugacucucuccaa

SEQ ID NO: 715701 - RNA, 19 nt, Homo sapiens
caggaucagcuccaucuca

SEQ ID NO: 715702 - RNA, 18 nt, Homo sapiens
caggaucuuugacugaaa

SEQ ID NO: 715703 - RNA, 22 nt, Homo sapiens
caggaugcugugauacacugaa

SEQ ID NO: 715704 - RNA, 20 nt, Homo sapiens
caggauggucucgaucuccu

SEQ ID NO: 715705 - RNA, 23 nt, Homo sapiens
caggauggugggcaggaucucaa

SEQ ID NO: 715706 - RNA, 20 nt, Homo sapiens
caggaugucccugaaacuuc

SEQ ID NO: 715707 - RNA, 12 nt, Homo sapiens
caggauucauug

SEQ ID NO: 715708 - RNA, 22 nt, Homo sapiens
caggcaauuucaccaccaaaug

SEQ ID NO: 715709 - RNA, 12 nt, Homo sapiens
caggcacaggcc

SEQ ID NO: 715710 - RNA, 19 nt, Homo sapiens
caggcacagguccccagau

SEQ ID NO: 715711 - RNA, 16 nt, Homo sapiens
caggcacuaagacuaa

SEQ ID NO: 715712 - RNA, 15 nt, Homo sapiens
caggcagauccagga

SEQ ID NO: 715713 - RNA, 23 nt, Homo sapiens
caggcagccagugugacacugcu

SEQ ID NO: 715714 - RNA, 12 nt, Homo sapiens
caggcaggagca

SEQ ID NO: 715715 - RNA, 16 nt, Homo sapiens
caggcaugcaagugag

SEQ ID NO: 715716 - RNA, 19 nt, Homo sapiens
caggcauggcgaggcugag

SEQ ID NO: 715717 - RNA, 23 nt, Homo sapiens
aaauuccuuagcuuagaccucag

SEQ ID NO: 715718 - RNA, 23 nt, Homo sapiens
aaauuccuuggcaugccuuccag

SEQ ID NO: 715719 - RNA, 15 nt, Homo sapiens
aaauucgcaaacuuu

SEQ ID NO: 715720 - RNA, 21 nt, Homo sapiens
aaauucugauguuucugugaa

SEQ ID NO: 715721 - RNA, 17 nt, Homo sapiens
aaauucuuuaguacuca

SEQ ID NO: 715722 - RNA, 15 nt, Homo sapiens
aaauugacaugcugu

SEQ ID NO: 715723 - RNA, 16 nt, Homo sapiens
aaauugcagauaccau

SEQ ID NO: 715724 - RNA, 23 nt, Homo sapiens
aaauugccugcaaaaaugaaauc

SEQ ID NO: 715725 - RNA, 13 nt, Homo sapiens
aaauugcugcuug

SEQ ID NO: 715726 - RNA, 15 nt, Homo sapiens
aaauugggcugugaa

SEQ ID NO: 715727 - RNA, 19 nt, Homo sapiens
aaauuguaucucagucuaa

SEQ ID NO: 715728 - RNA, 17 nt, Homo sapiens
aaauuguugugcuuaga

SEQ ID NO: 715729 - RNA, 15 nt, Homo sapiens
aaauuuaacugcaua

SEQ ID NO: 715730 - RNA, 13 nt, Homo sapiens
aaauuuaagcaaa

SEQ ID NO: 715731 - RNA, 15 nt, Homo sapiens
aaauuuaaugcugcc

SEQ ID NO: 715732 - RNA, 22 nt, Homo sapiens
aaauuuaugcauuucauucaaa

SEQ ID NO: 715733 - RNA, 22 nt, Homo sapiens
aaauuuauuugaaaaugcauca

SEQ ID NO: 715734 - RNA, 22 nt, Homo sapiens
aaauuuauuuuguguuguucau

SEQ ID NO: 715735 - RNA, 14 nt, Homo sapiens
aaauuucaccacug

SEQ ID NO: 715736 - RNA, 13 nt, Homo sapiens
aaauuucauagcu

SEQ ID NO: 715737 - RNA, 16 nt, Homo sapiens
aaauuucuacaccaag

SEQ ID NO: 715738 - RNA, 17 nt, Homo sapiens
aaauuucuaucagccuu

SEQ ID NO: 715739 - RNA, 22 nt, Homo sapiens
aaauuucucauuagugguacug

SEQ ID NO: 715740 - RNA, 15 nt, Homo sapiens
aaauuucuucugggc

SEQ ID NO: 715741 - RNA, 18 nt, Homo sapiens
aaauuuggccucuggccu

SEQ ID NO: 715742 - RNA, 20 nt, Homo sapiens
aaauuuguaaaucuuauucu

SEQ ID NO: 715743 - RNA, 20 nt, Homo sapiens
aaauuugugucauaccagaa

SEQ ID NO: 715744 - RNA, 18 nt, Homo sapiens
aaauuuuggggggaacau

SEQ ID NO: 715745 - RNA, 21 nt, Homo sapiens
aaauuuuggucauagcauuca

SEQ ID NO: 715746 - RNA, 16 nt, Homo sapiens
aaauuuuuaaauauuc

SEQ ID NO: 715747 - RNA, 15 nt, Homo sapiens
aaauuuuuacaucaa

SEQ ID NO: 715748 - RNA, 16 nt, Homo sapiens
aaauuuuuacugagaa

SEQ ID NO: 715749 - RNA, 11 nt, Homo sapiens
aacaaaaagcc

SEQ ID NO: 715750 - RNA, 19 nt, Homo sapiens
aacaaaaauguaaugauca

SEQ ID NO: 715751 - RNA, 12 nt, Homo sapiens
aacaaaaccaag

SEQ ID NO: 715752 - RNA, 21 nt, Homo sapiens
aacaaaacccucagcacuguu

SEQ ID NO: 715753 - RNA, 13 nt, Homo sapiens
aacaaaaggacuu

SEQ ID NO: 715754 - RNA, 15 nt, Homo sapiens
aacaaacaaacaauu

SEQ ID NO: 715755 - RNA, 12 nt, Homo sapiens
aacaaacagggc

SEQ ID NO: 715756 - RNA, 14 nt, Homo sapiens
aacaaagaaugggc

SEQ ID NO: 715757 - RNA, 14 nt, Homo sapiens
aacaaauaugcaaa

SEQ ID NO: 715758 - RNA, 15 nt, Homo sapiens
aacaaaugugcugcu

SEQ ID NO: 715759 - RNA, 21 nt, Homo sapiens
aacaaauucuuuaguacucaa

SEQ ID NO: 715760 - RNA, 22 nt, Homo sapiens
aacaacaaagacaugcuuucca

SEQ ID NO: 715761 - RNA, 19 nt, Homo sapiens
aacaacaauaacacugucu

SEQ ID NO: 715762 - RNA, 16 nt, Homo sapiens
aacaacaauaauaaag

SEQ ID NO: 715763 - RNA, 19 nt, Homo sapiens
aacaacagcuucaguccau

SEQ ID NO: 715764 - RNA, 12 nt, Homo sapiens
aacaacauuuau

SEQ ID NO: 715765 - RNA, 21 nt, Homo sapiens
aacaacguguauagugccuaa

SEQ ID NO: 715766 - RNA, 20 nt, Homo sapiens
aacaacguugacaaguuuug

SEQ ID NO: 715767 - RNA, 14 nt, Homo sapiens
aacaacuacuguga

SEQ ID NO: 715768 - RNA, 21 nt, Homo sapiens
aacaacucugauuaacuauuc

SEQ ID NO: 715769 - RNA, 19 nt, Homo sapiens
aacaacuguggucaauccg

SEQ ID NO: 715770 - RNA, 14 nt, Homo sapiens
agguagcuuaccug

SEQ ID NO: 715771 - RNA, 17 nt, Homo sapiens
agguaggaucaucccac

SEQ ID NO: 715772 - RNA, 22 nt, Homo sapiens
agguaggcauucugagcagggg

SEQ ID NO: 715773 - RNA, 19 nt, Homo sapiens
agguaggggcccacuucac

SEQ ID NO: 715774 - RNA, 20 nt, Homo sapiens
agguauauaaauuuucccaa

SEQ ID NO: 715775 - RNA, 17 nt, Homo sapiens
agguauauagaacacaa

SEQ ID NO: 715776 - RNA, 18 nt, Homo sapiens
agguauaucucccagugc

SEQ ID NO: 715777 - RNA, 23 nt, Homo sapiens
agguauccaaaaauguguaagaa

SEQ ID NO: 715778 - RNA, 19 nt, Homo sapiens
agguaucuguuuaacauuu

SEQ ID NO: 715779 - RNA, 21 nt, Homo sapiens
agguauggcagaggugcaaga

SEQ ID NO: 715780 - RNA, 20 nt, Homo sapiens
agguauuacacaagccaaaa

SEQ ID NO: 715781 - RNA, 18 nt, Homo sapiens
agguauuagcaaagcaaa

SEQ ID NO: 715782 - RNA, 15 nt, Homo sapiens
agguauuagugcuag

SEQ ID NO: 715783 - RNA, 16 nt, Homo sapiens
agguauuagugcuagu

SEQ ID NO: 715784 - RNA, 20 nt, Homo sapiens
agguauuucuccaguuggga

SEQ ID NO: 715785 - RNA, 21 nt, Homo sapiens
agguauuuuguagaugugauu

SEQ ID NO: 715786 - RNA, 17 nt, Homo sapiens
aggucaaaaaucugucc

SEQ ID NO: 715787 - RNA, 22 nt, Homo sapiens
aggucaaggcugcagugagcca

SEQ ID NO: 715788 - RNA, 14 nt, Homo sapiens
aggucaaguaagaa

SEQ ID NO: 715789 - RNA, 12 nt, Homo sapiens
aggucacuccug

SEQ ID NO: 715790 - RNA, 16 nt, Homo sapiens
aggucacugucacugc

SEQ ID NO: 715791 - RNA, 16 nt, Homo sapiens
aggucagagaugggcu

SEQ ID NO: 715792 - RNA, 16 nt, Homo sapiens
aggucaggaguugaag

SEQ ID NO: 715793 - RNA, 15 nt, Homo sapiens
aggucaggaugcaca

SEQ ID NO: 715794 - RNA, 19 nt, Homo sapiens
aggucauacaugcauacaa

SEQ ID NO: 715795 - RNA, 22 nt, Homo sapiens
aggucaucuggcggaggucucu

SEQ ID NO: 715796 - RNA, 11 nt, Homo sapiens
aggucaugccu

SEQ ID NO: 715797 - RNA, 13 nt, Homo sapiens
aggucaugggaag

SEQ ID NO: 715798 - RNA, 20 nt, Homo sapiens
aggucccggcuccugugcug

SEQ ID NO: 715799 - RNA, 15 nt, Homo sapiens
agguccugcugugga

SEQ ID NO: 715800 - RNA, 16 nt, Homo sapiens
agguccugcuguggaa

SEQ ID NO: 715801 - RNA, 21 nt, Homo sapiens
agguccuuguuguuucuugcc

SEQ ID NO: 715802 - RNA, 14 nt, Homo sapiens
aggucggagugccu

SEQ ID NO: 715803 - RNA, 17 nt, Homo sapiens
aggucuccuaaaacugg

SEQ ID NO: 715804 - RNA, 16 nt, Homo sapiens
aggucugaaauggagg

SEQ ID NO: 715805 - RNA, 20 nt, Homo sapiens
aggucugcucugcuccugaa

SEQ ID NO: 715806 - RNA, 11 nt, Homo sapiens
aggucuugacu

SEQ ID NO: 715807 - RNA, 13 nt, Homo sapiens
aggucuuuggucu

SEQ ID NO: 715808 - RNA, 16 nt, Homo sapiens
aggugaaagaaaccac

SEQ ID NO: 715809 - RNA, 17 nt, Homo sapiens
aggugaacugggagcag

SEQ ID NO: 715810 - RNA, 14 nt, Homo sapiens
aggugaagcacaua

SEQ ID NO: 715811 - RNA, 16 nt, Homo sapiens
aggugacccugaugaa

SEQ ID NO: 715812 - RNA, 22 nt, Homo sapiens
aggugacuucagaauaacagca

SEQ ID NO: 715813 - RNA, 19 nt, Homo sapiens
aggugagcagaacaccuga

SEQ ID NO: 715814 - RNA, 19 nt, Homo sapiens
aggugaguuugagcugccu

SEQ ID NO: 715815 - RNA, 19 nt, Homo sapiens
aggugauccacccaccuca

SEQ ID NO: 715816 - RNA, 19 nt, Homo sapiens
aggugauccgccuaccuca

SEQ ID NO: 715817 - RNA, 15 nt, Homo sapiens
aggugaucucuggga

SEQ ID NO: 715818 - RNA, 19 nt, Homo sapiens
aggugauguuuccagcugc

SEQ ID NO: 715819 - RNA, 19 nt, Homo sapiens
aggugcagagugcccagaa

SEQ ID NO: 715820 - RNA, 22 nt, Homo sapiens
aggugcaggggaagaccaaagu

SEQ ID NO: 715821 - RNA, 18 nt, Homo sapiens
aggugcauagcaagugaa

SEQ ID NO: 715822 - RNA, 19 nt, Homo sapiens
aggugcauagcaagugaaa

SEQ ID NO: 715823 - RNA, 18 nt, Homo sapiens
aggugcuacaaaaacaca

SEQ ID NO: 715824 - RNA, 18 nt, Homo sapiens
aggugcuacaacauguga

SEQ ID NO: 715825 - RNA, 21 nt, Homo sapiens
aggugcuauguucuuagugga

SEQ ID NO: 715826 - RNA, 17 nt, Homo sapiens
aggugcugaaugaagcu

SEQ ID NO: 715827 - RNA, 22 nt, Homo sapiens
aggugcugauccuaagaauuuu

SEQ ID NO: 715828 - RNA, 19 nt, Homo sapiens
aggugcuucugccugugca

SEQ ID NO: 715829 - RNA, 15 nt, Homo sapiens
aggugcuucuucacu

SEQ ID NO: 715830 - RNA, 13 nt, Homo sapiens
agguggaaugugu

SEQ ID NO: 715831 - RNA, 23 nt, Homo sapiens
agguggacgggguugucgagauc

SEQ ID NO: 715832 - RNA, 17 nt, Homo sapiens
agguggagacccugaga

SEQ ID NO: 715833 - RNA, 15 nt, Homo sapiens
agguggccacuccag

SEQ ID NO: 715834 - RNA, 16 nt, Homo sapiens
agguggccccaguuca

SEQ ID NO: 715835 - RNA, 19 nt, Homo sapiens
aggugggaucacuaaggga

SEQ ID NO: 715836 - RNA, 20 nt, Homo sapiens
aggugggcagaucacuggag

SEQ ID NO: 715837 - RNA, 14 nt, Homo sapiens
agguggguccagga

SEQ ID NO: 715838 - RNA, 19 nt, Homo sapiens
aggugucuuaauacugucc

SEQ ID NO: 715839 - RNA, 15 nt, Homo sapiens
aggugugacuugaac

SEQ ID NO: 715840 - RNA, 21 nt, Homo sapiens
aggugugcccuguacacaggc

SEQ ID NO: 715841 - RNA, 23 nt, Homo sapiens
agguguggggacacagcagugag

SEQ ID NO: 715842 - RNA, 21 nt, Homo sapiens
agguguucuucauuaccucag

SEQ ID NO: 715843 - RNA, 16 nt, Homo sapiens
agguguugccauuucu

SEQ ID NO: 715844 - RNA, 19 nt, Homo sapiens
agguguuggcugcacgugc

SEQ ID NO: 715845 - RNA, 14 nt, Homo sapiens
agguguuucuuucc

SEQ ID NO: 715846 - RNA, 16 nt, Homo sapiens
agguuaaauuucaagc

SEQ ID NO: 715847 - RNA, 16 nt, Homo sapiens
agguuacaagccugca

SEQ ID NO: 715848 - RNA, 23 nt, Homo sapiens
agguuaucugccuggccuggcuc

SEQ ID NO: 715849 - RNA, 15 nt, Homo sapiens
agguucacaccauuu

SEQ ID NO: 715850 - RNA, 14 nt, Homo sapiens
agguucagccugaa

SEQ ID NO: 715851 - RNA, 13 nt, Homo sapiens
agguucaguauua

SEQ ID NO: 715852 - RNA, 16 nt, Homo sapiens
agguucuaaaguucua

SEQ ID NO: 715853 - RNA, 20 nt, Homo sapiens
agguucuaaaguucuaagau

SEQ ID NO: 715854 - RNA, 13 nt, Homo sapiens
agguucucaccuc

SEQ ID NO: 715855 - RNA, 15 nt, Homo sapiens
agguucucaccucag

SEQ ID NO: 715856 - RNA, 19 nt, Homo sapiens
agguucucagguguugcca

SEQ ID NO: 715857 - RNA, 17 nt, Homo sapiens
agguucugguuccauuu

SEQ ID NO: 715858 - RNA, 22 nt, Homo sapiens
agguucuugaugucauguacuu

SEQ ID NO: 715859 - RNA, 20 nt, Homo sapiens
agguugcagugagccaugau

SEQ ID NO: 715860 - RNA, 16 nt, Homo sapiens
agguugccaaauugcu

SEQ ID NO: 715861 - RNA, 14 nt, Homo sapiens
agguuggugacuga

SEQ ID NO: 715862 - RNA, 19 nt, Homo sapiens
agguuguuaauguacaaaa

SEQ ID NO: 715863 - RNA, 21 nt, Homo sapiens
agguuucuugaauaucugccc

SEQ ID NO: 715864 - RNA, 14 nt, Homo sapiens
agguuugcacuucc

SEQ ID NO: 715865 - RNA, 18 nt, Homo sapiens
agguuugucccagucaga

SEQ ID NO: 715866 - RNA, 17 nt, Homo sapiens
agguuuuaaagugauua

SEQ ID NO: 715867 - RNA, 14 nt, Homo sapiens
agguuuuaacugaa

SEQ ID NO: 715868 - RNA, 13 nt, Homo sapiens
caaguuuccauag

SEQ ID NO: 715869 - RNA, 20 nt, Homo sapiens
caaguuucugauaccacugc

SEQ ID NO: 715870 - RNA, 20 nt, Homo sapiens
caauaaagggagaauggugc

SEQ ID NO: 715871 - RNA, 16 nt, Homo sapiens
caauaaaguuugccca

SEQ ID NO: 715872 - RNA, 22 nt, Homo sapiens
caauaaauuuuuuuuggucaaa

SEQ ID NO: 715873 - RNA, 16 nt, Homo sapiens
caauaacacugucucc

SEQ ID NO: 715874 - RNA, 13 nt, Homo sapiens
caauaacagguca

SEQ ID NO: 715875 - RNA, 20 nt, Homo sapiens
caauaaccgcuugguuugca

SEQ ID NO: 715876 - RNA, 19 nt, Homo sapiens
caauaacuuuucaccaaug

SEQ ID NO: 715877 - RNA, 22 nt, Homo sapiens
caauaacuuuucaccaaugagc

SEQ ID NO: 715878 - RNA, 21 nt, Homo sapiens
caauaauaaauauuuuugcca

SEQ ID NO: 715879 - RNA, 20 nt, Homo sapiens
caauaaugacaaaugcccug

SEQ ID NO: 715880 - RNA, 16 nt, Homo sapiens
caauaauuaccaauau

SEQ ID NO: 715881 - RNA, 14 nt, Homo sapiens
caauacaaccagcc

SEQ ID NO: 715882 - RNA, 13 nt, Homo sapiens
caacaauacaugc

SEQ ID NO: 715883 - RNA, 13 nt, Homo sapiens
caacaauauccuu

SEQ ID NO: 715884 - RNA, 22 nt, Homo sapiens
caacaaugacuuaaccauauaa

SEQ ID NO: 715885 - RNA, 18 nt, Homo sapiens
caacaauuuauccauuca

SEQ ID NO: 715886 - RNA, 22 nt, Homo sapiens
caacacaucuaauuaaauguag

SEQ ID NO: 715887 - RNA, 19 nt, Homo sapiens
caacaccccucccugccac

SEQ ID NO: 715888 - RNA, 10 nt, Homo sapiens
caacacugcu

SEQ ID NO: 715889 - RNA, 21 nt, Homo sapiens
caacacugucacuagucucac

SEQ ID NO: 715890 - RNA, 13 nt, Homo sapiens
caacacugugcac

SEQ ID NO: 715891 - RNA, 11 nt, Homo sapiens
caacacuuaag

SEQ ID NO: 715892 - RNA, 22 nt, Homo sapiens
caacagauggauagucugucca

SEQ ID NO: 715893 - RNA, 12 nt, Homo sapiens
caacagcacuuu

SEQ ID NO: 715894 - RNA, 15 nt, Homo sapiens
auugcucaucagcuu

SEQ ID NO: 715895 - RNA, 14 nt, Homo sapiens
auugcucccuacca

SEQ ID NO: 715896 - RNA, 20 nt, Homo sapiens
auugcuccuauacuauugaa

SEQ ID NO: 715897 - RNA, 16 nt, Homo sapiens
auugcucuaugucugc

SEQ ID NO: 715898 - RNA, 14 nt, Homo sapiens
auugcucucagugc

SEQ ID NO: 715899 - RNA, 22 nt, Homo sapiens
auugcugugucuccucucagag

SEQ ID NO: 715900 - RNA, 17 nt, Homo sapiens
auugcuuaaaagacauu

SEQ ID NO: 715901 - RNA, 14 nt, Homo sapiens
auugcuuuacuguc

SEQ ID NO: 715902 - RNA, 14 nt, Homo sapiens
auuggaaagcacac

SEQ ID NO: 715903 - RNA, 16 nt, Homo sapiens
auuggaaucugauaua

SEQ ID NO: 715904 - RNA, 23 nt, Homo sapiens
auuggacagcuacuucugggaaa

SEQ ID NO: 715905 - RNA, 15 nt, Homo sapiens
auuggauuuccuaau

SEQ ID NO: 715906 - RNA, 23 nt, Homo sapiens
auuggccacugggucucacuccu

SEQ ID NO: 715907 - RNA, 16 nt, Homo sapiens
auuggcccaacacugu

SEQ ID NO: 715908 - RNA, 17 nt, Homo sapiens
auugggaaggaugagau

SEQ ID NO: 715909 - RNA, 20 nt, Homo sapiens
auugggacuccaugcuccuu

SEQ ID NO: 715910 - RNA, 22 nt, Homo sapiens
auugggcacagccuagggucuu

SEQ ID NO: 715911 - RNA, 13 nt, Homo sapiens
auugggcaugcca

SEQ ID NO: 715912 - RNA, 16 nt, Homo sapiens
auugggccuuuuggau

SEQ ID NO: 715913 - RNA, 12 nt, Homo sapiens
auugguaaaaac

SEQ ID NO: 715914 - RNA, 20 nt, Homo sapiens
auugguauacuuuugcuuca

SEQ ID NO: 715915 - RNA, 17 nt, Homo sapiens
auuggugcauagcagau

SEQ ID NO: 715916 - RNA, 13 nt, Homo sapiens
auugguuauucaa

SEQ ID NO: 715917 - RNA, 13 nt, Homo sapiens
auugguucaccug

SEQ ID NO: 715918 - RNA, 15 nt, Homo sapiens
auugguuuugcagaa

SEQ ID NO: 715919 - RNA, 13 nt, Homo sapiens
auuguaacgacuu

SEQ ID NO: 715920 - RNA, 13 nt, Homo sapiens
auuguaacuaaua

SEQ ID NO: 715921 - RNA, 20 nt, Homo sapiens
auuguacaaauguaagcaaa

SEQ ID NO: 715922 - RNA, 21 nt, Homo sapiens
auuguacucaaugguaucauu

SEQ ID NO: 715923 - RNA, 16 nt, Homo sapiens
auuguacucugcuuua

SEQ ID NO: 715924 - RNA, 19 nt, Homo sapiens
auuguacuuccaggcuugg

SEQ ID NO: 715925 - RNA, 16 nt, Homo sapiens
auuguaguguucaaaa

SEQ ID NO: 715926 - RNA, 15 nt, Homo sapiens
auuguauuacagaug

SEQ ID NO: 715927 - RNA, 15 nt, Homo sapiens
auuguauuacuagaa

SEQ ID NO: 715928 - RNA, 18 nt, Homo sapiens
auuguauuccuccugaga

SEQ ID NO: 715929 - RNA, 14 nt, Homo sapiens
auuguauuuaguua

SEQ ID NO: 715930 - RNA, 20 nt, Homo sapiens
auugucagcucaaugaccug

SEQ ID NO: 715931 - RNA, 20 nt, Homo sapiens
auugucagucagcaaacucc

SEQ ID NO: 715932 - RNA, 22 nt, Homo sapiens
auugucauaggauuaagcaguu

SEQ ID NO: 715933 - RNA, 15 nt, Homo sapiens
auuguccccagggac

SEQ ID NO: 715934 - RNA, 17 nt, Homo sapiens
auugucgguuaccucug

SEQ ID NO: 715935 - RNA, 20 nt, Homo sapiens
auugucgguuaccucugcau

SEQ ID NO: 715936 - RNA, 14 nt, Homo sapiens
auugucuaaugaca

SEQ ID NO: 715937 - RNA, 17 nt, Homo sapiens
auugucuaaugacagau

SEQ ID NO: 715938 - RNA, 14 nt, Homo sapiens
auugucugucucua

SEQ ID NO: 715939 - RNA, 16 nt, Homo sapiens
auugugaaguacauau

SEQ ID NO: 715940 - RNA, 14 nt, Homo sapiens
auugugacuguguu

SEQ ID NO: 715941 - RNA, 10 nt, Homo sapiens
auugugaugu

SEQ ID NO: 715942 - RNA, 15 nt, Homo sapiens
auugugcaguacuuu

SEQ ID NO: 715943 - RNA, 16 nt, Homo sapiens
auugugcuucacagua

SEQ ID NO: 715944 - RNA, 15 nt, Homo sapiens
auuguggaaaaccag

SEQ ID NO: 715945 - RNA, 18 nt, Homo sapiens
auuguggugugagcuuca

SEQ ID NO: 715946 - RNA, 17 nt, Homo sapiens
auuguguuccugaagaa

SEQ ID NO: 715947 - RNA, 22 nt, Homo sapiens
auuguguucucuauugcugcuc

SEQ ID NO: 715948 - RNA, 15 nt, Homo sapiens
auuguuaaaauaacu

SEQ ID NO: 715949 - RNA, 14 nt, Homo sapiens
auuguuacaguacu

SEQ ID NO: 715950 - RNA, 20 nt, Homo sapiens
auuguuauacacagcuuuau

SEQ ID NO: 715951 - RNA, 19 nt, Homo sapiens
auuguugacaacugugacu

SEQ ID NO: 715952 - RNA, 21 nt, Homo sapiens
auuguuugguaaauguuucuu

SEQ ID NO: 715953 - RNA, 21 nt, Homo sapiens
auuguuuugaaacucaguaug

SEQ ID NO: 715954 - RNA, 19 nt, Homo sapiens
auuguuuugagcuuuccau

SEQ ID NO: 715955 - RNA, 22 nt, Homo sapiens
auuguuuuuuacucgucuuccu

SEQ ID NO: 715956 - RNA, 21 nt, Homo sapiens
auuuaaaaaacuaacacccag

SEQ ID NO: 715957 - RNA, 23 nt, Homo sapiens
auuuaaaaaagaaaaaaguccag

SEQ ID NO: 715958 - RNA, 17 nt, Homo sapiens
auuuaaaacaucauuac

SEQ ID NO: 715959 - RNA, 15 nt, Homo sapiens
auuuaaaacauguaa

SEQ ID NO: 715960 - RNA, 19 nt, Homo sapiens
auuuaaaacguuuugguca

SEQ ID NO: 715961 - RNA, 18 nt, Homo sapiens
auuuaaacaccuccucau

SEQ ID NO: 715962 - RNA, 23 nt, Homo sapiens
auuuaaagggaaauugagcugcu

SEQ ID NO: 715963 - RNA, 18 nt, Homo sapiens
auuuaaaucguacuacag

SEQ ID NO: 715964 - RNA, 20 nt, Homo sapiens
auuuaacaugaacacccuua

SEQ ID NO: 715965 - RNA, 12 nt, Homo sapiens
auuuaacugcau

SEQ ID NO: 715966 - RNA, 17 nt, Homo sapiens
auuuaacugcauauaga

SEQ ID NO: 715967 - RNA, 15 nt, Homo sapiens
auuuaagacuaugau

SEQ ID NO: 715968 - RNA, 13 nt, Homo sapiens
auuuaagauauau

SEQ ID NO: 715969 - RNA, 17 nt, Homo sapiens
auuuaagaugugaaaau

SEQ ID NO: 715970 - RNA, 22 nt, Homo sapiens
auuuaaggaagaaucuucugcc

SEQ ID NO: 715971 - RNA, 16 nt, Homo sapiens
auuuaagguacuuaaa

SEQ ID NO: 715972 - RNA, 16 nt, Homo sapiens
auuuaaguacuugaga

SEQ ID NO: 715973 - RNA, 12 nt, Homo sapiens
auuuaagugaau

SEQ ID NO: 715974 - RNA, 19 nt, Homo sapiens
auuuaaguuaucaacuuua

SEQ ID NO: 715975 - RNA, 15 nt, Homo sapiens
auuuaauaaagauga

SEQ ID NO: 715976 - RNA, 13 nt, Homo sapiens
auuuaaugucauu

SEQ ID NO: 715977 - RNA, 11 nt, Homo sapiens
auuuaauucca

SEQ ID NO: 715978 - RNA, 21 nt, Homo sapiens
auuuaauuuuuuaacugcugc

SEQ ID NO: 715979 - RNA, 19 nt, Homo sapiens
auuuaauuuuuuacuuuca

SEQ ID NO: 715980 - RNA, 20 nt, Homo sapiens
auuuacagaaacgcauccag

SEQ ID NO: 715981 - RNA, 15 nt, Homo sapiens
auuuacagaaaucaa

SEQ ID NO: 715982 - RNA, 14 nt, Homo sapiens
auuuacaguuucca

SEQ ID NO: 715983 - RNA, 15 nt, Homo sapiens
auuuacaguuuccag

SEQ ID NO: 715984 - RNA, 20 nt, Homo sapiens
auuuacauacucugcuuaga

SEQ ID NO: 715985 - RNA, 12 nt, Homo sapiens
auuuaccaaagc

SEQ ID NO: 715986 - RNA, 14 nt, Homo sapiens
auuuaccaaaguag

SEQ ID NO: 715987 - RNA, 19 nt, Homo sapiens
auuuaccugauuuuaauca

SEQ ID NO: 715988 - RNA, 17 nt, Homo sapiens
auuuaccuucuaccucu

SEQ ID NO: 715989 - RNA, 22 nt, Homo sapiens
auuuacuaaaucaaucugcagu

SEQ ID NO: 715990 - RNA, 21 nt, Homo sapiens
auuuacugaaguuauuuauua

SEQ ID NO: 715991 - RNA, 19 nt, Homo sapiens
auuuacuuaacagaacagu

SEQ ID NO: 715992 - RNA, 20 nt, Homo sapiens
auuuacuuaauucagucuca

SEQ ID NO: 715993 - RNA, 19 nt, Homo sapiens
auuuacuuuuaccacuauu

SEQ ID NO: 715994 - RNA, 17 nt, Homo sapiens
auuuagaugcacuacca

SEQ ID NO: 715995 - RNA, 22 nt, Homo sapiens
auuuaggaaaugggcagugaag

SEQ ID NO: 715996 - RNA, 19 nt, Homo sapiens
auuuaggagaagccaggaa

SEQ ID NO: 715997 - RNA, 16 nt, Homo sapiens
auuuagucuugccagg

SEQ ID NO: 715998 - RNA, 20 nt, Homo sapiens
auuuagugaaguugugcaac

SEQ ID NO: 715999 - RNA, 22 nt, Homo sapiens
auuuagugaucaaauugugcag

SEQ ID NO: 716000 - RNA, 17 nt, Homo sapiens
auuuaguucaacuguau

SEQ ID NO: 716001 - RNA, 18 nt, Homo sapiens
auuuuuuaagcagacuca

SEQ ID NO: 716002 - RNA, 20 nt, Homo sapiens
auuuuuuaguauaaguacau

SEQ ID NO: 716003 - RNA, 23 nt, Homo sapiens
auuuuuucucuguaaacuuccaa

SEQ ID NO: 716004 - RNA, 14 nt, Homo sapiens
auuuuuugucuguu

SEQ ID NO: 716005 - RNA, 18 nt, Homo sapiens
auuuuuuuuccuugccug

SEQ ID NO: 716006 - RNA, 20 nt, Homo sapiens
auuuuuuuuuccaaaacaau

SEQ ID NO: 716007 - RNA, 22 nt, Homo sapiens
auuuuuuuuuuuccaagacaga

SEQ ID NO: 716008 - RNA, 23 nt, Homo sapiens
caaaaaaaaaaaaaaauuacaaa

SEQ ID NO: 716009 - RNA, 22 nt, Homo sapiens
caaaaaaaaaaaaaggcagugg

SEQ ID NO: 716010 - RNA, 18 nt, Homo sapiens
caaaaaaaaaccaugcau

SEQ ID NO: 716011 - RNA, 19 nt, Homo sapiens
augauuuuuuuuucauaca

SEQ ID NO: 716012 - RNA, 9 nt, Homo sapiens
augcaaaac

SEQ ID NO: 716013 - RNA, 16 nt, Homo sapiens
ccagcaaucugcauuu

SEQ ID NO: 716014 - RNA, 13 nt, Homo sapiens
ccagcaauuccau

SEQ ID NO: 716015 - RNA, 13 nt, Homo sapiens
ccagcacauggcc

SEQ ID NO: 716016 - RNA, 12 nt, Homo sapiens
ccagcaccaccu

SEQ ID NO: 716017 - RNA, 18 nt, Homo sapiens
ccagcacccagaaucuca

SEQ ID NO: 716018 - RNA, 15 nt, Homo sapiens
ccagcacccugcaaa

SEQ ID NO: 716019 - RNA, 12 nt, Homo sapiens
ccagcaccugcc

SEQ ID NO: 716020 - RNA, 14 nt, Homo sapiens
ccagcacugaggaa

SEQ ID NO: 716021 - RNA, 12 nt, Homo sapiens
ccagcacuucca

SEQ ID NO: 716022 - RNA, 13 nt, Homo sapiens
ccagcacuugaau

SEQ ID NO: 716023 - RNA, 21 nt, Homo sapiens
ccagcacuuuagaucacuuga

SEQ ID NO: 716024 - RNA, 12 nt, Homo sapiens
ccagcacuuugg

SEQ ID NO: 716025 - RNA, 21 nt, Homo sapiens
ccagcacuuugggaggcugag

SEQ ID NO: 716026 - RNA, 21 nt, Homo sapiens
ccagcagagggggaguagcca

SEQ ID NO: 716027 - RNA, 21 nt, Homo sapiens
ccagcagcacagucacccaug

SEQ ID NO: 716028 - RNA, 15 nt, Homo sapiens
ccagcagcacuggaa

SEQ ID NO: 716029 - RNA, 21 nt, Homo sapiens
ccagcagcagagaaccaucaa

SEQ ID NO: 716030 - RNA, 23 nt, Homo sapiens
ccagcaggauggcaggggcaaag

SEQ ID NO: 716031 - RNA, 16 nt, Homo sapiens
ccagcaucagccugua

SEQ ID NO: 716032 - RNA, 18 nt, Homo sapiens
ccagcaugcagguggugg

SEQ ID NO: 716033 - RNA, 17 nt, Homo sapiens
ccagcaugguugcagau

SEQ ID NO: 716034 - RNA, 19 nt, Homo sapiens
ccagcauuuuuauaaacua

SEQ ID NO: 716035 - RNA, 19 nt, Homo sapiens
ccagccaaucuagaggcaa

SEQ ID NO: 716036 - RNA, 23 nt, Homo sapiens
ccagccacggggacucagcccuu

SEQ ID NO: 716037 - RNA, 14 nt, Homo sapiens
ccagccaugcaaug

SEQ ID NO: 716038 - RNA, 16 nt, Homo sapiens
ccagcccacguucucu

SEQ ID NO: 716039 - RNA, 13 nt, Homo sapiens
ccagcccagagac

SEQ ID NO: 716040 - RNA, 19 nt, Homo sapiens
ccagcccauaucuacagua

SEQ ID NO: 716041 - RNA, 12 nt, Homo sapiens
ccagcccauugc

SEQ ID NO: 716042 - RNA, 16 nt, Homo sapiens
ccagccccaagcuggg

SEQ ID NO: 716043 - RNA, 16 nt, Homo sapiens
ccagccccacugccag

SEQ ID NO: 716044 - RNA, 18 nt, Homo sapiens
ccagcccuccucugucaa

SEQ ID NO: 716045 - RNA, 16 nt, Homo sapiens
ccagcccugggaacca

SEQ ID NO: 716046 - RNA, 16 nt, Homo sapiens
ccagccguauuuuaca

SEQ ID NO: 716047 - RNA, 15 nt, Homo sapiens
ccagccuacauucac

SEQ ID NO: 716048 - RNA, 12 nt, Homo sapiens
ccagccucagau

SEQ ID NO: 716049 - RNA, 19 nt, Homo sapiens
ccagccuccccgugccaaa

SEQ ID NO: 716050 - RNA, 15 nt, Homo sapiens
ccagccuggccaaca

SEQ ID NO: 716051 - RNA, 19 nt, Homo sapiens
ccagccuggccaacauggc

SEQ ID NO: 716052 - RNA, 21 nt, Homo sapiens
ccagccugggacucccaguga

SEQ ID NO: 716053 - RNA, 20 nt, Homo sapiens
ccagccuggggaacagagca

SEQ ID NO: 716054 - RNA, 18 nt, Homo sapiens
ccagcgagagaaagaguu

SEQ ID NO: 716055 - RNA, 16 nt, Homo sapiens
ccagcgagcucucaaa

SEQ ID NO: 716056 - RNA, 16 nt, Homo sapiens
ccagcgguccaaaguu

SEQ ID NO: 716057 - RNA, 15 nt, Homo sapiens
ccagcgucccagucu

SEQ ID NO: 716058 - RNA, 15 nt, Homo sapiens
ccagcuacucaggag

SEQ ID NO: 716059 - RNA, 21 nt, Homo sapiens
ccagcuacucgggaggcugag

SEQ ID NO: 716060 - RNA, 15 nt, Homo sapiens
ccagcucagucccau

SEQ ID NO: 716061 - RNA, 19 nt, Homo sapiens
ccagcucccuaggagacca

SEQ ID NO: 716062 - RNA, 16 nt, Homo sapiens
ccagcucuaguuuuca

SEQ ID NO: 716063 - RNA, 15 nt, Homo sapiens
ccagcugacauggaa

SEQ ID NO: 716064 - RNA, 22 nt, Homo sapiens
ccagcugagucuauguagguga

SEQ ID NO: 716065 - RNA, 15 nt, Homo sapiens
ccagcugccuuggac

SEQ ID NO: 716066 - RNA, 16 nt, Homo sapiens
ccagcugcugucuucu

SEQ ID NO: 716067 - RNA, 16 nt, Homo sapiens
ccagcugggguccugu

SEQ ID NO: 716068 - RNA, 15 nt, Homo sapiens
ccagcugugcacuuu

SEQ ID NO: 716069 - RNA, 14 nt, Homo sapiens
ccagcuugguucca

SEQ ID NO: 716070 - RNA, 14 nt, Homo sapiens
ccagcuuuccucau

SEQ ID NO: 716071 - RNA, 14 nt, Homo sapiens
ccagcuuugcagug

SEQ ID NO: 716072 - RNA, 22 nt, Homo sapiens
ccagcuuuuagaaaaugcaguc

SEQ ID NO: 716073 - RNA, 23 nt, Homo sapiens
ccaggaaacaaggggucugagga

SEQ ID NO: 716074 - RNA, 21 nt, Homo sapiens
ccaggaacagcaaaugcaaaa

SEQ ID NO: 716075 - RNA, 15 nt, Homo sapiens
ccaggaaggcagcug

SEQ ID NO: 716076 - RNA, 22 nt, Homo sapiens
ccaggaagguagcccagcacug

SEQ ID NO: 716077 - RNA, 23 nt, Homo sapiens
ccaggaagguagcccagcacugu

SEQ ID NO: 716078 - RNA, 16 nt, Homo sapiens
ccaggaccaccacuua

SEQ ID NO: 716079 - RNA, 13 nt, Homo sapiens
ccaggacccugaa

SEQ ID NO: 716080 - RNA, 17 nt, Homo sapiens
ccaggacugaccucuuc

SEQ ID NO: 716081 - RNA, 14 nt, Homo sapiens
ccaggagaaggggg

SEQ ID NO: 716082 - RNA, 14 nt, Homo sapiens
ccaggagaccucca

SEQ ID NO: 716083 - RNA, 13 nt, Homo sapiens
ccaggagcucuuc

SEQ ID NO: 716084 - RNA, 23 nt, Homo sapiens
ccaggagcugggcagaaggccaa

SEQ ID NO: 716085 - RNA, 15 nt, Homo sapiens
ccaggaguaccugga

SEQ ID NO: 716086 - RNA, 22 nt, Homo sapiens
ccaggaguucgaggcugcaguc

SEQ ID NO: 716087 - RNA, 14 nt, Homo sapiens
ccaggauacuggca

SEQ ID NO: 716088 - RNA, 17 nt, Homo sapiens
ccaggauccugcaggaa

SEQ ID NO: 716089 - RNA, 16 nt, Homo sapiens
ccaggaucugcuccaa

SEQ ID NO: 716090 - RNA, 22 nt, Homo sapiens
ccaggaugcccaccguuaggau

SEQ ID NO: 716091 - RNA, 16 nt, Homo sapiens
ccaggcaacgugcgug

SEQ ID NO: 716092 - RNA, 17 nt, Homo sapiens
ccaggccagagggcagu

SEQ ID NO: 716093 - RNA, 16 nt, Homo sapiens
ccaggccaggggaccc

SEQ ID NO: 716094 - RNA, 14 nt, Homo sapiens
ccaggcccaucuca

SEQ ID NO: 716095 - RNA, 18 nt, Homo sapiens
ccaggcccgagaugugac

SEQ ID NO: 716096 - RNA, 22 nt, Homo sapiens
ccaggcccggggcuggcggcua

SEQ ID NO: 716097 - RNA, 22 nt, Homo sapiens
ccaggcccuuggcugcaggcaa

SEQ ID NO: 716098 - RNA, 14 nt, Homo sapiens
ccaggccugaccag

SEQ ID NO: 716099 - RNA, 18 nt, Homo sapiens
ccaggccugagcaacaaa

SEQ ID NO: 716100 - RNA, 18 nt, Homo sapiens
ccaggccuguugcuauag

SEQ ID NO: 716101 - RNA, 20 nt, Homo sapiens
ccaggcugaauuacagugaa

SEQ ID NO: 716102 - RNA, 15 nt, Homo sapiens
ccaggcugagccaug

SEQ ID NO: 716103 - RNA, 17 nt, Homo sapiens
ccaggcugcacugcagu

SEQ ID NO: 716104 - RNA, 17 nt, Homo sapiens
ccaggcugcagccucca

SEQ ID NO: 716105 - RNA, 20 nt, Homo sapiens
ccaggcugccucggacucca

SEQ ID NO: 716106 - RNA, 16 nt, Homo sapiens
ccaggcugcucagggc

SEQ ID NO: 716107 - RNA, 17 nt, Homo sapiens
ccaggcuggacugcaau

SEQ ID NO: 716108 - RNA, 17 nt, Homo sapiens
ccaggcuggaguacagu

SEQ ID NO: 716109 - RNA, 17 nt, Homo sapiens
ccaggcuggagugcagu

SEQ ID NO: 716110 - RNA, 18 nt, Homo sapiens
ccaggcuggagugcagua

SEQ ID NO: 716111 - RNA, 20 nt, Homo sapiens
ccaggcuggagugcaguggu

SEQ ID NO: 716112 - RNA, 21 nt, Homo sapiens
ccaggcuucacccugaauggu

SEQ ID NO: 716113 - RNA, 20 nt, Homo sapiens
ccagggaagaagaucaacgc

SEQ ID NO: 716114 - RNA, 20 nt, Homo sapiens
ccagggagcacccugcccac

SEQ ID NO: 716115 - RNA, 18 nt, Homo sapiens
ccagggccacucugccuc

SEQ ID NO: 716116 - RNA, 19 nt, Homo sapiens
ccagggccugggggcagug

SEQ ID NO: 716117 - RNA, 17 nt, Homo sapiens
ccagggcuuugcuccag

SEQ ID NO: 716118 - RNA, 22 nt, Homo sapiens
ccaggggaaccugccaugccag

SEQ ID NO: 716119 - RNA, 23 nt, Homo sapiens
ccaggggaaggaaggagggcaca

SEQ ID NO: 716120 - RNA, 19 nt, Homo sapiens
ccaggguuucucugaagaa

SEQ ID NO: 716121 - RNA, 21 nt, Homo sapiens
ccagguaaguauaaguauuca

SEQ ID NO: 716122 - RNA, 19 nt, Homo sapiens
ccaggucaggaugcacauu

SEQ ID NO: 716123 - RNA, 14 nt, Homo sapiens
ccaggugggugugg

SEQ ID NO: 716124 - RNA, 13 nt, Homo sapiens
ccaggugguuggg

SEQ ID NO: 716125 - RNA, 15 nt, Homo sapiens
ccagguucucauuag

SEQ ID NO: 716126 - RNA, 16 nt, Homo sapiens
ccagguuggagugcag

SEQ ID NO: 716127 - RNA, 23 nt, Homo sapiens
ccagguuugguuauuaugaauaa

SEQ ID NO: 716128 - RNA, 18 nt, Homo sapiens
cauaagggagauuguaua

SEQ ID NO: 716129 - RNA, 22 nt, Homo sapiens
cauaagguuucguuucuguaua

SEQ ID NO: 716130 - RNA, 16 nt, Homo sapiens
cauaaguauuaugucu

SEQ ID NO: 716131 - RNA, 21 nt, Homo sapiens
cauaagucgucacuaauacac

SEQ ID NO: 716132 - RNA, 19 nt, Homo sapiens
cauaagucuaaauaaauga

SEQ ID NO: 716133 - RNA, 18 nt, Homo sapiens
cauaauaaauaucuguac

SEQ ID NO: 716134 - RNA, 15 nt, Homo sapiens
cauaauacauaacau

SEQ ID NO: 716135 - RNA, 14 nt, Homo sapiens
cauaauaccucaca

SEQ ID NO: 716136 - RNA, 22 nt, Homo sapiens
cauaauagucaauuucuacuuc

SEQ ID NO: 716137 - RNA, 17 nt, Homo sapiens
cauaaucacaaauauag

SEQ ID NO: 716138 - RNA, 15 nt, Homo sapiens
cauaaucuaguuuac

SEQ ID NO: 716139 - RNA, 14 nt, Homo sapiens
cauaaugcuuuguu

SEQ ID NO: 716140 - RNA, 12 nt, Homo sapiens
cauaauguauua

SEQ ID NO: 716141 - RNA, 21 nt, Homo sapiens
cauaauuauuauuuccagugu

SEQ ID NO: 716142 - RNA, 14 nt, Homo sapiens
cauaauucagcacu

SEQ ID NO: 716143 - RNA, 16 nt, Homo sapiens
cauaauucagcacuua

SEQ ID NO: 716144 - RNA, 17 nt, Homo sapiens
cauaauucagcacuuaa

SEQ ID NO: 716145 - RNA, 22 nt, Homo sapiens
cauaauugcuguucugcugaau

SEQ ID NO: 716146 - RNA, 20 nt, Homo sapiens
cauaauugcuuugccaaaau

SEQ ID NO: 716147 - RNA, 16 nt, Homo sapiens
cauaauuguucuuagu

SEQ ID NO: 716148 - RNA, 23 nt, Homo sapiens
cauaauuuaaaaaucuccauuaa

SEQ ID NO: 716149 - RNA, 18 nt, Homo sapiens
cauacaaagagguguaca

SEQ ID NO: 716150 - RNA, 14 nt, Homo sapiens
cauacaaagcaguu

SEQ ID NO: 716151 - RNA, 16 nt, Homo sapiens
cauacaacagaaacca

SEQ ID NO: 716152 - RNA, 14 nt, Homo sapiens
cauacaaguuucau

SEQ ID NO: 716153 - RNA, 15 nt, Homo sapiens
cauacacaugugcac

SEQ ID NO: 716154 - RNA, 17 nt, Homo sapiens
cauacacugugaacuca

SEQ ID NO: 716155 - RNA, 16 nt, Homo sapiens
cauacagcuucauaaa

SEQ ID NO: 716156 - RNA, 18 nt, Homo sapiens
cauacauaagcagcauuu

SEQ ID NO: 716157 - RNA, 16 nt, Homo sapiens
caggguggaugaucuc

SEQ ID NO: 716158 - RNA, 19 nt, Homo sapiens
caggguggucuugaucucc

SEQ ID NO: 716159 - RNA, 22 nt, Homo sapiens
caggguugugcuuucuagcaaa

SEQ ID NO: 716160 - RNA, 20 nt, Homo sapiens
caggguuucaccauguuggc

SEQ ID NO: 716161 - RNA, 21 nt, Homo sapiens
caggguuucaccauguuggcc

SEQ ID NO: 716162 - RNA, 16 nt, Homo sapiens
caggguuucugcacug

SEQ ID NO: 716163 - RNA, 22 nt, Homo sapiens
caggguuugcuguuugcgugaa

SEQ ID NO: 716164 - RNA, 23 nt, Homo sapiens
cagguacaguaggauaagccacu

SEQ ID NO: 716165 - RNA, 20 nt, Homo sapiens
cagguaccaucuuguauaca

SEQ ID NO: 716166 - RNA, 21 nt, Homo sapiens
cagguaccaucuuguauacac

SEQ ID NO: 716167 - RNA, 23 nt, Homo sapiens
cagguaccaucuuguauacacau

SEQ ID NO: 716168 - RNA, 19 nt, Homo sapiens
cagguaccucuuucagggu

SEQ ID NO: 716169 - RNA, 19 nt, Homo sapiens
cagguaguauuacaccacc

SEQ ID NO: 716170 - RNA, 18 nt, Homo sapiens
caggucaggaugcacauu

SEQ ID NO: 716171 - RNA, 16 nt, Homo sapiens
cagguccaauuuguaa

SEQ ID NO: 716172 - RNA, 20 nt, Homo sapiens
cagguccaccgagccccuga

SEQ ID NO: 716173 - RNA, 14 nt, Homo sapiens
cagguccuuccuuu

SEQ ID NO: 716174 - RNA, 14 nt, Homo sapiens
caggucucacugcu

SEQ ID NO: 716175 - RNA, 13 nt, Homo sapiens
caggucugagaua

SEQ ID NO: 716176 - RNA, 21 nt, Homo sapiens
caggucuugacucauggcagc

SEQ ID NO: 716177 - RNA, 14 nt, Homo sapiens
caggugaaaaucca

SEQ ID NO: 716178 - RNA, 20 nt, Homo sapiens
caggugaaaauccaucucau

SEQ ID NO: 716179 - RNA, 15 nt, Homo sapiens
caggugaacagccuc

SEQ ID NO: 716180 - RNA, 17 nt, Homo sapiens
caggugaacugggagca

SEQ ID NO: 716181 - RNA, 19 nt, Homo sapiens
caggugaccccuaggagca

SEQ ID NO: 716182 - RNA, 22 nt, Homo sapiens
caggugagcaauuagauuagua

SEQ ID NO: 716183 - RNA, 17 nt, Homo sapiens
aggccaagaacuugcaa

SEQ ID NO: 716184 - RNA, 21 nt, Homo sapiens
aggccaagaggcuguucccac

SEQ ID NO: 716185 - RNA, 21 nt, Homo sapiens
aggccaagaguuaaagaccag

SEQ ID NO: 716186 - RNA, 19 nt, Homo sapiens
aggccaagggccaagagaa

SEQ ID NO: 716187 - RNA, 19 nt, Homo sapiens
aggccaaguacacugagag

SEQ ID NO: 716188 - RNA, 16 nt, Homo sapiens
aggccacaccaucucc

SEQ ID NO: 716189 - RNA, 19 nt, Homo sapiens
aggccagaauaauuggcau

SEQ ID NO: 716190 - RNA, 19 nt, Homo sapiens
aggccagagggcaguggcc

SEQ ID NO: 716191 - RNA, 15 nt, Homo sapiens
aggccagagugcagu

SEQ ID NO: 716192 - RNA, 22 nt, Homo sapiens
aggccagugccagcaccugccc

SEQ ID NO: 716193 - RNA, 21 nt, Homo sapiens
aggccauggcagaauaaucuu

SEQ ID NO: 716194 - RNA, 19 nt, Homo sapiens
aggccauuaugccuggcua

SEQ ID NO: 716195 - RNA, 15 nt, Homo sapiens
aggcccacuguaaua

SEQ ID NO: 716196 - RNA, 16 nt, Homo sapiens
aggcccagcaugcagg

SEQ ID NO: 716197 - RNA, 18 nt, Homo sapiens
aggcccaggagaccucca

SEQ ID NO: 716198 - RNA, 19 nt, Homo sapiens
aggcccagggaggugaccc

SEQ ID NO: 716199 - RNA, 20 nt, Homo sapiens
aggcccaguucacccugauu

SEQ ID NO: 716200 - RNA, 14 nt, Homo sapiens
aggcccgcaccgcu

SEQ ID NO: 716201 - RNA, 14 nt, Homo sapiens
agggagcugcucag

SEQ ID NO: 716202 - RNA, 15 nt, Homo sapiens
agggagcugggagac

SEQ ID NO: 716203 - RNA, 21 nt, Homo sapiens
agggagcuucuaccuggaaaa

SEQ ID NO: 716204 - RNA, 15 nt, Homo sapiens
agggaggcccuggga

SEQ ID NO: 716205 - RNA, 16 nt, Homo sapiens
agggagggaaagacaa

SEQ ID NO: 716206 - RNA, 15 nt, Homo sapiens
agggagggcuguggu

SEQ ID NO: 716207 - RNA, 21 nt, Homo sapiens
agggaggugaauacucuugaa

SEQ ID NO: 716208 - RNA, 16 nt, Homo sapiens
agggagguuugugaga

SEQ ID NO: 716209 - RNA, 17 nt, Homo sapiens
agggauccguacauuca

SEQ ID NO: 716210 - RNA, 16 nt, Homo sapiens
agggauggagaaagaa

SEQ ID NO: 716211 - RNA, 15 nt, Homo sapiens
agggauggagcugaa

SEQ ID NO: 716212 - RNA, 18 nt, Homo sapiens
agggauggggccaucucc

SEQ ID NO: 716213 - RNA, 19 nt, Homo sapiens
agggauugaggaguugccu

SEQ ID NO: 716214 - RNA, 18 nt, Homo sapiens
agggauuucuuaauuuau

SEQ ID NO: 716215 - RNA, 21 nt, Homo sapiens
agggauuuuuuuuuucagggc

SEQ ID NO: 716216 - RNA, 22 nt, Homo sapiens
agggcaaaugacaugcacugac

SEQ ID NO: 716217 - RNA, 23 nt, Homo sapiens
agggcaagaaauggcgucugcuc

SEQ ID NO: 716218 - RNA, 11 nt, Homo sapiens
agggcacauua

SEQ ID NO: 716219 - RNA, 13 nt, Homo sapiens
agggcaccagagg

SEQ ID NO: 716220 - RNA, 18 nt, Homo sapiens
agggcagagaauggcugg

SEQ ID NO: 716221 - RNA, 14 nt, Homo sapiens
agggcagaggaaug

SEQ ID NO: 716222 - RNA, 16 nt, Homo sapiens
agggcagggcucugau

SEQ ID NO: 716223 - RNA, 16 nt, Homo sapiens
agggcaggggugcugu

SEQ ID NO: 716224 - RNA, 18 nt, Homo sapiens
agggcaguaccugggaaa

SEQ ID NO: 716225 - RNA, 19 nt, Homo sapiens
agggcagugcccuuugaga

SEQ ID NO: 716226 - RNA, 20 nt, Homo sapiens
agggcaguucugaguguuua

SEQ ID NO: 716227 - RNA, 14 nt, Homo sapiens
agggcaucaucuau

SEQ ID NO: 716228 - RNA, 18 nt, Homo sapiens
agggcaucuccugugcau

SEQ ID NO: 716229 - RNA, 15 nt, Homo sapiens
agggcauugcucagc

SEQ ID NO: 716230 - RNA, 16 nt, Homo sapiens
agggcauugcucagcc

SEQ ID NO: 716231 - RNA, 22 nt, Homo sapiens
agggccacagagcuacauggug

SEQ ID NO: 716232 - RNA, 20 nt, Homo sapiens
agggccagaccugccugcau

SEQ ID NO: 716233 - RNA, 14 nt, Homo sapiens
agggcccuaccuga

SEQ ID NO: 716234 - RNA, 22 nt, Homo sapiens
agggccgcccgggcccagagga

SEQ ID NO: 716235 - RNA, 17 nt, Homo sapiens
agggccuagaaacucac

SEQ ID NO: 716236 - RNA, 20 nt, Homo sapiens
agggcgagacucugucucaa

SEQ ID NO: 716237 - RNA, 18 nt, Homo sapiens
agggcgagcggcaaaggc

SEQ ID NO: 716238 - RNA, 19 nt, Homo sapiens
agggcgccuacucuucagg

SEQ ID NO: 716239 - RNA, 15 nt, Homo sapiens
agggcuacagcaucc

SEQ ID NO: 716240 - RNA, 15 nt, Homo sapiens
agggcuauagcagaa

SEQ ID NO: 716241 - RNA, 18 nt, Homo sapiens
agggcuccaaaucugccu

SEQ ID NO: 716242 - RNA, 19 nt, Homo sapiens
agggcuccagcauccagcc

SEQ ID NO: 716243 - RNA, 16 nt, Homo sapiens
agggcugaaucuucug

SEQ ID NO: 716244 - RNA, 15 nt, Homo sapiens
agggcugagugucca

SEQ ID NO: 716245 - RNA, 17 nt, Homo sapiens
agggcugcuuaggucuc

SEQ ID NO: 716246 - RNA, 19 nt, Homo sapiens
agggcugguguggcugcuc

SEQ ID NO: 716247 - RNA, 15 nt, Homo sapiens
agggcuuucucagga

SEQ ID NO: 716248 - RNA, 17 nt, Homo sapiens
aggggaaggccuuuuca

SEQ ID NO: 716249 - RNA, 15 nt, Homo sapiens
aggggacaagggauu

SEQ ID NO: 716250 - RNA, 15 nt, Homo sapiens
aggggacacuucccu

SEQ ID NO: 716251 - RNA, 21 nt, Homo sapiens
aggggaccacaccucccugaa

SEQ ID NO: 716252 - RNA, 18 nt, Homo sapiens
aggggacccauguaaucc

SEQ ID NO: 716253 - RNA, 20 nt, Homo sapiens
aggggacucagcccugaggu

SEQ ID NO: 716254 - RNA, 23 nt, Homo sapiens
aggggagcaaaaucgaugcagug

SEQ ID NO: 716255 - RNA, 15 nt, Homo sapiens
aggggagggaucucc

SEQ ID NO: 716256 - RNA, 18 nt, Homo sapiens
aggggagggcaggcuugg

SEQ ID NO: 716257 - RNA, 16 nt, Homo sapiens
aggggauccagccacu

SEQ ID NO: 716258 - RNA, 18 nt, Homo sapiens
aggggcaacuguaugaaa

SEQ ID NO: 716259 - RNA, 16 nt, Homo sapiens
aggggcacuucauuga

SEQ ID NO: 716260 - RNA, 13 nt, Homo sapiens
aggggcagccaca

SEQ ID NO: 716261 - RNA, 20 nt, Homo sapiens
aggggcagccacaccacugc

SEQ ID NO: 716262 - RNA, 22 nt, Homo sapiens
aggggcagguguuucuuuccug

SEQ ID NO: 716263 - RNA, 14 nt, Homo sapiens
aggggcauuucaca

SEQ ID NO: 716264 - RNA, 23 nt, Homo sapiens
aggggcccaaauucuuucagugg

SEQ ID NO: 716265 - RNA, 12 nt, Homo sapiens
aggggccugcag

SEQ ID NO: 716266 - RNA, 14 nt, Homo sapiens
aggggcucaguggc

SEQ ID NO: 716267 - RNA, 16 nt, Homo sapiens
aggggcucugcuuccu

SEQ ID NO: 716268 - RNA, 17 nt, Homo sapiens
aggggcugaggacgaga

SEQ ID NO: 716269 - RNA, 20 nt, Homo sapiens
aggggcuguguuuccaucuc

SEQ ID NO: 716270 - RNA, 22 nt, Homo sapiens
aggggcuuguugcaggcugugg

SEQ ID NO: 716271 - RNA, 18 nt, Homo sapiens
agggggaagacagauaug

SEQ ID NO: 716272 - RNA, 18 nt, Homo sapiens
agggggagaauggguguu

SEQ ID NO: 716273 - RNA, 21 nt, Homo sapiens
agggggaugccacuccucccu

SEQ ID NO: 716274 - RNA, 22 nt, Homo sapiens
agggggcaucuuuaagcaaggu

SEQ ID NO: 716275 - RNA, 12 nt, Homo sapiens
agggggcccaaa

SEQ ID NO: 716276 - RNA, 22 nt, Homo sapiens
aggggguggggaagaagacaca

SEQ ID NO: 716277 - RNA, 14 nt, Homo sapiens
aggggucauucaug

SEQ ID NO: 716278 - RNA, 14 nt, Homo sapiens
aggggugugcugag

SEQ ID NO: 716279 - RNA, 17 nt, Homo sapiens
agggguuaagagcucag

SEQ ID NO: 716280 - RNA, 21 nt, Homo sapiens
aggguaaauaggaaucauuca

SEQ ID NO: 716281 - RNA, 17 nt, Homo sapiens
aggguaccgucuucucc

SEQ ID NO: 716282 - RNA, 21 nt, Homo sapiens
aggguaccuugaacacugggg

SEQ ID NO: 716283 - RNA, 20 nt, Homo sapiens
aggguagauaaccuguacuu

SEQ ID NO: 716284 - RNA, 20 nt, Homo sapiens
agggucagccugcugugccc

SEQ ID NO: 716285 - RNA, 13 nt, Homo sapiens
aggguccagugga

SEQ ID NO: 716286 - RNA, 16 nt, Homo sapiens
aggguccgcaccagcu

SEQ ID NO: 716287 - RNA, 20 nt, Homo sapiens
aggguccuuuaguaccugaa

SEQ ID NO: 716288 - RNA, 22 nt, Homo sapiens
agggucucgcucuguugcccag

SEQ ID NO: 716289 - RNA, 13 nt, Homo sapiens
agggucucuucag

SEQ ID NO: 716290 - RNA, 14 nt, Homo sapiens
agggucucuucagg

SEQ ID NO: 716291 - RNA, 23 nt, Homo sapiens
agggucuucuuacaugcauuuga

SEQ ID NO: 716292 - RNA, 22 nt, Homo sapiens
agggugaagcuauuuaucugua

SEQ ID NO: 716293 - RNA, 21 nt, Homo sapiens
agggugaccacaccuuggccu

SEQ ID NO: 716294 - RNA, 19 nt, Homo sapiens
agggugcagcccucuugcc

SEQ ID NO: 716295 - RNA, 20 nt, Homo sapiens
agggugcagcccucuugccc

SEQ ID NO: 716296 - RNA, 17 nt, Homo sapiens
agggugcugggugggca

SEQ ID NO: 716297 - RNA, 13 nt, Homo sapiens
aaaaagugucuca

SEQ ID NO: 716298 - RNA, 20 nt, Homo sapiens
aaaaauaaccaaaaaaugug

SEQ ID NO: 716299 - RNA, 13 nt, Homo sapiens
aaaaauaacugug

SEQ ID NO: 716300 - RNA, 23 nt, Homo sapiens
aaaaauauauuuaaugauaagua

SEQ ID NO: 716301 - RNA, 21 nt, Homo sapiens
aaaaauauguugaguguucau

SEQ ID NO: 716302 - RNA, 13 nt, Homo sapiens
aaaaaucaauaaa

SEQ ID NO: 716303 - RNA, 22 nt, Homo sapiens
aaaaaucauguguugcagcuuu

SEQ ID NO: 716304 - RNA, 11 nt, Homo sapiens
aaaaauccauu

SEQ ID NO: 716305 - RNA, 22 nt, Homo sapiens
aaaaaucuugugcuagaauacu

SEQ ID NO: 716306 - RNA, 20 nt, Homo sapiens
aaaaaucuuuucauuaaaga

SEQ ID NO: 716307 - RNA, 16 nt, Homo sapiens
aaaaaugcagggugau

SEQ ID NO: 716308 - RNA, 21 nt, Homo sapiens
aaaaauggaaacuauauugac

SEQ ID NO: 716309 - RNA, 21 nt, Homo sapiens
aaaaauggacaaaauccauga

SEQ ID NO: 716310 - RNA, 15 nt, Homo sapiens
aaaaauuagugagua

SEQ ID NO: 716311 - RNA, 19 nt, Homo sapiens
aaaacaaaacaaaccuuaa

SEQ ID NO: 716312 - RNA, 15 nt, Homo sapiens
aaaacaaaaccaagc

SEQ ID NO: 716313 - RNA, 20 nt, Homo sapiens
aaaacaaagaaauaaugguc

SEQ ID NO: 716314 - RNA, 21 nt, Homo sapiens
aaaacaaaggaauaaaaccau

SEQ ID NO: 716315 - RNA, 20 nt, Homo sapiens
aaaacaaaugggaaaauguc

SEQ ID NO: 716316 - RNA, 13 nt, Homo sapiens
aaaacaaauucau

SEQ ID NO: 716317 - RNA, 13 nt, Homo sapiens
aaaacacacauac

SEQ ID NO: 716318 - RNA, 13 nt, Homo sapiens
aaaacacagguuu

SEQ ID NO: 716319 - RNA, 13 nt, Homo sapiens
aaaacaccaaaga

SEQ ID NO: 716320 - RNA, 14 nt, Homo sapiens
aaaacaccaugaaa

SEQ ID NO: 716321 - RNA, 19 nt, Homo sapiens
aaaacaccgcuucugccuu

SEQ ID NO: 716322 - RNA, 12 nt, Homo sapiens
aaaacagaauuu

SEQ ID NO: 716323 - RNA, 19 nt, Homo sapiens
aaaacagagggcugcauuc

SEQ ID NO: 716324 - RNA, 22 nt, Homo sapiens
aaaacagcagcucauagaauuu

SEQ ID NO: 716325 - RNA, 11 nt, Homo sapiens
aaaacauguaa

SEQ ID NO: 716326 - RNA, 11 nt, Homo sapiens
aaaacauguau

SEQ ID NO: 716327 - RNA, 19 nt, Homo sapiens
aaaacauuuugaaggaaaa

SEQ ID NO: 716328 - RNA, 22 nt, Homo sapiens
aaaaccaaaagaacaagaauuu

SEQ ID NO: 716329 - RNA, 12 nt, Homo sapiens
aaaaccaaagag

SEQ ID NO: 716330 - RNA, 20 nt, Homo sapiens
aaaaccaaauuuguauuuaa

SEQ ID NO: 716331 - RNA, 18 nt, Homo sapiens
aaaaccacagcugggcag

SEQ ID NO: 716332 - RNA, 22 nt, Homo sapiens
aaaaccacugggaggagucuau

SEQ ID NO: 716333 - RNA, 12 nt, Homo sapiens
aaaaccacuuuu

SEQ ID NO: 716334 - RNA, 14 nt, Homo sapiens
aaaacccacagaag

SEQ ID NO: 716335 - RNA, 18 nt, Homo sapiens
aaaaccccaucucuacua

SEQ ID NO: 716336 - RNA, 20 nt, Homo sapiens
aaaaccccaucucuacuaaa

SEQ ID NO: 716337 - RNA, 14 nt, Homo sapiens
aaaaccccucccac

SEQ ID NO: 716338 - RNA, 17 nt, Homo sapiens
aaaacccucagcacugu

SEQ ID NO: 716339 - RNA, 21 nt, Homo sapiens
aaaaccgcaaggguagacugg

SEQ ID NO: 716340 - RNA, 23 nt, Homo sapiens
aaaaccuacacacguaccuucau

SEQ ID NO: 716341 - RNA, 13 nt, Homo sapiens
aaaaccuccagua

SEQ ID NO: 716342 - RNA, 15 nt, Homo sapiens
aaaaccucuaugcaa

SEQ ID NO: 716343 - RNA, 14 nt, Homo sapiens
aaaaccugacuuca

SEQ ID NO: 716344 - RNA, 19 nt, Homo sapiens
aaaaccuuguaaaaaaagc

SEQ ID NO: 716345 - RNA, 15 nt, Homo sapiens
aaaaccuuguguaag

SEQ ID NO: 716346 - RNA, 19 nt, Homo sapiens
aaaacgcacaagccagacc

SEQ ID NO: 716347 - RNA, 16 nt, Homo sapiens
aaaacuaaacuuucau

SEQ ID NO: 716348 - RNA, 15 nt, Homo sapiens
aaaacuaaccaucug

SEQ ID NO: 716349 - RNA, 17 nt, Homo sapiens
aaaacuaaccaucugaa

SEQ ID NO: 716350 - RNA, 15 nt, Homo sapiens
aaaacuaagcacaaa

SEQ ID NO: 716351 - RNA, 20 nt, Homo sapiens
aaaacuauauucauuuccac

SEQ ID NO: 716352 - RNA, 14 nt, Homo sapiens
aaaacucaaccaga

SEQ ID NO: 716353 - RNA, 14 nt, Homo sapiens
aaaacuccaucuca

SEQ ID NO: 716354 - RNA, 17 nt, Homo sapiens
aaaacuccccuuccuca

SEQ ID NO: 716355 - RNA, 22 nt, Homo sapiens
aaaacucuaauuguccauucuu

SEQ ID NO: 716356 - RNA, 14 nt, Homo sapiens
aaaacugacagagg

SEQ ID NO: 716357 - RNA, 11 nt, Homo sapiens
aaaacugacuc

SEQ ID NO: 716358 - RNA, 12 nt, Homo sapiens
aaaacugucauc

SEQ ID NO: 716359 - RNA, 21 nt, Homo sapiens
aaaacuuaauaaaaauuauua

SEQ ID NO: 716360 - RNA, 22 nt, Homo sapiens
aaguuauguucuucuucauuga

SEQ ID NO: 716361 - RNA, 17 nt, Homo sapiens
aaguuauuaacuuuaau

SEQ ID NO: 716362 - RNA, 16 nt, Homo sapiens
aaguuauucucuucac

SEQ ID NO: 716363 - RNA, 16 nt, Homo sapiens
aaguuauuuacuuuua

SEQ ID NO: 716364 - RNA, 16 nt, Homo sapiens
aaguucaacuuccaaa

SEQ ID NO: 716365 - RNA, 20 nt, Homo sapiens
aaguucaugcagcuguggca

SEQ ID NO: 716366 - RNA, 20 nt, Homo sapiens
aaguuccaaaauaaagcaua

SEQ ID NO: 716367 - RNA, 20 nt, Homo sapiens
aaguuccauauagacaccaa

SEQ ID NO: 716368 - RNA, 16 nt, Homo sapiens
aaguuccuacuaggca

SEQ ID NO: 716369 - RNA, 19 nt, Homo sapiens
aaguucgagucaaaguuga

SEQ ID NO: 716370 - RNA, 14 nt, Homo sapiens
aaguucucauugaa

SEQ ID NO: 716371 - RNA, 19 nt, Homo sapiens
aaguucuuaugccauguua

SEQ ID NO: 716372 - RNA, 22 nt, Homo sapiens
aaguugcauuccuuugucuuca

SEQ ID NO: 716373 - RNA, 19 nt, Homo sapiens
aaguuggguucacuugcca

SEQ ID NO: 716374 - RNA, 23 nt, Homo sapiens
aaguuggugcuuuugagaaccaa

SEQ ID NO: 716375 - RNA, 21 nt, Homo sapiens
aaguuguaaaguauguauuau

SEQ ID NO: 716376 - RNA, 13 nt, Homo sapiens
aaguugugcaacg

SEQ ID NO: 716377 - RNA, 13 nt, Homo sapiens
aaguugugcuuga

SEQ ID NO: 716378 - RNA, 17 nt, Homo sapiens
aaguuguugacugugau

SEQ ID NO: 716379 - RNA, 19 nt, Homo sapiens
aaguuuacaaucaaaggaa

SEQ ID NO: 716380 - RNA, 15 nt, Homo sapiens
aaguuucuagaauuu

SEQ ID NO: 716381 - RNA, 18 nt, Homo sapiens
aaguuucugauaccacug

SEQ ID NO: 716382 - RNA, 17 nt, Homo sapiens
aaguuucuggugccauu

SEQ ID NO: 716383 - RNA, 19 nt, Homo sapiens
aaguuucuggugccauuuc

SEQ ID NO: 716384 - RNA, 16 nt, Homo sapiens
aaguuucugucuuccu

SEQ ID NO: 716385 - RNA, 17 nt, Homo sapiens
aaguuugggccagugaa

SEQ ID NO: 716386 - RNA, 23 nt, Homo sapiens
aaguuugggccagugaacagggu

SEQ ID NO: 716387 - RNA, 19 nt, Homo sapiens
aaguuuuaaauaaaccuau

SEQ ID NO: 716388 - RNA, 23 nt, Homo sapiens
aaguuuucagaaccucuucccca

SEQ ID NO: 716389 - RNA, 17 nt, Homo sapiens
aaguuuugcaacaauaa

SEQ ID NO: 716390 - RNA, 20 nt, Homo sapiens
aaguuuuuuauuaugcauua

SEQ ID NO: 716391 - RNA, 13 nt, Homo sapiens
aauaaaaacugac

SEQ ID NO: 716392 - RNA, 22 nt, Homo sapiens
aaauuaguauagcuacuuugga

SEQ ID NO: 716393 - RNA, 15 nt, Homo sapiens
aaauuagugaguaua

SEQ ID NO: 716394 - RNA, 14 nt, Homo sapiens
aaauuaugccauag

SEQ ID NO: 716395 - RNA, 18 nt, Homo sapiens
aaauuauguauguuuaca

SEQ ID NO: 716396 - RNA, 14 nt, Homo sapiens
aaauuauuugucau

SEQ ID NO: 716397 - RNA, 19 nt, Homo sapiens
aaauucaaagaaguacuuu

SEQ ID NO: 716398 - RNA, 16 nt, Homo sapiens
aaauucaaagcauaaa

SEQ ID NO: 716399 - RNA, 18 nt, Homo sapiens
aaauucaauuaggauuaa

SEQ ID NO: 716400 - RNA, 14 nt, Homo sapiens
aaauucagaacaag

SEQ ID NO: 716401 - RNA, 15 nt, Homo sapiens
aaauucagaugcugu

SEQ ID NO: 716402 - RNA, 20 nt, Homo sapiens
aaauucaggaugcugugaua

SEQ ID NO: 716403 - RNA, 14 nt, Homo sapiens
aaauuccagaagaa

SEQ ID NO: 716404 - RNA, 13 nt, Homo sapiens
aaauuccuaucuc

SEQ ID NO: 716405 - RNA, 18 nt, Homo sapiens
aaauuccucuuacuguaa

SEQ ID NO: 716406 - RNA, 23 nt, Homo sapiens
aaauucgcugcaaccuguugaua

SEQ ID NO: 716407 - RNA, 13 nt, Homo sapiens
aaauucuaauggu

SEQ ID NO: 716408 - RNA, 15 nt, Homo sapiens
aaauucuacaacuuu

SEQ ID NO: 716409 - RNA, 20 nt, Homo sapiens
aaauucuauaggaacauaug

SEQ ID NO: 716410 - RNA, 21 nt, Homo sapiens
aaauucuauugaaaacagugu

SEQ ID NO: 716411 - RNA, 14 nt, Homo sapiens
aaauucucugcgau

SEQ ID NO: 716412 - RNA, 19 nt, Homo sapiens
aaauugaaaggcauucucu

SEQ ID NO: 716413 - RNA, 17 nt, Homo sapiens
aaauugauugaauuaaa

SEQ ID NO: 716414 - RNA, 20 nt, Homo sapiens
aaauugcacuuuuaaaccuc

SEQ ID NO: 716415 - RNA, 17 nt, Homo sapiens
aaauuggacugucuuua

SEQ ID NO: 716416 - RNA, 20 nt, Homo sapiens
aaauugggaaaggaguagaa

SEQ ID NO: 716417 - RNA, 17 nt, Homo sapiens
aaauuggugaacagugu

SEQ ID NO: 716418 - RNA, 16 nt, Homo sapiens
aaauugugugugcaag

SEQ ID NO: 716419 - RNA, 16 nt, Homo sapiens
aaauuguugggaggac

SEQ ID NO: 716420 - RNA, 14 nt, Homo sapiens
aaauuguugugcuu

SEQ ID NO: 716421 - RNA, 15 nt, Homo sapiens
aaauuguugugcuua

SEQ ID NO: 716422 - RNA, 16 nt, Homo sapiens
aaauuguuuagugaua

SEQ ID NO: 716423 - RNA, 16 nt, Homo sapiens
aaauuguuuuuacuga

SEQ ID NO: 716424 - RNA, 18 nt, Homo sapiens
aaauuuaaaacuguugga

SEQ ID NO: 716425 - RNA, 19 nt, Homo sapiens
aaauuuaauauacugcaua

SEQ ID NO: 716426 - RNA, 18 nt, Homo sapiens
aaauuuaaugacaguuuu

SEQ ID NO: 716427 - RNA, 22 nt, Homo sapiens
aaauuuaggaccaauaccuccu

SEQ ID NO: 716428 - RNA, 15 nt, Homo sapiens
aaauuuaucuuucaa

SEQ ID NO: 716429 - RNA, 16 nt, Homo sapiens
aaauuuaugcauuuca

SEQ ID NO: 716430 - RNA, 13 nt, Homo sapiens
aaauuuaugugau

SEQ ID NO: 716431 - RNA, 13 nt, Homo sapiens
aaauuucuaucag

SEQ ID NO: 716432 - RNA, 21 nt, Homo sapiens
aaauuucuguaaaacagguua

SEQ ID NO: 716433 - RNA, 22 nt, Homo sapiens
aaauuuggccuuaagaacugug

SEQ ID NO: 716434 - RNA, 14 nt, Homo sapiens
aaauuugugucaua

SEQ ID NO: 716435 - RNA, 18 nt, Homo sapiens
aaauuuuaaaaaucuaag

SEQ ID NO: 716436 - RNA, 18 nt, Homo sapiens
aaauuuuagugugccuuc

SEQ ID NO: 716437 - RNA, 17 nt, Homo sapiens
aacauaagguacuagca

SEQ ID NO: 716438 - RNA, 22 nt, Homo sapiens
aacauaaguguugguagcacuu

SEQ ID NO: 716439 - RNA, 18 nt, Homo sapiens
aacauaaucuaguuuaca

SEQ ID NO: 716440 - RNA, 16 nt, Homo sapiens
aacauaauucucucac

SEQ ID NO: 716441 - RNA, 20 nt, Homo sapiens
aacauacuggccuggacugu

SEQ ID NO: 716442 - RNA, 17 nt, Homo sapiens
aacauagcaucucagga

SEQ ID NO: 716443 - RNA, 22 nt, Homo sapiens
aacauagugaaaccccaucucu

SEQ ID NO: 716444 - RNA, 12 nt, Homo sapiens
aacauagugucu

SEQ ID NO: 716445 - RNA, 18 nt, Homo sapiens
aacauaguuuaaguugau

SEQ ID NO: 716446 - RNA, 13 nt, Homo sapiens
aacauauaugugu

SEQ ID NO: 716447 - RNA, 22 nt, Homo sapiens
aacauauccaaaauaaugagga

SEQ ID NO: 716448 - RNA, 19 nt, Homo sapiens
aacauauccuuucaagaca

SEQ ID NO: 716449 - RNA, 15 nt, Homo sapiens
aacauauguuugcuu

SEQ ID NO: 716450 - RNA, 16 nt, Homo sapiens
aacaucacucuugucu

SEQ ID NO: 716451 - RNA, 18 nt, Homo sapiens
aacaucacugucuugcca

SEQ ID NO: 716452 - RNA, 22 nt, Homo sapiens
aacaucacugucuugccagauu

SEQ ID NO: 716453 - RNA, 17 nt, Homo sapiens
aacaucagcugaauuca

SEQ ID NO: 716454 - RNA, 20 nt, Homo sapiens
aacaucauuacugccaucuu

SEQ ID NO: 716455 - RNA, 18 nt, Homo sapiens
aacaucauuacuuaugau

SEQ ID NO: 716456 - RNA, 15 nt, Homo sapiens
aacaucuacaaucag

SEQ ID NO: 716457 - RNA, 14 nt, Homo sapiens
aacaucucugggaa

SEQ ID NO: 716458 - RNA, 16 nt, Homo sapiens
aacaucuuuagugucu

SEQ ID NO: 716459 - RNA, 17 nt, Homo sapiens
aacaucuuuuacauucu

SEQ ID NO: 716460 - RNA, 23 nt, Homo sapiens
aacaucuuuuggaaguuuugcua

SEQ ID NO: 716461 - RNA, 13 nt, Homo sapiens
aacaugaggacag

SEQ ID NO: 716462 - RNA, 12 nt, Homo sapiens
aacaugaugaaa

SEQ ID NO: 716463 - RNA, 14 nt, Homo sapiens
aacaugcaaagauc

SEQ ID NO: 716464 - RNA, 15 nt, Homo sapiens
aacaugccaggcuca

SEQ ID NO: 716465 - RNA, 17 nt, Homo sapiens
aacaugcccacagauca

SEQ ID NO: 716466 - RNA, 22 nt, Homo sapiens
aacaugcuugaauaacugagcu

SEQ ID NO: 716467 - RNA, 15 nt, Homo sapiens
aacauggacuuguau

SEQ ID NO: 716468 - RNA, 21 nt, Homo sapiens
aacauggacuuucuugcauga

SEQ ID NO: 716469 - RNA, 22 nt, Homo sapiens
aacaugguaaaaccccaucucu

SEQ ID NO: 716470 - RNA, 22 nt, Homo sapiens
aacauggugaaaccccgucucu

SEQ ID NO: 716471 - RNA, 22 nt, Homo sapiens
aacauggugaaaccucaucucu

SEQ ID NO: 716472 - RNA, 23 nt, Homo sapiens
aacauggugaaaccucaucucua

SEQ ID NO: 716473 - RNA, 21 nt, Homo sapiens
aacaugguggaaaacgaagcu

SEQ ID NO: 716474 - RNA, 19 nt, Homo sapiens
aacauguaauuaaguacua

SEQ ID NO: 716475 - RNA, 13 nt, Homo sapiens
aacauguaugugc

SEQ ID NO: 716476 - RNA, 15 nt, Homo sapiens
aacauguccuaauuc

SEQ ID NO: 716477 - RNA, 21 nt, Homo sapiens
aacaugugacaacaugcaaga

SEQ ID NO: 716478 - RNA, 11 nt, Homo sapiens
aacauguuaag

SEQ ID NO: 716479 - RNA, 21 nt, Homo sapiens
aacauguuagaagcaaugaau

SEQ ID NO: 716480 - RNA, 19 nt, Homo sapiens
aacauguuguacauuucac

SEQ ID NO: 716481 - RNA, 20 nt, Homo sapiens
aacauguuugggaaguccua

SEQ ID NO: 716482 - RNA, 21 nt, Homo sapiens
aacauuaaauggugccuccaa

SEQ ID NO: 716483 - RNA, 15 nt, Homo sapiens
aacauuaacauugau

SEQ ID NO: 716484 - RNA, 20 nt, Homo sapiens
aacauuauuagcacuucccg

SEQ ID NO: 716485 - RNA, 20 nt, Homo sapiens
aacauuauuuggauaucaaa

SEQ ID NO: 716486 - RNA, 13 nt, Homo sapiens
aacauuccaagac

SEQ ID NO: 716487 - RNA, 21 nt, Homo sapiens
aacauuccuguugaugggaaa

SEQ ID NO: 716488 - RNA, 18 nt, Homo sapiens
aacauuccuuagucucaa

SEQ ID NO: 716489 - RNA, 15 nt, Homo sapiens
aacauugacuucuug

SEQ ID NO: 716490 - RNA, 13 nt, Homo sapiens
aacauuuacaugu

SEQ ID NO: 716491 - RNA, 22 nt, Homo sapiens
aacauuuauuuugagaagcucu

SEQ ID NO: 716492 - RNA, 22 nt, Homo sapiens
aacauuugccaagugaguugaa

SEQ ID NO: 716493 - RNA, 14 nt, Homo sapiens
aacauuuugacuaa

SEQ ID NO: 716494 - RNA, 15 nt, Homo sapiens
aaccaaaacaugucu

SEQ ID NO: 716495 - RNA, 18 nt, Homo sapiens
aaccaaaagaauuugcac

SEQ ID NO: 716496 - RNA, 19 nt, Homo sapiens
aaccaaagagggcuuccuc

SEQ ID NO: 716497 - RNA, 19 nt, Homo sapiens
aaccaaaucuuaaaugaga

SEQ ID NO: 716498 - RNA, 22 nt, Homo sapiens
aaccaaaucuuaaaugagacca

SEQ ID NO: 716499 - RNA, 17 nt, Homo sapiens
aaccaagaccuuucugc

SEQ ID NO: 716500 - RNA, 22 nt, Homo sapiens
aaccaagcuguacccuugagac

SEQ ID NO: 716501 - RNA, 16 nt, Homo sapiens
aaccaaggaaagugaa

SEQ ID NO: 716502 - RNA, 16 nt, Homo sapiens
aaccaaggacugagca

SEQ ID NO: 716503 - RNA, 14 nt, Homo sapiens
aaccaauaaaggaa

SEQ ID NO: 716504 - RNA, 17 nt, Homo sapiens
aaccacagcacuugagu

SEQ ID NO: 716505 - RNA, 12 nt, Homo sapiens
aaccaccaaucc

SEQ ID NO: 716506 - RNA, 23 nt, Homo sapiens
aaccacgccucuugaccaggcug

SEQ ID NO: 716507 - RNA, 22 nt, Homo sapiens
aaccacuaugaagcuaccucaa

SEQ ID NO: 716508 - RNA, 18 nt, Homo sapiens
aaccacugugccacugac

SEQ ID NO: 716509 - RNA, 18 nt, Homo sapiens
aaccacuucauucuugaa

SEQ ID NO: 716510 - RNA, 20 nt, Homo sapiens
aaccagacucuugccuguuu

SEQ ID NO: 716511 - RNA, 18 nt, Homo sapiens
aaaccaaguuuuacuaaa

SEQ ID NO: 716512 - RNA, 18 nt, Homo sapiens
aaaccacagucaguggag

SEQ ID NO: 716513 - RNA, 16 nt, Homo sapiens
aaaccaccaucuucua

SEQ ID NO: 716514 - RNA, 18 nt, Homo sapiens
aaaccaggccacuugccu

SEQ ID NO: 716515 - RNA, 12 nt, Homo sapiens
aaaccagguggc

SEQ ID NO: 716516 - RNA, 18 nt, Homo sapiens
aaaccaucaaaaauauuc

SEQ ID NO: 716517 - RNA, 14 nt, Homo sapiens
aaaccauccaguga

SEQ ID NO: 716518 - RNA, 12 nt, Homo sapiens
aaaccauucuag

SEQ ID NO: 716519 - RNA, 19 nt, Homo sapiens
aaaccauuuucaaaagcaa

SEQ ID NO: 716520 - RNA, 22 nt, Homo sapiens
aaaccauuuuguuauugacuaa

SEQ ID NO: 716521 - RNA, 17 nt, Homo sapiens
aaacccaccucucugga

SEQ ID NO: 716522 - RNA, 20 nt, Homo sapiens
aaacccagucuccucuccau

SEQ ID NO: 716523 - RNA, 11 nt, Homo sapiens
aaacccagugc

SEQ ID NO: 716524 - RNA, 24 nt, Homo sapiens
aaacccauacaauguauguacaau

SEQ ID NO: 716525 - RNA, 19 nt, Homo sapiens
aaacccauucccucuccag

SEQ ID NO: 716526 - RNA, 13 nt, Homo sapiens
aaacccccagugu

SEQ ID NO: 716527 - RNA, 14 nt, Homo sapiens
aaacccccaucucu

SEQ ID NO: 716528 - RNA, 13 nt, Homo sapiens
aaaccccgucucu

SEQ ID NO: 716529 - RNA, 14 nt, Homo sapiens
aaacccuaaaaaga

SEQ ID NO: 716530 - RNA, 13 nt, Homo sapiens
aaacccucaaggg

SEQ ID NO: 716531 - RNA, 20 nt, Homo sapiens
aaacccucagcacuguuaca

SEQ ID NO: 716532 - RNA, 17 nt, Homo sapiens
aaacccugcugaacaca

SEQ ID NO: 716533 - RNA, 21 nt, Homo sapiens
aaacccugcugaacacagugu

SEQ ID NO: 716534 - RNA, 15 nt, Homo sapiens
aaacccuugccaggu

SEQ ID NO: 716535 - RNA, 16 nt, Homo sapiens
aaaccgagugcaauga

SEQ ID NO: 716536 - RNA, 16 nt, Homo sapiens
aaaccuaauauucaau

SEQ ID NO: 716537 - RNA, 13 nt, Homo sapiens
aaaccuaaugauc

SEQ ID NO: 716538 - RNA, 15 nt, Homo sapiens
aaaccuaguacugcc

SEQ ID NO: 716539 - RNA, 14 nt, Homo sapiens
aaaccucaaaaugu

SEQ ID NO: 716540 - RNA, 13 nt, Homo sapiens
aaaccucaucucu

SEQ ID NO: 716541 - RNA, 15 nt, Homo sapiens
aaaccucaucucuac

SEQ ID NO: 716542 - RNA, 15 nt, Homo sapiens
aaaccuccagccucc

SEQ ID NO: 716543 - RNA, 13 nt, Homo sapiens
aaaccugaccaca

SEQ ID NO: 716544 - RNA, 22 nt, Homo sapiens
aaaccugauguuaaaauuccau

SEQ ID NO: 716545 - RNA, 15 nt, Homo sapiens
aaaccuggaugucac

SEQ ID NO: 716546 - RNA, 22 nt, Homo sapiens
aaaccuggcaagucaccugcag

SEQ ID NO: 716547 - RNA, 14 nt, Homo sapiens
aaaccugugugcca

SEQ ID NO: 716548 - RNA, 18 nt, Homo sapiens
aaaccuuuacaguuagca

SEQ ID NO: 716549 - RNA, 16 nt, Homo sapiens
aaacgaaaugcuauga

SEQ ID NO: 716550 - RNA, 19 nt, Homo sapiens
aaacgaagcucauucccaa

SEQ ID NO: 716551 - RNA, 17 nt, Homo sapiens
aaacgcgaccuuggccg

SEQ ID NO: 716552 - RNA, 16 nt, Homo sapiens
aaacgggaacaugccc

SEQ ID NO: 716553 - RNA, 18 nt, Homo sapiens
aaacgguaauacgugaaa

SEQ ID NO: 716554 - RNA, 21 nt, Homo sapiens
aaacggugaggccccaguggc

SEQ ID NO: 716555 - RNA, 21 nt, Homo sapiens
aaacgugaaauucuauugaaa

SEQ ID NO: 716556 - RNA, 16 nt, Homo sapiens
aaacuaacacccaguc

SEQ ID NO: 716557 - RNA, 14 nt, Homo sapiens
aaacuaauuucaua

SEQ ID NO: 716558 - RNA, 18 nt, Homo sapiens
aaacuaccaaauuaguga

SEQ ID NO: 716559 - RNA, 15 nt, Homo sapiens
aaacuaccaauccca

SEQ ID NO: 716560 - RNA, 21 nt, Homo sapiens
aaacuagcagaagaacuagua

SEQ ID NO: 716561 - RNA, 18 nt, Homo sapiens
aaacuaggcaauguacuc

SEQ ID NO: 716562 - RNA, 20 nt, Homo sapiens
aaacuauccugauuccaaau

SEQ ID NO: 716563 - RNA, 18 nt, Homo sapiens
aaacuaugaggacugccu

SEQ ID NO: 716564 - RNA, 19 nt, Homo sapiens
aaacuauuggaaaguacuc

SEQ ID NO: 716565 - RNA, 17 nt, Homo sapiens
aaacuauuuauaucaca

SEQ ID NO: 716566 - RNA, 15 nt, Homo sapiens
aaacuauuugggaua

SEQ ID NO: 716567 - RNA, 13 nt, Homo sapiens
aaacucaaaauau

SEQ ID NO: 716568 - RNA, 12 nt, Homo sapiens
aaugcauucccu

SEQ ID NO: 716569 - RNA, 18 nt, Homo sapiens
aaugcauuugauggccac

SEQ ID NO: 716570 - RNA, 19 nt, Homo sapiens
aaugcauuuuauucuuuaa

SEQ ID NO: 716571 - RNA, 18 nt, Homo sapiens
aaugccaaaauucauuca

SEQ ID NO: 716572 - RNA, 18 nt, Homo sapiens
aaugccaaacacuagcuc

SEQ ID NO: 716573 - RNA, 15 nt, Homo sapiens
aaugccaaauugcag

SEQ ID NO: 716574 - RNA, 20 nt, Homo sapiens
aaugccaaucuucaguauuu

SEQ ID NO: 716575 - RNA, 23 nt, Homo sapiens
aaugccagcauaaauccauccau

SEQ ID NO: 716576 - RNA, 23 nt, Homo sapiens
aaugcccucauacccaugcacag

SEQ ID NO: 716577 - RNA, 16 nt, Homo sapiens
aaugccggugagaaua

SEQ ID NO: 716578 - RNA, 16 nt, Homo sapiens
aaugccugguaccaga

SEQ ID NO: 716579 - RNA, 18 nt, Homo sapiens
aaugccugugaagcaguc

SEQ ID NO: 716580 - RNA, 19 nt, Homo sapiens
aaugccuuuaaaguaugaa

SEQ ID NO: 716581 - RNA, 19 nt, Homo sapiens
aaugcuaagaaaugcugaa

SEQ ID NO: 716582 - RNA, 22 nt, Homo sapiens
aaugcuaucacugucuuugacu

SEQ ID NO: 716583 - RNA, 16 nt, Homo sapiens
aaugcuaugacuguau

SEQ ID NO: 716584 - RNA, 21 nt, Homo sapiens
aaugcuaugacuguaucuuga

SEQ ID NO: 716585 - RNA, 10 nt, Homo sapiens
aaugcucacc

SEQ ID NO: 716586 - RNA, 15 nt, Homo sapiens
aaugcucaccuuuau

SEQ ID NO: 716587 - RNA, 21 nt, Homo sapiens
aaugcucauuuucugguuugg

SEQ ID NO: 716588 - RNA, 10 nt, Homo sapiens
aaugcuccau

SEQ ID NO: 716589 - RNA, 22 nt, Homo sapiens
aaugcucuucaaaauaaaacau

SEQ ID NO: 716590 - RNA, 14 nt, Homo sapiens
aaugcucuuuugca

SEQ ID NO: 716591 - RNA, 21 nt, Homo sapiens
aaugcucuuuugcacaaggaa

SEQ ID NO: 716592 - RNA, 13 nt, Homo sapiens
aaugcugagguua

SEQ ID NO: 716593 - RNA, 20 nt, Homo sapiens
aaugcugcaggacuugagaa

SEQ ID NO: 716594 - RNA, 14 nt, Homo sapiens
aaugcuggacugga

SEQ ID NO: 716595 - RNA, 16 nt, Homo sapiens
aaugcuggcauuugca

SEQ ID NO: 716596 - RNA, 17 nt, Homo sapiens
aaugcuggcauuugcac

SEQ ID NO: 716597 - RNA, 14 nt, Homo sapiens
aaugcuguuaauau

SEQ ID NO: 716598 - RNA, 22 nt, Homo sapiens
aaugcuucagauauuauugcuu

SEQ ID NO: 716599 - RNA, 15 nt, Homo sapiens
aaugcuucugcacac

SEQ ID NO: 716600 - RNA, 18 nt, Homo sapiens
aaugcuuuggacuuuuga

SEQ ID NO: 716601 - RNA, 17 nt, Homo sapiens
aauggaaaguaacucau

SEQ ID NO: 716602 - RNA, 20 nt, Homo sapiens
aauggaaauuccaacagauu

SEQ ID NO: 716603 - RNA, 19 nt, Homo sapiens
aauggacuauuuguuccac

SEQ ID NO: 716604 - RNA, 17 nt, Homo sapiens
aauggaggccauugugu

SEQ ID NO: 716605 - RNA, 21 nt, Homo sapiens
aauggauuugaugcuguuuga

SEQ ID NO: 716606 - RNA, 16 nt, Homo sapiens
aauggcagaaccaaag

SEQ ID NO: 716607 - RNA, 13 nt, Homo sapiens
aauggcagggaua

SEQ ID NO: 716608 - RNA, 22 nt, Homo sapiens
aauggcagggauacccagugau

SEQ ID NO: 716609 - RNA, 18 nt, Homo sapiens
aauggcccaguccucucc

SEQ ID NO: 716610 - RNA, 14 nt, Homo sapiens
aaugggaaaaacgg

SEQ ID NO: 716611 - RNA, 23 nt, Homo sapiens
aaugggaaaguauucuguacucu

SEQ ID NO: 716612 - RNA, 24 nt, Homo sapiens
aaugggaauauuuuauacugacag

SEQ ID NO: 716613 - RNA, 17 nt, Homo sapiens
aaugggacccuguugau

SEQ ID NO: 716614 - RNA, 19 nt, Homo sapiens
aaugguaggauaucuuggc

SEQ ID NO: 716615 - RNA, 20 nt, Homo sapiens
aaugguaggauaucuuggcu

SEQ ID NO: 716616 - RNA, 12 nt, Homo sapiens
aauggugcuguu

SEQ ID NO: 716617 - RNA, 18 nt, Homo sapiens
aaugguguuguaugccuu

SEQ ID NO: 716618 - RNA, 19 nt, Homo sapiens
aaugguuucaaagauucaa

SEQ ID NO: 716619 - RNA, 15 nt, Homo sapiens
aaugguuucaaguua

SEQ ID NO: 716620 - RNA, 21 nt, Homo sapiens
aaugguuucaaguuauucaaa

SEQ ID NO: 716621 - RNA, 16 nt, Homo sapiens
aaugguuuccucugga

SEQ ID NO: 716622 - RNA, 14 nt, Homo sapiens
aauguaaaagcaca

SEQ ID NO: 716623 - RNA, 20 nt, Homo sapiens
aauguaaaguaagacaucuc

SEQ ID NO: 716624 - RNA, 14 nt, Homo sapiens
aauguaacugcuga

SEQ ID NO: 716625 - RNA, 17 nt, Homo sapiens
aauguaacugugccagu

SEQ ID NO: 716626 - RNA, 14 nt, Homo sapiens
aauguaagcauacu

SEQ ID NO: 716627 - RNA, 22 nt, Homo sapiens
aauguaauaaaaauaguuacag

SEQ ID NO: 716628 - RNA, 16 nt, Homo sapiens
aauguaccugauguac

SEQ ID NO: 716629 - RNA, 13 nt, Homo sapiens
aauguagucaaua

SEQ ID NO: 716630 - RNA, 20 nt, Homo sapiens
aauguaguuagcuccauaaa

SEQ ID NO: 716631 - RNA, 19 nt, Homo sapiens
aauguauaaaaauuaucaa

SEQ ID NO: 716632 - RNA, 13 nt, Homo sapiens
aauguauaaagau

SEQ ID NO: 716633 - RNA, 22 nt, Homo sapiens
aauguaucuaguguguccugug

SEQ ID NO: 716634 - RNA, 21 nt, Homo sapiens
aauguaucuauuuguacaauu

SEQ ID NO: 716635 - RNA, 15 nt, Homo sapiens
aauguauguacaaua

SEQ ID NO: 716636 - RNA, 13 nt, Homo sapiens
aauguauugaacu

SEQ ID NO: 716637 - RNA, 15 nt, Homo sapiens
aauguauugauucaa

SEQ ID NO: 716638 - RNA, 17 nt, Homo sapiens
aauguauuuuagacuuc

SEQ ID NO: 716639 - RNA, 19 nt, Homo sapiens
aauguauuuuagacuuccu

SEQ ID NO: 716640 - RNA, 14 nt, Homo sapiens
aaugucacauucua

SEQ ID NO: 716641 - RNA, 12 nt, Homo sapiens
aaugucacuuaa

SEQ ID NO: 716642 - RNA, 19 nt, Homo sapiens
aaugucagaaaccaguuau

SEQ ID NO: 716643 - RNA, 17 nt, Homo sapiens
aaugucagaacagagug

SEQ ID NO: 716644 - RNA, 14 nt, Homo sapiens
aaugucauagucuu

SEQ ID NO: 716645 - RNA, 19 nt, Homo sapiens
aaugucauuaaacaugaca

SEQ ID NO: 716646 - RNA, 17 nt, Homo sapiens
aaugucauugcuaaaaa

SEQ ID NO: 716647 - RNA, 19 nt, Homo sapiens
aauguccccacgguacuua

SEQ ID NO: 716648 - RNA, 19 nt, Homo sapiens
aauguccugacaccugcuu

SEQ ID NO: 716649 - RNA, 13 nt, Homo sapiens
aaugucuaagaua

SEQ ID NO: 716650 - RNA, 12 nt, Homo sapiens
aaugucuaucaa

SEQ ID NO: 716651 - RNA, 14 nt, Homo sapiens
aaugucucauguca

SEQ ID NO: 716652 - RNA, 13 nt, Homo sapiens
aaugugacuucau

SEQ ID NO: 716653 - RNA, 21 nt, Homo sapiens
aauccuggaaggacacaguga

SEQ ID NO: 716654 - RNA, 15 nt, Homo sapiens
aauccugucauauaa

SEQ ID NO: 716655 - RNA, 17 nt, Homo sapiens
aauccuguuacucuguc

SEQ ID NO: 716656 - RNA, 15 nt, Homo sapiens
aauccuuaacauuuc

SEQ ID NO: 716657 - RNA, 17 nt, Homo sapiens
aauccuuccacuaucau

SEQ ID NO: 716658 - RNA, 15 nt, Homo sapiens
aauccuuccauucca

SEQ ID NO: 716659 - RNA, 16 nt, Homo sapiens
aauccuuccauuccac

SEQ ID NO: 716660 - RNA, 20 nt, Homo sapiens
aauccuucccugcucuugca

SEQ ID NO: 716661 - RNA, 21 nt, Homo sapiens
aauccuucccugcucuugcag

SEQ ID NO: 716662 - RNA, 19 nt, Homo sapiens
aauccuucuauucuagccu

SEQ ID NO: 716663 - RNA, 16 nt, Homo sapiens
aauccuuuacauucaa

SEQ ID NO: 716664 - RNA, 23 nt, Homo sapiens
aauccuuuacauucaacuuuucu

SEQ ID NO: 716665 - RNA, 18 nt, Homo sapiens
aauccuuuacuguuaguc

SEQ ID NO: 716666 - RNA, 14 nt, Homo sapiens
aaucgaacuaugaa

SEQ ID NO: 716667 - RNA, 19 nt, Homo sapiens
aaucgauucugcagcaccg

SEQ ID NO: 716668 - RNA, 19 nt, Homo sapiens
aaucggcuggggacugcua

SEQ ID NO: 716669 - RNA, 21 nt, Homo sapiens
aaucguccagcgaccuuccuc

SEQ ID NO: 716670 - RNA, 16 nt, Homo sapiens
aaucuaagcagcuuau

SEQ ID NO: 716671 - RNA, 17 nt, Homo sapiens
aaucuaaggauaaugaa

SEQ ID NO: 716672 - RNA, 20 nt, Homo sapiens
aaucuacagaacuacauauu

SEQ ID NO: 716673 - RNA, 10 nt, Homo sapiens
aaucuacauu

SEQ ID NO: 716674 - RNA, 17 nt, Homo sapiens
aaucuaccaguggugcu

SEQ ID NO: 716675 - RNA, 21 nt, Homo sapiens
aaucuaccaguggugcucaau

SEQ ID NO: 716676 - RNA, 14 nt, Homo sapiens
aaucuaguuuacag

SEQ ID NO: 716677 - RNA, 15 nt, Homo sapiens
aaucuauguuugcac

SEQ ID NO: 716678 - RNA, 16 nt, Homo sapiens
aaucuauuauacugua

SEQ ID NO: 716679 - RNA, 16 nt, Homo sapiens
aaucuauugucuacuu

SEQ ID NO: 716680 - RNA, 18 nt, Homo sapiens
aaucucaccccaucccac

SEQ ID NO: 716681 - RNA, 20 nt, Homo sapiens
aaucucacccucuccuccag

SEQ ID NO: 716682 - RNA, 16 nt, Homo sapiens
aaucucggcucacuga

SEQ ID NO: 716683 - RNA, 15 nt, Homo sapiens
aaucucuauuugaga

SEQ ID NO: 716684 - RNA, 16 nt, Homo sapiens
aaucucucugcagcug

SEQ ID NO: 716685 - RNA, 22 nt, Homo sapiens
aaucucuguucuguuuggcacu

SEQ ID NO: 716686 - RNA, 11 nt, Homo sapiens
aaucucuucau

SEQ ID NO: 716687 - RNA, 22 nt, Homo sapiens
aaucugaagauugcgguuuaca

SEQ ID NO: 716688 - RNA, 13 nt, Homo sapiens
aaucugaccaaaa

SEQ ID NO: 716689 - RNA, 13 nt, Homo sapiens
aaucugagccagu

SEQ ID NO: 716690 - RNA, 13 nt, Homo sapiens
aaucugagcugca

SEQ ID NO: 716691 - RNA, 22 nt, Homo sapiens
aaucugaguagagcagccacaa

SEQ ID NO: 716692 - RNA, 17 nt, Homo sapiens
aaucugauguuaaccaa

SEQ ID NO: 716693 - RNA, 19 nt, Homo sapiens
aaucugauguuaaccaaug

SEQ ID NO: 716694 - RNA, 13 nt, Homo sapiens
aaucugauugcac

SEQ ID NO: 716695 - RNA, 17 nt, Homo sapiens
aaucugauuggacauuu

SEQ ID NO: 716696 - RNA, 20 nt, Homo sapiens
aaucugcugcauagcucuau

SEQ ID NO: 716697 - RNA, 18 nt, Homo sapiens
aaucugggauguacuguu

SEQ ID NO: 716698 - RNA, 18 nt, Homo sapiens
aaucuguccgugaccuau

SEQ ID NO: 716699 - RNA, 20 nt, Homo sapiens
aaucuguccguucacaugug

SEQ ID NO: 716700 - RNA, 23 nt, Homo sapiens
aaucuguugauaaauccaucacu

SEQ ID NO: 716701 - RNA, 12 nt, Homo sapiens
aaucuguugcua

SEQ ID NO: 716702 - RNA, 16 nt, Homo sapiens
aaucuuaauacuguua

SEQ ID NO: 716703 - RNA, 13 nt, Homo sapiens
aaucuuaucuuug

SEQ ID NO: 716704 - RNA, 18 nt, Homo sapiens
aaucuucaaagccuucuc

SEQ ID NO: 716705 - RNA, 12 nt, Homo sapiens
aaucuucuacuu

SEQ ID NO: 716706 - RNA, 20 nt, Homo sapiens
aaucuucugccuucucauga

SEQ ID NO: 716707 - RNA, 15 nt, Homo sapiens
aaucuucugucuugu

SEQ ID NO: 716708 - RNA, 20 nt, Homo sapiens
aaucuugcucugcuugacaa

SEQ ID NO: 716709 - RNA, 19 nt, Homo sapiens
aaucuuugccuuuaucucu

SEQ ID NO: 716710 - RNA, 19 nt, Homo sapiens
aaucuuuggguaacuucaa

SEQ ID NO: 716711 - RNA, 20 nt, Homo sapiens
aaugaaaaggaaacuugaaa

SEQ ID NO: 716712 - RNA, 21 nt, Homo sapiens
aaugaaacaagcuuacaaaga

SEQ ID NO: 716713 - RNA, 13 nt, Homo sapiens
aaugaaagggaaa

SEQ ID NO: 716714 - RNA, 19 nt, Homo sapiens
aaugaaauaauacuucagc

SEQ ID NO: 716715 - RNA, 12 nt, Homo sapiens
aaugaacaucuc

SEQ ID NO: 716716 - RNA, 11 nt, Homo sapiens
aaugaacuaau

SEQ ID NO: 716717 - RNA, 18 nt, Homo sapiens
aaugaacuuccauuugua

SEQ ID NO: 716718 - RNA, 19 nt, Homo sapiens
aaugaacuugguaccugca

SEQ ID NO: 716719 - RNA, 22 nt, Homo sapiens
aaugaagacuacauuugugaac

SEQ ID NO: 716720 - RNA, 17 nt, Homo sapiens
aaugaagccuuagccag

SEQ ID NO: 716721 - RNA, 16 nt, Homo sapiens
aaugaauacugggaau

SEQ ID NO: 716722 - RNA, 20 nt, Homo sapiens
aaugaauauucaacagcuca

SEQ ID NO: 716723 - RNA, 14 nt, Homo sapiens
aaugaaugugcaac

SEQ ID NO: 716724 - RNA, 14 nt, Homo sapiens
aaugaauguuuaca

SEQ ID NO: 716725 - RNA, 23 nt, Homo sapiens
aaugacaucuucaaagcuugaag

SEQ ID NO: 716726 - RNA, 15 nt, Homo sapiens
aaugacaugcacuga

SEQ ID NO: 716727 - RNA, 10 nt, Homo sapiens
aaugacauuc

SEQ ID NO: 716728 - RNA, 12 nt, Homo sapiens
aaugaccaagac

SEQ ID NO: 716729 - RNA, 17 nt, Homo sapiens
aaugaccgagcccugga

SEQ ID NO: 716730 - RNA, 18 nt, Homo sapiens
aaugaccgagcccuggag

SEQ ID NO: 716731 - RNA, 13 nt, Homo sapiens
aaugaccugguga

SEQ ID NO: 716732 - RNA, 15 nt, Homo sapiens
aaugacugcauuuga

SEQ ID NO: 716733 - RNA, 21 nt, Homo sapiens
aaugagacugaacugugugaa

SEQ ID NO: 716734 - RNA, 19 nt, Homo sapiens
aaugagaguuccuucucac

SEQ ID NO: 716735 - RNA, 22 nt, Homo sapiens
aaugagcauguuugccuagaca

SEQ ID NO: 716736 - RNA, 13 nt, Homo sapiens
aaugagcauugau

SEQ ID NO: 716737 - RNA, 22 nt, Homo sapiens
aaaucagaagucaucuugcuac

SEQ ID NO: 716738 - RNA, 20 nt, Homo sapiens
aaaucagcugcuacuacucc

SEQ ID NO: 716739 - RNA, 14 nt, Homo sapiens
aaaucaguuucuca

SEQ ID NO: 716740 - RNA, 15 nt, Homo sapiens
aaaucauaguuuaaa

SEQ ID NO: 716741 - RNA, 21 nt, Homo sapiens
aaaucauaguuuaaacugcau

SEQ ID NO: 716742 - RNA, 21 nt, Homo sapiens
aaaucaugaaacuuguuucac

SEQ ID NO: 716743 - RNA, 16 nt, Homo sapiens
aaaucauucagaucau

SEQ ID NO: 716744 - RNA, 16 nt, Homo sapiens
aaaucauuuagucuaa

SEQ ID NO: 716745 - RNA, 21 nt, Homo sapiens
aaauccaaaaagaaaugaugu

SEQ ID NO: 716746 - RNA, 22 nt, Homo sapiens
aaauccaaaaagaaaugauguu

SEQ ID NO: 716747 - RNA, 10 nt, Homo sapiens
aaauccaaag

SEQ ID NO: 716748 - RNA, 15 nt, Homo sapiens
aaauccaacuuucac

SEQ ID NO: 716749 - RNA, 21 nt, Homo sapiens
aaauccacacacccagagcau

SEQ ID NO: 716750 - RNA, 14 nt, Homo sapiens
aaauccagaacuca

SEQ ID NO: 716751 - RNA, 16 nt, Homo sapiens
aaauccagaacucaaa

SEQ ID NO: 716752 - RNA, 20 nt, Homo sapiens
aaaucccaagaaauggaauc

SEQ ID NO: 716753 - RNA, 19 nt, Homo sapiens
aaauccuauaagauuuaaa

SEQ ID NO: 716754 - RNA, 23 nt, Homo sapiens
aaauccuggaaggacacagugau

SEQ ID NO: 716755 - RNA, 12 nt, Homo sapiens
aaauccuugaua

SEQ ID NO: 716756 - RNA, 20 nt, Homo sapiens
aaaucgagagugugcucucc

SEQ ID NO: 716757 - RNA, 12 nt, Homo sapiens
aaaucuagaaga

SEQ ID NO: 716758 - RNA, 17 nt, Homo sapiens
aaaucuaggaugugaug

SEQ ID NO: 716759 - RNA, 20 nt, Homo sapiens
aaaucuaggugauuguucau

SEQ ID NO: 716760 - RNA, 19 nt, Homo sapiens
aaaucuaugaaguauauaa

SEQ ID NO: 716761 - RNA, 23 nt, Homo sapiens
aaaucucucauauucgcuagugu

SEQ ID NO: 716762 - RNA, 19 nt, Homo sapiens
aaaucucuuccacaugggu

SEQ ID NO: 716763 - RNA, 20 nt, Homo sapiens
aaaucugagaaacucuacau

SEQ ID NO: 716764 - RNA, 20 nt, Homo sapiens
aaaucugagggagcugagua

SEQ ID NO: 716765 - RNA, 15 nt, Homo sapiens
aaaucugaguauaua

SEQ ID NO: 716766 - RNA, 15 nt, Homo sapiens
aaaucugccuagaaa

SEQ ID NO: 716767 - RNA, 14 nt, Homo sapiens
aaaucugcugcacc

SEQ ID NO: 716768 - RNA, 20 nt, Homo sapiens
aaaucuguaaucagcaauaa

SEQ ID NO: 716769 - RNA, 21 nt, Homo sapiens
aaaucugucauaagcauuacu

SEQ ID NO: 716770 - RNA, 12 nt, Homo sapiens
aaaucugugaug

SEQ ID NO: 716771 - RNA, 18 nt, Homo sapiens
aaaucuguguaacuguaa

SEQ ID NO: 716772 - RNA, 18 nt, Homo sapiens
aaaucuguugauaaaucc

SEQ ID NO: 716773 - RNA, 15 nt, Homo sapiens
aaaucuuaacuugaa

SEQ ID NO: 716774 - RNA, 16 nt, Homo sapiens
aaaucuuauaguucua

SEQ ID NO: 716775 - RNA, 17 nt, Homo sapiens
aaaucuuguuaauguca

SEQ ID NO: 716776 - RNA, 21 nt, Homo sapiens
aaaucuuuuucuauauucuca

SEQ ID NO: 716777 - RNA, 15 nt, Homo sapiens
aaaugaaagcaugug

SEQ ID NO: 716778 - RNA, 21 nt, Homo sapiens
aaaugaaagggaaacugggaa

SEQ ID NO: 716779 - RNA, 17 nt, Homo sapiens
aaaugaaguauuucuca

SEQ ID NO: 716780 - RNA, 15 nt, Homo sapiens
aaaugaauacugaau

SEQ ID NO: 716781 - RNA, 19 nt, Homo sapiens
aaaugacaagugagacaaa

SEQ ID NO: 716782 - RNA, 12 nt, Homo sapiens
aaaugaccaaga

SEQ ID NO: 716783 - RNA, 15 nt, Homo sapiens
aaaugagaaguacuu

SEQ ID NO: 716784 - RNA, 17 nt, Homo sapiens
aagcauugacuugccgu

SEQ ID NO: 716785 - RNA, 22 nt, Homo sapiens
aagcauugccuggacugaccac

SEQ ID NO: 716786 - RNA, 16 nt, Homo sapiens
aagcauuuucauuucu

SEQ ID NO: 716787 - RNA, 16 nt, Homo sapiens
aagccaaacucugcca

SEQ ID NO: 716788 - RNA, 17 nt, Homo sapiens
aagccaaacucugccag

SEQ ID NO: 716789 - RNA, 23 nt, Homo sapiens
aagccaaagaaaaauaacccuuu

SEQ ID NO: 716790 - RNA, 19 nt, Homo sapiens
aagccaaagagccucccac

SEQ ID NO: 716791 - RNA, 17 nt, Homo sapiens
aagccacaagucuucca

SEQ ID NO: 716792 - RNA, 15 nt, Homo sapiens
aagccacucuguccc

SEQ ID NO: 716793 - RNA, 20 nt, Homo sapiens
aagccacucugucccuuccu

SEQ ID NO: 716794 - RNA, 23 nt, Homo sapiens
aagccagaugugaaaacaucuca

SEQ ID NO: 716795 - RNA, 16 nt, Homo sapiens
aagccagcaggagcuc

SEQ ID NO: 716796 - RNA, 16 nt, Homo sapiens
aagccagcuuuccuca

SEQ ID NO: 716797 - RNA, 14 nt, Homo sapiens
aagccaugaguucc

SEQ ID NO: 716798 - RNA, 16 nt, Homo sapiens
aagccaugugccagau

SEQ ID NO: 716799 - RNA, 14 nt, Homo sapiens
aagccauuaugaua

SEQ ID NO: 716800 - RNA, 17 nt, Homo sapiens
aagcccaagugaaauca

SEQ ID NO: 716801 - RNA, 21 nt, Homo sapiens
aagcccaaguucaugcagcug

SEQ ID NO: 716802 - RNA, 15 nt, Homo sapiens
aagcccaauauuaua

SEQ ID NO: 716803 - RNA, 14 nt, Homo sapiens
aagcccagcacuug

SEQ ID NO: 716804 - RNA, 15 nt, Homo sapiens
aagcccagugcacug

SEQ ID NO: 716805 - RNA, 18 nt, Homo sapiens
aagcccauagcacugggc

SEQ ID NO: 716806 - RNA, 15 nt, Homo sapiens
aagccccacuugaag

SEQ ID NO: 716807 - RNA, 19 nt, Homo sapiens
aagccccagaguggcucac

SEQ ID NO: 716808 - RNA, 18 nt, Homo sapiens
aagccccauuuccucaca

SEQ ID NO: 716809 - RNA, 22 nt, Homo sapiens
aagccccuuacuaugaucucag

SEQ ID NO: 716810 - RNA, 20 nt, Homo sapiens
aagcccuccgccauucucaa

SEQ ID NO: 716811 - RNA, 23 nt, Homo sapiens
aagcccuggccaaauuuugaucc

SEQ ID NO: 716812 - RNA, 17 nt, Homo sapiens
aagcccuguucuccugu

SEQ ID NO: 716813 - RNA, 14 nt, Homo sapiens
aagccucauuugaa

SEQ ID NO: 716814 - RNA, 23 nt, Homo sapiens
aagccuccgcugggcuucauucc

SEQ ID NO: 716815 - RNA, 20 nt, Homo sapiens
aagccucuggucacauggcu

SEQ ID NO: 716816 - RNA, 12 nt, Homo sapiens
aagccugagaac

SEQ ID NO: 716817 - RNA, 16 nt, Homo sapiens
aagccugagaacugaa

SEQ ID NO: 716818 - RNA, 13 nt, Homo sapiens
aagccugaggcug

SEQ ID NO: 716819 - RNA, 14 nt, Homo sapiens
aagccugugaaagg

SEQ ID NO: 716820 - RNA, 17 nt, Homo sapiens
aagccuuaauuugcaca

SEQ ID NO: 716821 - RNA, 22 nt, Homo sapiens
aagccuuagggcaggaaagaau

SEQ ID NO: 716822 - RNA, 23 nt, Homo sapiens
aagccuuauuucuagaagcacau

SEQ ID NO: 716823 - RNA, 14 nt, Homo sapiens
aagccuuccuacac

SEQ ID NO: 716824 - RNA, 19 nt, Homo sapiens
aagccuucuaaaugaguca

SEQ ID NO: 716825 - RNA, 21 nt, Homo sapiens
aagccuuuagagccagcccau

SEQ ID NO: 716826 - RNA, 17 nt, Homo sapiens
aagccuuuguaucuuuc

SEQ ID NO: 716827 - RNA, 22 nt, Homo sapiens
aagccuuuuguuucccuugcuu

SEQ ID NO: 716828 - RNA, 20 nt, Homo sapiens
aagcgauccuaucaccucag

SEQ ID NO: 716829 - RNA, 19 nt, Homo sapiens
aagcggaaaguuagugcuu

SEQ ID NO: 716830 - RNA, 14 nt, Homo sapiens
aagcguccucucag

SEQ ID NO: 716831 - RNA, 17 nt, Homo sapiens
aagcguuaugugcagua

SEQ ID NO: 716832 - RNA, 16 nt, Homo sapiens
aagcguucagugaugu

SEQ ID NO: 716833 - RNA, 21 nt, Homo sapiens
aagcguuucuuuacuucucac

SEQ ID NO: 716834 - RNA, 15 nt, Homo sapiens
aagcguuuuucucaa

SEQ ID NO: 716835 - RNA, 14 nt, Homo sapiens
aagcuaaaaggaaa

SEQ ID NO: 716836 - RNA, 22 nt, Homo sapiens
aagcuaaaauuagaugaacuca

SEQ ID NO: 716837 - RNA, 22 nt, Homo sapiens
aagcuaaauccuuuacuguuag

SEQ ID NO: 716838 - RNA, 21 nt, Homo sapiens
aagcuaggguggcccuugcag

SEQ ID NO: 716839 - RNA, 16 nt, Homo sapiens
aagcuauauaagacaa

SEQ ID NO: 716840 - RNA, 15 nt, Homo sapiens
aagcucagaauccaa

SEQ ID NO: 716841 - RNA, 15 nt, Homo sapiens
aagcuccuuccagac

SEQ ID NO: 716842 - RNA, 21 nt, Homo sapiens
aagcucuagaaucugcaauuc

SEQ ID NO: 716843 - RNA, 16 nt, Homo sapiens
aagcucugaagucaca

SEQ ID NO: 716844 - RNA, 23 nt, Homo sapiens
aagcucuguuccaugcaacugga

SEQ ID NO: 716845 - RNA, 18 nt, Homo sapiens
aagcugaagaccauggau

SEQ ID NO: 716846 - RNA, 15 nt, Homo sapiens
aagcugaauccagau

SEQ ID NO: 716847 - RNA, 19 nt, Homo sapiens
aagcugacuuggcacuuaa

SEQ ID NO: 716848 - RNA, 19 nt, Homo sapiens
aagcugauuacugucaaua

SEQ ID NO: 716849 - RNA, 14 nt, Homo sapiens
aagcugcauccaga

SEQ ID NO: 716850 - RNA, 12 nt, Homo sapiens
aagcugcuccuu

SEQ ID NO: 716851 - RNA, 12 nt, Homo sapiens
aagcuggaagaa

SEQ ID NO: 716852 - RNA, 14 nt, Homo sapiens
aagcuggugaaagc

SEQ ID NO: 716853 - RNA, 21 nt, Homo sapiens
aagcugucccucacuguugaa

SEQ ID NO: 716854 - RNA, 22 nt, Homo sapiens
aagcugugaaagaaccaaaaga

SEQ ID NO: 716855 - RNA, 22 nt, Homo sapiens
aagcugugacauauucugagga

SEQ ID NO: 716856 - RNA, 21 nt, Homo sapiens
aagcuguuauucuuguuauac

SEQ ID NO: 716857 - RNA, 12 nt, Homo sapiens
aagcuguugcua

SEQ ID NO: 716858 - RNA, 15 nt, Homo sapiens
aagcuguugcuauuu

SEQ ID NO: 716859 - RNA, 12 nt, Homo sapiens
aagcuuauguca

SEQ ID NO: 716860 - RNA, 18 nt, Homo sapiens
aagcuucccuccaucccc

SEQ ID NO: 716861 - RNA, 20 nt, Homo sapiens
aagcuugagucucaagggug

SEQ ID NO: 716862 - RNA, 15 nt, Homo sapiens
aagcuuuaaaugucu

SEQ ID NO: 716863 - RNA, 17 nt, Homo sapiens
aagcuuuacuacugugg

SEQ ID NO: 716864 - RNA, 14 nt, Homo sapiens
aaggaaaaauaaca

SEQ ID NO: 716865 - RNA, 18 nt, Homo sapiens
aaugugcaaagucaucaa

SEQ ID NO: 716866 - RNA, 15 nt, Homo sapiens
aaugugcaacauucu

SEQ ID NO: 716867 - RNA, 18 nt, Homo sapiens
aaugugcagaugcaauug

SEQ ID NO: 716868 - RNA, 23 nt, Homo sapiens
aauguggaagucaguacgaucaa

SEQ ID NO: 716869 - RNA, 20 nt, Homo sapiens
aauguggagcagcagccacu

SEQ ID NO: 716870 - RNA, 22 nt, Homo sapiens
aaugugguaguacccagggcca

SEQ ID NO: 716871 - RNA, 23 nt, Homo sapiens
aaugugguuacuuccuacuguag

SEQ ID NO: 716872 - RNA, 20 nt, Homo sapiens
aauguguauuuuucaaggca

SEQ ID NO: 716873 - RNA, 12 nt, Homo sapiens
aaugugucacua

SEQ ID NO: 716874 - RNA, 11 nt, Homo sapiens
aaugugucaua

SEQ ID NO: 716875 - RNA, 19 nt, Homo sapiens
aaugugugggguauagaaa

SEQ ID NO: 716876 - RNA, 21 nt, Homo sapiens
aauguuaacacucaugaagca

SEQ ID NO: 716877 - RNA, 13 nt, Homo sapiens
aauguuaagcaga

SEQ ID NO: 716878 - RNA, 18 nt, Homo sapiens
aauguuacauuauuauca

SEQ ID NO: 716879 - RNA, 19 nt, Homo sapiens
aauguuaccacuacuuuaa

SEQ ID NO: 716880 - RNA, 23 nt, Homo sapiens
aauguuacuaaauuuucuaauua

SEQ ID NO: 716881 - RNA, 18 nt, Homo sapiens
aauguuagucauuguuau

SEQ ID NO: 716882 - RNA, 13 nt, Homo sapiens
aauguuauaucau

SEQ ID NO: 716883 - RNA, 21 nt, Homo sapiens
aauguuauuuuuuaauuauua

SEQ ID NO: 716884 - RNA, 12 nt, Homo sapiens
aauguuccauuc

SEQ ID NO: 716885 - RNA, 21 nt, Homo sapiens
aauguuccugaaaauugcaau

SEQ ID NO: 716886 - RNA, 20 nt, Homo sapiens
aauguucuuugucucaaaau

SEQ ID NO: 716887 - RNA, 14 nt, Homo sapiens
aauguugcuuuaac

SEQ ID NO: 716888 - RNA, 15 nt, Homo sapiens
aauguuguccaggaa

SEQ ID NO: 716889 - RNA, 16 nt, Homo sapiens
aauguuguccaggaaa

SEQ ID NO: 716890 - RNA, 13 nt, Homo sapiens
aauguuuaaucuc

SEQ ID NO: 716891 - RNA, 14 nt, Homo sapiens
aauguuuacacucu

SEQ ID NO: 716892 - RNA, 14 nt, Homo sapiens
aauguuuaccauga

SEQ ID NO: 716893 - RNA, 18 nt, Homo sapiens
aauguuuauuguucaaua

SEQ ID NO: 716894 - RNA, 23 nt, Homo sapiens
accaaccuuccauucacaccagc

SEQ ID NO: 716895 - RNA, 18 nt, Homo sapiens
accaagaacauaagaauu

SEQ ID NO: 716896 - RNA, 14 nt, Homo sapiens
accaagaacugaag

SEQ ID NO: 716897 - RNA, 21 nt, Homo sapiens
accaagaauguuaugugcaag

SEQ ID NO: 716898 - RNA, 15 nt, Homo sapiens
accaagagcaaggaa

SEQ ID NO: 716899 - RNA, 20 nt, Homo sapiens
accaagauggguggcaccaa

SEQ ID NO: 716900 - RNA, 14 nt, Homo sapiens
accaagccugccau

SEQ ID NO: 716901 - RNA, 18 nt, Homo sapiens
accaagccugccaugggu

SEQ ID NO: 716902 - RNA, 23 nt, Homo sapiens
accaagcguuucccagucuuagc

SEQ ID NO: 716903 - RNA, 21 nt, Homo sapiens
accaaggacugagcacccucu

SEQ ID NO: 716904 - RNA, 17 nt, Homo sapiens
accaaggauauuuacag

SEQ ID NO: 716905 - RNA, 19 nt, Homo sapiens
accaagggaucugccauug

SEQ ID NO: 716906 - RNA, 16 nt, Homo sapiens
accaagguauacaucu

SEQ ID NO: 716907 - RNA, 19 nt, Homo sapiens
accaaguaaaacaaaacca

SEQ ID NO: 716908 - RNA, 17 nt, Homo sapiens
accaaguaccaguauaa

SEQ ID NO: 716909 - RNA, 13 nt, Homo sapiens
accaagugcaaua

SEQ ID NO: 716910 - RNA, 21 nt, Homo sapiens
accaauaauggggcagacaca

SEQ ID NO: 716911 - RNA, 13 nt, Homo sapiens
accaauaccuccu

SEQ ID NO: 716912 - RNA, 12 nt, Homo sapiens
accaaucucuaa

SEQ ID NO: 716913 - RNA, 16 nt, Homo sapiens
accaaugagccuuagu

SEQ ID NO: 716914 - RNA, 20 nt, Homo sapiens
accaaugugugaaguaugca

SEQ ID NO: 716915 - RNA, 21 nt, Homo sapiens
accaauguucuaaaguuuugc

SEQ ID NO: 716916 - RNA, 16 nt, Homo sapiens
accaauuacccauaaa

SEQ ID NO: 716917 - RNA, 17 nt, Homo sapiens
accaauugacucucaca

SEQ ID NO: 716918 - RNA, 20 nt, Homo sapiens
accaauugugcugccauuug

SEQ ID NO: 716919 - RNA, 23 nt, Homo sapiens
accaauuugguaaaaaugcugcu

SEQ ID NO: 716920 - RNA, 22 nt, Homo sapiens
accacaaagcacaguuugaaca

SEQ ID NO: 716921 - RNA, 15 nt, Homo sapiens
accacaacugacaca

SEQ ID NO: 716922 - RNA, 16 nt, Homo sapiens
accacaagccugagaa

SEQ ID NO: 716923 - RNA, 13 nt, Homo sapiens
accacacauauug

SEQ ID NO: 716924 - RNA, 21 nt, Homo sapiens
accacaccuggcccuugcaau

SEQ ID NO: 716925 - RNA, 14 nt, Homo sapiens
accacacugauccu

SEQ ID NO: 716926 - RNA, 16 nt, Homo sapiens
accacagacgggcaca

SEQ ID NO: 716927 - RNA, 17 nt, Homo sapiens
accacaggcuuguuacc

SEQ ID NO: 716928 - RNA, 17 nt, Homo sapiens
accacagguucaugcca

SEQ ID NO: 716929 - RNA, 13 nt, Homo sapiens
accacagucagug

SEQ ID NO: 716930 - RNA, 22 nt, Homo sapiens
accacagugaauccagaccaac

SEQ ID NO: 716931 - RNA, 19 nt, Homo sapiens
accacauguguuucugucu

SEQ ID NO: 716932 - RNA, 14 nt, Homo sapiens
accacccacuugau

SEQ ID NO: 716933 - RNA, 18 nt, Homo sapiens
accacccagaguggccca

SEQ ID NO: 716934 - RNA, 21 nt, Homo sapiens
accaccccaacaaaccaucca

SEQ ID NO: 716935 - RNA, 16 nt, Homo sapiens
accacccuagucccuu

SEQ ID NO: 716936 - RNA, 15 nt, Homo sapiens
accaccuaguucucc

SEQ ID NO: 716937 - RNA, 17 nt, Homo sapiens
accaccucguccucgug

SEQ ID NO: 716938 - RNA, 15 nt, Homo sapiens
accaccugcuucuga

SEQ ID NO: 716939 - RNA, 20 nt, Homo sapiens
accaccuucccagcucuccc

SEQ ID NO: 716940 - RNA, 18 nt, Homo sapiens
accaccuuuccagccaua

SEQ ID NO: 716941 - RNA, 18 nt, Homo sapiens
accacgacuggccagggc

SEQ ID NO: 716942 - RNA, 14 nt, Homo sapiens
accacgcccggcua

SEQ ID NO: 716943 - RNA, 20 nt, Homo sapiens
accacgggacaucacagggu

SEQ ID NO: 716944 - RNA, 21 nt, Homo sapiens
accacuaagaauucaaacugg

SEQ ID NO: 716945 - RNA, 21 nt, Homo sapiens
accacuacaugcagcccaugc

SEQ ID NO: 716946 - RNA, 17 nt, Homo sapiens
accacuagaacucucca

SEQ ID NO: 716947 - RNA, 16 nt, Homo sapiens
accacucccaccacag

SEQ ID NO: 716948 - RNA, 13 nt, Homo sapiens
accacucuuggcu

SEQ ID NO: 716949 - RNA, 11 nt, Homo sapiens
accacugcacu

SEQ ID NO: 716950 - RNA, 22 nt, Homo sapiens
accacugcccccugcugccaug

SEQ ID NO: 716951 - RNA, 20 nt, Homo sapiens
accacuguaccccagguucu

SEQ ID NO: 716952 - RNA, 15 nt, Homo sapiens
accacuguacuccag

SEQ ID NO: 716953 - RNA, 21 nt, Homo sapiens
accacuugaauuuauugauau

SEQ ID NO: 716954 - RNA, 14 nt, Homo sapiens
accacuuuuuguaa

SEQ ID NO: 716955 - RNA, 16 nt, Homo sapiens
accagaaaagcaauac

SEQ ID NO: 716956 - RNA, 17 nt, Homo sapiens
accagaaaagcaauacu

SEQ ID NO: 716957 - RNA, 15 nt, Homo sapiens
accagacucuugccu

SEQ ID NO: 716958 - RNA, 21 nt, Homo sapiens
accagacuugaauacaacauu

SEQ ID NO: 716959 - RNA, 20 nt, Homo sapiens
accagagaggcucugagaaa

SEQ ID NO: 716960 - RNA, 14 nt, Homo sapiens
accagagcagcuca

SEQ ID NO: 716961 - RNA, 15 nt, Homo sapiens
accagagcauuucca

SEQ ID NO: 716962 - RNA, 22 nt, Homo sapiens
accagagcuucucugggcugaa

SEQ ID NO: 716963 - RNA, 16 nt, Homo sapiens
accagaggucaggugu

SEQ ID NO: 716964 - RNA, 13 nt, Homo sapiens
accagauuugcua

SEQ ID NO: 716965 - RNA, 11 nt, Homo sapiens
accagcacauc

SEQ ID NO: 716966 - RNA, 23 nt, Homo sapiens
accagcacggcccugacugaauc

SEQ ID NO: 716967 - RNA, 17 nt, Homo sapiens
accagcacggugacucu

SEQ ID NO: 716968 - RNA, 18 nt, Homo sapiens
accagcagcccugucacg

SEQ ID NO: 716969 - RNA, 17 nt, Homo sapiens
accagcaucaccugccu

SEQ ID NO: 716970 - RNA, 18 nt, Homo sapiens
accagccacaguacauau

SEQ ID NO: 716971 - RNA, 17 nt, Homo sapiens
accagccccacugccag

SEQ ID NO: 716972 - RNA, 20 nt, Homo sapiens
accagcccugaccccagugu

SEQ ID NO: 716973 - RNA, 20 nt, Homo sapiens
accagccguauuuuacauga

SEQ ID NO: 716974 - RNA, 21 nt, Homo sapiens
accagccguauuuuacaugaa

SEQ ID NO: 716975 - RNA, 23 nt, Homo sapiens
accagccucccucccugugccag

SEQ ID NO: 716976 - RNA, 18 nt, Homo sapiens
accagccuccuguuugca

SEQ ID NO: 716977 - RNA, 15 nt, Homo sapiens
accagccugggcaac

SEQ ID NO: 716978 - RNA, 22 nt, Homo sapiens
accagccuggucaacaugguga

SEQ ID NO: 716979 - RNA, 14 nt, Homo sapiens
accagcugcucugc

SEQ ID NO: 716980 - RNA, 14 nt, Homo sapiens
accaggauggucuc

SEQ ID NO: 716981 - RNA, 16 nt, Homo sapiens
accaggccaccucccc

SEQ ID NO: 716982 - RNA, 21 nt, Homo sapiens
acccccaucucuacuaaaaau

SEQ ID NO: 716983 - RNA, 13 nt, Homo sapiens
acccccaucuuua

SEQ ID NO: 716984 - RNA, 16 nt, Homo sapiens
acccccaucuuuacaa

SEQ ID NO: 716985 - RNA, 18 nt, Homo sapiens
accccccagcacugagga

SEQ ID NO: 716986 - RNA, 15 nt, Homo sapiens
acccccgccaggcug

SEQ ID NO: 716987 - RNA, 13 nt, Homo sapiens
acccccugcccug

SEQ ID NO: 716988 - RNA, 21 nt, Homo sapiens
acccccugcuccaccagcagc

SEQ ID NO: 716989 - RNA, 19 nt, Homo sapiens
acccccugugagcagggau

SEQ ID NO: 716990 - RNA, 13 nt, Homo sapiens
acccccuucccug

SEQ ID NO: 716991 - RNA, 17 nt, Homo sapiens
accccgcggugcucugg

SEQ ID NO: 716992 - RNA, 14 nt, Homo sapiens
accccguagcucca

SEQ ID NO: 716993 - RNA, 12 nt, Homo sapiens
accccgugccac

SEQ ID NO: 716994 - RNA, 15 nt, Homo sapiens
accccuacacuguga

SEQ ID NO: 716995 - RNA, 22 nt, Homo sapiens
accccuagagacagugaugccu

SEQ ID NO: 716996 - RNA, 20 nt, Homo sapiens
accccucccacggugcccaa

SEQ ID NO: 716997 - RNA, 17 nt, Homo sapiens
accccucccuuucuccc

SEQ ID NO: 716998 - RNA, 16 nt, Homo sapiens
accccuccuuccuuga

SEQ ID NO: 716999 - RNA, 12 nt, Homo sapiens
accccucuggcc

SEQ ID NO: 717000 - RNA, 19 nt, Homo sapiens
accccucuuucgucuacug

SEQ ID NO: 717001 - RNA, 13 nt, Homo sapiens
accccugcucagu

SEQ ID NO: 717002 - RNA, 14 nt, Homo sapiens
accccugucccaac

SEQ ID NO: 717003 - RNA, 23 nt, Homo sapiens
accccugucccaaccccagugga

SEQ ID NO: 717004 - RNA, 18 nt, Homo sapiens
accccuuagccucccuga

SEQ ID NO: 717005 - RNA, 15 nt, Homo sapiens
acccgaggcugagaa

SEQ ID NO: 717006 - RNA, 23 nt, Homo sapiens
acccggcggcccugcugaagcug

SEQ ID NO: 717007 - RNA, 14 nt, Homo sapiens
acccgugugcacac

SEQ ID NO: 717008 - RNA, 16 nt, Homo sapiens
acccuaaacauccaua

SEQ ID NO: 717009 - RNA, 13 nt, Homo sapiens
acuaaaugaacua

SEQ ID NO: 717010 - RNA, 16 nt, Homo sapiens
acuaacaggccaaaga

SEQ ID NO: 717011 - RNA, 14 nt, Homo sapiens
acuaaccaaugccu

SEQ ID NO: 717012 - RNA, 18 nt, Homo sapiens
acuaaccauccccaacuc

SEQ ID NO: 717013 - RNA, 14 nt, Homo sapiens
acuaaccaucugaa

SEQ ID NO: 717014 - RNA, 22 nt, Homo sapiens
acuaaccaucugaagaaacuuc

SEQ ID NO: 717015 - RNA, 14 nt, Homo sapiens
acuaacccaaugcc

SEQ ID NO: 717016 - RNA, 15 nt, Homo sapiens
acuaacccaaugccu

SEQ ID NO: 717017 - RNA, 20 nt, Homo sapiens
acuaaccccaacgcacagga

SEQ ID NO: 717018 - RNA, 21 nt, Homo sapiens
acuaaccccaacgcacaggaa

SEQ ID NO: 717019 - RNA, 19 nt, Homo sapiens
acuaacuaugcauggugcc

SEQ ID NO: 717020 - RNA, 14 nt, Homo sapiens
acuaagcaauuucc

SEQ ID NO: 717021 - RNA, 13 nt, Homo sapiens
acuaagcacaaag

SEQ ID NO: 717022 - RNA, 12 nt, Homo sapiens
acuaagcucucu

SEQ ID NO: 717023 - RNA, 20 nt, Homo sapiens
acuaagggauggggcagucu

SEQ ID NO: 717024 - RNA, 19 nt, Homo sapiens
acuaauaaacuguguaguu

SEQ ID NO: 717025 - RNA, 23 nt, Homo sapiens
acuaauagaauaaaggcaguuuu

SEQ ID NO: 717026 - RNA, 22 nt, Homo sapiens
acuaaucugauguuaaccaaug

SEQ ID NO: 717027 - RNA, 18 nt, Homo sapiens
acuaaucuuaacccugug

SEQ ID NO: 717028 - RNA, 19 nt, Homo sapiens
acuaauuauacuacuuugu

SEQ ID NO: 717029 - RNA, 20 nt, Homo sapiens
acuaauuauacuacuuuguu

SEQ ID NO: 717030 - RNA, 21 nt, Homo sapiens
acuaauuugaauaaacucucc

SEQ ID NO: 717031 - RNA, 15 nt, Homo sapiens
acuacaaacuucaaa

SEQ ID NO: 717032 - RNA, 22 nt, Homo sapiens
acuacaaagauauuucagagag

SEQ ID NO: 717033 - RNA, 17 nt, Homo sapiens
accuuacauguguaaag

SEQ ID NO: 717034 - RNA, 17 nt, Homo sapiens
accuuauuuuuucccaa

SEQ ID NO: 717035 - RNA, 18 nt, Homo sapiens
accuucaaaauguucuau

SEQ ID NO: 717036 - RNA, 22 nt, Homo sapiens
accuucaaaggccaagagaauu

SEQ ID NO: 717037 - RNA, 15 nt, Homo sapiens
accuucaagaucuca

SEQ ID NO: 717038 - RNA, 13 nt, Homo sapiens
accuucaccuuug

SEQ ID NO: 717039 - RNA, 14 nt, Homo sapiens
accuucagagccag

SEQ ID NO: 717040 - RNA, 20 nt, Homo sapiens
accuucaugcccuucugauu

SEQ ID NO: 717041 - RNA, 23 nt, Homo sapiens
accuucaugugguucagugccuu

SEQ ID NO: 717042 - RNA, 19 nt, Homo sapiens
accuuccauucacaccagc

SEQ ID NO: 717043 - RNA, 20 nt, Homo sapiens
accuuccauucacaccagcu

SEQ ID NO: 717044 - RNA, 12 nt, Homo sapiens
accuuccucauc

SEQ ID NO: 717045 - RNA, 17 nt, Homo sapiens
accuucuaaaagccauu

SEQ ID NO: 717046 - RNA, 14 nt, Homo sapiens
accuucuaccucuu

SEQ ID NO: 717047 - RNA, 20 nt, Homo sapiens
accuucuguggcucacagaa

SEQ ID NO: 717048 - RNA, 21 nt, Homo sapiens
accuugacuugauuagugccu

SEQ ID NO: 717049 - RNA, 16 nt, Homo sapiens
accuugagcaaauuag

SEQ ID NO: 717050 - RNA, 16 nt, Homo sapiens
accuugcaguguagga

SEQ ID NO: 717051 - RNA, 19 nt, Homo sapiens
accuugcugggacuuggau

SEQ ID NO: 717052 - RNA, 16 nt, Homo sapiens
accuuggacauccucc

SEQ ID NO: 717053 - RNA, 22 nt, Homo sapiens
accuuggagaggagaguggcag

SEQ ID NO: 717054 - RNA, 16 nt, Homo sapiens
accuuggcaccagaca

SEQ ID NO: 717055 - RNA, 23 nt, Homo sapiens
accuuggcaccagacacccagga

SEQ ID NO: 717056 - RNA, 19 nt, Homo sapiens
accuugggcacaucugcug

SEQ ID NO: 717057 - RNA, 12 nt, Homo sapiens
accuugucucau

SEQ ID NO: 717058 - RNA, 16 nt, Homo sapiens
accuagaguuuuauca

SEQ ID NO: 717059 - RNA, 18 nt, Homo sapiens
accuagcagccucaaaac

SEQ ID NO: 717060 - RNA, 11 nt, Homo sapiens
accuagcuuua

SEQ ID NO: 717061 - RNA, 20 nt, Homo sapiens
accuagcuuuauucuucaga

SEQ ID NO: 717062 - RNA, 13 nt, Homo sapiens
accuaggauuuca

SEQ ID NO: 717063 - RNA, 13 nt, Homo sapiens
accuagggacaca

SEQ ID NO: 717064 - RNA, 14 nt, Homo sapiens
accuagggauguuc

SEQ ID NO: 717065 - RNA, 23 nt, Homo sapiens
accuaguacugccccccaugagg

SEQ ID NO: 717066 - RNA, 16 nt, Homo sapiens
accuaguagaguguaa

SEQ ID NO: 717067 - RNA, 18 nt, Homo sapiens
accuaguauaucagugac

SEQ ID NO: 717068 - RNA, 13 nt, Homo sapiens
accuauaaaucau

SEQ ID NO: 717069 - RNA, 13 nt, Homo sapiens
accuauacauuau

SEQ ID NO: 717070 - RNA, 14 nt, Homo sapiens
accuauacauuaua

SEQ ID NO: 717071 - RNA, 16 nt, Homo sapiens
accuaugcaaagauga

SEQ ID NO: 717072 - RNA, 18 nt, Homo sapiens
accuaugccagugcucaa

SEQ ID NO: 717073 - RNA, 18 nt, Homo sapiens
accucaaacuuccaguca

SEQ ID NO: 717074 - RNA, 19 nt, Homo sapiens
accucaaaggcucucacua

SEQ ID NO: 717075 - RNA, 22 nt, Homo sapiens
accucaacugccuacuccaaaa

SEQ ID NO: 717076 - RNA, 21 nt, Homo sapiens
accucaagcaaccaugaacuc

SEQ ID NO: 717077 - RNA, 18 nt, Homo sapiens
accucaaguguccugaaa

SEQ ID NO: 717078 - RNA, 12 nt, Homo sapiens
accucacagcua

SEQ ID NO: 717079 - RNA, 13 nt, Homo sapiens
accucacagugac

SEQ ID NO: 717080 - RNA, 14 nt, Homo sapiens
accucaccaaggac

SEQ ID NO: 717081 - RNA, 12 nt, Homo sapiens
accucaccugcu

SEQ ID NO: 717082 - RNA, 18 nt, Homo sapiens
accucaccugggcaggga

SEQ ID NO: 717083 - RNA, 17 nt, Homo sapiens
accucagccccacugac

SEQ ID NO: 717084 - RNA, 16 nt, Homo sapiens
accucagccuggccag

SEQ ID NO: 717085 - RNA, 18 nt, Homo sapiens
accaugcauggugcauca

SEQ ID NO: 717086 - RNA, 21 nt, Homo sapiens
accaugccagacccacugaaa

SEQ ID NO: 717087 - RNA, 23 nt, Homo sapiens
accaugcugcuggggaagacagu

SEQ ID NO: 717088 - RNA, 16 nt, Homo sapiens
accauggagaugaaau

SEQ ID NO: 717089 - RNA, 19 nt, Homo sapiens
accauggugagaaauugac

SEQ ID NO: 717090 - RNA, 15 nt, Homo sapiens
accauguacauagcu

SEQ ID NO: 717091 - RNA, 16 nt, Homo sapiens
accauguacauagcuu

SEQ ID NO: 717092 - RNA, 13 nt, Homo sapiens
accauguacauga

SEQ ID NO: 717093 - RNA, 18 nt, Homo sapiens
accauguaucacaccuaa

SEQ ID NO: 717094 - RNA, 13 nt, Homo sapiens
accaugugcaaua

SEQ ID NO: 717095 - RNA, 12 nt, Homo sapiens
accauguggcaa

SEQ ID NO: 717096 - RNA, 13 nt, Homo sapiens
accauuaccaaaa

SEQ ID NO: 717097 - RNA, 20 nt, Homo sapiens
accauuagauaaacacaggc

SEQ ID NO: 717098 - RNA, 22 nt, Homo sapiens
accauuccauuuccaagcacuu

SEQ ID NO: 717099 - RNA, 17 nt, Homo sapiens
accauucccugccuugc

SEQ ID NO: 717100 - RNA, 21 nt, Homo sapiens
accauucccugccuugcugac

SEQ ID NO: 717101 - RNA, 20 nt, Homo sapiens
accauugaaggaaagcuaua

SEQ ID NO: 717102 - RNA, 16 nt, Homo sapiens
accauugucagcucaa

SEQ ID NO: 717103 - RNA, 13 nt, Homo sapiens
accauuuaugugu

SEQ ID NO: 717104 - RNA, 14 nt, Homo sapiens
accauuucagagag

SEQ ID NO: 717105 - RNA, 16 nt, Homo sapiens
accauuucagccaaac

SEQ ID NO: 717106 - RNA, 15 nt, Homo sapiens
accauuugacuguuc

SEQ ID NO: 717107 - RNA, 18 nt, Homo sapiens
accauuugacuguucaau

SEQ ID NO: 717108 - RNA, 12 nt, Homo sapiens
accauuugcacu

SEQ ID NO: 717109 - RNA, 22 nt, Homo sapiens
acccaaaacacaggaagucagu

SEQ ID NO: 717110 - RNA, 16 nt, Homo sapiens
acccaacaggugcuga

SEQ ID NO: 717111 - RNA, 13 nt, Homo sapiens
acccaagccugau

SEQ ID NO: 717112 - RNA, 16 nt, Homo sapiens
acccaagggcaggggc

SEQ ID NO: 717113 - RNA, 19 nt, Homo sapiens
acccaagugccucaccucg

SEQ ID NO: 717114 - RNA, 20 nt, Homo sapiens
acccacaaauaaaugacaag

SEQ ID NO: 717115 - RNA, 13 nt, Homo sapiens
acccacacaagcg

SEQ ID NO: 717116 - RNA, 14 nt, Homo sapiens
acccacagccauag

SEQ ID NO: 717117 - RNA, 23 nt, Homo sapiens
acccacaugugacacauaugcac

SEQ ID NO: 717118 - RNA, 23 nt, Homo sapiens
acccaccugguacugacccagga

SEQ ID NO: 717119 - RNA, 21 nt, Homo sapiens
acccacgaggauggccuggaa

SEQ ID NO: 717120 - RNA, 14 nt, Homo sapiens
acccacgcauauac

SEQ ID NO: 717121 - RNA, 14 nt, Homo sapiens
acccacuaaugugu

SEQ ID NO: 717122 - RNA, 20 nt, Homo sapiens
acccacuggucugcuuaaag

SEQ ID NO: 717123 - RNA, 19 nt, Homo sapiens
acccagaaaucauuuuacc

SEQ ID NO: 717124 - RNA, 19 nt, Homo sapiens
acccagaaggcagagguug

SEQ ID NO: 717125 - RNA, 22 nt, Homo sapiens
acccagacacaucgcacugugg

SEQ ID NO: 717126 - RNA, 21 nt, Homo sapiens
acccagacuggaaugcaguga

SEQ ID NO: 717127 - RNA, 17 nt, Homo sapiens
acccagaguggcccaag

SEQ ID NO: 717128 - RNA, 20 nt, Homo sapiens
acccagaguggcccaagacu

SEQ ID NO: 717129 - RNA, 13 nt, Homo sapiens
acccagaucucau

SEQ ID NO: 717130 - RNA, 18 nt, Homo sapiens
acccagcagugucacucu

SEQ ID NO: 717131 - RNA, 21 nt, Homo sapiens
acccagcuacucuguccaggc

SEQ ID NO: 717132 - RNA, 18 nt, Homo sapiens
acccaggaccaagccaca

SEQ ID NO: 717133 - RNA, 19 nt, Homo sapiens
acccaggcuggagugcagu

SEQ ID NO: 717134 - RNA, 23 nt, Homo sapiens
acccagggugugaacauguucuc

SEQ ID NO: 717135 - RNA, 20 nt, Homo sapiens
acccagguuggagugcagug

SEQ ID NO: 717136 - RNA, 14 nt, Homo sapiens
acccaguauuccau

SEQ ID NO: 717137 - RNA, 18 nt, Homo sapiens
acccagucaccucugucu

SEQ ID NO: 717138 - RNA, 20 nt, Homo sapiens
acccagucuucuacacagau

SEQ ID NO: 717139 - RNA, 17 nt, Homo sapiens
acccagugacugacauu

SEQ ID NO: 717140 - RNA, 9 nt, Homo sapiens
acccagugc

SEQ ID NO: 717141 - RNA, 19 nt, Homo sapiens
acccaguggacucuuccac

SEQ ID NO: 717142 - RNA, 19 nt, Homo sapiens
acccauauuucauccagga

SEQ ID NO: 717143 - RNA, 14 nt, Homo sapiens
acccaucacuuugg

SEQ ID NO: 717144 - RNA, 17 nt, Homo sapiens
acccaucacuuuggaca

SEQ ID NO: 717145 - RNA, 14 nt, Homo sapiens
acccaucaggacca

SEQ ID NO: 717146 - RNA, 19 nt, Homo sapiens
acccaucuaguacuugaaa

SEQ ID NO: 717147 - RNA, 12 nt, Homo sapiens
acccaugacaau

SEQ ID NO: 717148 - RNA, 15 nt, Homo sapiens
acccaugcagcugcu

SEQ ID NO: 717149 - RNA, 16 nt, Homo sapiens
acccauucacuacagg

SEQ ID NO: 717150 - RNA, 18 nt, Homo sapiens
acccauucacuacaggug

SEQ ID NO: 717151 - RNA, 17 nt, Homo sapiens
acccauucagagacugu

SEQ ID NO: 717152 - RNA, 21 nt, Homo sapiens
acccauuucuacuuuuugcac

SEQ ID NO: 717153 - RNA, 20 nt, Homo sapiens
acccauuugucucuacuuuu

SEQ ID NO: 717154 - RNA, 15 nt, Homo sapiens
accccaaaccuggca

SEQ ID NO: 717155 - RNA, 14 nt, Homo sapiens
accccacagaguug

SEQ ID NO: 717156 - RNA, 13 nt, Homo sapiens
accccaccuugcc

SEQ ID NO: 717157 - RNA, 20 nt, Homo sapiens
accccacgugcgacagagag

SEQ ID NO: 717158 - RNA, 12 nt, Homo sapiens
accccacugcaa

SEQ ID NO: 717159 - RNA, 17 nt, Homo sapiens
accccagcucccuagga

SEQ ID NO: 717160 - RNA, 21 nt, Homo sapiens
accccaggcaaggaugucuga

SEQ ID NO: 717161 - RNA, 19 nt, Homo sapiens
accccagggccagcuuuuc

SEQ ID NO: 717162 - RNA, 17 nt, Homo sapiens
accccagguucucaccu

SEQ ID NO: 717163 - RNA, 16 nt, Homo sapiens
accccaucucuacuga

SEQ ID NO: 717164 - RNA, 16 nt, Homo sapiens
accccaucuuccagcc

SEQ ID NO: 717165 - RNA, 19 nt, Homo sapiens
accccaucuuuacuaaaaa

SEQ ID NO: 717166 - RNA, 14 nt, Homo sapiens
accccauuccugau

SEQ ID NO: 717167 - RNA, 13 nt, Homo sapiens
acccccagcacuu

SEQ ID NO: 717168 - RNA, 14 nt, Homo sapiens
acccccagcacuug

SEQ ID NO: 717169 - RNA, 13 nt, Homo sapiens
acccccagcucaa

SEQ ID NO: 717170 - RNA, 14 nt, Homo sapiens
acccccagcucaau

SEQ ID NO: 717171 - RNA, 15 nt, Homo sapiens
acccccagcucaaug

SEQ ID NO: 717172 - RNA, 14 nt, Homo sapiens
acccccaucccucg

SEQ ID NO: 717173 - RNA, 15 nt, Homo sapiens
agagaggcugccuca

SEQ ID NO: 717174 - RNA, 12 nt, Homo sapiens
agagagggacuc

SEQ ID NO: 717175 - RNA, 16 nt, Homo sapiens
agagagguuuuucuga

SEQ ID NO: 717176 - RNA, 22 nt, Homo sapiens
agagaguauuuuuauacaaacc

SEQ ID NO: 717177 - RNA, 17 nt, Homo sapiens
agagauaagucuuucau

SEQ ID NO: 717178 - RNA, 19 nt, Homo sapiens
agagaucagcgacccugag

SEQ ID NO: 717179 - RNA, 21 nt, Homo sapiens
agagaucaugaauuauauaau

SEQ ID NO: 717180 - RNA, 14 nt, Homo sapiens
agagaucuacacau

SEQ ID NO: 717181 - RNA, 19 nt, Homo sapiens
agagaucuuucuuuccaaa

SEQ ID NO: 717182 - RNA, 21 nt, Homo sapiens
agagaugcauuuggaacagug

SEQ ID NO: 717183 - RNA, 19 nt, Homo sapiens
agagauuacuuugcugccu

SEQ ID NO: 717184 - RNA, 12 nt, Homo sapiens
agagauuucaag

SEQ ID NO: 717185 - RNA, 19 nt, Homo sapiens
agagcaaaacuccgucuca

SEQ ID NO: 717186 - RNA, 20 nt, Homo sapiens
agagcaaaacuccgucucaa

SEQ ID NO: 717187 - RNA, 20 nt, Homo sapiens
agagcaaaacucugucucaa

SEQ ID NO: 717188 - RNA, 21 nt, Homo sapiens
agagcaacaauccaucucuca

SEQ ID NO: 717189 - RNA, 20 nt, Homo sapiens
agagcaagacuccaucucaa

SEQ ID NO: 717190 - RNA, 16 nt, Homo sapiens
agagcaauuccaggcu

SEQ ID NO: 717191 - RNA, 13 nt, Homo sapiens
agagcacacugua

SEQ ID NO: 717192 - RNA, 16 nt, Homo sapiens
agagcacucauuccuu

SEQ ID NO: 717193 - RNA, 16 nt, Homo sapiens
agagcagcuucaguga

SEQ ID NO: 717194 - RNA, 13 nt, Homo sapiens
agagccagcagca

SEQ ID NO: 717195 - RNA, 17 nt, Homo sapiens
agagccagcagcaaaaa

SEQ ID NO: 717196 - RNA, 13 nt, Homo sapiens
agagcccagcucc

SEQ ID NO: 717197 - RNA, 18 nt, Homo sapiens
agagccccacuugacacu

SEQ ID NO: 717198 - RNA, 14 nt, Homo sapiens
agagcccuugccuc

SEQ ID NO: 717199 - RNA, 17 nt, Homo sapiens
agagccgggaaggggaa

SEQ ID NO: 717200 - RNA, 21 nt, Homo sapiens
agagccucggcccuagcauug

SEQ ID NO: 717201 - RNA, 20 nt, Homo sapiens
agagccuucagaaugcuccu

SEQ ID NO: 717202 - RNA, 24 nt, Homo sapiens
agagccuugucuucuuagcuguca

SEQ ID NO: 717203 - RNA, 13 nt, Homo sapiens
agagccuuuccaa

SEQ ID NO: 717204 - RNA, 20 nt, Homo sapiens
agagcgagacuccgucucaa

SEQ ID NO: 717205 - RNA, 15 nt, Homo sapiens
agagcgagaguccau

SEQ ID NO: 717206 - RNA, 15 nt, Homo sapiens
agagcgucauguccu

SEQ ID NO: 717207 - RNA, 14 nt, Homo sapiens
agagcuacauggug

SEQ ID NO: 717208 - RNA, 22 nt, Homo sapiens
agagcucuuuaccaaggaugaa

SEQ ID NO: 717209 - RNA, 21 nt, Homo sapiens
agagcugagggcccuguggag

SEQ ID NO: 717210 - RNA, 18 nt, Homo sapiens
agagcugccaucgcugug

SEQ ID NO: 717211 - RNA, 20 nt, Homo sapiens
agagcuuaggauucuaaucu

SEQ ID NO: 717212 - RNA, 16 nt, Homo sapiens
agagcuucucccaaac

SEQ ID NO: 717213 - RNA, 20 nt, Homo sapiens
agagcuuggacuacacaaua

SEQ ID NO: 717214 - RNA, 21 nt, Homo sapiens
agagcuuuccuacuugcacuc

SEQ ID NO: 717215 - RNA, 17 nt, Homo sapiens
agagcuuugugcuuguc

SEQ ID NO: 717216 - RNA, 20 nt, Homo sapiens
agagcuuuuuaauagcacua

SEQ ID NO: 717217 - RNA, 15 nt, Homo sapiens
agaggaaaaggcugg

SEQ ID NO: 717218 - RNA, 19 nt, Homo sapiens
agaggaaaaguaaccauca

SEQ ID NO: 717219 - RNA, 13 nt, Homo sapiens
agaggaaagggau

SEQ ID NO: 717220 - RNA, 13 nt, Homo sapiens
agaggacuguguu

SEQ ID NO: 717221 - RNA, 13 nt, Homo sapiens
agaggagaaaaag

SEQ ID NO: 717222 - RNA, 12 nt, Homo sapiens
agaggagcauga

SEQ ID NO: 717223 - RNA, 17 nt, Homo sapiens
agaggagccaccaguuc

SEQ ID NO: 717224 - RNA, 19 nt, Homo sapiens
agaggaggggacccaugua

SEQ ID NO: 717225 - RNA, 15 nt, Homo sapiens
agaggauacauuuaa

SEQ ID NO: 717226 - RNA, 22 nt, Homo sapiens
agaggcaaugauuguuaauuua

SEQ ID NO: 717227 - RNA, 19 nt, Homo sapiens
agaggcagggaagcucuac

SEQ ID NO: 717228 - RNA, 20 nt, Homo sapiens
agaggccaccuaugccagug

SEQ ID NO: 717229 - RNA, 22 nt, Homo sapiens
agaggccagcacauuaucuuca

SEQ ID NO: 717230 - RNA, 14 nt, Homo sapiens
agaggccauggcag

SEQ ID NO: 717231 - RNA, 22 nt, Homo sapiens
agaggcuauuauuuucacugua

SEQ ID NO: 717232 - RNA, 13 nt, Homo sapiens
agaggcucugaga

SEQ ID NO: 717233 - RNA, 18 nt, Homo sapiens
agaggcugacuuuuccaa

SEQ ID NO: 717234 - RNA, 17 nt, Homo sapiens
agaggcugccccucuca

SEQ ID NO: 717235 - RNA, 18 nt, Homo sapiens
agagggaaggucucagga

SEQ ID NO: 717236 - RNA, 22 nt, Homo sapiens
agagggacagaugaaugccgug

SEQ ID NO: 717237 - RNA, 15 nt, Homo sapiens
agagggaggucacug

SEQ ID NO: 717238 - RNA, 16 nt, Homo sapiens
agagggaggucacugg

SEQ ID NO: 717239 - RNA, 14 nt, Homo sapiens
agagggcugcauuc

SEQ ID NO: 717240 - RNA, 13 nt, Homo sapiens
agagggcuuccuc

SEQ ID NO: 717241 - RNA, 17 nt, Homo sapiens
agagggcuuucucagga

SEQ ID NO: 717242 - RNA, 13 nt, Homo sapiens
agaggggaaaaug

SEQ ID NO: 717243 - RNA, 18 nt, Homo sapiens
agaggggauucacaaggu

SEQ ID NO: 717244 - RNA, 13 nt, Homo sapiens
agaggguacuuua

SEQ ID NO: 717245 - RNA, 13 nt, Homo sapiens
agagguacuguaa

SEQ ID NO: 717246 - RNA, 21 nt, Homo sapiens
agagguagucucacugcuuga

SEQ ID NO: 717247 - RNA, 17 nt, Homo sapiens
agaggucaccagcugcu

SEQ ID NO: 717248 - RNA, 19 nt, Homo sapiens
agaggucugauuggcugcu

SEQ ID NO: 717249 - RNA, 16 nt, Homo sapiens
agagguggaguucuua

SEQ ID NO: 717250 - RNA, 23 nt, Homo sapiens
agaggugucacccaaaccggcag

SEQ ID NO: 717251 - RNA, 17 nt, Homo sapiens
agaggugugggugucug

SEQ ID NO: 717252 - RNA, 22 nt, Homo sapiens
agagguugcagugagcugagau

SEQ ID NO: 717253 - RNA, 14 nt, Homo sapiens
agagguuucuugaa

SEQ ID NO: 717254 - RNA, 21 nt, Homo sapiens
agagguuugguuuccuguguc

SEQ ID NO: 717255 - RNA, 16 nt, Homo sapiens
agaguaacacauaaca

SEQ ID NO: 717256 - RNA, 17 nt, Homo sapiens
agaguagcaacaaaagg

SEQ ID NO: 717257 - RNA, 19 nt, Homo sapiens
agaguaucagaucuaucuu

SEQ ID NO: 717258 - RNA, 12 nt, Homo sapiens
agagucaucuga

SEQ ID NO: 717259 - RNA, 16 nt, Homo sapiens
agagugaaugccauuu

SEQ ID NO: 717260 - RNA, 15 nt, Homo sapiens
agagugaauuugacc

SEQ ID NO: 717261 - RNA, 14 nt, Homo sapiens
agagugacagucau

SEQ ID NO: 717262 - RNA, 15 nt, Homo sapiens
agagugacagucaua

SEQ ID NO: 717263 - RNA, 20 nt, Homo sapiens
agagugagaccccaucucua

SEQ ID NO: 717264 - RNA, 19 nt, Homo sapiens
agagugagacuccaccuca

SEQ ID NO: 717265 - RNA, 16 nt, Homo sapiens
agagugagagggcaug

SEQ ID NO: 717266 - RNA, 22 nt, Homo sapiens
agagugagcaagggggcccaaa

SEQ ID NO: 717267 - RNA, 15 nt, Homo sapiens
agaguggcuuggccu

SEQ ID NO: 717268 - RNA, 21 nt, Homo sapiens
agagugggguagguugggaga

SEQ ID NO: 717269 - RNA, 14 nt, Homo sapiens
agaguggugcugcu

SEQ ID NO: 717270 - RNA, 15 nt, Homo sapiens
agaguggugcugcuu

SEQ ID NO: 717271 - RNA, 12 nt, Homo sapiens
agaguggugggg

SEQ ID NO: 717272 - RNA, 15 nt, Homo sapiens
agaguguaaugggga

SEQ ID NO: 717273 - RNA, 15 nt, Homo sapiens
agaguguagcuguaa

SEQ ID NO: 717274 - RNA, 18 nt, Homo sapiens
agaguguggguccuucaa

SEQ ID NO: 717275 - RNA, 22 nt, Homo sapiens
agaguguuuggggguuccguga

SEQ ID NO: 717276 - RNA, 14 nt, Homo sapiens
agaguucagacuca

SEQ ID NO: 717277 - RNA, 16 nt, Homo sapiens
agaguucuauccccaa

SEQ ID NO: 717278 - RNA, 12 nt, Homo sapiens
agaguugacaug

SEQ ID NO: 717279 - RNA, 19 nt, Homo sapiens
agaguuggacuucuagacu

SEQ ID NO: 717280 - RNA, 13 nt, Homo sapiens
agaguuguucucu

SEQ ID NO: 717281 - RNA, 15 nt, Homo sapiens
agaguuuacagacaa

SEQ ID NO: 717282 - RNA, 21 nt, Homo sapiens
agaguuuaguccuuacugucu

SEQ ID NO: 717283 - RNA, 13 nt, Homo sapiens
agaguuuccugaa

SEQ ID NO: 717284 - RNA, 14 nt, Homo sapiens
agaguuucuccuuu

SEQ ID NO: 717285 - RNA, 20 nt, Homo sapiens
agaguuucuccuuuugacca

SEQ ID NO: 717286 - RNA, 22 nt, Homo sapiens
agaguuucuccuuuugaccaaa

SEQ ID NO: 717287 - RNA, 16 nt, Homo sapiens
agaguuuugucauuca

SEQ ID NO: 717288 - RNA, 23 nt, Homo sapiens
agaccaguccuguuugcagggaa

SEQ ID NO: 717289 - RNA, 18 nt, Homo sapiens
agaccaguugggagcacu

SEQ ID NO: 717290 - RNA, 16 nt, Homo sapiens
agaccauaauguuaca

SEQ ID NO: 717291 - RNA, 13 nt, Homo sapiens
agaccaucuuugc

SEQ ID NO: 717292 - RNA, 15 nt, Homo sapiens
agaccauuaucagug

SEQ ID NO: 717293 - RNA, 22 nt, Homo sapiens
agacccacgugcuaggggauga

SEQ ID NO: 717294 - RNA, 15 nt, Homo sapiens
agacccagaucucau

SEQ ID NO: 717295 - RNA, 11 nt, Homo sapiens
agacccagugg

SEQ ID NO: 717296 - RNA, 14 nt, Homo sapiens
agacccaguggacu

SEQ ID NO: 717297 - RNA, 14 nt, Homo sapiens
agaccccaugccug

SEQ ID NO: 717298 - RNA, 15 nt, Homo sapiens
agaccccaugccugu

SEQ ID NO: 717299 - RNA, 17 nt, Homo sapiens
agacccccacaccucag

SEQ ID NO: 717300 - RNA, 13 nt, Homo sapiens
agaccccuuggcc

SEQ ID NO: 717301 - RNA, 14 nt, Homo sapiens
agacccgcccuccc

SEQ ID NO: 717302 - RNA, 12 nt, Homo sapiens
agacccgugacc

SEQ ID NO: 717303 - RNA, 14 nt, Homo sapiens
agacccgugaccug

SEQ ID NO: 717304 - RNA, 20 nt, Homo sapiens
agacccgugaccugagaugu

SEQ ID NO: 717305 - RNA, 16 nt, Homo sapiens
agacccugaagauuuc

SEQ ID NO: 717306 - RNA, 21 nt, Homo sapiens
agacccugagaaggacccugg

SEQ ID NO: 717307 - RNA, 17 nt, Homo sapiens
agacccuguguccucca

SEQ ID NO: 717308 - RNA, 22 nt, Homo sapiens
agacccuuauugcuguccugga

SEQ ID NO: 717309 - RNA, 21 nt, Homo sapiens
agacccuuuuaucugcuguug

SEQ ID NO: 717310 - RNA, 12 nt, Homo sapiens
acucauccugau

SEQ ID NO: 717311 - RNA, 15 nt, Homo sapiens
acucaucuguuaucc

SEQ ID NO: 717312 - RNA, 20 nt, Homo sapiens
acucaucuuagugccugaga

SEQ ID NO: 717313 - RNA, 21 nt, Homo sapiens
acucaugcugguggcauuguu

SEQ ID NO: 717314 - RNA, 13 nt, Homo sapiens
acucauucagucc

SEQ ID NO: 717315 - RNA, 22 nt, Homo sapiens
acucauuucauuccuaacacag

SEQ ID NO: 717316 - RNA, 17 nt, Homo sapiens
acucauuuuuguuuuca

SEQ ID NO: 717317 - RNA, 16 nt, Homo sapiens
acuccaaaauguuggu

SEQ ID NO: 717318 - RNA, 22 nt, Homo sapiens
acuccaaagaaauguaagggaa

SEQ ID NO: 717319 - RNA, 23 nt, Homo sapiens
acuccaccgaccaacugcccuaa

SEQ ID NO: 717320 - RNA, 15 nt, Homo sapiens
acuccacucccagca

SEQ ID NO: 717321 - RNA, 20 nt, Homo sapiens
acuccacuggccuccuggca

SEQ ID NO: 717322 - RNA, 12 nt, Homo sapiens
acuccagaagau

SEQ ID NO: 717323 - RNA, 15 nt, Homo sapiens
acuccagaagaugag

SEQ ID NO: 717324 - RNA, 17 nt, Homo sapiens
acuccagagacagggaa

SEQ ID NO: 717325 - RNA, 13 nt, Homo sapiens
acuccagccugag

SEQ ID NO: 717326 - RNA, 20 nt, Homo sapiens
acuccagccugagugacaga

SEQ ID NO: 717327 - RNA, 21 nt, Homo sapiens
acuccagcuugggcaacagag

SEQ ID NO: 717328 - RNA, 19 nt, Homo sapiens
acuccaugcuuagucacug

SEQ ID NO: 717329 - RNA, 22 nt, Homo sapiens
acuccauggcuaagaccacaga

SEQ ID NO: 717330 - RNA, 13 nt, Homo sapiens
acuccauuacugu

SEQ ID NO: 717331 - RNA, 12 nt, Homo sapiens
acuccauucaaa

SEQ ID NO: 717332 - RNA, 18 nt, Homo sapiens
acucccaucugauuuacu

SEQ ID NO: 717333 - RNA, 15 nt, Homo sapiens
acucccauuccugaa

SEQ ID NO: 717334 - RNA, 17 nt, Homo sapiens
acuccccagagcugugc

SEQ ID NO: 717335 - RNA, 15 nt, Homo sapiens
uucaagaaagcuuca

SEQ ID NO: 717336 - RNA, 15 nt, Homo sapiens
uucaagaacauucua

SEQ ID NO: 717337 - RNA, 20 nt, Homo sapiens
uucaagaccagccugaccaa

SEQ ID NO: 717338 - RNA, 20 nt, Homo sapiens
uucaagcaaaaugcuuacag

SEQ ID NO: 717339 - RNA, 23 nt, Homo sapiens
uucaagcaaaaugcuuacagggc

SEQ ID NO: 717340 - RNA, 23 nt, Homo sapiens
uucaagcagucgugccugugucc

SEQ ID NO: 717341 - RNA, 15 nt, Homo sapiens
uucaagccugugcaa

SEQ ID NO: 717342 - RNA, 17 nt, Homo sapiens
uucaaggcccucagcau

SEQ ID NO: 717343 - RNA, 19 nt, Homo sapiens
uucaaggccuucaguuuau

SEQ ID NO: 717344 - RNA, 22 nt, Homo sapiens
uucaagucagugaggaguaaaa

SEQ ID NO: 717345 - RNA, 22 nt, Homo sapiens
uucaagugauucuccugccuca

SEQ ID NO: 717346 - RNA, 22 nt, Homo sapiens
uucaaguuaaagugaauaacca

SEQ ID NO: 717347 - RNA, 20 nt, Homo sapiens
uucaauauuuuuguauauac

SEQ ID NO: 717348 - RNA, 14 nt, Homo sapiens
uucaaucuguaaac

SEQ ID NO: 717349 - RNA, 17 nt, Homo sapiens
uucaaugaauuauauuc

SEQ ID NO: 717350 - RNA, 16 nt, Homo sapiens
uucaauuuauuacuga

SEQ ID NO: 717351 - RNA, 16 nt, Homo sapiens
uucacaaauccuucaa

SEQ ID NO: 717352 - RNA, 20 nt, Homo sapiens
uucacaacuuugacguaauu

SEQ ID NO: 717353 - RNA, 20 nt, Homo sapiens
uucacaaguuacaguucguc

SEQ ID NO: 717354 - RNA, 16 nt, Homo sapiens
uucacaccccauucuc

SEQ ID NO: 717355 - RNA, 17 nt, Homo sapiens
uucacacuuccaccagc

SEQ ID NO: 717356 - RNA, 19 nt, Homo sapiens
uucacagaauagcacaaac

SEQ ID NO: 717357 - RNA, 22 nt, Homo sapiens
uucacagcacaguacacacaaa

SEQ ID NO: 717358 - RNA, 19 nt, Homo sapiens
uucacagccagacuggcac

SEQ ID NO: 717359 - RNA, 16 nt, Homo sapiens
uucacaggcacuccug

SEQ ID NO: 717360 - RNA, 21 nt, Homo sapiens
uucacaggcagugcaugugaa

SEQ ID NO: 717361 - RNA, 16 nt, Homo sapiens
uucacagucucuggaa

SEQ ID NO: 717362 - RNA, 12 nt, Homo sapiens
uucacagugugu

SEQ ID NO: 717363 - RNA, 21 nt, Homo sapiens
uucacaguucuuugggccaga

SEQ ID NO: 717364 - RNA, 18 nt, Homo sapiens
uucacaugccuugcaaug

SEQ ID NO: 717365 - RNA, 21 nt, Homo sapiens
uucaccaaaauagucuucuca

SEQ ID NO: 717366 - RNA, 17 nt, Homo sapiens
uucaccaaaugaugcca

SEQ ID NO: 717367 - RNA, 18 nt, Homo sapiens
uucaccagagcauuucca

SEQ ID NO: 717368 - RNA, 18 nt, Homo sapiens
uucaccaucaauccugau

SEQ ID NO: 717369 - RNA, 17 nt, Homo sapiens
uucaccccugcacuuca

SEQ ID NO: 717370 - RNA, 15 nt, Homo sapiens
uucacccuguccaaa

SEQ ID NO: 717371 - RNA, 23 nt, Homo sapiens
uucaccguggcuaccauugucac

SEQ ID NO: 717372 - RNA, 20 nt, Homo sapiens
uucacgccuguaaucccagc

SEQ ID NO: 717373 - RNA, 19 nt, Homo sapiens
uucacgcuuuuguuuucau

SEQ ID NO: 717374 - RNA, 18 nt, Homo sapiens
uucacuauaaaugguguu

SEQ ID NO: 717375 - RNA, 16 nt, Homo sapiens
uucacucccaaccuga

SEQ ID NO: 717376 - RNA, 16 nt, Homo sapiens
uucacucuccauuaga

SEQ ID NO: 717377 - RNA, 13 nt, Homo sapiens
uucacucugucau

SEQ ID NO: 717378 - RNA, 15 nt, Homo sapiens
uucacugaaggugau

SEQ ID NO: 717379 - RNA, 13 nt, Homo sapiens
uucacugccuucc

SEQ ID NO: 717380 - RNA, 15 nt, Homo sapiens
uucacugucaccacc

SEQ ID NO: 717381 - RNA, 14 nt, Homo sapiens
uucacuguuucacu

SEQ ID NO: 717382 - RNA, 16 nt, Homo sapiens
uucacuuguauugacu

SEQ ID NO: 717383 - RNA, 13 nt, Homo sapiens
uucacuuuacaaa

SEQ ID NO: 717384 - RNA, 16 nt, Homo sapiens
uucacuuugugauuau

SEQ ID NO: 717385 - RNA, 16 nt, Homo sapiens
uucagaagugagcuuu

SEQ ID NO: 717386 - RNA, 15 nt, Homo sapiens
uucagacaacauuau

SEQ ID NO: 717387 - RNA, 20 nt, Homo sapiens
uucagacuuuaaaauucuaa

SEQ ID NO: 717388 - RNA, 15 nt, Homo sapiens
uucagagaacccacu

SEQ ID NO: 717389 - RNA, 13 nt, Homo sapiens
uucagagcacuca

SEQ ID NO: 717390 - RNA, 15 nt, Homo sapiens
uucagagccagugaa

SEQ ID NO: 717391 - RNA, 12 nt, Homo sapiens
uucagaguauau

SEQ ID NO: 717392 - RNA, 22 nt, Homo sapiens
uucagagucagccaggaccaua

SEQ ID NO: 717393 - RNA, 13 nt, Homo sapiens
uucagaguccuca

SEQ ID NO: 717394 - RNA, 17 nt, Homo sapiens
uucagagugacuacaca

SEQ ID NO: 717395 - RNA, 19 nt, Homo sapiens
uucagaguuguacacugug

SEQ ID NO: 717396 - RNA, 16 nt, Homo sapiens
uucagauacaaacugc

SEQ ID NO: 717397 - RNA, 17 nt, Homo sapiens
uucagauacaaacugca

SEQ ID NO: 717398 - RNA, 19 nt, Homo sapiens
uucagauauauuuuucaca

SEQ ID NO: 717399 - RNA, 12 nt, Homo sapiens
uucagauauuau

SEQ ID NO: 717400 - RNA, 19 nt, Homo sapiens
uucagauauuauugcuuua

SEQ ID NO: 717401 - RNA, 13 nt, Homo sapiens
uucagccaaguga

SEQ ID NO: 717402 - RNA, 13 nt, Homo sapiens
uucagccaccagc

SEQ ID NO: 717403 - RNA, 19 nt, Homo sapiens
uucagccccuagugcuauu

SEQ ID NO: 717404 - RNA, 16 nt, Homo sapiens
uucagcccuaacauag

SEQ ID NO: 717405 - RNA, 19 nt, Homo sapiens
uucaggaaaauguauugau

SEQ ID NO: 717406 - RNA, 19 nt, Homo sapiens
uucaggaaacaagcuuuau

SEQ ID NO: 717407 - RNA, 16 nt, Homo sapiens
uucaggacucuaccuc

SEQ ID NO: 717408 - RNA, 18 nt, Homo sapiens
uucaggagcgcaagauag

SEQ ID NO: 717409 - RNA, 14 nt, Homo sapiens
uucaggaggcugga

SEQ ID NO: 717410 - RNA, 19 nt, Homo sapiens
uucaggagggaaccagcuu

SEQ ID NO: 717411 - RNA, 18 nt, Homo sapiens
uucaggcagccaguguga

SEQ ID NO: 717412 - RNA, 21 nt, Homo sapiens
uucaggccgcaagcagcugcc

SEQ ID NO: 717413 - RNA, 17 nt, Homo sapiens
uucaggcuacucauuca

SEQ ID NO: 717414 - RNA, 16 nt, Homo sapiens
uucagggaccguccag

SEQ ID NO: 717415 - RNA, 21 nt, Homo sapiens
uucaguagugcuggccaggga

SEQ ID NO: 717416 - RNA, 21 nt, Homo sapiens
uucagucucuauaccaauaaa

SEQ ID NO: 717417 - RNA, 13 nt, Homo sapiens
uucagucuugccu

SEQ ID NO: 717418 - RNA, 13 nt, Homo sapiens
uucagugcaguga

SEQ ID NO: 717419 - RNA, 16 nt, Homo sapiens
uucaguguacauggaa

SEQ ID NO: 717420 - RNA, 18 nt, Homo sapiens
uucagugucaacuauuca

SEQ ID NO: 717421 - RNA, 21 nt, Homo sapiens
uucaguucagauaauuggcaa

SEQ ID NO: 717422 - RNA, 16 nt, Homo sapiens
uucaguucuacgugaa

SEQ ID NO: 717423 - RNA, 19 nt, Homo sapiens
uucaguugaucacuggcaa

SEQ ID NO: 717424 - RNA, 17 nt, Homo sapiens
uucaguuuauuuccacu

SEQ ID NO: 717425 - RNA, 14 nt, Homo sapiens
uucaguuucacaga

SEQ ID NO: 717426 - RNA, 14 nt, Homo sapiens
uucauaaccaaaga

SEQ ID NO: 717427 - RNA, 13 nt, Homo sapiens
uucauacaacaga

SEQ ID NO: 717428 - RNA, 18 nt, Homo sapiens
uucauaggucuccaagac

SEQ ID NO: 717429 - RNA, 21 nt, Homo sapiens
uucauaguuucaaaucuguaa

SEQ ID NO: 717430 - RNA, 15 nt, Homo sapiens
uucauauauacaggc

SEQ ID NO: 717431 - RNA, 13 nt, Homo sapiens
uucauaucuauaa

SEQ ID NO: 717432 - RNA, 18 nt, Homo sapiens
uucauaugcuguauaucc

SEQ ID NO: 717433 - RNA, 19 nt, Homo sapiens
uucauauuuauugauuaaa

SEQ ID NO: 717434 - RNA, 22 nt, Homo sapiens
uucaucaauaucccucuuguaa

SEQ ID NO: 717435 - RNA, 14 nt, Homo sapiens
uucauccaaugcag

SEQ ID NO: 717436 - RNA, 23 nt, Homo sapiens
uucauccauauuguugaauguuu

SEQ ID NO: 717437 - RNA, 15 nt, Homo sapiens
uucauccguguaacc

SEQ ID NO: 717438 - RNA, 14 nt, Homo sapiens
uucaucuaauguga

SEQ ID NO: 717439 - RNA, 16 nt, Homo sapiens
uucaucucucuaccuc

SEQ ID NO: 717440 - RNA, 13 nt, Homo sapiens
uucaucuucaaaa

SEQ ID NO: 717441 - RNA, 14 nt, Homo sapiens
uucaugcuugacau

SEQ ID NO: 717442 - RNA, 15 nt, Homo sapiens
uucauggacacuuug

SEQ ID NO: 717443 - RNA, 19 nt, Homo sapiens
uucaugggacuaaaugaac

SEQ ID NO: 717444 - RNA, 16 nt, Homo sapiens
uucauggucugcugag

SEQ ID NO: 717445 - RNA, 11 nt, Homo sapiens
uucauggugau

SEQ ID NO: 717446 - RNA, 18 nt, Homo sapiens
uucauggugcacugagcu

SEQ ID NO: 717447 - RNA, 21 nt, Homo sapiens
uucaugucgaggcuagaggca

SEQ ID NO: 717448 - RNA, 20 nt, Homo sapiens
uucauguggcucagugccuu

SEQ ID NO: 717449 - RNA, 14 nt, Homo sapiens
uucauguuacucau

SEQ ID NO: 717450 - RNA, 20 nt, Homo sapiens
ugugcauuucaccugugaca

SEQ ID NO: 717451 - RNA, 14 nt, Homo sapiens
ugugccacacagug

SEQ ID NO: 717452 - RNA, 13 nt, Homo sapiens
ugugccaccaagc

SEQ ID NO: 717453 - RNA, 23 nt, Homo sapiens
ugugccaccaagcauuccugcuc

SEQ ID NO: 717454 - RNA, 14 nt, Homo sapiens
ugugccagcaccuu

SEQ ID NO: 717455 - RNA, 17 nt, Homo sapiens
ugugcccaggguuuugc

SEQ ID NO: 717456 - RNA, 16 nt, Homo sapiens
ugugccccaugccugu

SEQ ID NO: 717457 - RNA, 20 nt, Homo sapiens
ugugccucccuccccagugc

SEQ ID NO: 717458 - RNA, 18 nt, Homo sapiens
ugugccugcucagcagcc

SEQ ID NO: 717459 - RNA, 17 nt, Homo sapiens
ugugccuuggucucucc

SEQ ID NO: 717460 - RNA, 15 nt, Homo sapiens
ugugcggagucauuu

SEQ ID NO: 717461 - RNA, 16 nt, Homo sapiens
ugugcggaucucugga

SEQ ID NO: 717462 - RNA, 13 nt, Homo sapiens
ugugcuacagaug

SEQ ID NO: 717463 - RNA, 17 nt, Homo sapiens
ugugcuagucacuggca

SEQ ID NO: 717464 - RNA, 16 nt, Homo sapiens
ugugcuccgugccucc

SEQ ID NO: 717465 - RNA, 20 nt, Homo sapiens
uggauuucauuaucauauga

SEQ ID NO: 717466 - RNA, 15 nt, Homo sapiens
uggauuucauuugua

SEQ ID NO: 717467 - RNA, 23 nt, Homo sapiens
uggauuugaucacuacaaguauu

SEQ ID NO: 717468 - RNA, 14 nt, Homo sapiens
uggauuugauucau

SEQ ID NO: 717469 - RNA, 24 nt, Homo sapiens
uggauuugcaggugaacagccucc

SEQ ID NO: 717470 - RNA, 17 nt, Homo sapiens
uggauuugccugugcca

SEQ ID NO: 717471 - RNA, 22 nt, Homo sapiens
uggauuuuacauguggcccaac

SEQ ID NO: 717472 - RNA, 22 nt, Homo sapiens
uggauuuugggagugacucaag

SEQ ID NO: 717473 - RNA, 15 nt, Homo sapiens
uggauuuuuccuuaa

SEQ ID NO: 717474 - RNA, 15 nt, Homo sapiens
uggcaaagugcugua

SEQ ID NO: 717475 - RNA, 17 nt, Homo sapiens
uggcaaauggaggcuuu

SEQ ID NO: 717476 - RNA, 18 nt, Homo sapiens
uggcaacaacaaagccaa

SEQ ID NO: 717477 - RNA, 17 nt, Homo sapiens
uggcaacagagcaagac

SEQ ID NO: 717478 - RNA, 21 nt, Homo sapiens
uggcaacagagcgagauucca

SEQ ID NO: 717479 - RNA, 15 nt, Homo sapiens
uggcaagcagggaaa

SEQ ID NO: 717480 - RNA, 23 nt, Homo sapiens
uggcaaguugcaucagaaagcuu

SEQ ID NO: 717481 - RNA, 21 nt, Homo sapiens
uggcaauuuccuggcccucca

SEQ ID NO: 717482 - RNA, 23 nt, Homo sapiens
uggcacacaccguggccuaccug

SEQ ID NO: 717483 - RNA, 13 nt, Homo sapiens
uggcacaggagac

SEQ ID NO: 717484 - RNA, 16 nt, Homo sapiens
uggcacaggagacucc

SEQ ID NO: 717485 - RNA, 14 nt, Homo sapiens
uggcaccgagacca

SEQ ID NO: 717486 - RNA, 18 nt, Homo sapiens
uggcacuguuagugacag

SEQ ID NO: 717487 - RNA, 12 nt, Homo sapiens
uggcacuugccu

SEQ ID NO: 717488 - RNA, 14 nt, Homo sapiens
uggcagaaagcaaa

SEQ ID NO: 717489 - RNA, 15 nt, Homo sapiens
uggcagaaccaaagc

SEQ ID NO: 717490 - RNA, 18 nt, Homo sapiens
uggcagaagcauugccug

SEQ ID NO: 717491 - RNA, 20 nt, Homo sapiens
uggcagaagggaauugcuca

SEQ ID NO: 717492 - RNA, 20 nt, Homo sapiens
uggcagagucagcugcugac

SEQ ID NO: 717493 - RNA, 15 nt, Homo sapiens
uggcagauuuuacaa

SEQ ID NO: 717494 - RNA, 21 nt, Homo sapiens
uggcagcccuauuucaguuua

SEQ ID NO: 717495 - RNA, 16 nt, Homo sapiens
uggcagccgugccuuc

SEQ ID NO: 717496 - RNA, 17 nt, Homo sapiens
uggcagccgugccuuca

SEQ ID NO: 717497 - RNA, 20 nt, Homo sapiens
uggcagcgccucaucuucaa

SEQ ID NO: 717498 - RNA, 17 nt, Homo sapiens
uggcagcuagugccuuu

SEQ ID NO: 717499 - RNA, 22 nt, Homo sapiens
uggcagguccucuguugcaaac

SEQ ID NO: 717500 - RNA, 17 nt, Homo sapiens
uggcagucugcccugca

SEQ ID NO: 717501 - RNA, 18 nt, Homo sapiens
uggcaguggaacaugcaa

SEQ ID NO: 717502 - RNA, 17 nt, Homo sapiens
uggcaguggccaggcag

SEQ ID NO: 717503 - RNA, 19 nt, Homo sapiens
uggcaguguggcagugacc

SEQ ID NO: 717504 - RNA, 17 nt, Homo sapiens
uggcauauauguucaaa

SEQ ID NO: 717505 - RNA, 15 nt, Homo sapiens
uggcaucaucucagc

SEQ ID NO: 717506 - RNA, 16 nt, Homo sapiens
uggcaucucacuuuau

SEQ ID NO: 717507 - RNA, 17 nt, Homo sapiens
uggcaucugcucuagau

SEQ ID NO: 717508 - RNA, 18 nt, Homo sapiens
uggcauguugauuucuau

SEQ ID NO: 717509 - RNA, 20 nt, Homo sapiens
uggcauugucuguaaugaca

SEQ ID NO: 717510 - RNA, 11 nt, Homo sapiens
uggcauuucaa

SEQ ID NO: 717511 - RNA, 14 nt, Homo sapiens
uggccaacugcaaa

SEQ ID NO: 717512 - RNA, 22 nt, Homo sapiens
uggccaacugcaaaaaaagccu

SEQ ID NO: 717513 - RNA, 15 nt, Homo sapiens
uggccacaauaccca

SEQ ID NO: 717514 - RNA, 21 nt, Homo sapiens
uggccaccaguaugacaguau

SEQ ID NO: 717515 - RNA, 21 nt, Homo sapiens
uggccacccgcccacagccag

SEQ ID NO: 717516 - RNA, 17 nt, Homo sapiens
uggccagaccacagcag

SEQ ID NO: 717517 - RNA, 17 nt, Homo sapiens
uggccagaggugucacc

SEQ ID NO: 717518 - RNA, 16 nt, Homo sapiens
uggccaggauggucuc

SEQ ID NO: 717519 - RNA, 17 nt, Homo sapiens
uggccaggugguugucu

SEQ ID NO: 717520 - RNA, 20 nt, Homo sapiens
uggccagucuuccucuuagc

SEQ ID NO: 717521 - RNA, 13 nt, Homo sapiens
uggccaucauuuc

SEQ ID NO: 717522 - RNA, 19 nt, Homo sapiens
uggcccaacacaauucuuc

SEQ ID NO: 717523 - RNA, 14 nt, Homo sapiens
uggcccaacacugu

SEQ ID NO: 717524 - RNA, 13 nt, Homo sapiens
uggcccacacuga

SEQ ID NO: 717525 - RNA, 19 nt, Homo sapiens
uggcccacugcuggcugca

SEQ ID NO: 717526 - RNA, 16 nt, Homo sapiens
uggcccagccaaucua

SEQ ID NO: 717527 - RNA, 23 nt, Homo sapiens
uggcccagcuuuuagaaaaugca

SEQ ID NO: 717528 - RNA, 19 nt, Homo sapiens
uggcccagggaagccaaaa

SEQ ID NO: 717529 - RNA, 15 nt, Homo sapiens
uggcccauaauguga

SEQ ID NO: 717530 - RNA, 19 nt, Homo sapiens
uggcccauagaaacaugac

SEQ ID NO: 717531 - RNA, 14 nt, Homo sapiens
uggcccaucugugc

SEQ ID NO: 717532 - RNA, 17 nt, Homo sapiens
uggccccaguccaugcu

SEQ ID NO: 717533 - RNA, 18 nt, Homo sapiens
uggccccgggcucuggcc

SEQ ID NO: 717534 - RNA, 17 nt, Homo sapiens
uggcccgcaauacugua

SEQ ID NO: 717535 - RNA, 23 nt, Homo sapiens
uggcccucacugcagggcacugu

SEQ ID NO: 717536 - RNA, 22 nt, Homo sapiens
uggccgcuccucccucagaaaa

SEQ ID NO: 717537 - RNA, 18 nt, Homo sapiens
uggccgggcccugcugag

SEQ ID NO: 717538 - RNA, 20 nt, Homo sapiens
uggccgggucccugagcucc

SEQ ID NO: 717539 - RNA, 13 nt, Homo sapiens
uggccggugcugg

SEQ ID NO: 717540 - RNA, 14 nt, Homo sapiens
uggccgugaggaca

SEQ ID NO: 717541 - RNA, 17 nt, Homo sapiens
uggccguguucaaagag

SEQ ID NO: 717542 - RNA, 21 nt, Homo sapiens
uggccuacagucaucugccac

SEQ ID NO: 717543 - RNA, 21 nt, Homo sapiens
uggccuagcaggcacaggaca

SEQ ID NO: 717544 - RNA, 22 nt, Homo sapiens
uggccuauccgcugccagccuu

SEQ ID NO: 717545 - RNA, 14 nt, Homo sapiens
uggccuccaaacac

SEQ ID NO: 717546 - RNA, 21 nt, Homo sapiens
uggccuccgcagugucuccac

SEQ ID NO: 717547 - RNA, 16 nt, Homo sapiens
uggccucugcaacugc

SEQ ID NO: 717548 - RNA, 22 nt, Homo sapiens
uggccucugggcaguguggccu

SEQ ID NO: 717549 - RNA, 21 nt, Homo sapiens
uggccucugugccuucuuuug

SEQ ID NO: 717550 - RNA, 14 nt, Homo sapiens
uggccugcacuggu

SEQ ID NO: 717551 - RNA, 15 nt, Homo sapiens
uggccugcugggaac

SEQ ID NO: 717552 - RNA, 22 nt, Homo sapiens
uggccuggauucacgcccucuu

SEQ ID NO: 717553 - RNA, 13 nt, Homo sapiens
uggccuggcacac

SEQ ID NO: 717554 - RNA, 18 nt, Homo sapiens
uggccuggcacacaucag

SEQ ID NO: 717555 - RNA, 13 nt, Homo sapiens
uggccuggcacau

SEQ ID NO: 717556 - RNA, 22 nt, Homo sapiens
uggccugggaucuggcacacuc

SEQ ID NO: 717557 - RNA, 21 nt, Homo sapiens
uggccuggggaagcugugaaa

SEQ ID NO: 717558 - RNA, 22 nt, Homo sapiens
uggccuguucuucuauggguug

SEQ ID NO: 717559 - RNA, 19 nt, Homo sapiens
uggccuuaagaacuguguc

SEQ ID NO: 717560 - RNA, 14 nt, Homo sapiens
uggccuucugggaa

SEQ ID NO: 717561 - RNA, 15 nt, Homo sapiens
uguacucaaguacca

SEQ ID NO: 717562 - RNA, 23 nt, Homo sapiens
uguacucacauauaacaugcaaa

SEQ ID NO: 717563 - RNA, 17 nt, Homo sapiens
uguacugcacaaggaca

SEQ ID NO: 717564 - RNA, 19 nt, Homo sapiens
uguacugguaauuguacaa

SEQ ID NO: 717565 - RNA, 15 nt, Homo sapiens
uguacuuccugugua

SEQ ID NO: 717566 - RNA, 16 nt, Homo sapiens
uguacuugucaacccc

SEQ ID NO: 717567 - RNA, 23 nt, Homo sapiens
uguagaaaaugaggaaaugccac

SEQ ID NO: 717568 - RNA, 13 nt, Homo sapiens
uguagaaaucuca

SEQ ID NO: 717569 - RNA, 20 nt, Homo sapiens
uguagaagaaagagcaacaa

SEQ ID NO: 717570 - RNA, 20 nt, Homo sapiens
uguagaaugauuucaugcua

SEQ ID NO: 717571 - RNA, 19 nt, Homo sapiens
uguagaccaccuaauauca

SEQ ID NO: 717572 - RNA, 22 nt, Homo sapiens
uguagacuguggcuagugacaa

SEQ ID NO: 717573 - RNA, 15 nt, Homo sapiens
uguagcaucuaauga

SEQ ID NO: 717574 - RNA, 19 nt, Homo sapiens
uguagcaucuaaugaaugu

SEQ ID NO: 717575 - RNA, 13 nt, Homo sapiens
ugucgucuuuaug

SEQ ID NO: 717576 - RNA, 17 nt, Homo sapiens
ugucuaaacaaugcuga

SEQ ID NO: 717577 - RNA, 16 nt, Homo sapiens
ugucuacugcuuggau

SEQ ID NO: 717578 - RNA, 23 nt, Homo sapiens
ugucuagaauguggauuugauuc

SEQ ID NO: 717579 - RNA, 18 nt, Homo sapiens
ugucuaggacugcagugu

SEQ ID NO: 717580 - RNA, 20 nt, Homo sapiens
ugucuaggauuuuggauguu

SEQ ID NO: 717581 - RNA, 21 nt, Homo sapiens
ugucuaggcuggaagagccaa

SEQ ID NO: 717582 - RNA, 15 nt, Homo sapiens
ugucuauaauggaaa

SEQ ID NO: 717583 - RNA, 16 nt, Homo sapiens
ugucuauaauggaaac

SEQ ID NO: 717584 - RNA, 19 nt, Homo sapiens
ugucuauuaaaauucugau

SEQ ID NO: 717585 - RNA, 21 nt, Homo sapiens
ugucucaaaggagcuuucuca

SEQ ID NO: 717586 - RNA, 18 nt, Homo sapiens
ugucucagacugcaugua

SEQ ID NO: 717587 - RNA, 14 nt, Homo sapiens
ugucucccaaaaau

SEQ ID NO: 717588 - RNA, 14 nt, Homo sapiens
ugucuccuacugag

SEQ ID NO: 717589 - RNA, 20 nt, Homo sapiens
ugucucuaaaggaagaaaua

SEQ ID NO: 717590 - RNA, 19 nt, Homo sapiens
ugucucugccauguggcag

SEQ ID NO: 717591 - RNA, 21 nt, Homo sapiens
ugucucuuagaaauacuugug

SEQ ID NO: 717592 - RNA, 16 nt, Homo sapiens
ugucucuucugagcua

SEQ ID NO: 717593 - RNA, 16 nt, Homo sapiens
ugucugaaacagagaa

SEQ ID NO: 717594 - RNA, 19 nt, Homo sapiens
ugucugaacggcugaauau

SEQ ID NO: 717595 - RNA, 16 nt, Homo sapiens
ugucugacaaccucuu

SEQ ID NO: 717596 - RNA, 17 nt, Homo sapiens
ugucugcucaguaauuu

SEQ ID NO: 717597 - RNA, 22 nt, Homo sapiens
ugucuggcccgcaauacuguag

SEQ ID NO: 717598 - RNA, 17 nt, Homo sapiens
ugucugguucacaguuu

SEQ ID NO: 717599 - RNA, 19 nt, Homo sapiens
ugucuguaaugacaaauaa

SEQ ID NO: 717600 - RNA, 21 nt, Homo sapiens
ugucuguaaugacaaauaagu

SEQ ID NO: 717601 - RNA, 22 nt, Homo sapiens
ugucuguaucggagacagugau

SEQ ID NO: 717602 - RNA, 20 nt, Homo sapiens
ugucuguccugauuucuaca

SEQ ID NO: 717603 - RNA, 21 nt, Homo sapiens
ugucugucuacauuucugcag

SEQ ID NO: 717604 - RNA, 15 nt, Homo sapiens
ugucuguugcuugua

SEQ ID NO: 717605 - RNA, 20 nt, Homo sapiens
ugucuucagcacccucauaa

SEQ ID NO: 717606 - RNA, 20 nt, Homo sapiens
ugucuucuggacuuggucuu

SEQ ID NO: 717607 - RNA, 21 nt, Homo sapiens
ugucuugaaaguggcaccaga

SEQ ID NO: 717608 - RNA, 19 nt, Homo sapiens
ugucuugaugugucaucua

SEQ ID NO: 717609 - RNA, 15 nt, Homo sapiens
ugucuugccagccag

SEQ ID NO: 717610 - RNA, 17 nt, Homo sapiens
ugucuugccagccagaa

SEQ ID NO: 717611 - RNA, 22 nt, Homo sapiens
ugucuugguguucaugaucucc

SEQ ID NO: 717612 - RNA, 18 nt, Homo sapiens
ugucuuuguuguagugaa

SEQ ID NO: 717613 - RNA, 21 nt, Homo sapiens
ugugaaaauuacaguccaaaa

SEQ ID NO: 717614 - RNA, 20 nt, Homo sapiens
ugugaaacauuuuuucuucu

SEQ ID NO: 717615 - RNA, 16 nt, Homo sapiens
ugugaaagaaccaaaa

SEQ ID NO: 717616 - RNA, 23 nt, Homo sapiens
ugugaaagaaccaaaagagauca

SEQ ID NO: 717617 - RNA, 14 nt, Homo sapiens
ugugaaauuuacau

SEQ ID NO: 717618 - RNA, 16 nt, Homo sapiens
ugugaaauuuacauca

SEQ ID NO: 717619 - RNA, 21 nt, Homo sapiens
ugugaaccaacccccaucucc

SEQ ID NO: 717620 - RNA, 12 nt, Homo sapiens
ugugaacccugg

SEQ ID NO: 717621 - RNA, 16 nt, Homo sapiens
ugugaacugucuuggc

SEQ ID NO: 717622 - RNA, 23 nt, Homo sapiens
ugugaagaacuauuuuauucuaa

SEQ ID NO: 717623 - RNA, 16 nt, Homo sapiens
ugugaagcaaacucua

SEQ ID NO: 717624 - RNA, 20 nt, Homo sapiens
ugugaagccugcagagugca

SEQ ID NO: 717625 - RNA, 14 nt, Homo sapiens
ugugaaguacauau

SEQ ID NO: 717626 - RNA, 15 nt, Homo sapiens
ugugaaguaugcacu

SEQ ID NO: 717627 - RNA, 22 nt, Homo sapiens
ugugaauaaaaacccuguaugg

SEQ ID NO: 717628 - RNA, 15 nt, Homo sapiens
ugugaaucaauccug

SEQ ID NO: 717629 - RNA, 17 nt, Homo sapiens
ugugaauuaggcuguaa

SEQ ID NO: 717630 - RNA, 19 nt, Homo sapiens
ugugaauuaggcuguaacu

SEQ ID NO: 717631 - RNA, 20 nt, Homo sapiens
ugugaauuauucugauucuu

SEQ ID NO: 717632 - RNA, 20 nt, Homo sapiens
ugugaauuauugacacugaa

SEQ ID NO: 717633 - RNA, 19 nt, Homo sapiens
ugugacaacacucaucaca

SEQ ID NO: 717634 - RNA, 15 nt, Homo sapiens
ugugacacauaugca

SEQ ID NO: 717635 - RNA, 22 nt, Homo sapiens
ugugacauacauauuaucucau

SEQ ID NO: 717636 - RNA, 23 nt, Homo sapiens
ugugaccacugaagcaccacagg

SEQ ID NO: 717637 - RNA, 18 nt, Homo sapiens
ugugaccccaccuugacg

SEQ ID NO: 717638 - RNA, 18 nt, Homo sapiens
ugugaccccuuucacuua

SEQ ID NO: 717639 - RNA, 19 nt, Homo sapiens
ugugaccccuuucacuuac

SEQ ID NO: 717640 - RNA, 12 nt, Homo sapiens
ugugacuacuga

SEQ ID NO: 717641 - RNA, 21 nt, Homo sapiens
ugugacuauaaagcuguuauu

SEQ ID NO: 717642 - RNA, 15 nt, Homo sapiens
ugugacuguguuugc

SEQ ID NO: 717643 - RNA, 17 nt, Homo sapiens
ugugacuuuuauaugcu

SEQ ID NO: 717644 - RNA, 22 nt, Homo sapiens
ugugacuuuuuagccagugacu

SEQ ID NO: 717645 - RNA, 19 nt, Homo sapiens
ugugacuuuuucagaguug

SEQ ID NO: 717646 - RNA, 20 nt, Homo sapiens
ugugagaauugugcuuucac

SEQ ID NO: 717647 - RNA, 15 nt, Homo sapiens
ugugagagaaagugu

SEQ ID NO: 717648 - RNA, 19 nt, Homo sapiens
ugugagaggcgugauaucu

SEQ ID NO: 717649 - RNA, 15 nt, Homo sapiens
ugugagauccuucac

SEQ ID NO: 717650 - RNA, 16 nt, Homo sapiens
ugugagauccuucaca

SEQ ID NO: 717651 - RNA, 16 nt, Homo sapiens
ugugagcaacugcgac

SEQ ID NO: 717652 - RNA, 19 nt, Homo sapiens
ugugaguaagagcuggugu

SEQ ID NO: 717653 - RNA, 14 nt, Homo sapiens
ugugaguccaaaga

SEQ ID NO: 717654 - RNA, 18 nt, Homo sapiens
ugugaucggccuggggaa

SEQ ID NO: 717655 - RNA, 15 nt, Homo sapiens
ugugaugcaugagcu

SEQ ID NO: 717656 - RNA, 14 nt, Homo sapiens
ugugauguguccug

SEQ ID NO: 717657 - RNA, 13 nt, Homo sapiens
ugugauguucuaa

SEQ ID NO: 717658 - RNA, 19 nt, Homo sapiens
ugugauucaaucuguaaac

SEQ ID NO: 717659 - RNA, 21 nt, Homo sapiens
ugugauuccauggauugauuc

SEQ ID NO: 717660 - RNA, 23 nt, Homo sapiens
ugugauuggcugguuaaugggaa

SEQ ID NO: 717661 - RNA, 17 nt, Homo sapiens
ugugauugucuuugaau

SEQ ID NO: 717662 - RNA, 17 nt, Homo sapiens
ugugauuuccuaaacau

SEQ ID NO: 717663 - RNA, 19 nt, Homo sapiens
ugugauuuggaccauggca

SEQ ID NO: 717664 - RNA, 13 nt, Homo sapiens
ugugcaacggcca

SEQ ID NO: 717665 - RNA, 16 nt, Homo sapiens
ugugcaauauucuuaa

SEQ ID NO: 717666 - RNA, 21 nt, Homo sapiens
ugugcaauauucuuaaauacu

SEQ ID NO: 717667 - RNA, 16 nt, Homo sapiens
ugugcaccaauuauca

SEQ ID NO: 717668 - RNA, 21 nt, Homo sapiens
ugugcaccaauuaucaucuuu

SEQ ID NO: 717669 - RNA, 23 nt, Homo sapiens
ugugcacuuucuucucuuuccca

SEQ ID NO: 717670 - RNA, 22 nt, Homo sapiens
ugugcaggguguguacugcaca

SEQ ID NO: 717671 - RNA, 21 nt, Homo sapiens
ugugcaguggcccccacagaa

SEQ ID NO: 717672 - RNA, 15 nt, Homo sapiens
ugugcaucuggugua

SEQ ID NO: 717673 - RNA, 13 nt, Homo sapiens
ugugcaugugcug

SEQ ID NO: 717674 - RNA, 20 nt, Homo sapiens
cuuaaagcauuugcaacagc

SEQ ID NO: 717675 - RNA, 16 nt, Homo sapiens
cuuaaaggcuguggua

SEQ ID NO: 717676 - RNA, 13 nt, Homo sapiens
cuuaaagucagaa

SEQ ID NO: 717677 - RNA, 17 nt, Homo sapiens
cuuaaauccaguuuuca

SEQ ID NO: 717678 - RNA, 15 nt, Homo sapiens
cuuaaaucuuuucaa

SEQ ID NO: 717679 - RNA, 21 nt, Homo sapiens
cuuaaaugcucauuuucuggu

SEQ ID NO: 717680 - RNA, 21 nt, Homo sapiens
cuuaaauuaagauuaugugag

SEQ ID NO: 717681 - RNA, 15 nt, Homo sapiens
cuuaacaaagccuuu

SEQ ID NO: 717682 - RNA, 21 nt, Homo sapiens
cuuaacaaagccuuugcuuug

SEQ ID NO: 717683 - RNA, 14 nt, Homo sapiens
cuuaacaguuguau

SEQ ID NO: 717684 - RNA, 22 nt, Homo sapiens
cuuaacccccuagaaagacaga

SEQ ID NO: 717685 - RNA, 14 nt, Homo sapiens
cuuaaccuuuccag

SEQ ID NO: 717686 - RNA, 17 nt, Homo sapiens
cuuaacggcuccaggau

SEQ ID NO: 717687 - RNA, 15 nt, Homo sapiens
cuuaacuauuucaca

SEQ ID NO: 717688 - RNA, 22 nt, Homo sapiens
cuuaacuccuuuuccacuuuaa

SEQ ID NO: 717689 - RNA, 15 nt, Homo sapiens
cuuaagagugcugug

SEQ ID NO: 717690 - RNA, 22 nt, Homo sapiens
cuuaagcagcaacagccuacaa

SEQ ID NO: 717691 - RNA, 13 nt, Homo sapiens
cuuaagccaaacu

SEQ ID NO: 717692 - RNA, 19 nt, Homo sapiens
cuuaagccaaacucaggcc

SEQ ID NO: 717693 - RNA, 16 nt, Homo sapiens
cuuaagccauaaaaua

SEQ ID NO: 717694 - RNA, 21 nt, Homo sapiens
cuuaagcccagugcacugaaa

SEQ ID NO: 717695 - RNA, 13 nt, Homo sapiens
cuuaagcugggau

SEQ ID NO: 717696 - RNA, 19 nt, Homo sapiens
cuuaagggaaaaguucucc

SEQ ID NO: 717697 - RNA, 21 nt, Homo sapiens
cuuaaguuuuagaaaugagaa

SEQ ID NO: 717698 - RNA, 16 nt, Homo sapiens
cuuaauaaauauuaca

SEQ ID NO: 717699 - RNA, 21 nt, Homo sapiens
cuuaauaaauauuacagugaa

SEQ ID NO: 717700 - RNA, 17 nt, Homo sapiens
cuuaauaacaacagauc

SEQ ID NO: 717701 - RNA, 19 nt, Homo sapiens
cuuaauaacuguguacugu

SEQ ID NO: 717702 - RNA, 13 nt, Homo sapiens
cuuaauacugucc

SEQ ID NO: 717703 - RNA, 14 nt, Homo sapiens
cuuaauaguauuuu

SEQ ID NO: 717704 - RNA, 19 nt, Homo sapiens
cuuaauccaauauuuugcc

SEQ ID NO: 717705 - RNA, 12 nt, Homo sapiens
cuuaaugcacag

SEQ ID NO: 717706 - RNA, 16 nt, Homo sapiens
cuuaaugguagcaacu

SEQ ID NO: 717707 - RNA, 15 nt, Homo sapiens
cuuaaugugcagcaa

SEQ ID NO: 717708 - RNA, 22 nt, Homo sapiens
cuuaauguucugaauaauuucu

SEQ ID NO: 717709 - RNA, 16 nt, Homo sapiens
cuuaauucacucccac

SEQ ID NO: 717710 - RNA, 14 nt, Homo sapiens
cuuaauuuacuuua

SEQ ID NO: 717711 - RNA, 21 nt, Homo sapiens
cuuacaacgccgagugcacug

SEQ ID NO: 717712 - RNA, 20 nt, Homo sapiens
cuuacacuuuaugcacaaaa

SEQ ID NO: 717713 - RNA, 17 nt, Homo sapiens
cuuacagaacuacuucu

SEQ ID NO: 717714 - RNA, 12 nt, Homo sapiens
cuuacagaauua

SEQ ID NO: 717715 - RNA, 14 nt, Homo sapiens
cuuacagucccaga

SEQ ID NO: 717716 - RNA, 23 nt, Homo sapiens
cuuacauguuuguuucuguagaa

SEQ ID NO: 717717 - RNA, 17 nt, Homo sapiens
cuuacccucccaccacu

SEQ ID NO: 717718 - RNA, 18 nt, Homo sapiens
cuuacccucccaccacuc

SEQ ID NO: 717719 - RNA, 14 nt, Homo sapiens
cuuaccgcucuguu

SEQ ID NO: 717720 - RNA, 14 nt, Homo sapiens
cuuaccugacacaa

SEQ ID NO: 717721 - RNA, 20 nt, Homo sapiens
cuuacucuaagaucuuagau

SEQ ID NO: 717722 - RNA, 14 nt, Homo sapiens
cuuacugcaggcaa

SEQ ID NO: 717723 - RNA, 15 nt, Homo sapiens
cuuagaaauacuugu

SEQ ID NO: 717724 - RNA, 15 nt, Homo sapiens
cuuagagaggacaau

SEQ ID NO: 717725 - RNA, 22 nt, Homo sapiens
cuuagagaggacaauacugggg

SEQ ID NO: 717726 - RNA, 14 nt, Homo sapiens
cuuagagauugcau

SEQ ID NO: 717727 - RNA, 18 nt, Homo sapiens
cuuagaguguagcuguaa

SEQ ID NO: 717728 - RNA, 17 nt, Homo sapiens
cuuagcagcuuccagau

SEQ ID NO: 717729 - RNA, 14 nt, Homo sapiens
cuuagccagaguua

SEQ ID NO: 717730 - RNA, 15 nt, Homo sapiens
cuuagcgucaagaca

SEQ ID NO: 717731 - RNA, 16 nt, Homo sapiens
cuuaggaaccuaccag

SEQ ID NO: 717732 - RNA, 20 nt, Homo sapiens
cuuaggacuuuccacuccug

SEQ ID NO: 717733 - RNA, 15 nt, Homo sapiens
cuuaggcaugcacag

SEQ ID NO: 717734 - RNA, 23 nt, Homo sapiens
cuuaggcuuuguaugacagugaa

SEQ ID NO: 717735 - RNA, 18 nt, Homo sapiens
cuuagggcagauuuucau

SEQ ID NO: 717736 - RNA, 21 nt, Homo sapiens
cuuaggugcuucuucacuuca

SEQ ID NO: 717737 - RNA, 16 nt, Homo sapiens
cuuaguaaguauuucc

SEQ ID NO: 717738 - RNA, 13 nt, Homo sapiens
cuuaguaagugcu

SEQ ID NO: 717739 - RNA, 15 nt, Homo sapiens
cuuaguaagugcuuu

SEQ ID NO: 717740 - RNA, 14 nt, Homo sapiens
cuuaguauugugau

SEQ ID NO: 717741 - RNA, 17 nt, Homo sapiens
cuuagucacuuauuuca

SEQ ID NO: 717742 - RNA, 16 nt, Homo sapiens
cuuagugacaaaauag

SEQ ID NO: 717743 - RNA, 21 nt, Homo sapiens
cuuagugccacccaccuuugc

SEQ ID NO: 717744 - RNA, 18 nt, Homo sapiens
cuuagugcuucagaguuu

SEQ ID NO: 717745 - RNA, 15 nt, Homo sapiens
cuuagugucacuuac

SEQ ID NO: 717746 - RNA, 16 nt, Homo sapiens
cuuauaaaaaucuuaa

SEQ ID NO: 717747 - RNA, 20 nt, Homo sapiens
cuuauaagaaagaucaaaga

SEQ ID NO: 717748 - RNA, 20 nt, Homo sapiens
cuuauagacacuugcuccca

SEQ ID NO: 717749 - RNA, 20 nt, Homo sapiens
cuuauaucauguaccucaga

SEQ ID NO: 717750 - RNA, 14 nt, Homo sapiens
cuuaucaacaacuu

SEQ ID NO: 717751 - RNA, 23 nt, Homo sapiens
cuuaucaacauuuguuccaugag

SEQ ID NO: 717752 - RNA, 17 nt, Homo sapiens
cuuaucaggauaccaga

SEQ ID NO: 717753 - RNA, 16 nt, Homo sapiens
cuuauccaucuuugaa

SEQ ID NO: 717754 - RNA, 18 nt, Homo sapiens
cuuaucuuucuaaaacug

SEQ ID NO: 717755 - RNA, 19 nt, Homo sapiens
cuuaucuuucuaaaacugc

SEQ ID NO: 717756 - RNA, 20 nt, Homo sapiens
cuuaugaaaagaauuugaug

SEQ ID NO: 717757 - RNA, 16 nt, Homo sapiens
cuuaugccagcgugac

SEQ ID NO: 717758 - RNA, 18 nt, Homo sapiens
cuuauucuuugaguaaug

SEQ ID NO: 717759 - RNA, 18 nt, Homo sapiens
cuuauugacaauugugua

SEQ ID NO: 717760 - RNA, 21 nt, Homo sapiens
cuuauuggccacugggucuca

SEQ ID NO: 717761 - RNA, 19 nt, Homo sapiens
cuuauuguuucucugaaag

SEQ ID NO: 717762 - RNA, 20 nt, Homo sapiens
cuuauuucuagaagcacaug

SEQ ID NO: 717763 - RNA, 16 nt, Homo sapiens
cuuauuugaugguggu

SEQ ID NO: 717764 - RNA, 19 nt, Homo sapiens
cugugcccuagaugcacgu

SEQ ID NO: 717765 - RNA, 18 nt, Homo sapiens
cugugccuccccccagac

SEQ ID NO: 717766 - RNA, 14 nt, Homo sapiens
cugugccuuuugcc

SEQ ID NO: 717767 - RNA, 20 nt, Homo sapiens
cugugcgccgggggaccugg

SEQ ID NO: 717768 - RNA, 15 nt, Homo sapiens
cugugcuaugaauuu

SEQ ID NO: 717769 - RNA, 12 nt, Homo sapiens
cugugcucagau

SEQ ID NO: 717770 - RNA, 20 nt, Homo sapiens
cugugcucagccaccaucug

SEQ ID NO: 717771 - RNA, 23 nt, Homo sapiens
cugugcucugaaugggagccaga

SEQ ID NO: 717772 - RNA, 16 nt, Homo sapiens
cugugcugguguccug

SEQ ID NO: 717773 - RNA, 21 nt, Homo sapiens
cugugcugguguccugaccac

SEQ ID NO: 717774 - RNA, 18 nt, Homo sapiens
cugugcuucgacuacugc

SEQ ID NO: 717775 - RNA, 23 nt, Homo sapiens
cugugcuucgacuacugcuccug

SEQ ID NO: 717776 - RNA, 19 nt, Homo sapiens
cuguggagccccagcauau

SEQ ID NO: 717777 - RNA, 14 nt, Homo sapiens
cuguggcagaguua

SEQ ID NO: 717778 - RNA, 16 nt, Homo sapiens
cuguggcaucuuugcc

SEQ ID NO: 717779 - RNA, 16 nt, Homo sapiens
cuguggcauuuccaaa

SEQ ID NO: 717780 - RNA, 18 nt, Homo sapiens
cuguggccuguuaacugg

SEQ ID NO: 717781 - RNA, 19 nt, Homo sapiens
cuguggcuuuuuguucaga

SEQ ID NO: 717782 - RNA, 16 nt, Homo sapiens
cuguggggaacacagc

SEQ ID NO: 717783 - RNA, 21 nt, Homo sapiens
cuguggggcaggagugccagg

SEQ ID NO: 717784 - RNA, 15 nt, Homo sapiens
cuguggucacuugua

SEQ ID NO: 717785 - RNA, 16 nt, Homo sapiens
cuguggucacuuguac

SEQ ID NO: 717786 - RNA, 12 nt, Homo sapiens
cuguggugagaa

SEQ ID NO: 717787 - RNA, 16 nt, Homo sapiens
cuguggugauguugcc

SEQ ID NO: 717788 - RNA, 21 nt, Homo sapiens
cuguggugcccucugacaagg

SEQ ID NO: 717789 - RNA, 20 nt, Homo sapiens
cugugguuacaagaaacagc

SEQ ID NO: 717790 - RNA, 18 nt, Homo sapiens
cugugguuacagugcaga

SEQ ID NO: 717791 - RNA, 20 nt, Homo sapiens
cugugguuccucugcucacc

SEQ ID NO: 717792 - RNA, 21 nt, Homo sapiens
cuguguaaaacuauauucuca

SEQ ID NO: 717793 - RNA, 20 nt, Homo sapiens
cuguguaagaagcugugaau

SEQ ID NO: 717794 - RNA, 19 nt, Homo sapiens
cuguguacacaugggaguu

SEQ ID NO: 717795 - RNA, 16 nt, Homo sapiens
cuguguacauaacuga

SEQ ID NO: 717796 - RNA, 14 nt, Homo sapiens
cuguguacugugga

SEQ ID NO: 717797 - RNA, 22 nt, Homo sapiens
cugugucauucuguuagauacu

SEQ ID NO: 717798 - RNA, 16 nt, Homo sapiens
cuguguccaagaacuc

SEQ ID NO: 717799 - RNA, 14 nt, Homo sapiens
cuguguccauguga

SEQ ID NO: 717800 - RNA, 15 nt, Homo sapiens
cuguguccaugugau

SEQ ID NO: 717801 - RNA, 16 nt, Homo sapiens
cuguguccgaugcugg

SEQ ID NO: 717802 - RNA, 19 nt, Homo sapiens
cuguguccuugcaccugca

SEQ ID NO: 717803 - RNA, 21 nt, Homo sapiens
cugugucggauacacacucga

SEQ ID NO: 717804 - RNA, 15 nt, Homo sapiens
cugugucuaagauuc

SEQ ID NO: 717805 - RNA, 19 nt, Homo sapiens
cugugucuccucucagagu

SEQ ID NO: 717806 - RNA, 15 nt, Homo sapiens
cugugugaaggugaa

SEQ ID NO: 717807 - RNA, 13 nt, Homo sapiens
cugugugccccac

SEQ ID NO: 717808 - RNA, 15 nt, Homo sapiens
cugugugcgugcgca

SEQ ID NO: 717809 - RNA, 15 nt, Homo sapiens
cuguguggacuguga

SEQ ID NO: 717810 - RNA, 21 nt, Homo sapiens
cuguguggacugugaugccac

SEQ ID NO: 717811 - RNA, 18 nt, Homo sapiens
cugugugguggagccagg

SEQ ID NO: 717812 - RNA, 18 nt, Homo sapiens
cuguguguccuugcaugg

SEQ ID NO: 717813 - RNA, 17 nt, Homo sapiens
cugugugugauuugcua

SEQ ID NO: 717814 - RNA, 17 nt, Homo sapiens
cugugugugccuccagc

SEQ ID NO: 717815 - RNA, 14 nt, Homo sapiens
cuguguguugccug

SEQ ID NO: 717816 - RNA, 13 nt, Homo sapiens
cuguguuaggggu

SEQ ID NO: 717817 - RNA, 17 nt, Homo sapiens
cuguuaacgucaucuca

SEQ ID NO: 717818 - RNA, 22 nt, Homo sapiens
cuguuaacuuuuguaccaaaua

SEQ ID NO: 717819 - RNA, 13 nt, Homo sapiens
cuguuaccauuca

SEQ ID NO: 717820 - RNA, 18 nt, Homo sapiens
cuguuacuaaauccuuuu

SEQ ID NO: 717821 - RNA, 23 nt, Homo sapiens
cuguuacucugucccacguccaa

SEQ ID NO: 717822 - RNA, 17 nt, Homo sapiens
cuguuacuuaccuaaac

SEQ ID NO: 717823 - RNA, 16 nt, Homo sapiens
cuguuacuugcuucag

SEQ ID NO: 717824 - RNA, 16 nt, Homo sapiens
cuguuagucauuugcu

SEQ ID NO: 717825 - RNA, 23 nt, Homo sapiens
cuguuauccugcuagcuguagaa

SEQ ID NO: 717826 - RNA, 18 nt, Homo sapiens
cuguuauggggacuuuau

SEQ ID NO: 717827 - RNA, 22 nt, Homo sapiens
cuguuauuaccauuagcauucu

SEQ ID NO: 717828 - RNA, 17 nt, Homo sapiens
cuguucaaagaugcauu

SEQ ID NO: 717829 - RNA, 13 nt, Homo sapiens
cuguucacagcca

SEQ ID NO: 717830 - RNA, 17 nt, Homo sapiens
cuguucagagcacucau

SEQ ID NO: 717831 - RNA, 17 nt, Homo sapiens
cuguucauguuacucau

SEQ ID NO: 717832 - RNA, 22 nt, Homo sapiens
cuguucccaccaggcugcucag

SEQ ID NO: 717833 - RNA, 14 nt, Homo sapiens
cuguuccccagaga

SEQ ID NO: 717834 - RNA, 15 nt, Homo sapiens
cuguucccuugcagg

SEQ ID NO: 717835 - RNA, 16 nt, Homo sapiens
cuguucugaaaccuua

SEQ ID NO: 717836 - RNA, 23 nt, Homo sapiens
cuguucugaaaggagacauugcu

SEQ ID NO: 717837 - RNA, 15 nt, Homo sapiens
cuguucugcacugaa

SEQ ID NO: 717838 - RNA, 18 nt, Homo sapiens
cuguucugcgcuguguac

SEQ ID NO: 717839 - RNA, 16 nt, Homo sapiens
cuguucuucaacuccu

SEQ ID NO: 717840 - RNA, 22 nt, Homo sapiens
cuguucuugcuacccaugacuu

SEQ ID NO: 717841 - RNA, 17 nt, Homo sapiens
cuguucuuguauuguau

SEQ ID NO: 717842 - RNA, 21 nt, Homo sapiens
cuguugaucccacuucacugu

SEQ ID NO: 717843 - RNA, 12 nt, Homo sapiens
cuguugcucaaa

SEQ ID NO: 717844 - RNA, 18 nt, Homo sapiens
cuguugcuuaaaccacuu

SEQ ID NO: 717845 - RNA, 11 nt, Homo sapiens
cuguugcuugu

SEQ ID NO: 717846 - RNA, 19 nt, Homo sapiens
cuguuggccccucugcugu

SEQ ID NO: 717847 - RNA, 16 nt, Homo sapiens
cuguuggggaccucac

SEQ ID NO: 717848 - RNA, 16 nt, Homo sapiens
cuguugguuagauuca

SEQ ID NO: 717849 - RNA, 20 nt, Homo sapiens
cuguuguaggguugccagau

SEQ ID NO: 717850 - RNA, 15 nt, Homo sapiens
cuguuuaacauuucc

SEQ ID NO: 717851 - RNA, 19 nt, Homo sapiens
cuguuuaacauuuccucag

SEQ ID NO: 717852 - RNA, 21 nt, Homo sapiens
cuguuucuuaagggcacacac

SEQ ID NO: 717853 - RNA, 16 nt, Homo sapiens
cuuauuugcugcagaa

SEQ ID NO: 717854 - RNA, 19 nt, Homo sapiens
cuuauuuucucaaucuccu

SEQ ID NO: 717855 - RNA, 16 nt, Homo sapiens
cuuauuuugcauucca

SEQ ID NO: 717856 - RNA, 17 nt, Homo sapiens
cuuauuuugcauuccag

SEQ ID NO: 717857 - RNA, 18 nt, Homo sapiens
cuuauuuugguugcaguu

SEQ ID NO: 717858 - RNA, 21 nt, Homo sapiens
cuucaaaacggggcagccaaa

SEQ ID NO: 717859 - RNA, 20 nt, Homo sapiens
cuucaaacugugaagcauuu

SEQ ID NO: 717860 - RNA, 19 nt, Homo sapiens
cuucaaagaggaaccagga

SEQ ID NO: 717861 - RNA, 15 nt, Homo sapiens
cuucaaauauuuccc

SEQ ID NO: 717862 - RNA, 13 nt, Homo sapiens
cuucaaaugcaaa

SEQ ID NO: 717863 - RNA, 21 nt, Homo sapiens
cuucaaaugcaaauucaucau

SEQ ID NO: 717864 - RNA, 12 nt, Homo sapiens
cuucaacccagu

SEQ ID NO: 717865 - RNA, 17 nt, Homo sapiens
cuucaacguagucaucc

SEQ ID NO: 717866 - RNA, 21 nt, Homo sapiens
cuucaagacgacagcucugua

SEQ ID NO: 717867 - RNA, 16 nt, Homo sapiens
cuucaagagcugagaa

SEQ ID NO: 717868 - RNA, 14 nt, Homo sapiens
cuucaagaucucau

SEQ ID NO: 717869 - RNA, 14 nt, Homo sapiens
cuucaaggcuucca

SEQ ID NO: 717870 - RNA, 13 nt, Homo sapiens
cuucaagugccaa

SEQ ID NO: 717871 - RNA, 15 nt, Homo sapiens
cuucaagugccaaac

SEQ ID NO: 717872 - RNA, 13 nt, Homo sapiens
cuucaaguggcag

SEQ ID NO: 717873 - RNA, 14 nt, Homo sapiens
cuucaaguggcagg

SEQ ID NO: 717874 - RNA, 13 nt, Homo sapiens
cuucaauacuuaa

SEQ ID NO: 717875 - RNA, 13 nt, Homo sapiens
cuucaaucacugu

SEQ ID NO: 717876 - RNA, 18 nt, Homo sapiens
cuucaaucggcuuguggg

SEQ ID NO: 717877 - RNA, 21 nt, Homo sapiens
cuucucaaaguacugggauua

SEQ ID NO: 717878 - RNA, 20 nt, Homo sapiens
cuucucaaauuagcugcaau

SEQ ID NO: 717879 - RNA, 16 nt, Homo sapiens
cuucucaccccaggau

SEQ ID NO: 717880 - RNA, 18 nt, Homo sapiens
cuucucaucauauuguau

SEQ ID NO: 717881 - RNA, 15 nt, Homo sapiens
cuucucaucugcaaa

SEQ ID NO: 717882 - RNA, 17 nt, Homo sapiens
cuucuccaaaugagauc

SEQ ID NO: 717883 - RNA, 15 nt, Homo sapiens
cuucuccaguuagaa

SEQ ID NO: 717884 - RNA, 20 nt, Homo sapiens
cuucuccaucccucuaauga

SEQ ID NO: 717885 - RNA, 15 nt, Homo sapiens
cuucuccccauucug

SEQ ID NO: 717886 - RNA, 19 nt, Homo sapiens
cuucuccccugcacuguaa

SEQ ID NO: 717887 - RNA, 19 nt, Homo sapiens
cuucucuccagcugacuaa

SEQ ID NO: 717888 - RNA, 13 nt, Homo sapiens
cuucucugcucca

SEQ ID NO: 717889 - RNA, 13 nt, Homo sapiens
cuucucugugaac

SEQ ID NO: 717890 - RNA, 22 nt, Homo sapiens
cuucucuguugucaaacugaaa

SEQ ID NO: 717891 - RNA, 23 nt, Homo sapiens
cuucucuucccugcgccugugau

SEQ ID NO: 717892 - RNA, 22 nt, Homo sapiens
cuucucuugggaacuccacucu

SEQ ID NO: 717893 - RNA, 16 nt, Homo sapiens
cuucugaagucccugc

SEQ ID NO: 717894 - RNA, 18 nt, Homo sapiens
cuucugacaaagguggua

SEQ ID NO: 717895 - RNA, 19 nt, Homo sapiens
cuucugacacugaaacuuc

SEQ ID NO: 717896 - RNA, 19 nt, Homo sapiens
cuucugacuacuuguugua

SEQ ID NO: 717897 - RNA, 19 nt, Homo sapiens
cuucugacuuuuagaaaca

SEQ ID NO: 717898 - RNA, 17 nt, Homo sapiens
cuucugcaacaucuuaa

SEQ ID NO: 717899 - RNA, 18 nt, Homo sapiens
cuucugccccagcuuugc

SEQ ID NO: 717900 - RNA, 18 nt, Homo sapiens
cuucugccuucucaggaa

SEQ ID NO: 717901 - RNA, 21 nt, Homo sapiens
cuucuggagaaaaaggugcca

SEQ ID NO: 717902 - RNA, 15 nt, Homo sapiens
cuucuggcauaacua

SEQ ID NO: 717903 - RNA, 16 nt, Homo sapiens
cuucuggggguggugg

SEQ ID NO: 717904 - RNA, 19 nt, Homo sapiens
cuucugguauaauugugua

SEQ ID NO: 717905 - RNA, 18 nt, Homo sapiens
cuucuguggucaccccau

SEQ ID NO: 717906 - RNA, 20 nt, Homo sapiens
cuucuguuugaucacuguga

SEQ ID NO: 717907 - RNA, 23 nt, Homo sapiens
cuucuuaaaaucaaauguaaauc

SEQ ID NO: 717908 - RNA, 19 nt, Homo sapiens
cuucuuacaugcauuugag

SEQ ID NO: 717909 - RNA, 15 nt, Homo sapiens
cuucuuacuggugcu

SEQ ID NO: 717910 - RNA, 21 nt, Homo sapiens
cuucuuagcacuguugagagg

SEQ ID NO: 717911 - RNA, 16 nt, Homo sapiens
cuucuuauuaaucaua

SEQ ID NO: 717912 - RNA, 18 nt, Homo sapiens
cuucuucccucccuaucu

SEQ ID NO: 717913 - RNA, 17 nt, Homo sapiens
cuucuuccuauuguaau

SEQ ID NO: 717914 - RNA, 16 nt, Homo sapiens
cuucuugcugaucaga

SEQ ID NO: 717915 - RNA, 23 nt, Homo sapiens
cuucuuggcguauuuauacucac

SEQ ID NO: 717916 - RNA, 13 nt, Homo sapiens
cuucuuguucccc

SEQ ID NO: 717917 - RNA, 18 nt, Homo sapiens
cuucuuuagaacagggaa

SEQ ID NO: 717918 - RNA, 16 nt, Homo sapiens
cuucuuuuugcuucaa

SEQ ID NO: 717919 - RNA, 17 nt, Homo sapiens
cuucuuuuugcuucaaa

SEQ ID NO: 717920 - RNA, 15 nt, Homo sapiens
cuugaaaauagaaca

SEQ ID NO: 717921 - RNA, 16 nt, Homo sapiens
cuugaaacugagaugu

SEQ ID NO: 717922 - RNA, 13 nt, Homo sapiens
cuugaaaguuuuc

SEQ ID NO: 717923 - RNA, 22 nt, Homo sapiens
cuugaaaugaguaaaaacuaga

SEQ ID NO: 717924 - RNA, 14 nt, Homo sapiens
cuugaaaugcauua

SEQ ID NO: 717925 - RNA, 21 nt, Homo sapiens
cuugaaaugcucuuuugcaca

SEQ ID NO: 717926 - RNA, 17 nt, Homo sapiens
cuugaacucuguucccc

SEQ ID NO: 717927 - RNA, 15 nt, Homo sapiens
cuugaagaagggaga

SEQ ID NO: 717928 - RNA, 15 nt, Homo sapiens
cuugaaguaugccuu

SEQ ID NO: 717929 - RNA, 22 nt, Homo sapiens
cuugaaguugcuuuuuugacuc

SEQ ID NO: 717930 - RNA, 19 nt, Homo sapiens
cuugaauccuuccauucca

SEQ ID NO: 717931 - RNA, 14 nt, Homo sapiens
cuugaaugcugcca

SEQ ID NO: 717932 - RNA, 21 nt, Homo sapiens
cuugaauguccccauucuaua

SEQ ID NO: 717933 - RNA, 15 nt, Homo sapiens
cuugaaugugucacu

SEQ ID NO: 717934 - RNA, 17 nt, Homo sapiens
cuugaauucauguuggu

SEQ ID NO: 717935 - RNA, 14 nt, Homo sapiens
cuugacauaccuac

SEQ ID NO: 717936 - RNA, 16 nt, Homo sapiens
cuugacauuuaucacc

SEQ ID NO: 717937 - RNA, 24 nt, Homo sapiens
cuugaccagcagaucccagcucac

SEQ ID NO: 717938 - RNA, 16 nt, Homo sapiens
cuugacucaggauuua

SEQ ID NO: 717939 - RNA, 15 nt, Homo sapiens
cuugacucauggcag

SEQ ID NO: 717940 - RNA, 21 nt, Homo sapiens
cuugagcaaccuggcuaagau

SEQ ID NO: 717941 - RNA, 15 nt, Homo sapiens
cuugagccaguaauu

SEQ ID NO: 717942 - RNA, 12 nt, Homo sapiens
cuugagcccaaa

SEQ ID NO: 717943 - RNA, 19 nt, Homo sapiens
cuugagccucccccaaagc

SEQ ID NO: 717944 - RNA, 15 nt, Homo sapiens
cuugagcgugaaucu

SEQ ID NO: 717945 - RNA, 15 nt, Homo sapiens
cuugagcuacaguag

SEQ ID NO: 717946 - RNA, 12 nt, Homo sapiens
cuugagugcucu

SEQ ID NO: 717947 - RNA, 15 nt, Homo sapiens
cuugaguuauuaaaa

SEQ ID NO: 717948 - RNA, 24 nt, Homo sapiens
cuugaguuauuaaaaucauaggaa

SEQ ID NO: 717949 - RNA, 20 nt, Homo sapiens
cuugaguugccugaugcuca

SEQ ID NO: 717950 - RNA, 14 nt, Homo sapiens
cuugauaucauuca

SEQ ID NO: 717951 - RNA, 16 nt, Homo sapiens
cuugauauuuuccaaa

SEQ ID NO: 717952 - RNA, 22 nt, Homo sapiens
cuugaucaacaucuuuucuugc

SEQ ID NO: 717953 - RNA, 17 nt, Homo sapiens
cuugauccacagaaaua

SEQ ID NO: 717954 - RNA, 17 nt, Homo sapiens
cuugaucucucuugucc

SEQ ID NO: 717955 - RNA, 20 nt, Homo sapiens
cuugaucuuaacaaagccuu

SEQ ID NO: 717956 - RNA, 21 nt, Homo sapiens
cuugaucuuaacaaagccuuu

SEQ ID NO: 717957 - RNA, 18 nt, Homo sapiens
cuugauggagauauuuac

SEQ ID NO: 717958 - RNA, 18 nt, Homo sapiens
cuugauugguucuuccaa

SEQ ID NO: 717959 - RNA, 22 nt, Homo sapiens
cuugauuuugcccccugaggga

SEQ ID NO: 717960 - RNA, 22 nt, Homo sapiens
cuugauuuuuuucauuuugcca

SEQ ID NO: 717961 - RNA, 14 nt, Homo sapiens
cuugcacacuuccc

SEQ ID NO: 717962 - RNA, 13 nt, Homo sapiens
cuugcacagccaa

SEQ ID NO: 717963 - RNA, 15 nt, Homo sapiens
cuugcagaacuguag

SEQ ID NO: 717964 - RNA, 14 nt, Homo sapiens
cuugcagagcauga

SEQ ID NO: 717965 - RNA, 20 nt, Homo sapiens
cuugcagauaucugcaugug

SEQ ID NO: 717966 - RNA, 18 nt, Homo sapiens
cuugcagcugauguugga

SEQ ID NO: 717967 - RNA, 17 nt, Homo sapiens
cuugcaguuaaggguua

SEQ ID NO: 717968 - RNA, 18 nt, Homo sapiens
cuugcaguuaaggguuag

SEQ ID NO: 717969 - RNA, 14 nt, Homo sapiens
cuugcaucacuuaa

SEQ ID NO: 717970 - RNA, 19 nt, Homo sapiens
cuugcauccaaaccuguaa

SEQ ID NO: 717971 - RNA, 13 nt, Homo sapiens
cuugcaugaauca

SEQ ID NO: 717972 - RNA, 20 nt, Homo sapiens
cuugccaagggucccugugu

SEQ ID NO: 717973 - RNA, 12 nt, Homo sapiens
cuugccagacau

SEQ ID NO: 717974 - RNA, 13 nt, Homo sapiens
cuugccaggcucc

SEQ ID NO: 717975 - RNA, 15 nt, Homo sapiens
cuugccaugugcugg

SEQ ID NO: 717976 - RNA, 15 nt, Homo sapiens
cuugcccaaguccca

SEQ ID NO: 717977 - RNA, 20 nt, Homo sapiens
cuugcccagagaugccucca

SEQ ID NO: 717978 - RNA, 23 nt, Homo sapiens
cuugcccgccagccucagugcca

SEQ ID NO: 717979 - RNA, 11 nt, Homo sapiens
cuugccucuuc

SEQ ID NO: 717980 - RNA, 15 nt, Homo sapiens
cuugcuaaagcacuu

SEQ ID NO: 717981 - RNA, 17 nt, Homo sapiens
cuugcuaccaguauuua

SEQ ID NO: 717982 - RNA, 15 nt, Homo sapiens
cuugcuaccugugag

SEQ ID NO: 717983 - RNA, 16 nt, Homo sapiens
cuugcuaccugugagc

SEQ ID NO: 717984 - RNA, 15 nt, Homo sapiens
cuugcucaaagggaa

SEQ ID NO: 717985 - RNA, 17 nt, Homo sapiens
cuugcucauccaaggau

SEQ ID NO: 717986 - RNA, 21 nt, Homo sapiens
cuugcuccacagggcccuguu

SEQ ID NO: 717987 - RNA, 13 nt, Homo sapiens
cuugcugacaaua

SEQ ID NO: 717988 - RNA, 13 nt, Homo sapiens
cuugcugccugaa

SEQ ID NO: 717989 - RNA, 12 nt, Homo sapiens
cuugcugugagc

SEQ ID NO: 717990 - RNA, 14 nt, Homo sapiens
cuugcuuccugucu

SEQ ID NO: 717991 - RNA, 12 nt, Homo sapiens
cuugcuuucaca

SEQ ID NO: 717992 - RNA, 18 nt, Homo sapiens
uggacaaaauugcagaua

SEQ ID NO: 717993 - RNA, 17 nt, Homo sapiens
uggacaaggagugugac

SEQ ID NO: 717994 - RNA, 22 nt, Homo sapiens
uggacacggaucugcugggcuc

SEQ ID NO: 717995 - RNA, 15 nt, Homo sapiens
uggacagauugccug

SEQ ID NO: 717996 - RNA, 16 nt, Homo sapiens
uggacaggcucugcuu

SEQ ID NO: 717997 - RNA, 12 nt, Homo sapiens
uggaccacugca

SEQ ID NO: 717998 - RNA, 21 nt, Homo sapiens
uggaccacuuuguauacacuc

SEQ ID NO: 717999 - RNA, 15 nt, Homo sapiens
uggaccaguacuccc

SEQ ID NO: 718000 - RNA, 22 nt, Homo sapiens
uggacccuuggccuccauuucu

SEQ ID NO: 718001 - RNA, 15 nt, Homo sapiens
uggaccuaacauucg

SEQ ID NO: 718002 - RNA, 19 nt, Homo sapiens
uggaccuauguccuaagga

SEQ ID NO: 718003 - RNA, 21 nt, Homo sapiens
uggaccugcccugggccacac

SEQ ID NO: 718004 - RNA, 21 nt, Homo sapiens
uggaccuuuucccuugcugua

SEQ ID NO: 718005 - RNA, 16 nt, Homo sapiens
uggacgugugugaaug

SEQ ID NO: 718006 - RNA, 18 nt, Homo sapiens
uggacuaaaacauuuuga

SEQ ID NO: 718007 - RNA, 20 nt, Homo sapiens
uggacuacacccaagccuga

SEQ ID NO: 718008 - RNA, 22 nt, Homo sapiens
uggacuccaucucucauccucc

SEQ ID NO: 718009 - RNA, 16 nt, Homo sapiens
uggacuccccucccug

SEQ ID NO: 718010 - RNA, 15 nt, Homo sapiens
uggacucucagggau

SEQ ID NO: 718011 - RNA, 14 nt, Homo sapiens
uggacucugcacau

SEQ ID NO: 718012 - RNA, 13 nt, Homo sapiens
uggacucuuccac

SEQ ID NO: 718013 - RNA, 12 nt, Homo sapiens
uggacugaccaa

SEQ ID NO: 718014 - RNA, 13 nt, Homo sapiens
uggacugcaauga

SEQ ID NO: 718015 - RNA, 18 nt, Homo sapiens
uggacugugcuggugcau

SEQ ID NO: 718016 - RNA, 13 nt, Homo sapiens
uggacuuacaaaa

SEQ ID NO: 718017 - RNA, 15 nt, Homo sapiens
uggacuucagugugu

SEQ ID NO: 718018 - RNA, 19 nt, Homo sapiens
uggacuuccacugccaucc

SEQ ID NO: 718019 - RNA, 13 nt, Homo sapiens
uggacuucucuga

SEQ ID NO: 718020 - RNA, 21 nt, Homo sapiens
uggacuuguccucagcagcug

SEQ ID NO: 718021 - RNA, 16 nt, Homo sapiens
uggacuuucuugcaug

SEQ ID NO: 718022 - RNA, 18 nt, Homo sapiens
uggacuuucuugcaugaa

SEQ ID NO: 718023 - RNA, 20 nt, Homo sapiens
uggagaaaagggauggagcu

SEQ ID NO: 718024 - RNA, 23 nt, Homo sapiens
uggagaaaagggauggagcugaa

SEQ ID NO: 718025 - RNA, 16 nt, Homo sapiens
uggagaaagagcugcc

SEQ ID NO: 718026 - RNA, 16 nt, Homo sapiens
uggagaaaucuacuga

SEQ ID NO: 718027 - RNA, 16 nt, Homo sapiens
uggagaaccagggcuc

SEQ ID NO: 718028 - RNA, 22 nt, Homo sapiens
uggagaaccagggcucuucuca

SEQ ID NO: 718029 - RNA, 13 nt, Homo sapiens
uggagaaccucau

SEQ ID NO: 718030 - RNA, 15 nt, Homo sapiens
uggagaaggcauguu

SEQ ID NO: 718031 - RNA, 17 nt, Homo sapiens
uggagaagucucagcua

SEQ ID NO: 718032 - RNA, 15 nt, Homo sapiens
uggagaauugacuga

SEQ ID NO: 718033 - RNA, 14 nt, Homo sapiens
uggagacaaacuug

SEQ ID NO: 718034 - RNA, 22 nt, Homo sapiens
uggagacaagggcaucaucuau

SEQ ID NO: 718035 - RNA, 23 nt, Homo sapiens
uggagacacccucuggggguccu

SEQ ID NO: 718036 - RNA, 19 nt, Homo sapiens
uggagaccaucuaccccuu

SEQ ID NO: 718037 - RNA, 12 nt, Homo sapiens
uggagaccauua

SEQ ID NO: 718038 - RNA, 19 nt, Homo sapiens
uggagacugagaucacuga

SEQ ID NO: 718039 - RNA, 20 nt, Homo sapiens
uggagagcucaggauggcuc

SEQ ID NO: 718040 - RNA, 18 nt, Homo sapiens
uggagaggaggggaccca

SEQ ID NO: 718041 - RNA, 19 nt, Homo sapiens
uggagaugcagcuacugga

SEQ ID NO: 718042 - RNA, 15 nt, Homo sapiens
uggagcaugcaacac

SEQ ID NO: 718043 - RNA, 18 nt, Homo sapiens
uggagcaugcaacacauc

SEQ ID NO: 718044 - RNA, 10 nt, Homo sapiens
uggagccagg

SEQ ID NO: 718045 - RNA, 17 nt, Homo sapiens
uggagcccacaaccuuc

SEQ ID NO: 718046 - RNA, 18 nt, Homo sapiens
uggagccccaucagcucc

SEQ ID NO: 718047 - RNA, 19 nt, Homo sapiens
uggagccccauccuguguu

SEQ ID NO: 718048 - RNA, 15 nt, Homo sapiens
uggagcccgugcagu

SEQ ID NO: 718049 - RNA, 22 nt, Homo sapiens
uggagcccuaaccccuuccaga

SEQ ID NO: 718050 - RNA, 21 nt, Homo sapiens
uggagcuaauggcgaucaucu

SEQ ID NO: 718051 - RNA, 16 nt, Homo sapiens
uggagcuacugaugaa

SEQ ID NO: 718052 - RNA, 15 nt, Homo sapiens
uggagcugacuguuc

SEQ ID NO: 718053 - RNA, 17 nt, Homo sapiens
uggaggaaaaaaagcau

SEQ ID NO: 718054 - RNA, 18 nt, Homo sapiens
uggaggaaagugauaucc

SEQ ID NO: 718055 - RNA, 14 nt, Homo sapiens
uggaggaacaguau

SEQ ID NO: 718056 - RNA, 16 nt, Homo sapiens
uggaggaagagccacc

SEQ ID NO: 718057 - RNA, 23 nt, Homo sapiens
uggaggccuguccugaccugucu

SEQ ID NO: 718058 - RNA, 23 nt, Homo sapiens
uggaggcugcaccuacugaggau

SEQ ID NO: 718059 - RNA, 20 nt, Homo sapiens
uggaggcugcuguggggacc

SEQ ID NO: 718060 - RNA, 20 nt, Homo sapiens
uggaggcugucuucucaggc

SEQ ID NO: 718061 - RNA, 11 nt, Homo sapiens
uggaggcuucc

SEQ ID NO: 718062 - RNA, 23 nt, Homo sapiens
uggagggcaacauuccacagcug

SEQ ID NO: 718063 - RNA, 19 nt, Homo sapiens
uggagggggagcaccagcg

SEQ ID NO: 718064 - RNA, 11 nt, Homo sapiens
uggaggggugu

SEQ ID NO: 718065 - RNA, 14 nt, Homo sapiens
uggagguugcagug

SEQ ID NO: 718066 - RNA, 20 nt, Homo sapiens
uggaguaaauauauauguca

SEQ ID NO: 718067 - RNA, 13 nt, Homo sapiens
uggaguccagcuc

SEQ ID NO: 718068 - RNA, 15 nt, Homo sapiens
uggaguccagucucu

SEQ ID NO: 718069 - RNA, 15 nt, Homo sapiens
uggagucucagagca

SEQ ID NO: 718070 - RNA, 12 nt, Homo sapiens
uggagugcagug

SEQ ID NO: 718071 - RNA, 15 nt, Homo sapiens
uggagugcagugcca

SEQ ID NO: 718072 - RNA, 20 nt, Homo sapiens
uggagugcaguggugccauc

SEQ ID NO: 718073 - RNA, 16 nt, Homo sapiens
uggagugcauuugacu

SEQ ID NO: 718074 - RNA, 22 nt, Homo sapiens
uggaguggcugccauggaagga

SEQ ID NO: 718075 - RNA, 23 nt, Homo sapiens
uggaguguuuuuacauugaucuu

SEQ ID NO: 718076 - RNA, 17 nt, Homo sapiens
uggauaaaauaaaugca

SEQ ID NO: 718077 - RNA, 22 nt, Homo sapiens
uggauaggcacauagagaggga

SEQ ID NO: 718078 - RNA, 15 nt, Homo sapiens
uggauagucugucca

SEQ ID NO: 718079 - RNA, 22 nt, Homo sapiens
uggauaugcugcuuuaaacuug

SEQ ID NO: 718080 - RNA, 18 nt, Homo sapiens
uggauauuauucuuguag

SEQ ID NO: 718081 - RNA, 18 nt, Homo sapiens
uggaucaccugaggucag

SEQ ID NO: 718082 - RNA, 20 nt, Homo sapiens
uggaucaguccuuugaucag

SEQ ID NO: 718083 - RNA, 13 nt, Homo sapiens
uggauccagcacu

SEQ ID NO: 718084 - RNA, 19 nt, Homo sapiens
uggauccagccaugccuga

SEQ ID NO: 718085 - RNA, 22 nt, Homo sapiens
uggaucuaccagcauaaauauc

SEQ ID NO: 718086 - RNA, 15 nt, Homo sapiens
uggaugaaaaaagcc

SEQ ID NO: 718087 - RNA, 15 nt, Homo sapiens
uggaugaggagacag

SEQ ID NO: 718088 - RNA, 17 nt, Homo sapiens
cuggcuuugcucuauua

SEQ ID NO: 718089 - RNA, 22 nt, Homo sapiens
cugggaagcuugagccuccccc

SEQ ID NO: 718090 - RNA, 15 nt, Homo sapiens
cugggaaucaagaca

SEQ ID NO: 718091 - RNA, 15 nt, Homo sapiens
cugggacauggugga

SEQ ID NO: 718092 - RNA, 17 nt, Homo sapiens
cugggaccacuggguac

SEQ ID NO: 718093 - RNA, 20 nt, Homo sapiens
cugggaccacuggguacaag

SEQ ID NO: 718094 - RNA, 15 nt, Homo sapiens
cugggaccuccuuag

SEQ ID NO: 718095 - RNA, 22 nt, Homo sapiens
cugggacuauaggcaugcgcca

SEQ ID NO: 718096 - RNA, 16 nt, Homo sapiens
cugggagaaccucagg

SEQ ID NO: 718097 - RNA, 22 nt, Homo sapiens
cugggagacuuugaagaccagu

SEQ ID NO: 718098 - RNA, 16 nt, Homo sapiens
cugggagcacuggugu

SEQ ID NO: 718099 - RNA, 19 nt, Homo sapiens
cugggaucuggcacacucc

SEQ ID NO: 718100 - RNA, 22 nt, Homo sapiens
cugggauguccacagaugccuc

SEQ ID NO: 718101 - RNA, 22 nt, Homo sapiens
cugggauuacaagcaugaguca

SEQ ID NO: 718102 - RNA, 22 nt, Homo sapiens
cugggauuacaggcaugagcca

SEQ ID NO: 718103 - RNA, 21 nt, Homo sapiens
cugggauuacaggcgugaucc

SEQ ID NO: 718104 - RNA, 15 nt, Homo sapiens
cugggauuacaggug

SEQ ID NO: 718105 - RNA, 22 nt, Homo sapiens
cugggauuacaggugugagcca

SEQ ID NO: 718106 - RNA, 23 nt, Homo sapiens
cugggauuaccggcgugagccac

SEQ ID NO: 718107 - RNA, 22 nt, Homo sapiens
cugggauuacuggcaugagcca

SEQ ID NO: 718108 - RNA, 19 nt, Homo sapiens
cugggcaacacagcgagac

SEQ ID NO: 718109 - RNA, 20 nt, Homo sapiens
cugggcaagagaugggacaa

SEQ ID NO: 718110 - RNA, 14 nt, Homo sapiens
cugggcaccaccuc

SEQ ID NO: 718111 - RNA, 18 nt, Homo sapiens
cugggcagaaggccaaga

SEQ ID NO: 718112 - RNA, 13 nt, Homo sapiens
cugggcauugcuu

SEQ ID NO: 718113 - RNA, 18 nt, Homo sapiens
cugggcauuguugagguu

SEQ ID NO: 718114 - RNA, 15 nt, Homo sapiens
cugggccacugggga

SEQ ID NO: 718115 - RNA, 15 nt, Homo sapiens
cugggccaggucucc

SEQ ID NO: 718116 - RNA, 10 nt, Homo sapiens
cugggccaug

SEQ ID NO: 718117 - RNA, 14 nt, Homo sapiens
cugggccauugugg

SEQ ID NO: 718118 - RNA, 16 nt, Homo sapiens
cugggccccaccaccu

SEQ ID NO: 718119 - RNA, 20 nt, Homo sapiens
cugggccuggagggggagca

SEQ ID NO: 718120 - RNA, 16 nt, Homo sapiens
cugggccugugcagca

SEQ ID NO: 718121 - RNA, 13 nt, Homo sapiens
cugggcucacuca

SEQ ID NO: 718122 - RNA, 15 nt, Homo sapiens
cugggcucacugugc

SEQ ID NO: 718123 - RNA, 17 nt, Homo sapiens
cugggcugaccccggug

SEQ ID NO: 718124 - RNA, 17 nt, Homo sapiens
cugggcuggacuggcca

SEQ ID NO: 718125 - RNA, 17 nt, Homo sapiens
cugggcugggaaaaacu

SEQ ID NO: 718126 - RNA, 20 nt, Homo sapiens
cuggggaaagacacugccug

SEQ ID NO: 718127 - RNA, 17 nt, Homo sapiens
cuggggaacuagaggga

SEQ ID NO: 718128 - RNA, 11 nt, Homo sapiens
cuggggaccau

SEQ ID NO: 718129 - RNA, 15 nt, Homo sapiens
cuggggaguccucau

SEQ ID NO: 718130 - RNA, 19 nt, Homo sapiens
cuggggaugucucucauga

SEQ ID NO: 718131 - RNA, 21 nt, Homo sapiens
cuggggaugucucucaugacc

SEQ ID NO: 718132 - RNA, 15 nt, Homo sapiens
cuggggccuccagaa

SEQ ID NO: 718133 - RNA, 22 nt, Homo sapiens
cuggggcuccgaaauuccaagg

SEQ ID NO: 718134 - RNA, 13 nt, Homo sapiens
cugggggccaagg

SEQ ID NO: 718135 - RNA, 19 nt, Homo sapiens
cuggggggacccagugcag

SEQ ID NO: 718136 - RNA, 23 nt, Homo sapiens
cuggggguccucucugagucaaa

SEQ ID NO: 718137 - RNA, 22 nt, Homo sapiens
cuggggguuggcccucacugca

SEQ ID NO: 718138 - RNA, 21 nt, Homo sapiens
cugggguuggacuguaaggga

SEQ ID NO: 718139 - RNA, 18 nt, Homo sapiens
cugggguuuacugaggug

SEQ ID NO: 718140 - RNA, 14 nt, Homo sapiens
cuggguccuccaaa

SEQ ID NO: 718141 - RNA, 20 nt, Homo sapiens
cugggucuaccacucagaga

SEQ ID NO: 718142 - RNA, 21 nt, Homo sapiens
cugggucucgcuuuguugccc

SEQ ID NO: 718143 - RNA, 11 nt, Homo sapiens
cugggugaccc

SEQ ID NO: 718144 - RNA, 22 nt, Homo sapiens
cugggugggugggguacaggca

SEQ ID NO: 718145 - RNA, 20 nt, Homo sapiens
cuggguucccuuuccuucca

SEQ ID NO: 718146 - RNA, 15 nt, Homo sapiens
cuggguucuuuggaa

SEQ ID NO: 718147 - RNA, 15 nt, Homo sapiens
cugguaaaaagaucc

SEQ ID NO: 718148 - RNA, 15 nt, Homo sapiens
cugguauauaaucca

SEQ ID NO: 718149 - RNA, 20 nt, Homo sapiens
cugguauauguaaguguuca

SEQ ID NO: 718150 - RNA, 19 nt, Homo sapiens
cugguauuuuaucuuugau

SEQ ID NO: 718151 - RNA, 15 nt, Homo sapiens
cuggucagaugauau

SEQ ID NO: 718152 - RNA, 16 nt, Homo sapiens
cuggucagcauguacu

SEQ ID NO: 718153 - RNA, 19 nt, Homo sapiens
cugguccccuccucaguga

SEQ ID NO: 718154 - RNA, 23 nt, Homo sapiens
cugguccccuccucagugacauc

SEQ ID NO: 718155 - RNA, 19 nt, Homo sapiens
cuggucccuucaguaucuu

SEQ ID NO: 718156 - RNA, 13 nt, Homo sapiens
cuggucuccuugc

SEQ ID NO: 718157 - RNA, 18 nt, Homo sapiens
cuggugaauaacuaugcc

SEQ ID NO: 718158 - RNA, 15 nt, Homo sapiens
cuggugacaccagcc

SEQ ID NO: 718159 - RNA, 15 nt, Homo sapiens
cuggugcaaguugag

SEQ ID NO: 718160 - RNA, 20 nt, Homo sapiens
cuggugcagaugguugacau

SEQ ID NO: 718161 - RNA, 14 nt, Homo sapiens
cuggugcauugcug

SEQ ID NO: 718162 - RNA, 20 nt, Homo sapiens
cugguggagaaagcacugac

SEQ ID NO: 718163 - RNA, 14 nt, Homo sapiens
cugguggucaggga

SEQ ID NO: 718164 - RNA, 18 nt, Homo sapiens
cuggugguggcaccaucu

SEQ ID NO: 718165 - RNA, 19 nt, Homo sapiens
cuggugucggcaucauacu

SEQ ID NO: 718166 - RNA, 17 nt, Homo sapiens
cugguuagguagaggga

SEQ ID NO: 718167 - RNA, 19 nt, Homo sapiens
cugguuagguccaccugcu

SEQ ID NO: 718168 - RNA, 20 nt, Homo sapiens
cugguucccaccauucccug

SEQ ID NO: 718169 - RNA, 21 nt, Homo sapiens
cugguuccgccaggcgcugca

SEQ ID NO: 718170 - RNA, 14 nt, Homo sapiens
cugguuccuuucau

SEQ ID NO: 718171 - RNA, 17 nt, Homo sapiens
cugguugaaaaauggca

SEQ ID NO: 718172 - RNA, 21 nt, Homo sapiens
cugguugcuguagaaacacau

SEQ ID NO: 718173 - RNA, 21 nt, Homo sapiens
acucuagccugggccagagaa

SEQ ID NO: 718174 - RNA, 15 nt, Homo sapiens
acucuaggguccagu

SEQ ID NO: 718175 - RNA, 16 nt, Homo sapiens
ucaaaauccaaaaaga

SEQ ID NO: 718176 - RNA, 24 nt, Homo sapiens
ucaaaaugucuaagauaguaacaa

SEQ ID NO: 718177 - RNA, 19 nt, Homo sapiens
ucaaacaaccgguaaccaa

SEQ ID NO: 718178 - RNA, 19 nt, Homo sapiens
ucaaacacaguuacacuug

SEQ ID NO: 718179 - RNA, 14 nt, Homo sapiens
ucaaacauuucaaa

SEQ ID NO: 718180 - RNA, 22 nt, Homo sapiens
ucaaacucaccuugucucauga

SEQ ID NO: 718181 - RNA, 17 nt, Homo sapiens
ucaaagacuguauuuag

SEQ ID NO: 718182 - RNA, 16 nt, Homo sapiens
ucaaagacugugaaca

SEQ ID NO: 718183 - RNA, 13 nt, Homo sapiens
ucaaagacuucca

SEQ ID NO: 718184 - RNA, 18 nt, Homo sapiens
ucaaagagcaauauucca

SEQ ID NO: 718185 - RNA, 15 nt, Homo sapiens
ucaaagaggugaaca

SEQ ID NO: 718186 - RNA, 23 nt, Homo sapiens
ucaaagauguguugcuauccuga

SEQ ID NO: 718187 - RNA, 22 nt, Homo sapiens
ucaaagauuaggugagguuuau

SEQ ID NO: 718188 - RNA, 13 nt, Homo sapiens
ucaaagauucaaa

SEQ ID NO: 718189 - RNA, 15 nt, Homo sapiens
ucaaagcaagucaac

SEQ ID NO: 718190 - RNA, 15 nt, Homo sapiens
ucaaagcacacguca

SEQ ID NO: 718191 - RNA, 12 nt, Homo sapiens
ucaaagcaguag

SEQ ID NO: 718192 - RNA, 16 nt, Homo sapiens
ucaaaggaagacuuga

SEQ ID NO: 718193 - RNA, 15 nt, Homo sapiens
ucaaaguaaaacuug

SEQ ID NO: 718194 - RNA, 21 nt, Homo sapiens
cauauaggccagaguugcaaa

SEQ ID NO: 718195 - RNA, 21 nt, Homo sapiens
cauauauauauagcagcuuua

SEQ ID NO: 718196 - RNA, 19 nt, Homo sapiens
cauauauauauauaacaua

SEQ ID NO: 718197 - RNA, 13 nt, Homo sapiens
cauauauaugaaa

SEQ ID NO: 718198 - RNA, 13 nt, Homo sapiens
cauauauauguau

SEQ ID NO: 718199 - RNA, 18 nt, Homo sapiens
cauauauaugucaggcaa

SEQ ID NO: 718200 - RNA, 21 nt, Homo sapiens
cauauauauuaauacugguau

SEQ ID NO: 718201 - RNA, 18 nt, Homo sapiens
cauauauauugaaaugca

SEQ ID NO: 718202 - RNA, 14 nt, Homo sapiens
cauauaucucugug

SEQ ID NO: 718203 - RNA, 14 nt, Homo sapiens
cauauauguauaau

SEQ ID NO: 718204 - RNA, 20 nt, Homo sapiens
cauaucagggguacauucua

SEQ ID NO: 718205 - RNA, 17 nt, Homo sapiens
cauaucagugaaccuuu

SEQ ID NO: 718206 - RNA, 21 nt, Homo sapiens
cauaucccuuccucucaggcu

SEQ ID NO: 718207 - RNA, 12 nt, Homo sapiens
cauauccugccu

SEQ ID NO: 718208 - RNA, 13 nt, Homo sapiens
cauauccuuucaa

SEQ ID NO: 718209 - RNA, 20 nt, Homo sapiens
cauaucuaaagcuuuggaca

SEQ ID NO: 718210 - RNA, 20 nt, Homo sapiens
cauaucuauaaaaugacaga

SEQ ID NO: 718211 - RNA, 21 nt, Homo sapiens
cauaucuggagccugaugucu

SEQ ID NO: 718212 - RNA, 14 nt, Homo sapiens
cauaucuucuauau

SEQ ID NO: 718213 - RNA, 15 nt, Homo sapiens
cauaugaacuuguca

SEQ ID NO: 718214 - RNA, 16 nt, Homo sapiens
cauaugacuugaucuu

SEQ ID NO: 718215 - RNA, 18 nt, Homo sapiens
cauaugagaauauaccuu

SEQ ID NO: 718216 - RNA, 22 nt, Homo sapiens
cauaugaggacgaggaguaaug

SEQ ID NO: 718217 - RNA, 14 nt, Homo sapiens
cauaugauucugcu

SEQ ID NO: 718218 - RNA, 20 nt, Homo sapiens
cauaugcagccaaccaagau

SEQ ID NO: 718219 - RNA, 22 nt, Homo sapiens
cauauguacuuguuugcuauga

SEQ ID NO: 718220 - RNA, 22 nt, Homo sapiens
cauauguuucugcuagcuauau

SEQ ID NO: 718221 - RNA, 23 nt, Homo sapiens
cauauguuugcuuauauguuaaa

SEQ ID NO: 718222 - RNA, 20 nt, Homo sapiens
cauauuaauauauuuccauu

SEQ ID NO: 718223 - RNA, 13 nt, Homo sapiens
cauauuaucucau

SEQ ID NO: 718224 - RNA, 23 nt, Homo sapiens
cauauucugaggaccuccaaaga

SEQ ID NO: 718225 - RNA, 17 nt, Homo sapiens
cauauugugauucugcc

SEQ ID NO: 718226 - RNA, 17 nt, Homo sapiens
cauauuuaaaacaaaga

SEQ ID NO: 718227 - RNA, 14 nt, Homo sapiens
cauauuuacugguc

SEQ ID NO: 718228 - RNA, 16 nt, Homo sapiens
cauauuucauccagga

SEQ ID NO: 718229 - RNA, 23 nt, Homo sapiens
cauauuuccuauuguucacuuua

SEQ ID NO: 718230 - RNA, 22 nt, Homo sapiens
cauauuuguuuaugguaaaaaa

SEQ ID NO: 718231 - RNA, 21 nt, Homo sapiens
cauauuuucuguccagucaau

SEQ ID NO: 718232 - RNA, 23 nt, Homo sapiens
cauauuuugguuuguguauccau

SEQ ID NO: 718233 - RNA, 19 nt, Homo sapiens
cauauuuuucacauaucua

SEQ ID NO: 718234 - RNA, 19 nt, Homo sapiens
cauauuuuuuuuacuguca

SEQ ID NO: 718235 - RNA, 16 nt, Homo sapiens
caucaaaaacaucacu

SEQ ID NO: 718236 - RNA, 14 nt, Homo sapiens
caucaaaaagaaca

SEQ ID NO: 718237 - RNA, 17 nt, Homo sapiens
caucaaaagcaccagca

SEQ ID NO: 718238 - RNA, 15 nt, Homo sapiens
caucaaacauuugcc

SEQ ID NO: 718239 - RNA, 15 nt, Homo sapiens
caucaaaccucacau

SEQ ID NO: 718240 - RNA, 12 nt, Homo sapiens
caucaaagccuu

SEQ ID NO: 718241 - RNA, 17 nt, Homo sapiens
caucaaagugguaaaua

SEQ ID NO: 718242 - RNA, 16 nt, Homo sapiens
cuaugagcacauagga

SEQ ID NO: 718243 - RNA, 15 nt, Homo sapiens
cuaugcaaaugccuc

SEQ ID NO: 718244 - RNA, 19 nt, Homo sapiens
cuaugcaacagcucucacc

SEQ ID NO: 718245 - RNA, 11 nt, Homo sapiens
cuaugcaaggg

SEQ ID NO: 718246 - RNA, 15 nt, Homo sapiens
cuaugcaauucuuaa

SEQ ID NO: 718247 - RNA, 23 nt, Homo sapiens
cuaugcacauauggacucugcac

SEQ ID NO: 718248 - RNA, 15 nt, Homo sapiens
cuaugccagugcuca

SEQ ID NO: 718249 - RNA, 11 nt, Homo sapiens
cuaugccuuua

SEQ ID NO: 718250 - RNA, 15 nt, Homo sapiens
cuaugcugaguauuu

SEQ ID NO: 718251 - RNA, 14 nt, Homo sapiens
cuaugcugugcucc

SEQ ID NO: 718252 - RNA, 22 nt, Homo sapiens
cuauggaaacuuuuguacuugu

SEQ ID NO: 718253 - RNA, 22 nt, Homo sapiens
cuauggacagcuuuucccaaga

SEQ ID NO: 718254 - RNA, 15 nt, Homo sapiens
cuauguacuguaaua

SEQ ID NO: 718255 - RNA, 16 nt, Homo sapiens
cuauguauucaaguaa

SEQ ID NO: 718256 - RNA, 22 nt, Homo sapiens
cuaugucaguacuauucaggua

SEQ ID NO: 718257 - RNA, 16 nt, Homo sapiens
cuauguccauucucau

SEQ ID NO: 718258 - RNA, 22 nt, Homo sapiens
cuaugucuuguuuuaaguugcu

SEQ ID NO: 718259 - RNA, 13 nt, Homo sapiens
cuaugugauuaca

SEQ ID NO: 718260 - RNA, 12 nt, Homo sapiens
cuauguguacag

SEQ ID NO: 718261 - RNA, 18 nt, Homo sapiens
cuauguuuggaguuuaau

SEQ ID NO: 718262 - RNA, 19 nt, Homo sapiens
cuauguuugugugauuucc

SEQ ID NO: 718263 - RNA, 20 nt, Homo sapiens
cuauuaaaacagccaaaacu

SEQ ID NO: 718264 - RNA, 14 nt, Homo sapiens
cuauuaccaugaga

SEQ ID NO: 718265 - RNA, 23 nt, Homo sapiens
cuauuauuuggagccugccaaga

SEQ ID NO: 718266 - RNA, 17 nt, Homo sapiens
cuauucaaacagucuca

SEQ ID NO: 718267 - RNA, 15 nt, Homo sapiens
cuauucacuugcuga

SEQ ID NO: 718268 - RNA, 16 nt, Homo sapiens
cuauucagacaagcaa

SEQ ID NO: 718269 - RNA, 18 nt, Homo sapiens
cuauucaggagaguagaa

SEQ ID NO: 718270 - RNA, 20 nt, Homo sapiens
cuauucccucucucucccag

SEQ ID NO: 718271 - RNA, 13 nt, Homo sapiens
cuauucuauccau

SEQ ID NO: 718272 - RNA, 21 nt, Homo sapiens
cuauugaaaacagugucuuga

SEQ ID NO: 718273 - RNA, 17 nt, Homo sapiens
cuauugaguggcagugu

SEQ ID NO: 718274 - RNA, 21 nt, Homo sapiens
cuauugauguacagucuguca

SEQ ID NO: 718275 - RNA, 22 nt, Homo sapiens
cuauugcagagacucauuucac

SEQ ID NO: 718276 - RNA, 11 nt, Homo sapiens
cuauugcugag

SEQ ID NO: 718277 - RNA, 12 nt, Homo sapiens
cuauuggucucc

SEQ ID NO: 718278 - RNA, 13 nt, Homo sapiens
cuauugucaguca

SEQ ID NO: 718279 - RNA, 15 nt, Homo sapiens
cuauugucuguaaua

SEQ ID NO: 718280 - RNA, 16 nt, Homo sapiens
cuauuguucacuuuau

SEQ ID NO: 718281 - RNA, 21 nt, Homo sapiens
cuauuuaaaggaaaaucacau

SEQ ID NO: 718282 - RNA, 15 nt, Homo sapiens
cuauuuaacaacugg

SEQ ID NO: 718283 - RNA, 16 nt, Homo sapiens
cuauuuaaugcuucca

SEQ ID NO: 718284 - RNA, 14 nt, Homo sapiens
cuauuuaucuguag

SEQ ID NO: 718285 - RNA, 18 nt, Homo sapiens
cuauuuccaaaagcacau

SEQ ID NO: 718286 - RNA, 13 nt, Homo sapiens
cuauuugaagcau

SEQ ID NO: 718287 - RNA, 18 nt, Homo sapiens
cuauuugcuuuaaugaga

SEQ ID NO: 718288 - RNA, 15 nt, Homo sapiens
cuauuuguacaauuu

SEQ ID NO: 718289 - RNA, 14 nt, Homo sapiens
cuauuugucaugua

SEQ ID NO: 718290 - RNA, 14 nt, Homo sapiens
cuauuuucagagca

SEQ ID NO: 718291 - RNA, 19 nt, Homo sapiens
cuauuuuuuuuuguuguuu

SEQ ID NO: 718292 - RNA, 17 nt, Homo sapiens
cucaaaaacaaagagua

SEQ ID NO: 718293 - RNA, 23 nt, Homo sapiens
cucaaaaauccuuaugcaugaaa

SEQ ID NO: 718294 - RNA, 16 nt, Homo sapiens
cucaaaacugcacugu

SEQ ID NO: 718295 - RNA, 14 nt, Homo sapiens
cucaaaacuuucaa

SEQ ID NO: 718296 - RNA, 21 nt, Homo sapiens
cucaaaagaaaaaaaaaagca

SEQ ID NO: 718297 - RNA, 18 nt, Homo sapiens
cucaaaauaccaugccau

SEQ ID NO: 718298 - RNA, 13 nt, Homo sapiens
cucaaacagucuu

SEQ ID NO: 718299 - RNA, 20 nt, Homo sapiens
cucaaacuccugaccucagg

SEQ ID NO: 718300 - RNA, 11 nt, Homo sapiens
cucaaacugcc

SEQ ID NO: 718301 - RNA, 14 nt, Homo sapiens
cucaaagaaagugu

SEQ ID NO: 718302 - RNA, 23 nt, Homo sapiens
cucaaagaagucggaaugucaua

SEQ ID NO: 718303 - RNA, 18 nt, Homo sapiens
cucaaagugacuauucag

SEQ ID NO: 718304 - RNA, 20 nt, Homo sapiens
cucaaaugaauuugcuaaau

SEQ ID NO: 718305 - RNA, 13 nt, Homo sapiens
cucaaaugcacau

SEQ ID NO: 718306 - RNA, 18 nt, Homo sapiens
cucaaaugcacaucucau

SEQ ID NO: 718307 - RNA, 23 nt, Homo sapiens
cucaacaaugguugaaugaauaa

SEQ ID NO: 718308 - RNA, 15 nt, Homo sapiens
cucaacacuauugua

SEQ ID NO: 718309 - RNA, 20 nt, Homo sapiens
cucaacauugcauggugcua

SEQ ID NO: 718310 - RNA, 13 nt, Homo sapiens
cucaacauugugu

SEQ ID NO: 718311 - RNA, 20 nt, Homo sapiens
cucaaccugggucaaagugg

SEQ ID NO: 718312 - RNA, 15 nt, Homo sapiens
cucaacucacagcuu

SEQ ID NO: 718313 - RNA, 14 nt, Homo sapiens
cucaacuccaggau

SEQ ID NO: 718314 - RNA, 21 nt, Homo sapiens
cucaagaacaaacacugcagu

SEQ ID NO: 718315 - RNA, 16 nt, Homo sapiens
cucaagaagugaagaa

SEQ ID NO: 718316 - RNA, 15 nt, Homo sapiens
cucaagaaucuagaa

SEQ ID NO: 718317 - RNA, 17 nt, Homo sapiens
uggugccaaacaaaaag

SEQ ID NO: 718318 - RNA, 14 nt, Homo sapiens
uggugcccaccugu

SEQ ID NO: 718319 - RNA, 14 nt, Homo sapiens
ugguggaccacagg

SEQ ID NO: 718320 - RNA, 13 nt, Homo sapiens
ugguggagccagg

SEQ ID NO: 718321 - RNA, 20 nt, Homo sapiens
ugguggcaacauucauugcc

SEQ ID NO: 718322 - RNA, 19 nt, Homo sapiens
ugguggcagauuuuacaaa

SEQ ID NO: 718323 - RNA, 17 nt, Homo sapiens
ugguggcauuguuuaca

SEQ ID NO: 718324 - RNA, 14 nt, Homo sapiens
ugguggccugggau

SEQ ID NO: 718325 - RNA, 19 nt, Homo sapiens
ugguggcgggcgccuguag

SEQ ID NO: 718326 - RNA, 20 nt, Homo sapiens
ugguggggugugcaugccac

SEQ ID NO: 718327 - RNA, 20 nt, Homo sapiens
ugguggguacaaaaagucaa

SEQ ID NO: 718328 - RNA, 14 nt, Homo sapiens
ugguggucagggag

SEQ ID NO: 718329 - RNA, 22 nt, Homo sapiens
ugguguaaagccaacacccugu

SEQ ID NO: 718330 - RNA, 20 nt, Homo sapiens
ucuguucacagucucuggaa

SEQ ID NO: 718331 - RNA, 13 nt, Homo sapiens
ucuguucagauua

SEQ ID NO: 718332 - RNA, 18 nt, Homo sapiens
ucuguucugggccagguc

SEQ ID NO: 718333 - RNA, 18 nt, Homo sapiens
ucuguugaaaagcacaca

SEQ ID NO: 718334 - RNA, 13 nt, Homo sapiens
ucuguugccaguc

SEQ ID NO: 718335 - RNA, 16 nt, Homo sapiens
ucuguugugugucaug

SEQ ID NO: 718336 - RNA, 22 nt, Homo sapiens
ucuguuuauaugacauuguuaa

SEQ ID NO: 718337 - RNA, 18 nt, Homo sapiens
ucuguuucaaagcacaau

SEQ ID NO: 718338 - RNA, 19 nt, Homo sapiens
ucuguuugaucacugugaa

SEQ ID NO: 718339 - RNA, 14 nt, Homo sapiens
ucuguuuuaucuuc

SEQ ID NO: 718340 - RNA, 21 nt, Homo sapiens
ucuguuuuuucagucugugaa

SEQ ID NO: 718341 - RNA, 14 nt, Homo sapiens
ucuuaaaacaaauu

SEQ ID NO: 718342 - RNA, 18 nt, Homo sapiens
ucuuaaaaugggaucuca

SEQ ID NO: 718343 - RNA, 20 nt, Homo sapiens
ucuuaaauauguauaugaca

SEQ ID NO: 718344 - RNA, 22 nt, Homo sapiens
ucuuaacaaaccaacaucuuug

SEQ ID NO: 718345 - RNA, 22 nt, Homo sapiens
ucuuaacuuuucaccaggggug

SEQ ID NO: 718346 - RNA, 22 nt, Homo sapiens
ucuuaagauccacaaaugaagg

SEQ ID NO: 718347 - RNA, 18 nt, Homo sapiens
ucuuaauguacacauugc

SEQ ID NO: 718348 - RNA, 14 nt, Homo sapiens
ucuuacacauagca

SEQ ID NO: 718349 - RNA, 15 nt, Homo sapiens
ucuuacauuagcagu

SEQ ID NO: 718350 - RNA, 21 nt, Homo sapiens
ucuuacauuuuucagacuuca

SEQ ID NO: 718351 - RNA, 17 nt, Homo sapiens
ucuuaccugggaccuca

SEQ ID NO: 718352 - RNA, 18 nt, Homo sapiens
ucuuaccugggaccucac

SEQ ID NO: 718353 - RNA, 22 nt, Homo sapiens
ucuuacugcaggcaagugggau

SEQ ID NO: 718354 - RNA, 14 nt, Homo sapiens
ucuuacuuaugugu

SEQ ID NO: 718355 - RNA, 16 nt, Homo sapiens
ucuuagaaguggacca

SEQ ID NO: 718356 - RNA, 19 nt, Homo sapiens
ucuuagagcaaagagccag

SEQ ID NO: 718357 - RNA, 13 nt, Homo sapiens
ucuuagauucucu

SEQ ID NO: 718358 - RNA, 15 nt, Homo sapiens
ucuuagauucuuaau

SEQ ID NO: 718359 - RNA, 20 nt, Homo sapiens
ucuuagcacaccuacaccuc

SEQ ID NO: 718360 - RNA, 18 nt, Homo sapiens
ucuuagcacacucacaga

SEQ ID NO: 718361 - RNA, 16 nt, Homo sapiens
ucuuagcuuacaggaa

SEQ ID NO: 718362 - RNA, 19 nt, Homo sapiens
ucuuagugcuucagaguuu

SEQ ID NO: 718363 - RNA, 15 nt, Homo sapiens
ucuuaguguaugauu

SEQ ID NO: 718364 - RNA, 15 nt, Homo sapiens
ucuuagugucacuua

SEQ ID NO: 718365 - RNA, 20 nt, Homo sapiens
ucuuagugugccaagaguuc

SEQ ID NO: 718366 - RNA, 12 nt, Homo sapiens
ucuuaguuauug

SEQ ID NO: 718367 - RNA, 14 nt, Homo sapiens
ucuuaguuugcagu

SEQ ID NO: 718368 - RNA, 11 nt, Homo sapiens
ucuuaucauuu

SEQ ID NO: 718369 - RNA, 20 nt, Homo sapiens
ucuuaucuuugcucccugca

SEQ ID NO: 718370 - RNA, 17 nt, Homo sapiens
ucuuaugauuacuauca

SEQ ID NO: 718371 - RNA, 17 nt, Homo sapiens
ucuuaugcaaucuaugu

SEQ ID NO: 718372 - RNA, 23 nt, Homo sapiens
ucuuauucuggcggcagcgccuu

SEQ ID NO: 718373 - RNA, 23 nt, Homo sapiens
ucuuauuuaaugaaagacuguac

SEQ ID NO: 718374 - RNA, 20 nt, Homo sapiens
ucuuauuuuagacaaccaua

SEQ ID NO: 718375 - RNA, 15 nt, Homo sapiens
ucuuauuuugcauuc

SEQ ID NO: 718376 - RNA, 18 nt, Homo sapiens
ucuuauuuugcauuccag

SEQ ID NO: 718377 - RNA, 15 nt, Homo sapiens
ucuucaaaugucuaa

SEQ ID NO: 718378 - RNA, 18 nt, Homo sapiens
ucuucaagacgacagcuc

SEQ ID NO: 718379 - RNA, 18 nt, Homo sapiens
ucuucaaggagaaugaau

SEQ ID NO: 718380 - RNA, 13 nt, Homo sapiens
ucuucacaacaga

SEQ ID NO: 718381 - RNA, 18 nt, Homo sapiens
ucuucacaacagauuauu

SEQ ID NO: 718382 - RNA, 21 nt, Homo sapiens
ucuucaccccuacacugugaa

SEQ ID NO: 718383 - RNA, 22 nt, Homo sapiens
ucuucaccccuacacugugaag

SEQ ID NO: 718384 - RNA, 12 nt, Homo sapiens
ucuucacucuga

SEQ ID NO: 718385 - RNA, 18 nt, Homo sapiens
ucuucacuucuaaaugca

SEQ ID NO: 718386 - RNA, 22 nt, Homo sapiens
ucuucacuucuaaaugcauauc

SEQ ID NO: 718387 - RNA, 21 nt, Homo sapiens
ucuucagagagcuaaauuaca

SEQ ID NO: 718388 - RNA, 17 nt, Homo sapiens
ucuucagaggagaaaga

SEQ ID NO: 718389 - RNA, 15 nt, Homo sapiens
ucuucagaugccacu

SEQ ID NO: 718390 - RNA, 13 nt, Homo sapiens
ucuucagccauag

SEQ ID NO: 718391 - RNA, 15 nt, Homo sapiens
ucuucagucucuaua

SEQ ID NO: 718392 - RNA, 19 nt, Homo sapiens
ucuucaguguaaugugacu

SEQ ID NO: 718393 - RNA, 12 nt, Homo sapiens
ucuucaucccau

SEQ ID NO: 718394 - RNA, 18 nt, Homo sapiens
ucuucaucccauuccagg

SEQ ID NO: 718395 - RNA, 14 nt, Homo sapiens
ucuucaugcuugac

SEQ ID NO: 718396 - RNA, 17 nt, Homo sapiens
ucuucaugguguccauu

SEQ ID NO: 718397 - RNA, 15 nt, Homo sapiens
ucuucauuaccucag

SEQ ID NO: 718398 - RNA, 22 nt, Homo sapiens
ucuucauuuauuuugacuguga

SEQ ID NO: 718399 - RNA, 21 nt, Homo sapiens
ucuuccaacguggcccagaga

SEQ ID NO: 718400 - RNA, 22 nt, Homo sapiens
ucuuccacccauucccccaugu

SEQ ID NO: 718401 - RNA, 16 nt, Homo sapiens
ucuucccaaacccagu

SEQ ID NO: 718402 - RNA, 14 nt, Homo sapiens
ucuucccccaaagc

SEQ ID NO: 718403 - RNA, 13 nt, Homo sapiens
ucuucccuaccuc

SEQ ID NO: 718404 - RNA, 15 nt, Homo sapiens
ucuucccuaccucag

SEQ ID NO: 718405 - RNA, 16 nt, Homo sapiens
ucuucccuuaccucaa

SEQ ID NO: 718406 - RNA, 23 nt, Homo sapiens
ucuucccuuuuacauacugcugu

SEQ ID NO: 718407 - RNA, 19 nt, Homo sapiens
ucuuccuccucgcugccag

SEQ ID NO: 718408 - RNA, 23 nt, Homo sapiens
ucuuccugacauuugucagugau

SEQ ID NO: 718409 - RNA, 17 nt, Homo sapiens
ucuuccuguguaccucu

SEQ ID NO: 718410 - RNA, 16 nt, Homo sapiens
ucuuccuuagacuuac

SEQ ID NO: 718411 - RNA, 14 nt, Homo sapiens
ucuucgcugugaug

SEQ ID NO: 718412 - RNA, 14 nt, Homo sapiens
ucuucuaagcaaaa

SEQ ID NO: 718413 - RNA, 14 nt, Homo sapiens
ucuucuacuuuaag

SEQ ID NO: 718414 - RNA, 20 nt, Homo sapiens
ucuucuacuuuuaacuaaua

SEQ ID NO: 718415 - RNA, 21 nt, Homo sapiens
ucuucuaguuuugacauuuua

SEQ ID NO: 718416 - RNA, 22 nt, Homo sapiens
ucuucuauggguuggacaaccu

SEQ ID NO: 718417 - RNA, 16 nt, Homo sapiens
ucuucucaaguucuaa

SEQ ID NO: 718418 - RNA, 13 nt, Homo sapiens
ucuucuccacugg

SEQ ID NO: 718419 - RNA, 21 nt, Homo sapiens
ucuucugcaagccucaugcca

SEQ ID NO: 718420 - RNA, 23 nt, Homo sapiens
ucuucugccccagcuuugcagga

SEQ ID NO: 718421 - RNA, 23 nt, Homo sapiens
ucuucugcuggcagaaagcaaau

SEQ ID NO: 718422 - RNA, 18 nt, Homo sapiens
ucuucuggugcuacucca

SEQ ID NO: 718423 - RNA, 18 nt, Homo sapiens
ucuucuuagcugucaccu

SEQ ID NO: 718424 - RNA, 14 nt, Homo sapiens
ucuucuucauugaa

SEQ ID NO: 718425 - RNA, 21 nt, Homo sapiens
ucuucuuggggcccagugcau

SEQ ID NO: 718426 - RNA, 14 nt, Homo sapiens
ucuucuuugcugca

SEQ ID NO: 718427 - RNA, 22 nt, Homo sapiens
ucuucuuuuggcuuccaugaug

SEQ ID NO: 718428 - RNA, 23 nt, Homo sapiens
ucuugaaaauagaacaacuugca

SEQ ID NO: 718429 - RNA, 13 nt, Homo sapiens
ucuugaaagcugu

SEQ ID NO: 718430 - RNA, 14 nt, Homo sapiens
ucuugaaggugcug

SEQ ID NO: 718431 - RNA, 17 nt, Homo sapiens
ucuugaauagacuucca

SEQ ID NO: 718432 - RNA, 23 nt, Homo sapiens
ucuugaccuaguauaucagugac

SEQ ID NO: 718433 - RNA, 19 nt, Homo sapiens
ucuugacguuuacauauau

SEQ ID NO: 718434 - RNA, 17 nt, Homo sapiens
ucuugagagcugcugag

SEQ ID NO: 718435 - RNA, 15 nt, Homo sapiens
ucuugagcagaugau

SEQ ID NO: 718436 - RNA, 16 nt, Homo sapiens
ucuugauucagucaca

SEQ ID NO: 718437 - RNA, 18 nt, Homo sapiens
ucuugcaaagauuucuca

SEQ ID NO: 718438 - RNA, 19 nt, Homo sapiens
ucuugcaucugggccagaa

SEQ ID NO: 718439 - RNA, 16 nt, Homo sapiens
ucuugcgauccuuaau

SEQ ID NO: 718440 - RNA, 14 nt, Homo sapiens
ucuugcuaccagua

SEQ ID NO: 718441 - RNA, 15 nt, Homo sapiens
ucuugcuaccuguga

SEQ ID NO: 718442 - RNA, 13 nt, Homo sapiens
ucuuggacacugu

SEQ ID NO: 718443 - RNA, 18 nt, Homo sapiens
ucuuggagaaaauaacaa

SEQ ID NO: 718444 - RNA, 15 nt, Homo sapiens
ucuuggagcugagau

SEQ ID NO: 718445 - RNA, 19 nt, Homo sapiens
ucuguaaaaaauggagcuc

SEQ ID NO: 718446 - RNA, 13 nt, Homo sapiens
ucuguaauugaau

SEQ ID NO: 718447 - RNA, 15 nt, Homo sapiens
ucuguacauacuguu

SEQ ID NO: 718448 - RNA, 19 nt, Homo sapiens
ucuguagaauuagucaucu

SEQ ID NO: 718449 - RNA, 23 nt, Homo sapiens
ucuguagacugaauucagcacca

SEQ ID NO: 718450 - RNA, 13 nt, Homo sapiens
ucuguagggauuu

SEQ ID NO: 718451 - RNA, 21 nt, Homo sapiens
ucuguauugggguacaggaau

SEQ ID NO: 718452 - RNA, 13 nt, Homo sapiens
ucugucaccaacu

SEQ ID NO: 718453 - RNA, 18 nt, Homo sapiens
ucugucacguucuccaca

SEQ ID NO: 718454 - RNA, 19 nt, Homo sapiens
ucugucaggccuucagggu

SEQ ID NO: 718455 - RNA, 12 nt, Homo sapiens
ucugucaggggu

SEQ ID NO: 718456 - RNA, 23 nt, Homo sapiens
ucuguccucuugccuuuuacuua

SEQ ID NO: 718457 - RNA, 14 nt, Homo sapiens
ucuguccucuuggc

SEQ ID NO: 718458 - RNA, 13 nt, Homo sapiens
ucugucuaccugg

SEQ ID NO: 718459 - RNA, 14 nt, Homo sapiens
ucugucuacugugg

SEQ ID NO: 718460 - RNA, 13 nt, Homo sapiens
ucugucucccuuc

SEQ ID NO: 718461 - RNA, 17 nt, Homo sapiens
ucugucuuuauaaucua

SEQ ID NO: 718462 - RNA, 19 nt, Homo sapiens
ucugugaagaaagagguua

SEQ ID NO: 718463 - RNA, 15 nt, Homo sapiens
ucugugacauacaua

SEQ ID NO: 718464 - RNA, 18 nt, Homo sapiens
ucugugacuuaucuacca

SEQ ID NO: 718465 - RNA, 15 nt, Homo sapiens
ucugugaggugcuga

SEQ ID NO: 718466 - RNA, 20 nt, Homo sapiens
ucugugauccuuggugcugu

SEQ ID NO: 718467 - RNA, 16 nt, Homo sapiens
ucugugcaggugcugc

SEQ ID NO: 718468 - RNA, 16 nt, Homo sapiens
ucugugcagucacugg

SEQ ID NO: 718469 - RNA, 19 nt, Homo sapiens
ucugugccuuggucucucc

SEQ ID NO: 718470 - RNA, 14 nt, Homo sapiens
ucuguggaugccag

SEQ ID NO: 718471 - RNA, 19 nt, Homo sapiens
ucuguggauuggccuuuaa

SEQ ID NO: 718472 - RNA, 15 nt, Homo sapiens
ucuguggcuuaccuu

SEQ ID NO: 718473 - RNA, 17 nt, Homo sapiens
ucuguggcuuaccuuga

SEQ ID NO: 718474 - RNA, 14 nt, Homo sapiens
ucugugggcacugg

SEQ ID NO: 718475 - RNA, 21 nt, Homo sapiens
ucuguggugagaaauuugccu

SEQ ID NO: 718476 - RNA, 17 nt, Homo sapiens
ucuguguaaucucugau

SEQ ID NO: 718477 - RNA, 21 nt, Homo sapiens
ucuguguagcaagcuauucaa

SEQ ID NO: 718478 - RNA, 23 nt, Homo sapiens
ucugugucaaggugaagcacaua

SEQ ID NO: 718479 - RNA, 15 nt, Homo sapiens
ucuguguuaggggua

SEQ ID NO: 718480 - RNA, 13 nt, Homo sapiens
ucuguguuuacag

SEQ ID NO: 718481 - RNA, 22 nt, Homo sapiens
ucuguguuuugaaugguguugu

SEQ ID NO: 718482 - RNA, 14 nt, Homo sapiens
ucuguuauguacua

SEQ ID NO: 718483 - RNA, 12 nt, Homo sapiens
ucugagacagaa

SEQ ID NO: 718484 - RNA, 15 nt, Homo sapiens
ucugagacauuccac

SEQ ID NO: 718485 - RNA, 22 nt, Homo sapiens
ucugagacccuuuucucaggac

SEQ ID NO: 718486 - RNA, 20 nt, Homo sapiens
ucugagacuccucauaccuc

SEQ ID NO: 718487 - RNA, 20 nt, Homo sapiens
ucugagagaccugugugaac

SEQ ID NO: 718488 - RNA, 15 nt, Homo sapiens
ucugagauugaauau

SEQ ID NO: 718489 - RNA, 13 nt, Homo sapiens
ucugagcacuguu

SEQ ID NO: 718490 - RNA, 17 nt, Homo sapiens
ucugagcuccaccucug

SEQ ID NO: 718491 - RNA, 16 nt, Homo sapiens
ucugagcucccaccuc

SEQ ID NO: 718492 - RNA, 20 nt, Homo sapiens
ucugaguaagcccucaggag

SEQ ID NO: 718493 - RNA, 18 nt, Homo sapiens
ucugaguccuuugcuaau

SEQ ID NO: 718494 - RNA, 21 nt, Homo sapiens
ucugauaaaagauggccauau

SEQ ID NO: 718495 - RNA, 15 nt, Homo sapiens
ucugauaaugcucac

SEQ ID NO: 718496 - RNA, 19 nt, Homo sapiens
ucugauaccacugcacugu

SEQ ID NO: 718497 - RNA, 13 nt, Homo sapiens
ucugauaccucaa

SEQ ID NO: 718498 - RNA, 16 nt, Homo sapiens
ucugauauaacaaacu

SEQ ID NO: 718499 - RNA, 19 nt, Homo sapiens
ucugaucauguaugcaucc

SEQ ID NO: 718500 - RNA, 13 nt, Homo sapiens
ucugaugugaugu

SEQ ID NO: 718501 - RNA, 19 nt, Homo sapiens
ucugauuaacuauuccuau

SEQ ID NO: 718502 - RNA, 22 nt, Homo sapiens
ucugauuccccuccaccaaacc

SEQ ID NO: 718503 - RNA, 16 nt, Homo sapiens
ucugauuuacauucaa

SEQ ID NO: 718504 - RNA, 18 nt, Homo sapiens
ucugcaaauaguuucaaa

SEQ ID NO: 718505 - RNA, 19 nt, Homo sapiens
ucugcaacccgguuuacca

SEQ ID NO: 718506 - RNA, 18 nt, Homo sapiens
ucugcaagggcccagagu

SEQ ID NO: 718507 - RNA, 19 nt, Homo sapiens
ucugcaccaacucaccugg

SEQ ID NO: 718508 - RNA, 20 nt, Homo sapiens
ucugcacccagaacaguggu

SEQ ID NO: 718509 - RNA, 23 nt, Homo sapiens
ucugcacuuauaagaaagaucaa

SEQ ID NO: 718510 - RNA, 15 nt, Homo sapiens
ucugcagacugcugc

SEQ ID NO: 718511 - RNA, 20 nt, Homo sapiens
ucugcagcacucuuaucuac

SEQ ID NO: 718512 - RNA, 23 nt, Homo sapiens
ucugcagcccggcgccaccaucc

SEQ ID NO: 718513 - RNA, 21 nt, Homo sapiens
ucugcagcgagccccccaugu

SEQ ID NO: 718514 - RNA, 13 nt, Homo sapiens
ucugcauggggcu

SEQ ID NO: 718515 - RNA, 16 nt, Homo sapiens
ucugcauguguaaaag

SEQ ID NO: 718516 - RNA, 21 nt, Homo sapiens
ucugcauuaucugaggucaca

SEQ ID NO: 718517 - RNA, 11 nt, Homo sapiens
ucugcauuuac

SEQ ID NO: 718518 - RNA, 13 nt, Homo sapiens
ucugccagcaucu

SEQ ID NO: 718519 - RNA, 16 nt, Homo sapiens
ucugccaggccuguau

SEQ ID NO: 718520 - RNA, 22 nt, Homo sapiens
ucucauccuccaguaccuugcu

SEQ ID NO: 718521 - RNA, 14 nt, Homo sapiens
ucucaucugugauu

SEQ ID NO: 718522 - RNA, 17 nt, Homo sapiens
ucucaugaccaaaugcu

SEQ ID NO: 718523 - RNA, 21 nt, Homo sapiens
ucucauguuuuuuccuuuuca

SEQ ID NO: 718524 - RNA, 17 nt, Homo sapiens
ucucauuacuuauacug

SEQ ID NO: 718525 - RNA, 19 nt, Homo sapiens
ucucauuuauauugcagau

SEQ ID NO: 718526 - RNA, 19 nt, Homo sapiens
ucucauuuuguccaugucc

SEQ ID NO: 718527 - RNA, 18 nt, Homo sapiens
ucuccaaccacugugcca

SEQ ID NO: 718528 - RNA, 23 nt, Homo sapiens
ucuccaaccccccagcacugagg

SEQ ID NO: 718529 - RNA, 21 nt, Homo sapiens
ucuccaagacaauaauuacau

SEQ ID NO: 718530 - RNA, 13 nt, Homo sapiens
ucuccaauacuca

SEQ ID NO: 718531 - RNA, 18 nt, Homo sapiens
ucuccaccucccccaaac

SEQ ID NO: 718532 - RNA, 18 nt, Homo sapiens
ucuccacggccugcccag

SEQ ID NO: 718533 - RNA, 20 nt, Homo sapiens
ucuccacucaguugcaacuu

SEQ ID NO: 718534 - RNA, 22 nt, Homo sapiens
ucuccagcaauaauguuuucua

SEQ ID NO: 718535 - RNA, 22 nt, Homo sapiens
ucuccagccagcaaugaugucc

SEQ ID NO: 718536 - RNA, 24 nt, Homo sapiens
ucuccagccagcaaugauguccag

SEQ ID NO: 718537 - RNA, 14 nt, Homo sapiens
ucuccaggggccug

SEQ ID NO: 718538 - RNA, 18 nt, Homo sapiens
ucuccaguugggacucag

SEQ ID NO: 718539 - RNA, 18 nt, Homo sapiens
ucuccaguuugcaccugu

SEQ ID NO: 718540 - RNA, 19 nt, Homo sapiens
ucuccaucccucuaaugag

SEQ ID NO: 718541 - RNA, 20 nt, Homo sapiens
ucuccaucccucuaaugaga

SEQ ID NO: 718542 - RNA, 22 nt, Homo sapiens
ucuccaucccugaaauuucuca

SEQ ID NO: 718543 - RNA, 15 nt, Homo sapiens
ucuccaucucaaaaa

SEQ ID NO: 718544 - RNA, 22 nt, Homo sapiens
ucuccaugaauuaguucuccua

SEQ ID NO: 718545 - RNA, 21 nt, Homo sapiens
ucucccaccuuucgggccaug

SEQ ID NO: 718546 - RNA, 15 nt, Homo sapiens
ucucccagccaaguc

SEQ ID NO: 718547 - RNA, 17 nt, Homo sapiens
ucuccccagcccagaga

SEQ ID NO: 718548 - RNA, 19 nt, Homo sapiens
ucuccccagugccugccac

SEQ ID NO: 718549 - RNA, 16 nt, Homo sapiens
ucuccccgauggggca

SEQ ID NO: 718550 - RNA, 21 nt, Homo sapiens
ucuccccucacacuuugccau

SEQ ID NO: 718551 - RNA, 16 nt, Homo sapiens
ucucccguccauucca

SEQ ID NO: 718552 - RNA, 16 nt, Homo sapiens
ucucccuccaguccuc

SEQ ID NO: 718553 - RNA, 19 nt, Homo sapiens
ucucccuccccugccauuu

SEQ ID NO: 718554 - RNA, 21 nt, Homo sapiens
ucucccucuuucucaguuccu

SEQ ID NO: 718555 - RNA, 18 nt, Homo sapiens
ucgaucuuccagaagcug

SEQ ID NO: 718556 - RNA, 17 nt, Homo sapiens
ucgcaccacugcacucc

SEQ ID NO: 718557 - RNA, 18 nt, Homo sapiens
ucgcaccacugcacucca

SEQ ID NO: 718558 - RNA, 21 nt, Homo sapiens
ucgcaccacugcacuccagcc

SEQ ID NO: 718559 - RNA, 16 nt, Homo sapiens
ucgcacucaaugccaa

SEQ ID NO: 718560 - RNA, 12 nt, Homo sapiens
ucgcagccugaa

SEQ ID NO: 718561 - RNA, 17 nt, Homo sapiens
ucgcauggcagccauca

SEQ ID NO: 718562 - RNA, 21 nt, Homo sapiens
ucgcauggcagccaucaaaga

SEQ ID NO: 718563 - RNA, 17 nt, Homo sapiens
ucgccagucacugcugc

SEQ ID NO: 718564 - RNA, 20 nt, Homo sapiens
ucgccaugaucagacauaca

SEQ ID NO: 718565 - RNA, 20 nt, Homo sapiens
ucgcccaggcuggagugcaa

SEQ ID NO: 718566 - RNA, 21 nt, Homo sapiens
ucgcccaggcuggagugcagu

SEQ ID NO: 718567 - RNA, 13 nt, Homo sapiens
ucgcccugugcac

SEQ ID NO: 718568 - RNA, 22 nt, Homo sapiens
ucgccguguuacuguugcacug

SEQ ID NO: 718569 - RNA, 21 nt, Homo sapiens
ucgccucugcuccuguggucc

SEQ ID NO: 718570 - RNA, 17 nt, Homo sapiens
ucgccugcuggggaccu

SEQ ID NO: 718571 - RNA, 19 nt, Homo sapiens
ucgccuguuggggaccuca

SEQ ID NO: 718572 - RNA, 19 nt, Homo sapiens
ucgcgucucauuuugucca

SEQ ID NO: 718573 - RNA, 22 nt, Homo sapiens
ucgcuauugauuuuuacuucaa

SEQ ID NO: 718574 - RNA, 14 nt, Homo sapiens
ucgcugccagauga

SEQ ID NO: 718575 - RNA, 22 nt, Homo sapiens
ucgcugccagaugauuguucaa

SEQ ID NO: 718576 - RNA, 19 nt, Homo sapiens
ucgcugggcucaacauaga

SEQ ID NO: 718577 - RNA, 13 nt, Homo sapiens
ucgcuucuugccu

SEQ ID NO: 718578 - RNA, 10 nt, Homo sapiens
ucgcuuuaug

SEQ ID NO: 718579 - RNA, 15 nt, Homo sapiens
ucgcuuugccuauug

SEQ ID NO: 718580 - RNA, 19 nt, Homo sapiens
ucggaccaagcagagcuca

SEQ ID NO: 718581 - RNA, 12 nt, Homo sapiens
ucggacucugcu

SEQ ID NO: 718582 - RNA, 18 nt, Homo sapiens
ucggagacagugaucucc

SEQ ID NO: 718583 - RNA, 13 nt, Homo sapiens
ucggaggacccug

SEQ ID NO: 718584 - RNA, 17 nt, Homo sapiens
ucggaugaccaaaccag

SEQ ID NO: 718585 - RNA, 14 nt, Homo sapiens
ucggccccaucucu

SEQ ID NO: 718586 - RNA, 16 nt, Homo sapiens
ucggcuccaccccagg

SEQ ID NO: 718587 - RNA, 17 nt, Homo sapiens
ucggcuucuuggaccuu

SEQ ID NO: 718588 - RNA, 16 nt, Homo sapiens
ucgggagccaugucau

SEQ ID NO: 718589 - RNA, 17 nt, Homo sapiens
ucgggaggcugaggcag

SEQ ID NO: 718590 - RNA, 22 nt, Homo sapiens
ucgggaggcugaggcggaagaa

SEQ ID NO: 718591 - RNA, 17 nt, Homo sapiens
ucgggccccauccucau

SEQ ID NO: 718592 - RNA, 18 nt, Homo sapiens
ucgggcugagaaggcagu

SEQ ID NO: 718593 - RNA, 20 nt, Homo sapiens
ucgguagaggauuucuaguu

SEQ ID NO: 718594 - RNA, 15 nt, Homo sapiens
ucggugguaccugag

SEQ ID NO: 718595 - RNA, 14 nt, Homo sapiens
ucgguguucugucc

SEQ ID NO: 718596 - RNA, 15 nt, Homo sapiens
ucgguguucuguccc

SEQ ID NO: 718597 - RNA, 13 nt, Homo sapiens
ucguagccaucuc

SEQ ID NO: 718598 - RNA, 14 nt, Homo sapiens
ucguagccaucucu

SEQ ID NO: 718599 - RNA, 18 nt, Homo sapiens
ucguaguguuaaguuaua

SEQ ID NO: 718600 - RNA, 19 nt, Homo sapiens
ucgucaagagcaugcacau

SEQ ID NO: 718601 - RNA, 18 nt, Homo sapiens
ucguccaccccagugugc

SEQ ID NO: 718602 - RNA, 22 nt, Homo sapiens
ucguccgucugucucgaugccu

SEQ ID NO: 718603 - RNA, 20 nt, Homo sapiens
ucgucuuaaguuuuuuaugc

SEQ ID NO: 718604 - RNA, 16 nt, Homo sapiens
ucgucuucagcugcau

SEQ ID NO: 718605 - RNA, 14 nt, Homo sapiens
ucgugcauuucaac

SEQ ID NO: 718606 - RNA, 17 nt, Homo sapiens
ucgugcuccccaaauca

SEQ ID NO: 718607 - RNA, 13 nt, Homo sapiens
ucguggccuuccc

SEQ ID NO: 718608 - RNA, 20 nt, Homo sapiens
ucguuagccuuccucugauu

SEQ ID NO: 718609 - RNA, 18 nt, Homo sapiens
ucguuuucauaacuugcu

SEQ ID NO: 718610 - RNA, 14 nt, Homo sapiens
ucuaaaaacuucuu

SEQ ID NO: 718611 - RNA, 13 nt, Homo sapiens
ucuaaaagcuuuc

SEQ ID NO: 718612 - RNA, 15 nt, Homo sapiens
ucuaaaauuaaggaa

SEQ ID NO: 718613 - RNA, 21 nt, Homo sapiens
ucuaaacagacucauuacaaa

SEQ ID NO: 718614 - RNA, 13 nt, Homo sapiens
ucuaaacauuuca

SEQ ID NO: 718615 - RNA, 18 nt, Homo sapiens
ucuaaaccagaggacaaa

SEQ ID NO: 718616 - RNA, 22 nt, Homo sapiens
ucuaaacuaucaauaauacaaa

SEQ ID NO: 718617 - RNA, 18 nt, Homo sapiens
ucuaaagaaaaaugccug

SEQ ID NO: 718618 - RNA, 14 nt, Homo sapiens
ucuaaagagaguga

SEQ ID NO: 718619 - RNA, 14 nt, Homo sapiens
ucuaaaggcuugau

SEQ ID NO: 718620 - RNA, 22 nt, Homo sapiens
ucuaaagguaccaaacaaggaa

SEQ ID NO: 718621 - RNA, 20 nt, Homo sapiens
ucuaaagucaucaugaacug

SEQ ID NO: 718622 - RNA, 18 nt, Homo sapiens
ucuaaaguuuugcaacaa

SEQ ID NO: 718623 - RNA, 14 nt, Homo sapiens
ucuaaauaugaagg

SEQ ID NO: 718624 - RNA, 23 nt, Homo sapiens
ucuaaaugcauauccugagccau

SEQ ID NO: 718625 - RNA, 22 nt, Homo sapiens
ucuaaauuuugucuuuaacuca

SEQ ID NO: 718626 - RNA, 16 nt, Homo sapiens
ucuaacaaaaacuaca

SEQ ID NO: 718627 - RNA, 22 nt, Homo sapiens
ucuaacaaaaccaaugugcaga

SEQ ID NO: 718628 - RNA, 13 nt, Homo sapiens
ucuaacaaacaag

SEQ ID NO: 718629 - RNA, 15 nt, Homo sapiens
ucuaacacauuucau

SEQ ID NO: 718630 - RNA, 18 nt, Homo sapiens
ucuaacagcccuccucug

SEQ ID NO: 718631 - RNA, 15 nt, Homo sapiens
ucuaaccuugaaugc

SEQ ID NO: 718632 - RNA, 18 nt, Homo sapiens
ucuaacgggcauucacaa

SEQ ID NO: 718633 - RNA, 20 nt, Homo sapiens
ucuaacucauauguucccaa

SEQ ID NO: 718634 - RNA, 16 nt, Homo sapiens
ucuaacuggacaugaa

SEQ ID NO: 718635 - RNA, 20 nt, Homo sapiens
ucuaagaaaaugaucuuaau

SEQ ID NO: 718636 - RNA, 18 nt, Homo sapiens
ucuaagaugccagcauau

SEQ ID NO: 718637 - RNA, 22 nt, Homo sapiens
ucuaagccaaaaggauuccucu

SEQ ID NO: 718638 - RNA, 15 nt, Homo sapiens
ucuaagccaacuuua

SEQ ID NO: 718639 - RNA, 20 nt, Homo sapiens
ucuaagguaguaacuuucca

SEQ ID NO: 718640 - RNA, 21 nt, Homo sapiens
ucuaagugggacauucaaaaa

SEQ ID NO: 718641 - RNA, 20 nt, Homo sapiens
ucuaaguuauuuacuuuuac

SEQ ID NO: 718642 - RNA, 14 nt, Homo sapiens
ucuaauaaacuugg

SEQ ID NO: 718643 - RNA, 19 nt, Homo sapiens
ucuaauaaauauacuauga

SEQ ID NO: 718644 - RNA, 18 nt, Homo sapiens
ucuaauccuuuuccuuau

SEQ ID NO: 718645 - RNA, 13 nt, Homo sapiens
ucuaaucucucac

SEQ ID NO: 718646 - RNA, 22 nt, Homo sapiens
ucuaaucuuuuaauguauuugu

SEQ ID NO: 718647 - RNA, 15 nt, Homo sapiens
ucuaaugaagaauuc

SEQ ID NO: 718648 - RNA, 16 nt, Homo sapiens
ucuaaugaagaauucu

SEQ ID NO: 718649 - RNA, 15 nt, Homo sapiens
ucuaaugcauguauu

SEQ ID NO: 718650 - RNA, 19 nt, Homo sapiens
ucuaaugccuuuugaauac

SEQ ID NO: 718651 - RNA, 21 nt, Homo sapiens
ucuaauuagaucaauuacuua

SEQ ID NO: 718652 - RNA, 22 nt, Homo sapiens
ucuaauuagaucaauuacuuau

SEQ ID NO: 718653 - RNA, 20 nt, Homo sapiens
ucuaauuauuuacucaaaga

SEQ ID NO: 718654 - RNA, 22 nt, Homo sapiens
ucuaauucuauuaaagugcuaa

SEQ ID NO: 718655 - RNA, 24 nt, Homo sapiens
ucuacaaaaaaccaggaugcccac

SEQ ID NO: 718656 - RNA, 14 nt, Homo sapiens
ucuacaaaaugcca

SEQ ID NO: 718657 - RNA, 20 nt, Homo sapiens
ucuacaaaaugccaagggug

SEQ ID NO: 718658 - RNA, 19 nt, Homo sapiens
ucuacaaacucccacuugu

SEQ ID NO: 718659 - RNA, 20 nt, Homo sapiens
ucuacaagauccuccugcug

SEQ ID NO: 718660 - RNA, 12 nt, Homo sapiens
ucuacacagccu

SEQ ID NO: 718661 - RNA, 19 nt, Homo sapiens
ucuacacaguaaaaacuug

SEQ ID NO: 718662 - RNA, 19 nt, Homo sapiens
ucuacagugaugauugaau

SEQ ID NO: 718663 - RNA, 16 nt, Homo sapiens
ucuacauacuauggaa

SEQ ID NO: 718664 - RNA, 19 nt, Homo sapiens
ucuacauagugacaugcac

SEQ ID NO: 718665 - RNA, 13 nt, Homo sapiens
ucuacaugugcca

SEQ ID NO: 718666 - RNA, 16 nt, Homo sapiens
ucuacauuaaaucacu

SEQ ID NO: 718667 - RNA, 21 nt, Homo sapiens
ucuacauuaaaucacuugaau

SEQ ID NO: 718668 - RNA, 14 nt, Homo sapiens
ucuacauucacuuu

SEQ ID NO: 718669 - RNA, 21 nt, Homo sapiens
ucuaccagagcgugcacuugu

SEQ ID NO: 718670 - RNA, 15 nt, Homo sapiens
ucuaccagcauaaau

SEQ ID NO: 718671 - RNA, 10 nt, Homo sapiens
ucuaccccag

SEQ ID NO: 718672 - RNA, 17 nt, Homo sapiens
ucuaccccugcuaagga

SEQ ID NO: 718673 - RNA, 15 nt, Homo sapiens
ucuacccuauacaac

SEQ ID NO: 718674 - RNA, 19 nt, Homo sapiens
ucuacccugcugaccuccc

SEQ ID NO: 718675 - RNA, 16 nt, Homo sapiens
ucuacuaccacaagga

SEQ ID NO: 718676 - RNA, 13 nt, Homo sapiens
ucuacucccaagu

SEQ ID NO: 718677 - RNA, 23 nt, Homo sapiens
ucuacucuugagagcucaggcag

SEQ ID NO: 718678 - RNA, 11 nt, Homo sapiens
ucuacugcugg

SEQ ID NO: 718679 - RNA, 21 nt, Homo sapiens
ucuacuggaaauguagcacuu

SEQ ID NO: 718680 - RNA, 12 nt, Homo sapiens
ucuacugugguc

SEQ ID NO: 718681 - RNA, 14 nt, Homo sapiens
ucuacuuugauucu

SEQ ID NO: 718682 - RNA, 15 nt, Homo sapiens
ucuagaacacaggca

SEQ ID NO: 718683 - RNA, 15 nt, Homo sapiens
ucuagaacaugcaca

SEQ ID NO: 718684 - RNA, 13 nt, Homo sapiens
ucuagaacuugac

SEQ ID NO: 718685 - RNA, 14 nt, Homo sapiens
ucuagacuagcaau

SEQ ID NO: 718686 - RNA, 19 nt, Homo sapiens
ucuagacuauuaggugcaa

SEQ ID NO: 718687 - RNA, 16 nt, Homo sapiens
ucuagacuugugcuga

SEQ ID NO: 718688 - RNA, 14 nt, Homo sapiens
ucuagagucacuga

SEQ ID NO: 718689 - RNA, 18 nt, Homo sapiens
ucuagagucuagacagac

SEQ ID NO: 718690 - RNA, 18 nt, Homo sapiens
ucuagaguucagaguccu

SEQ ID NO: 718691 - RNA, 19 nt, Homo sapiens
ucuagauuaugucuuucca

SEQ ID NO: 718692 - RNA, 12 nt, Homo sapiens
ucuagauucaaa

SEQ ID NO: 718693 - RNA, 13 nt, Homo sapiens
ucuagauucauaa

SEQ ID NO: 718694 - RNA, 18 nt, Homo sapiens
ucuagauuuucuacuuua

SEQ ID NO: 718695 - RNA, 21 nt, Homo sapiens
ucuagcaaauguuaugcauaa

SEQ ID NO: 718696 - RNA, 14 nt, Homo sapiens
ucuagcaagggagg

SEQ ID NO: 718697 - RNA, 23 nt, Homo sapiens
ucuagcauggcauauuuuucaca

SEQ ID NO: 718698 - RNA, 21 nt, Homo sapiens
ucuagccagagcccuucacug

SEQ ID NO: 718699 - RNA, 17 nt, Homo sapiens
ucuaggcuaagcacuuu

SEQ ID NO: 718700 - RNA, 23 nt, Homo sapiens
ucuagggaaauuuuucagacuuu

SEQ ID NO: 718701 - RNA, 13 nt, Homo sapiens
ucuaggguccagu

SEQ ID NO: 718702 - RNA, 10 nt, Homo sapiens
ucacuacuga

SEQ ID NO: 718703 - RNA, 12 nt, Homo sapiens
ucacuacuggug

SEQ ID NO: 718704 - RNA, 15 nt, Homo sapiens
ucacuaggaggucau

SEQ ID NO: 718705 - RNA, 13 nt, Homo sapiens
ucacuagucucac

SEQ ID NO: 718706 - RNA, 17 nt, Homo sapiens
ucacuaugacacugagc

SEQ ID NO: 718707 - RNA, 16 nt, Homo sapiens
ucacucaggacagccc

SEQ ID NO: 718708 - RNA, 23 nt, Homo sapiens
ucacucaucaauggggccaguca

SEQ ID NO: 718709 - RNA, 18 nt, Homo sapiens
ucacucauggaacacuca

SEQ ID NO: 718710 - RNA, 14 nt, Homo sapiens
ucacucccagucca

SEQ ID NO: 718711 - RNA, 18 nt, Homo sapiens
ucacuccucucuagggca

SEQ ID NO: 718712 - RNA, 19 nt, Homo sapiens
ucacucucaaacuucacua

SEQ ID NO: 718713 - RNA, 22 nt, Homo sapiens
ucacucugggcggcuccccaua

SEQ ID NO: 718714 - RNA, 18 nt, Homo sapiens
ucacugaaaccucugccu

SEQ ID NO: 718715 - RNA, 14 nt, Homo sapiens
ucacugaaccacug

SEQ ID NO: 718716 - RNA, 16 nt, Homo sapiens
ucacugaucuugucau

SEQ ID NO: 718717 - RNA, 23 nt, Homo sapiens
ucacugaugggaaaacugccaau

SEQ ID NO: 718718 - RNA, 12 nt, Homo sapiens
ucacugcaauuu

SEQ ID NO: 718719 - RNA, 16 nt, Homo sapiens
ucacugcagccuccac

SEQ ID NO: 718720 - RNA, 17 nt, Homo sapiens
ucacugcagggcacugu

SEQ ID NO: 718721 - RNA, 19 nt, Homo sapiens
ucacugcauggcuucugaa

SEQ ID NO: 718722 - RNA, 17 nt, Homo sapiens
ucacugccccucucuca

SEQ ID NO: 718723 - RNA, 14 nt, Homo sapiens
ucacugcucaagaa

SEQ ID NO: 718724 - RNA, 19 nt, Homo sapiens
ucacugcucuggacugugu

SEQ ID NO: 718725 - RNA, 20 nt, Homo sapiens
ucacugcugcaaauacugua

SEQ ID NO: 718726 - RNA, 14 nt, Homo sapiens
ucacuggacugcau

SEQ ID NO: 718727 - RNA, 21 nt, Homo sapiens
ucacuggagguugaagccaag

SEQ ID NO: 718728 - RNA, 14 nt, Homo sapiens
ucacuguacugcau

SEQ ID NO: 718729 - RNA, 15 nt, Homo sapiens
ucacugucaccaccc

SEQ ID NO: 718730 - RNA, 15 nt, Homo sapiens
ucacuuaauccuuug

SEQ ID NO: 718731 - RNA, 14 nt, Homo sapiens
ucacuuauuucaua

SEQ ID NO: 718732 - RNA, 16 nt, Homo sapiens
ucacuucacuguucuc

SEQ ID NO: 718733 - RNA, 19 nt, Homo sapiens
ucacuugaauccauugaaa

SEQ ID NO: 718734 - RNA, 16 nt, Homo sapiens
ucacuuuagaugcuga

SEQ ID NO: 718735 - RNA, 14 nt, Homo sapiens
ucacuuugccauua

SEQ ID NO: 718736 - RNA, 19 nt, Homo sapiens
ucacuuuuuacagugcuau

SEQ ID NO: 718737 - RNA, 22 nt, Homo sapiens
ucagaaaauaaaauauucacuc

SEQ ID NO: 718738 - RNA, 13 nt, Homo sapiens
ucagaaacagcuu

SEQ ID NO: 718739 - RNA, 13 nt, Homo sapiens
ucagaaaccugca

SEQ ID NO: 718740 - RNA, 16 nt, Homo sapiens
ucagaaacuccaugau

SEQ ID NO: 718741 - RNA, 12 nt, Homo sapiens
ucagaaagggau

SEQ ID NO: 718742 - RNA, 19 nt, Homo sapiens
ucagaaauucucugcgauu

SEQ ID NO: 718743 - RNA, 14 nt, Homo sapiens
ucagaacacuccaa

SEQ ID NO: 718744 - RNA, 19 nt, Homo sapiens
ucagaacauguuaagauaa

SEQ ID NO: 718745 - RNA, 15 nt, Homo sapiens
ucagaaccauccaua

SEQ ID NO: 718746 - RNA, 21 nt, Homo sapiens
ucagaaggaauaagcauuccu

SEQ ID NO: 718747 - RNA, 20 nt, Homo sapiens
ucagaaggccccagagagac

SEQ ID NO: 718748 - RNA, 20 nt, Homo sapiens
ucagaaguuaguuuguauau

SEQ ID NO: 718749 - RNA, 20 nt, Homo sapiens
ucagaauaaauuauugcugu

SEQ ID NO: 718750 - RNA, 19 nt, Homo sapiens
ucagaaucccuuaacaguu

SEQ ID NO: 718751 - RNA, 19 nt, Homo sapiens
ucagaaucuccaucccuga

SEQ ID NO: 718752 - RNA, 20 nt, Homo sapiens
ucagaauggcaguccuggag

SEQ ID NO: 718753 - RNA, 16 nt, Homo sapiens
ucagaauuaagcagaa

SEQ ID NO: 718754 - RNA, 19 nt, Homo sapiens
ucagacacccucuccuuaa

SEQ ID NO: 718755 - RNA, 20 nt, Homo sapiens
ucagacacccucuccuuaaa

SEQ ID NO: 718756 - RNA, 17 nt, Homo sapiens
ucagacaccuguucaca

SEQ ID NO: 718757 - RNA, 19 nt, Homo sapiens
ucagacauuuucacuggaa

SEQ ID NO: 718758 - RNA, 15 nt, Homo sapiens
ucagacccaacagca

SEQ ID NO: 718759 - RNA, 17 nt, Homo sapiens
ucagacgagcagugacg

SEQ ID NO: 718760 - RNA, 17 nt, Homo sapiens
ucagacucccgcgugaa

SEQ ID NO: 718761 - RNA, 17 nt, Homo sapiens
ucagacuccugugcaac

SEQ ID NO: 718762 - RNA, 21 nt, Homo sapiens
ucagacuccugugcaacuuuc

SEQ ID NO: 718763 - RNA, 15 nt, Homo sapiens
ucagacugucagaaa

SEQ ID NO: 718764 - RNA, 11 nt, Homo sapiens
ucagacuguua

SEQ ID NO: 718765 - RNA, 18 nt, Homo sapiens
ucagacuuucacaccauu

SEQ ID NO: 718766 - RNA, 21 nt, Homo sapiens
ucagacuuuguguucauuuca

SEQ ID NO: 718767 - RNA, 22 nt, Homo sapiens
ucagacuuuguguucauuucau

SEQ ID NO: 718768 - RNA, 13 nt, Homo sapiens
ucagagaccagca

SEQ ID NO: 718769 - RNA, 16 nt, Homo sapiens
ucagagauaacaucca

SEQ ID NO: 718770 - RNA, 15 nt, Homo sapiens
ucagagccagugaag

SEQ ID NO: 718771 - RNA, 20 nt, Homo sapiens
ucagagccccuacagcauug

SEQ ID NO: 718772 - RNA, 15 nt, Homo sapiens
ucagagcuaaacucc

SEQ ID NO: 718773 - RNA, 13 nt, Homo sapiens
ucagagugccacu

SEQ ID NO: 718774 - RNA, 23 nt, Homo sapiens
ucagaguguuuaauuguacucaa

SEQ ID NO: 718775 - RNA, 15 nt, Homo sapiens
ucagauacacaagga

SEQ ID NO: 718776 - RNA, 21 nt, Homo sapiens
ucagauacaugguugugaccu

SEQ ID NO: 718777 - RNA, 15 nt, Homo sapiens
ucagauccagggaca

SEQ ID NO: 718778 - RNA, 12 nt, Homo sapiens
ucagaucucaug

SEQ ID NO: 718779 - RNA, 15 nt, Homo sapiens
ucagaucucauggga

SEQ ID NO: 718780 - RNA, 16 nt, Homo sapiens
ucagaugaacucaugu

SEQ ID NO: 718781 - RNA, 17 nt, Homo sapiens
ucagaugaacucauguc

SEQ ID NO: 718782 - RNA, 23 nt, Homo sapiens
ucagaugcuugcggcaaaaggaa

SEQ ID NO: 718783 - RNA, 18 nt, Homo sapiens
ucagauggacaagauuac

SEQ ID NO: 718784 - RNA, 13 nt, Homo sapiens
ucagauguauuaa

SEQ ID NO: 718785 - RNA, 20 nt, Homo sapiens
ucagauuaagaguugccaaa

SEQ ID NO: 718786 - RNA, 15 nt, Homo sapiens
ucagauuaguauuag

SEQ ID NO: 718787 - RNA, 16 nt, Homo sapiens
ucagauucugugagac

SEQ ID NO: 718788 - RNA, 15 nt, Homo sapiens
ucagauuucauguca

SEQ ID NO: 718789 - RNA, 21 nt, Homo sapiens
ucagauuuuacugucuaugga

SEQ ID NO: 718790 - RNA, 21 nt, Homo sapiens
ucagauuuuuuccucugcauu

SEQ ID NO: 718791 - RNA, 13 nt, Homo sapiens
ucagcaaccugua

SEQ ID NO: 718792 - RNA, 20 nt, Homo sapiens
ucagcaagcccuacagagcu

SEQ ID NO: 718793 - RNA, 19 nt, Homo sapiens
ucagcacauucgggaccaa

SEQ ID NO: 718794 - RNA, 19 nt, Homo sapiens
ucccuugccucaaugccag

SEQ ID NO: 718795 - RNA, 15 nt, Homo sapiens
ucccuugcuguaugc

SEQ ID NO: 718796 - RNA, 23 nt, Homo sapiens
ucccuugcuguaugcugaucauc

SEQ ID NO: 718797 - RNA, 15 nt, Homo sapiens
ucccuugcuugccug

SEQ ID NO: 718798 - RNA, 20 nt, Homo sapiens
ucccuuggaaccuuuguacg

SEQ ID NO: 718799 - RNA, 18 nt, Homo sapiens
ucccuuggucuuccaugg

SEQ ID NO: 718800 - RNA, 15 nt, Homo sapiens
ucccuuguccugcuu

SEQ ID NO: 718801 - RNA, 16 nt, Homo sapiens
ucccuuucuuggccag

SEQ ID NO: 718802 - RNA, 14 nt, Homo sapiens
ucccuuugauucuc

SEQ ID NO: 718803 - RNA, 16 nt, Homo sapiens
ucccuuuggagaugcu

SEQ ID NO: 718804 - RNA, 18 nt, Homo sapiens
ucccuuuggagaugcuga

SEQ ID NO: 718805 - RNA, 23 nt, Homo sapiens
ucccuuuggagauuuuuuaaucc

SEQ ID NO: 718806 - RNA, 17 nt, Homo sapiens
ucccuuuuuauauccca

SEQ ID NO: 718807 - RNA, 19 nt, Homo sapiens
ucccuuuuucuccacacuc

SEQ ID NO: 718808 - RNA, 13 nt, Homo sapiens
uccgagcauucca

SEQ ID NO: 718809 - RNA, 17 nt, Homo sapiens
uccgaugaguaaaaagu

SEQ ID NO: 718810 - RNA, 20 nt, Homo sapiens
uccgaugcugaggccaccca

SEQ ID NO: 718811 - RNA, 17 nt, Homo sapiens
uccgaugguaucugggu

SEQ ID NO: 718812 - RNA, 12 nt, Homo sapiens
uccgauguuugu

SEQ ID NO: 718813 - RNA, 15 nt, Homo sapiens
uccgccauucucaag

SEQ ID NO: 718814 - RNA, 20 nt, Homo sapiens
uccgcccccggauuugcuca

SEQ ID NO: 718815 - RNA, 13 nt, Homo sapiens
uccgccuaccuca

SEQ ID NO: 718816 - RNA, 20 nt, Homo sapiens
uccgcgccuugccuccucac

SEQ ID NO: 718817 - RNA, 15 nt, Homo sapiens
uccgcuacuacauca

SEQ ID NO: 718818 - RNA, 17 nt, Homo sapiens
uccggccucugccuuug

SEQ ID NO: 718819 - RNA, 23 nt, Homo sapiens
uccggcgggugacagcuccggga

SEQ ID NO: 718820 - RNA, 22 nt, Homo sapiens
uccgggaagugagggcucacuc

SEQ ID NO: 718821 - RNA, 13 nt, Homo sapiens
uccgggcucagaa

SEQ ID NO: 718822 - RNA, 12 nt, Homo sapiens
uccguacauuca

SEQ ID NO: 718823 - RNA, 13 nt, Homo sapiens
ucaauuacaaagc

SEQ ID NO: 718824 - RNA, 16 nt, Homo sapiens
ucaauuacaacaguga

SEQ ID NO: 718825 - RNA, 19 nt, Homo sapiens
ucaauuacuugaaguugcu

SEQ ID NO: 718826 - RNA, 15 nt, Homo sapiens
ucaauuccugugauu

SEQ ID NO: 718827 - RNA, 13 nt, Homo sapiens
ucaauucuaguca

SEQ ID NO: 718828 - RNA, 19 nt, Homo sapiens
ucaauucucaauauauuca

SEQ ID NO: 718829 - RNA, 22 nt, Homo sapiens
ucaauucuuuguauaugcauuc

SEQ ID NO: 718830 - RNA, 22 nt, Homo sapiens
ucaauuucuggaaaacugccuu

SEQ ID NO: 718831 - RNA, 20 nt, Homo sapiens
ucaauuuugucuguacucau

SEQ ID NO: 718832 - RNA, 16 nt, Homo sapiens
ucacaaaccaugcaaa

SEQ ID NO: 718833 - RNA, 22 nt, Homo sapiens
ucacaaaggcagagagucagac

SEQ ID NO: 718834 - RNA, 10 nt, Homo sapiens
ucacaaagug

SEQ ID NO: 718835 - RNA, 17 nt, Homo sapiens
ucacaaauaaaagccaa

SEQ ID NO: 718836 - RNA, 23 nt, Homo sapiens
ucacaaaucuuaacuugaaggag

SEQ ID NO: 718837 - RNA, 19 nt, Homo sapiens
ucacaaaugucauugucua

SEQ ID NO: 718838 - RNA, 23 nt, Homo sapiens
ucacaacagauuauuaccuuaca

SEQ ID NO: 718839 - RNA, 17 nt, Homo sapiens
ucacaacauuuacuuaa

SEQ ID NO: 718840 - RNA, 20 nt, Homo sapiens
ucacaacauuuacuuaacag

SEQ ID NO: 718841 - RNA, 19 nt, Homo sapiens
ucacaaccacucauucaaa

SEQ ID NO: 718842 - RNA, 19 nt, Homo sapiens
ucacaagcaugaagugcug

SEQ ID NO: 718843 - RNA, 13 nt, Homo sapiens
ucacaaggucaag

SEQ ID NO: 718844 - RNA, 23 nt, Homo sapiens
ucacaagugguguuuauugcaau

SEQ ID NO: 718845 - RNA, 16 nt, Homo sapiens
ucacaauuccauuucc

SEQ ID NO: 718846 - RNA, 21 nt, Homo sapiens
ucacaauuccauuuccaguuc

SEQ ID NO: 718847 - RNA, 15 nt, Homo sapiens
ucacacaacacugau

SEQ ID NO: 718848 - RNA, 11 nt, Homo sapiens
ucacacacagg

SEQ ID NO: 718849 - RNA, 14 nt, Homo sapiens
ucacacacauggaa

SEQ ID NO: 718850 - RNA, 21 nt, Homo sapiens
ucacacacauggaaggugaug

SEQ ID NO: 718851 - RNA, 16 nt, Homo sapiens
ucacaccccauucuca

SEQ ID NO: 718852 - RNA, 19 nt, Homo sapiens
ucacaccgcgucuggugac

SEQ ID NO: 718853 - RNA, 19 nt, Homo sapiens
ucacacguuuaaucccagc

SEQ ID NO: 718854 - RNA, 22 nt, Homo sapiens
ucacacuccccuagggggagaa

SEQ ID NO: 718855 - RNA, 18 nt, Homo sapiens
ucacacugugcucagauu

SEQ ID NO: 718856 - RNA, 19 nt, Homo sapiens
ucacacuuccaccagccug

SEQ ID NO: 718857 - RNA, 19 nt, Homo sapiens
ucacagaauuuaagcaaga

SEQ ID NO: 718858 - RNA, 16 nt, Homo sapiens
ucacagagaagcuccu

SEQ ID NO: 718859 - RNA, 16 nt, Homo sapiens
ucacagagugagacuc

SEQ ID NO: 718860 - RNA, 18 nt, Homo sapiens
ucacagagugcauuguga

SEQ ID NO: 718861 - RNA, 20 nt, Homo sapiens
ucacagcaagucacuggcca

SEQ ID NO: 718862 - RNA, 18 nt, Homo sapiens
ucacagcccucaugauca

SEQ ID NO: 718863 - RNA, 18 nt, Homo sapiens
ucacagcuguaauaacaa

SEQ ID NO: 718864 - RNA, 18 nt, Homo sapiens
ucacagcuucagccagga

SEQ ID NO: 718865 - RNA, 14 nt, Homo sapiens
ucacaggacauuaa

SEQ ID NO: 718866 - RNA, 15 nt, Homo sapiens
ucacaggcaucagga

SEQ ID NO: 718867 - RNA, 20 nt, Homo sapiens
ucacagggccccagaaggca

SEQ ID NO: 718868 - RNA, 14 nt, Homo sapiens
ucacaguaaugugu

SEQ ID NO: 718869 - RNA, 23 nt, Homo sapiens
ucacaguaugagaagaaaaaugg

SEQ ID NO: 718870 - RNA, 18 nt, Homo sapiens
ucacagugaagugccuuu

SEQ ID NO: 718871 - RNA, 21 nt, Homo sapiens
ucacauaagcucagaauccaa

SEQ ID NO: 718872 - RNA, 16 nt, Homo sapiens
ucacauccacaaaacc

SEQ ID NO: 718873 - RNA, 22 nt, Homo sapiens
ucacauccuaccccuuugcacu

SEQ ID NO: 718874 - RNA, 15 nt, Homo sapiens
ucacaucucaaggag

SEQ ID NO: 718875 - RNA, 12 nt, Homo sapiens
ucacaucuccag

SEQ ID NO: 718876 - RNA, 14 nt, Homo sapiens
ucacaucugucacg

SEQ ID NO: 718877 - RNA, 17 nt, Homo sapiens
ucacaucuuaaauucau

SEQ ID NO: 718878 - RNA, 14 nt, Homo sapiens
ucacauggcauggu

SEQ ID NO: 718879 - RNA, 17 nt, Homo sapiens
ucacauggccuaugcac

SEQ ID NO: 718880 - RNA, 16 nt, Homo sapiens
ucacauuaucaucuga

SEQ ID NO: 718881 - RNA, 17 nt, Homo sapiens
ucacauuaucaucugaa

SEQ ID NO: 718882 - RNA, 23 nt, Homo sapiens
ucacauucuauuuuggguauuaa

SEQ ID NO: 718883 - RNA, 14 nt, Homo sapiens
ucacauucuuggcu

SEQ ID NO: 718884 - RNA, 17 nt, Homo sapiens
ucacauuggagucacug

SEQ ID NO: 718885 - RNA, 14 nt, Homo sapiens
ucacauugugccuu

SEQ ID NO: 718886 - RNA, 19 nt, Homo sapiens
ucacauuguuugcugcuau

SEQ ID NO: 718887 - RNA, 21 nt, Homo sapiens
ucacauuguuugcugcuauug

SEQ ID NO: 718888 - RNA, 18 nt, Homo sapiens
ucacauuuuccuuuucaa

SEQ ID NO: 718889 - RNA, 21 nt, Homo sapiens
ucacauuuuuaaaagaacaau

SEQ ID NO: 718890 - RNA, 17 nt, Homo sapiens
ucaccaaaauagucuuc

SEQ ID NO: 718891 - RNA, 22 nt, Homo sapiens
ucaccaaaauagucuucucaaa

SEQ ID NO: 718892 - RNA, 17 nt, Homo sapiens
ucaccaaacacaagaaa

SEQ ID NO: 718893 - RNA, 19 nt, Homo sapiens
ucaccaaaucagcugcuac

SEQ ID NO: 718894 - RNA, 16 nt, Homo sapiens
ucaccaacuacagaaa

SEQ ID NO: 718895 - RNA, 20 nt, Homo sapiens
ucaccaacugaaguggcuaa

SEQ ID NO: 718896 - RNA, 20 nt, Homo sapiens
ucaccaacuuuuaaugggau

SEQ ID NO: 718897 - RNA, 21 nt, Homo sapiens
ucaccaagcaggaaagggagg

SEQ ID NO: 718898 - RNA, 16 nt, Homo sapiens
ucaccaaggugacaca

SEQ ID NO: 718899 - RNA, 20 nt, Homo sapiens
ucaccacccugcucauccac

SEQ ID NO: 718900 - RNA, 19 nt, Homo sapiens
ucaccagccccacugccag

SEQ ID NO: 718901 - RNA, 18 nt, Homo sapiens
ucaccagcccuagcuguc

SEQ ID NO: 718902 - RNA, 21 nt, Homo sapiens
ucaccaggagcccggcuucca

SEQ ID NO: 718903 - RNA, 21 nt, Homo sapiens
ucaccagucugucuacugugg

SEQ ID NO: 718904 - RNA, 23 nt, Homo sapiens
ucaccaugaugugaagaguuuca

SEQ ID NO: 718905 - RNA, 15 nt, Homo sapiens
ucaccauguacauag

SEQ ID NO: 718906 - RNA, 14 nt, Homo sapiens
ucacccaaacacuu

SEQ ID NO: 718907 - RNA, 23 nt, Homo sapiens
ucacccaaugcaucacguacccc

SEQ ID NO: 718908 - RNA, 20 nt, Homo sapiens
ucacccaggcuggacugcaa

SEQ ID NO: 718909 - RNA, 16 nt, Homo sapiens
ucacccaucaaaagca

SEQ ID NO: 718910 - RNA, 13 nt, Homo sapiens
ucacccaucagga

SEQ ID NO: 718911 - RNA, 13 nt, Homo sapiens
ucacccauggaac

SEQ ID NO: 718912 - RNA, 20 nt, Homo sapiens
ucaccccagcgagcucucaa

SEQ ID NO: 718913 - RNA, 17 nt, Homo sapiens
ucacccgggacucuccc

SEQ ID NO: 718914 - RNA, 18 nt, Homo sapiens
ucacccuggauaggcaag

SEQ ID NO: 718915 - RNA, 22 nt, Homo sapiens
accugucccucuccuauguggc

SEQ ID NO: 718916 - RNA, 18 nt, Homo sapiens
accugucuaggucuccuc

SEQ ID NO: 718917 - RNA, 18 nt, Homo sapiens
accugucuauaagagaau

SEQ ID NO: 718918 - RNA, 22 nt, Homo sapiens
accugucuuccaaggagaccaa

SEQ ID NO: 718919 - RNA, 23 nt, Homo sapiens
accugucuuggccucccaaagug

SEQ ID NO: 718920 - RNA, 19 nt, Homo sapiens
accugugacaaaggaugaa

SEQ ID NO: 718921 - RNA, 14 nt, Homo sapiens
accugugaccagca

SEQ ID NO: 718922 - RNA, 19 nt, Homo sapiens
accuguggugauguugcca

SEQ ID NO: 718923 - RNA, 20 nt, Homo sapiens
accuguucagugucccgggc

SEQ ID NO: 718924 - RNA, 24 nt, Homo sapiens
accuguucuuagaguguagcugua

SEQ ID NO: 718925 - RNA, 21 nt, Homo sapiens
accuguugauagcaagugaau

SEQ ID NO: 718926 - RNA, 20 nt, Homo sapiens
accuuaaagaaccaucagca

SEQ ID NO: 718927 - RNA, 17 nt, Homo sapiens
accuuaagagacacucc

SEQ ID NO: 718928 - RNA, 13 nt, Homo sapiens
accuuaguacuuu

SEQ ID NO: 718929 - RNA, 18 nt, Homo sapiens
accuuauaguuacugugu

SEQ ID NO: 718930 - RNA, 18 nt, Homo sapiens
accuuauucuacaucauu

SEQ ID NO: 718931 - RNA, 13 nt, Homo sapiens
accuucaauacuu

SEQ ID NO: 718932 - RNA, 15 nt, Homo sapiens
accuucaauuccugg

SEQ ID NO: 718933 - RNA, 14 nt, Homo sapiens
accuucagugaaag

SEQ ID NO: 718934 - RNA, 23 nt, Homo sapiens
accuucauguggcucagugccuu

SEQ ID NO: 718935 - RNA, 19 nt, Homo sapiens
accuuccagcuccuguaac

SEQ ID NO: 718936 - RNA, 18 nt, Homo sapiens
accuuccauucacaccag

SEQ ID NO: 718937 - RNA, 18 nt, Homo sapiens
accuuccccagcguccca

SEQ ID NO: 718938 - RNA, 18 nt, Homo sapiens
accuucugggacauggug

SEQ ID NO: 718939 - RNA, 12 nt, Homo sapiens
accuucuuucac

SEQ ID NO: 718940 - RNA, 15 nt, Homo sapiens
accuugaacacuggg

SEQ ID NO: 718941 - RNA, 16 nt, Homo sapiens
accuugaacacugggg

SEQ ID NO: 718942 - RNA, 14 nt, Homo sapiens
accuugacagagca

SEQ ID NO: 718943 - RNA, 20 nt, Homo sapiens
accuugacuugaaaugcucu

SEQ ID NO: 718944 - RNA, 13 nt, Homo sapiens
accuugcaauguu

SEQ ID NO: 718945 - RNA, 15 nt, Homo sapiens
accuugccacacuga

SEQ ID NO: 718946 - RNA, 15 nt, Homo sapiens
accuuggcuuguuau

SEQ ID NO: 718947 - RNA, 17 nt, Homo sapiens
guuuaaucccagcacuu

SEQ ID NO: 718948 - RNA, 17 nt, Homo sapiens
guuuacagcacuacucu

SEQ ID NO: 718949 - RNA, 18 nt, Homo sapiens
guuuaccaguugccuuuu

SEQ ID NO: 718950 - RNA, 23 nt, Homo sapiens
guuuaccaugaagauaaacuguu

SEQ ID NO: 718951 - RNA, 19 nt, Homo sapiens
guuuacuuaucuuaugcca

SEQ ID NO: 718952 - RNA, 16 nt, Homo sapiens
guuuacuucucuaaaa

SEQ ID NO: 718953 - RNA, 21 nt, Homo sapiens
guuuagagcauuucuuuugaa

SEQ ID NO: 718954 - RNA, 13 nt, Homo sapiens
guuuagaucccau

SEQ ID NO: 718955 - RNA, 17 nt, Homo sapiens
guuuaggaauccuuugg

SEQ ID NO: 718956 - RNA, 16 nt, Homo sapiens
guuuaggauuacuuag

SEQ ID NO: 718957 - RNA, 17 nt, Homo sapiens
guuuaguugcagacuca

SEQ ID NO: 718958 - RNA, 21 nt, Homo sapiens
guuuauacaguguacauguac

SEQ ID NO: 718959 - RNA, 15 nt, Homo sapiens
guuuauguagucagu

SEQ ID NO: 718960 - RNA, 22 nt, Homo sapiens
guuuauuucaggcauuggauau

SEQ ID NO: 718961 - RNA, 19 nt, Homo sapiens
guuucaaaaauaaauuugc

SEQ ID NO: 718962 - RNA, 15 nt, Homo sapiens
guuucaaaaccaugc

SEQ ID NO: 718963 - RNA, 13 nt, Homo sapiens
guuucaacaaaga

SEQ ID NO: 718964 - RNA, 14 nt, Homo sapiens
guuucaacugugcu

SEQ ID NO: 718965 - RNA, 17 nt, Homo sapiens
guuucaaguuauucaaa

SEQ ID NO: 718966 - RNA, 18 nt, Homo sapiens
guuucacacuagucacau

SEQ ID NO: 718967 - RNA, 20 nt, Homo sapiens
guuucagcuucaguccuccu

SEQ ID NO: 718968 - RNA, 23 nt, Homo sapiens
guuucaggugggugaaaccuccu

SEQ ID NO: 718969 - RNA, 20 nt, Homo sapiens
guuucagugaaggucaccug

SEQ ID NO: 718970 - RNA, 22 nt, Homo sapiens
guuucauauucaugcaaguauu

SEQ ID NO: 718971 - RNA, 16 nt, Homo sapiens
guuuccaaaaccagaa

SEQ ID NO: 718972 - RNA, 14 nt, Homo sapiens
guuuccacuggcuu

SEQ ID NO: 718973 - RNA, 15 nt, Homo sapiens
guuuccagcugccaa

SEQ ID NO: 718974 - RNA, 15 nt, Homo sapiens
guuucccuaucucga

SEQ ID NO: 718975 - RNA, 19 nt, Homo sapiens
guuuccuagcugugugaau

SEQ ID NO: 718976 - RNA, 23 nt, Homo sapiens
guuuccuaggaaaucacaggcuu

SEQ ID NO: 718977 - RNA, 12 nt, Homo sapiens
guuuccugaaac

SEQ ID NO: 718978 - RNA, 21 nt, Homo sapiens
guuuccuuuuggaacauuucu

SEQ ID NO: 718979 - RNA, 19 nt, Homo sapiens
guuucgaaguugaugcaau

SEQ ID NO: 718980 - RNA, 20 nt, Homo sapiens
guuucgaaguugaugcaauc

SEQ ID NO: 718981 - RNA, 21 nt, Homo sapiens
guuucgugaaguauacuguau

SEQ ID NO: 718982 - RNA, 13 nt, Homo sapiens
guuucuauacugu

SEQ ID NO: 718983 - RNA, 19 nt, Homo sapiens
guuucuccucuuuccuccu

SEQ ID NO: 718984 - RNA, 17 nt, Homo sapiens
guuucugaagugcucuu

SEQ ID NO: 718985 - RNA, 17 nt, Homo sapiens
guuucugguggucuguu

SEQ ID NO: 718986 - RNA, 19 nt, Homo sapiens
guuucugugaaauucucag

SEQ ID NO: 718987 - RNA, 13 nt, Homo sapiens
guuucuguucucc

SEQ ID NO: 718988 - RNA, 16 nt, Homo sapiens
guuucuuaaauggaau

SEQ ID NO: 718989 - RNA, 15 nt, Homo sapiens
guuucuuccuuuccu

SEQ ID NO: 718990 - RNA, 15 nt, Homo sapiens
guuucuugacaagcu

SEQ ID NO: 718991 - RNA, 20 nt, Homo sapiens
guuucuugcuuggaagccag

SEQ ID NO: 718992 - RNA, 22 nt, Homo sapiens
guuugaaaauaguuaccuucaa

SEQ ID NO: 718993 - RNA, 21 nt, Homo sapiens
guuugaaaauauuuuguugcc

SEQ ID NO: 718994 - RNA, 15 nt, Homo sapiens
guuugaaauucgcug

SEQ ID NO: 718995 - RNA, 17 nt, Homo sapiens
guuugaacagaggccac

SEQ ID NO: 718996 - RNA, 21 nt, Homo sapiens
guuugaagucuuguguauuug

SEQ ID NO: 718997 - RNA, 10 nt, Homo sapiens
guuugacaac

SEQ ID NO: 718998 - RNA, 20 nt, Homo sapiens
guuugagaagaaaacaucua

SEQ ID NO: 718999 - RNA, 16 nt, Homo sapiens
guuugcaaugucacaa

SEQ ID NO: 719000 - RNA, 13 nt, Homo sapiens
guuugcacuccac

SEQ ID NO: 719001 - RNA, 10 nt, Homo sapiens
guuugcacug

SEQ ID NO: 719002 - RNA, 23 nt, Homo sapiens
guuugcugccacacugucucauc

SEQ ID NO: 719003 - RNA, 14 nt, Homo sapiens
guuugcugugaaca

SEQ ID NO: 719004 - RNA, 16 nt, Homo sapiens
guuugcuucuugccau

SEQ ID NO: 719005 - RNA, 17 nt, Homo sapiens
guuuggaaaaguggcgu

SEQ ID NO: 719006 - RNA, 16 nt, Homo sapiens
guuuggaaaccacagu

SEQ ID NO: 719007 - RNA, 20 nt, Homo sapiens
guuuggaaaccacagucagu

SEQ ID NO: 719008 - RNA, 21 nt, Homo sapiens
guuuggacuuuuauuuuggca

SEQ ID NO: 719009 - RNA, 21 nt, Homo sapiens
guuugguaguuagccaucuaa

SEQ ID NO: 719010 - RNA, 14 nt, Homo sapiens
guuuguaagacuua

SEQ ID NO: 719011 - RNA, 17 nt, Homo sapiens
guuuguaagacuuacaa

SEQ ID NO: 719012 - RNA, 21 nt, Homo sapiens
guuuguccuuuuucacuuuga

SEQ ID NO: 719013 - RNA, 22 nt, Homo sapiens
guuuguccuuuuucacuuugaa

SEQ ID NO: 719014 - RNA, 18 nt, Homo sapiens
guuugugcauaucugccu

SEQ ID NO: 719015 - RNA, 20 nt, Homo sapiens
guuuguggcuuuaguggcca

SEQ ID NO: 719016 - RNA, 11 nt, Homo sapiens
guuuguuguuu

SEQ ID NO: 719017 - RNA, 17 nt, Homo sapiens
guuuguuuuuuugccac

SEQ ID NO: 719018 - RNA, 14 nt, Homo sapiens
guuuuaaauugaua

SEQ ID NO: 719019 - RNA, 15 nt, Homo sapiens
guuuuaaggucuauc

SEQ ID NO: 719020 - RNA, 19 nt, Homo sapiens
guuuuacugugaaacuggc

SEQ ID NO: 719021 - RNA, 16 nt, Homo sapiens
guuuuagaaccagccg

SEQ ID NO: 719022 - RNA, 14 nt, Homo sapiens
guuuucauuaucuc

SEQ ID NO: 719023 - RNA, 12 nt, Homo sapiens
guuuucauuugu

SEQ ID NO: 719024 - RNA, 17 nt, Homo sapiens
guuuuccaaugugacua

SEQ ID NO: 719025 - RNA, 21 nt, Homo sapiens
guuuucccugaccucccucua

SEQ ID NO: 719026 - RNA, 17 nt, Homo sapiens
guuuuccuaaaugcagu

SEQ ID NO: 719027 - RNA, 13 nt, Homo sapiens
guuuuccuuaacu

SEQ ID NO: 719028 - RNA, 23 nt, Homo sapiens
guuuucuccuugauaucauucag

SEQ ID NO: 719029 - RNA, 18 nt, Homo sapiens
guuuugaagcuguugcua

SEQ ID NO: 719030 - RNA, 20 nt, Homo sapiens
acguggccucuugagcagug

SEQ ID NO: 719031 - RNA, 22 nt, Homo sapiens
acgugggugcccucuccaaagg

SEQ ID NO: 719032 - RNA, 22 nt, Homo sapiens
acguguccguccacccuuccau

SEQ ID NO: 719033 - RNA, 18 nt, Homo sapiens
acgugucuccucacucua

SEQ ID NO: 719034 - RNA, 19 nt, Homo sapiens
acguguguccuuugguacu

SEQ ID NO: 719035 - RNA, 21 nt, Homo sapiens
acguucagaggugcagcugga

SEQ ID NO: 719036 - RNA, 16 nt, Homo sapiens
acguuguguauggccu

SEQ ID NO: 719037 - RNA, 16 nt, Homo sapiens
acguuugcucauuuaa

SEQ ID NO: 719038 - RNA, 21 nt, Homo sapiens
acguuugcucauuuaagaauu

SEQ ID NO: 719039 - RNA, 21 nt, Homo sapiens
acguuugcuccuugacuccaa

SEQ ID NO: 719040 - RNA, 13 nt, Homo sapiens
acuaaaaagaauu

SEQ ID NO: 719041 - RNA, 13 nt, Homo sapiens
acuaaaaagccau

SEQ ID NO: 719042 - RNA, 16 nt, Homo sapiens
acuaaaaauacaaaaa

SEQ ID NO: 719043 - RNA, 14 nt, Homo sapiens
acuaaaaauauuau

SEQ ID NO: 719044 - RNA, 16 nt, Homo sapiens
acuaaaaggugaccaa

SEQ ID NO: 719045 - RNA, 14 nt, Homo sapiens
acuaaacauuuugu

SEQ ID NO: 719046 - RNA, 17 nt, Homo sapiens
acuaaacuucaccuaca

SEQ ID NO: 719047 - RNA, 14 nt, Homo sapiens
acuaaagauaucag

SEQ ID NO: 719048 - RNA, 12 nt, Homo sapiens
acuaaagcuuua

SEQ ID NO: 719049 - RNA, 16 nt, Homo sapiens
acuaaaucaaucugca

SEQ ID NO: 719050 - RNA, 14 nt, Homo sapiens
acuaaaugaacuaa

SEQ ID NO: 719051 - RNA, 20 nt, Homo sapiens
acuaaauggcugcagaacuc

SEQ ID NO: 719052 - RNA, 15 nt, Homo sapiens
acuaaauucaaagaa

SEQ ID NO: 719053 - RNA, 19 nt, Homo sapiens
acuaaauuuucuaauuaaa

SEQ ID NO: 719054 - RNA, 22 nt, Homo sapiens
acuaacaagaauguaacuccag

SEQ ID NO: 719055 - RNA, 15 nt, Homo sapiens
acuaacagauaagca

SEQ ID NO: 719056 - RNA, 21 nt, Homo sapiens
acuaacccaaugccugugaag

SEQ ID NO: 719057 - RNA, 18 nt, Homo sapiens
acuaaccuggguucccuu

SEQ ID NO: 719058 - RNA, 22 nt, Homo sapiens
acuaacgcaaccaagugugcua

SEQ ID NO: 719059 - RNA, 23 nt, Homo sapiens
acuaacucaaauacacauuugcu

SEQ ID NO: 719060 - RNA, 15 nt, Homo sapiens
acuaagaaauaugca

SEQ ID NO: 719061 - RNA, 12 nt, Homo sapiens
acuaagccagac

SEQ ID NO: 719062 - RNA, 13 nt, Homo sapiens
uaaaaacuuguac

SEQ ID NO: 719063 - RNA, 16 nt, Homo sapiens
uaaaaagaagccacag

SEQ ID NO: 719064 - RNA, 17 nt, Homo sapiens
uaaaaagauagacuuca

SEQ ID NO: 719065 - RNA, 18 nt, Homo sapiens
uaaaaagcaaagguuaca

SEQ ID NO: 719066 - RNA, 14 nt, Homo sapiens
uaaaaagccugcau

SEQ ID NO: 719067 - RNA, 16 nt, Homo sapiens
uaaaaaggaacaaaua

SEQ ID NO: 719068 - RNA, 17 nt, Homo sapiens
uaaaaaggcaguuugca

SEQ ID NO: 719069 - RNA, 18 nt, Homo sapiens
uaaaaaggcuaaauggaa

SEQ ID NO: 719070 - RNA, 12 nt, Homo sapiens
uaaaaaguaaug

SEQ ID NO: 719071 - RNA, 17 nt, Homo sapiens
uaaaaaguauguucuaa

SEQ ID NO: 719072 - RNA, 18 nt, Homo sapiens
uaaaaaguucucauugaa

SEQ ID NO: 719073 - RNA, 23 nt, Homo sapiens
uaaaaaguuguucuuuguuucca

SEQ ID NO: 719074 - RNA, 18 nt, Homo sapiens
uaaaaauaaaucccaugg

SEQ ID NO: 719075 - RNA, 16 nt, Homo sapiens
uaaaaauacaaaaaau

SEQ ID NO: 719076 - RNA, 14 nt, Homo sapiens
uaaaaauacaagca

SEQ ID NO: 719077 - RNA, 16 nt, Homo sapiens
uaaaaauaugcuucua

SEQ ID NO: 719078 - RNA, 15 nt, Homo sapiens
uaaaaaucacacugu

SEQ ID NO: 719079 - RNA, 16 nt, Homo sapiens
uaaaaaucacacugua

SEQ ID NO: 719080 - RNA, 17 nt, Homo sapiens
uaaaaaucacacuguaa

SEQ ID NO: 719081 - RNA, 18 nt, Homo sapiens
uaaaaaucauaguacucu

SEQ ID NO: 719082 - RNA, 15 nt, Homo sapiens
uaaaaaugagugcuu

SEQ ID NO: 719083 - RNA, 17 nt, Homo sapiens
uaaaaaugauacugaug

SEQ ID NO: 719084 - RNA, 15 nt, Homo sapiens
uaaaaaugcaacuuc

SEQ ID NO: 719085 - RNA, 18 nt, Homo sapiens
uaaaaauggauacuggug

SEQ ID NO: 719086 - RNA, 19 nt, Homo sapiens
uaaaaauggccauuugcuu

SEQ ID NO: 719087 - RNA, 16 nt, Homo sapiens
uaaaaauguccugccu

SEQ ID NO: 719088 - RNA, 13 nt, Homo sapiens
uaaaaauucauaa

SEQ ID NO: 719089 - RNA, 20 nt, Homo sapiens
uaaaaauuccaaauggacua

SEQ ID NO: 719090 - RNA, 16 nt, Homo sapiens
uaaaaauuuacuacaa

SEQ ID NO: 719091 - RNA, 16 nt, Homo sapiens
uaaaacaaaaccaagc

SEQ ID NO: 719092 - RNA, 22 nt, Homo sapiens
uaaaacaaaauuugacuaauuu

SEQ ID NO: 719093 - RNA, 17 nt, Homo sapiens
uaaaacaagugugaugc

SEQ ID NO: 719094 - RNA, 16 nt, Homo sapiens
uaaaacagaaucuucu

SEQ ID NO: 719095 - RNA, 22 nt, Homo sapiens
uaaaacagccaaaacuccacag

SEQ ID NO: 719096 - RNA, 21 nt, Homo sapiens
uaaaacaggcaaaguuuuaca

SEQ ID NO: 719097 - RNA, 21 nt, Homo sapiens
uaaaacagguuauaacagugu

SEQ ID NO: 719098 - RNA, 21 nt, Homo sapiens
uaaaacauguaauauaaagau

SEQ ID NO: 719099 - RNA, 15 nt, Homo sapiens
uaaaacauguacaaa

SEQ ID NO: 719100 - RNA, 14 nt, Homo sapiens
uaaaacauuaguca

SEQ ID NO: 719101 - RNA, 19 nt, Homo sapiens
uaaaacauugaaugaaacu

SEQ ID NO: 719102 - RNA, 15 nt, Homo sapiens
uaaaacauuuugacu

SEQ ID NO: 719103 - RNA, 12 nt, Homo sapiens
uaaaaccaaaga

SEQ ID NO: 719104 - RNA, 19 nt, Homo sapiens
uaaaaccccaucucuacua

SEQ ID NO: 719105 - RNA, 19 nt, Homo sapiens
uaaaaccugggauuauaua

SEQ ID NO: 719106 - RNA, 17 nt, Homo sapiens
uaaaacggugcugugag

SEQ ID NO: 719107 - RNA, 14 nt, Homo sapiens
uaaaacuaagcaca

SEQ ID NO: 719108 - RNA, 16 nt, Homo sapiens
uaaaacuauauucuca

SEQ ID NO: 719109 - RNA, 17 nt, Homo sapiens
uaaaacuauauucucag

SEQ ID NO: 719110 - RNA, 18 nt, Homo sapiens
uaaaacucaaggcuuaua

SEQ ID NO: 719111 - RNA, 17 nt, Homo sapiens
uaaaacuuaacauucau

SEQ ID NO: 719112 - RNA, 19 nt, Homo sapiens
uaaaagaaccgagcaauuu

SEQ ID NO: 719113 - RNA, 20 nt, Homo sapiens
uaaaagaacuuacugauuau

SEQ ID NO: 719114 - RNA, 19 nt, Homo sapiens
uaaaagcaauucugacugu

SEQ ID NO: 719115 - RNA, 17 nt, Homo sapiens
uaaaagccaauuagcuc

SEQ ID NO: 719116 - RNA, 21 nt, Homo sapiens
uaaaaggaaagaaaacaucuu

SEQ ID NO: 719117 - RNA, 15 nt, Homo sapiens
uaaaaggacugugau

SEQ ID NO: 719118 - RNA, 18 nt, Homo sapiens
uaaaagggaaagaaggcc

SEQ ID NO: 719119 - RNA, 24 nt, Homo sapiens
uaaaagguauacuuuaguagacau

SEQ ID NO: 719120 - RNA, 22 nt, Homo sapiens
uaaaagguuaaauauugucaua

SEQ ID NO: 719121 - RNA, 22 nt, Homo sapiens
uaaaagguuaauuucugucaaa

SEQ ID NO: 719122 - RNA, 15 nt, Homo sapiens
uaaaagucugagaua

SEQ ID NO: 719123 - RNA, 19 nt, Homo sapiens
uaaaagugcuuugcauuga

SEQ ID NO: 719124 - RNA, 13 nt, Homo sapiens
uaaaaguggcauu

SEQ ID NO: 719125 - RNA, 20 nt, Homo sapiens
uaaaaguucuuuuugcucua

SEQ ID NO: 719126 - RNA, 19 nt, Homo sapiens
uaaaaguuggagaagucuu

SEQ ID NO: 719127 - RNA, 19 nt, Homo sapiens
uaaaauaaacuagauauua

SEQ ID NO: 719128 - RNA, 16 nt, Homo sapiens
uaaaauaacuugcauc

SEQ ID NO: 719129 - RNA, 20 nt, Homo sapiens
uaaaauaaguggauuuugua

SEQ ID NO: 719130 - RNA, 14 nt, Homo sapiens
uaaaauacauaaua

SEQ ID NO: 719131 - RNA, 12 nt, Homo sapiens
uaaaauacucac

SEQ ID NO: 719132 - RNA, 14 nt, Homo sapiens
uaaaauacugaaua

SEQ ID NO: 719133 - RNA, 13 nt, Homo sapiens
uaaaauagaaaca

SEQ ID NO: 719134 - RNA, 12 nt, Homo sapiens
uaaaauagagua

SEQ ID NO: 719135 - RNA, 21 nt, Homo sapiens
uaaaauagaguguaguuuaca

SEQ ID NO: 719136 - RNA, 14 nt, Homo sapiens
uaaaauauggcuau

SEQ ID NO: 719137 - RNA, 23 nt, Homo sapiens
uaaaauauguaguugugucuuaa

SEQ ID NO: 719138 - RNA, 22 nt, Homo sapiens
uaaaauauuuaucugauuaagu

SEQ ID NO: 719139 - RNA, 12 nt, Homo sapiens
uaaaaucuguaa

SEQ ID NO: 719140 - RNA, 18 nt, Homo sapiens
uaaaaucuguaaaccaua

SEQ ID NO: 719141 - RNA, 19 nt, Homo sapiens
uaaaaucuuggcacagaaa

SEQ ID NO: 719142 - RNA, 20 nt, Homo sapiens
uaaaaucuugucauguguau

SEQ ID NO: 719143 - RNA, 21 nt, Homo sapiens
uaaaaucuuucugauaaugca

SEQ ID NO: 719144 - RNA, 20 nt, Homo sapiens
uaaaaugaaauuacuacaaa

SEQ ID NO: 719145 - RNA, 20 nt, Homo sapiens
acucaaaugaauuugcuaaa

SEQ ID NO: 719146 - RNA, 17 nt, Homo sapiens
acucaaauggggccaga

SEQ ID NO: 719147 - RNA, 21 nt, Homo sapiens
acucaaauggggccagaucca

SEQ ID NO: 719148 - RNA, 18 nt, Homo sapiens
acucaaauuggugaacag

SEQ ID NO: 719149 - RNA, 16 nt, Homo sapiens
acucaaucuccagggc

SEQ ID NO: 719150 - RNA, 17 nt, Homo sapiens
acucaaucuccagggcu

SEQ ID NO: 719151 - RNA, 12 nt, Homo sapiens
acucacacuggc

SEQ ID NO: 719152 - RNA, 14 nt, Homo sapiens
acucacacuggcca

SEQ ID NO: 719153 - RNA, 12 nt, Homo sapiens
acucacagaguc

SEQ ID NO: 719154 - RNA, 15 nt, Homo sapiens
acucacagcuucucc

SEQ ID NO: 719155 - RNA, 18 nt, Homo sapiens
acucacauauaacaugca

SEQ ID NO: 719156 - RNA, 14 nt, Homo sapiens
acucaccaaaauau

SEQ ID NO: 719157 - RNA, 21 nt, Homo sapiens
acucaccacuaccagccagcc

SEQ ID NO: 719158 - RNA, 15 nt, Homo sapiens
acucaccagauuuac

SEQ ID NO: 719159 - RNA, 15 nt, Homo sapiens
acucaccugcacuaa

SEQ ID NO: 719160 - RNA, 17 nt, Homo sapiens
acucaccuguucucacu

SEQ ID NO: 719161 - RNA, 22 nt, Homo sapiens
acucaccuucuagucuuggcca

SEQ ID NO: 719162 - RNA, 14 nt, Homo sapiens
acucacuagacuca

SEQ ID NO: 719163 - RNA, 21 nt, Homo sapiens
acucacucucccccuccucuu

SEQ ID NO: 719164 - RNA, 13 nt, Homo sapiens
acucacugccuag

SEQ ID NO: 719165 - RNA, 15 nt, Homo sapiens
acucacugccuagga

SEQ ID NO: 719166 - RNA, 14 nt, Homo sapiens
acucacugcucaag

SEQ ID NO: 719167 - RNA, 15 nt, Homo sapiens
acucacuuguaagaa

SEQ ID NO: 719168 - RNA, 21 nt, Homo sapiens
acucacuuucccuugugucaa

SEQ ID NO: 719169 - RNA, 23 nt, Homo sapiens
acucagauugagcccuacauugu

SEQ ID NO: 719170 - RNA, 13 nt, Homo sapiens
acucagcacauuc

SEQ ID NO: 719171 - RNA, 15 nt, Homo sapiens
acucagcaguugaca

SEQ ID NO: 719172 - RNA, 21 nt, Homo sapiens
acucagccguaggguggcacu

SEQ ID NO: 719173 - RNA, 13 nt, Homo sapiens
acucagcugagaa

SEQ ID NO: 719174 - RNA, 17 nt, Homo sapiens
acucagcuguccugcag

SEQ ID NO: 719175 - RNA, 23 nt, Homo sapiens
acucagcuuuuucguauuucaaa

SEQ ID NO: 719176 - RNA, 17 nt, Homo sapiens
acucaggaggcugagac

SEQ ID NO: 719177 - RNA, 19 nt, Homo sapiens
uaaacaucagcaagacuuu

SEQ ID NO: 719178 - RNA, 14 nt, Homo sapiens
uaaaccaaggacug

SEQ ID NO: 719179 - RNA, 20 nt, Homo sapiens
uaaaccaaugaagaagacaa

SEQ ID NO: 719180 - RNA, 16 nt, Homo sapiens
uaaaccuccuucggga

SEQ ID NO: 719181 - RNA, 20 nt, Homo sapiens
uaaacgacaagaauaauuca

SEQ ID NO: 719182 - RNA, 13 nt, Homo sapiens
uaaacgggaacau

SEQ ID NO: 719183 - RNA, 22 nt, Homo sapiens
uaaacuaaaaaaaaaaaggccg

SEQ ID NO: 719184 - RNA, 24 nt, Homo sapiens
uaaacuaagagaaacuguguauag

SEQ ID NO: 719185 - RNA, 19 nt, Homo sapiens
uaaacuaucaauaauacaa

SEQ ID NO: 719186 - RNA, 16 nt, Homo sapiens
uaaacuauuuauauca

SEQ ID NO: 719187 - RNA, 18 nt, Homo sapiens
uaaacuauuuauaucaca

SEQ ID NO: 719188 - RNA, 21 nt, Homo sapiens
uaaacucaucaaugugccuuu

SEQ ID NO: 719189 - RNA, 12 nt, Homo sapiens
uaaacuccuuaa

SEQ ID NO: 719190 - RNA, 13 nt, Homo sapiens
uaaacucugucca

SEQ ID NO: 719191 - RNA, 19 nt, Homo sapiens
uaaacuggaauccuuucac

SEQ ID NO: 719192 - RNA, 18 nt, Homo sapiens
uaaacuggcaucugcucu

SEQ ID NO: 719193 - RNA, 22 nt, Homo sapiens
uaaacuuaagggaaaaguucuc

SEQ ID NO: 719194 - RNA, 21 nt, Homo sapiens
uaaacuuaccugggcauucuu

SEQ ID NO: 719195 - RNA, 14 nt, Homo sapiens
uaaacuucagggau

SEQ ID NO: 719196 - RNA, 23 nt, Homo sapiens
uaaacuuuuuuucuguaccaguu

SEQ ID NO: 719197 - RNA, 20 nt, Homo sapiens
uaaagaaaaaaauacuauuu

SEQ ID NO: 719198 - RNA, 20 nt, Homo sapiens
uaaagaaaaaugccugucuc

SEQ ID NO: 719199 - RNA, 20 nt, Homo sapiens
uaaagaaaggaacuaaguca

SEQ ID NO: 719200 - RNA, 15 nt, Homo sapiens
uaaagaauaauacuu

SEQ ID NO: 719201 - RNA, 18 nt, Homo sapiens
uaaagaauucgguugaaa

SEQ ID NO: 719202 - RNA, 17 nt, Homo sapiens
uaaagacaacaaaagaa

SEQ ID NO: 719203 - RNA, 16 nt, Homo sapiens
uaaagacaaucacugc

SEQ ID NO: 719204 - RNA, 15 nt, Homo sapiens
uaaagagaacucugg

SEQ ID NO: 719205 - RNA, 20 nt, Homo sapiens
uaaagagagaauguagauau

SEQ ID NO: 719206 - RNA, 18 nt, Homo sapiens
uaaagagagaugaaccac

SEQ ID NO: 719207 - RNA, 19 nt, Homo sapiens
uaaagagagaugaaccaca

SEQ ID NO: 719208 - RNA, 18 nt, Homo sapiens
uaaagagcuuugugauau

SEQ ID NO: 719209 - RNA, 23 nt, Homo sapiens
uaaagagucuggccuggacccug

SEQ ID NO: 719210 - RNA, 17 nt, Homo sapiens
uaaagagugaaugccau

SEQ ID NO: 719211 - RNA, 16 nt, Homo sapiens
uaaagauaaaauaucc

SEQ ID NO: 719212 - RNA, 21 nt, Homo sapiens
uaaagauaacccuuauuccau

SEQ ID NO: 719213 - RNA, 16 nt, Homo sapiens
uaaagaugaucuacuc

SEQ ID NO: 719214 - RNA, 17 nt, Homo sapiens
uaaagaugaucuacuca

SEQ ID NO: 719215 - RNA, 17 nt, Homo sapiens
uaaagauuauugugacu

SEQ ID NO: 719216 - RNA, 19 nt, Homo sapiens
uaaagauuucuaguaggca

SEQ ID NO: 719217 - RNA, 16 nt, Homo sapiens
uaaagauuuucugcuu

SEQ ID NO: 719218 - RNA, 18 nt, Homo sapiens
uaaagcaagggccauuua

SEQ ID NO: 719219 - RNA, 20 nt, Homo sapiens
uaaagcagaggcaacacugg

SEQ ID NO: 719220 - RNA, 16 nt, Homo sapiens
uaaagcauaaaaaggu

SEQ ID NO: 719221 - RNA, 14 nt, Homo sapiens
uaaagcguccucuc

SEQ ID NO: 719222 - RNA, 16 nt, Homo sapiens
uaaagcguccucucag

SEQ ID NO: 719223 - RNA, 19 nt, Homo sapiens
uaaagcuauguuacaugga

SEQ ID NO: 719224 - RNA, 22 nt, Homo sapiens
uaaagcuauuuaugggccccug

SEQ ID NO: 719225 - RNA, 18 nt, Homo sapiens
uaaagcucaucagcuauc

SEQ ID NO: 719226 - RNA, 15 nt, Homo sapiens
uaaaggaaaaucaca

SEQ ID NO: 719227 - RNA, 17 nt, Homo sapiens
uaaaggcaaaguggaau

SEQ ID NO: 719228 - RNA, 22 nt, Homo sapiens
uaaaggcaaugguuugugucaa

SEQ ID NO: 719229 - RNA, 19 nt, Homo sapiens
uaaaggccaggacgggcca

SEQ ID NO: 719230 - RNA, 16 nt, Homo sapiens
uaaagggaaaacccuc

SEQ ID NO: 719231 - RNA, 17 nt, Homo sapiens
uaaagggucuuaugaaa

SEQ ID NO: 719232 - RNA, 14 nt, Homo sapiens
uaaaggucccuuag

SEQ ID NO: 719233 - RNA, 15 nt, Homo sapiens
uaaagguuuucucua

SEQ ID NO: 719234 - RNA, 15 nt, Homo sapiens
uaaaguacauaacaa

SEQ ID NO: 719235 - RNA, 11 nt, Homo sapiens
uaaaguaccac

SEQ ID NO: 719236 - RNA, 17 nt, Homo sapiens
uaaaguaccacacauau

SEQ ID NO: 719237 - RNA, 21 nt, Homo sapiens
uaaaguaccacacauauugca

SEQ ID NO: 719238 - RNA, 16 nt, Homo sapiens
uaaaguacccugugcu

SEQ ID NO: 719239 - RNA, 21 nt, Homo sapiens
uaaaguaguaaucauaaagga

SEQ ID NO: 719240 - RNA, 19 nt, Homo sapiens
uaaagucacaucccuguaa

SEQ ID NO: 719241 - RNA, 20 nt, Homo sapiens
uaaagugaauaaccacuuaa

SEQ ID NO: 719242 - RNA, 18 nt, Homo sapiens
uaaagugacccuguucuc

SEQ ID NO: 719243 - RNA, 21 nt, Homo sapiens
uaaaguugcugugaauacuua

SEQ ID NO: 719244 - RNA, 16 nt, Homo sapiens
uaaauaaaagcacaag

SEQ ID NO: 719245 - RNA, 15 nt, Homo sapiens
uaaauaaaagcuaga

SEQ ID NO: 719246 - RNA, 22 nt, Homo sapiens
uaaauaaaagcuagauacugga

SEQ ID NO: 719247 - RNA, 18 nt, Homo sapiens
uaaauaaaaggacuguga

SEQ ID NO: 719248 - RNA, 19 nt, Homo sapiens
uaaauaaaaggacugugau

SEQ ID NO: 719249 - RNA, 20 nt, Homo sapiens
uaaauaaaaggacugugauu

SEQ ID NO: 719250 - RNA, 14 nt, Homo sapiens
uaaauaaacaugug

SEQ ID NO: 719251 - RNA, 16 nt, Homo sapiens
uaaauaaaccacugug

SEQ ID NO: 719252 - RNA, 15 nt, Homo sapiens
uaaauaaaucauuaa

SEQ ID NO: 719253 - RNA, 21 nt, Homo sapiens
uaaauaaauguaauagccaaa

SEQ ID NO: 719254 - RNA, 20 nt, Homo sapiens
uaaauacagcauacuucaaa

SEQ ID NO: 719255 - RNA, 17 nt, Homo sapiens
uaaauacuacugcucua

SEQ ID NO: 719256 - RNA, 13 nt, Homo sapiens
uaaauacugucaa

SEQ ID NO: 719257 - RNA, 17 nt, Homo sapiens
uaaauagaugcugugua

SEQ ID NO: 719258 - RNA, 16 nt, Homo sapiens
uaaauauagagaugug

SEQ ID NO: 719259 - RNA, 18 nt, Homo sapiens
uaaauauauaugucaaua

SEQ ID NO: 719260 - RNA, 18 nt, Homo sapiens
uaaauauaucuaccccag

SEQ ID NO: 719261 - RNA, 17 nt, Homo sapiens
uaaauaugaaugaacaa

SEQ ID NO: 719262 - RNA, 13 nt, Homo sapiens
uaaauauuucaag

SEQ ID NO: 719263 - RNA, 16 nt, Homo sapiens
uaaauauuucaagaca

SEQ ID NO: 719264 - RNA, 19 nt, Homo sapiens
uaaauauuucucaacugag

SEQ ID NO: 719265 - RNA, 14 nt, Homo sapiens
uaaauccaucacua

SEQ ID NO: 719266 - RNA, 15 nt, Homo sapiens
uaaauccauuuucua

SEQ ID NO: 719267 - RNA, 13 nt, Homo sapiens
uaaaucccaagaa

SEQ ID NO: 719268 - RNA, 15 nt, Homo sapiens
uaaauccgacuugaa

SEQ ID NO: 719269 - RNA, 13 nt, Homo sapiens
uaaauccugccau

SEQ ID NO: 719270 - RNA, 22 nt, Homo sapiens
uaaauccuuugcuucauuccaa

SEQ ID NO: 719271 - RNA, 20 nt, Homo sapiens
uaaaucguccucccaggcca

SEQ ID NO: 719272 - RNA, 20 nt, Homo sapiens
uaaaucuaggaugugaugau

SEQ ID NO: 719273 - RNA, 14 nt, Homo sapiens
uaaaucuccagugg

SEQ ID NO: 719274 - RNA, 22 nt, Homo sapiens
uaaaucugaguauauauuuaca

SEQ ID NO: 719275 - RNA, 13 nt, Homo sapiens
uaaaucugccaca

SEQ ID NO: 719276 - RNA, 20 nt, Homo sapiens
uaaaucuggcagagccucag

SEQ ID NO: 719277 - RNA, 20 nt, Homo sapiens
uaaaucuguuauuuugcuau

SEQ ID NO: 719278 - RNA, 21 nt, Homo sapiens
uaaaugaagaaaaguauugca

SEQ ID NO: 719279 - RNA, 14 nt, Homo sapiens
uaaaugaagccaag

SEQ ID NO: 719280 - RNA, 15 nt, Homo sapiens
uaaaugaagccaagu

SEQ ID NO: 719281 - RNA, 14 nt, Homo sapiens
uaaaugaccaaaga

SEQ ID NO: 719282 - RNA, 18 nt, Homo sapiens
uaaaugcuacauacucca

SEQ ID NO: 719283 - RNA, 22 nt, Homo sapiens
uaaaugggaaaucaguguuuua

SEQ ID NO: 719284 - RNA, 15 nt, Homo sapiens
uaaaugggacuggag

SEQ ID NO: 719285 - RNA, 21 nt, Homo sapiens
uaaauguaaauauguacacaa

SEQ ID NO: 719286 - RNA, 21 nt, Homo sapiens
uaaauguaccccucucagucu

SEQ ID NO: 719287 - RNA, 16 nt, Homo sapiens
uaaauguaucauagaa

SEQ ID NO: 719288 - RNA, 17 nt, Homo sapiens
uaaauguaucauagaaa

SEQ ID NO: 719289 - RNA, 19 nt, Homo sapiens
uaaauguauuccuguaggg

SEQ ID NO: 719290 - RNA, 21 nt, Homo sapiens
uaaauguauuuuagacuuccu

SEQ ID NO: 719291 - RNA, 12 nt, Homo sapiens
acucaggaucca

SEQ ID NO: 719292 - RNA, 15 nt, Homo sapiens
acucaggaugcccag

SEQ ID NO: 719293 - RNA, 22 nt, Homo sapiens
acucaggaugcccagggccacu

SEQ ID NO: 719294 - RNA, 20 nt, Homo sapiens
acucaguaauuucaaaauac

SEQ ID NO: 719295 - RNA, 13 nt, Homo sapiens
acucaguagagau

SEQ ID NO: 719296 - RNA, 18 nt, Homo sapiens
acucaguccacuguugag

SEQ ID NO: 719297 - RNA, 18 nt, Homo sapiens
acucagucuuuaaucuga

SEQ ID NO: 719298 - RNA, 19 nt, Homo sapiens
acucagugggacauagcca

SEQ ID NO: 719299 - RNA, 15 nt, Homo sapiens
acucaguuccaaagu

SEQ ID NO: 719300 - RNA, 14 nt, Homo sapiens
acucaguugcaacu

SEQ ID NO: 719301 - RNA, 23 nt, Homo sapiens
acucauagcgggggccuaaaaaa

SEQ ID NO: 719302 - RNA, 20 nt, Homo sapiens
acucauaggcuuauuuccaa

SEQ ID NO: 719303 - RNA, 17 nt, Homo sapiens
acucauauguucccaau

SEQ ID NO: 719304 - RNA, 16 nt, Homo sapiens
acucaucacacuucau

SEQ ID NO: 719305 - RNA, 17 nt, Homo sapiens
acucauccauccccugg

SEQ ID NO: 719306 - RNA, 21 nt, Homo sapiens
acucauggccuugucuaacuu

SEQ ID NO: 719307 - RNA, 17 nt, Homo sapiens
acucaugucuuucucag

SEQ ID NO: 719308 - RNA, 19 nt, Homo sapiens
acucauuaaugaaucacau

SEQ ID NO: 719309 - RNA, 15 nt, Homo sapiens
acucauucaguccca

SEQ ID NO: 719310 - RNA, 12 nt, Homo sapiens
acucauuccugc

SEQ ID NO: 719311 - RNA, 17 nt, Homo sapiens
acucauuucacagccuu

SEQ ID NO: 719312 - RNA, 16 nt, Homo sapiens
acucauuuggguauau

SEQ ID NO: 719313 - RNA, 23 nt, Homo sapiens
acucauuuuuguuuucauuaucu

SEQ ID NO: 719314 - RNA, 11 nt, Homo sapiens
acuccaaggag

SEQ ID NO: 719315 - RNA, 14 nt, Homo sapiens
acuccacagaguga

SEQ ID NO: 719316 - RNA, 17 nt, Homo sapiens
acuccacagucaauauu

SEQ ID NO: 719317 - RNA, 13 nt, Homo sapiens
acuccacugcccu

SEQ ID NO: 719318 - RNA, 15 nt, Homo sapiens
acuccagcccugucc

SEQ ID NO: 719319 - RNA, 15 nt, Homo sapiens
acuccagccugggca

SEQ ID NO: 719320 - RNA, 21 nt, Homo sapiens
acuccagccugggcgacaaaa

SEQ ID NO: 719321 - RNA, 18 nt, Homo sapiens
acuccaggauuuaggccu

SEQ ID NO: 719322 - RNA, 21 nt, Homo sapiens
acuccagucuggcaacagagc

SEQ ID NO: 719323 - RNA, 18 nt, Homo sapiens
acuccaguuuucaaauca

SEQ ID NO: 719324 - RNA, 15 nt, Homo sapiens
acuccaucgccaucu

SEQ ID NO: 719325 - RNA, 15 nt, Homo sapiens
acuccaucucaaaaa

SEQ ID NO: 719326 - RNA, 22 nt, Homo sapiens
acuccaucuugguaguucugug

SEQ ID NO: 719327 - RNA, 13 nt, Homo sapiens
acuccaugcugcc

SEQ ID NO: 719328 - RNA, 20 nt, Homo sapiens
acuccauucaaaucuacggu

SEQ ID NO: 719329 - RNA, 15 nt, Homo sapiens
acucccaacccuggc

SEQ ID NO: 719330 - RNA, 19 nt, Homo sapiens
acucccaccacaggcauaa

SEQ ID NO: 719331 - RNA, 16 nt, Homo sapiens
acucccagugaugcug

SEQ ID NO: 719332 - RNA, 16 nt, Homo sapiens
acucccccagcuuucc

SEQ ID NO: 719333 - RNA, 16 nt, Homo sapiens
acucccccucuuucac

SEQ ID NO: 719334 - RNA, 12 nt, Homo sapiens
acuccccugcac

SEQ ID NO: 719335 - RNA, 19 nt, Homo sapiens
acuccccuuaaucuaaucu

SEQ ID NO: 719336 - RNA, 17 nt, Homo sapiens
acucccugcagaugcca

SEQ ID NO: 719337 - RNA, 18 nt, Homo sapiens
acucccugcagaugccac

SEQ ID NO: 719338 - RNA, 22 nt, Homo sapiens
acucccugccuacacacacagc

SEQ ID NO: 719339 - RNA, 17 nt, Homo sapiens
acucccuuugccagugc

SEQ ID NO: 719340 - RNA, 15 nt, Homo sapiens
acuccggagguagag

SEQ ID NO: 719341 - RNA, 15 nt, Homo sapiens
acuccgucucaaaaa

SEQ ID NO: 719342 - RNA, 19 nt, Homo sapiens
acuccgugcuuaaccaaag

SEQ ID NO: 719343 - RNA, 20 nt, Homo sapiens
acuccuauaaggagaguuca

SEQ ID NO: 719344 - RNA, 15 nt, Homo sapiens
acuccucauaccuca

SEQ ID NO: 719345 - RNA, 18 nt, Homo sapiens
acuccuccugcuccucac

SEQ ID NO: 719346 - RNA, 18 nt, Homo sapiens
acuccugaccucagguga

SEQ ID NO: 719347 - RNA, 13 nt, Homo sapiens
acuccugcaaaau

SEQ ID NO: 719348 - RNA, 13 nt, Homo sapiens
acuccugccauuc

SEQ ID NO: 719349 - RNA, 14 nt, Homo sapiens
acuccugcuuaauc

SEQ ID NO: 719350 - RNA, 18 nt, Homo sapiens
acuccuggccucaaguga

SEQ ID NO: 719351 - RNA, 12 nt, Homo sapiens
acuccuguuacu

SEQ ID NO: 719352 - RNA, 17 nt, Homo sapiens
acuccuuagagacauca

SEQ ID NO: 719353 - RNA, 21 nt, Homo sapiens
acuccuuaggcuuuguugaau

SEQ ID NO: 719354 - RNA, 13 nt, Homo sapiens
acuccuuccauca

SEQ ID NO: 719355 - RNA, 19 nt, Homo sapiens
acuccuuguaaagacugua

SEQ ID NO: 719356 - RNA, 17 nt, Homo sapiens
acucgagucacacucaa

SEQ ID NO: 719357 - RNA, 14 nt, Homo sapiens
acucgggaagggaa

SEQ ID NO: 719358 - RNA, 20 nt, Homo sapiens
acucgguauuaauccaaagc

SEQ ID NO: 719359 - RNA, 18 nt, Homo sapiens
acucuaacaaacaagaga

SEQ ID NO: 719360 - RNA, 18 nt, Homo sapiens
acucuaagcuggagcucu

SEQ ID NO: 719361 - RNA, 17 nt, Homo sapiens
acucuaccucauaucag

SEQ ID NO: 719362 - RNA, 13 nt, Homo sapiens
acucuacuauuaa

SEQ ID NO: 719363 - RNA, 16 nt, Homo sapiens
acucuaggguccagug

SEQ ID NO: 719364 - RNA, 17 nt, Homo sapiens
acucucaccauuuggau

SEQ ID NO: 719365 - RNA, 14 nt, Homo sapiens
acucucagcaccaa

SEQ ID NO: 719366 - RNA, 23 nt, Homo sapiens
acucuccccuuucuuugcaacuu

SEQ ID NO: 719367 - RNA, 18 nt, Homo sapiens
acucucugguuuacuuca

SEQ ID NO: 719368 - RNA, 18 nt, Homo sapiens
acucucugugaccugccc

SEQ ID NO: 719369 - RNA, 20 nt, Homo sapiens
acucucuguuuuaguguuua

SEQ ID NO: 719370 - RNA, 14 nt, Homo sapiens
acucugaaagaccu

SEQ ID NO: 719371 - RNA, 15 nt, Homo sapiens
acucugaaagaccua

SEQ ID NO: 719372 - RNA, 18 nt, Homo sapiens
acucugaaaucucagaau

SEQ ID NO: 719373 - RNA, 17 nt, Homo sapiens
acucugaauccucauga

SEQ ID NO: 719374 - RNA, 20 nt, Homo sapiens
uaccucugagaagacacaag

SEQ ID NO: 719375 - RNA, 22 nt, Homo sapiens
uaccucuuacuuugcuugagaa

SEQ ID NO: 719376 - RNA, 15 nt, Homo sapiens
uaccugaacaggaau

SEQ ID NO: 719377 - RNA, 17 nt, Homo sapiens
uaccugcccccaucaua

SEQ ID NO: 719378 - RNA, 14 nt, Homo sapiens
uaccuggaguuuaa

SEQ ID NO: 719379 - RNA, 18 nt, Homo sapiens
uaccuggcucugcuucca

SEQ ID NO: 719380 - RNA, 11 nt, Homo sapiens
uaccugggaaa

SEQ ID NO: 719381 - RNA, 16 nt, Homo sapiens
uaccuguacacugacu

SEQ ID NO: 719382 - RNA, 22 nt, Homo sapiens
uaccugucauuuugcacuguaa

SEQ ID NO: 719383 - RNA, 19 nt, Homo sapiens
uaccuuaagagacacucca

SEQ ID NO: 719384 - RNA, 22 nt, Homo sapiens
uaccuuauucuacaucauuaac

SEQ ID NO: 719385 - RNA, 20 nt, Homo sapiens
uaccuucaugcauagguuua

SEQ ID NO: 719386 - RNA, 17 nt, Homo sapiens
uaccuucaugugauuca

SEQ ID NO: 719387 - RNA, 17 nt, Homo sapiens
uaccuucaugugguuca

SEQ ID NO: 719388 - RNA, 23 nt, Homo sapiens
uaccuuccccagacuugcacugg

SEQ ID NO: 719389 - RNA, 18 nt, Homo sapiens
uaccuuucagaagguguu

SEQ ID NO: 719390 - RNA, 15 nt, Homo sapiens
uaccuuuucuuggga

SEQ ID NO: 719391 - RNA, 12 nt, Homo sapiens
uacgaagacaaa

SEQ ID NO: 719392 - RNA, 21 nt, Homo sapiens
uacgacuuauuuuguugaaau

SEQ ID NO: 719393 - RNA, 23 nt, Homo sapiens
uacgagccccacagagcaggaag

SEQ ID NO: 719394 - RNA, 15 nt, Homo sapiens
uacgcucaucaccua

SEQ ID NO: 719395 - RNA, 22 nt, Homo sapiens
uacgcuuuuauuggaaauguga

SEQ ID NO: 719396 - RNA, 16 nt, Homo sapiens
uacguauaaauaucag

SEQ ID NO: 719397 - RNA, 16 nt, Homo sapiens
uacgugagggggagcu

SEQ ID NO: 719398 - RNA, 20 nt, Homo sapiens
uacgugauccucucaccuca

SEQ ID NO: 719399 - RNA, 19 nt, Homo sapiens
uacgugcgcucugccauuc

SEQ ID NO: 719400 - RNA, 13 nt, Homo sapiens
uacguuugugcag

SEQ ID NO: 719401 - RNA, 15 nt, Homo sapiens
uacuaaaaauugugg

SEQ ID NO: 719402 - RNA, 16 nt, Homo sapiens
uacuaaggaaucuuuc

SEQ ID NO: 719403 - RNA, 13 nt, Homo sapiens
uacuaaucuuucu

SEQ ID NO: 719404 - RNA, 21 nt, Homo sapiens
uacuacaguaacugugacuga

SEQ ID NO: 719405 - RNA, 22 nt, Homo sapiens
uacuaccugucaagguuugugu

SEQ ID NO: 719406 - RNA, 14 nt, Homo sapiens
uacuacgaaguaua

SEQ ID NO: 719407 - RNA, 20 nt, Homo sapiens
uacuagagcgacugaggcag

SEQ ID NO: 719408 - RNA, 17 nt, Homo sapiens
agaaccuucaacccagu

SEQ ID NO: 719409 - RNA, 19 nt, Homo sapiens
agaacgagaagcagcauuu

SEQ ID NO: 719410 - RNA, 23 nt, Homo sapiens
agaacggggcucuucucauuuca

SEQ ID NO: 719411 - RNA, 15 nt, Homo sapiens
agaacguggugaccu

SEQ ID NO: 719412 - RNA, 19 nt, Homo sapiens
agaacguuuuuuccucagu

SEQ ID NO: 719413 - RNA, 23 nt, Homo sapiens
agaacguuuuuuccucagugcau

SEQ ID NO: 719414 - RNA, 19 nt, Homo sapiens
agaacucaaauggggccag

SEQ ID NO: 719415 - RNA, 21 nt, Homo sapiens
agaacucaaauggggccagau

SEQ ID NO: 719416 - RNA, 20 nt, Homo sapiens
agaacuccuguguguggaag

SEQ ID NO: 719417 - RNA, 19 nt, Homo sapiens
agaacugaaggcauaugca

SEQ ID NO: 719418 - RNA, 20 nt, Homo sapiens
agaacugaaggcauaugcac

SEQ ID NO: 719419 - RNA, 16 nt, Homo sapiens
agaacuggacucagga

SEQ ID NO: 719420 - RNA, 23 nt, Homo sapiens
agaacugucuauuuucucaguca

SEQ ID NO: 719421 - RNA, 14 nt, Homo sapiens
agaacugugccaca

SEQ ID NO: 719422 - RNA, 21 nt, Homo sapiens
agaacuuagccuuuaccugug

SEQ ID NO: 719423 - RNA, 19 nt, Homo sapiens
agaacuucagaaagacuug

SEQ ID NO: 719424 - RNA, 14 nt, Homo sapiens
agaacuugaccccc

SEQ ID NO: 719425 - RNA, 20 nt, Homo sapiens
agaacuuuaagucucaccca

SEQ ID NO: 719426 - RNA, 17 nt, Homo sapiens
agaacuuuucgacauau

SEQ ID NO: 719427 - RNA, 16 nt, Homo sapiens
agaacuuuuucacuuc

SEQ ID NO: 719428 - RNA, 15 nt, Homo sapiens
agaagaaaacaaagu

SEQ ID NO: 719429 - RNA, 15 nt, Homo sapiens
agaagaaauagcaga

SEQ ID NO: 719430 - RNA, 18 nt, Homo sapiens
agaagacaacauuucuca

SEQ ID NO: 719431 - RNA, 23 nt, Homo sapiens
agaagaccuugggccaagaugcu

SEQ ID NO: 719432 - RNA, 13 nt, Homo sapiens
agaagacucugac

SEQ ID NO: 719433 - RNA, 14 nt, Homo sapiens
agaagacucugacc

SEQ ID NO: 719434 - RNA, 15 nt, Homo sapiens
agaagacucugaccu

SEQ ID NO: 719435 - RNA, 17 nt, Homo sapiens
agaagacuugccugcua

SEQ ID NO: 719436 - RNA, 19 nt, Homo sapiens
agaagagaauucaguauuu

SEQ ID NO: 719437 - RNA, 15 nt, Homo sapiens
agaagagaauuccuu

SEQ ID NO: 719438 - RNA, 17 nt, Homo sapiens
agaagagugcugucauu

SEQ ID NO: 719439 - RNA, 21 nt, Homo sapiens
agaagauaauguucuuuaaug

SEQ ID NO: 719440 - RNA, 14 nt, Homo sapiens
agaagaugccagcu

SEQ ID NO: 719441 - RNA, 17 nt, Homo sapiens
agaagauuaguuaccau

SEQ ID NO: 719442 - RNA, 19 nt, Homo sapiens
agaagauuuuaugcugcug

SEQ ID NO: 719443 - RNA, 17 nt, Homo sapiens
agaagauuuuauucuua

SEQ ID NO: 719444 - RNA, 13 nt, Homo sapiens
agaagcaagacac

SEQ ID NO: 719445 - RNA, 17 nt, Homo sapiens
agaagcaagacacgugg

SEQ ID NO: 719446 - RNA, 13 nt, Homo sapiens
agaagcaaguggu

SEQ ID NO: 719447 - RNA, 16 nt, Homo sapiens
agaagcaagugguggg

SEQ ID NO: 719448 - RNA, 23 nt, Homo sapiens
agaagcaauaacuauuuuuccuc

SEQ ID NO: 719449 - RNA, 19 nt, Homo sapiens
agaagcaaugggucacuca

SEQ ID NO: 719450 - RNA, 20 nt, Homo sapiens
agaagcacccaggacuucca

SEQ ID NO: 719451 - RNA, 15 nt, Homo sapiens
agaagccgugggaag

SEQ ID NO: 719452 - RNA, 18 nt, Homo sapiens
agaagccuuaauuugcac

SEQ ID NO: 719453 - RNA, 19 nt, Homo sapiens
agaagcguuaugugcagua

SEQ ID NO: 719454 - RNA, 13 nt, Homo sapiens
agaagcucuuacu

SEQ ID NO: 719455 - RNA, 13 nt, Homo sapiens
agaagcuggugcc

SEQ ID NO: 719456 - RNA, 22 nt, Homo sapiens
agaagcuguguuagaacagcau

SEQ ID NO: 719457 - RNA, 11 nt, Homo sapiens
agaagcuuugu

SEQ ID NO: 719458 - RNA, 14 nt, Homo sapiens
agaaggaacaauaa

SEQ ID NO: 719459 - RNA, 21 nt, Homo sapiens
agaaggacucacuagacucag

SEQ ID NO: 719460 - RNA, 21 nt, Homo sapiens
agaaggaguuucacuacaauc

SEQ ID NO: 719461 - RNA, 17 nt, Homo sapiens
agaaggauguacauuuc

SEQ ID NO: 719462 - RNA, 13 nt, Homo sapiens
agaaggauuaccu

SEQ ID NO: 719463 - RNA, 14 nt, Homo sapiens
agaaggcauguucc

SEQ ID NO: 719464 - RNA, 16 nt, Homo sapiens
agaagggggugggggg

SEQ ID NO: 719465 - RNA, 22 nt, Homo sapiens
agaaggguaccuugaacacugg

SEQ ID NO: 719466 - RNA, 19 nt, Homo sapiens
agaaggucauaagggagca

SEQ ID NO: 719467 - RNA, 12 nt, Homo sapiens
agaaggugcuga

SEQ ID NO: 719468 - RNA, 20 nt, Homo sapiens
agaagguggaccuggcagug

SEQ ID NO: 719469 - RNA, 14 nt, Homo sapiens
agaagguugcucua

SEQ ID NO: 719470 - RNA, 21 nt, Homo sapiens
agaagguugguggggggucca

SEQ ID NO: 719471 - RNA, 18 nt, Homo sapiens
agaaguaagaagaggagc

SEQ ID NO: 719472 - RNA, 14 nt, Homo sapiens
agaaguaccagacu

SEQ ID NO: 719473 - RNA, 13 nt, Homo sapiens
agaaguagcuuca

SEQ ID NO: 719474 - RNA, 21 nt, Homo sapiens
agaaguaggggaagacaugca

SEQ ID NO: 719475 - RNA, 24 nt, Homo sapiens
agaaguauuuucuaguucugguca

SEQ ID NO: 719476 - RNA, 22 nt, Homo sapiens
agaagucacucacacuggccac

SEQ ID NO: 719477 - RNA, 16 nt, Homo sapiens
agaagucauggcccaa

SEQ ID NO: 719478 - RNA, 21 nt, Homo sapiens
agaagucuggcuuugcucuau

SEQ ID NO: 719479 - RNA, 13 nt, Homo sapiens
agaagucuuccca

SEQ ID NO: 719480 - RNA, 19 nt, Homo sapiens
agaagugagcuuugcugcu

SEQ ID NO: 719481 - RNA, 23 nt, Homo sapiens
agaagugauauggugaagggaag

SEQ ID NO: 719482 - RNA, 23 nt, Homo sapiens
agaagugcagaauuggggcacuu

SEQ ID NO: 719483 - RNA, 16 nt, Homo sapiens
agaagugguaggucag

SEQ ID NO: 719484 - RNA, 22 nt, Homo sapiens
agaaguguuugauggugccaga

SEQ ID NO: 719485 - RNA, 23 nt, Homo sapiens
agaaguuacacagaaaugcugcu

SEQ ID NO: 719486 - RNA, 14 nt, Homo sapiens
agaaguuuguuaua

SEQ ID NO: 719487 - RNA, 23 nt, Homo sapiens
agaaguuuguuauagauuuagcu

SEQ ID NO: 719488 - RNA, 19 nt, Homo sapiens
uacuucaaccagccuacaa

SEQ ID NO: 719489 - RNA, 17 nt, Homo sapiens
uacuucaggggcacuuc

SEQ ID NO: 719490 - RNA, 22 nt, Homo sapiens
uacuucagugcaccuacugcuu

SEQ ID NO: 719491 - RNA, 17 nt, Homo sapiens
uacuucauggacuucca

SEQ ID NO: 719492 - RNA, 23 nt, Homo sapiens
uacuucauucucucucauuauug

SEQ ID NO: 719493 - RNA, 12 nt, Homo sapiens
uacuucucacca

SEQ ID NO: 719494 - RNA, 15 nt, Homo sapiens
uacuucuguguucau

SEQ ID NO: 719495 - RNA, 17 nt, Homo sapiens
uacuucuuacuugucug

SEQ ID NO: 719496 - RNA, 16 nt, Homo sapiens
uacuucuugaauauaa

SEQ ID NO: 719497 - RNA, 14 nt, Homo sapiens
uacuugaaccuggg

SEQ ID NO: 719498 - RNA, 15 nt, Homo sapiens
uacuugaaccuggga

SEQ ID NO: 719499 - RNA, 20 nt, Homo sapiens
uacuugagaggcugaggcaa

SEQ ID NO: 719500 - RNA, 14 nt, Homo sapiens
uacuugccaagaaa

SEQ ID NO: 719501 - RNA, 15 nt, Homo sapiens
uacuugcuucucuag

SEQ ID NO: 719502 - RNA, 21 nt, Homo sapiens
uacuuuacuaauaaacugugu

SEQ ID NO: 719503 - RNA, 17 nt, Homo sapiens
uacuuuagacuaauugu

SEQ ID NO: 719504 - RNA, 14 nt, Homo sapiens
uacuuuauugcccu

SEQ ID NO: 719505 - RNA, 22 nt, Homo sapiens
uacuuuauuucugaucuauaca

SEQ ID NO: 719506 - RNA, 16 nt, Homo sapiens
uacuuugauaucugau

SEQ ID NO: 719507 - RNA, 18 nt, Homo sapiens
uacuuugauaucugauca

SEQ ID NO: 719508 - RNA, 22 nt, Homo sapiens
uacuuugcaauccaaauaaaga

SEQ ID NO: 719509 - RNA, 17 nt, Homo sapiens
uacuuugguagcuggga

SEQ ID NO: 719510 - RNA, 18 nt, Homo sapiens
uacuuuguaaauaggauu

SEQ ID NO: 719511 - RNA, 15 nt, Homo sapiens
uacuuuucacacugu

SEQ ID NO: 719512 - RNA, 17 nt, Homo sapiens
uacuuuucacacugucu

SEQ ID NO: 719513 - RNA, 13 nt, Homo sapiens
uacuuuugcuuca

SEQ ID NO: 719514 - RNA, 16 nt, Homo sapiens
uacuuuuuauacucca

SEQ ID NO: 719515 - RNA, 23 nt, Homo sapiens
uagaaaaacuuuuaaacaugaga

SEQ ID NO: 719516 - RNA, 20 nt, Homo sapiens
uagaaaacgcgaccuuggcc

SEQ ID NO: 719517 - RNA, 16 nt, Homo sapiens
uagaaaagaaagcaaa

SEQ ID NO: 719518 - RNA, 23 nt, Homo sapiens
uagaaaaugacuuauuucugcuc

SEQ ID NO: 719519 - RNA, 12 nt, Homo sapiens
uagaaacaaaca

SEQ ID NO: 719520 - RNA, 20 nt, Homo sapiens
uagaaagaaggacccagaac

SEQ ID NO: 719521 - RNA, 22 nt, Homo sapiens
uagaaagcuggacugaccaaag

SEQ ID NO: 719522 - RNA, 17 nt, Homo sapiens
uagaaaggcaaaguaca

SEQ ID NO: 719523 - RNA, 15 nt, Homo sapiens
agaauguaacuccag

SEQ ID NO: 719524 - RNA, 17 nt, Homo sapiens
agaaugugauauuugaa

SEQ ID NO: 719525 - RNA, 13 nt, Homo sapiens
agaaugugauucc

SEQ ID NO: 719526 - RNA, 15 nt, Homo sapiens
agaaugugcucaugc

SEQ ID NO: 719527 - RNA, 13 nt, Homo sapiens
agaauguuacagu

SEQ ID NO: 719528 - RNA, 13 nt, Homo sapiens
agaauuacagacu

SEQ ID NO: 719529 - RNA, 15 nt, Homo sapiens
agaauucuuacaugu

SEQ ID NO: 719530 - RNA, 23 nt, Homo sapiens
agaauuggggcacuuaaugguca

SEQ ID NO: 719531 - RNA, 13 nt, Homo sapiens
agaauuguaucau

SEQ ID NO: 719532 - RNA, 14 nt, Homo sapiens
agaauuguaucauu

SEQ ID NO: 719533 - RNA, 12 nt, Homo sapiens
agaauuucacaa

SEQ ID NO: 719534 - RNA, 18 nt, Homo sapiens
agaauuucacaagcuauu

SEQ ID NO: 719535 - RNA, 19 nt, Homo sapiens
agaauuucugcuaaauauc

SEQ ID NO: 719536 - RNA, 10 nt, Homo sapiens
agaauuugca

SEQ ID NO: 719537 - RNA, 15 nt, Homo sapiens
agaauuuguccaaua

SEQ ID NO: 719538 - RNA, 15 nt, Homo sapiens
agacaaacacugcca

SEQ ID NO: 719539 - RNA, 18 nt, Homo sapiens
agacaacagcauaacuaa

SEQ ID NO: 719540 - RNA, 14 nt, Homo sapiens
agacaagauuuaug

SEQ ID NO: 719541 - RNA, 16 nt, Homo sapiens
agacaagguucugccc

SEQ ID NO: 719542 - RNA, 14 nt, Homo sapiens
agacaauaugugag

SEQ ID NO: 719543 - RNA, 14 nt, Homo sapiens
agacaaugcagaua

SEQ ID NO: 719544 - RNA, 20 nt, Homo sapiens
agacaauucauucauuugca

SEQ ID NO: 719545 - RNA, 17 nt, Homo sapiens
agacacagaagccuuug

SEQ ID NO: 719546 - RNA, 23 nt, Homo sapiens
agacacagcgucccuagcaguga

SEQ ID NO: 719547 - RNA, 19 nt, Homo sapiens
agacacccaggacuuauuu

SEQ ID NO: 719548 - RNA, 14 nt, Homo sapiens
agacaccugaugac

SEQ ID NO: 719549 - RNA, 18 nt, Homo sapiens
agacaccuguucacagaa

SEQ ID NO: 719550 - RNA, 23 nt, Homo sapiens
agacaccuucugaguauucucau

SEQ ID NO: 719551 - RNA, 21 nt, Homo sapiens
agacaccuuggacauccuccu

SEQ ID NO: 719552 - RNA, 17 nt, Homo sapiens
agacacgacagcacaca

SEQ ID NO: 719553 - RNA, 22 nt, Homo sapiens
agacacggagcccagcccuccc

SEQ ID NO: 719554 - RNA, 20 nt, Homo sapiens
agacacuggcguuacugcuu

SEQ ID NO: 719555 - RNA, 19 nt, Homo sapiens
agacacuucccugcauuaa

SEQ ID NO: 719556 - RNA, 14 nt, Homo sapiens
agacagaaagccuc

SEQ ID NO: 719557 - RNA, 14 nt, Homo sapiens
agacagaacuugaa

SEQ ID NO: 719558 - RNA, 18 nt, Homo sapiens
agacagacuugagaacuu

SEQ ID NO: 719559 - RNA, 17 nt, Homo sapiens
agacagagaagaccaaa

SEQ ID NO: 719560 - RNA, 13 nt, Homo sapiens
agacagagucuca

SEQ ID NO: 719561 - RNA, 13 nt, Homo sapiens
agacagauauuuc

SEQ ID NO: 719562 - RNA, 15 nt, Homo sapiens
agacagcuacacaga

SEQ ID NO: 719563 - RNA, 17 nt, Homo sapiens
agacaggaaaaagacua

SEQ ID NO: 719564 - RNA, 18 nt, Homo sapiens
agacaggaacccuugcau

SEQ ID NO: 719565 - RNA, 22 nt, Homo sapiens
agacaggcaaauguacuucuca

SEQ ID NO: 719566 - RNA, 19 nt, Homo sapiens
agacaggguuucacugugu

SEQ ID NO: 719567 - RNA, 18 nt, Homo sapiens
agacaggguuucgccaug

SEQ ID NO: 719568 - RNA, 16 nt, Homo sapiens
agacagugaugccugc

SEQ ID NO: 719569 - RNA, 19 nt, Homo sapiens
agacaguguuuucugggau

SEQ ID NO: 719570 - RNA, 14 nt, Homo sapiens
agacaguucaagaa

SEQ ID NO: 719571 - RNA, 20 nt, Homo sapiens
agacauacauuuaugcacau

SEQ ID NO: 719572 - RNA, 17 nt, Homo sapiens
agacauacuccuuccau

SEQ ID NO: 719573 - RNA, 15 nt, Homo sapiens
agacauccugagcag

SEQ ID NO: 719574 - RNA, 13 nt, Homo sapiens
agacaucucagga

SEQ ID NO: 719575 - RNA, 13 nt, Homo sapiens
agacauuccacca

SEQ ID NO: 719576 - RNA, 19 nt, Homo sapiens
agacauucuuccaaaaaga

SEQ ID NO: 719577 - RNA, 13 nt, Homo sapiens
agacauugcucua

SEQ ID NO: 719578 - RNA, 13 nt, Homo sapiens
agacauuggcuua

SEQ ID NO: 719579 - RNA, 23 nt, Homo sapiens
agacauuucucuaacuccugcca

SEQ ID NO: 719580 - RNA, 13 nt, Homo sapiens
agacauuugcuga

SEQ ID NO: 719581 - RNA, 15 nt, Homo sapiens
agacauuugcugaac

SEQ ID NO: 719582 - RNA, 19 nt, Homo sapiens
agacauuugcugaacucag

SEQ ID NO: 719583 - RNA, 19 nt, Homo sapiens
agaccaaagcauugccugc

SEQ ID NO: 719584 - RNA, 22 nt, Homo sapiens
agaccaaggcgggagcaucucu

SEQ ID NO: 719585 - RNA, 15 nt, Homo sapiens
agaccacuguuauca

SEQ ID NO: 719586 - RNA, 17 nt, Homo sapiens
agaccagcuuugcagug

SEQ ID NO: 719587 - RNA, 23 nt, Homo sapiens
agaccaggccugagcaacaaagc

SEQ ID NO: 719588 - RNA, 20 nt, Homo sapiens
agaccagggcuccagccccu

SEQ ID NO: 719589 - RNA, 17 nt, Homo sapiens
agaccauccuggacuga

SEQ ID NO: 719590 - RNA, 17 nt, Homo sapiens
agaccaugccagaccca

SEQ ID NO: 719591 - RNA, 12 nt, Homo sapiens
agacccacugaa

SEQ ID NO: 719592 - RNA, 22 nt, Homo sapiens
agacccacugaaaugaccaaga

SEQ ID NO: 719593 - RNA, 16 nt, Homo sapiens
agacccaguacauccu

SEQ ID NO: 719594 - RNA, 16 nt, Homo sapiens
agacccaguaugaaau

SEQ ID NO: 719595 - RNA, 21 nt, Homo sapiens
agacccaguggacucuuccac

SEQ ID NO: 719596 - RNA, 19 nt, Homo sapiens
agacccauagcagcuuugu

SEQ ID NO: 719597 - RNA, 14 nt, Homo sapiens
agacccccauccag

SEQ ID NO: 719598 - RNA, 15 nt, Homo sapiens
agacccccauccagc

SEQ ID NO: 719599 - RNA, 17 nt, Homo sapiens
agacccuuuucucagga

SEQ ID NO: 719600 - RNA, 23 nt, Homo sapiens
agaccguucgcauggcagccauc

SEQ ID NO: 719601 - RNA, 22 nt, Homo sapiens
agaccucucaauuucuggaaaa

SEQ ID NO: 719602 - RNA, 15 nt, Homo sapiens
agaccugagaaccuu

SEQ ID NO: 719603 - RNA, 11 nt, Homo sapiens
uagaguggaau

SEQ ID NO: 719604 - RNA, 13 nt, Homo sapiens
uagaguggugcug

SEQ ID NO: 719605 - RNA, 14 nt, Homo sapiens
uagaguggugcugc

SEQ ID NO: 719606 - RNA, 18 nt, Homo sapiens
uagaguguagacuguggc

SEQ ID NO: 719607 - RNA, 17 nt, Homo sapiens
uagaguuaacaaugaua

SEQ ID NO: 719608 - RNA, 14 nt, Homo sapiens
uagaguugggacaa

SEQ ID NO: 719609 - RNA, 20 nt, Homo sapiens
uagauaaagauuucuaguag

SEQ ID NO: 719610 - RNA, 17 nt, Homo sapiens
uagauauaacacuaugu

SEQ ID NO: 719611 - RNA, 22 nt, Homo sapiens
uagauauaacacuauguuuauu

SEQ ID NO: 719612 - RNA, 23 nt, Homo sapiens
uagauauccaggcuuaccaaagu

SEQ ID NO: 719613 - RNA, 19 nt, Homo sapiens
uagaucaagcauuacacac

SEQ ID NO: 719614 - RNA, 19 nt, Homo sapiens
uagaucaaggagcccagaa

SEQ ID NO: 719615 - RNA, 16 nt, Homo sapiens
uagaucagaagacuac

SEQ ID NO: 719616 - RNA, 17 nt, Homo sapiens
uagaugcaugacuugug

SEQ ID NO: 719617 - RNA, 11 nt, Homo sapiens
uagaugcauua

SEQ ID NO: 719618 - RNA, 19 nt, Homo sapiens
uagaugcauuaguguugaa

SEQ ID NO: 719619 - RNA, 16 nt, Homo sapiens
uagaugguuugagccu

SEQ ID NO: 719620 - RNA, 14 nt, Homo sapiens
uagauguugccaug

SEQ ID NO: 719621 - RNA, 17 nt, Homo sapiens
uagauguuucaacugug

SEQ ID NO: 719622 - RNA, 17 nt, Homo sapiens
uagauuaguauuuucca

SEQ ID NO: 719623 - RNA, 21 nt, Homo sapiens
uagauuauuccaagccuuauu

SEQ ID NO: 719624 - RNA, 21 nt, Homo sapiens
uagauucucugugucuaagau

SEQ ID NO: 719625 - RNA, 13 nt, Homo sapiens
uagauuugcagcu

SEQ ID NO: 719626 - RNA, 13 nt, Homo sapiens
uagcaaaauuccu

SEQ ID NO: 719627 - RNA, 14 nt, Homo sapiens
uagcaaaauugagg

SEQ ID NO: 719628 - RNA, 13 nt, Homo sapiens
uagcaaagcaaaa

SEQ ID NO: 719629 - RNA, 14 nt, Homo sapiens
uagcaacaaaagga

SEQ ID NO: 719630 - RNA, 17 nt, Homo sapiens
uagcaagacacaucccu

SEQ ID NO: 719631 - RNA, 17 nt, Homo sapiens
uagcaaggggcucagaa

SEQ ID NO: 719632 - RNA, 14 nt, Homo sapiens
uagcaaugugccuu

SEQ ID NO: 719633 - RNA, 16 nt, Homo sapiens
uagcaauugacuguca

SEQ ID NO: 719634 - RNA, 20 nt, Homo sapiens
uagcacugacagauuuccau

SEQ ID NO: 719635 - RNA, 18 nt, Homo sapiens
uagcacugggcucugaug

SEQ ID NO: 719636 - RNA, 19 nt, Homo sapiens
uagcacugggugugagaau

SEQ ID NO: 719637 - RNA, 14 nt, Homo sapiens
uagcagacaguguu

SEQ ID NO: 719638 - RNA, 15 nt, Homo sapiens
uagcagcacacacuu

SEQ ID NO: 719639 - RNA, 22 nt, Homo sapiens
uagcagcaggcucaggcacaua

SEQ ID NO: 719640 - RNA, 18 nt, Homo sapiens
agacugaacauguuuaca

SEQ ID NO: 719641 - RNA, 16 nt, Homo sapiens
agacugagcucaaggu

SEQ ID NO: 719642 - RNA, 21 nt, Homo sapiens
agacugcaaaugcuauuguca

SEQ ID NO: 719643 - RNA, 18 nt, Homo sapiens
agacugcagcugcugaag

SEQ ID NO: 719644 - RNA, 14 nt, Homo sapiens
agacugcaucucaa

SEQ ID NO: 719645 - RNA, 22 nt, Homo sapiens
agacugcauguaccauuugcau

SEQ ID NO: 719646 - RNA, 18 nt, Homo sapiens
agacuggauucgugacaa

SEQ ID NO: 719647 - RNA, 19 nt, Homo sapiens
agacuggccuaggggccag

SEQ ID NO: 719648 - RNA, 17 nt, Homo sapiens
agacugggggcaggaug

SEQ ID NO: 719649 - RNA, 17 nt, Homo sapiens
agacugucagcuuccaa

SEQ ID NO: 719650 - RNA, 19 nt, Homo sapiens
agacugucucaagagggca

SEQ ID NO: 719651 - RNA, 14 nt, Homo sapiens
agacuguggcucaa

SEQ ID NO: 719652 - RNA, 17 nt, Homo sapiens
agacuguugccacuuaa

SEQ ID NO: 719653 - RNA, 15 nt, Homo sapiens
agacuuaacacuucu

SEQ ID NO: 719654 - RNA, 16 nt, Homo sapiens
agacuuacucuaagau

SEQ ID NO: 719655 - RNA, 19 nt, Homo sapiens
agacuuacucuaagaucuu

SEQ ID NO: 719656 - RNA, 12 nt, Homo sapiens
agacuuacugca

SEQ ID NO: 719657 - RNA, 18 nt, Homo sapiens
agacuuaggaaccuacca

SEQ ID NO: 719658 - RNA, 17 nt, Homo sapiens
agacuuauguauuagcu

SEQ ID NO: 719659 - RNA, 21 nt, Homo sapiens
agacuuccaucuagucacaaa

SEQ ID NO: 719660 - RNA, 12 nt, Homo sapiens
agacuuccccau

SEQ ID NO: 719661 - RNA, 12 nt, Homo sapiens
agacuuccugua

SEQ ID NO: 719662 - RNA, 13 nt, Homo sapiens
agacuuccuguag

SEQ ID NO: 719663 - RNA, 18 nt, Homo sapiens
agacuugaacauuugcag

SEQ ID NO: 719664 - RNA, 12 nt, Homo sapiens
agacuugcacug

SEQ ID NO: 719665 - RNA, 17 nt, Homo sapiens
agacuuucaaacauaua

SEQ ID NO: 719666 - RNA, 18 nt, Homo sapiens
agacuuucuuaucacuua

SEQ ID NO: 719667 - RNA, 20 nt, Homo sapiens
agacuuuguguucauuucau

SEQ ID NO: 719668 - RNA, 18 nt, Homo sapiens
agacuuuuguguaaaaag

SEQ ID NO: 719669 - RNA, 15 nt, Homo sapiens
agagaaaaacuaacu

SEQ ID NO: 719670 - RNA, 17 nt, Homo sapiens
agagaaaauauuacuua

SEQ ID NO: 719671 - RNA, 16 nt, Homo sapiens
agagaaagaacuauga

SEQ ID NO: 719672 - RNA, 18 nt, Homo sapiens
agagaaagaaguaggcau

SEQ ID NO: 719673 - RNA, 23 nt, Homo sapiens
agagaaagaggccagacauggug

SEQ ID NO: 719674 - RNA, 15 nt, Homo sapiens
agagaaaggacucag

SEQ ID NO: 719675 - RNA, 14 nt, Homo sapiens
agagaaauacuuuc

SEQ ID NO: 719676 - RNA, 14 nt, Homo sapiens
agagaaccaaaggg

SEQ ID NO: 719677 - RNA, 19 nt, Homo sapiens
agagaacucgcgcucagua

SEQ ID NO: 719678 - RNA, 23 nt, Homo sapiens
agagaagaccaaagcauugccug

SEQ ID NO: 719679 - RNA, 19 nt, Homo sapiens
agagaagcuccugcuacuu

SEQ ID NO: 719680 - RNA, 19 nt, Homo sapiens
agagaagguggaccuggca

SEQ ID NO: 719681 - RNA, 19 nt, Homo sapiens
agagaaucaagauaccuuu

SEQ ID NO: 719682 - RNA, 20 nt, Homo sapiens
agagaauccauccaaaguuc

SEQ ID NO: 719683 - RNA, 15 nt, Homo sapiens
agagaaugugcucau

SEQ ID NO: 719684 - RNA, 22 nt, Homo sapiens
agagaauuguaucauuugaaca

SEQ ID NO: 719685 - RNA, 13 nt, Homo sapiens
agagacacuccaa

SEQ ID NO: 719686 - RNA, 19 nt, Homo sapiens
agagacagauaacucuccu

SEQ ID NO: 719687 - RNA, 16 nt, Homo sapiens
agagacaggauuucac

SEQ ID NO: 719688 - RNA, 21 nt, Homo sapiens
agagacaggguuucacugugu

SEQ ID NO: 719689 - RNA, 12 nt, Homo sapiens
agagacccaagg

SEQ ID NO: 719690 - RNA, 18 nt, Homo sapiens
agagaccugcccucucug

SEQ ID NO: 719691 - RNA, 14 nt, Homo sapiens
agagaccuguguga

SEQ ID NO: 719692 - RNA, 20 nt, Homo sapiens
agagacggguuucaccaugu

SEQ ID NO: 719693 - RNA, 18 nt, Homo sapiens
agagacgguguuuugcca

SEQ ID NO: 719694 - RNA, 16 nt, Homo sapiens
agagacuauguagcaa

SEQ ID NO: 719695 - RNA, 22 nt, Homo sapiens
agagacucauuucacagccuuu

SEQ ID NO: 719696 - RNA, 12 nt, Homo sapiens
agagacuguaga

SEQ ID NO: 719697 - RNA, 16 nt, Homo sapiens
agagacugucccugaa

SEQ ID NO: 719698 - RNA, 13 nt, Homo sapiens
agagacugugagg

SEQ ID NO: 719699 - RNA, 18 nt, Homo sapiens
agagagacagacuugaga

SEQ ID NO: 719700 - RNA, 17 nt, Homo sapiens
agagagacccugucuca

SEQ ID NO: 719701 - RNA, 22 nt, Homo sapiens
agagagcagcuucagugacaaa

SEQ ID NO: 719702 - RNA, 15 nt, Homo sapiens
agagagcaucuuucc

SEQ ID NO: 719703 - RNA, 19 nt, Homo sapiens
agagagccgccaaacauuc

SEQ ID NO: 719704 - RNA, 20 nt, Homo sapiens
agagaggccuuuuguuuaaa

SEQ ID NO: 719705 - RNA, 13 nt, Homo sapiens
agagaggcugccu

SEQ ID NO: 719706 - RNA, 13 nt, Homo sapiens
agagagggagcag

SEQ ID NO: 719707 - RNA, 16 nt, Homo sapiens
agagagggcuuucuca

SEQ ID NO: 719708 - RNA, 12 nt, Homo sapiens
agagagucccag

SEQ ID NO: 719709 - RNA, 22 nt, Homo sapiens
agagauaacauccaacuaacuc

SEQ ID NO: 719710 - RNA, 13 nt, Homo sapiens
agagauacugaag

SEQ ID NO: 719711 - RNA, 19 nt, Homo sapiens
agagaucgagaccauccug

SEQ ID NO: 719712 - RNA, 16 nt, Homo sapiens
agagaugaaugcccag

SEQ ID NO: 719713 - RNA, 15 nt, Homo sapiens
agagaugacagggaa

SEQ ID NO: 719714 - RNA, 18 nt, Homo sapiens
agagauggauauugaaau

SEQ ID NO: 719715 - RNA, 17 nt, Homo sapiens
agagaugggacuaggac

SEQ ID NO: 719716 - RNA, 21 nt, Homo sapiens
agagcaaaucaauucuaguca

SEQ ID NO: 719717 - RNA, 17 nt, Homo sapiens
agagcaaaucuaugaga

SEQ ID NO: 719718 - RNA, 20 nt, Homo sapiens
uaggagggugugaguggcau

SEQ ID NO: 719719 - RNA, 16 nt, Homo sapiens
uaggagguuauuucaa

SEQ ID NO: 719720 - RNA, 17 nt, Homo sapiens
uaggagugauuacuaau

SEQ ID NO: 719721 - RNA, 16 nt, Homo sapiens
uaggagugguucucau

SEQ ID NO: 719722 - RNA, 14 nt, Homo sapiens
uaggauaagcacua

SEQ ID NO: 719723 - RNA, 14 nt, Homo sapiens
uaggauaagccacu

SEQ ID NO: 719724 - RNA, 15 nt, Homo sapiens
uaggauaucuuggcu

SEQ ID NO: 719725 - RNA, 15 nt, Homo sapiens
uaggauuaauaaaga

SEQ ID NO: 719726 - RNA, 16 nt, Homo sapiens
uaggauucaagucugc

SEQ ID NO: 719727 - RNA, 17 nt, Homo sapiens
uaggauucuaaucucau

SEQ ID NO: 719728 - RNA, 16 nt, Homo sapiens
uaggcaauguacucuu

SEQ ID NO: 719729 - RNA, 12 nt, Homo sapiens
uaggcagaucac

SEQ ID NO: 719730 - RNA, 20 nt, Homo sapiens
uaggcaguggccccuauuga

SEQ ID NO: 719731 - RNA, 21 nt, Homo sapiens
uaggcauguagcuacaggaca

SEQ ID NO: 719732 - RNA, 23 nt, Homo sapiens
uaggcauugcaggaccuugggca

SEQ ID NO: 719733 - RNA, 15 nt, Homo sapiens
uaggccugucccuug

SEQ ID NO: 719734 - RNA, 19 nt, Homo sapiens
uaggccuuaacacacuggc

SEQ ID NO: 719735 - RNA, 17 nt, Homo sapiens
uaggcggggcacggugg

SEQ ID NO: 719736 - RNA, 21 nt, Homo sapiens
uaggcggucaugugugcaugu

SEQ ID NO: 719737 - RNA, 23 nt, Homo sapiens
uaggcggucaugugugcauguga

SEQ ID NO: 719738 - RNA, 17 nt, Homo sapiens
uaggcuaagcacuuuau

SEQ ID NO: 719739 - RNA, 14 nt, Homo sapiens
uaggcuacaguguc

SEQ ID NO: 719740 - RNA, 21 nt, Homo sapiens
uaggcucuuaugugugccuuu

SEQ ID NO: 719741 - RNA, 21 nt, Homo sapiens
uaggcuuuaggagcucuguaa

SEQ ID NO: 719742 - RNA, 20 nt, Homo sapiens
uaggcuuuguaugacaguga

SEQ ID NO: 719743 - RNA, 14 nt, Homo sapiens
uagggaacugggga

SEQ ID NO: 719744 - RNA, 22 nt, Homo sapiens
uagggacucagggccaugccug

SEQ ID NO: 719745 - RNA, 22 nt, Homo sapiens
uagggaugccuuucuaguccua

SEQ ID NO: 719746 - RNA, 19 nt, Homo sapiens
uagggcaauauugccaugg

SEQ ID NO: 719747 - RNA, 14 nt, Homo sapiens
uagggcugagcucu

SEQ ID NO: 719748 - RNA, 18 nt, Homo sapiens
uagggcuggaagcacaga

SEQ ID NO: 719749 - RNA, 16 nt, Homo sapiens
uaggggucaggcucca

SEQ ID NO: 719750 - RNA, 23 nt, Homo sapiens
uaggguccaaccagaccuggaag

SEQ ID NO: 719751 - RNA, 16 nt, Homo sapiens
uaggguugccuguauc

SEQ ID NO: 719752 - RNA, 14 nt, Homo sapiens
uagguaaagcuaua

SEQ ID NO: 719753 - RNA, 15 nt, Homo sapiens
uagguagacuuugcu

SEQ ID NO: 719754 - RNA, 17 nt, Homo sapiens
uagguaucauucaacuc

SEQ ID NO: 719755 - RNA, 14 nt, Homo sapiens
uagguccaccugcu

SEQ ID NO: 719756 - RNA, 21 nt, Homo sapiens
agaggaaggaaaaggaggaaa

SEQ ID NO: 719757 - RNA, 19 nt, Homo sapiens
agaggaauaagaauggagc

SEQ ID NO: 719758 - RNA, 13 nt, Homo sapiens
agaggaauccaug

SEQ ID NO: 719759 - RNA, 15 nt, Homo sapiens
agaggaauguguucg

SEQ ID NO: 719760 - RNA, 20 nt, Homo sapiens
agaggacaauaaauuugaug

SEQ ID NO: 719761 - RNA, 15 nt, Homo sapiens
agaggaggggaccaa

SEQ ID NO: 719762 - RNA, 21 nt, Homo sapiens
agaggaugcucuuucccagga

SEQ ID NO: 719763 - RNA, 23 nt, Homo sapiens
agaggcagaucuggacuuggcaa

SEQ ID NO: 719764 - RNA, 24 nt, Homo sapiens
agaggcagcagagcauucagacuc

SEQ ID NO: 719765 - RNA, 20 nt, Homo sapiens
agaggcagcuucuagacaga

SEQ ID NO: 719766 - RNA, 14 nt, Homo sapiens
agaggcagugacag

SEQ ID NO: 719767 - RNA, 23 nt, Homo sapiens
agaggcauuuggaacaacaaauc

SEQ ID NO: 719768 - RNA, 22 nt, Homo sapiens
agaggccuggagcccacaaccu

SEQ ID NO: 719769 - RNA, 15 nt, Homo sapiens
agaggcucugagaaa

SEQ ID NO: 719770 - RNA, 14 nt, Homo sapiens
agaggcugccucag

SEQ ID NO: 719771 - RNA, 16 nt, Homo sapiens
agaggcuuucuccagg

SEQ ID NO: 719772 - RNA, 22 nt, Homo sapiens
agagggaagugucaugcaagug

SEQ ID NO: 719773 - RNA, 22 nt, Homo sapiens
agagggagacuuguucuagaga

SEQ ID NO: 719774 - RNA, 16 nt, Homo sapiens
agagggagagcagaga

SEQ ID NO: 719775 - RNA, 18 nt, Homo sapiens
agagggaggucacuggaa

SEQ ID NO: 719776 - RNA, 16 nt, Homo sapiens
agagggcaggggugcu

SEQ ID NO: 719777 - RNA, 18 nt, Homo sapiens
agagggcauauacaguga

SEQ ID NO: 719778 - RNA, 18 nt, Homo sapiens
agagggccauugaacucu

SEQ ID NO: 719779 - RNA, 15 nt, Homo sapiens
agagggcccagccca

SEQ ID NO: 719780 - RNA, 14 nt, Homo sapiens
agagggcccaggca

SEQ ID NO: 719781 - RNA, 15 nt, Homo sapiens
agagggcccaucagg

SEQ ID NO: 719782 - RNA, 22 nt, Homo sapiens
agagggcuguuggacagcugcu

SEQ ID NO: 719783 - RNA, 20 nt, Homo sapiens
agaggggagagagacuggag

SEQ ID NO: 719784 - RNA, 23 nt, Homo sapiens
agaggggcuccccgggucucuca

SEQ ID NO: 719785 - RNA, 22 nt, Homo sapiens
agagggggcgauauagagaaua

SEQ ID NO: 719786 - RNA, 23 nt, Homo sapiens
agagggguggaguuuuaacugua

SEQ ID NO: 719787 - RNA, 22 nt, Homo sapiens
agagguagguaggaucauccca

SEQ ID NO: 719788 - RNA, 15 nt, Homo sapiens
agaggucaccagcug

SEQ ID NO: 719789 - RNA, 19 nt, Homo sapiens
agagguccuggccaucaaa

SEQ ID NO: 719790 - RNA, 22 nt, Homo sapiens
agaggugcagcuggaggcugcu

SEQ ID NO: 719791 - RNA, 13 nt, Homo sapiens
agaggugcuucug

SEQ ID NO: 719792 - RNA, 15 nt, Homo sapiens
agagguuucuugaau

SEQ ID NO: 719793 - RNA, 22 nt, Homo sapiens
agagguuugagaccgaccagcc

SEQ ID NO: 719794 - RNA, 17 nt, Homo sapiens
agaguagaacagauaau

SEQ ID NO: 719795 - RNA, 22 nt, Homo sapiens
agaguagaacagauaaucagug

SEQ ID NO: 719796 - RNA, 20 nt, Homo sapiens
agaguauaugcacuuuccaa

SEQ ID NO: 719797 - RNA, 15 nt, Homo sapiens
agaguauccuaccca

SEQ ID NO: 719798 - RNA, 22 nt, Homo sapiens
agaguaugagucuucuguaauu

SEQ ID NO: 719799 - RNA, 21 nt, Homo sapiens
agaguauuuuuaacacuuaaa

SEQ ID NO: 719800 - RNA, 13 nt, Homo sapiens
agagucuaaagau

SEQ ID NO: 719801 - RNA, 22 nt, Homo sapiens
agagucuaauagucuuugccag

SEQ ID NO: 719802 - RNA, 23 nt, Homo sapiens
agagucuaggcuaagcacuuuau

SEQ ID NO: 719803 - RNA, 15 nt, Homo sapiens
agagucuccaguuua

SEQ ID NO: 719804 - RNA, 14 nt, Homo sapiens
agagucuucccuac

SEQ ID NO: 719805 - RNA, 19 nt, Homo sapiens
agagugagacuccaucuca

SEQ ID NO: 719806 - RNA, 19 nt, Homo sapiens
agagugagcaugagcucac

SEQ ID NO: 719807 - RNA, 15 nt, Homo sapiens
agagugauugcagcu

SEQ ID NO: 719808 - RNA, 19 nt, Homo sapiens
agagugcaacccagucaca

SEQ ID NO: 719809 - RNA, 10 nt, Homo sapiens
agagugccac

SEQ ID NO: 719810 - RNA, 21 nt, Homo sapiens
agagugcccagaacuggacuc

SEQ ID NO: 719811 - RNA, 21 nt, Homo sapiens
agagugccguaacaacugugg

SEQ ID NO: 719812 - RNA, 22 nt, Homo sapiens
agagugccguaacaacuguggu

SEQ ID NO: 719813 - RNA, 21 nt, Homo sapiens
agaguggccuggccaggagcu

SEQ ID NO: 719814 - RNA, 17 nt, Homo sapiens
agaguggucgagugaca

SEQ ID NO: 719815 - RNA, 21 nt, Homo sapiens
agagugugugauuagaagcua

SEQ ID NO: 719816 - RNA, 19 nt, Homo sapiens
agaguguuaucagucauaa

SEQ ID NO: 719817 - RNA, 14 nt, Homo sapiens
agaguuccuucuca

SEQ ID NO: 719818 - RNA, 16 nt, Homo sapiens
agaguuguacacugug

SEQ ID NO: 719819 - RNA, 21 nt, Homo sapiens
agaguuucaaaagcaaaacau

SEQ ID NO: 719820 - RNA, 14 nt, Homo sapiens
agauaaaccaauaa

SEQ ID NO: 719821 - RNA, 15 nt, Homo sapiens
agauaaacugauguu

SEQ ID NO: 719822 - RNA, 20 nt, Homo sapiens
agauaaagucaaaugccaaa

SEQ ID NO: 719823 - RNA, 18 nt, Homo sapiens
agauaaccuguacuucaa

SEQ ID NO: 719824 - RNA, 13 nt, Homo sapiens
agauaacuaaggu

SEQ ID NO: 719825 - RNA, 16 nt, Homo sapiens
agauaagaaaagccug

SEQ ID NO: 719826 - RNA, 13 nt, Homo sapiens
agauaagcaagag

SEQ ID NO: 719827 - RNA, 16 nt, Homo sapiens
agauaaguuggagcag

SEQ ID NO: 719828 - RNA, 12 nt, Homo sapiens
agauaaucagug

SEQ ID NO: 719829 - RNA, 18 nt, Homo sapiens
agauaaucagugugucua

SEQ ID NO: 719830 - RNA, 20 nt, Homo sapiens
agauaauugaauaaguaccu

SEQ ID NO: 719831 - RNA, 14 nt, Homo sapiens
agauaauuggcaac

SEQ ID NO: 719832 - RNA, 17 nt, Homo sapiens
uaguugguuuccuucac

SEQ ID NO: 719833 - RNA, 16 nt, Homo sapiens
uaguuguagacaaagu

SEQ ID NO: 719834 - RNA, 15 nt, Homo sapiens
uaguuguaucucuuu

SEQ ID NO: 719835 - RNA, 19 nt, Homo sapiens
uaguuuaggagaaaccagc

SEQ ID NO: 719836 - RNA, 21 nt, Homo sapiens
uaguuuaguacaauaaucucu

SEQ ID NO: 719837 - RNA, 13 nt, Homo sapiens
uaguuuccuuuag

SEQ ID NO: 719838 - RNA, 22 nt, Homo sapiens
uaguuugauacucccagucuug

SEQ ID NO: 719839 - RNA, 22 nt, Homo sapiens
uaguuuuaccuaccccagucuu

SEQ ID NO: 719840 - RNA, 16 nt, Homo sapiens
uaguuuuaguugcaga

SEQ ID NO: 719841 - RNA, 19 nt, Homo sapiens
uaguuuucuagaugacaua

SEQ ID NO: 719842 - RNA, 20 nt, Homo sapiens
uaguuuugucaaacuguaga

SEQ ID NO: 719843 - RNA, 14 nt, Homo sapiens
uauaaaaaguggag

SEQ ID NO: 719844 - RNA, 13 nt, Homo sapiens
uauaaaacaguca

SEQ ID NO: 719845 - RNA, 14 nt, Homo sapiens
uauaaaauacauaa

SEQ ID NO: 719846 - RNA, 17 nt, Homo sapiens
uauaaaauacauaauau

SEQ ID NO: 719847 - RNA, 20 nt, Homo sapiens
uauaaacagacaauauguga

SEQ ID NO: 719848 - RNA, 23 nt, Homo sapiens
uauaaacuauaaccucuccuuca

SEQ ID NO: 719849 - RNA, 16 nt, Homo sapiens
uauaaagaagaacuug

SEQ ID NO: 719850 - RNA, 22 nt, Homo sapiens
uauaaagaagaacuugcaugga

SEQ ID NO: 719851 - RNA, 17 nt, Homo sapiens
uauaaagacaacaaaag

SEQ ID NO: 719852 - RNA, 15 nt, Homo sapiens
uauaaagauacuaaa

SEQ ID NO: 719853 - RNA, 14 nt, Homo sapiens
uauaaaguauucaa

SEQ ID NO: 719854 - RNA, 22 nt, Homo sapiens
uauaaaguugguucacuucaaa

SEQ ID NO: 719855 - RNA, 21 nt, Homo sapiens
uauaaauacagcauacuucaa

SEQ ID NO: 719856 - RNA, 14 nt, Homo sapiens
uauaaauacaugca

SEQ ID NO: 719857 - RNA, 22 nt, Homo sapiens
uauaaaugaauuugcauaccag

SEQ ID NO: 719858 - RNA, 20 nt, Homo sapiens
uauaaaugggaaaucagugu

SEQ ID NO: 719859 - RNA, 13 nt, Homo sapiens
uauaaauguuugu

SEQ ID NO: 719860 - RNA, 16 nt, Homo sapiens
uauaaauuuaagcaaa

SEQ ID NO: 719861 - RNA, 15 nt, Homo sapiens
uauaacaaacuacau

SEQ ID NO: 719862 - RNA, 21 nt, Homo sapiens
uauaacaaacuacauguaauc

SEQ ID NO: 719863 - RNA, 13 nt, Homo sapiens
uauaacacuguga

SEQ ID NO: 719864 - RNA, 21 nt, Homo sapiens
uauaacagaauuaaaguagau

SEQ ID NO: 719865 - RNA, 22 nt, Homo sapiens
uauaacccuaggaauuuagaca

SEQ ID NO: 719866 - RNA, 13 nt, Homo sapiens
uauaaccuggcaa

SEQ ID NO: 719867 - RNA, 21 nt, Homo sapiens
uauaaccuuguucucugcuug

SEQ ID NO: 719868 - RNA, 12 nt, Homo sapiens
uauaacuugucu

SEQ ID NO: 719869 - RNA, 13 nt, Homo sapiens
uauaagacuacua

SEQ ID NO: 719870 - RNA, 17 nt, Homo sapiens
agauccccccacugagc

SEQ ID NO: 719871 - RNA, 18 nt, Homo sapiens
agauccccccacugagcu

SEQ ID NO: 719872 - RNA, 16 nt, Homo sapiens
agauccccguguuacu

SEQ ID NO: 719873 - RNA, 17 nt, Homo sapiens
agauccgagugugauuu

SEQ ID NO: 719874 - RNA, 20 nt, Homo sapiens
agauccuaagucucuuacaa

SEQ ID NO: 719875 - RNA, 20 nt, Homo sapiens
agauccugaagcaguucaga

SEQ ID NO: 719876 - RNA, 19 nt, Homo sapiens
agaucgcgccacugcacuc

SEQ ID NO: 719877 - RNA, 16 nt, Homo sapiens
agaucguuuaaaaaca

SEQ ID NO: 719878 - RNA, 20 nt, Homo sapiens
agaucuaagccuuuccauaa

SEQ ID NO: 719879 - RNA, 19 nt, Homo sapiens
agaucuccaacagccagug

SEQ ID NO: 719880 - RNA, 16 nt, Homo sapiens
agaucuccuggcaaag

SEQ ID NO: 719881 - RNA, 22 nt, Homo sapiens
agaucucucgaaugcugagaag

SEQ ID NO: 719882 - RNA, 19 nt, Homo sapiens
agaucuggaaccucagccu

SEQ ID NO: 719883 - RNA, 20 nt, Homo sapiens
agaucuggggaggcaggcau

SEQ ID NO: 719884 - RNA, 22 nt, Homo sapiens
agaucuggucccuugcagcuag

SEQ ID NO: 719885 - RNA, 13 nt, Homo sapiens
agaucugucuuga

SEQ ID NO: 719886 - RNA, 10 nt, Homo sapiens
agaucuugau

SEQ ID NO: 719887 - RNA, 20 nt, Homo sapiens
agaucuuucaggaaagacgg

SEQ ID NO: 719888 - RNA, 21 nt, Homo sapiens
agaucuuuguguccagaguuu

SEQ ID NO: 719889 - RNA, 21 nt, Homo sapiens
agaucuuuucuugaccuagua

SEQ ID NO: 719890 - RNA, 17 nt, Homo sapiens
agaugaaauucaagccu

SEQ ID NO: 719891 - RNA, 21 nt, Homo sapiens
agaugaacccgaggcugagaa

SEQ ID NO: 719892 - RNA, 15 nt, Homo sapiens
agaugaauaugagcu

SEQ ID NO: 719893 - RNA, 17 nt, Homo sapiens
agaugacgaguaacucc

SEQ ID NO: 719894 - RNA, 18 nt, Homo sapiens
agaugacggaugccuaga

SEQ ID NO: 719895 - RNA, 21 nt, Homo sapiens
agaugagccccacguggagcu

SEQ ID NO: 719896 - RNA, 17 nt, Homo sapiens
agaugaggcacuggaag

SEQ ID NO: 719897 - RNA, 16 nt, Homo sapiens
agaugcaaugugcuac

SEQ ID NO: 719898 - RNA, 22 nt, Homo sapiens
agaugcacagaauauguaugua

SEQ ID NO: 719899 - RNA, 12 nt, Homo sapiens
agaugcacugaa

SEQ ID NO: 719900 - RNA, 21 nt, Homo sapiens
agaugcaggaggcucagguga

SEQ ID NO: 719901 - RNA, 20 nt, Homo sapiens
agaugcaggauguucaggga

SEQ ID NO: 719902 - RNA, 19 nt, Homo sapiens
agaugcauggcuggcacau

SEQ ID NO: 719903 - RNA, 18 nt, Homo sapiens
agaugccaaaccacaaga

SEQ ID NO: 719904 - RNA, 23 nt, Homo sapiens
agaugccgcggaaggucccucag

SEQ ID NO: 719905 - RNA, 15 nt, Homo sapiens
agaugcgcacugcau

SEQ ID NO: 719906 - RNA, 16 nt, Homo sapiens
agaugcuccaagauuc

SEQ ID NO: 719907 - RNA, 23 nt, Homo sapiens
agaugcucuacuuuuuccuuuua

SEQ ID NO: 719908 - RNA, 20 nt, Homo sapiens
agaugcugacuguacuccuc

SEQ ID NO: 719909 - RNA, 14 nt, Homo sapiens
agaugcugauucau

SEQ ID NO: 719910 - RNA, 15 nt, Homo sapiens
agaugcuugguugug

SEQ ID NO: 719911 - RNA, 20 nt, Homo sapiens
agauggaaaacaaaccaucu

SEQ ID NO: 719912 - RNA, 20 nt, Homo sapiens
agauggaaaagaaauugcau

SEQ ID NO: 719913 - RNA, 17 nt, Homo sapiens
agauggacaacucaaug

SEQ ID NO: 719914 - RNA, 19 nt, Homo sapiens
agauggaccugccugcaua

SEQ ID NO: 719915 - RNA, 15 nt, Homo sapiens
agauggagguuuacc

SEQ ID NO: 719916 - RNA, 12 nt, Homo sapiens
agauggaguucu

SEQ ID NO: 719917 - RNA, 16 nt, Homo sapiens
agauggauagucuguc

SEQ ID NO: 719918 - RNA, 18 nt, Homo sapiens
agauggauagucugucca

SEQ ID NO: 719919 - RNA, 15 nt, Homo sapiens
agauggauugauaau

SEQ ID NO: 719920 - RNA, 15 nt, Homo sapiens
agaugggacaagcag

SEQ ID NO: 719921 - RNA, 13 nt, Homo sapiens
agauggggaggag

SEQ ID NO: 719922 - RNA, 17 nt, Homo sapiens
agaugggggaacuguga

SEQ ID NO: 719923 - RNA, 21 nt, Homo sapiens
agauggggucucacaguguug

SEQ ID NO: 719924 - RNA, 16 nt, Homo sapiens
agauggguggcaccaa

SEQ ID NO: 719925 - RNA, 22 nt, Homo sapiens
agaugguguggguguccugccu

SEQ ID NO: 719926 - RNA, 16 nt, Homo sapiens
agaugguuucuugcaa

SEQ ID NO: 719927 - RNA, 18 nt, Homo sapiens
agauguacaaaacaguuu

SEQ ID NO: 719928 - RNA, 12 nt, Homo sapiens
agauguacugca

SEQ ID NO: 719929 - RNA, 18 nt, Homo sapiens
agaugucuagguacuuca

SEQ ID NO: 719930 - RNA, 19 nt, Homo sapiens
agaugucuucugccuguua

SEQ ID NO: 719931 - RNA, 21 nt, Homo sapiens
agaugucuucugccuguuaua

SEQ ID NO: 719932 - RNA, 21 nt, Homo sapiens
agaugugacccaccagugccu

SEQ ID NO: 719933 - RNA, 22 nt, Homo sapiens
agaugugauuuggaccauggca

SEQ ID NO: 719934 - RNA, 15 nt, Homo sapiens
agaugugcauuucac

SEQ ID NO: 719935 - RNA, 18 nt, Homo sapiens
agaugugcuuugcugcac

SEQ ID NO: 719936 - RNA, 22 nt, Homo sapiens
agaugugggcagugaugucacu

SEQ ID NO: 719937 - RNA, 18 nt, Homo sapiens
agauguggucaauggaag

SEQ ID NO: 719938 - RNA, 16 nt, Homo sapiens
agauguguuaggaaug

SEQ ID NO: 719939 - RNA, 14 nt, Homo sapiens
agauguguucuccu

SEQ ID NO: 719940 - RNA, 17 nt, Homo sapiens
agauguuacaaguuuau

SEQ ID NO: 719941 - RNA, 16 nt, Homo sapiens
agauguuauuacuguu

SEQ ID NO: 719942 - RNA, 20 nt, Homo sapiens
agauguucuuuucuauuuau

SEQ ID NO: 719943 - RNA, 21 nt, Homo sapiens
agauguugauuuuuacugugu

SEQ ID NO: 719944 - RNA, 12 nt, Homo sapiens
agauguuuauuu

SEQ ID NO: 719945 - RNA, 14 nt, Homo sapiens
agauguuuauuuca

SEQ ID NO: 719946 - RNA, 16 nt, Homo sapiens
uauauguuuauauacu

SEQ ID NO: 719947 - RNA, 13 nt, Homo sapiens
uauauuaauauca

SEQ ID NO: 719948 - RNA, 11 nt, Homo sapiens
uauauucacag

SEQ ID NO: 719949 - RNA, 18 nt, Homo sapiens
uauauucaguaaugaaga

SEQ ID NO: 719950 - RNA, 11 nt, Homo sapiens
uauauucuuga

SEQ ID NO: 719951 - RNA, 21 nt, Homo sapiens
uauauugcuuaccugaucuca

SEQ ID NO: 719952 - RNA, 11 nt, Homo sapiens
uauauuugcua

SEQ ID NO: 719953 - RNA, 18 nt, Homo sapiens
uauauuuguaaagcuauu

SEQ ID NO: 719954 - RNA, 16 nt, Homo sapiens
uauauuuuaaauaccc

SEQ ID NO: 719955 - RNA, 14 nt, Homo sapiens
uauauuuuggcuca

SEQ ID NO: 719956 - RNA, 18 nt, Homo sapiens
uauauuuuuauaagacua

SEQ ID NO: 719957 - RNA, 22 nt, Homo sapiens
uauauuuuuguacugaaucuca

SEQ ID NO: 719958 - RNA, 11 nt, Homo sapiens
uaucaaaaagc

SEQ ID NO: 719959 - RNA, 15 nt, Homo sapiens
uaucaaaaagcuaau

SEQ ID NO: 719960 - RNA, 16 nt, Homo sapiens
uaucaaaaaguauuau

SEQ ID NO: 719961 - RNA, 21 nt, Homo sapiens
uaucaaacccuagccuugcuu

SEQ ID NO: 719962 - RNA, 20 nt, Homo sapiens
uaucaaauagcgaugugcag

SEQ ID NO: 719963 - RNA, 12 nt, Homo sapiens
uaucaacuuuag

SEQ ID NO: 719964 - RNA, 14 nt, Homo sapiens
uaucaagcuuuuaa

SEQ ID NO: 719965 - RNA, 15 nt, Homo sapiens
uaucaagucauggca

SEQ ID NO: 719966 - RNA, 21 nt, Homo sapiens
uaucaccuagcagccucaaaa

SEQ ID NO: 719967 - RNA, 22 nt, Homo sapiens
uaucaccucauucugaacccuu

SEQ ID NO: 719968 - RNA, 16 nt, Homo sapiens
uaucacgccuacuuaa

SEQ ID NO: 719969 - RNA, 18 nt, Homo sapiens
uaucacuucacuguucuc

SEQ ID NO: 719970 - RNA, 14 nt, Homo sapiens
uaucagaauucuca

SEQ ID NO: 719971 - RNA, 13 nt, Homo sapiens
uaucagacaagca

SEQ ID NO: 719972 - RNA, 21 nt, Homo sapiens
uaucagacucuguaauugaau

SEQ ID NO: 719973 - RNA, 19 nt, Homo sapiens
uaucagccugugccacgau

SEQ ID NO: 719974 - RNA, 21 nt, Homo sapiens
uaucagugcuucccgagugag

SEQ ID NO: 719975 - RNA, 16 nt, Homo sapiens
uaucaguuaccaaaca

SEQ ID NO: 719976 - RNA, 19 nt, Homo sapiens
uaucauaacuauacuugau

SEQ ID NO: 719977 - RNA, 18 nt, Homo sapiens
uaucauaauucagcacuu

SEQ ID NO: 719978 - RNA, 20 nt, Homo sapiens
uaucauauuauuauccuccu

SEQ ID NO: 719979 - RNA, 16 nt, Homo sapiens
uaucauggcauauaac

SEQ ID NO: 719980 - RNA, 16 nt, Homo sapiens
uaucaugguagucacu

SEQ ID NO: 719981 - RNA, 20 nt, Homo sapiens
uaucaugguagucacuaaca

SEQ ID NO: 719982 - RNA, 15 nt, Homo sapiens
uaucauguaccucag

SEQ ID NO: 719983 - RNA, 16 nt, Homo sapiens
uaucauguuaaauuag

SEQ ID NO: 719984 - RNA, 19 nt, Homo sapiens
uaucauucagcaucuacuc

SEQ ID NO: 719985 - RNA, 22 nt, Homo sapiens
agauuuugaaugcuuccugaca

SEQ ID NO: 719986 - RNA, 23 nt, Homo sapiens
agauuuugggagaguaaagcuaa

SEQ ID NO: 719987 - RNA, 19 nt, Homo sapiens
agcaaaaacauguaugugc

SEQ ID NO: 719988 - RNA, 21 nt, Homo sapiens
agcaaaaacauguaugugcau

SEQ ID NO: 719989 - RNA, 20 nt, Homo sapiens
agcaaaacaauaaacuagca

SEQ ID NO: 719990 - RNA, 17 nt, Homo sapiens
agcaaaacuccaucuca

SEQ ID NO: 719991 - RNA, 18 nt, Homo sapiens
agcaaaacuccaucucaa

SEQ ID NO: 719992 - RNA, 18 nt, Homo sapiens
agcaaaagggaggaacac

SEQ ID NO: 719993 - RNA, 13 nt, Homo sapiens
agcaaaaugucuc

SEQ ID NO: 719994 - RNA, 19 nt, Homo sapiens
agcaaaccgcccugcagca

SEQ ID NO: 719995 - RNA, 21 nt, Homo sapiens
agcaaacgucuauuuuguaua

SEQ ID NO: 719996 - RNA, 19 nt, Homo sapiens
agcaaagauuaaauguguc

SEQ ID NO: 719997 - RNA, 17 nt, Homo sapiens
agcaaaggaaacuuugc

SEQ ID NO: 719998 - RNA, 17 nt, Homo sapiens
agcaaauaaagaccuga

SEQ ID NO: 719999 - RNA, 15 nt, Homo sapiens
agcaaauacaauuca

SEQ ID NO: 720000 - RNA, 14 nt, Homo sapiens
agcaaaucuaugag

SEQ ID NO: 720001 - RNA, 18 nt, Homo sapiens
agcaaauggcagaaccaa

SEQ ID NO: 720002 - RNA, 13 nt, Homo sapiens
agcaaaugugacc

SEQ ID NO: 720003 - RNA, 19 nt, Homo sapiens
agcaaauuucuaucagccu

SEQ ID NO: 720004 - RNA, 15 nt, Homo sapiens
agcaacaagaccacc

SEQ ID NO: 720005 - RNA, 21 nt, Homo sapiens
agcaacacucuauauuuagau

SEQ ID NO: 720006 - RNA, 15 nt, Homo sapiens
agcaacaguuaucac

SEQ ID NO: 720007 - RNA, 20 nt, Homo sapiens
agcaacccuuccugcugcug

SEQ ID NO: 720008 - RNA, 20 nt, Homo sapiens
agcaagacauacuuaaugca

SEQ ID NO: 720009 - RNA, 16 nt, Homo sapiens
agcaagaccucaucuc

SEQ ID NO: 720010 - RNA, 22 nt, Homo sapiens
agcaagaucccauggguugugu

SEQ ID NO: 720011 - RNA, 14 nt, Homo sapiens
agcaagcacugugg

SEQ ID NO: 720012 - RNA, 17 nt, Homo sapiens
agcaagcacuguggucu

SEQ ID NO: 720013 - RNA, 14 nt, Homo sapiens
agcaagcuauucaa

SEQ ID NO: 720014 - RNA, 17 nt, Homo sapiens
agcaaggccuuggugga

SEQ ID NO: 720015 - RNA, 14 nt, Homo sapiens
agcaagucacuuaa

SEQ ID NO: 720016 - RNA, 20 nt, Homo sapiens
agcaagucuuagacaucaua

SEQ ID NO: 720017 - RNA, 21 nt, Homo sapiens
agcaagugaauuuuucucuaa

SEQ ID NO: 720018 - RNA, 15 nt, Homo sapiens
agcaauaacauuccc

SEQ ID NO: 720019 - RNA, 14 nt, Homo sapiens
agcaauacaaagac

SEQ ID NO: 720020 - RNA, 18 nt, Homo sapiens
agcaauacguuugugcag

SEQ ID NO: 720021 - RNA, 16 nt, Homo sapiens
agcaauacuaagggaa

SEQ ID NO: 720022 - RNA, 12 nt, Homo sapiens
agcaaugaugac

SEQ ID NO: 720023 - RNA, 14 nt, Homo sapiens
agcaaugaugucca

SEQ ID NO: 720024 - RNA, 20 nt, Homo sapiens
agcaaugcaagcagccuagc

SEQ ID NO: 720025 - RNA, 15 nt, Homo sapiens
agcaaugccauuuca

SEQ ID NO: 720026 - RNA, 15 nt, Homo sapiens
agcaauggaguggcu

SEQ ID NO: 720027 - RNA, 18 nt, Homo sapiens
agcaauuaguaagccaug

SEQ ID NO: 720028 - RNA, 20 nt, Homo sapiens
agcaauuauuuuaagcacuu

SEQ ID NO: 720029 - RNA, 23 nt, Homo sapiens
agcaauuccaggcugagccauga

SEQ ID NO: 720030 - RNA, 17 nt, Homo sapiens
agcaauucuccugccuc

SEQ ID NO: 720031 - RNA, 22 nt, Homo sapiens
agcacaaagcccauagcacugg

SEQ ID NO: 720032 - RNA, 22 nt, Homo sapiens
agcacaagcaggugaacuggga

SEQ ID NO: 720033 - RNA, 22 nt, Homo sapiens
agcacaagccacaagucuucca

SEQ ID NO: 720034 - RNA, 15 nt, Homo sapiens
agcacaauuugcacu

SEQ ID NO: 720035 - RNA, 21 nt, Homo sapiens
agcacaauuugcacuaaauca

SEQ ID NO: 720036 - RNA, 17 nt, Homo sapiens
agcacaccaaguggcug

SEQ ID NO: 720037 - RNA, 12 nt, Homo sapiens
agcacacgucau

SEQ ID NO: 720038 - RNA, 11 nt, Homo sapiens
agcacacugua

SEQ ID NO: 720039 - RNA, 16 nt, Homo sapiens
agcacacuuuacacaa

SEQ ID NO: 720040 - RNA, 16 nt, Homo sapiens
agcacacuuuuccaca

SEQ ID NO: 720041 - RNA, 12 nt, Homo sapiens
agcacacuuuuu

SEQ ID NO: 720042 - RNA, 13 nt, Homo sapiens
agcacagaauuug

SEQ ID NO: 720043 - RNA, 16 nt, Homo sapiens
agcacagcuugaccug

SEQ ID NO: 720044 - RNA, 18 nt, Homo sapiens
agcacagugccugacaca

SEQ ID NO: 720045 - RNA, 15 nt, Homo sapiens
agcacagugccugca

SEQ ID NO: 720046 - RNA, 18 nt, Homo sapiens
agcacaucaauuacaagc

SEQ ID NO: 720047 - RNA, 13 nt, Homo sapiens
agcacauggccau

SEQ ID NO: 720048 - RNA, 16 nt, Homo sapiens
agcacaugguuuaaau

SEQ ID NO: 720049 - RNA, 16 nt, Homo sapiens
agcaccaaccuuccaa

SEQ ID NO: 720050 - RNA, 23 nt, Homo sapiens
agcaccagcgguccaacgccgcc

SEQ ID NO: 720051 - RNA, 14 nt, Homo sapiens
agcaccccaugcca

SEQ ID NO: 720052 - RNA, 22 nt, Homo sapiens
agcacccucuggauucugaauc

SEQ ID NO: 720053 - RNA, 20 nt, Homo sapiens
agcacccugcccaccaagaa

SEQ ID NO: 720054 - RNA, 17 nt, Homo sapiens
agcacccugggugccau

SEQ ID NO: 720055 - RNA, 18 nt, Homo sapiens
agcaccuccagccugaac

SEQ ID NO: 720056 - RNA, 13 nt, Homo sapiens
agcaccuccaugu

SEQ ID NO: 720057 - RNA, 21 nt, Homo sapiens
agcaccugaagugaccuggaa

SEQ ID NO: 720058 - RNA, 21 nt, Homo sapiens
agcaccugauucucacagcaa

SEQ ID NO: 720059 - RNA, 18 nt, Homo sapiens
agcacgagcuggaaccca

SEQ ID NO: 720060 - RNA, 14 nt, Homo sapiens
agcacggacucucc

SEQ ID NO: 720061 - RNA, 19 nt, Homo sapiens
agcacuaaccaaugccuuu

SEQ ID NO: 720062 - RNA, 17 nt, Homo sapiens
agcacuacaccuugccu

SEQ ID NO: 720063 - RNA, 13 nt, Homo sapiens
agcacuagaauau

SEQ ID NO: 720064 - RNA, 11 nt, Homo sapiens
agcacugagca

SEQ ID NO: 720065 - RNA, 17 nt, Homo sapiens
agcacugggcucugaug

SEQ ID NO: 720066 - RNA, 15 nt, Homo sapiens
agcacuguucugucc

SEQ ID NO: 720067 - RNA, 15 nt, Homo sapiens
agcacuguuuauaca

SEQ ID NO: 720068 - RNA, 20 nt, Homo sapiens
agcacuuagcaggcaccgcc

SEQ ID NO: 720069 - RNA, 12 nt, Homo sapiens
agcacuugucca

SEQ ID NO: 720070 - RNA, 19 nt, Homo sapiens
agcacuuuagaucacuuga

SEQ ID NO: 720071 - RNA, 17 nt, Homo sapiens
agcacuuugcacuuaau

SEQ ID NO: 720072 - RNA, 15 nt, Homo sapiens
agcacuuugccaugc

SEQ ID NO: 720073 - RNA, 20 nt, Homo sapiens
agcacuuugggagacugaag

SEQ ID NO: 720074 - RNA, 20 nt, Homo sapiens
agcagaagagaaaauguugu

SEQ ID NO: 720075 - RNA, 20 nt, Homo sapiens
agcagaauguuguacuugaa

SEQ ID NO: 720076 - RNA, 17 nt, Homo sapiens
agcagagauguacugca

SEQ ID NO: 720077 - RNA, 19 nt, Homo sapiens
agcagaggcguacuaccca

SEQ ID NO: 720078 - RNA, 17 nt, Homo sapiens
agcagagugcacagcug

SEQ ID NO: 720079 - RNA, 18 nt, Homo sapiens
agcagagugcacagcugu

SEQ ID NO: 720080 - RNA, 13 nt, Homo sapiens
agcagaugaugcc

SEQ ID NO: 720081 - RNA, 14 nt, Homo sapiens
agcagaugauuccc

SEQ ID NO: 720082 - RNA, 19 nt, Homo sapiens
agcagauuucuaugguacc

SEQ ID NO: 720083 - RNA, 13 nt, Homo sapiens
agcagauuugcac

SEQ ID NO: 720084 - RNA, 22 nt, Homo sapiens
agcagcacaccucagccccacu

SEQ ID NO: 720085 - RNA, 19 nt, Homo sapiens
agcagcaccuccuccaugc

SEQ ID NO: 720086 - RNA, 22 nt, Homo sapiens
agcagcaccuccuccaugcagg

SEQ ID NO: 720087 - RNA, 15 nt, Homo sapiens
agcagcaucuucaaa

SEQ ID NO: 720088 - RNA, 14 nt, Homo sapiens
agcagcaucuuuaa

SEQ ID NO: 720089 - RNA, 18 nt, Homo sapiens
agcagccagagcugugcc

SEQ ID NO: 720090 - RNA, 14 nt, Homo sapiens
agcagcccugucac

SEQ ID NO: 720091 - RNA, 18 nt, Homo sapiens
agcagccgccagcuggga

SEQ ID NO: 720092 - RNA, 23 nt, Homo sapiens
agcagccuuucucucuuuauaca

SEQ ID NO: 720093 - RNA, 13 nt, Homo sapiens
agcagcucuguga

SEQ ID NO: 720094 - RNA, 15 nt, Homo sapiens
agcagcucugugacu

SEQ ID NO: 720095 - RNA, 19 nt, Homo sapiens
agcagcugauucagcagug

SEQ ID NO: 720096 - RNA, 23 nt, Homo sapiens
agcagcugguggaagaccuggac

SEQ ID NO: 720097 - RNA, 21 nt, Homo sapiens
agcagcuuuaaacaaauucau

SEQ ID NO: 720098 - RNA, 23 nt, Homo sapiens
agcaggaauauaugugugccuau

SEQ ID NO: 720099 - RNA, 19 nt, Homo sapiens
agcaggacuuugaggcaag

SEQ ID NO: 720100 - RNA, 22 nt, Homo sapiens
uaucauuggaugauauguugau

SEQ ID NO: 720101 - RNA, 15 nt, Homo sapiens
uauccaaaccaaaua

SEQ ID NO: 720102 - RNA, 23 nt, Homo sapiens
uauccacagcuuacagcaauuug

SEQ ID NO: 720103 - RNA, 14 nt, Homo sapiens
uauccagccuccca

SEQ ID NO: 720104 - RNA, 16 nt, Homo sapiens
uauccaguugcaggua

SEQ ID NO: 720105 - RNA, 16 nt, Homo sapiens
uauccauugaacuaaa

SEQ ID NO: 720106 - RNA, 22 nt, Homo sapiens
uaucccacauccaacuccagca

SEQ ID NO: 720107 - RNA, 18 nt, Homo sapiens
uaucccauugaaacaaaa

SEQ ID NO: 720108 - RNA, 13 nt, Homo sapiens
uaucccucucuuc

SEQ ID NO: 720109 - RNA, 23 nt, Homo sapiens
uauccuaaacuuuagacuuccca

SEQ ID NO: 720110 - RNA, 16 nt, Homo sapiens
uauccuagucuucaca

SEQ ID NO: 720111 - RNA, 20 nt, Homo sapiens
uauccugagccaucggugaa

SEQ ID NO: 720112 - RNA, 22 nt, Homo sapiens
uauccugauaaacauuaaacac

SEQ ID NO: 720113 - RNA, 15 nt, Homo sapiens
uauccugccucagcc

SEQ ID NO: 720114 - RNA, 22 nt, Homo sapiens
uauccuggugccccccaccccu

SEQ ID NO: 720115 - RNA, 22 nt, Homo sapiens
uauccuggugucuaguuugcau

SEQ ID NO: 720116 - RNA, 15 nt, Homo sapiens
uauccugugacuguc

SEQ ID NO: 720117 - RNA, 19 nt, Homo sapiens
uauccuucuagaucauaca

SEQ ID NO: 720118 - RNA, 15 nt, Homo sapiens
uauccuuucuaacaa

SEQ ID NO: 720119 - RNA, 15 nt, Homo sapiens
uaucgcugggcucaa

SEQ ID NO: 720120 - RNA, 22 nt, Homo sapiens
uaucgggagaggggauucacaa

SEQ ID NO: 720121 - RNA, 17 nt, Homo sapiens
uaucgggagcagugucu

SEQ ID NO: 720122 - RNA, 21 nt, Homo sapiens
uaucgggagcagugucuucca

SEQ ID NO: 720123 - RNA, 14 nt, Homo sapiens
uaucuaagacucau

SEQ ID NO: 720124 - RNA, 15 nt, Homo sapiens
uaucuacagaacugg

SEQ ID NO: 720125 - RNA, 14 nt, Homo sapiens
uaucuaguaugaaa

SEQ ID NO: 720126 - RNA, 20 nt, Homo sapiens
uaucuaugcaguuccaauca

SEQ ID NO: 720127 - RNA, 16 nt, Homo sapiens
uaucucaguaccccau

SEQ ID NO: 720128 - RNA, 20 nt, Homo sapiens
uaucucauacugucugggau

SEQ ID NO: 720129 - RNA, 14 nt, Homo sapiens
uaucucauuacuua

SEQ ID NO: 720130 - RNA, 18 nt, Homo sapiens
uaucucucaaaacaauau

SEQ ID NO: 720131 - RNA, 17 nt, Homo sapiens
uaucucucagugaacug

SEQ ID NO: 720132 - RNA, 14 nt, Homo sapiens
uaucucugagacag

SEQ ID NO: 720133 - RNA, 15 nt, Homo sapiens
uaucucuucagucuc

SEQ ID NO: 720134 - RNA, 16 nt, Homo sapiens
uaucugacaaugcuga

SEQ ID NO: 720135 - RNA, 21 nt, Homo sapiens
uaucugagagaccugugugaa

SEQ ID NO: 720136 - RNA, 14 nt, Homo sapiens
uaucugaggucaca

SEQ ID NO: 720137 - RNA, 20 nt, Homo sapiens
uaucugcgugcacuucccag

SEQ ID NO: 720138 - RNA, 20 nt, Homo sapiens
uaucuggcacuguuaauaca

SEQ ID NO: 720139 - RNA, 15 nt, Homo sapiens
uaucuguacagauca

SEQ ID NO: 720140 - RNA, 11 nt, Homo sapiens
uaucugugaaa

SEQ ID NO: 720141 - RNA, 19 nt, Homo sapiens
uaucugugaacauguuaag

SEQ ID NO: 720142 - RNA, 15 nt, Homo sapiens
uaucugugucaaaag

SEQ ID NO: 720143 - RNA, 14 nt, Homo sapiens
uaucuguucuugcu

SEQ ID NO: 720144 - RNA, 13 nt, Homo sapiens
uaucuuaugccac

SEQ ID NO: 720145 - RNA, 20 nt, Homo sapiens
uaucuugaaggaaaaauuca

SEQ ID NO: 720146 - RNA, 15 nt, Homo sapiens
uaucuuggcuuugcc

SEQ ID NO: 720147 - RNA, 17 nt, Homo sapiens
uaucuuguuuuuccacu

SEQ ID NO: 720148 - RNA, 19 nt, Homo sapiens
uaucuuuauguagcacuac

SEQ ID NO: 720149 - RNA, 14 nt, Homo sapiens
uaucuuucaaagag

SEQ ID NO: 720150 - RNA, 17 nt, Homo sapiens
uaucuuugugugacaug

SEQ ID NO: 720151 - RNA, 20 nt, Homo sapiens
uaugaaaauauagacauucu

SEQ ID NO: 720152 - RNA, 21 nt, Homo sapiens
uaugaaaaucuccaucucaaa

SEQ ID NO: 720153 - RNA, 17 nt, Homo sapiens
uaugaaaugccacuggg

SEQ ID NO: 720154 - RNA, 17 nt, Homo sapiens
uaugaaauuauaaucug

SEQ ID NO: 720155 - RNA, 12 nt, Homo sapiens
uaugaacacuug

SEQ ID NO: 720156 - RNA, 16 nt, Homo sapiens
uaugaacagaaaugca

SEQ ID NO: 720157 - RNA, 19 nt, Homo sapiens
uaugaagcccacccagaaa

SEQ ID NO: 720158 - RNA, 15 nt, Homo sapiens
uaugaaguauauaau

SEQ ID NO: 720159 - RNA, 14 nt, Homo sapiens
uaugaauauuacuc

SEQ ID NO: 720160 - RNA, 22 nt, Homo sapiens
uaugaauauuuauaacagcauu

SEQ ID NO: 720161 - RNA, 18 nt, Homo sapiens
uaugaauccaacguguaa

SEQ ID NO: 720162 - RNA, 12 nt, Homo sapiens
uaugaaugcagu

SEQ ID NO: 720163 - RNA, 13 nt, Homo sapiens
uaugaaugcagug

SEQ ID NO: 720164 - RNA, 22 nt, Homo sapiens
uaugacauaaaaacaacuuuau

SEQ ID NO: 720165 - RNA, 15 nt, Homo sapiens
uaugacccacacugc

SEQ ID NO: 720166 - RNA, 17 nt, Homo sapiens
uaugaccuaaauccauu

SEQ ID NO: 720167 - RNA, 22 nt, Homo sapiens
uaugacuaaagagagaauguag

SEQ ID NO: 720168 - RNA, 13 nt, Homo sapiens
uaugacugauuac

SEQ ID NO: 720169 - RNA, 14 nt, Homo sapiens
uaugacugauuacu

SEQ ID NO: 720170 - RNA, 15 nt, Homo sapiens
uaugacugauuacuc

SEQ ID NO: 720171 - RNA, 17 nt, Homo sapiens
uaugacuguaucuugau

SEQ ID NO: 720172 - RNA, 21 nt, Homo sapiens
uaugacuguuuuuguaguggu

SEQ ID NO: 720173 - RNA, 17 nt, Homo sapiens
uaugagaaaguucucau

SEQ ID NO: 720174 - RNA, 17 nt, Homo sapiens
uaugagcuucuaacuca

SEQ ID NO: 720175 - RNA, 18 nt, Homo sapiens
uaugagggaaaaugagua

SEQ ID NO: 720176 - RNA, 23 nt, Homo sapiens
agcauuuugaaacaaaguacucu

SEQ ID NO: 720177 - RNA, 15 nt, Homo sapiens
agccaaaccccuaga

SEQ ID NO: 720178 - RNA, 14 nt, Homo sapiens
agccaaacucugcc

SEQ ID NO: 720179 - RNA, 15 nt, Homo sapiens
agccaaacucugcca

SEQ ID NO: 720180 - RNA, 16 nt, Homo sapiens
agccaaacucugccag

SEQ ID NO: 720181 - RNA, 13 nt, Homo sapiens
agccaaagagccu

SEQ ID NO: 720182 - RNA, 22 nt, Homo sapiens
agccaaagggacuggcagucug

SEQ ID NO: 720183 - RNA, 16 nt, Homo sapiens
agccaaauaaaaucua

SEQ ID NO: 720184 - RNA, 16 nt, Homo sapiens
agccaaccaagaugca

SEQ ID NO: 720185 - RNA, 18 nt, Homo sapiens
agccaaccaagaugcaaa

SEQ ID NO: 720186 - RNA, 22 nt, Homo sapiens
agccaacgagacacauugccuu

SEQ ID NO: 720187 - RNA, 18 nt, Homo sapiens
agccaacuuuaauugcuu

SEQ ID NO: 720188 - RNA, 14 nt, Homo sapiens
agccaacuuuugca

SEQ ID NO: 720189 - RNA, 23 nt, Homo sapiens
agccaacuuuugcauguuuugua

SEQ ID NO: 720190 - RNA, 12 nt, Homo sapiens
agccaagaccca

SEQ ID NO: 720191 - RNA, 20 nt, Homo sapiens
agccaagauugcaccacugc

SEQ ID NO: 720192 - RNA, 23 nt, Homo sapiens
agccaaggaggugaggagcagag

SEQ ID NO: 720193 - RNA, 19 nt, Homo sapiens
agccaaggcagcgacccca

SEQ ID NO: 720194 - RNA, 18 nt, Homo sapiens
agccaaguuuauauacaa

SEQ ID NO: 720195 - RNA, 16 nt, Homo sapiens
agccaaugucuccucc

SEQ ID NO: 720196 - RNA, 15 nt, Homo sapiens
agccaauuagcucua

SEQ ID NO: 720197 - RNA, 13 nt, Homo sapiens
agccacaaaauac

SEQ ID NO: 720198 - RNA, 15 nt, Homo sapiens
agccacaaccaaaaa

SEQ ID NO: 720199 - RNA, 17 nt, Homo sapiens
agccacaagcugcacug

SEQ ID NO: 720200 - RNA, 16 nt, Homo sapiens
agccacaagucuucca

SEQ ID NO: 720201 - RNA, 19 nt, Homo sapiens
agccacacaaacguuuacu

SEQ ID NO: 720202 - RNA, 16 nt, Homo sapiens
agccacagaccaccug

SEQ ID NO: 720203 - RNA, 12 nt, Homo sapiens
agccacagcucu

SEQ ID NO: 720204 - RNA, 22 nt, Homo sapiens
agccacagcugugcaugcucag

SEQ ID NO: 720205 - RNA, 17 nt, Homo sapiens
agccaccacauccagcc

SEQ ID NO: 720206 - RNA, 23 nt, Homo sapiens
agccaccaugccuggcccggaua

SEQ ID NO: 720207 - RNA, 14 nt, Homo sapiens
agccacucaaagga

SEQ ID NO: 720208 - RNA, 23 nt, Homo sapiens
agccacugugucuuaugaggaau

SEQ ID NO: 720209 - RNA, 23 nt, Homo sapiens
agccagagcugugccugcucagc

SEQ ID NO: 720210 - RNA, 17 nt, Homo sapiens
agccagaggucuggccc

SEQ ID NO: 720211 - RNA, 13 nt, Homo sapiens
agccagauucaaa

SEQ ID NO: 720212 - RNA, 14 nt, Homo sapiens
agccagcaaccagc

SEQ ID NO: 720213 - RNA, 20 nt, Homo sapiens
agccagcaggagcucugacu

SEQ ID NO: 720214 - RNA, 21 nt, Homo sapiens
agccagccaucaaauagugaa

SEQ ID NO: 720215 - RNA, 18 nt, Homo sapiens
uauggaggggagggaucu

SEQ ID NO: 720216 - RNA, 16 nt, Homo sapiens
uauggcuagacaggaa

SEQ ID NO: 720217 - RNA, 21 nt, Homo sapiens
uauggcuauaggugcuacaaa

SEQ ID NO: 720218 - RNA, 17 nt, Homo sapiens
uauggcucacuaugaau

SEQ ID NO: 720219 - RNA, 19 nt, Homo sapiens
uauggcugccugcaucuau

SEQ ID NO: 720220 - RNA, 23 nt, Homo sapiens
uaugguguuccuagaaugcagcu

SEQ ID NO: 720221 - RNA, 19 nt, Homo sapiens
uauguaccauguacaugaa

SEQ ID NO: 720222 - RNA, 13 nt, Homo sapiens
uauguacuaagca

SEQ ID NO: 720223 - RNA, 12 nt, Homo sapiens
uauguacuucag

SEQ ID NO: 720224 - RNA, 16 nt, Homo sapiens
uauguacuucagugca

SEQ ID NO: 720225 - RNA, 13 nt, Homo sapiens
uauguacuuuuau

SEQ ID NO: 720226 - RNA, 16 nt, Homo sapiens
uauguagaacuguuca

SEQ ID NO: 720227 - RNA, 15 nt, Homo sapiens
uauguauaacaagcc

SEQ ID NO: 720228 - RNA, 18 nt, Homo sapiens
uauguauaacaagccaaa

SEQ ID NO: 720229 - RNA, 13 nt, Homo sapiens
uauguauuacaaa

SEQ ID NO: 720230 - RNA, 15 nt, Homo sapiens
uauguauuauuugca

SEQ ID NO: 720231 - RNA, 16 nt, Homo sapiens
uaugucaaagcuuuga

SEQ ID NO: 720232 - RNA, 17 nt, Homo sapiens
uaugucagcagcucuga

SEQ ID NO: 720233 - RNA, 21 nt, Homo sapiens
uaugucaggcaaagugcugcu

SEQ ID NO: 720234 - RNA, 19 nt, Homo sapiens
uaugucauuuuuaauguau

SEQ ID NO: 720235 - RNA, 17 nt, Homo sapiens
uauguccgaugguaucu

SEQ ID NO: 720236 - RNA, 11 nt, Homo sapiens
uaugucucagg

SEQ ID NO: 720237 - RNA, 13 nt, Homo sapiens
uaugucugcugaa

SEQ ID NO: 720238 - RNA, 14 nt, Homo sapiens
uaugucuuggacac

SEQ ID NO: 720239 - RNA, 20 nt, Homo sapiens
uaugucuuggacacuguaca

SEQ ID NO: 720240 - RNA, 19 nt, Homo sapiens
uaugugacuuaaagucaga

SEQ ID NO: 720241 - RNA, 20 nt, Homo sapiens
uaugugaucauguguggaag

SEQ ID NO: 720242 - RNA, 22 nt, Homo sapiens
uauguggaagugugggucugug

SEQ ID NO: 720243 - RNA, 13 nt, Homo sapiens
uauguguaaguau

SEQ ID NO: 720244 - RNA, 20 nt, Homo sapiens
uaugugucacugcauggcuu

SEQ ID NO: 720245 - RNA, 14 nt, Homo sapiens
uaugugugaagccu

SEQ ID NO: 720246 - RNA, 20 nt, Homo sapiens
uauguguggaugaugcugcc

SEQ ID NO: 720247 - RNA, 16 nt, Homo sapiens
uauguugaccuuugca

SEQ ID NO: 720248 - RNA, 18 nt, Homo sapiens
uauguugauacuagcaua

SEQ ID NO: 720249 - RNA, 20 nt, Homo sapiens
uauguuuacauaucaccuca

SEQ ID NO: 720250 - RNA, 17 nt, Homo sapiens
uauguuuacuucucacc

SEQ ID NO: 720251 - RNA, 14 nt, Homo sapiens
uauguuugcacuuu

SEQ ID NO: 720252 - RNA, 23 nt, Homo sapiens
uauuaaagugcuaagguucuaag

SEQ ID NO: 720253 - RNA, 14 nt, Homo sapiens
uauuaaauguugcu

SEQ ID NO: 720254 - RNA, 14 nt, Homo sapiens
uauuaacuacugaa

SEQ ID NO: 720255 - RNA, 14 nt, Homo sapiens
uauuaacuucacag

SEQ ID NO: 720256 - RNA, 14 nt, Homo sapiens
uauuaacuugagcu

SEQ ID NO: 720257 - RNA, 15 nt, Homo sapiens
uauuaagauucuuga

SEQ ID NO: 720258 - RNA, 12 nt, Homo sapiens
uauuaagcacuu

SEQ ID NO: 720259 - RNA, 20 nt, Homo sapiens
uauuaagguuuucaaccgga

SEQ ID NO: 720260 - RNA, 22 nt, Homo sapiens
uauuaauaaagcauucuuuaac

SEQ ID NO: 720261 - RNA, 19 nt, Homo sapiens
uauuaauaguucaguguau

SEQ ID NO: 720262 - RNA, 16 nt, Homo sapiens
uauuaauauauuucca

SEQ ID NO: 720263 - RNA, 17 nt, Homo sapiens
uauuaaucauagauuau

SEQ ID NO: 720264 - RNA, 19 nt, Homo sapiens
uauuaaucuggacauucga

SEQ ID NO: 720265 - RNA, 20 nt, Homo sapiens
uauuaauuguuuugcacuuu

SEQ ID NO: 720266 - RNA, 16 nt, Homo sapiens
uauuacaaaacaaaca

SEQ ID NO: 720267 - RNA, 21 nt, Homo sapiens
uauuacaauuuuugaacaacu

SEQ ID NO: 720268 - RNA, 12 nt, Homo sapiens
uauuacagugaa

SEQ ID NO: 720269 - RNA, 13 nt, Homo sapiens
uauuaccaugaga

SEQ ID NO: 720270 - RNA, 14 nt, Homo sapiens
uauuacccuccuaa

SEQ ID NO: 720271 - RNA, 22 nt, Homo sapiens
uauuaccuccccuacucccuua

SEQ ID NO: 720272 - RNA, 14 nt, Homo sapiens
uauuagaaauuaga

SEQ ID NO: 720273 - RNA, 22 nt, Homo sapiens
uauuagagauaauuuacuuagu

SEQ ID NO: 720274 - RNA, 21 nt, Homo sapiens
uauuagagcugccugugccuu

SEQ ID NO: 720275 - RNA, 15 nt, Homo sapiens
uauuagcucacugaa

SEQ ID NO: 720276 - RNA, 23 nt, Homo sapiens
uauuagcucacugaaucuucacg

SEQ ID NO: 720277 - RNA, 19 nt, Homo sapiens
uauuaggaaauucugauga

SEQ ID NO: 720278 - RNA, 20 nt, Homo sapiens
uauuaggaaauucugaugag

SEQ ID NO: 720279 - RNA, 13 nt, Homo sapiens
uauuauacugaca

SEQ ID NO: 720280 - RNA, 21 nt, Homo sapiens
uauuauauauauauaucuaua

SEQ ID NO: 720281 - RNA, 12 nt, Homo sapiens
uauuaucacugc

SEQ ID NO: 720282 - RNA, 15 nt, Homo sapiens
uauuauggcaaguga

SEQ ID NO: 720283 - RNA, 23 nt, Homo sapiens
uauuauggcaagugauaucaccu

SEQ ID NO: 720284 - RNA, 18 nt, Homo sapiens
uauuauucuucauaacaa

SEQ ID NO: 720285 - RNA, 24 nt, Homo sapiens
uauuauugguuguuguauugauca

SEQ ID NO: 720286 - RNA, 21 nt, Homo sapiens
uauuauuugacaacaauccaa

SEQ ID NO: 720287 - RNA, 17 nt, Homo sapiens
uauuauuuugcacuguu

SEQ ID NO: 720288 - RNA, 14 nt, Homo sapiens
uauucaacaguaug

SEQ ID NO: 720289 - RNA, 14 nt, Homo sapiens
uauucaagcacuua

SEQ ID NO: 720290 - RNA, 14 nt, Homo sapiens
uauucaaugcauuu

SEQ ID NO: 720291 - RNA, 17 nt, Homo sapiens
aggaugaaucauauuca

SEQ ID NO: 720292 - RNA, 12 nt, Homo sapiens
aggaugacaaaa

SEQ ID NO: 720293 - RNA, 18 nt, Homo sapiens
aggaugauccuggggaag

SEQ ID NO: 720294 - RNA, 15 nt, Homo sapiens
aggaugcacagucag

SEQ ID NO: 720295 - RNA, 15 nt, Homo sapiens
aggaugcacauuucu

SEQ ID NO: 720296 - RNA, 22 nt, Homo sapiens
aggaugcccaccguuaggauuc

SEQ ID NO: 720297 - RNA, 12 nt, Homo sapiens
aggauggucucc

SEQ ID NO: 720298 - RNA, 18 nt, Homo sapiens
aggauggucucgaucucc

SEQ ID NO: 720299 - RNA, 12 nt, Homo sapiens
aggauggugggc

SEQ ID NO: 720300 - RNA, 16 nt, Homo sapiens
aggaugguucugugac

SEQ ID NO: 720301 - RNA, 20 nt, Homo sapiens
aggauguuuggucuuuaaug

SEQ ID NO: 720302 - RNA, 14 nt, Homo sapiens
aggauucagcuauu

SEQ ID NO: 720303 - RNA, 20 nt, Homo sapiens
aggauuccgucuucucucau

SEQ ID NO: 720304 - RNA, 21 nt, Homo sapiens
aggauuugcucuggacagaga

SEQ ID NO: 720305 - RNA, 18 nt, Homo sapiens
aggauuuuacagaaacgu

SEQ ID NO: 720306 - RNA, 19 nt, Homo sapiens
aggcaaacugcaaaccaug

SEQ ID NO: 720307 - RNA, 15 nt, Homo sapiens
aggcaaaguggaaug

SEQ ID NO: 720308 - RNA, 17 nt, Homo sapiens
aggcaaaguuuacagau

SEQ ID NO: 720309 - RNA, 14 nt, Homo sapiens
aggcaacugugagu

SEQ ID NO: 720310 - RNA, 21 nt, Homo sapiens
aggcaagggauaacucuucua

SEQ ID NO: 720311 - RNA, 16 nt, Homo sapiens
aggcaaggggcauuuc

SEQ ID NO: 720312 - RNA, 17 nt, Homo sapiens
aggcaaggggcauuuca

SEQ ID NO: 720313 - RNA, 13 nt, Homo sapiens
aggcaauuucacc

SEQ ID NO: 720314 - RNA, 18 nt, Homo sapiens
aggcacacagcuacucuc

SEQ ID NO: 720315 - RNA, 19 nt, Homo sapiens
aggcacagcugaguuauga

SEQ ID NO: 720316 - RNA, 21 nt, Homo sapiens
aggcacccgcccuuuccuugc

SEQ ID NO: 720317 - RNA, 22 nt, Homo sapiens
aggcaccuggccugcugggaac

SEQ ID NO: 720318 - RNA, 23 nt, Homo sapiens
aggcacuacaugaaauaaugcac

SEQ ID NO: 720319 - RNA, 19 nt, Homo sapiens
aggcacugcucaucuguac

SEQ ID NO: 720320 - RNA, 22 nt, Homo sapiens
aggcacuguaguucuaagacuc

SEQ ID NO: 720321 - RNA, 16 nt, Homo sapiens
aggcacuguucaucuc

SEQ ID NO: 720322 - RNA, 18 nt, Homo sapiens
aggcacuguucaucucag

SEQ ID NO: 720323 - RNA, 22 nt, Homo sapiens
aggcagagagucagacccuuca

SEQ ID NO: 720324 - RNA, 21 nt, Homo sapiens
aggcagagauagaaccuggag

SEQ ID NO: 720325 - RNA, 19 nt, Homo sapiens
aggcagagguugcagugaa

SEQ ID NO: 720326 - RNA, 18 nt, Homo sapiens
aggcagagguugcagugu

SEQ ID NO: 720327 - RNA, 16 nt, Homo sapiens
aggcagauguuugccu

SEQ ID NO: 720328 - RNA, 16 nt, Homo sapiens
aggcagccuugaccac

SEQ ID NO: 720329 - RNA, 20 nt, Homo sapiens
aggcagcugccucugcuccc

SEQ ID NO: 720330 - RNA, 18 nt, Homo sapiens
aggcaggagaaucacuug

SEQ ID NO: 720331 - RNA, 12 nt, Homo sapiens
aggcaggagcag

SEQ ID NO: 720332 - RNA, 11 nt, Homo sapiens
ucaggaaaaug

SEQ ID NO: 720333 - RNA, 22 nt, Homo sapiens
ucaggaagaaaucacagaauca

SEQ ID NO: 720334 - RNA, 21 nt, Homo sapiens
ucaggaaggucuucaaucuua

SEQ ID NO: 720335 - RNA, 16 nt, Homo sapiens
ucaggacacaucuauu

SEQ ID NO: 720336 - RNA, 18 nt, Homo sapiens
ucaggaccacucaguuaa

SEQ ID NO: 720337 - RNA, 23 nt, Homo sapiens
ucaggagaaccuaacaugcuggu

SEQ ID NO: 720338 - RNA, 15 nt, Homo sapiens
ucaggagagugcaga

SEQ ID NO: 720339 - RNA, 16 nt, Homo sapiens
ucaggagccaccagca

SEQ ID NO: 720340 - RNA, 17 nt, Homo sapiens
ucaggagcuugcaagaa

SEQ ID NO: 720341 - RNA, 18 nt, Homo sapiens
ucaggaguucgaaaccag

SEQ ID NO: 720342 - RNA, 17 nt, Homo sapiens
ucaggaguugaagacca

SEQ ID NO: 720343 - RNA, 17 nt, Homo sapiens
ucaggaguuggagacca

SEQ ID NO: 720344 - RNA, 18 nt, Homo sapiens
ucaggaguuggagaccag

SEQ ID NO: 720345 - RNA, 16 nt, Homo sapiens
ucaggauacucuguca

SEQ ID NO: 720346 - RNA, 16 nt, Homo sapiens
ucaggaugcacauuuc

SEQ ID NO: 720347 - RNA, 16 nt, Homo sapiens
ucaggauuucaccaga

SEQ ID NO: 720348 - RNA, 18 nt, Homo sapiens
ucaggcaaagugcugcug

SEQ ID NO: 720349 - RNA, 21 nt, Homo sapiens
ucaggcaaggggcauuucaca

SEQ ID NO: 720350 - RNA, 22 nt, Homo sapiens
ucaggcaugauggcccauacuu

SEQ ID NO: 720351 - RNA, 18 nt, Homo sapiens
ucaggccaacaagccaac

SEQ ID NO: 720352 - RNA, 18 nt, Homo sapiens
ucaggccaggugcagugg

SEQ ID NO: 720353 - RNA, 16 nt, Homo sapiens
ucaggccagugcaccc

SEQ ID NO: 720354 - RNA, 23 nt, Homo sapiens
ucaggcccagagaagcaaguggc

SEQ ID NO: 720355 - RNA, 23 nt, Homo sapiens
ucaggcgauccaccugucucagc

SEQ ID NO: 720356 - RNA, 16 nt, Homo sapiens
ucagggagaagaucau

SEQ ID NO: 720357 - RNA, 21 nt, Homo sapiens
ucagggggucuggaaagaagg

SEQ ID NO: 720358 - RNA, 22 nt, Homo sapiens
ucagguagaagguugacacagu

SEQ ID NO: 720359 - RNA, 16 nt, Homo sapiens
ucagguauguugccuu

SEQ ID NO: 720360 - RNA, 14 nt, Homo sapiens
ucagguccaauuug

SEQ ID NO: 720361 - RNA, 19 nt, Homo sapiens
ucaggugaaaauccaucuc

SEQ ID NO: 720362 - RNA, 22 nt, Homo sapiens
ucaggugaucuaccugccucag

SEQ ID NO: 720363 - RNA, 21 nt, Homo sapiens
ucagguuuguuuugugaauuu

SEQ ID NO: 720364 - RNA, 21 nt, Homo sapiens
ucaguaaaacauaauguauca

SEQ ID NO: 720365 - RNA, 14 nt, Homo sapiens
ucaguaaacaauga

SEQ ID NO: 720366 - RNA, 18 nt, Homo sapiens
ucaguaaacaaugaauag

SEQ ID NO: 720367 - RNA, 16 nt, Homo sapiens
ucaguaaaugugauuc

SEQ ID NO: 720368 - RNA, 21 nt, Homo sapiens
ucaguaacauuucuguucuca

SEQ ID NO: 720369 - RNA, 21 nt, Homo sapiens
ucaguacacccaguugccaaa

SEQ ID NO: 720370 - RNA, 15 nt, Homo sapiens
ucaguauguccccau

SEQ ID NO: 720371 - RNA, 19 nt, Homo sapiens
ucaguauuagaugcacuua

SEQ ID NO: 720372 - RNA, 20 nt, Homo sapiens
ucaguauuuacauacagcuu

SEQ ID NO: 720373 - RNA, 15 nt, Homo sapiens
ucagucaauagccau

SEQ ID NO: 720374 - RNA, 19 nt, Homo sapiens
ucagucaauagccauauca

SEQ ID NO: 720375 - RNA, 12 nt, Homo sapiens
ucagucagggac

SEQ ID NO: 720376 - RNA, 21 nt, Homo sapiens
ucagucccagagcauugcuau

SEQ ID NO: 720377 - RNA, 16 nt, Homo sapiens
ucagucccccaccaca

SEQ ID NO: 720378 - RNA, 13 nt, Homo sapiens
ucaguccuaagaa

SEQ ID NO: 720379 - RNA, 16 nt, Homo sapiens
ucaguccuauucugua

SEQ ID NO: 720380 - RNA, 15 nt, Homo sapiens
ucaguccuuugauca

SEQ ID NO: 720381 - RNA, 20 nt, Homo sapiens
ucagucguuuuagugucuga

SEQ ID NO: 720382 - RNA, 19 nt, Homo sapiens
ucagucucuauaccaauaa

SEQ ID NO: 720383 - RNA, 19 nt, Homo sapiens
ucagucugggugggacuua

SEQ ID NO: 720384 - RNA, 15 nt, Homo sapiens
ucagucuuugcucag

SEQ ID NO: 720385 - RNA, 22 nt, Homo sapiens
ucagugaaauaauuacagaaua

SEQ ID NO: 720386 - RNA, 18 nt, Homo sapiens
ucagugaagaugcaauca

SEQ ID NO: 720387 - RNA, 22 nt, Homo sapiens
ucagugaagaugcuguaaauag

SEQ ID NO: 720388 - RNA, 14 nt, Homo sapiens
ucagugaaguagca

SEQ ID NO: 720389 - RNA, 22 nt, Homo sapiens
ucagugacagaguucacuauaa

SEQ ID NO: 720390 - RNA, 16 nt, Homo sapiens
ucagugaccuguuuua

SEQ ID NO: 720391 - RNA, 22 nt, Homo sapiens
ucagugagccaugaucaugcca

SEQ ID NO: 720392 - RNA, 14 nt, Homo sapiens
ucagugcaguuucu

SEQ ID NO: 720393 - RNA, 21 nt, Homo sapiens
ucagugccacuugacauuccu

SEQ ID NO: 720394 - RNA, 20 nt, Homo sapiens
ucagugccgaccugcgccaa

SEQ ID NO: 720395 - RNA, 20 nt, Homo sapiens
ucagugccuucaacaacgug

SEQ ID NO: 720396 - RNA, 22 nt, Homo sapiens
ucagugcucacccguaggcaaa

SEQ ID NO: 720397 - RNA, 19 nt, Homo sapiens
ucagugguggucuucaaga

SEQ ID NO: 720398 - RNA, 14 nt, Homo sapiens
ucaguguacaugga

SEQ ID NO: 720399 - RNA, 19 nt, Homo sapiens
ucaguguccucuugcucaa

SEQ ID NO: 720400 - RNA, 18 nt, Homo sapiens
ucaguuacucagcccugg

SEQ ID NO: 720401 - RNA, 15 nt, Homo sapiens
ucaguuauuacaugu

SEQ ID NO: 720402 - RNA, 15 nt, Homo sapiens
ucaguuccaaaguca

SEQ ID NO: 720403 - RNA, 21 nt, Homo sapiens
ucaguuccaaagucacaggaa

SEQ ID NO: 720404 - RNA, 20 nt, Homo sapiens
ucaguucccaccaucugauu

SEQ ID NO: 720405 - RNA, 20 nt, Homo sapiens
aggcucuuaugugugccuuu

SEQ ID NO: 720406 - RNA, 15 nt, Homo sapiens
aggcugacuuuucca

SEQ ID NO: 720407 - RNA, 18 nt, Homo sapiens
aggcugagaacucguuca

SEQ ID NO: 720408 - RNA, 20 nt, Homo sapiens
aggcugagaaucagacugac

SEQ ID NO: 720409 - RNA, 14 nt, Homo sapiens
aggcugagccagga

SEQ ID NO: 720410 - RNA, 17 nt, Homo sapiens
aggcugaggcaagagaa

SEQ ID NO: 720411 - RNA, 17 nt, Homo sapiens
aggcugaggcaggugga

SEQ ID NO: 720412 - RNA, 22 nt, Homo sapiens
aggcugaggccuggacuuuccu

SEQ ID NO: 720413 - RNA, 19 nt, Homo sapiens
aggcugaggggaggaucac

SEQ ID NO: 720414 - RNA, 14 nt, Homo sapiens
aggcugaguguccg

SEQ ID NO: 720415 - RNA, 18 nt, Homo sapiens
aggcugccccucucacca

SEQ ID NO: 720416 - RNA, 20 nt, Homo sapiens
aggcugcgagagaaagggag

SEQ ID NO: 720417 - RNA, 17 nt, Homo sapiens
aggcugcugcugcugca

SEQ ID NO: 720418 - RNA, 20 nt, Homo sapiens
aggcuggaagagccaaagaa

SEQ ID NO: 720419 - RNA, 16 nt, Homo sapiens
aggcuggagugcaaug

SEQ ID NO: 720420 - RNA, 14 nt, Homo sapiens
aggcuggagugcag

SEQ ID NO: 720421 - RNA, 20 nt, Homo sapiens
aggcuggagugcaguggugu

SEQ ID NO: 720422 - RNA, 22 nt, Homo sapiens
aggcuggauacuaagcacaaag

SEQ ID NO: 720423 - RNA, 12 nt, Homo sapiens
aggcugguggga

SEQ ID NO: 720424 - RNA, 11 nt, Homo sapiens
aggcuguaacu

SEQ ID NO: 720425 - RNA, 20 nt, Homo sapiens
aggcugucgugagcuaugau

SEQ ID NO: 720426 - RNA, 23 nt, Homo sapiens
aggcugucgugagcuaugauuau

SEQ ID NO: 720427 - RNA, 14 nt, Homo sapiens
aggcugucuucuca

SEQ ID NO: 720428 - RNA, 17 nt, Homo sapiens
aggcuguucugcacuga

SEQ ID NO: 720429 - RNA, 18 nt, Homo sapiens
aggcuguucugcacugaa

SEQ ID NO: 720430 - RNA, 15 nt, Homo sapiens
aggcuucacccugaa

SEQ ID NO: 720431 - RNA, 19 nt, Homo sapiens
aggcuucaguuuuacucug

SEQ ID NO: 720432 - RNA, 22 nt, Homo sapiens
aggcuucccugacuugcuuuag

SEQ ID NO: 720433 - RNA, 15 nt, Homo sapiens
aggcuuuaugauaau

SEQ ID NO: 720434 - RNA, 23 nt, Homo sapiens
aggcuuucagaagcucuucuaaa

SEQ ID NO: 720435 - RNA, 20 nt, Homo sapiens
aggcuuuggguggcucacua

SEQ ID NO: 720436 - RNA, 19 nt, Homo sapiens
agggaaaaauaugagaaaa

SEQ ID NO: 720437 - RNA, 21 nt, Homo sapiens
agggaaaaggguucaacaaag

SEQ ID NO: 720438 - RNA, 14 nt, Homo sapiens
agggaaacugggaa

SEQ ID NO: 720439 - RNA, 17 nt, Homo sapiens
agggaaagagcuuuccu

SEQ ID NO: 720440 - RNA, 16 nt, Homo sapiens
agggaaaggggugcuu

SEQ ID NO: 720441 - RNA, 14 nt, Homo sapiens
agggaaaguuaaaa

SEQ ID NO: 720442 - RNA, 14 nt, Homo sapiens
agggaagccgugaa

SEQ ID NO: 720443 - RNA, 21 nt, Homo sapiens
agggaagcugucccucacugu

SEQ ID NO: 720444 - RNA, 14 nt, Homo sapiens
agggaaggagccca

SEQ ID NO: 720445 - RNA, 14 nt, Homo sapiens
agggaagggagcag

SEQ ID NO: 720446 - RNA, 19 nt, Homo sapiens
ucaucaacuaccauucuau

SEQ ID NO: 720447 - RNA, 16 nt, Homo sapiens
ucaucaggaagccugu

SEQ ID NO: 720448 - RNA, 12 nt, Homo sapiens
ucaucauggcaa

SEQ ID NO: 720449 - RNA, 17 nt, Homo sapiens
ucaucauuaaugacuuu

SEQ ID NO: 720450 - RNA, 13 nt, Homo sapiens
ucauccaccccau

SEQ ID NO: 720451 - RNA, 17 nt, Homo sapiens
ucauccagcucacucau

SEQ ID NO: 720452 - RNA, 13 nt, Homo sapiens
ucaucccauucca

SEQ ID NO: 720453 - RNA, 18 nt, Homo sapiens
ucauccccucccagaugu

SEQ ID NO: 720454 - RNA, 15 nt, Homo sapiens
ucaucccuaugggau

SEQ ID NO: 720455 - RNA, 14 nt, Homo sapiens
ucauccgcacugua

SEQ ID NO: 720456 - RNA, 11 nt, Homo sapiens
ucauccuccau

SEQ ID NO: 720457 - RNA, 17 nt, Homo sapiens
ucauccucccaccucag

SEQ ID NO: 720458 - RNA, 15 nt, Homo sapiens
ucauccucugaguua

SEQ ID NO: 720459 - RNA, 12 nt, Homo sapiens
ucauccuggcac

SEQ ID NO: 720460 - RNA, 23 nt, Homo sapiens
ucauccuuaaaacaauucuguga

SEQ ID NO: 720461 - RNA, 12 nt, Homo sapiens
ucauccuuccau

SEQ ID NO: 720462 - RNA, 21 nt, Homo sapiens
ucauccuuggucuaugugcuc

SEQ ID NO: 720463 - RNA, 16 nt, Homo sapiens
ucaucuacccugcuga

SEQ ID NO: 720464 - RNA, 20 nt, Homo sapiens
ucaucuauucaagcacuuac

SEQ ID NO: 720465 - RNA, 14 nt, Homo sapiens
ucaucucauuccaa

SEQ ID NO: 720466 - RNA, 19 nt, Homo sapiens
ucaucuccuuuauugcagu

SEQ ID NO: 720467 - RNA, 16 nt, Homo sapiens
ucaucucggaguucca

SEQ ID NO: 720468 - RNA, 13 nt, Homo sapiens
ucaucucuacuaa

SEQ ID NO: 720469 - RNA, 14 nt, Homo sapiens
ucaucucuuuauuc

SEQ ID NO: 720470 - RNA, 14 nt, Homo sapiens
ucaucugacuauga

SEQ ID NO: 720471 - RNA, 15 nt, Homo sapiens
ucaucuguaccucug

SEQ ID NO: 720472 - RNA, 18 nt, Homo sapiens
ucaucuucacugcaauuu

SEQ ID NO: 720473 - RNA, 13 nt, Homo sapiens
ucaugaaaucagc

SEQ ID NO: 720474 - RNA, 22 nt, Homo sapiens
ucaugaaauuacuuaucaucca

SEQ ID NO: 720475 - RNA, 22 nt, Homo sapiens
ucaugaagaaaacugauucucu

SEQ ID NO: 720476 - RNA, 13 nt, Homo sapiens
ucaugaagcacau

SEQ ID NO: 720477 - RNA, 15 nt, Homo sapiens
ucaugaagugcacag

SEQ ID NO: 720478 - RNA, 23 nt, Homo sapiens
ucaugaagugcacaggagccaaa

SEQ ID NO: 720479 - RNA, 13 nt, Homo sapiens
ucaugacauauga

SEQ ID NO: 720480 - RNA, 18 nt, Homo sapiens
ucaugagccugcuggaag

SEQ ID NO: 720481 - RNA, 16 nt, Homo sapiens
ucaugauaugucaggg

SEQ ID NO: 720482 - RNA, 17 nt, Homo sapiens
ucaugauccaacuaaug

SEQ ID NO: 720483 - RNA, 12 nt, Homo sapiens
ucaugaugcuag

SEQ ID NO: 720484 - RNA, 16 nt, Homo sapiens
ucaugcaaaugcugua

SEQ ID NO: 720485 - RNA, 11 nt, Homo sapiens
ucaugccugua

SEQ ID NO: 720486 - RNA, 17 nt, Homo sapiens
ucaugccuguaaucuca

SEQ ID NO: 720487 - RNA, 16 nt, Homo sapiens
ucaugcgcaacuggag

SEQ ID NO: 720488 - RNA, 23 nt, Homo sapiens
ucaugcuguugcugcuacugucu

SEQ ID NO: 720489 - RNA, 17 nt, Homo sapiens
ucaugcuugacauaccu

SEQ ID NO: 720490 - RNA, 18 nt, Homo sapiens
ucaugcuugacauaccua

SEQ ID NO: 720491 - RNA, 17 nt, Homo sapiens
ucaugcuuuugcuugca

SEQ ID NO: 720492 - RNA, 20 nt, Homo sapiens
ucaugcuuuugcuugcaaug

SEQ ID NO: 720493 - RNA, 14 nt, Homo sapiens
ucauggaccaaagg

SEQ ID NO: 720494 - RNA, 20 nt, Homo sapiens
ucauggagaaucugcugcau

SEQ ID NO: 720495 - RNA, 20 nt, Homo sapiens
ucaugggagggggcuugaag

SEQ ID NO: 720496 - RNA, 15 nt, Homo sapiens
ucauggggucccugc

SEQ ID NO: 720497 - RNA, 22 nt, Homo sapiens
ucaugguacauuuaucacugaa

SEQ ID NO: 720498 - RNA, 17 nt, Homo sapiens
ucaugguagagaaucuc

SEQ ID NO: 720499 - RNA, 18 nt, Homo sapiens
ucaugguggguucagggg

SEQ ID NO: 720500 - RNA, 19 nt, Homo sapiens
ucauguaccucagaucucu

SEQ ID NO: 720501 - RNA, 13 nt, Homo sapiens
ucauguacuuccu

SEQ ID NO: 720502 - RNA, 14 nt, Homo sapiens
ucauguauauaccu

SEQ ID NO: 720503 - RNA, 17 nt, Homo sapiens
ucaugucccagaacuua

SEQ ID NO: 720504 - RNA, 19 nt, Homo sapiens
ucauguccucuauaccugu

SEQ ID NO: 720505 - RNA, 20 nt, Homo sapiens
ucaugugagugggugggaug

SEQ ID NO: 720506 - RNA, 21 nt, Homo sapiens
ucaugugcaaacccacucaga

SEQ ID NO: 720507 - RNA, 20 nt, Homo sapiens
ucaugugguucagugccuuc

SEQ ID NO: 720508 - RNA, 20 nt, Homo sapiens
ucauguucacugugagugaa

SEQ ID NO: 720509 - RNA, 19 nt, Homo sapiens
ucauguuuacagaggacag

SEQ ID NO: 720510 - RNA, 19 nt, Homo sapiens
ucauguuugcuucauaaau

SEQ ID NO: 720511 - RNA, 16 nt, Homo sapiens
ucauuaagaagcuggg

SEQ ID NO: 720512 - RNA, 19 nt, Homo sapiens
ucauuacaauuuucuguaa

SEQ ID NO: 720513 - RNA, 22 nt, Homo sapiens
ucauuacagauuuaguuuacca

SEQ ID NO: 720514 - RNA, 21 nt, Homo sapiens
ucauuagggcuuuugauuuau

SEQ ID NO: 720515 - RNA, 11 nt, Homo sapiens
ucauuaucuca

SEQ ID NO: 720516 - RNA, 19 nt, Homo sapiens
ucauuaucucaaaacugca

SEQ ID NO: 720517 - RNA, 20 nt, Homo sapiens
ucauucagcaucuacucuaa

SEQ ID NO: 720518 - RNA, 13 nt, Homo sapiens
ucauucaucauag

SEQ ID NO: 720519 - RNA, 13 nt, Homo sapiens
ucauucauggcua

SEQ ID NO: 720520 - RNA, 13 nt, Homo sapiens
ucauucauuucau

SEQ ID NO: 720521 - RNA, 21 nt, Homo sapiens
ucauuccaaucuauugcuuca

SEQ ID NO: 720522 - RNA, 20 nt, Homo sapiens
ucauucccaacgugcaaagc

SEQ ID NO: 720523 - RNA, 17 nt, Homo sapiens
ucauucccucucaucuc

SEQ ID NO: 720524 - RNA, 15 nt, Homo sapiens
ucauucucaguccca

SEQ ID NO: 720525 - RNA, 19 nt, Homo sapiens
ucauucucucucauuauug

SEQ ID NO: 720526 - RNA, 15 nt, Homo sapiens
ucauucugaugucca

SEQ ID NO: 720527 - RNA, 16 nt, Homo sapiens
ucauucugcuacuuca

SEQ ID NO: 720528 - RNA, 15 nt, Homo sapiens
ucauugaauccucau

SEQ ID NO: 720529 - RNA, 14 nt, Homo sapiens
ucauugauugaaua

SEQ ID NO: 720530 - RNA, 22 nt, Homo sapiens
ucauugcccgaaaccagagccu

SEQ ID NO: 720531 - RNA, 21 nt, Homo sapiens
ucauugcuaaacugaugacuu

SEQ ID NO: 720532 - RNA, 11 nt, Homo sapiens
ucauugcugag

SEQ ID NO: 720533 - RNA, 12 nt, Homo sapiens
ucauugucuuau

SEQ ID NO: 720534 - RNA, 14 nt, Homo sapiens
ucauuguguucucu

SEQ ID NO: 720535 - RNA, 15 nt, Homo sapiens
ucauuguuucugcau

SEQ ID NO: 720536 - RNA, 21 nt, Homo sapiens
ucauuguuuugcaaaagugua

SEQ ID NO: 720537 - RNA, 14 nt, Homo sapiens
ucauuuaaaacagg

SEQ ID NO: 720538 - RNA, 16 nt, Homo sapiens
ucauuuauucaaguau

SEQ ID NO: 720539 - RNA, 17 nt, Homo sapiens
ucauuucagauaaacaa

SEQ ID NO: 720540 - RNA, 14 nt, Homo sapiens
ucauuucauuucag

SEQ ID NO: 720541 - RNA, 15 nt, Homo sapiens
ucauuuccccuccca

SEQ ID NO: 720542 - RNA, 18 nt, Homo sapiens
ucauuuccggacucucug

SEQ ID NO: 720543 - RNA, 17 nt, Homo sapiens
ucauuuccugcccuucc

SEQ ID NO: 720544 - RNA, 13 nt, Homo sapiens
ucauuugaacaac

SEQ ID NO: 720545 - RNA, 13 nt, Homo sapiens
ucauuugagauaa

SEQ ID NO: 720546 - RNA, 18 nt, Homo sapiens
ucauuugagauaaaguca

SEQ ID NO: 720547 - RNA, 14 nt, Homo sapiens
ucauuugcagucag

SEQ ID NO: 720548 - RNA, 21 nt, Homo sapiens
ucauuuuacucuuaugaucaa

SEQ ID NO: 720549 - RNA, 15 nt, Homo sapiens
ucauuuugcacugua

SEQ ID NO: 720550 - RNA, 12 nt, Homo sapiens
ucauuuugccaa

SEQ ID NO: 720551 - RNA, 10 nt, Homo sapiens
uccaaaaaga

SEQ ID NO: 720552 - RNA, 18 nt, Homo sapiens
uccaaaaauguguaagaa

SEQ ID NO: 720553 - RNA, 20 nt, Homo sapiens
uccaaaaccucaguuaaacu

SEQ ID NO: 720554 - RNA, 21 nt, Homo sapiens
uccaaaacuaauuuccucuga

SEQ ID NO: 720555 - RNA, 23 nt, Homo sapiens
uccaaaacuuuaaugaacuaacu

SEQ ID NO: 720556 - RNA, 18 nt, Homo sapiens
uccaaaauaaagcauaaa

SEQ ID NO: 720557 - RNA, 19 nt, Homo sapiens
uccaaacagaccccuguuc

SEQ ID NO: 720558 - RNA, 17 nt, Homo sapiens
uccaaaccccaggguag

SEQ ID NO: 720559 - RNA, 23 nt, Homo sapiens
uccaaaccccaggguagccaugg

SEQ ID NO: 720560 - RNA, 15 nt, Homo sapiens
uccaaacucuucccu

SEQ ID NO: 720561 - RNA, 21 nt, Homo sapiens
uccaaagaaauguaagggaaa

SEQ ID NO: 720562 - RNA, 15 nt, Homo sapiens
agggaaguccuugca

SEQ ID NO: 720563 - RNA, 14 nt, Homo sapiens
agggaauugcucag

SEQ ID NO: 720564 - RNA, 22 nt, Homo sapiens
agggaauuuggcucaacuucag

SEQ ID NO: 720565 - RNA, 16 nt, Homo sapiens
agggacagaugaaugc

SEQ ID NO: 720566 - RNA, 21 nt, Homo sapiens
agggaccacacccuguacugu

SEQ ID NO: 720567 - RNA, 16 nt, Homo sapiens
agggaccuucaugccc

SEQ ID NO: 720568 - RNA, 21 nt, Homo sapiens
agggacucagggccaugccug

SEQ ID NO: 720569 - RNA, 19 nt, Homo sapiens
agggacuccaugcugccag

SEQ ID NO: 720570 - RNA, 13 nt, Homo sapiens
agggacuccuccu

SEQ ID NO: 720571 - RNA, 16 nt, Homo sapiens
agggacuuugcugauu

SEQ ID NO: 720572 - RNA, 17 nt, Homo sapiens
agggagacugcaucuca

SEQ ID NO: 720573 - RNA, 18 nt, Homo sapiens
agggagaggucaccagcu

SEQ ID NO: 720574 - RNA, 9 nt, Homo sapiens
agggagcag

SEQ ID NO: 720575 - RNA, 15 nt, Homo sapiens
agggagcgcucucuu

SEQ ID NO: 720576 - RNA, 20 nt, Homo sapiens
agggagcucuggggacagcu

SEQ ID NO: 720577 - RNA, 19 nt, Homo sapiens
agggaggaggccaccucuc

SEQ ID NO: 720578 - RNA, 14 nt, Homo sapiens
agggagguggcaag

SEQ ID NO: 720579 - RNA, 14 nt, Homo sapiens
agggaggugguccu

SEQ ID NO: 720580 - RNA, 20 nt, Homo sapiens
agggaggugguccuccuauc

SEQ ID NO: 720581 - RNA, 21 nt, Homo sapiens
agggauaguacuaagcauuuc

SEQ ID NO: 720582 - RNA, 18 nt, Homo sapiens
agggauaucuacuguggu

SEQ ID NO: 720583 - RNA, 14 nt, Homo sapiens
agggaucacuggcu

SEQ ID NO: 720584 - RNA, 17 nt, Homo sapiens
agggaucccuaacuguu

SEQ ID NO: 720585 - RNA, 22 nt, Homo sapiens
agggauggagaaagaaguggag

SEQ ID NO: 720586 - RNA, 13 nt, Homo sapiens
agggauguaucaa

SEQ ID NO: 720587 - RNA, 17 nt, Homo sapiens
agggauuagguguucag

SEQ ID NO: 720588 - RNA, 19 nt, Homo sapiens
agggauuugaggugagggu

SEQ ID NO: 720589 - RNA, 21 nt, Homo sapiens
agggcaaaucuauuacuuuug

SEQ ID NO: 720590 - RNA, 16 nt, Homo sapiens
agggcacagcccuccg

SEQ ID NO: 720591 - RNA, 21 nt, Homo sapiens
agggcacugagcccuucccag

SEQ ID NO: 720592 - RNA, 14 nt, Homo sapiens
agggcacugggcug

SEQ ID NO: 720593 - RNA, 15 nt, Homo sapiens
agggcagagccaugg

SEQ ID NO: 720594 - RNA, 14 nt, Homo sapiens
agggcagaggugga

SEQ ID NO: 720595 - RNA, 16 nt, Homo sapiens
agggcagaguagccag

SEQ ID NO: 720596 - RNA, 12 nt, Homo sapiens
agggcagcagaa

SEQ ID NO: 720597 - RNA, 15 nt, Homo sapiens
agggcaggcacaugu

SEQ ID NO: 720598 - RNA, 20 nt, Homo sapiens
agggcagggcuggcaccucu

SEQ ID NO: 720599 - RNA, 13 nt, Homo sapiens
agggcagguagcu

SEQ ID NO: 720600 - RNA, 17 nt, Homo sapiens
agggcauauacagugaa

SEQ ID NO: 720601 - RNA, 14 nt, Homo sapiens
agggcauugcucag

SEQ ID NO: 720602 - RNA, 17 nt, Homo sapiens
agggcauuuccaaguua

SEQ ID NO: 720603 - RNA, 23 nt, Homo sapiens
agggccaagagaucuguguggcu

SEQ ID NO: 720604 - RNA, 13 nt, Homo sapiens
agggccaggugca

SEQ ID NO: 720605 - RNA, 10 nt, Homo sapiens
agggccaguc

SEQ ID NO: 720606 - RNA, 15 nt, Homo sapiens
agggccauugaacuc

SEQ ID NO: 720607 - RNA, 17 nt, Homo sapiens
agggcccagcuguagcc

SEQ ID NO: 720608 - RNA, 16 nt, Homo sapiens
agggccccagcacuaa

SEQ ID NO: 720609 - RNA, 18 nt, Homo sapiens
agggccccucccucugcc

SEQ ID NO: 720610 - RNA, 12 nt, Homo sapiens
agggccgugccc

SEQ ID NO: 720611 - RNA, 14 nt, Homo sapiens
agggcgcucagacg

SEQ ID NO: 720612 - RNA, 15 nt, Homo sapiens
agggcucaaggguga

SEQ ID NO: 720613 - RNA, 13 nt, Homo sapiens
agggcucacucag

SEQ ID NO: 720614 - RNA, 17 nt, Homo sapiens
agggcucacucagccac

SEQ ID NO: 720615 - RNA, 23 nt, Homo sapiens
agggcuccaaaucugccuagaaa

SEQ ID NO: 720616 - RNA, 15 nt, Homo sapiens
agggcuccuguggca

SEQ ID NO: 720617 - RNA, 19 nt, Homo sapiens
agggcugcuuaggucucau

SEQ ID NO: 720618 - RNA, 17 nt, Homo sapiens
aggggaaaaaugggaaa

SEQ ID NO: 720619 - RNA, 18 nt, Homo sapiens
aggggaaagacuuccauc

SEQ ID NO: 720620 - RNA, 16 nt, Homo sapiens
aggggaaaguucucag

SEQ ID NO: 720621 - RNA, 22 nt, Homo sapiens
aggggaagaccaaaguuugcaa

SEQ ID NO: 720622 - RNA, 17 nt, Homo sapiens
aggggaaggaagagaga

SEQ ID NO: 720623 - RNA, 22 nt, Homo sapiens
aggggaagggccagucugggcu

SEQ ID NO: 720624 - RNA, 13 nt, Homo sapiens
aggggaauggagg

SEQ ID NO: 720625 - RNA, 18 nt, Homo sapiens
aggggagcucaguuuuca

SEQ ID NO: 720626 - RNA, 15 nt, Homo sapiens
aggggaggacacugg

SEQ ID NO: 720627 - RNA, 15 nt, Homo sapiens
aggggaggagcuucu

SEQ ID NO: 720628 - RNA, 21 nt, Homo sapiens
aggggcagccacaccacugcc

SEQ ID NO: 720629 - RNA, 23 nt, Homo sapiens
aggggcaggccugggacccagcu

SEQ ID NO: 720630 - RNA, 14 nt, Homo sapiens
aggggcccacagga

SEQ ID NO: 720631 - RNA, 17 nt, Homo sapiens
aggggccucccugugac

SEQ ID NO: 720632 - RNA, 17 nt, Homo sapiens
aggggccugcaggugag

SEQ ID NO: 720633 - RNA, 22 nt, Homo sapiens
aggggccuggaggucuggcuga

SEQ ID NO: 720634 - RNA, 21 nt, Homo sapiens
aggggccuuagggcacugggc

SEQ ID NO: 720635 - RNA, 15 nt, Homo sapiens
aggggcuacugugac

SEQ ID NO: 720636 - RNA, 16 nt, Homo sapiens
uccagaucacugccac

SEQ ID NO: 720637 - RNA, 14 nt, Homo sapiens
uccagaugagucag

SEQ ID NO: 720638 - RNA, 22 nt, Homo sapiens
uccagcacaccugccgucuuca

SEQ ID NO: 720639 - RNA, 14 nt, Homo sapiens
uccagcagauuucc

SEQ ID NO: 720640 - RNA, 14 nt, Homo sapiens
uccagccacuuccc

SEQ ID NO: 720641 - RNA, 19 nt, Homo sapiens
uccagccgcugcacaucac

SEQ ID NO: 720642 - RNA, 14 nt, Homo sapiens
uccagccugaacag

SEQ ID NO: 720643 - RNA, 14 nt, Homo sapiens
uccagccugaaugu

SEQ ID NO: 720644 - RNA, 20 nt, Homo sapiens
uccagccuggggaacagagc

SEQ ID NO: 720645 - RNA, 12 nt, Homo sapiens
uccagccuucca

SEQ ID NO: 720646 - RNA, 13 nt, Homo sapiens
uccagcucccacu

SEQ ID NO: 720647 - RNA, 14 nt, Homo sapiens
uccagcuccuguaa

SEQ ID NO: 720648 - RNA, 12 nt, Homo sapiens
uccagcucugag

SEQ ID NO: 720649 - RNA, 14 nt, Homo sapiens
uccagcucugagac

SEQ ID NO: 720650 - RNA, 23 nt, Homo sapiens
uccagcuggaagggucaacaucu

SEQ ID NO: 720651 - RNA, 14 nt, Homo sapiens
uccagcuucaggca

SEQ ID NO: 720652 - RNA, 19 nt, Homo sapiens
uccagcuugggcaacagag

SEQ ID NO: 720653 - RNA, 14 nt, Homo sapiens
uccaggaaggcagc

SEQ ID NO: 720654 - RNA, 15 nt, Homo sapiens
uccaggacagggaag

SEQ ID NO: 720655 - RNA, 13 nt, Homo sapiens
uccaggacuguuu

SEQ ID NO: 720656 - RNA, 14 nt, Homo sapiens
uccaggcagccucu

SEQ ID NO: 720657 - RNA, 13 nt, Homo sapiens
uccaggccagaau

SEQ ID NO: 720658 - RNA, 15 nt, Homo sapiens
uccaggccauuuaau

SEQ ID NO: 720659 - RNA, 18 nt, Homo sapiens
uccaggcgugguggcaca

SEQ ID NO: 720660 - RNA, 23 nt, Homo sapiens
uccaggcgugguggcacacaccu

SEQ ID NO: 720661 - RNA, 21 nt, Homo sapiens
uccagggaaugaugacaacaa

SEQ ID NO: 720662 - RNA, 18 nt, Homo sapiens
uccagggcauugcucagc

SEQ ID NO: 720663 - RNA, 15 nt, Homo sapiens
uccaggguggaugau

SEQ ID NO: 720664 - RNA, 16 nt, Homo sapiens
uccaggucuugacuca

SEQ ID NO: 720665 - RNA, 22 nt, Homo sapiens
uccagguggcgugagaggcaau

SEQ ID NO: 720666 - RNA, 15 nt, Homo sapiens
uccagguuccaucca

SEQ ID NO: 720667 - RNA, 14 nt, Homo sapiens
uccaguacaguauu

SEQ ID NO: 720668 - RNA, 16 nt, Homo sapiens
uccaguacaguauucu

SEQ ID NO: 720669 - RNA, 14 nt, Homo sapiens
uccaguaucuccaa

SEQ ID NO: 720670 - RNA, 16 nt, Homo sapiens
uccagucccaugaccu

SEQ ID NO: 720671 - RNA, 15 nt, Homo sapiens
uccagucuacuugag

SEQ ID NO: 720672 - RNA, 16 nt, Homo sapiens
uccagucugaucugug

SEQ ID NO: 720673 - RNA, 22 nt, Homo sapiens
uccagugaguaccugcaaaaau

SEQ ID NO: 720674 - RNA, 17 nt, Homo sapiens
uccagugcaguugugau

SEQ ID NO: 720675 - RNA, 19 nt, Homo sapiens
uccaguguuucuacaauca

SEQ ID NO: 720676 - RNA, 17 nt, Homo sapiens
uccaguguuugggauga

SEQ ID NO: 720677 - RNA, 19 nt, Homo sapiens
uccaguuccucuuuugugc

SEQ ID NO: 720678 - RNA, 16 nt, Homo sapiens
uccaguuguguugaca

SEQ ID NO: 720679 - RNA, 12 nt, Homo sapiens
agguaaagcuau

SEQ ID NO: 720680 - RNA, 15 nt, Homo sapiens
agguaacucuuugca

SEQ ID NO: 720681 - RNA, 20 nt, Homo sapiens
agguaauguuccugaaaauu

SEQ ID NO: 720682 - RNA, 11 nt, Homo sapiens
agguacaggag

SEQ ID NO: 720683 - RNA, 12 nt, Homo sapiens
agguaccagcac

SEQ ID NO: 720684 - RNA, 19 nt, Homo sapiens
agguacuucaggggcacuu

SEQ ID NO: 720685 - RNA, 22 nt, Homo sapiens
agguacuucaggggcacuucau

SEQ ID NO: 720686 - RNA, 18 nt, Homo sapiens
agguagaagugagcaaaa

SEQ ID NO: 720687 - RNA, 19 nt, Homo sapiens
agguagacuuuuaauauca

SEQ ID NO: 720688 - RNA, 12 nt, Homo sapiens
agguagcacagc

SEQ ID NO: 720689 - RNA, 14 nt, Homo sapiens
agguagcacagcac

SEQ ID NO: 720690 - RNA, 17 nt, Homo sapiens
agguagcacagcacuuu

SEQ ID NO: 720691 - RNA, 14 nt, Homo sapiens
agguagccauccca

SEQ ID NO: 720692 - RNA, 17 nt, Homo sapiens
agguagcccagcacugu

SEQ ID NO: 720693 - RNA, 18 nt, Homo sapiens
agguagcuuuagggcaau

SEQ ID NO: 720694 - RNA, 17 nt, Homo sapiens
agguauaaugauacugc

SEQ ID NO: 720695 - RNA, 17 nt, Homo sapiens
agguauacuuuaguaga

SEQ ID NO: 720696 - RNA, 14 nt, Homo sapiens
agguauagaugccg

SEQ ID NO: 720697 - RNA, 19 nt, Homo sapiens
agguauaugccaaaucucu

SEQ ID NO: 720698 - RNA, 13 nt, Homo sapiens
agguauggcagag

SEQ ID NO: 720699 - RNA, 18 nt, Homo sapiens
aggucacauugugccuuu

SEQ ID NO: 720700 - RNA, 12 nt, Homo sapiens
aggucacugcua

SEQ ID NO: 720701 - RNA, 20 nt, Homo sapiens
aggucagcagccucccugaa

SEQ ID NO: 720702 - RNA, 14 nt, Homo sapiens
aggucagguguuca

SEQ ID NO: 720703 - RNA, 22 nt, Homo sapiens
aggucagugcuucgugccucga

SEQ ID NO: 720704 - RNA, 22 nt, Homo sapiens
aggucaucaugaaagguuaaaa

SEQ ID NO: 720705 - RNA, 12 nt, Homo sapiens
agguccacagag

SEQ ID NO: 720706 - RNA, 23 nt, Homo sapiens
agguccagccugggcuccuccac

SEQ ID NO: 720707 - RNA, 15 nt, Homo sapiens
agguccagcucugga

SEQ ID NO: 720708 - RNA, 18 nt, Homo sapiens
aggucccaccuccauuug

SEQ ID NO: 720709 - RNA, 20 nt, Homo sapiens
agguccuccaucccaacagc

SEQ ID NO: 720710 - RNA, 23 nt, Homo sapiens
agguccucuacuuaaugagauag

SEQ ID NO: 720711 - RNA, 20 nt, Homo sapiens
agguccuuaggccucugaga

SEQ ID NO: 720712 - RNA, 21 nt, Homo sapiens
agguccuuaggccucugagaa

SEQ ID NO: 720713 - RNA, 16 nt, Homo sapiens
agguccuuucuccuga

SEQ ID NO: 720714 - RNA, 17 nt, Homo sapiens
aggucggagugccugga

SEQ ID NO: 720715 - RNA, 23 nt, Homo sapiens
aggucguuugauuucaaagcaag

SEQ ID NO: 720716 - RNA, 18 nt, Homo sapiens
aggucucagaugagcuua

SEQ ID NO: 720717 - RNA, 21 nt, Homo sapiens
aggucuugugauauugcccag

SEQ ID NO: 720718 - RNA, 18 nt, Homo sapiens
aggugaaaauccaucuca

SEQ ID NO: 720719 - RNA, 23 nt, Homo sapiens
aggugaacugggagcagcucugu

SEQ ID NO: 720720 - RNA, 21 nt, Homo sapiens
aggugacugaaggcugucagg

SEQ ID NO: 720721 - RNA, 13 nt, Homo sapiens
aggugaggcccaa

SEQ ID NO: 720722 - RNA, 14 nt, Homo sapiens
aggugaggcccaag

SEQ ID NO: 720723 - RNA, 20 nt, Homo sapiens
aggugauccacccaccucag

SEQ ID NO: 720724 - RNA, 17 nt, Homo sapiens
aggugaucuaccugccu

SEQ ID NO: 720725 - RNA, 14 nt, Homo sapiens
aggugauggcagaa

SEQ ID NO: 720726 - RNA, 20 nt, Homo sapiens
aggugauucgcccaccucag

SEQ ID NO: 720727 - RNA, 23 nt, Homo sapiens
aggugauuuguaugcucauugaa

SEQ ID NO: 720728 - RNA, 11 nt, Homo sapiens
aggugcacagg

SEQ ID NO: 720729 - RNA, 17 nt, Homo sapiens
aggugccuguccuugaa

SEQ ID NO: 720730 - RNA, 21 nt, Homo sapiens
aggugcgaaugacaguagcau

SEQ ID NO: 720731 - RNA, 21 nt, Homo sapiens
aggugcuacaaaaacacagca

SEQ ID NO: 720732 - RNA, 15 nt, Homo sapiens
aggugcuuggaguuu

SEQ ID NO: 720733 - RNA, 19 nt, Homo sapiens
agguggcaacaaugccccg

SEQ ID NO: 720734 - RNA, 18 nt, Homo sapiens
agguggccacagugucac

SEQ ID NO: 720735 - RNA, 21 nt, Homo sapiens
agguggccacagugucacugg

SEQ ID NO: 720736 - RNA, 22 nt, Homo sapiens
agguggccccaguucaaucucc

SEQ ID NO: 720737 - RNA, 15 nt, Homo sapiens
agguggccucugccu

SEQ ID NO: 720738 - RNA, 18 nt, Homo sapiens
aggugggaucgacuguaa

SEQ ID NO: 720739 - RNA, 20 nt, Homo sapiens
aggugggccagucuguggau

SEQ ID NO: 720740 - RNA, 21 nt, Homo sapiens
aggugggccuugcuaccucaa

SEQ ID NO: 720741 - RNA, 17 nt, Homo sapiens
agguggugggacacugg

SEQ ID NO: 720742 - RNA, 22 nt, Homo sapiens
aggugguuggguucugccuuua

SEQ ID NO: 720743 - RNA, 13 nt, Homo sapiens
aggugucauauga

SEQ ID NO: 720744 - RNA, 16 nt, Homo sapiens
aggugucauaugacug

SEQ ID NO: 720745 - RNA, 14 nt, Homo sapiens
aggugucccugccu

SEQ ID NO: 720746 - RNA, 17 nt, Homo sapiens
aggugucccugccuuca

SEQ ID NO: 720747 - RNA, 20 nt, Homo sapiens
aggugucuucuuugacuuaa

SEQ ID NO: 720748 - RNA, 14 nt, Homo sapiens
aggugugacuugaa

SEQ ID NO: 720749 - RNA, 20 nt, Homo sapiens
agguguucuucauuaccuca

SEQ ID NO: 720750 - RNA, 15 nt, Homo sapiens
agguguuuaguugca

SEQ ID NO: 720751 - RNA, 16 nt, Homo sapiens
ucccaagguccucuca

SEQ ID NO: 720752 - RNA, 20 nt, Homo sapiens
ucccaagguccucucaguuc

SEQ ID NO: 720753 - RNA, 20 nt, Homo sapiens
ucccaaguacccugagauac

SEQ ID NO: 720754 - RNA, 21 nt, Homo sapiens
ucccaauaaaagugacucuca

SEQ ID NO: 720755 - RNA, 22 nt, Homo sapiens
ucccaauaaaagugacucucag

SEQ ID NO: 720756 - RNA, 19 nt, Homo sapiens
ucccaaucagcacugaaaa

SEQ ID NO: 720757 - RNA, 15 nt, Homo sapiens
ucccacacuuugaag

SEQ ID NO: 720758 - RNA, 16 nt, Homo sapiens
ucccacaggcccuucc

SEQ ID NO: 720759 - RNA, 16 nt, Homo sapiens
ucccacaugaggccau

SEQ ID NO: 720760 - RNA, 14 nt, Homo sapiens
ucccaccacugcac

SEQ ID NO: 720761 - RNA, 14 nt, Homo sapiens
ucccaccauucccu

SEQ ID NO: 720762 - RNA, 18 nt, Homo sapiens
ucccacccacagccauag

SEQ ID NO: 720763 - RNA, 16 nt, Homo sapiens
ucccaccccacuccag

SEQ ID NO: 720764 - RNA, 23 nt, Homo sapiens
ucccaccuccauuugcaauugac

SEQ ID NO: 720765 - RNA, 23 nt, Homo sapiens
ucccaccucuccuuuugaggcuu

SEQ ID NO: 720766 - RNA, 14 nt, Homo sapiens
ucccacgaggaauc

SEQ ID NO: 720767 - RNA, 17 nt, Homo sapiens
ucccacucccuuuccaa

SEQ ID NO: 720768 - RNA, 19 nt, Homo sapiens
ucccacuccugcugcacag

SEQ ID NO: 720769 - RNA, 16 nt, Homo sapiens
ucccacuccuucagga

SEQ ID NO: 720770 - RNA, 16 nt, Homo sapiens
ucccacucuuugaauc

SEQ ID NO: 720771 - RNA, 17 nt, Homo sapiens
ucccagacauucauugu

SEQ ID NO: 720772 - RNA, 18 nt, Homo sapiens
ucccagagcaucuugcau

SEQ ID NO: 720773 - RNA, 15 nt, Homo sapiens
ucccagaucagucag

SEQ ID NO: 720774 - RNA, 21 nt, Homo sapiens
ucccagauguuggaccaacac

SEQ ID NO: 720775 - RNA, 21 nt, Homo sapiens
ucccagauuggcucacacuga

SEQ ID NO: 720776 - RNA, 17 nt, Homo sapiens
ucccagauuucaggaaa

SEQ ID NO: 720777 - RNA, 21 nt, Homo sapiens
ucccagcacgaguggccaguu

SEQ ID NO: 720778 - RNA, 12 nt, Homo sapiens
ucccagcacuuu

SEQ ID NO: 720779 - RNA, 23 nt, Homo sapiens
ucccagcacuuugggaggccaag

SEQ ID NO: 720780 - RNA, 13 nt, Homo sapiens
ucccagccaaguc

SEQ ID NO: 720781 - RNA, 12 nt, Homo sapiens
ucccagcccagc

SEQ ID NO: 720782 - RNA, 13 nt, Homo sapiens
ucccagcuacuca

SEQ ID NO: 720783 - RNA, 17 nt, Homo sapiens
ucccagcuacucgggag

SEQ ID NO: 720784 - RNA, 15 nt, Homo sapiens
ucccaggaacugggc

SEQ ID NO: 720785 - RNA, 20 nt, Homo sapiens
ucccaggccaacaguagcca

SEQ ID NO: 720786 - RNA, 23 nt, Homo sapiens
ucccaggccagcaagcucuucac

SEQ ID NO: 720787 - RNA, 21 nt, Homo sapiens
ucccaggcccgagaugugacc

SEQ ID NO: 720788 - RNA, 22 nt, Homo sapiens
ucccaggccugccugcauggca

SEQ ID NO: 720789 - RNA, 21 nt, Homo sapiens
ucccaggggagccagcugcuu

SEQ ID NO: 720790 - RNA, 21 nt, Homo sapiens
ucccaggguuauagacagucg

SEQ ID NO: 720791 - RNA, 14 nt, Homo sapiens
ucccagucacuccu

SEQ ID NO: 720792 - RNA, 15 nt, Homo sapiens
ucccagucucuggca

SEQ ID NO: 720793 - RNA, 13 nt, Homo sapiens
ucccagucuguga

SEQ ID NO: 720794 - RNA, 17 nt, Homo sapiens
aguaaugugucauauca

SEQ ID NO: 720795 - RNA, 20 nt, Homo sapiens
aguacaaaacaaucucucaa

SEQ ID NO: 720796 - RNA, 18 nt, Homo sapiens
aguacacccaguugccaa

SEQ ID NO: 720797 - RNA, 11 nt, Homo sapiens
aguacccaggg

SEQ ID NO: 720798 - RNA, 10 nt, Homo sapiens
aguaccccau

SEQ ID NO: 720799 - RNA, 16 nt, Homo sapiens
aguaccgccagcagcu

SEQ ID NO: 720800 - RNA, 20 nt, Homo sapiens
aguaccgcccucggggcccg

SEQ ID NO: 720801 - RNA, 17 nt, Homo sapiens
aguaccuucaauacuua

SEQ ID NO: 720802 - RNA, 21 nt, Homo sapiens
aguaccuugcuucuuacugau

SEQ ID NO: 720803 - RNA, 16 nt, Homo sapiens
aguacuaagcauuuca

SEQ ID NO: 720804 - RNA, 19 nt, Homo sapiens
aguacucaaauauuucuga

SEQ ID NO: 720805 - RNA, 15 nt, Homo sapiens
aguacuccugcaaaa

SEQ ID NO: 720806 - RNA, 19 nt, Homo sapiens
aguacucucugcucuagcc

SEQ ID NO: 720807 - RNA, 15 nt, Homo sapiens
aguacugaccacugg

SEQ ID NO: 720808 - RNA, 14 nt, Homo sapiens
aguacuggcauggu

SEQ ID NO: 720809 - RNA, 16 nt, Homo sapiens
aguacuuauguugcac

SEQ ID NO: 720810 - RNA, 15 nt, Homo sapiens
aguacuugugaaaca

SEQ ID NO: 720811 - RNA, 21 nt, Homo sapiens
aguacuugugaaacacagcug

SEQ ID NO: 720812 - RNA, 14 nt, Homo sapiens
aguagaauccuaaa

SEQ ID NO: 720813 - RNA, 15 nt, Homo sapiens
aguagaaugguggcu

SEQ ID NO: 720814 - RNA, 13 nt, Homo sapiens
aguagacauuuau

SEQ ID NO: 720815 - RNA, 14 nt, Homo sapiens
aguagagacagggu

SEQ ID NO: 720816 - RNA, 18 nt, Homo sapiens
aguagagacggguuucac

SEQ ID NO: 720817 - RNA, 21 nt, Homo sapiens
aguagagcagccacaaccaaa

SEQ ID NO: 720818 - RNA, 18 nt, Homo sapiens
aguagauauugauuacua

SEQ ID NO: 720819 - RNA, 15 nt, Homo sapiens
aguagauccauuucc

SEQ ID NO: 720820 - RNA, 17 nt, Homo sapiens
aguagaugauuuccuua

SEQ ID NO: 720821 - RNA, 14 nt, Homo sapiens
aguagcaacaaaag

SEQ ID NO: 720822 - RNA, 16 nt, Homo sapiens
aguagcaucaccaucu

SEQ ID NO: 720823 - RNA, 15 nt, Homo sapiens
aguagcaugaucagu

SEQ ID NO: 720824 - RNA, 22 nt, Homo sapiens
aguagcugggacuauaggcaug

SEQ ID NO: 720825 - RNA, 16 nt, Homo sapiens
aguaggaggccuccac

SEQ ID NO: 720826 - RNA, 23 nt, Homo sapiens
aguaggauuuugagggugggggu

SEQ ID NO: 720827 - RNA, 13 nt, Homo sapiens
aguaggugcuuga

SEQ ID NO: 720828 - RNA, 16 nt, Homo sapiens
aguagguuuacauuca

SEQ ID NO: 720829 - RNA, 17 nt, Homo sapiens
aguauaaagucacuucc

SEQ ID NO: 720830 - RNA, 19 nt, Homo sapiens
aguauaaagucacuuccag

SEQ ID NO: 720831 - RNA, 19 nt, Homo sapiens
aguauacuagggagccauu

SEQ ID NO: 720832 - RNA, 14 nt, Homo sapiens
aguauauauagaau

SEQ ID NO: 720833 - RNA, 16 nt, Homo sapiens
aguaucacgauuugca

SEQ ID NO: 720834 - RNA, 15 nt, Homo sapiens
aguaucaguauuuac

SEQ ID NO: 720835 - RNA, 12 nt, Homo sapiens
aguauccacaau

SEQ ID NO: 720836 - RNA, 14 nt, Homo sapiens
aguaucccacaucc

SEQ ID NO: 720837 - RNA, 16 nt, Homo sapiens
aguaucucuucagucu

SEQ ID NO: 720838 - RNA, 19 nt, Homo sapiens
aguaugaauauuacucuca

SEQ ID NO: 720839 - RNA, 19 nt, Homo sapiens
aguaugagaagaaaaaugg

SEQ ID NO: 720840 - RNA, 12 nt, Homo sapiens
aguaugccuuaa

SEQ ID NO: 720841 - RNA, 17 nt, Homo sapiens
aguaugguaaucuuuac

SEQ ID NO: 720842 - RNA, 18 nt, Homo sapiens
aguaugguauuacaaaac

SEQ ID NO: 720843 - RNA, 14 nt, Homo sapiens
aguauguacuucag

SEQ ID NO: 720844 - RNA, 12 nt, Homo sapiens
aguauuaauauc

SEQ ID NO: 720845 - RNA, 19 nt, Homo sapiens
aguauuagaugcacuuaag

SEQ ID NO: 720846 - RNA, 22 nt, Homo sapiens
aguauuaucauugcuccccuga

SEQ ID NO: 720847 - RNA, 18 nt, Homo sapiens
aguauuauuuuacaauca

SEQ ID NO: 720848 - RNA, 13 nt, Homo sapiens
aguauucaaguau

SEQ ID NO: 720849 - RNA, 12 nt, Homo sapiens
aguauucacaaa

SEQ ID NO: 720850 - RNA, 17 nt, Homo sapiens
aguauucauucugcauu

SEQ ID NO: 720851 - RNA, 21 nt, Homo sapiens
aguauuccaugagcugcucau

SEQ ID NO: 720852 - RNA, 12 nt, Homo sapiens
aguauuccauuu

SEQ ID NO: 720853 - RNA, 23 nt, Homo sapiens
aguauuccuguugcugucuucag

SEQ ID NO: 720854 - RNA, 23 nt, Homo sapiens
aguauuccuuuauacacagugga

SEQ ID NO: 720855 - RNA, 15 nt, Homo sapiens
aguauugcaugcuca

SEQ ID NO: 720856 - RNA, 20 nt, Homo sapiens
aguauugucgguuaccucug

SEQ ID NO: 720857 - RNA, 13 nt, Homo sapiens
aguauugugauau

SEQ ID NO: 720858 - RNA, 17 nt, Homo sapiens
aguauuuggggucauau

SEQ ID NO: 720859 - RNA, 23 nt, Homo sapiens
aguauuuuaucuggaacaacuug

SEQ ID NO: 720860 - RNA, 13 nt, Homo sapiens
aguauuuugccac

SEQ ID NO: 720861 - RNA, 19 nt, Homo sapiens
aguauuuuuaacacuuaaa

SEQ ID NO: 720862 - RNA, 13 nt, Homo sapiens
agucaaauccagu

SEQ ID NO: 720863 - RNA, 15 nt, Homo sapiens
agucaaauuuguaaa

SEQ ID NO: 720864 - RNA, 21 nt, Homo sapiens
agucaaauuuguaaaucuuau

SEQ ID NO: 720865 - RNA, 17 nt, Homo sapiens
agucaaccaauguagaa

SEQ ID NO: 720866 - RNA, 18 nt, Homo sapiens
gccagccucagaaggccc

SEQ ID NO: 720867 - RNA, 13 nt, Homo sapiens
gccagccucagug

SEQ ID NO: 720868 - RNA, 17 nt, Homo sapiens
gccagcguggcgcagug

SEQ ID NO: 720869 - RNA, 15 nt, Homo sapiens
gccagcugacaucuu

SEQ ID NO: 720870 - RNA, 14 nt, Homo sapiens
gccaggaccauggc

SEQ ID NO: 720871 - RNA, 16 nt, Homo sapiens
gccaggacgaauugag

SEQ ID NO: 720872 - RNA, 12 nt, Homo sapiens
gccaggacugug

SEQ ID NO: 720873 - RNA, 15 nt, Homo sapiens
gccaggagcaggcac

SEQ ID NO: 720874 - RNA, 17 nt, Homo sapiens
gccaggaggccugcuag

SEQ ID NO: 720875 - RNA, 20 nt, Homo sapiens
gccaggagguuggugacuga

SEQ ID NO: 720876 - RNA, 21 nt, Homo sapiens
gccaggauggucucgaucucc

SEQ ID NO: 720877 - RNA, 17 nt, Homo sapiens
gccaggcaugguggcac

SEQ ID NO: 720878 - RNA, 18 nt, Homo sapiens
gccaggcaugguggcuca

SEQ ID NO: 720879 - RNA, 16 nt, Homo sapiens
gccaggcgcugcaggg

SEQ ID NO: 720880 - RNA, 23 nt, Homo sapiens
gccaggcuguuggaaaauccaga

SEQ ID NO: 720881 - RNA, 22 nt, Homo sapiens
gccagggugggaagagaagaaa

SEQ ID NO: 720882 - RNA, 20 nt, Homo sapiens
gccagucaggcccaggcacu

SEQ ID NO: 720883 - RNA, 15 nt, Homo sapiens
gccaguccugcuacc

SEQ ID NO: 720884 - RNA, 12 nt, Homo sapiens
gccagugacaga

SEQ ID NO: 720885 - RNA, 19 nt, Homo sapiens
aaaguagguuuacauucau

SEQ ID NO: 720886 - RNA, 15 nt, Homo sapiens
aaaguaguccuguga

SEQ ID NO: 720887 - RNA, 16 nt, Homo sapiens
aaaguaguccugugaa

SEQ ID NO: 720888 - RNA, 17 nt, Homo sapiens
aaagucaaaguguugcu

SEQ ID NO: 720889 - RNA, 22 nt, Homo sapiens
aaagucacggcugcgcacugug

SEQ ID NO: 720890 - RNA, 23 nt, Homo sapiens
aaagucagaauaguccuugggca

SEQ ID NO: 720891 - RNA, 23 nt, Homo sapiens
aaagucagugcccaacuguuaua

SEQ ID NO: 720892 - RNA, 15 nt, Homo sapiens
aaagucaucaugaac

SEQ ID NO: 720893 - RNA, 12 nt, Homo sapiens
aaaguccugaca

SEQ ID NO: 720894 - RNA, 14 nt, Homo sapiens
aaagugacacagca

SEQ ID NO: 720895 - RNA, 15 nt, Homo sapiens
aaagugacuauucag

SEQ ID NO: 720896 - RNA, 18 nt, Homo sapiens
aaagugacuuccaaacaa

SEQ ID NO: 720897 - RNA, 16 nt, Homo sapiens
aaagugauaugcauuu

SEQ ID NO: 720898 - RNA, 15 nt, Homo sapiens
aaagugaucuugaga

SEQ ID NO: 720899 - RNA, 9 nt, Homo sapiens
aaagugaug

SEQ ID NO: 720900 - RNA, 17 nt, Homo sapiens
aaagugauuaguacuau

SEQ ID NO: 720901 - RNA, 18 nt, Homo sapiens
aaagugcauauuuaucca

SEQ ID NO: 720902 - RNA, 18 nt, Homo sapiens
aaagugcuaagguucuaa

SEQ ID NO: 720903 - RNA, 22 nt, Homo sapiens
aaagugcugauaaguagcauga

SEQ ID NO: 720904 - RNA, 12 nt, Homo sapiens
aaagugcugcug

SEQ ID NO: 720905 - RNA, 16 nt, Homo sapiens
aaagugcugggaugac

SEQ ID NO: 720906 - RNA, 22 nt, Homo sapiens
aaagugcugggauuacaggcgu

SEQ ID NO: 720907 - RNA, 23 nt, Homo sapiens
aaagugcugggauuacaggugug

SEQ ID NO: 720908 - RNA, 16 nt, Homo sapiens
aaaguggacaaggagu

SEQ ID NO: 720909 - RNA, 17 nt, Homo sapiens
aaagugugucacccuuu

SEQ ID NO: 720910 - RNA, 13 nt, Homo sapiens
aaagugugugauu

SEQ ID NO: 720911 - RNA, 16 nt, Homo sapiens
aaaguguucauuguuu

SEQ ID NO: 720912 - RNA, 15 nt, Homo sapiens
aaaguuaaaagcaaa

SEQ ID NO: 720913 - RNA, 23 nt, Homo sapiens
aaaguuagucaauccugucauau

SEQ ID NO: 720914 - RNA, 16 nt, Homo sapiens
aaaguuauuuguucau

SEQ ID NO: 720915 - RNA, 20 nt, Homo sapiens
aaaguucaacuuccaaaggg

SEQ ID NO: 720916 - RNA, 19 nt, Homo sapiens
aaaguuccagaaacuuuaa

SEQ ID NO: 720917 - RNA, 16 nt, Homo sapiens
aaaguugcugugaaua

SEQ ID NO: 720918 - RNA, 23 nt, Homo sapiens
aaaguuguuguaaccugcuguga

SEQ ID NO: 720919 - RNA, 17 nt, Homo sapiens
aaaguuuacccaugaag

SEQ ID NO: 720920 - RNA, 17 nt, Homo sapiens
aaaguuugcaacucgaa

SEQ ID NO: 720921 - RNA, 15 nt, Homo sapiens
aaaguuuugaugaaa

SEQ ID NO: 720922 - RNA, 15 nt, Homo sapiens
aaaguuuuugcuuca

SEQ ID NO: 720923 - RNA, 21 nt, Homo sapiens
aaaguuuuuuauuaugcauua

SEQ ID NO: 720924 - RNA, 19 nt, Homo sapiens
aaauaaaaauauuguguug

SEQ ID NO: 720925 - RNA, 15 nt, Homo sapiens
aaauaaaacuaagcu

SEQ ID NO: 720926 - RNA, 18 nt, Homo sapiens
aaauaaaagcuagauacu

SEQ ID NO: 720927 - RNA, 13 nt, Homo sapiens
aaauaaacaugug

SEQ ID NO: 720928 - RNA, 18 nt, Homo sapiens
aaauaaagcguccucuca

SEQ ID NO: 720929 - RNA, 18 nt, Homo sapiens
aaauaaaggugacuggga

SEQ ID NO: 720930 - RNA, 13 nt, Homo sapiens
aaauaaaguacca

SEQ ID NO: 720931 - RNA, 14 nt, Homo sapiens
aaauaaaguaccac

SEQ ID NO: 720932 - RNA, 16 nt, Homo sapiens
aaauaaaguaccacac

SEQ ID NO: 720933 - RNA, 14 nt, Homo sapiens
aaauaaaguaccau

SEQ ID NO: 720934 - RNA, 16 nt, Homo sapiens
aaauaaaguaccauua

SEQ ID NO: 720935 - RNA, 22 nt, Homo sapiens
aaauaaaguauauauagaaucu

SEQ ID NO: 720936 - RNA, 22 nt, Homo sapiens
aaauaaauauugaugugguaua

SEQ ID NO: 720937 - RNA, 14 nt, Homo sapiens
aaauaaaugacaau

SEQ ID NO: 720938 - RNA, 23 nt, Homo sapiens
aaauaacuaaaagguaugcaauc

SEQ ID NO: 720939 - RNA, 12 nt, Homo sapiens
aaauaacuggaa

SEQ ID NO: 720940 - RNA, 16 nt, Homo sapiens
aaauaagcuucaucuc

SEQ ID NO: 720941 - RNA, 21 nt, Homo sapiens
aaauaaguuuuuuuucugggu

SEQ ID NO: 720942 - RNA, 13 nt, Homo sapiens
aaauaaucaagau

SEQ ID NO: 720943 - RNA, 14 nt, Homo sapiens
aaauaaucagugac

SEQ ID NO: 720944 - RNA, 13 nt, Homo sapiens
aaauaaugcacug

SEQ ID NO: 720945 - RNA, 17 nt, Homo sapiens
aaauaauucaugauuca

SEQ ID NO: 720946 - RNA, 16 nt, Homo sapiens
aaauaauugauuucaa

SEQ ID NO: 720947 - RNA, 13 nt, Homo sapiens
aaauaauugcauc

SEQ ID NO: 720948 - RNA, 19 nt, Homo sapiens
aaauaauuucuacucuguc

SEQ ID NO: 720949 - RNA, 19 nt, Homo sapiens
aaauacacaccccuaagaa

SEQ ID NO: 720950 - RNA, 19 nt, Homo sapiens
aaauacacacucaaaucaa

SEQ ID NO: 720951 - RNA, 23 nt, Homo sapiens
aaauacacgcuaguaacuccucu

SEQ ID NO: 720952 - RNA, 17 nt, Homo sapiens
aaauacagauagauaua

SEQ ID NO: 720953 - RNA, 21 nt, Homo sapiens
aaauaccaaaugcauuguugu

SEQ ID NO: 720954 - RNA, 19 nt, Homo sapiens
aaauaccacaagccugaga

SEQ ID NO: 720955 - RNA, 14 nt, Homo sapiens
aaauaccagugaac

SEQ ID NO: 720956 - RNA, 16 nt, Homo sapiens
aaauacccacuaacaa

SEQ ID NO: 720957 - RNA, 20 nt, Homo sapiens
aaauaccuauaugaauauga

SEQ ID NO: 720958 - RNA, 21 nt, Homo sapiens
aaauaccugucaauacuaugg

SEQ ID NO: 720959 - RNA, 16 nt, Homo sapiens
aaauacuauugccuca

SEQ ID NO: 720960 - RNA, 12 nt, Homo sapiens
aaauacugugaa

SEQ ID NO: 720961 - RNA, 15 nt, Homo sapiens
aaauacuucuugaag

SEQ ID NO: 720962 - RNA, 23 nt, Homo sapiens
aaauagagcuuuuaaaaaugucc

SEQ ID NO: 720963 - RNA, 13 nt, Homo sapiens
aaauagauccaau

SEQ ID NO: 720964 - RNA, 20 nt, Homo sapiens
aaauagcacacuuuuccaca

SEQ ID NO: 720965 - RNA, 20 nt, Homo sapiens
aaauagcugaaaagggcacu

SEQ ID NO: 720966 - RNA, 19 nt, Homo sapiens
aaauaggagccgauggauc

SEQ ID NO: 720967 - RNA, 15 nt, Homo sapiens
aaauagggcuuuuaa

SEQ ID NO: 720968 - RNA, 16 nt, Homo sapiens
aaauaguaaacauuaa

SEQ ID NO: 720969 - RNA, 14 nt, Homo sapiens
aaauagucuucuca

SEQ ID NO: 720970 - RNA, 22 nt, Homo sapiens
aaauaguguaagaacuguacau

SEQ ID NO: 720971 - RNA, 15 nt, Homo sapiens
aaauaguuaccuuca

SEQ ID NO: 720972 - RNA, 21 nt, Homo sapiens
aaauaguucuaaacuaucaau

SEQ ID NO: 720973 - RNA, 17 nt, Homo sapiens
aaauauaauaugcacac

SEQ ID NO: 720974 - RNA, 14 nt, Homo sapiens
aaauauaauugaca

SEQ ID NO: 720975 - RNA, 19 nt, Homo sapiens
aaauauagacauucucaca

SEQ ID NO: 720976 - RNA, 17 nt, Homo sapiens
aaauaucauaaagcauu

SEQ ID NO: 720977 - RNA, 16 nt, Homo sapiens
aaauaucuugcuuuca

SEQ ID NO: 720978 - RNA, 22 nt, Homo sapiens
aaauauguucuuuaguuugcug

SEQ ID NO: 720979 - RNA, 20 nt, Homo sapiens
aaauauuauugguguuuacc

SEQ ID NO: 720980 - RNA, 22 nt, Homo sapiens
aaauauuauugguguuuaccca

SEQ ID NO: 720981 - RNA, 20 nt, Homo sapiens
aaauuaguuucaaauuuacc

SEQ ID NO: 720982 - RNA, 16 nt, Homo sapiens
aaauuauaaaccaagg

SEQ ID NO: 720983 - RNA, 14 nt, Homo sapiens
aaauuauaucucag

SEQ ID NO: 720984 - RNA, 17 nt, Homo sapiens
aaauuaugaccauggua

SEQ ID NO: 720985 - RNA, 14 nt, Homo sapiens
aaauuauggcccag

SEQ ID NO: 720986 - RNA, 17 nt, Homo sapiens
aaauuauguauguuuac

SEQ ID NO: 720987 - RNA, 22 nt, Homo sapiens
aaauuauugacgcuuaaccuuu

SEQ ID NO: 720988 - RNA, 22 nt, Homo sapiens
aaauuauuguuaaagaauacac

SEQ ID NO: 720989 - RNA, 21 nt, Homo sapiens
aaauuauuuuaaaaacuaaaa

SEQ ID NO: 720990 - RNA, 19 nt, Homo sapiens
aaauuauuuuguucauaca

SEQ ID NO: 720991 - RNA, 20 nt, Homo sapiens
aaauucaaaaccugcaguua

SEQ ID NO: 720992 - RNA, 16 nt, Homo sapiens
aaauucaagagccucc

SEQ ID NO: 720993 - RNA, 15 nt, Homo sapiens
aaauucaagccuuag

SEQ ID NO: 720994 - RNA, 21 nt, Homo sapiens
aaauucacagcgcuaugcaau

SEQ ID NO: 720995 - RNA, 20 nt, Homo sapiens
aaauucauggugcacugagc

SEQ ID NO: 720996 - RNA, 22 nt, Homo sapiens
aaauucauuuuuuucacuggag

SEQ ID NO: 720997 - RNA, 23 nt, Homo sapiens
aaauuccagaagaagagaagcug

SEQ ID NO: 720998 - RNA, 19 nt, Homo sapiens
aaauuccauacuucucuca

SEQ ID NO: 720999 - RNA, 11 nt, Homo sapiens
aaauuccccaa

SEQ ID NO: 721000 - RNA, 16 nt, Homo sapiens
aaauuccuacaacuua

SEQ ID NO: 721001 - RNA, 18 nt, Homo sapiens
gccccugggcuaccaucu

SEQ ID NO: 721002 - RNA, 12 nt, Homo sapiens
gccccuucaucc

SEQ ID NO: 721003 - RNA, 18 nt, Homo sapiens
gcccgagaugugacccac

SEQ ID NO: 721004 - RNA, 14 nt, Homo sapiens
gcccgccaccugug

SEQ ID NO: 721005 - RNA, 15 nt, Homo sapiens
gcccggaccuccauc

SEQ ID NO: 721006 - RNA, 21 nt, Homo sapiens
gcccgugcccccgccugccac

SEQ ID NO: 721007 - RNA, 16 nt, Homo sapiens
gcccguucuugaaaug

SEQ ID NO: 721008 - RNA, 20 nt, Homo sapiens
gcccuaaaaauccagacucu

SEQ ID NO: 721009 - RNA, 16 nt, Homo sapiens
gcccuaagggacuuaa

SEQ ID NO: 721010 - RNA, 14 nt, Homo sapiens
gcccuaauagcaga

SEQ ID NO: 721011 - RNA, 21 nt, Homo sapiens
gcccuaccugauuggugcaac

SEQ ID NO: 721012 - RNA, 17 nt, Homo sapiens
gcccuagagcacacugu

SEQ ID NO: 721013 - RNA, 21 nt, Homo sapiens
gcccucaccccugguucucau

SEQ ID NO: 721014 - RNA, 15 nt, Homo sapiens
gcccucacugcaggg

SEQ ID NO: 721015 - RNA, 16 nt, Homo sapiens
gcccucccgcaccuuc

SEQ ID NO: 721016 - RNA, 21 nt, Homo sapiens
gcccucccuggcugugagcag

SEQ ID NO: 721017 - RNA, 15 nt, Homo sapiens
gcccucccuuggaaa

SEQ ID NO: 721018 - RNA, 22 nt, Homo sapiens
gcccucuaugguguggcaaagc

SEQ ID NO: 721019 - RNA, 13 nt, Homo sapiens
gcccucuauuuau

SEQ ID NO: 721020 - RNA, 15 nt, Homo sapiens
gcccucuccaaaggc

SEQ ID NO: 721021 - RNA, 23 nt, Homo sapiens
gcccucuggauccagccaugccu

SEQ ID NO: 721022 - RNA, 17 nt, Homo sapiens
gcccugaggccuagacu

SEQ ID NO: 721023 - RNA, 13 nt, Homo sapiens
gcccugcaccaug

SEQ ID NO: 721024 - RNA, 15 nt, Homo sapiens
gcccugcaccaugcu

SEQ ID NO: 721025 - RNA, 17 nt, Homo sapiens
gcccugcucuuccucag

SEQ ID NO: 721026 - RNA, 12 nt, Homo sapiens
gcccugggaugu

SEQ ID NO: 721027 - RNA, 16 nt, Homo sapiens
gcccugggucuugcca

SEQ ID NO: 721028 - RNA, 18 nt, Homo sapiens
gcccugggucuugccaug

SEQ ID NO: 721029 - RNA, 18 nt, Homo sapiens
gcccugucauccagcuca

SEQ ID NO: 721030 - RNA, 12 nt, Homo sapiens
gcccuguggcag

SEQ ID NO: 721031 - RNA, 15 nt, Homo sapiens
gcccuucacugucac

SEQ ID NO: 721032 - RNA, 16 nt, Homo sapiens
gcccuucagccuucaa

SEQ ID NO: 721033 - RNA, 16 nt, Homo sapiens
gcccuucauugccaca

SEQ ID NO: 721034 - RNA, 13 nt, Homo sapiens
gcccuucugggac

SEQ ID NO: 721035 - RNA, 17 nt, Homo sapiens
gcccuugcuuaccucuc

SEQ ID NO: 721036 - RNA, 14 nt, Homo sapiens
gcccuuggcugcag

SEQ ID NO: 721037 - RNA, 14 nt, Homo sapiens
gcccuuguccugcc

SEQ ID NO: 721038 - RNA, 12 nt, Homo sapiens
gcccuuuccucc

SEQ ID NO: 721039 - RNA, 18 nt, Homo sapiens
gccgaaaaggauaugcag

SEQ ID NO: 721040 - RNA, 19 nt, Homo sapiens
gccgaaaaggauaugcagu

SEQ ID NO: 721041 - RNA, 15 nt, Homo sapiens
gccgaagcucuggcu

SEQ ID NO: 721042 - RNA, 14 nt, Homo sapiens
gccgacuuggagac

SEQ ID NO: 721043 - RNA, 18 nt, Homo sapiens
gccgacuuggagacuccu

SEQ ID NO: 721044 - RNA, 23 nt, Homo sapiens
gccgagaacaccgagcacugaac

SEQ ID NO: 721045 - RNA, 19 nt, Homo sapiens
gccgagagcagacaccagc

SEQ ID NO: 721046 - RNA, 20 nt, Homo sapiens
gccgagaucacaccacugua

SEQ ID NO: 721047 - RNA, 21 nt, Homo sapiens
gccgagaucacgucacugcac

SEQ ID NO: 721048 - RNA, 21 nt, Homo sapiens
gccgagaucgcgccacugcac

SEQ ID NO: 721049 - RNA, 17 nt, Homo sapiens
gccgaggccugcauguc

SEQ ID NO: 721050 - RNA, 15 nt, Homo sapiens
gccgagugcacugca

SEQ ID NO: 721051 - RNA, 16 nt, Homo sapiens
gccgcagacgggcaca

SEQ ID NO: 721052 - RNA, 16 nt, Homo sapiens
gccgcagccaacccgg

SEQ ID NO: 721053 - RNA, 13 nt, Homo sapiens
gccgcccaaagag

SEQ ID NO: 721054 - RNA, 19 nt, Homo sapiens
gccgccguggcuauaccug

SEQ ID NO: 721055 - RNA, 13 nt, Homo sapiens
gccgcuaccuccc

SEQ ID NO: 721056 - RNA, 20 nt, Homo sapiens
gccggaaggaaugucagggc

SEQ ID NO: 721057 - RNA, 23 nt, Homo sapiens
gccggcauggugccugggcugcc

SEQ ID NO: 721058 - RNA, 18 nt, Homo sapiens
gccggcuucaaguggcag

SEQ ID NO: 721059 - RNA, 13 nt, Homo sapiens
gccgggagccaac

SEQ ID NO: 721060 - RNA, 16 nt, Homo sapiens
gccgggcaugguggca

SEQ ID NO: 721061 - RNA, 23 nt, Homo sapiens
gccggucauggugguggacaccu

SEQ ID NO: 721062 - RNA, 23 nt, Homo sapiens
gccggucccccaugccaccaccc

SEQ ID NO: 721063 - RNA, 15 nt, Homo sapiens
gccgucagagcagug

SEQ ID NO: 721064 - RNA, 18 nt, Homo sapiens
gccguguuacuguugcac

SEQ ID NO: 721065 - RNA, 21 nt, Homo sapiens
gccguucuguuccaaccuccu

SEQ ID NO: 721066 - RNA, 18 nt, Homo sapiens
gccguuuccccuccuugg

SEQ ID NO: 721067 - RNA, 17 nt, Homo sapiens
gccuaaaaaugcaacuu

SEQ ID NO: 721068 - RNA, 23 nt, Homo sapiens
gccuaaaucccaagaaauggaau

SEQ ID NO: 721069 - RNA, 19 nt, Homo sapiens
gccuaaauuuaaugcugcc

SEQ ID NO: 721070 - RNA, 16 nt, Homo sapiens
gccuaaggugucugag

SEQ ID NO: 721071 - RNA, 22 nt, Homo sapiens
gccuacccccugaaagugacag

SEQ ID NO: 721072 - RNA, 22 nt, Homo sapiens
gccuaccgcuggcccugccguu

SEQ ID NO: 721073 - RNA, 18 nt, Homo sapiens
gccuacuuaagagugcug

SEQ ID NO: 721074 - RNA, 16 nt, Homo sapiens
gccuacuucugagcaa

SEQ ID NO: 721075 - RNA, 14 nt, Homo sapiens
gccuagcgaucucu

SEQ ID NO: 721076 - RNA, 14 nt, Homo sapiens
gccuaucugaccaa

SEQ ID NO: 721077 - RNA, 15 nt, Homo sapiens
gccuaucugaccaaa

SEQ ID NO: 721078 - RNA, 12 nt, Homo sapiens
gccuauuccagg

SEQ ID NO: 721079 - RNA, 15 nt, Homo sapiens
gccucaagacuauag

SEQ ID NO: 721080 - RNA, 17 nt, Homo sapiens
gccucacucaccaucug

SEQ ID NO: 721081 - RNA, 19 nt, Homo sapiens
gccucagggcgcucagacg

SEQ ID NO: 721082 - RNA, 17 nt, Homo sapiens
gccucagugccacuuga

SEQ ID NO: 721083 - RNA, 21 nt, Homo sapiens
gccucauauuguccucugcaa

SEQ ID NO: 721084 - RNA, 22 nt, Homo sapiens
gccucauccugagagaccugcc

SEQ ID NO: 721085 - RNA, 12 nt, Homo sapiens
gccucaugggcc

SEQ ID NO: 721086 - RNA, 17 nt, Homo sapiens
gccuccaaaguggagcu

SEQ ID NO: 721087 - RNA, 17 nt, Homo sapiens
gccuccaagccauucac

SEQ ID NO: 721088 - RNA, 21 nt, Homo sapiens
gccuccaagccauucacuucc

SEQ ID NO: 721089 - RNA, 16 nt, Homo sapiens
gccuccaaugcauugg

SEQ ID NO: 721090 - RNA, 19 nt, Homo sapiens
gccuccaccaccacuggcc

SEQ ID NO: 721091 - RNA, 21 nt, Homo sapiens
gccuccaccccccagaaccug

SEQ ID NO: 721092 - RNA, 15 nt, Homo sapiens
gccuccagcucccac

SEQ ID NO: 721093 - RNA, 21 nt, Homo sapiens
gccuccaggagccuacccccu

SEQ ID NO: 721094 - RNA, 12 nt, Homo sapiens
gccuccauggcu

SEQ ID NO: 721095 - RNA, 18 nt, Homo sapiens
gccuccauguccucuuca

SEQ ID NO: 721096 - RNA, 16 nt, Homo sapiens
gcgcauugagccagug

SEQ ID NO: 721097 - RNA, 15 nt, Homo sapiens
gcgccagcacuguau

SEQ ID NO: 721098 - RNA, 18 nt, Homo sapiens
gcgcccagccucaucucu

SEQ ID NO: 721099 - RNA, 14 nt, Homo sapiens
gcgcccucucugcu

SEQ ID NO: 721100 - RNA, 15 nt, Homo sapiens
gcgcccuuaccuucc

SEQ ID NO: 721101 - RNA, 21 nt, Homo sapiens
gcgcccuuggcuucugugaug

SEQ ID NO: 721102 - RNA, 16 nt, Homo sapiens
gcgccgggggaccugg

SEQ ID NO: 721103 - RNA, 17 nt, Homo sapiens
gcgccuccuuccuugcu

SEQ ID NO: 721104 - RNA, 20 nt, Homo sapiens
gcgcgugaguggucuucaaa

SEQ ID NO: 721105 - RNA, 10 nt, Homo sapiens
gcgcugcuaa

SEQ ID NO: 721106 - RNA, 22 nt, Homo sapiens
gcggaccccucgucaucaggug

SEQ ID NO: 721107 - RNA, 17 nt, Homo sapiens
gcggagguugcaaugag

SEQ ID NO: 721108 - RNA, 15 nt, Homo sapiens
gcggaucucuggagu

SEQ ID NO: 721109 - RNA, 15 nt, Homo sapiens
gcggcuggugcaggg

SEQ ID NO: 721110 - RNA, 17 nt, Homo sapiens
gcgggauuuaugugcac

SEQ ID NO: 721111 - RNA, 19 nt, Homo sapiens
gcgggccccucaccuggua

SEQ ID NO: 721112 - RNA, 15 nt, Homo sapiens
gcgggcgcgugagug

SEQ ID NO: 721113 - RNA, 15 nt, Homo sapiens
gcggucaauuugccu

SEQ ID NO: 721114 - RNA, 22 nt, Homo sapiens
gcgguggcucacgccuguaauc

SEQ ID NO: 721115 - RNA, 22 nt, Homo sapiens
gcguaagaugauggauuugauu

SEQ ID NO: 721116 - RNA, 12 nt, Homo sapiens
gcgucaguuuuu

SEQ ID NO: 721117 - RNA, 21 nt, Homo sapiens
aacagaauuuuuuaaauugac

SEQ ID NO: 721118 - RNA, 12 nt, Homo sapiens
aacagacuugaa

SEQ ID NO: 721119 - RNA, 14 nt, Homo sapiens
aacagagacugaau

SEQ ID NO: 721120 - RNA, 21 nt, Homo sapiens
aacagagcaagacuccaucuc

SEQ ID NO: 721121 - RNA, 22 nt, Homo sapiens
aacagagcaagacuccaucuca

SEQ ID NO: 721122 - RNA, 18 nt, Homo sapiens
aacagauaucagugucuc

SEQ ID NO: 721123 - RNA, 16 nt, Homo sapiens
aacagaucuccuggca

SEQ ID NO: 721124 - RNA, 21 nt, Homo sapiens
aacagcaaaacuccaucucaa

SEQ ID NO: 721125 - RNA, 13 nt, Homo sapiens
aacagcaaauaac

SEQ ID NO: 721126 - RNA, 23 nt, Homo sapiens
aacagcaagaguaagcaguguua

SEQ ID NO: 721127 - RNA, 14 nt, Homo sapiens
aacagcaccucccc

SEQ ID NO: 721128 - RNA, 11 nt, Homo sapiens
aacagcacuuu

SEQ ID NO: 721129 - RNA, 19 nt, Homo sapiens
aacagcagugaucucaggg

SEQ ID NO: 721130 - RNA, 13 nt, Homo sapiens
aacagcauaacua

SEQ ID NO: 721131 - RNA, 14 nt, Homo sapiens
aacagccagugugu

SEQ ID NO: 721132 - RNA, 22 nt, Homo sapiens
aacagcgggagaccugugcuag

SEQ ID NO: 721133 - RNA, 18 nt, Homo sapiens
aacagcguggaugucgau

SEQ ID NO: 721134 - RNA, 15 nt, Homo sapiens
aacagcucaccaacu

SEQ ID NO: 721135 - RNA, 23 nt, Homo sapiens
aacagcugaggucucuugaggga

SEQ ID NO: 721136 - RNA, 20 nt, Homo sapiens
aacagcuguaaucuaugaau

SEQ ID NO: 721137 - RNA, 15 nt, Homo sapiens
aacagcuugcuguca

SEQ ID NO: 721138 - RNA, 21 nt, Homo sapiens
aacaggaauccuuacugauau

SEQ ID NO: 721139 - RNA, 20 nt, Homo sapiens
aacaggcuguucugcacuga

SEQ ID NO: 721140 - RNA, 23 nt, Homo sapiens
aacaggugcugaacugugcauca

SEQ ID NO: 721141 - RNA, 22 nt, Homo sapiens
aacagguuuucaccauagccua

SEQ ID NO: 721142 - RNA, 22 nt, Homo sapiens
aacagugucuggugcacauaau

SEQ ID NO: 721143 - RNA, 18 nt, Homo sapiens
aacaguugugaugacuau

SEQ ID NO: 721144 - RNA, 22 nt, Homo sapiens
aacauaaaaaauaaaguaccac

SEQ ID NO: 721145 - RNA, 21 nt, Homo sapiens
aacauaaauuucuuuaaucau

SEQ ID NO: 721146 - RNA, 19 nt, Homo sapiens
aacauaacugcuucuugga

SEQ ID NO: 721147 - RNA, 23 nt, Homo sapiens
aacauaagagagccuugguucau

SEQ ID NO: 721148 - RNA, 20 nt, Homo sapiens
aacauagauuuaagugaaua

SEQ ID NO: 721149 - RNA, 15 nt, Homo sapiens
aacauagcaucucag

SEQ ID NO: 721150 - RNA, 22 nt, Homo sapiens
aacauagucagcucugaucaca

SEQ ID NO: 721151 - RNA, 17 nt, Homo sapiens
aacauauucuugcuuuc

SEQ ID NO: 721152 - RNA, 10 nt, Homo sapiens
aacaucaaag

SEQ ID NO: 721153 - RNA, 13 nt, Homo sapiens
aacaucaguuucu

SEQ ID NO: 721154 - RNA, 15 nt, Homo sapiens
aacaucauaacccau

SEQ ID NO: 721155 - RNA, 17 nt, Homo sapiens
aacauccaagucuuucu

SEQ ID NO: 721156 - RNA, 19 nt, Homo sapiens
aacauccuucaagaacucu

SEQ ID NO: 721157 - RNA, 19 nt, Homo sapiens
aacaucuaauaaguauaua

SEQ ID NO: 721158 - RNA, 21 nt, Homo sapiens
aacaucuuggucagauuugaa

SEQ ID NO: 721159 - RNA, 17 nt, Homo sapiens
aacaugaaaugcuucca

SEQ ID NO: 721160 - RNA, 14 nt, Homo sapiens
aacaugagaugugu

SEQ ID NO: 721161 - RNA, 17 nt, Homo sapiens
aacaugauugaaccauu

SEQ ID NO: 721162 - RNA, 20 nt, Homo sapiens
aacaugcuaaauaguucuau

SEQ ID NO: 721163 - RNA, 17 nt, Homo sapiens
aacaugcuugcauuaua

SEQ ID NO: 721164 - RNA, 18 nt, Homo sapiens
aacaugcuuuuacuuuau

SEQ ID NO: 721165 - RNA, 21 nt, Homo sapiens
aacauggaggaacaguauuac

SEQ ID NO: 721166 - RNA, 11 nt, Homo sapiens
aacauggccau

SEQ ID NO: 721167 - RNA, 18 nt, Homo sapiens
aacauggcuaaauacaau

SEQ ID NO: 721168 - RNA, 13 nt, Homo sapiens
aacaugguacaaa

SEQ ID NO: 721169 - RNA, 22 nt, Homo sapiens
aacauggugaaacuccaucucu

SEQ ID NO: 721170 - RNA, 19 nt, Homo sapiens
aacauggugccuauaucug

SEQ ID NO: 721171 - RNA, 19 nt, Homo sapiens
aacauguaaaacaguuaca

SEQ ID NO: 721172 - RNA, 13 nt, Homo sapiens
aacauguacaaaa

SEQ ID NO: 721173 - RNA, 16 nt, Homo sapiens
aacauguaugugcauu

SEQ ID NO: 721174 - RNA, 21 nt, Homo sapiens
aacaugucuccuacugaggau

SEQ ID NO: 721175 - RNA, 21 nt, Homo sapiens
aacaugugaggcauucgggga

SEQ ID NO: 721176 - RNA, 22 nt, Homo sapiens
aacauguuuugugcagcacagu

SEQ ID NO: 721177 - RNA, 20 nt, Homo sapiens
aacauucacacagggcucuu

SEQ ID NO: 721178 - RNA, 13 nt, Homo sapiens
aacauucccacug

SEQ ID NO: 721179 - RNA, 13 nt, Homo sapiens
aacauuccuccag

SEQ ID NO: 721180 - RNA, 14 nt, Homo sapiens
aacauuccuguuga

SEQ ID NO: 721181 - RNA, 17 nt, Homo sapiens
aacauugacuucuuggu

SEQ ID NO: 721182 - RNA, 18 nt, Homo sapiens
aacauugauuauaagcau

SEQ ID NO: 721183 - RNA, 21 nt, Homo sapiens
aacauugcagagcuaagcagu

SEQ ID NO: 721184 - RNA, 24 nt, Homo sapiens
aacauugcagagcuaagcagucgu

SEQ ID NO: 721185 - RNA, 23 nt, Homo sapiens
aacauuuacauguauuauuucau

SEQ ID NO: 721186 - RNA, 16 nt, Homo sapiens
aacauuuaucaaucag

SEQ ID NO: 721187 - RNA, 13 nt, Homo sapiens
aacauuucucacu

SEQ ID NO: 721188 - RNA, 13 nt, Homo sapiens
aacauuugccaag

SEQ ID NO: 721189 - RNA, 16 nt, Homo sapiens
aacauuugcugccauu

SEQ ID NO: 721190 - RNA, 18 nt, Homo sapiens
aacauuugcugccauuac

SEQ ID NO: 721191 - RNA, 14 nt, Homo sapiens
aacauuuguuccug

SEQ ID NO: 721192 - RNA, 20 nt, Homo sapiens
aacauuuuguuauugggcaa

SEQ ID NO: 721193 - RNA, 18 nt, Homo sapiens
aacauuuuucacaucucu

SEQ ID NO: 721194 - RNA, 15 nt, Homo sapiens
aaccaaaaguuauua

SEQ ID NO: 721195 - RNA, 20 nt, Homo sapiens
aaccaaaucuggaagccaaa

SEQ ID NO: 721196 - RNA, 17 nt, Homo sapiens
aaccaacccccaucucc

SEQ ID NO: 721197 - RNA, 17 nt, Homo sapiens
aaccaagauauccacuu

SEQ ID NO: 721198 - RNA, 15 nt, Homo sapiens
aaccaagcaaaggaa

SEQ ID NO: 721199 - RNA, 16 nt, Homo sapiens
aaccaagccaauguua

SEQ ID NO: 721200 - RNA, 15 nt, Homo sapiens
aaccaaggacugagc

SEQ ID NO: 721201 - RNA, 23 nt, Homo sapiens
aaccaaugcuuucucaugucuca

SEQ ID NO: 721202 - RNA, 14 nt, Homo sapiens
aaccaauguagcac

SEQ ID NO: 721203 - RNA, 22 nt, Homo sapiens
aaccacaaagcacaguuugaac

SEQ ID NO: 721204 - RNA, 20 nt, Homo sapiens
aaccaccgcgcccagccuuu

SEQ ID NO: 721205 - RNA, 22 nt, Homo sapiens
aaccacuaagaauucaaacugg

SEQ ID NO: 721206 - RNA, 22 nt, Homo sapiens
aaccacuaguugauguauggua

SEQ ID NO: 721207 - RNA, 13 nt, Homo sapiens
aaccacucaaauu

SEQ ID NO: 721208 - RNA, 17 nt, Homo sapiens
aaccacuccacuggccu

SEQ ID NO: 721209 - RNA, 14 nt, Homo sapiens
aaccacugugccac

SEQ ID NO: 721210 - RNA, 20 nt, Homo sapiens
ggacugcauggggaggcagc

SEQ ID NO: 721211 - RNA, 15 nt, Homo sapiens
ggacugcuggcaugc

SEQ ID NO: 721212 - RNA, 15 nt, Homo sapiens
ggacuguaagggauu

SEQ ID NO: 721213 - RNA, 15 nt, Homo sapiens
ggacugugauuugaa

SEQ ID NO: 721214 - RNA, 19 nt, Homo sapiens
ggacugugccucaggccag

SEQ ID NO: 721215 - RNA, 21 nt, Homo sapiens
ggacuucaagccccaccacau

SEQ ID NO: 721216 - RNA, 14 nt, Homo sapiens
ggacuucagugugu

SEQ ID NO: 721217 - RNA, 14 nt, Homo sapiens
ggacuuccugucau

SEQ ID NO: 721218 - RNA, 18 nt, Homo sapiens
ggacuuccugucauuuuc

SEQ ID NO: 721219 - RNA, 15 nt, Homo sapiens
ggacuucugccugaa

SEQ ID NO: 721220 - RNA, 13 nt, Homo sapiens
ggacuuguaggga

SEQ ID NO: 721221 - RNA, 18 nt, Homo sapiens
ggacuuugagcacacuuu

SEQ ID NO: 721222 - RNA, 16 nt, Homo sapiens
ggacuuuucgaccaau

SEQ ID NO: 721223 - RNA, 17 nt, Homo sapiens
ggacuuuugaaaagcuu

SEQ ID NO: 721224 - RNA, 21 nt, Homo sapiens
ggagaaaagggauggagcuga

SEQ ID NO: 721225 - RNA, 16 nt, Homo sapiens
ggagaaaauaacaaga

SEQ ID NO: 721226 - RNA, 23 nt, Homo sapiens
ggagaaaauuggaacucuacuca

SEQ ID NO: 721227 - RNA, 21 nt, Homo sapiens
ggagaaacuguagucucagga

SEQ ID NO: 721228 - RNA, 18 nt, Homo sapiens
ggagaaagcucauggcug

SEQ ID NO: 721229 - RNA, 15 nt, Homo sapiens
ggagaaaugucauaa

SEQ ID NO: 721230 - RNA, 14 nt, Homo sapiens
ggagaacuagagaa

SEQ ID NO: 721231 - RNA, 14 nt, Homo sapiens
ggagaacuauccaa

SEQ ID NO: 721232 - RNA, 21 nt, Homo sapiens
ggagaagagaugcugccauuu

SEQ ID NO: 721233 - RNA, 21 nt, Homo sapiens
aagcaccuuugcucucagcca

SEQ ID NO: 721234 - RNA, 22 nt, Homo sapiens
aagcacgugucucagacugcau

SEQ ID NO: 721235 - RNA, 14 nt, Homo sapiens
aagcacuacaccuu

SEQ ID NO: 721236 - RNA, 19 nt, Homo sapiens
aagcacuacaccuugccuu

SEQ ID NO: 721237 - RNA, 15 nt, Homo sapiens
aagcagaaauguacu

SEQ ID NO: 721238 - RNA, 12 nt, Homo sapiens
aagcagcacugu

SEQ ID NO: 721239 - RNA, 23 nt, Homo sapiens
aagcagcauggaaaaaugguuga

SEQ ID NO: 721240 - RNA, 11 nt, Homo sapiens
aagcagcauuu

SEQ ID NO: 721241 - RNA, 22 nt, Homo sapiens
aagcagcgaccgcccccuccuc

SEQ ID NO: 721242 - RNA, 14 nt, Homo sapiens
aagcagcuuacuua

SEQ ID NO: 721243 - RNA, 13 nt, Homo sapiens
aagcaggugcuac

SEQ ID NO: 721244 - RNA, 16 nt, Homo sapiens
aagcagucagcccuua

SEQ ID NO: 721245 - RNA, 23 nt, Homo sapiens
aagcagucagcccuuauggccaa

SEQ ID NO: 721246 - RNA, 16 nt, Homo sapiens
aagcagucuugcucug

SEQ ID NO: 721247 - RNA, 21 nt, Homo sapiens
aagcagugccucgaggcaccg

SEQ ID NO: 721248 - RNA, 17 nt, Homo sapiens
aagcaguucaugucuga

SEQ ID NO: 721249 - RNA, 22 nt, Homo sapiens
aagcaguuguaccaagugaaau

SEQ ID NO: 721250 - RNA, 12 nt, Homo sapiens
aagcauacuuug

SEQ ID NO: 721251 - RNA, 13 nt, Homo sapiens
aagcaucagagau

SEQ ID NO: 721252 - RNA, 11 nt, Homo sapiens
aagcaucaucc

SEQ ID NO: 721253 - RNA, 16 nt, Homo sapiens
aagcaucugauagaau

SEQ ID NO: 721254 - RNA, 12 nt, Homo sapiens
aagcaucugcca

SEQ ID NO: 721255 - RNA, 15 nt, Homo sapiens
aagcaucuggcucua

SEQ ID NO: 721256 - RNA, 22 nt, Homo sapiens
aagcaugaucuuguuacuguga

SEQ ID NO: 721257 - RNA, 23 nt, Homo sapiens
aagcaugaucuuguuacugugau

SEQ ID NO: 721258 - RNA, 14 nt, Homo sapiens
aagcaugcauucua

SEQ ID NO: 721259 - RNA, 23 nt, Homo sapiens
aagcauguuuuguugcucagugu

SEQ ID NO: 721260 - RNA, 13 nt, Homo sapiens
aagcauucuucaa

SEQ ID NO: 721261 - RNA, 18 nt, Homo sapiens
aagcauucuuguguaaua

SEQ ID NO: 721262 - RNA, 17 nt, Homo sapiens
aagcauugguuauucaa

SEQ ID NO: 721263 - RNA, 11 nt, Homo sapiens
aagcauuguaa

SEQ ID NO: 721264 - RNA, 19 nt, Homo sapiens
aagcauuguccaaaauccc

SEQ ID NO: 721265 - RNA, 14 nt, Homo sapiens
aagcauuuggugcc

SEQ ID NO: 721266 - RNA, 22 nt, Homo sapiens
aagcauuuggugccuauuugaa

SEQ ID NO: 721267 - RNA, 15 nt, Homo sapiens
aagcauuuguagcaa

SEQ ID NO: 721268 - RNA, 11 nt, Homo sapiens
aagccaaaggc

SEQ ID NO: 721269 - RNA, 15 nt, Homo sapiens
aagccaaauuuccag

SEQ ID NO: 721270 - RNA, 19 nt, Homo sapiens
aagccaaauuuccaguuua

SEQ ID NO: 721271 - RNA, 18 nt, Homo sapiens
aagccaacaacucugccu

SEQ ID NO: 721272 - RNA, 19 nt, Homo sapiens
aagccaaguaaagugcuua

SEQ ID NO: 721273 - RNA, 18 nt, Homo sapiens
aagccacauggcugggau

SEQ ID NO: 721274 - RNA, 14 nt, Homo sapiens
aagccaccucacca

SEQ ID NO: 721275 - RNA, 11 nt, Homo sapiens
aagccacugaa

SEQ ID NO: 721276 - RNA, 13 nt, Homo sapiens
aagccacuugaaa

SEQ ID NO: 721277 - RNA, 18 nt, Homo sapiens
aagccagcauauuccuag

SEQ ID NO: 721278 - RNA, 17 nt, Homo sapiens
aagccagccagaggcau

SEQ ID NO: 721279 - RNA, 17 nt, Homo sapiens
aagccaucauccuccau

SEQ ID NO: 721280 - RNA, 18 nt, Homo sapiens
aagccauuucugucucca

SEQ ID NO: 721281 - RNA, 17 nt, Homo sapiens
aagcccagcgguucaca

SEQ ID NO: 721282 - RNA, 17 nt, Homo sapiens
aagcccagugcacugaa

SEQ ID NO: 721283 - RNA, 12 nt, Homo sapiens
aagcccaguuca

SEQ ID NO: 721284 - RNA, 17 nt, Homo sapiens
aagcccauagcacuggg

SEQ ID NO: 721285 - RNA, 19 nt, Homo sapiens
aagcccauagcacugggcu

SEQ ID NO: 721286 - RNA, 19 nt, Homo sapiens
aagcccauuuguguacaca

SEQ ID NO: 721287 - RNA, 18 nt, Homo sapiens
aagccccagcuuggcuca

SEQ ID NO: 721288 - RNA, 19 nt, Homo sapiens
aagcccccagggccuccag

SEQ ID NO: 721289 - RNA, 14 nt, Homo sapiens
aagcccuaagugac

SEQ ID NO: 721290 - RNA, 13 nt, Homo sapiens
aagcccuggcaac

SEQ ID NO: 721291 - RNA, 21 nt, Homo sapiens
aagccgaccuucccuccgccu

SEQ ID NO: 721292 - RNA, 20 nt, Homo sapiens
aagccuaagggauccugccu

SEQ ID NO: 721293 - RNA, 13 nt, Homo sapiens
aagccucauuuga

SEQ ID NO: 721294 - RNA, 20 nt, Homo sapiens
aagccuggcccauaauguga

SEQ ID NO: 721295 - RNA, 12 nt, Homo sapiens
aagccugucauu

SEQ ID NO: 721296 - RNA, 14 nt, Homo sapiens
aagccugugcaaug

SEQ ID NO: 721297 - RNA, 15 nt, Homo sapiens
aagccugugcaaugc

SEQ ID NO: 721298 - RNA, 21 nt, Homo sapiens
aagccuuaauuugcacagugu

SEQ ID NO: 721299 - RNA, 15 nt, Homo sapiens
aagccuuauuuuuca

SEQ ID NO: 721300 - RNA, 13 nt, Homo sapiens
aagccuucagcuc

SEQ ID NO: 721301 - RNA, 22 nt, Homo sapiens
aagcgacccauucagagacugu

SEQ ID NO: 721302 - RNA, 18 nt, Homo sapiens
aagcggagcuugcaguga

SEQ ID NO: 721303 - RNA, 18 nt, Homo sapiens
aagcggagguugcaggga

SEQ ID NO: 721304 - RNA, 17 nt, Homo sapiens
aagcggcuguuuacugc

SEQ ID NO: 721305 - RNA, 21 nt, Homo sapiens
aagcggugguuuguaauuccu

SEQ ID NO: 721306 - RNA, 20 nt, Homo sapiens
aagcuaaaauuagaugaacu

SEQ ID NO: 721307 - RNA, 14 nt, Homo sapiens
aagcuaaauuccac

SEQ ID NO: 721308 - RNA, 14 nt, Homo sapiens
aagcuacaguuuug

SEQ ID NO: 721309 - RNA, 16 nt, Homo sapiens
aagcuagcacuaacuc

SEQ ID NO: 721310 - RNA, 17 nt, Homo sapiens
aagcuaguggcuucaaa

SEQ ID NO: 721311 - RNA, 17 nt, Homo sapiens
aagcuaguguaccuccu

SEQ ID NO: 721312 - RNA, 12 nt, Homo sapiens
aagcuauaucua

SEQ ID NO: 721313 - RNA, 17 nt, Homo sapiens
aagcuauucucaugccu

SEQ ID NO: 721314 - RNA, 17 nt, Homo sapiens
aagcucaauucaaguga

SEQ ID NO: 721315 - RNA, 15 nt, Homo sapiens
aagcucagacuugcc

SEQ ID NO: 721316 - RNA, 18 nt, Homo sapiens
aagcuccugcuacuuccc

SEQ ID NO: 721317 - RNA, 19 nt, Homo sapiens
aagcuccugcuacuucccc

SEQ ID NO: 721318 - RNA, 15 nt, Homo sapiens
aagcucgagugaauu

SEQ ID NO: 721319 - RNA, 14 nt, Homo sapiens
aagcucuagaaucu

SEQ ID NO: 721320 - RNA, 14 nt, Homo sapiens
aagcucugaaguca

SEQ ID NO: 721321 - RNA, 13 nt, Homo sapiens
aagcucuucuaaa

SEQ ID NO: 721322 - RNA, 16 nt, Homo sapiens
aagcucuucucuccag

SEQ ID NO: 721323 - RNA, 16 nt, Homo sapiens
aagcugacucaaaaau

SEQ ID NO: 721324 - RNA, 17 nt, Homo sapiens
aagcugagaagaaugaa

SEQ ID NO: 721325 - RNA, 12 nt, Homo sapiens
aagcugcacaug

SEQ ID NO: 721326 - RNA, 14 nt, Homo sapiens
ggaguuggagacca

SEQ ID NO: 721327 - RNA, 21 nt, Homo sapiens
ggaguuuucuggagugagcac

SEQ ID NO: 721328 - RNA, 12 nt, Homo sapiens
ggauaaaagccc

SEQ ID NO: 721329 - RNA, 21 nt, Homo sapiens
ggauaaagaaaagacauuuua

SEQ ID NO: 721330 - RNA, 19 nt, Homo sapiens
ggauaaaucauaaagucag

SEQ ID NO: 721331 - RNA, 23 nt, Homo sapiens
ggauaauauccagccucccacaa

SEQ ID NO: 721332 - RNA, 23 nt, Homo sapiens
ggauaaucacauuaucaucugaa

SEQ ID NO: 721333 - RNA, 18 nt, Homo sapiens
ggauacagaaaugcaaaa

SEQ ID NO: 721334 - RNA, 15 nt, Homo sapiens
ggauacuucauuaaa

SEQ ID NO: 721335 - RNA, 12 nt, Homo sapiens
ggauauauuuga

SEQ ID NO: 721336 - RNA, 21 nt, Homo sapiens
ggauauauuugaaauaguaua

SEQ ID NO: 721337 - RNA, 21 nt, Homo sapiens
ggauauuaaauguugcuuuaa

SEQ ID NO: 721338 - RNA, 22 nt, Homo sapiens
ggauauugguucuuccccucau

SEQ ID NO: 721339 - RNA, 13 nt, Homo sapiens
ggauauuuacuac

SEQ ID NO: 721340 - RNA, 15 nt, Homo sapiens
ggauauuuaguucaa

SEQ ID NO: 721341 - RNA, 21 nt, Homo sapiens
ggauauuuaguucaacuguau

SEQ ID NO: 721342 - RNA, 15 nt, Homo sapiens
ggauauuuucuucca

SEQ ID NO: 721343 - RNA, 20 nt, Homo sapiens
ggaucaauaggaaagcauau

SEQ ID NO: 721344 - RNA, 15 nt, Homo sapiens
ggaucacucucugcu

SEQ ID NO: 721345 - RNA, 12 nt, Homo sapiens
ggauccagcacu

SEQ ID NO: 721346 - RNA, 18 nt, Homo sapiens
ggaucccaggccagggaa

SEQ ID NO: 721347 - RNA, 17 nt, Homo sapiens
ggaucccguguugccau

SEQ ID NO: 721348 - RNA, 14 nt, Homo sapiens
ggauccgcugccac

SEQ ID NO: 721349 - RNA, 13 nt, Homo sapiens
aaggaaaaauaau

SEQ ID NO: 721350 - RNA, 19 nt, Homo sapiens
aaggaaaaucacaucucca

SEQ ID NO: 721351 - RNA, 12 nt, Homo sapiens
aaggaaacacuu

SEQ ID NO: 721352 - RNA, 17 nt, Homo sapiens
aaggaaacccccagugu

SEQ ID NO: 721353 - RNA, 12 nt, Homo sapiens
aaggaaagugau

SEQ ID NO: 721354 - RNA, 19 nt, Homo sapiens
aaggaaaucuccucuuuug

SEQ ID NO: 721355 - RNA, 12 nt, Homo sapiens
aaggaaccagaa

SEQ ID NO: 721356 - RNA, 21 nt, Homo sapiens
aaggaaccguggagcaugcaa

SEQ ID NO: 721357 - RNA, 15 nt, Homo sapiens
aaggaacuaagucag

SEQ ID NO: 721358 - RNA, 21 nt, Homo sapiens
aaggaacucuacuucagucaa

SEQ ID NO: 721359 - RNA, 21 nt, Homo sapiens
aaggaagcaaguuuucuucca

SEQ ID NO: 721360 - RNA, 18 nt, Homo sapiens
aaggaaguuucaguauua

SEQ ID NO: 721361 - RNA, 15 nt, Homo sapiens
aaggaauaaaaccau

SEQ ID NO: 721362 - RNA, 13 nt, Homo sapiens
aaggaauggugcg

SEQ ID NO: 721363 - RNA, 13 nt, Homo sapiens
aaggacacaguga

SEQ ID NO: 721364 - RNA, 14 nt, Homo sapiens
aaggacacagugau

SEQ ID NO: 721365 - RNA, 21 nt, Homo sapiens
aaggacacuagccugugcacg

SEQ ID NO: 721366 - RNA, 18 nt, Homo sapiens
aaggacacuuccugccua

SEQ ID NO: 721367 - RNA, 15 nt, Homo sapiens
aaggacaggacccuc

SEQ ID NO: 721368 - RNA, 13 nt, Homo sapiens
aaggaccaauagc

SEQ ID NO: 721369 - RNA, 21 nt, Homo sapiens
aaggaccugaaauuccaaagu

SEQ ID NO: 721370 - RNA, 23 nt, Homo sapiens
aaggacgugggccuccagaguug

SEQ ID NO: 721371 - RNA, 22 nt, Homo sapiens
aaggacuccauuggaucugcaa

SEQ ID NO: 721372 - RNA, 14 nt, Homo sapiens
aaggacucuuccac

SEQ ID NO: 721373 - RNA, 21 nt, Homo sapiens
aaggacugagggcagugcccu

SEQ ID NO: 721374 - RNA, 15 nt, Homo sapiens
aaggagaacuaucca

SEQ ID NO: 721375 - RNA, 18 nt, Homo sapiens
aaggagaacuauccaaaa

SEQ ID NO: 721376 - RNA, 19 nt, Homo sapiens
aaggagaacuauccaaaac

SEQ ID NO: 721377 - RNA, 15 nt, Homo sapiens
aaggagagcuuugca

SEQ ID NO: 721378 - RNA, 23 nt, Homo sapiens
aaggagagguuggggacacgcac

SEQ ID NO: 721379 - RNA, 22 nt, Homo sapiens
aaggagauaauuacugccuuga

SEQ ID NO: 721380 - RNA, 19 nt, Homo sapiens
aaggagcuacugacauucc

SEQ ID NO: 721381 - RNA, 21 nt, Homo sapiens
aaggaggacgguuaacuugua

SEQ ID NO: 721382 - RNA, 22 nt, Homo sapiens
aaggagggagcucugaugagca

SEQ ID NO: 721383 - RNA, 15 nt, Homo sapiens
aaggagggagcugcu

SEQ ID NO: 721384 - RNA, 19 nt, Homo sapiens
aaggagugagaugaaucaa

SEQ ID NO: 721385 - RNA, 15 nt, Homo sapiens
aaggauagugcgaug

SEQ ID NO: 721386 - RNA, 17 nt, Homo sapiens
aaggauaugcaguaugc

SEQ ID NO: 721387 - RNA, 18 nt, Homo sapiens
aaggauauuuacuacuuu

SEQ ID NO: 721388 - RNA, 21 nt, Homo sapiens
aaggaucaucuauguauucaa

SEQ ID NO: 721389 - RNA, 22 nt, Homo sapiens
aaggaugcacagucaggaagac

SEQ ID NO: 721390 - RNA, 18 nt, Homo sapiens
aaggauggagccagcucu

SEQ ID NO: 721391 - RNA, 18 nt, Homo sapiens
aaggauuuaagcaaaggc

SEQ ID NO: 721392 - RNA, 16 nt, Homo sapiens
aaggcaaaguggaaug

SEQ ID NO: 721393 - RNA, 21 nt, Homo sapiens
aaggcacccgcccuuuccuug

SEQ ID NO: 721394 - RNA, 14 nt, Homo sapiens
aaggcaguauuuca

SEQ ID NO: 721395 - RNA, 15 nt, Homo sapiens
aaggcauaucuucua

SEQ ID NO: 721396 - RNA, 14 nt, Homo sapiens
aaggcauaugcaca

SEQ ID NO: 721397 - RNA, 19 nt, Homo sapiens
aaggcaucuacacaauuua

SEQ ID NO: 721398 - RNA, 18 nt, Homo sapiens
aaggcauguggccuuuau

SEQ ID NO: 721399 - RNA, 13 nt, Homo sapiens
aaggcauuucaua

SEQ ID NO: 721400 - RNA, 22 nt, Homo sapiens
aaggccaagaggcuguucccac

SEQ ID NO: 721401 - RNA, 13 nt, Homo sapiens
aaggccacagugc

SEQ ID NO: 721402 - RNA, 16 nt, Homo sapiens
aaggcccacuguaaua

SEQ ID NO: 721403 - RNA, 19 nt, Homo sapiens
aaggccccagaugauccca

SEQ ID NO: 721404 - RNA, 16 nt, Homo sapiens
aaggcccugcugaguc

SEQ ID NO: 721405 - RNA, 21 nt, Homo sapiens
aaggcuauguaaacaaaccac

SEQ ID NO: 721406 - RNA, 16 nt, Homo sapiens
aaggcucacaccucau

SEQ ID NO: 721407 - RNA, 17 nt, Homo sapiens
aaggcucagucucagga

SEQ ID NO: 721408 - RNA, 22 nt, Homo sapiens
aaggcucccggaauuccgucac

SEQ ID NO: 721409 - RNA, 16 nt, Homo sapiens
aaggcuccuccuugcc

SEQ ID NO: 721410 - RNA, 22 nt, Homo sapiens
aaggcucugaaauaaaaugcca

SEQ ID NO: 721411 - RNA, 17 nt, Homo sapiens
aaggcucugugccuugg

SEQ ID NO: 721412 - RNA, 15 nt, Homo sapiens
aaggcugcugugaac

SEQ ID NO: 721413 - RNA, 18 nt, Homo sapiens
aaggcugugcaggcacau

SEQ ID NO: 721414 - RNA, 19 nt, Homo sapiens
aaggcuuauauuaagcaaa

SEQ ID NO: 721415 - RNA, 15 nt, Homo sapiens
aaggcuuugaguuaa

SEQ ID NO: 721416 - RNA, 20 nt, Homo sapiens
aaggcuuuguauaaucccac

SEQ ID NO: 721417 - RNA, 16 nt, Homo sapiens
aagggaaacugggaaa

SEQ ID NO: 721418 - RNA, 15 nt, Homo sapiens
aagggaaagucagcu

SEQ ID NO: 721419 - RNA, 18 nt, Homo sapiens
aagggaagugaggcccaa

SEQ ID NO: 721420 - RNA, 23 nt, Homo sapiens
aagggaauacugugcauaagcca

SEQ ID NO: 721421 - RNA, 13 nt, Homo sapiens
aagggaccugcuc

SEQ ID NO: 721422 - RNA, 18 nt, Homo sapiens
aagggagagaaaagcugg

SEQ ID NO: 721423 - RNA, 22 nt, Homo sapiens
aagggagagaacaaaagcuaua

SEQ ID NO: 721424 - RNA, 18 nt, Homo sapiens
aagggauaguccaaagac

SEQ ID NO: 721425 - RNA, 14 nt, Homo sapiens
aagggauggcaaga

SEQ ID NO: 721426 - RNA, 23 nt, Homo sapiens
aagggauugcuuugcauuacugu

SEQ ID NO: 721427 - RNA, 14 nt, Homo sapiens
aagggcaucaucua

SEQ ID NO: 721428 - RNA, 12 nt, Homo sapiens
aagggcauuucc

SEQ ID NO: 721429 - RNA, 19 nt, Homo sapiens
aagggcccaaaggccuugg

SEQ ID NO: 721430 - RNA, 17 nt, Homo sapiens
aagggcccaaugaauua

SEQ ID NO: 721431 - RNA, 17 nt, Homo sapiens
aagggcccuuucaucuu

SEQ ID NO: 721432 - RNA, 19 nt, Homo sapiens
aagggcugcaaugcccuca

SEQ ID NO: 721433 - RNA, 15 nt, Homo sapiens
aaggggagaagggaa

SEQ ID NO: 721434 - RNA, 18 nt, Homo sapiens
aaggggaggggaugucag

SEQ ID NO: 721435 - RNA, 22 nt, Homo sapiens
aaggggcccaagccccaucuca

SEQ ID NO: 721436 - RNA, 13 nt, Homo sapiens
aaggggcugagga

SEQ ID NO: 721437 - RNA, 17 nt, Homo sapiens
aaggggugacugaacug

SEQ ID NO: 721438 - RNA, 19 nt, Homo sapiens
aagggucucucuccagguc

SEQ ID NO: 721439 - RNA, 14 nt, Homo sapiens
aagggucuugacuc

SEQ ID NO: 721440 - RNA, 13 nt, Homo sapiens
aaggguggaaauc

SEQ ID NO: 721441 - RNA, 24 nt, Homo sapiens
aaguguauaugauucucuugagau

SEQ ID NO: 721442 - RNA, 18 nt, Homo sapiens
aagugucuacaugugcca

SEQ ID NO: 721443 - RNA, 23 nt, Homo sapiens
aagugugugccaccaugccucac

SEQ ID NO: 721444 - RNA, 19 nt, Homo sapiens
aaguguuuacuaugugcca

SEQ ID NO: 721445 - RNA, 20 nt, Homo sapiens
aaguguuuucucagaacagc

SEQ ID NO: 721446 - RNA, 17 nt, Homo sapiens
aaguuagaaaacauaau

SEQ ID NO: 721447 - RNA, 21 nt, Homo sapiens
aaguuagucaauccugucaua

SEQ ID NO: 721448 - RNA, 23 nt, Homo sapiens
aaguuauuuacuuuuaccacuau

SEQ ID NO: 721449 - RNA, 11 nt, Homo sapiens
aaguucaggga

SEQ ID NO: 721450 - RNA, 13 nt, Homo sapiens
aaguucccuccau

SEQ ID NO: 721451 - RNA, 15 nt, Homo sapiens
aaguucucauugaau

SEQ ID NO: 721452 - RNA, 23 nt, Homo sapiens
aaguucuccuuuugaacuuguca

SEQ ID NO: 721453 - RNA, 17 nt, Homo sapiens
aaguucuggaucuuaua

SEQ ID NO: 721454 - RNA, 14 nt, Homo sapiens
aaguugcuaauaca

SEQ ID NO: 721455 - RNA, 17 nt, Homo sapiens
aaguugcugaugaacuc

SEQ ID NO: 721456 - RNA, 20 nt, Homo sapiens
aaguugcugaugaacucuua

SEQ ID NO: 721457 - RNA, 13 nt, Homo sapiens
aaguugcugucac

SEQ ID NO: 721458 - RNA, 23 nt, Homo sapiens
aaguugcuuuuuuaggcuacagu

SEQ ID NO: 721459 - RNA, 18 nt, Homo sapiens
aaguuguuuuuaaaacac

SEQ ID NO: 721460 - RNA, 18 nt, Homo sapiens
aaguuuaucacacagugu

SEQ ID NO: 721461 - RNA, 13 nt, Homo sapiens
aaguuuauuucca

SEQ ID NO: 721462 - RNA, 16 nt, Homo sapiens
aaguuucagauuugcc

SEQ ID NO: 721463 - RNA, 20 nt, Homo sapiens
aaguuucagauuugccauuc

SEQ ID NO: 721464 - RNA, 15 nt, Homo sapiens
ggcaugacucuugac

SEQ ID NO: 721465 - RNA, 20 nt, Homo sapiens
ggcaugagacucagugcaga

SEQ ID NO: 721466 - RNA, 16 nt, Homo sapiens
ggcauggguccagggc

SEQ ID NO: 721467 - RNA, 14 nt, Homo sapiens
ggcaugguggcaca

SEQ ID NO: 721468 - RNA, 20 nt, Homo sapiens
ggcauucuaggcucuauuua

SEQ ID NO: 721469 - RNA, 13 nt, Homo sapiens
ggcauucuucuaa

SEQ ID NO: 721470 - RNA, 20 nt, Homo sapiens
ggcauuugcaccuaccucac

SEQ ID NO: 721471 - RNA, 12 nt, Homo sapiens
ggcauuuggacc

SEQ ID NO: 721472 - RNA, 22 nt, Homo sapiens
ggcauuugucagggauuuagcc

SEQ ID NO: 721473 - RNA, 21 nt, Homo sapiens
ggccaaagagucuccaguuua

SEQ ID NO: 721474 - RNA, 12 nt, Homo sapiens
ggccaacaaaga

SEQ ID NO: 721475 - RNA, 14 nt, Homo sapiens
ggccaacagcaccu

SEQ ID NO: 721476 - RNA, 14 nt, Homo sapiens
ggccaacuaggcag

SEQ ID NO: 721477 - RNA, 15 nt, Homo sapiens
ggccaacugcaaaaa

SEQ ID NO: 721478 - RNA, 19 nt, Homo sapiens
ggccaagagcaucgugacc

SEQ ID NO: 721479 - RNA, 12 nt, Homo sapiens
ggccaagcagaa

SEQ ID NO: 721480 - RNA, 22 nt, Homo sapiens
ggccaaggggugggccugugaa

SEQ ID NO: 721481 - RNA, 23 nt, Homo sapiens
ggccaaggugccaccacccugcc

SEQ ID NO: 721482 - RNA, 19 nt, Homo sapiens
ggccaaggugggcagauca

SEQ ID NO: 721483 - RNA, 14 nt, Homo sapiens
ggccaaggugucca

SEQ ID NO: 721484 - RNA, 19 nt, Homo sapiens
ggccaagguguccaggguc

SEQ ID NO: 721485 - RNA, 16 nt, Homo sapiens
ggccaagucuaaugaa

SEQ ID NO: 721486 - RNA, 15 nt, Homo sapiens
ggccaaguuccucua

SEQ ID NO: 721487 - RNA, 15 nt, Homo sapiens
ggccaauaaauauga

SEQ ID NO: 721488 - RNA, 19 nt, Homo sapiens
ggccaaugggagagcucuu

SEQ ID NO: 721489 - RNA, 19 nt, Homo sapiens
ggccacaaaacaccaaaga

SEQ ID NO: 721490 - RNA, 15 nt, Homo sapiens
ggccacaccaucucc

SEQ ID NO: 721491 - RNA, 18 nt, Homo sapiens
ggccacagugcaauuuua

SEQ ID NO: 721492 - RNA, 13 nt, Homo sapiens
ggccacccacuga

SEQ ID NO: 721493 - RNA, 22 nt, Homo sapiens
ggccacccccuauccucugagu

SEQ ID NO: 721494 - RNA, 17 nt, Homo sapiens
ggccaccccgugccacc

SEQ ID NO: 721495 - RNA, 13 nt, Homo sapiens
ggccaccucccac

SEQ ID NO: 721496 - RNA, 15 nt, Homo sapiens
ggccacucaggccag

SEQ ID NO: 721497 - RNA, 20 nt, Homo sapiens
ggccacuugccucaccugcu

SEQ ID NO: 721498 - RNA, 20 nt, Homo sapiens
ggccagagggcaguggcccu

SEQ ID NO: 721499 - RNA, 14 nt, Homo sapiens
ggccagagugcagu

SEQ ID NO: 721500 - RNA, 13 nt, Homo sapiens
ggccagauccagc

SEQ ID NO: 721501 - RNA, 11 nt, Homo sapiens
ggccagcacca

SEQ ID NO: 721502 - RNA, 23 nt, Homo sapiens
ggccaguauuuuuauuucuuuaa

SEQ ID NO: 721503 - RNA, 23 nt, Homo sapiens
ggccagucaggcugcagaggcac

SEQ ID NO: 721504 - RNA, 13 nt, Homo sapiens
ggccauauuaccc

SEQ ID NO: 721505 - RNA, 16 nt, Homo sapiens
ggccauccacugugac

SEQ ID NO: 721506 - RNA, 23 nt, Homo sapiens
ggccauuccaacagcucaagucu

SEQ ID NO: 721507 - RNA, 22 nt, Homo sapiens
ggccauuuccaagaggcuguag

SEQ ID NO: 721508 - RNA, 11 nt, Homo sapiens
ggcccaagacu

SEQ ID NO: 721509 - RNA, 19 nt, Homo sapiens
ggcccaagccccaucucau

SEQ ID NO: 721510 - RNA, 16 nt, Homo sapiens
ggcccaagucccuguu

SEQ ID NO: 721511 - RNA, 12 nt, Homo sapiens
ggcccacaggaa

SEQ ID NO: 721512 - RNA, 15 nt, Homo sapiens
ggcccacccccagga

SEQ ID NO: 721513 - RNA, 19 nt, Homo sapiens
ggcccagagcccagcucca

SEQ ID NO: 721514 - RNA, 19 nt, Homo sapiens
ggcccagaguuuacauucu

SEQ ID NO: 721515 - RNA, 21 nt, Homo sapiens
ggcccagcacauggccauaga

SEQ ID NO: 721516 - RNA, 16 nt, Homo sapiens
ggcccauaucugugaa

SEQ ID NO: 721517 - RNA, 11 nt, Homo sapiens
ggcccaucuca

SEQ ID NO: 721518 - RNA, 17 nt, Homo sapiens
ggcccaucuuacuggaa

SEQ ID NO: 721519 - RNA, 21 nt, Homo sapiens
ggccccagacgcauagacuga

SEQ ID NO: 721520 - RNA, 17 nt, Homo sapiens
ggccccaguucaaucuc

SEQ ID NO: 721521 - RNA, 15 nt, Homo sapiens
ggcccccacaggccc

SEQ ID NO: 721522 - RNA, 19 nt, Homo sapiens
ggccccugcgugggggcca

SEQ ID NO: 721523 - RNA, 17 nt, Homo sapiens
ggccccuggcacucuug

SEQ ID NO: 721524 - RNA, 14 nt, Homo sapiens
ggccccuggcccag

SEQ ID NO: 721525 - RNA, 23 nt, Homo sapiens
ggcccgcaccgcugggagucuga

SEQ ID NO: 721526 - RNA, 22 nt, Homo sapiens
ggcccgcagugcugggaccaga

SEQ ID NO: 721527 - RNA, 23 nt, Homo sapiens
ggcccgccucacaccccagugga

SEQ ID NO: 721528 - RNA, 20 nt, Homo sapiens
ggcccuaaaggacucuccag

SEQ ID NO: 721529 - RNA, 20 nt, Homo sapiens
ggcccucacucuugaagucc

SEQ ID NO: 721530 - RNA, 23 nt, Homo sapiens
ggcccuccucucccauccuugau

SEQ ID NO: 721531 - RNA, 17 nt, Homo sapiens
ggcccucugccugcacu

SEQ ID NO: 721532 - RNA, 15 nt, Homo sapiens
ggcccucugcugagc

SEQ ID NO: 721533 - RNA, 12 nt, Homo sapiens
ggcccugcugaa

SEQ ID NO: 721534 - RNA, 20 nt, Homo sapiens
ggcccuggggaucuucccac

SEQ ID NO: 721535 - RNA, 21 nt, Homo sapiens
ggcccuucuugccuacuaugc

SEQ ID NO: 721536 - RNA, 20 nt, Homo sapiens
ggccgaaaaggauaugcagu

SEQ ID NO: 721537 - RNA, 12 nt, Homo sapiens
ggccgacuccac

SEQ ID NO: 721538 - RNA, 14 nt, Homo sapiens
ggccgccagcgugu

SEQ ID NO: 721539 - RNA, 18 nt, Homo sapiens
ggccgccgcugacccugg

SEQ ID NO: 721540 - RNA, 16 nt, Homo sapiens
ggccgugagggguccc

SEQ ID NO: 721541 - RNA, 16 nt, Homo sapiens
ggccguguucaaagag

SEQ ID NO: 721542 - RNA, 16 nt, Homo sapiens
ggccuacggagucagc

SEQ ID NO: 721543 - RNA, 17 nt, Homo sapiens
ggccuaugcacauaugg

SEQ ID NO: 721544 - RNA, 21 nt, Homo sapiens
ggccuauuccaggaauuccuc

SEQ ID NO: 721545 - RNA, 15 nt, Homo sapiens
ggccuauuccugcug

SEQ ID NO: 721546 - RNA, 22 nt, Homo sapiens
ggccucacccaccccugcacag

SEQ ID NO: 721547 - RNA, 17 nt, Homo sapiens
ggccucagugugcccau

SEQ ID NO: 721548 - RNA, 12 nt, Homo sapiens
ggccuccacucc

SEQ ID NO: 721549 - RNA, 11 nt, Homo sapiens
ggccuccagaa

SEQ ID NO: 721550 - RNA, 20 nt, Homo sapiens
ggccuccggcgucuugccca

SEQ ID NO: 721551 - RNA, 18 nt, Homo sapiens
ggccucuccaguuugcac

SEQ ID NO: 721552 - RNA, 16 nt, Homo sapiens
ggccucugagaagcuc

SEQ ID NO: 721553 - RNA, 22 nt, Homo sapiens
ggccucugccugggacacugcg

SEQ ID NO: 721554 - RNA, 17 nt, Homo sapiens
ggccucuggacuggccu

SEQ ID NO: 721555 - RNA, 17 nt, Homo sapiens
ggccugaagcucuucuc

SEQ ID NO: 721556 - RNA, 19 nt, Homo sapiens
ggccugagaugcaggugau

SEQ ID NO: 721557 - RNA, 15 nt, Homo sapiens
ggccugagauuucau

SEQ ID NO: 721558 - RNA, 14 nt, Homo sapiens
ggccugcaggugag

SEQ ID NO: 721559 - RNA, 19 nt, Homo sapiens
ggccugcagugauucagca

SEQ ID NO: 721560 - RNA, 19 nt, Homo sapiens
ggccugccuucuucuugug

SEQ ID NO: 721561 - RNA, 14 nt, Homo sapiens
ggccugcuccagac

SEQ ID NO: 721562 - RNA, 18 nt, Homo sapiens
ggccugcuccagaccuga

SEQ ID NO: 721563 - RNA, 15 nt, Homo sapiens
ggccuggacaguauc

SEQ ID NO: 721564 - RNA, 15 nt, Homo sapiens
ggccuggccagucaa

SEQ ID NO: 721565 - RNA, 22 nt, Homo sapiens
ggccugggaucuggcacacucc

SEQ ID NO: 721566 - RNA, 22 nt, Homo sapiens
ggccugggggcagugacuggca

SEQ ID NO: 721567 - RNA, 15 nt, Homo sapiens
ggccugguugugugc

SEQ ID NO: 721568 - RNA, 19 nt, Homo sapiens
ggccuguaaucuaccagug

SEQ ID NO: 721569 - RNA, 22 nt, Homo sapiens
ggccuucaguuuauuuccacua

SEQ ID NO: 721570 - RNA, 20 nt, Homo sapiens
ggccuuccacgucuuccucc

SEQ ID NO: 721571 - RNA, 11 nt, Homo sapiens
ggccuugcccg

SEQ ID NO: 721572 - RNA, 22 nt, Homo sapiens
ggccuuggacaacugcauggag

SEQ ID NO: 721573 - RNA, 21 nt, Homo sapiens
ggccuugguggagcagccaga

SEQ ID NO: 721574 - RNA, 13 nt, Homo sapiens
ggccuuguaagac

SEQ ID NO: 721575 - RNA, 21 nt, Homo sapiens
ggcgacaagagugagacucca

SEQ ID NO: 721576 - RNA, 20 nt, Homo sapiens
ggcgacagagcgagacuccg

SEQ ID NO: 721577 - RNA, 18 nt, Homo sapiens
ggcgacggcuuccaucug

SEQ ID NO: 721578 - RNA, 16 nt, Homo sapiens
ggcgacugucaugugg

SEQ ID NO: 721579 - RNA, 22 nt, Homo sapiens
aaguuucuguuucaaagcacaa

SEQ ID NO: 721580 - RNA, 19 nt, Homo sapiens
aaguuuggggacaugugau

SEQ ID NO: 721581 - RNA, 21 nt, Homo sapiens
aaguuuuacuaaauacuuuaa

SEQ ID NO: 721582 - RNA, 14 nt, Homo sapiens
aaguuuuacugucu

SEQ ID NO: 721583 - RNA, 19 nt, Homo sapiens
aaguuuucuuccaugauuu

SEQ ID NO: 721584 - RNA, 14 nt, Homo sapiens
aaguuuugcugucu

SEQ ID NO: 721585 - RNA, 20 nt, Homo sapiens
aauaaaaaaaaaaggaugaa

SEQ ID NO: 721586 - RNA, 18 nt, Homo sapiens
aauaaaaaaguaacaagg

SEQ ID NO: 721587 - RNA, 15 nt, Homo sapiens
aauaaaaacccugua

SEQ ID NO: 721588 - RNA, 18 nt, Homo sapiens
aauaaaaacccuguaugg

SEQ ID NO: 721589 - RNA, 14 nt, Homo sapiens
aauaaaaaucacuu

SEQ ID NO: 721590 - RNA, 24 nt, Homo sapiens
aauaaaacccaacagauacuggaa

SEQ ID NO: 721591 - RNA, 21 nt, Homo sapiens
aauaaaagccaauuagcucua

SEQ ID NO: 721592 - RNA, 16 nt, Homo sapiens
aauaaaaguuuacaga

SEQ ID NO: 721593 - RNA, 16 nt, Homo sapiens
aauaaaauaaguggau

SEQ ID NO: 721594 - RNA, 14 nt, Homo sapiens
aauaaaauaucaua

SEQ ID NO: 721595 - RNA, 17 nt, Homo sapiens
aauaaaauauucacucu

SEQ ID NO: 721596 - RNA, 16 nt, Homo sapiens
aauaaaaucauguagu

SEQ ID NO: 721597 - RNA, 16 nt, Homo sapiens
aauaaaaugcauuuaa

SEQ ID NO: 721598 - RNA, 18 nt, Homo sapiens
aauaaaauuccuaucuca

SEQ ID NO: 721599 - RNA, 18 nt, Homo sapiens
aauaaacugaaaauggac

SEQ ID NO: 721600 - RNA, 14 nt, Homo sapiens
aauaaacugugcaa

SEQ ID NO: 721601 - RNA, 16 nt, Homo sapiens
aauaaagcacugagca

SEQ ID NO: 721602 - RNA, 17 nt, Homo sapiens
aauaaagcguccucuca

SEQ ID NO: 721603 - RNA, 14 nt, Homo sapiens
aauaaagcuucauu

SEQ ID NO: 721604 - RNA, 14 nt, Homo sapiens
aauaaagcuugcaa

SEQ ID NO: 721605 - RNA, 14 nt, Homo sapiens
aauaaaggcagcug

SEQ ID NO: 721606 - RNA, 13 nt, Homo sapiens
aauaaaguaccac

SEQ ID NO: 721607 - RNA, 17 nt, Homo sapiens
aauaaaguauagguuua

SEQ ID NO: 721608 - RNA, 11 nt, Homo sapiens
aauaaagugac

SEQ ID NO: 721609 - RNA, 20 nt, Homo sapiens
aauaaagugacccuguucuc

SEQ ID NO: 721610 - RNA, 13 nt, Homo sapiens
aauaaagugcagu

SEQ ID NO: 721611 - RNA, 23 nt, Homo sapiens
aauaaaguugcugugaauacuua

SEQ ID NO: 721612 - RNA, 14 nt, Homo sapiens
aauaaauaucugua

SEQ ID NO: 721613 - RNA, 16 nt, Homo sapiens
aauaaauccuccaguc

SEQ ID NO: 721614 - RNA, 16 nt, Homo sapiens
aauaaauguacauuaa

SEQ ID NO: 721615 - RNA, 15 nt, Homo sapiens
aauaaauguauucaa

SEQ ID NO: 721616 - RNA, 20 nt, Homo sapiens
aauaaauuuuuuuuggucaa

SEQ ID NO: 721617 - RNA, 14 nt, Homo sapiens
aauaacacagagag

SEQ ID NO: 721618 - RNA, 12 nt, Homo sapiens
aauaacagagag

SEQ ID NO: 721619 - RNA, 15 nt, Homo sapiens
aauaacaggcauuug

SEQ ID NO: 721620 - RNA, 14 nt, Homo sapiens
aauaaccacuuaaa

SEQ ID NO: 721621 - RNA, 15 nt, Homo sapiens
aauaaccuucaucaa

SEQ ID NO: 721622 - RNA, 22 nt, Homo sapiens
aauaacuaugccagcaaccuug

SEQ ID NO: 721623 - RNA, 18 nt, Homo sapiens
aauaacucuccaguaaca

SEQ ID NO: 721624 - RNA, 14 nt, Homo sapiens
aauaacugaucuca

SEQ ID NO: 721625 - RNA, 12 nt, Homo sapiens
aauaacugccuu

SEQ ID NO: 721626 - RNA, 18 nt, Homo sapiens
aauaacuucucugugaac

SEQ ID NO: 721627 - RNA, 23 nt, Homo sapiens
aauaacuucucugugaacuauua

SEQ ID NO: 721628 - RNA, 20 nt, Homo sapiens
aauaagaaacuuauuucuca

SEQ ID NO: 721629 - RNA, 19 nt, Homo sapiens
aauaagaacagaucaggaa

SEQ ID NO: 721630 - RNA, 21 nt, Homo sapiens
aauaagaauucagacaucuga

SEQ ID NO: 721631 - RNA, 17 nt, Homo sapiens
aauaagagauccuuuag

SEQ ID NO: 721632 - RNA, 22 nt, Homo sapiens
aauaagcaguauguuuguuuca

SEQ ID NO: 721633 - RNA, 14 nt, Homo sapiens
aauaaggcacaaaa

SEQ ID NO: 721634 - RNA, 15 nt, Homo sapiens
aauaaguacauauag

SEQ ID NO: 721635 - RNA, 19 nt, Homo sapiens
aauaaguacuguguacaga

SEQ ID NO: 721636 - RNA, 12 nt, Homo sapiens
aauaagugccag

SEQ ID NO: 721637 - RNA, 15 nt, Homo sapiens
aauaauaaaucuggu

SEQ ID NO: 721638 - RNA, 17 nt, Homo sapiens
aauaauaacaaucacaa

SEQ ID NO: 721639 - RNA, 18 nt, Homo sapiens
aauaauaacaaucacaaa

SEQ ID NO: 721640 - RNA, 16 nt, Homo sapiens
aauaauacaccagaga

SEQ ID NO: 721641 - RNA, 19 nt, Homo sapiens
aauaauacaccagagauaa

SEQ ID NO: 721642 - RNA, 14 nt, Homo sapiens
aauaauaccuaagc

SEQ ID NO: 721643 - RNA, 13 nt, Homo sapiens
aauaauaccuuau

SEQ ID NO: 721644 - RNA, 18 nt, Homo sapiens
aauaauacugaccuaccu

SEQ ID NO: 721645 - RNA, 16 nt, Homo sapiens
aauaauagaauugcuc

SEQ ID NO: 721646 - RNA, 20 nt, Homo sapiens
aauaauagggaaaauaccua

SEQ ID NO: 721647 - RNA, 18 nt, Homo sapiens
aauaauaugcugccaaau

SEQ ID NO: 721648 - RNA, 18 nt, Homo sapiens
aauaaugacaaaugcccu

SEQ ID NO: 721649 - RNA, 21 nt, Homo sapiens
aauaaugaguuagaacuauua

SEQ ID NO: 721650 - RNA, 18 nt, Homo sapiens
aauaaugauuuucuugcc

SEQ ID NO: 721651 - RNA, 14 nt, Homo sapiens
aauaauguacaucu

SEQ ID NO: 721652 - RNA, 15 nt, Homo sapiens
aauaauguacucaca

SEQ ID NO: 721653 - RNA, 20 nt, Homo sapiens
aauaauguuguaauucaugc

SEQ ID NO: 721654 - RNA, 15 nt, Homo sapiens
aauaauuaccaauau

SEQ ID NO: 721655 - RNA, 13 nt, Homo sapiens
aauaauucaaguc

SEQ ID NO: 721656 - RNA, 21 nt, Homo sapiens
aauaauuuuuaccuaaucucc

SEQ ID NO: 721657 - RNA, 23 nt, Homo sapiens
aauaauuuuuaccuaaucuccac

SEQ ID NO: 721658 - RNA, 15 nt, Homo sapiens
aauacaacauugcca

SEQ ID NO: 721659 - RNA, 15 nt, Homo sapiens
aauacaaucagccca

SEQ ID NO: 721660 - RNA, 17 nt, Homo sapiens
aauacaaucagcccagu

SEQ ID NO: 721661 - RNA, 17 nt, Homo sapiens
aauacacacucaaauca

SEQ ID NO: 721662 - RNA, 22 nt, Homo sapiens
aauacagaaguccccucuacuu

SEQ ID NO: 721663 - RNA, 20 nt, Homo sapiens
aauacagauagauauaugcu

SEQ ID NO: 721664 - RNA, 20 nt, Homo sapiens
aauacagaucaucuuggaac

SEQ ID NO: 721665 - RNA, 14 nt, Homo sapiens
aauacagauuugaa

SEQ ID NO: 721666 - RNA, 17 nt, Homo sapiens
aauacagggcaugcauu

SEQ ID NO: 721667 - RNA, 13 nt, Homo sapiens
aauacaguauuau

SEQ ID NO: 721668 - RNA, 18 nt, Homo sapiens
aauacaguauuauagaca

SEQ ID NO: 721669 - RNA, 23 nt, Homo sapiens
aauacaucagaaaauaaaauauu

SEQ ID NO: 721670 - RNA, 19 nt, Homo sapiens
aauacaugcugcuaauuca

SEQ ID NO: 721671 - RNA, 14 nt, Homo sapiens
aaucacuugcacuc

SEQ ID NO: 721672 - RNA, 22 nt, Homo sapiens
aaucacuugcacuccggaggua

SEQ ID NO: 721673 - RNA, 13 nt, Homo sapiens
aaucagagacaaa

SEQ ID NO: 721674 - RNA, 20 nt, Homo sapiens
aaucagagcuccaguuugca

SEQ ID NO: 721675 - RNA, 14 nt, Homo sapiens
aaucagaucauuuc

SEQ ID NO: 721676 - RNA, 17 nt, Homo sapiens
aaucagcauucucacuc

SEQ ID NO: 721677 - RNA, 12 nt, Homo sapiens
aaucagccauaa

SEQ ID NO: 721678 - RNA, 16 nt, Homo sapiens
aaucagcccagugcaa

SEQ ID NO: 721679 - RNA, 22 nt, Homo sapiens
aaucagccucuucucugaugac

SEQ ID NO: 721680 - RNA, 17 nt, Homo sapiens
aaucagcuuaaaaucca

SEQ ID NO: 721681 - RNA, 18 nt, Homo sapiens
aaucaggaauauuuucca

SEQ ID NO: 721682 - RNA, 12 nt, Homo sapiens
aaucaguauaau

SEQ ID NO: 721683 - RNA, 23 nt, Homo sapiens
aaucagugugucuaaauuugaau

SEQ ID NO: 721684 - RNA, 20 nt, Homo sapiens
aaucaguuucucaaacugag

SEQ ID NO: 721685 - RNA, 16 nt, Homo sapiens
aaucauaaaacuugau

SEQ ID NO: 721686 - RNA, 24 nt, Homo sapiens
aaucaucuauaaagaagaacuugc

SEQ ID NO: 721687 - RNA, 21 nt, Homo sapiens
aaucaucugcauuccugauga

SEQ ID NO: 721688 - RNA, 21 nt, Homo sapiens
aaucaugugggugagccagug

SEQ ID NO: 721689 - RNA, 18 nt, Homo sapiens
aaucauguugaaacaaac

SEQ ID NO: 721690 - RNA, 15 nt, Homo sapiens
aaucauuucuauuaa

SEQ ID NO: 721691 - RNA, 16 nt, Homo sapiens
aaucauuucugcauca

SEQ ID NO: 721692 - RNA, 20 nt, Homo sapiens
aaucauuucugcaucagcug

SEQ ID NO: 721693 - RNA, 18 nt, Homo sapiens
aauccaaagaaagauuaa

SEQ ID NO: 721694 - RNA, 19 nt, Homo sapiens
gggaagacuuuaaaccacc

SEQ ID NO: 721695 - RNA, 20 nt, Homo sapiens
gggaagacuuuaaaccaccu

SEQ ID NO: 721696 - RNA, 17 nt, Homo sapiens
gggaagccccacuugaa

SEQ ID NO: 721697 - RNA, 22 nt, Homo sapiens
gggaagccugugccagcaccuu

SEQ ID NO: 721698 - RNA, 19 nt, Homo sapiens
gggaagcggcccuaaggga

SEQ ID NO: 721699 - RNA, 13 nt, Homo sapiens
gggaaggagccca

SEQ ID NO: 721700 - RNA, 21 nt, Homo sapiens
gggaaggaggccaagcagugc

SEQ ID NO: 721701 - RNA, 21 nt, Homo sapiens
gggaagugagggcucacucag

SEQ ID NO: 721702 - RNA, 14 nt, Homo sapiens
gggaaucuaagaga

SEQ ID NO: 721703 - RNA, 22 nt, Homo sapiens
gggaauggggacacggugucca

SEQ ID NO: 721704 - RNA, 15 nt, Homo sapiens
gggaauucccucccc

SEQ ID NO: 721705 - RNA, 16 nt, Homo sapiens
gggacacaacacagau

SEQ ID NO: 721706 - RNA, 23 nt, Homo sapiens
gggacagagccccacgcuguuga

SEQ ID NO: 721707 - RNA, 16 nt, Homo sapiens
gggacagcaagugagc

SEQ ID NO: 721708 - RNA, 14 nt, Homo sapiens
gggacagcccacug

SEQ ID NO: 721709 - RNA, 17 nt, Homo sapiens
gggacaucacagggugg

SEQ ID NO: 721710 - RNA, 14 nt, Homo sapiens
gggacaucagggua

SEQ ID NO: 721711 - RNA, 13 nt, Homo sapiens
gggacaugaaguu

SEQ ID NO: 721712 - RNA, 15 nt, Homo sapiens
gggacccagugcaga

SEQ ID NO: 721713 - RNA, 14 nt, Homo sapiens
gggacuccaugcug

SEQ ID NO: 721714 - RNA, 14 nt, Homo sapiens
gggacucgggugcu

SEQ ID NO: 721715 - RNA, 18 nt, Homo sapiens
gggacucucccccuuuca

SEQ ID NO: 721716 - RNA, 11 nt, Homo sapiens
gggacucuccu

SEQ ID NO: 721717 - RNA, 13 nt, Homo sapiens
gggacugagccug

SEQ ID NO: 721718 - RNA, 18 nt, Homo sapiens
gggacuggcugggcugcu

SEQ ID NO: 721719 - RNA, 23 nt, Homo sapiens
gggacuuauguauuuaugaccuu

SEQ ID NO: 721720 - RNA, 18 nt, Homo sapiens
gggacuucugucuucaca

SEQ ID NO: 721721 - RNA, 22 nt, Homo sapiens
gggacuuuaccugcugggaccu

SEQ ID NO: 721722 - RNA, 24 nt, Homo sapiens
gggagaaacaggcgcggggucuca

SEQ ID NO: 721723 - RNA, 13 nt, Homo sapiens
gggagaaaugacu

SEQ ID NO: 721724 - RNA, 13 nt, Homo sapiens
gggagaacucauu

SEQ ID NO: 721725 - RNA, 19 nt, Homo sapiens
gggagaagcuccucucccc

SEQ ID NO: 721726 - RNA, 19 nt, Homo sapiens
gggagacaccaguggugcg

SEQ ID NO: 721727 - RNA, 19 nt, Homo sapiens
gggagcacuguucacauca

SEQ ID NO: 721728 - RNA, 20 nt, Homo sapiens
gggagcacuguucacaucau

SEQ ID NO: 721729 - RNA, 13 nt, Homo sapiens
gggagcagugucu

SEQ ID NO: 721730 - RNA, 17 nt, Homo sapiens
gggagccauggggagca

SEQ ID NO: 721731 - RNA, 17 nt, Homo sapiens
gggagcucugcuugccg

SEQ ID NO: 721732 - RNA, 23 nt, Homo sapiens
gggaggaaaaggccccugcaaug

SEQ ID NO: 721733 - RNA, 23 nt, Homo sapiens
gggaggauugcuugaacccaaga

SEQ ID NO: 721734 - RNA, 21 nt, Homo sapiens
gggaggccccagggggucuca

SEQ ID NO: 721735 - RNA, 21 nt, Homo sapiens
gggaggcccugagacagggau

SEQ ID NO: 721736 - RNA, 15 nt, Homo sapiens
gggaggcgaugccag

SEQ ID NO: 721737 - RNA, 20 nt, Homo sapiens
gggaggcggagguugcaaug

SEQ ID NO: 721738 - RNA, 15 nt, Homo sapiens
gggaggcugagccag

SEQ ID NO: 721739 - RNA, 16 nt, Homo sapiens
gggaggcugaggcagc

SEQ ID NO: 721740 - RNA, 20 nt, Homo sapiens
gggagguggagguugcagug

SEQ ID NO: 721741 - RNA, 17 nt, Homo sapiens
gggauaaacugagccug

SEQ ID NO: 721742 - RNA, 16 nt, Homo sapiens
gggauaagggagucca

SEQ ID NO: 721743 - RNA, 23 nt, Homo sapiens
gggauaaguaaguuugauuucau

SEQ ID NO: 721744 - RNA, 16 nt, Homo sapiens
gggauacccagugaug

SEQ ID NO: 721745 - RNA, 16 nt, Homo sapiens
gggauaucuacugugg

SEQ ID NO: 721746 - RNA, 18 nt, Homo sapiens
gggauauggcugcccagg

SEQ ID NO: 721747 - RNA, 19 nt, Homo sapiens
gggaugacuggcuuugaga

SEQ ID NO: 721748 - RNA, 23 nt, Homo sapiens
gggauggggcggcgguagcagcu

SEQ ID NO: 721749 - RNA, 17 nt, Homo sapiens
gggaugugacaugccca

SEQ ID NO: 721750 - RNA, 22 nt, Homo sapiens
gggauguucagcacugucccuu

SEQ ID NO: 721751 - RNA, 22 nt, Homo sapiens
gggauuucucccucucagugga

SEQ ID NO: 721752 - RNA, 23 nt, Homo sapiens
gggauuucuucgcugcucuagcu

SEQ ID NO: 721753 - RNA, 23 nt, Homo sapiens
gggauuuguuacuuuagguuugu

SEQ ID NO: 721754 - RNA, 12 nt, Homo sapiens
gggcaacagagc

SEQ ID NO: 721755 - RNA, 22 nt, Homo sapiens
gggcaccacccgcuuucuugcu

SEQ ID NO: 721756 - RNA, 11 nt, Homo sapiens
gggcaccuuuu

SEQ ID NO: 721757 - RNA, 21 nt, Homo sapiens
gggcacgguggcucaugccug

SEQ ID NO: 721758 - RNA, 20 nt, Homo sapiens
gggcacuacauaauugcugu

SEQ ID NO: 721759 - RNA, 11 nt, Homo sapiens
gggcacuuuuu

SEQ ID NO: 721760 - RNA, 22 nt, Homo sapiens
gggcagagccuuccacagugaa

SEQ ID NO: 721761 - RNA, 14 nt, Homo sapiens
gggcagcacucccc

SEQ ID NO: 721762 - RNA, 19 nt, Homo sapiens
gggcagcgcaugugugcau

SEQ ID NO: 721763 - RNA, 20 nt, Homo sapiens
gggcaggcaggagcagggga

SEQ ID NO: 721764 - RNA, 21 nt, Homo sapiens
gggcaggcugggccaugucca

SEQ ID NO: 721765 - RNA, 16 nt, Homo sapiens
gggcagggacccgggg

SEQ ID NO: 721766 - RNA, 23 nt, Homo sapiens
gggcagggaggcaacacugcugu

SEQ ID NO: 721767 - RNA, 20 nt, Homo sapiens
gggcaggguggggagggagc

SEQ ID NO: 721768 - RNA, 22 nt, Homo sapiens
gggcaucggcaggagagugugu

SEQ ID NO: 721769 - RNA, 13 nt, Homo sapiens
gggcaucucaagc

SEQ ID NO: 721770 - RNA, 21 nt, Homo sapiens
gggccagagccagggggguga

SEQ ID NO: 721771 - RNA, 21 nt, Homo sapiens
gggccagcacuuccaugggaa

SEQ ID NO: 721772 - RNA, 19 nt, Homo sapiens
gggccagcauacuccguga

SEQ ID NO: 721773 - RNA, 17 nt, Homo sapiens
gggccauguccaaagag

SEQ ID NO: 721774 - RNA, 18 nt, Homo sapiens
gggcccacccacaugacu

SEQ ID NO: 721775 - RNA, 19 nt, Homo sapiens
gggcccagccaggagcaga

SEQ ID NO: 721776 - RNA, 15 nt, Homo sapiens
gggcccagcccagag

SEQ ID NO: 721777 - RNA, 22 nt, Homo sapiens
gggccccgccagggcuggggac

SEQ ID NO: 721778 - RNA, 20 nt, Homo sapiens
gggcccgccucacaccccag

SEQ ID NO: 721779 - RNA, 15 nt, Homo sapiens
gggcccuaugucuca

SEQ ID NO: 721780 - RNA, 17 nt, Homo sapiens
gggccgugagggguccc

SEQ ID NO: 721781 - RNA, 19 nt, Homo sapiens
gggccuccagggcccaggu

SEQ ID NO: 721782 - RNA, 19 nt, Homo sapiens
gggccuccuucccaugccu

SEQ ID NO: 721783 - RNA, 22 nt, Homo sapiens
gggccuccuuguccaggucuca

SEQ ID NO: 721784 - RNA, 20 nt, Homo sapiens
gguacuucaggggcacuuca

SEQ ID NO: 721785 - RNA, 19 nt, Homo sapiens
gguagacuuuuaauaucac

SEQ ID NO: 721786 - RNA, 22 nt, Homo sapiens
gguagauuuccuccucccagug

SEQ ID NO: 721787 - RNA, 20 nt, Homo sapiens
gguagggugggagugguuua

SEQ ID NO: 721788 - RNA, 14 nt, Homo sapiens
gguaggucggcacu

SEQ ID NO: 721789 - RNA, 14 nt, Homo sapiens
gguagguugggaga

SEQ ID NO: 721790 - RNA, 20 nt, Homo sapiens
gguaguacuccugcaaaauu

SEQ ID NO: 721791 - RNA, 15 nt, Homo sapiens
gguagucagauuuca

SEQ ID NO: 721792 - RNA, 16 nt, Homo sapiens
gguagugaaacagcuu

SEQ ID NO: 721793 - RNA, 18 nt, Homo sapiens
gguaguuagccaucuaau

SEQ ID NO: 721794 - RNA, 23 nt, Homo sapiens
gguaguuuguuuuagaaccagcc

SEQ ID NO: 721795 - RNA, 11 nt, Homo sapiens
gguaugucuuu

SEQ ID NO: 721796 - RNA, 15 nt, Homo sapiens
ggucaaaggcucaaa

SEQ ID NO: 721797 - RNA, 17 nt, Homo sapiens
ggucaauuaaauugacu

SEQ ID NO: 721798 - RNA, 12 nt, Homo sapiens
ggucacaugaug

SEQ ID NO: 721799 - RNA, 17 nt, Homo sapiens
ggucacauugugccuuu

SEQ ID NO: 721800 - RNA, 14 nt, Homo sapiens
ggucaccagcugcu

SEQ ID NO: 721801 - RNA, 20 nt, Homo sapiens
ggucagaaagauaagccagu

SEQ ID NO: 721802 - RNA, 19 nt, Homo sapiens
ggucaggaugcacauuucu

SEQ ID NO: 721803 - RNA, 20 nt, Homo sapiens
ggucagggccagacuggaag

SEQ ID NO: 721804 - RNA, 19 nt, Homo sapiens
ggucagguguucaagacca

SEQ ID NO: 721805 - RNA, 19 nt, Homo sapiens
ggucaguaaauaacaggca

SEQ ID NO: 721806 - RNA, 12 nt, Homo sapiens
ggucaguccaug

SEQ ID NO: 721807 - RNA, 21 nt, Homo sapiens
ggucagugguggucuucaaga

SEQ ID NO: 721808 - RNA, 13 nt, Homo sapiens
aaugcaaccaagu

SEQ ID NO: 721809 - RNA, 14 nt, Homo sapiens
aaugcaauuuccaa

SEQ ID NO: 721810 - RNA, 13 nt, Homo sapiens
aaugcacaucuca

SEQ ID NO: 721811 - RNA, 14 nt, Homo sapiens
aaugcaccaagaaa

SEQ ID NO: 721812 - RNA, 23 nt, Homo sapiens
aaugcagcaggaaggaacaaaga

SEQ ID NO: 721813 - RNA, 18 nt, Homo sapiens
aaugcagcucaucacuug

SEQ ID NO: 721814 - RNA, 15 nt, Homo sapiens
aaugcaggcuguuuc

SEQ ID NO: 721815 - RNA, 14 nt, Homo sapiens
aaugcaguugucuu

SEQ ID NO: 721816 - RNA, 15 nt, Homo sapiens
aaugcaucacaugau

SEQ ID NO: 721817 - RNA, 15 nt, Homo sapiens
aaugcaucucaucaa

SEQ ID NO: 721818 - RNA, 14 nt, Homo sapiens
aaugcaugcuucuu

SEQ ID NO: 721819 - RNA, 21 nt, Homo sapiens
aaugcauuauaggaucauuug

SEQ ID NO: 721820 - RNA, 16 nt, Homo sapiens
aaugcauucccugaau

SEQ ID NO: 721821 - RNA, 21 nt, Homo sapiens
aaugcauuuaaacucauuuga

SEQ ID NO: 721822 - RNA, 23 nt, Homo sapiens
aaugccaagggggugacuggaag

SEQ ID NO: 721823 - RNA, 14 nt, Homo sapiens
aaugccacugggac

SEQ ID NO: 721824 - RNA, 14 nt, Homo sapiens
aaugccaugaauua

SEQ ID NO: 721825 - RNA, 14 nt, Homo sapiens
aaugcccugugcau

SEQ ID NO: 721826 - RNA, 16 nt, Homo sapiens
aaugcccuucacuguc

SEQ ID NO: 721827 - RNA, 23 nt, Homo sapiens
aaugcccuuccagugggacccca

SEQ ID NO: 721828 - RNA, 23 nt, Homo sapiens
aaugccuaucugaccaaacugga

SEQ ID NO: 721829 - RNA, 19 nt, Homo sapiens
aaugccuccaagccauuca

SEQ ID NO: 721830 - RNA, 19 nt, Homo sapiens
aaugccugucucuagcugu

SEQ ID NO: 721831 - RNA, 12 nt, Homo sapiens
aaugccugugaa

SEQ ID NO: 721832 - RNA, 19 nt, Homo sapiens
aaugccugugaagcaguca

SEQ ID NO: 721833 - RNA, 13 nt, Homo sapiens
aaugcuacugucu

SEQ ID NO: 721834 - RNA, 12 nt, Homo sapiens
aaugcuccccac

SEQ ID NO: 721835 - RNA, 15 nt, Homo sapiens
aaugcucuuuugcac

SEQ ID NO: 721836 - RNA, 17 nt, Homo sapiens
aaugcucuuuugcacaa

SEQ ID NO: 721837 - RNA, 21 nt, Homo sapiens
aaugcugacaaaaauauuuuc

SEQ ID NO: 721838 - RNA, 12 nt, Homo sapiens
aaugcugagaag

SEQ ID NO: 721839 - RNA, 19 nt, Homo sapiens
aaugcugcccgcucugcag

SEQ ID NO: 721840 - RNA, 18 nt, Homo sapiens
aaugcugggacucagccu

SEQ ID NO: 721841 - RNA, 13 nt, Homo sapiens
aaugcuucaauca

SEQ ID NO: 721842 - RNA, 17 nt, Homo sapiens
aaugcuucauuauucaa

SEQ ID NO: 721843 - RNA, 18 nt, Homo sapiens
aaugcuucuaaauaugaa

SEQ ID NO: 721844 - RNA, 17 nt, Homo sapiens
aaugcuucuagaguuuu

SEQ ID NO: 721845 - RNA, 16 nt, Homo sapiens
aauggaaagguccugc

SEQ ID NO: 721846 - RNA, 12 nt, Homo sapiens
aauggaaaguug

SEQ ID NO: 721847 - RNA, 16 nt, Homo sapiens
aauggaacuacuguac

SEQ ID NO: 721848 - RNA, 14 nt, Homo sapiens
aauggaacuaucuc

SEQ ID NO: 721849 - RNA, 13 nt, Homo sapiens
aauggaaguccau

SEQ ID NO: 721850 - RNA, 15 nt, Homo sapiens
aauggaauacugaaa

SEQ ID NO: 721851 - RNA, 20 nt, Homo sapiens
aauggacauugagauacuau

SEQ ID NO: 721852 - RNA, 12 nt, Homo sapiens
aauggaucacaa

SEQ ID NO: 721853 - RNA, 13 nt, Homo sapiens
aauggcaugucag

SEQ ID NO: 721854 - RNA, 21 nt, Homo sapiens
aauggcuacacucaucugacu

SEQ ID NO: 721855 - RNA, 20 nt, Homo sapiens
aaugggagagcucuuguuau

SEQ ID NO: 721856 - RNA, 14 nt, Homo sapiens
aaugggcucuucca

SEQ ID NO: 721857 - RNA, 13 nt, Homo sapiens
aauggggccagau

SEQ ID NO: 721858 - RNA, 15 nt, Homo sapiens
aauggguuacuugau

SEQ ID NO: 721859 - RNA, 14 nt, Homo sapiens
aaugguagcauuua

SEQ ID NO: 721860 - RNA, 14 nt, Homo sapiens
aauggucauccaaa

SEQ ID NO: 721861 - RNA, 17 nt, Homo sapiens
aauggucucuaacauuu

SEQ ID NO: 721862 - RNA, 15 nt, Homo sapiens
aauggugaauggauu

SEQ ID NO: 721863 - RNA, 22 nt, Homo sapiens
aauggugcaaauccuacugaau

SEQ ID NO: 721864 - RNA, 19 nt, Homo sapiens
aaugguggaguguagccuc

SEQ ID NO: 721865 - RNA, 17 nt, Homo sapiens
aaugguguuguaugccu

SEQ ID NO: 721866 - RNA, 22 nt, Homo sapiens
aaugguuguacguuuugcacau

SEQ ID NO: 721867 - RNA, 17 nt, Homo sapiens
aaugguuucaacaaaga

SEQ ID NO: 721868 - RNA, 16 nt, Homo sapiens
aauguaaaacagagcc

SEQ ID NO: 721869 - RNA, 13 nt, Homo sapiens
aauguaacugcug

SEQ ID NO: 721870 - RNA, 23 nt, Homo sapiens
aauguaagaucguucucugccuc

SEQ ID NO: 721871 - RNA, 20 nt, Homo sapiens
aauguaagggaaacugccag

SEQ ID NO: 721872 - RNA, 23 nt, Homo sapiens
aauguaauacuccuaagacuuau

SEQ ID NO: 721873 - RNA, 19 nt, Homo sapiens
aauguaauagccaaaccca

SEQ ID NO: 721874 - RNA, 16 nt, Homo sapiens
aauguacaacugcacc

SEQ ID NO: 721875 - RNA, 13 nt, Homo sapiens
aauguacauguau

SEQ ID NO: 721876 - RNA, 22 nt, Homo sapiens
aauguauaaaaauuaucaaaaa

SEQ ID NO: 721877 - RNA, 21 nt, Homo sapiens
aauguaucugugugugauuug

SEQ ID NO: 721878 - RNA, 13 nt, Homo sapiens
aauguaugugcuc

SEQ ID NO: 721879 - RNA, 15 nt, Homo sapiens
aauguaugugcucuu

SEQ ID NO: 721880 - RNA, 21 nt, Homo sapiens
aauguaugugcucuuagcaaa

SEQ ID NO: 721881 - RNA, 15 nt, Homo sapiens
aauguauuaugagcc

SEQ ID NO: 721882 - RNA, 15 nt, Homo sapiens
aauguauuccuguag

SEQ ID NO: 721883 - RNA, 17 nt, Homo sapiens
aauguauuuguuugcaa

SEQ ID NO: 721884 - RNA, 21 nt, Homo sapiens
aauguauuuguuugcaauuuu

SEQ ID NO: 721885 - RNA, 22 nt, Homo sapiens
aauguauuuuagacuuccugua

SEQ ID NO: 721886 - RNA, 19 nt, Homo sapiens
aaugucaauacuuacuucu

SEQ ID NO: 721887 - RNA, 14 nt, Homo sapiens
aaugucaccaccuu

SEQ ID NO: 721888 - RNA, 14 nt, Homo sapiens
aaugucacuuaaag

SEQ ID NO: 721889 - RNA, 16 nt, Homo sapiens
aaugucagaaaccagu

SEQ ID NO: 721890 - RNA, 20 nt, Homo sapiens
aaugucauaaauuacuguuu

SEQ ID NO: 721891 - RNA, 14 nt, Homo sapiens
aaugucauagguaa

SEQ ID NO: 721892 - RNA, 14 nt, Homo sapiens
aaugucauugcuaa

SEQ ID NO: 721893 - RNA, 15 nt, Homo sapiens
aaugucauugcuaaa

SEQ ID NO: 721894 - RNA, 18 nt, Homo sapiens
aauguccugacaccugcu

SEQ ID NO: 721895 - RNA, 17 nt, Homo sapiens
aauguccuuucauuugu

SEQ ID NO: 721896 - RNA, 15 nt, Homo sapiens
aauguccuuuuauga

SEQ ID NO: 721897 - RNA, 22 nt, Homo sapiens
aaugucgauuaaaaucacucuc

SEQ ID NO: 721898 - RNA, 19 nt, Homo sapiens
aaugucuaucaacuuuaau

SEQ ID NO: 721899 - RNA, 21 nt, Homo sapiens
acaggcuuggagggaagggag

SEQ ID NO: 721900 - RNA, 20 nt, Homo sapiens
acaggcuuguuaccaccaug

SEQ ID NO: 721901 - RNA, 20 nt, Homo sapiens
acagggaaaacugcaaagcu

SEQ ID NO: 721902 - RNA, 20 nt, Homo sapiens
acagggagacugcaucucaa

SEQ ID NO: 721903 - RNA, 14 nt, Homo sapiens
acagggcauucaaa

SEQ ID NO: 721904 - RNA, 19 nt, Homo sapiens
acaggggccccagaucugc

SEQ ID NO: 721905 - RNA, 9 nt, Homo sapiens
acaggguuu

SEQ ID NO: 721906 - RNA, 21 nt, Homo sapiens
acaggguuuuguauucuuuac

SEQ ID NO: 721907 - RNA, 15 nt, Homo sapiens
acagguacagcaaca

SEQ ID NO: 721908 - RNA, 13 nt, Homo sapiens
acagguaugccac

SEQ ID NO: 721909 - RNA, 17 nt, Homo sapiens
acaggucacccaucagg

SEQ ID NO: 721910 - RNA, 20 nt, Homo sapiens
acaggugcaacagacuugaa

SEQ ID NO: 721911 - RNA, 13 nt, Homo sapiens
acaggugccucac

SEQ ID NO: 721912 - RNA, 19 nt, Homo sapiens
acagguggcaacaaugccc

SEQ ID NO: 721913 - RNA, 15 nt, Homo sapiens
acaggugggcuguau

SEQ ID NO: 721914 - RNA, 14 nt, Homo sapiens
acaggugugcagau

SEQ ID NO: 721915 - RNA, 17 nt, Homo sapiens
acaguaacugccaucaa

SEQ ID NO: 721916 - RNA, 15 nt, Homo sapiens
acaguaaugugucau

SEQ ID NO: 721917 - RNA, 14 nt, Homo sapiens
acaguacucacuuu

SEQ ID NO: 721918 - RNA, 21 nt, Homo sapiens
acaguaggucccggccagcuc

SEQ ID NO: 721919 - RNA, 14 nt, Homo sapiens
acaguauccacaau

SEQ ID NO: 721920 - RNA, 16 nt, Homo sapiens
acaguaucccacaucc

SEQ ID NO: 721921 - RNA, 21 nt, Homo sapiens
acaguaugagaagaaaaaugg

SEQ ID NO: 721922 - RNA, 15 nt, Homo sapiens
acaguauuacagugu

SEQ ID NO: 721923 - RNA, 11 nt, Homo sapiens
acagucacuga

SEQ ID NO: 721924 - RNA, 22 nt, Homo sapiens
acagucacugcucuucagccau

SEQ ID NO: 721925 - RNA, 17 nt, Homo sapiens
acagucaucugccacca

SEQ ID NO: 721926 - RNA, 18 nt, Homo sapiens
acaguccacaggggccac

SEQ ID NO: 721927 - RNA, 14 nt, Homo sapiens
acaguccccagagu

SEQ ID NO: 721928 - RNA, 19 nt, Homo sapiens
gucuccagaguuguucucu

SEQ ID NO: 721929 - RNA, 14 nt, Homo sapiens
gucuccagcccacg

SEQ ID NO: 721930 - RNA, 18 nt, Homo sapiens
gucuccagucaucuguaa

SEQ ID NO: 721931 - RNA, 17 nt, Homo sapiens
gucuccaugcucaccaa

SEQ ID NO: 721932 - RNA, 22 nt, Homo sapiens
gucucccugcacagccucuagu

SEQ ID NO: 721933 - RNA, 22 nt, Homo sapiens
gucuccugucuucagagcaaaa

SEQ ID NO: 721934 - RNA, 23 nt, Homo sapiens
gucuccuuugcacugagggccac

SEQ ID NO: 721935 - RNA, 19 nt, Homo sapiens
gucuccuuugcaggcucau

SEQ ID NO: 721936 - RNA, 19 nt, Homo sapiens
gucuccuuugcucuugcca

SEQ ID NO: 721937 - RNA, 18 nt, Homo sapiens
gucucgcuauacugcacu

SEQ ID NO: 721938 - RNA, 17 nt, Homo sapiens
gucucgcuuuguugccc

SEQ ID NO: 721939 - RNA, 17 nt, Homo sapiens
gucucuaccuaaggaca

SEQ ID NO: 721940 - RNA, 21 nt, Homo sapiens
gucucuauaccaaccaaacca

SEQ ID NO: 721941 - RNA, 14 nt, Homo sapiens
gucucuauaccaau

SEQ ID NO: 721942 - RNA, 16 nt, Homo sapiens
gucucuaucuccugaa

SEQ ID NO: 721943 - RNA, 17 nt, Homo sapiens
gucucugauuugcaaau

SEQ ID NO: 721944 - RNA, 21 nt, Homo sapiens
gucugaaggacacuuccugcc

SEQ ID NO: 721945 - RNA, 16 nt, Homo sapiens
gucugagaauuuccaa

SEQ ID NO: 721946 - RNA, 18 nt, Homo sapiens
gucugagaauuuccaaaa

SEQ ID NO: 721947 - RNA, 14 nt, Homo sapiens
gucugagacugaaa

SEQ ID NO: 721948 - RNA, 19 nt, Homo sapiens
gucugagauauauuugcua

SEQ ID NO: 721949 - RNA, 20 nt, Homo sapiens
gucugccacuugucaaagaa

SEQ ID NO: 721950 - RNA, 18 nt, Homo sapiens
gucugccuggaggccagg

SEQ ID NO: 721951 - RNA, 16 nt, Homo sapiens
gucugcuagccaggau

SEQ ID NO: 721952 - RNA, 14 nt, Homo sapiens
gucugcuucagugc

SEQ ID NO: 721953 - RNA, 23 nt, Homo sapiens
gucuggaaaacagaaaccauucu

SEQ ID NO: 721954 - RNA, 23 nt, Homo sapiens
gucuggagccccauccuguguua

SEQ ID NO: 721955 - RNA, 16 nt, Homo sapiens
gucugggagucacaca

SEQ ID NO: 721956 - RNA, 21 nt, Homo sapiens
gucugucaugaacauguuccu

SEQ ID NO: 721957 - RNA, 15 nt, Homo sapiens
gucugucuacugugg

SEQ ID NO: 721958 - RNA, 16 nt, Homo sapiens
gucugugaagucaaga

SEQ ID NO: 721959 - RNA, 15 nt, Homo sapiens
gucugugugguggag

SEQ ID NO: 721960 - RNA, 14 nt, Homo sapiens
gucuguugcuugua

SEQ ID NO: 721961 - RNA, 20 nt, Homo sapiens
gucuguuuauuaacuacuga

SEQ ID NO: 721962 - RNA, 21 nt, Homo sapiens
gucuguuucaaugaccuguau

SEQ ID NO: 721963 - RNA, 16 nt, Homo sapiens
gucuguuuugccuuca

SEQ ID NO: 721964 - RNA, 21 nt, Homo sapiens
gucuuaaacuaaaugugcaau

SEQ ID NO: 721965 - RNA, 22 nt, Homo sapiens
gucuuaaaugagaaguacuugg

SEQ ID NO: 721966 - RNA, 21 nt, Homo sapiens
gucuuaaucguccugcugcug

SEQ ID NO: 721967 - RNA, 15 nt, Homo sapiens
gucuuagauguauau

SEQ ID NO: 721968 - RNA, 15 nt, Homo sapiens
gucuuaucauuugaa

SEQ ID NO: 721969 - RNA, 13 nt, Homo sapiens
gucuucagcaccc

SEQ ID NO: 721970 - RNA, 21 nt, Homo sapiens
gucuucagugucuuaaugugg

SEQ ID NO: 721971 - RNA, 15 nt, Homo sapiens
gucuucaguuucauu

SEQ ID NO: 721972 - RNA, 22 nt, Homo sapiens
gucuuccugaguggugccaaac

SEQ ID NO: 721973 - RNA, 13 nt, Homo sapiens
gucuuccugugua

SEQ ID NO: 721974 - RNA, 16 nt, Homo sapiens
gucuucucucuggcuc

SEQ ID NO: 721975 - RNA, 20 nt, Homo sapiens
gucuucuguaauucauugag

SEQ ID NO: 721976 - RNA, 17 nt, Homo sapiens
gucuugauucagucaca

SEQ ID NO: 721977 - RNA, 18 nt, Homo sapiens
gucuugauucagucacau

SEQ ID NO: 721978 - RNA, 11 nt, Homo sapiens
gucuugccagg

SEQ ID NO: 721979 - RNA, 16 nt, Homo sapiens
gucuugccaugugcug

SEQ ID NO: 721980 - RNA, 17 nt, Homo sapiens
gucuugggggucagggg

SEQ ID NO: 721981 - RNA, 18 nt, Homo sapiens
gucuuggguuccuguaug

SEQ ID NO: 721982 - RNA, 14 nt, Homo sapiens
gucuuguacuucug

SEQ ID NO: 721983 - RNA, 18 nt, Homo sapiens
gucuuguagaaaucucag

SEQ ID NO: 721984 - RNA, 15 nt, Homo sapiens
gucuugugaaggcag

SEQ ID NO: 721985 - RNA, 15 nt, Homo sapiens
gucuuuacuuccauc

SEQ ID NO: 721986 - RNA, 21 nt, Homo sapiens
gucuuucccauuucuaccuaa

SEQ ID NO: 721987 - RNA, 22 nt, Homo sapiens
gucuuucggggugcuccugugg

SEQ ID NO: 721988 - RNA, 17 nt, Homo sapiens
gucuuuguucugugauu

SEQ ID NO: 721989 - RNA, 18 nt, Homo sapiens
gucuuuuuuauguuaaaa

SEQ ID NO: 721990 - RNA, 18 nt, Homo sapiens
gugaaaaaggaaugauau

SEQ ID NO: 721991 - RNA, 21 nt, Homo sapiens
gugaaaaaguuaaacauugaa

SEQ ID NO: 721992 - RNA, 16 nt, Homo sapiens
gugaaacagagugauu

SEQ ID NO: 721993 - RNA, 13 nt, Homo sapiens
gugaaacauacaa

SEQ ID NO: 721994 - RNA, 21 nt, Homo sapiens
gugaaaccccaucucuacuaa

SEQ ID NO: 721995 - RNA, 22 nt, Homo sapiens
gugaaacccccaucucuacuaa

SEQ ID NO: 721996 - RNA, 21 nt, Homo sapiens
gugaaaccccgucucuacuaa

SEQ ID NO: 721997 - RNA, 21 nt, Homo sapiens
gugaaaccucaucucuacuaa

SEQ ID NO: 721998 - RNA, 15 nt, Homo sapiens
gugaaauaauuccuc

SEQ ID NO: 721999 - RNA, 20 nt, Homo sapiens
gugaaaugcuggcauuugca

SEQ ID NO: 722000 - RNA, 18 nt, Homo sapiens
gugaaauggccacuacuu

SEQ ID NO: 722001 - RNA, 19 nt, Homo sapiens
gugaaauggccacuacuuu

SEQ ID NO: 722002 - RNA, 19 nt, Homo sapiens
gugaacauucccagcccag

SEQ ID NO: 722003 - RNA, 16 nt, Homo sapiens
gugaacggacacugaa

SEQ ID NO: 722004 - RNA, 22 nt, Homo sapiens
gugaacucaaucuccagggcuc

SEQ ID NO: 722005 - RNA, 13 nt, Homo sapiens
gugaacugagcug

SEQ ID NO: 722006 - RNA, 21 nt, Homo sapiens
gugaagaacacuacugcuaaa

SEQ ID NO: 722007 - RNA, 19 nt, Homo sapiens
gugaagaggaaaaugccuc

SEQ ID NO: 722008 - RNA, 22 nt, Homo sapiens
gugaagaggcugcuucucuaca

SEQ ID NO: 722009 - RNA, 19 nt, Homo sapiens
gugaagaguuucacaaauc

SEQ ID NO: 722010 - RNA, 18 nt, Homo sapiens
gugaagcagucagcccuu

SEQ ID NO: 722011 - RNA, 12 nt, Homo sapiens
gugaagcauuua

SEQ ID NO: 722012 - RNA, 18 nt, Homo sapiens
gugaagggagagccagcu

SEQ ID NO: 722013 - RNA, 19 nt, Homo sapiens
gugcugacgagcagggugg

SEQ ID NO: 722014 - RNA, 19 nt, Homo sapiens
gugcugccuugcuucugua

SEQ ID NO: 722015 - RNA, 12 nt, Homo sapiens
gugcugcucucu

SEQ ID NO: 722016 - RNA, 17 nt, Homo sapiens
gugcugcucucuccgag

SEQ ID NO: 722017 - RNA, 19 nt, Homo sapiens
gugcuggagcaaaagucau

SEQ ID NO: 722018 - RNA, 11 nt, Homo sapiens
gugcugggaug

SEQ ID NO: 722019 - RNA, 19 nt, Homo sapiens
gugcugggauuaacaggua

SEQ ID NO: 722020 - RNA, 15 nt, Homo sapiens
gugcuggggcacggc

SEQ ID NO: 722021 - RNA, 17 nt, Homo sapiens
gugcuguggccugggca

SEQ ID NO: 722022 - RNA, 18 nt, Homo sapiens
gugcuuaaaaaucauuga

SEQ ID NO: 722023 - RNA, 13 nt, Homo sapiens
gugcuuaaccaaa

SEQ ID NO: 722024 - RNA, 18 nt, Homo sapiens
gugcuuccaacaaggaca

SEQ ID NO: 722025 - RNA, 18 nt, Homo sapiens
gugcuucuccagccucag

SEQ ID NO: 722026 - RNA, 15 nt, Homo sapiens
gugcuugagccagga

SEQ ID NO: 722027 - RNA, 17 nt, Homo sapiens
gugcuugcuggccacaa

SEQ ID NO: 722028 - RNA, 16 nt, Homo sapiens
gugcuugcuggugccu

SEQ ID NO: 722029 - RNA, 14 nt, Homo sapiens
gugcuuguuuacag

SEQ ID NO: 722030 - RNA, 21 nt, Homo sapiens
gugcuuuccguggcacugcau

SEQ ID NO: 722031 - RNA, 14 nt, Homo sapiens
guggaacauugggg

SEQ ID NO: 722032 - RNA, 23 nt, Homo sapiens
guggaauauaaggaaagcaauaa

SEQ ID NO: 722033 - RNA, 22 nt, Homo sapiens
guggaaucucuuggaugcagcu

SEQ ID NO: 722034 - RNA, 16 nt, Homo sapiens
guggaaugcagggaag

SEQ ID NO: 722035 - RNA, 18 nt, Homo sapiens
guggaaugccgcugucuc

SEQ ID NO: 722036 - RNA, 14 nt, Homo sapiens
guggacacaacagc

SEQ ID NO: 722037 - RNA, 12 nt, Homo sapiens
guggacugugau

SEQ ID NO: 722038 - RNA, 14 nt, Homo sapiens
guggagacaguccu

SEQ ID NO: 722039 - RNA, 22 nt, Homo sapiens
guggagauuuacacuacauugu

SEQ ID NO: 722040 - RNA, 19 nt, Homo sapiens
guggagggugaccacaccu

SEQ ID NO: 722041 - RNA, 20 nt, Homo sapiens
guggauaugacccacacugc

SEQ ID NO: 722042 - RNA, 12 nt, Homo sapiens
guggaugacccu

SEQ ID NO: 722043 - RNA, 21 nt, Homo sapiens
guggauguauggggaaucuaa

SEQ ID NO: 722044 - RNA, 19 nt, Homo sapiens
acaugucuuguacaugugu

SEQ ID NO: 722045 - RNA, 15 nt, Homo sapiens
acaugugacacauau

SEQ ID NO: 722046 - RNA, 17 nt, Homo sapiens
acaugugacacauaugc

SEQ ID NO: 722047 - RNA, 15 nt, Homo sapiens
acaugugacuggcag

SEQ ID NO: 722048 - RNA, 12 nt, Homo sapiens
acauguguaaac

SEQ ID NO: 722049 - RNA, 20 nt, Homo sapiens
acauguguagccugugcaug

SEQ ID NO: 722050 - RNA, 22 nt, Homo sapiens
acauguguagccugugcaugua

SEQ ID NO: 722051 - RNA, 10 nt, Homo sapiens
acauguuaau

SEQ ID NO: 722052 - RNA, 13 nt, Homo sapiens
acauguuccccau

SEQ ID NO: 722053 - RNA, 11 nt, Homo sapiens
acauguuccug

SEQ ID NO: 722054 - RNA, 20 nt, Homo sapiens
acauguuuaaauagccuaaa

SEQ ID NO: 722055 - RNA, 23 nt, Homo sapiens
acauuaaacacaaagcuguugaa

SEQ ID NO: 722056 - RNA, 22 nt, Homo sapiens
acauuaacucccuccaccagcc

SEQ ID NO: 722057 - RNA, 20 nt, Homo sapiens
acauuagucguuauauuuga

SEQ ID NO: 722058 - RNA, 19 nt, Homo sapiens
acauuauuucuaguccaaa

SEQ ID NO: 722059 - RNA, 14 nt, Homo sapiens
acauucacacaggg

SEQ ID NO: 722060 - RNA, 19 nt, Homo sapiens
acauucacacagggcucuu

SEQ ID NO: 722061 - RNA, 14 nt, Homo sapiens
acauucaguuccca

SEQ ID NO: 722062 - RNA, 13 nt, Homo sapiens
acauuccaggaaa

SEQ ID NO: 722063 - RNA, 17 nt, Homo sapiens
acauuccaggaaaccau

SEQ ID NO: 722064 - RNA, 23 nt, Homo sapiens
acauucccuuggauguagucuga

SEQ ID NO: 722065 - RNA, 15 nt, Homo sapiens
acauuccugcauuca

SEQ ID NO: 722066 - RNA, 21 nt, Homo sapiens
acauucuagcugagaagcaau

SEQ ID NO: 722067 - RNA, 18 nt, Homo sapiens
acauucucuucccaguga

SEQ ID NO: 722068 - RNA, 20 nt, Homo sapiens
acauucugcaagcacaucug

SEQ ID NO: 722069 - RNA, 23 nt, Homo sapiens
acauucugcaagcacaucugcau

SEQ ID NO: 722070 - RNA, 19 nt, Homo sapiens
acauucuggaaaagcaaaa

SEQ ID NO: 722071 - RNA, 15 nt, Homo sapiens
acauucuuauugaca

SEQ ID NO: 722072 - RNA, 22 nt, Homo sapiens
acauucuuccaucaucacugua

SEQ ID NO: 722073 - RNA, 23 nt, Homo sapiens
acauucuuguuuuaagugccuuu

SEQ ID NO: 722074 - RNA, 11 nt, Homo sapiens
acauugaacaa

SEQ ID NO: 722075 - RNA, 22 nt, Homo sapiens
acauugagcgugaccuugcaau

SEQ ID NO: 722076 - RNA, 19 nt, Homo sapiens
acauugcagcuucaacuuu

SEQ ID NO: 722077 - RNA, 17 nt, Homo sapiens
acauuggcaccuaaucc

SEQ ID NO: 722078 - RNA, 21 nt, Homo sapiens
acauuguacaaggaaugaaag

SEQ ID NO: 722079 - RNA, 15 nt, Homo sapiens
acauuguacuguugc

SEQ ID NO: 722080 - RNA, 15 nt, Homo sapiens
acauugucaccauuu

SEQ ID NO: 722081 - RNA, 15 nt, Homo sapiens
acauugugacugugu

SEQ ID NO: 722082 - RNA, 23 nt, Homo sapiens
acauugugucagauuaccaguua

SEQ ID NO: 722083 - RNA, 17 nt, Homo sapiens
acauuuaaaauugcuau

SEQ ID NO: 722084 - RNA, 17 nt, Homo sapiens
acauuuaauaaaacugc

SEQ ID NO: 722085 - RNA, 17 nt, Homo sapiens
acauuuaauacagauaa

SEQ ID NO: 722086 - RNA, 22 nt, Homo sapiens
acauuuaauacagcagugucau

SEQ ID NO: 722087 - RNA, 14 nt, Homo sapiens
acauuuagaacuuu

SEQ ID NO: 722088 - RNA, 13 nt, Homo sapiens
acauuuaucacug

SEQ ID NO: 722089 - RNA, 14 nt, Homo sapiens
acauuuaugaccua

SEQ ID NO: 722090 - RNA, 21 nt, Homo sapiens
acauuucucuaacuccugcca

SEQ ID NO: 722091 - RNA, 23 nt, Homo sapiens
acauuucucuaacuccugccauu

SEQ ID NO: 722092 - RNA, 15 nt, Homo sapiens
acauuugcuacuguu

SEQ ID NO: 722093 - RNA, 14 nt, Homo sapiens
acauuuggccacaa

SEQ ID NO: 722094 - RNA, 21 nt, Homo sapiens
acauuuggugagagaaguaca

SEQ ID NO: 722095 - RNA, 12 nt, Homo sapiens
acauuugugcuc

SEQ ID NO: 722096 - RNA, 13 nt, Homo sapiens
acauuugugcucc

SEQ ID NO: 722097 - RNA, 14 nt, Homo sapiens
acauuuguuccaug

SEQ ID NO: 722098 - RNA, 23 nt, Homo sapiens
acauuuguuccuggaguuuugau

SEQ ID NO: 722099 - RNA, 21 nt, Homo sapiens
acauuuguuucccccacaguu

SEQ ID NO: 722100 - RNA, 14 nt, Homo sapiens
acauuuucuuucau

SEQ ID NO: 722101 - RNA, 15 nt, Homo sapiens
acauuuugacacaaa

SEQ ID NO: 722102 - RNA, 16 nt, Homo sapiens
acauuuugacacaaaa

SEQ ID NO: 722103 - RNA, 12 nt, Homo sapiens
acauuuugugac

SEQ ID NO: 722104 - RNA, 13 nt, Homo sapiens
accaaaaccacag

SEQ ID NO: 722105 - RNA, 16 nt, Homo sapiens
accaaaaccacagugc

SEQ ID NO: 722106 - RNA, 19 nt, Homo sapiens
accaaaaugacaaugauga

SEQ ID NO: 722107 - RNA, 21 nt, Homo sapiens
accaaaaugacaaugaugaug

SEQ ID NO: 722108 - RNA, 13 nt, Homo sapiens
accaaacacucag

SEQ ID NO: 722109 - RNA, 16 nt, Homo sapiens
accaaacacucagucc

SEQ ID NO: 722110 - RNA, 20 nt, Homo sapiens
accaaaccgcaaacgugaaa

SEQ ID NO: 722111 - RNA, 14 nt, Homo sapiens
accaaagacaucag

SEQ ID NO: 722112 - RNA, 16 nt, Homo sapiens
accaaagacugcagaa

SEQ ID NO: 722113 - RNA, 22 nt, Homo sapiens
accaaagccaccagacugacaa

SEQ ID NO: 722114 - RNA, 13 nt, Homo sapiens
accaaagcugccc

SEQ ID NO: 722115 - RNA, 16 nt, Homo sapiens
accaaagcugcccacu

SEQ ID NO: 722116 - RNA, 18 nt, Homo sapiens
accaaaggauagugcgau

SEQ ID NO: 722117 - RNA, 13 nt, Homo sapiens
accaaaguaacug

SEQ ID NO: 722118 - RNA, 16 nt, Homo sapiens
accaaagucacaucca

SEQ ID NO: 722119 - RNA, 15 nt, Homo sapiens
accaaagugauaaau

SEQ ID NO: 722120 - RNA, 16 nt, Homo sapiens
accaaauaaaguacca

SEQ ID NO: 722121 - RNA, 17 nt, Homo sapiens
accaaauaaaguaccau

SEQ ID NO: 722122 - RNA, 18 nt, Homo sapiens
accaaauaaaguaccauu

SEQ ID NO: 722123 - RNA, 19 nt, Homo sapiens
accaaaucuggaagccaaa

SEQ ID NO: 722124 - RNA, 19 nt, Homo sapiens
accaaaugcuuuuccucaa

SEQ ID NO: 722125 - RNA, 16 nt, Homo sapiens
accaaauugcuuuaca

SEQ ID NO: 722126 - RNA, 13 nt, Homo sapiens
accaaauuuguau

SEQ ID NO: 722127 - RNA, 14 nt, Homo sapiens
accaacacugaccc

SEQ ID NO: 722128 - RNA, 15 nt, Homo sapiens
acccaccaccaugcc

SEQ ID NO: 722129 - RNA, 14 nt, Homo sapiens
acccaccccaacuc

SEQ ID NO: 722130 - RNA, 16 nt, Homo sapiens
acccaccccugcacag

SEQ ID NO: 722131 - RNA, 22 nt, Homo sapiens
acccacccuguggcucacagug

SEQ ID NO: 722132 - RNA, 21 nt, Homo sapiens
acccacuucuaaauagcaauu

SEQ ID NO: 722133 - RNA, 15 nt, Homo sapiens
acccagaaaucauuu

SEQ ID NO: 722134 - RNA, 14 nt, Homo sapiens
acccagaaucucau

SEQ ID NO: 722135 - RNA, 23 nt, Homo sapiens
acccagaauguagcaucugagaa

SEQ ID NO: 722136 - RNA, 16 nt, Homo sapiens
acccagacugucucca

SEQ ID NO: 722137 - RNA, 17 nt, Homo sapiens
acccagaggcagcagag

SEQ ID NO: 722138 - RNA, 14 nt, Homo sapiens
acccagcacccaca

SEQ ID NO: 722139 - RNA, 14 nt, Homo sapiens
acccagcaguccuc

SEQ ID NO: 722140 - RNA, 16 nt, Homo sapiens
acccaggaccaagcca

SEQ ID NO: 722141 - RNA, 18 nt, Homo sapiens
acccaggcuuuagcauua

SEQ ID NO: 722142 - RNA, 18 nt, Homo sapiens
acccagggaaggugcuga

SEQ ID NO: 722143 - RNA, 20 nt, Homo sapiens
acccagggcucugcagcacc

SEQ ID NO: 722144 - RNA, 21 nt, Homo sapiens
acccaggggacagcuggugca

SEQ ID NO: 722145 - RNA, 18 nt, Homo sapiens
acccagguggagggcaca

SEQ ID NO: 722146 - RNA, 12 nt, Homo sapiens
acccagugcaga

SEQ ID NO: 722147 - RNA, 20 nt, Homo sapiens
acccagugcugccaugccac

SEQ ID NO: 722148 - RNA, 17 nt, Homo sapiens
acccaguggacucuucc

SEQ ID NO: 722149 - RNA, 14 nt, Homo sapiens
acccaguucaguga

SEQ ID NO: 722150 - RNA, 15 nt, Homo sapiens
acccaguucagugag

SEQ ID NO: 722151 - RNA, 13 nt, Homo sapiens
acccauauguccu

SEQ ID NO: 722152 - RNA, 14 nt, Homo sapiens
acccauauuacaga

SEQ ID NO: 722153 - RNA, 19 nt, Homo sapiens
acccaucaaaagcaccagc

SEQ ID NO: 722154 - RNA, 13 nt, Homo sapiens
acccauuagccau

SEQ ID NO: 722155 - RNA, 20 nt, Homo sapiens
acccauucguggugaucaau

SEQ ID NO: 722156 - RNA, 16 nt, Homo sapiens
accccaaaacucugua

SEQ ID NO: 722157 - RNA, 18 nt, Homo sapiens
accccaaacuguugauua

SEQ ID NO: 722158 - RNA, 21 nt, Homo sapiens
accccaaaggaacacugacau

SEQ ID NO: 722159 - RNA, 23 nt, Homo sapiens
accccaaaggaacacugacauca

SEQ ID NO: 722160 - RNA, 16 nt, Homo sapiens
guguuacuguugcacu

SEQ ID NO: 722161 - RNA, 13 nt, Homo sapiens
guguuacuugcca

SEQ ID NO: 722162 - RNA, 19 nt, Homo sapiens
guguuauuauuuugcacug

SEQ ID NO: 722163 - RNA, 20 nt, Homo sapiens
guguucacaaaggcagagag

SEQ ID NO: 722164 - RNA, 18 nt, Homo sapiens
guguucacaacagugaaa

SEQ ID NO: 722165 - RNA, 15 nt, Homo sapiens
guguucauacauuug

SEQ ID NO: 722166 - RNA, 14 nt, Homo sapiens
guguucaugaucuc

SEQ ID NO: 722167 - RNA, 15 nt, Homo sapiens
guguucaugaucucc

SEQ ID NO: 722168 - RNA, 15 nt, Homo sapiens
guguucuagaccucu

SEQ ID NO: 722169 - RNA, 15 nt, Homo sapiens
guguucucagugaaa

SEQ ID NO: 722170 - RNA, 23 nt, Homo sapiens
guguucuucauuaccucagugag

SEQ ID NO: 722171 - RNA, 12 nt, Homo sapiens
guguugauccca

SEQ ID NO: 722172 - RNA, 22 nt, Homo sapiens
guguuguaucaaagugugauau

SEQ ID NO: 722173 - RNA, 18 nt, Homo sapiens
guguuuaaauaaacacag

SEQ ID NO: 722174 - RNA, 17 nt, Homo sapiens
guguuucugucucucca

SEQ ID NO: 722175 - RNA, 21 nt, Homo sapiens
guguuuggaaauaaacugugc

SEQ ID NO: 722176 - RNA, 12 nt, Homo sapiens
guguuugggaug

SEQ ID NO: 722177 - RNA, 19 nt, Homo sapiens
guguuugggaugaccagga

SEQ ID NO: 722178 - RNA, 16 nt, Homo sapiens
guguuuucaccauuca

SEQ ID NO: 722179 - RNA, 20 nt, Homo sapiens
guguuuucccaaagcacuuu

SEQ ID NO: 722180 - RNA, 13 nt, Homo sapiens
guguuuuccugaa

SEQ ID NO: 722181 - RNA, 16 nt, Homo sapiens
guguuuuguacacuua

SEQ ID NO: 722182 - RNA, 23 nt, Homo sapiens
guguuuuguaggagacuugccag

SEQ ID NO: 722183 - RNA, 17 nt, Homo sapiens
guguuuuuaacauguca

SEQ ID NO: 722184 - RNA, 23 nt, Homo sapiens
guuaaacacgugucuauaaugga

SEQ ID NO: 722185 - RNA, 17 nt, Homo sapiens
guuaaacauugaaguaa

SEQ ID NO: 722186 - RNA, 19 nt, Homo sapiens
guuaaacccacagccaaac

SEQ ID NO: 722187 - RNA, 19 nt, Homo sapiens
guuaaauccuuugcuucau

SEQ ID NO: 722188 - RNA, 17 nt, Homo sapiens
guuaacacucaugaagc

SEQ ID NO: 722189 - RNA, 18 nt, Homo sapiens
guuaaccccauguccuca

SEQ ID NO: 722190 - RNA, 16 nt, Homo sapiens
guuaaccucaguguca

SEQ ID NO: 722191 - RNA, 18 nt, Homo sapiens
guuaacgucaucucaggg

SEQ ID NO: 722192 - RNA, 14 nt, Homo sapiens
guuaacugagcuac

SEQ ID NO: 722193 - RNA, 13 nt, Homo sapiens
guuaacuguguau

SEQ ID NO: 722194 - RNA, 20 nt, Homo sapiens
guuaacuuuucuaacagaaa

SEQ ID NO: 722195 - RNA, 16 nt, Homo sapiens
guuaagaaagcacuua

SEQ ID NO: 722196 - RNA, 13 nt, Homo sapiens
guuaagagcucag

SEQ ID NO: 722197 - RNA, 21 nt, Homo sapiens
guuaagcagauggaaugcugu

SEQ ID NO: 722198 - RNA, 18 nt, Homo sapiens
guuaaggguuaguuuaca

SEQ ID NO: 722199 - RNA, 12 nt, Homo sapiens
guuaagugcagg

SEQ ID NO: 722200 - RNA, 17 nt, Homo sapiens
guuaauaaaccuuugca

SEQ ID NO: 722201 - RNA, 20 nt, Homo sapiens
guuaauaaaccuuugcaaac

SEQ ID NO: 722202 - RNA, 24 nt, Homo sapiens
guuaauauuuauuaagugacuaua

SEQ ID NO: 722203 - RNA, 15 nt, Homo sapiens
guuaauccacaucuu

SEQ ID NO: 722204 - RNA, 14 nt, Homo sapiens
guuaauguacaaaa

SEQ ID NO: 722205 - RNA, 20 nt, Homo sapiens
guuaauguuuauuguucaau

SEQ ID NO: 722206 - RNA, 19 nt, Homo sapiens
guuaauuguaauugcauga

SEQ ID NO: 722207 - RNA, 19 nt, Homo sapiens
guuaauuuugaagugcugu

SEQ ID NO: 722208 - RNA, 20 nt, Homo sapiens
guuaauuuuuccaacuacua

SEQ ID NO: 722209 - RNA, 22 nt, Homo sapiens
guuaauuuuuccuauauugcau

SEQ ID NO: 722210 - RNA, 16 nt, Homo sapiens
guuacaaguguucuua

SEQ ID NO: 722211 - RNA, 18 nt, Homo sapiens
guuacacccuuucuugac

SEQ ID NO: 722212 - RNA, 17 nt, Homo sapiens
guuacaggaagucccuu

SEQ ID NO: 722213 - RNA, 12 nt, Homo sapiens
guuacaguacug

SEQ ID NO: 722214 - RNA, 19 nt, Homo sapiens
guuacaguacuguucccaa

SEQ ID NO: 722215 - RNA, 22 nt, Homo sapiens
guuacaguuugagacuuccaaa

SEQ ID NO: 722216 - RNA, 15 nt, Homo sapiens
guuaccaacuaccua

SEQ ID NO: 722217 - RNA, 17 nt, Homo sapiens
guuaccacauuacucug

SEQ ID NO: 722218 - RNA, 15 nt, Homo sapiens
guuaccaccaugcuc

SEQ ID NO: 722219 - RNA, 14 nt, Homo sapiens
guuacccacugcca

SEQ ID NO: 722220 - RNA, 22 nt, Homo sapiens
guuaccucugaguuguguucca

SEQ ID NO: 722221 - RNA, 20 nt, Homo sapiens
guuaccugucauuuugcacu

SEQ ID NO: 722222 - RNA, 23 nt, Homo sapiens
guuacgaguuuucccucagugaa

SEQ ID NO: 722223 - RNA, 18 nt, Homo sapiens
guuacuauucuguaucau

SEQ ID NO: 722224 - RNA, 22 nt, Homo sapiens
guuacuauuuucuacaauuaau

SEQ ID NO: 722225 - RNA, 20 nt, Homo sapiens
guuacucugucccacgucca

SEQ ID NO: 722226 - RNA, 15 nt, Homo sapiens
guuacugaaggugau

SEQ ID NO: 722227 - RNA, 18 nt, Homo sapiens
guuacugaauauuaaaaa

SEQ ID NO: 722228 - RNA, 15 nt, Homo sapiens
guuacugaccagcaa

SEQ ID NO: 722229 - RNA, 17 nt, Homo sapiens
guuacugcuuugcaaag

SEQ ID NO: 722230 - RNA, 19 nt, Homo sapiens
guuacuguggccaguauuu

SEQ ID NO: 722231 - RNA, 15 nt, Homo sapiens
guuacuguugcacug

SEQ ID NO: 722232 - RNA, 13 nt, Homo sapiens
guuacuuccuuau

SEQ ID NO: 722233 - RNA, 16 nt, Homo sapiens
guuagaacuagccaaa

SEQ ID NO: 722234 - RNA, 15 nt, Homo sapiens
guuagcucauuugag

SEQ ID NO: 722235 - RNA, 23 nt, Homo sapiens
guuagguccaccugcuaaucaca

SEQ ID NO: 722236 - RNA, 15 nt, Homo sapiens
guuaguaaugcucug

SEQ ID NO: 722237 - RNA, 18 nt, Homo sapiens
guuagucaauccugucau

SEQ ID NO: 722238 - RNA, 21 nt, Homo sapiens
guuagucaauccugucauaua

SEQ ID NO: 722239 - RNA, 19 nt, Homo sapiens
guuauaaaucaaugucacu

SEQ ID NO: 722240 - RNA, 22 nt, Homo sapiens
guuauaaaucaaugucacuuaa

SEQ ID NO: 722241 - RNA, 21 nt, Homo sapiens
guuauaacucugcacuacucc

SEQ ID NO: 722242 - RNA, 14 nt, Homo sapiens
guuauacacagcuu

SEQ ID NO: 722243 - RNA, 15 nt, Homo sapiens
ucuuggaugcagcuu

SEQ ID NO: 722244 - RNA, 17 nt, Homo sapiens
ucuuggcuuaaucauuu

SEQ ID NO: 722245 - RNA, 19 nt, Homo sapiens
ucuuggggacuaacccaau

SEQ ID NO: 722246 - RNA, 23 nt, Homo sapiens
ucuuggggacuaacccaaugccu

SEQ ID NO: 722247 - RNA, 21 nt, Homo sapiens
ucuugggguuuucaguaugaa

SEQ ID NO: 722248 - RNA, 13 nt, Homo sapiens
ucuugggucuugg

SEQ ID NO: 722249 - RNA, 16 nt, Homo sapiens
ucuugguauuacccuc

SEQ ID NO: 722250 - RNA, 15 nt, Homo sapiens
ucuuggucacauaca

SEQ ID NO: 722251 - RNA, 15 nt, Homo sapiens
ucuuguaauugugga

SEQ ID NO: 722252 - RNA, 24 nt, Homo sapiens
ucuuguagguuccaucaaugguga

SEQ ID NO: 722253 - RNA, 14 nt, Homo sapiens
ucuuguauacacau

SEQ ID NO: 722254 - RNA, 18 nt, Homo sapiens
ucuuguauacacauauau

SEQ ID NO: 722255 - RNA, 17 nt, Homo sapiens
ucuugucauugccagcu

SEQ ID NO: 722256 - RNA, 17 nt, Homo sapiens
ucuugucccuuucccua

SEQ ID NO: 722257 - RNA, 15 nt, Homo sapiens
ucuugugaguggaua

SEQ ID NO: 722258 - RNA, 20 nt, Homo sapiens
ucuugugguaacuugcugcu

SEQ ID NO: 722259 - RNA, 16 nt, Homo sapiens
ucuuguugagugccag

SEQ ID NO: 722260 - RNA, 14 nt, Homo sapiens
ucuuguugcucaaa

SEQ ID NO: 722261 - RNA, 18 nt, Homo sapiens
ucuuuaaaggcaucuaca

SEQ ID NO: 722262 - RNA, 20 nt, Homo sapiens
ucuuuaaaggcaucuacaca

SEQ ID NO: 722263 - RNA, 15 nt, Homo sapiens
ucuuuaacaaccucu

SEQ ID NO: 722264 - RNA, 15 nt, Homo sapiens
ucuuuaaucagcuua

SEQ ID NO: 722265 - RNA, 23 nt, Homo sapiens
ucuuuaccaaaaaccauguugcg

SEQ ID NO: 722266 - RNA, 12 nt, Homo sapiens
ucuuuaccucag

SEQ ID NO: 722267 - RNA, 13 nt, Homo sapiens
ucuuuacucaggc

SEQ ID NO: 722268 - RNA, 14 nt, Homo sapiens
ucuuuacucugcau

SEQ ID NO: 722269 - RNA, 18 nt, Homo sapiens
ucuuuacugcacucagau

SEQ ID NO: 722270 - RNA, 17 nt, Homo sapiens
ucuuuauaaucuacucc

SEQ ID NO: 722271 - RNA, 13 nt, Homo sapiens
ucuuuauacagcu

SEQ ID NO: 722272 - RNA, 22 nt, Homo sapiens
ucuuuaucaugaagcacaucaa

SEQ ID NO: 722273 - RNA, 16 nt, Homo sapiens
ucuuucacaggcauca

SEQ ID NO: 722274 - RNA, 15 nt, Homo sapiens
ucuuucauccuugac

SEQ ID NO: 722275 - RNA, 11 nt, Homo sapiens
ucuuuccagag

SEQ ID NO: 722276 - RNA, 23 nt, Homo sapiens
ucuuuccuguaaagaaacauuuc

SEQ ID NO: 722277 - RNA, 16 nt, Homo sapiens
ucuuucucaaucuuga

SEQ ID NO: 722278 - RNA, 20 nt, Homo sapiens
ucuuucucugccagugacag

SEQ ID NO: 722279 - RNA, 22 nt, Homo sapiens
ucuuucucugccagugacagac

SEQ ID NO: 722280 - RNA, 19 nt, Homo sapiens
ucuuucugucugcuuuaaa

SEQ ID NO: 722281 - RNA, 17 nt, Homo sapiens
ucuuucuuuaccugaga

SEQ ID NO: 722282 - RNA, 20 nt, Homo sapiens
ucuuucuuugcaccaaagac

SEQ ID NO: 722283 - RNA, 20 nt, Homo sapiens
ucuuugaacccuugcuugca

SEQ ID NO: 722284 - RNA, 19 nt, Homo sapiens
ucuuugacaauuccuagau

SEQ ID NO: 722285 - RNA, 21 nt, Homo sapiens
ucuuugacauuuggugguacu

SEQ ID NO: 722286 - RNA, 20 nt, Homo sapiens
ucuuugcaccaaagacauca

SEQ ID NO: 722287 - RNA, 14 nt, Homo sapiens
ucuuugcaguucca

SEQ ID NO: 722288 - RNA, 14 nt, Homo sapiens
ucuuugcauuccag

SEQ ID NO: 722289 - RNA, 20 nt, Homo sapiens
ucuuugccucaacuccagga

SEQ ID NO: 722290 - RNA, 11 nt, Homo sapiens
ucuuugccucu

SEQ ID NO: 722291 - RNA, 24 nt, Homo sapiens
ucuuugcucaacagaacauauguu

SEQ ID NO: 722292 - RNA, 12 nt, Homo sapiens
ucuuugcucagu

SEQ ID NO: 722293 - RNA, 18 nt, Homo sapiens
ucuuugcucccugcaaga

SEQ ID NO: 722294 - RNA, 14 nt, Homo sapiens
ucuuuggauuugau

SEQ ID NO: 722295 - RNA, 21 nt, Homo sapiens
ucuuuggggguuagaccacuu

SEQ ID NO: 722296 - RNA, 16 nt, Homo sapiens
ucuuuggguccauuca

SEQ ID NO: 722297 - RNA, 14 nt, Homo sapiens
ucuuugguggcaug

SEQ ID NO: 722298 - RNA, 21 nt, Homo sapiens
ucuuuguaaugucaccaccuu

SEQ ID NO: 722299 - RNA, 14 nt, Homo sapiens
ucuuuguaccaaaa

SEQ ID NO: 722300 - RNA, 20 nt, Homo sapiens
ucuuugucccaccaacuuaa

SEQ ID NO: 722301 - RNA, 13 nt, Homo sapiens
ucuuugugccuuu

SEQ ID NO: 722302 - RNA, 21 nt, Homo sapiens
ucuuuguggggaagaggggcu

SEQ ID NO: 722303 - RNA, 18 nt, Homo sapiens
ucuuuguuacuuccuuau

SEQ ID NO: 722304 - RNA, 21 nt, Homo sapiens
ucuuuuaagcuauccacagcu

SEQ ID NO: 722305 - RNA, 22 nt, Homo sapiens
ucuuuucaagaaguucuuugau

SEQ ID NO: 722306 - RNA, 13 nt, Homo sapiens
ucuuuucaucaaa

SEQ ID NO: 722307 - RNA, 11 nt, Homo sapiens
ucuuuuccacu

SEQ ID NO: 722308 - RNA, 19 nt, Homo sapiens
ucuuuuccuccuccaccca

SEQ ID NO: 722309 - RNA, 12 nt, Homo sapiens
ucuuuugcaauu

SEQ ID NO: 722310 - RNA, 16 nt, Homo sapiens
ucuuuugcacaaggaa

SEQ ID NO: 722311 - RNA, 20 nt, Homo sapiens
ucuuuugcuaaugcaauuag

SEQ ID NO: 722312 - RNA, 19 nt, Homo sapiens
ucuuuuggggaagcuuucu

SEQ ID NO: 722313 - RNA, 14 nt, Homo sapiens
ucuuuugucccaga

SEQ ID NO: 722314 - RNA, 13 nt, Homo sapiens
ucuuuuugcuuca

SEQ ID NO: 722315 - RNA, 23 nt, Homo sapiens
ucuuuuugguagaugcugggcuc

SEQ ID NO: 722316 - RNA, 17 nt, Homo sapiens
ucuuuuuuaauuuccag

SEQ ID NO: 722317 - RNA, 16 nt, Homo sapiens
ucuuuuuuaugcagaa

SEQ ID NO: 722318 - RNA, 18 nt, Homo sapiens
ugcagauagaaagcauua

SEQ ID NO: 722319 - RNA, 13 nt, Homo sapiens
ugcagaucaagaa

SEQ ID NO: 722320 - RNA, 17 nt, Homo sapiens
ugcagaucugugcucau

SEQ ID NO: 722321 - RNA, 21 nt, Homo sapiens
ugcagaugccacccuagccaa

SEQ ID NO: 722322 - RNA, 11 nt, Homo sapiens
ugcagauuucc

SEQ ID NO: 722323 - RNA, 19 nt, Homo sapiens
ugcagauuuuggccaugaa

SEQ ID NO: 722324 - RNA, 14 nt, Homo sapiens
ugcagcaaccagaa

SEQ ID NO: 722325 - RNA, 11 nt, Homo sapiens
ugcagcaauau

SEQ ID NO: 722326 - RNA, 19 nt, Homo sapiens
ugcagcaccggccucggga

SEQ ID NO: 722327 - RNA, 14 nt, Homo sapiens
ugcagcacucuuau

SEQ ID NO: 722328 - RNA, 19 nt, Homo sapiens
ugcagcacucuuaucuaca

SEQ ID NO: 722329 - RNA, 21 nt, Homo sapiens
ugcagcauaccaauuacccau

SEQ ID NO: 722330 - RNA, 17 nt, Homo sapiens
ugcagccccacagacaa

SEQ ID NO: 722331 - RNA, 17 nt, Homo sapiens
ugcagcccuugugaugu

SEQ ID NO: 722332 - RNA, 17 nt, Homo sapiens
ugcagcccuuugccaag

SEQ ID NO: 722333 - RNA, 14 nt, Homo sapiens
ugcagccuccgccu

SEQ ID NO: 722334 - RNA, 13 nt, Homo sapiens
ugcagcuacugga

SEQ ID NO: 722335 - RNA, 15 nt, Homo sapiens
ugcagcuacuggaau

SEQ ID NO: 722336 - RNA, 12 nt, Homo sapiens
ugcagcucucua

SEQ ID NO: 722337 - RNA, 20 nt, Homo sapiens
ugcagcucuugggaccgugu

SEQ ID NO: 722338 - RNA, 23 nt, Homo sapiens
ugcagcuucuaacugguaaaaag

SEQ ID NO: 722339 - RNA, 20 nt, Homo sapiens
ugcaggacuugagaagaccu

SEQ ID NO: 722340 - RNA, 22 nt, Homo sapiens
ugcaggacuugagaagaccuca

SEQ ID NO: 722341 - RNA, 17 nt, Homo sapiens
ugcaggcaagugggaua

SEQ ID NO: 722342 - RNA, 22 nt, Homo sapiens
ugcaggcaggaacaaacagggc

SEQ ID NO: 722343 - RNA, 22 nt, Homo sapiens
ugcaggccgugugucugucagc

SEQ ID NO: 722344 - RNA, 16 nt, Homo sapiens
ugcaggcgauggggca

SEQ ID NO: 722345 - RNA, 16 nt, Homo sapiens
ugcaggcuuuuccucc

SEQ ID NO: 722346 - RNA, 18 nt, Homo sapiens
ugcagggaagagggcagu

SEQ ID NO: 722347 - RNA, 19 nt, Homo sapiens
ugcagggaagagggcagua

SEQ ID NO: 722348 - RNA, 18 nt, Homo sapiens
ugcagggagcacuguuca

SEQ ID NO: 722349 - RNA, 17 nt, Homo sapiens
ugcagggauauugccuu

SEQ ID NO: 722350 - RNA, 18 nt, Homo sapiens
ugcagggauauugccuua

SEQ ID NO: 722351 - RNA, 21 nt, Homo sapiens
ugcagggccuguaaucccagc

SEQ ID NO: 722352 - RNA, 12 nt, Homo sapiens
ugcagggguccc

SEQ ID NO: 722353 - RNA, 20 nt, Homo sapiens
ugcaggguggauuguuacag

SEQ ID NO: 722354 - RNA, 19 nt, Homo sapiens
ugcaguacauuaauauuca

SEQ ID NO: 722355 - RNA, 12 nt, Homo sapiens
ugcaguacuuga

SEQ ID NO: 722356 - RNA, 20 nt, Homo sapiens
ugcaguaggggcuacuguga

SEQ ID NO: 722357 - RNA, 14 nt, Homo sapiens
ugcaguaguauuua

SEQ ID NO: 722358 - RNA, 20 nt, Homo sapiens
ugcaguaugaacuauugccu

SEQ ID NO: 722359 - RNA, 15 nt, Homo sapiens
ugcagucacauugau

SEQ ID NO: 722360 - RNA, 15 nt, Homo sapiens
ugcagucaucuacuu

SEQ ID NO: 722361 - RNA, 21 nt, Homo sapiens
ugcagucggugguaccugaga

SEQ ID NO: 722362 - RNA, 22 nt, Homo sapiens
ugcagucggugguaccugagau

SEQ ID NO: 722363 - RNA, 17 nt, Homo sapiens
ugcagugacagcuugag

SEQ ID NO: 722364 - RNA, 19 nt, Homo sapiens
ugcaguggcgcgaucucag

SEQ ID NO: 722365 - RNA, 20 nt, Homo sapiens
cagugagccgagauugcgcc

SEQ ID NO: 722366 - RNA, 22 nt, Homo sapiens
cagugagccgcaucuucuccau

SEQ ID NO: 722367 - RNA, 19 nt, Homo sapiens
cagugagcuuggaaaggac

SEQ ID NO: 722368 - RNA, 17 nt, Homo sapiens
cagugagggcucuggau

SEQ ID NO: 722369 - RNA, 23 nt, Homo sapiens
cagugauauaugccuauaauaua

SEQ ID NO: 722370 - RNA, 11 nt, Homo sapiens
cagugaucuca

SEQ ID NO: 722371 - RNA, 23 nt, Homo sapiens
cagugauggcgcgggaggcacca

SEQ ID NO: 722372 - RNA, 18 nt, Homo sapiens
cagugcaccuacugcuua

SEQ ID NO: 722373 - RNA, 12 nt, Homo sapiens
cagugcacugaa

SEQ ID NO: 722374 - RNA, 13 nt, Homo sapiens
cagugcaguuucu

SEQ ID NO: 722375 - RNA, 17 nt, Homo sapiens
cagugcauuauguacac

SEQ ID NO: 722376 - RNA, 17 nt, Homo sapiens
cagugccagcaccugcc

SEQ ID NO: 722377 - RNA, 16 nt, Homo sapiens
cagugcccaugggcua

SEQ ID NO: 722378 - RNA, 22 nt, Homo sapiens
cagugcccuggggcugaucuca

SEQ ID NO: 722379 - RNA, 18 nt, Homo sapiens
cagugccuucucucagcu

SEQ ID NO: 722380 - RNA, 23 nt, Homo sapiens
cagugcuaaaauucagaugcugu

SEQ ID NO: 722381 - RNA, 14 nt, Homo sapiens
cagugcuacugaaa

SEQ ID NO: 722382 - RNA, 19 nt, Homo sapiens
cagugcugcccaugagcaa

SEQ ID NO: 722383 - RNA, 21 nt, Homo sapiens
cagugcuguggccugggcaag

SEQ ID NO: 722384 - RNA, 18 nt, Homo sapiens
cagugcuucuuacuauua

SEQ ID NO: 722385 - RNA, 14 nt, Homo sapiens
caguggagcccacg

SEQ ID NO: 722386 - RNA, 13 nt, Homo sapiens
caguggauguaua

SEQ ID NO: 722387 - RNA, 17 nt, Homo sapiens
caguggauugauuauaa

SEQ ID NO: 722388 - RNA, 18 nt, Homo sapiens
caguggauugauuauaaa

SEQ ID NO: 722389 - RNA, 15 nt, Homo sapiens
caguggcaucaucuc

SEQ ID NO: 722390 - RNA, 16 nt, Homo sapiens
caguggcaucaucuca

SEQ ID NO: 722391 - RNA, 23 nt, Homo sapiens
caguggcccauaaguguaaaaua

SEQ ID NO: 722392 - RNA, 17 nt, Homo sapiens
caguggcgugaucucag

SEQ ID NO: 722393 - RNA, 20 nt, Homo sapiens
caguggcgugaucucagcuc

SEQ ID NO: 722394 - RNA, 21 nt, Homo sapiens
caguggcgugaucucagcuca

SEQ ID NO: 722395 - RNA, 21 nt, Homo sapiens
cagugggaaacaaacugucua

SEQ ID NO: 722396 - RNA, 21 nt, Homo sapiens
cagugggaccccacagaguug

SEQ ID NO: 722397 - RNA, 23 nt, Homo sapiens
cagugguauccugugacauguaa

SEQ ID NO: 722398 - RNA, 13 nt, Homo sapiens
caguggugccauc

SEQ ID NO: 722399 - RNA, 13 nt, Homo sapiens
cagugguggugcc

SEQ ID NO: 722400 - RNA, 16 nt, Homo sapiens
caguguauguacuaag

SEQ ID NO: 722401 - RNA, 17 nt, Homo sapiens
cagugucacucuguagu

SEQ ID NO: 722402 - RNA, 17 nt, Homo sapiens
cagugucccuuuugcua

SEQ ID NO: 722403 - RNA, 16 nt, Homo sapiens
cagugucuuccauaau

SEQ ID NO: 722404 - RNA, 16 nt, Homo sapiens
caguguggcagugacc

SEQ ID NO: 722405 - RNA, 14 nt, Homo sapiens
caguguggccucuu

SEQ ID NO: 722406 - RNA, 22 nt, Homo sapiens
caguguggggaagugucccugu

SEQ ID NO: 722407 - RNA, 11 nt, Homo sapiens
caguguugccc

SEQ ID NO: 722408 - RNA, 20 nt, Homo sapiens
caguguuggggaugccuugg

SEQ ID NO: 722409 - RNA, 17 nt, Homo sapiens
caguguuucuacaauca

SEQ ID NO: 722410 - RNA, 14 nt, Homo sapiens
caguguuuggugua

SEQ ID NO: 722411 - RNA, 18 nt, Homo sapiens
caguguuuuuauugcucg

SEQ ID NO: 722412 - RNA, 17 nt, Homo sapiens
caguuacaguugauguu

SEQ ID NO: 722413 - RNA, 17 nt, Homo sapiens
caguuagcucauuugag

SEQ ID NO: 722414 - RNA, 20 nt, Homo sapiens
caguuaggguuuugcaauaa

SEQ ID NO: 722415 - RNA, 16 nt, Homo sapiens
caguuagguagcuuua

SEQ ID NO: 722416 - RNA, 13 nt, Homo sapiens
caguuaggugcug

SEQ ID NO: 722417 - RNA, 20 nt, Homo sapiens
caguuaugugaaugaucucu

SEQ ID NO: 722418 - RNA, 23 nt, Homo sapiens
caguuauuaaucuggacauucga

SEQ ID NO: 722419 - RNA, 14 nt, Homo sapiens
caguuauucuugca

SEQ ID NO: 722420 - RNA, 19 nt, Homo sapiens
caguuauucuugcaaagau

SEQ ID NO: 722421 - RNA, 15 nt, Homo sapiens
caguuauuucaaaaa

SEQ ID NO: 722422 - RNA, 15 nt, Homo sapiens
caguucaaauccuca

SEQ ID NO: 722423 - RNA, 17 nt, Homo sapiens
caguucaccugcacuua

SEQ ID NO: 722424 - RNA, 21 nt, Homo sapiens
caguucaggagucccaaggaa

SEQ ID NO: 722425 - RNA, 12 nt, Homo sapiens
caguucaucacc

SEQ ID NO: 722426 - RNA, 18 nt, Homo sapiens
caguucccccaguaccuc

SEQ ID NO: 722427 - RNA, 15 nt, Homo sapiens
caguucccucuugcu

SEQ ID NO: 722428 - RNA, 15 nt, Homo sapiens
caguucuaaccuccu

SEQ ID NO: 722429 - RNA, 17 nt, Homo sapiens
caguucuacacugauac

SEQ ID NO: 722430 - RNA, 18 nt, Homo sapiens
caguucuacacugauaca

SEQ ID NO: 722431 - RNA, 21 nt, Homo sapiens
caguucuagaagccacagugc

SEQ ID NO: 722432 - RNA, 17 nt, Homo sapiens
caguucugaacuggaac

SEQ ID NO: 722433 - RNA, 19 nt, Homo sapiens
uaugaguggcuucugggag

SEQ ID NO: 722434 - RNA, 16 nt, Homo sapiens
uaugauauauugcugu

SEQ ID NO: 722435 - RNA, 21 nt, Homo sapiens
uaugaucagguaacuuucgac

SEQ ID NO: 722436 - RNA, 19 nt, Homo sapiens
uaugaucuggcccuugcuu

SEQ ID NO: 722437 - RNA, 12 nt, Homo sapiens
uaugaucuuggc

SEQ ID NO: 722438 - RNA, 17 nt, Homo sapiens
uaugaugagcauacaca

SEQ ID NO: 722439 - RNA, 18 nt, Homo sapiens
uaugauucagauuguuau

SEQ ID NO: 722440 - RNA, 16 nt, Homo sapiens
uaugauugcauuguau

SEQ ID NO: 722441 - RNA, 15 nt, Homo sapiens
uaugauuuaagacua

SEQ ID NO: 722442 - RNA, 16 nt, Homo sapiens
uaugcaaauacaauca

SEQ ID NO: 722443 - RNA, 18 nt, Homo sapiens
uaugcaaauacaaucagc

SEQ ID NO: 722444 - RNA, 13 nt, Homo sapiens
uaugcaauucuua

SEQ ID NO: 722445 - RNA, 15 nt, Homo sapiens
uaugcacacauauau

SEQ ID NO: 722446 - RNA, 13 nt, Homo sapiens
uaugcacaccucc

SEQ ID NO: 722447 - RNA, 14 nt, Homo sapiens
uaugcacauucacg

SEQ ID NO: 722448 - RNA, 21 nt, Homo sapiens
uaugcaccuugugucuguaca

SEQ ID NO: 722449 - RNA, 22 nt, Homo sapiens
uaugcagccaaccaagaugcaa

SEQ ID NO: 722450 - RNA, 10 nt, Homo sapiens
uaaagacaga

SEQ ID NO: 722451 - RNA, 18 nt, Homo sapiens
uaaagacugaucucaggg

SEQ ID NO: 722452 - RNA, 13 nt, Homo sapiens
uaaagacugugau

SEQ ID NO: 722453 - RNA, 19 nt, Homo sapiens
uaaagagagaauguagaua

SEQ ID NO: 722454 - RNA, 20 nt, Homo sapiens
uaaagauacuaaaccagcau

SEQ ID NO: 722455 - RNA, 17 nt, Homo sapiens
uaagaguaaaauuccuc

SEQ ID NO: 722456 - RNA, 22 nt, Homo sapiens
uaagagugccguaacaacugug

SEQ ID NO: 722457 - RNA, 13 nt, Homo sapiens
uaagaguuacuua

SEQ ID NO: 722458 - RNA, 13 nt, Homo sapiens
uaagaguugccaa

SEQ ID NO: 722459 - RNA, 19 nt, Homo sapiens
uaagauauucagaaguaua

SEQ ID NO: 722460 - RNA, 17 nt, Homo sapiens
uaagauauuuaguaaua

SEQ ID NO: 722461 - RNA, 18 nt, Homo sapiens
uaagauauuuaguaauau

SEQ ID NO: 722462 - RNA, 19 nt, Homo sapiens
uaagauccacaaaugaagg

SEQ ID NO: 722463 - RNA, 21 nt, Homo sapiens
uaagaucguucucugccucac

SEQ ID NO: 722464 - RNA, 19 nt, Homo sapiens
uaagaucuuagauucucug

SEQ ID NO: 722465 - RNA, 13 nt, Homo sapiens
uaagaugcacuga

SEQ ID NO: 722466 - RNA, 16 nt, Homo sapiens
uaagauuaauuuucuc

SEQ ID NO: 722467 - RNA, 16 nt, Homo sapiens
uaagauucuugacuua

SEQ ID NO: 722468 - RNA, 21 nt, Homo sapiens
uaagcaaaaugcuucugcaca

SEQ ID NO: 722469 - RNA, 15 nt, Homo sapiens
uaagcaaauguuaaa

SEQ ID NO: 722470 - RNA, 21 nt, Homo sapiens
uaagcacaaagcccauagcac

SEQ ID NO: 722471 - RNA, 16 nt, Homo sapiens
uaagcagaaauccugc

SEQ ID NO: 722472 - RNA, 12 nt, Homo sapiens
uaagcagcauuu

SEQ ID NO: 722473 - RNA, 20 nt, Homo sapiens
uaagcaguauauuaguauua

SEQ ID NO: 722474 - RNA, 15 nt, Homo sapiens
uaagcauaaaagauc

SEQ ID NO: 722475 - RNA, 14 nt, Homo sapiens
uaagcauacuuugu

SEQ ID NO: 722476 - RNA, 14 nt, Homo sapiens
uaagcaucugccau

SEQ ID NO: 722477 - RNA, 18 nt, Homo sapiens
uaagcaugugucccagga

SEQ ID NO: 722478 - RNA, 21 nt, Homo sapiens
uaagcauuccuucuuucacag

SEQ ID NO: 722479 - RNA, 23 nt, Homo sapiens
uaagccaaagaaacaagcugugc

SEQ ID NO: 722480 - RNA, 22 nt, Homo sapiens
uaagccaacuuuaauugcuuaa

SEQ ID NO: 722481 - RNA, 16 nt, Homo sapiens
uaagccagaauccaga

SEQ ID NO: 722482 - RNA, 20 nt, Homo sapiens
uaagcccccucaacuaccau

SEQ ID NO: 722483 - RNA, 22 nt, Homo sapiens
uaagcccuaagguccuaaggca

SEQ ID NO: 722484 - RNA, 13 nt, Homo sapiens
uaagccuaaagau

SEQ ID NO: 722485 - RNA, 22 nt, Homo sapiens
uaagccugauuuuccugaugcu

SEQ ID NO: 722486 - RNA, 18 nt, Homo sapiens
uaagcgaagaugauuuca

SEQ ID NO: 722487 - RNA, 16 nt, Homo sapiens
uaagcuaucuucaaau

SEQ ID NO: 722488 - RNA, 17 nt, Homo sapiens
uaagcucuuuaugacug

SEQ ID NO: 722489 - RNA, 18 nt, Homo sapiens
uaagcuggagugcagugg

SEQ ID NO: 722490 - RNA, 22 nt, Homo sapiens
uaagcugggaaaaaaguuuuga

SEQ ID NO: 722491 - RNA, 22 nt, Homo sapiens
uaaggaaacacuucuauuuaau

SEQ ID NO: 722492 - RNA, 14 nt, Homo sapiens
uaaggaaagcaaua

SEQ ID NO: 722493 - RNA, 13 nt, Homo sapiens
uaaggaacaacgu

SEQ ID NO: 722494 - RNA, 16 nt, Homo sapiens
uaaggaaguaucagca

SEQ ID NO: 722495 - RNA, 20 nt, Homo sapiens
uaaggaaguaucagcacuag

SEQ ID NO: 722496 - RNA, 23 nt, Homo sapiens
uaaggauggauggcacccuggaa

SEQ ID NO: 722497 - RNA, 14 nt, Homo sapiens
uaaggauucaggga

SEQ ID NO: 722498 - RNA, 18 nt, Homo sapiens
uaaggcagcuaagacaua

SEQ ID NO: 722499 - RNA, 21 nt, Homo sapiens
uaaggccaaguacacugagag

SEQ ID NO: 722500 - RNA, 22 nt, Homo sapiens
uaaggccuccagccccaugugu

SEQ ID NO: 722501 - RNA, 17 nt, Homo sapiens
uaaggcucugugccuug

SEQ ID NO: 722502 - RNA, 21 nt, Homo sapiens
uaagggcuggucucugcugaa

SEQ ID NO: 722503 - RNA, 18 nt, Homo sapiens
uaagggguaucauguaug

SEQ ID NO: 722504 - RNA, 14 nt, Homo sapiens
uaagggucucucau

SEQ ID NO: 722505 - RNA, 21 nt, Homo sapiens
uaagguauauaaauuuuccca

SEQ ID NO: 722506 - RNA, 15 nt, Homo sapiens
uaaggugaaccaaag

SEQ ID NO: 722507 - RNA, 12 nt, Homo sapiens
uaaggugcuauc

SEQ ID NO: 722508 - RNA, 16 nt, Homo sapiens
uaagguuuccagucag

SEQ ID NO: 722509 - RNA, 14 nt, Homo sapiens
uaaguaaaaccaca

SEQ ID NO: 722510 - RNA, 15 nt, Homo sapiens
uaaguaagacuuuua

SEQ ID NO: 722511 - RNA, 23 nt, Homo sapiens
uaaguaccuuauucuacaucauu

SEQ ID NO: 722512 - RNA, 13 nt, Homo sapiens
uaaguacuaugua

SEQ ID NO: 722513 - RNA, 20 nt, Homo sapiens
uaaguacuauguaucaauga

SEQ ID NO: 722514 - RNA, 22 nt, Homo sapiens
uaaguagggacuucugucuuca

SEQ ID NO: 722515 - RNA, 14 nt, Homo sapiens
uaaguauucaagua

SEQ ID NO: 722516 - RNA, 16 nt, Homo sapiens
uaaguccaguguuucu

SEQ ID NO: 722517 - RNA, 21 nt, Homo sapiens
uaaguccuuccaccugccacc

SEQ ID NO: 722518 - RNA, 17 nt, Homo sapiens
uaagugaauacauuaac

SEQ ID NO: 722519 - RNA, 20 nt, Homo sapiens
uaagugggguugcaaccacu

SEQ ID NO: 722520 - RNA, 15 nt, Homo sapiens
uaagugucucacuaa

SEQ ID NO: 722521 - RNA, 14 nt, Homo sapiens
uaagugugccaaau

SEQ ID NO: 722522 - RNA, 13 nt, Homo sapiens
uaaguguucucau

SEQ ID NO: 722523 - RNA, 15 nt, Homo sapiens
uaaguguucucauga

SEQ ID NO: 722524 - RNA, 15 nt, Homo sapiens
uaaguuaaacaguca

SEQ ID NO: 722525 - RNA, 20 nt, Homo sapiens
uaaguuauuuacuuuuacca

SEQ ID NO: 722526 - RNA, 12 nt, Homo sapiens
uaaguucaggga

SEQ ID NO: 722527 - RNA, 23 nt, Homo sapiens
uaaguuguagaaauuaacaaaug

SEQ ID NO: 722528 - RNA, 21 nt, Homo sapiens
uaaguuugaaggaaacaguua

SEQ ID NO: 722529 - RNA, 16 nt, Homo sapiens
uaauaaaaaauuucag

SEQ ID NO: 722530 - RNA, 13 nt, Homo sapiens
uaauaaacauccu

SEQ ID NO: 722531 - RNA, 15 nt, Homo sapiens
uaauaaacuacacaa

SEQ ID NO: 722532 - RNA, 14 nt, Homo sapiens
uaauaaagcauucu

SEQ ID NO: 722533 - RNA, 19 nt, Homo sapiens
uaauaaaggucuuugcaca

SEQ ID NO: 722534 - RNA, 13 nt, Homo sapiens
uaauaaauacuca

SEQ ID NO: 722535 - RNA, 18 nt, Homo sapiens
uaauaaauuuaauaaaua

SEQ ID NO: 722536 - RNA, 20 nt, Homo sapiens
uaauaacaacagaucugcag

SEQ ID NO: 722537 - RNA, 21 nt, Homo sapiens
uaauaacugugaaguuuacau

SEQ ID NO: 722538 - RNA, 14 nt, Homo sapiens
uaauaacuuaucua

SEQ ID NO: 722539 - RNA, 22 nt, Homo sapiens
uaauaagagaauguuccuacuc

SEQ ID NO: 722540 - RNA, 21 nt, Homo sapiens
uaauaagcaaagggagcacug

SEQ ID NO: 722541 - RNA, 15 nt, Homo sapiens
uaauaagcuaaagag

SEQ ID NO: 722542 - RNA, 14 nt, Homo sapiens
uaauaauaauaaua

SEQ ID NO: 722543 - RNA, 13 nt, Homo sapiens
uaauaauuauuca

SEQ ID NO: 722544 - RNA, 14 nt, Homo sapiens
uaauacagcagugu

SEQ ID NO: 722545 - RNA, 15 nt, Homo sapiens
uaauaccagaacucu

SEQ ID NO: 722546 - RNA, 14 nt, Homo sapiens
uaauacucauuccu

SEQ ID NO: 722547 - RNA, 15 nt, Homo sapiens
uaauacuccagagac

SEQ ID NO: 722548 - RNA, 23 nt, Homo sapiens
uaauacugguauuuuuacuuaau

SEQ ID NO: 722549 - RNA, 19 nt, Homo sapiens
uaauagucaauuucuacuu

SEQ ID NO: 722550 - RNA, 18 nt, Homo sapiens
uaauauaaauaguguaca

SEQ ID NO: 722551 - RNA, 12 nt, Homo sapiens
uaauauacuuua

SEQ ID NO: 722552 - RNA, 17 nt, Homo sapiens
uaauauaguuauugcac

SEQ ID NO: 722553 - RNA, 14 nt, Homo sapiens
uaauauauuuccau

SEQ ID NO: 722554 - RNA, 17 nt, Homo sapiens
uaauauccaagacuuag

SEQ ID NO: 722555 - RNA, 20 nt, Homo sapiens
uaauaucugaggaugaccag

SEQ ID NO: 722556 - RNA, 14 nt, Homo sapiens
uaauauuuggagcu

SEQ ID NO: 722557 - RNA, 15 nt, Homo sapiens
uaauauuuggagcua

SEQ ID NO: 722558 - RNA, 17 nt, Homo sapiens
uaauauuuuaaauugcu

SEQ ID NO: 722559 - RNA, 14 nt, Homo sapiens
uaauauuuuccaua

SEQ ID NO: 722560 - RNA, 19 nt, Homo sapiens
uaauauuuuuccacuuaaa

SEQ ID NO: 722561 - RNA, 21 nt, Homo sapiens
uaaucaagaaaaacaucuuug

SEQ ID NO: 722562 - RNA, 13 nt, Homo sapiens
uaaucacaguguu

SEQ ID NO: 722563 - RNA, 17 nt, Homo sapiens
uaaucauaaaggacaag

SEQ ID NO: 722564 - RNA, 18 nt, Homo sapiens
uaaucaucuauaaagaag

SEQ ID NO: 722565 - RNA, 18 nt, Homo sapiens
uaaucaugucguauuugc

SEQ ID NO: 722566 - RNA, 20 nt, Homo sapiens
uaaucauuguaugugcuuca

SEQ ID NO: 722567 - RNA, 20 nt, Homo sapiens
uaauccaauauuuugccuuu

SEQ ID NO: 722568 - RNA, 23 nt, Homo sapiens
uaauccacaucuuuacucaggca

SEQ ID NO: 722569 - RNA, 18 nt, Homo sapiens
uaauccaggcagauccag

SEQ ID NO: 722570 - RNA, 11 nt, Homo sapiens
uagucuugucu

SEQ ID NO: 722571 - RNA, 15 nt, Homo sapiens
uagugaaaugccaca

SEQ ID NO: 722572 - RNA, 20 nt, Homo sapiens
uagugaaccaaaaauagaaa

SEQ ID NO: 722573 - RNA, 17 nt, Homo sapiens
uagugaaguugugcaac

SEQ ID NO: 722574 - RNA, 17 nt, Homo sapiens
uagugaauacugcuaca

SEQ ID NO: 722575 - RNA, 21 nt, Homo sapiens
uagugacuuaauucuuucuaa

SEQ ID NO: 722576 - RNA, 19 nt, Homo sapiens
uagugaugagaauuguaug

SEQ ID NO: 722577 - RNA, 14 nt, Homo sapiens
uagugcaucagaug

SEQ ID NO: 722578 - RNA, 20 nt, Homo sapiens
uagugccacccaccuuugcc

SEQ ID NO: 722579 - RNA, 16 nt, Homo sapiens
uagugcuucagaguuu

SEQ ID NO: 722580 - RNA, 22 nt, Homo sapiens
uagugguauagaguacugcaga

SEQ ID NO: 722581 - RNA, 15 nt, Homo sapiens
uagugguaugucucu

SEQ ID NO: 722582 - RNA, 16 nt, Homo sapiens
uaguguccggggaccu

SEQ ID NO: 722583 - RNA, 18 nt, Homo sapiens
uaguguuaauaucuugaa

SEQ ID NO: 722584 - RNA, 23 nt, Homo sapiens
guauccaugcaccuaccuuagaa

SEQ ID NO: 722585 - RNA, 18 nt, Homo sapiens
guaucccacauccaacuc

SEQ ID NO: 722586 - RNA, 22 nt, Homo sapiens
guauccguucaauaagcauuuc

SEQ ID NO: 722587 - RNA, 20 nt, Homo sapiens
guaucuaccuuuugcuacuu

SEQ ID NO: 722588 - RNA, 19 nt, Homo sapiens
guaucuagcucuaguucaa

SEQ ID NO: 722589 - RNA, 17 nt, Homo sapiens
guaucucaguaccccau

SEQ ID NO: 722590 - RNA, 20 nt, Homo sapiens
guaauaaaccuccuucggga

SEQ ID NO: 722591 - RNA, 22 nt, Homo sapiens
guaauaauaaaucguccuccca

SEQ ID NO: 722592 - RNA, 15 nt, Homo sapiens
guaauacaucaaaga

SEQ ID NO: 722593 - RNA, 16 nt, Homo sapiens
guaauacaucaaagag

SEQ ID NO: 722594 - RNA, 20 nt, Homo sapiens
guaauacuuuacaaaccauu

SEQ ID NO: 722595 - RNA, 16 nt, Homo sapiens
guaauaguucuauccu

SEQ ID NO: 722596 - RNA, 20 nt, Homo sapiens
guaauauauuuaaagggaaa

SEQ ID NO: 722597 - RNA, 16 nt, Homo sapiens
ggucacagagugagac

SEQ ID NO: 722598 - RNA, 20 nt, Homo sapiens
ggucacucaggacagcccag

SEQ ID NO: 722599 - RNA, 15 nt, Homo sapiens
ggucagaaggccagc

SEQ ID NO: 722600 - RNA, 18 nt, Homo sapiens
ggucagagaaaaugagaa

SEQ ID NO: 722601 - RNA, 23 nt, Homo sapiens
ggucagagagaccucauccugcu

SEQ ID NO: 722602 - RNA, 14 nt, Homo sapiens
ggucagagugaauu

SEQ ID NO: 722603 - RNA, 15 nt, Homo sapiens
ggucagagugccacu

SEQ ID NO: 722604 - RNA, 16 nt, Homo sapiens
ggucagccuccucucc

SEQ ID NO: 722605 - RNA, 20 nt, Homo sapiens
ggucagcuuuuguuguuuau

SEQ ID NO: 722606 - RNA, 21 nt, Homo sapiens
ggucaggagaaugaaacagcu

SEQ ID NO: 722607 - RNA, 12 nt, Homo sapiens
gcccugaccaau

SEQ ID NO: 722608 - RNA, 18 nt, Homo sapiens
gcccugaccuucugggac

SEQ ID NO: 722609 - RNA, 16 nt, Homo sapiens
gcccugaguccaagag

SEQ ID NO: 722610 - RNA, 19 nt, Homo sapiens
gcccugaugcgucuaccca

SEQ ID NO: 722611 - RNA, 21 nt, Homo sapiens
gcccugauguguccucaggga

SEQ ID NO: 722612 - RNA, 13 nt, Homo sapiens
gcccugcacagau

SEQ ID NO: 722613 - RNA, 17 nt, Homo sapiens
gcccugcacgucauggg

SEQ ID NO: 722614 - RNA, 18 nt, Homo sapiens
gcccugcagcccaaaacc

SEQ ID NO: 722615 - RNA, 17 nt, Homo sapiens
gcccugccccaccccau

SEQ ID NO: 722616 - RNA, 20 nt, Homo sapiens
gcccugcccuccuuugccuu

SEQ ID NO: 722617 - RNA, 12 nt, Homo sapiens
gcccugcuccuc

SEQ ID NO: 722618 - RNA, 16 nt, Homo sapiens
gcccugcuuagcucau

SEQ ID NO: 722619 - RNA, 15 nt, Homo sapiens
gcccuggaugugaau

SEQ ID NO: 722620 - RNA, 12 nt, Homo sapiens
gcccuggcagca

SEQ ID NO: 722621 - RNA, 21 nt, Homo sapiens
gcccuggcagcaugacucaga

SEQ ID NO: 722622 - RNA, 18 nt, Homo sapiens
gcccuggcagggggcaug

SEQ ID NO: 722623 - RNA, 14 nt, Homo sapiens
gcccuggccaggac

SEQ ID NO: 722624 - RNA, 19 nt, Homo sapiens
gcccugggaaccacuccca

SEQ ID NO: 722625 - RNA, 19 nt, Homo sapiens
gcccugggccccaccaccu

SEQ ID NO: 722626 - RNA, 22 nt, Homo sapiens
gcccugucauccagcucacuca

SEQ ID NO: 722627 - RNA, 15 nt, Homo sapiens
gcccuguguccugag

SEQ ID NO: 722628 - RNA, 16 nt, Homo sapiens
gcccuuauggccaaua

SEQ ID NO: 722629 - RNA, 17 nt, Homo sapiens
gcccuuccaaacucuuc

SEQ ID NO: 722630 - RNA, 18 nt, Homo sapiens
gcccuuccaugugccuuu

SEQ ID NO: 722631 - RNA, 17 nt, Homo sapiens
gcccuugagcuacuuca

SEQ ID NO: 722632 - RNA, 13 nt, Homo sapiens
gcccuugcccuug

SEQ ID NO: 722633 - RNA, 19 nt, Homo sapiens
ggcaagcgcuucugcugaa

SEQ ID NO: 722634 - RNA, 19 nt, Homo sapiens
ggcaaucaugagcaaguga

SEQ ID NO: 722635 - RNA, 17 nt, Homo sapiens
ggcaaucuuugccuuua

SEQ ID NO: 722636 - RNA, 19 nt, Homo sapiens
ggcaaucuuugccuuuauc

SEQ ID NO: 722637 - RNA, 18 nt, Homo sapiens
ggcaauuguccccaggga

SEQ ID NO: 722638 - RNA, 18 nt, Homo sapiens
ggcaauuucaccaccaaa

SEQ ID NO: 722639 - RNA, 22 nt, Homo sapiens
ggcaauuucaccaccaaaugcc

SEQ ID NO: 722640 - RNA, 21 nt, Homo sapiens
ggcacacaucaggaguucaau

SEQ ID NO: 722641 - RNA, 18 nt, Homo sapiens
ggcacaggacugauucug

SEQ ID NO: 722642 - RNA, 16 nt, Homo sapiens
ggcacaggagacucca

SEQ ID NO: 722643 - RNA, 19 nt, Homo sapiens
ggcacaguaggaauuggaa

SEQ ID NO: 722644 - RNA, 11 nt, Homo sapiens
ggcacauagaa

SEQ ID NO: 722645 - RNA, 21 nt, Homo sapiens
ggcacauaggcugguggccuu

SEQ ID NO: 722646 - RNA, 11 nt, Homo sapiens
ggcacauuccc

SEQ ID NO: 722647 - RNA, 17 nt, Homo sapiens
ggcacauuccccuugcc

SEQ ID NO: 722648 - RNA, 14 nt, Homo sapiens
gggcucucucauga

SEQ ID NO: 722649 - RNA, 17 nt, Homo sapiens
gggcucugauggcugcu

SEQ ID NO: 722650 - RNA, 14 nt, Homo sapiens
gggcucuguauaua

SEQ ID NO: 722651 - RNA, 22 nt, Homo sapiens
gggcucuuccaacaaggaagaa

SEQ ID NO: 722652 - RNA, 16 nt, Homo sapiens
gggcucuuuagccagu

SEQ ID NO: 722653 - RNA, 21 nt, Homo sapiens
gggcugaccugccucucacac

SEQ ID NO: 722654 - RNA, 22 nt, Homo sapiens
gggcugacuccugcucucugga

SEQ ID NO: 722655 - RNA, 22 nt, Homo sapiens
gggcugagcccuggcaggauga

SEQ ID NO: 722656 - RNA, 11 nt, Homo sapiens
gggcugagggu

SEQ ID NO: 722657 - RNA, 23 nt, Homo sapiens
gggcugaguggucugacaccaaa

SEQ ID NO: 722658 - RNA, 13 nt, Homo sapiens
gggcuguauuuau

SEQ ID NO: 722659 - RNA, 18 nt, Homo sapiens
gggcuucaaucacuguaa

SEQ ID NO: 722660 - RNA, 11 nt, Homo sapiens
gggcuuucaua

SEQ ID NO: 722661 - RNA, 15 nt, Homo sapiens
gggcuuucauagugu

SEQ ID NO: 722662 - RNA, 22 nt, Homo sapiens
ggggacugcuaccucugagaag

SEQ ID NO: 722663 - RNA, 16 nt, Homo sapiens
ggggagaauguaauca

SEQ ID NO: 722664 - RNA, 16 nt, Homo sapiens
ggggagcacuugucca

SEQ ID NO: 722665 - RNA, 15 nt, Homo sapiens
ggggagccuuagccg

SEQ ID NO: 722666 - RNA, 13 nt, Homo sapiens
ggggagcgguggc

SEQ ID NO: 722667 - RNA, 23 nt, Homo sapiens
ggggagcugggguacagguuugg

SEQ ID NO: 722668 - RNA, 14 nt, Homo sapiens
ggggaugugacaug

SEQ ID NO: 722669 - RNA, 14 nt, Homo sapiens
ggggauguggagug

SEQ ID NO: 722670 - RNA, 14 nt, Homo sapiens
ggggcagcacuccc

SEQ ID NO: 722671 - RNA, 16 nt, Homo sapiens
ggggcagggccacuca

SEQ ID NO: 722672 - RNA, 14 nt, Homo sapiens
ggggcaugggugga

SEQ ID NO: 722673 - RNA, 13 nt, Homo sapiens
ggggccaccuccu

SEQ ID NO: 722674 - RNA, 16 nt, Homo sapiens
ggggccacguggaugg

SEQ ID NO: 722675 - RNA, 23 nt, Homo sapiens
ggggccaggucacccuuugcugu

SEQ ID NO: 722676 - RNA, 17 nt, Homo sapiens
ggggccauugcuuaccu

SEQ ID NO: 722677 - RNA, 14 nt, Homo sapiens
ggggcccagugcau

SEQ ID NO: 722678 - RNA, 19 nt, Homo sapiens
ggggccuagggagccgcac

SEQ ID NO: 722679 - RNA, 14 nt, Homo sapiens
ggggcucccucucu

SEQ ID NO: 722680 - RNA, 16 nt, Homo sapiens
ggggcucugugcaggg

SEQ ID NO: 722681 - RNA, 21 nt, Homo sapiens
ggggcugacuucaauccaugu

SEQ ID NO: 722682 - RNA, 24 nt, Homo sapiens
gggggaaaaguuagucaauccugu

SEQ ID NO: 722683 - RNA, 12 nt, Homo sapiens
gggggaagggag

SEQ ID NO: 722684 - RNA, 18 nt, Homo sapiens
gggggagaagaagccgag

SEQ ID NO: 722685 - RNA, 23 nt, Homo sapiens
gggggagugggcgcaguggcuca

SEQ ID NO: 722686 - RNA, 13 nt, Homo sapiens
ggggguuccguga

SEQ ID NO: 722687 - RNA, 18 nt, Homo sapiens
gggguccuccugugcuau

SEQ ID NO: 722688 - RNA, 11 nt, Homo sapiens
gggguggagca

SEQ ID NO: 722689 - RNA, 22 nt, Homo sapiens
ggguaauccaggcacagcugag

SEQ ID NO: 722690 - RNA, 16 nt, Homo sapiens
ggguacaaaaagucaa

SEQ ID NO: 722691 - RNA, 17 nt, Homo sapiens
ggguacagcgcggagga

SEQ ID NO: 722692 - RNA, 14 nt, Homo sapiens
ggguacugacugag

SEQ ID NO: 722693 - RNA, 13 nt, Homo sapiens
ggguagaucucaa

SEQ ID NO: 722694 - RNA, 15 nt, Homo sapiens
gggucaaaccaagaa

SEQ ID NO: 722695 - RNA, 15 nt, Homo sapiens
gggucaucgauucaa

SEQ ID NO: 722696 - RNA, 23 nt, Homo sapiens
ggguccacugaagggacccuggg

SEQ ID NO: 722697 - RNA, 14 nt, Homo sapiens
gggucuccuuggcu

SEQ ID NO: 722698 - RNA, 19 nt, Homo sapiens
gggucucgcuuuguugccc

SEQ ID NO: 722699 - RNA, 12 nt, Homo sapiens
gggucugggauc

SEQ ID NO: 722700 - RNA, 10 nt, Homo sapiens
gggucugugu

SEQ ID NO: 722701 - RNA, 16 nt, Homo sapiens
gggugacagugccuuc

SEQ ID NO: 722702 - RNA, 23 nt, Homo sapiens
gggugaccagccacucaaaggaa

SEQ ID NO: 722703 - RNA, 22 nt, Homo sapiens
gggugauuuuaugaucaguguu

SEQ ID NO: 722704 - RNA, 18 nt, Homo sapiens
gggugcaaagauguucau

SEQ ID NO: 722705 - RNA, 20 nt, Homo sapiens
gggugcagcccucuugcccg

SEQ ID NO: 722706 - RNA, 22 nt, Homo sapiens
gggugccgcuuucucugagggg

SEQ ID NO: 722707 - RNA, 18 nt, Homo sapiens
gggugcgcucaccugcag

SEQ ID NO: 722708 - RNA, 19 nt, Homo sapiens
gggugcucucucugagggg

SEQ ID NO: 722709 - RNA, 15 nt, Homo sapiens
ggguggaugaucuca

SEQ ID NO: 722710 - RNA, 18 nt, Homo sapiens
ggguggcacucagucucu

SEQ ID NO: 722711 - RNA, 21 nt, Homo sapiens
ggguggcgguggaccaaagga

SEQ ID NO: 722712 - RNA, 14 nt, Homo sapiens
gggugguacccucu

SEQ ID NO: 722713 - RNA, 19 nt, Homo sapiens
gggugguccgggaagugag

SEQ ID NO: 722714 - RNA, 14 nt, Homo sapiens
ggguuaagucuccu

SEQ ID NO: 722715 - RNA, 22 nt, Homo sapiens
ggguucaagcaauugucugccu

SEQ ID NO: 722716 - RNA, 15 nt, Homo sapiens
ggguuccaggacagg

SEQ ID NO: 722717 - RNA, 18 nt, Homo sapiens
ggguugaaagacaucaau

SEQ ID NO: 722718 - RNA, 21 nt, Homo sapiens
ggguuggcuguuccagacuca

SEQ ID NO: 722719 - RNA, 22 nt, Homo sapiens
ggguuggggugcuuccuuucag

SEQ ID NO: 722720 - RNA, 12 nt, Homo sapiens
ggguuuugcucu

SEQ ID NO: 722721 - RNA, 20 nt, Homo sapiens
gguaaaaaucuguaaauauc

SEQ ID NO: 722722 - RNA, 19 nt, Homo sapiens
gguaaagggaggacagcuu

SEQ ID NO: 722723 - RNA, 18 nt, Homo sapiens
gguaaauaaaauuuaacu

SEQ ID NO: 722724 - RNA, 17 nt, Homo sapiens
gguaaauacugugaaau

SEQ ID NO: 722725 - RNA, 18 nt, Homo sapiens
gguaagaagaaagcaaaa

SEQ ID NO: 722726 - RNA, 14 nt, Homo sapiens
gguaagaaguuuua

SEQ ID NO: 722727 - RNA, 16 nt, Homo sapiens
gguaaguugagauguu

SEQ ID NO: 722728 - RNA, 19 nt, Homo sapiens
gguaauaaguacuguguac

SEQ ID NO: 722729 - RNA, 14 nt, Homo sapiens
gguaaucagcauua

SEQ ID NO: 722730 - RNA, 15 nt, Homo sapiens
gguaaugugaauaaa

SEQ ID NO: 722731 - RNA, 17 nt, Homo sapiens
gguacaaacccaaaaaa

SEQ ID NO: 722732 - RNA, 22 nt, Homo sapiens
gguacaguuugauuuuugacca

SEQ ID NO: 722733 - RNA, 23 nt, Homo sapiens
gguacauucuagcugagaagcaa

SEQ ID NO: 722734 - RNA, 21 nt, Homo sapiens
gguacuuuuaugauguauauu

SEQ ID NO: 722735 - RNA, 22 nt, Homo sapiens
gguagaaggggaggacacuggu

SEQ ID NO: 722736 - RNA, 17 nt, Homo sapiens
gguagagucauguuugc

SEQ ID NO: 722737 - RNA, 16 nt, Homo sapiens
gguagcuuaccugaca

SEQ ID NO: 722738 - RNA, 21 nt, Homo sapiens
gguagcuuaccugacacaaga

SEQ ID NO: 722739 - RNA, 15 nt, Homo sapiens
gguagguugggacac

SEQ ID NO: 722740 - RNA, 19 nt, Homo sapiens
gguaguacuccugcaaaau

SEQ ID NO: 722741 - RNA, 22 nt, Homo sapiens
gguaguuuagaucccaugucac

SEQ ID NO: 722742 - RNA, 13 nt, Homo sapiens
gguauaaugauac

SEQ ID NO: 722743 - RNA, 17 nt, Homo sapiens
gguauccugggggaccc

SEQ ID NO: 722744 - RNA, 13 nt, Homo sapiens
gguaucugugaac

SEQ ID NO: 722745 - RNA, 18 nt, Homo sapiens
gguaucugugaacauguu

SEQ ID NO: 722746 - RNA, 23 nt, Homo sapiens
gguaugcuugaaaguagcaauua

SEQ ID NO: 722747 - RNA, 21 nt, Homo sapiens
gguauuaaauugauguugcug

SEQ ID NO: 722748 - RNA, 23 nt, Homo sapiens
gguauuaacuuuauacacuugga

SEQ ID NO: 722749 - RNA, 18 nt, Homo sapiens
gguauuagcaaagcaaaa

SEQ ID NO: 722750 - RNA, 21 nt, Homo sapiens
ggucaagagaguucugaccug

SEQ ID NO: 722751 - RNA, 19 nt, Homo sapiens
gccuguaaucccagcacuu

SEQ ID NO: 722752 - RNA, 19 nt, Homo sapiens
gccuguaaucucagcacuu

SEQ ID NO: 722753 - RNA, 21 nt, Homo sapiens
gccuguaaucucagcacuuug

SEQ ID NO: 722754 - RNA, 22 nt, Homo sapiens
gccuguagucccagcuacucag

SEQ ID NO: 722755 - RNA, 19 nt, Homo sapiens
gccuguccaacauggugaa

SEQ ID NO: 722756 - RNA, 17 nt, Homo sapiens
gccugucuccuuugcag

SEQ ID NO: 722757 - RNA, 19 nt, Homo sapiens
gccugucucuagcuguucu

SEQ ID NO: 722758 - RNA, 12 nt, Homo sapiens
gccugugaagca

SEQ ID NO: 722759 - RNA, 12 nt, Homo sapiens
gccugugcaaug

SEQ ID NO: 722760 - RNA, 13 nt, Homo sapiens
gccugugcaugua

SEQ ID NO: 722761 - RNA, 12 nt, Homo sapiens
gccugugccuuu

SEQ ID NO: 722762 - RNA, 20 nt, Homo sapiens
gccugugcgccgggggaccu

SEQ ID NO: 722763 - RNA, 14 nt, Homo sapiens
gccugugcugugac

SEQ ID NO: 722764 - RNA, 18 nt, Homo sapiens
gccugugcugugacucga

SEQ ID NO: 722765 - RNA, 21 nt, Homo sapiens
gccuguggaggaacuuuucaa

SEQ ID NO: 722766 - RNA, 20 nt, Homo sapiens
gccugugggcgcauacuaca

SEQ ID NO: 722767 - RNA, 18 nt, Homo sapiens
gccugugguuaacaucuc

SEQ ID NO: 722768 - RNA, 20 nt, Homo sapiens
gccugugguuaacaucucag

SEQ ID NO: 722769 - RNA, 20 nt, Homo sapiens
gccuguuauaacucugcacu

SEQ ID NO: 722770 - RNA, 14 nt, Homo sapiens
gccuguugaaucug

SEQ ID NO: 722771 - RNA, 20 nt, Homo sapiens
gccuguuggauaaagaccuu

SEQ ID NO: 722772 - RNA, 23 nt, Homo sapiens
gccuguuggcaggcccacucccc

SEQ ID NO: 722773 - RNA, 20 nt, Homo sapiens
gccuuaaaccuaccucccac

SEQ ID NO: 722774 - RNA, 23 nt, Homo sapiens
gccuuacaaagggaaagccucug

SEQ ID NO: 722775 - RNA, 17 nt, Homo sapiens
gcuacugucucacugaa

SEQ ID NO: 722776 - RNA, 20 nt, Homo sapiens
gcuagaaaaaaaaaacacuu

SEQ ID NO: 722777 - RNA, 19 nt, Homo sapiens
gcuagaacacuacagggga

SEQ ID NO: 722778 - RNA, 20 nt, Homo sapiens
gcuagaauauccuauacugg

SEQ ID NO: 722779 - RNA, 18 nt, Homo sapiens
gcuagagaaggaccagaa

SEQ ID NO: 722780 - RNA, 17 nt, Homo sapiens
gcuagcuucugcaaugu

SEQ ID NO: 722781 - RNA, 15 nt, Homo sapiens
gcuaggcggagcuca

SEQ ID NO: 722782 - RNA, 14 nt, Homo sapiens
gcuagggaccucgc

SEQ ID NO: 722783 - RNA, 14 nt, Homo sapiens
gcuagucacuggca

SEQ ID NO: 722784 - RNA, 12 nt, Homo sapiens
gcuagugcugua

SEQ ID NO: 722785 - RNA, 11 nt, Homo sapiens
gcuaguguuua

SEQ ID NO: 722786 - RNA, 22 nt, Homo sapiens
gcuaguuuauuggaaguguuca

SEQ ID NO: 722787 - RNA, 18 nt, Homo sapiens
gcuauaauaaagaagugu

SEQ ID NO: 722788 - RNA, 14 nt, Homo sapiens
gcuauacugcacuu

SEQ ID NO: 722789 - RNA, 13 nt, Homo sapiens
gcuauagcacaca

SEQ ID NO: 722790 - RNA, 14 nt, Homo sapiens
gcuauagcuacagg

SEQ ID NO: 722791 - RNA, 22 nt, Homo sapiens
gcuaucaucauccuacaacuca

SEQ ID NO: 722792 - RNA, 17 nt, Homo sapiens
gcuaucgcaccacugug

SEQ ID NO: 722793 - RNA, 11 nt, Homo sapiens
gcuaucucugu

SEQ ID NO: 722794 - RNA, 22 nt, Homo sapiens
gcuaugaaaacagcuaucucac

SEQ ID NO: 722795 - RNA, 23 nt, Homo sapiens
gcuaugcggaggaaagcaagugu

SEQ ID NO: 722796 - RNA, 17 nt, Homo sapiens
gcuaugcuaaaccuccu

SEQ ID NO: 722797 - RNA, 18 nt, Homo sapiens
gcuauggaaacuuuugua

SEQ ID NO: 722798 - RNA, 19 nt, Homo sapiens
gcuauguucugucuuccca

SEQ ID NO: 722799 - RNA, 18 nt, Homo sapiens
gcuauuaagaaaaucaca

SEQ ID NO: 722800 - RNA, 21 nt, Homo sapiens
gcuauuacagugccacugcaa

SEQ ID NO: 722801 - RNA, 14 nt, Homo sapiens
gcuauucaccucag

SEQ ID NO: 722802 - RNA, 20 nt, Homo sapiens
gcuauucccucaaaucugag

SEQ ID NO: 722803 - RNA, 13 nt, Homo sapiens
gcuauugcugcug

SEQ ID NO: 722804 - RNA, 15 nt, Homo sapiens
gcuauuguagagcca

SEQ ID NO: 722805 - RNA, 21 nt, Homo sapiens
gcuauuuaauaucuggcacug

SEQ ID NO: 722806 - RNA, 11 nt, Homo sapiens
gcuauuugccu

SEQ ID NO: 722807 - RNA, 22 nt, Homo sapiens
gcuauuuuauuuguauucauga

SEQ ID NO: 722808 - RNA, 22 nt, Homo sapiens
gcucaacagaacauauguugca

SEQ ID NO: 722809 - RNA, 14 nt, Homo sapiens
gcucaacauugugu

SEQ ID NO: 722810 - RNA, 16 nt, Homo sapiens
gcucaagaacacaugu

SEQ ID NO: 722811 - RNA, 17 nt, Homo sapiens
gcucaagaggccacuua

SEQ ID NO: 722812 - RNA, 12 nt, Homo sapiens
gcucaagcugac

SEQ ID NO: 722813 - RNA, 16 nt, Homo sapiens
gcucaauagcuugaag

SEQ ID NO: 722814 - RNA, 23 nt, Homo sapiens
gcucaauagcuugaagcccaaga

SEQ ID NO: 722815 - RNA, 15 nt, Homo sapiens
gcucaauauuccuga

SEQ ID NO: 722816 - RNA, 21 nt, Homo sapiens
gcucaauuuugucuguacuca

SEQ ID NO: 722817 - RNA, 16 nt, Homo sapiens
gcucacacccuaccuu

SEQ ID NO: 722818 - RNA, 14 nt, Homo sapiens
gcucacaguuauua

SEQ ID NO: 722819 - RNA, 15 nt, Homo sapiens
gcucacauccagccu

SEQ ID NO: 722820 - RNA, 17 nt, Homo sapiens
gcucaccgcccaucagg

SEQ ID NO: 722821 - RNA, 14 nt, Homo sapiens
gcucaccguggauu

SEQ ID NO: 722822 - RNA, 13 nt, Homo sapiens
gcucacuaugaau

SEQ ID NO: 722823 - RNA, 13 nt, Homo sapiens
gcucacucagcca

SEQ ID NO: 722824 - RNA, 12 nt, Homo sapiens
gcucacuucuaa

SEQ ID NO: 722825 - RNA, 16 nt, Homo sapiens
gcucagaacuugcugc

SEQ ID NO: 722826 - RNA, 13 nt, Homo sapiens
gcucagacauuuu

SEQ ID NO: 722827 - RNA, 19 nt, Homo sapiens
gcucagaucucaugggaua

SEQ ID NO: 722828 - RNA, 16 nt, Homo sapiens
gcucagcccugcacca

SEQ ID NO: 722829 - RNA, 19 nt, Homo sapiens
gcucaggacagaugccaca

SEQ ID NO: 722830 - RNA, 22 nt, Homo sapiens
gcucaggaggcuuggaaagcau

SEQ ID NO: 722831 - RNA, 14 nt, Homo sapiens
gcucaggcauuuga

SEQ ID NO: 722832 - RNA, 19 nt, Homo sapiens
gcucaggguuaauguagug

SEQ ID NO: 722833 - RNA, 16 nt, Homo sapiens
gcucaggugguugugg

SEQ ID NO: 722834 - RNA, 21 nt, Homo sapiens
gcucagguuuugagaagccau

SEQ ID NO: 722835 - RNA, 23 nt, Homo sapiens
gcucaguaaacgggaacaugccc

SEQ ID NO: 722836 - RNA, 18 nt, Homo sapiens
gcucauaggaccugcauc

SEQ ID NO: 722837 - RNA, 21 nt, Homo sapiens
gcucauaugcauguagucacu

SEQ ID NO: 722838 - RNA, 15 nt, Homo sapiens
gcucaugagcgucug

SEQ ID NO: 722839 - RNA, 20 nt, Homo sapiens
gcucaugucuauaaucccag

SEQ ID NO: 722840 - RNA, 18 nt, Homo sapiens
gcucauugcuaaccacug

SEQ ID NO: 722841 - RNA, 16 nt, Homo sapiens
gcucauuuugacaaag

SEQ ID NO: 722842 - RNA, 21 nt, Homo sapiens
gcuccaacccccgccaccuca

SEQ ID NO: 722843 - RNA, 12 nt, Homo sapiens
gcuccagcaaca

SEQ ID NO: 722844 - RNA, 17 nt, Homo sapiens
gcuccagcaacugcccu

SEQ ID NO: 722845 - RNA, 21 nt, Homo sapiens
gcuccagcugcucugucuucu

SEQ ID NO: 722846 - RNA, 19 nt, Homo sapiens
gcuccagggaauccaagcc

SEQ ID NO: 722847 - RNA, 23 nt, Homo sapiens
gcuccagggcagccuccaccuug

SEQ ID NO: 722848 - RNA, 19 nt, Homo sapiens
gcuccaucccaaccaggca

SEQ ID NO: 722849 - RNA, 20 nt, Homo sapiens
gcuccauugguguugacaua

SEQ ID NO: 722850 - RNA, 13 nt, Homo sapiens
gcucccaccacca

SEQ ID NO: 722851 - RNA, 12 nt, Homo sapiens
gcucccaugacc

SEQ ID NO: 722852 - RNA, 13 nt, Homo sapiens
gcuccccaaaggg

SEQ ID NO: 722853 - RNA, 14 nt, Homo sapiens
gcuccccaaagggu

SEQ ID NO: 722854 - RNA, 20 nt, Homo sapiens
gcuccccacaccuuccaggg

SEQ ID NO: 722855 - RNA, 17 nt, Homo sapiens
gcucccuaggagaccaa

SEQ ID NO: 722856 - RNA, 21 nt, Homo sapiens
gcucccuccucuccuacccac

SEQ ID NO: 722857 - RNA, 14 nt, Homo sapiens
gcucccuguccuag

SEQ ID NO: 722858 - RNA, 14 nt, Homo sapiens
gcucccuuccugcc

SEQ ID NO: 722859 - RNA, 16 nt, Homo sapiens
gcucccuuccugccac

SEQ ID NO: 722860 - RNA, 17 nt, Homo sapiens
gcuccgaggacccagga

SEQ ID NO: 722861 - RNA, 17 nt, Homo sapiens
gcuccguguuccucggu

SEQ ID NO: 722862 - RNA, 15 nt, Homo sapiens
gcuccuauaggacca

SEQ ID NO: 722863 - RNA, 22 nt, Homo sapiens
gcuccucuaguaagaugcacug

SEQ ID NO: 722864 - RNA, 15 nt, Homo sapiens
gcuccugucugccag

SEQ ID NO: 722865 - RNA, 15 nt, Homo sapiens
gcuccuuccagaccu

SEQ ID NO: 722866 - RNA, 19 nt, Homo sapiens
gcucgcauuugucaaugac

SEQ ID NO: 722867 - RNA, 23 nt, Homo sapiens
gcucguucucuucucucuucaau

SEQ ID NO: 722868 - RNA, 15 nt, Homo sapiens
cagcgaccccaggac

SEQ ID NO: 722869 - RNA, 18 nt, Homo sapiens
cagcgagacuccgucuca

SEQ ID NO: 722870 - RNA, 15 nt, Homo sapiens
cagcgauggugcugc

SEQ ID NO: 722871 - RNA, 16 nt, Homo sapiens
cagcgcagaacagccc

SEQ ID NO: 722872 - RNA, 18 nt, Homo sapiens
cagcgcaugugugcaugu

SEQ ID NO: 722873 - RNA, 17 nt, Homo sapiens
cagcgccuuuccugcca

SEQ ID NO: 722874 - RNA, 14 nt, Homo sapiens
cagcgggugcugcu

SEQ ID NO: 722875 - RNA, 16 nt, Homo sapiens
cagcgucaacaucgug

SEQ ID NO: 722876 - RNA, 17 nt, Homo sapiens
cagcgucacuccagugc

SEQ ID NO: 722877 - RNA, 18 nt, Homo sapiens
cagcgucccuagcaguga

SEQ ID NO: 722878 - RNA, 23 nt, Homo sapiens
cagcguggaugucgaugacuuca

SEQ ID NO: 722879 - RNA, 21 nt, Homo sapiens
cagcuaauugagaccacaggc

SEQ ID NO: 722880 - RNA, 16 nt, Homo sapiens
cagcuacaaauuugag

SEQ ID NO: 722881 - RNA, 22 nt, Homo sapiens
cagcuacgaauauagaggguuu

SEQ ID NO: 722882 - RNA, 22 nt, Homo sapiens
cagcuacgugggaggcugaggc

SEQ ID NO: 722883 - RNA, 14 nt, Homo sapiens
cagcuacucaggag

SEQ ID NO: 722884 - RNA, 24 nt, Homo sapiens
cagcuacucaggaggcugaggcag

SEQ ID NO: 722885 - RNA, 15 nt, Homo sapiens
cagcuaucucucagu

SEQ ID NO: 722886 - RNA, 20 nt, Homo sapiens
cagcucaacucacagcuucu

SEQ ID NO: 722887 - RNA, 17 nt, Homo sapiens
cagcucccauuucauca

SEQ ID NO: 722888 - RNA, 23 nt, Homo sapiens
cagcucccucgucuucagcugca

SEQ ID NO: 722889 - RNA, 17 nt, Homo sapiens
cagcucccucugccuga

SEQ ID NO: 722890 - RNA, 18 nt, Homo sapiens
cagcuccgcaagcaucau

SEQ ID NO: 722891 - RNA, 21 nt, Homo sapiens
cagcucugcauuaucugaggu

SEQ ID NO: 722892 - RNA, 18 nt, Homo sapiens
cagcucuguaucugccau

SEQ ID NO: 722893 - RNA, 13 nt, Homo sapiens
cagcugaaauuga

SEQ ID NO: 722894 - RNA, 20 nt, Homo sapiens
cagcugaccuuugucaucuu

SEQ ID NO: 722895 - RNA, 20 nt, Homo sapiens
cacuuugggaggcugaggcg

SEQ ID NO: 722896 - RNA, 24 nt, Homo sapiens
cacuuuuuuuuuuucugccugaga

SEQ ID NO: 722897 - RNA, 19 nt, Homo sapiens
cagaaaaaaaagugucuca

SEQ ID NO: 722898 - RNA, 20 nt, Homo sapiens
cagaaaaacucugggaaaua

SEQ ID NO: 722899 - RNA, 16 nt, Homo sapiens
cagaaaacaaaagaga

SEQ ID NO: 722900 - RNA, 15 nt, Homo sapiens
cagaaaagugauuag

SEQ ID NO: 722901 - RNA, 20 nt, Homo sapiens
cagaaaagugauuaguacua

SEQ ID NO: 722902 - RNA, 20 nt, Homo sapiens
cagaaaauauuauguguuuc

SEQ ID NO: 722903 - RNA, 16 nt, Homo sapiens
cagaaacaaaaagccc

SEQ ID NO: 722904 - RNA, 20 nt, Homo sapiens
cagaaacuugugaaguggaa

SEQ ID NO: 722905 - RNA, 21 nt, Homo sapiens
cagaaagaacuuuaaagcuca

SEQ ID NO: 722906 - RNA, 20 nt, Homo sapiens
cagaaagagacuccgucuca

SEQ ID NO: 722907 - RNA, 22 nt, Homo sapiens
cagaaagcaggagcagcugugc

SEQ ID NO: 722908 - RNA, 19 nt, Homo sapiens
cagaaagcuccuuccagac

SEQ ID NO: 722909 - RNA, 23 nt, Homo sapiens
cagaaagugauaagugcagggag

SEQ ID NO: 722910 - RNA, 16 nt, Homo sapiens
cagaaaguuauugaua

SEQ ID NO: 722911 - RNA, 23 nt, Homo sapiens
cagaaaguucaacuuccaaaggg

SEQ ID NO: 722912 - RNA, 21 nt, Homo sapiens
cagaaauaauaaaaaauuuca

SEQ ID NO: 722913 - RNA, 16 nt, Homo sapiens
cagaaauacagauaaa

SEQ ID NO: 722914 - RNA, 21 nt, Homo sapiens
cagaaaucuagaagacuguca

SEQ ID NO: 722915 - RNA, 17 nt, Homo sapiens
cagaaaugcauuuguaa

SEQ ID NO: 722916 - RNA, 12 nt, Homo sapiens
cagaaaugcugc

SEQ ID NO: 722917 - RNA, 21 nt, Homo sapiens
cagaaaugucuaaaugcugaa

SEQ ID NO: 722918 - RNA, 15 nt, Homo sapiens
cagaaauucuagcgc

SEQ ID NO: 722919 - RNA, 18 nt, Homo sapiens
cagaaauuuaauucaugu

SEQ ID NO: 722920 - RNA, 21 nt, Homo sapiens
cagaaauuuggcauugaucuu

SEQ ID NO: 722921 - RNA, 16 nt, Homo sapiens
cagaacaaacauuaaa

SEQ ID NO: 722922 - RNA, 14 nt, Homo sapiens
cagaacaccuaugc

SEQ ID NO: 722923 - RNA, 18 nt, Homo sapiens
cagaacacgagacagcuu

SEQ ID NO: 722924 - RNA, 19 nt, Homo sapiens
cagaacacugcagucagau

SEQ ID NO: 722925 - RNA, 21 nt, Homo sapiens
cagaacagagugcaacccagu

SEQ ID NO: 722926 - RNA, 13 nt, Homo sapiens
caaguuguuuaaa

SEQ ID NO: 722927 - RNA, 19 nt, Homo sapiens
caaguuucugauaccacug

SEQ ID NO: 722928 - RNA, 19 nt, Homo sapiens
caauaaaaacaacuuucac

SEQ ID NO: 722929 - RNA, 22 nt, Homo sapiens
caauaaaaacaacuuucacuuc

SEQ ID NO: 722930 - RNA, 15 nt, Homo sapiens
caauaaacuuagagg

SEQ ID NO: 722931 - RNA, 18 nt, Homo sapiens
caauaaagauauuuccaa

SEQ ID NO: 722932 - RNA, 23 nt, Homo sapiens
caauaaaggacaggcuggugcua

SEQ ID NO: 722933 - RNA, 22 nt, Homo sapiens
caauaaagggagaauggugcug

SEQ ID NO: 722934 - RNA, 14 nt, Homo sapiens
caauaaaguacuuu

SEQ ID NO: 722935 - RNA, 13 nt, Homo sapiens
caauaaagugacc

SEQ ID NO: 722936 - RNA, 18 nt, Homo sapiens
caauaaaugaaugaauaa

SEQ ID NO: 722937 - RNA, 14 nt, Homo sapiens
caauaacuuuucac

SEQ ID NO: 722938 - RNA, 17 nt, Homo sapiens
caauaauacaaagcaaa

SEQ ID NO: 722939 - RNA, 18 nt, Homo sapiens
caauaaucucuauuugag

SEQ ID NO: 722940 - RNA, 20 nt, Homo sapiens
caauaauggggcagacacaa

SEQ ID NO: 722941 - RNA, 18 nt, Homo sapiens
caauaauuacauuggcac

SEQ ID NO: 722942 - RNA, 14 nt, Homo sapiens
caauaauuucaggu

SEQ ID NO: 722943 - RNA, 14 nt, Homo sapiens
caauacaaauggau

SEQ ID NO: 722944 - RNA, 22 nt, Homo sapiens
caauacacggacacaaccaaau

SEQ ID NO: 722945 - RNA, 13 nt, Homo sapiens
caauacagaucau

SEQ ID NO: 722946 - RNA, 17 nt, Homo sapiens
caauacaugcugcuaau

SEQ ID NO: 722947 - RNA, 21 nt, Homo sapiens
caauacaugcugcuaauucaa

SEQ ID NO: 722948 - RNA, 14 nt, Homo sapiens
caauaccaaauagc

SEQ ID NO: 722949 - RNA, 15 nt, Homo sapiens
caauacucaaaagag

SEQ ID NO: 722950 - RNA, 11 nt, Homo sapiens
caauacuguag

SEQ ID NO: 722951 - RNA, 15 nt, Homo sapiens
caauacuguuuccau

SEQ ID NO: 722952 - RNA, 14 nt, Homo sapiens
caauagagacugua

SEQ ID NO: 722953 - RNA, 15 nt, Homo sapiens
caauagagacuguag

SEQ ID NO: 722954 - RNA, 12 nt, Homo sapiens
caauagcuugaa

SEQ ID NO: 722955 - RNA, 16 nt, Homo sapiens
caauagguaaagcuau

SEQ ID NO: 722956 - RNA, 19 nt, Homo sapiens
caauagucucucugcaaga

SEQ ID NO: 722957 - RNA, 16 nt, Homo sapiens
caauagugcaacaucu

SEQ ID NO: 722958 - RNA, 18 nt, Homo sapiens
caauagugcaacaucucu

SEQ ID NO: 722959 - RNA, 19 nt, Homo sapiens
caauauccuuuuacugcag

SEQ ID NO: 722960 - RNA, 14 nt, Homo sapiens
caauaucuugccag

SEQ ID NO: 722961 - RNA, 21 nt, Homo sapiens
caauauuaaauacagacacua

SEQ ID NO: 722962 - RNA, 13 nt, Homo sapiens
caagagaauagcu

SEQ ID NO: 722963 - RNA, 18 nt, Homo sapiens
caagagauaagucuuuca

SEQ ID NO: 722964 - RNA, 19 nt, Homo sapiens
caagagauaagucuuucau

SEQ ID NO: 722965 - RNA, 16 nt, Homo sapiens
caagagaucuacacau

SEQ ID NO: 722966 - RNA, 23 nt, Homo sapiens
caagagauuguuguuugccauac

SEQ ID NO: 722967 - RNA, 15 nt, Homo sapiens
caagagccugaguga

SEQ ID NO: 722968 - RNA, 13 nt, Homo sapiens
caagagccuucaa

SEQ ID NO: 722969 - RNA, 19 nt, Homo sapiens
caagaguaagcaguguuac

SEQ ID NO: 722970 - RNA, 22 nt, Homo sapiens
caagagugagacuccaccucaa

SEQ ID NO: 722971 - RNA, 18 nt, Homo sapiens
caagagugauugcagcuu

SEQ ID NO: 722972 - RNA, 17 nt, Homo sapiens
caagauacagccugcaa

SEQ ID NO: 722973 - RNA, 19 nt, Homo sapiens
caagaugagaacagauaaa

SEQ ID NO: 722974 - RNA, 12 nt, Homo sapiens
caagaugagauu

SEQ ID NO: 722975 - RNA, 16 nt, Homo sapiens
caagaugcaacuagga

SEQ ID NO: 722976 - RNA, 21 nt, Homo sapiens
caagauggaugcgacccaaga

SEQ ID NO: 722977 - RNA, 13 nt, Homo sapiens
caagaugguccau

SEQ ID NO: 722978 - RNA, 21 nt, Homo sapiens
caagaugugaauuauugacac

SEQ ID NO: 722979 - RNA, 13 nt, Homo sapiens
caagauguguucu

SEQ ID NO: 722980 - RNA, 18 nt, Homo sapiens
caagauucagacuccagc

SEQ ID NO: 722981 - RNA, 17 nt, Homo sapiens
caagauugcaccacugc

SEQ ID NO: 722982 - RNA, 20 nt, Homo sapiens
caagauugcgccauugcacu

SEQ ID NO: 722983 - RNA, 16 nt, Homo sapiens
caagauuuucuacuuu

SEQ ID NO: 722984 - RNA, 20 nt, Homo sapiens
caagauuuugggagaguaaa

SEQ ID NO: 722985 - RNA, 19 nt, Homo sapiens
caagcaaaugggggaaaag

SEQ ID NO: 722986 - RNA, 13 nt, Homo sapiens
caagcacaaagcu

SEQ ID NO: 722987 - RNA, 15 nt, Homo sapiens
caagcacauguaaua

SEQ ID NO: 722988 - RNA, 14 nt, Homo sapiens
caagcacugugguc

SEQ ID NO: 722989 - RNA, 18 nt, Homo sapiens
caagcacuuuaauggccu

SEQ ID NO: 722990 - RNA, 17 nt, Homo sapiens
caagcagucaguuugca

SEQ ID NO: 722991 - RNA, 22 nt, Homo sapiens
caagcagugccugccuaugaaa

SEQ ID NO: 722992 - RNA, 20 nt, Homo sapiens
caagcauaccaacacgagca

SEQ ID NO: 722993 - RNA, 16 nt, Homo sapiens
caagcaugaagugcug

SEQ ID NO: 722994 - RNA, 13 nt, Homo sapiens
caagcaugcuugu

SEQ ID NO: 722995 - RNA, 21 nt, Homo sapiens
caagccagcccccuccagcuc

SEQ ID NO: 722996 - RNA, 23 nt, Homo sapiens
caagccagccuugcuccuggcug

SEQ ID NO: 722997 - RNA, 18 nt, Homo sapiens
caagccaguacgugcuaa

SEQ ID NO: 722998 - RNA, 17 nt, Homo sapiens
caagccauucacuuccc

SEQ ID NO: 722999 - RNA, 23 nt, Homo sapiens
caaagcacagcugggcaugccau

SEQ ID NO: 723000 - RNA, 18 nt, Homo sapiens
caaagcacgaaauguuau

SEQ ID NO: 723001 - RNA, 14 nt, Homo sapiens
caaagcacuguuga

SEQ ID NO: 723002 - RNA, 18 nt, Homo sapiens
caaagcauggacauuuag

SEQ ID NO: 723003 - RNA, 21 nt, Homo sapiens
caaagccacccuaccaugaau

SEQ ID NO: 723004 - RNA, 18 nt, Homo sapiens
caaagcuaggaugguucu

SEQ ID NO: 723005 - RNA, 23 nt, Homo sapiens
caaagcucaagaugacagcucuu

SEQ ID NO: 723006 - RNA, 22 nt, Homo sapiens
caaagcugaugacaacuuccca

SEQ ID NO: 723007 - RNA, 17 nt, Homo sapiens
caaagcuugucaaagau

SEQ ID NO: 723008 - RNA, 17 nt, Homo sapiens
caaaggaacacugacau

SEQ ID NO: 723009 - RNA, 23 nt, Homo sapiens
caaaggaacauugugucuaggau

SEQ ID NO: 723010 - RNA, 20 nt, Homo sapiens
caaaggaaguccaaccugag

SEQ ID NO: 723011 - RNA, 14 nt, Homo sapiens
caaaggagcuuucu

SEQ ID NO: 723012 - RNA, 17 nt, Homo sapiens
caaaggagcuuucucaa

SEQ ID NO: 723013 - RNA, 20 nt, Homo sapiens
caaaggcaagcguauaucaa

SEQ ID NO: 723014 - RNA, 16 nt, Homo sapiens
caaaggcccucaguga

SEQ ID NO: 723015 - RNA, 17 nt, Homo sapiens
caaaggcugaacuggau

SEQ ID NO: 723016 - RNA, 15 nt, Homo sapiens
caaagggauguucac

SEQ ID NO: 723017 - RNA, 18 nt, Homo sapiens
caaagggcccacagugac

SEQ ID NO: 723018 - RNA, 17 nt, Homo sapiens
caaaggggacagcugug

SEQ ID NO: 723019 - RNA, 17 nt, Homo sapiens
caaaggugguaaauuca

SEQ ID NO: 723020 - RNA, 15 nt, Homo sapiens
caaagguugcagugc

SEQ ID NO: 723021 - RNA, 22 nt, Homo sapiens
caaaguagggaugcggauccug

SEQ ID NO: 723022 - RNA, 15 nt, Homo sapiens
caaagucaucaaaga

SEQ ID NO: 723023 - RNA, 14 nt, Homo sapiens
caaaguccuuaaca

SEQ ID NO: 723024 - RNA, 17 nt, Homo sapiens
caaagucuccagcccac

SEQ ID NO: 723025 - RNA, 15 nt, Homo sapiens
caaagugcugagauu

SEQ ID NO: 723026 - RNA, 18 nt, Homo sapiens
caaagugcuggcauuaca

SEQ ID NO: 723027 - RNA, 16 nt, Homo sapiens
caaaguguuaaucuua

SEQ ID NO: 723028 - RNA, 14 nt, Homo sapiens
caaauaaaaaccca

SEQ ID NO: 723029 - RNA, 14 nt, Homo sapiens
caaauaaaauauca

SEQ ID NO: 723030 - RNA, 15 nt, Homo sapiens
caaauaaagaccuga

SEQ ID NO: 723031 - RNA, 17 nt, Homo sapiens
caaauaaaguaccauua

SEQ ID NO: 723032 - RNA, 16 nt, Homo sapiens
caaauaaagugcaguu

SEQ ID NO: 723033 - RNA, 18 nt, Homo sapiens
caaauaaagugcaguuua

SEQ ID NO: 723034 - RNA, 16 nt, Homo sapiens
caaauaagaggacaga

SEQ ID NO: 723035 - RNA, 21 nt, Homo sapiens
caaauaagaggacagauaacu

SEQ ID NO: 723036 - RNA, 22 nt, Homo sapiens
caaauaaguauuuauaauagca

SEQ ID NO: 723037 - RNA, 22 nt, Homo sapiens
caaauaauagaauugcucccua

SEQ ID NO: 723038 - RNA, 12 nt, Homo sapiens
gcacaaugucau

SEQ ID NO: 723039 - RNA, 15 nt, Homo sapiens
gcacaauuccaugac

SEQ ID NO: 723040 - RNA, 17 nt, Homo sapiens
gcacacacacaaacaca

SEQ ID NO: 723041 - RNA, 19 nt, Homo sapiens
gcacacacacacaucucau

SEQ ID NO: 723042 - RNA, 19 nt, Homo sapiens
gcacacagcugagcacuua

SEQ ID NO: 723043 - RNA, 19 nt, Homo sapiens
gcacacccaugcacacuca

SEQ ID NO: 723044 - RNA, 18 nt, Homo sapiens
gcacaccgggccaaguga

SEQ ID NO: 723045 - RNA, 19 nt, Homo sapiens
gcacacuuuuccacauucc

SEQ ID NO: 723046 - RNA, 16 nt, Homo sapiens
gcacagaccaguuuca

SEQ ID NO: 723047 - RNA, 16 nt, Homo sapiens
gcacagaguggcuugg

SEQ ID NO: 723048 - RNA, 23 nt, Homo sapiens
gcacagcccugggagggggcuau

SEQ ID NO: 723049 - RNA, 22 nt, Homo sapiens
gcacagcucccggcgggugcuc

SEQ ID NO: 723050 - RNA, 16 nt, Homo sapiens
gcacaggccuaggaga

SEQ ID NO: 723051 - RNA, 22 nt, Homo sapiens
gcacaggguccccgagugccua

SEQ ID NO: 723052 - RNA, 19 nt, Homo sapiens
gcacaguagagcaaaucua

SEQ ID NO: 723053 - RNA, 22 nt, Homo sapiens
gcacaguggcggcaacauugaa

SEQ ID NO: 723054 - RNA, 15 nt, Homo sapiens
gcacauaacaugcuu

SEQ ID NO: 723055 - RNA, 22 nt, Homo sapiens
gcacauauccaggcaccaggac

SEQ ID NO: 723056 - RNA, 21 nt, Homo sapiens
gcacaucaauuacaagcugua

SEQ ID NO: 723057 - RNA, 22 nt, Homo sapiens
gcacaucugcauuuucacccca

SEQ ID NO: 723058 - RNA, 20 nt, Homo sapiens
gcacauguaauaaauucaaa

SEQ ID NO: 723059 - RNA, 20 nt, Homo sapiens
gcacauuccccuugccuaaa

SEQ ID NO: 723060 - RNA, 13 nt, Homo sapiens
gcacauuucugga

SEQ ID NO: 723061 - RNA, 14 nt, Homo sapiens
gcacauuucuuugc

SEQ ID NO: 723062 - RNA, 22 nt, Homo sapiens
gcacauuugucaguauuuuugc

SEQ ID NO: 723063 - RNA, 13 nt, Homo sapiens
gcaccaaccugca

SEQ ID NO: 723064 - RNA, 21 nt, Homo sapiens
gcaccaccaggagcagcagcc

SEQ ID NO: 723065 - RNA, 23 nt, Homo sapiens
gcaccacucucuucauccugggg

SEQ ID NO: 723066 - RNA, 22 nt, Homo sapiens
gcaccagagagagauucuuccc

SEQ ID NO: 723067 - RNA, 23 nt, Homo sapiens
gcaccagagggauaaaaacaaua

SEQ ID NO: 723068 - RNA, 16 nt, Homo sapiens
gcaccaucagccuguu

SEQ ID NO: 723069 - RNA, 13 nt, Homo sapiens
gcaccaucucuga

SEQ ID NO: 723070 - RNA, 14 nt, Homo sapiens
gcaccaugcugcug

SEQ ID NO: 723071 - RNA, 20 nt, Homo sapiens
gcaccauucuccugccucag

SEQ ID NO: 723072 - RNA, 22 nt, Homo sapiens
gcacccaggacuuccauuugcu

SEQ ID NO: 723073 - RNA, 20 nt, Homo sapiens
gcacccauccgcuccgugac

SEQ ID NO: 723074 - RNA, 21 nt, Homo sapiens
gcaccccaugugggugaccag

SEQ ID NO: 723075 - RNA, 20 nt, Homo sapiens
gcacccccugcuccaccagc

SEQ ID NO: 723076 - RNA, 13 nt, Homo sapiens
gcaccccggccuc

SEQ ID NO: 723077 - RNA, 14 nt, Homo sapiens
gcacccucccaguu

SEQ ID NO: 723078 - RNA, 17 nt, Homo sapiens
gcacccugcccaccaag

SEQ ID NO: 723079 - RNA, 21 nt, Homo sapiens
gcacccugcgccuccagaggu

SEQ ID NO: 723080 - RNA, 16 nt, Homo sapiens
gcacccuggacaaaga

SEQ ID NO: 723081 - RNA, 13 nt, Homo sapiens
gcaccguggucag

SEQ ID NO: 723082 - RNA, 14 nt, Homo sapiens
gcaccuaaagccua

SEQ ID NO: 723083 - RNA, 21 nt, Homo sapiens
gcaccuaauccaggcagaucc

SEQ ID NO: 723084 - RNA, 12 nt, Homo sapiens
gcaccuaccuca

SEQ ID NO: 723085 - RNA, 14 nt, Homo sapiens
gcaccuauucugua

SEQ ID NO: 723086 - RNA, 13 nt, Homo sapiens
gcaccugauucuc

SEQ ID NO: 723087 - RNA, 16 nt, Homo sapiens
gcaccugauucucaca

SEQ ID NO: 723088 - RNA, 17 nt, Homo sapiens
gcaccuguacucaggag

SEQ ID NO: 723089 - RNA, 13 nt, Homo sapiens
gcaccuuugcaca

SEQ ID NO: 723090 - RNA, 14 nt, Homo sapiens
gcaccuuugcacgu

SEQ ID NO: 723091 - RNA, 12 nt, Homo sapiens
gcacgcacacac

SEQ ID NO: 723092 - RNA, 14 nt, Homo sapiens
gcacgcccuccuca

SEQ ID NO: 723093 - RNA, 13 nt, Homo sapiens
gcacggacucucc

SEQ ID NO: 723094 - RNA, 22 nt, Homo sapiens
gcacguggccucuugagcagug

SEQ ID NO: 723095 - RNA, 22 nt, Homo sapiens
gcacguguggccuguucuucua

SEQ ID NO: 723096 - RNA, 22 nt, Homo sapiens
gcacuaacucguguuuggagcu

SEQ ID NO: 723097 - RNA, 23 nt, Homo sapiens
gcaggggcuuguugcaggcugug

SEQ ID NO: 723098 - RNA, 21 nt, Homo sapiens
gcaggucacugucacugccga

SEQ ID NO: 723099 - RNA, 12 nt, Homo sapiens
gcaggugccucc

SEQ ID NO: 723100 - RNA, 13 nt, Homo sapiens
gcaggugccuugu

SEQ ID NO: 723101 - RNA, 11 nt, Homo sapiens
gcaggugcugc

SEQ ID NO: 723102 - RNA, 12 nt, Homo sapiens
gcaggugcugcg

SEQ ID NO: 723103 - RNA, 12 nt, Homo sapiens
gcaggugucaua

SEQ ID NO: 723104 - RNA, 18 nt, Homo sapiens
gcagguguguauuuacuu

SEQ ID NO: 723105 - RNA, 20 nt, Homo sapiens
gcaguaccaaaguaacugaa

SEQ ID NO: 723106 - RNA, 20 nt, Homo sapiens
gcaguagaaauaauaugcau

SEQ ID NO: 723107 - RNA, 23 nt, Homo sapiens
gcaguagaaggugccgugagcag

SEQ ID NO: 723108 - RNA, 18 nt, Homo sapiens
gcaguagccuucuucccu

SEQ ID NO: 723109 - RNA, 16 nt, Homo sapiens
gcaguaucacaggcca

SEQ ID NO: 723110 - RNA, 16 nt, Homo sapiens
gcaguaugcugucaug

SEQ ID NO: 723111 - RNA, 20 nt, Homo sapiens
gcagucacacuguuacucca

SEQ ID NO: 723112 - RNA, 13 nt, Homo sapiens
gcagucacagcua

SEQ ID NO: 723113 - RNA, 12 nt, Homo sapiens
gcagucacugga

SEQ ID NO: 723114 - RNA, 20 nt, Homo sapiens
gcagucagcgccagcacugu

SEQ ID NO: 723115 - RNA, 22 nt, Homo sapiens
gcagucagggugggaagaaaga

SEQ ID NO: 723116 - RNA, 19 nt, Homo sapiens
gcaguccugccucagccuc

SEQ ID NO: 723117 - RNA, 17 nt, Homo sapiens
gcagucugcuucagugc

SEQ ID NO: 723118 - RNA, 20 nt, Homo sapiens
gcagucugcuucagugcagu

SEQ ID NO: 723119 - RNA, 20 nt, Homo sapiens
gcagugaaugcuagacagaa

SEQ ID NO: 723120 - RNA, 15 nt, Homo sapiens
gcagugagcugagau

SEQ ID NO: 723121 - RNA, 16 nt, Homo sapiens
gcaguggaagcaguuu

SEQ ID NO: 723122 - RNA, 18 nt, Homo sapiens
gcaguggcgcgaucucag

SEQ ID NO: 723123 - RNA, 18 nt, Homo sapiens
gcaguggcgugaucucag

SEQ ID NO: 723124 - RNA, 22 nt, Homo sapiens
gcaguggcgugaucucagcuca

SEQ ID NO: 723125 - RNA, 17 nt, Homo sapiens
gcaguggcugugccacc

SEQ ID NO: 723126 - RNA, 14 nt, Homo sapiens
gcaguggugcaauc

SEQ ID NO: 723127 - RNA, 17 nt, Homo sapiens
gcaguggugccaucacc

SEQ ID NO: 723128 - RNA, 16 nt, Homo sapiens
gcagugucuguaccuc

SEQ ID NO: 723129 - RNA, 23 nt, Homo sapiens
gcaguuacagcucuguaguuuau

SEQ ID NO: 723130 - RNA, 12 nt, Homo sapiens
gcaguuagcuca

SEQ ID NO: 723131 - RNA, 17 nt, Homo sapiens
gcaguuagcucauuuga

SEQ ID NO: 723132 - RNA, 14 nt, Homo sapiens
gcaguuaggugcug

SEQ ID NO: 723133 - RNA, 14 nt, Homo sapiens
gcaguucaugaccc

SEQ ID NO: 723134 - RNA, 17 nt, Homo sapiens
gcaguugauaagaggaa

SEQ ID NO: 723135 - RNA, 17 nt, Homo sapiens
gcaguuguaccaaguga

SEQ ID NO: 723136 - RNA, 18 nt, Homo sapiens
gcaguuuaagagcagaac

SEQ ID NO: 723137 - RNA, 21 nt, Homo sapiens
gcaguuuugcuaucugggcug

SEQ ID NO: 723138 - RNA, 12 nt, Homo sapiens
gcauaaagccaa

SEQ ID NO: 723139 - RNA, 13 nt, Homo sapiens
gcauaaagccaaa

SEQ ID NO: 723140 - RNA, 14 nt, Homo sapiens
gcauaaagccaaau

SEQ ID NO: 723141 - RNA, 17 nt, Homo sapiens
gcauaacuaaauuauuu

SEQ ID NO: 723142 - RNA, 20 nt, Homo sapiens
gcauaagagcuuaagaacca

SEQ ID NO: 723143 - RNA, 17 nt, Homo sapiens
gcauaagcuaucaccua

SEQ ID NO: 723144 - RNA, 18 nt, Homo sapiens
gcauaaguuaacuuccaa

SEQ ID NO: 723145 - RNA, 21 nt, Homo sapiens
gcauaauguuucuggauuuca

SEQ ID NO: 723146 - RNA, 20 nt, Homo sapiens
gcauaauucuaagucuucca

SEQ ID NO: 723147 - RNA, 16 nt, Homo sapiens
gcauacaaagcaguuu

SEQ ID NO: 723148 - RNA, 14 nt, Homo sapiens
gcauacacacaggu

SEQ ID NO: 723149 - RNA, 16 nt, Homo sapiens
gcauacacacaugccc

SEQ ID NO: 723150 - RNA, 11 nt, Homo sapiens
gcauacuacag

SEQ ID NO: 723151 - RNA, 11 nt, Homo sapiens
gccacagccau

SEQ ID NO: 723152 - RNA, 18 nt, Homo sapiens
gccacagcccccuugccc

SEQ ID NO: 723153 - RNA, 19 nt, Homo sapiens
gccacagugucacugguca

SEQ ID NO: 723154 - RNA, 17 nt, Homo sapiens
gccacauggcugggauu

SEQ ID NO: 723155 - RNA, 19 nt, Homo sapiens
gccacauuucauugucuua

SEQ ID NO: 723156 - RNA, 18 nt, Homo sapiens
gccaccaagauguguucu

SEQ ID NO: 723157 - RNA, 13 nt, Homo sapiens
gccaccaguucuc

SEQ ID NO: 723158 - RNA, 14 nt, Homo sapiens
gccacccacugacc

SEQ ID NO: 723159 - RNA, 22 nt, Homo sapiens
gccacccaggcuggagugcagu

SEQ ID NO: 723160 - RNA, 17 nt, Homo sapiens
gccacccuuugguuauu

SEQ ID NO: 723161 - RNA, 21 nt, Homo sapiens
gccaccgagcaggggcagcuu

SEQ ID NO: 723162 - RNA, 14 nt, Homo sapiens
gccaccgcacucca

SEQ ID NO: 723163 - RNA, 16 nt, Homo sapiens
gccacucuuagcuaaa

SEQ ID NO: 723164 - RNA, 22 nt, Homo sapiens
gccacugccccccgaggcugcu

SEQ ID NO: 723165 - RNA, 11 nt, Homo sapiens
gccacugggca

SEQ ID NO: 723166 - RNA, 21 nt, Homo sapiens
gccacugggccugucacugau

SEQ ID NO: 723167 - RNA, 13 nt, Homo sapiens
gccacuguguacu

SEQ ID NO: 723168 - RNA, 20 nt, Homo sapiens
gccacuugaguuggggccau

SEQ ID NO: 723169 - RNA, 16 nt, Homo sapiens
gccacuugucaaagaa

SEQ ID NO: 723170 - RNA, 13 nt, Homo sapiens
gccagacucugcc

SEQ ID NO: 723171 - RNA, 16 nt, Homo sapiens
gccagagcugugccug

SEQ ID NO: 723172 - RNA, 19 nt, Homo sapiens
gccagaguagugaagcuaa

SEQ ID NO: 723173 - RNA, 14 nt, Homo sapiens
gccagagugcagug

SEQ ID NO: 723174 - RNA, 13 nt, Homo sapiens
gccagaguuccug

SEQ ID NO: 723175 - RNA, 15 nt, Homo sapiens
gccagaugcaggaca

SEQ ID NO: 723176 - RNA, 16 nt, Homo sapiens
gccagaugccucccca

SEQ ID NO: 723177 - RNA, 20 nt, Homo sapiens
gccagaugugaaaacaucuc

SEQ ID NO: 723178 - RNA, 17 nt, Homo sapiens
gccagaugugguggcac

SEQ ID NO: 723179 - RNA, 18 nt, Homo sapiens
gccagaugugguggcacg

SEQ ID NO: 723180 - RNA, 19 nt, Homo sapiens
gccagcaccugcccagugg

SEQ ID NO: 723181 - RNA, 21 nt, Homo sapiens
gccagcaggagcucugacuaa

SEQ ID NO: 723182 - RNA, 13 nt, Homo sapiens
gccagcaucugca

SEQ ID NO: 723183 - RNA, 14 nt, Homo sapiens
gccagcaucugcag

SEQ ID NO: 723184 - RNA, 14 nt, Homo sapiens
gccagccgugagug

SEQ ID NO: 723185 - RNA, 13 nt, Homo sapiens
gccagccucagaa

SEQ ID NO: 723186 - RNA, 23 nt, Homo sapiens
gccagccucagaaggccccagag

SEQ ID NO: 723187 - RNA, 21 nt, Homo sapiens
gccagcgggcacagggcacca

SEQ ID NO: 723188 - RNA, 14 nt, Homo sapiens
gccagcuacuuccu

SEQ ID NO: 723189 - RNA, 14 nt, Homo sapiens
gccagcugccagua

SEQ ID NO: 723190 - RNA, 20 nt, Homo sapiens
gccagcugggagcacuggug

SEQ ID NO: 723191 - RNA, 22 nt, Homo sapiens
gccagcugugggacaauuaucu

SEQ ID NO: 723192 - RNA, 22 nt, Homo sapiens
gccagcuuacuagcacuuugag

SEQ ID NO: 723193 - RNA, 21 nt, Homo sapiens
gccaggacaugcagcccagaa

SEQ ID NO: 723194 - RNA, 15 nt, Homo sapiens
gccaggacuguguuu

SEQ ID NO: 723195 - RNA, 11 nt, Homo sapiens
gccaggagcuc

SEQ ID NO: 723196 - RNA, 15 nt, Homo sapiens
gccaggagcugucac

SEQ ID NO: 723197 - RNA, 18 nt, Homo sapiens
gccaggcguuggugccac

SEQ ID NO: 723198 - RNA, 14 nt, Homo sapiens
gccaggcuccuucc

SEQ ID NO: 723199 - RNA, 16 nt, Homo sapiens
gccaggcuggucucaa

SEQ ID NO: 723200 - RNA, 21 nt, Homo sapiens
gccaggcuggucucaaacucc

SEQ ID NO: 723201 - RNA, 14 nt, Homo sapiens
gccagggaugggca

SEQ ID NO: 723202 - RNA, 15 nt, Homo sapiens
gccagggcagaggaa

SEQ ID NO: 723203 - RNA, 17 nt, Homo sapiens
gccaggggcgaggcccu

SEQ ID NO: 723204 - RNA, 21 nt, Homo sapiens
gccaggguggucuugaucucc

SEQ ID NO: 723205 - RNA, 18 nt, Homo sapiens
gccagguugggggcagug

SEQ ID NO: 723206 - RNA, 11 nt, Homo sapiens
gccaguauuuu

SEQ ID NO: 723207 - RNA, 15 nt, Homo sapiens
gccagucacugcugc

SEQ ID NO: 723208 - RNA, 15 nt, Homo sapiens
gccagugagggcagu

SEQ ID NO: 723209 - RNA, 18 nt, Homo sapiens
gccagugccucucacccc

SEQ ID NO: 723210 - RNA, 23 nt, Homo sapiens
gccagugcuuuaauggcauguca

SEQ ID NO: 723211 - RNA, 21 nt, Homo sapiens
gccaguggcuggaucugugag

SEQ ID NO: 723212 - RNA, 21 nt, Homo sapiens
gccaguggugcuaaaugcuac

SEQ ID NO: 723213 - RNA, 18 nt, Homo sapiens
gccaguuccgucuucccu

SEQ ID NO: 723214 - RNA, 19 nt, Homo sapiens
gacguucauuauguaugaa

SEQ ID NO: 723215 - RNA, 18 nt, Homo sapiens
gacuaacccaaugccugu

SEQ ID NO: 723216 - RNA, 22 nt, Homo sapiens
gacuaacccaaugccugugaag

SEQ ID NO: 723217 - RNA, 12 nt, Homo sapiens
gacuacaaagau

SEQ ID NO: 723218 - RNA, 16 nt, Homo sapiens
gacuacacaauacagu

SEQ ID NO: 723219 - RNA, 19 nt, Homo sapiens
gacuacacaauacaguauu

SEQ ID NO: 723220 - RNA, 14 nt, Homo sapiens
gacuacacccaagc

SEQ ID NO: 723221 - RNA, 15 nt, Homo sapiens
gacuaccaauuucuu

SEQ ID NO: 723222 - RNA, 19 nt, Homo sapiens
gacuacugcccacaccaac

SEQ ID NO: 723223 - RNA, 16 nt, Homo sapiens
gacuagaggcagggag

SEQ ID NO: 723224 - RNA, 17 nt, Homo sapiens
gacuagaggcuugcaua

SEQ ID NO: 723225 - RNA, 12 nt, Homo sapiens
gacuaugacaua

SEQ ID NO: 723226 - RNA, 21 nt, Homo sapiens
gacuaugacauaaaaacaacu

SEQ ID NO: 723227 - RNA, 17 nt, Homo sapiens
gacuaugcagaggccug

SEQ ID NO: 723228 - RNA, 17 nt, Homo sapiens
gacuauggcuaccaaaa

SEQ ID NO: 723229 - RNA, 17 nt, Homo sapiens
gacuauuaggugcaauu

SEQ ID NO: 723230 - RNA, 14 nt, Homo sapiens
gacuauucuaauga

SEQ ID NO: 723231 - RNA, 16 nt, Homo sapiens
gacuauuuaugaaggc

SEQ ID NO: 723232 - RNA, 16 nt, Homo sapiens
gacucaaauguucuaa

SEQ ID NO: 723233 - RNA, 12 nt, Homo sapiens
gacucacacaaa

SEQ ID NO: 723234 - RNA, 19 nt, Homo sapiens
gacucaccucauccuuacc

SEQ ID NO: 723235 - RNA, 18 nt, Homo sapiens
gacucaggaugcccaggg

SEQ ID NO: 723236 - RNA, 21 nt, Homo sapiens
gacucagggccaugccugccc

SEQ ID NO: 723237 - RNA, 19 nt, Homo sapiens
gacucagggccccagcacu

SEQ ID NO: 723238 - RNA, 21 nt, Homo sapiens
gacucauuuuaaaaaauggaa

SEQ ID NO: 723239 - RNA, 12 nt, Homo sapiens
gacuccaucuca

SEQ ID NO: 723240 - RNA, 12 nt, Homo sapiens
gacuccaucucu

SEQ ID NO: 723241 - RNA, 16 nt, Homo sapiens
gacuccgucucaagga

SEQ ID NO: 723242 - RNA, 13 nt, Homo sapiens
gacuccucaaaag

SEQ ID NO: 723243 - RNA, 15 nt, Homo sapiens
gacuccucaaaagca

SEQ ID NO: 723244 - RNA, 17 nt, Homo sapiens
gacuccugugcaacuuu

SEQ ID NO: 723245 - RNA, 22 nt, Homo sapiens
gacuccuuagagacaucaaaau

SEQ ID NO: 723246 - RNA, 17 nt, Homo sapiens
gacucuacuauuaaguu

SEQ ID NO: 723247 - RNA, 12 nt, Homo sapiens
gacucucaggga

SEQ ID NO: 723248 - RNA, 14 nt, Homo sapiens
gacucugaucucug

SEQ ID NO: 723249 - RNA, 10 nt, Homo sapiens
gacucugcac

SEQ ID NO: 723250 - RNA, 14 nt, Homo sapiens
gacucugcacaugu

SEQ ID NO: 723251 - RNA, 22 nt, Homo sapiens
gacucuuuuuuugagugacagc

SEQ ID NO: 723252 - RNA, 14 nt, Homo sapiens
gacugaaacuggaa

SEQ ID NO: 723253 - RNA, 21 nt, Homo sapiens
gacugaacauuaguugcacua

SEQ ID NO: 723254 - RNA, 14 nt, Homo sapiens
gacugaaccagucc

SEQ ID NO: 723255 - RNA, 16 nt, Homo sapiens
gacugaagacucagcc

SEQ ID NO: 723256 - RNA, 14 nt, Homo sapiens
gacugagauggagu

SEQ ID NO: 723257 - RNA, 15 nt, Homo sapiens
gacugagcucaaggu

SEQ ID NO: 723258 - RNA, 20 nt, Homo sapiens
gacugagguauaaagacaag

SEQ ID NO: 723259 - RNA, 13 nt, Homo sapiens
gacugaguccucg

SEQ ID NO: 723260 - RNA, 16 nt, Homo sapiens
gacugaugucaucuug

SEQ ID NO: 723261 - RNA, 21 nt, Homo sapiens
gacugcaaaugcuauugucag

SEQ ID NO: 723262 - RNA, 14 nt, Homo sapiens
gacugcagggacac

SEQ ID NO: 723263 - RNA, 15 nt, Homo sapiens
gacugcaucucaaaa

SEQ ID NO: 723264 - RNA, 18 nt, Homo sapiens
gacugccaugcuagacaa

SEQ ID NO: 723265 - RNA, 21 nt, Homo sapiens
gacugccaugcuagacaagcu

SEQ ID NO: 723266 - RNA, 18 nt, Homo sapiens
gacugcuaccucugagaa

SEQ ID NO: 723267 - RNA, 19 nt, Homo sapiens
gacugcucagaacuugcug

SEQ ID NO: 723268 - RNA, 18 nt, Homo sapiens
gacugcugcuagagccag

SEQ ID NO: 723269 - RNA, 20 nt, Homo sapiens
gacuggaaugcagugacaca

SEQ ID NO: 723270 - RNA, 19 nt, Homo sapiens
gacugggucugaccuggug

SEQ ID NO: 723271 - RNA, 16 nt, Homo sapiens
gacugguaaguaacug

SEQ ID NO: 723272 - RNA, 13 nt, Homo sapiens
gacuguaaacauc

SEQ ID NO: 723273 - RNA, 13 nt, Homo sapiens
gacuguagaagaa

SEQ ID NO: 723274 - RNA, 14 nt, Homo sapiens
gacugucaguucuc

SEQ ID NO: 723275 - RNA, 16 nt, Homo sapiens
gacugucucacuuaau

SEQ ID NO: 723276 - RNA, 19 nt, Homo sapiens
gacugugauuagaucacau

SEQ ID NO: 723277 - RNA, 22 nt, Homo sapiens
gacugugcauacuuucccucau

SEQ ID NO: 723278 - RNA, 22 nt, Homo sapiens
gagcucaguuuucaacucuucc

SEQ ID NO: 723279 - RNA, 18 nt, Homo sapiens
gagcuccaaauugaauca

SEQ ID NO: 723280 - RNA, 21 nt, Homo sapiens
gagcucgguggacccagggau

SEQ ID NO: 723281 - RNA, 20 nt, Homo sapiens
gagcucuggguugugcacau

SEQ ID NO: 723282 - RNA, 18 nt, Homo sapiens
gagcucugguggagacaa

SEQ ID NO: 723283 - RNA, 15 nt, Homo sapiens
gagcucuucauuuau

SEQ ID NO: 723284 - RNA, 14 nt, Homo sapiens
gagcugagaucacg

SEQ ID NO: 723285 - RNA, 14 nt, Homo sapiens
gagcugagcuggaa

SEQ ID NO: 723286 - RNA, 15 nt, Homo sapiens
gagcugcacuaucac

SEQ ID NO: 723287 - RNA, 16 nt, Homo sapiens
gagcugcauaaugucc

SEQ ID NO: 723288 - RNA, 13 nt, Homo sapiens
gagcugcucagaa

SEQ ID NO: 723289 - RNA, 17 nt, Homo sapiens
gagcugcugagggaccu

SEQ ID NO: 723290 - RNA, 23 nt, Homo sapiens
gagcuggcccagggggccuggag

SEQ ID NO: 723291 - RNA, 13 nt, Homo sapiens
gagcugggcagaa

SEQ ID NO: 723292 - RNA, 21 nt, Homo sapiens
gagcugggcagaaggccaaga

SEQ ID NO: 723293 - RNA, 17 nt, Homo sapiens
gagcuggggggcgugga

SEQ ID NO: 723294 - RNA, 20 nt, Homo sapiens
gagcuguggguaaauuaacu

SEQ ID NO: 723295 - RNA, 20 nt, Homo sapiens
gagcuguuuucccugaccuc

SEQ ID NO: 723296 - RNA, 13 nt, Homo sapiens
gagcuuauuacuu

SEQ ID NO: 723297 - RNA, 12 nt, Homo sapiens
gagcuucugggg

SEQ ID NO: 723298 - RNA, 12 nt, Homo sapiens
gagcuugagcuc

SEQ ID NO: 723299 - RNA, 20 nt, Homo sapiens
gagcuugagcuccccuggag

SEQ ID NO: 723300 - RNA, 16 nt, Homo sapiens
gagcuugucagcaaga

SEQ ID NO: 723301 - RNA, 21 nt, Homo sapiens
gagcuugugcuccucuugauu

SEQ ID NO: 723302 - RNA, 20 nt, Homo sapiens
gagcuuuccuacuugcacuc

SEQ ID NO: 723303 - RNA, 22 nt, Homo sapiens
gagcuuugugcuugucauucca

SEQ ID NO: 723304 - RNA, 22 nt, Homo sapiens
gagcuuuugcccacacacuuuc

SEQ ID NO: 723305 - RNA, 22 nt, Homo sapiens
gaggaaaaaaagcaugcauucu

SEQ ID NO: 723306 - RNA, 18 nt, Homo sapiens
gaggaaaaaagaaccaaa

SEQ ID NO: 723307 - RNA, 14 nt, Homo sapiens
gaggaaaccuagca

SEQ ID NO: 723308 - RNA, 13 nt, Homo sapiens
gaggaaacuugca

SEQ ID NO: 723309 - RNA, 13 nt, Homo sapiens
gaggaaagauuca

SEQ ID NO: 723310 - RNA, 19 nt, Homo sapiens
gaggaaggaacagcaaugg

SEQ ID NO: 723311 - RNA, 23 nt, Homo sapiens
gaggaaguagcugucagauguca

SEQ ID NO: 723312 - RNA, 22 nt, Homo sapiens
gaggaauauuucaagcucugca

SEQ ID NO: 723313 - RNA, 15 nt, Homo sapiens
gaggaauuggccgcu

SEQ ID NO: 723314 - RNA, 17 nt, Homo sapiens
gaggacaauacuggggu

SEQ ID NO: 723315 - RNA, 22 nt, Homo sapiens
gaggacauucuggaaaagcaaa

SEQ ID NO: 723316 - RNA, 20 nt, Homo sapiens
gaggacucucccuuggugac

SEQ ID NO: 723317 - RNA, 15 nt, Homo sapiens
gaggaguaaaauuca

SEQ ID NO: 723318 - RNA, 13 nt, Homo sapiens
gaggaguaacaau

SEQ ID NO: 723319 - RNA, 17 nt, Homo sapiens
gaggaguaccgccagca

SEQ ID NO: 723320 - RNA, 13 nt, Homo sapiens
gaggauaaagggc

SEQ ID NO: 723321 - RNA, 14 nt, Homo sapiens
gaggaucuggagaa

SEQ ID NO: 723322 - RNA, 20 nt, Homo sapiens
gaggauggcuugaggccaga

SEQ ID NO: 723323 - RNA, 18 nt, Homo sapiens
gaggaugggucagagcua

SEQ ID NO: 723324 - RNA, 21 nt, Homo sapiens
gaggauuccgucuucucucau

SEQ ID NO: 723325 - RNA, 18 nt, Homo sapiens
gaggauugcuaucuggag

SEQ ID NO: 723326 - RNA, 16 nt, Homo sapiens
gaggauuucaucucuu

SEQ ID NO: 723327 - RNA, 17 nt, Homo sapiens
gaggcaaacagcaagag

SEQ ID NO: 723328 - RNA, 20 nt, Homo sapiens
gaggcaagaaaaggacaaau

SEQ ID NO: 723329 - RNA, 20 nt, Homo sapiens
gaggcaagagaauugcuuga

SEQ ID NO: 723330 - RNA, 19 nt, Homo sapiens
gaggcagaaaauugcacaa

SEQ ID NO: 723331 - RNA, 18 nt, Homo sapiens
gaggcagagguugcagug

SEQ ID NO: 723332 - RNA, 21 nt, Homo sapiens
cugcuuuuuuuuuuccagcaa

SEQ ID NO: 723333 - RNA, 15 nt, Homo sapiens
cuggaaaaauuccag

SEQ ID NO: 723334 - RNA, 19 nt, Homo sapiens
cuggaaaaauuccagaaga

SEQ ID NO: 723335 - RNA, 17 nt, Homo sapiens
cuggaaaacagaaacca

SEQ ID NO: 723336 - RNA, 16 nt, Homo sapiens
cuggaaaacccaaagu

SEQ ID NO: 723337 - RNA, 14 nt, Homo sapiens
cuggaaacccaccu

SEQ ID NO: 723338 - RNA, 16 nt, Homo sapiens
cuggaaagacauagcc

SEQ ID NO: 723339 - RNA, 20 nt, Homo sapiens
cuggaaaggcucagucucag

SEQ ID NO: 723340 - RNA, 13 nt, Homo sapiens
cuggaacaccagc

SEQ ID NO: 723341 - RNA, 18 nt, Homo sapiens
cuggaaccaccuggacga

SEQ ID NO: 723342 - RNA, 20 nt, Homo sapiens
cuggaagaaagcaacaaaga

SEQ ID NO: 723343 - RNA, 12 nt, Homo sapiens
cuggaagacacu

SEQ ID NO: 723344 - RNA, 16 nt, Homo sapiens
cuggaagagccaaaga

SEQ ID NO: 723345 - RNA, 16 nt, Homo sapiens
cuggaagcagagcaaa

SEQ ID NO: 723346 - RNA, 22 nt, Homo sapiens
cuggaagccaccucaccaagga

SEQ ID NO: 723347 - RNA, 17 nt, Homo sapiens
cuggaagccugccgaaa

SEQ ID NO: 723348 - RNA, 17 nt, Homo sapiens
cuggaaggacacaguga

SEQ ID NO: 723349 - RNA, 19 nt, Homo sapiens
cuggaaggacacagugaug

SEQ ID NO: 723350 - RNA, 15 nt, Homo sapiens
cuggaaggggccacg

SEQ ID NO: 723351 - RNA, 19 nt, Homo sapiens
cuggaaggggccacgugga

SEQ ID NO: 723352 - RNA, 15 nt, Homo sapiens
cuggaagucaucuca

SEQ ID NO: 723353 - RNA, 20 nt, Homo sapiens
cuggaaguuucuggugccau

SEQ ID NO: 723354 - RNA, 22 nt, Homo sapiens
cuggaaucacauucuuagcaca

SEQ ID NO: 723355 - RNA, 12 nt, Homo sapiens
cuggaauggugu

SEQ ID NO: 723356 - RNA, 13 nt, Homo sapiens
cuggaauugcuca

SEQ ID NO: 723357 - RNA, 21 nt, Homo sapiens
cuggaauuuggacaagugcug

SEQ ID NO: 723358 - RNA, 13 nt, Homo sapiens
cuggacacccucu

SEQ ID NO: 723359 - RNA, 22 nt, Homo sapiens
cuggacaccgggccaguaucua

SEQ ID NO: 723360 - RNA, 16 nt, Homo sapiens
cuggacauucgaggaa

SEQ ID NO: 723361 - RNA, 14 nt, Homo sapiens
cuggacauucucuu

SEQ ID NO: 723362 - RNA, 15 nt, Homo sapiens
cuggaccacugggca

SEQ ID NO: 723363 - RNA, 15 nt, Homo sapiens
cuggacgacacggcc

SEQ ID NO: 723364 - RNA, 21 nt, Homo sapiens
cuggacuacacccaagccuga

SEQ ID NO: 723365 - RNA, 13 nt, Homo sapiens
cuggacugaccaa

SEQ ID NO: 723366 - RNA, 16 nt, Homo sapiens
cuggacugaccaaaga

SEQ ID NO: 723367 - RNA, 12 nt, Homo sapiens
cuggacugcaau

SEQ ID NO: 723368 - RNA, 11 nt, Homo sapiens
cuggacuguca

SEQ ID NO: 723369 - RNA, 20 nt, Homo sapiens
cuggagaacuagagaaggac

SEQ ID NO: 723370 - RNA, 20 nt, Homo sapiens
cuggagaagaauggcuuuca

SEQ ID NO: 723371 - RNA, 21 nt, Homo sapiens
cuggagaccagggagccuuug

SEQ ID NO: 723372 - RNA, 12 nt, Homo sapiens
cuggagauccuc

SEQ ID NO: 723373 - RNA, 17 nt, Homo sapiens
cuggagcaaaagucauu

SEQ ID NO: 723374 - RNA, 19 nt, Homo sapiens
cuggagcaaccuacugucu

SEQ ID NO: 723375 - RNA, 16 nt, Homo sapiens
cuggagcccacaaccu

SEQ ID NO: 723376 - RNA, 17 nt, Homo sapiens
cuggagccuccacugcc

SEQ ID NO: 723377 - RNA, 20 nt, Homo sapiens
cuggagccuccacugccucu

SEQ ID NO: 723378 - RNA, 15 nt, Homo sapiens
cuggaggcacgcacc

SEQ ID NO: 723379 - RNA, 21 nt, Homo sapiens
cuggagggacuuuuaaucagu

SEQ ID NO: 723380 - RNA, 15 nt, Homo sapiens
cuggagucagguguc

SEQ ID NO: 723381 - RNA, 22 nt, Homo sapiens
cuggagugcagugagcuauuac

SEQ ID NO: 723382 - RNA, 17 nt, Homo sapiens
cuggagugcagugccac

SEQ ID NO: 723383 - RNA, 21 nt, Homo sapiens
cuggagugcaguggugcaauc

SEQ ID NO: 723384 - RNA, 20 nt, Homo sapiens
cuggaguggaguggcgugau

SEQ ID NO: 723385 - RNA, 12 nt, Homo sapiens
cuggaguggugu

SEQ ID NO: 723386 - RNA, 22 nt, Homo sapiens
cuggaguugaucuggaacccag

SEQ ID NO: 723387 - RNA, 23 nt, Homo sapiens
cuggaucaaaaaugaaucacuuc

SEQ ID NO: 723388 - RNA, 21 nt, Homo sapiens
cuggaucccgagguauggcag

SEQ ID NO: 723389 - RNA, 21 nt, Homo sapiens
cuggaucuaccagcauaaaua

SEQ ID NO: 723390 - RNA, 20 nt, Homo sapiens
cuggaucugugaggggcucu

SEQ ID NO: 723391 - RNA, 22 nt, Homo sapiens
cuggaucuuauacccaacacac

SEQ ID NO: 723392 - RNA, 18 nt, Homo sapiens
cuggaugggggucccugu

SEQ ID NO: 723393 - RNA, 23 nt, Homo sapiens
cuggauuauaaguucuauuuuac

SEQ ID NO: 723394 - RNA, 16 nt, Homo sapiens
cuggauuauugcuuag

SEQ ID NO: 723395 - RNA, 21 nt, Homo sapiens
cuggauucuacaaaaaaccag

SEQ ID NO: 723396 - RNA, 19 nt, Homo sapiens
cuggcaauguuuauuucau

SEQ ID NO: 723397 - RNA, 12 nt, Homo sapiens
cuggcacacucc

SEQ ID NO: 723398 - RNA, 15 nt, Homo sapiens
cuggcacaggacuga

SEQ ID NO: 723399 - RNA, 19 nt, Homo sapiens
cuggcacgcccuacuccac

SEQ ID NO: 723400 - RNA, 18 nt, Homo sapiens
cuggcacuuagcccaaga

SEQ ID NO: 723401 - RNA, 20 nt, Homo sapiens
cuggcacuuagcccaagagg

SEQ ID NO: 723402 - RNA, 21 nt, Homo sapiens
cuggcagaaagcaaaugugac

SEQ ID NO: 723403 - RNA, 16 nt, Homo sapiens
cuggcagaagcauugc

SEQ ID NO: 723404 - RNA, 19 nt, Homo sapiens
cuggcagacucgggaccaa

SEQ ID NO: 723405 - RNA, 20 nt, Homo sapiens
cuggcagagucagcugcuga

SEQ ID NO: 723406 - RNA, 20 nt, Homo sapiens
cuggcagcaucuucacuucu

SEQ ID NO: 723407 - RNA, 19 nt, Homo sapiens
cuggcagccgugccuucag

SEQ ID NO: 723408 - RNA, 21 nt, Homo sapiens
cuggcaguccaaauugaaaga

SEQ ID NO: 723409 - RNA, 22 nt, Homo sapiens
cuggcauagcccuccugagcac

SEQ ID NO: 723410 - RNA, 15 nt, Homo sapiens
cuggcaucucacuuu

SEQ ID NO: 723411 - RNA, 15 nt, Homo sapiens
cuggcauuacaggug

SEQ ID NO: 723412 - RNA, 17 nt, Homo sapiens
cuggcauuacaggugug

SEQ ID NO: 723413 - RNA, 18 nt, Homo sapiens
cuggcauuacagguguga

SEQ ID NO: 723414 - RNA, 22 nt, Homo sapiens
gaauggcugcaccuuuuugcau

SEQ ID NO: 723415 - RNA, 16 nt, Homo sapiens
gaauggggacacggug

SEQ ID NO: 723416 - RNA, 16 nt, Homo sapiens
gaauggguuugcuaga

SEQ ID NO: 723417 - RNA, 16 nt, Homo sapiens
gaauggucucugucaa

SEQ ID NO: 723418 - RNA, 23 nt, Homo sapiens
gaaugguuguacguuuugcacau

SEQ ID NO: 723419 - RNA, 15 nt, Homo sapiens
gaauguaacugcuga

SEQ ID NO: 723420 - RNA, 14 nt, Homo sapiens
gaauguacucuguu

SEQ ID NO: 723421 - RNA, 18 nt, Homo sapiens
gaaugucaagaaaaggag

SEQ ID NO: 723422 - RNA, 22 nt, Homo sapiens
gaaugucaagaaaaggagucaa

SEQ ID NO: 723423 - RNA, 13 nt, Homo sapiens
gaaugucacuggu

SEQ ID NO: 723424 - RNA, 16 nt, Homo sapiens
gaaugucacuggugga

SEQ ID NO: 723425 - RNA, 14 nt, Homo sapiens
gaaugucaguucau

SEQ ID NO: 723426 - RNA, 16 nt, Homo sapiens
gaaugugcaacauucu

SEQ ID NO: 723427 - RNA, 18 nt, Homo sapiens
gaaugugugggguauaga

SEQ ID NO: 723428 - RNA, 11 nt, Homo sapiens
gaauguguucu

SEQ ID NO: 723429 - RNA, 15 nt, Homo sapiens
gaauguuaagcagau

SEQ ID NO: 723430 - RNA, 18 nt, Homo sapiens
gaauguuaugugcaaguu

SEQ ID NO: 723431 - RNA, 19 nt, Homo sapiens
gaauguuauuuccugagaa

SEQ ID NO: 723432 - RNA, 23 nt, Homo sapiens
gaauguucccugcacccuggaaa

SEQ ID NO: 723433 - RNA, 17 nt, Homo sapiens
gaauguuuaaagaucau

SEQ ID NO: 723434 - RNA, 17 nt, Homo sapiens
gaauguuuuacugugaa

SEQ ID NO: 723435 - RNA, 20 nt, Homo sapiens
gaauuaagcguuguaguaaa

SEQ ID NO: 723436 - RNA, 20 nt, Homo sapiens
gaauuacaguacacaucccc

SEQ ID NO: 723437 - RNA, 16 nt, Homo sapiens
gaauuacuugaaccug

SEQ ID NO: 723438 - RNA, 18 nt, Homo sapiens
gaauuacuuguguuacuu

SEQ ID NO: 723439 - RNA, 21 nt, Homo sapiens
gaauuagauuucuauaggauu

SEQ ID NO: 723440 - RNA, 16 nt, Homo sapiens
gaauuaggaagaccaa

SEQ ID NO: 723441 - RNA, 17 nt, Homo sapiens
gaauuaggaagaccaag

SEQ ID NO: 723442 - RNA, 13 nt, Homo sapiens
gaauuaugcuucc

SEQ ID NO: 723443 - RNA, 20 nt, Homo sapiens
gaauuaugucguaagucacu

SEQ ID NO: 723444 - RNA, 17 nt, Homo sapiens
gaauuaugucugcugaa

SEQ ID NO: 723445 - RNA, 21 nt, Homo sapiens
gaauucaccuugguguuucuc

SEQ ID NO: 723446 - RNA, 13 nt, Homo sapiens
gaauucagcacca

SEQ ID NO: 723447 - RNA, 13 nt, Homo sapiens
gaauuccuaacuu

SEQ ID NO: 723448 - RNA, 14 nt, Homo sapiens
gaauucuaagugaa

SEQ ID NO: 723449 - RNA, 15 nt, Homo sapiens
gaauucuacuggaaa

SEQ ID NO: 723450 - RNA, 22 nt, Homo sapiens
gaauucugcuaccucacugggg

SEQ ID NO: 723451 - RNA, 13 nt, Homo sapiens
gaauucuugaguu

SEQ ID NO: 723452 - RNA, 19 nt, Homo sapiens
gaauucuuuuucauuugag

SEQ ID NO: 723453 - RNA, 21 nt, Homo sapiens
gaauugagauaauaucuguga

SEQ ID NO: 723454 - RNA, 11 nt, Homo sapiens
gaauugcacau

SEQ ID NO: 723455 - RNA, 15 nt, Homo sapiens
gaauugcacugaaca

SEQ ID NO: 723456 - RNA, 17 nt, Homo sapiens
gaauugcuuaccaaagg

SEQ ID NO: 723457 - RNA, 17 nt, Homo sapiens
gaauuguggaguguuuu

SEQ ID NO: 723458 - RNA, 16 nt, Homo sapiens
gaauuuaaacaaugca

SEQ ID NO: 723459 - RNA, 15 nt, Homo sapiens
gaauuuaaugcugaa

SEQ ID NO: 723460 - RNA, 18 nt, Homo sapiens
gaauuucaguaaacaaug

SEQ ID NO: 723461 - RNA, 20 nt, Homo sapiens
gaauuucaucucaucaggca

SEQ ID NO: 723462 - RNA, 22 nt, Homo sapiens
gaauuucaucucaucaggcaaa

SEQ ID NO: 723463 - RNA, 11 nt, Homo sapiens
gaauuuccucu

SEQ ID NO: 723464 - RNA, 11 nt, Homo sapiens
gaauuugcacc

SEQ ID NO: 723465 - RNA, 18 nt, Homo sapiens
gaauuuguuuugguacuc

SEQ ID NO: 723466 - RNA, 19 nt, Homo sapiens
gaauuuucucuaacuucaa

SEQ ID NO: 723467 - RNA, 15 nt, Homo sapiens
gaauuuugagucuau

SEQ ID NO: 723468 - RNA, 16 nt, Homo sapiens
gaauuuuucccuccac

SEQ ID NO: 723469 - RNA, 20 nt, Homo sapiens
gaauuuuucuuccucuccac

SEQ ID NO: 723470 - RNA, 14 nt, Homo sapiens
gacaaaacacugug

SEQ ID NO: 723471 - RNA, 15 nt, Homo sapiens
gacaaaacacugugu

SEQ ID NO: 723472 - RNA, 21 nt, Homo sapiens
gacaaaacauuuugaaggaaa

SEQ ID NO: 723473 - RNA, 21 nt, Homo sapiens
gacaaagccaaacucugccag

SEQ ID NO: 723474 - RNA, 13 nt, Homo sapiens
gacaaauguuucu

SEQ ID NO: 723475 - RNA, 20 nt, Homo sapiens
gacaacaaucucaauuccau

SEQ ID NO: 723476 - RNA, 15 nt, Homo sapiens
gacaacagguuuuca

SEQ ID NO: 723477 - RNA, 11 nt, Homo sapiens
gacaacauguu

SEQ ID NO: 723478 - RNA, 17 nt, Homo sapiens
gacaacauuaugaucua

SEQ ID NO: 723479 - RNA, 22 nt, Homo sapiens
gacaaccaacggccgacugccu

SEQ ID NO: 723480 - RNA, 23 nt, Homo sapiens
gacaaccaacggccgacugccug

SEQ ID NO: 723481 - RNA, 15 nt, Homo sapiens
gacaacucaaugaaa

SEQ ID NO: 723482 - RNA, 15 nt, Homo sapiens
gacaacugugacugu

SEQ ID NO: 723483 - RNA, 22 nt, Homo sapiens
gacaagaauuguuaccugucau

SEQ ID NO: 723484 - RNA, 19 nt, Homo sapiens
gacaagacccccagcacuu

SEQ ID NO: 723485 - RNA, 18 nt, Homo sapiens
gacaagaugguuaaguca

SEQ ID NO: 723486 - RNA, 17 nt, Homo sapiens
gacaagcugcauuucag

SEQ ID NO: 723487 - RNA, 18 nt, Homo sapiens
gacaagguucugcccuua

SEQ ID NO: 723488 - RNA, 22 nt, Homo sapiens
gacaauaaaauggaaagguccu

SEQ ID NO: 723489 - RNA, 17 nt, Homo sapiens
gacaauaauuacauugg

SEQ ID NO: 723490 - RNA, 12 nt, Homo sapiens
gacaaugaaggg

SEQ ID NO: 723491 - RNA, 14 nt, Homo sapiens
gacaaugaagggaa

SEQ ID NO: 723492 - RNA, 22 nt, Homo sapiens
gacacaacagcagucuccuuca

SEQ ID NO: 723493 - RNA, 18 nt, Homo sapiens
gacacaacuauuuuucca

SEQ ID NO: 723494 - RNA, 21 nt, Homo sapiens
gacacaacuauuuuuccaaaa

SEQ ID NO: 723495 - RNA, 22 nt, Homo sapiens
gacacaaucucggcucacugaa

SEQ ID NO: 723496 - RNA, 18 nt, Homo sapiens
gacacacaggcagcugaa

SEQ ID NO: 723497 - RNA, 15 nt, Homo sapiens
gacacagacauuuug

SEQ ID NO: 723498 - RNA, 13 nt, Homo sapiens
gacacagccuccc

SEQ ID NO: 723499 - RNA, 19 nt, Homo sapiens
gacacaggcccucccuguu

SEQ ID NO: 723500 - RNA, 15 nt, Homo sapiens
gacacaggugccuca

SEQ ID NO: 723501 - RNA, 15 nt, Homo sapiens
gacacauacauguca

SEQ ID NO: 723502 - RNA, 15 nt, Homo sapiens
gacacauaugcaccu

SEQ ID NO: 723503 - RNA, 22 nt, Homo sapiens
gacacauuuagaugcacuacca

SEQ ID NO: 723504 - RNA, 19 nt, Homo sapiens
gacaccaauaaauguuugu

SEQ ID NO: 723505 - RNA, 18 nt, Homo sapiens
gacacccaugccagagag

SEQ ID NO: 723506 - RNA, 21 nt, Homo sapiens
gacacccccugggauggcuca

SEQ ID NO: 723507 - RNA, 16 nt, Homo sapiens
gacaccucaccucacc

SEQ ID NO: 723508 - RNA, 17 nt, Homo sapiens
gacaccuguacauucuu

SEQ ID NO: 723509 - RNA, 20 nt, Homo sapiens
gacaccuuuacuaacucugg

SEQ ID NO: 723510 - RNA, 14 nt, Homo sapiens
gacacuacauaucu

SEQ ID NO: 723511 - RNA, 21 nt, Homo sapiens
gacacuagccugugcacgcgc

SEQ ID NO: 723512 - RNA, 24 nt, Homo sapiens
gacacuggugguucuacugaccca

SEQ ID NO: 723513 - RNA, 19 nt, Homo sapiens
gacacuuuggaaguuugug

SEQ ID NO: 723514 - RNA, 23 nt, Homo sapiens
gacagaaaccaagccauuaauga

SEQ ID NO: 723515 - RNA, 18 nt, Homo sapiens
gacagaacaccuaugcaa

SEQ ID NO: 723516 - RNA, 17 nt, Homo sapiens
gacagaaugguggagug

SEQ ID NO: 723517 - RNA, 22 nt, Homo sapiens
gacagaggcugcugcugcugca

SEQ ID NO: 723518 - RNA, 16 nt, Homo sapiens
gacagagggcucaccu

SEQ ID NO: 723519 - RNA, 22 nt, Homo sapiens
gacagagucccuggcuccucua

SEQ ID NO: 723520 - RNA, 19 nt, Homo sapiens
gacagaugccacacaagga

SEQ ID NO: 723521 - RNA, 17 nt, Homo sapiens
gacagcccuccuugacc

SEQ ID NO: 723522 - RNA, 18 nt, Homo sapiens
gacagcugcugugcauua

SEQ ID NO: 723523 - RNA, 16 nt, Homo sapiens
gacagcugugugacau

SEQ ID NO: 723524 - RNA, 14 nt, Homo sapiens
gacagcuuccucac

SEQ ID NO: 723525 - RNA, 13 nt, Homo sapiens
gacaggaagcugg

SEQ ID NO: 723526 - RNA, 16 nt, Homo sapiens
gacaggaagcuggcag

SEQ ID NO: 723527 - RNA, 18 nt, Homo sapiens
gacaggagaaucaccuga

SEQ ID NO: 723528 - RNA, 16 nt, Homo sapiens
gacaggaggcggcccg

SEQ ID NO: 723529 - RNA, 19 nt, Homo sapiens
gaagguucuucaugaucca

SEQ ID NO: 723530 - RNA, 17 nt, Homo sapiens
gaagguugcuauauagu

SEQ ID NO: 723531 - RNA, 19 nt, Homo sapiens
gaagguuggugaauuucac

SEQ ID NO: 723532 - RNA, 20 nt, Homo sapiens
gaagguugguggggggucca

SEQ ID NO: 723533 - RNA, 18 nt, Homo sapiens
gaaguaaccauuugcacu

SEQ ID NO: 723534 - RNA, 22 nt, Homo sapiens
gaaguaggaggaaacaguucuc

SEQ ID NO: 723535 - RNA, 15 nt, Homo sapiens
gaaguaggcauauau

SEQ ID NO: 723536 - RNA, 20 nt, Homo sapiens
gaaguagguggcuugagcua

SEQ ID NO: 723537 - RNA, 17 nt, Homo sapiens
gaaguaggugugacuug

SEQ ID NO: 723538 - RNA, 20 nt, Homo sapiens
gaaguaggugugacuugaac

SEQ ID NO: 723539 - RNA, 18 nt, Homo sapiens
gaaguaguccagccuucc

SEQ ID NO: 723540 - RNA, 15 nt, Homo sapiens
gaaguaugagggaaa

SEQ ID NO: 723541 - RNA, 18 nt, Homo sapiens
gaaguauuuucuaguucu

SEQ ID NO: 723542 - RNA, 18 nt, Homo sapiens
gaagucagccacacuggg

SEQ ID NO: 723543 - RNA, 20 nt, Homo sapiens
gaagucaucucauuccacug

SEQ ID NO: 723544 - RNA, 19 nt, Homo sapiens
gaagucgaggcugcaguca

SEQ ID NO: 723545 - RNA, 18 nt, Homo sapiens
gaagucuaaaagcagaaa

SEQ ID NO: 723546 - RNA, 21 nt, Homo sapiens
gaagucuucuccuccaugaac

SEQ ID NO: 723547 - RNA, 22 nt, Homo sapiens
gaagugauauggugaagggaag

SEQ ID NO: 723548 - RNA, 12 nt, Homo sapiens
gaagugcucccu

SEQ ID NO: 723549 - RNA, 19 nt, Homo sapiens
gaagugcuggcaaccacua

SEQ ID NO: 723550 - RNA, 22 nt, Homo sapiens
gaaguggaguugacucuggaag

SEQ ID NO: 723551 - RNA, 13 nt, Homo sapiens
gaaguggauucug

SEQ ID NO: 723552 - RNA, 18 nt, Homo sapiens
gaagugguucuaugucca

SEQ ID NO: 723553 - RNA, 22 nt, Homo sapiens
gaagugugucacccuuaggcca

SEQ ID NO: 723554 - RNA, 16 nt, Homo sapiens
gaaguuccaguguucu

SEQ ID NO: 723555 - RNA, 19 nt, Homo sapiens
gaaguuccaguguucucuc

SEQ ID NO: 723556 - RNA, 23 nt, Homo sapiens
gaaguucucagaauaacuaccuc

SEQ ID NO: 723557 - RNA, 17 nt, Homo sapiens
gaaguucuccagcuuca

SEQ ID NO: 723558 - RNA, 13 nt, Homo sapiens
gaaguucuggaga

SEQ ID NO: 723559 - RNA, 16 nt, Homo sapiens
gaaguucuggagaaag

SEQ ID NO: 723560 - RNA, 21 nt, Homo sapiens
gaaguucuuugauucuguaau

SEQ ID NO: 723561 - RNA, 20 nt, Homo sapiens
gaaguugcaccauugcacuc

SEQ ID NO: 723562 - RNA, 13 nt, Homo sapiens
gaaguugugcaac

SEQ ID NO: 723563 - RNA, 20 nt, Homo sapiens
gaaguuucuggugccauuuc

SEQ ID NO: 723564 - RNA, 18 nt, Homo sapiens
gaaguuugcuuuguacug

SEQ ID NO: 723565 - RNA, 13 nt, Homo sapiens
gaaguuuguuaua

SEQ ID NO: 723566 - RNA, 21 nt, Homo sapiens
gaaguuuuaugcgugugacag

SEQ ID NO: 723567 - RNA, 13 nt, Homo sapiens
gaauaaaaccauc

SEQ ID NO: 723568 - RNA, 15 nt, Homo sapiens
gaauaaaagugcaca

SEQ ID NO: 723569 - RNA, 18 nt, Homo sapiens
gaauaaaauuagcuugag

SEQ ID NO: 723570 - RNA, 14 nt, Homo sapiens
gaauaaaauugcac

SEQ ID NO: 723571 - RNA, 15 nt, Homo sapiens
gaauaaaauugcacu

SEQ ID NO: 723572 - RNA, 17 nt, Homo sapiens
gaauaaaauugcacuuu

SEQ ID NO: 723573 - RNA, 18 nt, Homo sapiens
gaauaaauaaauguaucu

SEQ ID NO: 723574 - RNA, 12 nt, Homo sapiens
gaauaaccacuu

SEQ ID NO: 723575 - RNA, 22 nt, Homo sapiens
gaauaagcauuccuucuuucac

SEQ ID NO: 723576 - RNA, 17 nt, Homo sapiens
gaauaaggaaaaauaca

SEQ ID NO: 723577 - RNA, 12 nt, Homo sapiens
gaauaaggccca

SEQ ID NO: 723578 - RNA, 14 nt, Homo sapiens
gaauaauaaauauu

SEQ ID NO: 723579 - RNA, 13 nt, Homo sapiens
gaauaaugaaggu

SEQ ID NO: 723580 - RNA, 13 nt, Homo sapiens
gaauaauuucacu

SEQ ID NO: 723581 - RNA, 16 nt, Homo sapiens
gaauaauuucuauuaa

SEQ ID NO: 723582 - RNA, 22 nt, Homo sapiens
gaauacaguaagcugcucuauu

SEQ ID NO: 723583 - RNA, 21 nt, Homo sapiens
gaauacaguuuugaguagagu

SEQ ID NO: 723584 - RNA, 15 nt, Homo sapiens
gaauacauucuuugc

SEQ ID NO: 723585 - RNA, 14 nt, Homo sapiens
gaauacauuuccaa

SEQ ID NO: 723586 - RNA, 14 nt, Homo sapiens
gaauaccaccuaau

SEQ ID NO: 723587 - RNA, 18 nt, Homo sapiens
gaauacguucuccucuga

SEQ ID NO: 723588 - RNA, 17 nt, Homo sapiens
gaauacugcauuuacag

SEQ ID NO: 723589 - RNA, 21 nt, Homo sapiens
gaauacugcauuuacagugua

SEQ ID NO: 723590 - RNA, 21 nt, Homo sapiens
gaauacugggaaucaagacaa

SEQ ID NO: 723591 - RNA, 20 nt, Homo sapiens
gaauagauggguuauuucaa

SEQ ID NO: 723592 - RNA, 15 nt, Homo sapiens
gaauagugcuugcug

SEQ ID NO: 723593 - RNA, 19 nt, Homo sapiens
gaauauaaauuuguguucu

SEQ ID NO: 723594 - RNA, 18 nt, Homo sapiens
gaauauaaggaaagcaau

SEQ ID NO: 723595 - RNA, 20 nt, Homo sapiens
gaauauauuauaaucuucca

SEQ ID NO: 723596 - RNA, 21 nt, Homo sapiens
gaauauauuauaaucuuccau

SEQ ID NO: 723597 - RNA, 16 nt, Homo sapiens
gaauaucagucacugu

SEQ ID NO: 723598 - RNA, 19 nt, Homo sapiens
gaauaucuguaaugguacu

SEQ ID NO: 723599 - RNA, 22 nt, Homo sapiens
gaauaugaccauuugacuguuc

SEQ ID NO: 723600 - RNA, 21 nt, Homo sapiens
gaauaugauaaaacacugccc

SEQ ID NO: 723601 - RNA, 23 nt, Homo sapiens
gaauauggugggcacagaaguag

SEQ ID NO: 723602 - RNA, 17 nt, Homo sapiens
gaauauuguaagucagc

SEQ ID NO: 723603 - RNA, 17 nt, Homo sapiens
gaaucaaaucucuucca

SEQ ID NO: 723604 - RNA, 20 nt, Homo sapiens
gaaucaacagggcagcagau

SEQ ID NO: 723605 - RNA, 16 nt, Homo sapiens
gaaucaauuacuugaa

SEQ ID NO: 723606 - RNA, 15 nt, Homo sapiens
gaaucacaguacuuu

SEQ ID NO: 723607 - RNA, 13 nt, Homo sapiens
gaaucagacugac

SEQ ID NO: 723608 - RNA, 15 nt, Homo sapiens
gaaucagcugggaug

SEQ ID NO: 723609 - RNA, 15 nt, Homo sapiens
gaauccaaaagacaa

SEQ ID NO: 723610 - RNA, 16 nt, Homo sapiens
gaauccaaagaucaca

SEQ ID NO: 723611 - RNA, 22 nt, Homo sapiens
gaauccaagugaacacuagcca

SEQ ID NO: 723612 - RNA, 18 nt, Homo sapiens
gaauccagaucauuccuc

SEQ ID NO: 723613 - RNA, 13 nt, Homo sapiens
gaaucccaagacc

SEQ ID NO: 723614 - RNA, 23 nt, Homo sapiens
gaaucccagauaugguugcacaa

SEQ ID NO: 723615 - RNA, 17 nt, Homo sapiens
gaauccuuccauuccac

SEQ ID NO: 723616 - RNA, 23 nt, Homo sapiens
gaauccuuuggugccaacuggug

SEQ ID NO: 723617 - RNA, 20 nt, Homo sapiens
gaaucggagcgaagcagaga

SEQ ID NO: 723618 - RNA, 22 nt, Homo sapiens
gaaucuaaaccuuacaugugua

SEQ ID NO: 723619 - RNA, 21 nt, Homo sapiens
gaaucuaacgggcauucacaa

SEQ ID NO: 723620 - RNA, 19 nt, Homo sapiens
gaaucucuuggaugcagcu

SEQ ID NO: 723621 - RNA, 23 nt, Homo sapiens
gaaucuucaccucagaguggagu

SEQ ID NO: 723622 - RNA, 12 nt, Homo sapiens
gaaucuugacuu

SEQ ID NO: 723623 - RNA, 20 nt, Homo sapiens
gaaugaaaacuguaaauauu

SEQ ID NO: 723624 - RNA, 14 nt, Homo sapiens
gaaugaacacuccc

SEQ ID NO: 723625 - RNA, 15 nt, Homo sapiens
gaaugaacacucccc

SEQ ID NO: 723626 - RNA, 13 nt, Homo sapiens
gaaugaagaccac

SEQ ID NO: 723627 - RNA, 21 nt, Homo sapiens
gaaugaagccuuagccaggag

SEQ ID NO: 723628 - RNA, 21 nt, Homo sapiens
gaaugaagcguugccauugaa

SEQ ID NO: 723629 - RNA, 19 nt, Homo sapiens
gaaugagagcgacacagac

SEQ ID NO: 723630 - RNA, 19 nt, Homo sapiens
gaaugcaaaguagcaauuu

SEQ ID NO: 723631 - RNA, 18 nt, Homo sapiens
gaaugcacaagaauggau

SEQ ID NO: 723632 - RNA, 24 nt, Homo sapiens
gaaugcacacuagccucuccagga

SEQ ID NO: 723633 - RNA, 17 nt, Homo sapiens
gaaugcagaagcaaaca

SEQ ID NO: 723634 - RNA, 15 nt, Homo sapiens
gaaugcagugacaca

SEQ ID NO: 723635 - RNA, 11 nt, Homo sapiens
gaaugcagugg

SEQ ID NO: 723636 - RNA, 16 nt, Homo sapiens
gaaugcaguggggaca

SEQ ID NO: 723637 - RNA, 12 nt, Homo sapiens
gaaugcggccca

SEQ ID NO: 723638 - RNA, 19 nt, Homo sapiens
gaaugcuccagucaacaaa

SEQ ID NO: 723639 - RNA, 18 nt, Homo sapiens
gaaugcuccauuaaucca

SEQ ID NO: 723640 - RNA, 21 nt, Homo sapiens
gaaugcucuuuacuucaugga

SEQ ID NO: 723641 - RNA, 21 nt, Homo sapiens
gaauggagggaaugcucagaa

SEQ ID NO: 723642 - RNA, 19 nt, Homo sapiens
gaauggcaggugucauaug

SEQ ID NO: 723643 - RNA, 21 nt, Homo sapiens
gaagcguugccauugaacuca

SEQ ID NO: 723644 - RNA, 18 nt, Homo sapiens
gaagcuacuucuccacug

SEQ ID NO: 723645 - RNA, 16 nt, Homo sapiens
gaagcuccuccaguga

SEQ ID NO: 723646 - RNA, 17 nt, Homo sapiens
gaagcuccuccagugaa

SEQ ID NO: 723647 - RNA, 19 nt, Homo sapiens
gaagcuccugcuacuuccc

SEQ ID NO: 723648 - RNA, 18 nt, Homo sapiens
gaagcugauccaguuucc

SEQ ID NO: 723649 - RNA, 15 nt, Homo sapiens
gaagcugcauaugau

SEQ ID NO: 723650 - RNA, 16 nt, Homo sapiens
gaagcugggcucuuuu

SEQ ID NO: 723651 - RNA, 21 nt, Homo sapiens
gaagcuggugcccuuccucac

SEQ ID NO: 723652 - RNA, 12 nt, Homo sapiens
gaagcugugaaa

SEQ ID NO: 723653 - RNA, 13 nt, Homo sapiens
gaagcugugaaua

SEQ ID NO: 723654 - RNA, 15 nt, Homo sapiens
gaagcuuccauucca

SEQ ID NO: 723655 - RNA, 13 nt, Homo sapiens
gaaggaagugaag

SEQ ID NO: 723656 - RNA, 15 nt, Homo sapiens
gaaggaauuauuccc

SEQ ID NO: 723657 - RNA, 16 nt, Homo sapiens
gaaggacacagugaug

SEQ ID NO: 723658 - RNA, 18 nt, Homo sapiens
gaaggacacagugaugaa

SEQ ID NO: 723659 - RNA, 12 nt, Homo sapiens
gaaggacuauca

SEQ ID NO: 723660 - RNA, 15 nt, Homo sapiens
gaaggacuggugcga

SEQ ID NO: 723661 - RNA, 19 nt, Homo sapiens
gaaggagaaguaagaggcu

SEQ ID NO: 723662 - RNA, 14 nt, Homo sapiens
gaaggagaagucua

SEQ ID NO: 723663 - RNA, 23 nt, Homo sapiens
gaaggagccacgugaauggcccu

SEQ ID NO: 723664 - RNA, 17 nt, Homo sapiens
gaaggaggaaguggaag

SEQ ID NO: 723665 - RNA, 22 nt, Homo sapiens
gaaggaggcuuaggacuuucca

SEQ ID NO: 723666 - RNA, 18 nt, Homo sapiens
gaaggauugcaaugcccg

SEQ ID NO: 723667 - RNA, 19 nt, Homo sapiens
gaaggcaagagggggugga

SEQ ID NO: 723668 - RNA, 14 nt, Homo sapiens
gaaggcagagccau

SEQ ID NO: 723669 - RNA, 14 nt, Homo sapiens
gaaggccuuuucac

SEQ ID NO: 723670 - RNA, 15 nt, Homo sapiens
gaaggcugagugucc

SEQ ID NO: 723671 - RNA, 19 nt, Homo sapiens
gaaggcuucaucaccaaga

SEQ ID NO: 723672 - RNA, 19 nt, Homo sapiens
gaaggcuucugugucaaug

SEQ ID NO: 723673 - RNA, 15 nt, Homo sapiens
gaagggaauccuccu

SEQ ID NO: 723674 - RNA, 15 nt, Homo sapiens
gaagggaauugcuca

SEQ ID NO: 723675 - RNA, 23 nt, Homo sapiens
gaagggauuguuguguagucaag

SEQ ID NO: 723676 - RNA, 12 nt, Homo sapiens
gaagggccaguc

SEQ ID NO: 723677 - RNA, 17 nt, Homo sapiens
gaagggcgagugaaucu

SEQ ID NO: 723678 - RNA, 19 nt, Homo sapiens
gaagggcugaguggucuga

SEQ ID NO: 723679 - RNA, 20 nt, Homo sapiens
gaaggggguggggaagaaga

SEQ ID NO: 723680 - RNA, 15 nt, Homo sapiens
gaagggguuccucaa

SEQ ID NO: 723681 - RNA, 14 nt, Homo sapiens
gaagguaaagggag

SEQ ID NO: 723682 - RNA, 22 nt, Homo sapiens
gaagguagcccagcacugugaa

SEQ ID NO: 723683 - RNA, 16 nt, Homo sapiens
gaagguauaugccaaa

SEQ ID NO: 723684 - RNA, 20 nt, Homo sapiens
gaaggucccaccuccauuug

SEQ ID NO: 723685 - RNA, 22 nt, Homo sapiens
gaagguccccuggcagugcuga

SEQ ID NO: 723686 - RNA, 15 nt, Homo sapiens
gaaggucccucagac

SEQ ID NO: 723687 - RNA, 23 nt, Homo sapiens
gaaggugcugauccuaagaauuu

SEQ ID NO: 723688 - RNA, 19 nt, Homo sapiens
gaagguggaccuggcagug

SEQ ID NO: 723689 - RNA, 20 nt, Homo sapiens
gaagguucucugugcuccuc

SEQ ID NO: 723690 - RNA, 22 nt, Homo sapiens
cuguaucagucuuucuugagca

SEQ ID NO: 723691 - RNA, 19 nt, Homo sapiens
cuguaucuuguuuuuccac

SEQ ID NO: 723692 - RNA, 20 nt, Homo sapiens
cuguaugagcuucuaacuca

SEQ ID NO: 723693 - RNA, 14 nt, Homo sapiens
cuguauggcacuua

SEQ ID NO: 723694 - RNA, 20 nt, Homo sapiens
cuguaugugccaaagcuuua

SEQ ID NO: 723695 - RNA, 22 nt, Homo sapiens
cuguauuagagcgccagcuccu

SEQ ID NO: 723696 - RNA, 18 nt, Homo sapiens
cuguauuccgauacaaag

SEQ ID NO: 723697 - RNA, 22 nt, Homo sapiens
cuguauugucugaacuugcauu

SEQ ID NO: 723698 - RNA, 20 nt, Homo sapiens
cuguauuuugccagacuuaa

SEQ ID NO: 723699 - RNA, 19 nt, Homo sapiens
cuguauuuuuaaauugcca

SEQ ID NO: 723700 - RNA, 20 nt, Homo sapiens
cuguauuuuuaaauugccaa

SEQ ID NO: 723701 - RNA, 18 nt, Homo sapiens
cugucaaaugucacagau

SEQ ID NO: 723702 - RNA, 19 nt, Homo sapiens
cugucaaguuaacaaggaa

SEQ ID NO: 723703 - RNA, 19 nt, Homo sapiens
cugucaauacuauggagua

SEQ ID NO: 723704 - RNA, 22 nt, Homo sapiens
cugucacaaccaagaauguuau

SEQ ID NO: 723705 - RNA, 18 nt, Homo sapiens
cugucacuagucucacca

SEQ ID NO: 723706 - RNA, 21 nt, Homo sapiens
cugucacuagucucaccagcc

SEQ ID NO: 723707 - RNA, 17 nt, Homo sapiens
cugucacucagcugaga

SEQ ID NO: 723708 - RNA, 23 nt, Homo sapiens
cugucacugaugguggcucuggu

SEQ ID NO: 723709 - RNA, 21 nt, Homo sapiens
cugucacuugaccaauacuga

SEQ ID NO: 723710 - RNA, 17 nt, Homo sapiens
cugucagaugucacaua

SEQ ID NO: 723711 - RNA, 13 nt, Homo sapiens
cugucagcugcaa

SEQ ID NO: 723712 - RNA, 18 nt, Homo sapiens
cugucaggauucuucaag

SEQ ID NO: 723713 - RNA, 18 nt, Homo sapiens
cugucaggguugucuacc

SEQ ID NO: 723714 - RNA, 12 nt, Homo sapiens
cugucauaacau

SEQ ID NO: 723715 - RNA, 16 nt, Homo sapiens
cugucauaacauccag

SEQ ID NO: 723716 - RNA, 18 nt, Homo sapiens
cugucauaacauccagag

SEQ ID NO: 723717 - RNA, 20 nt, Homo sapiens
cugucauugcgaccauuucu

SEQ ID NO: 723718 - RNA, 18 nt, Homo sapiens
cugucauuuuuaacagca

SEQ ID NO: 723719 - RNA, 20 nt, Homo sapiens
cuguccacauguggggacag

SEQ ID NO: 723720 - RNA, 20 nt, Homo sapiens
cuguccacccugccaagacu

SEQ ID NO: 723721 - RNA, 14 nt, Homo sapiens
cugucccaccaacu

SEQ ID NO: 723722 - RNA, 13 nt, Homo sapiens
cugucccagagag

SEQ ID NO: 723723 - RNA, 15 nt, Homo sapiens
cuguccccacacuga

SEQ ID NO: 723724 - RNA, 16 nt, Homo sapiens
cugucccuguagcuca

SEQ ID NO: 723725 - RNA, 17 nt, Homo sapiens
cugucccuguagcucag

SEQ ID NO: 723726 - RNA, 15 nt, Homo sapiens
cuguccucagccuug

SEQ ID NO: 723727 - RNA, 19 nt, Homo sapiens
cuguccucagccuugccag

SEQ ID NO: 723728 - RNA, 15 nt, Homo sapiens
cuguccucuguagua

SEQ ID NO: 723729 - RNA, 15 nt, Homo sapiens
cuguccuuccugacc

SEQ ID NO: 723730 - RNA, 17 nt, Homo sapiens
cuguccuuuaugauccc

SEQ ID NO: 723731 - RNA, 22 nt, Homo sapiens
cuguccuuuuggcacugagaua

SEQ ID NO: 723732 - RNA, 15 nt, Homo sapiens
cugucuaacugcugu

SEQ ID NO: 723733 - RNA, 17 nt, Homo sapiens
cugucuauaagagaauu

SEQ ID NO: 723734 - RNA, 13 nt, Homo sapiens
cugucucuacuaa

SEQ ID NO: 723735 - RNA, 17 nt, Homo sapiens
cugucucuagcuguucu

SEQ ID NO: 723736 - RNA, 20 nt, Homo sapiens
cugucugaaggacacuuccu

SEQ ID NO: 723737 - RNA, 14 nt, Homo sapiens
cugucugacaaccu

SEQ ID NO: 723738 - RNA, 23 nt, Homo sapiens
cugucugaguaagcccucaggag

SEQ ID NO: 723739 - RNA, 18 nt, Homo sapiens
cugucuguggggugguuc

SEQ ID NO: 723740 - RNA, 19 nt, Homo sapiens
cugucuuaugguccagaaa

SEQ ID NO: 723741 - RNA, 15 nt, Homo sapiens
cugucuucacaugua

SEQ ID NO: 723742 - RNA, 21 nt, Homo sapiens
cugucuucagucucacagaga

SEQ ID NO: 723743 - RNA, 20 nt, Homo sapiens
cugucuuccuguguaccucu

SEQ ID NO: 723744 - RNA, 14 nt, Homo sapiens
cugucuucucaggc

SEQ ID NO: 723745 - RNA, 16 nt, Homo sapiens
cugucuugccagauua

SEQ ID NO: 723746 - RNA, 17 nt, Homo sapiens
cugucuugccagauuac

SEQ ID NO: 723747 - RNA, 15 nt, Homo sapiens
cugucuuggggccac

SEQ ID NO: 723748 - RNA, 18 nt, Homo sapiens
cugucuuugacugugauu

SEQ ID NO: 723749 - RNA, 17 nt, Homo sapiens
cugucuuugucaccacg

SEQ ID NO: 723750 - RNA, 21 nt, Homo sapiens
cugugaaaaauaaagucauca

SEQ ID NO: 723751 - RNA, 22 nt, Homo sapiens
cugugaaaugcuggcauuugca

SEQ ID NO: 723752 - RNA, 20 nt, Homo sapiens
cugugaaauucacaguaaua

SEQ ID NO: 723753 - RNA, 15 nt, Homo sapiens
cugugaaauucucag

SEQ ID NO: 723754 - RNA, 22 nt, Homo sapiens
cugugaauguaaaacagagcca

SEQ ID NO: 723755 - RNA, 19 nt, Homo sapiens
cugugacauauucugagga

SEQ ID NO: 723756 - RNA, 19 nt, Homo sapiens
cugugacgagguggcaguc

SEQ ID NO: 723757 - RNA, 18 nt, Homo sapiens
cugugacuuaagaagccu

SEQ ID NO: 723758 - RNA, 19 nt, Homo sapiens
cugugacuuaagaagccuu

SEQ ID NO: 723759 - RNA, 20 nt, Homo sapiens
cugugacuuaagaagccuua

SEQ ID NO: 723760 - RNA, 23 nt, Homo sapiens
cugugagccgauuguccuaucuc

SEQ ID NO: 723761 - RNA, 14 nt, Homo sapiens
cugugaggugcuga

SEQ ID NO: 723762 - RNA, 15 nt, Homo sapiens
cugugagguucugua

SEQ ID NO: 723763 - RNA, 13 nt, Homo sapiens
cugugaguguaag

SEQ ID NO: 723764 - RNA, 14 nt, Homo sapiens
cugugauacacuga

SEQ ID NO: 723765 - RNA, 23 nt, Homo sapiens
cugugauauuuucacacugguaa

SEQ ID NO: 723766 - RNA, 17 nt, Homo sapiens
cugugaugcaugagcuc

SEQ ID NO: 723767 - RNA, 16 nt, Homo sapiens
cugugauuuaugccaa

SEQ ID NO: 723768 - RNA, 21 nt, Homo sapiens
cuuaacacacuggccauucuu

SEQ ID NO: 723769 - RNA, 17 nt, Homo sapiens
cuuaacauuucucucca

SEQ ID NO: 723770 - RNA, 12 nt, Homo sapiens
cuuaaccaaaga

SEQ ID NO: 723771 - RNA, 22 nt, Homo sapiens
cuuaacgaauaaaggucccaug

SEQ ID NO: 723772 - RNA, 16 nt, Homo sapiens
cuuaacggaccaaagc

SEQ ID NO: 723773 - RNA, 12 nt, Homo sapiens
cuuaacuaugag

SEQ ID NO: 723774 - RNA, 17 nt, Homo sapiens
cuuaacucugaugguuc

SEQ ID NO: 723775 - RNA, 18 nt, Homo sapiens
cuuaacugcauuuuuaga

SEQ ID NO: 723776 - RNA, 20 nt, Homo sapiens
cuuaagauucuuugugauga

SEQ ID NO: 723777 - RNA, 12 nt, Homo sapiens
cuuaagauuugg

SEQ ID NO: 723778 - RNA, 14 nt, Homo sapiens
cuuaagcaaaagaa

SEQ ID NO: 723779 - RNA, 16 nt, Homo sapiens
cuuaagcccagugcac

SEQ ID NO: 723780 - RNA, 21 nt, Homo sapiens
cuuaagggaacugaaucacuu

SEQ ID NO: 723781 - RNA, 20 nt, Homo sapiens
cuuaaguaagcaacagcaua

SEQ ID NO: 723782 - RNA, 13 nt, Homo sapiens
cuuaaguuuuaga

SEQ ID NO: 723783 - RNA, 19 nt, Homo sapiens
cuuaauaaaauaaacuaga

SEQ ID NO: 723784 - RNA, 22 nt, Homo sapiens
cuuaauaagauauuuaguaaua

SEQ ID NO: 723785 - RNA, 21 nt, Homo sapiens
cuuaauacuaggauacagaaa

SEQ ID NO: 723786 - RNA, 20 nt, Homo sapiens
cuuaauccaauauuuugccu

SEQ ID NO: 723787 - RNA, 21 nt, Homo sapiens
cuuaaugauccguuccauugc

SEQ ID NO: 723788 - RNA, 22 nt, Homo sapiens
cuuaaugcagacucuucuuaag

SEQ ID NO: 723789 - RNA, 23 nt, Homo sapiens
cuuaauggaugggcagucauuuu

SEQ ID NO: 723790 - RNA, 22 nt, Homo sapiens
cuuaauggcucaugaccuggaa

SEQ ID NO: 723791 - RNA, 17 nt, Homo sapiens
cuuaaugugcagcaaaa

SEQ ID NO: 723792 - RNA, 22 nt, Homo sapiens
cuuaaugugugugccaauggug

SEQ ID NO: 723793 - RNA, 15 nt, Homo sapiens
cuuaauguuuauucc

SEQ ID NO: 723794 - RNA, 14 nt, Homo sapiens
cuuaauucagucuc

SEQ ID NO: 723795 - RNA, 15 nt, Homo sapiens
cuuaauucucugcaa

SEQ ID NO: 723796 - RNA, 16 nt, Homo sapiens
cuuaauuuacuuuaag

SEQ ID NO: 723797 - RNA, 23 nt, Homo sapiens
cuuaauuuccuuuuugacacuga

SEQ ID NO: 723798 - RNA, 20 nt, Homo sapiens
cuuacaggaaaaccugcaga

SEQ ID NO: 723799 - RNA, 21 nt, Homo sapiens
cuuacauuuuucagacuucau

SEQ ID NO: 723800 - RNA, 18 nt, Homo sapiens
cuuaccagaagcuuccau

SEQ ID NO: 723801 - RNA, 16 nt, Homo sapiens
cuuaccugaacaggaa

SEQ ID NO: 723802 - RNA, 17 nt, Homo sapiens
cuuaccugggaccucac

SEQ ID NO: 723803 - RNA, 18 nt, Homo sapiens
cuuaccugggaccucaca

SEQ ID NO: 723804 - RNA, 16 nt, Homo sapiens
cuuacuagaccuguaa

SEQ ID NO: 723805 - RNA, 18 nt, Homo sapiens
aucuuaacccugugcugu

SEQ ID NO: 723806 - RNA, 16 nt, Homo sapiens
aucuuaagauccacaa

SEQ ID NO: 723807 - RNA, 16 nt, Homo sapiens
aucuuaagauucuuug

SEQ ID NO: 723808 - RNA, 16 nt, Homo sapiens
aucuuaauacuguuau

SEQ ID NO: 723809 - RNA, 21 nt, Homo sapiens
aucuuaaugaacacacaagcu

SEQ ID NO: 723810 - RNA, 14 nt, Homo sapiens
aucuuagcuuuuaa

SEQ ID NO: 723811 - RNA, 20 nt, Homo sapiens
aucuuauucuuuuguaauau

SEQ ID NO: 723812 - RNA, 13 nt, Homo sapiens
aucuucacugcaa

SEQ ID NO: 723813 - RNA, 15 nt, Homo sapiens
aucuucacugcaauu

SEQ ID NO: 723814 - RNA, 13 nt, Homo sapiens
aucuucagauuaa

SEQ ID NO: 723815 - RNA, 23 nt, Homo sapiens
aucuucagcccaggcuuuugcua

SEQ ID NO: 723816 - RNA, 20 nt, Homo sapiens
aucuuccagaaacuacauga

SEQ ID NO: 723817 - RNA, 23 nt, Homo sapiens
aucuuccguggucagagugccac

SEQ ID NO: 723818 - RNA, 15 nt, Homo sapiens
aucuuccugcugcug

SEQ ID NO: 723819 - RNA, 14 nt, Homo sapiens
aucuucucccccac

SEQ ID NO: 723820 - RNA, 13 nt, Homo sapiens
aucuucugaauuu

SEQ ID NO: 723821 - RNA, 22 nt, Homo sapiens
aucuucuuuauaauucuacuuu

SEQ ID NO: 723822 - RNA, 22 nt, Homo sapiens
aucuugaauccuuccauuccac

SEQ ID NO: 723823 - RNA, 15 nt, Homo sapiens
aucuugaccaacaga

SEQ ID NO: 723824 - RNA, 20 nt, Homo sapiens
aucuugccuaaaucccaaga

SEQ ID NO: 723825 - RNA, 15 nt, Homo sapiens
aucuugcuaccagua

SEQ ID NO: 723826 - RNA, 19 nt, Homo sapiens
aucuugcuaccaguauuua

SEQ ID NO: 723827 - RNA, 15 nt, Homo sapiens
aucuuggaacugcau

SEQ ID NO: 723828 - RNA, 19 nt, Homo sapiens
aucuuggagaaugugagaa

SEQ ID NO: 723829 - RNA, 17 nt, Homo sapiens
aucuuggcucacugcaa

SEQ ID NO: 723830 - RNA, 14 nt, Homo sapiens
aucuuguaaaggau

SEQ ID NO: 723831 - RNA, 16 nt, Homo sapiens
aucuuguggggccagg

SEQ ID NO: 723832 - RNA, 13 nt, Homo sapiens
aucuugugugauu

SEQ ID NO: 723833 - RNA, 15 nt, Homo sapiens
aucuuguuaauguca

SEQ ID NO: 723834 - RNA, 15 nt, Homo sapiens
aucuuguuacuguga

SEQ ID NO: 723835 - RNA, 23 nt, Homo sapiens
aucuuguuuuuccacuacugcua

SEQ ID NO: 723836 - RNA, 18 nt, Homo sapiens
aucuuuaaaauacacacu

SEQ ID NO: 723837 - RNA, 15 nt, Homo sapiens
aucuuuaacacagcc

SEQ ID NO: 723838 - RNA, 23 nt, Homo sapiens
aucuuuaacauaguccuguuacu

SEQ ID NO: 723839 - RNA, 23 nt, Homo sapiens
aucuuuaucaugaagcacaucaa

SEQ ID NO: 723840 - RNA, 18 nt, Homo sapiens
aucuuuauguagcacuac

SEQ ID NO: 723841 - RNA, 21 nt, Homo sapiens
aucuuucaggacucuaccuca

SEQ ID NO: 723842 - RNA, 14 nt, Homo sapiens
aucuuucauccuug

SEQ ID NO: 723843 - RNA, 16 nt, Homo sapiens
aucuuugggccugucc

SEQ ID NO: 723844 - RNA, 12 nt, Homo sapiens
aucuuuguauau

SEQ ID NO: 723845 - RNA, 18 nt, Homo sapiens
aucuuuguauauuacaua

SEQ ID NO: 723846 - RNA, 17 nt, Homo sapiens
aucuuuuagacacagcc

SEQ ID NO: 723847 - RNA, 13 nt, Homo sapiens
aucuuuucaaggc

SEQ ID NO: 723848 - RNA, 15 nt, Homo sapiens
aucuuuuuccacuuu

SEQ ID NO: 723849 - RNA, 14 nt, Homo sapiens
aucuuuuucuauau

SEQ ID NO: 723850 - RNA, 18 nt, Homo sapiens
augaaaaaaaaaugggaa

SEQ ID NO: 723851 - RNA, 17 nt, Homo sapiens
augaaaaauguguucca

SEQ ID NO: 723852 - RNA, 12 nt, Homo sapiens
augaaaaauugg

SEQ ID NO: 723853 - RNA, 21 nt, Homo sapiens
augaaaacauagcaucucagg

SEQ ID NO: 723854 - RNA, 19 nt, Homo sapiens
augaaaaucuccaucucaa

SEQ ID NO: 723855 - RNA, 14 nt, Homo sapiens
augaaaaugaauau

SEQ ID NO: 723856 - RNA, 17 nt, Homo sapiens
augaaaaugucaauacu

SEQ ID NO: 723857 - RNA, 16 nt, Homo sapiens
augaaacauuuuguca

SEQ ID NO: 723858 - RNA, 18 nt, Homo sapiens
augaaagaaaauugaguu

SEQ ID NO: 723859 - RNA, 21 nt, Homo sapiens
augaaagaagaguuccauggu

SEQ ID NO: 723860 - RNA, 18 nt, Homo sapiens
augaaagauucagugacg

SEQ ID NO: 723861 - RNA, 19 nt, Homo sapiens
augaaagggaaacugggaa

SEQ ID NO: 723862 - RNA, 13 nt, Homo sapiens
augaaauaaucag

SEQ ID NO: 723863 - RNA, 20 nt, Homo sapiens
augaaauccagugagcacua

SEQ ID NO: 723864 - RNA, 22 nt, Homo sapiens
augaaauccugcuucaguguau

SEQ ID NO: 723865 - RNA, 13 nt, Homo sapiens
augaaaucuugca

SEQ ID NO: 723866 - RNA, 18 nt, Homo sapiens
augaaauguaugugcucu

SEQ ID NO: 723867 - RNA, 13 nt, Homo sapiens
augaaauuacuua

SEQ ID NO: 723868 - RNA, 17 nt, Homo sapiens
augaaauuauaaucugu

SEQ ID NO: 723869 - RNA, 20 nt, Homo sapiens
augaaauuauaaucugugga

SEQ ID NO: 723870 - RNA, 20 nt, Homo sapiens
augaaauucuugaaguucau

SEQ ID NO: 723871 - RNA, 21 nt, Homo sapiens
augaacaaacuaugaucacag

SEQ ID NO: 723872 - RNA, 20 nt, Homo sapiens
augaacacuuauaagugaag

SEQ ID NO: 723873 - RNA, 17 nt, Homo sapiens
augaacauauuguugaa

SEQ ID NO: 723874 - RNA, 13 nt, Homo sapiens
augaaccacauua

SEQ ID NO: 723875 - RNA, 19 nt, Homo sapiens
augaaccuacuacccaggu

SEQ ID NO: 723876 - RNA, 12 nt, Homo sapiens
augaacugguga

SEQ ID NO: 723877 - RNA, 22 nt, Homo sapiens
augaacuuccauuuguauucaa

SEQ ID NO: 723878 - RNA, 19 nt, Homo sapiens
augaagaagacaaagucua

SEQ ID NO: 723879 - RNA, 20 nt, Homo sapiens
augaagacccuggaguucaa

SEQ ID NO: 723880 - RNA, 22 nt, Homo sapiens
augaagagcuauuuaaugacac

SEQ ID NO: 723881 - RNA, 19 nt, Homo sapiens
augaagcacaucaauuaca

SEQ ID NO: 723882 - RNA, 20 nt, Homo sapiens
augaaggauuacucuccaua

SEQ ID NO: 723883 - RNA, 13 nt, Homo sapiens
augaagguaauau

SEQ ID NO: 723884 - RNA, 15 nt, Homo sapiens
augaaguucuggaga

SEQ ID NO: 723885 - RNA, 11 nt, Homo sapiens
augaauaucag

SEQ ID NO: 723886 - RNA, 14 nt, Homo sapiens
augaaucauauuca

SEQ ID NO: 723887 - RNA, 18 nt, Homo sapiens
augaaucauugauugaau

SEQ ID NO: 723888 - RNA, 22 nt, Homo sapiens
augaauccccaauaauugcaga

SEQ ID NO: 723889 - RNA, 16 nt, Homo sapiens
aucuaagggucucuca

SEQ ID NO: 723890 - RNA, 17 nt, Homo sapiens
aucuaagggucucucau

SEQ ID NO: 723891 - RNA, 16 nt, Homo sapiens
aucuaauauauaugaa

SEQ ID NO: 723892 - RNA, 22 nt, Homo sapiens
aucuacaaaaaacaacaaauaa

SEQ ID NO: 723893 - RNA, 21 nt, Homo sapiens
aucuacaagauccuccugcug

SEQ ID NO: 723894 - RNA, 12 nt, Homo sapiens
aucuacacagcc

SEQ ID NO: 723895 - RNA, 18 nt, Homo sapiens
aucuacacccaccagagu

SEQ ID NO: 723896 - RNA, 17 nt, Homo sapiens
aucuacagcucaccucu

SEQ ID NO: 723897 - RNA, 12 nt, Homo sapiens
aucuacauucac

SEQ ID NO: 723898 - RNA, 14 nt, Homo sapiens
aucuaccacuguau

SEQ ID NO: 723899 - RNA, 14 nt, Homo sapiens
aucuaccagcauaa

SEQ ID NO: 723900 - RNA, 15 nt, Homo sapiens
aucuaccccuuccuu

SEQ ID NO: 723901 - RNA, 18 nt, Homo sapiens
aucuacccugcugaccuc

SEQ ID NO: 723902 - RNA, 17 nt, Homo sapiens
aucuaccuuuugcuacu

SEQ ID NO: 723903 - RNA, 18 nt, Homo sapiens
aucuacuucaacacuuca

SEQ ID NO: 723904 - RNA, 22 nt, Homo sapiens
aucuacuucaacacuucaugua

SEQ ID NO: 723905 - RNA, 16 nt, Homo sapiens
aucuagaaauguucac

SEQ ID NO: 723906 - RNA, 20 nt, Homo sapiens
aucuagagaaggcauuucau

SEQ ID NO: 723907 - RNA, 19 nt, Homo sapiens
aucuagccuaaaguauaca

SEQ ID NO: 723908 - RNA, 22 nt, Homo sapiens
aucuagguucaggaagaccaca

SEQ ID NO: 723909 - RNA, 16 nt, Homo sapiens
aucuagucacaaagac

SEQ ID NO: 723910 - RNA, 12 nt, Homo sapiens
aucuaguuuaca

SEQ ID NO: 723911 - RNA, 19 nt, Homo sapiens
aucuauaaaaugacagauc

SEQ ID NO: 723912 - RNA, 17 nt, Homo sapiens
aucuauaggcagcuucu

SEQ ID NO: 723913 - RNA, 14 nt, Homo sapiens
aucuaucaacuaua

SEQ ID NO: 723914 - RNA, 17 nt, Homo sapiens
aucuaucaccugucauc

SEQ ID NO: 723915 - RNA, 14 nt, Homo sapiens
aucuaugcugagua

SEQ ID NO: 723916 - RNA, 13 nt, Homo sapiens
aucuauuaucuca

SEQ ID NO: 723917 - RNA, 16 nt, Homo sapiens
aucuauuccuguaaau

SEQ ID NO: 723918 - RNA, 14 nt, Homo sapiens
aucuauucucucca

SEQ ID NO: 723919 - RNA, 18 nt, Homo sapiens
aucuauugcucaucagcu

SEQ ID NO: 723920 - RNA, 21 nt, Homo sapiens
aucuauugcucaucagcuuua

SEQ ID NO: 723921 - RNA, 16 nt, Homo sapiens
aucuauuucugagaag

SEQ ID NO: 723922 - RNA, 14 nt, Homo sapiens
aucucaaaacugca

SEQ ID NO: 723923 - RNA, 18 nt, Homo sapiens
aucucaagauucaguaga

SEQ ID NO: 723924 - RNA, 12 nt, Homo sapiens
aucucaaucucc

SEQ ID NO: 723925 - RNA, 17 nt, Homo sapiens
aucucaaugaaccauaa

SEQ ID NO: 723926 - RNA, 22 nt, Homo sapiens
aucucaaugaaccauaaauuca

SEQ ID NO: 723927 - RNA, 14 nt, Homo sapiens
aucucaauguacau

SEQ ID NO: 723928 - RNA, 17 nt, Homo sapiens
aucucaauguacauaga

SEQ ID NO: 723929 - RNA, 16 nt, Homo sapiens
aucucaccccauccca

SEQ ID NO: 723930 - RNA, 13 nt, Homo sapiens
aucucaccugcug

SEQ ID NO: 723931 - RNA, 22 nt, Homo sapiens
aucucaccugcuggggaccuca

SEQ ID NO: 723932 - RNA, 19 nt, Homo sapiens
aucucacuuaguccuuuau

SEQ ID NO: 723933 - RNA, 12 nt, Homo sapiens
aucucacuuuau

SEQ ID NO: 723934 - RNA, 17 nt, Homo sapiens
aucucagagacaggugg

SEQ ID NO: 723935 - RNA, 17 nt, Homo sapiens
aucucagccagccucca

SEQ ID NO: 723936 - RNA, 23 nt, Homo sapiens
aucucagccagccuccagcaccu

SEQ ID NO: 723937 - RNA, 20 nt, Homo sapiens
aucucagccauucuaacuca

SEQ ID NO: 723938 - RNA, 11 nt, Homo sapiens
aucucagcuca

SEQ ID NO: 723939 - RNA, 17 nt, Homo sapiens
aucucagcucacugcaa

SEQ ID NO: 723940 - RNA, 15 nt, Homo sapiens
aucucaggaacauca

SEQ ID NO: 723941 - RNA, 20 nt, Homo sapiens
aucucaggauuucaccagaa

SEQ ID NO: 723942 - RNA, 14 nt, Homo sapiens
aucucaucccucaa

SEQ ID NO: 723943 - RNA, 17 nt, Homo sapiens
aucucaucgucugcgca

SEQ ID NO: 723944 - RNA, 12 nt, Homo sapiens
aucuccacuuuu

SEQ ID NO: 723945 - RNA, 17 nt, Homo sapiens
aucuccagggcuccaaa

SEQ ID NO: 723946 - RNA, 15 nt, Homo sapiens
aucucccaucuuccu

SEQ ID NO: 723947 - RNA, 21 nt, Homo sapiens
aucuccccucacacuuugcca

SEQ ID NO: 723948 - RNA, 19 nt, Homo sapiens
aucucccgugggcaucuca

SEQ ID NO: 723949 - RNA, 15 nt, Homo sapiens
aucucccucuaagca

SEQ ID NO: 723950 - RNA, 18 nt, Homo sapiens
aucucccucuaagcacau

SEQ ID NO: 723951 - RNA, 21 nt, Homo sapiens
aucuccucucucuuuccucca

SEQ ID NO: 723952 - RNA, 16 nt, Homo sapiens
aucuccucuguaauga

SEQ ID NO: 723953 - RNA, 21 nt, Homo sapiens
aucuccugacagaaggugcca

SEQ ID NO: 723954 - RNA, 19 nt, Homo sapiens
aucucgccacugcacucca

SEQ ID NO: 723955 - RNA, 17 nt, Homo sapiens
aucucggcucacugcaa

SEQ ID NO: 723956 - RNA, 15 nt, Homo sapiens
aucucuacuaaaaau

SEQ ID NO: 723957 - RNA, 13 nt, Homo sapiens
aucucuacugcuu

SEQ ID NO: 723958 - RNA, 17 nt, Homo sapiens
aucucucaaaacaauau

SEQ ID NO: 723959 - RNA, 14 nt, Homo sapiens
aucucucuaccucc

SEQ ID NO: 723960 - RNA, 15 nt, Homo sapiens
aucucucuaccucca

SEQ ID NO: 723961 - RNA, 13 nt, Homo sapiens
aucucucuacucc

SEQ ID NO: 723962 - RNA, 16 nt, Homo sapiens
aucucucuagugaugg

SEQ ID NO: 723963 - RNA, 17 nt, Homo sapiens
aucucugccauaucagu

SEQ ID NO: 723964 - RNA, 13 nt, Homo sapiens
aucucugucucaa

SEQ ID NO: 723965 - RNA, 17 nt, Homo sapiens
aucucuuauuuuacaau

SEQ ID NO: 723966 - RNA, 22 nt, Homo sapiens
aucucuucagucucuauaccaa

SEQ ID NO: 723967 - RNA, 13 nt, Homo sapiens
aucucuuccacau

SEQ ID NO: 723968 - RNA, 16 nt, Homo sapiens
aucucuugaaaccugu

SEQ ID NO: 723969 - RNA, 19 nt, Homo sapiens
aucucuugcacucaaagcu

SEQ ID NO: 723970 - RNA, 23 nt, Homo sapiens
aucucuuguauaugaugaucugg

SEQ ID NO: 723971 - RNA, 21 nt, Homo sapiens
aucucuuuugaauccaugcuu

SEQ ID NO: 723972 - RNA, 13 nt, Homo sapiens
aucugacccagug

SEQ ID NO: 723973 - RNA, 15 nt, Homo sapiens
aucugacuaugacau

SEQ ID NO: 723974 - RNA, 17 nt, Homo sapiens
aucugagaggccacagu

SEQ ID NO: 723975 - RNA, 18 nt, Homo sapiens
aucugagggagacugcaa

SEQ ID NO: 723976 - RNA, 17 nt, Homo sapiens
aucugauguaacaaggu

SEQ ID NO: 723977 - RNA, 18 nt, Homo sapiens
aucugauguuaaccaaug

SEQ ID NO: 723978 - RNA, 22 nt, Homo sapiens
aucugcauccagccuccugcua

SEQ ID NO: 723979 - RNA, 17 nt, Homo sapiens
aucugcaugucuacuca

SEQ ID NO: 723980 - RNA, 11 nt, Homo sapiens
aucugccauug

SEQ ID NO: 723981 - RNA, 16 nt, Homo sapiens
aucugccauugggacc

SEQ ID NO: 723982 - RNA, 23 nt, Homo sapiens
aucugccuggggccucaccugcu

SEQ ID NO: 723983 - RNA, 20 nt, Homo sapiens
aucugcuagggaauaucaau

SEQ ID NO: 723984 - RNA, 16 nt, Homo sapiens
aucugcucuagauuca

SEQ ID NO: 723985 - RNA, 14 nt, Homo sapiens
aucuggaacccaga

SEQ ID NO: 723986 - RNA, 20 nt, Homo sapiens
aucuggagccugaugucuua

SEQ ID NO: 723987 - RNA, 14 nt, Homo sapiens
aucuggauucuaca

SEQ ID NO: 723988 - RNA, 16 nt, Homo sapiens
aucuggcacacucccu

SEQ ID NO: 723989 - RNA, 15 nt, Homo sapiens
aucuggcccagggug

SEQ ID NO: 723990 - RNA, 16 nt, Homo sapiens
aucuggcuuagugcca

SEQ ID NO: 723991 - RNA, 17 nt, Homo sapiens
aucuggguaucuuucca

SEQ ID NO: 723992 - RNA, 16 nt, Homo sapiens
aucuggucccuugcag

SEQ ID NO: 723993 - RNA, 16 nt, Homo sapiens
aucuggugacaaauau

SEQ ID NO: 723994 - RNA, 22 nt, Homo sapiens
aucuguaaauuuaacugcauau

SEQ ID NO: 723995 - RNA, 15 nt, Homo sapiens
aucuguacauacugu

SEQ ID NO: 723996 - RNA, 14 nt, Homo sapiens
aucuguacauauua

SEQ ID NO: 723997 - RNA, 16 nt, Homo sapiens
aucuguauauacaaua

SEQ ID NO: 723998 - RNA, 20 nt, Homo sapiens
aucugucuugccagccagaa

SEQ ID NO: 723999 - RNA, 18 nt, Homo sapiens
aucugugaacauguuaag

SEQ ID NO: 724000 - RNA, 20 nt, Homo sapiens
aucugugcaggauauuugca

SEQ ID NO: 724001 - RNA, 17 nt, Homo sapiens
aucuguuuucuaccucc

SEQ ID NO: 724002 - RNA, 16 nt, Homo sapiens
aucuguuuuucaugua

SEQ ID NO: 724003 - RNA, 18 nt, Homo sapiens
aucuuaaaacaaauucau

SEQ ID NO: 724004 - RNA, 13 nt, Homo sapiens
aucuuaaaacuaa

SEQ ID NO: 724005 - RNA, 17 nt, Homo sapiens
agguuuccuaggucuga

SEQ ID NO: 724006 - RNA, 21 nt, Homo sapiens
agguuuccuuuuggaacauuu

SEQ ID NO: 724007 - RNA, 15 nt, Homo sapiens
agguuugccagugaa

SEQ ID NO: 724008 - RNA, 17 nt, Homo sapiens
agguuugucccagucag

SEQ ID NO: 724009 - RNA, 21 nt, Homo sapiens
agguuuguuuagaagaagugu

SEQ ID NO: 724010 - RNA, 17 nt, Homo sapiens
agguuuuacacuugcau

SEQ ID NO: 724011 - RNA, 20 nt, Homo sapiens
agguuuuuauuuuuccuaca

SEQ ID NO: 724012 - RNA, 22 nt, Homo sapiens
agguuuuucaucugaaaagcag

SEQ ID NO: 724013 - RNA, 21 nt, Homo sapiens
aguaaaaaauuaaagcccaua

SEQ ID NO: 724014 - RNA, 19 nt, Homo sapiens
aguaaaaacuguucucuau

SEQ ID NO: 724015 - RNA, 15 nt, Homo sapiens
aguaaaaagguggua

SEQ ID NO: 724016 - RNA, 15 nt, Homo sapiens
aguaaaacuguggua

SEQ ID NO: 724017 - RNA, 14 nt, Homo sapiens
aguaaaagaugaag

SEQ ID NO: 724018 - RNA, 14 nt, Homo sapiens
aguaaaagugcuuu

SEQ ID NO: 724019 - RNA, 12 nt, Homo sapiens
aguaaacacuug

SEQ ID NO: 724020 - RNA, 20 nt, Homo sapiens
aguaaaggcaguaaugccuu

SEQ ID NO: 724021 - RNA, 23 nt, Homo sapiens
aguaaaggcugcugcuacaaugu

SEQ ID NO: 724022 - RNA, 21 nt, Homo sapiens
aguaaagguacgauuauacuu

SEQ ID NO: 724023 - RNA, 21 nt, Homo sapiens
aguaaagguuuuuguaauaaa

SEQ ID NO: 724024 - RNA, 15 nt, Homo sapiens
aguaaauaacuggaa

SEQ ID NO: 724025 - RNA, 20 nt, Homo sapiens
aguaacaauacaaauggauu

SEQ ID NO: 724026 - RNA, 13 nt, Homo sapiens
aguaacugagauu

SEQ ID NO: 724027 - RNA, 12 nt, Homo sapiens
aguaacugugac

SEQ ID NO: 724028 - RNA, 19 nt, Homo sapiens
aguaacuuggcuuucauua

SEQ ID NO: 724029 - RNA, 14 nt, Homo sapiens
aguaagaauaccac

SEQ ID NO: 724030 - RNA, 16 nt, Homo sapiens
aguaagacccagcauu

SEQ ID NO: 724031 - RNA, 18 nt, Homo sapiens
aguaagagcuggugucug

SEQ ID NO: 724032 - RNA, 20 nt, Homo sapiens
aguaagcaguguuacuugca

SEQ ID NO: 724033 - RNA, 16 nt, Homo sapiens
aguaagcugcucuauu

SEQ ID NO: 724034 - RNA, 13 nt, Homo sapiens
aguaagugcuuuu

SEQ ID NO: 724035 - RNA, 17 nt, Homo sapiens
aguaauaagauggcugu

SEQ ID NO: 724036 - RNA, 15 nt, Homo sapiens
aguaauagagcaaaa

SEQ ID NO: 724037 - RNA, 19 nt, Homo sapiens
aguaauauagcugagacua

SEQ ID NO: 724038 - RNA, 13 nt, Homo sapiens
aguaaucaggcag

SEQ ID NO: 724039 - RNA, 19 nt, Homo sapiens
aguaaucccauuucccaaa

SEQ ID NO: 724040 - RNA, 13 nt, Homo sapiens
aguaaucuuggcu

SEQ ID NO: 724041 - RNA, 14 nt, Homo sapiens
aguaaugcucugac

SEQ ID NO: 724042 - RNA, 14 nt, Homo sapiens
aguaauggcauuuu

SEQ ID NO: 724043 - RNA, 16 nt, Homo sapiens
aguaaugugucauauc

SEQ ID NO: 724044 - RNA, 17 nt, Homo sapiens
aguaauuccuguuacuu

SEQ ID NO: 724045 - RNA, 21 nt, Homo sapiens
aguacaaggucaucaugcucc

SEQ ID NO: 724046 - RNA, 19 nt, Homo sapiens
aguacacccaguugccaaa

SEQ ID NO: 724047 - RNA, 21 nt, Homo sapiens
aguacaugcacacucaugugc

SEQ ID NO: 724048 - RNA, 14 nt, Homo sapiens
aguaccacacauau

SEQ ID NO: 724049 - RNA, 18 nt, Homo sapiens
aguaccacacauauugca

SEQ ID NO: 724050 - RNA, 22 nt, Homo sapiens
aguaccaccccucucuccccac

SEQ ID NO: 724051 - RNA, 15 nt, Homo sapiens
aguaccacucaggcc

SEQ ID NO: 724052 - RNA, 15 nt, Homo sapiens
aguaccuacugugug

SEQ ID NO: 724053 - RNA, 13 nt, Homo sapiens
aguaccuggaccu

SEQ ID NO: 724054 - RNA, 14 nt, Homo sapiens
aguaccuguaguga

SEQ ID NO: 724055 - RNA, 15 nt, Homo sapiens
aguacugccaauacu

SEQ ID NO: 724056 - RNA, 12 nt, Homo sapiens
aguagagccagc

SEQ ID NO: 724057 - RNA, 16 nt, Homo sapiens
aguagaucaccuccuc

SEQ ID NO: 724058 - RNA, 14 nt, Homo sapiens
aguagaugggacua

SEQ ID NO: 724059 - RNA, 16 nt, Homo sapiens
aguagauucuuacaag

SEQ ID NO: 724060 - RNA, 16 nt, Homo sapiens
aguagcuggauuacag

SEQ ID NO: 724061 - RNA, 21 nt, Homo sapiens
aguagcuggauuacaggcaug

SEQ ID NO: 724062 - RNA, 19 nt, Homo sapiens
aguagcugggacuacaggc

SEQ ID NO: 724063 - RNA, 13 nt, Homo sapiens
aguagcugggauu

SEQ ID NO: 724064 - RNA, 15 nt, Homo sapiens
aguaggagcacuggg

SEQ ID NO: 724065 - RNA, 15 nt, Homo sapiens
aguaggauccaguga

SEQ ID NO: 724066 - RNA, 14 nt, Homo sapiens
aguaggaugaauca

SEQ ID NO: 724067 - RNA, 19 nt, Homo sapiens
aguaggcauauaucacuaa

SEQ ID NO: 724068 - RNA, 20 nt, Homo sapiens
aguaggcccugguuccugcu

SEQ ID NO: 724069 - RNA, 18 nt, Homo sapiens
aguaggugugacuugaac

SEQ ID NO: 724070 - RNA, 18 nt, Homo sapiens
aguagucccugcacagug

SEQ ID NO: 724071 - RNA, 15 nt, Homo sapiens
aguagugucaucacu

SEQ ID NO: 724072 - RNA, 23 nt, Homo sapiens
aguaguuuuuacagcuguguuau

SEQ ID NO: 724073 - RNA, 16 nt, Homo sapiens
aguaguuuuucagcua

SEQ ID NO: 724074 - RNA, 19 nt, Homo sapiens
aguauaaaugaauuugcau

SEQ ID NO: 724075 - RNA, 17 nt, Homo sapiens
aguauaaguauucaagu

SEQ ID NO: 724076 - RNA, 15 nt, Homo sapiens
aguauacaacugccu

SEQ ID NO: 724077 - RNA, 21 nt, Homo sapiens
aguauagcuugcauagucaau

SEQ ID NO: 724078 - RNA, 19 nt, Homo sapiens
aguauaugucauuuacuca

SEQ ID NO: 724079 - RNA, 13 nt, Homo sapiens
aguaucagcacua

SEQ ID NO: 724080 - RNA, 13 nt, Homo sapiens
aguauccacuuug

SEQ ID NO: 724081 - RNA, 15 nt, Homo sapiens
aguauccaugcaugu

SEQ ID NO: 724082 - RNA, 22 nt, Homo sapiens
aguauccaugcaugugcauaua

SEQ ID NO: 724083 - RNA, 15 nt, Homo sapiens
aguaucccacaucca

SEQ ID NO: 724084 - RNA, 19 nt, Homo sapiens
aguauccugcuucugauau

SEQ ID NO: 724085 - RNA, 20 nt, Homo sapiens
aguaucucuucagucucuau

SEQ ID NO: 724086 - RNA, 23 nt, Homo sapiens
aguaucucuucagucucuauacc

SEQ ID NO: 724087 - RNA, 23 nt, Homo sapiens
aguaucuguauguauauauacac

SEQ ID NO: 724088 - RNA, 14 nt, Homo sapiens
aguaugagggaaaa

SEQ ID NO: 724089 - RNA, 13 nt, Homo sapiens
aguaugauggcag

SEQ ID NO: 724090 - RNA, 21 nt, Homo sapiens
aguaugcaaugcuaucacugu

SEQ ID NO: 724091 - RNA, 16 nt, Homo sapiens
aguaugcacuuggccu

SEQ ID NO: 724092 - RNA, 17 nt, Homo sapiens
aguaugccuuaagcaga

SEQ ID NO: 724093 - RNA, 14 nt, Homo sapiens
aguaugggaucuga

SEQ ID NO: 724094 - RNA, 18 nt, Homo sapiens
aguauguccgaugguauc

SEQ ID NO: 724095 - RNA, 15 nt, Homo sapiens
aguauguggaagugu

SEQ ID NO: 724096 - RNA, 21 nt, Homo sapiens
aguauuaagucaagaauauaa

SEQ ID NO: 724097 - RNA, 18 nt, Homo sapiens
aguauuaucacugcugga

SEQ ID NO: 724098 - RNA, 22 nt, Homo sapiens
aguauucauucugcauugcuag

SEQ ID NO: 724099 - RNA, 23 nt, Homo sapiens
aguauuccaugguguauaugugc

SEQ ID NO: 724100 - RNA, 20 nt, Homo sapiens
aguauuccuaaccugucaga

SEQ ID NO: 724101 - RNA, 20 nt, Homo sapiens
aguauucucuuuucaagaag

SEQ ID NO: 724102 - RNA, 23 nt, Homo sapiens
aguauugaaauguuugcauaaag

SEQ ID NO: 724103 - RNA, 14 nt, Homo sapiens
aguauuuaagccua

SEQ ID NO: 724104 - RNA, 23 nt, Homo sapiens
aguauuuauugcaggaugguguc

SEQ ID NO: 724105 - RNA, 18 nt, Homo sapiens
aguauuucaugcugggaa

SEQ ID NO: 724106 - RNA, 17 nt, Homo sapiens
aguauuuuuaacacuua

SEQ ID NO: 724107 - RNA, 16 nt, Homo sapiens
agucaaaagagagaag

SEQ ID NO: 724108 - RNA, 17 nt, Homo sapiens
agucaaaaggugccugu

SEQ ID NO: 724109 - RNA, 17 nt, Homo sapiens
agucaaagagcacugga

SEQ ID NO: 724110 - RNA, 17 nt, Homo sapiens
agucaaagcaggauuau

SEQ ID NO: 724111 - RNA, 15 nt, Homo sapiens
agucaaauccagugg

SEQ ID NO: 724112 - RNA, 17 nt, Homo sapiens
agucaacaguucaaaga

SEQ ID NO: 724113 - RNA, 21 nt, Homo sapiens
agucaaccuuguuucuacugu

SEQ ID NO: 724114 - RNA, 18 nt, Homo sapiens
agucaacucaacauggca

SEQ ID NO: 724115 - RNA, 19 nt, Homo sapiens
agucaagaacaauucacag

SEQ ID NO: 724116 - RNA, 14 nt, Homo sapiens
agucaauccuguca

SEQ ID NO: 724117 - RNA, 22 nt, Homo sapiens
agucacaggaagaaagcagaaa

SEQ ID NO: 724118 - RNA, 22 nt, Homo sapiens
agucacaugcuagcagcuguga

SEQ ID NO: 724119 - RNA, 13 nt, Homo sapiens
agucaccaggaau

SEQ ID NO: 724120 - RNA, 16 nt, Homo sapiens
aggcuggccaaggugu

SEQ ID NO: 724121 - RNA, 15 nt, Homo sapiens
aggcugggcagcaca

SEQ ID NO: 724122 - RNA, 16 nt, Homo sapiens
aggcugggccaugucc

SEQ ID NO: 724123 - RNA, 17 nt, Homo sapiens
aggcugggccaugucca

SEQ ID NO: 724124 - RNA, 18 nt, Homo sapiens
aggcugggccauguccaa

SEQ ID NO: 724125 - RNA, 23 nt, Homo sapiens
aggcugggccauguccaaagagg

SEQ ID NO: 724126 - RNA, 19 nt, Homo sapiens
aggcugguauuuuugucug

SEQ ID NO: 724127 - RNA, 14 nt, Homo sapiens
aggcugguggcaag

SEQ ID NO: 724128 - RNA, 12 nt, Homo sapiens
aggcugucacag

SEQ ID NO: 724129 - RNA, 16 nt, Homo sapiens
aggcuguccuguacau

SEQ ID NO: 724130 - RNA, 14 nt, Homo sapiens
aggcugugcaccua

SEQ ID NO: 724131 - RNA, 18 nt, Homo sapiens
aggcuguuugagaaccau

SEQ ID NO: 724132 - RNA, 12 nt, Homo sapiens
aggcuuacuuca

SEQ ID NO: 724133 - RNA, 20 nt, Homo sapiens
aggcuuaucagggaguuaca

SEQ ID NO: 724134 - RNA, 20 nt, Homo sapiens
aggcuucagugagccaugau

SEQ ID NO: 724135 - RNA, 22 nt, Homo sapiens
aggcuucagugagccaugauca

SEQ ID NO: 724136 - RNA, 23 nt, Homo sapiens
aggcuucagugagccaugaucau

SEQ ID NO: 724137 - RNA, 10 nt, Homo sapiens
aggcuuccug

SEQ ID NO: 724138 - RNA, 23 nt, Homo sapiens
aggcuucucacggcgaccaauaa

SEQ ID NO: 724139 - RNA, 16 nt, Homo sapiens
aggcuugagucaccau

SEQ ID NO: 724140 - RNA, 16 nt, Homo sapiens
aggcuuggcuggugua

SEQ ID NO: 724141 - RNA, 16 nt, Homo sapiens
aggcuugucacuagca

SEQ ID NO: 724142 - RNA, 15 nt, Homo sapiens
aggcuuuacagugua

SEQ ID NO: 724143 - RNA, 20 nt, Homo sapiens
aggcuuuccaauguagcuca

SEQ ID NO: 724144 - RNA, 19 nt, Homo sapiens
aggcuuugaguuaacucac

SEQ ID NO: 724145 - RNA, 13 nt, Homo sapiens
agggaaaacugca

SEQ ID NO: 724146 - RNA, 18 nt, Homo sapiens
agggaaaaguucuccuau

SEQ ID NO: 724147 - RNA, 22 nt, Homo sapiens
agggaaaauguuuaccagugua

SEQ ID NO: 724148 - RNA, 13 nt, Homo sapiens
agggaaaggggag

SEQ ID NO: 724149 - RNA, 22 nt, Homo sapiens
agggaaauuuuggggggaacau

SEQ ID NO: 724150 - RNA, 13 nt, Homo sapiens
agggaagccaaaa

SEQ ID NO: 724151 - RNA, 18 nt, Homo sapiens
agggaagccccacuugaa

SEQ ID NO: 724152 - RNA, 20 nt, Homo sapiens
agggaagcuccuccagugaa

SEQ ID NO: 724153 - RNA, 18 nt, Homo sapiens
agggaagcugucccucac

SEQ ID NO: 724154 - RNA, 21 nt, Homo sapiens
agggaaggagcccagccagaa

SEQ ID NO: 724155 - RNA, 19 nt, Homo sapiens
agggaaggucucaggagaa

SEQ ID NO: 724156 - RNA, 19 nt, Homo sapiens
agggaaguugaacgagcau

SEQ ID NO: 724157 - RNA, 21 nt, Homo sapiens
agggaaguuucguaugcacuc

SEQ ID NO: 724158 - RNA, 16 nt, Homo sapiens
agggaauacugugcau

SEQ ID NO: 724159 - RNA, 17 nt, Homo sapiens
agggaaugcagcaggaa

SEQ ID NO: 724160 - RNA, 16 nt, Homo sapiens
agggaaugugaaauuu

SEQ ID NO: 724161 - RNA, 17 nt, Homo sapiens
agggacaaaacacugug

SEQ ID NO: 724162 - RNA, 20 nt, Homo sapiens
agggacaccaagccuuggcu

SEQ ID NO: 724163 - RNA, 16 nt, Homo sapiens
agggacaggcacucca

SEQ ID NO: 724164 - RNA, 14 nt, Homo sapiens
agggacccacuuca

SEQ ID NO: 724165 - RNA, 16 nt, Homo sapiens
agggaccuuguuaaca

SEQ ID NO: 724166 - RNA, 17 nt, Homo sapiens
agggacuuuagagaaua

SEQ ID NO: 724167 - RNA, 22 nt, Homo sapiens
agggagaauccucccuucccag

SEQ ID NO: 724168 - RNA, 20 nt, Homo sapiens
agggagacaccaguggugcg

SEQ ID NO: 724169 - RNA, 15 nt, Homo sapiens
agggagacugcaucu

SEQ ID NO: 724170 - RNA, 14 nt, Homo sapiens
agggagagccagcu

SEQ ID NO: 724171 - RNA, 17 nt, Homo sapiens
agggagcacuguucaca

SEQ ID NO: 724172 - RNA, 22 nt, Homo sapiens
agggaggcaacacugcugucca

SEQ ID NO: 724173 - RNA, 18 nt, Homo sapiens
agggaggcggauuucccu

SEQ ID NO: 724174 - RNA, 20 nt, Homo sapiens
agggaggcgggggcugcccu

SEQ ID NO: 724175 - RNA, 18 nt, Homo sapiens
agggagggcuguggugcc

SEQ ID NO: 724176 - RNA, 14 nt, Homo sapiens
agggaggucacugg

SEQ ID NO: 724177 - RNA, 16 nt, Homo sapiens
agggaggucacuggaa

SEQ ID NO: 724178 - RNA, 15 nt, Homo sapiens
agggauaauacugug

SEQ ID NO: 724179 - RNA, 15 nt, Homo sapiens
agggaucacugccaa

SEQ ID NO: 724180 - RNA, 12 nt, Homo sapiens
agggaucacugg

SEQ ID NO: 724181 - RNA, 19 nt, Homo sapiens
agggaucucucuacaagag

SEQ ID NO: 724182 - RNA, 21 nt, Homo sapiens
agggaugaguccccugugaga

SEQ ID NO: 724183 - RNA, 19 nt, Homo sapiens
agggaugcugccugaguca

SEQ ID NO: 724184 - RNA, 16 nt, Homo sapiens
agggauuccccuaacc

SEQ ID NO: 724185 - RNA, 23 nt, Homo sapiens
agggcaacaauacaugcugcuaa

SEQ ID NO: 724186 - RNA, 15 nt, Homo sapiens
agggcaagaucucag

SEQ ID NO: 724187 - RNA, 23 nt, Homo sapiens
agggcagggcaucuccugugcau

SEQ ID NO: 724188 - RNA, 23 nt, Homo sapiens
agggcagggcugaggccucucau

SEQ ID NO: 724189 - RNA, 13 nt, Homo sapiens
agggcaggggugc

SEQ ID NO: 724190 - RNA, 15 nt, Homo sapiens
agggcagugcccuuu

SEQ ID NO: 724191 - RNA, 22 nt, Homo sapiens
agggcaguuuugaggcaugacu

SEQ ID NO: 724192 - RNA, 16 nt, Homo sapiens
agggccaaagcacagc

SEQ ID NO: 724193 - RNA, 20 nt, Homo sapiens
agggccagauuucauucuca

SEQ ID NO: 724194 - RNA, 23 nt, Homo sapiens
agggccccaauguauguguggcu

SEQ ID NO: 724195 - RNA, 23 nt, Homo sapiens
agggcccucccagcccauugcug

SEQ ID NO: 724196 - RNA, 20 nt, Homo sapiens
agggccugcagugauucagc

SEQ ID NO: 724197 - RNA, 16 nt, Homo sapiens
agggccuguaauccca

SEQ ID NO: 724198 - RNA, 18 nt, Homo sapiens
agggcgggcagagggcug

SEQ ID NO: 724199 - RNA, 19 nt, Homo sapiens
agggcuccugcacuuacuu

SEQ ID NO: 724200 - RNA, 17 nt, Homo sapiens
agggcucguuuccccac

SEQ ID NO: 724201 - RNA, 19 nt, Homo sapiens
agggcugcagucacauuga

SEQ ID NO: 724202 - RNA, 21 nt, Homo sapiens
agggcuugucauuaccagacg

SEQ ID NO: 724203 - RNA, 22 nt, Homo sapiens
aggggaaaagaaaaucuuuuaa

SEQ ID NO: 724204 - RNA, 18 nt, Homo sapiens
aggggaagaggccuguuu

SEQ ID NO: 724205 - RNA, 15 nt, Homo sapiens
aggggaaguggucca

SEQ ID NO: 724206 - RNA, 19 nt, Homo sapiens
aggggaauuuucucuccau

SEQ ID NO: 724207 - RNA, 17 nt, Homo sapiens
aggggaggaucacugga

SEQ ID NO: 724208 - RNA, 15 nt, Homo sapiens
aggggaucacacgag

SEQ ID NO: 724209 - RNA, 13 nt, Homo sapiens
aggggauccagcc

SEQ ID NO: 724210 - RNA, 14 nt, Homo sapiens
aggggcaacgaaga

SEQ ID NO: 724211 - RNA, 21 nt, Homo sapiens
aggggcagcgcaugugugcau

SEQ ID NO: 724212 - RNA, 11 nt, Homo sapiens
aggggcccaag

SEQ ID NO: 724213 - RNA, 20 nt, Homo sapiens
aggggcccacccacaugacu

SEQ ID NO: 724214 - RNA, 14 nt, Homo sapiens
aggggcuacuguga

SEQ ID NO: 724215 - RNA, 14 nt, Homo sapiens
aggggcucucucau

SEQ ID NO: 724216 - RNA, 21 nt, Homo sapiens
agguguuguauauagagugga

SEQ ID NO: 724217 - RNA, 20 nt, Homo sapiens
agguuaaaaaaaaaagucac

SEQ ID NO: 724218 - RNA, 17 nt, Homo sapiens
agguuaauucucuaggg

SEQ ID NO: 724219 - RNA, 14 nt, Homo sapiens
agguuagaaaggca

SEQ ID NO: 724220 - RNA, 15 nt, Homo sapiens
agguuauacuccucc

SEQ ID NO: 724221 - RNA, 14 nt, Homo sapiens
agguuauauccaau

SEQ ID NO: 724222 - RNA, 22 nt, Homo sapiens
agguuccauccaccaccuugcc

SEQ ID NO: 724223 - RNA, 19 nt, Homo sapiens
agguuccuuaucugucaca

SEQ ID NO: 724224 - RNA, 21 nt, Homo sapiens
agguucugcccuuauggagcu

SEQ ID NO: 724225 - RNA, 14 nt, Homo sapiens
agguucuuuccaug

SEQ ID NO: 724226 - RNA, 22 nt, Homo sapiens
agguucuuuuuuuuuucaggaa

SEQ ID NO: 724227 - RNA, 17 nt, Homo sapiens
agguugaagucucuucc

SEQ ID NO: 724228 - RNA, 17 nt, Homo sapiens
agguugagacuacuuaa

SEQ ID NO: 724229 - RNA, 21 nt, Homo sapiens
agguugcagcaugagacuuuc

SEQ ID NO: 724230 - RNA, 17 nt, Homo sapiens
agguugcagugagccaa

SEQ ID NO: 724231 - RNA, 17 nt, Homo sapiens
agguuggugaauuucac

SEQ ID NO: 724232 - RNA, 18 nt, Homo sapiens
agguugucugaagucacu

SEQ ID NO: 724233 - RNA, 21 nt, Homo sapiens
agguugucugaagucacugca

SEQ ID NO: 724234 - RNA, 13 nt, Homo sapiens
agguuuacauuca

SEQ ID NO: 724235 - RNA, 19 nt, Homo sapiens
agguuucagcaacaagacu

SEQ ID NO: 724236 - RNA, 13 nt, Homo sapiens
agagcccuugccu

SEQ ID NO: 724237 - RNA, 18 nt, Homo sapiens
agagccuauuuuggugag

SEQ ID NO: 724238 - RNA, 19 nt, Homo sapiens
agagccugagucacugguc

SEQ ID NO: 724239 - RNA, 13 nt, Homo sapiens
agagccuguaaac

SEQ ID NO: 724240 - RNA, 18 nt, Homo sapiens
agagccuguaaacuuuau

SEQ ID NO: 724241 - RNA, 15 nt, Homo sapiens
agagcgagacuccau

SEQ ID NO: 724242 - RNA, 19 nt, Homo sapiens
agagcgagacuccgucuca

SEQ ID NO: 724243 - RNA, 17 nt, Homo sapiens
agagcgaggaaaggauu

SEQ ID NO: 724244 - RNA, 15 nt, Homo sapiens
agagcuagcugccac

SEQ ID NO: 724245 - RNA, 14 nt, Homo sapiens
agacuaagaauuag

SEQ ID NO: 724246 - RNA, 14 nt, Homo sapiens
agacuaagccagac

SEQ ID NO: 724247 - RNA, 11 nt, Homo sapiens
agacuacaggg

SEQ ID NO: 724248 - RNA, 13 nt, Homo sapiens
agacuacuguuca

SEQ ID NO: 724249 - RNA, 12 nt, Homo sapiens
agacuagccacu

SEQ ID NO: 724250 - RNA, 14 nt, Homo sapiens
agacuagugccgua

SEQ ID NO: 724251 - RNA, 14 nt, Homo sapiens
agacuaugauuuac

SEQ ID NO: 724252 - RNA, 17 nt, Homo sapiens
agacuauucaaacaguc

SEQ ID NO: 724253 - RNA, 22 nt, Homo sapiens
acugccuuccucucucuaccag

SEQ ID NO: 724254 - RNA, 20 nt, Homo sapiens
acugccuucgcuucuugccu

SEQ ID NO: 724255 - RNA, 21 nt, Homo sapiens
acugccuucgcuucuugccuc

SEQ ID NO: 724256 - RNA, 15 nt, Homo sapiens
cugaggucaggaguu

SEQ ID NO: 724257 - RNA, 16 nt, Homo sapiens
cugaggucucuugagg

SEQ ID NO: 724258 - RNA, 17 nt, Homo sapiens
cugagguuggauuugcu

SEQ ID NO: 724259 - RNA, 19 nt, Homo sapiens
cugaguaagcccucaggag

SEQ ID NO: 724260 - RNA, 17 nt, Homo sapiens
cugaguaaucgcuuaaa

SEQ ID NO: 724261 - RNA, 20 nt, Homo sapiens
cugagucaaauccaguggug

SEQ ID NO: 724262 - RNA, 21 nt, Homo sapiens
cugagucaaauccaguggugg

SEQ ID NO: 724263 - RNA, 16 nt, Homo sapiens
cugagucagacuguca

SEQ ID NO: 724264 - RNA, 20 nt, Homo sapiens
cugagugaguguuuggccga

SEQ ID NO: 724265 - RNA, 18 nt, Homo sapiens
cugagugggcccagcaca

SEQ ID NO: 724266 - RNA, 13 nt, Homo sapiens
cugaguggggcca

SEQ ID NO: 724267 - RNA, 16 nt, Homo sapiens
cugaguggucugacac

SEQ ID NO: 724268 - RNA, 14 nt, Homo sapiens
cugaguggugccaa

SEQ ID NO: 724269 - RNA, 21 nt, Homo sapiens
cugaguguccagcacaccugc

SEQ ID NO: 724270 - RNA, 19 nt, Homo sapiens
cugaguuucuggcucuuga

SEQ ID NO: 724271 - RNA, 21 nt, Homo sapiens
cugauaaacauuaaacacugu

SEQ ID NO: 724272 - RNA, 15 nt, Homo sapiens
cugauaauaauugau

SEQ ID NO: 724273 - RNA, 14 nt, Homo sapiens
cugauaccacugca

SEQ ID NO: 724274 - RNA, 16 nt, Homo sapiens
cugauaccacugcacu

SEQ ID NO: 724275 - RNA, 23 nt, Homo sapiens
cugauauaacaaacuacauguaa

SEQ ID NO: 724276 - RNA, 13 nt, Homo sapiens
cugauauaauuua

SEQ ID NO: 724277 - RNA, 12 nt, Homo sapiens
cugauaugaguu

SEQ ID NO: 724278 - RNA, 17 nt, Homo sapiens
cugauccagagcacaga

SEQ ID NO: 724279 - RNA, 20 nt, Homo sapiens
cugaucccugcucucugagu

SEQ ID NO: 724280 - RNA, 14 nt, Homo sapiens
cugaucgugcuaaa

SEQ ID NO: 724281 - RNA, 20 nt, Homo sapiens
cugaucgugcuaaauuuuca

SEQ ID NO: 724282 - RNA, 15 nt, Homo sapiens
cugaucuaacaaaau

SEQ ID NO: 724283 - RNA, 22 nt, Homo sapiens
cugaucucagggaagcccagcu

SEQ ID NO: 724284 - RNA, 22 nt, Homo sapiens
cugaugaaaacauagcaucuca

SEQ ID NO: 724285 - RNA, 22 nt, Homo sapiens
cugaugaguuucacuguacugc

SEQ ID NO: 724286 - RNA, 12 nt, Homo sapiens
cugaugaucaaa

SEQ ID NO: 724287 - RNA, 20 nt, Homo sapiens
cugaugauccagaacagugg

SEQ ID NO: 724288 - RNA, 22 nt, Homo sapiens
cugaugaugucucuuguagaag

SEQ ID NO: 724289 - RNA, 15 nt, Homo sapiens
cugaugcugggcaau

SEQ ID NO: 724290 - RNA, 21 nt, Homo sapiens
cugauggaccgggugggccug

SEQ ID NO: 724291 - RNA, 13 nt, Homo sapiens
cugauggccaagg

SEQ ID NO: 724292 - RNA, 15 nt, Homo sapiens
cugauggcugaagaa

SEQ ID NO: 724293 - RNA, 16 nt, Homo sapiens
cugauggcugcuccac

SEQ ID NO: 724294 - RNA, 13 nt, Homo sapiens
cugaugggaacca

SEQ ID NO: 724295 - RNA, 19 nt, Homo sapiens
cugauguaccugaugcuau

SEQ ID NO: 724296 - RNA, 19 nt, Homo sapiens
cugaugucuccacuuucac

SEQ ID NO: 724297 - RNA, 18 nt, Homo sapiens
cugauguguccucaggga

SEQ ID NO: 724298 - RNA, 20 nt, Homo sapiens
cugauucuuaugauuacuau

SEQ ID NO: 724299 - RNA, 15 nt, Homo sapiens
cugauuggugauuca

SEQ ID NO: 724300 - RNA, 20 nt, Homo sapiens
cugauuuaaaagggcucuuu

SEQ ID NO: 724301 - RNA, 15 nt, Homo sapiens
cugauuuacauucaa

SEQ ID NO: 724302 - RNA, 17 nt, Homo sapiens
cugauuuccuaauguca

SEQ ID NO: 724303 - RNA, 14 nt, Homo sapiens
cugauuugcaaaug

SEQ ID NO: 724304 - RNA, 19 nt, Homo sapiens
cugauuugcaaaugcacau

SEQ ID NO: 724305 - RNA, 18 nt, Homo sapiens
cugauuuguauucuguga

SEQ ID NO: 724306 - RNA, 20 nt, Homo sapiens
cugcaaagaucuguccucag

SEQ ID NO: 724307 - RNA, 22 nt, Homo sapiens
cugcaaagcccuuggaacaccc

SEQ ID NO: 724308 - RNA, 22 nt, Homo sapiens
cugcaaauaaggacagcagcug

SEQ ID NO: 724309 - RNA, 13 nt, Homo sapiens
cugcaagaccacg

SEQ ID NO: 724310 - RNA, 21 nt, Homo sapiens
cugcaaucugagccagugcuu

SEQ ID NO: 724311 - RNA, 20 nt, Homo sapiens
cugcaauuuuaauugauuau

SEQ ID NO: 724312 - RNA, 22 nt, Homo sapiens
cugcacaaaagcagauacuuga

SEQ ID NO: 724313 - RNA, 15 nt, Homo sapiens
cugcacaaacaauau

SEQ ID NO: 724314 - RNA, 13 nt, Homo sapiens
cugcacacugccu

SEQ ID NO: 724315 - RNA, 20 nt, Homo sapiens
cugcacagaaauuuucaauu

SEQ ID NO: 724316 - RNA, 22 nt, Homo sapiens
cugcacagauauuuccauuucu

SEQ ID NO: 724317 - RNA, 17 nt, Homo sapiens
cugcacagugcaucuca

SEQ ID NO: 724318 - RNA, 18 nt, Homo sapiens
cugcacagugcaucucag

SEQ ID NO: 724319 - RNA, 20 nt, Homo sapiens
cugcacaugaaaguuuugca

SEQ ID NO: 724320 - RNA, 16 nt, Homo sapiens
cugcacaugugccaca

SEQ ID NO: 724321 - RNA, 12 nt, Homo sapiens
cugcacauuccu

SEQ ID NO: 724322 - RNA, 16 nt, Homo sapiens
cugcaccaacucaccu

SEQ ID NO: 724323 - RNA, 14 nt, Homo sapiens
cugcaccaugcugc

SEQ ID NO: 724324 - RNA, 20 nt, Homo sapiens
cugcaccaugcugcugggga

SEQ ID NO: 724325 - RNA, 14 nt, Homo sapiens
cugcacccaugaca

SEQ ID NO: 724326 - RNA, 15 nt, Homo sapiens
cugcacccucgauga

SEQ ID NO: 724327 - RNA, 16 nt, Homo sapiens
cugcaccuaaagccua

SEQ ID NO: 724328 - RNA, 14 nt, Homo sapiens
cugcaccuuugcac

SEQ ID NO: 724329 - RNA, 15 nt, Homo sapiens
cugcaccuuugcacg

SEQ ID NO: 724330 - RNA, 18 nt, Homo sapiens
cugcacuccagucuggau

SEQ ID NO: 724331 - RNA, 16 nt, Homo sapiens
cugcacuccauggcca

SEQ ID NO: 724332 - RNA, 17 nt, Homo sapiens
cugcacugaucacccaa

SEQ ID NO: 724333 - RNA, 18 nt, Homo sapiens
cugcacugaucacccaau

SEQ ID NO: 724334 - RNA, 22 nt, Homo sapiens
cugcacugaugcugccccucau

SEQ ID NO: 724335 - RNA, 20 nt, Homo sapiens
cugcacuggaguccagucuc

SEQ ID NO: 724336 - RNA, 15 nt, Homo sapiens
cugcacuggggccac

SEQ ID NO: 724337 - RNA, 16 nt, Homo sapiens
cugcacuggggccacc

SEQ ID NO: 724338 - RNA, 14 nt, Homo sapiens
cugcacuguaaaau

SEQ ID NO: 724339 - RNA, 16 nt, Homo sapiens
cugcagaauccagcua

SEQ ID NO: 724340 - RNA, 12 nt, Homo sapiens
cugcagaccaug

SEQ ID NO: 724341 - RNA, 15 nt, Homo sapiens
cugcagaucaagaaa

SEQ ID NO: 724342 - RNA, 13 nt, Homo sapiens
cugcagaucuucc

SEQ ID NO: 724343 - RNA, 19 nt, Homo sapiens
cugcagcaggccacugggg

SEQ ID NO: 724344 - RNA, 24 nt, Homo sapiens
cugcagccuccaccuccuaggcuc

SEQ ID NO: 724345 - RNA, 15 nt, Homo sapiens
cugcagcggcaggac

SEQ ID NO: 724346 - RNA, 15 nt, Homo sapiens
cugcagcugcugaag

SEQ ID NO: 724347 - RNA, 19 nt, Homo sapiens
cugcagcugggccccaugc

SEQ ID NO: 724348 - RNA, 18 nt, Homo sapiens
cugcaggcuggagacugg

SEQ ID NO: 724349 - RNA, 20 nt, Homo sapiens
cugcagggacuccaugcugc

SEQ ID NO: 724350 - RNA, 22 nt, Homo sapiens
cugcagggcaggcacucgggaa

SEQ ID NO: 724351 - RNA, 22 nt, Homo sapiens
cugcagggucgguacugaugga

SEQ ID NO: 724352 - RNA, 21 nt, Homo sapiens
cugcagguuccuuaucuguca

SEQ ID NO: 724353 - RNA, 21 nt, Homo sapiens
cugcaguauugaguuguuuaa

SEQ ID NO: 724354 - RNA, 17 nt, Homo sapiens
cugcagucaucuacuuu

SEQ ID NO: 724355 - RNA, 21 nt, Homo sapiens
cugcagugacgugcaccugua

SEQ ID NO: 724356 - RNA, 15 nt, Homo sapiens
cugcagugauucagc

SEQ ID NO: 724357 - RNA, 13 nt, Homo sapiens
cugcauaaugucc

SEQ ID NO: 724358 - RNA, 23 nt, Homo sapiens
cugcaucccuguguccacugaga

SEQ ID NO: 724359 - RNA, 16 nt, Homo sapiens
cugcauccucacugug

SEQ ID NO: 724360 - RNA, 15 nt, Homo sapiens
cugcaucuugcugcu

SEQ ID NO: 724361 - RNA, 12 nt, Homo sapiens
cugcaugcucug

SEQ ID NO: 724362 - RNA, 13 nt, Homo sapiens
cugcaugcugaaa

SEQ ID NO: 724363 - RNA, 23 nt, Homo sapiens
cugcaugcugcccagccacucca

SEQ ID NO: 724364 - RNA, 16 nt, Homo sapiens
cugcauggagaagggu

SEQ ID NO: 724365 - RNA, 22 nt, Homo sapiens
cugcauggagaaggguucugcc

SEQ ID NO: 724366 - RNA, 15 nt, Homo sapiens
cugcauggauucagc

SEQ ID NO: 724367 - RNA, 12 nt, Homo sapiens
cugcauguuaca

SEQ ID NO: 724368 - RNA, 20 nt, Homo sapiens
cugcauuaacugcacaaaca

SEQ ID NO: 724369 - RNA, 15 nt, Homo sapiens
cugcauucacccaga

SEQ ID NO: 724370 - RNA, 22 nt, Homo sapiens
aaaugauuccuggacaucacca

SEQ ID NO: 724371 - RNA, 11 nt, Homo sapiens
aaaugcauucg

SEQ ID NO: 724372 - RNA, 14 nt, Homo sapiens
aaaugcccaaaaga

SEQ ID NO: 724373 - RNA, 21 nt, Homo sapiens
aaaugcccaucuaugucccuu

SEQ ID NO: 724374 - RNA, 18 nt, Homo sapiens
aaaugccucaauucacau

SEQ ID NO: 724375 - RNA, 22 nt, Homo sapiens
aaaugccuccaagccauucacu

SEQ ID NO: 724376 - RNA, 16 nt, Homo sapiens
aaaugccuccauggca

SEQ ID NO: 724377 - RNA, 19 nt, Homo sapiens
aaaugccugguaccagagg

SEQ ID NO: 724378 - RNA, 19 nt, Homo sapiens
aaaugcuagguuaauucca

SEQ ID NO: 724379 - RNA, 19 nt, Homo sapiens
aaaugcucuugucccuguc

SEQ ID NO: 724380 - RNA, 18 nt, Homo sapiens
aaaugcucuuuugcacaa

SEQ ID NO: 724381 - RNA, 14 nt, Homo sapiens
aaaugcuguagaag

SEQ ID NO: 724382 - RNA, 16 nt, Homo sapiens
aaauggaaaguaacuc

SEQ ID NO: 724383 - RNA, 15 nt, Homo sapiens
aaaugggaauucuca

SEQ ID NO: 724384 - RNA, 21 nt, Homo sapiens
aaaugggacugaugucaucuu

SEQ ID NO: 724385 - RNA, 20 nt, Homo sapiens
aaaugggcuacuuuguccuu

SEQ ID NO: 724386 - RNA, 13 nt, Homo sapiens
aaauggggccaga

SEQ ID NO: 724387 - RNA, 20 nt, Homo sapiens
aaauggguuucuugccuuaa

SEQ ID NO: 724388 - RNA, 19 nt, Homo sapiens
aaauggugaauggauuucc

SEQ ID NO: 724389 - RNA, 21 nt, Homo sapiens
aaaugguucagaauuaaacuu

SEQ ID NO: 724390 - RNA, 15 nt, Homo sapiens
aaauguaaaagcaca

SEQ ID NO: 724391 - RNA, 15 nt, Homo sapiens
aaauguaacugugcc

SEQ ID NO: 724392 - RNA, 19 nt, Homo sapiens
aaauguaacugugccaguu

SEQ ID NO: 724393 - RNA, 15 nt, Homo sapiens
aaauguacaacugca

SEQ ID NO: 724394 - RNA, 23 nt, Homo sapiens
aaauguaccuucuuucacucugu

SEQ ID NO: 724395 - RNA, 18 nt, Homo sapiens
aaauguagcgacugucaa

SEQ ID NO: 724396 - RNA, 13 nt, Homo sapiens
aaauguaugugcu

SEQ ID NO: 724397 - RNA, 17 nt, Homo sapiens
aaauguauuuaauucca

SEQ ID NO: 724398 - RNA, 21 nt, Homo sapiens
aaauguauuuuagacuuccug

SEQ ID NO: 724399 - RNA, 16 nt, Homo sapiens
aaaugucaggccuucc

SEQ ID NO: 724400 - RNA, 15 nt, Homo sapiens
aaauguccccuugau

SEQ ID NO: 724401 - RNA, 18 nt, Homo sapiens
aaaugucucgaguccuaa

SEQ ID NO: 724402 - RNA, 22 nt, Homo sapiens
aaauguguauuuuucaaggcau

SEQ ID NO: 724403 - RNA, 22 nt, Homo sapiens
aaaugugucauuggaagccauc

SEQ ID NO: 724404 - RNA, 15 nt, Homo sapiens
aaauguuaacacuca

SEQ ID NO: 724405 - RNA, 17 nt, Homo sapiens
aaauguuacuucucuca

SEQ ID NO: 724406 - RNA, 22 nt, Homo sapiens
aaauguuauuuuuuaauuauua

SEQ ID NO: 724407 - RNA, 19 nt, Homo sapiens
aaauguucagaagguugcu

SEQ ID NO: 724408 - RNA, 21 nt, Homo sapiens
aaauguucauggacuauucca

SEQ ID NO: 724409 - RNA, 19 nt, Homo sapiens
aaauguucuaaguuucuaa

SEQ ID NO: 724410 - RNA, 16 nt, Homo sapiens
aaauguuuaccagugu

SEQ ID NO: 724411 - RNA, 12 nt, Homo sapiens
aaauguuucuca

SEQ ID NO: 724412 - RNA, 15 nt, Homo sapiens
aaauuaaaaugauuu

SEQ ID NO: 724413 - RNA, 20 nt, Homo sapiens
aaauuaaaccggaccaucuc

SEQ ID NO: 724414 - RNA, 23 nt, Homo sapiens
aaauuaaaccggaccaucucucc

SEQ ID NO: 724415 - RNA, 19 nt, Homo sapiens
aaauuagcugggcauggug

SEQ ID NO: 724416 - RNA, 17 nt, Homo sapiens
aaauuagcugugugaaa

SEQ ID NO: 724417 - RNA, 19 nt, Homo sapiens
aaauuagugaaccaaaaau

SEQ ID NO: 724418 - RNA, 18 nt, Homo sapiens
aaauuauaguagcuuaua

SEQ ID NO: 724419 - RNA, 19 nt, Homo sapiens
aaauuauaucaaggucuca

SEQ ID NO: 724420 - RNA, 12 nt, Homo sapiens
aaauuauauccg

SEQ ID NO: 724421 - RNA, 16 nt, Homo sapiens
aaauuauaucucagua

SEQ ID NO: 724422 - RNA, 21 nt, Homo sapiens
aaauuauaucugugaauugca

SEQ ID NO: 724423 - RNA, 18 nt, Homo sapiens
aaauuauucuagucaacu

SEQ ID NO: 724424 - RNA, 15 nt, Homo sapiens
aaauuauucugcccu

SEQ ID NO: 724425 - RNA, 15 nt, Homo sapiens
aaauucaaaccauuu

SEQ ID NO: 724426 - RNA, 17 nt, Homo sapiens
aaauucaaccacuguaa

SEQ ID NO: 724427 - RNA, 17 nt, Homo sapiens
aaauucacaaguugugu

SEQ ID NO: 724428 - RNA, 19 nt, Homo sapiens
aaauucacuaaucuugaau

SEQ ID NO: 724429 - RNA, 17 nt, Homo sapiens
aaauucagaugcuguua

SEQ ID NO: 724430 - RNA, 21 nt, Homo sapiens
gacuugaaaugcucuuuugca

SEQ ID NO: 724431 - RNA, 16 nt, Homo sapiens
gacuugagcuuggcag

SEQ ID NO: 724432 - RNA, 19 nt, Homo sapiens
gacuugauguuccuuccag

SEQ ID NO: 724433 - RNA, 15 nt, Homo sapiens
gacuuggagcugucc

SEQ ID NO: 724434 - RNA, 21 nt, Homo sapiens
gacuuggcaacagaagugguu

SEQ ID NO: 724435 - RNA, 14 nt, Homo sapiens
gacuuggcacuuaa

SEQ ID NO: 724436 - RNA, 18 nt, Homo sapiens
gacuuguuugucuuccau

SEQ ID NO: 724437 - RNA, 20 nt, Homo sapiens
gacuuguuuuaaacuugccu

SEQ ID NO: 724438 - RNA, 16 nt, Homo sapiens
gacuuuaaaccaccua

SEQ ID NO: 724439 - RNA, 12 nt, Homo sapiens
gacuuuaccugc

SEQ ID NO: 724440 - RNA, 14 nt, Homo sapiens
gacuuuaccugcug

SEQ ID NO: 724441 - RNA, 19 nt, Homo sapiens
gacuuuacgcccaucucag

SEQ ID NO: 724442 - RNA, 13 nt, Homo sapiens
gacuuucugauua

SEQ ID NO: 724443 - RNA, 12 nt, Homo sapiens
gacuuugcuugc

SEQ ID NO: 724444 - RNA, 17 nt, Homo sapiens
gacuuuguauagaaggu

SEQ ID NO: 724445 - RNA, 19 nt, Homo sapiens
gacuuuguccccacuuaca

SEQ ID NO: 724446 - RNA, 20 nt, Homo sapiens
gacuuuuuagccagugacuu

SEQ ID NO: 724447 - RNA, 17 nt, Homo sapiens
gagaaaagccucuccag

SEQ ID NO: 724448 - RNA, 18 nt, Homo sapiens
gagaaaagggauggagcu

SEQ ID NO: 724449 - RNA, 11 nt, Homo sapiens
gagaaaauccc

SEQ ID NO: 724450 - RNA, 16 nt, Homo sapiens
gagaaaauguuguaua

SEQ ID NO: 724451 - RNA, 15 nt, Homo sapiens
gagaaacaauggcua

SEQ ID NO: 724452 - RNA, 23 nt, Homo sapiens
gagaaacagagacaggcccaaga

SEQ ID NO: 724453 - RNA, 15 nt, Homo sapiens
gagaaacuguagucu

SEQ ID NO: 724454 - RNA, 18 nt, Homo sapiens
gagaaaguaacacaaaca

SEQ ID NO: 724455 - RNA, 15 nt, Homo sapiens
gagaaauacuuucag

SEQ ID NO: 724456 - RNA, 19 nt, Homo sapiens
gagaaaugaauaauuuccc

SEQ ID NO: 724457 - RNA, 15 nt, Homo sapiens
gagaaaugucuuuug

SEQ ID NO: 724458 - RNA, 14 nt, Homo sapiens
gagaaauugaggau

SEQ ID NO: 724459 - RNA, 20 nt, Homo sapiens
gagaaauuugccuuguucaa

SEQ ID NO: 724460 - RNA, 19 nt, Homo sapiens
gagaacaucauaacccaug

SEQ ID NO: 724461 - RNA, 9 nt, Homo sapiens
gagaaccac

SEQ ID NO: 724462 - RNA, 15 nt, Homo sapiens
gagaaccucagauca

SEQ ID NO: 724463 - RNA, 12 nt, Homo sapiens
gagaagaagcag

SEQ ID NO: 724464 - RNA, 19 nt, Homo sapiens
gagaagaaggaagaucuug

SEQ ID NO: 724465 - RNA, 18 nt, Homo sapiens
gagaagacccacgugcua

SEQ ID NO: 724466 - RNA, 22 nt, Homo sapiens
gagaagagcuguucacagccag

SEQ ID NO: 724467 - RNA, 14 nt, Homo sapiens
gagaagcaaugggu

SEQ ID NO: 724468 - RNA, 17 nt, Homo sapiens
gagaagccaaacagcaa

SEQ ID NO: 724469 - RNA, 21 nt, Homo sapiens
gagaagccagcuuuccucauc

SEQ ID NO: 724470 - RNA, 20 nt, Homo sapiens
gagaagcucugaagaacucu

SEQ ID NO: 724471 - RNA, 14 nt, Homo sapiens
gagaagcugaucca

SEQ ID NO: 724472 - RNA, 14 nt, Homo sapiens
gagaagcugcugac

SEQ ID NO: 724473 - RNA, 19 nt, Homo sapiens
gagaagcuggaaaguguga

SEQ ID NO: 724474 - RNA, 16 nt, Homo sapiens
gagaaggaaagugauu

SEQ ID NO: 724475 - RNA, 18 nt, Homo sapiens
gagaaggacggugccaag

SEQ ID NO: 724476 - RNA, 23 nt, Homo sapiens
gagaaggcuauguaaacaaacca

SEQ ID NO: 724477 - RNA, 19 nt, Homo sapiens
gagaagggggucucuguua

SEQ ID NO: 724478 - RNA, 23 nt, Homo sapiens
gagaagguauuagcaaagcaaaa

SEQ ID NO: 724479 - RNA, 19 nt, Homo sapiens
gagaagguggaccuggcag

SEQ ID NO: 724480 - RNA, 18 nt, Homo sapiens
gagaagucaaacauuuca

SEQ ID NO: 724481 - RNA, 14 nt, Homo sapiens
gagaaguuaagcaa

SEQ ID NO: 724482 - RNA, 21 nt, Homo sapiens
gagaaguucucagaauaacua

SEQ ID NO: 724483 - RNA, 14 nt, Homo sapiens
gagaauauaccuua

SEQ ID NO: 724484 - RNA, 12 nt, Homo sapiens
gagaauccuccc

SEQ ID NO: 724485 - RNA, 16 nt, Homo sapiens
gagaauguaagaacua

SEQ ID NO: 724486 - RNA, 19 nt, Homo sapiens
gagaaugugagaagccagc

SEQ ID NO: 724487 - RNA, 20 nt, Homo sapiens
gagaauguguuucaaaacca

SEQ ID NO: 724488 - RNA, 12 nt, Homo sapiens
gagaauuguuga

SEQ ID NO: 724489 - RNA, 23 nt, Homo sapiens
gagaauuuccaaaacuuuaauga

SEQ ID NO: 724490 - RNA, 21 nt, Homo sapiens
gagacaaaaucuuaaaugcca

SEQ ID NO: 724491 - RNA, 19 nt, Homo sapiens
gagacaagggcaucaucua

SEQ ID NO: 724492 - RNA, 11 nt, Homo sapiens
gagacacucca

SEQ ID NO: 724493 - RNA, 13 nt, Homo sapiens
gagacacuuuguc

SEQ ID NO: 724494 - RNA, 20 nt, Homo sapiens
gagacagaauagagugauag

SEQ ID NO: 724495 - RNA, 19 nt, Homo sapiens
gagacagaaucucagucug

SEQ ID NO: 724496 - RNA, 19 nt, Homo sapiens
gagacagauauacugggag

SEQ ID NO: 724497 - RNA, 15 nt, Homo sapiens
gagacaggcaaacug

SEQ ID NO: 724498 - RNA, 12 nt, Homo sapiens
gagacaggguuu

SEQ ID NO: 724499 - RNA, 17 nt, Homo sapiens
gagacaggguuucaccg

SEQ ID NO: 724500 - RNA, 17 nt, Homo sapiens
gagacaggguuucacug

SEQ ID NO: 724501 - RNA, 14 nt, Homo sapiens
gagacaguucaaga

SEQ ID NO: 724502 - RNA, 22 nt, Homo sapiens
gagacaugggccucccacuccu

SEQ ID NO: 724503 - RNA, 13 nt, Homo sapiens
gagacauugcucu

SEQ ID NO: 724504 - RNA, 22 nt, Homo sapiens
gagaccaagacucugaaaucuc

SEQ ID NO: 724505 - RNA, 17 nt, Homo sapiens
gagaccaggccugagca

SEQ ID NO: 724506 - RNA, 17 nt, Homo sapiens
gagacccaagcugccuc

SEQ ID NO: 724507 - RNA, 15 nt, Homo sapiens
gagacccagaucuca

SEQ ID NO: 724508 - RNA, 18 nt, Homo sapiens
gagacccagaucucaugg

SEQ ID NO: 724509 - RNA, 18 nt, Homo sapiens
gagacccagcugcagacc

SEQ ID NO: 724510 - RNA, 16 nt, Homo sapiens
gagaccccagucguga

SEQ ID NO: 724511 - RNA, 16 nt, Homo sapiens
gagacccguccauuug

SEQ ID NO: 724512 - RNA, 17 nt, Homo sapiens
gagaccuggaaccagag

SEQ ID NO: 724513 - RNA, 17 nt, Homo sapiens
gagacggaguuucacuc

SEQ ID NO: 724514 - RNA, 13 nt, Homo sapiens
gagacuaauucua

SEQ ID NO: 724515 - RNA, 19 nt, Homo sapiens
gagacuccaucucaaaaaa

SEQ ID NO: 724516 - RNA, 14 nt, Homo sapiens
gagacuccaucucu

SEQ ID NO: 724517 - RNA, 17 nt, Homo sapiens
gagacuccgucucaagg

SEQ ID NO: 724518 - RNA, 17 nt, Homo sapiens
gagacugccauacauaa

SEQ ID NO: 724519 - RNA, 22 nt, Homo sapiens
gagacugggagccacuucuccc

SEQ ID NO: 724520 - RNA, 17 nt, Homo sapiens
gagacuguagauugcuu

SEQ ID NO: 724521 - RNA, 20 nt, Homo sapiens
gagacuugugcucaaggaau

SEQ ID NO: 724522 - RNA, 19 nt, Homo sapiens
gagacuuucugcugggauc

SEQ ID NO: 724523 - RNA, 13 nt, Homo sapiens
gagagaaagggag

SEQ ID NO: 724524 - RNA, 15 nt, Homo sapiens
gagagaaccucaggu

SEQ ID NO: 724525 - RNA, 15 nt, Homo sapiens
gagagaagaaagugu

SEQ ID NO: 724526 - RNA, 13 nt, Homo sapiens
gagagacccaagg

SEQ ID NO: 724527 - RNA, 15 nt, Homo sapiens
gagagaccucauccu

SEQ ID NO: 724528 - RNA, 13 nt, Homo sapiens
gagagacugccau

SEQ ID NO: 724529 - RNA, 14 nt, Homo sapiens
gagagagaaggcag

SEQ ID NO: 724530 - RNA, 17 nt, Homo sapiens
gagagaggcugccucag

SEQ ID NO: 724531 - RNA, 14 nt, Homo sapiens
gagagagugcuauu

SEQ ID NO: 724532 - RNA, 20 nt, Homo sapiens
gagagaugaaccacauuaua

SEQ ID NO: 724533 - RNA, 16 nt, Homo sapiens
gagagauucugugauc

SEQ ID NO: 724534 - RNA, 21 nt, Homo sapiens
gagagcaagccaggaggacau

SEQ ID NO: 724535 - RNA, 15 nt, Homo sapiens
gagagcagaggucuc

SEQ ID NO: 724536 - RNA, 21 nt, Homo sapiens
gagagcagcuucagugacaaa

SEQ ID NO: 724537 - RNA, 20 nt, Homo sapiens
gagagccugucaccagagcu

SEQ ID NO: 724538 - RNA, 19 nt, Homo sapiens
gagagcucaggauggcuca

SEQ ID NO: 724539 - RNA, 15 nt, Homo sapiens
aaaaauaaauuugca

SEQ ID NO: 724540 - RNA, 13 nt, Homo sapiens
aaaaauaagagag

SEQ ID NO: 724541 - RNA, 17 nt, Homo sapiens
aaaaauaaguacauaua

SEQ ID NO: 724542 - RNA, 22 nt, Homo sapiens
aaaaauauaaaguacaucucua

SEQ ID NO: 724543 - RNA, 21 nt, Homo sapiens
aaaaauauccuugauguacag

SEQ ID NO: 724544 - RNA, 13 nt, Homo sapiens
aaaaauauuauaa

SEQ ID NO: 724545 - RNA, 15 nt, Homo sapiens
aaaaauauugcugaa

SEQ ID NO: 724546 - RNA, 17 nt, Homo sapiens
aaaaaucugagaaacuc

SEQ ID NO: 724547 - RNA, 15 nt, Homo sapiens
aaaaaucuuuaggga

SEQ ID NO: 724548 - RNA, 13 nt, Homo sapiens
aaaaaugagcucg

SEQ ID NO: 724549 - RNA, 13 nt, Homo sapiens
aaaaaugcugcuc

SEQ ID NO: 724550 - RNA, 20 nt, Homo sapiens
aaaaaugguugauggaaaau

SEQ ID NO: 724551 - RNA, 15 nt, Homo sapiens
aaaaaugucaucuca

SEQ ID NO: 724552 - RNA, 15 nt, Homo sapiens
aaaaauguccugccu

SEQ ID NO: 724553 - RNA, 18 nt, Homo sapiens
aaaaaugucucaugucaa

SEQ ID NO: 724554 - RNA, 14 nt, Homo sapiens
aaaaaugugagcua

SEQ ID NO: 724555 - RNA, 20 nt, Homo sapiens
aaaaaugugccuaguuuuau

SEQ ID NO: 724556 - RNA, 23 nt, Homo sapiens
gauucaccaaaauagucuucuca

SEQ ID NO: 724557 - RNA, 23 nt, Homo sapiens
gauucaccucuucuuucccuccu

SEQ ID NO: 724558 - RNA, 20 nt, Homo sapiens
gauucagacuuggacuauga

SEQ ID NO: 724559 - RNA, 12 nt, Homo sapiens
gauucagcaaaa

SEQ ID NO: 724560 - RNA, 21 nt, Homo sapiens
gauucagccaaaugcagggag

SEQ ID NO: 724561 - RNA, 21 nt, Homo sapiens
gauucauauuuacuucuuaua

SEQ ID NO: 724562 - RNA, 21 nt, Homo sapiens
gauucauccauauuguugaau

SEQ ID NO: 724563 - RNA, 20 nt, Homo sapiens
gauuccagcccacauuggau

SEQ ID NO: 724564 - RNA, 17 nt, Homo sapiens
gauuccagucuacuuga

SEQ ID NO: 724565 - RNA, 13 nt, Homo sapiens
gauucccagagac

SEQ ID NO: 724566 - RNA, 20 nt, Homo sapiens
gauucccgggcuuaccaggu

SEQ ID NO: 724567 - RNA, 21 nt, Homo sapiens
gauuccguauugguauacuuu

SEQ ID NO: 724568 - RNA, 13 nt, Homo sapiens
gauuccugaccca

SEQ ID NO: 724569 - RNA, 21 nt, Homo sapiens
gauucuacaaaaaaccaggau

SEQ ID NO: 724570 - RNA, 22 nt, Homo sapiens
gauucuacucuugucauuuuua

SEQ ID NO: 724571 - RNA, 15 nt, Homo sapiens
gauucuccugccuca

SEQ ID NO: 724572 - RNA, 23 nt, Homo sapiens
gauucucuuguauaagauccuag

SEQ ID NO: 724573 - RNA, 13 nt, Homo sapiens
gauucugcagcug

SEQ ID NO: 724574 - RNA, 17 nt, Homo sapiens
gauucugguuccagggu

SEQ ID NO: 724575 - RNA, 19 nt, Homo sapiens
gauucuuaauucucugcaa

SEQ ID NO: 724576 - RNA, 16 nt, Homo sapiens
gauucuuccugcuuag

SEQ ID NO: 724577 - RNA, 14 nt, Homo sapiens
gauugagcucucug

SEQ ID NO: 724578 - RNA, 17 nt, Homo sapiens
gauugaggagcugcacu

SEQ ID NO: 724579 - RNA, 16 nt, Homo sapiens
gauugcauuguaugaa

SEQ ID NO: 724580 - RNA, 22 nt, Homo sapiens
gauugccccuggcuuugccucu

SEQ ID NO: 724581 - RNA, 12 nt, Homo sapiens
gauugcugccau

SEQ ID NO: 724582 - RNA, 18 nt, Homo sapiens
gauugcuguguguugccu

SEQ ID NO: 724583 - RNA, 23 nt, Homo sapiens
gauuguaaauaaaggaugauggc

SEQ ID NO: 724584 - RNA, 17 nt, Homo sapiens
gauuguaguuauacuuu

SEQ ID NO: 724585 - RNA, 13 nt, Homo sapiens
gauugucuccuaa

SEQ ID NO: 724586 - RNA, 20 nt, Homo sapiens
gauugugccagugcacuccg

SEQ ID NO: 724587 - RNA, 17 nt, Homo sapiens
gauuguuuacagucauu

SEQ ID NO: 724588 - RNA, 19 nt, Homo sapiens
gauuguuuuugcucaaggc

SEQ ID NO: 724589 - RNA, 17 nt, Homo sapiens
gauuuaaaaaaagaaca

SEQ ID NO: 724590 - RNA, 13 nt, Homo sapiens
gauuuaaaugcca

SEQ ID NO: 724591 - RNA, 22 nt, Homo sapiens
gauuuaagccuuacaaagggaa

SEQ ID NO: 724592 - RNA, 15 nt, Homo sapiens
gauuuaauacaguuu

SEQ ID NO: 724593 - RNA, 16 nt, Homo sapiens
gauuuaaucugccaag

SEQ ID NO: 724594 - RNA, 22 nt, Homo sapiens
gauuuacuuaauucagucucag

SEQ ID NO: 724595 - RNA, 23 nt, Homo sapiens
gauuuagcccaugacguguuucu

SEQ ID NO: 724596 - RNA, 19 nt, Homo sapiens
gauuucaaagcaagucaac

SEQ ID NO: 724597 - RNA, 14 nt, Homo sapiens
gauuucaugccugg

SEQ ID NO: 724598 - RNA, 21 nt, Homo sapiens
gauuucauucugaaacauaau

SEQ ID NO: 724599 - RNA, 22 nt, Homo sapiens
gauuuccuccucccagugccuu

SEQ ID NO: 724600 - RNA, 16 nt, Homo sapiens
gauuuccuugugcaaa

SEQ ID NO: 724601 - RNA, 22 nt, Homo sapiens
gauuucuuucuuugcaccaaag

SEQ ID NO: 724602 - RNA, 20 nt, Homo sapiens
gauuugcaggugaacagccu

SEQ ID NO: 724603 - RNA, 22 nt, Homo sapiens
gauuugccagcacaggggcccc

SEQ ID NO: 724604 - RNA, 13 nt, Homo sapiens
gauuugccugugc

SEQ ID NO: 724605 - RNA, 13 nt, Homo sapiens
gauuugcugugua

SEQ ID NO: 724606 - RNA, 12 nt, Homo sapiens
gauuugggaaaa

SEQ ID NO: 724607 - RNA, 15 nt, Homo sapiens
gauuuggugaccaac

SEQ ID NO: 724608 - RNA, 14 nt, Homo sapiens
gauuuguagcacug

SEQ ID NO: 724609 - RNA, 18 nt, Homo sapiens
gauuuguaugcucauuga

SEQ ID NO: 724610 - RNA, 18 nt, Homo sapiens
gauuuuacaaaagaugua

SEQ ID NO: 724611 - RNA, 20 nt, Homo sapiens
gauuuuuaaaaugucaagac

SEQ ID NO: 724612 - RNA, 23 nt, Homo sapiens
gauuuuucuaaccuugaaugcug

SEQ ID NO: 724613 - RNA, 13 nt, Homo sapiens
gauuuuugcaaua

SEQ ID NO: 724614 - RNA, 20 nt, Homo sapiens
gauuuuuuucauuuugccaa

SEQ ID NO: 724615 - RNA, 23 nt, Homo sapiens
gcaaaaacaaaugggaaaauguc

SEQ ID NO: 724616 - RNA, 14 nt, Homo sapiens
gcaaaaccaaagaa

SEQ ID NO: 724617 - RNA, 19 nt, Homo sapiens
gcaaaaccacuagaacucu

SEQ ID NO: 724618 - RNA, 23 nt, Homo sapiens
gcaaaacugccgcaagucugcag

SEQ ID NO: 724619 - RNA, 15 nt, Homo sapiens
gcaaaacuuaggcau

SEQ ID NO: 724620 - RNA, 19 nt, Homo sapiens
gcaaaacuuaggcaugcac

SEQ ID NO: 724621 - RNA, 12 nt, Homo sapiens
gcaaaagguuua

SEQ ID NO: 724622 - RNA, 15 nt, Homo sapiens
gcaaaagucagucuu

SEQ ID NO: 724623 - RNA, 16 nt, Homo sapiens
gcaaaagucauuacac

SEQ ID NO: 724624 - RNA, 11 nt, Homo sapiens
gcaaaagugaa

SEQ ID NO: 724625 - RNA, 21 nt, Homo sapiens
gcaaaagugagggcuugucau

SEQ ID NO: 724626 - RNA, 18 nt, Homo sapiens
gcaaaauugauguguuua

SEQ ID NO: 724627 - RNA, 20 nt, Homo sapiens
gcaaaccaggccacuugccu

SEQ ID NO: 724628 - RNA, 22 nt, Homo sapiens
gcaaaccaggccacuugccuca

SEQ ID NO: 724629 - RNA, 12 nt, Homo sapiens
gcaaacguuucu

SEQ ID NO: 724630 - RNA, 22 nt, Homo sapiens
gcaaagauaugugggugcuccu

SEQ ID NO: 724631 - RNA, 17 nt, Homo sapiens
gcaaagaucuguccuca

SEQ ID NO: 724632 - RNA, 23 nt, Homo sapiens
gcaaagaugaacccgaggcugag

SEQ ID NO: 724633 - RNA, 22 nt, Homo sapiens
gcaaagauuauuuucauuuauc

SEQ ID NO: 724634 - RNA, 13 nt, Homo sapiens
gcaaagauuucuc

SEQ ID NO: 724635 - RNA, 16 nt, Homo sapiens
gcaaagauuuuuggca

SEQ ID NO: 724636 - RNA, 16 nt, Homo sapiens
gcaaagucaucaaaga

SEQ ID NO: 724637 - RNA, 16 nt, Homo sapiens
gcaaauaaaccacuuu

SEQ ID NO: 724638 - RNA, 17 nt, Homo sapiens
gcaaauaacugaucuca

SEQ ID NO: 724639 - RNA, 13 nt, Homo sapiens
gcaaauaauggaa

SEQ ID NO: 724640 - RNA, 22 nt, Homo sapiens
gcaaauaauggaaaaauaguaa

SEQ ID NO: 724641 - RNA, 22 nt, Homo sapiens
gcaaauacaaucagcccagugc

SEQ ID NO: 724642 - RNA, 14 nt, Homo sapiens
gcaaauauaaucca

SEQ ID NO: 724643 - RNA, 18 nt, Homo sapiens
gcaaauauaauccacuuu

SEQ ID NO: 724644 - RNA, 14 nt, Homo sapiens
gcaaaucaucugca

SEQ ID NO: 724645 - RNA, 21 nt, Homo sapiens
gcaaauccuugauacugcuca

SEQ ID NO: 724646 - RNA, 19 nt, Homo sapiens
gcaaaucuaugagauuuug

SEQ ID NO: 724647 - RNA, 15 nt, Homo sapiens
gcaaaugcaaaaacu

SEQ ID NO: 724648 - RNA, 23 nt, Homo sapiens
gcaaaugcuguauucuucuuugg

SEQ ID NO: 724649 - RNA, 16 nt, Homo sapiens
gcaaauguaacugugc

SEQ ID NO: 724650 - RNA, 23 nt, Homo sapiens
gcaaaugugcuggucacccuuca

SEQ ID NO: 724651 - RNA, 13 nt, Homo sapiens
gcaaauguuaaaa

SEQ ID NO: 724652 - RNA, 23 nt, Homo sapiens
gcaaauuucuaucagccuugcua

SEQ ID NO: 724653 - RNA, 19 nt, Homo sapiens
gcaaauuuucagcauuaag

SEQ ID NO: 724654 - RNA, 18 nt, Homo sapiens
gcaacaauaaaguacuuu

SEQ ID NO: 724655 - RNA, 17 nt, Homo sapiens
gcaacagacaagugacu

SEQ ID NO: 724656 - RNA, 16 nt, Homo sapiens
gcaacagacuguugag

SEQ ID NO: 724657 - RNA, 18 nt, Homo sapiens
gcaacagcaaacaggugc

SEQ ID NO: 724658 - RNA, 20 nt, Homo sapiens
gcaacaggaaggaaccagaa

SEQ ID NO: 724659 - RNA, 15 nt, Homo sapiens
gcaacaguuaucaca

SEQ ID NO: 724660 - RNA, 13 nt, Homo sapiens
gcaacauagcaaa

SEQ ID NO: 724661 - RNA, 12 nt, Homo sapiens
gcaacauccaga

SEQ ID NO: 724662 - RNA, 19 nt, Homo sapiens
gcaaccaagucacacgcuu

SEQ ID NO: 724663 - RNA, 14 nt, Homo sapiens
gcaaccacuaagaa

SEQ ID NO: 724664 - RNA, 13 nt, Homo sapiens
gcaaccagcacau

SEQ ID NO: 724665 - RNA, 17 nt, Homo sapiens
gcaacccgguuuaccag

SEQ ID NO: 724666 - RNA, 20 nt, Homo sapiens
gcaaccuaauuguagcaucu

SEQ ID NO: 724667 - RNA, 23 nt, Homo sapiens
gcaaccuuuuugauuucuuccag

SEQ ID NO: 724668 - RNA, 23 nt, Homo sapiens
gcaacgcaggcccccaggugcca

SEQ ID NO: 724669 - RNA, 23 nt, Homo sapiens
gcaacuaggaaaaucacuugcca

SEQ ID NO: 724670 - RNA, 21 nt, Homo sapiens
aaaaauguguuccauugccau

SEQ ID NO: 724671 - RNA, 12 nt, Homo sapiens
aaaaauguucuu

SEQ ID NO: 724672 - RNA, 14 nt, Homo sapiens
aaaaauuagccaga

SEQ ID NO: 724673 - RNA, 14 nt, Homo sapiens
aaaaauuagcugug

SEQ ID NO: 724674 - RNA, 19 nt, Homo sapiens
aaaaauuauaguagcuuau

SEQ ID NO: 724675 - RNA, 20 nt, Homo sapiens
aaaaauucuguuguuccauu

SEQ ID NO: 724676 - RNA, 16 nt, Homo sapiens
aaaaauugagacauuu

SEQ ID NO: 724677 - RNA, 12 nt, Homo sapiens
aaaaauuuggca

SEQ ID NO: 724678 - RNA, 14 nt, Homo sapiens
aaaacaaaccaucu

SEQ ID NO: 724679 - RNA, 11 nt, Homo sapiens
aaaacaaagag

SEQ ID NO: 724680 - RNA, 19 nt, Homo sapiens
aaaacaacuuggcauuucu

SEQ ID NO: 724681 - RNA, 15 nt, Homo sapiens
aaaacaagaugagau

SEQ ID NO: 724682 - RNA, 14 nt, Homo sapiens
aaaacaauacucaa

SEQ ID NO: 724683 - RNA, 17 nt, Homo sapiens
aaaacaauucugugaca

SEQ ID NO: 724684 - RNA, 13 nt, Homo sapiens
aaaacacaaaguc

SEQ ID NO: 724685 - RNA, 18 nt, Homo sapiens
aaaacacaaaguguauaa

SEQ ID NO: 724686 - RNA, 16 nt, Homo sapiens
aaaacacuaacuuaau

SEQ ID NO: 724687 - RNA, 18 nt, Homo sapiens
aaaacacugcccucuugu

SEQ ID NO: 724688 - RNA, 12 nt, Homo sapiens
aaaacacugugu

SEQ ID NO: 724689 - RNA, 13 nt, Homo sapiens
aaaacagaaagca

SEQ ID NO: 724690 - RNA, 16 nt, Homo sapiens
aaaacagaauuugaga

SEQ ID NO: 724691 - RNA, 18 nt, Homo sapiens
aaaacagagaugugauaa

SEQ ID NO: 724692 - RNA, 13 nt, Homo sapiens
aaaacaggccagg

SEQ ID NO: 724693 - RNA, 16 nt, Homo sapiens
aaaacauaauguauca

SEQ ID NO: 724694 - RNA, 17 nt, Homo sapiens
aaaacauaauguaucau

SEQ ID NO: 724695 - RNA, 20 nt, Homo sapiens
aaaacauaugaccauugagu

SEQ ID NO: 724696 - RNA, 19 nt, Homo sapiens
aaaacaucauuacugccau

SEQ ID NO: 724697 - RNA, 12 nt, Homo sapiens
aaaacauguaug

SEQ ID NO: 724698 - RNA, 13 nt, Homo sapiens
aaaacauuugcug

SEQ ID NO: 724699 - RNA, 23 nt, Homo sapiens
aaaaccaacaaaaagaacaaauc

SEQ ID NO: 724700 - RNA, 18 nt, Homo sapiens
aaaaccacagcaguugaa

SEQ ID NO: 724701 - RNA, 11 nt, Homo sapiens
aaaaccacagu

SEQ ID NO: 724702 - RNA, 17 nt, Homo sapiens
aaaaccacuagaacucu

SEQ ID NO: 724703 - RNA, 13 nt, Homo sapiens
aaaaccacuuuuu

SEQ ID NO: 724704 - RNA, 18 nt, Homo sapiens
aaaaccauggucucucug

SEQ ID NO: 724705 - RNA, 21 nt, Homo sapiens
aaaaccccaucuuuacuaaaa

SEQ ID NO: 724706 - RNA, 18 nt, Homo sapiens
aaaacccucugcuucucc

SEQ ID NO: 724707 - RNA, 22 nt, Homo sapiens
aaaaccuacacacguaccuuca

SEQ ID NO: 724708 - RNA, 23 nt, Homo sapiens
aaaaccuacgcacauaccuucau

SEQ ID NO: 724709 - RNA, 22 nt, Homo sapiens
aaaaccuuccuucccuggcuac

SEQ ID NO: 724710 - RNA, 15 nt, Homo sapiens
aaaaccuuuacaguu

SEQ ID NO: 724711 - RNA, 19 nt, Homo sapiens
aaaacgaaagcugaaccua

SEQ ID NO: 724712 - RNA, 13 nt, Homo sapiens
aaaacuaauuucc

SEQ ID NO: 724713 - RNA, 14 nt, Homo sapiens
aaaacuaccacaug

SEQ ID NO: 724714 - RNA, 18 nt, Homo sapiens
aaaacuacugacagggag

SEQ ID NO: 724715 - RNA, 16 nt, Homo sapiens
aaaacuacugauacuu

SEQ ID NO: 724716 - RNA, 16 nt, Homo sapiens
aaaacuagcauuacau

SEQ ID NO: 724717 - RNA, 15 nt, Homo sapiens
aaaacuauauucuca

SEQ ID NO: 724718 - RNA, 16 nt, Homo sapiens
aaaacuauuugggaua

SEQ ID NO: 724719 - RNA, 12 nt, Homo sapiens
aaaacucagaga

SEQ ID NO: 724720 - RNA, 19 nt, Homo sapiens
aaaacucaguaagaauuau

SEQ ID NO: 724721 - RNA, 13 nt, Homo sapiens
aaaacucauuucc

SEQ ID NO: 724722 - RNA, 16 nt, Homo sapiens
aaaacuccaucucaaa

SEQ ID NO: 724723 - RNA, 21 nt, Homo sapiens
aaaacucucugguuuacuuca

SEQ ID NO: 724724 - RNA, 15 nt, Homo sapiens
aaaacucugcaugua

SEQ ID NO: 724725 - RNA, 20 nt, Homo sapiens
aaaacucuugauaugaccug

SEQ ID NO: 724726 - RNA, 17 nt, Homo sapiens
aaaacucuuuggugcac

SEQ ID NO: 724727 - RNA, 23 nt, Homo sapiens
aaaacugaucaaaaauaaacuag

SEQ ID NO: 724728 - RNA, 21 nt, Homo sapiens
aaaacugauucucuaugacau

SEQ ID NO: 724729 - RNA, 17 nt, Homo sapiens
aaaacugauuuuuagcu

SEQ ID NO: 724730 - RNA, 20 nt, Homo sapiens
aaaacugauuuuuagcuuua

SEQ ID NO: 724731 - RNA, 18 nt, Homo sapiens
aaaacuggcuacugcucu

SEQ ID NO: 724732 - RNA, 12 nt, Homo sapiens
aaaacuuccuau

SEQ ID NO: 724733 - RNA, 19 nt, Homo sapiens
aaaacuugaucacaugcuu

SEQ ID NO: 724734 - RNA, 14 nt, Homo sapiens
aaaacuugcugccu

SEQ ID NO: 724735 - RNA, 15 nt, Homo sapiens
aaaacuuggaccacu

SEQ ID NO: 724736 - RNA, 21 nt, Homo sapiens
aaaacuuuaggcccugcccca

SEQ ID NO: 724737 - RNA, 15 nt, Homo sapiens
aaaagaacaaugaca

SEQ ID NO: 724738 - RNA, 13 nt, Homo sapiens
aaaagaacauaaa

SEQ ID NO: 724739 - RNA, 13 nt, Homo sapiens
aaaagaccuauga

SEQ ID NO: 724740 - RNA, 20 nt, Homo sapiens
aaaagacucugaccagagau

SEQ ID NO: 724741 - RNA, 22 nt, Homo sapiens
aaaagacuuuuuuuuaacacuu

SEQ ID NO: 724742 - RNA, 12 nt, Homo sapiens
aaaagaugaagu

SEQ ID NO: 724743 - RNA, 14 nt, Homo sapiens
aaaagauuauagaa

SEQ ID NO: 724744 - RNA, 23 nt, Homo sapiens
aaaagcaaaaauugucaguguuu

SEQ ID NO: 724745 - RNA, 18 nt, Homo sapiens
aaaagcaagggaccuuca

SEQ ID NO: 724746 - RNA, 21 nt, Homo sapiens
aaaagcaauucugacugucca

SEQ ID NO: 724747 - RNA, 13 nt, Homo sapiens
aaaagcacacucc

SEQ ID NO: 724748 - RNA, 14 nt, Homo sapiens
aaaagcagcuacca

SEQ ID NO: 724749 - RNA, 18 nt, Homo sapiens
aaaagcaguaacugacaa

SEQ ID NO: 724750 - RNA, 19 nt, Homo sapiens
aaaagcaguucaugucuga

SEQ ID NO: 724751 - RNA, 17 nt, Homo sapiens
aaaagcauaaggccgga

SEQ ID NO: 724752 - RNA, 19 nt, Homo sapiens
aaaagcccagcacuugaau

SEQ ID NO: 724753 - RNA, 14 nt, Homo sapiens
aaaagccucuuucu

SEQ ID NO: 724754 - RNA, 20 nt, Homo sapiens
aaaagcuuauucaucuguuu

SEQ ID NO: 724755 - RNA, 20 nt, Homo sapiens
aaaaggaaagcuguguuuau

SEQ ID NO: 724756 - RNA, 13 nt, Homo sapiens
aaaaggaaauuug

SEQ ID NO: 724757 - RNA, 23 nt, Homo sapiens
aaaaggacuauaagaauaauuuc

SEQ ID NO: 724758 - RNA, 16 nt, Homo sapiens
aaaaggauaagugaac

SEQ ID NO: 724759 - RNA, 16 nt, Homo sapiens
aaaaggauaguaagca

SEQ ID NO: 724760 - RNA, 15 nt, Homo sapiens
aaaaggauaugcagu

SEQ ID NO: 724761 - RNA, 15 nt, Homo sapiens
aaaagggcacuccca

SEQ ID NO: 724762 - RNA, 20 nt, Homo sapiens
aaaaggucauagcugagauu

SEQ ID NO: 724763 - RNA, 14 nt, Homo sapiens
aaaaggugauucua

SEQ ID NO: 724764 - RNA, 19 nt, Homo sapiens
aaaagguuuucuucauuca

SEQ ID NO: 724765 - RNA, 22 nt, Homo sapiens
aaaaguaaugaagaaaauugag

SEQ ID NO: 724766 - RNA, 16 nt, Homo sapiens
aaaaguacugcauuuu

SEQ ID NO: 724767 - RNA, 15 nt, Homo sapiens
aaaaguauaugugag

SEQ ID NO: 724768 - RNA, 15 nt, Homo sapiens
aaaagucaguaucau

SEQ ID NO: 724769 - RNA, 20 nt, Homo sapiens
gcacccugcgccuccagagg

SEQ ID NO: 724770 - RNA, 17 nt, Homo sapiens
gcacccuggccuggucc

SEQ ID NO: 724771 - RNA, 15 nt, Homo sapiens
gcaccggccucggga

SEQ ID NO: 724772 - RNA, 14 nt, Homo sapiens
gcaccgucauggcu

SEQ ID NO: 724773 - RNA, 15 nt, Homo sapiens
gcaccuaauccaggc

SEQ ID NO: 724774 - RNA, 13 nt, Homo sapiens
gcaccuacugcuu

SEQ ID NO: 724775 - RNA, 20 nt, Homo sapiens
gcaccucaccucccgaagcc

SEQ ID NO: 724776 - RNA, 22 nt, Homo sapiens
gcaccugccagaggaugcucuu

SEQ ID NO: 724777 - RNA, 19 nt, Homo sapiens
gcaccuggcccagaugaua

SEQ ID NO: 724778 - RNA, 23 nt, Homo sapiens
gcaccuggugggugguguccuga

SEQ ID NO: 724779 - RNA, 16 nt, Homo sapiens
gcaccuguacucagga

SEQ ID NO: 724780 - RNA, 21 nt, Homo sapiens
gcaccuguagucccagcuacu

SEQ ID NO: 724781 - RNA, 22 nt, Homo sapiens
gcaccuugucauguaccaucaa

SEQ ID NO: 724782 - RNA, 23 nt, Homo sapiens
gcacgagcuggaacccacgagga

SEQ ID NO: 724783 - RNA, 12 nt, Homo sapiens
gcacgcccuccu

SEQ ID NO: 724784 - RNA, 19 nt, Homo sapiens
gcacgggcccgugacaucc

SEQ ID NO: 724785 - RNA, 18 nt, Homo sapiens
gcacgguacaaacccaaa

SEQ ID NO: 724786 - RNA, 16 nt, Homo sapiens
aaaauaguaaagccaa

SEQ ID NO: 724787 - RNA, 21 nt, Homo sapiens
aaaauaguaaaugcuuugugu

SEQ ID NO: 724788 - RNA, 13 nt, Homo sapiens
aaaauaguaaugu

SEQ ID NO: 724789 - RNA, 20 nt, Homo sapiens
aaaauaguucuaaacuauca

SEQ ID NO: 724790 - RNA, 16 nt, Homo sapiens
aaaauaugccauuuau

SEQ ID NO: 724791 - RNA, 14 nt, Homo sapiens
aaaauauggcuaua

SEQ ID NO: 724792 - RNA, 17 nt, Homo sapiens
aaaauauguaauuucaa

SEQ ID NO: 724793 - RNA, 19 nt, Homo sapiens
aaaauauuauguguuucca

SEQ ID NO: 724794 - RNA, 13 nt, Homo sapiens
aaaauauucacuc

SEQ ID NO: 724795 - RNA, 21 nt, Homo sapiens
aaaauauucgugguaucugug

SEQ ID NO: 724796 - RNA, 20 nt, Homo sapiens
aaaauauuucuguugucaau

SEQ ID NO: 724797 - RNA, 23 nt, Homo sapiens
aaaauauuugagaauaaguucau

SEQ ID NO: 724798 - RNA, 15 nt, Homo sapiens
aaaaucacaucucca

SEQ ID NO: 724799 - RNA, 14 nt, Homo sapiens
aaaaucaucuuaca

SEQ ID NO: 724800 - RNA, 20 nt, Homo sapiens
aaaauccaaggcaauuccug

SEQ ID NO: 724801 - RNA, 24 nt, Homo sapiens
aaaauccuauucugaugaaucuca

SEQ ID NO: 724802 - RNA, 21 nt, Homo sapiens
aaaaucucccagugacaacau

SEQ ID NO: 724803 - RNA, 12 nt, Homo sapiens
aaaaucugucca

SEQ ID NO: 724804 - RNA, 16 nt, Homo sapiens
aaaaucuguguaacug

SEQ ID NO: 724805 - RNA, 23 nt, Homo sapiens
aaaaugaaaauucuaacccaaga

SEQ ID NO: 724806 - RNA, 19 nt, Homo sapiens
aaaaugaaagcaugucuca

SEQ ID NO: 724807 - RNA, 14 nt, Homo sapiens
aaaaugaaaggaag

SEQ ID NO: 724808 - RNA, 20 nt, Homo sapiens
aaaaugaaaggaaguuucag

SEQ ID NO: 724809 - RNA, 20 nt, Homo sapiens
aaaaugaaccugcaagccuu

SEQ ID NO: 724810 - RNA, 14 nt, Homo sapiens
aaaaugaauaucua

SEQ ID NO: 724811 - RNA, 14 nt, Homo sapiens
aaaaugagguacuc

SEQ ID NO: 724812 - RNA, 16 nt, Homo sapiens
aaaaugagugcuuaaa

SEQ ID NO: 724813 - RNA, 19 nt, Homo sapiens
aaaaugcaaagcugaagac

SEQ ID NO: 724814 - RNA, 20 nt, Homo sapiens
aaaaugcaauguaagcauac

SEQ ID NO: 724815 - RNA, 15 nt, Homo sapiens
aaaaugcauuaggga

SEQ ID NO: 724816 - RNA, 16 nt, Homo sapiens
aaaaugccuccauggc

SEQ ID NO: 724817 - RNA, 11 nt, Homo sapiens
aaaaugcugcu

SEQ ID NO: 724818 - RNA, 15 nt, Homo sapiens
aaaaugcugcucuca

SEQ ID NO: 724819 - RNA, 18 nt, Homo sapiens
aaaaugcuucugcacaca

SEQ ID NO: 724820 - RNA, 19 nt, Homo sapiens
aaaauggacaaaauccaug

SEQ ID NO: 724821 - RNA, 23 nt, Homo sapiens
aaaauggacaaaauccaugaaca

SEQ ID NO: 724822 - RNA, 18 nt, Homo sapiens
aaaauggcagugguggcc

SEQ ID NO: 724823 - RNA, 16 nt, Homo sapiens
aaaauggccauuugcu

SEQ ID NO: 724824 - RNA, 15 nt, Homo sapiens
aaaaugggaucucau

SEQ ID NO: 724825 - RNA, 14 nt, Homo sapiens
aaaauggucaucca

SEQ ID NO: 724826 - RNA, 22 nt, Homo sapiens
aaaauguauuuuagacuuccug

SEQ ID NO: 724827 - RNA, 15 nt, Homo sapiens
aaaauguauuuuucc

SEQ ID NO: 724828 - RNA, 15 nt, Homo sapiens
aaaaugucaggccuu

SEQ ID NO: 724829 - RNA, 22 nt, Homo sapiens
aaaauguguuccauugccauag

SEQ ID NO: 724830 - RNA, 12 nt, Homo sapiens
aaaauguucaca

SEQ ID NO: 724831 - RNA, 16 nt, Homo sapiens
aaaauguuuaccagug

SEQ ID NO: 724832 - RNA, 23 nt, Homo sapiens
aaaauuagccaggcaugguggca

SEQ ID NO: 724833 - RNA, 21 nt, Homo sapiens
aaaauuauuacuaaugaugcu

SEQ ID NO: 724834 - RNA, 18 nt, Homo sapiens
aaaauuauuuuguucaua

SEQ ID NO: 724835 - RNA, 13 nt, Homo sapiens
aaaauucauuucu

SEQ ID NO: 724836 - RNA, 17 nt, Homo sapiens
aaaauuccaaauucaug

SEQ ID NO: 724837 - RNA, 15 nt, Homo sapiens
aaaauuccuaucuca

SEQ ID NO: 724838 - RNA, 20 nt, Homo sapiens
aaaauucuauuacaguaugu

SEQ ID NO: 724839 - RNA, 21 nt, Homo sapiens
aaaauucuauuacaguauguc

SEQ ID NO: 724840 - RNA, 14 nt, Homo sapiens
aaaauugacaauga

SEQ ID NO: 724841 - RNA, 22 nt, Homo sapiens
aaaauugagaccugagugaaga

SEQ ID NO: 724842 - RNA, 17 nt, Homo sapiens
aaaauugggcaugccau

SEQ ID NO: 724843 - RNA, 20 nt, Homo sapiens
aaaauuggguguguauacuu

SEQ ID NO: 724844 - RNA, 15 nt, Homo sapiens
aaaauuuaaaucaua

SEQ ID NO: 724845 - RNA, 21 nt, Homo sapiens
aaaauuuacaauuugacauac

SEQ ID NO: 724846 - RNA, 17 nt, Homo sapiens
aaaauuucauagcugua

SEQ ID NO: 724847 - RNA, 15 nt, Homo sapiens
aaaauuuuacuucca

SEQ ID NO: 724848 - RNA, 12 nt, Homo sapiens
aaaauuuugcuu

SEQ ID NO: 724849 - RNA, 18 nt, Homo sapiens
aaaauuuuguauguuaaa

SEQ ID NO: 724850 - RNA, 12 nt, Homo sapiens
aaacaaaaagcc

SEQ ID NO: 724851 - RNA, 20 nt, Homo sapiens
aaacaaaacuugcaucuaac

SEQ ID NO: 724852 - RNA, 17 nt, Homo sapiens
aaacaaaaggguguaua

SEQ ID NO: 724853 - RNA, 17 nt, Homo sapiens
aaacaaaauuugacuaa

SEQ ID NO: 724854 - RNA, 18 nt, Homo sapiens
aaacaaaggaaguucucc

SEQ ID NO: 724855 - RNA, 13 nt, Homo sapiens
aaacaacauuuau

SEQ ID NO: 724856 - RNA, 18 nt, Homo sapiens
aaacaacuuccucccuua

SEQ ID NO: 724857 - RNA, 17 nt, Homo sapiens
aaacaacuuggcauuuc

SEQ ID NO: 724858 - RNA, 23 nt, Homo sapiens
aaacaacuuucuccuacucuucc

SEQ ID NO: 724859 - RNA, 23 nt, Homo sapiens
aaacaagcauagaaauggaagaa

SEQ ID NO: 724860 - RNA, 20 nt, Homo sapiens
aaacaauuggcaaacuuugu

SEQ ID NO: 724861 - RNA, 22 nt, Homo sapiens
aaacacaaauagaacauuccau

SEQ ID NO: 724862 - RNA, 19 nt, Homo sapiens
aaacacacauugcagcuuc

SEQ ID NO: 724863 - RNA, 19 nt, Homo sapiens
aaacacacgugcugugggc

SEQ ID NO: 724864 - RNA, 16 nt, Homo sapiens
aaacacagcuuuacaa

SEQ ID NO: 724865 - RNA, 12 nt, Homo sapiens
aaacaccaccaa

SEQ ID NO: 724866 - RNA, 14 nt, Homo sapiens
aaacaccuccucau

SEQ ID NO: 724867 - RNA, 15 nt, Homo sapiens
aaacacgugucuaua

SEQ ID NO: 724868 - RNA, 14 nt, Homo sapiens
aaacacuagcucug

SEQ ID NO: 724869 - RNA, 19 nt, Homo sapiens
aaacacucaucuccucugu

SEQ ID NO: 724870 - RNA, 22 nt, Homo sapiens
aaacagagacaggcccaagaga

SEQ ID NO: 724871 - RNA, 14 nt, Homo sapiens
aaacagaguauguc

SEQ ID NO: 724872 - RNA, 20 nt, Homo sapiens
aaacagauauuacagcuuau

SEQ ID NO: 724873 - RNA, 14 nt, Homo sapiens
aaacagaucuccug

SEQ ID NO: 724874 - RNA, 19 nt, Homo sapiens
aaacagauggcacuuugaa

SEQ ID NO: 724875 - RNA, 16 nt, Homo sapiens
aaacagauuucauacc

SEQ ID NO: 724876 - RNA, 22 nt, Homo sapiens
aaacagccuucuagcacacuuu

SEQ ID NO: 724877 - RNA, 20 nt, Homo sapiens
aaacagcucagccagugggg

SEQ ID NO: 724878 - RNA, 16 nt, Homo sapiens
aaacaggaacaaucca

SEQ ID NO: 724879 - RNA, 21 nt, Homo sapiens
aaacagggcugccuucuggcc

SEQ ID NO: 724880 - RNA, 21 nt, Homo sapiens
aaacagguuauaacaguguuu

SEQ ID NO: 724881 - RNA, 18 nt, Homo sapiens
aaacauaaucuucugccu

SEQ ID NO: 724882 - RNA, 16 nt, Homo sapiens
aaacauacgacuuauu

SEQ ID NO: 724883 - RNA, 14 nt, Homo sapiens
gcaggagaaucacu

SEQ ID NO: 724884 - RNA, 22 nt, Homo sapiens
gcaggauccgcugccaccacgu

SEQ ID NO: 724885 - RNA, 23 nt, Homo sapiens
gcaggcaagugggauaaaggccc

SEQ ID NO: 724886 - RNA, 21 nt, Homo sapiens
gcaggcagguggacugacugu

SEQ ID NO: 724887 - RNA, 14 nt, Homo sapiens
gcaggccacugggg

SEQ ID NO: 724888 - RNA, 16 nt, Homo sapiens
gcaggcccacucccca

SEQ ID NO: 724889 - RNA, 23 nt, Homo sapiens
gcaggccuccaacgccccugugg

SEQ ID NO: 724890 - RNA, 22 nt, Homo sapiens
gcaggcuccuuuguucuguauu

SEQ ID NO: 724891 - RNA, 14 nt, Homo sapiens
gcaggcugggccau

SEQ ID NO: 724892 - RNA, 14 nt, Homo sapiens
gcaggcuguuuccu

SEQ ID NO: 724893 - RNA, 15 nt, Homo sapiens
gcagggacuuuccug

SEQ ID NO: 724894 - RNA, 14 nt, Homo sapiens
gcagggagcacugu

SEQ ID NO: 724895 - RNA, 15 nt, Homo sapiens
gcagggaugauggca

SEQ ID NO: 724896 - RNA, 23 nt, Homo sapiens
gcagggauguuccuuaccaagga

SEQ ID NO: 724897 - RNA, 19 nt, Homo sapiens
gcagggcaaaugacaugca

SEQ ID NO: 724898 - RNA, 20 nt, Homo sapiens
gcagggcucucuguaucagu

SEQ ID NO: 724899 - RNA, 14 nt, Homo sapiens
gcagggcugugaug

SEQ ID NO: 724900 - RNA, 15 nt, Homo sapiens
gcaggggaagaccaa

SEQ ID NO: 724901 - RNA, 15 nt, Homo sapiens
aaaccagaaaagcaa

SEQ ID NO: 724902 - RNA, 15 nt, Homo sapiens
aaaccagccuggcca

SEQ ID NO: 724903 - RNA, 16 nt, Homo sapiens
aaaccagccuggccaa

SEQ ID NO: 724904 - RNA, 11 nt, Homo sapiens
aaaccagcucg

SEQ ID NO: 724905 - RNA, 20 nt, Homo sapiens
aaaccaucaaaaauauucca

SEQ ID NO: 724906 - RNA, 22 nt, Homo sapiens
aaaccauggucucucugcuugc

SEQ ID NO: 724907 - RNA, 20 nt, Homo sapiens
aaaccauucuagguguuuca

SEQ ID NO: 724908 - RNA, 16 nt, Homo sapiens
aaaccauuucagccaa

SEQ ID NO: 724909 - RNA, 18 nt, Homo sapiens
aaaccauuucagccaaac

SEQ ID NO: 724910 - RNA, 18 nt, Homo sapiens
aaacccacauucuuacca

SEQ ID NO: 724911 - RNA, 15 nt, Homo sapiens
aaacccagugcugcu

SEQ ID NO: 724912 - RNA, 22 nt, Homo sapiens
aaacccauguugaucuuucuca

SEQ ID NO: 724913 - RNA, 14 nt, Homo sapiens
aaaccccacuuccc

SEQ ID NO: 724914 - RNA, 21 nt, Homo sapiens
aaaccccccagagcucuuuac

SEQ ID NO: 724915 - RNA, 15 nt, Homo sapiens
aaaccuaauauucaa

SEQ ID NO: 724916 - RNA, 22 nt, Homo sapiens
aaaccuaauauucaaugaacuu

SEQ ID NO: 724917 - RNA, 13 nt, Homo sapiens
aaaccuaccaaaa

SEQ ID NO: 724918 - RNA, 16 nt, Homo sapiens
aaaccuaggucuccag

SEQ ID NO: 724919 - RNA, 17 nt, Homo sapiens
aaaccuccagccucccu

SEQ ID NO: 724920 - RNA, 16 nt, Homo sapiens
aaaccuccuauuccau

SEQ ID NO: 724921 - RNA, 14 nt, Homo sapiens
aaaccucuccugac

SEQ ID NO: 724922 - RNA, 16 nt, Homo sapiens
aaaccugaccccugcu

SEQ ID NO: 724923 - RNA, 21 nt, Homo sapiens
aaaccugaccccugcucagua

SEQ ID NO: 724924 - RNA, 15 nt, Homo sapiens
aaaccugauuuacua

SEQ ID NO: 724925 - RNA, 22 nt, Homo sapiens
aaaccugggcaugguggcucac

SEQ ID NO: 724926 - RNA, 16 nt, Homo sapiens
aaaccuuaguacugag

SEQ ID NO: 724927 - RNA, 13 nt, Homo sapiens
aaaccuucaguga

SEQ ID NO: 724928 - RNA, 14 nt, Homo sapiens
aaaccuuccucagc

SEQ ID NO: 724929 - RNA, 20 nt, Homo sapiens
aaaccuuccuucccuggcua

SEQ ID NO: 724930 - RNA, 18 nt, Homo sapiens
aaaccuuggccucugcua

SEQ ID NO: 724931 - RNA, 22 nt, Homo sapiens
aaacgauuccgccacacauccu

SEQ ID NO: 724932 - RNA, 13 nt, Homo sapiens
aaacuaaccaucu

SEQ ID NO: 724933 - RNA, 16 nt, Homo sapiens
aaacuaaccaucugaa

SEQ ID NO: 724934 - RNA, 23 nt, Homo sapiens
aaacuaaccuugaauaaggccca

SEQ ID NO: 724935 - RNA, 14 nt, Homo sapiens
aaacuaagcacaaa

SEQ ID NO: 724936 - RNA, 12 nt, Homo sapiens
aaacuaaggauu

SEQ ID NO: 724937 - RNA, 16 nt, Homo sapiens
aaacuacauuuugcaa

SEQ ID NO: 724938 - RNA, 19 nt, Homo sapiens
aaacuaguuuccaguggau

SEQ ID NO: 724939 - RNA, 13 nt, Homo sapiens
aaacuauauucuc

SEQ ID NO: 724940 - RNA, 16 nt, Homo sapiens
aaacuaugcuauuaaa

SEQ ID NO: 724941 - RNA, 12 nt, Homo sapiens
aaacucaguuca

SEQ ID NO: 724942 - RNA, 13 nt, Homo sapiens
aaacuccacaaag

SEQ ID NO: 724943 - RNA, 14 nt, Homo sapiens
aaacuccaugcaaa

SEQ ID NO: 724944 - RNA, 20 nt, Homo sapiens
aaacuccugaccucagguga

SEQ ID NO: 724945 - RNA, 23 nt, Homo sapiens
aaacuccugauuuuguaguuaau

SEQ ID NO: 724946 - RNA, 18 nt, Homo sapiens
aaacuccuuaacuucagg

SEQ ID NO: 724947 - RNA, 17 nt, Homo sapiens
aaacuccuuuugguuua

SEQ ID NO: 724948 - RNA, 18 nt, Homo sapiens
aaacucuacuuaauccaa

SEQ ID NO: 724949 - RNA, 16 nt, Homo sapiens
aaacucuccuagucaa

SEQ ID NO: 724950 - RNA, 11 nt, Homo sapiens
aaacucuucag

SEQ ID NO: 724951 - RNA, 15 nt, Homo sapiens
aaacugaaagaucug

SEQ ID NO: 724952 - RNA, 22 nt, Homo sapiens
aaacugagaaauuuacuacagu

SEQ ID NO: 724953 - RNA, 23 nt, Homo sapiens
aaacugauacccuuugaaaaagu

SEQ ID NO: 724954 - RNA, 19 nt, Homo sapiens
aaacugauuuuuagcuuua

SEQ ID NO: 724955 - RNA, 20 nt, Homo sapiens
aaacugcaaagcucggugcu

SEQ ID NO: 724956 - RNA, 11 nt, Homo sapiens
aaacugcauuu

SEQ ID NO: 724957 - RNA, 22 nt, Homo sapiens
aaacugcucagcgcgucucagc

SEQ ID NO: 724958 - RNA, 19 nt, Homo sapiens
aaacugcucuguaggucau

SEQ ID NO: 724959 - RNA, 23 nt, Homo sapiens
aaacugcuucccuuacuuugcug

SEQ ID NO: 724960 - RNA, 22 nt, Homo sapiens
aaacuggcugcuuuguucaaug

SEQ ID NO: 724961 - RNA, 17 nt, Homo sapiens
aaacuguaugugcaguu

SEQ ID NO: 724962 - RNA, 21 nt, Homo sapiens
aaacuguaugugcaguuauuu

SEQ ID NO: 724963 - RNA, 16 nt, Homo sapiens
aaacuguccaccaaga

SEQ ID NO: 724964 - RNA, 19 nt, Homo sapiens
aaacuguccucuacaucaa

SEQ ID NO: 724965 - RNA, 16 nt, Homo sapiens
aaacuguuaucacuua

SEQ ID NO: 724966 - RNA, 22 nt, Homo sapiens
aaacuuauuugcugcagaauuu

SEQ ID NO: 724967 - RNA, 12 nt, Homo sapiens
aaacuucaccua

SEQ ID NO: 724968 - RNA, 21 nt, Homo sapiens
aaacuucaccuacauuaucuc

SEQ ID NO: 724969 - RNA, 22 nt, Homo sapiens
aaacuucaccuacauuaucuca

SEQ ID NO: 724970 - RNA, 23 nt, Homo sapiens
aaacuucaccuacauuaucucac

SEQ ID NO: 724971 - RNA, 10 nt, Homo sapiens
aaacuugaau

SEQ ID NO: 724972 - RNA, 21 nt, Homo sapiens
aaacuugcauacagagacaga

SEQ ID NO: 724973 - RNA, 17 nt, Homo sapiens
aaacuuguacuauguua

SEQ ID NO: 724974 - RNA, 23 nt, Homo sapiens
aaacuuuaggcccugccccagau

SEQ ID NO: 724975 - RNA, 17 nt, Homo sapiens
aaacuuuguuugucaca

SEQ ID NO: 724976 - RNA, 18 nt, Homo sapiens
aaacuuuuaaacaugaga

SEQ ID NO: 724977 - RNA, 18 nt, Homo sapiens
aaagaaaaagaccuauga

SEQ ID NO: 724978 - RNA, 14 nt, Homo sapiens
aaagaaaaaucaga

SEQ ID NO: 724979 - RNA, 12 nt, Homo sapiens
aaagaaaacugg

SEQ ID NO: 724980 - RNA, 15 nt, Homo sapiens
aaagaaacaagaugc

SEQ ID NO: 724981 - RNA, 19 nt, Homo sapiens
aaagaaauauuaagcaugu

SEQ ID NO: 724982 - RNA, 14 nt, Homo sapiens
aaagaaauuuugcc

SEQ ID NO: 724983 - RNA, 21 nt, Homo sapiens
aaagaaauuuugccugccauu

SEQ ID NO: 724984 - RNA, 18 nt, Homo sapiens
aaagaagaaaacaguaca

SEQ ID NO: 724985 - RNA, 22 nt, Homo sapiens
aaagaagaaauaguucugugac

SEQ ID NO: 724986 - RNA, 13 nt, Homo sapiens
aaagaagaacuug

SEQ ID NO: 724987 - RNA, 14 nt, Homo sapiens
aaagaagaguuuac

SEQ ID NO: 724988 - RNA, 17 nt, Homo sapiens
aaagaagcuuccacaaa

SEQ ID NO: 724989 - RNA, 12 nt, Homo sapiens
aaagaagcuuug

SEQ ID NO: 724990 - RNA, 17 nt, Homo sapiens
aaagaaggaagugaaga

SEQ ID NO: 724991 - RNA, 21 nt, Homo sapiens
aaagaagguuggugaauuuca

SEQ ID NO: 724992 - RNA, 12 nt, Homo sapiens
aaagaaguacuu

SEQ ID NO: 724993 - RNA, 14 nt, Homo sapiens
aaagaaucagucuu

SEQ ID NO: 724994 - RNA, 15 nt, Homo sapiens
aaagaaucagucuug

SEQ ID NO: 724995 - RNA, 23 nt, Homo sapiens
aaagaaucccaauguuugacaaa

SEQ ID NO: 724996 - RNA, 16 nt, Homo sapiens
aaagaaugcucuuuac

SEQ ID NO: 724997 - RNA, 16 nt, Homo sapiens
aaagacaagaugcaac

SEQ ID NO: 724998 - RNA, 17 nt, Homo sapiens
aaagacaaucacugcca

SEQ ID NO: 724999 - RNA, 12 nt, Homo sapiens
aaagacacugcc

SEQ ID NO: 725000 - RNA, 17 nt, Homo sapiens
aaagacaggcaaacggc

SEQ ID NO: 725001 - RNA, 14 nt, Homo sapiens
aaagacauagccaa

SEQ ID NO: 725002 - RNA, 19 nt, Homo sapiens
aaagacauucuuccaaaaa

SEQ ID NO: 725003 - RNA, 21 nt, Homo sapiens
aaagacauucuuccaaaaaga

SEQ ID NO: 725004 - RNA, 20 nt, Homo sapiens
aaagacccuaaaucugagga

SEQ ID NO: 725005 - RNA, 14 nt, Homo sapiens
aaagaccugagaac

SEQ ID NO: 725006 - RNA, 15 nt, Homo sapiens
aaagacuaagccaga

SEQ ID NO: 725007 - RNA, 18 nt, Homo sapiens
aaagacugagcucaaggu

SEQ ID NO: 725008 - RNA, 16 nt, Homo sapiens
aaagacugcagcugcu

SEQ ID NO: 725009 - RNA, 12 nt, Homo sapiens
aaagacugccug

SEQ ID NO: 725010 - RNA, 20 nt, Homo sapiens
aaagacuguacaaaguagaa

SEQ ID NO: 725011 - RNA, 18 nt, Homo sapiens
aaagacuuaacugguuca

SEQ ID NO: 725012 - RNA, 13 nt, Homo sapiens
aaagagaagccaa

SEQ ID NO: 725013 - RNA, 17 nt, Homo sapiens
aaagagagaagggagac

SEQ ID NO: 725014 - RNA, 18 nt, Homo sapiens
aaagagagaugaaccaca

SEQ ID NO: 725015 - RNA, 22 nt, Homo sapiens
aaagagauuuucacccauccau

SEQ ID NO: 725016 - RNA, 20 nt, Homo sapiens
gcaggggaauucccuccccc

SEQ ID NO: 725017 - RNA, 13 nt, Homo sapiens
gcaggggagacag

SEQ ID NO: 725018 - RNA, 21 nt, Homo sapiens
gcaggggagacaggagccuag

SEQ ID NO: 725019 - RNA, 20 nt, Homo sapiens
gcagggggugugucugcuca

SEQ ID NO: 725020 - RNA, 18 nt, Homo sapiens
gcaggggugcuguggaca

SEQ ID NO: 725021 - RNA, 22 nt, Homo sapiens
gcaggguccacgccucugcugu

SEQ ID NO: 725022 - RNA, 22 nt, Homo sapiens
gcagguaccgugcucauugcua

SEQ ID NO: 725023 - RNA, 17 nt, Homo sapiens
gcagguaggucggcacu

SEQ ID NO: 725024 - RNA, 15 nt, Homo sapiens
gcagguauggaaggg

SEQ ID NO: 725025 - RNA, 13 nt, Homo sapiens
gcaggucugagau

SEQ ID NO: 725026 - RNA, 16 nt, Homo sapiens
gcaggugaugccauua

SEQ ID NO: 725027 - RNA, 12 nt, Homo sapiens
gcaggugccuug

SEQ ID NO: 725028 - RNA, 12 nt, Homo sapiens
gcaggugcgauu

SEQ ID NO: 725029 - RNA, 19 nt, Homo sapiens
gcagguggugggacacugg

SEQ ID NO: 725030 - RNA, 20 nt, Homo sapiens
gcagguuccccaagggcccu

SEQ ID NO: 725031 - RNA, 21 nt, Homo sapiens
gcagguugaccgggacuucaa

SEQ ID NO: 725032 - RNA, 13 nt, Homo sapiens
gcaguaagccugu

SEQ ID NO: 725033 - RNA, 13 nt, Homo sapiens
gcaguacuuugug

SEQ ID NO: 725034 - RNA, 20 nt, Homo sapiens
gcaguaggggcuacugugac

SEQ ID NO: 725035 - RNA, 12 nt, Homo sapiens
gcaguaucucaa

SEQ ID NO: 725036 - RNA, 13 nt, Homo sapiens
gcaguauguugcc

SEQ ID NO: 725037 - RNA, 19 nt, Homo sapiens
gcaguauguuuguuucauu

SEQ ID NO: 725038 - RNA, 19 nt, Homo sapiens
gcagucaacaguucaaaga

SEQ ID NO: 725039 - RNA, 13 nt, Homo sapiens
gcagucagggaca

SEQ ID NO: 725040 - RNA, 13 nt, Homo sapiens
gcagucaguucau

SEQ ID NO: 725041 - RNA, 13 nt, Homo sapiens
gcagucauaucaa

SEQ ID NO: 725042 - RNA, 13 nt, Homo sapiens
gcagucugcuuca

SEQ ID NO: 725043 - RNA, 22 nt, Homo sapiens
gcagucugcuucagugcaguga

SEQ ID NO: 725044 - RNA, 14 nt, Homo sapiens
gcagucuuugcuca

SEQ ID NO: 725045 - RNA, 18 nt, Homo sapiens
gcagugacgugcaccugu

SEQ ID NO: 725046 - RNA, 13 nt, Homo sapiens
gcagugagccaaa

SEQ ID NO: 725047 - RNA, 19 nt, Homo sapiens
gcagugagcccagaucgca

SEQ ID NO: 725048 - RNA, 16 nt, Homo sapiens
gcagugagcugagauc

SEQ ID NO: 725049 - RNA, 17 nt, Homo sapiens
gcagugagcuguguucu

SEQ ID NO: 725050 - RNA, 15 nt, Homo sapiens
gcagugauacaugua

SEQ ID NO: 725051 - RNA, 15 nt, Homo sapiens
gcagugcacauuuca

SEQ ID NO: 725052 - RNA, 16 nt, Homo sapiens
gcaguggcaucaucuc

SEQ ID NO: 725053 - RNA, 20 nt, Homo sapiens
gcaguggccaggcagggagu

SEQ ID NO: 725054 - RNA, 18 nt, Homo sapiens
gcaguuagcucauuugag

SEQ ID NO: 725055 - RNA, 20 nt, Homo sapiens
gcaguucauccgcacuguaa

SEQ ID NO: 725056 - RNA, 17 nt, Homo sapiens
gcaguucuaguuugcau

SEQ ID NO: 725057 - RNA, 19 nt, Homo sapiens
gcaguuggacucucaggga

SEQ ID NO: 725058 - RNA, 14 nt, Homo sapiens
gcaguuggcagaaa

SEQ ID NO: 725059 - RNA, 19 nt, Homo sapiens
gcaguuguaccaagugaaa

SEQ ID NO: 725060 - RNA, 23 nt, Homo sapiens
gcaguuucaucaaagaacaaaca

SEQ ID NO: 725061 - RNA, 18 nt, Homo sapiens
gcaguuucugcuauugug

SEQ ID NO: 725062 - RNA, 22 nt, Homo sapiens
gcauaaauccauccauccaaag

SEQ ID NO: 725063 - RNA, 13 nt, Homo sapiens
gcauaaaugcauu

SEQ ID NO: 725064 - RNA, 21 nt, Homo sapiens
gcauaaguuucugggaccuca

SEQ ID NO: 725065 - RNA, 18 nt, Homo sapiens
gcauaauaagcuaaagag

SEQ ID NO: 725066 - RNA, 14 nt, Homo sapiens
gcauaauagucaau

SEQ ID NO: 725067 - RNA, 14 nt, Homo sapiens
gcauacaaaauauu

SEQ ID NO: 725068 - RNA, 15 nt, Homo sapiens
gcauacagagacaga

SEQ ID NO: 725069 - RNA, 16 nt, Homo sapiens
gcauacccuuacucug

SEQ ID NO: 725070 - RNA, 21 nt, Homo sapiens
gcauacuacaguaacugugac

SEQ ID NO: 725071 - RNA, 16 nt, Homo sapiens
gcauagcucuauuuua

SEQ ID NO: 725072 - RNA, 21 nt, Homo sapiens
gcauaggaacaauaagaacaa

SEQ ID NO: 725073 - RNA, 20 nt, Homo sapiens
gcauaggcugacuuuugcag

SEQ ID NO: 725074 - RNA, 21 nt, Homo sapiens
gcauaggugaggcugggcccu

SEQ ID NO: 725075 - RNA, 16 nt, Homo sapiens
gcauaguccaaaaagc

SEQ ID NO: 725076 - RNA, 21 nt, Homo sapiens
gcauauacagugaagaguaag

SEQ ID NO: 725077 - RNA, 15 nt, Homo sapiens
gcauaucugccuccc

SEQ ID NO: 725078 - RNA, 15 nt, Homo sapiens
gcauaugcacaguca

SEQ ID NO: 725079 - RNA, 17 nt, Homo sapiens
gcaucaauacaaccagc

SEQ ID NO: 725080 - RNA, 15 nt, Homo sapiens
gcaucacaugaugaa

SEQ ID NO: 725081 - RNA, 14 nt, Homo sapiens
gcaucaccuacccc

SEQ ID NO: 725082 - RNA, 16 nt, Homo sapiens
gcaucacuagugacaa

SEQ ID NO: 725083 - RNA, 12 nt, Homo sapiens
gcaucacuuaac

SEQ ID NO: 725084 - RNA, 13 nt, Homo sapiens
gcaucaucuaugg

SEQ ID NO: 725085 - RNA, 22 nt, Homo sapiens
gcaucauuauuugcagagacag

SEQ ID NO: 725086 - RNA, 20 nt, Homo sapiens
gcauccacccagugcugcca

SEQ ID NO: 725087 - RNA, 17 nt, Homo sapiens
gcaucccgauaccucag

SEQ ID NO: 725088 - RNA, 12 nt, Homo sapiens
gcauccuggaca

SEQ ID NO: 725089 - RNA, 17 nt, Homo sapiens
gcauccuggacaacaac

SEQ ID NO: 725090 - RNA, 15 nt, Homo sapiens
gcauccugugcuucu

SEQ ID NO: 725091 - RNA, 17 nt, Homo sapiens
gcaucgaccacaccagc

SEQ ID NO: 725092 - RNA, 18 nt, Homo sapiens
gcaucggacaagaccccc

SEQ ID NO: 725093 - RNA, 20 nt, Homo sapiens
gcaucguggccuugaccucc

SEQ ID NO: 725094 - RNA, 11 nt, Homo sapiens
gcaucuacucu

SEQ ID NO: 725095 - RNA, 16 nt, Homo sapiens
gcaucuaucugugcua

SEQ ID NO: 725096 - RNA, 23 nt, Homo sapiens
gcaucuauucuuuguaccaucug

SEQ ID NO: 725097 - RNA, 13 nt, Homo sapiens
gcaucucagccua

SEQ ID NO: 725098 - RNA, 23 nt, Homo sapiens
gcaucugagugggcccagcacau

SEQ ID NO: 725099 - RNA, 23 nt, Homo sapiens
gcaucugugccagagauguacug

SEQ ID NO: 725100 - RNA, 20 nt, Homo sapiens
gcaucuucugguuuaaacuu

SEQ ID NO: 725101 - RNA, 15 nt, Homo sapiens
gcaucuuguuucaua

SEQ ID NO: 725102 - RNA, 16 nt, Homo sapiens
gcaucuuuaacacagc

SEQ ID NO: 725103 - RNA, 15 nt, Homo sapiens
gcaugacaaaccuua

SEQ ID NO: 725104 - RNA, 23 nt, Homo sapiens
gcaugaccugugaccagcacugu

SEQ ID NO: 725105 - RNA, 20 nt, Homo sapiens
gcaugacucagacugcauga

SEQ ID NO: 725106 - RNA, 23 nt, Homo sapiens
gcaugcagccagccaucaaauag

SEQ ID NO: 725107 - RNA, 10 nt, Homo sapiens
gcaugcaguu

SEQ ID NO: 725108 - RNA, 13 nt, Homo sapiens
gcaugcauucuag

SEQ ID NO: 725109 - RNA, 18 nt, Homo sapiens
gcaugcauucuagcacaa

SEQ ID NO: 725110 - RNA, 23 nt, Homo sapiens
gcaugcccuaagagugucacuga

SEQ ID NO: 725111 - RNA, 16 nt, Homo sapiens
gcaugccuguagucuc

SEQ ID NO: 725112 - RNA, 16 nt, Homo sapiens
gcauggaacacuucga

SEQ ID NO: 725113 - RNA, 17 nt, Homo sapiens
gaccucaucucuacuaa

SEQ ID NO: 725114 - RNA, 23 nt, Homo sapiens
gaccugacaccgucccucaguga

SEQ ID NO: 725115 - RNA, 17 nt, Homo sapiens
gaccugaggcugugguc

SEQ ID NO: 725116 - RNA, 14 nt, Homo sapiens
gaccugauccugga

SEQ ID NO: 725117 - RNA, 14 nt, Homo sapiens
gaccugcggcagua

SEQ ID NO: 725118 - RNA, 23 nt, Homo sapiens
gaccugcggcaguauguacuuca

SEQ ID NO: 725119 - RNA, 14 nt, Homo sapiens
gaccuguugggagu

SEQ ID NO: 725120 - RNA, 17 nt, Homo sapiens
gaccuuagcguucugga

SEQ ID NO: 725121 - RNA, 18 nt, Homo sapiens
gaccuuaggccuuccucu

SEQ ID NO: 725122 - RNA, 17 nt, Homo sapiens
gaccuucuccccauucu

SEQ ID NO: 725123 - RNA, 20 nt, Homo sapiens
gaccuuggagagacacagcg

SEQ ID NO: 725124 - RNA, 17 nt, Homo sapiens
gaccuugggguacaauu

SEQ ID NO: 725125 - RNA, 17 nt, Homo sapiens
gaccuugugaucugccc

SEQ ID NO: 725126 - RNA, 22 nt, Homo sapiens
gacgaagcggagagagccaaga

SEQ ID NO: 725127 - RNA, 12 nt, Homo sapiens
gacgaauuccac

SEQ ID NO: 725128 - RNA, 17 nt, Homo sapiens
gacgagcagggugguga

SEQ ID NO: 725129 - RNA, 14 nt, Homo sapiens
gacgaggaggacag

SEQ ID NO: 725130 - RNA, 19 nt, Homo sapiens
gacgaggggugucuugggc

SEQ ID NO: 725131 - RNA, 15 nt, Homo sapiens
gacgagguuucacug

SEQ ID NO: 725132 - RNA, 19 nt, Homo sapiens
gacgccugauggugcugcu

SEQ ID NO: 725133 - RNA, 15 nt, Homo sapiens
gacgcugacugcccu

SEQ ID NO: 725134 - RNA, 15 nt, Homo sapiens
gacgcuugugacagu

SEQ ID NO: 725135 - RNA, 22 nt, Homo sapiens
gacgggguuucaccauguuggc

SEQ ID NO: 725136 - RNA, 18 nt, Homo sapiens
gacggguugaaagacauc

SEQ ID NO: 725137 - RNA, 21 nt, Homo sapiens
gacggguuucaccauguuggc

SEQ ID NO: 725138 - RNA, 20 nt, Homo sapiens
gacgguaaguguucucauga

SEQ ID NO: 725139 - RNA, 13 nt, Homo sapiens
gacggucagucca

SEQ ID NO: 725140 - RNA, 22 nt, Homo sapiens
gacggucaguccaugucucgga

SEQ ID NO: 725141 - RNA, 21 nt, Homo sapiens
gacgguuaacuuguauauucc

SEQ ID NO: 725142 - RNA, 20 nt, Homo sapiens
gacguccucccugaucccac

SEQ ID NO: 725143 - RNA, 19 nt, Homo sapiens
gacuaaaugaaaucuugca

SEQ ID NO: 725144 - RNA, 21 nt, Homo sapiens
gacuaacauaaaaucugugaa

SEQ ID NO: 725145 - RNA, 12 nt, Homo sapiens
gacuaacccaau

SEQ ID NO: 725146 - RNA, 13 nt, Homo sapiens
gacuaacccaaug

SEQ ID NO: 725147 - RNA, 13 nt, Homo sapiens
gacuaacuaucaa

SEQ ID NO: 725148 - RNA, 13 nt, Homo sapiens
gacuaagccagac

SEQ ID NO: 725149 - RNA, 15 nt, Homo sapiens
gacuaauuaggcaag

SEQ ID NO: 725150 - RNA, 13 nt, Homo sapiens
gacuacaaccaau

SEQ ID NO: 725151 - RNA, 13 nt, Homo sapiens
gacuacuauacaa

SEQ ID NO: 725152 - RNA, 18 nt, Homo sapiens
gacuagaggcuugcauaa

SEQ ID NO: 725153 - RNA, 19 nt, Homo sapiens
gacuagugagucagcaccu

SEQ ID NO: 725154 - RNA, 16 nt, Homo sapiens
gacuauaaagcuguua

SEQ ID NO: 725155 - RNA, 18 nt, Homo sapiens
gacuauguuucuauucua

SEQ ID NO: 725156 - RNA, 12 nt, Homo sapiens
gacuauguuugg

SEQ ID NO: 725157 - RNA, 22 nt, Homo sapiens
gacucaagaagugaagaaugca

SEQ ID NO: 725158 - RNA, 22 nt, Homo sapiens
gacucaccaacuuuuaauggga

SEQ ID NO: 725159 - RNA, 21 nt, Homo sapiens
gacucacccucauaccaucug

SEQ ID NO: 725160 - RNA, 14 nt, Homo sapiens
gacucagagcucuc

SEQ ID NO: 725161 - RNA, 24 nt, Homo sapiens
gacucaggagucugccacuuguca

SEQ ID NO: 725162 - RNA, 13 nt, Homo sapiens
gacucagugcaga

SEQ ID NO: 725163 - RNA, 13 nt, Homo sapiens
gacucauuucaca

SEQ ID NO: 725164 - RNA, 20 nt, Homo sapiens
gacuccaaacagaccccugu

SEQ ID NO: 725165 - RNA, 22 nt, Homo sapiens
gacuccacgcuguccuuuggga

SEQ ID NO: 725166 - RNA, 23 nt, Homo sapiens
gacuccagaaucugcuguugcca

SEQ ID NO: 725167 - RNA, 13 nt, Homo sapiens
gacuccaucucaa

SEQ ID NO: 725168 - RNA, 16 nt, Homo sapiens
gacuccaucucaaaaa

SEQ ID NO: 725169 - RNA, 12 nt, Homo sapiens
gacuccaugcug

SEQ ID NO: 725170 - RNA, 16 nt, Homo sapiens
gacucccgcgugaaga

SEQ ID NO: 725171 - RNA, 23 nt, Homo sapiens
gacucgccucugcuccugugguc

SEQ ID NO: 725172 - RNA, 16 nt, Homo sapiens
gacucgguuucuccaa

SEQ ID NO: 725173 - RNA, 15 nt, Homo sapiens
gacucucacacugaa

SEQ ID NO: 725174 - RNA, 14 nt, Homo sapiens
gacucucagcagcu

SEQ ID NO: 725175 - RNA, 17 nt, Homo sapiens
gacucucccccuuucaa

SEQ ID NO: 725176 - RNA, 23 nt, Homo sapiens
gacucugaaaaacauuccaggaa

SEQ ID NO: 725177 - RNA, 13 nt, Homo sapiens
gacucugaucucu

SEQ ID NO: 725178 - RNA, 20 nt, Homo sapiens
gacucugauucuacagugau

SEQ ID NO: 725179 - RNA, 21 nt, Homo sapiens
gacucuggaaguuuucuagca

SEQ ID NO: 725180 - RNA, 22 nt, Homo sapiens
gacucugggcugucagcccaug

SEQ ID NO: 725181 - RNA, 16 nt, Homo sapiens
gacucuggucauagaa

SEQ ID NO: 725182 - RNA, 19 nt, Homo sapiens
gacucuggucauagaaaca

SEQ ID NO: 725183 - RNA, 22 nt, Homo sapiens
gacucuggucauagaaacaaua

SEQ ID NO: 725184 - RNA, 16 nt, Homo sapiens
gacucugucuaccugg

SEQ ID NO: 725185 - RNA, 12 nt, Homo sapiens
gacugaacucca

SEQ ID NO: 725186 - RNA, 14 nt, Homo sapiens
gacugaagcacagc

SEQ ID NO: 725187 - RNA, 19 nt, Homo sapiens
gacugaaggggcacaccac

SEQ ID NO: 725188 - RNA, 22 nt, Homo sapiens
gacugaaugugccuaauggaga

SEQ ID NO: 725189 - RNA, 13 nt, Homo sapiens
gacugacauuuag

SEQ ID NO: 725190 - RNA, 21 nt, Homo sapiens
gacugagaaauuauacuuacu

SEQ ID NO: 725191 - RNA, 12 nt, Homo sapiens
gacugagcucaa

SEQ ID NO: 725192 - RNA, 15 nt, Homo sapiens
gacugaugacuuuau

SEQ ID NO: 725193 - RNA, 17 nt, Homo sapiens
gacugaugucaucuuga

SEQ ID NO: 725194 - RNA, 17 nt, Homo sapiens
gacugcaugacagucac

SEQ ID NO: 725195 - RNA, 15 nt, Homo sapiens
gacugccaagccaga

SEQ ID NO: 725196 - RNA, 17 nt, Homo sapiens
gacugccaugcuagaca

SEQ ID NO: 725197 - RNA, 14 nt, Homo sapiens
gacugccugugaag

SEQ ID NO: 725198 - RNA, 17 nt, Homo sapiens
gacugcuaccucugaga

SEQ ID NO: 725199 - RNA, 16 nt, Homo sapiens
gacugcuaccuuucaa

SEQ ID NO: 725200 - RNA, 23 nt, Homo sapiens
gacugcuuuuaaaugaccaaaga

SEQ ID NO: 725201 - RNA, 17 nt, Homo sapiens
gacuggaagacacuuca

SEQ ID NO: 725202 - RNA, 19 nt, Homo sapiens
gacuggacgugcucagaca

SEQ ID NO: 725203 - RNA, 17 nt, Homo sapiens
gacuggauucgugacaa

SEQ ID NO: 725204 - RNA, 23 nt, Homo sapiens
gacugggacagcccaggaaacaa

SEQ ID NO: 725205 - RNA, 17 nt, Homo sapiens
gacuggguuacauaugc

SEQ ID NO: 725206 - RNA, 21 nt, Homo sapiens
gacugguggccccugccuugg

SEQ ID NO: 725207 - RNA, 16 nt, Homo sapiens
gacuguaaaugcucca

SEQ ID NO: 725208 - RNA, 17 nt, Homo sapiens
gacuguaagcuccauga

SEQ ID NO: 725209 - RNA, 18 nt, Homo sapiens
gacuguggcacuugccug

SEQ ID NO: 725210 - RNA, 15 nt, Homo sapiens
gacugugugcaacgc

SEQ ID NO: 725211 - RNA, 16 nt, Homo sapiens
gacuguugccacuuaa

SEQ ID NO: 725212 - RNA, 14 nt, Homo sapiens
gacuuaaaacaugg

SEQ ID NO: 725213 - RNA, 18 nt, Homo sapiens
gacuuaacugguucauau

SEQ ID NO: 725214 - RNA, 16 nt, Homo sapiens
gacuuaagaagccuua

SEQ ID NO: 725215 - RNA, 22 nt, Homo sapiens
gacuuaagcccagugcacugaa

SEQ ID NO: 725216 - RNA, 15 nt, Homo sapiens
gacuuacaaaaugcc

SEQ ID NO: 725217 - RNA, 16 nt, Homo sapiens
gacuuagagcugggaa

SEQ ID NO: 725218 - RNA, 20 nt, Homo sapiens
gacuuagaggcaacaggauu

SEQ ID NO: 725219 - RNA, 21 nt, Homo sapiens
gacuuagcgucaagacauuug

SEQ ID NO: 725220 - RNA, 18 nt, Homo sapiens
gacuuaggaaccuaccag

SEQ ID NO: 725221 - RNA, 18 nt, Homo sapiens
gacuuauuuaaacucugu

SEQ ID NO: 725222 - RNA, 13 nt, Homo sapiens
gacuucacuguau

SEQ ID NO: 725223 - RNA, 16 nt, Homo sapiens
gaagcucugaagucac

SEQ ID NO: 725224 - RNA, 15 nt, Homo sapiens
gaagcugcacaugug

SEQ ID NO: 725225 - RNA, 12 nt, Homo sapiens
gaagcugcuccu

SEQ ID NO: 725226 - RNA, 20 nt, Homo sapiens
gaagcugggugagccaagga

SEQ ID NO: 725227 - RNA, 13 nt, Homo sapiens
gaagcuggugccc

SEQ ID NO: 725228 - RNA, 11 nt, Homo sapiens
gaagcugugcg

SEQ ID NO: 725229 - RNA, 22 nt, Homo sapiens
gaagcuguguccuugcaccugc

SEQ ID NO: 725230 - RNA, 16 nt, Homo sapiens
gaagcuguugcggaca

SEQ ID NO: 725231 - RNA, 10 nt, Homo sapiens
gaagcuuuag

SEQ ID NO: 725232 - RNA, 18 nt, Homo sapiens
gaagcuuugaguugacuu

SEQ ID NO: 725233 - RNA, 18 nt, Homo sapiens
gaaggaagcaagcaucuc

SEQ ID NO: 725234 - RNA, 14 nt, Homo sapiens
gaaggaauggugcg

SEQ ID NO: 725235 - RNA, 14 nt, Homo sapiens
gaaggaauuauucc

SEQ ID NO: 725236 - RNA, 14 nt, Homo sapiens
gaaggacacaguga

SEQ ID NO: 725237 - RNA, 17 nt, Homo sapiens
gaaggacacuagccugu

SEQ ID NO: 725238 - RNA, 18 nt, Homo sapiens
gaaggacaggacccucag

SEQ ID NO: 725239 - RNA, 21 nt, Homo sapiens
gaaggagaguccccugaaggu

SEQ ID NO: 725240 - RNA, 20 nt, Homo sapiens
gaaggagauaauuacugccu

SEQ ID NO: 725241 - RNA, 17 nt, Homo sapiens
gaaggaggggaaccaga

SEQ ID NO: 725242 - RNA, 18 nt, Homo sapiens
gaaggaggggaaccagau

SEQ ID NO: 725243 - RNA, 23 nt, Homo sapiens
gaaggaugucccggguguguaca

SEQ ID NO: 725244 - RNA, 15 nt, Homo sapiens
gaaggauuacucucc

SEQ ID NO: 725245 - RNA, 13 nt, Homo sapiens
gaaggcaaaaaga

SEQ ID NO: 725246 - RNA, 16 nt, Homo sapiens
gaaggcaaaagaaaga

SEQ ID NO: 725247 - RNA, 23 nt, Homo sapiens
gaaggcaaauauaagcugggaaa

SEQ ID NO: 725248 - RNA, 21 nt, Homo sapiens
gaaggcaauuuuaguguauua

SEQ ID NO: 725249 - RNA, 11 nt, Homo sapiens
gaaggcagcug

SEQ ID NO: 725250 - RNA, 15 nt, Homo sapiens
gaaggccccagagag

SEQ ID NO: 725251 - RNA, 18 nt, Homo sapiens
gaaggcccugcugaguca

SEQ ID NO: 725252 - RNA, 18 nt, Homo sapiens
gaaggccgggcgcagugg

SEQ ID NO: 725253 - RNA, 14 nt, Homo sapiens
gaaggccuucagga

SEQ ID NO: 725254 - RNA, 16 nt, Homo sapiens
gaaggccuuucugcug

SEQ ID NO: 725255 - RNA, 22 nt, Homo sapiens
gaaggccuuucuucuguguuaa

SEQ ID NO: 725256 - RNA, 12 nt, Homo sapiens
gaaggcuaugua

SEQ ID NO: 725257 - RNA, 16 nt, Homo sapiens
gaaggcuucucuccac

SEQ ID NO: 725258 - RNA, 12 nt, Homo sapiens
gaaggcuuuagu

SEQ ID NO: 725259 - RNA, 22 nt, Homo sapiens
gaagggaauagaaauguuugcu

SEQ ID NO: 725260 - RNA, 19 nt, Homo sapiens
gaagggacacacaagaaga

SEQ ID NO: 725261 - RNA, 24 nt, Homo sapiens
gaagggaccaaggcaaggcaggug

SEQ ID NO: 725262 - RNA, 15 nt, Homo sapiens
gaagggauaucuacu

SEQ ID NO: 725263 - RNA, 12 nt, Homo sapiens
gaagggccagag

SEQ ID NO: 725264 - RNA, 17 nt, Homo sapiens
gaagggcguucuaggua

SEQ ID NO: 725265 - RNA, 9 nt, Homo sapiens
gaaggggag

SEQ ID NO: 725266 - RNA, 11 nt, Homo sapiens
gaaggggccac

SEQ ID NO: 725267 - RNA, 20 nt, Homo sapiens
gaagguaacuagaaagugag

SEQ ID NO: 725268 - RNA, 22 nt, Homo sapiens
gaagguauuccuuuuguguaca

SEQ ID NO: 725269 - RNA, 19 nt, Homo sapiens
gaaggugaaagugcaguuc

SEQ ID NO: 725270 - RNA, 13 nt, Homo sapiens
gaagguugcucua

SEQ ID NO: 725271 - RNA, 20 nt, Homo sapiens
gaagguuggugaauuucaca

SEQ ID NO: 725272 - RNA, 19 nt, Homo sapiens
gaagguuuguauauuguca

SEQ ID NO: 725273 - RNA, 22 nt, Homo sapiens
gaagguuuuuuugucgauuagu

SEQ ID NO: 725274 - RNA, 13 nt, Homo sapiens
gaaguaaacugau

SEQ ID NO: 725275 - RNA, 14 nt, Homo sapiens
gaaguaaacugcag

SEQ ID NO: 725276 - RNA, 22 nt, Homo sapiens
gaaguacugcacccagcagugu

SEQ ID NO: 725277 - RNA, 18 nt, Homo sapiens
gaaguagaauuuguccaa

SEQ ID NO: 725278 - RNA, 14 nt, Homo sapiens
gaaguaggcauaua

SEQ ID NO: 725279 - RNA, 19 nt, Homo sapiens
gaaguaguccagccuucca

SEQ ID NO: 725280 - RNA, 16 nt, Homo sapiens
gaagucacugcacagu

SEQ ID NO: 725281 - RNA, 19 nt, Homo sapiens
gaaguccccucuacuuuaa

SEQ ID NO: 725282 - RNA, 20 nt, Homo sapiens
gaagugaaugaaacacucag

SEQ ID NO: 725283 - RNA, 16 nt, Homo sapiens
gaagugagaaguucau

SEQ ID NO: 725284 - RNA, 14 nt, Homo sapiens
gaagugagcagugu

SEQ ID NO: 725285 - RNA, 22 nt, Homo sapiens
gaagugagggcucacucagcca

SEQ ID NO: 725286 - RNA, 17 nt, Homo sapiens
gaagugcagcagguuaa

SEQ ID NO: 725287 - RNA, 17 nt, Homo sapiens
gaaguggagauuuacac

SEQ ID NO: 725288 - RNA, 16 nt, Homo sapiens
gaagugguucuauguc

SEQ ID NO: 725289 - RNA, 20 nt, Homo sapiens
gaagugucccugugaucuug

SEQ ID NO: 725290 - RNA, 23 nt, Homo sapiens
gaagugugaggcggcccugacca

SEQ ID NO: 725291 - RNA, 14 nt, Homo sapiens
gaaguuaaagggca

SEQ ID NO: 725292 - RNA, 15 nt, Homo sapiens
gaaguuaagaaccug

SEQ ID NO: 725293 - RNA, 12 nt, Homo sapiens
gaaguuccucaa

SEQ ID NO: 725294 - RNA, 20 nt, Homo sapiens
gaaguugcuaagugugcuua

SEQ ID NO: 725295 - RNA, 19 nt, Homo sapiens
gaaguuucuggugccauuu

SEQ ID NO: 725296 - RNA, 15 nt, Homo sapiens
gaaguuuuucuuugu

SEQ ID NO: 725297 - RNA, 14 nt, Homo sapiens
gaauaaaauacucu

SEQ ID NO: 725298 - RNA, 16 nt, Homo sapiens
gaauaaaauacucucu

SEQ ID NO: 725299 - RNA, 19 nt, Homo sapiens
gaauaaaauugcacuuuua

SEQ ID NO: 725300 - RNA, 13 nt, Homo sapiens
gaauaaacucucc

SEQ ID NO: 725301 - RNA, 19 nt, Homo sapiens
gaauaaagccuuuguaucu

SEQ ID NO: 725302 - RNA, 18 nt, Homo sapiens
gaauaaaucaaauauucc

SEQ ID NO: 725303 - RNA, 21 nt, Homo sapiens
gaauaaggaggaggagggaga

SEQ ID NO: 725304 - RNA, 12 nt, Homo sapiens
gaauaaggccuu

SEQ ID NO: 725305 - RNA, 19 nt, Homo sapiens
gaauaaggcuuuuucuucc

SEQ ID NO: 725306 - RNA, 15 nt, Homo sapiens
gaauaaguucauaca

SEQ ID NO: 725307 - RNA, 14 nt, Homo sapiens
gaauaauaccuaag

SEQ ID NO: 725308 - RNA, 12 nt, Homo sapiens
gaauaaugaagg

SEQ ID NO: 725309 - RNA, 16 nt, Homo sapiens
gaauaaugaauggacu

SEQ ID NO: 725310 - RNA, 22 nt, Homo sapiens
gaauaaugcuaccaggaugcua

SEQ ID NO: 725311 - RNA, 17 nt, Homo sapiens
gaauacaacauugccaa

SEQ ID NO: 725312 - RNA, 23 nt, Homo sapiens
gaauaccaguguuauuaaugaca

SEQ ID NO: 725313 - RNA, 18 nt, Homo sapiens
gaauacugcuacagcaau

SEQ ID NO: 725314 - RNA, 16 nt, Homo sapiens
gaauagagguccucau

SEQ ID NO: 725315 - RNA, 15 nt, Homo sapiens
gaauagaugcugacu

SEQ ID NO: 725316 - RNA, 15 nt, Homo sapiens
gaauagcacagguga

SEQ ID NO: 725317 - RNA, 18 nt, Homo sapiens
gaauaguccauccccaga

SEQ ID NO: 725318 - RNA, 13 nt, Homo sapiens
gaauauaauuuca

SEQ ID NO: 725319 - RNA, 17 nt, Homo sapiens
gaauauauaugaugaaa

SEQ ID NO: 725320 - RNA, 22 nt, Homo sapiens
gaauauauuugugugugugaua

SEQ ID NO: 725321 - RNA, 19 nt, Homo sapiens
gaauaucgagaacugccau

SEQ ID NO: 725322 - RNA, 14 nt, Homo sapiens
gaauauuacucuca

SEQ ID NO: 725323 - RNA, 21 nt, Homo sapiens
gaauauugcuuuggucauaug

SEQ ID NO: 725324 - RNA, 18 nt, Homo sapiens
gaauauuuauuaccucug

SEQ ID NO: 725325 - RNA, 18 nt, Homo sapiens
gaaucaaaucucuuccac

SEQ ID NO: 725326 - RNA, 22 nt, Homo sapiens
gaaucaacaauaguaacucuuu

SEQ ID NO: 725327 - RNA, 19 nt, Homo sapiens
gaaucaagaagcugugaca

SEQ ID NO: 725328 - RNA, 16 nt, Homo sapiens
gaaucacagcccucau

SEQ ID NO: 725329 - RNA, 15 nt, Homo sapiens
gaaucacuugcacuc

SEQ ID NO: 725330 - RNA, 16 nt, Homo sapiens
gaaucacuugcacucc

SEQ ID NO: 725331 - RNA, 22 nt, Homo sapiens
gaaucagcauuuagucuugcca

SEQ ID NO: 725332 - RNA, 20 nt, Homo sapiens
gaaucagugaagaugccagu

SEQ ID NO: 725333 - RNA, 23 nt, Homo sapiens
gaaucagugaagaugccagugaa

SEQ ID NO: 725334 - RNA, 21 nt, Homo sapiens
gaaucagugaagccaaaggga

SEQ ID NO: 725335 - RNA, 22 nt, Homo sapiens
gaaucagugaagccaaagggac

SEQ ID NO: 725336 - RNA, 18 nt, Homo sapiens
gaaucauauucauaugca

SEQ ID NO: 725337 - RNA, 16 nt, Homo sapiens
gacacgaagccuuauu

SEQ ID NO: 725338 - RNA, 15 nt, Homo sapiens
gacacuacauaucua

SEQ ID NO: 725339 - RNA, 17 nt, Homo sapiens
gacacugaugaguuuca

SEQ ID NO: 725340 - RNA, 19 nt, Homo sapiens
gacacuggcguuacugcuu

SEQ ID NO: 725341 - RNA, 20 nt, Homo sapiens
gacacuggugguucuacuga

SEQ ID NO: 725342 - RNA, 20 nt, Homo sapiens
gacacuguggagacuuucug

SEQ ID NO: 725343 - RNA, 20 nt, Homo sapiens
gacacuuaguuauuuaccaa

SEQ ID NO: 725344 - RNA, 16 nt, Homo sapiens
gacacuucagaucuga

SEQ ID NO: 725345 - RNA, 17 nt, Homo sapiens
gacagaaaccaagccau

SEQ ID NO: 725346 - RNA, 14 nt, Homo sapiens
gacagaaagagaca

SEQ ID NO: 725347 - RNA, 19 nt, Homo sapiens
gacagaaggaacacugcuu

SEQ ID NO: 725348 - RNA, 23 nt, Homo sapiens
gacagaaggugccacuuuaccca

SEQ ID NO: 725349 - RNA, 14 nt, Homo sapiens
gacagaccuggaca

SEQ ID NO: 725350 - RNA, 17 nt, Homo sapiens
gacagagagaggcauuu

SEQ ID NO: 725351 - RNA, 14 nt, Homo sapiens
gacagagcuugaag

SEQ ID NO: 725352 - RNA, 22 nt, Homo sapiens
gacagaggacaauggcuuccau

SEQ ID NO: 725353 - RNA, 16 nt, Homo sapiens
gacagagggcacauga

SEQ ID NO: 725354 - RNA, 13 nt, Homo sapiens
gacagauauuuca

SEQ ID NO: 725355 - RNA, 22 nt, Homo sapiens
gacagauugccuguuucugauu

SEQ ID NO: 725356 - RNA, 14 nt, Homo sapiens
gacagcagccuccc

SEQ ID NO: 725357 - RNA, 16 nt, Homo sapiens
gacagcuuccuuuccu

SEQ ID NO: 725358 - RNA, 18 nt, Homo sapiens
gacagcuuguggcuuuuu

SEQ ID NO: 725359 - RNA, 14 nt, Homo sapiens
gacagcuuuucuca

SEQ ID NO: 725360 - RNA, 20 nt, Homo sapiens
gacaggaacccuugcaucca

SEQ ID NO: 725361 - RNA, 17 nt, Homo sapiens
gacaggccagaugaacu

SEQ ID NO: 725362 - RNA, 15 nt, Homo sapiens
gacaggcuggugcua

SEQ ID NO: 725363 - RNA, 21 nt, Homo sapiens
gacagguggcaacaaugcccc

SEQ ID NO: 725364 - RNA, 15 nt, Homo sapiens
gacaguauccacaau

SEQ ID NO: 725365 - RNA, 20 nt, Homo sapiens
gacagucauaaauacuguca

SEQ ID NO: 725366 - RNA, 17 nt, Homo sapiens
gacagucguucccagug

SEQ ID NO: 725367 - RNA, 16 nt, Homo sapiens
gacagucuguuaugca

SEQ ID NO: 725368 - RNA, 21 nt, Homo sapiens
gacaguuuguggcaucuugcc

SEQ ID NO: 725369 - RNA, 16 nt, Homo sapiens
gacaguuuuuauuuga

SEQ ID NO: 725370 - RNA, 21 nt, Homo sapiens
gacauacugcauguaagccaa

SEQ ID NO: 725371 - RNA, 15 nt, Homo sapiens
gacauacuuaaugca

SEQ ID NO: 725372 - RNA, 21 nt, Homo sapiens
gacauagccaacugcuguuca

SEQ ID NO: 725373 - RNA, 15 nt, Homo sapiens
gacauauacuaagau

SEQ ID NO: 725374 - RNA, 13 nt, Homo sapiens
gacauaugcauuu

SEQ ID NO: 725375 - RNA, 13 nt, Homo sapiens
gacaucaggaaac

SEQ ID NO: 725376 - RNA, 21 nt, Homo sapiens
gacaucgguguucuucuuccc

SEQ ID NO: 725377 - RNA, 19 nt, Homo sapiens
gacaugaaaggacccugug

SEQ ID NO: 725378 - RNA, 13 nt, Homo sapiens
gacaugcccugug

SEQ ID NO: 725379 - RNA, 17 nt, Homo sapiens
gacaugcuuuccauuuu

SEQ ID NO: 725380 - RNA, 17 nt, Homo sapiens
gacauggagaccaucua

SEQ ID NO: 725381 - RNA, 23 nt, Homo sapiens
gacauggagaccaucuaccccuu

SEQ ID NO: 725382 - RNA, 14 nt, Homo sapiens
gacauggagguucu

SEQ ID NO: 725383 - RNA, 20 nt, Homo sapiens
gacauuaaggaccaauagca

SEQ ID NO: 725384 - RNA, 13 nt, Homo sapiens
gacauuacuguau

SEQ ID NO: 725385 - RNA, 22 nt, Homo sapiens
gacauucaaggcauuucuauca

SEQ ID NO: 725386 - RNA, 17 nt, Homo sapiens
gacauucuuagcuguaa

SEQ ID NO: 725387 - RNA, 16 nt, Homo sapiens
gacauuggacuuccuc

SEQ ID NO: 725388 - RNA, 18 nt, Homo sapiens
gacauuguaugcagggag

SEQ ID NO: 725389 - RNA, 23 nt, Homo sapiens
gacauuucucuaacuccugccau

SEQ ID NO: 725390 - RNA, 21 nt, Homo sapiens
gacauuucuuccccaguguca

SEQ ID NO: 725391 - RNA, 19 nt, Homo sapiens
gacauuuugugacugaaga

SEQ ID NO: 725392 - RNA, 17 nt, Homo sapiens
gaccaaaaugacaauga

SEQ ID NO: 725393 - RNA, 13 nt, Homo sapiens
gaccaaagcaaga

SEQ ID NO: 725394 - RNA, 16 nt, Homo sapiens
gaccaaauaaaguacc

SEQ ID NO: 725395 - RNA, 17 nt, Homo sapiens
gaccaagcuuguccaac

SEQ ID NO: 725396 - RNA, 16 nt, Homo sapiens
gaccaauaaauuugua

SEQ ID NO: 725397 - RNA, 22 nt, Homo sapiens
gaccacagaaguggaauuugaa

SEQ ID NO: 725398 - RNA, 13 nt, Homo sapiens
gaccaccaccagg

SEQ ID NO: 725399 - RNA, 15 nt, Homo sapiens
gaccaccuaauauca

SEQ ID NO: 725400 - RNA, 21 nt, Homo sapiens
gaccaccuagucuguaacucu

SEQ ID NO: 725401 - RNA, 20 nt, Homo sapiens
gaccaccuccaggacucagu

SEQ ID NO: 725402 - RNA, 17 nt, Homo sapiens
gaccacugggcaaugau

SEQ ID NO: 725403 - RNA, 24 nt, Homo sapiens
gaccacugggcaaugauggcaauu

SEQ ID NO: 725404 - RNA, 17 nt, Homo sapiens
gaccacuguuaucaaaa

SEQ ID NO: 725405 - RNA, 14 nt, Homo sapiens
gaccagaaguggac

SEQ ID NO: 725406 - RNA, 13 nt, Homo sapiens
gaccagccagggc

SEQ ID NO: 725407 - RNA, 14 nt, Homo sapiens
gaccagccugggca

SEQ ID NO: 725408 - RNA, 18 nt, Homo sapiens
gaccaggaugacaccucc

SEQ ID NO: 725409 - RNA, 15 nt, Homo sapiens
gaccagucacucccu

SEQ ID NO: 725410 - RNA, 17 nt, Homo sapiens
gaccaguccuguuugca

SEQ ID NO: 725411 - RNA, 22 nt, Homo sapiens
gaccaguccuguuugcagggaa

SEQ ID NO: 725412 - RNA, 15 nt, Homo sapiens
gaccauaaagggugu

SEQ ID NO: 725413 - RNA, 13 nt, Homo sapiens
gaccaugccagac

SEQ ID NO: 725414 - RNA, 21 nt, Homo sapiens
gaccaugccagacccacugaa

SEQ ID NO: 725415 - RNA, 15 nt, Homo sapiens
gaccauggaggccag

SEQ ID NO: 725416 - RNA, 15 nt, Homo sapiens
gaccauucauaccca

SEQ ID NO: 725417 - RNA, 13 nt, Homo sapiens
gaccauucucacc

SEQ ID NO: 725418 - RNA, 16 nt, Homo sapiens
gacccaaaacacagga

SEQ ID NO: 725419 - RNA, 14 nt, Homo sapiens
gacccacagacugg

SEQ ID NO: 725420 - RNA, 20 nt, Homo sapiens
gacccacaugcuccagauua

SEQ ID NO: 725421 - RNA, 14 nt, Homo sapiens
gacccacccagugu

SEQ ID NO: 725422 - RNA, 19 nt, Homo sapiens
gacccacgaacgcucuuag

SEQ ID NO: 725423 - RNA, 13 nt, Homo sapiens
gacccagccugaa

SEQ ID NO: 725424 - RNA, 15 nt, Homo sapiens
gacccaggcccucca

SEQ ID NO: 725425 - RNA, 20 nt, Homo sapiens
gacccaucacgccugugcag

SEQ ID NO: 725426 - RNA, 14 nt, Homo sapiens
gaccccacuggaga

SEQ ID NO: 725427 - RNA, 21 nt, Homo sapiens
gaccccauuccugaucccaug

SEQ ID NO: 725428 - RNA, 14 nt, Homo sapiens
gacccccagcacuu

SEQ ID NO: 725429 - RNA, 19 nt, Homo sapiens
gacccccaucucuacaaaa

SEQ ID NO: 725430 - RNA, 18 nt, Homo sapiens
gaccccgagaagugcucu

SEQ ID NO: 725431 - RNA, 18 nt, Homo sapiens
gaccccgcacccggcucg

SEQ ID NO: 725432 - RNA, 17 nt, Homo sapiens
gacccggcggcccugcu

SEQ ID NO: 725433 - RNA, 18 nt, Homo sapiens
gacccuaaaucugaggaa

SEQ ID NO: 725434 - RNA, 15 nt, Homo sapiens
gacccuagcucuuuc

SEQ ID NO: 725435 - RNA, 23 nt, Homo sapiens
gacccucgggccccauccucauc

SEQ ID NO: 725436 - RNA, 17 nt, Homo sapiens
gacccuggucaccagag

SEQ ID NO: 725437 - RNA, 18 nt, Homo sapiens
gacccuucagggccagaa

SEQ ID NO: 725438 - RNA, 22 nt, Homo sapiens
gacccuucagguguuacuagaa

SEQ ID NO: 725439 - RNA, 15 nt, Homo sapiens
gacccuucccuugag

SEQ ID NO: 725440 - RNA, 18 nt, Homo sapiens
gacccuugauuuugcccc

SEQ ID NO: 725441 - RNA, 16 nt, Homo sapiens
gacccuugucaucucu

SEQ ID NO: 725442 - RNA, 22 nt, Homo sapiens
gaccgcaggccucagcaucucc

SEQ ID NO: 725443 - RNA, 18 nt, Homo sapiens
gaccgcccccuccucuag

SEQ ID NO: 725444 - RNA, 23 nt, Homo sapiens
gaccuaacauucgaucucauuca

SEQ ID NO: 725445 - RNA, 15 nt, Homo sapiens
gaccuagagacuuca

SEQ ID NO: 725446 - RNA, 16 nt, Homo sapiens
gaccuaguauaucagu

SEQ ID NO: 725447 - RNA, 18 nt, Homo sapiens
gaccuauuagaguauuuu

SEQ ID NO: 725448 - RNA, 23 nt, Homo sapiens
gaccuauuuccagaaauacaauu

SEQ ID NO: 725449 - RNA, 13 nt, Homo sapiens
caccauccagugg

SEQ ID NO: 725450 - RNA, 16 nt, Homo sapiens
caccauccuauugcaa

SEQ ID NO: 725451 - RNA, 15 nt, Homo sapiens
caccaugaaacuuua

SEQ ID NO: 725452 - RNA, 23 nt, Homo sapiens
caccaugcugaauguacacugau

SEQ ID NO: 725453 - RNA, 12 nt, Homo sapiens
caccaugcugcu

SEQ ID NO: 725454 - RNA, 23 nt, Homo sapiens
caccauggagaugaaaugccuuu

SEQ ID NO: 725455 - RNA, 15 nt, Homo sapiens
caccauguauuuugu

SEQ ID NO: 725456 - RNA, 17 nt, Homo sapiens
caccauguugcccagga

SEQ ID NO: 725457 - RNA, 13 nt, Homo sapiens
caccauguuggcc

SEQ ID NO: 725458 - RNA, 13 nt, Homo sapiens
caccauguuggcu

SEQ ID NO: 725459 - RNA, 19 nt, Homo sapiens
caccauucacauuugaugu

SEQ ID NO: 725460 - RNA, 10 nt, Homo sapiens
caccauuccc

SEQ ID NO: 725461 - RNA, 11 nt, Homo sapiens
caccauugcug

SEQ ID NO: 725462 - RNA, 18 nt, Homo sapiens
caccauuucugucacuca

SEQ ID NO: 725463 - RNA, 22 nt, Homo sapiens
cacccaaaagaauuaucauccc

SEQ ID NO: 725464 - RNA, 17 nt, Homo sapiens
cacccaaagcauggacu

SEQ ID NO: 725465 - RNA, 11 nt, Homo sapiens
cacccaaaugu

SEQ ID NO: 725466 - RNA, 11 nt, Homo sapiens
cacccacguga

SEQ ID NO: 725467 - RNA, 13 nt, Homo sapiens
cacccaggcacuu

SEQ ID NO: 725468 - RNA, 20 nt, Homo sapiens
cacccaggcuggaguacagu

SEQ ID NO: 725469 - RNA, 18 nt, Homo sapiens
cacccagguuggagugca

SEQ ID NO: 725470 - RNA, 13 nt, Homo sapiens
cacccaucaggac

SEQ ID NO: 725471 - RNA, 13 nt, Homo sapiens
cacccauccauga

SEQ ID NO: 725472 - RNA, 20 nt, Homo sapiens
cacccauggggagacaguug

SEQ ID NO: 725473 - RNA, 13 nt, Homo sapiens
caccccaacaucu

SEQ ID NO: 725474 - RNA, 15 nt, Homo sapiens
caccccaacucuccc

SEQ ID NO: 725475 - RNA, 21 nt, Homo sapiens
caccccaagagaacucgcgcu

SEQ ID NO: 725476 - RNA, 12 nt, Homo sapiens
caccccacugag

SEQ ID NO: 725477 - RNA, 16 nt, Homo sapiens
cacccccuuguuguaa

SEQ ID NO: 725478 - RNA, 17 nt, Homo sapiens
caccccuacacugugaa

SEQ ID NO: 725479 - RNA, 17 nt, Homo sapiens
caccccuccuuccuuga

SEQ ID NO: 725480 - RNA, 16 nt, Homo sapiens
caccccugcacaguug

SEQ ID NO: 725481 - RNA, 23 nt, Homo sapiens
caccccugugcuccgugccucca

SEQ ID NO: 725482 - RNA, 22 nt, Homo sapiens
cacccgaagcgcuucugcacca

SEQ ID NO: 725483 - RNA, 17 nt, Homo sapiens
cacccgacuccucaaaa

SEQ ID NO: 725484 - RNA, 15 nt, Homo sapiens
cacccgacuuuggaa

SEQ ID NO: 725485 - RNA, 18 nt, Homo sapiens
cacccgccgccucccacg

SEQ ID NO: 725486 - RNA, 15 nt, Homo sapiens
cacccgggaacuuuu

SEQ ID NO: 725487 - RNA, 12 nt, Homo sapiens
cacccuaccuuc

SEQ ID NO: 725488 - RNA, 24 nt, Homo sapiens
cacccugaguugcuuuucagcuga

SEQ ID NO: 725489 - RNA, 20 nt, Homo sapiens
cacccugcugcuggugcaca

SEQ ID NO: 725490 - RNA, 16 nt, Homo sapiens
cacccuggaggauuuc

SEQ ID NO: 725491 - RNA, 21 nt, Homo sapiens
cacccuggaggauuucaucuc

SEQ ID NO: 725492 - RNA, 15 nt, Homo sapiens
cacccuuucuugaca

SEQ ID NO: 725493 - RNA, 14 nt, Homo sapiens
caccgacuagccag

SEQ ID NO: 725494 - RNA, 17 nt, Homo sapiens
caccgaugcaaacauug

SEQ ID NO: 725495 - RNA, 18 nt, Homo sapiens
caccguacaucugcaaua

SEQ ID NO: 725496 - RNA, 19 nt, Homo sapiens
caccguccacguccacaag

SEQ ID NO: 725497 - RNA, 18 nt, Homo sapiens
caccuaauaggcugggag

SEQ ID NO: 725498 - RNA, 14 nt, Homo sapiens
caccuaauaucaau

SEQ ID NO: 725499 - RNA, 20 nt, Homo sapiens
caccuaauccaggcagaucc

SEQ ID NO: 725500 - RNA, 20 nt, Homo sapiens
cagcacccugaugucccugg

SEQ ID NO: 725501 - RNA, 18 nt, Homo sapiens
cagcaccuccuccaugca

SEQ ID NO: 725502 - RNA, 15 nt, Homo sapiens
cagcaccugcuccca

SEQ ID NO: 725503 - RNA, 19 nt, Homo sapiens
cagcaccuucccucucacc

SEQ ID NO: 725504 - RNA, 18 nt, Homo sapiens
cagcacgaguggccaguu

SEQ ID NO: 725505 - RNA, 21 nt, Homo sapiens
cagcacuaaagcaguggacac

SEQ ID NO: 725506 - RNA, 17 nt, Homo sapiens
cagcacucuuaucuaca

SEQ ID NO: 725507 - RNA, 20 nt, Homo sapiens
cagcacugaaaauaccauca

SEQ ID NO: 725508 - RNA, 20 nt, Homo sapiens
cagcacuggaaccaccugga

SEQ ID NO: 725509 - RNA, 13 nt, Homo sapiens
cagcacuggugaa

SEQ ID NO: 725510 - RNA, 20 nt, Homo sapiens
cagcacuguauuccugucau

SEQ ID NO: 725511 - RNA, 12 nt, Homo sapiens
cagcacuuccau

SEQ ID NO: 725512 - RNA, 12 nt, Homo sapiens
cagcacuuguau

SEQ ID NO: 725513 - RNA, 16 nt, Homo sapiens
cagcagaauggaggca

SEQ ID NO: 725514 - RNA, 17 nt, Homo sapiens
cagcagaucccagcuca

SEQ ID NO: 725515 - RNA, 21 nt, Homo sapiens
cagcagcaccuccuccaugca

SEQ ID NO: 725516 - RNA, 17 nt, Homo sapiens
cagcagcacuggaacca

SEQ ID NO: 725517 - RNA, 12 nt, Homo sapiens
cagcagcacugu

SEQ ID NO: 725518 - RNA, 21 nt, Homo sapiens
cagcagccccccuugccccac

SEQ ID NO: 725519 - RNA, 17 nt, Homo sapiens
cagcagccucccuguca

SEQ ID NO: 725520 - RNA, 12 nt, Homo sapiens
cagcagcucaua

SEQ ID NO: 725521 - RNA, 18 nt, Homo sapiens
cagcagcuggugccccac

SEQ ID NO: 725522 - RNA, 21 nt, Homo sapiens
cagcaggaaggaacaaagaca

SEQ ID NO: 725523 - RNA, 14 nt, Homo sapiens
cagcaggagcuuau

SEQ ID NO: 725524 - RNA, 14 nt, Homo sapiens
cagcagggcuguga

SEQ ID NO: 725525 - RNA, 23 nt, Homo sapiens
cagcagugaguaaucaauacaga

SEQ ID NO: 725526 - RNA, 14 nt, Homo sapiens
cagcagugaucuca

SEQ ID NO: 725527 - RNA, 21 nt, Homo sapiens
cagcaguugaaaagacuccaa

SEQ ID NO: 725528 - RNA, 24 nt, Homo sapiens
cagcauagggucacuuugccauua

SEQ ID NO: 725529 - RNA, 12 nt, Homo sapiens
cagcaucugcag

SEQ ID NO: 725530 - RNA, 15 nt, Homo sapiens
cagcaucugcuaaua

SEQ ID NO: 725531 - RNA, 18 nt, Homo sapiens
cagcaucuuuaacacagc

SEQ ID NO: 725532 - RNA, 15 nt, Homo sapiens
cagcaugaagaauuu

SEQ ID NO: 725533 - RNA, 12 nt, Homo sapiens
cagcaugaauaa

SEQ ID NO: 725534 - RNA, 21 nt, Homo sapiens
cagcaugaccugugaccagca

SEQ ID NO: 725535 - RNA, 22 nt, Homo sapiens
cagcaugaggacagaccacaga

SEQ ID NO: 725536 - RNA, 17 nt, Homo sapiens
cagcauucucacuccua

SEQ ID NO: 725537 - RNA, 11 nt, Homo sapiens
cagcauugcuu

SEQ ID NO: 725538 - RNA, 22 nt, Homo sapiens
cagcauuuagugaaguugugca

SEQ ID NO: 725539 - RNA, 16 nt, Homo sapiens
cagcauuugauuaaca

SEQ ID NO: 725540 - RNA, 12 nt, Homo sapiens
cagcauuugcuu

SEQ ID NO: 725541 - RNA, 20 nt, Homo sapiens
cagcauuuuacuacuuuaaa

SEQ ID NO: 725542 - RNA, 13 nt, Homo sapiens
cagccaaacugua

SEQ ID NO: 725543 - RNA, 18 nt, Homo sapiens
cagccaagacccaacagg

SEQ ID NO: 725544 - RNA, 18 nt, Homo sapiens
cagccacagguacagagc

SEQ ID NO: 725545 - RNA, 13 nt, Homo sapiens
cagccacauucua

SEQ ID NO: 725546 - RNA, 13 nt, Homo sapiens
cagccacccugag

SEQ ID NO: 725547 - RNA, 22 nt, Homo sapiens
cagccaccguuucuuccugcca

SEQ ID NO: 725548 - RNA, 15 nt, Homo sapiens
cagccaccuaguccc

SEQ ID NO: 725549 - RNA, 17 nt, Homo sapiens
cagccacggggacucag

SEQ ID NO: 725550 - RNA, 17 nt, Homo sapiens
cagccacuuucugccag

SEQ ID NO: 725551 - RNA, 14 nt, Homo sapiens
cagccagcacccac

SEQ ID NO: 725552 - RNA, 14 nt, Homo sapiens
cagccagccgugag

SEQ ID NO: 725553 - RNA, 21 nt, Homo sapiens
cagccaggcagguccacagag

SEQ ID NO: 725554 - RNA, 12 nt, Homo sapiens
cagccagucuca

SEQ ID NO: 725555 - RNA, 22 nt, Homo sapiens
cagccagucucagagaccagca

SEQ ID NO: 725556 - RNA, 23 nt, Homo sapiens
cagccagucucagagaccagcac

SEQ ID NO: 725557 - RNA, 15 nt, Homo sapiens
cagccaucaaauagu

SEQ ID NO: 725558 - RNA, 14 nt, Homo sapiens
cagccaugaaguca

SEQ ID NO: 725559 - RNA, 22 nt, Homo sapiens
cagccaugcaaugccaaauaau

SEQ ID NO: 725560 - RNA, 18 nt, Homo sapiens
cagccaugccucaugcca

SEQ ID NO: 725561 - RNA, 15 nt, Homo sapiens
cagcccaacagcacu

SEQ ID NO: 725562 - RNA, 18 nt, Homo sapiens
cagcccaaccuucacauc

SEQ ID NO: 725563 - RNA, 21 nt, Homo sapiens
cagcccaagaggacugagacu

SEQ ID NO: 725564 - RNA, 15 nt, Homo sapiens
cagcccacccugcug

SEQ ID NO: 725565 - RNA, 17 nt, Homo sapiens
cagcccagacccagugg

SEQ ID NO: 725566 - RNA, 13 nt, Homo sapiens
cagcccagagcca

SEQ ID NO: 725567 - RNA, 22 nt, Homo sapiens
cagcccagcccuccucugucaa

SEQ ID NO: 725568 - RNA, 15 nt, Homo sapiens
cagcccagugcaaac

SEQ ID NO: 725569 - RNA, 20 nt, Homo sapiens
gaauccaaagaucacauauu

SEQ ID NO: 725570 - RNA, 19 nt, Homo sapiens
gaauccagaucauuccuca

SEQ ID NO: 725571 - RNA, 18 nt, Homo sapiens
gaaucccagcagcagaga

SEQ ID NO: 725572 - RNA, 16 nt, Homo sapiens
gaauccccaacaugca

SEQ ID NO: 725573 - RNA, 13 nt, Homo sapiens
gaaucccuagucc

SEQ ID NO: 725574 - RNA, 19 nt, Homo sapiens
gaaucccuggcaaagggag

SEQ ID NO: 725575 - RNA, 17 nt, Homo sapiens
gaauccuccuccagggu

SEQ ID NO: 725576 - RNA, 16 nt, Homo sapiens
gaauccuggcagccca

SEQ ID NO: 725577 - RNA, 20 nt, Homo sapiens
gaauccuuggggagcacuug

SEQ ID NO: 725578 - RNA, 16 nt, Homo sapiens
gaaucgauauaggcau

SEQ ID NO: 725579 - RNA, 14 nt, Homo sapiens
gaaucuaaaccuua

SEQ ID NO: 725580 - RNA, 19 nt, Homo sapiens
gaaucuacaaaaaacaaca

SEQ ID NO: 725581 - RNA, 16 nt, Homo sapiens
gaaucuagaaaaucag

SEQ ID NO: 725582 - RNA, 19 nt, Homo sapiens
gaaucucugagccaaccuu

SEQ ID NO: 725583 - RNA, 17 nt, Homo sapiens
gaaucucuucacuaccc

SEQ ID NO: 725584 - RNA, 17 nt, Homo sapiens
gaaucugcuguugccau

SEQ ID NO: 725585 - RNA, 14 nt, Homo sapiens
gaaucuggagacca

SEQ ID NO: 725586 - RNA, 11 nt, Homo sapiens
gaaucuucucu

SEQ ID NO: 725587 - RNA, 17 nt, Homo sapiens
gaaucuuuguaccaaaa

SEQ ID NO: 725588 - RNA, 15 nt, Homo sapiens
gaaugaaacaagcag

SEQ ID NO: 725589 - RNA, 16 nt, Homo sapiens
gaaugaacaaagucca

SEQ ID NO: 725590 - RNA, 13 nt, Homo sapiens
gaaugaacacucc

SEQ ID NO: 725591 - RNA, 16 nt, Homo sapiens
gaaugaagcguugcca

SEQ ID NO: 725592 - RNA, 17 nt, Homo sapiens
gaaugaagcguugccau

SEQ ID NO: 725593 - RNA, 20 nt, Homo sapiens
gaaugagacugaacugugug

SEQ ID NO: 725594 - RNA, 18 nt, Homo sapiens
gaaugaggucccaggcag

SEQ ID NO: 725595 - RNA, 16 nt, Homo sapiens
gaaugaugguuuccaa

SEQ ID NO: 725596 - RNA, 18 nt, Homo sapiens
gaaugcaacuccauuuac

SEQ ID NO: 725597 - RNA, 12 nt, Homo sapiens
gaaugcagggaa

SEQ ID NO: 725598 - RNA, 13 nt, Homo sapiens
gaaugcagggaag

SEQ ID NO: 725599 - RNA, 13 nt, Homo sapiens
gaaugcagugaca

SEQ ID NO: 725600 - RNA, 21 nt, Homo sapiens
gaaugcauuauuuauugcugu

SEQ ID NO: 725601 - RNA, 15 nt, Homo sapiens
gaaugccacugccuu

SEQ ID NO: 725602 - RNA, 20 nt, Homo sapiens
gaaugccgguuaaauuccau

SEQ ID NO: 725603 - RNA, 19 nt, Homo sapiens
gaaugcuccucucuuugug

SEQ ID NO: 725604 - RNA, 12 nt, Homo sapiens
gaaugcugccag

SEQ ID NO: 725605 - RNA, 14 nt, Homo sapiens
gaaugcuuugccau

SEQ ID NO: 725606 - RNA, 16 nt, Homo sapiens
gaauggaaaacacaug

SEQ ID NO: 725607 - RNA, 16 nt, Homo sapiens
gaauggacauuucuaa

SEQ ID NO: 725608 - RNA, 19 nt, Homo sapiens
gaauggggggcgggccagg

SEQ ID NO: 725609 - RNA, 20 nt, Homo sapiens
gaauggucuggcaauauucu

SEQ ID NO: 725610 - RNA, 11 nt, Homo sapiens
gaaugguggag

SEQ ID NO: 725611 - RNA, 19 nt, Homo sapiens
gaauguaaaacagagccau

SEQ ID NO: 725612 - RNA, 18 nt, Homo sapiens
gaauguagcaucugagaa

SEQ ID NO: 725613 - RNA, 20 nt, Homo sapiens
gaauguauugaacuuggaaa

SEQ ID NO: 725614 - RNA, 19 nt, Homo sapiens
gaauguccucuuggagaaa

SEQ ID NO: 725615 - RNA, 15 nt, Homo sapiens
gaaugugauauuuga

SEQ ID NO: 725616 - RNA, 17 nt, Homo sapiens
gaaugugauauuugaag

SEQ ID NO: 725617 - RNA, 17 nt, Homo sapiens
gaaugugguuacuuccu

SEQ ID NO: 725618 - RNA, 21 nt, Homo sapiens
gaaugugucugcguuccuguu

SEQ ID NO: 725619 - RNA, 23 nt, Homo sapiens
gaauguguggccugcacagugaa

SEQ ID NO: 725620 - RNA, 13 nt, Homo sapiens
gaauguuacagua

SEQ ID NO: 725621 - RNA, 21 nt, Homo sapiens
gaauuaacaauaaaaguguga

SEQ ID NO: 725622 - RNA, 13 nt, Homo sapiens
gaauuaagcagaa

SEQ ID NO: 725623 - RNA, 12 nt, Homo sapiens
gaauuacuugug

SEQ ID NO: 725624 - RNA, 17 nt, Homo sapiens
gaauuagagaagcugaa

SEQ ID NO: 725625 - RNA, 16 nt, Homo sapiens
gaauuauaacuguaaa

SEQ ID NO: 725626 - RNA, 23 nt, Homo sapiens
gaauuaucccccaaaaugcauuu

SEQ ID NO: 725627 - RNA, 12 nt, Homo sapiens
gaauucaaacaa

SEQ ID NO: 725628 - RNA, 16 nt, Homo sapiens
gaauucaaacuggggc

SEQ ID NO: 725629 - RNA, 17 nt, Homo sapiens
gaauucagugccuucaa

SEQ ID NO: 725630 - RNA, 14 nt, Homo sapiens
gaauucauguuggu

SEQ ID NO: 725631 - RNA, 17 nt, Homo sapiens
gaauuccaucuuguaaa

SEQ ID NO: 725632 - RNA, 15 nt, Homo sapiens
gaauucccuugaauu

SEQ ID NO: 725633 - RNA, 21 nt, Homo sapiens
gaauucuaaauaaauuuccca

SEQ ID NO: 725634 - RNA, 11 nt, Homo sapiens
gaauucuuccg

SEQ ID NO: 725635 - RNA, 16 nt, Homo sapiens
gaauugcaguucagaa

SEQ ID NO: 725636 - RNA, 13 nt, Homo sapiens
gaauuguuuagaa

SEQ ID NO: 725637 - RNA, 23 nt, Homo sapiens
gaauuguuuccuuauuugcacuu

SEQ ID NO: 725638 - RNA, 21 nt, Homo sapiens
gaauuguuuggcaaugcacug

SEQ ID NO: 725639 - RNA, 14 nt, Homo sapiens
gaauuuagaccuuu

SEQ ID NO: 725640 - RNA, 22 nt, Homo sapiens
gaauuuaguauuaucaaaggga

SEQ ID NO: 725641 - RNA, 17 nt, Homo sapiens
gaauuuauucaauuccu

SEQ ID NO: 725642 - RNA, 14 nt, Homo sapiens
gaauuucacaagcu

SEQ ID NO: 725643 - RNA, 19 nt, Homo sapiens
gaauuucacaagcuauuuu

SEQ ID NO: 725644 - RNA, 13 nt, Homo sapiens
gaauuucaucuca

SEQ ID NO: 725645 - RNA, 16 nt, Homo sapiens
gaauuucuucagucca

SEQ ID NO: 725646 - RNA, 13 nt, Homo sapiens
gaauuugaggcag

SEQ ID NO: 725647 - RNA, 14 nt, Homo sapiens
gaauuuuguauauu

SEQ ID NO: 725648 - RNA, 20 nt, Homo sapiens
gaauuuuugcuaugcuguaa

SEQ ID NO: 725649 - RNA, 17 nt, Homo sapiens
gacaaacagaccauaaa

SEQ ID NO: 725650 - RNA, 17 nt, Homo sapiens
gacaaagaaacccaagu

SEQ ID NO: 725651 - RNA, 18 nt, Homo sapiens
gacaaagacaaauucugu

SEQ ID NO: 725652 - RNA, 20 nt, Homo sapiens
gacaaaggaaucaauuacuu

SEQ ID NO: 725653 - RNA, 19 nt, Homo sapiens
gacaaaggugguaaauuca

SEQ ID NO: 725654 - RNA, 15 nt, Homo sapiens
gacaaagugccucau

SEQ ID NO: 725655 - RNA, 23 nt, Homo sapiens
gacaaaguguguaauuauguaaa

SEQ ID NO: 725656 - RNA, 16 nt, Homo sapiens
gacaaauaauaagcaa

SEQ ID NO: 725657 - RNA, 13 nt, Homo sapiens
gacaaauucuguu

SEQ ID NO: 725658 - RNA, 16 nt, Homo sapiens
gacaacagcauaacua

SEQ ID NO: 725659 - RNA, 18 nt, Homo sapiens
gacaacaguucugagcug

SEQ ID NO: 725660 - RNA, 13 nt, Homo sapiens
gacaacaucgcaa

SEQ ID NO: 725661 - RNA, 15 nt, Homo sapiens
gacaaccucauuuua

SEQ ID NO: 725662 - RNA, 23 nt, Homo sapiens
gacaaccugaaauuuauucacau

SEQ ID NO: 725663 - RNA, 14 nt, Homo sapiens
gacaagaacaaagc

SEQ ID NO: 725664 - RNA, 13 nt, Homo sapiens
gacaagauuuaug

SEQ ID NO: 725665 - RNA, 23 nt, Homo sapiens
gacaagcagucccuuaauauuga

SEQ ID NO: 725666 - RNA, 16 nt, Homo sapiens
gacaagccuaacuuca

SEQ ID NO: 725667 - RNA, 13 nt, Homo sapiens
gacaaggugcuaa

SEQ ID NO: 725668 - RNA, 15 nt, Homo sapiens
gacaaguauggcucc

SEQ ID NO: 725669 - RNA, 14 nt, Homo sapiens
gacaauaugcccuu

SEQ ID NO: 725670 - RNA, 19 nt, Homo sapiens
gacaaucaugaaauaugca

SEQ ID NO: 725671 - RNA, 20 nt, Homo sapiens
gacaaucaugaaauaugcau

SEQ ID NO: 725672 - RNA, 19 nt, Homo sapiens
gacaauuaucugugucaaa

SEQ ID NO: 725673 - RNA, 18 nt, Homo sapiens
gacaauucauucauuugc

SEQ ID NO: 725674 - RNA, 19 nt, Homo sapiens
gacaauucauucauuugca

SEQ ID NO: 725675 - RNA, 21 nt, Homo sapiens
gacaauuccuagauaaaaaga

SEQ ID NO: 725676 - RNA, 18 nt, Homo sapiens
gacacagaucaagggccu

SEQ ID NO: 725677 - RNA, 20 nt, Homo sapiens
gacacagcccgaggaaucaa

SEQ ID NO: 725678 - RNA, 18 nt, Homo sapiens
gacacagcucuucauucc

SEQ ID NO: 725679 - RNA, 17 nt, Homo sapiens
gacacauacaugucaca

SEQ ID NO: 725680 - RNA, 20 nt, Homo sapiens
gacacaugaagguaaauaaa

SEQ ID NO: 725681 - RNA, 18 nt, Homo sapiens
gacacaugggcuugugac

SEQ ID NO: 725682 - RNA, 18 nt, Homo sapiens
gacaccacaaggcagccu

SEQ ID NO: 725683 - RNA, 16 nt, Homo sapiens
gacaccauuaccaaaa

SEQ ID NO: 725684 - RNA, 20 nt, Homo sapiens
gacaccuguacauucuucca

SEQ ID NO: 725685 - RNA, 15 nt, Homo sapiens
gaaagagcauaauga

SEQ ID NO: 725686 - RNA, 14 nt, Homo sapiens
gaaagaugcagugg

SEQ ID NO: 725687 - RNA, 15 nt, Homo sapiens
gaaagauuugugaac

SEQ ID NO: 725688 - RNA, 19 nt, Homo sapiens
gaaagcaaaagcaagggac

SEQ ID NO: 725689 - RNA, 18 nt, Homo sapiens
gaaagcaaguguucacaa

SEQ ID NO: 725690 - RNA, 21 nt, Homo sapiens
gaaagcaaguguucacaacag

SEQ ID NO: 725691 - RNA, 11 nt, Homo sapiens
gaaagcacuau

SEQ ID NO: 725692 - RNA, 18 nt, Homo sapiens
gaaagcaucaccucaggc

SEQ ID NO: 725693 - RNA, 14 nt, Homo sapiens
gaaagcuggacuga

SEQ ID NO: 725694 - RNA, 14 nt, Homo sapiens
gaaaggaaagaaga

SEQ ID NO: 725695 - RNA, 21 nt, Homo sapiens
gaaaggaaauaguaccuucaa

SEQ ID NO: 725696 - RNA, 14 nt, Homo sapiens
gaaaggaacauuuu

SEQ ID NO: 725697 - RNA, 13 nt, Homo sapiens
gaaaggaccaaau

SEQ ID NO: 725698 - RNA, 20 nt, Homo sapiens
gaaaggaccaaauugcuuua

SEQ ID NO: 725699 - RNA, 21 nt, Homo sapiens
gaaaggaccaguaugcuugga

SEQ ID NO: 725700 - RNA, 16 nt, Homo sapiens
gaaaggaucugugauu

SEQ ID NO: 725701 - RNA, 18 nt, Homo sapiens
gaaagggaaacugggaaa

SEQ ID NO: 725702 - RNA, 18 nt, Homo sapiens
gaaagggauaguccaaag

SEQ ID NO: 725703 - RNA, 16 nt, Homo sapiens
gaaagggcuggcugca

SEQ ID NO: 725704 - RNA, 23 nt, Homo sapiens
gaaaggggccccaccggggucua

SEQ ID NO: 725705 - RNA, 19 nt, Homo sapiens
gaaagggguccgauguuug

SEQ ID NO: 725706 - RNA, 16 nt, Homo sapiens
gaaaguaacugugaga

SEQ ID NO: 725707 - RNA, 17 nt, Homo sapiens
gaaaguauaaagucacu

SEQ ID NO: 725708 - RNA, 17 nt, Homo sapiens
gaaaguauucuguacuc

SEQ ID NO: 725709 - RNA, 22 nt, Homo sapiens
gaaagucacggcugcgcacugu

SEQ ID NO: 725710 - RNA, 23 nt, Homo sapiens
gaaaguggccaugccacccuguu

SEQ ID NO: 725711 - RNA, 20 nt, Homo sapiens
gaaagugugagcucuucccu

SEQ ID NO: 725712 - RNA, 19 nt, Homo sapiens
gaaaguucaacuuccaaag

SEQ ID NO: 725713 - RNA, 13 nt, Homo sapiens
gaaaguucugcug

SEQ ID NO: 725714 - RNA, 12 nt, Homo sapiens
gaaaguucuuaa

SEQ ID NO: 725715 - RNA, 22 nt, Homo sapiens
gaaauaaagcguccucucagua

SEQ ID NO: 725716 - RNA, 18 nt, Homo sapiens
gaaauaaauuuuguuuca

SEQ ID NO: 725717 - RNA, 16 nt, Homo sapiens
gaaauaacacugugaa

SEQ ID NO: 725718 - RNA, 12 nt, Homo sapiens
gaaauaagcaug

SEQ ID NO: 725719 - RNA, 15 nt, Homo sapiens
gaaauaagcugugau

SEQ ID NO: 725720 - RNA, 14 nt, Homo sapiens
gaaauaauacuuca

SEQ ID NO: 725721 - RNA, 21 nt, Homo sapiens
gaaauaauugaagagagaaau

SEQ ID NO: 725722 - RNA, 13 nt, Homo sapiens
gaaauacuuaaca

SEQ ID NO: 725723 - RNA, 16 nt, Homo sapiens
gaaauaguaccuucaa

SEQ ID NO: 725724 - RNA, 20 nt, Homo sapiens
gaaauauaacaaguggguga

SEQ ID NO: 725725 - RNA, 21 nt, Homo sapiens
gaaauauaacaagugggugaa

SEQ ID NO: 725726 - RNA, 17 nt, Homo sapiens
gaaauauauaauauuca

SEQ ID NO: 725727 - RNA, 15 nt, Homo sapiens
gaaauaucaaagugu

SEQ ID NO: 725728 - RNA, 14 nt, Homo sapiens
gaaauauugacuca

SEQ ID NO: 725729 - RNA, 21 nt, Homo sapiens
gaaauauugacucaaaccaua

SEQ ID NO: 725730 - RNA, 17 nt, Homo sapiens
gaaaucacgcagaccca

SEQ ID NO: 725731 - RNA, 23 nt, Homo sapiens
gaaaucauuuuacccuuggcuca

SEQ ID NO: 725732 - RNA, 15 nt, Homo sapiens
gaaaucccugagaca

SEQ ID NO: 725733 - RNA, 18 nt, Homo sapiens
gaaaucuagaagacuguc

SEQ ID NO: 725734 - RNA, 15 nt, Homo sapiens
gaaaucucacugggg

SEQ ID NO: 725735 - RNA, 12 nt, Homo sapiens
gaaaucugccaa

SEQ ID NO: 725736 - RNA, 12 nt, Homo sapiens
gaaaucuugcaa

SEQ ID NO: 725737 - RNA, 16 nt, Homo sapiens
gaaaucuuuaugugau

SEQ ID NO: 725738 - RNA, 14 nt, Homo sapiens
gaaaugaaagggaa

SEQ ID NO: 725739 - RNA, 23 nt, Homo sapiens
gaaaugaaagggaaacugggaaa

SEQ ID NO: 725740 - RNA, 21 nt, Homo sapiens
gaaaugacuuugaaaaccugg

SEQ ID NO: 725741 - RNA, 12 nt, Homo sapiens
gaaaugcaaaau

SEQ ID NO: 725742 - RNA, 16 nt, Homo sapiens
gaaaugcucuuuugca

SEQ ID NO: 725743 - RNA, 19 nt, Homo sapiens
gaaaugcucuuuugcacaa

SEQ ID NO: 725744 - RNA, 17 nt, Homo sapiens
gaaauguaccuucuuuc

SEQ ID NO: 725745 - RNA, 15 nt, Homo sapiens
gaaauguauccugau

SEQ ID NO: 725746 - RNA, 15 nt, Homo sapiens
gaaauguuugcugaa

SEQ ID NO: 725747 - RNA, 11 nt, Homo sapiens
gaaauuaacac

SEQ ID NO: 725748 - RNA, 13 nt, Homo sapiens
gaaauuauacuua

SEQ ID NO: 725749 - RNA, 18 nt, Homo sapiens
gaaauucagguacagaaa

SEQ ID NO: 725750 - RNA, 16 nt, Homo sapiens
gaaauuccuguacugu

SEQ ID NO: 725751 - RNA, 18 nt, Homo sapiens
gaaauugcauacuuugua

SEQ ID NO: 725752 - RNA, 16 nt, Homo sapiens
gaaauuguacuuccag

SEQ ID NO: 725753 - RNA, 20 nt, Homo sapiens
gaaauuuaauucauguuucu

SEQ ID NO: 725754 - RNA, 17 nt, Homo sapiens
gaaauuuggcuauaauc

SEQ ID NO: 725755 - RNA, 22 nt, Homo sapiens
gaacaaacuaugaucacaguga

SEQ ID NO: 725756 - RNA, 19 nt, Homo sapiens
gaacaaauuauaaaaacca

SEQ ID NO: 725757 - RNA, 23 nt, Homo sapiens
gaacaaauuauaaaaaccaugga

SEQ ID NO: 725758 - RNA, 14 nt, Homo sapiens
gaacaaugacaaac

SEQ ID NO: 725759 - RNA, 21 nt, Homo sapiens
gaacaaugggaggcugugauu

SEQ ID NO: 725760 - RNA, 12 nt, Homo sapiens
gaacaauuccuu

SEQ ID NO: 725761 - RNA, 15 nt, Homo sapiens
gaacacacagacuuu

SEQ ID NO: 725762 - RNA, 19 nt, Homo sapiens
gaacacagaacugaucuca

SEQ ID NO: 725763 - RNA, 18 nt, Homo sapiens
gaacaccagcagcacugg

SEQ ID NO: 725764 - RNA, 19 nt, Homo sapiens
gaacacccuggaugcuguu

SEQ ID NO: 725765 - RNA, 17 nt, Homo sapiens
gaacacccuugguggcu

SEQ ID NO: 725766 - RNA, 18 nt, Homo sapiens
gaacacgagacagcuugg

SEQ ID NO: 725767 - RNA, 21 nt, Homo sapiens
gaacacuggccugggucuccc

SEQ ID NO: 725768 - RNA, 12 nt, Homo sapiens
gaacacuggggg

SEQ ID NO: 725769 - RNA, 16 nt, Homo sapiens
gaacacugugaccagg

SEQ ID NO: 725770 - RNA, 23 nt, Homo sapiens
gaacacuucgaguucccaggguu

SEQ ID NO: 725771 - RNA, 17 nt, Homo sapiens
gaacagaaggaugaaug

SEQ ID NO: 725772 - RNA, 23 nt, Homo sapiens
gaacagaauguuuuacugugaaa

SEQ ID NO: 725773 - RNA, 16 nt, Homo sapiens
gaacagacaacagaag

SEQ ID NO: 725774 - RNA, 21 nt, Homo sapiens
gaacagacaacagaagucaug

SEQ ID NO: 725775 - RNA, 18 nt, Homo sapiens
gaacagagugcaacccag

SEQ ID NO: 725776 - RNA, 22 nt, Homo sapiens
gaacagauaaucagugugucua

SEQ ID NO: 725777 - RNA, 21 nt, Homo sapiens
gaacagcauuacccuccucuc

SEQ ID NO: 725778 - RNA, 12 nt, Homo sapiens
gaacagcauuua

SEQ ID NO: 725779 - RNA, 14 nt, Homo sapiens
gaacagccacaaaa

SEQ ID NO: 725780 - RNA, 13 nt, Homo sapiens
gaacaggccucuc

SEQ ID NO: 725781 - RNA, 14 nt, Homo sapiens
gaacaggugguggu

SEQ ID NO: 725782 - RNA, 12 nt, Homo sapiens
gaacaguauuac

SEQ ID NO: 725783 - RNA, 16 nt, Homo sapiens
gaacaguauuacagug

SEQ ID NO: 725784 - RNA, 13 nt, Homo sapiens
gaacaguguuucc

SEQ ID NO: 725785 - RNA, 19 nt, Homo sapiens
gaacauaaguaaucacuaa

SEQ ID NO: 725786 - RNA, 15 nt, Homo sapiens
gaacauacacuguga

SEQ ID NO: 725787 - RNA, 16 nt, Homo sapiens
gaacauacacugugaa

SEQ ID NO: 725788 - RNA, 20 nt, Homo sapiens
gaacauacacugugaacuca

SEQ ID NO: 725789 - RNA, 16 nt, Homo sapiens
gaacauagaacucugg

SEQ ID NO: 725790 - RNA, 17 nt, Homo sapiens
gaacaucauaacccaug

SEQ ID NO: 725791 - RNA, 19 nt, Homo sapiens
gaacaucauaacccaugaa

SEQ ID NO: 725792 - RNA, 15 nt, Homo sapiens
gaacaucccuacccu

SEQ ID NO: 725793 - RNA, 15 nt, Homo sapiens
gaacauggacuuucu

SEQ ID NO: 725794 - RNA, 23 nt, Homo sapiens
gaacauggacuuucuugcaugaa

SEQ ID NO: 725795 - RNA, 15 nt, Homo sapiens
uguuaaaauguacac

SEQ ID NO: 725796 - RNA, 16 nt, Homo sapiens
uguuaaacaugcuaaa

SEQ ID NO: 725797 - RNA, 18 nt, Homo sapiens
uguuaaagauuucaaaua

SEQ ID NO: 725798 - RNA, 12 nt, Homo sapiens
uguuaacacuca

SEQ ID NO: 725799 - RNA, 21 nt, Homo sapiens
uguuaaccaaauuuugagcaa

SEQ ID NO: 725800 - RNA, 14 nt, Homo sapiens
uguuaauaucuuga

SEQ ID NO: 725801 - RNA, 13 nt, Homo sapiens
uguuaaugcauca

SEQ ID NO: 725802 - RNA, 22 nt, Homo sapiens
uguuacccauucaaccauuuua

SEQ ID NO: 725803 - RNA, 16 nt, Homo sapiens
uguuacucaguguuag

SEQ ID NO: 725804 - RNA, 20 nt, Homo sapiens
uguuacuccauuacugugau

SEQ ID NO: 725805 - RNA, 22 nt, Homo sapiens
uguuacugguagaaaggcaguu

SEQ ID NO: 725806 - RNA, 19 nt, Homo sapiens
uguuacuuuggcaauuucc

SEQ ID NO: 725807 - RNA, 15 nt, Homo sapiens
uguuagaaucaaaua

SEQ ID NO: 725808 - RNA, 18 nt, Homo sapiens
uguuagcagacccagcuu

SEQ ID NO: 725809 - RNA, 16 nt, Homo sapiens
uguuagcccaagguua

SEQ ID NO: 725810 - RNA, 19 nt, Homo sapiens
uucauguuaguuaccuuau

SEQ ID NO: 725811 - RNA, 12 nt, Homo sapiens
uucauguucacu

SEQ ID NO: 725812 - RNA, 16 nt, Homo sapiens
uucauguucacuguga

SEQ ID NO: 725813 - RNA, 15 nt, Homo sapiens
uucauguuugcuuca

SEQ ID NO: 725814 - RNA, 14 nt, Homo sapiens
uucauuaaugauga

SEQ ID NO: 725815 - RNA, 21 nt, Homo sapiens
uucauuagugagccaugaaau

SEQ ID NO: 725816 - RNA, 14 nt, Homo sapiens
uucauuauguauga

SEQ ID NO: 725817 - RNA, 12 nt, Homo sapiens
uucauucaaaag

SEQ ID NO: 725818 - RNA, 18 nt, Homo sapiens
uucauucaguacaagaga

SEQ ID NO: 725819 - RNA, 21 nt, Homo sapiens
uucauuccuaacacagcaugu

SEQ ID NO: 725820 - RNA, 23 nt, Homo sapiens
cccuaaaauauuacaaaauaagu

SEQ ID NO: 725821 - RNA, 15 nt, Homo sapiens
cccuaaacucaggag

SEQ ID NO: 725822 - RNA, 13 nt, Homo sapiens
cccuaagugccca

SEQ ID NO: 725823 - RNA, 20 nt, Homo sapiens
cccuaaucuuucacuugaaa

SEQ ID NO: 725824 - RNA, 13 nt, Homo sapiens
cccuacaaaggcu

SEQ ID NO: 725825 - RNA, 15 nt, Homo sapiens
cccuacacugugaag

SEQ ID NO: 725826 - RNA, 18 nt, Homo sapiens
cccuaccagcgcccgcug

SEQ ID NO: 725827 - RNA, 14 nt, Homo sapiens
cccuacccacuucc

SEQ ID NO: 725828 - RNA, 22 nt, Homo sapiens
cccuacucccugcagaugccac

SEQ ID NO: 725829 - RNA, 15 nt, Homo sapiens
cccuacugcugugaa

SEQ ID NO: 725830 - RNA, 16 nt, Homo sapiens
cccuagccaaugucuc

SEQ ID NO: 725831 - RNA, 19 nt, Homo sapiens
cccuagccuugcuuguuaa

SEQ ID NO: 725832 - RNA, 20 nt, Homo sapiens
cccuaggaaacucacacucc

SEQ ID NO: 725833 - RNA, 22 nt, Homo sapiens
cccuaggaaggugaaucugccc

SEQ ID NO: 725834 - RNA, 14 nt, Homo sapiens
cccuaggagaccaa

SEQ ID NO: 725835 - RNA, 17 nt, Homo sapiens
cccuaguugaguagcca

SEQ ID NO: 725836 - RNA, 19 nt, Homo sapiens
cccucaaagaagucggaau

SEQ ID NO: 725837 - RNA, 16 nt, Homo sapiens
cccucaacugaagggg

SEQ ID NO: 725838 - RNA, 22 nt, Homo sapiens
cccucacagagacccaccuuca

SEQ ID NO: 725839 - RNA, 22 nt, Homo sapiens
cccucacuccugccaguugaaa

SEQ ID NO: 725840 - RNA, 15 nt, Homo sapiens
cccucacuguugaau

SEQ ID NO: 725841 - RNA, 12 nt, Homo sapiens
cccucagcacug

SEQ ID NO: 725842 - RNA, 20 nt, Homo sapiens
cccucaggagccucugcucc

SEQ ID NO: 725843 - RNA, 13 nt, Homo sapiens
cccucaucauagc

SEQ ID NO: 725844 - RNA, 14 nt, Homo sapiens
cccucaugaucauu

SEQ ID NO: 725845 - RNA, 18 nt, Homo sapiens
cccucauucuacugaaaa

SEQ ID NO: 725846 - RNA, 16 nt, Homo sapiens
cccuccaaaccuccag

SEQ ID NO: 725847 - RNA, 12 nt, Homo sapiens
cccuccaaagag

SEQ ID NO: 725848 - RNA, 21 nt, Homo sapiens
cccuccaaaggucugaugucu

SEQ ID NO: 725849 - RNA, 13 nt, Homo sapiens
cccuccaauccca

SEQ ID NO: 725850 - RNA, 15 nt, Homo sapiens
cccuccaccuuccau

SEQ ID NO: 725851 - RNA, 15 nt, Homo sapiens
cccuccacuccaucc

SEQ ID NO: 725852 - RNA, 13 nt, Homo sapiens
cccucccaacagc

SEQ ID NO: 725853 - RNA, 18 nt, Homo sapiens
cccucccaaggagccauu

SEQ ID NO: 725854 - RNA, 14 nt, Homo sapiens
cccucccacaccca

SEQ ID NO: 725855 - RNA, 15 nt, Homo sapiens
cccucccacggugcc

SEQ ID NO: 725856 - RNA, 20 nt, Homo sapiens
cccuccccauucagacacuu

SEQ ID NO: 725857 - RNA, 20 nt, Homo sapiens
cccuccuuucauuugcuaga

SEQ ID NO: 725858 - RNA, 16 nt, Homo sapiens
cccucgaggaaggggg

SEQ ID NO: 725859 - RNA, 12 nt, Homo sapiens
cccucggagcca

SEQ ID NO: 725860 - RNA, 13 nt, Homo sapiens
cccucuauuuauu

SEQ ID NO: 725861 - RNA, 23 nt, Homo sapiens
cccucuccuguagccacuggcau

SEQ ID NO: 725862 - RNA, 22 nt, Homo sapiens
cccucugugcuucgacuacugc

SEQ ID NO: 725863 - RNA, 20 nt, Homo sapiens
cccucuucuucuuuccuucc

SEQ ID NO: 725864 - RNA, 15 nt, Homo sapiens
cccugaagauuucag

SEQ ID NO: 725865 - RNA, 18 nt, Homo sapiens
cccugagacaaauggagg

SEQ ID NO: 725866 - RNA, 19 nt, Homo sapiens
cccugagauucagauguca

SEQ ID NO: 725867 - RNA, 15 nt, Homo sapiens
cccugagcaaugucu

SEQ ID NO: 725868 - RNA, 19 nt, Homo sapiens
cccugagcaggaaaguuua

SEQ ID NO: 725869 - RNA, 18 nt, Homo sapiens
cccugaggaaugaaaaag

SEQ ID NO: 725870 - RNA, 16 nt, Homo sapiens
cccugagucaccagga

SEQ ID NO: 725871 - RNA, 17 nt, Homo sapiens
cccugcaauguggugac

SEQ ID NO: 725872 - RNA, 17 nt, Homo sapiens
cccugcacaggcacaca

SEQ ID NO: 725873 - RNA, 14 nt, Homo sapiens
cccugcacagugac

SEQ ID NO: 725874 - RNA, 20 nt, Homo sapiens
cccugcacucccuccuggag

SEQ ID NO: 725875 - RNA, 11 nt, Homo sapiens
cccugccauca

SEQ ID NO: 725876 - RNA, 15 nt, Homo sapiens
cccugcccuggucca

SEQ ID NO: 725877 - RNA, 15 nt, Homo sapiens
cccugccgaacacac

SEQ ID NO: 725878 - RNA, 14 nt, Homo sapiens
cccugccuucacug

SEQ ID NO: 725879 - RNA, 16 nt, Homo sapiens
cccugccuucacugug

SEQ ID NO: 725880 - RNA, 20 nt, Homo sapiens
cccugccuugcugacaauaa

SEQ ID NO: 725881 - RNA, 23 nt, Homo sapiens
cccugcucccaccaccagugaga

SEQ ID NO: 725882 - RNA, 14 nt, Homo sapiens
cccugcucuugcag

SEQ ID NO: 725883 - RNA, 14 nt, Homo sapiens
cccugcugaccucc

SEQ ID NO: 725884 - RNA, 15 nt, Homo sapiens
cccuggaccagccuc

SEQ ID NO: 725885 - RNA, 20 nt, Homo sapiens
cccuggcagcagcaggugug

SEQ ID NO: 725886 - RNA, 23 nt, Homo sapiens
cccuggccuuaaaaggggcccaa

SEQ ID NO: 725887 - RNA, 20 nt, Homo sapiens
cccuggcuccucuacuguuu

SEQ ID NO: 725888 - RNA, 15 nt, Homo sapiens
cccuggcugcccugg

SEQ ID NO: 725889 - RNA, 15 nt, Homo sapiens
cccugggauggcuca

SEQ ID NO: 725890 - RNA, 12 nt, Homo sapiens
cccugguccuuc

SEQ ID NO: 725891 - RNA, 21 nt, Homo sapiens
cccuggugggccaacaaagaa

SEQ ID NO: 725892 - RNA, 15 nt, Homo sapiens
cccugguguguuucc

SEQ ID NO: 725893 - RNA, 13 nt, Homo sapiens
cccugucuggaac

SEQ ID NO: 725894 - RNA, 13 nt, Homo sapiens
cccugugccagac

SEQ ID NO: 725895 - RNA, 18 nt, Homo sapiens
cccugugccagaccucaa

SEQ ID NO: 725896 - RNA, 18 nt, Homo sapiens
cccuguggcccuggccac

SEQ ID NO: 725897 - RNA, 22 nt, Homo sapiens
cccuguggcucacaguggggcc

SEQ ID NO: 725898 - RNA, 20 nt, Homo sapiens
cccuguguauucuagugaau

SEQ ID NO: 725899 - RNA, 17 nt, Homo sapiens
cccuguguccacugaga

SEQ ID NO: 725900 - RNA, 22 nt, Homo sapiens
ugagaaaagaaauuaguuucaa

SEQ ID NO: 725901 - RNA, 18 nt, Homo sapiens
ugagaaaagccucuccag

SEQ ID NO: 725902 - RNA, 16 nt, Homo sapiens
ugagaaaauaucuugc

SEQ ID NO: 725903 - RNA, 22 nt, Homo sapiens
ugagaaaauccccaacuaugca

SEQ ID NO: 725904 - RNA, 17 nt, Homo sapiens
ugagaaacccaccagcc

SEQ ID NO: 725905 - RNA, 23 nt, Homo sapiens
ugagaaaccuuauuguaccucuc

SEQ ID NO: 725906 - RNA, 17 nt, Homo sapiens
ugagaaagaaacuaaua

SEQ ID NO: 725907 - RNA, 13 nt, Homo sapiens
ugagaaagcucaa

SEQ ID NO: 725908 - RNA, 23 nt, Homo sapiens
ugagaaauaaaaagccugucauu

SEQ ID NO: 725909 - RNA, 17 nt, Homo sapiens
ugagaaauggccaaaua

SEQ ID NO: 725910 - RNA, 14 nt, Homo sapiens
ugagaaauuuacua

SEQ ID NO: 725911 - RNA, 12 nt, Homo sapiens
ugagaacauucc

SEQ ID NO: 725912 - RNA, 20 nt, Homo sapiens
ugagaaccuuggaccacucc

SEQ ID NO: 725913 - RNA, 21 nt, Homo sapiens
ugagaagaaugaaaaugcagu

SEQ ID NO: 725914 - RNA, 13 nt, Homo sapiens
ugagaagaucuga

SEQ ID NO: 725915 - RNA, 19 nt, Homo sapiens
ugagaagccuucagcucca

SEQ ID NO: 725916 - RNA, 12 nt, Homo sapiens
ugagaagcucug

SEQ ID NO: 725917 - RNA, 18 nt, Homo sapiens
ugagaagcuucuaauuag

SEQ ID NO: 725918 - RNA, 20 nt, Homo sapiens
ugagaagucacucacacugg

SEQ ID NO: 725919 - RNA, 23 nt, Homo sapiens
ugagaagucacucacacuggcca

SEQ ID NO: 725920 - RNA, 22 nt, Homo sapiens
ugagaauacauaaacaacgcau

SEQ ID NO: 725921 - RNA, 19 nt, Homo sapiens
ugagaaucaaacauucuau

SEQ ID NO: 725922 - RNA, 14 nt, Homo sapiens
ugagaaucccuggc

SEQ ID NO: 725923 - RNA, 16 nt, Homo sapiens
ugagacaccugaugac

SEQ ID NO: 725924 - RNA, 14 nt, Homo sapiens
ugagacauuuacau

SEQ ID NO: 725925 - RNA, 17 nt, Homo sapiens
ugagaccacuguuauca

SEQ ID NO: 725926 - RNA, 18 nt, Homo sapiens
ugagaccagccuggccaa

SEQ ID NO: 725927 - RNA, 12 nt, Homo sapiens
ugagaccauuca

SEQ ID NO: 725928 - RNA, 14 nt, Homo sapiens
ugagaccucuagag

SEQ ID NO: 725929 - RNA, 17 nt, Homo sapiens
ugagacuacuuaagaua

SEQ ID NO: 725930 - RNA, 16 nt, Homo sapiens
ugagacuccaccucaa

SEQ ID NO: 725931 - RNA, 14 nt, Homo sapiens
ugagacuccaucuc

SEQ ID NO: 725932 - RNA, 14 nt, Homo sapiens
ugagagaagggaau

SEQ ID NO: 725933 - RNA, 15 nt, Homo sapiens
ugagagaaguacaaa

SEQ ID NO: 725934 - RNA, 14 nt, Homo sapiens
ugagagacccaagg

SEQ ID NO: 725935 - RNA, 15 nt, Homo sapiens
ccuauuguucacuuu

SEQ ID NO: 725936 - RNA, 20 nt, Homo sapiens
ccuauuuaaaaaaauagaaa

SEQ ID NO: 725937 - RNA, 18 nt, Homo sapiens
ccuauuuaaaacuggguc

SEQ ID NO: 725938 - RNA, 22 nt, Homo sapiens
ccuauuuccugaacucagcuga

SEQ ID NO: 725939 - RNA, 22 nt, Homo sapiens
ccucaacauugcauggugcuag

SEQ ID NO: 725940 - RNA, 18 nt, Homo sapiens
ccucaacuccgugcuuaa

SEQ ID NO: 725941 - RNA, 17 nt, Homo sapiens
ccucaacugaaggggug

SEQ ID NO: 725942 - RNA, 20 nt, Homo sapiens
ccucaagccccauuuccuca

SEQ ID NO: 725943 - RNA, 23 nt, Homo sapiens
ccucaaggguuauagacugccau

SEQ ID NO: 725944 - RNA, 19 nt, Homo sapiens
ccucaauaaaaaguuuuau

SEQ ID NO: 725945 - RNA, 20 nt, Homo sapiens
ccucacagagugcauuguga

SEQ ID NO: 725946 - RNA, 23 nt, Homo sapiens
ccucaccaggagcccggcuucca

SEQ ID NO: 725947 - RNA, 18 nt, Homo sapiens
ccucacccaucaaaagca

SEQ ID NO: 725948 - RNA, 21 nt, Homo sapiens
ccucaccuuggcaccagacac

SEQ ID NO: 725949 - RNA, 21 nt, Homo sapiens
ccucacuaugacacugagcaa

SEQ ID NO: 725950 - RNA, 12 nt, Homo sapiens
ccucacugaaaa

SEQ ID NO: 725951 - RNA, 22 nt, Homo sapiens
ccucagaaacccuucagugcua

SEQ ID NO: 725952 - RNA, 15 nt, Homo sapiens
ccucagaaagggauu

SEQ ID NO: 725953 - RNA, 21 nt, Homo sapiens
ccucagaaagggauugcuuug

SEQ ID NO: 725954 - RNA, 20 nt, Homo sapiens
ccucagaaggccccagagag

SEQ ID NO: 725955 - RNA, 17 nt, Homo sapiens
ccucagaauugaucauu

SEQ ID NO: 725956 - RNA, 12 nt, Homo sapiens
ccucagacaucc

SEQ ID NO: 725957 - RNA, 14 nt, Homo sapiens
ccucagaguggagu

SEQ ID NO: 725958 - RNA, 14 nt, Homo sapiens
ccucagaguggucg

SEQ ID NO: 725959 - RNA, 12 nt, Homo sapiens
ccucagcacugu

SEQ ID NO: 725960 - RNA, 20 nt, Homo sapiens
ccucagcugccucacuuccu

SEQ ID NO: 725961 - RNA, 21 nt, Homo sapiens
ccucagcuucucaaaguacug

SEQ ID NO: 725962 - RNA, 23 nt, Homo sapiens
ccucagggacagagacaccugca

SEQ ID NO: 725963 - RNA, 15 nt, Homo sapiens
ccucagggguuucau

SEQ ID NO: 725964 - RNA, 21 nt, Homo sapiens
ccucaggguggggggugacag

SEQ ID NO: 725965 - RNA, 17 nt, Homo sapiens
ccucagucucccagcua

SEQ ID NO: 725966 - RNA, 15 nt, Homo sapiens
ccucagugacaucaa

SEQ ID NO: 725967 - RNA, 16 nt, Homo sapiens
ccucagugagaagcca

SEQ ID NO: 725968 - RNA, 20 nt, Homo sapiens
ccucagugcacgagcuggcc

SEQ ID NO: 725969 - RNA, 12 nt, Homo sapiens
ccucagugcauu

SEQ ID NO: 725970 - RNA, 19 nt, Homo sapiens
ccucaguuucccuaucucg

SEQ ID NO: 725971 - RNA, 20 nt, Homo sapiens
ccucaugauaugucagggcg

SEQ ID NO: 725972 - RNA, 23 nt, Homo sapiens
ccucauggcucuggcacagugua

SEQ ID NO: 725973 - RNA, 15 nt, Homo sapiens
ccucauuaguaauaa

SEQ ID NO: 725974 - RNA, 19 nt, Homo sapiens
ccucauugcuaccacagac

SEQ ID NO: 725975 - RNA, 20 nt, Homo sapiens
ccucauugcuaccacagacu

SEQ ID NO: 725976 - RNA, 18 nt, Homo sapiens
ccucauuuuuauaaccug

SEQ ID NO: 725977 - RNA, 11 nt, Homo sapiens
ccuccaaggaa

SEQ ID NO: 725978 - RNA, 22 nt, Homo sapiens
ccuccaaggaggggcuguaaaa

SEQ ID NO: 725979 - RNA, 20 nt, Homo sapiens
ccuccaccuccuaggcucaa

SEQ ID NO: 725980 - RNA, 20 nt, Homo sapiens
ccuccacuccagcucugaga

SEQ ID NO: 725981 - RNA, 19 nt, Homo sapiens
ccuccacucuaguucuaga

SEQ ID NO: 725982 - RNA, 18 nt, Homo sapiens
ccuccagaggagacauug

SEQ ID NO: 725983 - RNA, 12 nt, Homo sapiens
ccuccagaguug

SEQ ID NO: 725984 - RNA, 12 nt, Homo sapiens
ccuccagccuuc

SEQ ID NO: 725985 - RNA, 22 nt, Homo sapiens
ccuccagcuucaggcaggccaa

SEQ ID NO: 725986 - RNA, 21 nt, Homo sapiens
ccuccagggcuggacugaggc

SEQ ID NO: 725987 - RNA, 17 nt, Homo sapiens
ccuccaguaguggacaa

SEQ ID NO: 725988 - RNA, 21 nt, Homo sapiens
ccuccaguaguggacaacagg

SEQ ID NO: 725989 - RNA, 20 nt, Homo sapiens
ccucccaaagugcuaguauu

SEQ ID NO: 725990 - RNA, 13 nt, Homo sapiens
ccucccaccagag

SEQ ID NO: 725991 - RNA, 17 nt, Homo sapiens
ccucccacggugcccaa

SEQ ID NO: 725992 - RNA, 22 nt, Homo sapiens
ccucccaggaacugggccaacu

SEQ ID NO: 725993 - RNA, 17 nt, Homo sapiens
ccucccaggccaggcuc

SEQ ID NO: 725994 - RNA, 16 nt, Homo sapiens
ccucccagguucacac

SEQ ID NO: 725995 - RNA, 21 nt, Homo sapiens
ccucccauaauugcuuugcca

SEQ ID NO: 725996 - RNA, 22 nt, Homo sapiens
ccuccccaacaccccacugagc

SEQ ID NO: 725997 - RNA, 18 nt, Homo sapiens
ccuccccgugccaaaaau

SEQ ID NO: 725998 - RNA, 21 nt, Homo sapiens
ccucccuagccagcacuugua

SEQ ID NO: 725999 - RNA, 18 nt, Homo sapiens
ccucccuggcucccauga

SEQ ID NO: 726000 - RNA, 15 nt, Homo sapiens
ccucccuuccaugcc

SEQ ID NO: 726001 - RNA, 18 nt, Homo sapiens
ccucccuuguggcagcaa

SEQ ID NO: 726002 - RNA, 16 nt, Homo sapiens
ccuccgaccacuucca

SEQ ID NO: 726003 - RNA, 18 nt, Homo sapiens
ccuccggcgucuugccca

SEQ ID NO: 726004 - RNA, 20 nt, Homo sapiens
ccuccuacccuuccagugcc

SEQ ID NO: 726005 - RNA, 21 nt, Homo sapiens
ccuccucacccacccuguggc

SEQ ID NO: 726006 - RNA, 13 nt, Homo sapiens
ccuccucaccucu

SEQ ID NO: 726007 - RNA, 19 nt, Homo sapiens
ccuccucagaggacaguuu

SEQ ID NO: 726008 - RNA, 14 nt, Homo sapiens
ccuccucagugaca

SEQ ID NO: 726009 - RNA, 13 nt, Homo sapiens
ccuccuccaugca

SEQ ID NO: 726010 - RNA, 16 nt, Homo sapiens
ccuccucccaucuccu

SEQ ID NO: 726011 - RNA, 18 nt, Homo sapiens
ccuccucccuaaugcuca

SEQ ID NO: 726012 - RNA, 12 nt, Homo sapiens
ccuccugaaccg

SEQ ID NO: 726013 - RNA, 20 nt, Homo sapiens
ccuccugauggagugugcag

SEQ ID NO: 726014 - RNA, 15 nt, Homo sapiens
ccuccugauggccaa

SEQ ID NO: 726015 - RNA, 13 nt, Homo sapiens
ccuccugcugcag

SEQ ID NO: 726016 - RNA, 14 nt, Homo sapiens
ugauuagacagaac

SEQ ID NO: 726017 - RNA, 20 nt, Homo sapiens
ugauuagacagaacaccuau

SEQ ID NO: 726018 - RNA, 20 nt, Homo sapiens
ugauuauauaaaauacauaa

SEQ ID NO: 726019 - RNA, 22 nt, Homo sapiens
ugauuauauaaaauacauaaua

SEQ ID NO: 726020 - RNA, 16 nt, Homo sapiens
ugauuauauucacaga

SEQ ID NO: 726021 - RNA, 13 nt, Homo sapiens
ugauuaucuucag

SEQ ID NO: 726022 - RNA, 15 nt, Homo sapiens
ugauuauuaaagucc

SEQ ID NO: 726023 - RNA, 20 nt, Homo sapiens
ugauuauucuuguucaggga

SEQ ID NO: 726024 - RNA, 16 nt, Homo sapiens
ugauucaccucuuccu

SEQ ID NO: 726025 - RNA, 17 nt, Homo sapiens
ugauucaccucuuccuc

SEQ ID NO: 726026 - RNA, 21 nt, Homo sapiens
ugauucagccaaaugcaggga

SEQ ID NO: 726027 - RNA, 14 nt, Homo sapiens
ugauucagucuucu

SEQ ID NO: 726028 - RNA, 11 nt, Homo sapiens
ugauuccaugg

SEQ ID NO: 726029 - RNA, 18 nt, Homo sapiens
ugauucccuguggugaua

SEQ ID NO: 726030 - RNA, 20 nt, Homo sapiens
ugauuccuuuaugaugacug

SEQ ID NO: 726031 - RNA, 21 nt, Homo sapiens
ugauucucuugagauaagguu

SEQ ID NO: 726032 - RNA, 19 nt, Homo sapiens
ugauucugauaaugcucac

SEQ ID NO: 726033 - RNA, 14 nt, Homo sapiens
ugauucuuguaaau

SEQ ID NO: 726034 - RNA, 19 nt, Homo sapiens
ugauugacacacagcacuc

SEQ ID NO: 726035 - RNA, 19 nt, Homo sapiens
ugauugaggagcugcacug

SEQ ID NO: 726036 - RNA, 20 nt, Homo sapiens
ugauugaggagcugcacuga

SEQ ID NO: 726037 - RNA, 13 nt, Homo sapiens
ugauugcugccau

SEQ ID NO: 726038 - RNA, 21 nt, Homo sapiens
ugauuggcuccuggguuucau

SEQ ID NO: 726039 - RNA, 14 nt, Homo sapiens
ugauuggugauuca

SEQ ID NO: 726040 - RNA, 18 nt, Homo sapiens
ugauugguugcauccagg

SEQ ID NO: 726041 - RNA, 12 nt, Homo sapiens
ugauugugaaac

SEQ ID NO: 726042 - RNA, 16 nt, Homo sapiens
ugauugugccagugca

SEQ ID NO: 726043 - RNA, 13 nt, Homo sapiens
ugauuuacauuuc

SEQ ID NO: 726044 - RNA, 15 nt, Homo sapiens
ugauuuagugaucaa

SEQ ID NO: 726045 - RNA, 17 nt, Homo sapiens
ugauuucagacugcaga

SEQ ID NO: 726046 - RNA, 13 nt, Homo sapiens
ugauuucaggaua

SEQ ID NO: 726047 - RNA, 22 nt, Homo sapiens
ugauuucaguucaucaaaucau

SEQ ID NO: 726048 - RNA, 18 nt, Homo sapiens
ugauuucugacucuauca

SEQ ID NO: 726049 - RNA, 14 nt, Homo sapiens
uggaagaccuggac

SEQ ID NO: 726050 - RNA, 23 nt, Homo sapiens
uggaagagauaaacgaccaaacu

SEQ ID NO: 726051 - RNA, 17 nt, Homo sapiens
uggaagaggaacagcac

SEQ ID NO: 726052 - RNA, 23 nt, Homo sapiens
uggaagaggaacagcacugggga

SEQ ID NO: 726053 - RNA, 14 nt, Homo sapiens
uggaagaguaguaa

SEQ ID NO: 726054 - RNA, 15 nt, Homo sapiens
uggaagauggcauaa

SEQ ID NO: 726055 - RNA, 15 nt, Homo sapiens
uggaagcacagagug

SEQ ID NO: 726056 - RNA, 12 nt, Homo sapiens
uggaagcacugc

SEQ ID NO: 726057 - RNA, 13 nt, Homo sapiens
uggaagcaguuuc

SEQ ID NO: 726058 - RNA, 11 nt, Homo sapiens
uggaagccugc

SEQ ID NO: 726059 - RNA, 17 nt, Homo sapiens
uggaagcucugaaguca

SEQ ID NO: 726060 - RNA, 13 nt, Homo sapiens
uggaagcuggaag

SEQ ID NO: 726061 - RNA, 18 nt, Homo sapiens
uggaagcuguguccuugc

SEQ ID NO: 726062 - RNA, 15 nt, Homo sapiens
uggaagggguccagc

SEQ ID NO: 726063 - RNA, 22 nt, Homo sapiens
uggaagucuccaugaagagcuu

SEQ ID NO: 726064 - RNA, 21 nt, Homo sapiens
uggaaguggaguugacucugg

SEQ ID NO: 726065 - RNA, 19 nt, Homo sapiens
uggaaguggauucuggaug

SEQ ID NO: 726066 - RNA, 20 nt, Homo sapiens
uggaaguuucuggugccauu

SEQ ID NO: 726067 - RNA, 14 nt, Homo sapiens
uggaauaaagucaa

SEQ ID NO: 726068 - RNA, 14 nt, Homo sapiens
uggaauaacaugua

SEQ ID NO: 726069 - RNA, 15 nt, Homo sapiens
uggaauaacucugug

SEQ ID NO: 726070 - RNA, 16 nt, Homo sapiens
uggaauagaugucuca

SEQ ID NO: 726071 - RNA, 21 nt, Homo sapiens
uggaauauaaggaaagcaaua

SEQ ID NO: 726072 - RNA, 23 nt, Homo sapiens
uggaaucagugaagccaaaggga

SEQ ID NO: 726073 - RNA, 15 nt, Homo sapiens
uggaaucccacugua

SEQ ID NO: 726074 - RNA, 16 nt, Homo sapiens
uggaaucuucaccuca

SEQ ID NO: 726075 - RNA, 19 nt, Homo sapiens
uggaaucuucucuuugaca

SEQ ID NO: 726076 - RNA, 23 nt, Homo sapiens
uggaaugcagggaagagggcagu

SEQ ID NO: 726077 - RNA, 22 nt, Homo sapiens
uggaauggcaggugucauauga

SEQ ID NO: 726078 - RNA, 19 nt, Homo sapiens
uggaauuaugucugcugaa

SEQ ID NO: 726079 - RNA, 21 nt, Homo sapiens
uggaauuauuuugaaugucac

SEQ ID NO: 726080 - RNA, 14 nt, Homo sapiens
uggaauuccucuuu

SEQ ID NO: 726081 - RNA, 18 nt, Homo sapiens
uggaauucuucacuugcu

SEQ ID NO: 726082 - RNA, 12 nt, Homo sapiens
uggaauucuucu

SEQ ID NO: 726083 - RNA, 14 nt, Homo sapiens
uggaauugcucaag

SEQ ID NO: 726084 - RNA, 15 nt, Homo sapiens
uggaauuuguucaag

SEQ ID NO: 726085 - RNA, 15 nt, Homo sapiens
uggaauuuugcaaag

SEQ ID NO: 726086 - RNA, 21 nt, Homo sapiens
uggaauuuugcaaagauuuaa

SEQ ID NO: 726087 - RNA, 18 nt, Homo sapiens
uggacaacauuuuacuac

SEQ ID NO: 726088 - RNA, 22 nt, Homo sapiens
uggacaaucaugaaauaugcau

SEQ ID NO: 726089 - RNA, 15 nt, Homo sapiens
uggacacgagccaca

SEQ ID NO: 726090 - RNA, 15 nt, Homo sapiens
uggacacucuauaug

SEQ ID NO: 726091 - RNA, 13 nt, Homo sapiens
uggacacugagag

SEQ ID NO: 726092 - RNA, 10 nt, Homo sapiens
uggacacugu

SEQ ID NO: 726093 - RNA, 19 nt, Homo sapiens
uggacacuuaguuauuuac

SEQ ID NO: 726094 - RNA, 14 nt, Homo sapiens
uggacagcugcuug

SEQ ID NO: 726095 - RNA, 16 nt, Homo sapiens
uggacagcuuugcucc

SEQ ID NO: 726096 - RNA, 22 nt, Homo sapiens
uggacaggaggcccccaucuau

SEQ ID NO: 726097 - RNA, 13 nt, Homo sapiens
uggaccacaggca

SEQ ID NO: 726098 - RNA, 19 nt, Homo sapiens
uggacccaucacuuuggac

SEQ ID NO: 726099 - RNA, 20 nt, Homo sapiens
uggacccaucacuuuggaca

SEQ ID NO: 726100 - RNA, 19 nt, Homo sapiens
uggaccuaggguggccuga

SEQ ID NO: 726101 - RNA, 15 nt, Homo sapiens
uggacgugcucagac

SEQ ID NO: 726102 - RNA, 20 nt, Homo sapiens
uggacuacacaauacaguau

SEQ ID NO: 726103 - RNA, 21 nt, Homo sapiens
uggacuacacaauacaguauu

SEQ ID NO: 726104 - RNA, 12 nt, Homo sapiens
uggacugaccac

SEQ ID NO: 726105 - RNA, 12 nt, Homo sapiens
uggacuggccau

SEQ ID NO: 726106 - RNA, 22 nt, Homo sapiens
uggacugguaaguaacuguggu

SEQ ID NO: 726107 - RNA, 16 nt, Homo sapiens
uggacuguaacugacu

SEQ ID NO: 726108 - RNA, 15 nt, Homo sapiens
uggacugucauagaa

SEQ ID NO: 726109 - RNA, 19 nt, Homo sapiens
uggacuguggcacuugccu

SEQ ID NO: 726110 - RNA, 12 nt, Homo sapiens
uggacuuguaua

SEQ ID NO: 726111 - RNA, 17 nt, Homo sapiens
uggacuuucuugcauga

SEQ ID NO: 726112 - RNA, 21 nt, Homo sapiens
uggacuuuucguuaacauuga

SEQ ID NO: 726113 - RNA, 17 nt, Homo sapiens
uggagaaacuguagucu

SEQ ID NO: 726114 - RNA, 19 nt, Homo sapiens
uggagaaacuguagucuca

SEQ ID NO: 726115 - RNA, 16 nt, Homo sapiens
uggagaaagcacugac

SEQ ID NO: 726116 - RNA, 14 nt, Homo sapiens
uggagacacaacua

SEQ ID NO: 726117 - RNA, 22 nt, Homo sapiens
uggagaccaggccugagcaaca

SEQ ID NO: 726118 - RNA, 15 nt, Homo sapiens
uggagagaacugaau

SEQ ID NO: 726119 - RNA, 18 nt, Homo sapiens
uggagagggcagggucca

SEQ ID NO: 726120 - RNA, 17 nt, Homo sapiens
uggagaguaaucuggga

SEQ ID NO: 726121 - RNA, 21 nt, Homo sapiens
uggagaucagaaagugacauu

SEQ ID NO: 726122 - RNA, 22 nt, Homo sapiens
uggagauggacaacucaaugaa

SEQ ID NO: 726123 - RNA, 15 nt, Homo sapiens
uggagcagaacuuuc

SEQ ID NO: 726124 - RNA, 13 nt, Homo sapiens
uggagcagcagcc

SEQ ID NO: 726125 - RNA, 16 nt, Homo sapiens
uggagcagcagccacu

SEQ ID NO: 726126 - RNA, 15 nt, Homo sapiens
uggagcauaacugga

SEQ ID NO: 726127 - RNA, 19 nt, Homo sapiens
uggagcaucauaauggacu

SEQ ID NO: 726128 - RNA, 20 nt, Homo sapiens
uggagccccauccuguguua

SEQ ID NO: 726129 - RNA, 21 nt, Homo sapiens
uggagccccauccuguguuau

SEQ ID NO: 726130 - RNA, 18 nt, Homo sapiens
uggagccuggcacaggac

SEQ ID NO: 726131 - RNA, 23 nt, Homo sapiens
uggagcucacacuccaguggcag

SEQ ID NO: 726132 - RNA, 24 nt, Homo sapiens
uggagcugagcagguguucuucau

SEQ ID NO: 726133 - RNA, 20 nt, Homo sapiens
uggaggaaguucuccagcuu

SEQ ID NO: 726134 - RNA, 20 nt, Homo sapiens
cgugcucauugcuaaccacu

SEQ ID NO: 726135 - RNA, 17 nt, Homo sapiens
cguggacucugcacaug

SEQ ID NO: 726136 - RNA, 21 nt, Homo sapiens
cguggacucugcacaugucuu

SEQ ID NO: 726137 - RNA, 15 nt, Homo sapiens
cgugguauaaucucc

SEQ ID NO: 726138 - RNA, 17 nt, Homo sapiens
cgugguauaaucuccau

SEQ ID NO: 726139 - RNA, 19 nt, Homo sapiens
cguggucuccuugcacuuu

SEQ ID NO: 726140 - RNA, 20 nt, Homo sapiens
cgugguggcucaugccugua

SEQ ID NO: 726141 - RNA, 14 nt, Homo sapiens
cguguaaauuaugu

SEQ ID NO: 726142 - RNA, 20 nt, Homo sapiens
cguguaucuaauucagcuga

SEQ ID NO: 726143 - RNA, 18 nt, Homo sapiens
cgugucccgcggugcuga

SEQ ID NO: 726144 - RNA, 20 nt, Homo sapiens
cgugucucagacugcaugua

SEQ ID NO: 726145 - RNA, 15 nt, Homo sapiens
cgugugaacugcaac

SEQ ID NO: 726146 - RNA, 14 nt, Homo sapiens
cgugugcacacuca

SEQ ID NO: 726147 - RNA, 21 nt, Homo sapiens
cguuaaggagaugggccuuuu

SEQ ID NO: 726148 - RNA, 21 nt, Homo sapiens
cguucccaguguggcugaggc

SEQ ID NO: 726149 - RNA, 23 nt, Homo sapiens
cguuccuguuagcauaaugugag

SEQ ID NO: 726150 - RNA, 14 nt, Homo sapiens
cguucgcauggcag

SEQ ID NO: 726151 - RNA, 13 nt, Homo sapiens
cguucugcugcuu

SEQ ID NO: 726152 - RNA, 20 nt, Homo sapiens
cguugaagaggaagggcaaa

SEQ ID NO: 726153 - RNA, 16 nt, Homo sapiens
cguugcgggguggagu

SEQ ID NO: 726154 - RNA, 20 nt, Homo sapiens
cguuguaguaaaugcgugcu

SEQ ID NO: 726155 - RNA, 13 nt, Homo sapiens
cguuguguuguug

SEQ ID NO: 726156 - RNA, 16 nt, Homo sapiens
cguuuauauuguagca

SEQ ID NO: 726157 - RNA, 22 nt, Homo sapiens
cguuugguuuacuugucuguca

SEQ ID NO: 726158 - RNA, 16 nt, Homo sapiens
cguuugugcauaucug

SEQ ID NO: 726159 - RNA, 21 nt, Homo sapiens
cguuuucuugcucaaagggaa

SEQ ID NO: 726160 - RNA, 16 nt, Homo sapiens
cguuuugaagacgugg

SEQ ID NO: 726161 - RNA, 19 nt, Homo sapiens
cguuuuguaaauguugugc

SEQ ID NO: 726162 - RNA, 21 nt, Homo sapiens
cuaaaaaaaaugcauauuaau

SEQ ID NO: 726163 - RNA, 17 nt, Homo sapiens
cuacacacauccacgca

SEQ ID NO: 726164 - RNA, 14 nt, Homo sapiens
cuacacagaucaca

SEQ ID NO: 726165 - RNA, 18 nt, Homo sapiens
cuacacagaucacagcuu

SEQ ID NO: 726166 - RNA, 22 nt, Homo sapiens
cuacacaguaaaaacuuguacu

SEQ ID NO: 726167 - RNA, 15 nt, Homo sapiens
cuacacauguaaaau

SEQ ID NO: 726168 - RNA, 15 nt, Homo sapiens
cuacacccuggccca

SEQ ID NO: 726169 - RNA, 18 nt, Homo sapiens
cuacacccuggcccagcu

SEQ ID NO: 726170 - RNA, 16 nt, Homo sapiens
cuacacguaaguauaa

SEQ ID NO: 726171 - RNA, 20 nt, Homo sapiens
cuacacugauacacuugaag

SEQ ID NO: 726172 - RNA, 15 nt, Homo sapiens
cuacagaggugaaau

SEQ ID NO: 726173 - RNA, 14 nt, Homo sapiens
cuacagauagaaaa

SEQ ID NO: 726174 - RNA, 23 nt, Homo sapiens
cuacagcagcacuguucuguccu

SEQ ID NO: 726175 - RNA, 20 nt, Homo sapiens
cuacagcaguagggagguca

SEQ ID NO: 726176 - RNA, 19 nt, Homo sapiens
cuacagcuaacccucacaa

SEQ ID NO: 726177 - RNA, 16 nt, Homo sapiens
cuacagcuacauugag

SEQ ID NO: 726178 - RNA, 21 nt, Homo sapiens
cuacagcugucuucacaugua

SEQ ID NO: 726179 - RNA, 18 nt, Homo sapiens
cuacagggaauuuguacg

SEQ ID NO: 726180 - RNA, 19 nt, Homo sapiens
cuacagggacacuaucacu

SEQ ID NO: 726181 - RNA, 19 nt, Homo sapiens
cuacaguaacugugacuga

SEQ ID NO: 726182 - RNA, 15 nt, Homo sapiens
cuacaguagcugcua

SEQ ID NO: 726183 - RNA, 17 nt, Homo sapiens
cuacaguuuuaacugug

SEQ ID NO: 726184 - RNA, 14 nt, Homo sapiens
cuacauaaguaauu

SEQ ID NO: 726185 - RNA, 17 nt, Homo sapiens
cuacauacguguuccua

SEQ ID NO: 726186 - RNA, 13 nt, Homo sapiens
cuacaucagccuu

SEQ ID NO: 726187 - RNA, 22 nt, Homo sapiens
cuacaugugccaccaacauaaa

SEQ ID NO: 726188 - RNA, 12 nt, Homo sapiens
cuacauguucuu

SEQ ID NO: 726189 - RNA, 22 nt, Homo sapiens
cuacauugacgagcaugagcug

SEQ ID NO: 726190 - RNA, 21 nt, Homo sapiens
cuaccaaagcaccuuagcugg

SEQ ID NO: 726191 - RNA, 13 nt, Homo sapiens
cuaccacaguguc

SEQ ID NO: 726192 - RNA, 15 nt, Homo sapiens
cuaccacucuaauca

SEQ ID NO: 726193 - RNA, 21 nt, Homo sapiens
cuaccagguguucuacacuca

SEQ ID NO: 726194 - RNA, 17 nt, Homo sapiens
cuaccaucugauguuuc

SEQ ID NO: 726195 - RNA, 15 nt, Homo sapiens
cuacccacaugcacu

SEQ ID NO: 726196 - RNA, 14 nt, Homo sapiens
cuacccagguauua

SEQ ID NO: 726197 - RNA, 18 nt, Homo sapiens
cuaccccauucucuagac

SEQ ID NO: 726198 - RNA, 14 nt, Homo sapiens
cuacccuaaccaag

SEQ ID NO: 726199 - RNA, 17 nt, Homo sapiens
cuacccuauucuaucca

SEQ ID NO: 726200 - RNA, 23 nt, Homo sapiens
cuacccugagaucugcacaguca

SEQ ID NO: 726201 - RNA, 23 nt, Homo sapiens
cuacccuuaguauuuauuacuaa

SEQ ID NO: 726202 - RNA, 23 nt, Homo sapiens
cuacccuuccagugcccuaggcc

SEQ ID NO: 726203 - RNA, 23 nt, Homo sapiens
cuaccgagucucuucuccacugg

SEQ ID NO: 726204 - RNA, 17 nt, Homo sapiens
cuaccuagaaguaagaa

SEQ ID NO: 726205 - RNA, 15 nt, Homo sapiens
cuaccuagggacaca

SEQ ID NO: 726206 - RNA, 16 nt, Homo sapiens
cuaccucaaacuucca

SEQ ID NO: 726207 - RNA, 12 nt, Homo sapiens
cuaccucaaggg

SEQ ID NO: 726208 - RNA, 10 nt, Homo sapiens
cuaccucagc

SEQ ID NO: 726209 - RNA, 14 nt, Homo sapiens
cuaccucagccucc

SEQ ID NO: 726210 - RNA, 23 nt, Homo sapiens
cuaccucugagaagacacaaggu

SEQ ID NO: 726211 - RNA, 19 nt, Homo sapiens
cuaccuggguccuuuucag

SEQ ID NO: 726212 - RNA, 22 nt, Homo sapiens
cuaccuguaggaucagggucua

SEQ ID NO: 726213 - RNA, 12 nt, Homo sapiens
cuaccugugagc

SEQ ID NO: 726214 - RNA, 17 nt, Homo sapiens
cuaccuguggugauguu

SEQ ID NO: 726215 - RNA, 17 nt, Homo sapiens
cuacgaauauagagggu

SEQ ID NO: 726216 - RNA, 19 nt, Homo sapiens
cuacgaggccauccagucc

SEQ ID NO: 726217 - RNA, 19 nt, Homo sapiens
cuacgugcgcucugccauu

SEQ ID NO: 726218 - RNA, 13 nt, Homo sapiens
cuacgugcuccuc

SEQ ID NO: 726219 - RNA, 15 nt, Homo sapiens
cuacuaaaacauaca

SEQ ID NO: 726220 - RNA, 20 nt, Homo sapiens
cuacuaaguucacauuagaa

SEQ ID NO: 726221 - RNA, 20 nt, Homo sapiens
cuacuacaaacuucaaagag

SEQ ID NO: 726222 - RNA, 16 nt, Homo sapiens
cuacuacaugugacug

SEQ ID NO: 726223 - RNA, 19 nt, Homo sapiens
cuacucaggaggcugaggc

SEQ ID NO: 726224 - RNA, 15 nt, Homo sapiens
cuacucccucuucac

SEQ ID NO: 726225 - RNA, 19 nt, Homo sapiens
cuacucgggaggcugaggc

SEQ ID NO: 726226 - RNA, 19 nt, Homo sapiens
cuacugagggcaguucuga

SEQ ID NO: 726227 - RNA, 16 nt, Homo sapiens
cuacugaggugcuaug

SEQ ID NO: 726228 - RNA, 18 nt, Homo sapiens
cuacugcagcaccuccag

SEQ ID NO: 726229 - RNA, 18 nt, Homo sapiens
cuacugcuaaauccucau

SEQ ID NO: 726230 - RNA, 20 nt, Homo sapiens
cuacugcucuccuccaccuc

SEQ ID NO: 726231 - RNA, 14 nt, Homo sapiens
cuacugcucugugu

SEQ ID NO: 726232 - RNA, 18 nt, Homo sapiens
cuacugcucuguguuuac

SEQ ID NO: 726233 - RNA, 18 nt, Homo sapiens
cuacugcuggaaaaagcc

SEQ ID NO: 726234 - RNA, 22 nt, Homo sapiens
cuacuggaaugguguuuuguca

SEQ ID NO: 726235 - RNA, 20 nt, Homo sapiens
cuacuggggaggcugaggca

SEQ ID NO: 726236 - RNA, 23 nt, Homo sapiens
cuacugugucuuggaaucuagcc

SEQ ID NO: 726237 - RNA, 13 nt, Homo sapiens
cuacuucagucuu

SEQ ID NO: 726238 - RNA, 15 nt, Homo sapiens
cuacuucuagcugua

SEQ ID NO: 726239 - RNA, 20 nt, Homo sapiens
cuacuuuaaguauacaaucu

SEQ ID NO: 726240 - RNA, 18 nt, Homo sapiens
cuacuuuucuuuccucag

SEQ ID NO: 726241 - RNA, 15 nt, Homo sapiens
cuagaaaucugccaa

SEQ ID NO: 726242 - RNA, 17 nt, Homo sapiens
cuagaacacuaacucac

SEQ ID NO: 726243 - RNA, 22 nt, Homo sapiens
cuagaaccaagcuucagagccu

SEQ ID NO: 726244 - RNA, 14 nt, Homo sapiens
cuagaacccgugac

SEQ ID NO: 726245 - RNA, 21 nt, Homo sapiens
cuagaaccucucguaguccau

SEQ ID NO: 726246 - RNA, 12 nt, Homo sapiens
cuagaagccaag

SEQ ID NO: 726247 - RNA, 22 nt, Homo sapiens
cuagaaggcguccauguuuauu

SEQ ID NO: 726248 - RNA, 20 nt, Homo sapiens
uggccaggccaggggacccc

SEQ ID NO: 726249 - RNA, 23 nt, Homo sapiens
uggccaggcuggucuaaaacucc

SEQ ID NO: 726250 - RNA, 19 nt, Homo sapiens
uggccaggcuggucucaaa

SEQ ID NO: 726251 - RNA, 20 nt, Homo sapiens
uggccauccuucuguguacc

SEQ ID NO: 726252 - RNA, 22 nt, Homo sapiens
uggcccaaucucugccauauca

SEQ ID NO: 726253 - RNA, 21 nt, Homo sapiens
uggcccacccaguccaugcuc

SEQ ID NO: 726254 - RNA, 20 nt, Homo sapiens
uggcccacgcccucccucuc

SEQ ID NO: 726255 - RNA, 13 nt, Homo sapiens
uggcccagaugau

SEQ ID NO: 726256 - RNA, 13 nt, Homo sapiens
uggcccagccaaa

SEQ ID NO: 726257 - RNA, 12 nt, Homo sapiens
uggcccaggaau

SEQ ID NO: 726258 - RNA, 20 nt, Homo sapiens
uggcccauacuuguaauccc

SEQ ID NO: 726259 - RNA, 22 nt, Homo sapiens
uggcccauagaaacaugacacu

SEQ ID NO: 726260 - RNA, 12 nt, Homo sapiens
uggcccaucaac

SEQ ID NO: 726261 - RNA, 18 nt, Homo sapiens
uggcccgcaauacuguag

SEQ ID NO: 726262 - RNA, 13 nt, Homo sapiens
uggcccuaaagga

SEQ ID NO: 726263 - RNA, 14 nt, Homo sapiens
uggcccuaugcuuc

SEQ ID NO: 726264 - RNA, 14 nt, Homo sapiens
uggcccugccucau

SEQ ID NO: 726265 - RNA, 14 nt, Homo sapiens
uggcccuucuugcc

SEQ ID NO: 726266 - RNA, 19 nt, Homo sapiens
uggcccuugcuuaccucuc

SEQ ID NO: 726267 - RNA, 22 nt, Homo sapiens
uggcccuuuccuuccagauccu

SEQ ID NO: 726268 - RNA, 19 nt, Homo sapiens
uggccgggucccugagcuc

SEQ ID NO: 726269 - RNA, 19 nt, Homo sapiens
uggccuaaaaaugcaacuu

SEQ ID NO: 726270 - RNA, 16 nt, Homo sapiens
uggccuauccgcugcc

SEQ ID NO: 726271 - RNA, 20 nt, Homo sapiens
uggccucccugcugugccau

SEQ ID NO: 726272 - RNA, 22 nt, Homo sapiens
uggccuccuuccccguacuuug

SEQ ID NO: 726273 - RNA, 23 nt, Homo sapiens
uggccugcugggcucuccaccuc

SEQ ID NO: 726274 - RNA, 21 nt, Homo sapiens
uggccugcugugauuccacua

SEQ ID NO: 726275 - RNA, 20 nt, Homo sapiens
uggccuggacaguaucccac

SEQ ID NO: 726276 - RNA, 12 nt, Homo sapiens
uggccuggcaca

SEQ ID NO: 726277 - RNA, 15 nt, Homo sapiens
ugggccccaccauuu

SEQ ID NO: 726278 - RNA, 17 nt, Homo sapiens
ugggccccuggcacucu

SEQ ID NO: 726279 - RNA, 19 nt, Homo sapiens
ugggcccuaugucucagga

SEQ ID NO: 726280 - RNA, 22 nt, Homo sapiens
ugggcgacagagcgagacucca

SEQ ID NO: 726281 - RNA, 17 nt, Homo sapiens
ugggcuaccaucugcau

SEQ ID NO: 726282 - RNA, 18 nt, Homo sapiens
ugggcuacccuaaaggga

SEQ ID NO: 726283 - RNA, 19 nt, Homo sapiens
ugggcuauuuggacucagg

SEQ ID NO: 726284 - RNA, 20 nt, Homo sapiens
ugggcuccuggggcaauggg

SEQ ID NO: 726285 - RNA, 21 nt, Homo sapiens
ugggcugagugacacaagcac

SEQ ID NO: 726286 - RNA, 19 nt, Homo sapiens
ugggcugccgggaaccuca

SEQ ID NO: 726287 - RNA, 19 nt, Homo sapiens
ugggcugccugcuguguua

SEQ ID NO: 726288 - RNA, 12 nt, Homo sapiens
ugggcugcugca

SEQ ID NO: 726289 - RNA, 20 nt, Homo sapiens
ugggcuggaacgugaacuca

SEQ ID NO: 726290 - RNA, 21 nt, Homo sapiens
ugggcuuaguauuucucagga

SEQ ID NO: 726291 - RNA, 22 nt, Homo sapiens
ugggcuucauuccggacuggca

SEQ ID NO: 726292 - RNA, 19 nt, Homo sapiens
ugggcuucgucuacuccuu

SEQ ID NO: 726293 - RNA, 12 nt, Homo sapiens
ugggcuuucaua

SEQ ID NO: 726294 - RNA, 12 nt, Homo sapiens
uggggaagacag

SEQ ID NO: 726295 - RNA, 15 nt, Homo sapiens
uggggacacagauca

SEQ ID NO: 726296 - RNA, 15 nt, Homo sapiens
uggggacauugcucu

SEQ ID NO: 726297 - RNA, 16 nt, Homo sapiens
uggggaccacacugau

SEQ ID NO: 726298 - RNA, 21 nt, Homo sapiens
uggggacgggggcugcuucuc

SEQ ID NO: 726299 - RNA, 15 nt, Homo sapiens
uggggacuaacccaa

SEQ ID NO: 726300 - RNA, 17 nt, Homo sapiens
uggggagauaguccaua

SEQ ID NO: 726301 - RNA, 18 nt, Homo sapiens
uggggagccugagccaca

SEQ ID NO: 726302 - RNA, 14 nt, Homo sapiens
uggggaggcccaaa

SEQ ID NO: 726303 - RNA, 17 nt, Homo sapiens
uggggaucgaugugcuc

SEQ ID NO: 726304 - RNA, 19 nt, Homo sapiens
uggggauuccacuaucuca

SEQ ID NO: 726305 - RNA, 16 nt, Homo sapiens
uggggcaaacagucua

SEQ ID NO: 726306 - RNA, 13 nt, Homo sapiens
uggggcccagugc

SEQ ID NO: 726307 - RNA, 18 nt, Homo sapiens
uggggcgagcacugugag

SEQ ID NO: 726308 - RNA, 21 nt, Homo sapiens
uggggcucagccacagccuga

SEQ ID NO: 726309 - RNA, 18 nt, Homo sapiens
uggggcugaucucaggga

SEQ ID NO: 726310 - RNA, 17 nt, Homo sapiens
uggggcugcuccccuaa

SEQ ID NO: 726311 - RNA, 20 nt, Homo sapiens
ugggggaaaaguuagucaau

SEQ ID NO: 726312 - RNA, 23 nt, Homo sapiens
ugggggaaaaguuagucaauccu

SEQ ID NO: 726313 - RNA, 19 nt, Homo sapiens
ugggggacgugggcauuuu

SEQ ID NO: 726314 - RNA, 19 nt, Homo sapiens
ugggggagggaagaccaga

SEQ ID NO: 726315 - RNA, 17 nt, Homo sapiens
ugggggauaagggaguc

SEQ ID NO: 726316 - RNA, 14 nt, Homo sapiens
ugggggauuucaaa

SEQ ID NO: 726317 - RNA, 23 nt, Homo sapiens
ugggggcuaagguuuccagucag

SEQ ID NO: 726318 - RNA, 16 nt, Homo sapiens
ugggggcuguccugcu

SEQ ID NO: 726319 - RNA, 17 nt, Homo sapiens
ugggggcuguccugcuc

SEQ ID NO: 726320 - RNA, 17 nt, Homo sapiens
ugggggguuuucuugcc

SEQ ID NO: 726321 - RNA, 14 nt, Homo sapiens
ugggggugaagucu

SEQ ID NO: 726322 - RNA, 18 nt, Homo sapiens
ugggggugcucucucuga

SEQ ID NO: 726323 - RNA, 20 nt, Homo sapiens
ugggggugcucucucugagg

SEQ ID NO: 726324 - RNA, 20 nt, Homo sapiens
ugggggugcugcucucuccg

SEQ ID NO: 726325 - RNA, 12 nt, Homo sapiens
uggggucacuca

SEQ ID NO: 726326 - RNA, 18 nt, Homo sapiens
ugggguccuccugugcua

SEQ ID NO: 726327 - RNA, 19 nt, Homo sapiens
ugggguccuccugugcuau

SEQ ID NO: 726328 - RNA, 21 nt, Homo sapiens
uggggucuuugugguagcuua

SEQ ID NO: 726329 - RNA, 15 nt, Homo sapiens
uggggucuuuuuaug

SEQ ID NO: 726330 - RNA, 21 nt, Homo sapiens
uggggucuuuuuaugcauuug

SEQ ID NO: 726331 - RNA, 19 nt, Homo sapiens
ugggguugcaaccacugca

SEQ ID NO: 726332 - RNA, 19 nt, Homo sapiens
uggguaagaagaaagcaaa

SEQ ID NO: 726333 - RNA, 18 nt, Homo sapiens
uggguagucauucuuaca

SEQ ID NO: 726334 - RNA, 16 nt, Homo sapiens
uggguauuuguucaaa

SEQ ID NO: 726335 - RNA, 22 nt, Homo sapiens
ugggucaaagugguacaggaag

SEQ ID NO: 726336 - RNA, 15 nt, Homo sapiens
ugggucacauccauc

SEQ ID NO: 726337 - RNA, 16 nt, Homo sapiens
ugggucacauccaucc

SEQ ID NO: 726338 - RNA, 19 nt, Homo sapiens
ugggucacucauuaaugaa

SEQ ID NO: 726339 - RNA, 19 nt, Homo sapiens
ugggucagagcuaaacucc

SEQ ID NO: 726340 - RNA, 21 nt, Homo sapiens
ugggucccagauuggcucaca

SEQ ID NO: 726341 - RNA, 23 nt, Homo sapiens
uggguccuggccuugugucacug

SEQ ID NO: 726342 - RNA, 20 nt, Homo sapiens
ugggucucugggcugucagc

SEQ ID NO: 726343 - RNA, 22 nt, Homo sapiens
ugggucugggagucacacagug

SEQ ID NO: 726344 - RNA, 21 nt, Homo sapiens
ugggucuucccuguaugauuc

SEQ ID NO: 726345 - RNA, 11 nt, Homo sapiens
ugggucuugcc

SEQ ID NO: 726346 - RNA, 21 nt, Homo sapiens
ugggugcaggaaagguucaca

SEQ ID NO: 726347 - RNA, 20 nt, Homo sapiens
uggguggggcugcuccucca

SEQ ID NO: 726348 - RNA, 14 nt, Homo sapiens
ugggugugggacac

SEQ ID NO: 726349 - RNA, 21 nt, Homo sapiens
uggguguuucaguuugaaaau

SEQ ID NO: 726350 - RNA, 13 nt, Homo sapiens
uggguuauuucaa

SEQ ID NO: 726351 - RNA, 22 nt, Homo sapiens
uggguugacuccugagcauauu

SEQ ID NO: 726352 - RNA, 17 nt, Homo sapiens
uggguuguguguuuauu

SEQ ID NO: 726353 - RNA, 18 nt, Homo sapiens
ugguaaaaccccaucucu

SEQ ID NO: 726354 - RNA, 18 nt, Homo sapiens
ugguaaagccucauuuga

SEQ ID NO: 726355 - RNA, 14 nt, Homo sapiens
ugguaaaugaucac

SEQ ID NO: 726356 - RNA, 23 nt, Homo sapiens
ugguaacuuuuuuuuaaagcuca

SEQ ID NO: 726357 - RNA, 16 nt, Homo sapiens
ugguaaggccucugga

SEQ ID NO: 726358 - RNA, 19 nt, Homo sapiens
ugguaauaaguacugugua

SEQ ID NO: 726359 - RNA, 21 nt, Homo sapiens
ugguaauauaguuauugcaca

SEQ ID NO: 726360 - RNA, 16 nt, Homo sapiens
ugguacacaguucugg

SEQ ID NO: 726361 - RNA, 21 nt, Homo sapiens
ugguacugacuuugcuugcuu

SEQ ID NO: 726362 - RNA, 18 nt, Homo sapiens
ugguacuuuuaugaugua

SEQ ID NO: 726363 - RNA, 22 nt, Homo sapiens
cuaugauguuucuuuugcaauu

SEQ ID NO: 726364 - RNA, 20 nt, Homo sapiens
cuaugcaaaauagacaucuu

SEQ ID NO: 726365 - RNA, 22 nt, Homo sapiens
cuaugcaaacaaaauccaagau

SEQ ID NO: 726366 - RNA, 14 nt, Homo sapiens
cuaugcaaucugag

SEQ ID NO: 726367 - RNA, 15 nt, Homo sapiens
cuaugcagaggccug

SEQ ID NO: 726368 - RNA, 18 nt, Homo sapiens
cuaugcauuaagaguaaa

SEQ ID NO: 726369 - RNA, 18 nt, Homo sapiens
cuaugccacccugcaaua

SEQ ID NO: 726370 - RNA, 19 nt, Homo sapiens
cuauggauuugaaguuugc

SEQ ID NO: 726371 - RNA, 14 nt, Homo sapiens
cuauggccagucug

SEQ ID NO: 726372 - RNA, 17 nt, Homo sapiens
cuauggcugccugcauc

SEQ ID NO: 726373 - RNA, 21 nt, Homo sapiens
cuaugggaacaauugaaguaa

SEQ ID NO: 726374 - RNA, 23 nt, Homo sapiens
cuauggucagguuauacuccucc

SEQ ID NO: 726375 - RNA, 11 nt, Homo sapiens
cuaugguucuc

SEQ ID NO: 726376 - RNA, 18 nt, Homo sapiens
cuauguaaacaaaccaca

SEQ ID NO: 726377 - RNA, 22 nt, Homo sapiens
cuauguauggaauacaguguua

SEQ ID NO: 726378 - RNA, 20 nt, Homo sapiens
cuauguggcugaaaaugcaa

SEQ ID NO: 726379 - RNA, 14 nt, Homo sapiens
cuauguuacuauuu

SEQ ID NO: 726380 - RNA, 15 nt, Homo sapiens
cuauguucaaagacu

SEQ ID NO: 726381 - RNA, 11 nt, Homo sapiens
cuauguucccc

SEQ ID NO: 726382 - RNA, 14 nt, Homo sapiens
cuauguuuauuuac

SEQ ID NO: 726383 - RNA, 17 nt, Homo sapiens
cuauguuuggaguuuaa

SEQ ID NO: 726384 - RNA, 21 nt, Homo sapiens
cuauguuuggcuucaguguuu

SEQ ID NO: 726385 - RNA, 19 nt, Homo sapiens
cuauuaaaugagcacguuu

SEQ ID NO: 726386 - RNA, 18 nt, Homo sapiens
cuauuaagaaaaucacau

SEQ ID NO: 726387 - RNA, 20 nt, Homo sapiens
cuauuaaucaccucucugua

SEQ ID NO: 726388 - RNA, 17 nt, Homo sapiens
cuauuauacuguauuaa

SEQ ID NO: 726389 - RNA, 20 nt, Homo sapiens
cuauuauagcaacuuuaaga

SEQ ID NO: 726390 - RNA, 13 nt, Homo sapiens
cuauuaucucaau

SEQ ID NO: 726391 - RNA, 10 nt, Homo sapiens
uguacugcaa

SEQ ID NO: 726392 - RNA, 21 nt, Homo sapiens
uguacuguaauagugugauua

SEQ ID NO: 726393 - RNA, 16 nt, Homo sapiens
uguacuucacugucag

SEQ ID NO: 726394 - RNA, 15 nt, Homo sapiens
uguagaaacacauaa

SEQ ID NO: 726395 - RNA, 14 nt, Homo sapiens
uguagaacugagaa

SEQ ID NO: 726396 - RNA, 20 nt, Homo sapiens
uguagaaucucuucaugcuu

SEQ ID NO: 726397 - RNA, 15 nt, Homo sapiens
uguagaaugauuuca

SEQ ID NO: 726398 - RNA, 20 nt, Homo sapiens
uguagacugaauucagcacc

SEQ ID NO: 726399 - RNA, 12 nt, Homo sapiens
uguagacugugu

SEQ ID NO: 726400 - RNA, 22 nt, Homo sapiens
uguagagacgaggucuugugau

SEQ ID NO: 726401 - RNA, 22 nt, Homo sapiens
uguagagacgguguuuugccau

SEQ ID NO: 726402 - RNA, 21 nt, Homo sapiens
uguagaguuuugucauucaga

SEQ ID NO: 726403 - RNA, 17 nt, Homo sapiens
uguagauaaacucagaa

SEQ ID NO: 726404 - RNA, 22 nt, Homo sapiens
uguagaugggggaacugugaau

SEQ ID NO: 726405 - RNA, 19 nt, Homo sapiens
uguagauuuucuacaggaa

SEQ ID NO: 726406 - RNA, 16 nt, Homo sapiens
uguagcaagaacugca

SEQ ID NO: 726407 - RNA, 15 nt, Homo sapiens
uguagcaauauauca

SEQ ID NO: 726408 - RNA, 15 nt, Homo sapiens
uguagcagucacuga

SEQ ID NO: 726409 - RNA, 17 nt, Homo sapiens
uguagcaucugagaagg

SEQ ID NO: 726410 - RNA, 15 nt, Homo sapiens
uguagcauuucuuga

SEQ ID NO: 726411 - RNA, 23 nt, Homo sapiens
uguagcccaggccagagugcagu

SEQ ID NO: 726412 - RNA, 15 nt, Homo sapiens
uguagcugugucaug

SEQ ID NO: 726413 - RNA, 22 nt, Homo sapiens
uguaggaagucauccugccaac

SEQ ID NO: 726414 - RNA, 13 nt, Homo sapiens
uguaggagcugga

SEQ ID NO: 726415 - RNA, 15 nt, Homo sapiens
uguagguaauauugu

SEQ ID NO: 726416 - RNA, 16 nt, Homo sapiens
uguaguaaacuauuua

SEQ ID NO: 726417 - RNA, 22 nt, Homo sapiens
uguagucccagcuacucaggag

SEQ ID NO: 726418 - RNA, 13 nt, Homo sapiens
uguagucucagcu

SEQ ID NO: 726419 - RNA, 13 nt, Homo sapiens
uguagucucagga

SEQ ID NO: 726420 - RNA, 14 nt, Homo sapiens
uguagucucaggac

SEQ ID NO: 726421 - RNA, 22 nt, Homo sapiens
uguagucuuuuuauagguuuua

SEQ ID NO: 726422 - RNA, 14 nt, Homo sapiens
uguaguuacugugg

SEQ ID NO: 726423 - RNA, 19 nt, Homo sapiens
uguaguuggggcaccauac

SEQ ID NO: 726424 - RNA, 18 nt, Homo sapiens
uguauaaaaugcuacuua

SEQ ID NO: 726425 - RNA, 14 nt, Homo sapiens
uguauaaaauguac

SEQ ID NO: 726426 - RNA, 16 nt, Homo sapiens
uguauagcuuaccuga

SEQ ID NO: 726427 - RNA, 11 nt, Homo sapiens
uguauaguguu

SEQ ID NO: 726428 - RNA, 15 nt, Homo sapiens
uguauaguguucaca

SEQ ID NO: 726429 - RNA, 18 nt, Homo sapiens
uguauaguugcuugccug

SEQ ID NO: 726430 - RNA, 22 nt, Homo sapiens
uguauauauuauuauaaucuua

SEQ ID NO: 726431 - RNA, 20 nt, Homo sapiens
uguauaugcauucuuuucag

SEQ ID NO: 726432 - RNA, 14 nt, Homo sapiens
uguauauguauuau

SEQ ID NO: 726433 - RNA, 12 nt, Homo sapiens
uguauauuacau

SEQ ID NO: 726434 - RNA, 17 nt, Homo sapiens
uguauauuuguacaaaa

SEQ ID NO: 726435 - RNA, 17 nt, Homo sapiens
uguaucaagucauggca

SEQ ID NO: 726436 - RNA, 16 nt, Homo sapiens
uguaucaguguccuuu

SEQ ID NO: 726437 - RNA, 17 nt, Homo sapiens
uguaucauuugaacaac

SEQ ID NO: 726438 - RNA, 18 nt, Homo sapiens
uguaucggagacagugau

SEQ ID NO: 726439 - RNA, 22 nt, Homo sapiens
uguaucuuucuuucucuaaugu

SEQ ID NO: 726440 - RNA, 12 nt, Homo sapiens
uguaugcacuuu

SEQ ID NO: 726441 - RNA, 16 nt, Homo sapiens
uguaugccaagugaga

SEQ ID NO: 726442 - RNA, 17 nt, Homo sapiens
uguaugccucugagcag

SEQ ID NO: 726443 - RNA, 20 nt, Homo sapiens
uguauggugauaaaagucac

SEQ ID NO: 726444 - RNA, 15 nt, Homo sapiens
uguauguuugcugau

SEQ ID NO: 726445 - RNA, 23 nt, Homo sapiens
uguauuaauguguuaagugcagg

SEQ ID NO: 726446 - RNA, 18 nt, Homo sapiens
uguauuacaaauggugaa

SEQ ID NO: 726447 - RNA, 21 nt, Homo sapiens
uguauuagagcgccagcuccu

SEQ ID NO: 726448 - RNA, 18 nt, Homo sapiens
uguauuaguuuuugauca

SEQ ID NO: 726449 - RNA, 14 nt, Homo sapiens
uguauuaugagcca

SEQ ID NO: 726450 - RNA, 15 nt, Homo sapiens
uguauucaccaccaa

SEQ ID NO: 726451 - RNA, 16 nt, Homo sapiens
uguauucccuuguauu

SEQ ID NO: 726452 - RNA, 15 nt, Homo sapiens
uguauucgugcauuu

SEQ ID NO: 726453 - RNA, 17 nt, Homo sapiens
uguauugaaaacacuua

SEQ ID NO: 726454 - RNA, 23 nt, Homo sapiens
uguauuggcgcaccaagaucucc

SEQ ID NO: 726455 - RNA, 18 nt, Homo sapiens
uguauuguuaaugcauca

SEQ ID NO: 726456 - RNA, 19 nt, Homo sapiens
uguauuuaauaaguacaac

SEQ ID NO: 726457 - RNA, 20 nt, Homo sapiens
uguauuuaccuucuaccucu

SEQ ID NO: 726458 - RNA, 22 nt, Homo sapiens
uguauuuauccaauaaauguga

SEQ ID NO: 726459 - RNA, 17 nt, Homo sapiens
uguauuuccagugcaau

SEQ ID NO: 726460 - RNA, 17 nt, Homo sapiens
uguauuuugugaugaau

SEQ ID NO: 726461 - RNA, 18 nt, Homo sapiens
uguauuuuucaaggcauu

SEQ ID NO: 726462 - RNA, 23 nt, Homo sapiens
uguauuuuugugaaguauucaca

SEQ ID NO: 726463 - RNA, 15 nt, Homo sapiens
ugucaaaacaagacu

SEQ ID NO: 726464 - RNA, 15 nt, Homo sapiens
ugucaaaagccagau

SEQ ID NO: 726465 - RNA, 17 nt, Homo sapiens
ugucaaagaaggugcug

SEQ ID NO: 726466 - RNA, 14 nt, Homo sapiens
ugucaaagacugua

SEQ ID NO: 726467 - RNA, 14 nt, Homo sapiens
ugucaaaugcagua

SEQ ID NO: 726468 - RNA, 11 nt, Homo sapiens
ugucaauguuu

SEQ ID NO: 726469 - RNA, 15 nt, Homo sapiens
ugucacacaaaaagu

SEQ ID NO: 726470 - RNA, 20 nt, Homo sapiens
ugucacagaagcagcuaaac

SEQ ID NO: 726471 - RNA, 20 nt, Homo sapiens
ugucacagaugaagacauca

SEQ ID NO: 726472 - RNA, 19 nt, Homo sapiens
ugucacauagagugaucuu

SEQ ID NO: 726473 - RNA, 14 nt, Homo sapiens
ugucaccaugccca

SEQ ID NO: 726474 - RNA, 15 nt, Homo sapiens
ugucacccauuggug

SEQ ID NO: 726475 - RNA, 19 nt, Homo sapiens
ugucaccucagcugauauu

SEQ ID NO: 726476 - RNA, 20 nt, Homo sapiens
ugucaccucagcugauauua

SEQ ID NO: 726477 - RNA, 19 nt, Homo sapiens
ugucacuacgugacugugg

SEQ ID NO: 726478 - RNA, 18 nt, Homo sapiens
ugucacucguaggggaug

SEQ ID NO: 726479 - RNA, 22 nt, Homo sapiens
ugucacucuguaguuacugugg

SEQ ID NO: 726480 - RNA, 22 nt, Homo sapiens
cuccacugcuggacaugagaug

SEQ ID NO: 726481 - RNA, 13 nt, Homo sapiens
cuccacugugcac

SEQ ID NO: 726482 - RNA, 17 nt, Homo sapiens
cuccacuugaagcacuu

SEQ ID NO: 726483 - RNA, 18 nt, Homo sapiens
cuccacuugaagcacuua

SEQ ID NO: 726484 - RNA, 17 nt, Homo sapiens
cuccagaaucugcuguu

SEQ ID NO: 726485 - RNA, 17 nt, Homo sapiens
cuccagaccugauccug

SEQ ID NO: 726486 - RNA, 17 nt, Homo sapiens
cuccagagacagggaaa

SEQ ID NO: 726487 - RNA, 17 nt, Homo sapiens
cuccagaggaugacugg

SEQ ID NO: 726488 - RNA, 20 nt, Homo sapiens
cuccagauaguguagcugag

SEQ ID NO: 726489 - RNA, 14 nt, Homo sapiens
cuccagauucugau

SEQ ID NO: 726490 - RNA, 22 nt, Homo sapiens
cuccagcccagacccaguggac

SEQ ID NO: 726491 - RNA, 23 nt, Homo sapiens
cuccagccucccugucuccagcu

SEQ ID NO: 726492 - RNA, 15 nt, Homo sapiens
cuccagccugaguga

SEQ ID NO: 726493 - RNA, 18 nt, Homo sapiens
cuccagcuucgaugaugu

SEQ ID NO: 726494 - RNA, 15 nt, Homo sapiens
cuccaggaaugaucu

SEQ ID NO: 726495 - RNA, 19 nt, Homo sapiens
cuccaggccaugauggccu

SEQ ID NO: 726496 - RNA, 16 nt, Homo sapiens
cuccaggcccaucuca

SEQ ID NO: 726497 - RNA, 12 nt, Homo sapiens
cuccaggcuuuc

SEQ ID NO: 726498 - RNA, 18 nt, Homo sapiens
cuccagucuggcaacaga

SEQ ID NO: 726499 - RNA, 23 nt, Homo sapiens
cuccagugaguaccugcaaaaau

SEQ ID NO: 726500 - RNA, 19 nt, Homo sapiens
cuccaguggcagacaaaca

SEQ ID NO: 726501 - RNA, 20 nt, Homo sapiens
cuccauaaacagacuguuaa

SEQ ID NO: 726502 - RNA, 22 nt, Homo sapiens
cuccauagauccccccacugag

SEQ ID NO: 726503 - RNA, 22 nt, Homo sapiens
cuccauaucccuuccucucagg

SEQ ID NO: 726504 - RNA, 14 nt, Homo sapiens
cuccauaucugauu

SEQ ID NO: 726505 - RNA, 18 nt, Homo sapiens
cuccaucccaacagccau

SEQ ID NO: 726506 - RNA, 23 nt, Homo sapiens
ugugauugcugccaggcacuguu

SEQ ID NO: 726507 - RNA, 17 nt, Homo sapiens
ugugcaagggcagugaa

SEQ ID NO: 726508 - RNA, 10 nt, Homo sapiens
ugugcacauc

SEQ ID NO: 726509 - RNA, 20 nt, Homo sapiens
ugugcaccccuccccauuca

SEQ ID NO: 726510 - RNA, 16 nt, Homo sapiens
ugugcacgagugggaa

SEQ ID NO: 726511 - RNA, 13 nt, Homo sapiens
ugugcaguacuua

SEQ ID NO: 726512 - RNA, 21 nt, Homo sapiens
ugugcaguguugacaguucau

SEQ ID NO: 726513 - RNA, 15 nt, Homo sapiens
ugugcaucaguggga

SEQ ID NO: 726514 - RNA, 19 nt, Homo sapiens
ugugcauucaugcaagagu

SEQ ID NO: 726515 - RNA, 13 nt, Homo sapiens
ugugccaaccugu

SEQ ID NO: 726516 - RNA, 19 nt, Homo sapiens
ugugccaguucuuuccaua

SEQ ID NO: 726517 - RNA, 15 nt, Homo sapiens
ugugccuacauuuaa

SEQ ID NO: 726518 - RNA, 16 nt, Homo sapiens
ugugccugcacugaga

SEQ ID NO: 726519 - RNA, 23 nt, Homo sapiens
ugugccugugguuaacaucucag

SEQ ID NO: 726520 - RNA, 16 nt, Homo sapiens
ugugccuugggucuca

SEQ ID NO: 726521 - RNA, 16 nt, Homo sapiens
ugugcggagucauuuu

SEQ ID NO: 726522 - RNA, 20 nt, Homo sapiens
ugugcucuggcaccaucagc

SEQ ID NO: 726523 - RNA, 22 nt, Homo sapiens
ugugcugauaggguaaggggag

SEQ ID NO: 726524 - RNA, 16 nt, Homo sapiens
ugugcugauccugcug

SEQ ID NO: 726525 - RNA, 18 nt, Homo sapiens
ugugcuggucauggaaug

SEQ ID NO: 726526 - RNA, 14 nt, Homo sapiens
ugugcuuacaguaa

SEQ ID NO: 726527 - RNA, 16 nt, Homo sapiens
ugugcuucauuccaau

SEQ ID NO: 726528 - RNA, 14 nt, Homo sapiens
uguggaaaauggag

SEQ ID NO: 726529 - RNA, 16 nt, Homo sapiens
uguggaaaugcuuaaa

SEQ ID NO: 726530 - RNA, 15 nt, Homo sapiens
uguggaagagcauua

SEQ ID NO: 726531 - RNA, 13 nt, Homo sapiens
uguggacugugau

SEQ ID NO: 726532 - RNA, 16 nt, Homo sapiens
uguggaggauugcuau

SEQ ID NO: 726533 - RNA, 12 nt, Homo sapiens
uguggagugucu

SEQ ID NO: 726534 - RNA, 17 nt, Homo sapiens
uguggauggucauugca

SEQ ID NO: 726535 - RNA, 15 nt, Homo sapiens
uguggcaaugggauu

SEQ ID NO: 726536 - RNA, 15 nt, Homo sapiens
uguggcaucuugcca

SEQ ID NO: 726537 - RNA, 14 nt, Homo sapiens
uguggccacagccc

SEQ ID NO: 726538 - RNA, 14 nt, Homo sapiens
uguggcccaagaca

SEQ ID NO: 726539 - RNA, 23 nt, Homo sapiens
uguggcccucuggauccagccau

SEQ ID NO: 726540 - RNA, 20 nt, Homo sapiens
uguggccgccaccugaggug

SEQ ID NO: 726541 - RNA, 14 nt, Homo sapiens
uguggcugcaucuu

SEQ ID NO: 726542 - RNA, 18 nt, Homo sapiens
uguggcuggaagauccug

SEQ ID NO: 726543 - RNA, 18 nt, Homo sapiens
uguggggaagaguggucu

SEQ ID NO: 726544 - RNA, 21 nt, Homo sapiens
ugugggucccgcacucugccc

SEQ ID NO: 726545 - RNA, 20 nt, Homo sapiens
ugugguacugucauugauaa

SEQ ID NO: 726546 - RNA, 20 nt, Homo sapiens
ugugguagcgccauggcugu

SEQ ID NO: 726547 - RNA, 21 nt, Homo sapiens
ugugguaggcacuguacuuaa

SEQ ID NO: 726548 - RNA, 23 nt, Homo sapiens
ugugguaguuggaaacaaaucau

SEQ ID NO: 726549 - RNA, 19 nt, Homo sapiens
uguggucacagccaugaag

SEQ ID NO: 726550 - RNA, 19 nt, Homo sapiens
uguggucugggcaccaccu

SEQ ID NO: 726551 - RNA, 12 nt, Homo sapiens
uguggugcuaca

SEQ ID NO: 726552 - RNA, 17 nt, Homo sapiens
ugugguuaacaucucag

SEQ ID NO: 726553 - RNA, 16 nt, Homo sapiens
ugugguuauguuccca

SEQ ID NO: 726554 - RNA, 19 nt, Homo sapiens
ugugguuccaugcagccuu

SEQ ID NO: 726555 - RNA, 14 nt, Homo sapiens
ugugguuugucaga

SEQ ID NO: 726556 - RNA, 15 nt, Homo sapiens
uguguaaauuucuca

SEQ ID NO: 726557 - RNA, 22 nt, Homo sapiens
uguguaacuguaaaacauugaa

SEQ ID NO: 726558 - RNA, 15 nt, Homo sapiens
uguguaauacuucau

SEQ ID NO: 726559 - RNA, 12 nt, Homo sapiens
uguguacccugg

SEQ ID NO: 726560 - RNA, 11 nt, Homo sapiens
uguguauauau

SEQ ID NO: 726561 - RNA, 21 nt, Homo sapiens
uguguauuccacuuaggaaga

SEQ ID NO: 726562 - RNA, 23 nt, Homo sapiens
uguguccacugcaauugguggua

SEQ ID NO: 726563 - RNA, 14 nt, Homo sapiens
uguguccagaguuu

SEQ ID NO: 726564 - RNA, 17 nt, Homo sapiens
ugugucccacccaugca

SEQ ID NO: 726565 - RNA, 14 nt, Homo sapiens
ugugucccaugacc

SEQ ID NO: 726566 - RNA, 17 nt, Homo sapiens
ugugucccccccagugc

SEQ ID NO: 726567 - RNA, 18 nt, Homo sapiens
uguguccugaaacgcucc

SEQ ID NO: 726568 - RNA, 19 nt, Homo sapiens
ugugucucugcauguguaa

SEQ ID NO: 726569 - RNA, 11 nt, Homo sapiens
ugugucugcug

SEQ ID NO: 726570 - RNA, 21 nt, Homo sapiens
ugugugagcuaugcaaacaaa

SEQ ID NO: 726571 - RNA, 21 nt, Homo sapiens
ugugugcauggaacaaauaau

SEQ ID NO: 726572 - RNA, 11 nt, Homo sapiens
ugugugccuuu

SEQ ID NO: 726573 - RNA, 14 nt, Homo sapiens
uguguggacuguga

SEQ ID NO: 726574 - RNA, 15 nt, Homo sapiens
uguguggccugccuu

SEQ ID NO: 726575 - RNA, 12 nt, Homo sapiens
ugugugugcaag

SEQ ID NO: 726576 - RNA, 12 nt, Homo sapiens
ugugugugcaug

SEQ ID NO: 726577 - RNA, 16 nt, Homo sapiens
ugugugugugcacauc

SEQ ID NO: 726578 - RNA, 16 nt, Homo sapiens
ugugugugugugcaca

SEQ ID NO: 726579 - RNA, 17 nt, Homo sapiens
uguguguucaccuucaa

SEQ ID NO: 726580 - RNA, 15 nt, Homo sapiens
uguguuaagugcagg

SEQ ID NO: 726581 - RNA, 10 nt, Homo sapiens
uguguucaag

SEQ ID NO: 726582 - RNA, 18 nt, Homo sapiens
uguguucugucaccaacu

SEQ ID NO: 726583 - RNA, 13 nt, Homo sapiens
uguguugcaugca

SEQ ID NO: 726584 - RNA, 15 nt, Homo sapiens
uguguuggcacaugc

SEQ ID NO: 726585 - RNA, 18 nt, Homo sapiens
uguguuuugaaagcccaa

SEQ ID NO: 726586 - RNA, 14 nt, Homo sapiens
uguguuuuucacau

SEQ ID NO: 726587 - RNA, 18 nt, Homo sapiens
uguguuuuuuaggacgau

SEQ ID NO: 726588 - RNA, 13 nt, Homo sapiens
uguuaaaauaacu

SEQ ID NO: 726589 - RNA, 23 nt, Homo sapiens
uguuaaagcuggaacauuugaua

SEQ ID NO: 726590 - RNA, 13 nt, Homo sapiens
uguuaacacucau

SEQ ID NO: 726591 - RNA, 19 nt, Homo sapiens
uguuaacauuccaagacuc

SEQ ID NO: 726592 - RNA, 21 nt, Homo sapiens
uguuaacuuuuguaccaaaua

SEQ ID NO: 726593 - RNA, 13 nt, Homo sapiens
uguuaagcauuua

SEQ ID NO: 726594 - RNA, 21 nt, Homo sapiens
uguuaaguccuuggcuugcca

SEQ ID NO: 726595 - RNA, 13 nt, Homo sapiens
uguuaagugcagg

SEQ ID NO: 726596 - RNA, 21 nt, Homo sapiens
uguuaaguuacaguuugcaca

SEQ ID NO: 726597 - RNA, 19 nt, Homo sapiens
cucugaagucacaucacag

SEQ ID NO: 726598 - RNA, 21 nt, Homo sapiens
cucugaauaaauacccauuga

SEQ ID NO: 726599 - RNA, 21 nt, Homo sapiens
cucugacaagggcugaccugc

SEQ ID NO: 726600 - RNA, 14 nt, Homo sapiens
cucugaccagagau

SEQ ID NO: 726601 - RNA, 16 nt, Homo sapiens
cucugacccuagcucu

SEQ ID NO: 726602 - RNA, 17 nt, Homo sapiens
cucugaccugcacuggg

SEQ ID NO: 726603 - RNA, 17 nt, Homo sapiens
cucugacguugauccca

SEQ ID NO: 726604 - RNA, 21 nt, Homo sapiens
cucugacguugaucccagaga

SEQ ID NO: 726605 - RNA, 23 nt, Homo sapiens
cucugagccaaccuuaaaccucu

SEQ ID NO: 726606 - RNA, 17 nt, Homo sapiens
cucugaggccucacuac

SEQ ID NO: 726607 - RNA, 22 nt, Homo sapiens
cucugaggggaggcaccuccag

SEQ ID NO: 726608 - RNA, 16 nt, Homo sapiens
cucugauaugggacug

SEQ ID NO: 726609 - RNA, 17 nt, Homo sapiens
cucugauggcugcucca

SEQ ID NO: 726610 - RNA, 18 nt, Homo sapiens
cucugauucuacagugau

SEQ ID NO: 726611 - RNA, 21 nt, Homo sapiens
cucugcaagacagaaaccucc

SEQ ID NO: 726612 - RNA, 20 nt, Homo sapiens
cucugcacaugucuuguaca

SEQ ID NO: 726613 - RNA, 16 nt, Homo sapiens
cucugcagacuuccca

SEQ ID NO: 726614 - RNA, 20 nt, Homo sapiens
cucugcagacuucccagcua

SEQ ID NO: 726615 - RNA, 17 nt, Homo sapiens
cucugcagcccucagau

SEQ ID NO: 726616 - RNA, 20 nt, Homo sapiens
cucugcagcccucagauuau

SEQ ID NO: 726617 - RNA, 18 nt, Homo sapiens
cucugcauggaacagcau

SEQ ID NO: 726618 - RNA, 14 nt, Homo sapiens
cucugcauguuaca

SEQ ID NO: 726619 - RNA, 19 nt, Homo sapiens
cucugcccuuuuuaauuaa

SEQ ID NO: 726620 - RNA, 16 nt, Homo sapiens
cucugccgguccccca

SEQ ID NO: 726621 - RNA, 23 nt, Homo sapiens
uuauguggaaaacagaacaucau

SEQ ID NO: 726622 - RNA, 11 nt, Homo sapiens
uuauguuccca

SEQ ID NO: 726623 - RNA, 12 nt, Homo sapiens
uuauguuccuca

SEQ ID NO: 726624 - RNA, 22 nt, Homo sapiens
uuauuaaagcauuuccuaccag

SEQ ID NO: 726625 - RNA, 19 nt, Homo sapiens
uuauuaagcacguauuuau

SEQ ID NO: 726626 - RNA, 14 nt, Homo sapiens
uuauuaaugacaaa

SEQ ID NO: 726627 - RNA, 18 nt, Homo sapiens
uuauuaccccacacaucc

SEQ ID NO: 726628 - RNA, 12 nt, Homo sapiens
uuauuaccucug

SEQ ID NO: 726629 - RNA, 15 nt, Homo sapiens
uuauuagaagccaag

SEQ ID NO: 726630 - RNA, 13 nt, Homo sapiens
uuauuauuugaca

SEQ ID NO: 726631 - RNA, 17 nt, Homo sapiens
uuauucaagugccucuu

SEQ ID NO: 726632 - RNA, 17 nt, Homo sapiens
uuauuccuccugcucau

SEQ ID NO: 726633 - RNA, 12 nt, Homo sapiens
uuauucuaaggu

SEQ ID NO: 726634 - RNA, 23 nt, Homo sapiens
uuauucuaauaaauauacuauga

SEQ ID NO: 726635 - RNA, 20 nt, Homo sapiens
uuauucuacaucauuaacca

SEQ ID NO: 726636 - RNA, 15 nt, Homo sapiens
uuauucugauuccac

SEQ ID NO: 726637 - RNA, 14 nt, Homo sapiens
uuauucugccuucc

SEQ ID NO: 726638 - RNA, 21 nt, Homo sapiens
uuauucuguuuugcacaguua

SEQ ID NO: 726639 - RNA, 13 nt, Homo sapiens
uuauugagauuca

SEQ ID NO: 726640 - RNA, 17 nt, Homo sapiens
uuauugauucacuuacu

SEQ ID NO: 726641 - RNA, 21 nt, Homo sapiens
uuauugcaaaguuguauucag

SEQ ID NO: 726642 - RNA, 23 nt, Homo sapiens
uuauugccucugaaaugccucuu

SEQ ID NO: 726643 - RNA, 15 nt, Homo sapiens
uuauugcgcugcuac

SEQ ID NO: 726644 - RNA, 17 nt, Homo sapiens
uuauuguuguacauacg

SEQ ID NO: 726645 - RNA, 14 nt, Homo sapiens
uuauuuaaagaaga

SEQ ID NO: 726646 - RNA, 14 nt, Homo sapiens
uuauuucugaucua

SEQ ID NO: 726647 - RNA, 22 nt, Homo sapiens
uuauuugcacagggagaauuga

SEQ ID NO: 726648 - RNA, 23 nt, Homo sapiens
uuauuugcuaccacagcaacuau

SEQ ID NO: 726649 - RNA, 16 nt, Homo sapiens
uuauuuugaaaauaau

SEQ ID NO: 726650 - RNA, 18 nt, Homo sapiens
uuauuuuggaacuaugaa

SEQ ID NO: 726651 - RNA, 13 nt, Homo sapiens
uuauuuuguugaa

SEQ ID NO: 726652 - RNA, 19 nt, Homo sapiens
uuauuuuuauaucagccug

SEQ ID NO: 726653 - RNA, 19 nt, Homo sapiens
uuauuuuuguuagcaaaga

SEQ ID NO: 726654 - RNA, 16 nt, Homo sapiens
uucaaaaaaaaaagca

SEQ ID NO: 726655 - RNA, 18 nt, Homo sapiens
uucaaaaccugcaguuaa

SEQ ID NO: 726656 - RNA, 16 nt, Homo sapiens
uucaaaacugccauua

SEQ ID NO: 726657 - RNA, 18 nt, Homo sapiens
uucaaaagguuauauacc

SEQ ID NO: 726658 - RNA, 22 nt, Homo sapiens
uucaaaauacagauuugaauag

SEQ ID NO: 726659 - RNA, 12 nt, Homo sapiens
uucaaaauaugu

SEQ ID NO: 726660 - RNA, 13 nt, Homo sapiens
uucaaacauauau

SEQ ID NO: 726661 - RNA, 18 nt, Homo sapiens
uucaaacugcaugauuca

SEQ ID NO: 726662 - RNA, 16 nt, Homo sapiens
uucaaagaaguacuuu

SEQ ID NO: 726663 - RNA, 17 nt, Homo sapiens
uucaaagagacauauac

SEQ ID NO: 726664 - RNA, 13 nt, Homo sapiens
uucaaagcacaga

SEQ ID NO: 726665 - RNA, 18 nt, Homo sapiens
uucaaaguuaaaagcaaa

SEQ ID NO: 726666 - RNA, 23 nt, Homo sapiens
uucaaaucuacgguuaugaaggc

SEQ ID NO: 726667 - RNA, 20 nt, Homo sapiens
uucaaauucuucugaacuca

SEQ ID NO: 726668 - RNA, 19 nt, Homo sapiens
uucaaauuuuuacugagaa

SEQ ID NO: 726669 - RNA, 13 nt, Homo sapiens
uucaacaauuuca

SEQ ID NO: 726670 - RNA, 16 nt, Homo sapiens
uucaacagcucaccaa

SEQ ID NO: 726671 - RNA, 16 nt, Homo sapiens
uucaacagggaagaaa

SEQ ID NO: 726672 - RNA, 19 nt, Homo sapiens
uucaacaguuuuugcuaau

SEQ ID NO: 726673 - RNA, 15 nt, Homo sapiens
uucaaccacuguaaa

SEQ ID NO: 726674 - RNA, 13 nt, Homo sapiens
uucaacccagugg

SEQ ID NO: 726675 - RNA, 13 nt, Homo sapiens
uucaacucugauc

SEQ ID NO: 726676 - RNA, 23 nt, Homo sapiens
uucaacuguauaguuuuauuuac

SEQ ID NO: 726677 - RNA, 14 nt, Homo sapiens
uucaagaauuuaau

SEQ ID NO: 726678 - RNA, 11 nt, Homo sapiens
uucaagacaga

SEQ ID NO: 726679 - RNA, 13 nt, Homo sapiens
uucaagacagaaa

SEQ ID NO: 726680 - RNA, 19 nt, Homo sapiens
uucaagagucuaaacccca

SEQ ID NO: 726681 - RNA, 15 nt, Homo sapiens
uucaagagugagcua

SEQ ID NO: 726682 - RNA, 17 nt, Homo sapiens
uucaagcacacuggaau

SEQ ID NO: 726683 - RNA, 18 nt, Homo sapiens
uucaagcuuucaaauccu

SEQ ID NO: 726684 - RNA, 14 nt, Homo sapiens
uucaaggaaaguga

SEQ ID NO: 726685 - RNA, 18 nt, Homo sapiens
uucaaggaacagccacaa

SEQ ID NO: 726686 - RNA, 21 nt, Homo sapiens
uucaaggaacagccacaaaau

SEQ ID NO: 726687 - RNA, 18 nt, Homo sapiens
uucaaggcaucaugcaga

SEQ ID NO: 726688 - RNA, 21 nt, Homo sapiens
uucaaggcauuucuaucacau

SEQ ID NO: 726689 - RNA, 14 nt, Homo sapiens
uucaagucagugag

SEQ ID NO: 726690 - RNA, 15 nt, Homo sapiens
uucaagugccaaaca

SEQ ID NO: 726691 - RNA, 12 nt, Homo sapiens
uucaagugccua

SEQ ID NO: 726692 - RNA, 18 nt, Homo sapiens
uucaaguuagcucaggag

SEQ ID NO: 726693 - RNA, 20 nt, Homo sapiens
uucaauauuuguuacuguua

SEQ ID NO: 726694 - RNA, 16 nt, Homo sapiens
uucaaucauaauaccu

SEQ ID NO: 726695 - RNA, 15 nt, Homo sapiens
uucaaugaccuguau

SEQ ID NO: 726696 - RNA, 22 nt, Homo sapiens
uucaaugauuauuuguauuuac

SEQ ID NO: 726697 - RNA, 21 nt, Homo sapiens
uucaaugcuagaacaacgccu

SEQ ID NO: 726698 - RNA, 18 nt, Homo sapiens
uucaaugggcucuuccaa

SEQ ID NO: 726699 - RNA, 13 nt, Homo sapiens
uucaaugugacac

SEQ ID NO: 726700 - RNA, 22 nt, Homo sapiens
uucaauuauacuaaaccucaca

SEQ ID NO: 726701 - RNA, 13 nt, Homo sapiens
uucacacuaugga

SEQ ID NO: 726702 - RNA, 11 nt, Homo sapiens
uucacacugca

SEQ ID NO: 726703 - RNA, 18 nt, Homo sapiens
uucacacuuccaccagcc

SEQ ID NO: 726704 - RNA, 19 nt, Homo sapiens
uucacagacugauuggaau

SEQ ID NO: 726705 - RNA, 13 nt, Homo sapiens
uucacagccuuuc

SEQ ID NO: 726706 - RNA, 20 nt, Homo sapiens
uucacaggcagugcauguga

SEQ ID NO: 726707 - RNA, 15 nt, Homo sapiens
uucacagucacugau

SEQ ID NO: 726708 - RNA, 21 nt, Homo sapiens
uucacauauuuguagcuagaa

SEQ ID NO: 726709 - RNA, 16 nt, Homo sapiens
uucacauuuguauuaa

SEQ ID NO: 726710 - RNA, 23 nt, Homo sapiens
uucaccaacaugcccacagauca

SEQ ID NO: 726711 - RNA, 16 nt, Homo sapiens
uucaccaagugcaaua

SEQ ID NO: 726712 - RNA, 13 nt, Homo sapiens
uucaccaccaaau

SEQ ID NO: 726713 - RNA, 14 nt, Homo sapiens
uucaccagagcauu

SEQ ID NO: 726714 - RNA, 19 nt, Homo sapiens
cuggauccagcacugguga

SEQ ID NO: 726715 - RNA, 21 nt, Homo sapiens
cuggauccagccaugccugag

SEQ ID NO: 726716 - RNA, 15 nt, Homo sapiens
cuggaucuaccagca

SEQ ID NO: 726717 - RNA, 13 nt, Homo sapiens
cuggaugagaaac

SEQ ID NO: 726718 - RNA, 17 nt, Homo sapiens
cuggauggcccauagac

SEQ ID NO: 726719 - RNA, 16 nt, Homo sapiens
cuggauggucaucucg

SEQ ID NO: 726720 - RNA, 20 nt, Homo sapiens
cuggauuacaggcaugugcc

SEQ ID NO: 726721 - RNA, 13 nt, Homo sapiens
cuggauucauuuc

SEQ ID NO: 726722 - RNA, 18 nt, Homo sapiens
cuggauuucauacuguaa

SEQ ID NO: 726723 - RNA, 22 nt, Homo sapiens
cuggcaacaaaaaguaaugaag

SEQ ID NO: 726724 - RNA, 14 nt, Homo sapiens
cuggcaacacagag

SEQ ID NO: 726725 - RNA, 15 nt, Homo sapiens
cuggcaacacagagg

SEQ ID NO: 726726 - RNA, 16 nt, Homo sapiens
cuggcaagcagggaaa

SEQ ID NO: 726727 - RNA, 13 nt, Homo sapiens
cuggcaauggaug

SEQ ID NO: 726728 - RNA, 19 nt, Homo sapiens
cuggcacugaauuaaucau

SEQ ID NO: 726729 - RNA, 22 nt, Homo sapiens
cuggcacugaauuaaucaucua

SEQ ID NO: 726730 - RNA, 16 nt, Homo sapiens
cuggcagaaagcaaau

SEQ ID NO: 726731 - RNA, 13 nt, Homo sapiens
cuggcagcaugac

SEQ ID NO: 726732 - RNA, 22 nt, Homo sapiens
cuggcaguaaccuagugaauuu

SEQ ID NO: 726733 - RNA, 19 nt, Homo sapiens
cuggcauagcccuccugag

SEQ ID NO: 726734 - RNA, 19 nt, Homo sapiens
cuggcauuugcaccuaccu

SEQ ID NO: 726735 - RNA, 15 nt, Homo sapiens
cuggccaaggugucc

SEQ ID NO: 726736 - RNA, 17 nt, Homo sapiens
cugucuuucagcauuca

SEQ ID NO: 726737 - RNA, 19 nt, Homo sapiens
cugugaaagaaccaaaaga

SEQ ID NO: 726738 - RNA, 21 nt, Homo sapiens
cugugaaaguacauuuggaga

SEQ ID NO: 726739 - RNA, 16 nt, Homo sapiens
cugugaaauaccacaa

SEQ ID NO: 726740 - RNA, 21 nt, Homo sapiens
cugugaaaugcuggcauuugc

SEQ ID NO: 726741 - RNA, 14 nt, Homo sapiens
cugugaacagcuug

SEQ ID NO: 726742 - RNA, 16 nt, Homo sapiens
cugugaaccugggcac

SEQ ID NO: 726743 - RNA, 21 nt, Homo sapiens
cugugaauaaaaacccuguau

SEQ ID NO: 726744 - RNA, 15 nt, Homo sapiens
cugugaauacuugaa

SEQ ID NO: 726745 - RNA, 15 nt, Homo sapiens
cugugacaccuggug

SEQ ID NO: 726746 - RNA, 15 nt, Homo sapiens
cugugacuaccucaa

SEQ ID NO: 726747 - RNA, 13 nt, Homo sapiens
cugugacuauaaa

SEQ ID NO: 726748 - RNA, 22 nt, Homo sapiens
cugugacucgagucacacucaa

SEQ ID NO: 726749 - RNA, 20 nt, Homo sapiens
cugugacuuucaaggacauu

SEQ ID NO: 726750 - RNA, 17 nt, Homo sapiens
cugugagaagucacuca

SEQ ID NO: 726751 - RNA, 15 nt, Homo sapiens
cugugauccacccaa

SEQ ID NO: 726752 - RNA, 15 nt, Homo sapiens
cugugaucccagcua

SEQ ID NO: 726753 - RNA, 18 nt, Homo sapiens
cugugauuaacuugcuua

SEQ ID NO: 726754 - RNA, 9 nt, Homo sapiens
cugugcacc

SEQ ID NO: 726755 - RNA, 18 nt, Homo sapiens
cugugcaccuauucugua

SEQ ID NO: 726756 - RNA, 21 nt, Homo sapiens
cugugcacggaaaagacaaga

SEQ ID NO: 726757 - RNA, 15 nt, Homo sapiens
cugugcaguaagccu

SEQ ID NO: 726758 - RNA, 17 nt, Homo sapiens
cugugcaguaagccugu

SEQ ID NO: 726759 - RNA, 16 nt, Homo sapiens
cugugcaguagcauca

SEQ ID NO: 726760 - RNA, 15 nt, Homo sapiens
cugugcagucacugg

SEQ ID NO: 726761 - RNA, 21 nt, Homo sapiens
cugugccaacuacuacuggug

SEQ ID NO: 726762 - RNA, 15 nt, Homo sapiens
cugugccagaccuca

SEQ ID NO: 726763 - RNA, 18 nt, Homo sapiens
cugugccagagauguacu

SEQ ID NO: 726764 - RNA, 15 nt, Homo sapiens
cugugccccaccacg

SEQ ID NO: 726765 - RNA, 15 nt, Homo sapiens
cugugcccuguggua

SEQ ID NO: 726766 - RNA, 17 nt, Homo sapiens
cugugccuaucaccucu

SEQ ID NO: 726767 - RNA, 21 nt, Homo sapiens
cugugccuuggugugcuguau

SEQ ID NO: 726768 - RNA, 17 nt, Homo sapiens
cugugcgccuuguagaa

SEQ ID NO: 726769 - RNA, 14 nt, Homo sapiens
cugugcguuacuaa

SEQ ID NO: 726770 - RNA, 15 nt, Homo sapiens
cugugcuaguuuuac

SEQ ID NO: 726771 - RNA, 23 nt, Homo sapiens
cugugcugugacucgagucacac

SEQ ID NO: 726772 - RNA, 18 nt, Homo sapiens
cuguggacaugugggugg

SEQ ID NO: 726773 - RNA, 21 nt, Homo sapiens
cuguggagaucagaaagugac

SEQ ID NO: 726774 - RNA, 16 nt, Homo sapiens
cuguggagcgggcaug

SEQ ID NO: 726775 - RNA, 21 nt, Homo sapiens
cuguggaggccugaugcugcc

SEQ ID NO: 726776 - RNA, 14 nt, Homo sapiens
cuguggaugccagg

SEQ ID NO: 726777 - RNA, 11 nt, Homo sapiens
cuguggcacag

SEQ ID NO: 726778 - RNA, 15 nt, Homo sapiens
cuguggcagaguuac

SEQ ID NO: 726779 - RNA, 17 nt, Homo sapiens
cuguggccuguguccca

SEQ ID NO: 726780 - RNA, 17 nt, Homo sapiens
cuguggcuagugacaaa

SEQ ID NO: 726781 - RNA, 17 nt, Homo sapiens
cuguggcucacaguggg

SEQ ID NO: 726782 - RNA, 15 nt, Homo sapiens
cuguggcugcuagca

SEQ ID NO: 726783 - RNA, 14 nt, Homo sapiens
cugugggcuuaugu

SEQ ID NO: 726784 - RNA, 21 nt, Homo sapiens
cuguggggcugaauugccagg

SEQ ID NO: 726785 - RNA, 16 nt, Homo sapiens
cugugggggugagggu

SEQ ID NO: 726786 - RNA, 16 nt, Homo sapiens
cugugguuaacaucuc

SEQ ID NO: 726787 - RNA, 22 nt, Homo sapiens
cuguguaaaacuauauucucag

SEQ ID NO: 726788 - RNA, 19 nt, Homo sapiens
cuguguaagcucacaucca

SEQ ID NO: 726789 - RNA, 22 nt, Homo sapiens
cuguguacagaauucugcuacc

SEQ ID NO: 726790 - RNA, 12 nt, Homo sapiens
cuguguacugug

SEQ ID NO: 726791 - RNA, 13 nt, Homo sapiens
cuguguacugugg

SEQ ID NO: 726792 - RNA, 13 nt, Homo sapiens
cuguguauuccaa

SEQ ID NO: 726793 - RNA, 13 nt, Homo sapiens
cuguguccuccac

SEQ ID NO: 726794 - RNA, 22 nt, Homo sapiens
cuguguccucuuccaccacaga

SEQ ID NO: 726795 - RNA, 14 nt, Homo sapiens
cugugucucaugga

SEQ ID NO: 726796 - RNA, 23 nt, Homo sapiens
cugugugccauuuuaagaguuac

SEQ ID NO: 726797 - RNA, 22 nt, Homo sapiens
cugugugggauacuuaguggua

SEQ ID NO: 726798 - RNA, 21 nt, Homo sapiens
cuguguggucuccaugcucac

SEQ ID NO: 726799 - RNA, 15 nt, Homo sapiens
cuguguguagggaga

SEQ ID NO: 726800 - RNA, 16 nt, Homo sapiens
cuguguguccaaaacu

SEQ ID NO: 726801 - RNA, 22 nt, Homo sapiens
cuguguguuuucccaaagcacu

SEQ ID NO: 726802 - RNA, 23 nt, Homo sapiens
cuguguguuuucccaaagcacuu

SEQ ID NO: 726803 - RNA, 22 nt, Homo sapiens
cuguguugggcaagaccucuuc

SEQ ID NO: 726804 - RNA, 14 nt, Homo sapiens
cuguuaaaaugcau

SEQ ID NO: 726805 - RNA, 15 nt, Homo sapiens
cuguuaacuuuugua

SEQ ID NO: 726806 - RNA, 14 nt, Homo sapiens
cuguuaauagucau

SEQ ID NO: 726807 - RNA, 22 nt, Homo sapiens
cuguuacagcuuucugugcaga

SEQ ID NO: 726808 - RNA, 20 nt, Homo sapiens
cuguuaccauucacaauaaa

SEQ ID NO: 726809 - RNA, 20 nt, Homo sapiens
cuguuacuccauuacuguga

SEQ ID NO: 726810 - RNA, 15 nt, Homo sapiens
cuguuaguguuaaaa

SEQ ID NO: 726811 - RNA, 15 nt, Homo sapiens
cuguuauauaucucu

SEQ ID NO: 726812 - RNA, 23 nt, Homo sapiens
cuguuauuagcugggaagaccaa

SEQ ID NO: 726813 - RNA, 14 nt, Homo sapiens
cuguucacuuugua

SEQ ID NO: 726814 - RNA, 14 nt, Homo sapiens
cuguucagcguuuu

SEQ ID NO: 726815 - RNA, 12 nt, Homo sapiens
cuguucaucuca

SEQ ID NO: 726816 - RNA, 15 nt, Homo sapiens
cuguucccaacucag

SEQ ID NO: 726817 - RNA, 21 nt, Homo sapiens
cuguucccccacccuccaugc

SEQ ID NO: 726818 - RNA, 12 nt, Homo sapiens
cuguucuacuuu

SEQ ID NO: 726819 - RNA, 19 nt, Homo sapiens
cuguucugaaaggagacau

SEQ ID NO: 726820 - RNA, 14 nt, Homo sapiens
cuguucugcacuga

SEQ ID NO: 726821 - RNA, 16 nt, Homo sapiens
cuguucugcacugaaa

SEQ ID NO: 726822 - RNA, 21 nt, Homo sapiens
cuguucugggccaggucccag

SEQ ID NO: 726823 - RNA, 15 nt, Homo sapiens
cuguucuuacuguaa

SEQ ID NO: 726824 - RNA, 15 nt, Homo sapiens
cuguugaaaagcaca

SEQ ID NO: 726825 - RNA, 23 nt, Homo sapiens
cuguugagguggcuguagauggu

SEQ ID NO: 726826 - RNA, 16 nt, Homo sapiens
cuguugauaaauccau

SEQ ID NO: 726827 - RNA, 21 nt, Homo sapiens
cuguugauuaucuucagccca

SEQ ID NO: 726828 - RNA, 23 nt, Homo sapiens
cuguugcaaacucaguuccaaag

SEQ ID NO: 726829 - RNA, 20 nt, Homo sapiens
aacuagguuuuugcuucucc

SEQ ID NO: 726830 - RNA, 15 nt, Homo sapiens
aacuauaacuuaaag

SEQ ID NO: 726831 - RNA, 23 nt, Homo sapiens
aacuauaaggugccucaguuuuc

SEQ ID NO: 726832 - RNA, 13 nt, Homo sapiens
aacuauacuugau

SEQ ID NO: 726833 - RNA, 13 nt, Homo sapiens
aacuauauucuca

SEQ ID NO: 726834 - RNA, 19 nt, Homo sapiens
aacuauguucacaagaaca

SEQ ID NO: 726835 - RNA, 12 nt, Homo sapiens
aacuauugagaa

SEQ ID NO: 726836 - RNA, 16 nt, Homo sapiens
aacuauugggugaaua

SEQ ID NO: 726837 - RNA, 15 nt, Homo sapiens
aacuauuuaaaggaa

SEQ ID NO: 726838 - RNA, 16 nt, Homo sapiens
aacuauuuaaaggaaa

SEQ ID NO: 726839 - RNA, 10 nt, Homo sapiens
aacuauuuau

SEQ ID NO: 726840 - RNA, 18 nt, Homo sapiens
aacuauuuauaucacaca

SEQ ID NO: 726841 - RNA, 22 nt, Homo sapiens
aacuauuuauuaaaaacaugac

SEQ ID NO: 726842 - RNA, 17 nt, Homo sapiens
aacuauuuauugaauga

SEQ ID NO: 726843 - RNA, 20 nt, Homo sapiens
aacucaaauacacauuugcu

SEQ ID NO: 726844 - RNA, 21 nt, Homo sapiens
aacucaaccuggacacucucu

SEQ ID NO: 726845 - RNA, 13 nt, Homo sapiens
aacucaaugagcu

SEQ ID NO: 726846 - RNA, 15 nt, Homo sapiens
aacucacaccugccu

SEQ ID NO: 726847 - RNA, 15 nt, Homo sapiens
aacucaccacagugu

SEQ ID NO: 726848 - RNA, 20 nt, Homo sapiens
aacucaccagccccacugcc

SEQ ID NO: 726849 - RNA, 11 nt, Homo sapiens
aacucacucag

SEQ ID NO: 726850 - RNA, 15 nt, Homo sapiens
aacucacucugggcu

SEQ ID NO: 726851 - RNA, 15 nt, Homo sapiens
aacucacugcucaag

SEQ ID NO: 726852 - RNA, 23 nt, Homo sapiens
aacucacuuucccuugugucaag

SEQ ID NO: 726853 - RNA, 13 nt, Homo sapiens
aacucagauccag

SEQ ID NO: 726854 - RNA, 17 nt, Homo sapiens
aacucaguuccaaaguc

SEQ ID NO: 726855 - RNA, 15 nt, Homo sapiens
aacucauuccugccu

SEQ ID NO: 726856 - RNA, 17 nt, Homo sapiens
aacucauuccugccugu

SEQ ID NO: 726857 - RNA, 20 nt, Homo sapiens
aacucauuccugccugucuc

SEQ ID NO: 726858 - RNA, 20 nt, Homo sapiens
aacucauuugagaucagucu

SEQ ID NO: 726859 - RNA, 12 nt, Homo sapiens
aacucauuugau

SEQ ID NO: 726860 - RNA, 18 nt, Homo sapiens
aacuccaccuucccacuu

SEQ ID NO: 726861 - RNA, 13 nt, Homo sapiens
aacuccaucucaa

SEQ ID NO: 726862 - RNA, 22 nt, Homo sapiens
aacuccccucagggauacgaca

SEQ ID NO: 726863 - RNA, 19 nt, Homo sapiens
aacuccugaccucagguga

SEQ ID NO: 726864 - RNA, 15 nt, Homo sapiens
aacucuaugaacuua

SEQ ID NO: 726865 - RNA, 21 nt, Homo sapiens
aacucuccaauguucuauuaa

SEQ ID NO: 726866 - RNA, 21 nt, Homo sapiens
aacucuccaucuuauuuucau

SEQ ID NO: 726867 - RNA, 23 nt, Homo sapiens
aacucucccucuggucuacucua

SEQ ID NO: 726868 - RNA, 20 nt, Homo sapiens
aacucucugguuuacuucaa

SEQ ID NO: 726869 - RNA, 15 nt, Homo sapiens
aacucugcacuccau

SEQ ID NO: 726870 - RNA, 18 nt, Homo sapiens
aacucugggcugccaugu

SEQ ID NO: 726871 - RNA, 16 nt, Homo sapiens
aacucuguaaaaccuc

SEQ ID NO: 726872 - RNA, 14 nt, Homo sapiens
aacucuuacucuua

SEQ ID NO: 726873 - RNA, 20 nt, Homo sapiens
aacucuucagaacacacaga

SEQ ID NO: 726874 - RNA, 21 nt, Homo sapiens
aacucuucgaagccuugccua

SEQ ID NO: 726875 - RNA, 20 nt, Homo sapiens
aacucuucgggagacauguu

SEQ ID NO: 726876 - RNA, 13 nt, Homo sapiens
aacucuugcacag

SEQ ID NO: 726877 - RNA, 20 nt, Homo sapiens
aacucuugguauuacccucc

SEQ ID NO: 726878 - RNA, 22 nt, Homo sapiens
aacucuuuaucaagcaacauuc

SEQ ID NO: 726879 - RNA, 14 nt, Homo sapiens
aacugaaaggugau

SEQ ID NO: 726880 - RNA, 13 nt, Homo sapiens
aacugaaauguua

SEQ ID NO: 726881 - RNA, 17 nt, Homo sapiens
aacugaaggccacuuga

SEQ ID NO: 726882 - RNA, 14 nt, Homo sapiens
aacugaaucacuua

SEQ ID NO: 726883 - RNA, 13 nt, Homo sapiens
aacugacaaugaa

SEQ ID NO: 726884 - RNA, 13 nt, Homo sapiens
aacugacugccuu

SEQ ID NO: 726885 - RNA, 23 nt, Homo sapiens
aacugacugccuugcuaaaagau

SEQ ID NO: 726886 - RNA, 18 nt, Homo sapiens
aacugacuuaaguggcau

SEQ ID NO: 726887 - RNA, 21 nt, Homo sapiens
aacugagauuacaggcaccca

SEQ ID NO: 726888 - RNA, 23 nt, Homo sapiens
aacugagauuacaggcacccacc

SEQ ID NO: 726889 - RNA, 13 nt, Homo sapiens
aacugauugcaac

SEQ ID NO: 726890 - RNA, 14 nt, Homo sapiens
aacugcauugagaa

SEQ ID NO: 726891 - RNA, 13 nt, Homo sapiens
aacugcauuuccu

SEQ ID NO: 726892 - RNA, 14 nt, Homo sapiens
aacugcccuuccag

SEQ ID NO: 726893 - RNA, 14 nt, Homo sapiens
aacugccucaggac

SEQ ID NO: 726894 - RNA, 14 nt, Homo sapiens
aacugcuccucccc

SEQ ID NO: 726895 - RNA, 22 nt, Homo sapiens
aacuggaaaacagaacacuuau

SEQ ID NO: 726896 - RNA, 16 nt, Homo sapiens
aacuggaagaaagcaa

SEQ ID NO: 726897 - RNA, 20 nt, Homo sapiens
aacuggaagauacauaaaag

SEQ ID NO: 726898 - RNA, 14 nt, Homo sapiens
aacuggaaggccuu

SEQ ID NO: 726899 - RNA, 23 nt, Homo sapiens
aacuggagccagcaaccagcaca

SEQ ID NO: 726900 - RNA, 19 nt, Homo sapiens
aacuggauugcagacuguu

SEQ ID NO: 726901 - RNA, 21 nt, Homo sapiens
aacuggcagguaccgugcuca

SEQ ID NO: 726902 - RNA, 17 nt, Homo sapiens
aacuggguuaaauauuu

SEQ ID NO: 726903 - RNA, 19 nt, Homo sapiens
aacugguauauacauauau

SEQ ID NO: 726904 - RNA, 23 nt, Homo sapiens
aacuguacauuuaaaauugcuau

SEQ ID NO: 726905 - RNA, 14 nt, Homo sapiens
aacugucacucauu

SEQ ID NO: 726906 - RNA, 20 nt, Homo sapiens
aacugucacucauugcugag

SEQ ID NO: 726907 - RNA, 17 nt, Homo sapiens
aacugucuuccucaaaa

SEQ ID NO: 726908 - RNA, 19 nt, Homo sapiens
aacugucuuguuucaguga

SEQ ID NO: 726909 - RNA, 13 nt, Homo sapiens
aacugugccuugu

SEQ ID NO: 726910 - RNA, 12 nt, Homo sapiens
aacugugcucuu

SEQ ID NO: 726911 - RNA, 21 nt, Homo sapiens
aacugugucuggcguucucaa

SEQ ID NO: 726912 - RNA, 12 nt, Homo sapiens
aacuguucucuu

SEQ ID NO: 726913 - RNA, 20 nt, Homo sapiens
aacuguugauugcaggaaua

SEQ ID NO: 726914 - RNA, 16 nt, Homo sapiens
aacuuaaacauauucu

SEQ ID NO: 726915 - RNA, 18 nt, Homo sapiens
aacuuacuguauauguau

SEQ ID NO: 726916 - RNA, 13 nt, Homo sapiens
aacuuagucaaua

SEQ ID NO: 726917 - RNA, 13 nt, Homo sapiens
aacuuagugacaa

SEQ ID NO: 726918 - RNA, 21 nt, Homo sapiens
aacuuauucuuugaguaaugu

SEQ ID NO: 726919 - RNA, 13 nt, Homo sapiens
aacuucaaaaauc

SEQ ID NO: 726920 - RNA, 18 nt, Homo sapiens
aacuucaaauagcaauaa

SEQ ID NO: 726921 - RNA, 22 nt, Homo sapiens
aacuucaagggacaaguauuaa

SEQ ID NO: 726922 - RNA, 16 nt, Homo sapiens
aacuucaccuacauua

SEQ ID NO: 726923 - RNA, 22 nt, Homo sapiens
aacuucaccuacauuaucucac

SEQ ID NO: 726924 - RNA, 13 nt, Homo sapiens
aacuucauuugau

SEQ ID NO: 726925 - RNA, 15 nt, Homo sapiens
aacuuccaauuuaca

SEQ ID NO: 726926 - RNA, 12 nt, Homo sapiens
aacuuccaguca

SEQ ID NO: 726927 - RNA, 22 nt, Homo sapiens
aacuucccuuaagagucaucca

SEQ ID NO: 726928 - RNA, 21 nt, Homo sapiens
aacuuccgccuccuguguuca

SEQ ID NO: 726929 - RNA, 19 nt, Homo sapiens
aacuuccgcugaggggucu

SEQ ID NO: 726930 - RNA, 21 nt, Homo sapiens
aacuugagcuucacugucauc

SEQ ID NO: 726931 - RNA, 19 nt, Homo sapiens
aacuugauuaacuccuccu

SEQ ID NO: 726932 - RNA, 16 nt, Homo sapiens
aacuugcaauaccaau

SEQ ID NO: 726933 - RNA, 12 nt, Homo sapiens
aacuugcugcuu

SEQ ID NO: 726934 - RNA, 19 nt, Homo sapiens
aacuuggucuggcuuuaag

SEQ ID NO: 726935 - RNA, 13 nt, Homo sapiens
aacuuguccuaug

SEQ ID NO: 726936 - RNA, 17 nt, Homo sapiens
aacuuguuacuaaagaa

SEQ ID NO: 726937 - RNA, 18 nt, Homo sapiens
aacuuuagcaacaguuau

SEQ ID NO: 726938 - RNA, 21 nt, Homo sapiens
aacuuuagcaacaguuaucac

SEQ ID NO: 726939 - RNA, 17 nt, Homo sapiens
aacuuuauacacuugga

SEQ ID NO: 726940 - RNA, 15 nt, Homo sapiens
aacuuuaucacuuaa

SEQ ID NO: 726941 - RNA, 13 nt, Homo sapiens
aacuuuggcuuau

SEQ ID NO: 726942 - RNA, 18 nt, Homo sapiens
aacuuuggguacuuauac

SEQ ID NO: 726943 - RNA, 18 nt, Homo sapiens
aacuuuguauuaaugugu

SEQ ID NO: 726944 - RNA, 16 nt, Homo sapiens
aagcagucaguuugca

SEQ ID NO: 726945 - RNA, 20 nt, Homo sapiens
aagcaguggccuuauugcau

SEQ ID NO: 726946 - RNA, 16 nt, Homo sapiens
aagcaguuacuaauau

SEQ ID NO: 726947 - RNA, 13 nt, Homo sapiens
aagcauacuuugu

SEQ ID NO: 726948 - RNA, 15 nt, Homo sapiens
aagcaucaccucagg

SEQ ID NO: 726949 - RNA, 16 nt, Homo sapiens
aagcaucaccucaggc

SEQ ID NO: 726950 - RNA, 17 nt, Homo sapiens
aagcaucccucacccau

SEQ ID NO: 726951 - RNA, 20 nt, Homo sapiens
aagcaugcauucuagcacaa

SEQ ID NO: 726952 - RNA, 14 nt, Homo sapiens
aagcaugucucucu

SEQ ID NO: 726953 - RNA, 13 nt, Homo sapiens
aagcauucuuuaa

SEQ ID NO: 726954 - RNA, 18 nt, Homo sapiens
aagccacaagucuuccag

SEQ ID NO: 726955 - RNA, 20 nt, Homo sapiens
aagccacagcagguccucca

SEQ ID NO: 726956 - RNA, 21 nt, Homo sapiens
aagccacagcagguccuccau

SEQ ID NO: 726957 - RNA, 19 nt, Homo sapiens
aagccacccuaccaugaau

SEQ ID NO: 726958 - RNA, 20 nt, Homo sapiens
aagccagacgugguggcuca

SEQ ID NO: 726959 - RNA, 21 nt, Homo sapiens
aagccagcccccuccagcuca

SEQ ID NO: 726960 - RNA, 20 nt, Homo sapiens
aagccaguuccgucuucccu

SEQ ID NO: 726961 - RNA, 13 nt, Homo sapiens
aagccaguuuuca

SEQ ID NO: 726962 - RNA, 16 nt, Homo sapiens
aagccauucacuuccc

SEQ ID NO: 726963 - RNA, 21 nt, Homo sapiens
aagcccagcgguucacacagg

SEQ ID NO: 726964 - RNA, 18 nt, Homo sapiens
aagcccaugaguccuuga

SEQ ID NO: 726965 - RNA, 20 nt, Homo sapiens
aagccccauccaacacugga

SEQ ID NO: 726966 - RNA, 23 nt, Homo sapiens
aagcccuuccuaccucuggugau

SEQ ID NO: 726967 - RNA, 15 nt, Homo sapiens
aagcccuuuacuuga

SEQ ID NO: 726968 - RNA, 16 nt, Homo sapiens
aagccuacccuauucu

SEQ ID NO: 726969 - RNA, 15 nt, Homo sapiens
aagccuauucacuug

SEQ ID NO: 726970 - RNA, 22 nt, Homo sapiens
aagccuauuugaacuacuuaaa

SEQ ID NO: 726971 - RNA, 16 nt, Homo sapiens
aagccucagaaaggga

SEQ ID NO: 726972 - RNA, 16 nt, Homo sapiens
aagccuccgcugggcu

SEQ ID NO: 726973 - RNA, 12 nt, Homo sapiens
aagccuccucau

SEQ ID NO: 726974 - RNA, 21 nt, Homo sapiens
aagccucguuuugaugccauu

SEQ ID NO: 726975 - RNA, 18 nt, Homo sapiens
aagccucuccagcaauaa

SEQ ID NO: 726976 - RNA, 23 nt, Homo sapiens
aagccucugcgucuuuuuacuca

SEQ ID NO: 726977 - RNA, 16 nt, Homo sapiens
aagccugaacuauuua

SEQ ID NO: 726978 - RNA, 12 nt, Homo sapiens
aagccugugaaa

SEQ ID NO: 726979 - RNA, 23 nt, Homo sapiens
aagccuuaaguggcagaauauaa

SEQ ID NO: 726980 - RNA, 12 nt, Homo sapiens
aagccuuaggga

SEQ ID NO: 726981 - RNA, 17 nt, Homo sapiens
aagcgauucuccugccu

SEQ ID NO: 726982 - RNA, 17 nt, Homo sapiens
aagcgcacauucaugug

SEQ ID NO: 726983 - RNA, 16 nt, Homo sapiens
aagcggagagagccaa

SEQ ID NO: 726984 - RNA, 21 nt, Homo sapiens
aagcggcccgccaccugugac

SEQ ID NO: 726985 - RNA, 15 nt, Homo sapiens
aagcgggccgucucc

SEQ ID NO: 726986 - RNA, 18 nt, Homo sapiens
aagcguccucucaguaau

SEQ ID NO: 726987 - RNA, 22 nt, Homo sapiens
aagcuaaguauaguugauguaa

SEQ ID NO: 726988 - RNA, 19 nt, Homo sapiens
aagcuaauaaaauucgcuu

SEQ ID NO: 726989 - RNA, 19 nt, Homo sapiens
aagcuaaugugcagggaua

SEQ ID NO: 726990 - RNA, 22 nt, Homo sapiens
aagcuagauacuggaaaccuaa

SEQ ID NO: 726991 - RNA, 19 nt, Homo sapiens
aagcuagaugccccugcag

SEQ ID NO: 726992 - RNA, 13 nt, Homo sapiens
aagcuaggauggu

SEQ ID NO: 726993 - RNA, 18 nt, Homo sapiens
aagcuaguguaccuccuc

SEQ ID NO: 726994 - RNA, 21 nt, Homo sapiens
aagcuaguguaccuccucuca

SEQ ID NO: 726995 - RNA, 18 nt, Homo sapiens
aagcuauugucuguaaua

SEQ ID NO: 726996 - RNA, 22 nt, Homo sapiens
aagcucaguaacugugcaucug

SEQ ID NO: 726997 - RNA, 15 nt, Homo sapiens
aagcuccuccaguga

SEQ ID NO: 726998 - RNA, 14 nt, Homo sapiens
aagcucgagugaau

SEQ ID NO: 726999 - RNA, 20 nt, Homo sapiens
aagcucugccucccggguuc

SEQ ID NO: 727000 - RNA, 23 nt, Homo sapiens
aagcucuggcugaacccugugcu

SEQ ID NO: 727001 - RNA, 16 nt, Homo sapiens
aagcugaaaggaugau

SEQ ID NO: 727002 - RNA, 19 nt, Homo sapiens
aagcugaaaggaugauccu

SEQ ID NO: 727003 - RNA, 18 nt, Homo sapiens
aagcugaaggcugaggca

SEQ ID NO: 727004 - RNA, 17 nt, Homo sapiens
aagcugaauccagauca

SEQ ID NO: 727005 - RNA, 17 nt, Homo sapiens
aagcugaccccaaagac

SEQ ID NO: 727006 - RNA, 16 nt, Homo sapiens
aagcugacuuggcacu

SEQ ID NO: 727007 - RNA, 20 nt, Homo sapiens
aagcugaugacaacuuccca

SEQ ID NO: 727008 - RNA, 19 nt, Homo sapiens
aagcugcacaugugccaca

SEQ ID NO: 727009 - RNA, 13 nt, Homo sapiens
aagcugcuuuaaa

SEQ ID NO: 727010 - RNA, 14 nt, Homo sapiens
aagcugcuuuagaa

SEQ ID NO: 727011 - RNA, 18 nt, Homo sapiens
aagcuggagcucuuggaa

SEQ ID NO: 727012 - RNA, 19 nt, Homo sapiens
aagcuggcuuuucccauuu

SEQ ID NO: 727013 - RNA, 19 nt, Homo sapiens
aagcugggauaaucacauu

SEQ ID NO: 727014 - RNA, 16 nt, Homo sapiens
aagcugggugagccaa

SEQ ID NO: 727015 - RNA, 11 nt, Homo sapiens
aagcuguuauu

SEQ ID NO: 727016 - RNA, 19 nt, Homo sapiens
aagcuguuuccauagggug

SEQ ID NO: 727017 - RNA, 16 nt, Homo sapiens
aagcuucacauuugcg

SEQ ID NO: 727018 - RNA, 22 nt, Homo sapiens
aagcuuccauuccaagccugac

SEQ ID NO: 727019 - RNA, 20 nt, Homo sapiens
aagcuucccucucagcugcu

SEQ ID NO: 727020 - RNA, 12 nt, Homo sapiens
aagcuucuaucc

SEQ ID NO: 727021 - RNA, 15 nt, Homo sapiens
aagcuuuaggaugac

SEQ ID NO: 727022 - RNA, 21 nt, Homo sapiens
aagcuuucuguugauguuaac

SEQ ID NO: 727023 - RNA, 22 nt, Homo sapiens
aagcuuuuccuuucucuuacac

SEQ ID NO: 727024 - RNA, 20 nt, Homo sapiens
aaggaaaagacugaaucuac

SEQ ID NO: 727025 - RNA, 16 nt, Homo sapiens
aaggaaacacuucuau

SEQ ID NO: 727026 - RNA, 19 nt, Homo sapiens
aaggaaacccccaguguaa

SEQ ID NO: 727027 - RNA, 13 nt, Homo sapiens
aaggaaaucuccu

SEQ ID NO: 727028 - RNA, 16 nt, Homo sapiens
aaggaaaucuccucuu

SEQ ID NO: 727029 - RNA, 14 nt, Homo sapiens
aaggaacacugaca

SEQ ID NO: 727030 - RNA, 13 nt, Homo sapiens
aaggaacacuggc

SEQ ID NO: 727031 - RNA, 23 nt, Homo sapiens
aaggaacagagugagagacauca

SEQ ID NO: 727032 - RNA, 23 nt, Homo sapiens
aaggaacauugcagagcuaagca

SEQ ID NO: 727033 - RNA, 17 nt, Homo sapiens
aaggaaccuuccuuccu

SEQ ID NO: 727034 - RNA, 16 nt, Homo sapiens
aaggaacucuacuuca

SEQ ID NO: 727035 - RNA, 23 nt, Homo sapiens
aaggaagaaaagcugccauuucc

SEQ ID NO: 727036 - RNA, 14 nt, Homo sapiens
aaggaagacuugaa

SEQ ID NO: 727037 - RNA, 15 nt, Homo sapiens
aaggaagauccugaa

SEQ ID NO: 727038 - RNA, 22 nt, Homo sapiens
aaggaagcaaguuuucuuccau

SEQ ID NO: 727039 - RNA, 14 nt, Homo sapiens
aaggaaggcauuug

SEQ ID NO: 727040 - RNA, 13 nt, Homo sapiens
aaggaaggcuucu

SEQ ID NO: 727041 - RNA, 15 nt, Homo sapiens
aaggaaguacugcac

SEQ ID NO: 727042 - RNA, 15 nt, Homo sapiens
aaggaauaagcauuc

SEQ ID NO: 727043 - RNA, 20 nt, Homo sapiens
aaggaauccuggauuuugcc

SEQ ID NO: 727044 - RNA, 13 nt, Homo sapiens
aaggaaucugugc

SEQ ID NO: 727045 - RNA, 19 nt, Homo sapiens
aaggaauuaucaauuacaa

SEQ ID NO: 727046 - RNA, 19 nt, Homo sapiens
aaggacagaguaugaacac

SEQ ID NO: 727047 - RNA, 12 nt, Homo sapiens
aaggacagggcu

SEQ ID NO: 727048 - RNA, 14 nt, Homo sapiens
aaggacccugugag

SEQ ID NO: 727049 - RNA, 21 nt, Homo sapiens
aaggacggccuucaacugaaa

SEQ ID NO: 727050 - RNA, 17 nt, Homo sapiens
aaggacuaggucuuccc

SEQ ID NO: 727051 - RNA, 18 nt, Homo sapiens
aaggacucuuccaccucc

SEQ ID NO: 727052 - RNA, 19 nt, Homo sapiens
aaggacuuagugcaucaga

SEQ ID NO: 727053 - RNA, 14 nt, Homo sapiens
aaggacuucaggaa

SEQ ID NO: 727054 - RNA, 16 nt, Homo sapiens
aaggagaacuauccaa

SEQ ID NO: 727055 - RNA, 17 nt, Homo sapiens
aaggagaacuauccaaa

SEQ ID NO: 727056 - RNA, 14 nt, Homo sapiens
aaggagagcauagg

SEQ ID NO: 727057 - RNA, 20 nt, Homo sapiens
aaggagcacauacuaccuag

SEQ ID NO: 727058 - RNA, 15 nt, Homo sapiens
aaggagcugauacuu

SEQ ID NO: 727059 - RNA, 22 nt, Homo sapiens
aaggaggacgguuaacuuguau

SEQ ID NO: 727060 - RNA, 20 nt, Homo sapiens
aaggaggcaugccucugaua

SEQ ID NO: 727061 - RNA, 17 nt, Homo sapiens
aaggagucccugguuca

SEQ ID NO: 727062 - RNA, 21 nt, Homo sapiens
aaggagucccugguucauuga

SEQ ID NO: 727063 - RNA, 19 nt, Homo sapiens
aaggauaaagccacuucug

SEQ ID NO: 727064 - RNA, 19 nt, Homo sapiens
aaggauagcaccgcuuuug

SEQ ID NO: 727065 - RNA, 23 nt, Homo sapiens
aaggauauguggagaaucaucaa

SEQ ID NO: 727066 - RNA, 14 nt, Homo sapiens
aaggauauuuacua

SEQ ID NO: 727067 - RNA, 21 nt, Homo sapiens
aaggaucuaggagaagggucu

SEQ ID NO: 727068 - RNA, 18 nt, Homo sapiens
aaggaugacaaaauggaa

SEQ ID NO: 727069 - RNA, 13 nt, Homo sapiens
aaggauggaccac

SEQ ID NO: 727070 - RNA, 21 nt, Homo sapiens
aaggaugguuuuaucuucccu

SEQ ID NO: 727071 - RNA, 12 nt, Homo sapiens
aaggauguugcc

SEQ ID NO: 727072 - RNA, 22 nt, Homo sapiens
aaggauguuuugucccauuucc

SEQ ID NO: 727073 - RNA, 13 nt, Homo sapiens
aaggauucauaau

SEQ ID NO: 727074 - RNA, 12 nt, Homo sapiens
aaggauugcaau

SEQ ID NO: 727075 - RNA, 14 nt, Homo sapiens
aaggauugcaaugc

SEQ ID NO: 727076 - RNA, 19 nt, Homo sapiens
aaggauuuuaccaaagcau

SEQ ID NO: 727077 - RNA, 22 nt, Homo sapiens
aaggauuuuaccaaagcaucaa

SEQ ID NO: 727078 - RNA, 13 nt, Homo sapiens
aaggcaaaaagca

SEQ ID NO: 727079 - RNA, 15 nt, Homo sapiens
aaggcaaaguggaau

SEQ ID NO: 727080 - RNA, 17 nt, Homo sapiens
aaggcaaaguuuacaga

SEQ ID NO: 727081 - RNA, 16 nt, Homo sapiens
aaggcaagacuugaac

SEQ ID NO: 727082 - RNA, 20 nt, Homo sapiens
aaggcaauuuuaguguauua

SEQ ID NO: 727083 - RNA, 23 nt, Homo sapiens
aaggcacccgcccuuuccuugcc

SEQ ID NO: 727084 - RNA, 14 nt, Homo sapiens
aaggcagcugccuc

SEQ ID NO: 727085 - RNA, 19 nt, Homo sapiens
aaggcagcugccucugcuc

SEQ ID NO: 727086 - RNA, 23 nt, Homo sapiens
aaggcagcugccucugcucccuc

SEQ ID NO: 727087 - RNA, 15 nt, Homo sapiens
aaggcaggugggcuc

SEQ ID NO: 727088 - RNA, 19 nt, Homo sapiens
aaggcaguagucauuuuca

SEQ ID NO: 727089 - RNA, 14 nt, Homo sapiens
aaggcauaaaugac

SEQ ID NO: 727090 - RNA, 18 nt, Homo sapiens
aaggcauguucccagaaa

SEQ ID NO: 727091 - RNA, 16 nt, Homo sapiens
aaggcauuuucaucuu

SEQ ID NO: 727092 - RNA, 17 nt, Homo sapiens
aaggccuuccacugugg

SEQ ID NO: 727093 - RNA, 16 nt, Homo sapiens
aaggcgccugccuugg

SEQ ID NO: 727094 - RNA, 15 nt, Homo sapiens
aaggcggcagguggg

SEQ ID NO: 727095 - RNA, 22 nt, Homo sapiens
aaggcgguacuaguucagacac

SEQ ID NO: 727096 - RNA, 15 nt, Homo sapiens
aaggcuauugcugag

SEQ ID NO: 727097 - RNA, 18 nt, Homo sapiens
aaggcucaaggcugugca

SEQ ID NO: 727098 - RNA, 15 nt, Homo sapiens
aaggcucacaccuca

SEQ ID NO: 727099 - RNA, 14 nt, Homo sapiens
aaggcucauuuaaa

SEQ ID NO: 727100 - RNA, 23 nt, Homo sapiens
aaggcucccggaauuccgucacc

SEQ ID NO: 727101 - RNA, 16 nt, Homo sapiens
aaggcucugugccuug

SEQ ID NO: 727102 - RNA, 15 nt, Homo sapiens
aaggcuguaugagcu

SEQ ID NO: 727103 - RNA, 21 nt, Homo sapiens
aaggcuucagugagccaugau

SEQ ID NO: 727104 - RNA, 21 nt, Homo sapiens
aaggcuucugugucaaugccu

SEQ ID NO: 727105 - RNA, 15 nt, Homo sapiens
aaggcuuuaucucag

SEQ ID NO: 727106 - RNA, 16 nt, Homo sapiens
aagggaaacaggcuaa

SEQ ID NO: 727107 - RNA, 18 nt, Homo sapiens
aagggaaguugcuggaaa

SEQ ID NO: 727108 - RNA, 14 nt, Homo sapiens
aagggaauccuccu

SEQ ID NO: 727109 - RNA, 18 nt, Homo sapiens
aagggacaccaagccuug

SEQ ID NO: 727110 - RNA, 19 nt, Homo sapiens
aagggagcgcucucuugau

SEQ ID NO: 727111 - RNA, 21 nt, Homo sapiens
aagggaggggcuguguuucca

SEQ ID NO: 727112 - RNA, 17 nt, Homo sapiens
aagggauaguccaaaga

SEQ ID NO: 727113 - RNA, 14 nt, Homo sapiens
aagggauggagcug

SEQ ID NO: 727114 - RNA, 12 nt, Homo sapiens
aagggccauuua

SEQ ID NO: 727115 - RNA, 14 nt, Homo sapiens
aagggcuacuuaau

SEQ ID NO: 727116 - RNA, 18 nt, Homo sapiens
aagggcuucugcacccuc

SEQ ID NO: 727117 - RNA, 16 nt, Homo sapiens
aaggggaggaaccaga

SEQ ID NO: 727118 - RNA, 16 nt, Homo sapiens
aaggggaggacacugg

SEQ ID NO: 727119 - RNA, 16 nt, Homo sapiens
aagggguagucugccu

SEQ ID NO: 727120 - RNA, 13 nt, Homo sapiens
aagggguucucac

SEQ ID NO: 727121 - RNA, 21 nt, Homo sapiens
aagggguuggauugcaauauc

SEQ ID NO: 727122 - RNA, 22 nt, Homo sapiens
aaggguuaggacucuccacuca

SEQ ID NO: 727123 - RNA, 13 nt, Homo sapiens
aagguaaagggag

SEQ ID NO: 727124 - RNA, 17 nt, Homo sapiens
aagguagccaucccaug

SEQ ID NO: 727125 - RNA, 12 nt, Homo sapiens
aagguaugcaau

SEQ ID NO: 727126 - RNA, 13 nt, Homo sapiens
aagguaugguggg

SEQ ID NO: 727127 - RNA, 19 nt, Homo sapiens
aagguauuuugaauaccau

SEQ ID NO: 727128 - RNA, 21 nt, Homo sapiens
aagguauuuuguagaugugau

SEQ ID NO: 727129 - RNA, 14 nt, Homo sapiens
aaggucugaucucc

SEQ ID NO: 727130 - RNA, 21 nt, Homo sapiens
aaggucugcucugcuccugaa

SEQ ID NO: 727131 - RNA, 14 nt, Homo sapiens
aaggugaagcacau

SEQ ID NO: 727132 - RNA, 14 nt, Homo sapiens
aaggugacugggau

SEQ ID NO: 727133 - RNA, 14 nt, Homo sapiens
aaggugccacuuua

SEQ ID NO: 727134 - RNA, 18 nt, Homo sapiens
aaggugggauucaugucg

SEQ ID NO: 727135 - RNA, 14 nt, Homo sapiens
aagguuaaauuuca

SEQ ID NO: 727136 - RNA, 18 nt, Homo sapiens
aagguuauaguaacauca

SEQ ID NO: 727137 - RNA, 15 nt, Homo sapiens
aagguucugcccuua

SEQ ID NO: 727138 - RNA, 22 nt, Homo sapiens
aagguuguguagcugugucaug

SEQ ID NO: 727139 - RNA, 17 nt, Homo sapiens
aagguuuuuacugugag

SEQ ID NO: 727140 - RNA, 20 nt, Homo sapiens
aaguaaaaacacuaccucuu

SEQ ID NO: 727141 - RNA, 12 nt, Homo sapiens
aaguaaaaccac

SEQ ID NO: 727142 - RNA, 22 nt, Homo sapiens
aaguaaaggcauuguccaaagu

SEQ ID NO: 727143 - RNA, 14 nt, Homo sapiens
aaguaaagugcuua

SEQ ID NO: 727144 - RNA, 13 nt, Homo sapiens
aaguaaauuaaac

SEQ ID NO: 727145 - RNA, 16 nt, Homo sapiens
aaguaaccauuugcac

SEQ ID NO: 727146 - RNA, 18 nt, Homo sapiens
aaguaaguaccacucagg

SEQ ID NO: 727147 - RNA, 13 nt, Homo sapiens
aaguaaugaauuu

SEQ ID NO: 727148 - RNA, 16 nt, Homo sapiens
aaguaauucucaagaa

SEQ ID NO: 727149 - RNA, 16 nt, Homo sapiens
aaguacaacuaccuau

SEQ ID NO: 727150 - RNA, 19 nt, Homo sapiens
aaguacagaauuugaauua

SEQ ID NO: 727151 - RNA, 18 nt, Homo sapiens
aaguacauaaaguacaua

SEQ ID NO: 727152 - RNA, 15 nt, Homo sapiens
aaguacccugagaua

SEQ ID NO: 727153 - RNA, 20 nt, Homo sapiens
aaguacucaaauauuucuga

SEQ ID NO: 727154 - RNA, 12 nt, Homo sapiens
aaguacuugaga

SEQ ID NO: 727155 - RNA, 16 nt, Homo sapiens
aaguagaauccuaaau

SEQ ID NO: 727156 - RNA, 13 nt, Homo sapiens
aaguagaggaauc

SEQ ID NO: 727157 - RNA, 19 nt, Homo sapiens
aaguagaucuuuucuugac

SEQ ID NO: 727158 - RNA, 20 nt, Homo sapiens
aaguagcaucccaucccaac

SEQ ID NO: 727159 - RNA, 22 nt, Homo sapiens
aaguaggauucaucauuccaua

SEQ ID NO: 727160 - RNA, 18 nt, Homo sapiens
aaguagggacuucugucu

SEQ ID NO: 727161 - RNA, 19 nt, Homo sapiens
aaguaggugugacuugaac

SEQ ID NO: 727162 - RNA, 17 nt, Homo sapiens
aaguauaacaacuuuga

SEQ ID NO: 727163 - RNA, 16 nt, Homo sapiens
aaguauaaguauucaa

SEQ ID NO: 727164 - RNA, 22 nt, Homo sapiens
aaguauaaucagcacuuugcca

SEQ ID NO: 727165 - RNA, 17 nt, Homo sapiens
aaguauauuuaacucau

SEQ ID NO: 727166 - RNA, 16 nt, Homo sapiens
aaguauccaugcaugu

SEQ ID NO: 727167 - RNA, 17 nt, Homo sapiens
aaguaugcacuuggccu

SEQ ID NO: 727168 - RNA, 12 nt, Homo sapiens
aaguauuagcca

SEQ ID NO: 727169 - RNA, 18 nt, Homo sapiens
aaguauugcugaguccaa

SEQ ID NO: 727170 - RNA, 12 nt, Homo sapiens
aaguauuuugcc

SEQ ID NO: 727171 - RNA, 14 nt, Homo sapiens
aaguauuuugccac

SEQ ID NO: 727172 - RNA, 17 nt, Homo sapiens
aagucaagcacauguaa

SEQ ID NO: 727173 - RNA, 19 nt, Homo sapiens
aagucaaguuuguggcuua

SEQ ID NO: 727174 - RNA, 22 nt, Homo sapiens
aauauccaagauuuaaaugcca

SEQ ID NO: 727175 - RNA, 17 nt, Homo sapiens
aauauccgaacuuuaau

SEQ ID NO: 727176 - RNA, 23 nt, Homo sapiens
aauauccuccaaugugugcaugg

SEQ ID NO: 727177 - RNA, 21 nt, Homo sapiens
aauauccuguguaacacuugg

SEQ ID NO: 727178 - RNA, 16 nt, Homo sapiens
aauaucugaaauguga

SEQ ID NO: 727179 - RNA, 15 nt, Homo sapiens
aauaucuggcacugu

SEQ ID NO: 727180 - RNA, 15 nt, Homo sapiens
aauaucuugcuuuca

SEQ ID NO: 727181 - RNA, 12 nt, Homo sapiens
aauaucuuggcc

SEQ ID NO: 727182 - RNA, 16 nt, Homo sapiens
aauaugaaucugcuca

SEQ ID NO: 727183 - RNA, 13 nt, Homo sapiens
aauaugaccauuu

SEQ ID NO: 727184 - RNA, 17 nt, Homo sapiens
aauaugaccauuugacu

SEQ ID NO: 727185 - RNA, 21 nt, Homo sapiens
aauaugagaugcguuguuaca

SEQ ID NO: 727186 - RNA, 19 nt, Homo sapiens
aauaugagcuucaauauaa

SEQ ID NO: 727187 - RNA, 22 nt, Homo sapiens
aauaugaguaauacaucaaaga

SEQ ID NO: 727188 - RNA, 23 nt, Homo sapiens
aauaugaucagguaacuuucgac

SEQ ID NO: 727189 - RNA, 19 nt, Homo sapiens
aauaugcacaauagcaguu

SEQ ID NO: 727190 - RNA, 16 nt, Homo sapiens
aauaugcuuuacaauc

SEQ ID NO: 727191 - RNA, 17 nt, Homo sapiens
aauaugggcucaaguca

SEQ ID NO: 727192 - RNA, 19 nt, Homo sapiens
aauaugugaucagcuuuca

SEQ ID NO: 727193 - RNA, 16 nt, Homo sapiens
aauauuaacauaagaa

SEQ ID NO: 727194 - RNA, 19 nt, Homo sapiens
aauauuaaggaaaaaagca

SEQ ID NO: 727195 - RNA, 13 nt, Homo sapiens
aauauuacaguga

SEQ ID NO: 727196 - RNA, 22 nt, Homo sapiens
aauauuagguugucacgaugaa

SEQ ID NO: 727197 - RNA, 20 nt, Homo sapiens
aauauucaaugaacuuccau

SEQ ID NO: 727198 - RNA, 23 nt, Homo sapiens
aauauugaaaggcaaacauuuga

SEQ ID NO: 727199 - RNA, 18 nt, Homo sapiens
aauauugacucaaaccau

SEQ ID NO: 727200 - RNA, 22 nt, Homo sapiens
aauauugcuuuggucauaugag

SEQ ID NO: 727201 - RNA, 17 nt, Homo sapiens
aauauuuaaguauauag

SEQ ID NO: 727202 - RNA, 13 nt, Homo sapiens
aauauuuaguaaa

SEQ ID NO: 727203 - RNA, 15 nt, Homo sapiens
aauauuuaucugauu

SEQ ID NO: 727204 - RNA, 17 nt, Homo sapiens
aauauuuaucugauuaa

SEQ ID NO: 727205 - RNA, 19 nt, Homo sapiens
aauauuuuaagaauuucac

SEQ ID NO: 727206 - RNA, 18 nt, Homo sapiens
aauauuuuagccacucaa

SEQ ID NO: 727207 - RNA, 14 nt, Homo sapiens
aauauuuuccauaa

SEQ ID NO: 727208 - RNA, 18 nt, Homo sapiens
aauauuuucucuguacuu

SEQ ID NO: 727209 - RNA, 17 nt, Homo sapiens
aauauuuuuauauuucc

SEQ ID NO: 727210 - RNA, 22 nt, Homo sapiens
aaucaaaggaaaauaguaaugu

SEQ ID NO: 727211 - RNA, 12 nt, Homo sapiens
aaucaacucuaa

SEQ ID NO: 727212 - RNA, 15 nt, Homo sapiens
aaucaacuuuacugu

SEQ ID NO: 727213 - RNA, 20 nt, Homo sapiens
aaucaagaaaaacaucuuug

SEQ ID NO: 727214 - RNA, 18 nt, Homo sapiens
aaucaagaaaauaugcca

SEQ ID NO: 727215 - RNA, 17 nt, Homo sapiens
aaucaagaagcugugac

SEQ ID NO: 727216 - RNA, 18 nt, Homo sapiens
aaucaaggccagugcuaa

SEQ ID NO: 727217 - RNA, 13 nt, Homo sapiens
aaucaaucugcag

SEQ ID NO: 727218 - RNA, 22 nt, Homo sapiens
aaucaaucuuuaacaaccucug

SEQ ID NO: 727219 - RNA, 13 nt, Homo sapiens
aaucacaucucca

SEQ ID NO: 727220 - RNA, 15 nt, Homo sapiens
aaucacugcauuuca

SEQ ID NO: 727221 - RNA, 19 nt, Homo sapiens
aaucacuucuccaaucagu

SEQ ID NO: 727222 - RNA, 19 nt, Homo sapiens
aaucacuugaauccauuga

SEQ ID NO: 727223 - RNA, 20 nt, Homo sapiens
aaucagacugacaguuuaca

SEQ ID NO: 727224 - RNA, 15 nt, Homo sapiens
aaucagaugaauuga

SEQ ID NO: 727225 - RNA, 13 nt, Homo sapiens
aaucagcauuuag

SEQ ID NO: 727226 - RNA, 16 nt, Homo sapiens
aaucagcauuuagucu

SEQ ID NO: 727227 - RNA, 19 nt, Homo sapiens
aaucagccauaagaaagca

SEQ ID NO: 727228 - RNA, 22 nt, Homo sapiens
aaucagcccagugucccugagc

SEQ ID NO: 727229 - RNA, 18 nt, Homo sapiens
aaucagcgauguauauaa

SEQ ID NO: 727230 - RNA, 18 nt, Homo sapiens
aaucaguaagagguguua

SEQ ID NO: 727231 - RNA, 19 nt, Homo sapiens
aaucaguauaauucuguac

SEQ ID NO: 727232 - RNA, 21 nt, Homo sapiens
aaucagugaagaugcaaucag

SEQ ID NO: 727233 - RNA, 20 nt, Homo sapiens
aaucagugaagccaaaggga

SEQ ID NO: 727234 - RNA, 21 nt, Homo sapiens
aaucagugaagccaaagggac

SEQ ID NO: 727235 - RNA, 19 nt, Homo sapiens
aaucauaaaacuugaugug

SEQ ID NO: 727236 - RNA, 19 nt, Homo sapiens
aaucauacaaacucucacc

SEQ ID NO: 727237 - RNA, 16 nt, Homo sapiens
aaucauacuuagcaaa

SEQ ID NO: 727238 - RNA, 21 nt, Homo sapiens
aaucauaguuuaaacugcauu

SEQ ID NO: 727239 - RNA, 18 nt, Homo sapiens
aaucauccaagacaguua

SEQ ID NO: 727240 - RNA, 18 nt, Homo sapiens
aaucauccucugaguuaa

SEQ ID NO: 727241 - RNA, 13 nt, Homo sapiens
aaucaucuaaguc

SEQ ID NO: 727242 - RNA, 17 nt, Homo sapiens
aaucaucuaagucagua

SEQ ID NO: 727243 - RNA, 19 nt, Homo sapiens
aaucaugaaacuuguuuca

SEQ ID NO: 727244 - RNA, 21 nt, Homo sapiens
aaucaugaaauaugcaucuca

SEQ ID NO: 727245 - RNA, 17 nt, Homo sapiens
aaucauguguugcagcu

SEQ ID NO: 727246 - RNA, 16 nt, Homo sapiens
aaucauuaauacucuu

SEQ ID NO: 727247 - RNA, 23 nt, Homo sapiens
aaucauugauugucagcuacuaa

SEQ ID NO: 727248 - RNA, 19 nt, Homo sapiens
aaucauuucuagauuauaa

SEQ ID NO: 727249 - RNA, 11 nt, Homo sapiens
aauccaaaaag

SEQ ID NO: 727250 - RNA, 21 nt, Homo sapiens
aauccaagugaacacuagcca

SEQ ID NO: 727251 - RNA, 14 nt, Homo sapiens
aauccacaucuuua

SEQ ID NO: 727252 - RNA, 17 nt, Homo sapiens
aauccagacucuuucga

SEQ ID NO: 727253 - RNA, 20 nt, Homo sapiens
aauccaggcagauccaggac

SEQ ID NO: 727254 - RNA, 20 nt, Homo sapiens
aauccaguaggauccaguga

SEQ ID NO: 727255 - RNA, 17 nt, Homo sapiens
aauccagugagcacuag

SEQ ID NO: 727256 - RNA, 18 nt, Homo sapiens
aauccauuuuacacagca

SEQ ID NO: 727257 - RNA, 17 nt, Homo sapiens
aaucccaacacuuugag

SEQ ID NO: 727258 - RNA, 16 nt, Homo sapiens
aaucccagcuacucaa

SEQ ID NO: 727259 - RNA, 23 nt, Homo sapiens
aaucccauuucccaaaccuaaaa

SEQ ID NO: 727260 - RNA, 22 nt, Homo sapiens
aaucccgauucacccuguccaa

SEQ ID NO: 727261 - RNA, 13 nt, Homo sapiens
aaucccugagaca

SEQ ID NO: 727262 - RNA, 13 nt, Homo sapiens
aauccgaagggaa

SEQ ID NO: 727263 - RNA, 14 nt, Homo sapiens
aauccgaaguauga

SEQ ID NO: 727264 - RNA, 22 nt, Homo sapiens
aauccuacuuuucgaacaccaa

SEQ ID NO: 727265 - RNA, 14 nt, Homo sapiens
aauccuauuuauca

SEQ ID NO: 727266 - RNA, 20 nt, Homo sapiens
aauccucaacacuauuguaa

SEQ ID NO: 727267 - RNA, 18 nt, Homo sapiens
aauccucauguuacucag

SEQ ID NO: 727268 - RNA, 16 nt, Homo sapiens
aauccugaugguauca

SEQ ID NO: 727269 - RNA, 22 nt, Homo sapiens
aauccugauuccucucuaagug

SEQ ID NO: 727270 - RNA, 16 nt, Homo sapiens
aauccuguauauuuag

SEQ ID NO: 727271 - RNA, 18 nt, Homo sapiens
aauccuucuaguuuccca

SEQ ID NO: 727272 - RNA, 15 nt, Homo sapiens
aauccuuuacauuca

SEQ ID NO: 727273 - RNA, 14 nt, Homo sapiens
aauccuuugcuuca

SEQ ID NO: 727274 - RNA, 15 nt, Homo sapiens
aauccuuuuccuuau

SEQ ID NO: 727275 - RNA, 19 nt, Homo sapiens
aaucgcaaggccugugcug

SEQ ID NO: 727276 - RNA, 21 nt, Homo sapiens
aaucgcugcccucucugccag

SEQ ID NO: 727277 - RNA, 16 nt, Homo sapiens
aaucuacaccaaugaa

SEQ ID NO: 727278 - RNA, 18 nt, Homo sapiens
aaucuacauucacuuuuu

SEQ ID NO: 727279 - RNA, 17 nt, Homo sapiens
aaucuaccuugcagugu

SEQ ID NO: 727280 - RNA, 21 nt, Homo sapiens
aaucuauccauugaacuaaaa

SEQ ID NO: 727281 - RNA, 18 nt, Homo sapiens
aaucuauuccuguaaaua

SEQ ID NO: 727282 - RNA, 14 nt, Homo sapiens
aaucucaccugcug

SEQ ID NO: 727283 - RNA, 14 nt, Homo sapiens
aaucucagcacuuu

SEQ ID NO: 727284 - RNA, 17 nt, Homo sapiens
aaucuccccuccucaca

SEQ ID NO: 727285 - RNA, 20 nt, Homo sapiens
aaucucccgugggcaucuca

SEQ ID NO: 727286 - RNA, 11 nt, Homo sapiens
aaucucugagc

SEQ ID NO: 727287 - RNA, 19 nt, Homo sapiens
aaucucuuauucuaauaaa

SEQ ID NO: 727288 - RNA, 12 nt, Homo sapiens
agaaagcaaaag

SEQ ID NO: 727289 - RNA, 18 nt, Homo sapiens
agaaagcacuacaaucau

SEQ ID NO: 727290 - RNA, 13 nt, Homo sapiens
agaaagcacugac

SEQ ID NO: 727291 - RNA, 21 nt, Homo sapiens
agaaagcacuuaaacagaagc

SEQ ID NO: 727292 - RNA, 19 nt, Homo sapiens
agaaagcucauggcugugu

SEQ ID NO: 727293 - RNA, 14 nt, Homo sapiens
agaaagcuucuuca

SEQ ID NO: 727294 - RNA, 22 nt, Homo sapiens
agaaaggcaaaguacauuguaa

SEQ ID NO: 727295 - RNA, 20 nt, Homo sapiens
agaaagggauugcugaggca

SEQ ID NO: 727296 - RNA, 23 nt, Homo sapiens
agaaaggucucuggagggacaaa

SEQ ID NO: 727297 - RNA, 18 nt, Homo sapiens
agaaagugaagcaaauca

SEQ ID NO: 727298 - RNA, 13 nt, Homo sapiens
agaaagugcugau

SEQ ID NO: 727299 - RNA, 23 nt, Homo sapiens
agaaaguuauugauaaguucaua

SEQ ID NO: 727300 - RNA, 23 nt, Homo sapiens
agaaauaaauguaccugauguac

SEQ ID NO: 727301 - RNA, 23 nt, Homo sapiens
agaaauacaauucuacauuguca

SEQ ID NO: 727302 - RNA, 21 nt, Homo sapiens
agaaauacaauuuuagauauc

SEQ ID NO: 727303 - RNA, 23 nt, Homo sapiens
agaaauacaauuuuagauaucau

SEQ ID NO: 727304 - RNA, 16 nt, Homo sapiens
agaaauacugcucuga

SEQ ID NO: 727305 - RNA, 17 nt, Homo sapiens
agaaauagacaguauau

SEQ ID NO: 727306 - RNA, 15 nt, Homo sapiens
agaaauaucuuucuc

SEQ ID NO: 727307 - RNA, 22 nt, Homo sapiens
agaaauauugacucaaaccaua

SEQ ID NO: 727308 - RNA, 23 nt, Homo sapiens
agaaaucauaguuuaaacugcau

SEQ ID NO: 727309 - RNA, 19 nt, Homo sapiens
agaaauccuaguaugccaa

SEQ ID NO: 727310 - RNA, 23 nt, Homo sapiens
agaaaucgagagugugcucuccc

SEQ ID NO: 727311 - RNA, 13 nt, Homo sapiens
agaaaucuagaag

SEQ ID NO: 727312 - RNA, 13 nt, Homo sapiens
agaaaucucagaa

SEQ ID NO: 727313 - RNA, 12 nt, Homo sapiens
agaaaucugcca

SEQ ID NO: 727314 - RNA, 16 nt, Homo sapiens
agaaaucuggucuugu

SEQ ID NO: 727315 - RNA, 23 nt, Homo sapiens
agaaaugauucaaauugcugcuu

SEQ ID NO: 727316 - RNA, 17 nt, Homo sapiens
agaaaugcuaucagaaa

SEQ ID NO: 727317 - RNA, 19 nt, Homo sapiens
agaaaugcugcuggccaaa

SEQ ID NO: 727318 - RNA, 21 nt, Homo sapiens
agaaaugcuuuccaaaaccgc

SEQ ID NO: 727319 - RNA, 20 nt, Homo sapiens
agaaauggauguaagccugg

SEQ ID NO: 727320 - RNA, 16 nt, Homo sapiens
agaaauguaguuugca

SEQ ID NO: 727321 - RNA, 15 nt, Homo sapiens
agaaauguauccuga

SEQ ID NO: 727322 - RNA, 22 nt, Homo sapiens
agaaaugucauaaauuacuguu

SEQ ID NO: 727323 - RNA, 21 nt, Homo sapiens
agaaauguuugcugaacauug

SEQ ID NO: 727324 - RNA, 19 nt, Homo sapiens
agaaauuaacaaaugugcu

SEQ ID NO: 727325 - RNA, 22 nt, Homo sapiens
agaaauuaacaaaugugcugcu

SEQ ID NO: 727326 - RNA, 14 nt, Homo sapiens
agaaauuagcugug

SEQ ID NO: 727327 - RNA, 14 nt, Homo sapiens
agaaauuaguuuca

SEQ ID NO: 727328 - RNA, 15 nt, Homo sapiens
agaaauuauacuuac

SEQ ID NO: 727329 - RNA, 19 nt, Homo sapiens
agaaauuauacuuacuucu

SEQ ID NO: 727330 - RNA, 21 nt, Homo sapiens
agaaauuccauacuucucuca

SEQ ID NO: 727331 - RNA, 13 nt, Homo sapiens
agaaauuccccaa

SEQ ID NO: 727332 - RNA, 20 nt, Homo sapiens
agaaauuccuuccuuaccug

SEQ ID NO: 727333 - RNA, 14 nt, Homo sapiens
agaaauucuggccc

SEQ ID NO: 727334 - RNA, 23 nt, Homo sapiens
agaaauuuucauucagguauuug

SEQ ID NO: 727335 - RNA, 20 nt, Homo sapiens
agaacaaaagcgacccauuc

SEQ ID NO: 727336 - RNA, 15 nt, Homo sapiens
agaacaaacucugaa

SEQ ID NO: 727337 - RNA, 12 nt, Homo sapiens
agaacaaaugug

SEQ ID NO: 727338 - RNA, 15 nt, Homo sapiens
agaacaacuaccuga

SEQ ID NO: 727339 - RNA, 15 nt, Homo sapiens
agaacaacuacugug

SEQ ID NO: 727340 - RNA, 13 nt, Homo sapiens
agaacaacuugcu

SEQ ID NO: 727341 - RNA, 19 nt, Homo sapiens
agaacaacuugcuacugac

SEQ ID NO: 727342 - RNA, 18 nt, Homo sapiens
agaacaagcaaugaugac

SEQ ID NO: 727343 - RNA, 17 nt, Homo sapiens
agaacaauggcuauuca

SEQ ID NO: 727344 - RNA, 23 nt, Homo sapiens
agaacaaugggaggcugugauuu

SEQ ID NO: 727345 - RNA, 20 nt, Homo sapiens
agaacacccucuaaauggga

SEQ ID NO: 727346 - RNA, 19 nt, Homo sapiens
agaacaccgagcacugaac

SEQ ID NO: 727347 - RNA, 18 nt, Homo sapiens
agaacaccuccagcuuuu

SEQ ID NO: 727348 - RNA, 14 nt, Homo sapiens
agaacacuccaagc

SEQ ID NO: 727349 - RNA, 23 nt, Homo sapiens
agaacaggccucuccauuugcuc

SEQ ID NO: 727350 - RNA, 20 nt, Homo sapiens
agaacagggcuauuugaaga

SEQ ID NO: 727351 - RNA, 21 nt, Homo sapiens
agaacaguggcucguauccca

SEQ ID NO: 727352 - RNA, 17 nt, Homo sapiens
agaacauacacugugaa

SEQ ID NO: 727353 - RNA, 18 nt, Homo sapiens
agaacauacacugugaac

SEQ ID NO: 727354 - RNA, 20 nt, Homo sapiens
agaacaucauuacuuaugau

SEQ ID NO: 727355 - RNA, 17 nt, Homo sapiens
agaacauggacuuguau

SEQ ID NO: 727356 - RNA, 16 nt, Homo sapiens
agaacauucuaccaaa

SEQ ID NO: 727357 - RNA, 14 nt, Homo sapiens
agaaccaaaagaga

SEQ ID NO: 727358 - RNA, 14 nt, Homo sapiens
agaaccaagcuuca

SEQ ID NO: 727359 - RNA, 20 nt, Homo sapiens
agaaccacacuugaaaccuu

SEQ ID NO: 727360 - RNA, 23 nt, Homo sapiens
agaaccacauauuuuagacacuu

SEQ ID NO: 727361 - RNA, 23 nt, Homo sapiens
agaaccaccauagugaaguguga

SEQ ID NO: 727362 - RNA, 19 nt, Homo sapiens
agaaccagggcucuucuca

SEQ ID NO: 727363 - RNA, 16 nt, Homo sapiens
agaacccuauccagug

SEQ ID NO: 727364 - RNA, 14 nt, Homo sapiens
agaacccugcugau

SEQ ID NO: 727365 - RNA, 16 nt, Homo sapiens
agaaccgagcaaagau

SEQ ID NO: 727366 - RNA, 18 nt, Homo sapiens
agaaccgagcaaagauca

SEQ ID NO: 727367 - RNA, 19 nt, Homo sapiens
agaaccucagauucuucau

SEQ ID NO: 727368 - RNA, 11 nt, Homo sapiens
agaaccucagg

SEQ ID NO: 727369 - RNA, 13 nt, Homo sapiens
agaaccuggaaaa

SEQ ID NO: 727370 - RNA, 20 nt, Homo sapiens
agaaccuggaaaaauuccag

SEQ ID NO: 727371 - RNA, 14 nt, Homo sapiens
agaaccuucaaccc

SEQ ID NO: 727372 - RNA, 20 nt, Homo sapiens
agaacguggugaccuuucac

SEQ ID NO: 727373 - RNA, 12 nt, Homo sapiens
agaacuauccaa

SEQ ID NO: 727374 - RNA, 16 nt, Homo sapiens
agaacuauguacuuua

SEQ ID NO: 727375 - RNA, 20 nt, Homo sapiens
agaacuccaguuuucaaauc

SEQ ID NO: 727376 - RNA, 18 nt, Homo sapiens
agaacucgcgcucaguaa

SEQ ID NO: 727377 - RNA, 22 nt, Homo sapiens
agaacucuccaucuuauuuuca

SEQ ID NO: 727378 - RNA, 18 nt, Homo sapiens
agaacucugggcugcuac

SEQ ID NO: 727379 - RNA, 18 nt, Homo sapiens
agaacugaauaaacagga

SEQ ID NO: 727380 - RNA, 14 nt, Homo sapiens
agaacuucaagaag

SEQ ID NO: 727381 - RNA, 15 nt, Homo sapiens
agaacuucagaaaga

SEQ ID NO: 727382 - RNA, 22 nt, Homo sapiens
agaacuuucuaguugcccucua

SEQ ID NO: 727383 - RNA, 15 nt, Homo sapiens
agaagaaaaauggaa

SEQ ID NO: 727384 - RNA, 16 nt, Homo sapiens
agaagaaaaauggaaa

SEQ ID NO: 727385 - RNA, 15 nt, Homo sapiens
agaagacaaagucua

SEQ ID NO: 727386 - RNA, 16 nt, Homo sapiens
agaagacaccaccauu

SEQ ID NO: 727387 - RNA, 13 nt, Homo sapiens
agaagacacugca

SEQ ID NO: 727388 - RNA, 20 nt, Homo sapiens
agaagacauccugagcagug

SEQ ID NO: 727389 - RNA, 20 nt, Homo sapiens
agaagacaucguaugcuugg

SEQ ID NO: 727390 - RNA, 18 nt, Homo sapiens
agaagagaaaugcugcua

SEQ ID NO: 727391 - RNA, 13 nt, Homo sapiens
agaagagauuucu

SEQ ID NO: 727392 - RNA, 12 nt, Homo sapiens
agaagagcaaaa

SEQ ID NO: 727393 - RNA, 16 nt, Homo sapiens
agaagaggaaagggag

SEQ ID NO: 727394 - RNA, 20 nt, Homo sapiens
agaagagguugggcuuccau

SEQ ID NO: 727395 - RNA, 15 nt, Homo sapiens
agaagauagauccaa

SEQ ID NO: 727396 - RNA, 20 nt, Homo sapiens
agaagaugaaagauucagug

SEQ ID NO: 727397 - RNA, 14 nt, Homo sapiens
agaagcaaacaagc

SEQ ID NO: 727398 - RNA, 14 nt, Homo sapiens
agaagcaaaccgcc

SEQ ID NO: 727399 - RNA, 18 nt, Homo sapiens
agaagcacugggugacca

SEQ ID NO: 727400 - RNA, 22 nt, Homo sapiens
agaagcauugccuggacugacc

SEQ ID NO: 727401 - RNA, 17 nt, Homo sapiens
agaagccaagcgcucau

SEQ ID NO: 727402 - RNA, 12 nt, Homo sapiens
agaagccaagga

SEQ ID NO: 727403 - RNA, 13 nt, Homo sapiens
agaagccacagug

SEQ ID NO: 727404 - RNA, 18 nt, Homo sapiens
agaagccaguggacaguu

SEQ ID NO: 727405 - RNA, 21 nt, Homo sapiens
agaagcccuguccuccacuca

SEQ ID NO: 727406 - RNA, 23 nt, Homo sapiens
agaagccucugccucccuagcuu

SEQ ID NO: 727407 - RNA, 18 nt, Homo sapiens
agaagcguuaugugcagu

SEQ ID NO: 727408 - RNA, 18 nt, Homo sapiens
agaagcuaaagucaucca

SEQ ID NO: 727409 - RNA, 22 nt, Homo sapiens
agaagcuagaaauuuagcaguc

SEQ ID NO: 727410 - RNA, 13 nt, Homo sapiens
agaagcucagcug

SEQ ID NO: 727411 - RNA, 20 nt, Homo sapiens
agaagcuuaaaaucugugaa

SEQ ID NO: 727412 - RNA, 16 nt, Homo sapiens
agaaggaacauugcag

SEQ ID NO: 727413 - RNA, 18 nt, Homo sapiens
agaaggcaguaguuuuca

SEQ ID NO: 727414 - RNA, 14 nt, Homo sapiens
agaaggccagcccu

SEQ ID NO: 727415 - RNA, 15 nt, Homo sapiens
agaaggcuaugggga

SEQ ID NO: 727416 - RNA, 18 nt, Homo sapiens
agaagggaauccuccucc

SEQ ID NO: 727417 - RNA, 15 nt, Homo sapiens
agaagggcacuguaa

SEQ ID NO: 727418 - RNA, 23 nt, Homo sapiens
agaagggccagauuucauucuca

SEQ ID NO: 727419 - RNA, 18 nt, Homo sapiens
agaagggcugaguggucu

SEQ ID NO: 727420 - RNA, 22 nt, Homo sapiens
agaaggguuuuccacccuggaa

SEQ ID NO: 727421 - RNA, 14 nt, Homo sapiens
agaagguaacucuu

SEQ ID NO: 727422 - RNA, 22 nt, Homo sapiens
agaagguuggugaauuucacaa

SEQ ID NO: 727423 - RNA, 12 nt, Homo sapiens
agaaguacuuua

SEQ ID NO: 727424 - RNA, 18 nt, Homo sapiens
agaaguacuuuauugcaa

SEQ ID NO: 727425 - RNA, 13 nt, Homo sapiens
agaaguaggcaug

SEQ ID NO: 727426 - RNA, 19 nt, Homo sapiens
agaagucacucacacuggc

SEQ ID NO: 727427 - RNA, 19 nt, Homo sapiens
agaagucauauguugucuu

SEQ ID NO: 727428 - RNA, 15 nt, Homo sapiens
agaagugaguggugu

SEQ ID NO: 727429 - RNA, 23 nt, Homo sapiens
agaagugaguuuguaaauauucu

SEQ ID NO: 727430 - RNA, 23 nt, Homo sapiens
agaagugauuagaggcagaucug

SEQ ID NO: 727431 - RNA, 19 nt, Homo sapiens
agaagugucguuuucauaa

SEQ ID NO: 727432 - RNA, 16 nt, Homo sapiens
agaagugucuaaaaac

SEQ ID NO: 727433 - RNA, 14 nt, Homo sapiens
agaaguucucagaa

SEQ ID NO: 727434 - RNA, 16 nt, Homo sapiens
agaaguugcaagacuc

SEQ ID NO: 727435 - RNA, 19 nt, Homo sapiens
agaaguugcuaagugugcu

SEQ ID NO: 727436 - RNA, 15 nt, Homo sapiens
agaaguuuguuauag

SEQ ID NO: 727437 - RNA, 21 nt, Homo sapiens
agaaguuuguuauagauuuag

SEQ ID NO: 727438 - RNA, 16 nt, Homo sapiens
agaauaaagauuuaua

SEQ ID NO: 727439 - RNA, 23 nt, Homo sapiens
agaauaagacaagagaucuacac

SEQ ID NO: 727440 - RNA, 16 nt, Homo sapiens
agaauaauaggccagg

SEQ ID NO: 727441 - RNA, 17 nt, Homo sapiens
agaauacacugugacuu

SEQ ID NO: 727442 - RNA, 18 nt, Homo sapiens
agaauacaguaagcugcu

SEQ ID NO: 727443 - RNA, 19 nt, Homo sapiens
agaauaccaccuaauccuu

SEQ ID NO: 727444 - RNA, 13 nt, Homo sapiens
agaauacuugacu

SEQ ID NO: 727445 - RNA, 14 nt, Homo sapiens
agaauagcuuugaa

SEQ ID NO: 727446 - RNA, 20 nt, Homo sapiens
agaauagcuuuuacucuggu

SEQ ID NO: 727447 - RNA, 18 nt, Homo sapiens
agaauaggaaaacauugc

SEQ ID NO: 727448 - RNA, 19 nt, Homo sapiens
agaauaucuguaaugguac

SEQ ID NO: 727449 - RNA, 13 nt, Homo sapiens
agaauaugacuuu

SEQ ID NO: 727450 - RNA, 12 nt, Homo sapiens
agaaucaaauac

SEQ ID NO: 727451 - RNA, 13 nt, Homo sapiens
agaaucagccugg

SEQ ID NO: 727452 - RNA, 13 nt, Homo sapiens
agaaucagucuug

SEQ ID NO: 727453 - RNA, 16 nt, Homo sapiens
agaauccaaagaucac

SEQ ID NO: 727454 - RNA, 21 nt, Homo sapiens
agaauccagcuacgaauauag

SEQ ID NO: 727455 - RNA, 15 nt, Homo sapiens
agaaucccugccugu

SEQ ID NO: 727456 - RNA, 19 nt, Homo sapiens
agaaucccuggcaaaggga

SEQ ID NO: 727457 - RNA, 16 nt, Homo sapiens
agaaucgcuagacuaa

SEQ ID NO: 727458 - RNA, 22 nt, Homo sapiens
agaaucucagucugucacccag

SEQ ID NO: 727459 - RNA, 12 nt, Homo sapiens
agaaucuugacu

SEQ ID NO: 727460 - RNA, 19 nt, Homo sapiens
agaaucuuguuuugaaaau

SEQ ID NO: 727461 - RNA, 21 nt, Homo sapiens
agaaugaauacugggaaucaa

SEQ ID NO: 727462 - RNA, 21 nt, Homo sapiens
agaaugaucuauugcucauca

SEQ ID NO: 727463 - RNA, 10 nt, Homo sapiens
agaaugcaac

SEQ ID NO: 727464 - RNA, 20 nt, Homo sapiens
agaaugcaagaguggacuga

SEQ ID NO: 727465 - RNA, 22 nt, Homo sapiens
agaaugcacaagaauggaucac

SEQ ID NO: 727466 - RNA, 13 nt, Homo sapiens
agaaugcauuccc

SEQ ID NO: 727467 - RNA, 14 nt, Homo sapiens
agaaugcuauuuca

SEQ ID NO: 727468 - RNA, 11 nt, Homo sapiens
agaaugcucuu

SEQ ID NO: 727469 - RNA, 14 nt, Homo sapiens
agaaugcuuugcca

SEQ ID NO: 727470 - RNA, 16 nt, Homo sapiens
agaauggaagccugaa

SEQ ID NO: 727471 - RNA, 16 nt, Homo sapiens
agaauggaauaagcag

SEQ ID NO: 727472 - RNA, 14 nt, Homo sapiens
agaauggagcagua

SEQ ID NO: 727473 - RNA, 18 nt, Homo sapiens
agaauuaaaaaagcauac

SEQ ID NO: 727474 - RNA, 18 nt, Homo sapiens
agaauuaagauacaaauu

SEQ ID NO: 727475 - RNA, 16 nt, Homo sapiens
agaauuacaguacaca

SEQ ID NO: 727476 - RNA, 19 nt, Homo sapiens
agaauuacaguacacaucc

SEQ ID NO: 727477 - RNA, 16 nt, Homo sapiens
agaauuaucaucccaa

SEQ ID NO: 727478 - RNA, 23 nt, Homo sapiens
agaauucagaagaccccugacuc

SEQ ID NO: 727479 - RNA, 17 nt, Homo sapiens
agaauucagacaucuga

SEQ ID NO: 727480 - RNA, 23 nt, Homo sapiens
agaauucugcuaccucacugggg

SEQ ID NO: 727481 - RNA, 15 nt, Homo sapiens
agaauugaccaaaua

SEQ ID NO: 727482 - RNA, 16 nt, Homo sapiens
agaauuggccaucuua

SEQ ID NO: 727483 - RNA, 17 nt, Homo sapiens
agaauuggccaucuuaa

SEQ ID NO: 727484 - RNA, 20 nt, Homo sapiens
agaauuuacucaggcaugau

SEQ ID NO: 727485 - RNA, 21 nt, Homo sapiens
agaauuuauucaauuccucug

SEQ ID NO: 727486 - RNA, 11 nt, Homo sapiens
agaauuugcac

SEQ ID NO: 727487 - RNA, 15 nt, Homo sapiens
agaauuugucagaaa

SEQ ID NO: 727488 - RNA, 21 nt, Homo sapiens
agaauuuugaguauuccauga

SEQ ID NO: 727489 - RNA, 16 nt, Homo sapiens
agacaaaauauuuccc

SEQ ID NO: 727490 - RNA, 14 nt, Homo sapiens
agacaaacacugcc

SEQ ID NO: 727491 - RNA, 16 nt, Homo sapiens
agacaacaguugcaca

SEQ ID NO: 727492 - RNA, 13 nt, Homo sapiens
agacaacauuucu

SEQ ID NO: 727493 - RNA, 15 nt, Homo sapiens
agacaacauuucuca

SEQ ID NO: 727494 - RNA, 17 nt, Homo sapiens
agacaagagaucuacac

SEQ ID NO: 727495 - RNA, 22 nt, Homo sapiens
agacaagagaucuacacauguu

SEQ ID NO: 727496 - RNA, 18 nt, Homo sapiens
agacaagauauuguacau

SEQ ID NO: 727497 - RNA, 14 nt, Homo sapiens
agacaagcacuauu

SEQ ID NO: 727498 - RNA, 16 nt, Homo sapiens
agacaagcugcauuuc

SEQ ID NO: 727499 - RNA, 16 nt, Homo sapiens
agacaaguauggcucc

SEQ ID NO: 727500 - RNA, 21 nt, Homo sapiens
agacaaguauggcuccuccau

SEQ ID NO: 727501 - RNA, 21 nt, Homo sapiens
agacaagugacuguaucugug

SEQ ID NO: 727502 - RNA, 20 nt, Homo sapiens
agacacaacuauuuuuccaa

SEQ ID NO: 727503 - RNA, 19 nt, Homo sapiens
agacacacuggaugugauu

SEQ ID NO: 727504 - RNA, 16 nt, Homo sapiens
agacaccaaaguucua

SEQ ID NO: 727505 - RNA, 17 nt, Homo sapiens
agacaccagcagcccug

SEQ ID NO: 727506 - RNA, 15 nt, Homo sapiens
agacaccaugugcaa

SEQ ID NO: 727507 - RNA, 17 nt, Homo sapiens
agacaccaugugcaaua

SEQ ID NO: 727508 - RNA, 18 nt, Homo sapiens
agacacgacagcacacac

SEQ ID NO: 727509 - RNA, 18 nt, Homo sapiens
agacacguggccucguga

SEQ ID NO: 727510 - RNA, 16 nt, Homo sapiens
agacacugagaucugu

SEQ ID NO: 727511 - RNA, 13 nt, Homo sapiens
agacagaagcuua

SEQ ID NO: 727512 - RNA, 17 nt, Homo sapiens
agacagagucucacuuu

SEQ ID NO: 727513 - RNA, 14 nt, Homo sapiens
agacagagucuuac

SEQ ID NO: 727514 - RNA, 21 nt, Homo sapiens
agacagcagggcucucuguau

SEQ ID NO: 727515 - RNA, 21 nt, Homo sapiens
agacaggaaaaagacuaagcc

SEQ ID NO: 727516 - RNA, 24 nt, Homo sapiens
agacaggaaaguuccagaaacuuu

SEQ ID NO: 727517 - RNA, 20 nt, Homo sapiens
agagucuugcucuguugccc

SEQ ID NO: 727518 - RNA, 19 nt, Homo sapiens
agagugagacccugucuca

SEQ ID NO: 727519 - RNA, 20 nt, Homo sapiens
agagugagacuccaccucaa

SEQ ID NO: 727520 - RNA, 20 nt, Homo sapiens
agagugagcaagggggccca

SEQ ID NO: 727521 - RNA, 13 nt, Homo sapiens
agagugagugcau

SEQ ID NO: 727522 - RNA, 14 nt, Homo sapiens
agagugauugcagc

SEQ ID NO: 727523 - RNA, 19 nt, Homo sapiens
agagugauugcagcuuuau

SEQ ID NO: 727524 - RNA, 22 nt, Homo sapiens
agagugcaguggcgcgaucuca

SEQ ID NO: 727525 - RNA, 23 nt, Homo sapiens
agagugccguaacaacugugguc

SEQ ID NO: 727526 - RNA, 18 nt, Homo sapiens
agagugcuauaaaagacu

SEQ ID NO: 727527 - RNA, 23 nt, Homo sapiens
agaguggaaugcuuccuagaagu

SEQ ID NO: 727528 - RNA, 23 nt, Homo sapiens
agaguggcuuggccucaagagaa

SEQ ID NO: 727529 - RNA, 19 nt, Homo sapiens
agaguggucuuucuggaga

SEQ ID NO: 727530 - RNA, 19 nt, Homo sapiens
agaguggugcugcuuuaau

SEQ ID NO: 727531 - RNA, 14 nt, Homo sapiens
agaguguagcugua

SEQ ID NO: 727532 - RNA, 15 nt, Homo sapiens
agagugugguuauga

SEQ ID NO: 727533 - RNA, 22 nt, Homo sapiens
agaguguuggaagucauuugau

SEQ ID NO: 727534 - RNA, 19 nt, Homo sapiens
agaguguuuaauuguacuc

SEQ ID NO: 727535 - RNA, 21 nt, Homo sapiens
agaguuaaaauguuuacugua

SEQ ID NO: 727536 - RNA, 18 nt, Homo sapiens
agaguuaaauaugcaucu

SEQ ID NO: 727537 - RNA, 17 nt, Homo sapiens
agaguuaacaaugauau

SEQ ID NO: 727538 - RNA, 15 nt, Homo sapiens
agaguuacaguucug

SEQ ID NO: 727539 - RNA, 19 nt, Homo sapiens
agaguuagguugucuccag

SEQ ID NO: 727540 - RNA, 15 nt, Homo sapiens
agaguucugcucuag

SEQ ID NO: 727541 - RNA, 16 nt, Homo sapiens
agaguugcuuaaugaa

SEQ ID NO: 727542 - RNA, 14 nt, Homo sapiens
agaguuuacugaag

SEQ ID NO: 727543 - RNA, 15 nt, Homo sapiens
agaguuucaaaagca

SEQ ID NO: 727544 - RNA, 21 nt, Homo sapiens
agaguuugcuauuagagcauu

SEQ ID NO: 727545 - RNA, 14 nt, Homo sapiens
agaguuuuaucaac

SEQ ID NO: 727546 - RNA, 23 nt, Homo sapiens
agauaaaagaaccgagcaauuuu

SEQ ID NO: 727547 - RNA, 17 nt, Homo sapiens
agauaaacaacaaauaa

SEQ ID NO: 727548 - RNA, 20 nt, Homo sapiens
agauaaaccaauaaauccac

SEQ ID NO: 727549 - RNA, 22 nt, Homo sapiens
agauaaagauuucuaguaggca

SEQ ID NO: 727550 - RNA, 13 nt, Homo sapiens
agauaaaugugcu

SEQ ID NO: 727551 - RNA, 14 nt, Homo sapiens
agauaaaugugcug

SEQ ID NO: 727552 - RNA, 23 nt, Homo sapiens
agauaacaagaucuuucaggaaa

SEQ ID NO: 727553 - RNA, 16 nt, Homo sapiens
agauaacuuacuguau

SEQ ID NO: 727554 - RNA, 17 nt, Homo sapiens
agauaagaaaugaucuu

SEQ ID NO: 727555 - RNA, 16 nt, Homo sapiens
agauaaguguucuuca

SEQ ID NO: 727556 - RNA, 15 nt, Homo sapiens
agauaauaucuguga

SEQ ID NO: 727557 - RNA, 16 nt, Homo sapiens
agauaauaucugugag

SEQ ID NO: 727558 - RNA, 22 nt, Homo sapiens
agauaauuggcaacugggugaa

SEQ ID NO: 727559 - RNA, 12 nt, Homo sapiens
agauacaaacug

SEQ ID NO: 727560 - RNA, 15 nt, Homo sapiens
agauacagccugcaa

SEQ ID NO: 727561 - RNA, 18 nt, Homo sapiens
agauacauaaaagugcuu

SEQ ID NO: 727562 - RNA, 22 nt, Homo sapiens
agauaccuggugagcucagaua

SEQ ID NO: 727563 - RNA, 17 nt, Homo sapiens
agauacuaucauuaaca

SEQ ID NO: 727564 - RNA, 16 nt, Homo sapiens
agauacuggaaaccua

SEQ ID NO: 727565 - RNA, 16 nt, Homo sapiens
agauagaaagcauuac

SEQ ID NO: 727566 - RNA, 14 nt, Homo sapiens
agauagaaccugga

SEQ ID NO: 727567 - RNA, 15 nt, Homo sapiens
agauagacggguuga

SEQ ID NO: 727568 - RNA, 18 nt, Homo sapiens
agauagggaaaaggggcu

SEQ ID NO: 727569 - RNA, 17 nt, Homo sapiens
agauagguggugccagu

SEQ ID NO: 727570 - RNA, 18 nt, Homo sapiens
agauaguccauaauguuc

SEQ ID NO: 727571 - RNA, 15 nt, Homo sapiens
agauauaaggggaaa

SEQ ID NO: 727572 - RNA, 23 nt, Homo sapiens
agauauaucccggaugaggcuga

SEQ ID NO: 727573 - RNA, 13 nt, Homo sapiens
agauauaugcucu

SEQ ID NO: 727574 - RNA, 17 nt, Homo sapiens
agauaucagagcucuua

SEQ ID NO: 727575 - RNA, 15 nt, Homo sapiens
agauaucagugucuc

SEQ ID NO: 727576 - RNA, 15 nt, Homo sapiens
agauaugaguucuuc

SEQ ID NO: 727577 - RNA, 21 nt, Homo sapiens
agauauguugaauuaacauaa

SEQ ID NO: 727578 - RNA, 23 nt, Homo sapiens
agauauguugagggcccaucucu

SEQ ID NO: 727579 - RNA, 17 nt, Homo sapiens
agauauuacagcuuauu

SEQ ID NO: 727580 - RNA, 19 nt, Homo sapiens
agauauuguaagcauucuu

SEQ ID NO: 727581 - RNA, 18 nt, Homo sapiens
agauauuuuaaacuuuug

SEQ ID NO: 727582 - RNA, 22 nt, Homo sapiens
agaucaaaauaaaaagugacac

SEQ ID NO: 727583 - RNA, 23 nt, Homo sapiens
agaucaaaauccuacagaugccu

SEQ ID NO: 727584 - RNA, 15 nt, Homo sapiens
agaucacaauacuca

SEQ ID NO: 727585 - RNA, 13 nt, Homo sapiens
agaucacaccacu

SEQ ID NO: 727586 - RNA, 18 nt, Homo sapiens
agaucacgucacugcacu

SEQ ID NO: 727587 - RNA, 10 nt, Homo sapiens
agaucacugc

SEQ ID NO: 727588 - RNA, 22 nt, Homo sapiens
agaucacugccacacucuccau

SEQ ID NO: 727589 - RNA, 20 nt, Homo sapiens
agaucacuuucucaguuuuc

SEQ ID NO: 727590 - RNA, 16 nt, Homo sapiens
agaucagguuugccca

SEQ ID NO: 727591 - RNA, 23 nt, Homo sapiens
agaucauaccacggcacuccagc

SEQ ID NO: 727592 - RNA, 14 nt, Homo sapiens
agaucaucagucac

SEQ ID NO: 727593 - RNA, 20 nt, Homo sapiens
agaucauccagaaguuccuc

SEQ ID NO: 727594 - RNA, 15 nt, Homo sapiens
agaucaugggucaag

SEQ ID NO: 727595 - RNA, 16 nt, Homo sapiens
agauccccccacugag

SEQ ID NO: 727596 - RNA, 13 nt, Homo sapiens
agauccucuggga

SEQ ID NO: 727597 - RNA, 15 nt, Homo sapiens
agauccuuaaaaccu

SEQ ID NO: 727598 - RNA, 17 nt, Homo sapiens
agauccuuaaugcagag

SEQ ID NO: 727599 - RNA, 20 nt, Homo sapiens
agauccuucgggugcuggaa

SEQ ID NO: 727600 - RNA, 20 nt, Homo sapiens
agaucgagaccauccuggcu

SEQ ID NO: 727601 - RNA, 18 nt, Homo sapiens
agaucgcaccacugcacu

SEQ ID NO: 727602 - RNA, 17 nt, Homo sapiens
agaucgcgccacugcac

SEQ ID NO: 727603 - RNA, 16 nt, Homo sapiens
agaucggccacagggc

SEQ ID NO: 727604 - RNA, 21 nt, Homo sapiens
agaucgugccauugcacucca

SEQ ID NO: 727605 - RNA, 18 nt, Homo sapiens
agaucgugcuacugcacu

SEQ ID NO: 727606 - RNA, 19 nt, Homo sapiens
agaucguucucugccucac

SEQ ID NO: 727607 - RNA, 16 nt, Homo sapiens
agaucuauguacugua

SEQ ID NO: 727608 - RNA, 17 nt, Homo sapiens
agaucuauguacuguaa

SEQ ID NO: 727609 - RNA, 18 nt, Homo sapiens
agaucuauguacuguaau

SEQ ID NO: 727610 - RNA, 19 nt, Homo sapiens
agaucugagauugaauauu

SEQ ID NO: 727611 - RNA, 17 nt, Homo sapiens
agaucugcacucaccuc

SEQ ID NO: 727612 - RNA, 18 nt, Homo sapiens
agaucuggucccuugcag

SEQ ID NO: 727613 - RNA, 22 nt, Homo sapiens
agaucuuaguucuagauggaga

SEQ ID NO: 727614 - RNA, 16 nt, Homo sapiens
agaucuucacucuggg

SEQ ID NO: 727615 - RNA, 15 nt, Homo sapiens
agaugaaagauucag

SEQ ID NO: 727616 - RNA, 18 nt, Homo sapiens
agaugaaagauucaguga

SEQ ID NO: 727617 - RNA, 16 nt, Homo sapiens
agaugaauaugagcuc

SEQ ID NO: 727618 - RNA, 18 nt, Homo sapiens
agaugaauggucuggcaa

SEQ ID NO: 727619 - RNA, 21 nt, Homo sapiens
agaugaauggucuggcaauau

SEQ ID NO: 727620 - RNA, 23 nt, Homo sapiens
agaugaauggucuggcaauauuc

SEQ ID NO: 727621 - RNA, 24 nt, Homo sapiens
agaugaccuacagugcuguguacc

SEQ ID NO: 727622 - RNA, 20 nt, Homo sapiens
agaugagauuggcauggcuu

SEQ ID NO: 727623 - RNA, 21 nt, Homo sapiens
agaugaguaauuucuuuggca

SEQ ID NO: 727624 - RNA, 14 nt, Homo sapiens
agaugaguuuugcc

SEQ ID NO: 727625 - RNA, 15 nt, Homo sapiens
agaugaguuuugcca

SEQ ID NO: 727626 - RNA, 17 nt, Homo sapiens
agaugaucccagucacu

SEQ ID NO: 727627 - RNA, 14 nt, Homo sapiens
agaugaugaugauc

SEQ ID NO: 727628 - RNA, 18 nt, Homo sapiens
agaugauuucaguucauc

SEQ ID NO: 727629 - RNA, 19 nt, Homo sapiens
agaugcaaggaccaggacu

SEQ ID NO: 727630 - RNA, 14 nt, Homo sapiens
agaugcacauagca

SEQ ID NO: 727631 - RNA, 17 nt, Homo sapiens
auauuaaaauauggcua

SEQ ID NO: 727632 - RNA, 20 nt, Homo sapiens
auauuaaauuucaaaugcag

SEQ ID NO: 727633 - RNA, 18 nt, Homo sapiens
auauuaauauauuuccau

SEQ ID NO: 727634 - RNA, 19 nt, Homo sapiens
auauuagccaguaccagcu

SEQ ID NO: 727635 - RNA, 12 nt, Homo sapiens
auauuagcuuua

SEQ ID NO: 727636 - RNA, 18 nt, Homo sapiens
auauuauuguaaccaaua

SEQ ID NO: 727637 - RNA, 19 nt, Homo sapiens
auauucaaugaacuuccau

SEQ ID NO: 727638 - RNA, 23 nt, Homo sapiens
auauucauuggcagcucaaagac

SEQ ID NO: 727639 - RNA, 17 nt, Homo sapiens
auauucauuuccacucu

SEQ ID NO: 727640 - RNA, 23 nt, Homo sapiens
auauuccccuuccuguguccaug

SEQ ID NO: 727641 - RNA, 22 nt, Homo sapiens
auauuccugguguagcacuuaa

SEQ ID NO: 727642 - RNA, 14 nt, Homo sapiens
auauucuacuaugc

SEQ ID NO: 727643 - RNA, 21 nt, Homo sapiens
auauucucaguguagggcaga

SEQ ID NO: 727644 - RNA, 17 nt, Homo sapiens
auauucugcaacacugu

SEQ ID NO: 727645 - RNA, 23 nt, Homo sapiens
auauucuguugcuuuacaguuac

SEQ ID NO: 727646 - RNA, 23 nt, Homo sapiens
auauugaacuuuuuuccacugaa

SEQ ID NO: 727647 - RNA, 15 nt, Homo sapiens
auauugcuucccugc

SEQ ID NO: 727648 - RNA, 21 nt, Homo sapiens
auauuguaauccuagcacuuu

SEQ ID NO: 727649 - RNA, 15 nt, Homo sapiens
auauuguacauaaaa

SEQ ID NO: 727650 - RNA, 17 nt, Homo sapiens
auauuguauaggggcaa

SEQ ID NO: 727651 - RNA, 19 nt, Homo sapiens
auauuguauuacuagaaga

SEQ ID NO: 727652 - RNA, 22 nt, Homo sapiens
auauugucugaacggcugaaua

SEQ ID NO: 727653 - RNA, 17 nt, Homo sapiens
auauugucugucucuau

SEQ ID NO: 727654 - RNA, 22 nt, Homo sapiens
auauugugaacccuagcugugu

SEQ ID NO: 727655 - RNA, 16 nt, Homo sapiens
auauugugauucugcc

SEQ ID NO: 727656 - RNA, 12 nt, Homo sapiens
auauuguugccg

SEQ ID NO: 727657 - RNA, 20 nt, Homo sapiens
auauuuaaaacaaagaagcu

SEQ ID NO: 727658 - RNA, 16 nt, Homo sapiens
auauuuaagugaagga

SEQ ID NO: 727659 - RNA, 19 nt, Homo sapiens
auauuuauagcaauccaug

SEQ ID NO: 727660 - RNA, 21 nt, Homo sapiens
auauuuaugagaaaguucuca

SEQ ID NO: 727661 - RNA, 15 nt, Homo sapiens
auauuucaaacauca

SEQ ID NO: 727662 - RNA, 17 nt, Homo sapiens
auauuuccuaaggcaug

SEQ ID NO: 727663 - RNA, 15 nt, Homo sapiens
auauuucuaacuaua

SEQ ID NO: 727664 - RNA, 16 nt, Homo sapiens
auauuucuaacuauau

SEQ ID NO: 727665 - RNA, 19 nt, Homo sapiens
auauuucuaccugagugaa

SEQ ID NO: 727666 - RNA, 21 nt, Homo sapiens
auauuuuaaauaucuuucaug

SEQ ID NO: 727667 - RNA, 21 nt, Homo sapiens
auauuuuacugaucucuuuaa

SEQ ID NO: 727668 - RNA, 17 nt, Homo sapiens
auauuuuagccacucaa

SEQ ID NO: 727669 - RNA, 13 nt, Homo sapiens
auauuuugcuaac

SEQ ID NO: 727670 - RNA, 20 nt, Homo sapiens
auauuuuucaucaaacauug

SEQ ID NO: 727671 - RNA, 14 nt, Homo sapiens
auauuuuugccaua

SEQ ID NO: 727672 - RNA, 14 nt, Homo sapiens
aucaaaaaguuuau

SEQ ID NO: 727673 - RNA, 18 nt, Homo sapiens
aucaaaagcuuauucauc

SEQ ID NO: 727674 - RNA, 15 nt, Homo sapiens
aucaaagaacaaaca

SEQ ID NO: 727675 - RNA, 17 nt, Homo sapiens
aucaaagaacaaacauc

SEQ ID NO: 727676 - RNA, 18 nt, Homo sapiens
aucaaagaacagaugggg

SEQ ID NO: 727677 - RNA, 17 nt, Homo sapiens
aucaaagccuggccuaa

SEQ ID NO: 727678 - RNA, 22 nt, Homo sapiens
aucaaaucucuuccacaugggu

SEQ ID NO: 727679 - RNA, 12 nt, Homo sapiens
aucaacaaagaa

SEQ ID NO: 727680 - RNA, 18 nt, Homo sapiens
aucaagaaaaaaagggag

SEQ ID NO: 727681 - RNA, 15 nt, Homo sapiens
aucaagaaaauaugc

SEQ ID NO: 727682 - RNA, 16 nt, Homo sapiens
aucaagagaaacuuca

SEQ ID NO: 727683 - RNA, 13 nt, Homo sapiens
aucaagcaaaaug

SEQ ID NO: 727684 - RNA, 12 nt, Homo sapiens
aucaagcacuuc

SEQ ID NO: 727685 - RNA, 17 nt, Homo sapiens
aucaagcccuuuacuug

SEQ ID NO: 727686 - RNA, 22 nt, Homo sapiens
aucaaggucuuuggucuucucc

SEQ ID NO: 727687 - RNA, 20 nt, Homo sapiens
aucaaguuguugacugugau

SEQ ID NO: 727688 - RNA, 20 nt, Homo sapiens
aucaauaggaaagcauaugc

SEQ ID NO: 727689 - RNA, 17 nt, Homo sapiens
aucaauauuauauucaa

SEQ ID NO: 727690 - RNA, 16 nt, Homo sapiens
aucaaucugcaguuua

SEQ ID NO: 727691 - RNA, 19 nt, Homo sapiens
aucaaucugcaguuuaaca

SEQ ID NO: 727692 - RNA, 13 nt, Homo sapiens
aucaaugucacuu

SEQ ID NO: 727693 - RNA, 16 nt, Homo sapiens
aucaauuacagauuaa

SEQ ID NO: 727694 - RNA, 17 nt, Homo sapiens
aucaauuuguaauugcu

SEQ ID NO: 727695 - RNA, 20 nt, Homo sapiens
aucaauuuuucccaguauuu

SEQ ID NO: 727696 - RNA, 16 nt, Homo sapiens
aucacaagauggaauu

SEQ ID NO: 727697 - RNA, 12 nt, Homo sapiens
aucacacagugu

SEQ ID NO: 727698 - RNA, 12 nt, Homo sapiens
aucacacuguaa

SEQ ID NO: 727699 - RNA, 16 nt, Homo sapiens
aucacauccuggccug

SEQ ID NO: 727700 - RNA, 15 nt, Homo sapiens
aucacauuaucaucu

SEQ ID NO: 727701 - RNA, 17 nt, Homo sapiens
aucacauuccucugccc

SEQ ID NO: 727702 - RNA, 16 nt, Homo sapiens
aucacccaagccacaa

SEQ ID NO: 727703 - RNA, 14 nt, Homo sapiens
aucacccucuuccu

SEQ ID NO: 727704 - RNA, 18 nt, Homo sapiens
aucacccuucccugcucc

SEQ ID NO: 727705 - RNA, 17 nt, Homo sapiens
aucacgccugugcagug

SEQ ID NO: 727706 - RNA, 22 nt, Homo sapiens
aucacgucacugcacuccagcu

SEQ ID NO: 727707 - RNA, 23 nt, Homo sapiens
aucacucuaauucggauuugcca

SEQ ID NO: 727708 - RNA, 12 nt, Homo sapiens
aucacugaauuu

SEQ ID NO: 727709 - RNA, 18 nt, Homo sapiens
aucacugacucugacuca

SEQ ID NO: 727710 - RNA, 19 nt, Homo sapiens
aucacugacucugacucau

SEQ ID NO: 727711 - RNA, 11 nt, Homo sapiens
aucacugccaa

SEQ ID NO: 727712 - RNA, 22 nt, Homo sapiens
aucacugccacacucuccauca

SEQ ID NO: 727713 - RNA, 21 nt, Homo sapiens
aucacugucuugccagauuac

SEQ ID NO: 727714 - RNA, 18 nt, Homo sapiens
aucacuucccuacaugga

SEQ ID NO: 727715 - RNA, 17 nt, Homo sapiens
aucacuugcacuccgga

SEQ ID NO: 727716 - RNA, 15 nt, Homo sapiens
aucacuuuaccugca

SEQ ID NO: 727717 - RNA, 20 nt, Homo sapiens
aucacuuucucaguuuucau

SEQ ID NO: 727718 - RNA, 15 nt, Homo sapiens
aucagaaauacaaaa

SEQ ID NO: 727719 - RNA, 15 nt, Homo sapiens
aucagaacauucagc

SEQ ID NO: 727720 - RNA, 17 nt, Homo sapiens
aucagaacuucaggugu

SEQ ID NO: 727721 - RNA, 15 nt, Homo sapiens
aucagacaagcacua

SEQ ID NO: 727722 - RNA, 16 nt, Homo sapiens
aucagaccauaauguu

SEQ ID NO: 727723 - RNA, 13 nt, Homo sapiens
aucagaccaugaa

SEQ ID NO: 727724 - RNA, 18 nt, Homo sapiens
aucagacgggcacagugg

SEQ ID NO: 727725 - RNA, 14 nt, Homo sapiens
aucagacucuguaa

SEQ ID NO: 727726 - RNA, 18 nt, Homo sapiens
aucagacugacaguuuac

SEQ ID NO: 727727 - RNA, 16 nt, Homo sapiens
aucagagaacuuuccc

SEQ ID NO: 727728 - RNA, 19 nt, Homo sapiens
aucagaugaacucaugucu

SEQ ID NO: 727729 - RNA, 17 nt, Homo sapiens
aucagaugcuccaagau

SEQ ID NO: 727730 - RNA, 21 nt, Homo sapiens
aucagcaauuucagaaccaaa

SEQ ID NO: 727731 - RNA, 14 nt, Homo sapiens
aucagcacugaaaa

SEQ ID NO: 727732 - RNA, 15 nt, Homo sapiens
aucagcaucacccgg

SEQ ID NO: 727733 - RNA, 21 nt, Homo sapiens
aucagccauaagaaagcacua

SEQ ID NO: 727734 - RNA, 13 nt, Homo sapiens
aucagccuugcua

SEQ ID NO: 727735 - RNA, 19 nt, Homo sapiens
aucagccuugcuaaagcua

SEQ ID NO: 727736 - RNA, 23 nt, Homo sapiens
aucagcuauuuugugaagccaug

SEQ ID NO: 727737 - RNA, 13 nt, Homo sapiens
aucagcugcugac

SEQ ID NO: 727738 - RNA, 21 nt, Homo sapiens
aucaggacucugacgucucuu

SEQ ID NO: 727739 - RNA, 22 nt, Homo sapiens
aucaggauccagucuggaaaac

SEQ ID NO: 727740 - RNA, 20 nt, Homo sapiens
aucaggccuggcacgguggc

SEQ ID NO: 727741 - RNA, 22 nt, Homo sapiens
aucagggacuugaaugcacuuu

SEQ ID NO: 727742 - RNA, 21 nt, Homo sapiens
aucagggaggguuaggaaaac

SEQ ID NO: 727743 - RNA, 21 nt, Homo sapiens
aucaggggugcauucuggcca

SEQ ID NO: 727744 - RNA, 21 nt, Homo sapiens
aucaggugcaggucagacucu

SEQ ID NO: 727745 - RNA, 15 nt, Homo sapiens
aucaguacugacuuu

SEQ ID NO: 727746 - RNA, 22 nt, Homo sapiens
aucaguauaauucuguacugau

SEQ ID NO: 727747 - RNA, 21 nt, Homo sapiens
aucaguccuaccuuugcugau

SEQ ID NO: 727748 - RNA, 17 nt, Homo sapiens
aucagugaagaugccag

SEQ ID NO: 727749 - RNA, 20 nt, Homo sapiens
aucagugaagccaaagggac

SEQ ID NO: 727750 - RNA, 15 nt, Homo sapiens
aucagugauuuucaa

SEQ ID NO: 727751 - RNA, 21 nt, Homo sapiens
aucagugauuuucaaaccuca

SEQ ID NO: 727752 - RNA, 14 nt, Homo sapiens
aucagugcagugau

SEQ ID NO: 727753 - RNA, 15 nt, Homo sapiens
aucaguuacuaagaa

SEQ ID NO: 727754 - RNA, 12 nt, Homo sapiens
aucaguugcuau

SEQ ID NO: 727755 - RNA, 16 nt, Homo sapiens
aucauaacauauagca

SEQ ID NO: 727756 - RNA, 17 nt, Homo sapiens
aucauaagggcacugag

SEQ ID NO: 727757 - RNA, 20 nt, Homo sapiens
aucauacuaaacuucaccua

SEQ ID NO: 727758 - RNA, 16 nt, Homo sapiens
aucauaugauucugcu

SEQ ID NO: 727759 - RNA, 23 nt, Homo sapiens
aucaucaacuaccauucuauucc

SEQ ID NO: 727760 - RNA, 13 nt, Homo sapiens
aucaucacuguaa

SEQ ID NO: 727761 - RNA, 13 nt, Homo sapiens
aucauccaagaca

SEQ ID NO: 727762 - RNA, 14 nt, Homo sapiens
aucauccaagacag

SEQ ID NO: 727763 - RNA, 21 nt, Homo sapiens
aucaucuauguauucaaguaa

SEQ ID NO: 727764 - RNA, 12 nt, Homo sapiens
aucaucucugca

SEQ ID NO: 727765 - RNA, 17 nt, Homo sapiens
aucaugaagcacaucaa

SEQ ID NO: 727766 - RNA, 13 nt, Homo sapiens
aucaugaauuaua

SEQ ID NO: 727767 - RNA, 20 nt, Homo sapiens
aucauggaaauguauuuuag

SEQ ID NO: 727768 - RNA, 15 nt, Homo sapiens
aucauggacugagcu

SEQ ID NO: 727769 - RNA, 20 nt, Homo sapiens
aucaugggccacaaggcaca

SEQ ID NO: 727770 - RNA, 18 nt, Homo sapiens
aucaugggccagagccuc

SEQ ID NO: 727771 - RNA, 16 nt, Homo sapiens
aucauguccauacacu

SEQ ID NO: 727772 - RNA, 12 nt, Homo sapiens
aucauguuccua

SEQ ID NO: 727773 - RNA, 12 nt, Homo sapiens
aucauguuugcu

SEQ ID NO: 727774 - RNA, 15 nt, Homo sapiens
aucauuaucagccug

SEQ ID NO: 727775 - RNA, 17 nt, Homo sapiens
aucauuccuucuggccu

SEQ ID NO: 727776 - RNA, 15 nt, Homo sapiens
aucauugcaccugca

SEQ ID NO: 727777 - RNA, 19 nt, Homo sapiens
aucauuuuuguaucuacau

SEQ ID NO: 727778 - RNA, 23 nt, Homo sapiens
auccaaaaauguguaagaacaac

SEQ ID NO: 727779 - RNA, 13 nt, Homo sapiens
auccaaaagacaa

SEQ ID NO: 727780 - RNA, 16 nt, Homo sapiens
auccaaauuaaaggaa

SEQ ID NO: 727781 - RNA, 17 nt, Homo sapiens
auccaacuccagcaacu

SEQ ID NO: 727782 - RNA, 23 nt, Homo sapiens
auccaagcaucccuuugcccaga

SEQ ID NO: 727783 - RNA, 21 nt, Homo sapiens
auccaauauguuuccaucacu

SEQ ID NO: 727784 - RNA, 17 nt, Homo sapiens
auccaaugaguguuaca

SEQ ID NO: 727785 - RNA, 21 nt, Homo sapiens
auccacacggcugaccucaua

SEQ ID NO: 727786 - RNA, 15 nt, Homo sapiens
auccacacugcacac

SEQ ID NO: 727787 - RNA, 14 nt, Homo sapiens
auccacaguacuca

SEQ ID NO: 727788 - RNA, 18 nt, Homo sapiens
auccaccaagaacauaag

SEQ ID NO: 727789 - RNA, 17 nt, Homo sapiens
auccaccaccuugccaa

SEQ ID NO: 727790 - RNA, 16 nt, Homo sapiens
auccacccaccucagc

SEQ ID NO: 727791 - RNA, 20 nt, Homo sapiens
auccacucuucuagggauau

SEQ ID NO: 727792 - RNA, 13 nt, Homo sapiens
auccacuuaccug

SEQ ID NO: 727793 - RNA, 17 nt, Homo sapiens
auccacuuugcucugaa

SEQ ID NO: 727794 - RNA, 16 nt, Homo sapiens
auccagaaauacuuaa

SEQ ID NO: 727795 - RNA, 18 nt, Homo sapiens
auccagaccaaccuucca

SEQ ID NO: 727796 - RNA, 12 nt, Homo sapiens
auccagcacugg

SEQ ID NO: 727797 - RNA, 23 nt, Homo sapiens
auccagcacuggugaacugagcu

SEQ ID NO: 727798 - RNA, 23 nt, Homo sapiens
auccagccagaccccacgcugac

SEQ ID NO: 727799 - RNA, 19 nt, Homo sapiens
auccagccaugccugaggu

SEQ ID NO: 727800 - RNA, 19 nt, Homo sapiens
auccaggaggcaguggaca

SEQ ID NO: 727801 - RNA, 19 nt, Homo sapiens
auccaggcccaacugugag

SEQ ID NO: 727802 - RNA, 15 nt, Homo sapiens
auccagucuauucac

SEQ ID NO: 727803 - RNA, 17 nt, Homo sapiens
auccauaaagacaauca

SEQ ID NO: 727804 - RNA, 17 nt, Homo sapiens
auccauaacuuuagucu

SEQ ID NO: 727805 - RNA, 16 nt, Homo sapiens
auccauaagauuugca

SEQ ID NO: 727806 - RNA, 23 nt, Homo sapiens
auccauaggcgcaggugcacagg

SEQ ID NO: 727807 - RNA, 18 nt, Homo sapiens
auccauauuuccuauugu

SEQ ID NO: 727808 - RNA, 13 nt, Homo sapiens
auccauccaaagg

SEQ ID NO: 727809 - RNA, 13 nt, Homo sapiens
auccaucccucca

SEQ ID NO: 727810 - RNA, 12 nt, Homo sapiens
auccaucucuca

SEQ ID NO: 727811 - RNA, 18 nt, Homo sapiens
auccaucuuuccauccau

SEQ ID NO: 727812 - RNA, 23 nt, Homo sapiens
auccaugcaccccaccagcaaua

SEQ ID NO: 727813 - RNA, 20 nt, Homo sapiens
auccaugcaccuaccuuaga

SEQ ID NO: 727814 - RNA, 20 nt, Homo sapiens
auccaugcaugugcauauag

SEQ ID NO: 727815 - RNA, 18 nt, Homo sapiens
auccauguaaauugcaaa

SEQ ID NO: 727816 - RNA, 15 nt, Homo sapiens
auccauucacaguuc

SEQ ID NO: 727817 - RNA, 21 nt, Homo sapiens
auccauucagaaagcauuuau

SEQ ID NO: 727818 - RNA, 17 nt, Homo sapiens
auccauuuuacacagca

SEQ ID NO: 727819 - RNA, 18 nt, Homo sapiens
aucccaaagcaaggagau

SEQ ID NO: 727820 - RNA, 16 nt, Homo sapiens
aucccaagaaugcaag

SEQ ID NO: 727821 - RNA, 15 nt, Homo sapiens
aucccaauaggcaga

SEQ ID NO: 727822 - RNA, 16 nt, Homo sapiens
aucccaaucaagguau

SEQ ID NO: 727823 - RNA, 12 nt, Homo sapiens
aucccacaucca

SEQ ID NO: 727824 - RNA, 17 nt, Homo sapiens
aucccacccacauguga

SEQ ID NO: 727825 - RNA, 18 nt, Homo sapiens
aucccacuucacugugag

SEQ ID NO: 727826 - RNA, 14 nt, Homo sapiens
aucccagcuacuca

SEQ ID NO: 727827 - RNA, 21 nt, Homo sapiens
aucccauggccaggugguugu

SEQ ID NO: 727828 - RNA, 16 nt, Homo sapiens
aucccauuuuauccca

SEQ ID NO: 727829 - RNA, 14 nt, Homo sapiens
auccccaacuccau

SEQ ID NO: 727830 - RNA, 18 nt, Homo sapiens
auccccaagugugaacaa

SEQ ID NO: 727831 - RNA, 14 nt, Homo sapiens
auccccacaaucug

SEQ ID NO: 727832 - RNA, 18 nt, Homo sapiens
auccccacccagucucau

SEQ ID NO: 727833 - RNA, 14 nt, Homo sapiens
auccccccacugag

SEQ ID NO: 727834 - RNA, 17 nt, Homo sapiens
auccccuggcuccagag

SEQ ID NO: 727835 - RNA, 19 nt, Homo sapiens
aucccgccgauagagggac

SEQ ID NO: 727836 - RNA, 22 nt, Homo sapiens
aucccgccucuucuucuucaga

SEQ ID NO: 727837 - RNA, 18 nt, Homo sapiens
aucccgugaaagaauuau

SEQ ID NO: 727838 - RNA, 12 nt, Homo sapiens
aucccuaccccc

SEQ ID NO: 727839 - RNA, 14 nt, Homo sapiens
aucccuccauucau

SEQ ID NO: 727840 - RNA, 19 nt, Homo sapiens
aucccucgggaagcagcca

SEQ ID NO: 727841 - RNA, 18 nt, Homo sapiens
aucccucgggugugcuau

SEQ ID NO: 727842 - RNA, 18 nt, Homo sapiens
aucccucugucaggguca

SEQ ID NO: 727843 - RNA, 17 nt, Homo sapiens
aucccugcucucugagu

SEQ ID NO: 727844 - RNA, 23 nt, Homo sapiens
aucccuggauguggauuucacac

SEQ ID NO: 727845 - RNA, 18 nt, Homo sapiens
aucccuuaacaguuguau

SEQ ID NO: 727846 - RNA, 18 nt, Homo sapiens
aucccuuugcaccugaga

SEQ ID NO: 727847 - RNA, 19 nt, Homo sapiens
aucccuuuuuuuacauuuc

SEQ ID NO: 727848 - RNA, 15 nt, Homo sapiens
auccgagugugauuu

SEQ ID NO: 727849 - RNA, 14 nt, Homo sapiens
auccgcgugugccu

SEQ ID NO: 727850 - RNA, 20 nt, Homo sapiens
auccggcagccuggauguuu

SEQ ID NO: 727851 - RNA, 13 nt, Homo sapiens
auccguacauuca

SEQ ID NO: 727852 - RNA, 17 nt, Homo sapiens
auccuaacguuugucau

SEQ ID NO: 727853 - RNA, 21 nt, Homo sapiens
auccuaccccuuugcacuugu

SEQ ID NO: 727854 - RNA, 15 nt, Homo sapiens
auccuagccaacauc

SEQ ID NO: 727855 - RNA, 21 nt, Homo sapiens
auccuagucuucacaacuuug

SEQ ID NO: 727856 - RNA, 20 nt, Homo sapiens
auccucacugggugggguga

SEQ ID NO: 727857 - RNA, 22 nt, Homo sapiens
auccucaugaggcuucucagcc

SEQ ID NO: 727858 - RNA, 13 nt, Homo sapiens
auccuccaacagc

SEQ ID NO: 727859 - RNA, 17 nt, Homo sapiens
auccuccaagaaucuau

SEQ ID NO: 727860 - RNA, 21 nt, Homo sapiens
augaagugggcuccaguauua

SEQ ID NO: 727861 - RNA, 18 nt, Homo sapiens
augaaguuaugcugucau

SEQ ID NO: 727862 - RNA, 19 nt, Homo sapiens
augaauaaaguugcuguga

SEQ ID NO: 727863 - RNA, 22 nt, Homo sapiens
augaauaaaguugcugugaaua

SEQ ID NO: 727864 - RNA, 23 nt, Homo sapiens
augaauagccaggccugaccuca

SEQ ID NO: 727865 - RNA, 21 nt, Homo sapiens
augaaucccacccacauguga

SEQ ID NO: 727866 - RNA, 13 nt, Homo sapiens
augaaucugcuca

SEQ ID NO: 727867 - RNA, 12 nt, Homo sapiens
augaaugaaacu

SEQ ID NO: 727868 - RNA, 23 nt, Homo sapiens
augaaugaaagaauaagugagua

SEQ ID NO: 727869 - RNA, 14 nt, Homo sapiens
augaaugaauaacu

SEQ ID NO: 727870 - RNA, 24 nt, Homo sapiens
augaaugcuuuuagugugugcaua

SEQ ID NO: 727871 - RNA, 20 nt, Homo sapiens
augaauggacucaaacugcc

SEQ ID NO: 727872 - RNA, 23 nt, Homo sapiens
augaauguuacuaaauuuucuaa

SEQ ID NO: 727873 - RNA, 22 nt, Homo sapiens
augaauuauauucaaugcauuu

SEQ ID NO: 727874 - RNA, 13 nt, Homo sapiens
augaauuauuaua

SEQ ID NO: 727875 - RNA, 12 nt, Homo sapiens
augacacagucu

SEQ ID NO: 727876 - RNA, 23 nt, Homo sapiens
augacaccuccauuucucuccag

SEQ ID NO: 727877 - RNA, 12 nt, Homo sapiens
augacacuacuu

SEQ ID NO: 727878 - RNA, 11 nt, Homo sapiens
augacacugac

SEQ ID NO: 727879 - RNA, 17 nt, Homo sapiens
augacagccagagccug

SEQ ID NO: 727880 - RNA, 16 nt, Homo sapiens
augacaguagcauuau

SEQ ID NO: 727881 - RNA, 22 nt, Homo sapiens
augacagugaagcagcacugug

SEQ ID NO: 727882 - RNA, 23 nt, Homo sapiens
augacagugaagcagcacuguga

SEQ ID NO: 727883 - RNA, 13 nt, Homo sapiens
augacagugcuaa

SEQ ID NO: 727884 - RNA, 13 nt, Homo sapiens
augacaugcacug

SEQ ID NO: 727885 - RNA, 14 nt, Homo sapiens
augacaugcacuga

SEQ ID NO: 727886 - RNA, 15 nt, Homo sapiens
augacaugcacugac

SEQ ID NO: 727887 - RNA, 16 nt, Homo sapiens
augaccacucuuggcu

SEQ ID NO: 727888 - RNA, 18 nt, Homo sapiens
augaccauauuuacucuu

SEQ ID NO: 727889 - RNA, 17 nt, Homo sapiens
augacccacccaguguc

SEQ ID NO: 727890 - RNA, 15 nt, Homo sapiens
augaccucaaugccu

SEQ ID NO: 727891 - RNA, 22 nt, Homo sapiens
augaccuuggacaaucaugaaa

SEQ ID NO: 727892 - RNA, 23 nt, Homo sapiens
augacgccugauggugcugcuca

SEQ ID NO: 727893 - RNA, 23 nt, Homo sapiens
augacgguguuaauuuugcuaac

SEQ ID NO: 727894 - RNA, 15 nt, Homo sapiens
augacgucaucauca

SEQ ID NO: 727895 - RNA, 21 nt, Homo sapiens
augacgucaucaucacauuca

SEQ ID NO: 727896 - RNA, 12 nt, Homo sapiens
augacuaaagag

SEQ ID NO: 727897 - RNA, 23 nt, Homo sapiens
augacuaaagagagaauguagau

SEQ ID NO: 727898 - RNA, 14 nt, Homo sapiens
augacuacuuuuuc

SEQ ID NO: 727899 - RNA, 15 nt, Homo sapiens
augacuccuuucucu

SEQ ID NO: 727900 - RNA, 16 nt, Homo sapiens
augacugaugacauau

SEQ ID NO: 727901 - RNA, 21 nt, Homo sapiens
augacugcaccaacaucauca

SEQ ID NO: 727902 - RNA, 14 nt, Homo sapiens
augacuguaucuug

SEQ ID NO: 727903 - RNA, 19 nt, Homo sapiens
augacuguuacagcuuucu

SEQ ID NO: 727904 - RNA, 18 nt, Homo sapiens
augacuucccugcuccaa

SEQ ID NO: 727905 - RNA, 19 nt, Homo sapiens
augacuucccugcuccaac

SEQ ID NO: 727906 - RNA, 16 nt, Homo sapiens
augacuugccauuaaa

SEQ ID NO: 727907 - RNA, 17 nt, Homo sapiens
augagaaaggacagagc

SEQ ID NO: 727908 - RNA, 20 nt, Homo sapiens
augagaagaaaaauggaaaa

SEQ ID NO: 727909 - RNA, 17 nt, Homo sapiens
augagaaguacuugguu

SEQ ID NO: 727910 - RNA, 20 nt, Homo sapiens
augagaaugaugcacacuga

SEQ ID NO: 727911 - RNA, 18 nt, Homo sapiens
augagacauccagcagau

SEQ ID NO: 727912 - RNA, 20 nt, Homo sapiens
augagagcaucagaguauua

SEQ ID NO: 727913 - RNA, 16 nt, Homo sapiens
augagaguuccuucuc

SEQ ID NO: 727914 - RNA, 16 nt, Homo sapiens
augagaucggagacaa

SEQ ID NO: 727915 - RNA, 17 nt, Homo sapiens
augagaugacauucacc

SEQ ID NO: 727916 - RNA, 20 nt, Homo sapiens
augagcacguuuuuguaaaa

SEQ ID NO: 727917 - RNA, 24 nt, Homo sapiens
augagcauccucucucacauggaa

SEQ ID NO: 727918 - RNA, 18 nt, Homo sapiens
augagcauuacuauucac

SEQ ID NO: 727919 - RNA, 19 nt, Homo sapiens
augagcccaccauuguuca

SEQ ID NO: 727920 - RNA, 18 nt, Homo sapiens
augagcugacaucucagu

SEQ ID NO: 727921 - RNA, 22 nt, Homo sapiens
augagcuggguacugacugaga

SEQ ID NO: 727922 - RNA, 22 nt, Homo sapiens
augagcuucaauauaagaagca

SEQ ID NO: 727923 - RNA, 22 nt, Homo sapiens
augagcuuucuuugcacuuaaa

SEQ ID NO: 727924 - RNA, 21 nt, Homo sapiens
augaggaaaacuguagucucu

SEQ ID NO: 727925 - RNA, 19 nt, Homo sapiens
augaggaauguacuuuuaa

SEQ ID NO: 727926 - RNA, 13 nt, Homo sapiens
augaggacagagg

SEQ ID NO: 727927 - RNA, 19 nt, Homo sapiens
augaggauuauugauagua

SEQ ID NO: 727928 - RNA, 15 nt, Homo sapiens
augaggccaucucag

SEQ ID NO: 727929 - RNA, 18 nt, Homo sapiens
augagggaaauugcuauu

SEQ ID NO: 727930 - RNA, 15 nt, Homo sapiens
augagguacucuccu

SEQ ID NO: 727931 - RNA, 17 nt, Homo sapiens
augaguaaaaacuagaa

SEQ ID NO: 727932 - RNA, 13 nt, Homo sapiens
augagucagucaa

SEQ ID NO: 727933 - RNA, 16 nt, Homo sapiens
augagugcaccugccu

SEQ ID NO: 727934 - RNA, 20 nt, Homo sapiens
augaguuggacuucagucuu

SEQ ID NO: 727935 - RNA, 16 nt, Homo sapiens
augaguuucacuguac

SEQ ID NO: 727936 - RNA, 20 nt, Homo sapiens
augaguuuuugauagcuuua

SEQ ID NO: 727937 - RNA, 20 nt, Homo sapiens
augauaaauuaagcaugaaa

SEQ ID NO: 727938 - RNA, 16 nt, Homo sapiens
augauaaggcucugaa

SEQ ID NO: 727939 - RNA, 15 nt, Homo sapiens
augauagaugacaaa

SEQ ID NO: 727940 - RNA, 13 nt, Homo sapiens
augauaugaccag

SEQ ID NO: 727941 - RNA, 19 nt, Homo sapiens
augaucaaaaccugugcca

SEQ ID NO: 727942 - RNA, 17 nt, Homo sapiens
augaucagcuguuuguc

SEQ ID NO: 727943 - RNA, 14 nt, Homo sapiens
augauccagaacag

SEQ ID NO: 727944 - RNA, 15 nt, Homo sapiens
augauccagaacagu

SEQ ID NO: 727945 - RNA, 15 nt, Homo sapiens
augaucccagucacu

SEQ ID NO: 727946 - RNA, 18 nt, Homo sapiens
augauccccaagugugaa

SEQ ID NO: 727947 - RNA, 19 nt, Homo sapiens
augaucuaauaaacuuuau

SEQ ID NO: 727948 - RNA, 17 nt, Homo sapiens
augaucuggauccacca

SEQ ID NO: 727949 - RNA, 12 nt, Homo sapiens
augaucuuggcu

SEQ ID NO: 727950 - RNA, 22 nt, Homo sapiens
augaugaaaaauuauaguagcu

SEQ ID NO: 727951 - RNA, 19 nt, Homo sapiens
augaugacugcuuaacucc

SEQ ID NO: 727952 - RNA, 19 nt, Homo sapiens
augaugagaguuucuguua

SEQ ID NO: 727953 - RNA, 18 nt, Homo sapiens
augaugagccuucgugcc

SEQ ID NO: 727954 - RNA, 22 nt, Homo sapiens
augaugagguuuucuuaacuua

SEQ ID NO: 727955 - RNA, 23 nt, Homo sapiens
augaugagucgguccucuuucca

SEQ ID NO: 727956 - RNA, 12 nt, Homo sapiens
augaugaucugg

SEQ ID NO: 727957 - RNA, 15 nt, Homo sapiens
augaugauguggaag

SEQ ID NO: 727958 - RNA, 13 nt, Homo sapiens
augaugcacuuau

SEQ ID NO: 727959 - RNA, 15 nt, Homo sapiens
augaugccacuuccc

SEQ ID NO: 727960 - RNA, 11 nt, Homo sapiens
augaugccaug

SEQ ID NO: 727961 - RNA, 22 nt, Homo sapiens
augaugcccagaugcucuacuu

SEQ ID NO: 727962 - RNA, 18 nt, Homo sapiens
augaugcgggacugcugg

SEQ ID NO: 727963 - RNA, 16 nt, Homo sapiens
augauggcaacagauc

SEQ ID NO: 727964 - RNA, 19 nt, Homo sapiens
augauggcaccacugcacu

SEQ ID NO: 727965 - RNA, 19 nt, Homo sapiens
augauggccuuacacugaa

SEQ ID NO: 727966 - RNA, 16 nt, Homo sapiens
augauggugacaugau

SEQ ID NO: 727967 - RNA, 23 nt, Homo sapiens
augauucaaaaagucacaguuaa

SEQ ID NO: 727968 - RNA, 14 nt, Homo sapiens
augauucaugagcu

SEQ ID NO: 727969 - RNA, 19 nt, Homo sapiens
augauuuagugaucaaauu

SEQ ID NO: 727970 - RNA, 21 nt, Homo sapiens
augauuuuaaguuucucugca

SEQ ID NO: 727971 - RNA, 14 nt, Homo sapiens
augauuuuauuuga

SEQ ID NO: 727972 - RNA, 21 nt, Homo sapiens
augauuuuguaaaaguggcau

SEQ ID NO: 727973 - RNA, 15 nt, Homo sapiens
augcaaaagguuuau

SEQ ID NO: 727974 - RNA, 14 nt, Homo sapiens
gcccacugccugcc

SEQ ID NO: 727975 - RNA, 22 nt, Homo sapiens
gcccacuucaccguacuaacca

SEQ ID NO: 727976 - RNA, 20 nt, Homo sapiens
gcccacuucccguuuccucu

SEQ ID NO: 727977 - RNA, 21 nt, Homo sapiens
gcccacuucccguuuccucuu

SEQ ID NO: 727978 - RNA, 20 nt, Homo sapiens
gcccagaacuggacucagga

SEQ ID NO: 727979 - RNA, 21 nt, Homo sapiens
gcccagaacuggacucaggau

SEQ ID NO: 727980 - RNA, 22 nt, Homo sapiens
gcccagagaagcaaguggcuuu

SEQ ID NO: 727981 - RNA, 14 nt, Homo sapiens
gcccagagcccagc

SEQ ID NO: 727982 - RNA, 15 nt, Homo sapiens
gcccagagcccagcu

SEQ ID NO: 727983 - RNA, 16 nt, Homo sapiens
gcccagagccucugcu

SEQ ID NO: 727984 - RNA, 21 nt, Homo sapiens
gcccagaucgcaccacugcac

SEQ ID NO: 727985 - RNA, 15 nt, Homo sapiens
gcccagaugaucacu

SEQ ID NO: 727986 - RNA, 18 nt, Homo sapiens
gcccagcaaucugcauuu

SEQ ID NO: 727987 - RNA, 19 nt, Homo sapiens
gcccagccccuacugcugu

SEQ ID NO: 727988 - RNA, 17 nt, Homo sapiens
gcccagccuacauucac

SEQ ID NO: 727989 - RNA, 12 nt, Homo sapiens
gcccagcuacau

SEQ ID NO: 727990 - RNA, 14 nt, Homo sapiens
gcccagcuacauuc

SEQ ID NO: 727991 - RNA, 23 nt, Homo sapiens
gcccagcuccaaggggaaucaga

SEQ ID NO: 727992 - RNA, 14 nt, Homo sapiens
gcccagcuccaggg

SEQ ID NO: 727993 - RNA, 14 nt, Homo sapiens
gcccagcugcucag

SEQ ID NO: 727994 - RNA, 23 nt, Homo sapiens
gcccagcuuauugugugcgcugc

SEQ ID NO: 727995 - RNA, 23 nt, Homo sapiens
gcccagcuuuuagaaaaugcagu

SEQ ID NO: 727996 - RNA, 15 nt, Homo sapiens
uucuuagguuuacug

SEQ ID NO: 727997 - RNA, 20 nt, Homo sapiens
uucuuagugcuucagaguuu

SEQ ID NO: 727998 - RNA, 14 nt, Homo sapiens
uucuuagugucacu

SEQ ID NO: 727999 - RNA, 22 nt, Homo sapiens
uucuuauaccacguuccacgga

SEQ ID NO: 728000 - RNA, 14 nt, Homo sapiens
uucuuauguuccag

SEQ ID NO: 728001 - RNA, 15 nt, Homo sapiens
uucuuauuaauuuca

SEQ ID NO: 728002 - RNA, 14 nt, Homo sapiens
uucuucagagacag

SEQ ID NO: 728003 - RNA, 21 nt, Homo sapiens
uucuucagauacaaacugcag

SEQ ID NO: 728004 - RNA, 13 nt, Homo sapiens
uucuucauggugu

SEQ ID NO: 728005 - RNA, 16 nt, Homo sapiens
uucuucauuaccucag

SEQ ID NO: 728006 - RNA, 20 nt, Homo sapiens
uucuuccaucaucacuguaa

SEQ ID NO: 728007 - RNA, 18 nt, Homo sapiens
uucuucccaguucuugac

SEQ ID NO: 728008 - RNA, 21 nt, Homo sapiens
uucuuccuuaaagcauuugca

SEQ ID NO: 728009 - RNA, 14 nt, Homo sapiens
uucuucuacugcua

SEQ ID NO: 728010 - RNA, 15 nt, Homo sapiens
uucuucuacugcuau

SEQ ID NO: 728011 - RNA, 12 nt, Homo sapiens
uucuucuauggg

SEQ ID NO: 728012 - RNA, 12 nt, Homo sapiens
uucuucugcaac

SEQ ID NO: 728013 - RNA, 16 nt, Homo sapiens
uucuucuguauguuag

SEQ ID NO: 728014 - RNA, 15 nt, Homo sapiens
uucuucuguccugag

SEQ ID NO: 728015 - RNA, 19 nt, Homo sapiens
uucuugcaagcaugcuugu

SEQ ID NO: 728016 - RNA, 15 nt, Homo sapiens
uucuugcaugaauca

SEQ ID NO: 728017 - RNA, 20 nt, Homo sapiens
uucuugccuuaaccagucuc

SEQ ID NO: 728018 - RNA, 19 nt, Homo sapiens
uucuugcuugacucuacua

SEQ ID NO: 728019 - RNA, 18 nt, Homo sapiens
uucuuggaugauugcagu

SEQ ID NO: 728020 - RNA, 13 nt, Homo sapiens
uucuugguauuau

SEQ ID NO: 728021 - RNA, 15 nt, Homo sapiens
uucuuguagaugcau

SEQ ID NO: 728022 - RNA, 20 nt, Homo sapiens
uucuuguauauuauggaaga

SEQ ID NO: 728023 - RNA, 23 nt, Homo sapiens
uucuuuaaggagauagacggguu

SEQ ID NO: 728024 - RNA, 18 nt, Homo sapiens
uucuuuaauguuguccag

SEQ ID NO: 728025 - RNA, 14 nt, Homo sapiens
uucuuuaccugaga

SEQ ID NO: 728026 - RNA, 18 nt, Homo sapiens
uucuuuccuucccaauag

SEQ ID NO: 728027 - RNA, 12 nt, Homo sapiens
uucuuucugucu

SEQ ID NO: 728028 - RNA, 13 nt, Homo sapiens
uucuuugaaguuu

SEQ ID NO: 728029 - RNA, 22 nt, Homo sapiens
uucuuugcaccaaagacaucag

SEQ ID NO: 728030 - RNA, 20 nt, Homo sapiens
uucuuugcugcagucaucua

SEQ ID NO: 728031 - RNA, 13 nt, Homo sapiens
uucuuugcugcug

SEQ ID NO: 728032 - RNA, 15 nt, Homo sapiens
uucuuugcugcugcu

SEQ ID NO: 728033 - RNA, 17 nt, Homo sapiens
uucuuugggccagacau

SEQ ID NO: 728034 - RNA, 19 nt, Homo sapiens
uucuuuguauaugcauucu

SEQ ID NO: 728035 - RNA, 13 nt, Homo sapiens
uucuuugugccuu

SEQ ID NO: 728036 - RNA, 16 nt, Homo sapiens
uucuuuuauacugaca

SEQ ID NO: 728037 - RNA, 13 nt, Homo sapiens
uucuuuugcucuu

SEQ ID NO: 728038 - RNA, 19 nt, Homo sapiens
uucuuuuggcuuccaugau

SEQ ID NO: 728039 - RNA, 13 nt, Homo sapiens
uucuuuuuccaca

SEQ ID NO: 728040 - RNA, 21 nt, Homo sapiens
uugaaaaagggaagccauucc

SEQ ID NO: 728041 - RNA, 19 nt, Homo sapiens
uugaaaaaugagagcugua

SEQ ID NO: 728042 - RNA, 12 nt, Homo sapiens
uugaaaacacuu

SEQ ID NO: 728043 - RNA, 12 nt, Homo sapiens
uugaaaaccaca

SEQ ID NO: 728044 - RNA, 16 nt, Homo sapiens
uugaaaacucacagaa

SEQ ID NO: 728045 - RNA, 16 nt, Homo sapiens
uugaaaauaaccuaau

SEQ ID NO: 728046 - RNA, 20 nt, Homo sapiens
uugaaaaugcaucacaugau

SEQ ID NO: 728047 - RNA, 15 nt, Homo sapiens
uugaaacugagaugu

SEQ ID NO: 728048 - RNA, 21 nt, Homo sapiens
uugaaacuuugggaaaacaug

SEQ ID NO: 728049 - RNA, 12 nt, Homo sapiens
uugaaagacauc

SEQ ID NO: 728050 - RNA, 15 nt, Homo sapiens
uugaaagaugcagug

SEQ ID NO: 728051 - RNA, 21 nt, Homo sapiens
uugaaagugcuucaaggguaa

SEQ ID NO: 728052 - RNA, 16 nt, Homo sapiens
uugaaauaagaauuca

SEQ ID NO: 728053 - RNA, 13 nt, Homo sapiens
uugaaauauucag

SEQ ID NO: 728054 - RNA, 23 nt, Homo sapiens
uugaaauauucagaaauucucca

SEQ ID NO: 728055 - RNA, 21 nt, Homo sapiens
uugaaaugcucuuuugcacaa

SEQ ID NO: 728056 - RNA, 13 nt, Homo sapiens
uugaaauguguaa

SEQ ID NO: 728057 - RNA, 17 nt, Homo sapiens
uugaaauuaaccauaga

SEQ ID NO: 728058 - RNA, 23 nt, Homo sapiens
uugaacaacuaggcuucagcaua

SEQ ID NO: 728059 - RNA, 16 nt, Homo sapiens
uugaacacaauugaua

SEQ ID NO: 728060 - RNA, 18 nt, Homo sapiens
uugaacuaggcugagcaa

SEQ ID NO: 728061 - RNA, 15 nt, Homo sapiens
uugaacuggaagaaa

SEQ ID NO: 728062 - RNA, 12 nt, Homo sapiens
uugaacuugagu

SEQ ID NO: 728063 - RNA, 20 nt, Homo sapiens
uugaacuuuuacuaaugauc

SEQ ID NO: 728064 - RNA, 14 nt, Homo sapiens
uugaagaagauaug

SEQ ID NO: 728065 - RNA, 21 nt, Homo sapiens
uugaagaugcuuguauuuuac

SEQ ID NO: 728066 - RNA, 14 nt, Homo sapiens
uugaagcccaagaa

SEQ ID NO: 728067 - RNA, 20 nt, Homo sapiens
uugaaggaguccuugcauca

SEQ ID NO: 728068 - RNA, 20 nt, Homo sapiens
uugaagggcaagaaauggcg

SEQ ID NO: 728069 - RNA, 22 nt, Homo sapiens
uugaaggguguugcacccuuuu

SEQ ID NO: 728070 - RNA, 13 nt, Homo sapiens
uugaaguuuacaa

SEQ ID NO: 728071 - RNA, 14 nt, Homo sapiens
uugaauacaacauu

SEQ ID NO: 728072 - RNA, 14 nt, Homo sapiens
uugaauacaaguuu

SEQ ID NO: 728073 - RNA, 21 nt, Homo sapiens
uugaauaccauuaaaacugcu

SEQ ID NO: 728074 - RNA, 17 nt, Homo sapiens
uugaauauauaugauga

SEQ ID NO: 728075 - RNA, 20 nt, Homo sapiens
uugaaucuacauucacuuuu

SEQ ID NO: 728076 - RNA, 15 nt, Homo sapiens
uugaaugaugagccu

SEQ ID NO: 728077 - RNA, 17 nt, Homo sapiens
uugaaugcagaagcaaa

SEQ ID NO: 728078 - RNA, 17 nt, Homo sapiens
uugaaugcugccagugu

SEQ ID NO: 728079 - RNA, 18 nt, Homo sapiens
uugaauggaaaacacaug

SEQ ID NO: 728080 - RNA, 19 nt, Homo sapiens
uugaauggaaaacacaugg

SEQ ID NO: 728081 - RNA, 19 nt, Homo sapiens
uugaaugugguuacuuccu

SEQ ID NO: 728082 - RNA, 21 nt, Homo sapiens
uugaaugugguuacuuccuac

SEQ ID NO: 728083 - RNA, 17 nt, Homo sapiens
uugacaaaguuacugau

SEQ ID NO: 728084 - RNA, 17 nt, Homo sapiens
uugacaacaucccacag

SEQ ID NO: 728085 - RNA, 17 nt, Homo sapiens
uugacaaccaugagacc

SEQ ID NO: 728086 - RNA, 17 nt, Homo sapiens
uugacaacugcacauga

SEQ ID NO: 728087 - RNA, 13 nt, Homo sapiens
uugacacacagca

SEQ ID NO: 728088 - RNA, 19 nt, Homo sapiens
uugacacuauucacuaaaa

SEQ ID NO: 728089 - RNA, 13 nt, Homo sapiens
uugacaggauuau

SEQ ID NO: 728090 - RNA, 18 nt, Homo sapiens
uugacaguugcagaauug

SEQ ID NO: 728091 - RNA, 18 nt, Homo sapiens
uugacauaauuucacuga

SEQ ID NO: 728092 - RNA, 13 nt, Homo sapiens
cuugaacacuggg

SEQ ID NO: 728093 - RNA, 22 nt, Homo sapiens
cuugaaccauaguuacuguaaa

SEQ ID NO: 728094 - RNA, 22 nt, Homo sapiens
cuugaacugaaggccacuugag

SEQ ID NO: 728095 - RNA, 13 nt, Homo sapiens
cuugaagacuccc

SEQ ID NO: 728096 - RNA, 15 nt, Homo sapiens
cuugaagccaaagaa

SEQ ID NO: 728097 - RNA, 18 nt, Homo sapiens
cuugaagggccagagcca

SEQ ID NO: 728098 - RNA, 19 nt, Homo sapiens
cuugaagggccagagccag

SEQ ID NO: 728099 - RNA, 16 nt, Homo sapiens
cuugaaggugcugacg

SEQ ID NO: 728100 - RNA, 12 nt, Homo sapiens
cuugaagucugu

SEQ ID NO: 728101 - RNA, 20 nt, Homo sapiens
cuugaaugcacuuuugcuca

SEQ ID NO: 728102 - RNA, 15 nt, Homo sapiens
cuugaaugcugccag

SEQ ID NO: 728103 - RNA, 18 nt, Homo sapiens
cuugaauggagcugguga

SEQ ID NO: 728104 - RNA, 18 nt, Homo sapiens
cuugaauuaguauuucag

SEQ ID NO: 728105 - RNA, 19 nt, Homo sapiens
cuugaauuccugaccucag

SEQ ID NO: 728106 - RNA, 23 nt, Homo sapiens
cuugaauuuuucuuccucuccac

SEQ ID NO: 728107 - RNA, 22 nt, Homo sapiens
cuugaauuuuuuuaauuuacac

SEQ ID NO: 728108 - RNA, 14 nt, Homo sapiens
cuugacaacaucug

SEQ ID NO: 728109 - RNA, 15 nt, Homo sapiens
cuugacaacaucuga

SEQ ID NO: 728110 - RNA, 16 nt, Homo sapiens
cuugacaaggacccuc

SEQ ID NO: 728111 - RNA, 15 nt, Homo sapiens
gaacugaaggcucag

SEQ ID NO: 728112 - RNA, 23 nt, Homo sapiens
gaacugaaguuuccgcccccgcc

SEQ ID NO: 728113 - RNA, 17 nt, Homo sapiens
gaacugaaucacuuaaa

SEQ ID NO: 728114 - RNA, 14 nt, Homo sapiens
gaacugacaaugaa

SEQ ID NO: 728115 - RNA, 23 nt, Homo sapiens
gaacugcuuuuccucaagcaaua

SEQ ID NO: 728116 - RNA, 16 nt, Homo sapiens
gaacuggacucaggau

SEQ ID NO: 728117 - RNA, 21 nt, Homo sapiens
gaacuggauucuuaaccaaga

SEQ ID NO: 728118 - RNA, 22 nt, Homo sapiens
gaacugggagcagcucugugac

SEQ ID NO: 728119 - RNA, 12 nt, Homo sapiens
gaacugugccac

SEQ ID NO: 728120 - RNA, 21 nt, Homo sapiens
gaacuguuagguucugaugac

SEQ ID NO: 728121 - RNA, 17 nt, Homo sapiens
gaacuuaauaacugugu

SEQ ID NO: 728122 - RNA, 18 nt, Homo sapiens
gaacuucaggugugacuc

SEQ ID NO: 728123 - RNA, 17 nt, Homo sapiens
gaacuucugacuacuug

SEQ ID NO: 728124 - RNA, 19 nt, Homo sapiens
gaacuucugacuacuuguu

SEQ ID NO: 728125 - RNA, 15 nt, Homo sapiens
gaacuugagcgugaa

SEQ ID NO: 728126 - RNA, 12 nt, Homo sapiens
gaacuugcaaua

SEQ ID NO: 728127 - RNA, 14 nt, Homo sapiens
gaacuugccuuaaa

SEQ ID NO: 728128 - RNA, 20 nt, Homo sapiens
gaacuugcugcugagugcac

SEQ ID NO: 728129 - RNA, 23 nt, Homo sapiens
gaacuuugcagcauaccaauuac

SEQ ID NO: 728130 - RNA, 21 nt, Homo sapiens
gaacuuuuuuagaaaugcaaa

SEQ ID NO: 728131 - RNA, 16 nt, Homo sapiens
gaagaaaagcugccau

SEQ ID NO: 728132 - RNA, 18 nt, Homo sapiens
gaagaaaagcugccauuu

SEQ ID NO: 728133 - RNA, 17 nt, Homo sapiens
gaagaaacacacuggau

SEQ ID NO: 728134 - RNA, 17 nt, Homo sapiens
gaagaaaccgauuuuua

SEQ ID NO: 728135 - RNA, 14 nt, Homo sapiens
gaagaaagcaacaa

SEQ ID NO: 728136 - RNA, 16 nt, Homo sapiens
gaagaaagcaacaaag

SEQ ID NO: 728137 - RNA, 19 nt, Homo sapiens
gaagaacaagaaauggaug

SEQ ID NO: 728138 - RNA, 19 nt, Homo sapiens
gaagaacaggccucuccau

SEQ ID NO: 728139 - RNA, 16 nt, Homo sapiens
gaagaaccaaauaccu

SEQ ID NO: 728140 - RNA, 18 nt, Homo sapiens
gaagaaccaaauaccuca

SEQ ID NO: 728141 - RNA, 20 nt, Homo sapiens
gaagaaguuggucaguauug

SEQ ID NO: 728142 - RNA, 15 nt, Homo sapiens
gaagaaugagcaaga

SEQ ID NO: 728143 - RNA, 14 nt, Homo sapiens
gaagacaacucugc

SEQ ID NO: 728144 - RNA, 11 nt, Homo sapiens
gaagacauuuu

SEQ ID NO: 728145 - RNA, 20 nt, Homo sapiens
gaagaccaaagcauugccug

SEQ ID NO: 728146 - RNA, 12 nt, Homo sapiens
gaagaccaaagu

SEQ ID NO: 728147 - RNA, 20 nt, Homo sapiens
gaagaccaagacacagauca

SEQ ID NO: 728148 - RNA, 16 nt, Homo sapiens
gaagacccacgugcua

SEQ ID NO: 728149 - RNA, 23 nt, Homo sapiens
gaagaccucguuuucuaaaggcu

SEQ ID NO: 728150 - RNA, 16 nt, Homo sapiens
gaagaccugcugaggg

SEQ ID NO: 728151 - RNA, 16 nt, Homo sapiens
gaagacuagaggccag

SEQ ID NO: 728152 - RNA, 20 nt, Homo sapiens
gaagacuccaguaugaaaau

SEQ ID NO: 728153 - RNA, 12 nt, Homo sapiens
gaagacucugac

SEQ ID NO: 728154 - RNA, 18 nt, Homo sapiens
gaagacuuaauucugauu

SEQ ID NO: 728155 - RNA, 19 nt, Homo sapiens
gaagacuuuaaaccaccua

SEQ ID NO: 728156 - RNA, 14 nt, Homo sapiens
gaagagaaaugcaa

SEQ ID NO: 728157 - RNA, 14 nt, Homo sapiens
gaagagaagcugcu

SEQ ID NO: 728158 - RNA, 17 nt, Homo sapiens
gaagagagagacccuca

SEQ ID NO: 728159 - RNA, 20 nt, Homo sapiens
gaagagauaaacgaccaaac

SEQ ID NO: 728160 - RNA, 14 nt, Homo sapiens
gaagagcaggugac

SEQ ID NO: 728161 - RNA, 14 nt, Homo sapiens
gaagagccaaagaa

SEQ ID NO: 728162 - RNA, 14 nt, Homo sapiens
gaagagcuauggcc

SEQ ID NO: 728163 - RNA, 17 nt, Homo sapiens
gaagagggacagaugaa

SEQ ID NO: 728164 - RNA, 14 nt, Homo sapiens
gaagagggucccuc

SEQ ID NO: 728165 - RNA, 14 nt, Homo sapiens
gaagagggucugca

SEQ ID NO: 728166 - RNA, 14 nt, Homo sapiens
gaagaggucugauu

SEQ ID NO: 728167 - RNA, 19 nt, Homo sapiens
gaagagguugggcuuccau

SEQ ID NO: 728168 - RNA, 18 nt, Homo sapiens
gaagaguauuuuugacag

SEQ ID NO: 728169 - RNA, 21 nt, Homo sapiens
gaagagucgaugaucaccaag

SEQ ID NO: 728170 - RNA, 19 nt, Homo sapiens
gaagaguggguuucacaag

SEQ ID NO: 728171 - RNA, 19 nt, Homo sapiens
gaagaguuaagaagaaaau

SEQ ID NO: 728172 - RNA, 16 nt, Homo sapiens
gaagaguuauaaagua

SEQ ID NO: 728173 - RNA, 21 nt, Homo sapiens
gaagauccaccuccccacugc

SEQ ID NO: 728174 - RNA, 22 nt, Homo sapiens
gaagaugauccacaacuugaga

SEQ ID NO: 728175 - RNA, 21 nt, Homo sapiens
gaagaugauuucaguucauca

SEQ ID NO: 728176 - RNA, 22 nt, Homo sapiens
gaagauguccgugagaacauca

SEQ ID NO: 728177 - RNA, 20 nt, Homo sapiens
gaagauguuucaaaaaaucu

SEQ ID NO: 728178 - RNA, 23 nt, Homo sapiens
gaagcaaaucagaaacuugugaa

SEQ ID NO: 728179 - RNA, 14 nt, Homo sapiens
gaagcaaucuuuga

SEQ ID NO: 728180 - RNA, 19 nt, Homo sapiens
gaagcacagagggcuaggg

SEQ ID NO: 728181 - RNA, 12 nt, Homo sapiens
gaagcacuacac

SEQ ID NO: 728182 - RNA, 23 nt, Homo sapiens
gaagcacuccucgguacucccau

SEQ ID NO: 728183 - RNA, 12 nt, Homo sapiens
gaagcagcauuu

SEQ ID NO: 728184 - RNA, 18 nt, Homo sapiens
gaagcagccagcucccca

SEQ ID NO: 728185 - RNA, 13 nt, Homo sapiens
gaagcagcugcuu

SEQ ID NO: 728186 - RNA, 19 nt, Homo sapiens
gaagcagugccuuccauaa

SEQ ID NO: 728187 - RNA, 19 nt, Homo sapiens
gaagcauauuuugcugguu

SEQ ID NO: 728188 - RNA, 21 nt, Homo sapiens
gaagcaucacauaaaaaugau

SEQ ID NO: 728189 - RNA, 18 nt, Homo sapiens
gaagcauuugauuuucaa

SEQ ID NO: 728190 - RNA, 18 nt, Homo sapiens
gaagccacaggccugaga

SEQ ID NO: 728191 - RNA, 20 nt, Homo sapiens
gaagccacugaagcugggau

SEQ ID NO: 728192 - RNA, 14 nt, Homo sapiens
gaagcccauaucac

SEQ ID NO: 728193 - RNA, 14 nt, Homo sapiens
gaagccccacuuga

SEQ ID NO: 728194 - RNA, 20 nt, Homo sapiens
gaagccgucugacuccagag

SEQ ID NO: 728195 - RNA, 17 nt, Homo sapiens
gaagcgagauguguggc

SEQ ID NO: 728196 - RNA, 14 nt, Homo sapiens
gaagcgcuucugca

SEQ ID NO: 728197 - RNA, 19 nt, Homo sapiens
gaagcguuuuucucaaagg

SEQ ID NO: 728198 - RNA, 12 nt, Homo sapiens
gaagcucucgau

SEQ ID NO: 728199 - RNA, 18 nt, Homo sapiens
gaagcucucgauggacaa

SEQ ID NO: 728200 - RNA, 22 nt, Homo sapiens
gaagcugcugaccaauugugcu

SEQ ID NO: 728201 - RNA, 20 nt, Homo sapiens
gaagcugcuguucuuagcaa

SEQ ID NO: 728202 - RNA, 14 nt, Homo sapiens
gaagcuggugaaag

SEQ ID NO: 728203 - RNA, 17 nt, Homo sapiens
gaagcuguauaauuaau

SEQ ID NO: 728204 - RNA, 21 nt, Homo sapiens
gaagcuguguccuugcaccug

SEQ ID NO: 728205 - RNA, 17 nt, Homo sapiens
gaagcuucuaauuagau

SEQ ID NO: 728206 - RNA, 15 nt, Homo sapiens
gaagcuuugcuuauu

SEQ ID NO: 728207 - RNA, 15 nt, Homo sapiens
gaaggaaaagcaaga

SEQ ID NO: 728208 - RNA, 14 nt, Homo sapiens
gaaggaaaaugaua

SEQ ID NO: 728209 - RNA, 12 nt, Homo sapiens
gaaggaaagcua

SEQ ID NO: 728210 - RNA, 18 nt, Homo sapiens
gaaggaauagccagagag

SEQ ID NO: 728211 - RNA, 15 nt, Homo sapiens
gaaggacacagugau

SEQ ID NO: 728212 - RNA, 21 nt, Homo sapiens
gaaggacacuagccugugcac

SEQ ID NO: 728213 - RNA, 15 nt, Homo sapiens
gaaggagagugcuug

SEQ ID NO: 728214 - RNA, 15 nt, Homo sapiens
gaaggagaugcugcu

SEQ ID NO: 728215 - RNA, 19 nt, Homo sapiens
gacacccucuggggguccu

SEQ ID NO: 728216 - RNA, 18 nt, Homo sapiens
gacaccgucccucaguga

SEQ ID NO: 728217 - RNA, 10 nt, Homo sapiens
gacaccucac

SEQ ID NO: 728218 - RNA, 15 nt, Homo sapiens
gacaccuccauuucu

SEQ ID NO: 728219 - RNA, 17 nt, Homo sapiens
gacccugauacaggcau

SEQ ID NO: 728220 - RNA, 16 nt, Homo sapiens
gacccuguccggccca

SEQ ID NO: 728221 - RNA, 14 nt, Homo sapiens
gacccuugucaucu

SEQ ID NO: 728222 - RNA, 13 nt, Homo sapiens
gaccguccagggg

SEQ ID NO: 728223 - RNA, 15 nt, Homo sapiens
gaccgugaccaucuu

SEQ ID NO: 728224 - RNA, 22 nt, Homo sapiens
gaccuaaauuauuuacugcaaa

SEQ ID NO: 728225 - RNA, 18 nt, Homo sapiens
gaccuaguagaguguaau

SEQ ID NO: 728226 - RNA, 16 nt, Homo sapiens
gaccucaagugaucug

SEQ ID NO: 728227 - RNA, 16 nt, Homo sapiens
gaccucaccuagaaau

SEQ ID NO: 728228 - RNA, 22 nt, Homo sapiens
gaccucacugugaccuugacuu

SEQ ID NO: 728229 - RNA, 22 nt, Homo sapiens
gaccucaggugauccacccacc

SEQ ID NO: 728230 - RNA, 14 nt, Homo sapiens
gaccucaggugauu

SEQ ID NO: 728231 - RNA, 19 nt, Homo sapiens
gaccucucucaaagugcug

SEQ ID NO: 728232 - RNA, 12 nt, Homo sapiens
gaccugauguaa

SEQ ID NO: 728233 - RNA, 21 nt, Homo sapiens
gaccugauguaaacagugucu

SEQ ID NO: 728234 - RNA, 14 nt, Homo sapiens
gaccugcaggccaa

SEQ ID NO: 728235 - RNA, 15 nt, Homo sapiens
gaccugccugcauuc

SEQ ID NO: 728236 - RNA, 13 nt, Homo sapiens
gaccuggaaccag

SEQ ID NO: 728237 - RNA, 18 nt, Homo sapiens
gaccuggcucucagagga

SEQ ID NO: 728238 - RNA, 17 nt, Homo sapiens
gaccugucucuaccuaa

SEQ ID NO: 728239 - RNA, 13 nt, Homo sapiens
gaccuuaagacag

SEQ ID NO: 728240 - RNA, 15 nt, Homo sapiens
gaccuucagagccag

SEQ ID NO: 728241 - RNA, 18 nt, Homo sapiens
gaccuugacagagcagcu

SEQ ID NO: 728242 - RNA, 18 nt, Homo sapiens
gaccuuuuggaaugacug

SEQ ID NO: 728243 - RNA, 23 nt, Homo sapiens
gaccuuuuuuuuuuuaauggcaa

SEQ ID NO: 728244 - RNA, 17 nt, Homo sapiens
gacgacaagugcugaac

SEQ ID NO: 728245 - RNA, 18 nt, Homo sapiens
gacgagcaugagcuggau

SEQ ID NO: 728246 - RNA, 15 nt, Homo sapiens
gacgaggcucaaaaa

SEQ ID NO: 728247 - RNA, 16 nt, Homo sapiens
gacgaguaacuccccu

SEQ ID NO: 728248 - RNA, 14 nt, Homo sapiens
gacgauucuuaaca

SEQ ID NO: 728249 - RNA, 22 nt, Homo sapiens
gacgcugcugucacaaccaaga

SEQ ID NO: 728250 - RNA, 17 nt, Homo sapiens
gacggaguccuguguuu

SEQ ID NO: 728251 - RNA, 15 nt, Homo sapiens
gacggaugauuggau

SEQ ID NO: 728252 - RNA, 22 nt, Homo sapiens
gacggcacccacacacaaagag

SEQ ID NO: 728253 - RNA, 20 nt, Homo sapiens
gacgggcacacagacuggag

SEQ ID NO: 728254 - RNA, 20 nt, Homo sapiens
gacggggggugggaacaaga

SEQ ID NO: 728255 - RNA, 11 nt, Homo sapiens
gacggugccaa

SEQ ID NO: 728256 - RNA, 18 nt, Homo sapiens
gacggugcccaagccaga

SEQ ID NO: 728257 - RNA, 12 nt, Homo sapiens
gacgugcacugu

SEQ ID NO: 728258 - RNA, 13 nt, Homo sapiens
gacguuucugggc

SEQ ID NO: 728259 - RNA, 14 nt, Homo sapiens
gacuaaaugaacua

SEQ ID NO: 728260 - RNA, 16 nt, Homo sapiens
gacuaacccaaugccu

SEQ ID NO: 728261 - RNA, 21 nt, Homo sapiens
gacuaacccaaugccugugaa

SEQ ID NO: 728262 - RNA, 23 nt, Homo sapiens
gacuaaccccaacgcacaggaaa

SEQ ID NO: 728263 - RNA, 15 nt, Homo sapiens
gacuaagcauugagc

SEQ ID NO: 728264 - RNA, 20 nt, Homo sapiens
gacuacccauagacaugaaa

SEQ ID NO: 728265 - RNA, 12 nt, Homo sapiens
gacuacugccca

SEQ ID NO: 728266 - RNA, 18 nt, Homo sapiens
gacuacuuguuguaucug

SEQ ID NO: 728267 - RNA, 18 nt, Homo sapiens
gacuagagcuuucuuuca

SEQ ID NO: 728268 - RNA, 21 nt, Homo sapiens
gacuagccaggaaguacuucc

SEQ ID NO: 728269 - RNA, 16 nt, Homo sapiens
gacuaggugcuugcuu

SEQ ID NO: 728270 - RNA, 18 nt, Homo sapiens
gacuauaaagcuguuauu

SEQ ID NO: 728271 - RNA, 12 nt, Homo sapiens
gacuauggagcc

SEQ ID NO: 728272 - RNA, 12 nt, Homo sapiens
gacuauggagcu

SEQ ID NO: 728273 - RNA, 18 nt, Homo sapiens
gacuauuugcuuauuuaa

SEQ ID NO: 728274 - RNA, 15 nt, Homo sapiens
gacuauuuuauauga

SEQ ID NO: 728275 - RNA, 13 nt, Homo sapiens
gacucaaacugcc

SEQ ID NO: 728276 - RNA, 19 nt, Homo sapiens
gacucaaauguucuaaguu

SEQ ID NO: 728277 - RNA, 21 nt, Homo sapiens
gacucacuagacucaggaaag

SEQ ID NO: 728278 - RNA, 17 nt, Homo sapiens
gacucaggaccagaugu

SEQ ID NO: 728279 - RNA, 12 nt, Homo sapiens
gacucaguucca

SEQ ID NO: 728280 - RNA, 11 nt, Homo sapiens
gacucaucccc

SEQ ID NO: 728281 - RNA, 23 nt, Homo sapiens
gacucauggcagcuguuucucau

SEQ ID NO: 728282 - RNA, 15 nt, Homo sapiens
gacuccagccugaau

SEQ ID NO: 728283 - RNA, 17 nt, Homo sapiens
gacucccacucuuugaa

SEQ ID NO: 728284 - RNA, 19 nt, Homo sapiens
gacucucacacugaaucag

SEQ ID NO: 728285 - RNA, 16 nt, Homo sapiens
gacucuccagccaccc

SEQ ID NO: 728286 - RNA, 21 nt, Homo sapiens
gacucucucugggaggccaua

SEQ ID NO: 728287 - RNA, 15 nt, Homo sapiens
gacucugaccacagc

SEQ ID NO: 728288 - RNA, 15 nt, Homo sapiens
gacucugcacauguc

SEQ ID NO: 728289 - RNA, 17 nt, Homo sapiens
gacucuguaauugaaua

SEQ ID NO: 728290 - RNA, 18 nt, Homo sapiens
gacugaaggggcacacca

SEQ ID NO: 728291 - RNA, 13 nt, Homo sapiens
gacugacaguuua

SEQ ID NO: 728292 - RNA, 17 nt, Homo sapiens
gacugaccauauugugc

SEQ ID NO: 728293 - RNA, 14 nt, Homo sapiens
gacugaugucaucu

SEQ ID NO: 728294 - RNA, 13 nt, Homo sapiens
gacugauucugug

SEQ ID NO: 728295 - RNA, 12 nt, Homo sapiens
gacugauuucag

SEQ ID NO: 728296 - RNA, 16 nt, Homo sapiens
gacugcaucucaaaaa

SEQ ID NO: 728297 - RNA, 20 nt, Homo sapiens
gacugccacccacacgcccu

SEQ ID NO: 728298 - RNA, 22 nt, Homo sapiens
gacugcuggcaugcagugcccu

SEQ ID NO: 728299 - RNA, 23 nt, Homo sapiens
gacuggcaguaaccuagugaauu

SEQ ID NO: 728300 - RNA, 14 nt, Homo sapiens
gacuggcugugaga

SEQ ID NO: 728301 - RNA, 17 nt, Homo sapiens
gacuggggagggcugca

SEQ ID NO: 728302 - RNA, 21 nt, Homo sapiens
gacugggugagacccaaagcg

SEQ ID NO: 728303 - RNA, 13 nt, Homo sapiens
gacuggguggucc

SEQ ID NO: 728304 - RNA, 18 nt, Homo sapiens
gacugguuguugccaaac

SEQ ID NO: 728305 - RNA, 21 nt, Homo sapiens
gacuguaaaugaggacuucug

SEQ ID NO: 728306 - RNA, 14 nt, Homo sapiens
gacuguacuccucc

SEQ ID NO: 728307 - RNA, 15 nt, Homo sapiens
gacugugacuuucaa

SEQ ID NO: 728308 - RNA, 19 nt, Homo sapiens
gacugugaggcggcagcug

SEQ ID NO: 728309 - RNA, 13 nt, Homo sapiens
gacuguugcucaa

SEQ ID NO: 728310 - RNA, 14 nt, Homo sapiens
gacuguugcucaaa

SEQ ID NO: 728311 - RNA, 20 nt, Homo sapiens
gacuuaaaacauggugccua

SEQ ID NO: 728312 - RNA, 14 nt, Homo sapiens
gacuuaaugugauu

SEQ ID NO: 728313 - RNA, 17 nt, Homo sapiens
gacuuacaaaaugccaa

SEQ ID NO: 728314 - RNA, 18 nt, Homo sapiens
gacuuacaaaaugccaag

SEQ ID NO: 728315 - RNA, 17 nt, Homo sapiens
gacuuaguugcguuaca

SEQ ID NO: 728316 - RNA, 21 nt, Homo sapiens
gacuuauuaugcauaaagcca

SEQ ID NO: 728317 - RNA, 22 nt, Homo sapiens
gacuucagcucagagagcacca

SEQ ID NO: 728318 - RNA, 17 nt, Homo sapiens
gacuucagucuugccua

SEQ ID NO: 728319 - RNA, 15 nt, Homo sapiens
gacuucccacuguuc

SEQ ID NO: 728320 - RNA, 23 nt, Homo sapiens
gacuuccccacugcucucugugg

SEQ ID NO: 728321 - RNA, 23 nt, Homo sapiens
gacuuccuuuauaauauuucagu

SEQ ID NO: 728322 - RNA, 16 nt, Homo sapiens
gacuucuaccugcccu

SEQ ID NO: 728323 - RNA, 12 nt, Homo sapiens
gacuucucugaa

SEQ ID NO: 728324 - RNA, 20 nt, Homo sapiens
gacuucugucuucacaacag

SEQ ID NO: 728325 - RNA, 23 nt, Homo sapiens
gacuugaaaugcucuuuugcaca

SEQ ID NO: 728326 - RNA, 16 nt, Homo sapiens
gacuugaaauucucau

SEQ ID NO: 728327 - RNA, 21 nt, Homo sapiens
gacuugaacuagauugcaugc

SEQ ID NO: 728328 - RNA, 17 nt, Homo sapiens
gacuugauuagugccuu

SEQ ID NO: 728329 - RNA, 19 nt, Homo sapiens
gacuuggagccccuuggag

SEQ ID NO: 728330 - RNA, 12 nt, Homo sapiens
gacuuggcacuu

SEQ ID NO: 728331 - RNA, 22 nt, Homo sapiens
gacuugugauuggcugcaggaa

SEQ ID NO: 728332 - RNA, 15 nt, Homo sapiens
gacuuuagaaauaaa

SEQ ID NO: 728333 - RNA, 18 nt, Homo sapiens
gacuuuauucggaccaag

SEQ ID NO: 728334 - RNA, 13 nt, Homo sapiens
gagcaacugcugu

SEQ ID NO: 728335 - RNA, 18 nt, Homo sapiens
gagcaagaccccaucuca

SEQ ID NO: 728336 - RNA, 15 nt, Homo sapiens
cagcccaugugcacc

SEQ ID NO: 728337 - RNA, 15 nt, Homo sapiens
cagccccaagcuggg

SEQ ID NO: 728338 - RNA, 15 nt, Homo sapiens
cagccccacugccag

SEQ ID NO: 728339 - RNA, 22 nt, Homo sapiens
cagccccuccuccucgggcaca

SEQ ID NO: 728340 - RNA, 15 nt, Homo sapiens
cagcccgcuuggcca

SEQ ID NO: 728341 - RNA, 15 nt, Homo sapiens
cagcccugcaccaug

SEQ ID NO: 728342 - RNA, 19 nt, Homo sapiens
cagcccugcaccaugcugc

SEQ ID NO: 728343 - RNA, 20 nt, Homo sapiens
cagcccugcaccaugcugcu

SEQ ID NO: 728344 - RNA, 21 nt, Homo sapiens
cagcccugcaccaugcugcug

SEQ ID NO: 728345 - RNA, 18 nt, Homo sapiens
cagcccugucacgccggg

SEQ ID NO: 728346 - RNA, 19 nt, Homo sapiens
cagcccugugugugucacc

SEQ ID NO: 728347 - RNA, 23 nt, Homo sapiens
cagccgccagcugggagcacugg

SEQ ID NO: 728348 - RNA, 15 nt, Homo sapiens
cagccguauuuuaca

SEQ ID NO: 728349 - RNA, 16 nt, Homo sapiens
cagccuacaaagagau

SEQ ID NO: 728350 - RNA, 13 nt, Homo sapiens
cagccucaagucu

SEQ ID NO: 728351 - RNA, 13 nt, Homo sapiens
cagccucaucucu

SEQ ID NO: 728352 - RNA, 12 nt, Homo sapiens
cagccuccaaag

SEQ ID NO: 728353 - RNA, 22 nt, Homo sapiens
cagccuccaaaguggagcuggg

SEQ ID NO: 728354 - RNA, 22 nt, Homo sapiens
cagccuccagggcauugcucag

SEQ ID NO: 728355 - RNA, 17 nt, Homo sapiens
cagccucccaaagugcu

SEQ ID NO: 728356 - RNA, 23 nt, Homo sapiens
cagccucccucccugugccagac

SEQ ID NO: 728357 - RNA, 14 nt, Homo sapiens
cagccucccugaag

SEQ ID NO: 728358 - RNA, 15 nt, Homo sapiens
cagccucccuuugau

SEQ ID NO: 728359 - RNA, 17 nt, Homo sapiens
cagccuccuccugacca

SEQ ID NO: 728360 - RNA, 18 nt, Homo sapiens
cagccuccugaguagcug

SEQ ID NO: 728361 - RNA, 20 nt, Homo sapiens
cagccuccugaguagcuggg

SEQ ID NO: 728362 - RNA, 23 nt, Homo sapiens
cagccuccugaguagcugggauu

SEQ ID NO: 728363 - RNA, 14 nt, Homo sapiens
cagccuccugcuaa

SEQ ID NO: 728364 - RNA, 20 nt, Homo sapiens
cagccugaauguuauuuccu

SEQ ID NO: 728365 - RNA, 13 nt, Homo sapiens
cagccugccaaau

SEQ ID NO: 728366 - RNA, 13 nt, Homo sapiens
cagccuggaaggg

SEQ ID NO: 728367 - RNA, 18 nt, Homo sapiens
cagccuggauguuuuuuc

SEQ ID NO: 728368 - RNA, 21 nt, Homo sapiens
cagccuggccaacauaguggg

SEQ ID NO: 728369 - RNA, 14 nt, Homo sapiens
cagccuggccagac

SEQ ID NO: 728370 - RNA, 24 nt, Homo sapiens
cagccugggccccagcucgcggga

SEQ ID NO: 728371 - RNA, 19 nt, Homo sapiens
cagccuggggaacagagca

SEQ ID NO: 728372 - RNA, 13 nt, Homo sapiens
cagccuguagcuc

SEQ ID NO: 728373 - RNA, 16 nt, Homo sapiens
cagccuguauguggug

SEQ ID NO: 728374 - RNA, 16 nt, Homo sapiens
cagccuugccagagau

SEQ ID NO: 728375 - RNA, 23 nt, Homo sapiens
cagccuugccagagauccaaaag

SEQ ID NO: 728376 - RNA, 22 nt, Homo sapiens
cagccuuggaggaucguggcca

SEQ ID NO: 728377 - RNA, 22 nt, Homo sapiens
cagccuuugcccaaaacuguca

SEQ ID NO: 728378 - RNA, 17 nt, Homo sapiens
cagcgaaaggauguaaa

SEQ ID NO: 728379 - RNA, 13 nt, Homo sapiens
cagcgaccucaag

SEQ ID NO: 728380 - RNA, 18 nt, Homo sapiens
cagcgaccucggugggcc

SEQ ID NO: 728381 - RNA, 13 nt, Homo sapiens
cagcgcaccuguu

SEQ ID NO: 728382 - RNA, 17 nt, Homo sapiens
cagugugguuauguucc

SEQ ID NO: 728383 - RNA, 20 nt, Homo sapiens
cagugugugccacaggauug

SEQ ID NO: 728384 - RNA, 21 nt, Homo sapiens
caguguuucauauucaugcaa

SEQ ID NO: 728385 - RNA, 23 nt, Homo sapiens
caguguuuuuccuuggaucccau

SEQ ID NO: 728386 - RNA, 21 nt, Homo sapiens
caguuaacaggauauuagaca

SEQ ID NO: 728387 - RNA, 16 nt, Homo sapiens
caguuaaggaagaucc

SEQ ID NO: 728388 - RNA, 20 nt, Homo sapiens
caguuaauaaaccuuugcaa

SEQ ID NO: 728389 - RNA, 23 nt, Homo sapiens
caguuagaagagguagugugaau

SEQ ID NO: 728390 - RNA, 19 nt, Homo sapiens
caguuaugcagaauccaaa

SEQ ID NO: 728391 - RNA, 16 nt, Homo sapiens
caguuauuaaucugga

SEQ ID NO: 728392 - RNA, 13 nt, Homo sapiens
caguucagcuuua

SEQ ID NO: 728393 - RNA, 12 nt, Homo sapiens
caguucagugag

SEQ ID NO: 728394 - RNA, 16 nt, Homo sapiens
caguucaugucugaaa

SEQ ID NO: 728395 - RNA, 19 nt, Homo sapiens
caguuccaggccugaucuu

SEQ ID NO: 728396 - RNA, 18 nt, Homo sapiens
caguucccaccaucugau

SEQ ID NO: 728397 - RNA, 13 nt, Homo sapiens
caguucuaaccuc

SEQ ID NO: 728398 - RNA, 18 nt, Homo sapiens
caguucucaaauguugga

SEQ ID NO: 728399 - RNA, 15 nt, Homo sapiens
caguucucuguggaa

SEQ ID NO: 728400 - RNA, 23 nt, Homo sapiens
caguucuuaacccaguguccaug

SEQ ID NO: 728401 - RNA, 18 nt, Homo sapiens
caguugcagcccuuguga

SEQ ID NO: 728402 - RNA, 15 nt, Homo sapiens
caguugcauaucuua

SEQ ID NO: 728403 - RNA, 19 nt, Homo sapiens
caguugccgucuaggauug

SEQ ID NO: 728404 - RNA, 23 nt, Homo sapiens
caguuguuaaaaugagcauugau

SEQ ID NO: 728405 - RNA, 15 nt, Homo sapiens
caguuguuccaggga

SEQ ID NO: 728406 - RNA, 20 nt, Homo sapiens
caguuguugaaacacuuugc

SEQ ID NO: 728407 - RNA, 13 nt, Homo sapiens
caguuuaaguaau

SEQ ID NO: 728408 - RNA, 19 nt, Homo sapiens
caguuuauggauaugcugc

SEQ ID NO: 728409 - RNA, 23 nt, Homo sapiens
caguuuauuaacuugagcuucac

SEQ ID NO: 728410 - RNA, 19 nt, Homo sapiens
caguuucauuaacugguga

SEQ ID NO: 728411 - RNA, 19 nt, Homo sapiens
caguuugaguuaaugugcu

SEQ ID NO: 728412 - RNA, 18 nt, Homo sapiens
caguuuguggaagcacag

SEQ ID NO: 728413 - RNA, 19 nt, Homo sapiens
caguuuuacucugcugcaa

SEQ ID NO: 728414 - RNA, 21 nt, Homo sapiens
caguuuuaucuuuaaucuccu

SEQ ID NO: 728415 - RNA, 22 nt, Homo sapiens
caguuuuguaaauguacuggua

SEQ ID NO: 728416 - RNA, 14 nt, Homo sapiens
caguuuuguugccc

SEQ ID NO: 728417 - RNA, 19 nt, Homo sapiens
caguuuuuggcaaaaaaca

SEQ ID NO: 728418 - RNA, 12 nt, Homo sapiens
caguuuuuuaca

SEQ ID NO: 728419 - RNA, 20 nt, Homo sapiens
cauaaaaaauaaaguaccac

SEQ ID NO: 728420 - RNA, 15 nt, Homo sapiens
cauaaaaagaagccu

SEQ ID NO: 728421 - RNA, 21 nt, Homo sapiens
cauaaaaagccugcaauuuca

SEQ ID NO: 728422 - RNA, 17 nt, Homo sapiens
cauaaaacaaaaccaag

SEQ ID NO: 728423 - RNA, 21 nt, Homo sapiens
cauaaaaugucucgaguccua

SEQ ID NO: 728424 - RNA, 23 nt, Homo sapiens
cauaaaauuuacauuuaauacag

SEQ ID NO: 728425 - RNA, 21 nt, Homo sapiens
cauaaacaaguucgagucaaa

SEQ ID NO: 728426 - RNA, 21 nt, Homo sapiens
cauaaagacaaucacugccaa

SEQ ID NO: 728427 - RNA, 12 nt, Homo sapiens
cauaaagcauuu

SEQ ID NO: 728428 - RNA, 18 nt, Homo sapiens
cauaaagccaaauuucca

SEQ ID NO: 728429 - RNA, 15 nt, Homo sapiens
cauaaagucagugcc

SEQ ID NO: 728430 - RNA, 14 nt, Homo sapiens
cauaaaugaaucau

SEQ ID NO: 728431 - RNA, 14 nt, Homo sapiens
cauaaauuacuguu

SEQ ID NO: 728432 - RNA, 18 nt, Homo sapiens
cauaaauugguauaauaa

SEQ ID NO: 728433 - RNA, 23 nt, Homo sapiens
cauaaauuuaugguucucaggcc

SEQ ID NO: 728434 - RNA, 21 nt, Homo sapiens
cauaacaccgucccagggcuc

SEQ ID NO: 728435 - RNA, 22 nt, Homo sapiens
cauaacagucuuacugcaggca

SEQ ID NO: 728436 - RNA, 14 nt, Homo sapiens
cauaacaugcuuua

SEQ ID NO: 728437 - RNA, 16 nt, Homo sapiens
cauaacaugcuuuaga

SEQ ID NO: 728438 - RNA, 23 nt, Homo sapiens
cauaacauuguacuguaauggag

SEQ ID NO: 728439 - RNA, 12 nt, Homo sapiens
cauaaccaaaga

SEQ ID NO: 728440 - RNA, 15 nt, Homo sapiens
cauaaccauacacag

SEQ ID NO: 728441 - RNA, 20 nt, Homo sapiens
cauaacugaaaaugugcuau

SEQ ID NO: 728442 - RNA, 18 nt, Homo sapiens
cauaagaaagcacuauua

SEQ ID NO: 728443 - RNA, 20 nt, Homo sapiens
cauaagacaaacacugccau

SEQ ID NO: 728444 - RNA, 17 nt, Homo sapiens
cauaagaggugaucucu

SEQ ID NO: 728445 - RNA, 22 nt, Homo sapiens
cauaagcucaguaacugugcau

SEQ ID NO: 728446 - RNA, 23 nt, Homo sapiens
cauaagggcacugagcccuuccc

SEQ ID NO: 728447 - RNA, 14 nt, Homo sapiens
cauaaggugcuauc

SEQ ID NO: 728448 - RNA, 23 nt, Homo sapiens
cauaaguaaucacuaaugcucaa

SEQ ID NO: 728449 - RNA, 20 nt, Homo sapiens
cauaauagcuacagugcaua

SEQ ID NO: 728450 - RNA, 21 nt, Homo sapiens
cauaauggacucuguggugcc

SEQ ID NO: 728451 - RNA, 14 nt, Homo sapiens
cauaggcucuuaag

SEQ ID NO: 728452 - RNA, 14 nt, Homo sapiens
cauaguaauuaccc

SEQ ID NO: 728453 - RNA, 14 nt, Homo sapiens
cauagucaaugaug

SEQ ID NO: 728454 - RNA, 17 nt, Homo sapiens
cauagugacaugcacac

SEQ ID NO: 728455 - RNA, 18 nt, Homo sapiens
cauaguggaucacucacc

SEQ ID NO: 728456 - RNA, 17 nt, Homo sapiens
cauaguuuaaacugcau

SEQ ID NO: 728457 - RNA, 22 nt, Homo sapiens
cauaguuucaaaucuguaauca

SEQ ID NO: 728458 - RNA, 15 nt, Homo sapiens
cauauaacaugcaaa

SEQ ID NO: 728459 - RNA, 14 nt, Homo sapiens
cauauaaccaaaau

SEQ ID NO: 728460 - RNA, 18 nt, Homo sapiens
cauauaaccuaugccaau

SEQ ID NO: 728461 - RNA, 13 nt, Homo sapiens
cauauaccagcaa

SEQ ID NO: 728462 - RNA, 16 nt, Homo sapiens
cauauaccagcaauau

SEQ ID NO: 728463 - RNA, 15 nt, Homo sapiens
cauauagcagaccaa

SEQ ID NO: 728464 - RNA, 19 nt, Homo sapiens
cauauaggugauguuugcu

SEQ ID NO: 728465 - RNA, 16 nt, Homo sapiens
cauauauacaggcaua

SEQ ID NO: 728466 - RNA, 15 nt, Homo sapiens
cauauauacccacau

SEQ ID NO: 728467 - RNA, 19 nt, Homo sapiens
cauauauacccacauguac

SEQ ID NO: 728468 - RNA, 21 nt, Homo sapiens
cauauauacccacauguacag

SEQ ID NO: 728469 - RNA, 15 nt, Homo sapiens
cauauauauauguau

SEQ ID NO: 728470 - RNA, 13 nt, Homo sapiens
cauauauggaaga

SEQ ID NO: 728471 - RNA, 19 nt, Homo sapiens
cauauauuuuuaccaucug

SEQ ID NO: 728472 - RNA, 14 nt, Homo sapiens
cauaucagcucucu

SEQ ID NO: 728473 - RNA, 13 nt, Homo sapiens
cauaucagugaac

SEQ ID NO: 728474 - RNA, 12 nt, Homo sapiens
cauauccaaaau

SEQ ID NO: 728475 - RNA, 16 nt, Homo sapiens
cauaucccuuccucuc

SEQ ID NO: 728476 - RNA, 19 nt, Homo sapiens
cauauccuuucaagacaga

SEQ ID NO: 728477 - RNA, 11 nt, Homo sapiens
cauaucugccu

SEQ ID NO: 728478 - RNA, 20 nt, Homo sapiens
cauaucuuaaagaaacagcu

SEQ ID NO: 728479 - RNA, 18 nt, Homo sapiens
cauaugacugauuacuca

SEQ ID NO: 728480 - RNA, 16 nt, Homo sapiens
cauaugcagugauaua

SEQ ID NO: 728481 - RNA, 16 nt, Homo sapiens
cauauggacucugcac

SEQ ID NO: 728482 - RNA, 19 nt, Homo sapiens
cauauggacucugcacaug

SEQ ID NO: 728483 - RNA, 16 nt, Homo sapiens
cauauguauacaugug

SEQ ID NO: 728484 - RNA, 20 nt, Homo sapiens
cauauguauacaugugccau

SEQ ID NO: 728485 - RNA, 19 nt, Homo sapiens
cauauucagcuugcacauu

SEQ ID NO: 728486 - RNA, 19 nt, Homo sapiens
cauauucaugaaaugugga

SEQ ID NO: 728487 - RNA, 21 nt, Homo sapiens
cauauuccugguguagcacuu

SEQ ID NO: 728488 - RNA, 15 nt, Homo sapiens
cauauucuaaaacca

SEQ ID NO: 728489 - RNA, 23 nt, Homo sapiens
cauauucugggcuccuggaacca

SEQ ID NO: 728490 - RNA, 18 nt, Homo sapiens
cauauuguauguaaguaa

SEQ ID NO: 728491 - RNA, 13 nt, Homo sapiens
cauauuucuuugg

SEQ ID NO: 728492 - RNA, 23 nt, Homo sapiens
cauauuuuaggacagguaaaaua

SEQ ID NO: 728493 - RNA, 15 nt, Homo sapiens
caucaaaaagaacaa

SEQ ID NO: 728494 - RNA, 15 nt, Homo sapiens
caucaaaaagccuua

SEQ ID NO: 728495 - RNA, 15 nt, Homo sapiens
caucaaaaucuggca

SEQ ID NO: 728496 - RNA, 18 nt, Homo sapiens
caucaaagaacaaacauc

SEQ ID NO: 728497 - RNA, 14 nt, Homo sapiens
caucaaagauuagg

SEQ ID NO: 728498 - RNA, 21 nt, Homo sapiens
caucaaagcucacaccaaauu

SEQ ID NO: 728499 - RNA, 21 nt, Homo sapiens
caucaagaugagagaacugga

SEQ ID NO: 728500 - RNA, 14 nt, Homo sapiens
caucaaggucuuug

SEQ ID NO: 728501 - RNA, 22 nt, Homo sapiens
caucaaucuuguuacugcugau

SEQ ID NO: 728502 - RNA, 12 nt, Homo sapiens
caucacacuggg

SEQ ID NO: 728503 - RNA, 16 nt, Homo sapiens
caucaccaagauuuug

SEQ ID NO: 728504 - RNA, 17 nt, Homo sapiens
caucacccaagccacaa

SEQ ID NO: 728505 - RNA, 18 nt, Homo sapiens
caucacgccugugcagug

SEQ ID NO: 728506 - RNA, 20 nt, Homo sapiens
caucacuagccaugauaacu

SEQ ID NO: 728507 - RNA, 17 nt, Homo sapiens
caucacugguugcacuu

SEQ ID NO: 728508 - RNA, 18 nt, Homo sapiens
caucacuguaaagacaaa

SEQ ID NO: 728509 - RNA, 21 nt, Homo sapiens
caucacugucuugccagauua

SEQ ID NO: 728510 - RNA, 19 nt, Homo sapiens
caucagacugucaagaaga

SEQ ID NO: 728511 - RNA, 18 nt, Homo sapiens
caucagagccagucucac

SEQ ID NO: 728512 - RNA, 19 nt, Homo sapiens
caucagcagagaacuggaa

SEQ ID NO: 728513 - RNA, 14 nt, Homo sapiens
caucagccugugua

SEQ ID NO: 728514 - RNA, 21 nt, Homo sapiens
caucagccuucaagaaucaga

SEQ ID NO: 728515 - RNA, 19 nt, Homo sapiens
caucagcuguuuuuaguua

SEQ ID NO: 728516 - RNA, 13 nt, Homo sapiens
caucaggacucug

SEQ ID NO: 728517 - RNA, 22 nt, Homo sapiens
caucaggauggaauucauaucc

SEQ ID NO: 728518 - RNA, 18 nt, Homo sapiens
caucaggccuaaucucau

SEQ ID NO: 728519 - RNA, 15 nt, Homo sapiens
caucagucaacaacu

SEQ ID NO: 728520 - RNA, 15 nt, Homo sapiens
caucaguccauugcu

SEQ ID NO: 728521 - RNA, 14 nt, Homo sapiens
ccagaaacaaaaag

SEQ ID NO: 728522 - RNA, 17 nt, Homo sapiens
ccagaaaguuauugaua

SEQ ID NO: 728523 - RNA, 19 nt, Homo sapiens
ccagaaaugucaugagauu

SEQ ID NO: 728524 - RNA, 12 nt, Homo sapiens
ccagaaaugucu

SEQ ID NO: 728525 - RNA, 21 nt, Homo sapiens
ccagaaccuguccuugcacac

SEQ ID NO: 728526 - RNA, 19 nt, Homo sapiens
ccagaacuggacucaggau

SEQ ID NO: 728527 - RNA, 22 nt, Homo sapiens
ccagaagaaagggccuucacag

SEQ ID NO: 728528 - RNA, 18 nt, Homo sapiens
ccagaagcuguacuuuua

SEQ ID NO: 728529 - RNA, 16 nt, Homo sapiens
ccagaaggauauuuac

SEQ ID NO: 728530 - RNA, 22 nt, Homo sapiens
ccagaaggcagggaaaggcucu

SEQ ID NO: 728531 - RNA, 13 nt, Homo sapiens
ccagaauagcuuu

SEQ ID NO: 728532 - RNA, 15 nt, Homo sapiens
ccagaaugcugaacu

SEQ ID NO: 728533 - RNA, 22 nt, Homo sapiens
ccagaaugcugcaggacuugag

SEQ ID NO: 728534 - RNA, 13 nt, Homo sapiens
ccagacaaaugga

SEQ ID NO: 728535 - RNA, 20 nt, Homo sapiens
ccagacauacgaaacacaaa

SEQ ID NO: 728536 - RNA, 21 nt, Homo sapiens
ccagacauacgaaacacaaac

SEQ ID NO: 728537 - RNA, 14 nt, Homo sapiens
ccagacccacugaa

SEQ ID NO: 728538 - RNA, 23 nt, Homo sapiens
ccagacccaguggacucuuccac

SEQ ID NO: 728539 - RNA, 15 nt, Homo sapiens
ccagacucagacauu

SEQ ID NO: 728540 - RNA, 23 nt, Homo sapiens
ccagacuccaccgucagcuguaa

SEQ ID NO: 728541 - RNA, 14 nt, Homo sapiens
ccagacucuugccu

SEQ ID NO: 728542 - RNA, 17 nt, Homo sapiens
ccagacuggaagacacu

SEQ ID NO: 728543 - RNA, 14 nt, Homo sapiens
ccagacuggcacag

SEQ ID NO: 728544 - RNA, 10 nt, Homo sapiens
ccagacuguu

SEQ ID NO: 728545 - RNA, 15 nt, Homo sapiens
ccagagaguggcucc

SEQ ID NO: 728546 - RNA, 18 nt, Homo sapiens
ccagagauggucacauga

SEQ ID NO: 728547 - RNA, 12 nt, Homo sapiens
ccagagcagcuc

SEQ ID NO: 728548 - RNA, 22 nt, Homo sapiens
ccagagcaucucggaguucaga

SEQ ID NO: 728549 - RNA, 14 nt, Homo sapiens
ccagagcccagcuc

SEQ ID NO: 728550 - RNA, 16 nt, Homo sapiens
ccagagcccagcucuu

SEQ ID NO: 728551 - RNA, 22 nt, Homo sapiens
ccagagcggaaggagggagcuc

SEQ ID NO: 728552 - RNA, 15 nt, Homo sapiens
ccagagcugugccag

SEQ ID NO: 728553 - RNA, 18 nt, Homo sapiens
ccagaggcagagccugag

SEQ ID NO: 728554 - RNA, 22 nt, Homo sapiens
ccagagucuaggcuaagcacuu

SEQ ID NO: 728555 - RNA, 13 nt, Homo sapiens
ccagagugcagug

SEQ ID NO: 728556 - RNA, 20 nt, Homo sapiens
ccagaguggccuggccagga

SEQ ID NO: 728557 - RNA, 21 nt, Homo sapiens
ccagaguuggacccgacccca

SEQ ID NO: 728558 - RNA, 18 nt, Homo sapiens
ccagauaacucucuuucc

SEQ ID NO: 728559 - RNA, 15 nt, Homo sapiens
ccagauacaugguga

SEQ ID NO: 728560 - RNA, 20 nt, Homo sapiens
ccagauagguggugccagug

SEQ ID NO: 728561 - RNA, 12 nt, Homo sapiens
ccagauccagcc

SEQ ID NO: 728562 - RNA, 14 nt, Homo sapiens
ccagaugacacaua

SEQ ID NO: 728563 - RNA, 13 nt, Homo sapiens
ccagaugauauaa

SEQ ID NO: 728564 - RNA, 17 nt, Homo sapiens
ccagaugaucccaguca

SEQ ID NO: 728565 - RNA, 19 nt, Homo sapiens
ccagaugaucccagucacu

SEQ ID NO: 728566 - RNA, 18 nt, Homo sapiens
ccagauggucauccagac

SEQ ID NO: 728567 - RNA, 12 nt, Homo sapiens
ccagauguggug

SEQ ID NO: 728568 - RNA, 16 nt, Homo sapiens
ccagauguuagaucag

SEQ ID NO: 728569 - RNA, 21 nt, Homo sapiens
ccagauuagagccuguaaacu

SEQ ID NO: 728570 - RNA, 23 nt, Homo sapiens
ccagauuggcucacacugagaau

SEQ ID NO: 728571 - RNA, 20 nt, Homo sapiens
ccagcaaugauguccagaag

SEQ ID NO: 728572 - RNA, 12 nt, Homo sapiens
ccagcacaccaa

SEQ ID NO: 728573 - RNA, 12 nt, Homo sapiens
ccagcacagggg

SEQ ID NO: 728574 - RNA, 22 nt, Homo sapiens
ccagcacuaacguaaauacaca

SEQ ID NO: 728575 - RNA, 16 nt, Homo sapiens
ccagcacucagccuca

SEQ ID NO: 728576 - RNA, 14 nt, Homo sapiens
ccagcacuggugaa

SEQ ID NO: 728577 - RNA, 15 nt, Homo sapiens
ccagcagaucccagc

SEQ ID NO: 728578 - RNA, 17 nt, Homo sapiens
ccagcagaucccagcuc

SEQ ID NO: 728579 - RNA, 19 nt, Homo sapiens
ccagcagaucccagcucac

SEQ ID NO: 728580 - RNA, 14 nt, Homo sapiens
ccagcagcagagaa

SEQ ID NO: 728581 - RNA, 15 nt, Homo sapiens
ccagcagcucaagaa

SEQ ID NO: 728582 - RNA, 19 nt, Homo sapiens
ccagcagugucacucugua

SEQ ID NO: 728583 - RNA, 21 nt, Homo sapiens
ccagcauauacugaagucuuu

SEQ ID NO: 728584 - RNA, 19 nt, Homo sapiens
ccagcauccccaacugcga

SEQ ID NO: 728585 - RNA, 12 nt, Homo sapiens
ccagcaucuccc

SEQ ID NO: 728586 - RNA, 13 nt, Homo sapiens
ccagcaucuccca

SEQ ID NO: 728587 - RNA, 19 nt, Homo sapiens
ccagcaucucccaguucau

SEQ ID NO: 728588 - RNA, 13 nt, Homo sapiens
ccagcaucugcag

SEQ ID NO: 728589 - RNA, 18 nt, Homo sapiens
ccagcauucagcacacac

SEQ ID NO: 728590 - RNA, 14 nt, Homo sapiens
ccagccaagcuuua

SEQ ID NO: 728591 - RNA, 10 nt, Homo sapiens
ccagccacag

SEQ ID NO: 728592 - RNA, 15 nt, Homo sapiens
ccagccauagagauu

SEQ ID NO: 728593 - RNA, 17 nt, Homo sapiens
ccagcccagacccagug

SEQ ID NO: 728594 - RNA, 17 nt, Homo sapiens
ccagccgaaaagcuuuu

SEQ ID NO: 728595 - RNA, 15 nt, Homo sapiens
ccagccgugagugca

SEQ ID NO: 728596 - RNA, 12 nt, Homo sapiens
ccagccuaagaa

SEQ ID NO: 728597 - RNA, 18 nt, Homo sapiens
ccagccuccagggcauug

SEQ ID NO: 728598 - RNA, 21 nt, Homo sapiens
ccagccugcccaacgugguga

SEQ ID NO: 728599 - RNA, 20 nt, Homo sapiens
ccagccuggccaacauggca

SEQ ID NO: 728600 - RNA, 23 nt, Homo sapiens
ucugggucuuucugacaucagca

SEQ ID NO: 728601 - RNA, 16 nt, Homo sapiens
ucuguaaacuguguau

SEQ ID NO: 728602 - RNA, 15 nt, Homo sapiens
ucuguaaacuuccaa

SEQ ID NO: 728603 - RNA, 17 nt, Homo sapiens
ucuguaaguguagcuca

SEQ ID NO: 728604 - RNA, 18 nt, Homo sapiens
ucuguaaguguagcucaa

SEQ ID NO: 728605 - RNA, 22 nt, Homo sapiens
ucuguaaguugcuuccuaacau

SEQ ID NO: 728606 - RNA, 19 nt, Homo sapiens
ucuguacauauuacuguug

SEQ ID NO: 728607 - RNA, 22 nt, Homo sapiens
ucuguagcuauaaugagcaugu

SEQ ID NO: 728608 - RNA, 17 nt, Homo sapiens
ucuguaggaaacccaac

SEQ ID NO: 728609 - RNA, 21 nt, Homo sapiens
ucuguaguuuaugaugcaaau

SEQ ID NO: 728610 - RNA, 16 nt, Homo sapiens
ucuguauaugauucuc

SEQ ID NO: 728611 - RNA, 11 nt, Homo sapiens
ucuguaucugc

SEQ ID NO: 728612 - RNA, 15 nt, Homo sapiens
ucuguaucugccaug

SEQ ID NO: 728613 - RNA, 20 nt, Homo sapiens
ucugucacccuuguccuuga

SEQ ID NO: 728614 - RNA, 14 nt, Homo sapiens
ucugucagcugcaa

SEQ ID NO: 728615 - RNA, 17 nt, Homo sapiens
ucuguccccuucucuca

SEQ ID NO: 728616 - RNA, 16 nt, Homo sapiens
ucugucccuuugcucc

SEQ ID NO: 728617 - RNA, 20 nt, Homo sapiens
ucuguccugauuucuacaac

SEQ ID NO: 728618 - RNA, 14 nt, Homo sapiens
ucugugaaaguaca

SEQ ID NO: 728619 - RNA, 22 nt, Homo sapiens
ucugugaaauucucagaguguu

SEQ ID NO: 728620 - RNA, 23 nt, Homo sapiens
ucugugacauacauauuaucuca

SEQ ID NO: 728621 - RNA, 21 nt, Homo sapiens
ucugugagacccccacaccuc

SEQ ID NO: 728622 - RNA, 22 nt, Homo sapiens
ucugugcagagaugacugucca

SEQ ID NO: 728623 - RNA, 18 nt, Homo sapiens
ucugugcagucacuggag

SEQ ID NO: 728624 - RNA, 20 nt, Homo sapiens
ucugugccagacauugcucu

SEQ ID NO: 728625 - RNA, 19 nt, Homo sapiens
ucugugcuucgacuacugc

SEQ ID NO: 728626 - RNA, 15 nt, Homo sapiens
ucuguggaaugauuc

SEQ ID NO: 728627 - RNA, 21 nt, Homo sapiens
ucuguggaucagagaugcacc

SEQ ID NO: 728628 - RNA, 13 nt, Homo sapiens
ucuguggccacuc

SEQ ID NO: 728629 - RNA, 20 nt, Homo sapiens
ucugugugguggagccaggg

SEQ ID NO: 728630 - RNA, 18 nt, Homo sapiens
ucugugugugauuugcua

SEQ ID NO: 728631 - RNA, 23 nt, Homo sapiens
ucuguguguguguaugugggggu

SEQ ID NO: 728632 - RNA, 17 nt, Homo sapiens
ucuguucaaagcugccu

SEQ ID NO: 728633 - RNA, 17 nt, Homo sapiens
ucuguuccccauggcca

SEQ ID NO: 728634 - RNA, 21 nt, Homo sapiens
ucuguucuguugaucccacuu

SEQ ID NO: 728635 - RNA, 19 nt, Homo sapiens
ucuguucuguuucaaggca

SEQ ID NO: 728636 - RNA, 14 nt, Homo sapiens
ccaggacuguguuu

SEQ ID NO: 728637 - RNA, 13 nt, Homo sapiens
ccaggagacaguu

SEQ ID NO: 728638 - RNA, 16 nt, Homo sapiens
ccaggagagagccagg

SEQ ID NO: 728639 - RNA, 22 nt, Homo sapiens
ccaggagcagcagccagcacca

SEQ ID NO: 728640 - RNA, 23 nt, Homo sapiens
ccaggagcaggaccuacuaggag

SEQ ID NO: 728641 - RNA, 18 nt, Homo sapiens
ccaggagcaggcacgggu

SEQ ID NO: 728642 - RNA, 17 nt, Homo sapiens
ccaggagcugauggcag

SEQ ID NO: 728643 - RNA, 21 nt, Homo sapiens
ccaggaggugcagacuucuua

SEQ ID NO: 728644 - RNA, 13 nt, Homo sapiens
ccaggaguaccug

SEQ ID NO: 728645 - RNA, 17 nt, Homo sapiens
ccaggaguuugagacca

SEQ ID NO: 728646 - RNA, 18 nt, Homo sapiens
ccaggaguuugagaccag

SEQ ID NO: 728647 - RNA, 15 nt, Homo sapiens
ccaggauagugggca

SEQ ID NO: 728648 - RNA, 13 nt, Homo sapiens
ccaggaugcuaaa

SEQ ID NO: 728649 - RNA, 16 nt, Homo sapiens
ccaggcacugcccuuu

SEQ ID NO: 728650 - RNA, 16 nt, Homo sapiens
ccaggcacugccugga

SEQ ID NO: 728651 - RNA, 15 nt, Homo sapiens
ccaggccaacaguag

SEQ ID NO: 728652 - RNA, 21 nt, Homo sapiens
ccaggccaccuccccagcauu

SEQ ID NO: 728653 - RNA, 21 nt, Homo sapiens
ccaggcccugcucuuccucag

SEQ ID NO: 728654 - RNA, 13 nt, Homo sapiens
ccaggccugacca

SEQ ID NO: 728655 - RNA, 15 nt, Homo sapiens
ccaggccugaccagg

SEQ ID NO: 728656 - RNA, 16 nt, Homo sapiens
ccaggccugagcaaca

SEQ ID NO: 728657 - RNA, 17 nt, Homo sapiens
ccaggcgugguggcaca

SEQ ID NO: 728658 - RNA, 21 nt, Homo sapiens
ccaggcugagugagccacaga

SEQ ID NO: 728659 - RNA, 18 nt, Homo sapiens
ccaggcugcacugcagug

SEQ ID NO: 728660 - RNA, 17 nt, Homo sapiens
ccaggcugcccaucagg

SEQ ID NO: 728661 - RNA, 20 nt, Homo sapiens
ccaggcuggacugcaaugac

SEQ ID NO: 728662 - RNA, 15 nt, Homo sapiens
ccaggcuggagugca

SEQ ID NO: 728663 - RNA, 18 nt, Homo sapiens
ccaggcuggagugcagug

SEQ ID NO: 728664 - RNA, 15 nt, Homo sapiens
ccaggcugggaacuc

SEQ ID NO: 728665 - RNA, 14 nt, Homo sapiens
ccaggcuuuguaca

SEQ ID NO: 728666 - RNA, 19 nt, Homo sapiens
ccaggcuuuguugcuuccg

SEQ ID NO: 728667 - RNA, 21 nt, Homo sapiens
ccagggagcaguggcugagua

SEQ ID NO: 728668 - RNA, 14 nt, Homo sapiens
ccagggaucacugg

SEQ ID NO: 728669 - RNA, 15 nt, Homo sapiens
ccagggaugacaugu

SEQ ID NO: 728670 - RNA, 17 nt, Homo sapiens
ccagggcaacacaguga

SEQ ID NO: 728671 - RNA, 16 nt, Homo sapiens
ccagggcauugcucag

SEQ ID NO: 728672 - RNA, 20 nt, Homo sapiens
ccagggcccucccagcccau

SEQ ID NO: 728673 - RNA, 14 nt, Homo sapiens
ccagggcuccaaau

SEQ ID NO: 728674 - RNA, 18 nt, Homo sapiens
ccagggcuggacugaggc

SEQ ID NO: 728675 - RNA, 18 nt, Homo sapiens
ccagguacaggagaggca

SEQ ID NO: 728676 - RNA, 22 nt, Homo sapiens
ccaggucaggaugcacauuucu

SEQ ID NO: 728677 - RNA, 14 nt, Homo sapiens
ccagguuagccuuu

SEQ ID NO: 728678 - RNA, 18 nt, Homo sapiens
ccagguuucuacaccccc

SEQ ID NO: 728679 - RNA, 23 nt, Homo sapiens
ccagguuuuacacuugcaucucu

SEQ ID NO: 728680 - RNA, 13 nt, Homo sapiens
ccaguacauuuaa

SEQ ID NO: 728681 - RNA, 19 nt, Homo sapiens
ccaguacucccugcuaaag

SEQ ID NO: 728682 - RNA, 12 nt, Homo sapiens
ccaguacuggga

SEQ ID NO: 728683 - RNA, 22 nt, Homo sapiens
ccaguacugggagauacagcca

SEQ ID NO: 728684 - RNA, 15 nt, Homo sapiens
ccaguaugacaguau

SEQ ID NO: 728685 - RNA, 14 nt, Homo sapiens
ccaguauuaugcau

SEQ ID NO: 728686 - RNA, 21 nt, Homo sapiens
ccagucacugcugcaaggugg

SEQ ID NO: 728687 - RNA, 23 nt, Homo sapiens
ccagucaugagcguuagacugac

SEQ ID NO: 728688 - RNA, 16 nt, Homo sapiens
ccaguccaugcuccag

SEQ ID NO: 728689 - RNA, 21 nt, Homo sapiens
ccagucccagacaauuccauu

SEQ ID NO: 728690 - RNA, 21 nt, Homo sapiens
ccaguccccgaggagcugggc

SEQ ID NO: 728691 - RNA, 19 nt, Homo sapiens
ccaguccucccagcugcca

SEQ ID NO: 728692 - RNA, 14 nt, Homo sapiens
ccagucgaccccaa

SEQ ID NO: 728693 - RNA, 14 nt, Homo sapiens
ccagucuaguuccu

SEQ ID NO: 728694 - RNA, 22 nt, Homo sapiens
ccagucucagagaccagcacuc

SEQ ID NO: 728695 - RNA, 20 nt, Homo sapiens
ccagucuugucauugccagc

SEQ ID NO: 728696 - RNA, 14 nt, Homo sapiens
ccagugacaacauc

SEQ ID NO: 728697 - RNA, 20 nt, Homo sapiens
ccagugaccccugaccucac

SEQ ID NO: 728698 - RNA, 22 nt, Homo sapiens
ccagugaggaacccugaucucu

SEQ ID NO: 728699 - RNA, 14 nt, Homo sapiens
ccagugagggcagu

SEQ ID NO: 728700 - RNA, 13 nt, Homo sapiens
ccagugcagggaa

SEQ ID NO: 728701 - RNA, 23 nt, Homo sapiens
ccagugcuccaggcacccagcuu

SEQ ID NO: 728702 - RNA, 21 nt, Homo sapiens
ccagugcuuugcacacaagcu

SEQ ID NO: 728703 - RNA, 14 nt, Homo sapiens
ccaguggaugccac

SEQ ID NO: 728704 - RNA, 14 nt, Homo sapiens
ccagugggacccca

SEQ ID NO: 728705 - RNA, 20 nt, Homo sapiens
ccaguggggaaggaggccaa

SEQ ID NO: 728706 - RNA, 24 nt, Homo sapiens
ccaguguaauaauaaaucguccuc

SEQ ID NO: 728707 - RNA, 13 nt, Homo sapiens
ccaguguuuacaa

SEQ ID NO: 728708 - RNA, 12 nt, Homo sapiens
ccaguguuucua

SEQ ID NO: 728709 - RNA, 22 nt, Homo sapiens
ccaguuaaagauuauugugacu

SEQ ID NO: 728710 - RNA, 17 nt, Homo sapiens
ccaguuacguuguguau

SEQ ID NO: 728711 - RNA, 15 nt, Homo sapiens
ccaguucacccugau

SEQ ID NO: 728712 - RNA, 20 nt, Homo sapiens
ccaguucagcuuggugggag

SEQ ID NO: 728713 - RNA, 19 nt, Homo sapiens
ccaguucauugcacuuuga

SEQ ID NO: 728714 - RNA, 16 nt, Homo sapiens
ucuucugggaacuucc

SEQ ID NO: 728715 - RNA, 20 nt, Homo sapiens
ucuucugggaacuuccucag

SEQ ID NO: 728716 - RNA, 17 nt, Homo sapiens
ucuucugggcgucugag

SEQ ID NO: 728717 - RNA, 12 nt, Homo sapiens
ucuucuggucug

SEQ ID NO: 728718 - RNA, 14 nt, Homo sapiens
ucuucuuacaugca

SEQ ID NO: 728719 - RNA, 14 nt, Homo sapiens
ucuucuuguugacc

SEQ ID NO: 728720 - RNA, 15 nt, Homo sapiens
ucuucuuugccuucu

SEQ ID NO: 728721 - RNA, 23 nt, Homo sapiens
ucuucuuuguuuggauugcagca

SEQ ID NO: 728722 - RNA, 22 nt, Homo sapiens
ucuucuuuucuuuuuuuaaaca

SEQ ID NO: 728723 - RNA, 14 nt, Homo sapiens
ucuugaaacaagca

SEQ ID NO: 728724 - RNA, 20 nt, Homo sapiens
ucuugaaagaggcacgcauu

SEQ ID NO: 728725 - RNA, 15 nt, Homo sapiens
ucuugaaauguagaa

SEQ ID NO: 728726 - RNA, 20 nt, Homo sapiens
ucuugaacucauagauuauu

SEQ ID NO: 728727 - RNA, 20 nt, Homo sapiens
ucuugaagucuguacagauu

SEQ ID NO: 728728 - RNA, 16 nt, Homo sapiens
ucuugaauauuugcca

SEQ ID NO: 728729 - RNA, 17 nt, Homo sapiens
ucuugacauucaaggca

SEQ ID NO: 728730 - RNA, 12 nt, Homo sapiens
ucuugacuuccc

SEQ ID NO: 728731 - RNA, 15 nt, Homo sapiens
ucuugagagcugcug

SEQ ID NO: 728732 - RNA, 14 nt, Homo sapiens
ucuugagcagauga

SEQ ID NO: 728733 - RNA, 16 nt, Homo sapiens
ucuugaggcauuucca

SEQ ID NO: 728734 - RNA, 14 nt, Homo sapiens
ucuugauaaaugac

SEQ ID NO: 728735 - RNA, 11 nt, Homo sapiens
ucuugaucucc

SEQ ID NO: 728736 - RNA, 17 nt, Homo sapiens
ucuugauucagucacau

SEQ ID NO: 728737 - RNA, 15 nt, Homo sapiens
ucuugcaacucugua

SEQ ID NO: 728738 - RNA, 17 nt, Homo sapiens
ucuugccuaaaucccaa

SEQ ID NO: 728739 - RNA, 10 nt, Homo sapiens
ucuugccuug

SEQ ID NO: 728740 - RNA, 22 nt, Homo sapiens
ucuugcgauaguuuacugagaa

SEQ ID NO: 728741 - RNA, 21 nt, Homo sapiens
ucuugcggcugaagugucaca

SEQ ID NO: 728742 - RNA, 13 nt, Homo sapiens
ucuugcucaaaaa

SEQ ID NO: 728743 - RNA, 15 nt, Homo sapiens
ucuugcucagugaag

SEQ ID NO: 728744 - RNA, 18 nt, Homo sapiens
ucuugcuggucuagucac

SEQ ID NO: 728745 - RNA, 20 nt, Homo sapiens
ucuuggccaaagaccaaauu

SEQ ID NO: 728746 - RNA, 16 nt, Homo sapiens
ucuuggcugaccccuc

SEQ ID NO: 728747 - RNA, 14 nt, Homo sapiens
ucuuggcuuaucca

SEQ ID NO: 728748 - RNA, 20 nt, Homo sapiens
ucuugggacccccacuaaga

SEQ ID NO: 728749 - RNA, 16 nt, Homo sapiens
ucuuggggcccagugc

SEQ ID NO: 728750 - RNA, 17 nt, Homo sapiens
ucuugguaauccccuaa

SEQ ID NO: 728751 - RNA, 19 nt, Homo sapiens
cccaccuagugcuuccacu

SEQ ID NO: 728752 - RNA, 13 nt, Homo sapiens
cccaccuuugcca

SEQ ID NO: 728753 - RNA, 21 nt, Homo sapiens
cccacuagaagcaacuaggaa

SEQ ID NO: 728754 - RNA, 22 nt, Homo sapiens
cccacucccuggcucucagaag

SEQ ID NO: 728755 - RNA, 15 nt, Homo sapiens
cccacuccugcugca

SEQ ID NO: 728756 - RNA, 13 nt, Homo sapiens
cccacucuuugaa

SEQ ID NO: 728757 - RNA, 16 nt, Homo sapiens
cccacugacuguaugg

SEQ ID NO: 728758 - RNA, 13 nt, Homo sapiens
cccacugagauuu

SEQ ID NO: 728759 - RNA, 17 nt, Homo sapiens
cccacuggggugugugg

SEQ ID NO: 728760 - RNA, 11 nt, Homo sapiens
cccacuugaag

SEQ ID NO: 728761 - RNA, 16 nt, Homo sapiens
cccacuugacacuauu

SEQ ID NO: 728762 - RNA, 15 nt, Homo sapiens
cccacuuugaagggc

SEQ ID NO: 728763 - RNA, 18 nt, Homo sapiens
cccagaaaaccuccagua

SEQ ID NO: 728764 - RNA, 19 nt, Homo sapiens
cccagaaaaggcggugcuc

SEQ ID NO: 728765 - RNA, 22 nt, Homo sapiens
cccagaaagugauaagugcagg

SEQ ID NO: 728766 - RNA, 19 nt, Homo sapiens
cccagaacuggacucagga

SEQ ID NO: 728767 - RNA, 23 nt, Homo sapiens
cccagaaucucauuaaagcuuau

SEQ ID NO: 728768 - RNA, 18 nt, Homo sapiens
cccagaaugagacaucca

SEQ ID NO: 728769 - RNA, 18 nt, Homo sapiens
cccagacaccaugugcaa

SEQ ID NO: 728770 - RNA, 18 nt, Homo sapiens
cccagacuagauguagua

SEQ ID NO: 728771 - RNA, 17 nt, Homo sapiens
cccagacuccaccguca

SEQ ID NO: 728772 - RNA, 19 nt, Homo sapiens
cccagacuggaaugcagug

SEQ ID NO: 728773 - RNA, 20 nt, Homo sapiens
cccagacuggaaugcaguga

SEQ ID NO: 728774 - RNA, 22 nt, Homo sapiens
cccagaggagccaccaguucuc

SEQ ID NO: 728775 - RNA, 22 nt, Homo sapiens
cccagaggcagcagagcauuca

SEQ ID NO: 728776 - RNA, 22 nt, Homo sapiens
cccagagugcugggauuacaau

SEQ ID NO: 728777 - RNA, 14 nt, Homo sapiens
cccagauaacuuuc

SEQ ID NO: 728778 - RNA, 15 nt, Homo sapiens
cccagauacauggug

SEQ ID NO: 728779 - RNA, 21 nt, Homo sapiens
cccagauagguggugccagug

SEQ ID NO: 728780 - RNA, 13 nt, Homo sapiens
cccagaugcucuc

SEQ ID NO: 728781 - RNA, 22 nt, Homo sapiens
cccagaugcucuccccuccucg

SEQ ID NO: 728782 - RNA, 19 nt, Homo sapiens
cccagauuccccuguguca

SEQ ID NO: 728783 - RNA, 22 nt, Homo sapiens
cccagauuggcucacacugaga

SEQ ID NO: 728784 - RNA, 19 nt, Homo sapiens
cccagcacacgaguuccag

SEQ ID NO: 728785 - RNA, 14 nt, Homo sapiens
cccagcacugagga

SEQ ID NO: 728786 - RNA, 11 nt, Homo sapiens
cccagcacugu

SEQ ID NO: 728787 - RNA, 11 nt, Homo sapiens
cccagcacuug

SEQ ID NO: 728788 - RNA, 12 nt, Homo sapiens
cccagcacuuug

SEQ ID NO: 728789 - RNA, 15 nt, Homo sapiens
cccagcagugucacu

SEQ ID NO: 728790 - RNA, 16 nt, Homo sapiens
cccagcauuccagcuc

SEQ ID NO: 728791 - RNA, 20 nt, Homo sapiens
cccagccaaacccugucuga

SEQ ID NO: 728792 - RNA, 18 nt, Homo sapiens
cccagccaggcagggggc

SEQ ID NO: 728793 - RNA, 15 nt, Homo sapiens
cccagcccagagcca

SEQ ID NO: 728794 - RNA, 19 nt, Homo sapiens
cccagccuccccgugccaa

SEQ ID NO: 728795 - RNA, 20 nt, Homo sapiens
cccagccuccccgugccaaa

SEQ ID NO: 728796 - RNA, 15 nt, Homo sapiens
cccagccucccugaa

SEQ ID NO: 728797 - RNA, 16 nt, Homo sapiens
cccagcuacucaggag

SEQ ID NO: 728798 - RNA, 21 nt, Homo sapiens
cccagcuaucuauauggaauu

SEQ ID NO: 728799 - RNA, 20 nt, Homo sapiens
cccagcuccugaauaaagau

SEQ ID NO: 728800 - RNA, 18 nt, Homo sapiens
cccagcugggcucugcca

SEQ ID NO: 728801 - RNA, 13 nt, Homo sapiens
cccagcuugccaa

SEQ ID NO: 728802 - RNA, 23 nt, Homo sapiens
cccagcuuuuagaaaaugcaguc

SEQ ID NO: 728803 - RNA, 14 nt, Homo sapiens
cccaggagacagac

SEQ ID NO: 728804 - RNA, 23 nt, Homo sapiens
cccaggagacagaccacuugcca

SEQ ID NO: 728805 - RNA, 20 nt, Homo sapiens
cccaggagcacccaggcaug

SEQ ID NO: 728806 - RNA, 23 nt, Homo sapiens
cccaggagcugaggauaaagggc

SEQ ID NO: 728807 - RNA, 22 nt, Homo sapiens
cccaggaggcccagcugcucag

SEQ ID NO: 728808 - RNA, 21 nt, Homo sapiens
cccaggaggugugauuccuga

SEQ ID NO: 728809 - RNA, 15 nt, Homo sapiens
cccaggauacuggca

SEQ ID NO: 728810 - RNA, 20 nt, Homo sapiens
cccaggccacccccauggaa

SEQ ID NO: 728811 - RNA, 20 nt, Homo sapiens
cccaggcccgagaugugacc

SEQ ID NO: 728812 - RNA, 20 nt, Homo sapiens
cccaggccuuuuccacuuug

SEQ ID NO: 728813 - RNA, 20 nt, Homo sapiens
cccaggcuggacugcaauga

SEQ ID NO: 728814 - RNA, 14 nt, Homo sapiens
cccaggcuggagug

SEQ ID NO: 728815 - RNA, 17 nt, Homo sapiens
cccaggcugggaacuca

SEQ ID NO: 728816 - RNA, 17 nt, Homo sapiens
cccaggcuuuagcauua

SEQ ID NO: 728817 - RNA, 14 nt, Homo sapiens
cccagggaaggugg

SEQ ID NO: 728818 - RNA, 14 nt, Homo sapiens
cccagggagcucug

SEQ ID NO: 728819 - RNA, 17 nt, Homo sapiens
cccagggcacuacauaa

SEQ ID NO: 728820 - RNA, 20 nt, Homo sapiens
cccagggccugggggcagug

SEQ ID NO: 728821 - RNA, 15 nt, Homo sapiens
cccagggugugaaca

SEQ ID NO: 728822 - RNA, 19 nt, Homo sapiens
cccaggguuucugcacugg

SEQ ID NO: 728823 - RNA, 18 nt, Homo sapiens
cccaguaacugcaccaac

SEQ ID NO: 728824 - RNA, 21 nt, Homo sapiens
cccaguaucucuucagucucu

SEQ ID NO: 728825 - RNA, 15 nt, Homo sapiens
cccagucacuccucu

SEQ ID NO: 728826 - RNA, 19 nt, Homo sapiens
cccagucccagacaauucc

SEQ ID NO: 728827 - RNA, 23 nt, Homo sapiens
cccaguccucucccaaguccaca

SEQ ID NO: 728828 - RNA, 19 nt, Homo sapiens
cccagucgaccccaaagga

SEQ ID NO: 728829 - RNA, 16 nt, Homo sapiens
ugaagacaacagcaua

SEQ ID NO: 728830 - RNA, 13 nt, Homo sapiens
ugaagacauucca

SEQ ID NO: 728831 - RNA, 18 nt, Homo sapiens
ugaagacgaagaagcaag

SEQ ID NO: 728832 - RNA, 20 nt, Homo sapiens
ugaagacugggugaggauaa

SEQ ID NO: 728833 - RNA, 22 nt, Homo sapiens
ugaagagauuucaacaagaaua

SEQ ID NO: 728834 - RNA, 14 nt, Homo sapiens
ugaagagcuucauu

SEQ ID NO: 728835 - RNA, 18 nt, Homo sapiens
ugaagagggagaagcaug

SEQ ID NO: 728836 - RNA, 23 nt, Homo sapiens
ugaagaguauccuuccuucaggg

SEQ ID NO: 728837 - RNA, 21 nt, Homo sapiens
ugaagaugccagugaaacuuc

SEQ ID NO: 728838 - RNA, 14 nt, Homo sapiens
ugaagauuauuuca

SEQ ID NO: 728839 - RNA, 20 nt, Homo sapiens
ugaagauucuccugugcuag

SEQ ID NO: 728840 - RNA, 19 nt, Homo sapiens
ugaagauuuaugaugcacu

SEQ ID NO: 728841 - RNA, 19 nt, Homo sapiens
ugaagcaaauacaauucac

SEQ ID NO: 728842 - RNA, 13 nt, Homo sapiens
ugaagcacaucaa

SEQ ID NO: 728843 - RNA, 17 nt, Homo sapiens
ugaagcagcacugugag

SEQ ID NO: 728844 - RNA, 15 nt, Homo sapiens
ugaagccaaagggac

SEQ ID NO: 728845 - RNA, 18 nt, Homo sapiens
ugaagccggacagcugcc

SEQ ID NO: 728846 - RNA, 14 nt, Homo sapiens
ugaagccugcaugu

SEQ ID NO: 728847 - RNA, 22 nt, Homo sapiens
ugaagcguugccauugaacuca

SEQ ID NO: 728848 - RNA, 18 nt, Homo sapiens
ugaagcguuuuucucaaa

SEQ ID NO: 728849 - RNA, 15 nt, Homo sapiens
ugaagcuaauaauuc

SEQ ID NO: 728850 - RNA, 20 nt, Homo sapiens
ugaagcuguugcggacauca

SEQ ID NO: 728851 - RNA, 21 nt, Homo sapiens
ugaagcuuaggacuaccagcc

SEQ ID NO: 728852 - RNA, 22 nt, Homo sapiens
ugaaggaucaucuauguauuca

SEQ ID NO: 728853 - RNA, 18 nt, Homo sapiens
ugaaggcaaccuggaagg

SEQ ID NO: 728854 - RNA, 14 nt, Homo sapiens
ugaaggcauaugca

SEQ ID NO: 728855 - RNA, 17 nt, Homo sapiens
ugaaggcuuacuucaga

SEQ ID NO: 728856 - RNA, 15 nt, Homo sapiens
ugaagggaagugggg

SEQ ID NO: 728857 - RNA, 13 nt, Homo sapiens
ugaaggugauuca

SEQ ID NO: 728858 - RNA, 16 nt, Homo sapiens
ugaaguagaauccuaa

SEQ ID NO: 728859 - RNA, 16 nt, Homo sapiens
ugaaguaggugugacu

SEQ ID NO: 728860 - RNA, 13 nt, Homo sapiens
ugaagucacauuc

SEQ ID NO: 728861 - RNA, 20 nt, Homo sapiens
ugaagucccugcagcccuuu

SEQ ID NO: 728862 - RNA, 23 nt, Homo sapiens
ugaaguguccugauggaggagac

SEQ ID NO: 728863 - RNA, 20 nt, Homo sapiens
ugaaguuaagaaccugaaua

SEQ ID NO: 728864 - RNA, 15 nt, Homo sapiens
ugaaguuuacaauca

SEQ ID NO: 728865 - RNA, 14 nt, Homo sapiens
uugugucaaaacug

SEQ ID NO: 728866 - RNA, 17 nt, Homo sapiens
uugugucaaaacugguu

SEQ ID NO: 728867 - RNA, 12 nt, Homo sapiens
uugugucacugg

SEQ ID NO: 728868 - RNA, 16 nt, Homo sapiens
uugugucagauuacca

SEQ ID NO: 728869 - RNA, 14 nt, Homo sapiens
uuguguucugcucc

SEQ ID NO: 728870 - RNA, 14 nt, Homo sapiens
uuguguugucacua

SEQ ID NO: 728871 - RNA, 13 nt, Homo sapiens
uuguuaaugucau

SEQ ID NO: 728872 - RNA, 18 nt, Homo sapiens
uuguuaauuguaauugca

SEQ ID NO: 728873 - RNA, 13 nt, Homo sapiens
uuguuacagcuuc

SEQ ID NO: 728874 - RNA, 22 nt, Homo sapiens
uuguuacauguaauauauuuca

SEQ ID NO: 728875 - RNA, 19 nt, Homo sapiens
uuguucaauaauuacugua

SEQ ID NO: 728876 - RNA, 13 nt, Homo sapiens
uuguucagaauua

SEQ ID NO: 728877 - RNA, 18 nt, Homo sapiens
uuguucagggcugugauc

SEQ ID NO: 728878 - RNA, 16 nt, Homo sapiens
uuguucaguugccaag

SEQ ID NO: 728879 - RNA, 21 nt, Homo sapiens
uuguucauugaacuuuugcua

SEQ ID NO: 728880 - RNA, 16 nt, Homo sapiens
uuguugaaauugucaa

SEQ ID NO: 728881 - RNA, 15 nt, Homo sapiens
uuguugagugccagc

SEQ ID NO: 728882 - RNA, 19 nt, Homo sapiens
uuguugcaagaugugaauu

SEQ ID NO: 728883 - RNA, 22 nt, Homo sapiens
uuguugcagaugggugauauau

SEQ ID NO: 728884 - RNA, 16 nt, Homo sapiens
uuguugcaggcugugg

SEQ ID NO: 728885 - RNA, 18 nt, Homo sapiens
uuguugccuucaucuuca

SEQ ID NO: 728886 - RNA, 17 nt, Homo sapiens
uuguuggaaaguaacug

SEQ ID NO: 728887 - RNA, 15 nt, Homo sapiens
uuguuggaugaaauu

SEQ ID NO: 728888 - RNA, 17 nt, Homo sapiens
uuguuguauugaucaau

SEQ ID NO: 728889 - RNA, 23 nt, Homo sapiens
uuguuuaaagaauaaaguccaaa

SEQ ID NO: 728890 - RNA, 22 nt, Homo sapiens
uuguuuaccucuuugucccaga

SEQ ID NO: 728891 - RNA, 16 nt, Homo sapiens
uuguuuagagagccug

SEQ ID NO: 728892 - RNA, 20 nt, Homo sapiens
uuguuuagauaugacauuua

SEQ ID NO: 728893 - RNA, 19 nt, Homo sapiens
uuguuucaaccaagucaug

SEQ ID NO: 728894 - RNA, 21 nt, Homo sapiens
uuguuucccaucagacuguca

SEQ ID NO: 728895 - RNA, 17 nt, Homo sapiens
uuguuucuaugcagaug

SEQ ID NO: 728896 - RNA, 12 nt, Homo sapiens
uuguuucuuaag

SEQ ID NO: 728897 - RNA, 18 nt, Homo sapiens
uuguuugaauuccuccuc

SEQ ID NO: 728898 - RNA, 14 nt, Homo sapiens
uuguuuggugaauu

SEQ ID NO: 728899 - RNA, 15 nt, Homo sapiens
uuguuugucuuccau

SEQ ID NO: 728900 - RNA, 17 nt, Homo sapiens
uuguuuucacuuguauu

SEQ ID NO: 728901 - RNA, 20 nt, Homo sapiens
uuguuuugagcagacaggcu

SEQ ID NO: 728902 - RNA, 19 nt, Homo sapiens
uuguuuuuuugcagaauua

SEQ ID NO: 728903 - RNA, 21 nt, Homo sapiens
uuuaaaaaaaaauacugaugu

SEQ ID NO: 728904 - RNA, 20 nt, Homo sapiens
uuuaaaaaaaaauugaacaa

SEQ ID NO: 728905 - RNA, 23 nt, Homo sapiens
uuuaaaaaaaagaaucaccaaau

SEQ ID NO: 728906 - RNA, 21 nt, Homo sapiens
uuuaaaaaaauaacaucugaa

SEQ ID NO: 728907 - RNA, 19 nt, Homo sapiens
uuuaaaaaauauuuucucu

SEQ ID NO: 728908 - RNA, 15 nt, Homo sapiens
uuuaaaaacaaacaa

SEQ ID NO: 728909 - RNA, 13 nt, Homo sapiens
uuuaaaaacaaag

SEQ ID NO: 728910 - RNA, 14 nt, Homo sapiens
uuuaaaacauguaa

SEQ ID NO: 728911 - RNA, 14 nt, Homo sapiens
uuuaaaagauaaaa

SEQ ID NO: 728912 - RNA, 13 nt, Homo sapiens
uuuaaaagugauc

SEQ ID NO: 728913 - RNA, 19 nt, Homo sapiens
uuuaaaauaccacuguaau

SEQ ID NO: 728914 - RNA, 15 nt, Homo sapiens
uuuaaaauauccugu

SEQ ID NO: 728915 - RNA, 21 nt, Homo sapiens
uuuaaaaucauuucugcauca

SEQ ID NO: 728916 - RNA, 14 nt, Homo sapiens
uuuaaaauucuaau

SEQ ID NO: 728917 - RNA, 16 nt, Homo sapiens
uuuaaaauuuguccua

SEQ ID NO: 728918 - RNA, 21 nt, Homo sapiens
uuuaaacaguaaaccuuaaca

SEQ ID NO: 728919 - RNA, 21 nt, Homo sapiens
uuuaaaccaccuaguucuccc

SEQ ID NO: 728920 - RNA, 18 nt, Homo sapiens
uuuaaacucaucaaugug

SEQ ID NO: 728921 - RNA, 12 nt, Homo sapiens
uuuaaacugcau

SEQ ID NO: 728922 - RNA, 16 nt, Homo sapiens
guggcccugugccugg

SEQ ID NO: 728923 - RNA, 17 nt, Homo sapiens
guggccgaggacuuuga

SEQ ID NO: 728924 - RNA, 18 nt, Homo sapiens
guggccgaggacuuugau

SEQ ID NO: 728925 - RNA, 19 nt, Homo sapiens
guggccuaggcuaccucaa

SEQ ID NO: 728926 - RNA, 20 nt, Homo sapiens
guggccugccuucaccccac

SEQ ID NO: 728927 - RNA, 14 nt, Homo sapiens
guggcgacucuaua

SEQ ID NO: 728928 - RNA, 15 nt, Homo sapiens
guggcggggcagcag

SEQ ID NO: 728929 - RNA, 14 nt, Homo sapiens
guggcucacagugg

SEQ ID NO: 728930 - RNA, 16 nt, Homo sapiens
guggcucagugccuuc

SEQ ID NO: 728931 - RNA, 17 nt, Homo sapiens
guggcuccuaucugugu

SEQ ID NO: 728932 - RNA, 20 nt, Homo sapiens
guggcucuggguaccugcaa

SEQ ID NO: 728933 - RNA, 22 nt, Homo sapiens
guggcuggaucugugaggggcu

SEQ ID NO: 728934 - RNA, 13 nt, Homo sapiens
gugggaacucuga

SEQ ID NO: 728935 - RNA, 19 nt, Homo sapiens
gugggacccccguggggca

SEQ ID NO: 728936 - RNA, 15 nt, Homo sapiens
gugggagaaggacua

SEQ ID NO: 728937 - RNA, 17 nt, Homo sapiens
gugggagcaccugccag

SEQ ID NO: 728938 - RNA, 20 nt, Homo sapiens
gugggauacuuagugguaug

SEQ ID NO: 728939 - RNA, 23 nt, Homo sapiens
gugggauggggacauuugaacau

SEQ ID NO: 728940 - RNA, 17 nt, Homo sapiens
gugggcagagccuucca

SEQ ID NO: 728941 - RNA, 20 nt, Homo sapiens
gugggcagaucacgagguca

SEQ ID NO: 728942 - RNA, 21 nt, Homo sapiens
gugggcucugugcagucacug

SEQ ID NO: 728943 - RNA, 23 nt, Homo sapiens
gugggcucugugcagucacugga

SEQ ID NO: 728944 - RNA, 18 nt, Homo sapiens
guggggaaggaggccaag

SEQ ID NO: 728945 - RNA, 13 nt, Homo sapiens
guggggacaucag

SEQ ID NO: 728946 - RNA, 14 nt, Homo sapiens
guggggugcacucg

SEQ ID NO: 728947 - RNA, 22 nt, Homo sapiens
guggguauugagugugauuuga

SEQ ID NO: 728948 - RNA, 20 nt, Homo sapiens
gugggucucugggcugucag

SEQ ID NO: 728949 - RNA, 14 nt, Homo sapiens
gugguaacugccag

SEQ ID NO: 728950 - RNA, 14 nt, Homo sapiens
gugguaaguggagg

SEQ ID NO: 728951 - RNA, 12 nt, Homo sapiens
gugguaaucuac

SEQ ID NO: 728952 - RNA, 19 nt, Homo sapiens
gugguacaaucuggcucac

SEQ ID NO: 728953 - RNA, 13 nt, Homo sapiens
gugguacaggaag

SEQ ID NO: 728954 - RNA, 22 nt, Homo sapiens
gugguauccugugacauguaac

SEQ ID NO: 728955 - RNA, 23 nt, Homo sapiens
guggucacaacuugauggcugcg

SEQ ID NO: 728956 - RNA, 17 nt, Homo sapiens
gugguccagaaacaaaa

SEQ ID NO: 728957 - RNA, 20 nt, Homo sapiens
guggucugggcaccaccucu

SEQ ID NO: 728958 - RNA, 16 nt, Homo sapiens
gugguggaagcaagac

SEQ ID NO: 728959 - RNA, 16 nt, Homo sapiens
gugguggcgugcauau

SEQ ID NO: 728960 - RNA, 17 nt, Homo sapiens
guggugggacacugggc

SEQ ID NO: 728961 - RNA, 14 nt, Homo sapiens
gugguggucuucaa

SEQ ID NO: 728962 - RNA, 22 nt, Homo sapiens
gugguguccugaagcugcugga

SEQ ID NO: 728963 - RNA, 17 nt, Homo sapiens
gugguguuuauugcaau

SEQ ID NO: 728964 - RNA, 21 nt, Homo sapiens
gugguuccucccucuccugaa

SEQ ID NO: 728965 - RNA, 17 nt, Homo sapiens
gugguugcuguccucuc

SEQ ID NO: 728966 - RNA, 18 nt, Homo sapiens
gugguugucuuauugcac

SEQ ID NO: 728967 - RNA, 22 nt, Homo sapiens
gugguuuuccagaagugaugaa

SEQ ID NO: 728968 - RNA, 15 nt, Homo sapiens
guguaaaaagcaaag

SEQ ID NO: 728969 - RNA, 18 nt, Homo sapiens
guguaaaauacguuugaa

SEQ ID NO: 728970 - RNA, 20 nt, Homo sapiens
guguaacccccaguucaaga

SEQ ID NO: 728971 - RNA, 14 nt, Homo sapiens
guguaauaugcaca

SEQ ID NO: 728972 - RNA, 16 nt, Homo sapiens
guguaauggaaaccaa

SEQ ID NO: 728973 - RNA, 19 nt, Homo sapiens
guguacaccugcggggcca

SEQ ID NO: 728974 - RNA, 23 nt, Homo sapiens
guguaccucaguucccucuugcu

SEQ ID NO: 728975 - RNA, 20 nt, Homo sapiens
guguaccuccucucaguguu

SEQ ID NO: 728976 - RNA, 23 nt, Homo sapiens
guguaguuucuucauuucaggaa

SEQ ID NO: 728977 - RNA, 22 nt, Homo sapiens
guguauuuauuuuacagcucau

SEQ ID NO: 728978 - RNA, 14 nt, Homo sapiens
guguauuugcuaau

SEQ ID NO: 728979 - RNA, 13 nt, Homo sapiens
guucaaacugcuc

SEQ ID NO: 728980 - RNA, 22 nt, Homo sapiens
guucaaagacugugaacagcuu

SEQ ID NO: 728981 - RNA, 14 nt, Homo sapiens
guucaaagagguga

SEQ ID NO: 728982 - RNA, 13 nt, Homo sapiens
guucaaagcacag

SEQ ID NO: 728983 - RNA, 20 nt, Homo sapiens
guucaaaugcccuuccagug

SEQ ID NO: 728984 - RNA, 16 nt, Homo sapiens
guucaagcacacugga

SEQ ID NO: 728985 - RNA, 13 nt, Homo sapiens
guucaaucauuga

SEQ ID NO: 728986 - RNA, 13 nt, Homo sapiens
guucaauguucca

SEQ ID NO: 728987 - RNA, 15 nt, Homo sapiens
guucacaaacuguga

SEQ ID NO: 728988 - RNA, 16 nt, Homo sapiens
guucacaaacugugaa

SEQ ID NO: 728989 - RNA, 15 nt, Homo sapiens
guucacaacagugaa

SEQ ID NO: 728990 - RNA, 12 nt, Homo sapiens
guucaccagccu

SEQ ID NO: 728991 - RNA, 23 nt, Homo sapiens
guucaccuugggaugaugccuca

SEQ ID NO: 728992 - RNA, 11 nt, Homo sapiens
guucagacucu

SEQ ID NO: 728993 - RNA, 22 nt, Homo sapiens
guucagaguuguacacugugua

SEQ ID NO: 728994 - RNA, 18 nt, Homo sapiens
guucaggaaaacuacuga

SEQ ID NO: 728995 - RNA, 20 nt, Homo sapiens
guucaggaguuggagaccag

SEQ ID NO: 728996 - RNA, 18 nt, Homo sapiens
guucaggcagcacaucaa

SEQ ID NO: 728997 - RNA, 16 nt, Homo sapiens
guucagggcugugauc

SEQ ID NO: 728998 - RNA, 12 nt, Homo sapiens
guucagugccuu

SEQ ID NO: 728999 - RNA, 13 nt, Homo sapiens
guucaguucuguu

SEQ ID NO: 729000 - RNA, 20 nt, Homo sapiens
guucauaggucuccaagacc

SEQ ID NO: 729001 - RNA, 17 nt, Homo sapiens
guucauauuaugucaug

SEQ ID NO: 729002 - RNA, 17 nt, Homo sapiens
guucauccaggcccaac

SEQ ID NO: 729003 - RNA, 16 nt, Homo sapiens
guucauguuugcuuca

SEQ ID NO: 729004 - RNA, 20 nt, Homo sapiens
guucauguuuguaaauuaau

SEQ ID NO: 729005 - RNA, 15 nt, Homo sapiens
guucauugaugcugc

SEQ ID NO: 729006 - RNA, 17 nt, Homo sapiens
guucauuuugaguauuu

SEQ ID NO: 729007 - RNA, 12 nt, Homo sapiens
guuccagacuca

SEQ ID NO: 729008 - RNA, 23 nt, Homo sapiens
guuccagugaugaaaacauucaa

SEQ ID NO: 729009 - RNA, 15 nt, Homo sapiens
guuccaguugcuuga

SEQ ID NO: 729010 - RNA, 22 nt, Homo sapiens
guuccauccaccaccuugccaa

SEQ ID NO: 729011 - RNA, 15 nt, Homo sapiens
guucccacuccuuca

SEQ ID NO: 729012 - RNA, 16 nt, Homo sapiens
guucccucuugcucag

SEQ ID NO: 729013 - RNA, 18 nt, Homo sapiens
guucccugggcugaaacu

SEQ ID NO: 729014 - RNA, 19 nt, Homo sapiens
guucccuuaucuguuuucu

SEQ ID NO: 729015 - RNA, 14 nt, Homo sapiens
guuccuacuaggca

SEQ ID NO: 729016 - RNA, 17 nt, Homo sapiens
guuccucaagguccauu

SEQ ID NO: 729017 - RNA, 20 nt, Homo sapiens
guuccucaucugagaggcuc

SEQ ID NO: 729018 - RNA, 12 nt, Homo sapiens
guuccuuauaua

SEQ ID NO: 729019 - RNA, 16 nt, Homo sapiens
guucgagaccaaccug

SEQ ID NO: 729020 - RNA, 19 nt, Homo sapiens
guucgauguuagcguuuac

SEQ ID NO: 729021 - RNA, 21 nt, Homo sapiens
guucguucuguacuguuacug

SEQ ID NO: 729022 - RNA, 17 nt, Homo sapiens
guucuacacucaucuua

SEQ ID NO: 729023 - RNA, 21 nt, Homo sapiens
guucuaccucaggcagcucaa

SEQ ID NO: 729024 - RNA, 22 nt, Homo sapiens
guucuacugagaaaagccucuc

SEQ ID NO: 729025 - RNA, 20 nt, Homo sapiens
guucuaugcuaaacugugaa

SEQ ID NO: 729026 - RNA, 15 nt, Homo sapiens
guucuauuuguauau

SEQ ID NO: 729027 - RNA, 17 nt, Homo sapiens
guucuauuuguauauau

SEQ ID NO: 729028 - RNA, 21 nt, Homo sapiens
guucucacagugggagccagg

SEQ ID NO: 729029 - RNA, 11 nt, Homo sapiens
guucucaggcc

SEQ ID NO: 729030 - RNA, 18 nt, Homo sapiens
guucucaucuuucuugau

SEQ ID NO: 729031 - RNA, 20 nt, Homo sapiens
guucucauggguggcacuca

SEQ ID NO: 729032 - RNA, 22 nt, Homo sapiens
guucuccccacgacaaccccac

SEQ ID NO: 729033 - RNA, 16 nt, Homo sapiens
guucucuauugcugcu

SEQ ID NO: 729034 - RNA, 23 nt, Homo sapiens
guucucucugccugugagccagu

SEQ ID NO: 729035 - RNA, 13 nt, Homo sapiens
guucucugccuca

SEQ ID NO: 729036 - RNA, 15 nt, Homo sapiens
guucugcacugaaaa

SEQ ID NO: 729037 - RNA, 19 nt, Homo sapiens
guucugcauggauucagca

SEQ ID NO: 729038 - RNA, 15 nt, Homo sapiens
uuuauguaaaaccaa

SEQ ID NO: 729039 - RNA, 14 nt, Homo sapiens
uuuauguacuaaau

SEQ ID NO: 729040 - RNA, 17 nt, Homo sapiens
uuuaugugaacuaugau

SEQ ID NO: 729041 - RNA, 15 nt, Homo sapiens
uuuaugugcuaugca

SEQ ID NO: 729042 - RNA, 13 nt, Homo sapiens
uuuauuaccucug

SEQ ID NO: 729043 - RNA, 16 nt, Homo sapiens
uuuauuaccucugaua

SEQ ID NO: 729044 - RNA, 18 nt, Homo sapiens
uuuauuauaugauuauca

SEQ ID NO: 729045 - RNA, 17 nt, Homo sapiens
uuuauuaugcaaccagu

SEQ ID NO: 729046 - RNA, 18 nt, Homo sapiens
uuuauucaagaaugccag

SEQ ID NO: 729047 - RNA, 18 nt, Homo sapiens
uuuauuuaagcaucaaau

SEQ ID NO: 729048 - RNA, 14 nt, Homo sapiens
uuuauuuccagugg

SEQ ID NO: 729049 - RNA, 20 nt, Homo sapiens
uuuauuuugacugugauuua

SEQ ID NO: 729050 - RNA, 22 nt, Homo sapiens
uuuauuuuuuuaaaacacaaau

SEQ ID NO: 729051 - RNA, 18 nt, Homo sapiens
uuucaaaaaauuauauga

SEQ ID NO: 729052 - RNA, 21 nt, Homo sapiens
uuucaaaagcggggcuucauc

SEQ ID NO: 729053 - RNA, 23 nt, Homo sapiens
uuucaaaagcggggcuucaucug

SEQ ID NO: 729054 - RNA, 22 nt, Homo sapiens
uuucaaaagguauuauacaugu

SEQ ID NO: 729055 - RNA, 17 nt, Homo sapiens
uuucaaaauccaaaaag

SEQ ID NO: 729056 - RNA, 22 nt, Homo sapiens
uuucaaacugcugcauacuuug

SEQ ID NO: 729057 - RNA, 22 nt, Homo sapiens
uuucaaacuuaaacaaaaaacu

SEQ ID NO: 729058 - RNA, 13 nt, Homo sapiens
uuucaaagugaua

SEQ ID NO: 729059 - RNA, 16 nt, Homo sapiens
uuucaacaaguaacuu

SEQ ID NO: 729060 - RNA, 17 nt, Homo sapiens
uuucaacuaauauaucu

SEQ ID NO: 729061 - RNA, 23 nt, Homo sapiens
uuucaagaccuucuccccauucu

SEQ ID NO: 729062 - RNA, 14 nt, Homo sapiens
uuucaagcucugca

SEQ ID NO: 729063 - RNA, 24 nt, Homo sapiens
uuucaaguuauucaaauuuguaca

SEQ ID NO: 729064 - RNA, 23 nt, Homo sapiens
uuucaauaaaaguaaagacugua

SEQ ID NO: 729065 - RNA, 16 nt, Homo sapiens
uuucaauaccagggaa

SEQ ID NO: 729066 - RNA, 15 nt, Homo sapiens
uuucaaucaacuuua

SEQ ID NO: 729067 - RNA, 15 nt, Homo sapiens
uuucaaugaccugua

SEQ ID NO: 729068 - RNA, 18 nt, Homo sapiens
uuucaauuugagauucua

SEQ ID NO: 729069 - RNA, 19 nt, Homo sapiens
uuucacaaauauaguugaa

SEQ ID NO: 729070 - RNA, 15 nt, Homo sapiens
uuucacaaugugaaa

SEQ ID NO: 729071 - RNA, 18 nt, Homo sapiens
uuucacacuuccaccagc

SEQ ID NO: 729072 - RNA, 21 nt, Homo sapiens
uuucacagagugugcugcuau

SEQ ID NO: 729073 - RNA, 20 nt, Homo sapiens
uuucacauaucuaguaugaa

SEQ ID NO: 729074 - RNA, 17 nt, Homo sapiens
uuucacaugagucaaaa

SEQ ID NO: 729075 - RNA, 20 nt, Homo sapiens
uuucacgccugaggcaauua

SEQ ID NO: 729076 - RNA, 23 nt, Homo sapiens
uuucacuaauuuaaguacuugag

SEQ ID NO: 729077 - RNA, 15 nt, Homo sapiens
uuucacucugucauc

SEQ ID NO: 729078 - RNA, 19 nt, Homo sapiens
uuucacuggaagauuuaug

SEQ ID NO: 729079 - RNA, 23 nt, Homo sapiens
uuucagaagugagcuuugcugcu

SEQ ID NO: 729080 - RNA, 14 nt, Homo sapiens
uuucagaauuuugu

SEQ ID NO: 729081 - RNA, 14 nt, Homo sapiens
uuucagacuuuaaa

SEQ ID NO: 729082 - RNA, 12 nt, Homo sapiens
uuucagcuaaag

SEQ ID NO: 729083 - RNA, 18 nt, Homo sapiens
uuucaggguccaaacaaa

SEQ ID NO: 729084 - RNA, 22 nt, Homo sapiens
uuucaguacacccaguugccaa

SEQ ID NO: 729085 - RNA, 18 nt, Homo sapiens
uuucagugugagucagaa

SEQ ID NO: 729086 - RNA, 18 nt, Homo sapiens
uuucauaaacuucaggga

SEQ ID NO: 729087 - RNA, 15 nt, Homo sapiens
uuucauaguguucau

SEQ ID NO: 729088 - RNA, 19 nt, Homo sapiens
uuucauccugauacuguag

SEQ ID NO: 729089 - RNA, 19 nt, Homo sapiens
uuucauguuuuugaucaaa

SEQ ID NO: 729090 - RNA, 17 nt, Homo sapiens
uuucauuuaauggggau

SEQ ID NO: 729091 - RNA, 13 nt, Homo sapiens
uuucauuuaucca

SEQ ID NO: 729092 - RNA, 17 nt, Homo sapiens
uuucauuuaucuauaau

SEQ ID NO: 729093 - RNA, 12 nt, Homo sapiens
uuuccaaaacau

SEQ ID NO: 729094 - RNA, 15 nt, Homo sapiens
uuuccaaaaccagaa

SEQ ID NO: 729095 - RNA, 15 nt, Homo sapiens
uuuccaaauucacaa

SEQ ID NO: 729096 - RNA, 15 nt, Homo sapiens
uuuccaacuacuaau

SEQ ID NO: 729097 - RNA, 13 nt, Homo sapiens
uuuccaacuuuua

SEQ ID NO: 729098 - RNA, 18 nt, Homo sapiens
uuuccaacuuuuauuuca

SEQ ID NO: 729099 - RNA, 14 nt, Homo sapiens
uuuccacaaacaga

SEQ ID NO: 729100 - RNA, 20 nt, Homo sapiens
uuuccacuauuuucaaagaa

SEQ ID NO: 729101 - RNA, 17 nt, Homo sapiens
uuuccacuuugacuaca

SEQ ID NO: 729102 - RNA, 18 nt, Homo sapiens
uuuccagcugccaagugc

SEQ ID NO: 729103 - RNA, 11 nt, Homo sapiens
uuuccagucag

SEQ ID NO: 729104 - RNA, 22 nt, Homo sapiens
uuuccaguggaucauaagacaa

SEQ ID NO: 729105 - RNA, 18 nt, Homo sapiens
uuuccauaaauuuggacu

SEQ ID NO: 729106 - RNA, 16 nt, Homo sapiens
uuuccauccaguuccu

SEQ ID NO: 729107 - RNA, 15 nt, Homo sapiens
uuuccauccuaguca

SEQ ID NO: 729108 - RNA, 17 nt, Homo sapiens
uuuccauguugcugcca

SEQ ID NO: 729109 - RNA, 19 nt, Homo sapiens
uuucccaucagacugucaa

SEQ ID NO: 729110 - RNA, 13 nt, Homo sapiens
uuucccauugcca

SEQ ID NO: 729111 - RNA, 22 nt, Homo sapiens
uuuccccaaagacgaccagcau

SEQ ID NO: 729112 - RNA, 14 nt, Homo sapiens
uuuccccuagcuua

SEQ ID NO: 729113 - RNA, 22 nt, Homo sapiens
uuuccccuagcuuacugauaaa

SEQ ID NO: 729114 - RNA, 23 nt, Homo sapiens
uuucccuaggaaacucacacucc

SEQ ID NO: 729115 - RNA, 21 nt, Homo sapiens
uuucccucucucauacccucc

SEQ ID NO: 729116 - RNA, 16 nt, Homo sapiens
uuucccugcaccacuc

SEQ ID NO: 729117 - RNA, 23 nt, Homo sapiens
uuucccuucagucuucuucacuu

SEQ ID NO: 729118 - RNA, 14 nt, Homo sapiens
uuucccuugcugua

SEQ ID NO: 729119 - RNA, 21 nt, Homo sapiens
uuuccggaaacaaaauccuuu

SEQ ID NO: 729120 - RNA, 15 nt, Homo sapiens
uuuccuaaaagugua

SEQ ID NO: 729121 - RNA, 15 nt, Homo sapiens
uuuccuaaacccagu

SEQ ID NO: 729122 - RNA, 14 nt, Homo sapiens
uuuccuaauuuuga

SEQ ID NO: 729123 - RNA, 17 nt, Homo sapiens
uuuccuacuguccucag

SEQ ID NO: 729124 - RNA, 18 nt, Homo sapiens
uuuccuauuugcaguuac

SEQ ID NO: 729125 - RNA, 12 nt, Homo sapiens
uuuccucaaaaa

SEQ ID NO: 729126 - RNA, 16 nt, Homo sapiens
uuuccucaccaggagc

SEQ ID NO: 729127 - RNA, 17 nt, Homo sapiens
uuuccuccucccagugc

SEQ ID NO: 729128 - RNA, 14 nt, Homo sapiens
uuuccucuguucac

SEQ ID NO: 729129 - RNA, 19 nt, Homo sapiens
uuuccugaggguuuucuca

SEQ ID NO: 729130 - RNA, 12 nt, Homo sapiens
uuuccugauaca

SEQ ID NO: 729131 - RNA, 18 nt, Homo sapiens
uuuccugcccuuccucag

SEQ ID NO: 729132 - RNA, 18 nt, Homo sapiens
uuuccuggaauugccagc

SEQ ID NO: 729133 - RNA, 18 nt, Homo sapiens
uuuccuuuguaaguuccu

SEQ ID NO: 729134 - RNA, 16 nt, Homo sapiens
uuuccuuuuuugucua

SEQ ID NO: 729135 - RNA, 14 nt, Homo sapiens
uuucguaugcacuc

SEQ ID NO: 729136 - RNA, 16 nt, Homo sapiens
uuucuaaaacugccuu

SEQ ID NO: 729137 - RNA, 17 nt, Homo sapiens
uuucuaagaaaagcauu

SEQ ID NO: 729138 - RNA, 21 nt, Homo sapiens
uuucuaaguguucgucuuuag

SEQ ID NO: 729139 - RNA, 14 nt, Homo sapiens
uuucuacaggccag

SEQ ID NO: 729140 - RNA, 21 nt, Homo sapiens
uuucuagaagcacauguguau

SEQ ID NO: 729141 - RNA, 13 nt, Homo sapiens
uuucuagacuguc

SEQ ID NO: 729142 - RNA, 13 nt, Homo sapiens
uuucuauauucuc

SEQ ID NO: 729143 - RNA, 14 nt, Homo sapiens
uuucuauucuguca

SEQ ID NO: 729144 - RNA, 14 nt, Homo sapiens
uuucucaaaugcac

SEQ ID NO: 729145 - RNA, 23 nt, Homo sapiens
uuucucagauguugaaacuuuga

SEQ ID NO: 729146 - RNA, 19 nt, Homo sapiens
uuucucagugcacaugcaa

SEQ ID NO: 729147 - RNA, 14 nt, Homo sapiens
uuucucauacuuag

SEQ ID NO: 729148 - RNA, 21 nt, Homo sapiens
uuucucauaucaacuuaguca

SEQ ID NO: 729149 - RNA, 15 nt, Homo sapiens
uuucuccccauuugg

SEQ ID NO: 729150 - RNA, 17 nt, Homo sapiens
uuucuccuuuaauugua

SEQ ID NO: 729151 - RNA, 16 nt, Homo sapiens
uuucucuaaaacugcc

SEQ ID NO: 729152 - RNA, 23 nt, Homo sapiens
uuucucuccagcgguccaaaguu

SEQ ID NO: 729153 - RNA, 15 nt, Homo sapiens
guucugcugaccaaa

SEQ ID NO: 729154 - RNA, 18 nt, Homo sapiens
guucuggaccugggcaug

SEQ ID NO: 729155 - RNA, 19 nt, Homo sapiens
guucuggggggacccagug

SEQ ID NO: 729156 - RNA, 16 nt, Homo sapiens
guucuguccucaagua

SEQ ID NO: 729157 - RNA, 14 nt, Homo sapiens
guucugugaccacu

SEQ ID NO: 729158 - RNA, 18 nt, Homo sapiens
guucuuacagcacaucac

SEQ ID NO: 729159 - RNA, 17 nt, Homo sapiens
guucuuaguuugcaguu

SEQ ID NO: 729160 - RNA, 23 nt, Homo sapiens
guucuucccuuuuacauacugcu

SEQ ID NO: 729161 - RNA, 21 nt, Homo sapiens
guucuucuucccaguucuuga

SEQ ID NO: 729162 - RNA, 12 nt, Homo sapiens
guucuugggaua

SEQ ID NO: 729163 - RNA, 13 nt, Homo sapiens
guucuugggauac

SEQ ID NO: 729164 - RNA, 14 nt, Homo sapiens
guucuuugggccag

SEQ ID NO: 729165 - RNA, 17 nt, Homo sapiens
guucuuugucucaaaau

SEQ ID NO: 729166 - RNA, 15 nt, Homo sapiens
guucuuuugacugaa

SEQ ID NO: 729167 - RNA, 21 nt, Homo sapiens
guucuuuugacugaagucuga

SEQ ID NO: 729168 - RNA, 18 nt, Homo sapiens
guugaaaaccacagucag

SEQ ID NO: 729169 - RNA, 14 nt, Homo sapiens
guugaaaacccaga

SEQ ID NO: 729170 - RNA, 14 nt, Homo sapiens
guugaaaagcacac

SEQ ID NO: 729171 - RNA, 18 nt, Homo sapiens
guugaaccguuucuuuaa

SEQ ID NO: 729172 - RNA, 16 nt, Homo sapiens
guugaagcucugguga

SEQ ID NO: 729173 - RNA, 17 nt, Homo sapiens
guugaauguuucacuag

SEQ ID NO: 729174 - RNA, 15 nt, Homo sapiens
guugaggcugucaca

SEQ ID NO: 729175 - RNA, 16 nt, Homo sapiens
guugaggcugucacag

SEQ ID NO: 729176 - RNA, 18 nt, Homo sapiens
guugaggggcuccuggaa

SEQ ID NO: 729177 - RNA, 20 nt, Homo sapiens
guugauaaauuccacuggac

SEQ ID NO: 729178 - RNA, 17 nt, Homo sapiens
guugauuccuucauuca

SEQ ID NO: 729179 - RNA, 20 nt, Homo sapiens
guugcagagauuuccuccau

SEQ ID NO: 729180 - RNA, 18 nt, Homo sapiens
guugcagcugcucuugca

SEQ ID NO: 729181 - RNA, 14 nt, Homo sapiens
guugcagugagcca

SEQ ID NO: 729182 - RNA, 21 nt, Homo sapiens
guugcagugagccgagaucac

SEQ ID NO: 729183 - RNA, 19 nt, Homo sapiens
guugcccauuuaauguggu

SEQ ID NO: 729184 - RNA, 17 nt, Homo sapiens
guugcuauuuguauuuc

SEQ ID NO: 729185 - RNA, 19 nt, Homo sapiens
guugcugucuucagucuca

SEQ ID NO: 729186 - RNA, 14 nt, Homo sapiens
guugcuguuucaca

SEQ ID NO: 729187 - RNA, 16 nt, Homo sapiens
guugcuuuuacuucuc

SEQ ID NO: 729188 - RNA, 23 nt, Homo sapiens
guuggacaaaccgagugcaauga

SEQ ID NO: 729189 - RNA, 21 nt, Homo sapiens
guuggacuguaagggauugaa

SEQ ID NO: 729190 - RNA, 13 nt, Homo sapiens
guuggagugcagu

SEQ ID NO: 729191 - RNA, 15 nt, Homo sapiens
guuggcagcauucca

SEQ ID NO: 729192 - RNA, 15 nt, Homo sapiens
guugggagcacugga

SEQ ID NO: 729193 - RNA, 23 nt, Homo sapiens
guugggauaaggaaacacuucua

SEQ ID NO: 729194 - RNA, 16 nt, Homo sapiens
guugggccccugagga

SEQ ID NO: 729195 - RNA, 22 nt, Homo sapiens
guugggggaggggccuagacaa

SEQ ID NO: 729196 - RNA, 13 nt, Homo sapiens
guuggucaguauu

SEQ ID NO: 729197 - RNA, 16 nt, Homo sapiens
guuggugaauuucaca

SEQ ID NO: 729198 - RNA, 16 nt, Homo sapiens
guugguggggggucca

SEQ ID NO: 729199 - RNA, 14 nt, Homo sapiens
guugguucaucccu

SEQ ID NO: 729200 - RNA, 20 nt, Homo sapiens
guugguucguucuguacugu

SEQ ID NO: 729201 - RNA, 22 nt, Homo sapiens
guuguaaaaagcccagcacuug

SEQ ID NO: 729202 - RNA, 23 nt, Homo sapiens
guuguaaaaagcccagcacuuga

SEQ ID NO: 729203 - RNA, 20 nt, Homo sapiens
guuguaaaccaagugaucaa

SEQ ID NO: 729204 - RNA, 18 nt, Homo sapiens
guuguaaccugcugugau

SEQ ID NO: 729205 - RNA, 22 nt, Homo sapiens
guuguauguaaaucugcuuugu

SEQ ID NO: 729206 - RNA, 21 nt, Homo sapiens
guuguauuguggaacacugaa

SEQ ID NO: 729207 - RNA, 23 nt, Homo sapiens
guugucaaacugaaauucagagc

SEQ ID NO: 729208 - RNA, 23 nt, Homo sapiens
guugucaccucucucugaggaca

SEQ ID NO: 729209 - RNA, 14 nt, Homo sapiens
uuugagcacacuuu

SEQ ID NO: 729210 - RNA, 16 nt, Homo sapiens
uuugaggaacauucaa

SEQ ID NO: 729211 - RNA, 20 nt, Homo sapiens
uuugaggaauuaucauggga

SEQ ID NO: 729212 - RNA, 23 nt, Homo sapiens
uuugaggaccccuuaaucuugcu

SEQ ID NO: 729213 - RNA, 22 nt, Homo sapiens
uuugaggauauauuuucacuuu

SEQ ID NO: 729214 - RNA, 13 nt, Homo sapiens
uuugagugauccu

SEQ ID NO: 729215 - RNA, 14 nt, Homo sapiens
uuugauaaagcagu

SEQ ID NO: 729216 - RNA, 19 nt, Homo sapiens
uuugauacaagaaagcaau

SEQ ID NO: 729217 - RNA, 21 nt, Homo sapiens
uuugauaccuguaguggaacu

SEQ ID NO: 729218 - RNA, 20 nt, Homo sapiens
uuugauacucccagucuugu

SEQ ID NO: 729219 - RNA, 19 nt, Homo sapiens
uuugauagaaagaugagau

SEQ ID NO: 729220 - RNA, 20 nt, Homo sapiens
uuugauauaccaaauuaaaa

SEQ ID NO: 729221 - RNA, 20 nt, Homo sapiens
uuugaugauuaauucaccuu

SEQ ID NO: 729222 - RNA, 12 nt, Homo sapiens
uuugaugccauu

SEQ ID NO: 729223 - RNA, 14 nt, Homo sapiens
uuugauguuuacag

SEQ ID NO: 729224 - RNA, 20 nt, Homo sapiens
uuugcaacaauaaaguacuu

SEQ ID NO: 729225 - RNA, 23 nt, Homo sapiens
uuugcaacaauaaaguacuuuac

SEQ ID NO: 729226 - RNA, 22 nt, Homo sapiens
uuugcaauuggaauaaucacuu

SEQ ID NO: 729227 - RNA, 18 nt, Homo sapiens
uuugcagaauacauucaa

SEQ ID NO: 729228 - RNA, 19 nt, Homo sapiens
uuugcagcagugagucucu

SEQ ID NO: 729229 - RNA, 17 nt, Homo sapiens
uuugcagcugugagaag

SEQ ID NO: 729230 - RNA, 21 nt, Homo sapiens
uuugcaggguccucuucuggg

SEQ ID NO: 729231 - RNA, 16 nt, Homo sapiens
uuugcaguaugaacua

SEQ ID NO: 729232 - RNA, 19 nt, Homo sapiens
uuugcaguaugaacuauug

SEQ ID NO: 729233 - RNA, 19 nt, Homo sapiens
uuugcagucaguucauccc

SEQ ID NO: 729234 - RNA, 15 nt, Homo sapiens
uuugcaugcaugcaa

SEQ ID NO: 729235 - RNA, 17 nt, Homo sapiens
uuugcaugcaugcaaau

SEQ ID NO: 729236 - RNA, 11 nt, Homo sapiens
uuugcauuuca

SEQ ID NO: 729237 - RNA, 11 nt, Homo sapiens
uuugcauuugg

SEQ ID NO: 729238 - RNA, 19 nt, Homo sapiens
uuugccaaaauaccagagc

SEQ ID NO: 729239 - RNA, 14 nt, Homo sapiens
uuugccauguugcc

SEQ ID NO: 729240 - RNA, 18 nt, Homo sapiens
uuugcccaaaacugucau

SEQ ID NO: 729241 - RNA, 14 nt, Homo sapiens
uuugccugccauuu

SEQ ID NO: 729242 - RNA, 13 nt, Homo sapiens
uuugccugugauu

SEQ ID NO: 729243 - RNA, 22 nt, Homo sapiens
uuugccuucucuaaacauuuca

SEQ ID NO: 729244 - RNA, 23 nt, Homo sapiens
uuugcgcugguggaccacaggca

SEQ ID NO: 729245 - RNA, 22 nt, Homo sapiens
uuugcguacacagagaaggcua

SEQ ID NO: 729246 - RNA, 20 nt, Homo sapiens
uuugcguuugguuuacuugu

SEQ ID NO: 729247 - RNA, 14 nt, Homo sapiens
uuugcuacauucua

SEQ ID NO: 729248 - RNA, 23 nt, Homo sapiens
uuugcuacuaaguucacauuaga

SEQ ID NO: 729249 - RNA, 19 nt, Homo sapiens
uuugcuagacucuagacaa

SEQ ID NO: 729250 - RNA, 17 nt, Homo sapiens
uuugcuaugugcuccua

SEQ ID NO: 729251 - RNA, 15 nt, Homo sapiens
uuugcuccagaacac

SEQ ID NO: 729252 - RNA, 12 nt, Homo sapiens
uuugcucuugcc

SEQ ID NO: 729253 - RNA, 17 nt, Homo sapiens
uuugcugaguuguucua

SEQ ID NO: 729254 - RNA, 17 nt, Homo sapiens
uuugcugcagucaucua

SEQ ID NO: 729255 - RNA, 11 nt, Homo sapiens
uuugcugucuc

SEQ ID NO: 729256 - RNA, 21 nt, Homo sapiens
uuugcuuccucccaacaagca

SEQ ID NO: 729257 - RNA, 17 nt, Homo sapiens
uuugcuucuugccauca

SEQ ID NO: 729258 - RNA, 20 nt, Homo sapiens
uuuggaaaccacagucagug

SEQ ID NO: 729259 - RNA, 19 nt, Homo sapiens
uuuggaaaugguacuucau

SEQ ID NO: 729260 - RNA, 22 nt, Homo sapiens
uuuggaacauuucuuucuugcu

SEQ ID NO: 729261 - RNA, 16 nt, Homo sapiens
uuuggaagucaugagc

SEQ ID NO: 729262 - RNA, 16 nt, Homo sapiens
uuuggaauacauuucu

SEQ ID NO: 729263 - RNA, 16 nt, Homo sapiens
uuuggacccaguucag

SEQ ID NO: 729264 - RNA, 17 nt, Homo sapiens
uuuggacuguaacugac

SEQ ID NO: 729265 - RNA, 19 nt, Homo sapiens
uuuggagacacaacuauuu

SEQ ID NO: 729266 - RNA, 20 nt, Homo sapiens
uuuggagacagggucucgcu

SEQ ID NO: 729267 - RNA, 22 nt, Homo sapiens
guuugacccaggggucagccuu

SEQ ID NO: 729268 - RNA, 18 nt, Homo sapiens
guuugaccucauuuguaa

SEQ ID NO: 729269 - RNA, 19 nt, Homo sapiens
guuugagaccgaccagcca

SEQ ID NO: 729270 - RNA, 17 nt, Homo sapiens
guuugagcucaggcauu

SEQ ID NO: 729271 - RNA, 23 nt, Homo sapiens
guuugaucccuguuacccagaga

SEQ ID NO: 729272 - RNA, 12 nt, Homo sapiens
guuugauguaug

SEQ ID NO: 729273 - RNA, 15 nt, Homo sapiens
guuugauucagcaaa

SEQ ID NO: 729274 - RNA, 15 nt, Homo sapiens
guuugcagcugugag

SEQ ID NO: 729275 - RNA, 20 nt, Homo sapiens
guuuggacuuuuauuuuggc

SEQ ID NO: 729276 - RNA, 13 nt, Homo sapiens
guuuggaguuuaa

SEQ ID NO: 729277 - RNA, 15 nt, Homo sapiens
guuuggccucucuau

SEQ ID NO: 729278 - RNA, 18 nt, Homo sapiens
guuugguugugcugauag

SEQ ID NO: 729279 - RNA, 18 nt, Homo sapiens
guuuguaauacuuuacaa

SEQ ID NO: 729280 - RNA, 22 nt, Homo sapiens
guuugucacacgauaaagggau

SEQ ID NO: 729281 - RNA, 19 nt, Homo sapiens
guuugugucaaaacugguu

SEQ ID NO: 729282 - RNA, 20 nt, Homo sapiens
guuugugucuguugcuugua

SEQ ID NO: 729283 - RNA, 22 nt, Homo sapiens
guuugugugaucauacaguuau

SEQ ID NO: 729284 - RNA, 11 nt, Homo sapiens
guuuguuaaaa

SEQ ID NO: 729285 - RNA, 22 nt, Homo sapiens
guuuguuggaaaguaacuguga

SEQ ID NO: 729286 - RNA, 16 nt, Homo sapiens
guuuguuucauauaua

SEQ ID NO: 729287 - RNA, 15 nt, Homo sapiens
guuuuaaacauuaau

SEQ ID NO: 729288 - RNA, 15 nt, Homo sapiens
guuuuaaacuugccu

SEQ ID NO: 729289 - RNA, 17 nt, Homo sapiens
guuuuaacuguggauau

SEQ ID NO: 729290 - RNA, 18 nt, Homo sapiens
guuuuacaaugucauaua

SEQ ID NO: 729291 - RNA, 14 nt, Homo sapiens
guuuuaccagcucc

SEQ ID NO: 729292 - RNA, 10 nt, Homo sapiens
guuuuacuaa

SEQ ID NO: 729293 - RNA, 13 nt, Homo sapiens
guuuuacuuuuaa

SEQ ID NO: 729294 - RNA, 15 nt, Homo sapiens
guuuuagaaccagcc

SEQ ID NO: 729295 - RNA, 20 nt, Homo sapiens
guuuuagagacuauggagcc

SEQ ID NO: 729296 - RNA, 15 nt, Homo sapiens
guuuuauaauuuaau

SEQ ID NO: 729297 - RNA, 15 nt, Homo sapiens
guuuuauauguugcu

SEQ ID NO: 729298 - RNA, 18 nt, Homo sapiens
guuuuauuucaaagggaa

SEQ ID NO: 729299 - RNA, 19 nt, Homo sapiens
guuuucaagaugguguuau

SEQ ID NO: 729300 - RNA, 15 nt, Homo sapiens
guuuucaaugcacaa

SEQ ID NO: 729301 - RNA, 18 nt, Homo sapiens
guuuucccaaagcacuuu

SEQ ID NO: 729302 - RNA, 22 nt, Homo sapiens
guuuucccugaaguuaugugua

SEQ ID NO: 729303 - RNA, 19 nt, Homo sapiens
guuuuccuucucaucugug

SEQ ID NO: 729304 - RNA, 18 nt, Homo sapiens
guuuucuccuagacccgu

SEQ ID NO: 729305 - RNA, 22 nt, Homo sapiens
guuuucuccuugauaucauuca

SEQ ID NO: 729306 - RNA, 13 nt, Homo sapiens
guuuucugacuaa

SEQ ID NO: 729307 - RNA, 20 nt, Homo sapiens
guuuucuguaaauaaccuau

SEQ ID NO: 729308 - RNA, 14 nt, Homo sapiens
guuuucuucauuca

SEQ ID NO: 729309 - RNA, 20 nt, Homo sapiens
guuuucuugcucaaagggaa

SEQ ID NO: 729310 - RNA, 12 nt, Homo sapiens
guuuugccucac

SEQ ID NO: 729311 - RNA, 16 nt, Homo sapiens
guuuugcuacauucua

SEQ ID NO: 729312 - RNA, 19 nt, Homo sapiens
guuuuggggacucauuuca

SEQ ID NO: 729313 - RNA, 17 nt, Homo sapiens
guuuuguaaaacuguua

SEQ ID NO: 729314 - RNA, 17 nt, Homo sapiens
guuuuguacauaacuua

SEQ ID NO: 729315 - RNA, 16 nt, Homo sapiens
guuuuguguuuuguca

SEQ ID NO: 729316 - RNA, 15 nt, Homo sapiens
guuuuuacauucaau

SEQ ID NO: 729317 - RNA, 18 nt, Homo sapiens
guuuuuagagcuuccaaa

SEQ ID NO: 729318 - RNA, 19 nt, Homo sapiens
guuuuuagagcuuccaaau

SEQ ID NO: 729319 - RNA, 19 nt, Homo sapiens
guuuuuauaccagcuuaau

SEQ ID NO: 729320 - RNA, 17 nt, Homo sapiens
guuuuucccucagugaa

SEQ ID NO: 729321 - RNA, 13 nt, Homo sapiens
guuuuuccuccau

SEQ ID NO: 729322 - RNA, 19 nt, Homo sapiens
guuuuuccuggaauugcca

SEQ ID NO: 729323 - RNA, 22 nt, Homo sapiens
guuuuuuaaaaaaaaauugaac

SEQ ID NO: 729324 - RNA, 18 nt, Homo sapiens
cagauaaaacauggacaa

SEQ ID NO: 729325 - RNA, 18 nt, Homo sapiens
cagauaaacaacaaauaa

SEQ ID NO: 729326 - RNA, 15 nt, Homo sapiens
cagauaaguuugcag

SEQ ID NO: 729327 - RNA, 14 nt, Homo sapiens
cagauaauuggcaa

SEQ ID NO: 729328 - RNA, 19 nt, Homo sapiens
cagauacgggggcugugac

SEQ ID NO: 729329 - RNA, 17 nt, Homo sapiens
cagauagaguuccauau

SEQ ID NO: 729330 - RNA, 20 nt, Homo sapiens
cagauagcacugggugugag

SEQ ID NO: 729331 - RNA, 22 nt, Homo sapiens
cagaucacccggggcuuacuua

SEQ ID NO: 729332 - RNA, 20 nt, Homo sapiens
cagaucagauucuucucuua

SEQ ID NO: 729333 - RNA, 21 nt, Homo sapiens
cagaucaucuuggaacugcau

SEQ ID NO: 729334 - RNA, 12 nt, Homo sapiens
cagaucaugccc

SEQ ID NO: 729335 - RNA, 19 nt, Homo sapiens
cagauccgugcgugaagua

SEQ ID NO: 729336 - RNA, 17 nt, Homo sapiens
cagaucgcaccacugca

SEQ ID NO: 729337 - RNA, 16 nt, Homo sapiens
cagaucucauguccuc

SEQ ID NO: 729338 - RNA, 19 nt, Homo sapiens
cagaucuggacuuggcaac

SEQ ID NO: 729339 - RNA, 21 nt, Homo sapiens
cagaucugguuucuaagaguu

SEQ ID NO: 729340 - RNA, 17 nt, Homo sapiens
cagaugaacucaugucu

SEQ ID NO: 729341 - RNA, 20 nt, Homo sapiens
cagaugaacucuuucuggcc

SEQ ID NO: 729342 - RNA, 19 nt, Homo sapiens
cagaugaccauuuucugcc

SEQ ID NO: 729343 - RNA, 17 nt, Homo sapiens
cagaugagucagucucu

SEQ ID NO: 729344 - RNA, 14 nt, Homo sapiens
cagaugauuccccu

SEQ ID NO: 729345 - RNA, 15 nt, Homo sapiens
cagaugauuguucaa

SEQ ID NO: 729346 - RNA, 17 nt, Homo sapiens
cagaugccacacaagga

SEQ ID NO: 729347 - RNA, 19 nt, Homo sapiens
cagaugccccagagcuguu

SEQ ID NO: 729348 - RNA, 14 nt, Homo sapiens
cagauggauugaua

SEQ ID NO: 729349 - RNA, 14 nt, Homo sapiens
cagauggcacuuug

SEQ ID NO: 729350 - RNA, 17 nt, Homo sapiens
cagauggcacuuugaag

SEQ ID NO: 729351 - RNA, 16 nt, Homo sapiens
cagauggggucuguga

SEQ ID NO: 729352 - RNA, 16 nt, Homo sapiens
cagaugguagaacuaa

SEQ ID NO: 729353 - RNA, 14 nt, Homo sapiens
cagauguaaauuaa

SEQ ID NO: 729354 - RNA, 18 nt, Homo sapiens
cagauguaacagaacaaa

SEQ ID NO: 729355 - RNA, 16 nt, Homo sapiens
cagaugugaaaacauc

SEQ ID NO: 729356 - RNA, 11 nt, Homo sapiens
cagaugugcau

SEQ ID NO: 729357 - RNA, 22 nt, Homo sapiens
cagauuaugagagcaucagagu

SEQ ID NO: 729358 - RNA, 18 nt, Homo sapiens
cagauuauuuuuccucug

SEQ ID NO: 729359 - RNA, 11 nt, Homo sapiens
cagauucugug

SEQ ID NO: 729360 - RNA, 14 nt, Homo sapiens
cagauucugugaga

SEQ ID NO: 729361 - RNA, 12 nt, Homo sapiens
cagauucuucag

SEQ ID NO: 729362 - RNA, 18 nt, Homo sapiens
cagauugaauauauauga

SEQ ID NO: 729363 - RNA, 17 nt, Homo sapiens
cagauuguuaucuauca

SEQ ID NO: 729364 - RNA, 18 nt, Homo sapiens
cagauuuaaaaaaagaac

SEQ ID NO: 729365 - RNA, 15 nt, Homo sapiens
cagauuuaagccuua

SEQ ID NO: 729366 - RNA, 12 nt, Homo sapiens
cagauuuccauc

SEQ ID NO: 729367 - RNA, 23 nt, Homo sapiens
cagauuuuaagggggaaaacugu

SEQ ID NO: 729368 - RNA, 20 nt, Homo sapiens
cagauuuuaccuauccacaa

SEQ ID NO: 729369 - RNA, 18 nt, Homo sapiens
cagauuuuuuccucugca

SEQ ID NO: 729370 - RNA, 22 nt, Homo sapiens
cagcaaaaaucucccagugaca

SEQ ID NO: 729371 - RNA, 18 nt, Homo sapiens
cagcaaaacuccaucuca

SEQ ID NO: 729372 - RNA, 22 nt, Homo sapiens
cagcaaauaacagucugagacu

SEQ ID NO: 729373 - RNA, 13 nt, Homo sapiens
cagcaacaaugac

SEQ ID NO: 729374 - RNA, 19 nt, Homo sapiens
cagcaacuucuucuccauc

SEQ ID NO: 729375 - RNA, 20 nt, Homo sapiens
cagcaagcccuacagagcug

SEQ ID NO: 729376 - RNA, 23 nt, Homo sapiens
cagcaaguacgcaagaaauugga

SEQ ID NO: 729377 - RNA, 17 nt, Homo sapiens
cagcaaugccauuucag

SEQ ID NO: 729378 - RNA, 21 nt, Homo sapiens
cagcaauggugucaguaucca

SEQ ID NO: 729379 - RNA, 19 nt, Homo sapiens
cagcacacgaguuccagac

SEQ ID NO: 729380 - RNA, 21 nt, Homo sapiens
cagcacacgaguuccagaccc

SEQ ID NO: 729381 - RNA, 12 nt, Homo sapiens
cagcaccacagu

SEQ ID NO: 729382 - RNA, 17 nt, Homo sapiens
cagcaccggccucggga

SEQ ID NO: 729383 - RNA, 17 nt, Homo sapiens
cagcaccugauucucac

SEQ ID NO: 729384 - RNA, 22 nt, Homo sapiens
cagcaccugauucucacagcaa

SEQ ID NO: 729385 - RNA, 20 nt, Homo sapiens
cagcacgaguggccaguuca

SEQ ID NO: 729386 - RNA, 18 nt, Homo sapiens
cagcacuaguaaaggagg

SEQ ID NO: 729387 - RNA, 21 nt, Homo sapiens
cagcacuccccagagcugugc

SEQ ID NO: 729388 - RNA, 15 nt, Homo sapiens
cagcacucuuaucua

SEQ ID NO: 729389 - RNA, 11 nt, Homo sapiens
cagcacugagg

SEQ ID NO: 729390 - RNA, 17 nt, Homo sapiens
cagcacuggugaacuga

SEQ ID NO: 729391 - RNA, 12 nt, Homo sapiens
cagcacugugag

SEQ ID NO: 729392 - RNA, 18 nt, Homo sapiens
cagcagaucccagcucac

SEQ ID NO: 729393 - RNA, 22 nt, Homo sapiens
cagcagaucccagcucacguca

SEQ ID NO: 729394 - RNA, 16 nt, Homo sapiens
cagcagcacaccucag

SEQ ID NO: 729395 - RNA, 17 nt, Homo sapiens
cagcagccagcucucag

SEQ ID NO: 729396 - RNA, 20 nt, Homo sapiens
cagcagccagcucucagcca

SEQ ID NO: 729397 - RNA, 16 nt, Homo sapiens
cagcagccagucucag

SEQ ID NO: 729398 - RNA, 16 nt, Homo sapiens
cagcagcccuaaggau

SEQ ID NO: 729399 - RNA, 17 nt, Homo sapiens
cagcagcucauagaauu

SEQ ID NO: 729400 - RNA, 22 nt, Homo sapiens
cagcagcuucaccagagcauuu

SEQ ID NO: 729401 - RNA, 19 nt, Homo sapiens
cagcaggcucaggcacaua

SEQ ID NO: 729402 - RNA, 19 nt, Homo sapiens
cagcaguccacaaagcauu

SEQ ID NO: 729403 - RNA, 18 nt, Homo sapiens
cagcagugaguaaucaau

SEQ ID NO: 729404 - RNA, 15 nt, Homo sapiens
cagcagugaucucag

SEQ ID NO: 729405 - RNA, 22 nt, Homo sapiens
cagcauaccaauuacccauaaa

SEQ ID NO: 729406 - RNA, 14 nt, Homo sapiens
cagcauacuucaaa

SEQ ID NO: 729407 - RNA, 20 nt, Homo sapiens
cagcauagggucacuuugcc

SEQ ID NO: 729408 - RNA, 15 nt, Homo sapiens
cagcaucaccugccu

SEQ ID NO: 729409 - RNA, 23 nt, Homo sapiens
cagcaucucccucacugaaacca

SEQ ID NO: 729410 - RNA, 13 nt, Homo sapiens
cagcaucuuucac

SEQ ID NO: 729411 - RNA, 21 nt, Homo sapiens
cagcauggguccuugaugcca

SEQ ID NO: 729412 - RNA, 15 nt, Homo sapiens
cagcauugcugguuc

SEQ ID NO: 729413 - RNA, 22 nt, Homo sapiens
cagcauuuacuaugcacaacag

SEQ ID NO: 729414 - RNA, 23 nt, Homo sapiens
cagcauuuagugaaguugugcaa

SEQ ID NO: 729415 - RNA, 13 nt, Homo sapiens
cagcauuuuugca

SEQ ID NO: 729416 - RNA, 18 nt, Homo sapiens
cagccaaacugucuuugu

SEQ ID NO: 729417 - RNA, 16 nt, Homo sapiens
cagccaaaugcaggga

SEQ ID NO: 729418 - RNA, 17 nt, Homo sapiens
cagccaaaugcagggag

SEQ ID NO: 729419 - RNA, 20 nt, Homo sapiens
cagccaagagggcugcaaaa

SEQ ID NO: 729420 - RNA, 19 nt, Homo sapiens
cagccacacccaggcacuu

SEQ ID NO: 729421 - RNA, 13 nt, Homo sapiens
cagccaccaucug

SEQ ID NO: 729422 - RNA, 14 nt, Homo sapiens
cagccacccaagcc

SEQ ID NO: 729423 - RNA, 15 nt, Homo sapiens
cagccacccugaguu

SEQ ID NO: 729424 - RNA, 19 nt, Homo sapiens
cagccacggggacucagcc

SEQ ID NO: 729425 - RNA, 17 nt, Homo sapiens
cagccacgucagcuuuu

SEQ ID NO: 729426 - RNA, 16 nt, Homo sapiens
cagccacuuucugcca

SEQ ID NO: 729427 - RNA, 15 nt, Homo sapiens
cagccagagcugugc

SEQ ID NO: 729428 - RNA, 16 nt, Homo sapiens
cagccaggaccaccuc

SEQ ID NO: 729429 - RNA, 14 nt, Homo sapiens
cagccaggcugcca

SEQ ID NO: 729430 - RNA, 13 nt, Homo sapiens
cagccaggugcau

SEQ ID NO: 729431 - RNA, 17 nt, Homo sapiens
cagccagguuagccuuu

SEQ ID NO: 729432 - RNA, 18 nt, Homo sapiens
cagccagguuagccuuug

SEQ ID NO: 729433 - RNA, 20 nt, Homo sapiens
cagccauaagaaagcacuau

SEQ ID NO: 729434 - RNA, 19 nt, Homo sapiens
cagccaucaaauagugaau

SEQ ID NO: 729435 - RNA, 17 nt, Homo sapiens
cagccaugcaaugccaa

SEQ ID NO: 729436 - RNA, 18 nt, Homo sapiens
cagccauuaccauggaga

SEQ ID NO: 729437 - RNA, 15 nt, Homo sapiens
cagcccacacccagc

SEQ ID NO: 729438 - RNA, 21 nt, Homo sapiens
cagcccagccccuccaaaggu

SEQ ID NO: 729439 - RNA, 22 nt, Homo sapiens
caggcucggaggacccuggaaa

SEQ ID NO: 729440 - RNA, 18 nt, Homo sapiens
caggcucucgcacaccuc

SEQ ID NO: 729441 - RNA, 20 nt, Homo sapiens
caggcucuugacuacuugga

SEQ ID NO: 729442 - RNA, 22 nt, Homo sapiens
caggcugccucggacuccaugg

SEQ ID NO: 729443 - RNA, 17 nt, Homo sapiens
caggcuggagacuggac

SEQ ID NO: 729444 - RNA, 20 nt, Homo sapiens
caggcuggaguacaguggca

SEQ ID NO: 729445 - RNA, 16 nt, Homo sapiens
caggcuggagugcagu

SEQ ID NO: 729446 - RNA, 18 nt, Homo sapiens
caggcuggagugcagugg

SEQ ID NO: 729447 - RNA, 17 nt, Homo sapiens
caggcugggccaugucc

SEQ ID NO: 729448 - RNA, 20 nt, Homo sapiens
caggcugggccauguccaaa

SEQ ID NO: 729449 - RNA, 18 nt, Homo sapiens
caggcuggucuugaacuc

SEQ ID NO: 729450 - RNA, 17 nt, Homo sapiens
caggcuucggacagugc

SEQ ID NO: 729451 - RNA, 13 nt, Homo sapiens
caggcuuuguaca

SEQ ID NO: 729452 - RNA, 13 nt, Homo sapiens
cagggaaaacugc

SEQ ID NO: 729453 - RNA, 14 nt, Homo sapiens
cagggaaauaugaa

SEQ ID NO: 729454 - RNA, 13 nt, Homo sapiens
cagggaagccaaa

SEQ ID NO: 729455 - RNA, 19 nt, Homo sapiens
cagggaagcugucccucac

SEQ ID NO: 729456 - RNA, 14 nt, Homo sapiens
cagggaagggagca

SEQ ID NO: 729457 - RNA, 14 nt, Homo sapiens
cagggaagguaauu

SEQ ID NO: 729458 - RNA, 23 nt, Homo sapiens
cagggaaguggggaaguguucca

SEQ ID NO: 729459 - RNA, 18 nt, Homo sapiens
cagggaaugaugacaaca

SEQ ID NO: 729460 - RNA, 13 nt, Homo sapiens
cagggaauuucag

SEQ ID NO: 729461 - RNA, 21 nt, Homo sapiens
cagggacaaaacacugugucc

SEQ ID NO: 729462 - RNA, 15 nt, Homo sapiens
cagggacccacuuca

SEQ ID NO: 729463 - RNA, 17 nt, Homo sapiens
cagggaccguccagggg

SEQ ID NO: 729464 - RNA, 24 nt, Homo sapiens
cagggagaaguagcuaguagcaau

SEQ ID NO: 729465 - RNA, 22 nt, Homo sapiens
cagggagaauugaaacugagua

SEQ ID NO: 729466 - RNA, 15 nt, Homo sapiens
cagggagacugcauc

SEQ ID NO: 729467 - RNA, 18 nt, Homo sapiens
cagggagacugcaucuca

SEQ ID NO: 729468 - RNA, 19 nt, Homo sapiens
cagggagaggucaccagcu

SEQ ID NO: 729469 - RNA, 19 nt, Homo sapiens
cagggagauaaacaccacc

SEQ ID NO: 729470 - RNA, 12 nt, Homo sapiens
cagggagcauuu

SEQ ID NO: 729471 - RNA, 17 nt, Homo sapiens
cagggaggcaacacugc

SEQ ID NO: 729472 - RNA, 15 nt, Homo sapiens
cagggagggcugugg

SEQ ID NO: 729473 - RNA, 19 nt, Homo sapiens
cagggagguggcuggguuu

SEQ ID NO: 729474 - RNA, 17 nt, Homo sapiens
cagggauacccagugau

SEQ ID NO: 729475 - RNA, 17 nt, Homo sapiens
cagggaugacagauuug

SEQ ID NO: 729476 - RNA, 20 nt, Homo sapiens
cagggaugauucccacccaa

SEQ ID NO: 729477 - RNA, 13 nt, Homo sapiens
cagggauggagau

SEQ ID NO: 729478 - RNA, 18 nt, Homo sapiens
cagggauucuuccugcuu

SEQ ID NO: 729479 - RNA, 23 nt, Homo sapiens
cagggcaaaugacaugcacugac

SEQ ID NO: 729480 - RNA, 15 nt, Homo sapiens
cagggcacuacauaa

SEQ ID NO: 729481 - RNA, 14 nt, Homo sapiens
cagggcacugugcc

SEQ ID NO: 729482 - RNA, 14 nt, Homo sapiens
cagggcauuuuaca

SEQ ID NO: 729483 - RNA, 15 nt, Homo sapiens
cagggccacauagau

SEQ ID NO: 729484 - RNA, 22 nt, Homo sapiens
cagggccacucccggcacucca

SEQ ID NO: 729485 - RNA, 21 nt, Homo sapiens
cagggccagcuuuuccucacc

SEQ ID NO: 729486 - RNA, 19 nt, Homo sapiens
cagggcccagagcccagcu

SEQ ID NO: 729487 - RNA, 16 nt, Homo sapiens
cagggccccccaacug

SEQ ID NO: 729488 - RNA, 16 nt, Homo sapiens
cagggccugagcagcu

SEQ ID NO: 729489 - RNA, 13 nt, Homo sapiens
cagggcgugggac

SEQ ID NO: 729490 - RNA, 22 nt, Homo sapiens
cagggcucagccuggugggccu

SEQ ID NO: 729491 - RNA, 16 nt, Homo sapiens
cagggcuccugcacuu

SEQ ID NO: 729492 - RNA, 18 nt, Homo sapiens
cagggcucugcaggccac

SEQ ID NO: 729493 - RNA, 15 nt, Homo sapiens
cagggcugugcuuga

SEQ ID NO: 729494 - RNA, 15 nt, Homo sapiens
cagggcuuaccugua

SEQ ID NO: 729495 - RNA, 18 nt, Homo sapiens
cagggcuuaccuguacac

SEQ ID NO: 729496 - RNA, 17 nt, Homo sapiens
caggggaucacacgagc

SEQ ID NO: 729497 - RNA, 15 nt, Homo sapiens
caggggcagccacac

SEQ ID NO: 729498 - RNA, 13 nt, Homo sapiens
caggggcccucac

SEQ ID NO: 729499 - RNA, 19 nt, Homo sapiens
caggggcuuaucucuucaa

SEQ ID NO: 729500 - RNA, 14 nt, Homo sapiens
cagggggaaggugg

SEQ ID NO: 729501 - RNA, 22 nt, Homo sapiens
cagggggagcucccaagcugcc

SEQ ID NO: 729502 - RNA, 16 nt, Homo sapiens
cagggguacauucuag

SEQ ID NO: 729503 - RNA, 23 nt, Homo sapiens
cagggguggggguggaggcuucc

SEQ ID NO: 729504 - RNA, 17 nt, Homo sapiens
cagggguuaagagcuca

SEQ ID NO: 729505 - RNA, 18 nt, Homo sapiens
cagggguuaagagcucag

SEQ ID NO: 729506 - RNA, 21 nt, Homo sapiens
cagggguuggucaaggccacc

SEQ ID NO: 729507 - RNA, 22 nt, Homo sapiens
caggguccacgccucugcugua

SEQ ID NO: 729508 - RNA, 23 nt, Homo sapiens
cagggucugcucuuucucugcca

SEQ ID NO: 729509 - RNA, 17 nt, Homo sapiens
caggguggaugaucuca

SEQ ID NO: 729510 - RNA, 22 nt, Homo sapiens
caggguggggggugacagugcc

SEQ ID NO: 729511 - RNA, 18 nt, Homo sapiens
caggguguguacugcaca

SEQ ID NO: 729512 - RNA, 22 nt, Homo sapiens
caggguguguacugcacaagga

SEQ ID NO: 729513 - RNA, 15 nt, Homo sapiens
caggguucucuuagc

SEQ ID NO: 729514 - RNA, 21 nt, Homo sapiens
caggguugugcuuucuagcaa

SEQ ID NO: 729515 - RNA, 19 nt, Homo sapiens
caggguuucugcacugguc

SEQ ID NO: 729516 - RNA, 16 nt, Homo sapiens
cagguaaaacagggcc

SEQ ID NO: 729517 - RNA, 22 nt, Homo sapiens
cagguaacaugauuguuugaca

SEQ ID NO: 729518 - RNA, 14 nt, Homo sapiens
cagguaaugugaau

SEQ ID NO: 729519 - RNA, 20 nt, Homo sapiens
cagguauuacacaagccaaa

SEQ ID NO: 729520 - RNA, 21 nt, Homo sapiens
caggucauauuaauauauuuc

SEQ ID NO: 729521 - RNA, 22 nt, Homo sapiens
cagguccucuacuuaaugagau

SEQ ID NO: 729522 - RNA, 17 nt, Homo sapiens
cagguccucuguugcaa

SEQ ID NO: 729523 - RNA, 14 nt, Homo sapiens
cagguccugcggaa

SEQ ID NO: 729524 - RNA, 21 nt, Homo sapiens
caggucucuccacugcucuca

SEQ ID NO: 729525 - RNA, 19 nt, Homo sapiens
caggugaaaauccaucuca

SEQ ID NO: 729526 - RNA, 16 nt, Homo sapiens
caggugagaaaaccau

SEQ ID NO: 729527 - RNA, 16 nt, Homo sapiens
caggugauccacccac

SEQ ID NO: 729528 - RNA, 14 nt, Homo sapiens
caggugaugccauu

SEQ ID NO: 729529 - RNA, 21 nt, Homo sapiens
caggugauucgcccaccucag

SEQ ID NO: 729530 - RNA, 15 nt, Homo sapiens
caggugcaaguucau

SEQ ID NO: 729531 - RNA, 18 nt, Homo sapiens
caggugcaaucuacugga

SEQ ID NO: 729532 - RNA, 11 nt, Homo sapiens
caggugcagag

SEQ ID NO: 729533 - RNA, 19 nt, Homo sapiens
caggugccaguuauggcua

SEQ ID NO: 729534 - RNA, 16 nt, Homo sapiens
caggugccuucccaga

SEQ ID NO: 729535 - RNA, 11 nt, Homo sapiens
caggugcugcc

SEQ ID NO: 729536 - RNA, 19 nt, Homo sapiens
caggugggugaaaccuccu

SEQ ID NO: 729537 - RNA, 18 nt, Homo sapiens
cagguggugggacacugg

SEQ ID NO: 729538 - RNA, 21 nt, Homo sapiens
caggugugugccaccacaccc

SEQ ID NO: 729539 - RNA, 21 nt, Homo sapiens
cagguguucuucauuaccuca

SEQ ID NO: 729540 - RNA, 20 nt, Homo sapiens
cagguguugccauuucucug

SEQ ID NO: 729541 - RNA, 18 nt, Homo sapiens
cagguguugggaccugcu

SEQ ID NO: 729542 - RNA, 13 nt, Homo sapiens
cagguuagccuuu

SEQ ID NO: 729543 - RNA, 23 nt, Homo sapiens
cagguuccauccaccaccuugcc

SEQ ID NO: 729544 - RNA, 19 nt, Homo sapiens
cagguucucaccucagggg

SEQ ID NO: 729545 - RNA, 21 nt, Homo sapiens
cagguugccucucacaaugaa

SEQ ID NO: 729546 - RNA, 16 nt, Homo sapiens
cagguuugaugccugu

SEQ ID NO: 729547 - RNA, 19 nt, Homo sapiens
cagguuuguuuucagcacu

SEQ ID NO: 729548 - RNA, 18 nt, Homo sapiens
caguaaaaacuguucucu

SEQ ID NO: 729549 - RNA, 20 nt, Homo sapiens
caguaaaaggacagagauua

SEQ ID NO: 729550 - RNA, 20 nt, Homo sapiens
caguaaaauacuauucucau

SEQ ID NO: 729551 - RNA, 19 nt, Homo sapiens
caguaaaauacuauugccu

SEQ ID NO: 729552 - RNA, 22 nt, Homo sapiens
caguaaauaacaggcauuuguu

SEQ ID NO: 729553 - RNA, 18 nt, Homo sapiens
ccuuagcaaggggcucag

SEQ ID NO: 729554 - RNA, 22 nt, Homo sapiens
ccuuagcuggcauuacagcugg

SEQ ID NO: 729555 - RNA, 19 nt, Homo sapiens
ccuuaucuuucuaaaacug

SEQ ID NO: 729556 - RNA, 16 nt, Homo sapiens
ccuuaugaccagugag

SEQ ID NO: 729557 - RNA, 21 nt, Homo sapiens
ccuuauguagguugccagcua

SEQ ID NO: 729558 - RNA, 18 nt, Homo sapiens
ccuuauuaaggccccaga

SEQ ID NO: 729559 - RNA, 14 nt, Homo sapiens
ccuuauuguaccuc

SEQ ID NO: 729560 - RNA, 15 nt, Homo sapiens
ccuuauuugucugua

SEQ ID NO: 729561 - RNA, 19 nt, Homo sapiens
ccuucaaaacacucaucuc

SEQ ID NO: 729562 - RNA, 23 nt, Homo sapiens
ccuucaaaauguucuauuuaaca

SEQ ID NO: 729563 - RNA, 19 nt, Homo sapiens
ccuucaaaggccaagagaa

SEQ ID NO: 729564 - RNA, 20 nt, Homo sapiens
ccuucaaguuagcucaggag

SEQ ID NO: 729565 - RNA, 15 nt, Homo sapiens
ccuucaauggaagga

SEQ ID NO: 729566 - RNA, 17 nt, Homo sapiens
ccuucaccagagcccau

SEQ ID NO: 729567 - RNA, 15 nt, Homo sapiens
ccuucagaugugucu

SEQ ID NO: 729568 - RNA, 14 nt, Homo sapiens
ccuucagauuugcc

SEQ ID NO: 729569 - RNA, 16 nt, Homo sapiens
ccuucagcuccaggga

SEQ ID NO: 729570 - RNA, 19 nt, Homo sapiens
ccuucaggcagccagugug

SEQ ID NO: 729571 - RNA, 11 nt, Homo sapiens
ccuucagucuu

SEQ ID NO: 729572 - RNA, 19 nt, Homo sapiens
ccuucagucuucuucacuu

SEQ ID NO: 729573 - RNA, 20 nt, Homo sapiens
ccuucagugcuacauuuugu

SEQ ID NO: 729574 - RNA, 13 nt, Homo sapiens
ccuucaucaagaa

SEQ ID NO: 729575 - RNA, 21 nt, Homo sapiens
ccuucaucuuccuguguccug

SEQ ID NO: 729576 - RNA, 15 nt, Homo sapiens
ccuuccacucuggaa

SEQ ID NO: 729577 - RNA, 14 nt, Homo sapiens
ccuuccagcugcug

SEQ ID NO: 729578 - RNA, 21 nt, Homo sapiens
ccuuccauagccuaaucccug

SEQ ID NO: 729579 - RNA, 20 nt, Homo sapiens
ccuuccccacuucugugcca

SEQ ID NO: 729580 - RNA, 23 nt, Homo sapiens
ccuucccuagcuuuagacccugg

SEQ ID NO: 729581 - RNA, 23 nt, Homo sapiens
ccuucccucuccugcuuccucuu

SEQ ID NO: 729582 - RNA, 17 nt, Homo sapiens
ccuuccuaauaugcuuu

SEQ ID NO: 729583 - RNA, 16 nt, Homo sapiens
ccuuccucucaggcuc

SEQ ID NO: 729584 - RNA, 22 nt, Homo sapiens
ccuuccucucucucuuccucuu

SEQ ID NO: 729585 - RNA, 14 nt, Homo sapiens
ccuuccuggccuga

SEQ ID NO: 729586 - RNA, 14 nt, Homo sapiens
ccuuccugucuucc

SEQ ID NO: 729587 - RNA, 18 nt, Homo sapiens
ccuuccuguguccaugug

SEQ ID NO: 729588 - RNA, 15 nt, Homo sapiens
ccuucgaaaggccuu

SEQ ID NO: 729589 - RNA, 17 nt, Homo sapiens
ccuucgcuucuugccuc

SEQ ID NO: 729590 - RNA, 21 nt, Homo sapiens
ccuucgggcugugcccgggga

SEQ ID NO: 729591 - RNA, 15 nt, Homo sapiens
ccuucuacauuugag

SEQ ID NO: 729592 - RNA, 22 nt, Homo sapiens
ccuucuaggucacuucucacaa

SEQ ID NO: 729593 - RNA, 12 nt, Homo sapiens
ccuucuccaaau

SEQ ID NO: 729594 - RNA, 20 nt, Homo sapiens
ccuucuccccugcacuguaa

SEQ ID NO: 729595 - RNA, 17 nt, Homo sapiens
ccuucucccuugcccuc

SEQ ID NO: 729596 - RNA, 14 nt, Homo sapiens
ccuucucggagcug

SEQ ID NO: 729597 - RNA, 19 nt, Homo sapiens
ccuucucuacacucuugua

SEQ ID NO: 729598 - RNA, 17 nt, Homo sapiens
ccuucucuuaguuauug

SEQ ID NO: 729599 - RNA, 19 nt, Homo sapiens
ccuucugacugagcaauau

SEQ ID NO: 729600 - RNA, 14 nt, Homo sapiens
ccuucuuuaaacac

SEQ ID NO: 729601 - RNA, 18 nt, Homo sapiens
ccuucuuucacaggcauc

SEQ ID NO: 729602 - RNA, 15 nt, Homo sapiens
ccuucuuugucuugc

SEQ ID NO: 729603 - RNA, 22 nt, Homo sapiens
ccuucuuuugaaggacuccuua

SEQ ID NO: 729604 - RNA, 17 nt, Homo sapiens
ccuugaccagcagaucc

SEQ ID NO: 729605 - RNA, 13 nt, Homo sapiens
ccuugaggggcua

SEQ ID NO: 729606 - RNA, 14 nt, Homo sapiens
ccuugaguaaaaag

SEQ ID NO: 729607 - RNA, 22 nt, Homo sapiens
ccuugauauaaaaaaucuuuag

SEQ ID NO: 729608 - RNA, 22 nt, Homo sapiens
ccuugcaagcuaauucuuugac

SEQ ID NO: 729609 - RNA, 13 nt, Homo sapiens
ccuugcaauguuc

SEQ ID NO: 729610 - RNA, 13 nt, Homo sapiens
ccuugcacacucc

SEQ ID NO: 729611 - RNA, 16 nt, Homo sapiens
ccuugcacagcacuga

SEQ ID NO: 729612 - RNA, 13 nt, Homo sapiens
ccuugcagauauc

SEQ ID NO: 729613 - RNA, 20 nt, Homo sapiens
ccuugcagauaucugcaugu

SEQ ID NO: 729614 - RNA, 15 nt, Homo sapiens
ccuugccagacaugu

SEQ ID NO: 729615 - RNA, 13 nt, Homo sapiens
ccuugcccagaga

SEQ ID NO: 729616 - RNA, 14 nt, Homo sapiens
ccuugcccagagau

SEQ ID NO: 729617 - RNA, 15 nt, Homo sapiens
ccuugccuccucacc

SEQ ID NO: 729618 - RNA, 17 nt, Homo sapiens
ccuugcuaaaagauuau

SEQ ID NO: 729619 - RNA, 13 nt, Homo sapiens
ccuugcugggacu

SEQ ID NO: 729620 - RNA, 16 nt, Homo sapiens
ccuugcuuaccucuca

SEQ ID NO: 729621 - RNA, 17 nt, Homo sapiens
ccuuggacugagaaauu

SEQ ID NO: 729622 - RNA, 20 nt, Homo sapiens
ccuuggcaugccuuccagca

SEQ ID NO: 729623 - RNA, 18 nt, Homo sapiens
ccuuggccuugcagcugg

SEQ ID NO: 729624 - RNA, 14 nt, Homo sapiens
ccuuggcuugccau

SEQ ID NO: 729625 - RNA, 15 nt, Homo sapiens
ccuuggcuuguuauu

SEQ ID NO: 729626 - RNA, 19 nt, Homo sapiens
ccuuggcuuuaugcaaaua

SEQ ID NO: 729627 - RNA, 14 nt, Homo sapiens
ccuugggccaagau

SEQ ID NO: 729628 - RNA, 20 nt, Homo sapiens
ccuugggcuauuuggacuca

SEQ ID NO: 729629 - RNA, 16 nt, Homo sapiens
ccuugggggaagacuu

SEQ ID NO: 729630 - RNA, 17 nt, Homo sapiens
ccuuggucuuccauggg

SEQ ID NO: 729631 - RNA, 17 nt, Homo sapiens
ccuuggugaaauucacc

SEQ ID NO: 729632 - RNA, 17 nt, Homo sapiens
ccuuguaaaugcucuaa

SEQ ID NO: 729633 - RNA, 23 nt, Homo sapiens
ccuuguaucuauuuguggugaau

SEQ ID NO: 729634 - RNA, 17 nt, Homo sapiens
ccuuguccugccagcug

SEQ ID NO: 729635 - RNA, 21 nt, Homo sapiens
ccuugugguugaaaaccacag

SEQ ID NO: 729636 - RNA, 21 nt, Homo sapiens
ccuuguguacaguuauuuaug

SEQ ID NO: 729637 - RNA, 17 nt, Homo sapiens
ccuuguuccaauuugac

SEQ ID NO: 729638 - RNA, 17 nt, Homo sapiens
ccuuuaaaucugugaug

SEQ ID NO: 729639 - RNA, 18 nt, Homo sapiens
ccuuuagagccagcccau

SEQ ID NO: 729640 - RNA, 17 nt, Homo sapiens
ccuuuaguaccugaaaa

SEQ ID NO: 729641 - RNA, 16 nt, Homo sapiens
ccuuuauaagguuguc

SEQ ID NO: 729642 - RNA, 15 nt, Homo sapiens
ccuuuauauuugcuc

SEQ ID NO: 729643 - RNA, 21 nt, Homo sapiens
ccuuuaucaccucauucugaa

SEQ ID NO: 729644 - RNA, 22 nt, Homo sapiens
ccuuucaaauuuuuacugagaa

SEQ ID NO: 729645 - RNA, 12 nt, Homo sapiens
ccuuucacuuac

SEQ ID NO: 729646 - RNA, 19 nt, Homo sapiens
ccuuucaguauguccccau

SEQ ID NO: 729647 - RNA, 17 nt, Homo sapiens
ccuuucaucacacuggg

SEQ ID NO: 729648 - RNA, 11 nt, Homo sapiens
ccuuuccauaa

SEQ ID NO: 729649 - RNA, 21 nt, Homo sapiens
ccuuucguucugcugaccaaa

SEQ ID NO: 729650 - RNA, 13 nt, Homo sapiens
ccuuucuccugau

SEQ ID NO: 729651 - RNA, 21 nt, Homo sapiens
ccuuucucuccagccugacuu

SEQ ID NO: 729652 - RNA, 21 nt, Homo sapiens
ccuuucugaggacaccaguga

SEQ ID NO: 729653 - RNA, 24 nt, Homo sapiens
ccuuucuuugcaacuucccagcaa

SEQ ID NO: 729654 - RNA, 14 nt, Homo sapiens
ccuuucuuugccuc

SEQ ID NO: 729655 - RNA, 17 nt, Homo sapiens
ccuuugauucuccagua

SEQ ID NO: 729656 - RNA, 17 nt, Homo sapiens
ccuuugccacacugugg

SEQ ID NO: 729657 - RNA, 22 nt, Homo sapiens
ccuuugcucccuguugcugaaa

SEQ ID NO: 729658 - RNA, 18 nt, Homo sapiens
ccuuugcucucuggccac

SEQ ID NO: 729659 - RNA, 17 nt, Homo sapiens
ccuuugcucuugccaaa

SEQ ID NO: 729660 - RNA, 13 nt, Homo sapiens
ccuuugcuucaaa

SEQ ID NO: 729661 - RNA, 16 nt, Homo sapiens
ccuuugggcccagcgg

SEQ ID NO: 729662 - RNA, 16 nt, Homo sapiens
ccuuuggggacuuuuc

SEQ ID NO: 729663 - RNA, 14 nt, Homo sapiens
ccuuugucccagaa

SEQ ID NO: 729664 - RNA, 23 nt, Homo sapiens
ccuuugucgcugggucagugcug

SEQ ID NO: 729665 - RNA, 13 nt, Homo sapiens
ccuuuguugcaca

SEQ ID NO: 729666 - RNA, 16 nt, Homo sapiens
ccuuuguugcacaaau

SEQ ID NO: 729667 - RNA, 15 nt, Homo sapiens
ccuuuuaacucaccu

SEQ ID NO: 729668 - RNA, 17 nt, Homo sapiens
cuaagguucagccugaa

SEQ ID NO: 729669 - RNA, 18 nt, Homo sapiens
cuaaguauauuaauauca

SEQ ID NO: 729670 - RNA, 19 nt, Homo sapiens
cuaagucaaacacuuguga

SEQ ID NO: 729671 - RNA, 13 nt, Homo sapiens
cuaagugcuuauu

SEQ ID NO: 729672 - RNA, 20 nt, Homo sapiens
cuaagugggagaaggacuau

SEQ ID NO: 729673 - RNA, 16 nt, Homo sapiens
cuaaguuggugcuuuu

SEQ ID NO: 729674 - RNA, 19 nt, Homo sapiens
cuaauaaauauacuaugaa

SEQ ID NO: 729675 - RNA, 20 nt, Homo sapiens
cuaauaaauauacuaugaaa

SEQ ID NO: 729676 - RNA, 23 nt, Homo sapiens
cuaauaaauuuuagugugccuuc

SEQ ID NO: 729677 - RNA, 15 nt, Homo sapiens
cuaauaagugcuuuc

SEQ ID NO: 729678 - RNA, 14 nt, Homo sapiens
cuaauaaugcugaa

SEQ ID NO: 729679 - RNA, 19 nt, Homo sapiens
cuaauacagcaacaauuua

SEQ ID NO: 729680 - RNA, 22 nt, Homo sapiens
cuaauagagugguacagcacug

SEQ ID NO: 729681 - RNA, 14 nt, Homo sapiens
cuaauaucacuuaa

SEQ ID NO: 729682 - RNA, 20 nt, Homo sapiens
cuaauaucacuuaaaucgag

SEQ ID NO: 729683 - RNA, 13 nt, Homo sapiens
cuaaucacaucca

SEQ ID NO: 729684 - RNA, 20 nt, Homo sapiens
cuaaucaccauguaagcacu

SEQ ID NO: 729685 - RNA, 16 nt, Homo sapiens
cuaaucagcauucuca

SEQ ID NO: 729686 - RNA, 16 nt, Homo sapiens
cuaaucgaaugaacaa

SEQ ID NO: 729687 - RNA, 22 nt, Homo sapiens
cuaaucucauaccucugaccaa

SEQ ID NO: 729688 - RNA, 20 nt, Homo sapiens
cuaaucuugaauguuuguga

SEQ ID NO: 729689 - RNA, 22 nt, Homo sapiens
cuaaugauuuagugaucaaauu

SEQ ID NO: 729690 - RNA, 18 nt, Homo sapiens
cuaaugccuaucugacca

SEQ ID NO: 729691 - RNA, 13 nt, Homo sapiens
cuaaugccucuuc

SEQ ID NO: 729692 - RNA, 16 nt, Homo sapiens
cuaaugcucaccuuua

SEQ ID NO: 729693 - RNA, 13 nt, Homo sapiens
cuaaugggcuaaa

SEQ ID NO: 729694 - RNA, 16 nt, Homo sapiens
cuaaugucugcagcuc

SEQ ID NO: 729695 - RNA, 22 nt, Homo sapiens
cuaaugugcagggauauugccu

SEQ ID NO: 729696 - RNA, 13 nt, Homo sapiens
cuaaugugucauc

SEQ ID NO: 729697 - RNA, 13 nt, Homo sapiens
cuaauuaggcaag

SEQ ID NO: 729698 - RNA, 17 nt, Homo sapiens
cuaauucacagugcucu

SEQ ID NO: 729699 - RNA, 20 nt, Homo sapiens
cuaauucuuguagaugcauu

SEQ ID NO: 729700 - RNA, 17 nt, Homo sapiens
cuaauugagaccacagg

SEQ ID NO: 729701 - RNA, 19 nt, Homo sapiens
cuaauuguccauucuugcu

SEQ ID NO: 729702 - RNA, 23 nt, Homo sapiens
cuaauugucuuuguucugugauu

SEQ ID NO: 729703 - RNA, 12 nt, Homo sapiens
cuaauuguggau

SEQ ID NO: 729704 - RNA, 18 nt, Homo sapiens
cuaauuuaaguacuugag

SEQ ID NO: 729705 - RNA, 18 nt, Homo sapiens
cuaauuuauaacuauuau

SEQ ID NO: 729706 - RNA, 18 nt, Homo sapiens
cuaauuugauguuuacag

SEQ ID NO: 729707 - RNA, 20 nt, Homo sapiens
cuaauuuuaguauucauucu

SEQ ID NO: 729708 - RNA, 22 nt, Homo sapiens
cuaauuuuuggagaaaugucau

SEQ ID NO: 729709 - RNA, 17 nt, Homo sapiens
cuacaaaaaaccaggau

SEQ ID NO: 729710 - RNA, 15 nt, Homo sapiens
cuacaaaaaugaagc

SEQ ID NO: 729711 - RNA, 23 nt, Homo sapiens
cuacaaacucccacuugucaugu

SEQ ID NO: 729712 - RNA, 18 nt, Homo sapiens
cuacaaaggaaauaucaa

SEQ ID NO: 729713 - RNA, 14 nt, Homo sapiens
cuacaaaggccaug

SEQ ID NO: 729714 - RNA, 21 nt, Homo sapiens
cuacaaauuuaugcauuucau

SEQ ID NO: 729715 - RNA, 21 nt, Homo sapiens
cuacaacaaauacuacaggcc

SEQ ID NO: 729716 - RNA, 14 nt, Homo sapiens
cuacaagauuuaga

SEQ ID NO: 729717 - RNA, 21 nt, Homo sapiens
cuacaauauuaacauaagaaa

SEQ ID NO: 729718 - RNA, 19 nt, Homo sapiens
cuacaaucagcuagggacu

SEQ ID NO: 729719 - RNA, 12 nt, Homo sapiens
cuacacacaaac

SEQ ID NO: 729720 - RNA, 22 nt, Homo sapiens
cuacaccaaugaaaacauguac

SEQ ID NO: 729721 - RNA, 19 nt, Homo sapiens
cuacacucaccugcacuaa

SEQ ID NO: 729722 - RNA, 13 nt, Homo sapiens
cuacacugugaag

SEQ ID NO: 729723 - RNA, 22 nt, Homo sapiens
cuacagagucuggugaagcuca

SEQ ID NO: 729724 - RNA, 21 nt, Homo sapiens
cuacagaugugggccaccaug

SEQ ID NO: 729725 - RNA, 14 nt, Homo sapiens
cuacagcagcacug

SEQ ID NO: 729726 - RNA, 20 nt, Homo sapiens
cuacagcauccuggacaaca

SEQ ID NO: 729727 - RNA, 18 nt, Homo sapiens
cuacagcgagcugcauua

SEQ ID NO: 729728 - RNA, 19 nt, Homo sapiens
cuacagcuacauugagaua

SEQ ID NO: 729729 - RNA, 20 nt, Homo sapiens
cuacaggaagcaccccaugc

SEQ ID NO: 729730 - RNA, 17 nt, Homo sapiens
cuacaggcucaugccau

SEQ ID NO: 729731 - RNA, 19 nt, Homo sapiens
cuacagggagaaaauccag

SEQ ID NO: 729732 - RNA, 17 nt, Homo sapiens
cuacagggcuuaggacu

SEQ ID NO: 729733 - RNA, 16 nt, Homo sapiens
cuacagguaugugcca

SEQ ID NO: 729734 - RNA, 22 nt, Homo sapiens
cuacagucuaaaauugcuucuu

SEQ ID NO: 729735 - RNA, 21 nt, Homo sapiens
cuacagugucucgaugccaua

SEQ ID NO: 729736 - RNA, 18 nt, Homo sapiens
cuacauaaggaugaaggu

SEQ ID NO: 729737 - RNA, 14 nt, Homo sapiens
cuacaucuaacuca

SEQ ID NO: 729738 - RNA, 17 nt, Homo sapiens
cuacaugaugcccugcu

SEQ ID NO: 729739 - RNA, 13 nt, Homo sapiens
cuacauucacuuc

SEQ ID NO: 729740 - RNA, 11 nt, Homo sapiens
cuacauuccuc

SEQ ID NO: 729741 - RNA, 17 nt, Homo sapiens
cuacauuggaagcuuug

SEQ ID NO: 729742 - RNA, 23 nt, Homo sapiens
cuacauuguacaaggaaugaaag

SEQ ID NO: 729743 - RNA, 18 nt, Homo sapiens
cuacauuuuaaaaacuga

SEQ ID NO: 729744 - RNA, 20 nt, Homo sapiens
cuaccacagcaacuauauau

SEQ ID NO: 729745 - RNA, 18 nt, Homo sapiens
cuaccagagcgugcacuu

SEQ ID NO: 729746 - RNA, 17 nt, Homo sapiens
cuaccaguuggccauga

SEQ ID NO: 729747 - RNA, 13 nt, Homo sapiens
cuaccaucugcau

SEQ ID NO: 729748 - RNA, 13 nt, Homo sapiens
cuaccauugucac

SEQ ID NO: 729749 - RNA, 13 nt, Homo sapiens
cuacccacuucca

SEQ ID NO: 729750 - RNA, 23 nt, Homo sapiens
cuacccagacucagagaccguga

SEQ ID NO: 729751 - RNA, 13 nt, Homo sapiens
cuacccccugaaa

SEQ ID NO: 729752 - RNA, 21 nt, Homo sapiens
cuaccccgagggcgccaugca

SEQ ID NO: 729753 - RNA, 16 nt, Homo sapiens
cuacccuaaagggaga

SEQ ID NO: 729754 - RNA, 22 nt, Homo sapiens
cuacccuauucuauccaucucc

SEQ ID NO: 729755 - RNA, 14 nt, Homo sapiens
cuacccugcugacc

SEQ ID NO: 729756 - RNA, 19 nt, Homo sapiens
cuacccuuccagugcccua

SEQ ID NO: 729757 - RNA, 15 nt, Homo sapiens
cuaccguuguuugca

SEQ ID NO: 729758 - RNA, 17 nt, Homo sapiens
cuaccuagggcacuuua

SEQ ID NO: 729759 - RNA, 18 nt, Homo sapiens
cuaccuagggcacuuuaa

SEQ ID NO: 729760 - RNA, 18 nt, Homo sapiens
cuaccucaggcagcucaa

SEQ ID NO: 729761 - RNA, 23 nt, Homo sapiens
cuaccucuggugaugguuuccac

SEQ ID NO: 729762 - RNA, 16 nt, Homo sapiens
cuaccuuaaacuuaag

SEQ ID NO: 729763 - RNA, 23 nt, Homo sapiens
cuaccuugacuugaaaugcucuu

SEQ ID NO: 729764 - RNA, 14 nt, Homo sapiens
cuaccuugcagugu

SEQ ID NO: 729765 - RNA, 13 nt, Homo sapiens
cuaccuugccucc

SEQ ID NO: 729766 - RNA, 23 nt, Homo sapiens
cuaccuuuauauuugggguccuu

SEQ ID NO: 729767 - RNA, 17 nt, Homo sapiens
cuaccuuuugcuacuua

SEQ ID NO: 729768 - RNA, 15 nt, Homo sapiens
cuacggguaggucua

SEQ ID NO: 729769 - RNA, 18 nt, Homo sapiens
cuacgugacuguggcaca

SEQ ID NO: 729770 - RNA, 14 nt, Homo sapiens
cuacuaaaaacaca

SEQ ID NO: 729771 - RNA, 13 nt, Homo sapiens
cuacuaaggggcu

SEQ ID NO: 729772 - RNA, 19 nt, Homo sapiens
cuacuacaaacuucaaaga

SEQ ID NO: 729773 - RNA, 17 nt, Homo sapiens
cuacuaccuagggcacu

SEQ ID NO: 729774 - RNA, 14 nt, Homo sapiens
cuacuagagucuga

SEQ ID NO: 729775 - RNA, 14 nt, Homo sapiens
cuacuagaugugaa

SEQ ID NO: 729776 - RNA, 23 nt, Homo sapiens
cuacucaggaggcugaggcagaa

SEQ ID NO: 729777 - RNA, 16 nt, Homo sapiens
cuacucuucagggucu

SEQ ID NO: 729778 - RNA, 20 nt, Homo sapiens
cuacugacggaguccugugu

SEQ ID NO: 729779 - RNA, 13 nt, Homo sapiens
cuacugauacuuu

SEQ ID NO: 729780 - RNA, 16 nt, Homo sapiens
cuacugauuguuucau

SEQ ID NO: 729781 - RNA, 15 nt, Homo sapiens
cuacugcaagagcca

SEQ ID NO: 729782 - RNA, 15 nt, Homo sapiens
gaacaagaaauggau

SEQ ID NO: 729783 - RNA, 23 nt, Homo sapiens
gaacaagauggauggaaagggag

SEQ ID NO: 729784 - RNA, 16 nt, Homo sapiens
gaacaagcauuaguuu

SEQ ID NO: 729785 - RNA, 21 nt, Homo sapiens
gaacaagguaaaacaacuaca

SEQ ID NO: 729786 - RNA, 18 nt, Homo sapiens
gaacaaucuuugcuguau

SEQ ID NO: 729787 - RNA, 16 nt, Homo sapiens
gaacacaaaacuugaa

SEQ ID NO: 729788 - RNA, 19 nt, Homo sapiens
gaacacacaagcuugucaa

SEQ ID NO: 729789 - RNA, 17 nt, Homo sapiens
gaacacaggagauucca

SEQ ID NO: 729790 - RNA, 23 nt, Homo sapiens
gaacacauuuaaacaucaguauu

SEQ ID NO: 729791 - RNA, 14 nt, Homo sapiens
gaacaccaauauua

SEQ ID NO: 729792 - RNA, 19 nt, Homo sapiens
gaacaccauugagggagcu

SEQ ID NO: 729793 - RNA, 18 nt, Homo sapiens
gaacaccccgcucuggca

SEQ ID NO: 729794 - RNA, 21 nt, Homo sapiens
gaacacccgacuccucaaaag

SEQ ID NO: 729795 - RNA, 19 nt, Homo sapiens
gaacaccuauugcacuugg

SEQ ID NO: 729796 - RNA, 20 nt, Homo sapiens
gaacagacaacagaagucau

SEQ ID NO: 729797 - RNA, 15 nt, Homo sapiens
gaacagagugcaacc

SEQ ID NO: 729798 - RNA, 15 nt, Homo sapiens
gaacagaucaggaau

SEQ ID NO: 729799 - RNA, 22 nt, Homo sapiens
gaacagauggggucugugacug

SEQ ID NO: 729800 - RNA, 19 nt, Homo sapiens
gaacagcaauggugucagu

SEQ ID NO: 729801 - RNA, 15 nt, Homo sapiens
gaacagcacugggga

SEQ ID NO: 729802 - RNA, 22 nt, Homo sapiens
gaacagcacuggggagucuuug

SEQ ID NO: 729803 - RNA, 23 nt, Homo sapiens
gaacagccgcuccugucugccag

SEQ ID NO: 729804 - RNA, 17 nt, Homo sapiens
gaacagcgggagaccug

SEQ ID NO: 729805 - RNA, 20 nt, Homo sapiens
gaacagcuccuccucuugga

SEQ ID NO: 729806 - RNA, 20 nt, Homo sapiens
gaacaguaaagaaagcagaa

SEQ ID NO: 729807 - RNA, 16 nt, Homo sapiens
gaacaguaacugccau

SEQ ID NO: 729808 - RNA, 17 nt, Homo sapiens
gaacaguauuacagugu

SEQ ID NO: 729809 - RNA, 15 nt, Homo sapiens
gaacauaaagcaaau

SEQ ID NO: 729810 - RNA, 19 nt, Homo sapiens
gaacaugacccagccugaa

SEQ ID NO: 729811 - RNA, 19 nt, Homo sapiens
gaacaugcuuuuacuuuau

SEQ ID NO: 729812 - RNA, 17 nt, Homo sapiens
gaacauuaguugcacua

SEQ ID NO: 729813 - RNA, 23 nt, Homo sapiens
gaacauuccuuagucucaagggc

SEQ ID NO: 729814 - RNA, 19 nt, Homo sapiens
gaacauuucuuucuugcug

SEQ ID NO: 729815 - RNA, 16 nt, Homo sapiens
gaacauuuuuuaccaa

SEQ ID NO: 729816 - RNA, 10 nt, Homo sapiens
gaaccaaaac

SEQ ID NO: 729817 - RNA, 10 nt, Homo sapiens
gaaccaaaga

SEQ ID NO: 729818 - RNA, 21 nt, Homo sapiens
gaaccacgucugcuaacuugg

SEQ ID NO: 729819 - RNA, 21 nt, Homo sapiens
gaaccagagaggcucugagaa

SEQ ID NO: 729820 - RNA, 23 nt, Homo sapiens
gaaccagauguuagaucagggga

SEQ ID NO: 729821 - RNA, 21 nt, Homo sapiens
gaaccagcuucugauaaacac

SEQ ID NO: 729822 - RNA, 17 nt, Homo sapiens
gaaccagggcucuucuc

SEQ ID NO: 729823 - RNA, 12 nt, Homo sapiens
gaaccaggggag

SEQ ID NO: 729824 - RNA, 22 nt, Homo sapiens
gaaccauguggcagaagggaua

SEQ ID NO: 729825 - RNA, 22 nt, Homo sapiens
gaacccaagcuuagaacuuuaa

SEQ ID NO: 729826 - RNA, 14 nt, Homo sapiens
gaacccaagugccu

SEQ ID NO: 729827 - RNA, 15 nt, Homo sapiens
gaacccagacucaga

SEQ ID NO: 729828 - RNA, 19 nt, Homo sapiens
gaacccaucgguaggcaaa

SEQ ID NO: 729829 - RNA, 15 nt, Homo sapiens
gaacccccuccagac

SEQ ID NO: 729830 - RNA, 21 nt, Homo sapiens
gaacccccucccugucccagg

SEQ ID NO: 729831 - RNA, 18 nt, Homo sapiens
gaacccgaggcugagaau

SEQ ID NO: 729832 - RNA, 12 nt, Homo sapiens
gaacccugagca

SEQ ID NO: 729833 - RNA, 23 nt, Homo sapiens
gaaccgugguaugucugccaugu

SEQ ID NO: 729834 - RNA, 18 nt, Homo sapiens
gaaccuaggaggguguga

SEQ ID NO: 729835 - RNA, 13 nt, Homo sapiens
gaaccuggagcca

SEQ ID NO: 729836 - RNA, 14 nt, Homo sapiens
gaaccuuccaucuc

SEQ ID NO: 729837 - RNA, 16 nt, Homo sapiens
gaaccuuccaucucgc

SEQ ID NO: 729838 - RNA, 13 nt, Homo sapiens
gaaccuucuuaac

SEQ ID NO: 729839 - RNA, 17 nt, Homo sapiens
gaaccuugagcaaauua

SEQ ID NO: 729840 - RNA, 21 nt, Homo sapiens
gaacgagcacuggccagagag

SEQ ID NO: 729841 - RNA, 15 nt, Homo sapiens
gaacgcguguguaca

SEQ ID NO: 729842 - RNA, 13 nt, Homo sapiens
gaacggaaugugu

SEQ ID NO: 729843 - RNA, 17 nt, Homo sapiens
gaacgguaaauuucugu

SEQ ID NO: 729844 - RNA, 16 nt, Homo sapiens
gaacgucuaguacaau

SEQ ID NO: 729845 - RNA, 14 nt, Homo sapiens
gaacuaaagcaaau

SEQ ID NO: 729846 - RNA, 19 nt, Homo sapiens
gaacuaaauuuaagcuuaa

SEQ ID NO: 729847 - RNA, 15 nt, Homo sapiens
gaacuaacaugcaaa

SEQ ID NO: 729848 - RNA, 17 nt, Homo sapiens
gaacuaccaucugaugu

SEQ ID NO: 729849 - RNA, 17 nt, Homo sapiens
gaacuacuuuuggugcu

SEQ ID NO: 729850 - RNA, 15 nt, Homo sapiens
gaacuauuucuacac

SEQ ID NO: 729851 - RNA, 19 nt, Homo sapiens
gaacucaaauggggccaga

SEQ ID NO: 729852 - RNA, 19 nt, Homo sapiens
gaacucaccagugaguuag

SEQ ID NO: 729853 - RNA, 22 nt, Homo sapiens
gaacucagagaugaacaucuaa

SEQ ID NO: 729854 - RNA, 17 nt, Homo sapiens
gaacucucccucugguc

SEQ ID NO: 729855 - RNA, 15 nt, Homo sapiens
gaacucuuucauccc

SEQ ID NO: 729856 - RNA, 16 nt, Homo sapiens
gaacugaaucacuuaa

SEQ ID NO: 729857 - RNA, 14 nt, Homo sapiens
gaacugagggcucu

SEQ ID NO: 729858 - RNA, 22 nt, Homo sapiens
gaacugcauucuucugagcacu

SEQ ID NO: 729859 - RNA, 16 nt, Homo sapiens
gaacugggaguccagg

SEQ ID NO: 729860 - RNA, 13 nt, Homo sapiens
gaacugggguuca

SEQ ID NO: 729861 - RNA, 18 nt, Homo sapiens
gaacuguuggcugcuccc

SEQ ID NO: 729862 - RNA, 21 nt, Homo sapiens
gaacuuaauaacuguguacug

SEQ ID NO: 729863 - RNA, 22 nt, Homo sapiens
gaacuuacauacuaggugccuu

SEQ ID NO: 729864 - RNA, 17 nt, Homo sapiens
gaacuucacagugacac

SEQ ID NO: 729865 - RNA, 12 nt, Homo sapiens
gaacuuccuccc

SEQ ID NO: 729866 - RNA, 21 nt, Homo sapiens
gaacuuccugcuuccucagag

SEQ ID NO: 729867 - RNA, 22 nt, Homo sapiens
gaacuugagcgugaaucuguau

SEQ ID NO: 729868 - RNA, 22 nt, Homo sapiens
gaacuugccuuaaacacucacc

SEQ ID NO: 729869 - RNA, 21 nt, Homo sapiens
gaacuuuaagaagcaguguuu

SEQ ID NO: 729870 - RNA, 23 nt, Homo sapiens
gaacuuuaagaagcaguguuuua

SEQ ID NO: 729871 - RNA, 14 nt, Homo sapiens
gaacuuuaagcaac

SEQ ID NO: 729872 - RNA, 24 nt, Homo sapiens
gaacuuuaagcaacaagaccacca

SEQ ID NO: 729873 - RNA, 16 nt, Homo sapiens
gaacuuucaaaauaua

SEQ ID NO: 729874 - RNA, 20 nt, Homo sapiens
gaacuuuccagggauccagg

SEQ ID NO: 729875 - RNA, 20 nt, Homo sapiens
gaacuuucuggucccuucag

SEQ ID NO: 729876 - RNA, 20 nt, Homo sapiens
gaagaaaagcugccauuucc

SEQ ID NO: 729877 - RNA, 12 nt, Homo sapiens
gaagaaagcaaa

SEQ ID NO: 729878 - RNA, 19 nt, Homo sapiens
gaagaacaacaaagacaug

SEQ ID NO: 729879 - RNA, 17 nt, Homo sapiens
gaagaacauccaaggag

SEQ ID NO: 729880 - RNA, 14 nt, Homo sapiens
gaagaacuugcaug

SEQ ID NO: 729881 - RNA, 14 nt, Homo sapiens
gaagaagaguuucu

SEQ ID NO: 729882 - RNA, 16 nt, Homo sapiens
gaagaagauagaucca

SEQ ID NO: 729883 - RNA, 23 nt, Homo sapiens
gaagaagauaugugaagaaaaau

SEQ ID NO: 729884 - RNA, 19 nt, Homo sapiens
gaagaagaucaacgccuca

SEQ ID NO: 729885 - RNA, 12 nt, Homo sapiens
gaagaagcuaaa

SEQ ID NO: 729886 - RNA, 20 nt, Homo sapiens
gaagaagucuaagagugaag

SEQ ID NO: 729887 - RNA, 17 nt, Homo sapiens
gaagaagugagcagugu

SEQ ID NO: 729888 - RNA, 19 nt, Homo sapiens
gaagaauauucaggacuua

SEQ ID NO: 729889 - RNA, 20 nt, Homo sapiens
gaagaauuggccaucuuaaa

SEQ ID NO: 729890 - RNA, 12 nt, Homo sapiens
gaagacaacucu

SEQ ID NO: 729891 - RNA, 23 nt, Homo sapiens
gaagacauccugagcagugccag

SEQ ID NO: 729892 - RNA, 17 nt, Homo sapiens
gaagaccacacuuggug

SEQ ID NO: 729893 - RNA, 11 nt, Homo sapiens
gaagaccagcu

SEQ ID NO: 729894 - RNA, 19 nt, Homo sapiens
gaagacuauuuaguggaac

SEQ ID NO: 729895 - RNA, 16 nt, Homo sapiens
gaagagaaaggacuca

SEQ ID NO: 729896 - RNA, 14 nt, Homo sapiens
gaccucauguuguu

SEQ ID NO: 729897 - RNA, 17 nt, Homo sapiens
gaccuccaaccaggagu

SEQ ID NO: 729898 - RNA, 20 nt, Homo sapiens
gaccugagagcaucucagga

SEQ ID NO: 729899 - RNA, 15 nt, Homo sapiens
gaccugauccuggag

SEQ ID NO: 729900 - RNA, 19 nt, Homo sapiens
gaccugccucucacacaca

SEQ ID NO: 729901 - RNA, 19 nt, Homo sapiens
gaccugccugugugcuccg

SEQ ID NO: 729902 - RNA, 17 nt, Homo sapiens
gaccuggaaucagugaa

SEQ ID NO: 729903 - RNA, 19 nt, Homo sapiens
gaccuggagcagcugacuu

SEQ ID NO: 729904 - RNA, 16 nt, Homo sapiens
gaccuggcagcucugg

SEQ ID NO: 729905 - RNA, 15 nt, Homo sapiens
gaccuggcucucaga

SEQ ID NO: 729906 - RNA, 17 nt, Homo sapiens
gaccuguaaucauauaa

SEQ ID NO: 729907 - RNA, 12 nt, Homo sapiens
gaccuguguucc

SEQ ID NO: 729908 - RNA, 21 nt, Homo sapiens
gaccuguuuaugagaugcugg

SEQ ID NO: 729909 - RNA, 13 nt, Homo sapiens
gaccuuacuccuc

SEQ ID NO: 729910 - RNA, 23 nt, Homo sapiens
gaccuuaucaggauaccagagga

SEQ ID NO: 729911 - RNA, 18 nt, Homo sapiens
gaccuuccagcuccugug

SEQ ID NO: 729912 - RNA, 21 nt, Homo sapiens
gaccuucucccucacuccugc

SEQ ID NO: 729913 - RNA, 12 nt, Homo sapiens
gaccuugcaaug

SEQ ID NO: 729914 - RNA, 20 nt, Homo sapiens
gaccuugggggaagacuuua

SEQ ID NO: 729915 - RNA, 21 nt, Homo sapiens
gaccuugggggaagacuuuaa

SEQ ID NO: 729916 - RNA, 19 nt, Homo sapiens
gaccuuuaccuccugccuu

SEQ ID NO: 729917 - RNA, 16 nt, Homo sapiens
gaccuuuggagaccau

SEQ ID NO: 729918 - RNA, 20 nt, Homo sapiens
gacgaagcggagagagccaa

SEQ ID NO: 729919 - RNA, 23 nt, Homo sapiens
gacgaagcggagagagccaagac

SEQ ID NO: 729920 - RNA, 12 nt, Homo sapiens
gacgacaguacu

SEQ ID NO: 729921 - RNA, 15 nt, Homo sapiens
gacgagcaugagcug

SEQ ID NO: 729922 - RNA, 16 nt, Homo sapiens
gacgcuucccuugccg

SEQ ID NO: 729923 - RNA, 18 nt, Homo sapiens
gacgcuucccuugccguu

SEQ ID NO: 729924 - RNA, 21 nt, Homo sapiens
gacgggcacagugguggugcc

SEQ ID NO: 729925 - RNA, 21 nt, Homo sapiens
gacgggguugucgagaucuca

SEQ ID NO: 729926 - RNA, 22 nt, Homo sapiens
gacgggguugucgagaucucag

SEQ ID NO: 729927 - RNA, 16 nt, Homo sapiens
gacggguuucaccaug

SEQ ID NO: 729928 - RNA, 14 nt, Homo sapiens
gacggucaguccau

SEQ ID NO: 729929 - RNA, 22 nt, Homo sapiens
gacggugcucacucccaaggga

SEQ ID NO: 729930 - RNA, 14 nt, Homo sapiens
gacguagaaagauc

SEQ ID NO: 729931 - RNA, 16 nt, Homo sapiens
gacguccuccguccau

SEQ ID NO: 729932 - RNA, 19 nt, Homo sapiens
gacgugugagggaggacag

SEQ ID NO: 729933 - RNA, 17 nt, Homo sapiens
gacuaacccaaugccug

SEQ ID NO: 729934 - RNA, 16 nt, Homo sapiens
gacuaauggaaauauu

SEQ ID NO: 729935 - RNA, 12 nt, Homo sapiens
gacuacaaccaa

SEQ ID NO: 729936 - RNA, 20 nt, Homo sapiens
gacuacaaccaauuuacacu

SEQ ID NO: 729937 - RNA, 20 nt, Homo sapiens
gacuacauuugugaacaaaa

SEQ ID NO: 729938 - RNA, 19 nt, Homo sapiens
gacuacuauacaaacuaca

SEQ ID NO: 729939 - RNA, 14 nt, Homo sapiens
gacuacugcuccug

SEQ ID NO: 729940 - RNA, 19 nt, Homo sapiens
gacuacuuggaacuaggcu

SEQ ID NO: 729941 - RNA, 21 nt, Homo sapiens
gacuacuuggaacuaggcucu

SEQ ID NO: 729942 - RNA, 18 nt, Homo sapiens
gacuagauguaguauuuu

SEQ ID NO: 729943 - RNA, 22 nt, Homo sapiens
gacuauaggcaugcgccaccau

SEQ ID NO: 729944 - RNA, 20 nt, Homo sapiens
gacuaugauuuaccuauaca

SEQ ID NO: 729945 - RNA, 17 nt, Homo sapiens
gacuauggugcugccuu

SEQ ID NO: 729946 - RNA, 15 nt, Homo sapiens
gacuauguagcaaua

SEQ ID NO: 729947 - RNA, 13 nt, Homo sapiens
gacucaagggaaa

SEQ ID NO: 729948 - RNA, 22 nt, Homo sapiens
gacucaccaacuugccacaugu

SEQ ID NO: 729949 - RNA, 20 nt, Homo sapiens
gacucaccuguucucacucc

SEQ ID NO: 729950 - RNA, 15 nt, Homo sapiens
gacucagacugcaug

SEQ ID NO: 729951 - RNA, 17 nt, Homo sapiens
gacucagggccaugccu

SEQ ID NO: 729952 - RNA, 21 nt, Homo sapiens
gacucagggccccagcacuaa

SEQ ID NO: 729953 - RNA, 23 nt, Homo sapiens
gacuccaaagaaauguaagggaa

SEQ ID NO: 729954 - RNA, 16 nt, Homo sapiens
gacuccaauggggcca

SEQ ID NO: 729955 - RNA, 16 nt, Homo sapiens
gacuccaccucaaaaa

SEQ ID NO: 729956 - RNA, 14 nt, Homo sapiens
gacuccaucucuca

SEQ ID NO: 729957 - RNA, 20 nt, Homo sapiens
gacucccuccauagcgacac

SEQ ID NO: 729958 - RNA, 12 nt, Homo sapiens
gacuccucauca

SEQ ID NO: 729959 - RNA, 16 nt, Homo sapiens
gacuccuccuguggaa

SEQ ID NO: 729960 - RNA, 16 nt, Homo sapiens
gacuccuggucuguga

SEQ ID NO: 729961 - RNA, 13 nt, Homo sapiens
gacuccugugcaa

SEQ ID NO: 729962 - RNA, 20 nt, Homo sapiens
gacuccuuguggacuggcug

SEQ ID NO: 729963 - RNA, 13 nt, Homo sapiens
gacucgggaccaa

SEQ ID NO: 729964 - RNA, 15 nt, Homo sapiens
gacucugauucuaca

SEQ ID NO: 729965 - RNA, 18 nt, Homo sapiens
gacucugauucuacagug

SEQ ID NO: 729966 - RNA, 16 nt, Homo sapiens
gacucugcacaugucu

SEQ ID NO: 729967 - RNA, 18 nt, Homo sapiens
gacucugcacaugucuug

SEQ ID NO: 729968 - RNA, 20 nt, Homo sapiens
gacucugcacaugucuugua

SEQ ID NO: 729969 - RNA, 19 nt, Homo sapiens
gacucugcagagucacuca

SEQ ID NO: 729970 - RNA, 21 nt, Homo sapiens
gacucugccauuaaaacauua

SEQ ID NO: 729971 - RNA, 22 nt, Homo sapiens
gacucugcuagacuccucagga

SEQ ID NO: 729972 - RNA, 14 nt, Homo sapiens
gacucugguguucu

SEQ ID NO: 729973 - RNA, 11 nt, Homo sapiens
gacucuuccac

SEQ ID NO: 729974 - RNA, 17 nt, Homo sapiens
gacucuugcagggguag

SEQ ID NO: 729975 - RNA, 20 nt, Homo sapiens
gacugaagugaacuaugaag

SEQ ID NO: 729976 - RNA, 15 nt, Homo sapiens
gacugaaucagccca

SEQ ID NO: 729977 - RNA, 20 nt, Homo sapiens
gacugaccccagugguaucc

SEQ ID NO: 729978 - RNA, 22 nt, Homo sapiens
gacugagauaagaaaagccuga

SEQ ID NO: 729979 - RNA, 23 nt, Homo sapiens
gacugauggcgauucccucucac

SEQ ID NO: 729980 - RNA, 14 nt, Homo sapiens
gacugauguguaua

SEQ ID NO: 729981 - RNA, 18 nt, Homo sapiens
gacugauugauuauucaa

SEQ ID NO: 729982 - RNA, 13 nt, Homo sapiens
gacugcagggaca

SEQ ID NO: 729983 - RNA, 17 nt, Homo sapiens
gacugccccugccuuuu

SEQ ID NO: 729984 - RNA, 13 nt, Homo sapiens
gacugcuaccucu

SEQ ID NO: 729985 - RNA, 14 nt, Homo sapiens
gacugcuaccuuuc

SEQ ID NO: 729986 - RNA, 19 nt, Homo sapiens
gacugcuucaucugcugua

SEQ ID NO: 729987 - RNA, 16 nt, Homo sapiens
gacuggacgugcucag

SEQ ID NO: 729988 - RNA, 10 nt, Homo sapiens
gacuggccau

SEQ ID NO: 729989 - RNA, 13 nt, Homo sapiens
gacuggcugugag

SEQ ID NO: 729990 - RNA, 16 nt, Homo sapiens
gacuggggauggcgca

SEQ ID NO: 729991 - RNA, 15 nt, Homo sapiens
gacuggguuacauau

SEQ ID NO: 729992 - RNA, 13 nt, Homo sapiens
gacuggugcugca

SEQ ID NO: 729993 - RNA, 21 nt, Homo sapiens
gacugucaguucucugggaag

SEQ ID NO: 729994 - RNA, 17 nt, Homo sapiens
gacuguccaagugccac

SEQ ID NO: 729995 - RNA, 23 nt, Homo sapiens
gacuguccaagugccacaugccu

SEQ ID NO: 729996 - RNA, 11 nt, Homo sapiens
gacugucuaua

SEQ ID NO: 729997 - RNA, 14 nt, Homo sapiens
gacugucuuucaga

SEQ ID NO: 729998 - RNA, 18 nt, Homo sapiens
gacugugauuuauuugga

SEQ ID NO: 729999 - RNA, 16 nt, Homo sapiens
gacuguggccuguuaa

SEQ ID NO: 730000 - RNA, 12 nt, Homo sapiens
gacuguguuucc

SEQ ID NO: 730001 - RNA, 14 nt, Homo sapiens
gacuguguuugcau

SEQ ID NO: 730002 - RNA, 11 nt, Homo sapiens
gacuguuacag

SEQ ID NO: 730003 - RNA, 17 nt, Homo sapiens
gacuguugccacuuaac

SEQ ID NO: 730004 - RNA, 22 nt, Homo sapiens
gacuguugcucaaaucuauuca

SEQ ID NO: 730005 - RNA, 22 nt, Homo sapiens
gacuguuuauagcuguuggaag

SEQ ID NO: 730006 - RNA, 19 nt, Homo sapiens
gacuuagaauaaugaaggu

SEQ ID NO: 730007 - RNA, 16 nt, Homo sapiens
gacuuagccugaguca

SEQ ID NO: 730008 - RNA, 22 nt, Homo sapiens
gacuuauacuugccuucugaua

SEQ ID NO: 730009 - RNA, 13 nt, Homo sapiens
gacuuaucuacca

SEQ ID NO: 730010 - RNA, 16 nt, Homo sapiens
gacuuauuaugcauaa

SEQ ID NO: 730011 - RNA, 12 nt, Homo sapiens
ggaccacugcau

SEQ ID NO: 730012 - RNA, 13 nt, Homo sapiens
ggaccacugggua

SEQ ID NO: 730013 - RNA, 12 nt, Homo sapiens
ggacccaaaaca

SEQ ID NO: 730014 - RNA, 21 nt, Homo sapiens
ggacccacuacccuucuccuu

SEQ ID NO: 730015 - RNA, 21 nt, Homo sapiens
ggacccagccucagauccagg

SEQ ID NO: 730016 - RNA, 18 nt, Homo sapiens
ggacccagccuucaguca

SEQ ID NO: 730017 - RNA, 15 nt, Homo sapiens
ggacccccacuaaga

SEQ ID NO: 730018 - RNA, 22 nt, Homo sapiens
ggacccccuggcccugccucau

SEQ ID NO: 730019 - RNA, 18 nt, Homo sapiens
ggacccugagaagccagu

SEQ ID NO: 730020 - RNA, 21 nt, Homo sapiens
ggacccuuggccuccauuucu

SEQ ID NO: 730021 - RNA, 14 nt, Homo sapiens
ggaccucaccugcu

SEQ ID NO: 730022 - RNA, 12 nt, Homo sapiens
ggaccucaggug

SEQ ID NO: 730023 - RNA, 14 nt, Homo sapiens
ggaccucaguuuua

SEQ ID NO: 730024 - RNA, 22 nt, Homo sapiens
ggaccucuuuacucucuccgau

SEQ ID NO: 730025 - RNA, 20 nt, Homo sapiens
ggaccugagccugguccugg

SEQ ID NO: 730026 - RNA, 16 nt, Homo sapiens
ggaccuggcaguggug

SEQ ID NO: 730027 - RNA, 14 nt, Homo sapiens
ggaccuguccaugc

SEQ ID NO: 730028 - RNA, 15 nt, Homo sapiens
ggacggcaggcucac

SEQ ID NO: 730029 - RNA, 17 nt, Homo sapiens
ggacgguuuugcuuuau

SEQ ID NO: 730030 - RNA, 13 nt, Homo sapiens
ggacgugcucaga

SEQ ID NO: 730031 - RNA, 20 nt, Homo sapiens
ggacuaacccaaugccugug

SEQ ID NO: 730032 - RNA, 18 nt, Homo sapiens
ggacuacacccaagccug

SEQ ID NO: 730033 - RNA, 23 nt, Homo sapiens
ggacuauagugauuuaaacucau

SEQ ID NO: 730034 - RNA, 22 nt, Homo sapiens
ggacuauuauaauuuaaugcau

SEQ ID NO: 730035 - RNA, 20 nt, Homo sapiens
ggacucauauauuuaagccu

SEQ ID NO: 730036 - RNA, 17 nt, Homo sapiens
ggacucaucaaagccuu

SEQ ID NO: 730037 - RNA, 19 nt, Homo sapiens
ggacuccaggccugaccag

SEQ ID NO: 730038 - RNA, 13 nt, Homo sapiens
ggacuccaucucu

SEQ ID NO: 730039 - RNA, 23 nt, Homo sapiens
ggacuccaucucucauccuccag

SEQ ID NO: 730040 - RNA, 17 nt, Homo sapiens
ggacuccaugcugccag

SEQ ID NO: 730041 - RNA, 13 nt, Homo sapiens
ggacucugcacau

SEQ ID NO: 730042 - RNA, 12 nt, Homo sapiens
ggacucuuccac

SEQ ID NO: 730043 - RNA, 19 nt, Homo sapiens
ggacugaagggguucucac

SEQ ID NO: 730044 - RNA, 17 nt, Homo sapiens
ggacugaaugugccuaa

SEQ ID NO: 730045 - RNA, 19 nt, Homo sapiens
ggacugagaaauuauacuu

SEQ ID NO: 730046 - RNA, 11 nt, Homo sapiens
ggacugagaug

SEQ ID NO: 730047 - RNA, 22 nt, Homo sapiens
ggacugagccuggcccauagaa

SEQ ID NO: 730048 - RNA, 13 nt, Homo sapiens
ggacugauuugug

SEQ ID NO: 730049 - RNA, 17 nt, Homo sapiens
ggacugucagcugagcu

SEQ ID NO: 730050 - RNA, 11 nt, Homo sapiens
ggacuguguug

SEQ ID NO: 730051 - RNA, 11 nt, Homo sapiens
ggacuguguuu

SEQ ID NO: 730052 - RNA, 15 nt, Homo sapiens
ggacuuccauuugcu

SEQ ID NO: 730053 - RNA, 22 nt, Homo sapiens
ggacuuugguucucuccaggaa

SEQ ID NO: 730054 - RNA, 15 nt, Homo sapiens
ggagaaaaagcuuaa

SEQ ID NO: 730055 - RNA, 20 nt, Homo sapiens
ggagaaaagggauggagcug

SEQ ID NO: 730056 - RNA, 17 nt, Homo sapiens
ggagaaaugacuuugaa

SEQ ID NO: 730057 - RNA, 23 nt, Homo sapiens
ggagaaccucaggcuuccuuggc

SEQ ID NO: 730058 - RNA, 18 nt, Homo sapiens
ggagaagagcuguucaca

SEQ ID NO: 730059 - RNA, 13 nt, Homo sapiens
ggagaagaucgca

SEQ ID NO: 730060 - RNA, 14 nt, Homo sapiens
ggagaagcacagcu

SEQ ID NO: 730061 - RNA, 19 nt, Homo sapiens
ggagaaggucuccaaggga

SEQ ID NO: 730062 - RNA, 14 nt, Homo sapiens
ggagaagugauaug

SEQ ID NO: 730063 - RNA, 22 nt, Homo sapiens
ggagaauaaaauuccuaucuca

SEQ ID NO: 730064 - RNA, 16 nt, Homo sapiens
ggagaaucauguuucu

SEQ ID NO: 730065 - RNA, 14 nt, Homo sapiens
ggagaaugaugucc

SEQ ID NO: 730066 - RNA, 15 nt, Homo sapiens
ggagaauuagauuuc

SEQ ID NO: 730067 - RNA, 22 nt, Homo sapiens
ggagacacccucuggggguccu

SEQ ID NO: 730068 - RNA, 16 nt, Homo sapiens
ggagacagaaagccuc

SEQ ID NO: 730069 - RNA, 15 nt, Homo sapiens
ggagaccacacugca

SEQ ID NO: 730070 - RNA, 12 nt, Homo sapiens
ggagaccaucua

SEQ ID NO: 730071 - RNA, 12 nt, Homo sapiens
ggagacuggaaa

SEQ ID NO: 730072 - RNA, 18 nt, Homo sapiens
ggagagaaaguuacuguu

SEQ ID NO: 730073 - RNA, 14 nt, Homo sapiens
ggagagacugugag

SEQ ID NO: 730074 - RNA, 20 nt, Homo sapiens
ggagagagaggcugccucag

SEQ ID NO: 730075 - RNA, 12 nt, Homo sapiens
ggagagagccaa

SEQ ID NO: 730076 - RNA, 15 nt, Homo sapiens
ggagagagugcuauu

SEQ ID NO: 730077 - RNA, 15 nt, Homo sapiens
ggagagcccagccau

SEQ ID NO: 730078 - RNA, 23 nt, Homo sapiens
ggagagcccggcgccccugccac

SEQ ID NO: 730079 - RNA, 18 nt, Homo sapiens
ggagaggggaagggccag

SEQ ID NO: 730080 - RNA, 13 nt, Homo sapiens
ggagauacugaac

SEQ ID NO: 730081 - RNA, 14 nt, Homo sapiens
ggagaucuucacuc

SEQ ID NO: 730082 - RNA, 23 nt, Homo sapiens
ggagaugccacuucucacucacc

SEQ ID NO: 730083 - RNA, 20 nt, Homo sapiens
ggagcacgaggucuggccaa

SEQ ID NO: 730084 - RNA, 12 nt, Homo sapiens
ggagcacugggu

SEQ ID NO: 730085 - RNA, 16 nt, Homo sapiens
ggagcacuuguccacg

SEQ ID NO: 730086 - RNA, 13 nt, Homo sapiens
ggagcaggaccua

SEQ ID NO: 730087 - RNA, 21 nt, Homo sapiens
ggagcaguugcccucaggccu

SEQ ID NO: 730088 - RNA, 19 nt, Homo sapiens
ggagcaugggccuggccac

SEQ ID NO: 730089 - RNA, 17 nt, Homo sapiens
ggagccagggccucucc

SEQ ID NO: 730090 - RNA, 22 nt, Homo sapiens
ggagccaguccgugcaggcaca

SEQ ID NO: 730091 - RNA, 22 nt, Homo sapiens
ggagccccaggggacaagggau

SEQ ID NO: 730092 - RNA, 20 nt, Homo sapiens
ggagccccugaaagccucac

SEQ ID NO: 730093 - RNA, 18 nt, Homo sapiens
ggagcccgaggcaccagu

SEQ ID NO: 730094 - RNA, 22 nt, Homo sapiens
ggagcccggcuuccacucccca

SEQ ID NO: 730095 - RNA, 13 nt, Homo sapiens
ggagccucagaag

SEQ ID NO: 730096 - RNA, 21 nt, Homo sapiens
ggagccuuuuuaaaacacaug

SEQ ID NO: 730097 - RNA, 21 nt, Homo sapiens
ggagcucuacgugcuccucag

SEQ ID NO: 730098 - RNA, 13 nt, Homo sapiens
ggagcugcugagu

SEQ ID NO: 730099 - RNA, 15 nt, Homo sapiens
ggagcuucggggccu

SEQ ID NO: 730100 - RNA, 19 nt, Homo sapiens
ggagcuucuuguuuccuug

SEQ ID NO: 730101 - RNA, 16 nt, Homo sapiens
ggagcuugcagugagc

SEQ ID NO: 730102 - RNA, 15 nt, Homo sapiens
ggaggaccagagcua

SEQ ID NO: 730103 - RNA, 18 nt, Homo sapiens
ggaggacuccgggaccau

SEQ ID NO: 730104 - RNA, 16 nt, Homo sapiens
ggaggagggaggcgcu

SEQ ID NO: 730105 - RNA, 19 nt, Homo sapiens
ggaggcacacuuucuggca

SEQ ID NO: 730106 - RNA, 20 nt, Homo sapiens
ggaggcagagcuugcaguga

SEQ ID NO: 730107 - RNA, 20 nt, Homo sapiens
ggaggcagagguugcaguga

SEQ ID NO: 730108 - RNA, 12 nt, Homo sapiens
ggaggcauucuu

SEQ ID NO: 730109 - RNA, 18 nt, Homo sapiens
ggaggccuuccagcugcu

SEQ ID NO: 730110 - RNA, 14 nt, Homo sapiens
ggaggccuuucauc

SEQ ID NO: 730111 - RNA, 20 nt, Homo sapiens
ggaggcggagguuccaguga

SEQ ID NO: 730112 - RNA, 14 nt, Homo sapiens
ggaggcucuguucu

SEQ ID NO: 730113 - RNA, 14 nt, Homo sapiens
ggaggcuggccaag

SEQ ID NO: 730114 - RNA, 11 nt, Homo sapiens
ggaggcuuccu

SEQ ID NO: 730115 - RNA, 14 nt, Homo sapiens
ggagggagggacaa

SEQ ID NO: 730116 - RNA, 14 nt, Homo sapiens
ggagggcagguagc

SEQ ID NO: 730117 - RNA, 14 nt, Homo sapiens
ggagggcuguggug

SEQ ID NO: 730118 - RNA, 12 nt, Homo sapiens
ggaggggaccaa

SEQ ID NO: 730119 - RNA, 17 nt, Homo sapiens
ggagguaguuaagggau

SEQ ID NO: 730120 - RNA, 14 nt, Homo sapiens
ggagguaugaauua

SEQ ID NO: 730121 - RNA, 14 nt, Homo sapiens
ggagguauuugaaa

SEQ ID NO: 730122 - RNA, 16 nt, Homo sapiens
ggaggucaaggugagc

SEQ ID NO: 730123 - RNA, 19 nt, Homo sapiens
ggaggucauacaugcauac

SEQ ID NO: 730124 - RNA, 14 nt, Homo sapiens
ggaguaggcuguau

SEQ ID NO: 730125 - RNA, 21 nt, Homo sapiens
ggagugaaaccuuuagggcag

SEQ ID NO: 730126 - RNA, 21 nt, Homo sapiens
ggagugaagugguacaaucug

SEQ ID NO: 730127 - RNA, 11 nt, Homo sapiens
gggaaagccuc

SEQ ID NO: 730128 - RNA, 22 nt, Homo sapiens
gggaaauagccaaaaaggcaaa

SEQ ID NO: 730129 - RNA, 14 nt, Homo sapiens
gggaaaucaguguu

SEQ ID NO: 730130 - RNA, 18 nt, Homo sapiens
gggaacagagaagugugg

SEQ ID NO: 730131 - RNA, 13 nt, Homo sapiens
gggaagaccagcu

SEQ ID NO: 730132 - RNA, 17 nt, Homo sapiens
gggaagacuauggugcu

SEQ ID NO: 730133 - RNA, 14 nt, Homo sapiens
gggaagagggcagu

SEQ ID NO: 730134 - RNA, 15 nt, Homo sapiens
gggaagagugcauuu

SEQ ID NO: 730135 - RNA, 12 nt, Homo sapiens
gggaagccaaaa

SEQ ID NO: 730136 - RNA, 14 nt, Homo sapiens
gggaagcucagggg

SEQ ID NO: 730137 - RNA, 21 nt, Homo sapiens
gggaaggagggagcugcucag

SEQ ID NO: 730138 - RNA, 22 nt, Homo sapiens
gggaaggucagcccagccccuc

SEQ ID NO: 730139 - RNA, 19 nt, Homo sapiens
gggaagugucaugcaagug

SEQ ID NO: 730140 - RNA, 20 nt, Homo sapiens
gggaaguuucguaugcacuc

SEQ ID NO: 730141 - RNA, 23 nt, Homo sapiens
gggaauacugugcauaagccauu

SEQ ID NO: 730142 - RNA, 18 nt, Homo sapiens
gggaauagaggaaugugu

SEQ ID NO: 730143 - RNA, 13 nt, Homo sapiens
gggaauccugcua

SEQ ID NO: 730144 - RNA, 15 nt, Homo sapiens
gggaauggauccugg

SEQ ID NO: 730145 - RNA, 12 nt, Homo sapiens
gggaauggggac

SEQ ID NO: 730146 - RNA, 17 nt, Homo sapiens
gggacaauaaauuuugc

SEQ ID NO: 730147 - RNA, 22 nt, Homo sapiens
gggaccaacugggcccaagaca

SEQ ID NO: 730148 - RNA, 13 nt, Homo sapiens
gggaccccgagaa

SEQ ID NO: 730149 - RNA, 19 nt, Homo sapiens
gggaccccgagaacccuga

SEQ ID NO: 730150 - RNA, 14 nt, Homo sapiens
gggacccuguugau

SEQ ID NO: 730151 - RNA, 12 nt, Homo sapiens
gggaccugagag

SEQ ID NO: 730152 - RNA, 20 nt, Homo sapiens
gggaccugcuucacaaguua

SEQ ID NO: 730153 - RNA, 15 nt, Homo sapiens
gggaccuuggcugcu

SEQ ID NO: 730154 - RNA, 20 nt, Homo sapiens
gggacgcuccgcugccgugc

SEQ ID NO: 730155 - RNA, 15 nt, Homo sapiens
gggacgggggcugcu

SEQ ID NO: 730156 - RNA, 22 nt, Homo sapiens
gggacuauuuugcaugcugaaa

SEQ ID NO: 730157 - RNA, 16 nt, Homo sapiens
gggacucagggccaug

SEQ ID NO: 730158 - RNA, 22 nt, Homo sapiens
gggacucugaccacagcccgcu

SEQ ID NO: 730159 - RNA, 20 nt, Homo sapiens
gggacugcuaccucugagaa

SEQ ID NO: 730160 - RNA, 14 nt, Homo sapiens
gggacuucagcuca

SEQ ID NO: 730161 - RNA, 14 nt, Homo sapiens
gggagaaagcaaua

SEQ ID NO: 730162 - RNA, 12 nt, Homo sapiens
gggagacuggaa

SEQ ID NO: 730163 - RNA, 16 nt, Homo sapiens
gggagagagugcuauu

SEQ ID NO: 730164 - RNA, 19 nt, Homo sapiens
gggagagcgaaggggguca

SEQ ID NO: 730165 - RNA, 21 nt, Homo sapiens
gggagauuuuuuugagucaaa

SEQ ID NO: 730166 - RNA, 13 nt, Homo sapiens
gggagcaccagcg

SEQ ID NO: 730167 - RNA, 11 nt, Homo sapiens
gggagccagcc

SEQ ID NO: 730168 - RNA, 22 nt, Homo sapiens
gggagccagccuucuaacagcu

SEQ ID NO: 730169 - RNA, 12 nt, Homo sapiens
gggagcccagug

SEQ ID NO: 730170 - RNA, 16 nt, Homo sapiens
gggagcuaucacugua

SEQ ID NO: 730171 - RNA, 16 nt, Homo sapiens
gggagcucaguuuuca

SEQ ID NO: 730172 - RNA, 13 nt, Homo sapiens
gggagcugccaag

SEQ ID NO: 730173 - RNA, 14 nt, Homo sapiens
gggaggcaagaaaa

SEQ ID NO: 730174 - RNA, 23 nt, Homo sapiens
gggaggcaagugugggggguccu

SEQ ID NO: 730175 - RNA, 12 nt, Homo sapiens
gggaggcccaaa

SEQ ID NO: 730176 - RNA, 13 nt, Homo sapiens
gggaggggguccu

SEQ ID NO: 730177 - RNA, 23 nt, Homo sapiens
gggaggguggugggcccagacca

SEQ ID NO: 730178 - RNA, 15 nt, Homo sapiens
gggaggugggguaca

SEQ ID NO: 730179 - RNA, 20 nt, Homo sapiens
gggaguaggacauaccagcu

SEQ ID NO: 730180 - RNA, 16 nt, Homo sapiens
gggagugggcgcagug

SEQ ID NO: 730181 - RNA, 12 nt, Homo sapiens
gggagugucuaa

SEQ ID NO: 730182 - RNA, 21 nt, Homo sapiens
gggagugugaguuuugccuuu

SEQ ID NO: 730183 - RNA, 17 nt, Homo sapiens
gggauagaggaaaggga

SEQ ID NO: 730184 - RNA, 15 nt, Homo sapiens
gggaucacuaaggga

SEQ ID NO: 730185 - RNA, 18 nt, Homo sapiens
gggaucuggcacacuccc

SEQ ID NO: 730186 - RNA, 22 nt, Homo sapiens
gggaugggcucccacccucccc

SEQ ID NO: 730187 - RNA, 18 nt, Homo sapiens
gggauggggccaucuccu

SEQ ID NO: 730188 - RNA, 17 nt, Homo sapiens
gggauugcuuugcauua

SEQ ID NO: 730189 - RNA, 22 nt, Homo sapiens
gggcaaaugacaugcacugacc

SEQ ID NO: 730190 - RNA, 14 nt, Homo sapiens
gggcaacaacagca

SEQ ID NO: 730191 - RNA, 21 nt, Homo sapiens
gggcaacaauacaugcugcua

SEQ ID NO: 730192 - RNA, 17 nt, Homo sapiens
gggcaacagagcaagau

SEQ ID NO: 730193 - RNA, 18 nt, Homo sapiens
gggcaagagaugggacaa

SEQ ID NO: 730194 - RNA, 16 nt, Homo sapiens
gggcaauaccagugac

SEQ ID NO: 730195 - RNA, 21 nt, Homo sapiens
gggcaccuuccgacaucccag

SEQ ID NO: 730196 - RNA, 19 nt, Homo sapiens
gggcacugagcccuuccca

SEQ ID NO: 730197 - RNA, 16 nt, Homo sapiens
gggcagaugggcggac

SEQ ID NO: 730198 - RNA, 21 nt, Homo sapiens
gggcaggcaagguuuacacug

SEQ ID NO: 730199 - RNA, 20 nt, Homo sapiens
gggcagggaggcaacacugc

SEQ ID NO: 730200 - RNA, 15 nt, Homo sapiens
gggcagggccacuca

SEQ ID NO: 730201 - RNA, 14 nt, Homo sapiens
gggcagugcccaug

SEQ ID NO: 730202 - RNA, 21 nt, Homo sapiens
gggcauccuggaugauuucau

SEQ ID NO: 730203 - RNA, 22 nt, Homo sapiens
gggcaugcuggggcaagucccu

SEQ ID NO: 730204 - RNA, 12 nt, Homo sapiens
gggcauugccau

SEQ ID NO: 730205 - RNA, 16 nt, Homo sapiens
gggccacaaggcacag

SEQ ID NO: 730206 - RNA, 20 nt, Homo sapiens
gggccacccaaauguguaca

SEQ ID NO: 730207 - RNA, 14 nt, Homo sapiens
gggccacuggggac

SEQ ID NO: 730208 - RNA, 12 nt, Homo sapiens
gggccagagcca

SEQ ID NO: 730209 - RNA, 23 nt, Homo sapiens
gggccagcuuuuccucaccagga

SEQ ID NO: 730210 - RNA, 11 nt, Homo sapiens
gggccagugaa

SEQ ID NO: 730211 - RNA, 22 nt, Homo sapiens
gggccaucugacugccaagcca

SEQ ID NO: 730212 - RNA, 16 nt, Homo sapiens
gggccaugccaggcca

SEQ ID NO: 730213 - RNA, 13 nt, Homo sapiens
gggccauggcuca

SEQ ID NO: 730214 - RNA, 19 nt, Homo sapiens
gggccauggcucagggugg

SEQ ID NO: 730215 - RNA, 16 nt, Homo sapiens
gggccauguccaaaga

SEQ ID NO: 730216 - RNA, 14 nt, Homo sapiens
gggcccagagccca

SEQ ID NO: 730217 - RNA, 16 nt, Homo sapiens
gggcccaggaccagcu

SEQ ID NO: 730218 - RNA, 14 nt, Homo sapiens
gggccccacccggg

SEQ ID NO: 730219 - RNA, 16 nt, Homo sapiens
gggcccgaacagggac

SEQ ID NO: 730220 - RNA, 23 nt, Homo sapiens
gggcccucccagcccauugcugc

SEQ ID NO: 730221 - RNA, 22 nt, Homo sapiens
gggcccucuuucccugcgagac

SEQ ID NO: 730222 - RNA, 18 nt, Homo sapiens
gggccuggccaccucucu

SEQ ID NO: 730223 - RNA, 15 nt, Homo sapiens
gggccuguaauccca

SEQ ID NO: 730224 - RNA, 15 nt, Homo sapiens
gggccugucacugau

SEQ ID NO: 730225 - RNA, 21 nt, Homo sapiens
gggccuguucucuuggcugca

SEQ ID NO: 730226 - RNA, 12 nt, Homo sapiens
gggcgcgguggc

SEQ ID NO: 730227 - RNA, 21 nt, Homo sapiens
gggcggcaggaccagccagca

SEQ ID NO: 730228 - RNA, 16 nt, Homo sapiens
gggcggccagugcggc

SEQ ID NO: 730229 - RNA, 16 nt, Homo sapiens
gggcgggccagggugg

SEQ ID NO: 730230 - RNA, 18 nt, Homo sapiens
gggcguggagagcccggc

SEQ ID NO: 730231 - RNA, 17 nt, Homo sapiens
gggcuauagcacacagu

SEQ ID NO: 730232 - RNA, 19 nt, Homo sapiens
gggcucaaggaaagggggu

SEQ ID NO: 730233 - RNA, 16 nt, Homo sapiens
gggcuccuguuucuca

SEQ ID NO: 730234 - RNA, 18 nt, Homo sapiens
gggcugaaagaacaugga

SEQ ID NO: 730235 - RNA, 19 nt, Homo sapiens
gggcugaagacgccacucc

SEQ ID NO: 730236 - RNA, 17 nt, Homo sapiens
gggcugcacauugccug

SEQ ID NO: 730237 - RNA, 15 nt, Homo sapiens
gggcugcagguugca

SEQ ID NO: 730238 - RNA, 13 nt, Homo sapiens
gggcugcauucuu

SEQ ID NO: 730239 - RNA, 14 nt, Homo sapiens
gggcugcccugcca

SEQ ID NO: 730240 - RNA, 13 nt, Homo sapiens
gggcugucuuacc

SEQ ID NO: 730241 - RNA, 11 nt, Homo sapiens
gggcugugauc

SEQ ID NO: 730242 - RNA, 19 nt, Homo sapiens
gggcugugucguagccaag

SEQ ID NO: 730243 - RNA, 14 nt, Homo sapiens
caucaguguuaaaa

SEQ ID NO: 730244 - RNA, 15 nt, Homo sapiens
caucauaacccauga

SEQ ID NO: 730245 - RNA, 17 nt, Homo sapiens
caucauaagaauagcug

SEQ ID NO: 730246 - RNA, 14 nt, Homo sapiens
caucauaagggcac

SEQ ID NO: 730247 - RNA, 14 nt, Homo sapiens
caucauaauggacu

SEQ ID NO: 730248 - RNA, 21 nt, Homo sapiens
caucauaauuacauuccuaac

SEQ ID NO: 730249 - RNA, 18 nt, Homo sapiens
caucauagcaagaccuca

SEQ ID NO: 730250 - RNA, 14 nt, Homo sapiens
caucauauuccaac

SEQ ID NO: 730251 - RNA, 16 nt, Homo sapiens
caucauauuguaugua

SEQ ID NO: 730252 - RNA, 13 nt, Homo sapiens
caucaucacugua

SEQ ID NO: 730253 - RNA, 14 nt, Homo sapiens
caucaucacuguaa

SEQ ID NO: 730254 - RNA, 22 nt, Homo sapiens
caucaugaacuggcuuguacau

SEQ ID NO: 730255 - RNA, 13 nt, Homo sapiens
caucaugcuccac

SEQ ID NO: 730256 - RNA, 22 nt, Homo sapiens
caucauggaggucauacaugca

SEQ ID NO: 730257 - RNA, 15 nt, Homo sapiens
caucauuacugccau

SEQ ID NO: 730258 - RNA, 18 nt, Homo sapiens
caucauuccaaagcuaaa

SEQ ID NO: 730259 - RNA, 13 nt, Homo sapiens
caucauuccuuga

SEQ ID NO: 730260 - RNA, 21 nt, Homo sapiens
caucauuuugagaaugcugac

SEQ ID NO: 730261 - RNA, 16 nt, Homo sapiens
caucauuuuuguaucu

SEQ ID NO: 730262 - RNA, 20 nt, Homo sapiens
cauccaaaguucccuaugaa

SEQ ID NO: 730263 - RNA, 18 nt, Homo sapiens
cauccaaaucuagccaga

SEQ ID NO: 730264 - RNA, 15 nt, Homo sapiens
cauccaacacuggau

SEQ ID NO: 730265 - RNA, 19 nt, Homo sapiens
cauccaacauuaaaagcca

SEQ ID NO: 730266 - RNA, 19 nt, Homo sapiens
cauccaauuuaucaaggaa

SEQ ID NO: 730267 - RNA, 18 nt, Homo sapiens
cauccacaauaaccaaga

SEQ ID NO: 730268 - RNA, 17 nt, Homo sapiens
cauccacauuguuuuaa

SEQ ID NO: 730269 - RNA, 17 nt, Homo sapiens
cauccagaaguuccuca

SEQ ID NO: 730270 - RNA, 13 nt, Homo sapiens
cauccagaggcaa

SEQ ID NO: 730271 - RNA, 18 nt, Homo sapiens
cauccagaguaagugaug

SEQ ID NO: 730272 - RNA, 22 nt, Homo sapiens
cauccaggcuggccagugcugc

SEQ ID NO: 730273 - RNA, 13 nt, Homo sapiens
cauccagugacaa

SEQ ID NO: 730274 - RNA, 17 nt, Homo sapiens
cauccauagcaccucca

SEQ ID NO: 730275 - RNA, 23 nt, Homo sapiens
cauccaugcugugcuguguuauu

SEQ ID NO: 730276 - RNA, 20 nt, Homo sapiens
cauccauuaccuccauccau

SEQ ID NO: 730277 - RNA, 20 nt, Homo sapiens
cauccauucagaaagcauuu

SEQ ID NO: 730278 - RNA, 18 nt, Homo sapiens
caucccacgcuugcuuua

SEQ ID NO: 730279 - RNA, 14 nt, Homo sapiens
cauccccacagcug

SEQ ID NO: 730280 - RNA, 15 nt, Homo sapiens
cauccccacccaguc

SEQ ID NO: 730281 - RNA, 21 nt, Homo sapiens
caucccccaaggaugaaauca

SEQ ID NO: 730282 - RNA, 17 nt, Homo sapiens
caucccgaagccaucac

SEQ ID NO: 730283 - RNA, 19 nt, Homo sapiens
caucccucgggugugcuau

SEQ ID NO: 730284 - RNA, 18 nt, Homo sapiens
caucccugaugucugucu

SEQ ID NO: 730285 - RNA, 23 nt, Homo sapiens
caucccugcagaggaaagacagg

SEQ ID NO: 730286 - RNA, 16 nt, Homo sapiens
caucccuggaugugga

SEQ ID NO: 730287 - RNA, 15 nt, Homo sapiens
caucccuguguccac

SEQ ID NO: 730288 - RNA, 13 nt, Homo sapiens
caugcacacagau

SEQ ID NO: 730289 - RNA, 15 nt, Homo sapiens
caugcagaacaccaa

SEQ ID NO: 730290 - RNA, 21 nt, Homo sapiens
caugcagaacaccaauauuaa

SEQ ID NO: 730291 - RNA, 18 nt, Homo sapiens
caugcagccagccaucaa

SEQ ID NO: 730292 - RNA, 19 nt, Homo sapiens
caugcagccagccaucaaa

SEQ ID NO: 730293 - RNA, 22 nt, Homo sapiens
caugcagcggccugagcaguac

SEQ ID NO: 730294 - RNA, 22 nt, Homo sapiens
caugcagguggugggacacugg

SEQ ID NO: 730295 - RNA, 18 nt, Homo sapiens
caugcagugccggcugcc

SEQ ID NO: 730296 - RNA, 21 nt, Homo sapiens
caugcauggauggguccucac

SEQ ID NO: 730297 - RNA, 21 nt, Homo sapiens
caugcauuuugcagcagugag

SEQ ID NO: 730298 - RNA, 16 nt, Homo sapiens
caugccacaaggacuu

SEQ ID NO: 730299 - RNA, 18 nt, Homo sapiens
caugccagacccacugaa

SEQ ID NO: 730300 - RNA, 14 nt, Homo sapiens
caugccaugaauga

SEQ ID NO: 730301 - RNA, 12 nt, Homo sapiens
caugcccugugu

SEQ ID NO: 730302 - RNA, 16 nt, Homo sapiens
caugcccuguguggcu

SEQ ID NO: 730303 - RNA, 18 nt, Homo sapiens
caugccgggcgcaguggc

SEQ ID NO: 730304 - RNA, 20 nt, Homo sapiens
caugccugaggucuaccccu

SEQ ID NO: 730305 - RNA, 17 nt, Homo sapiens
caugccuguagucccag

SEQ ID NO: 730306 - RNA, 16 nt, Homo sapiens
caugcguccuggucaa

SEQ ID NO: 730307 - RNA, 24 nt, Homo sapiens
caugcuacagaaagcugcuugcca

SEQ ID NO: 730308 - RNA, 15 nt, Homo sapiens
caugcuacaguuauu

SEQ ID NO: 730309 - RNA, 20 nt, Homo sapiens
caugcuccacuauuuuauua

SEQ ID NO: 730310 - RNA, 16 nt, Homo sapiens
caugcucuuaaaacuu

SEQ ID NO: 730311 - RNA, 19 nt, Homo sapiens
caugcugcccagccacucc

SEQ ID NO: 730312 - RNA, 22 nt, Homo sapiens
caugcugcuaauucaaagcucu

SEQ ID NO: 730313 - RNA, 22 nt, Homo sapiens
caugcugcuggggaagacagug

SEQ ID NO: 730314 - RNA, 20 nt, Homo sapiens
caugcugcuuuuuggcacag

SEQ ID NO: 730315 - RNA, 12 nt, Homo sapiens
caugcuggugaa

SEQ ID NO: 730316 - RNA, 21 nt, Homo sapiens
caugcuuagucacugccugca

SEQ ID NO: 730317 - RNA, 17 nt, Homo sapiens
caugcuugacauaccua

SEQ ID NO: 730318 - RNA, 21 nt, Homo sapiens
caugcuuugaaguuucuggaa

SEQ ID NO: 730319 - RNA, 16 nt, Homo sapiens
caugcuuuuacuuuau

SEQ ID NO: 730320 - RNA, 14 nt, Homo sapiens
caugcuuuucugcc

SEQ ID NO: 730321 - RNA, 21 nt, Homo sapiens
cauggaacucauuccugccug

SEQ ID NO: 730322 - RNA, 13 nt, Homo sapiens
cauggacauuuag

SEQ ID NO: 730323 - RNA, 15 nt, Homo sapiens
cauggagaaacccug

SEQ ID NO: 730324 - RNA, 20 nt, Homo sapiens
cauggagaaucugcugcaua

SEQ ID NO: 730325 - RNA, 16 nt, Homo sapiens
cauggaggccaagaac

SEQ ID NO: 730326 - RNA, 18 nt, Homo sapiens
cauggaggccaagaacuu

SEQ ID NO: 730327 - RNA, 16 nt, Homo sapiens
cauggaucugaucugu

SEQ ID NO: 730328 - RNA, 13 nt, Homo sapiens
cauggaugcaugc

SEQ ID NO: 730329 - RNA, 21 nt, Homo sapiens
cauggcaagucaguggggaca

SEQ ID NO: 730330 - RNA, 23 nt, Homo sapiens
cauggcaccuuuugcacauaaca

SEQ ID NO: 730331 - RNA, 15 nt, Homo sapiens
cauggcagaagucaa

SEQ ID NO: 730332 - RNA, 17 nt, Homo sapiens
cauggcauauuuuucac

SEQ ID NO: 730333 - RNA, 16 nt, Homo sapiens
cauggcccaaauccag

SEQ ID NO: 730334 - RNA, 15 nt, Homo sapiens
cauggcuaaauacaa

SEQ ID NO: 730335 - RNA, 20 nt, Homo sapiens
cauggcuccagaaaugucua

SEQ ID NO: 730336 - RNA, 23 nt, Homo sapiens
cauggcucuggcacaguguaauc

SEQ ID NO: 730337 - RNA, 19 nt, Homo sapiens
caugggacuaaaugaacua

SEQ ID NO: 730338 - RNA, 21 nt, Homo sapiens
caugggcaccaaccugcauuu

SEQ ID NO: 730339 - RNA, 14 nt, Homo sapiens
cauggggucccugc

SEQ ID NO: 730340 - RNA, 24 nt, Homo sapiens
caugggguuugguugugcugauag

SEQ ID NO: 730341 - RNA, 18 nt, Homo sapiens
cauggguccuugaugcca

SEQ ID NO: 730342 - RNA, 19 nt, Homo sapiens
cauggguggagggucccua

SEQ ID NO: 730343 - RNA, 19 nt, Homo sapiens
cauggguggcacucagucu

SEQ ID NO: 730344 - RNA, 20 nt, Homo sapiens
caugguaaaaccccaucucu

SEQ ID NO: 730345 - RNA, 12 nt, Homo sapiens
caugguacaaac

SEQ ID NO: 730346 - RNA, 21 nt, Homo sapiens
cauggugaaacccccaucucu

SEQ ID NO: 730347 - RNA, 20 nt, Homo sapiens
cauggugaaaccccgucucu

SEQ ID NO: 730348 - RNA, 13 nt, Homo sapiens
cauggugacauug

SEQ ID NO: 730349 - RNA, 21 nt, Homo sapiens
cauggugccccaggaccagcu

SEQ ID NO: 730350 - RNA, 22 nt, Homo sapiens
caugguggcucacgccuguaau

SEQ ID NO: 730351 - RNA, 20 nt, Homo sapiens
cauggugggagagacuguga

SEQ ID NO: 730352 - RNA, 15 nt, Homo sapiens
cauggugguggacac

SEQ ID NO: 730353 - RNA, 20 nt, Homo sapiens
caugguggugugugccugua

SEQ ID NO: 730354 - RNA, 19 nt, Homo sapiens
cauggugugaguccaaaga

SEQ ID NO: 730355 - RNA, 15 nt, Homo sapiens
caugguuauugauga

SEQ ID NO: 730356 - RNA, 16 nt, Homo sapiens
cauguaagccaaguca

SEQ ID NO: 730357 - RNA, 22 nt, Homo sapiens
cauguaauauaaagauguuaaa

SEQ ID NO: 730358 - RNA, 19 nt, Homo sapiens
cauguaauuaaguacuaug

SEQ ID NO: 730359 - RNA, 13 nt, Homo sapiens
gaggaucacugga

SEQ ID NO: 730360 - RNA, 18 nt, Homo sapiens
gaggaucauuugagcuca

SEQ ID NO: 730361 - RNA, 12 nt, Homo sapiens
gaggaugcucuu

SEQ ID NO: 730362 - RNA, 18 nt, Homo sapiens
gaggauggccuggauuca

SEQ ID NO: 730363 - RNA, 19 nt, Homo sapiens
gaggaugguuugagcucag

SEQ ID NO: 730364 - RNA, 14 nt, Homo sapiens
gaggauuucuggga

SEQ ID NO: 730365 - RNA, 18 nt, Homo sapiens
gaggcaaagcuggcucac

SEQ ID NO: 730366 - RNA, 15 nt, Homo sapiens
gaggcaagaaaagga

SEQ ID NO: 730367 - RNA, 19 nt, Homo sapiens
gaggcaagugugggccacu

SEQ ID NO: 730368 - RNA, 21 nt, Homo sapiens
gaggcaagugugggggguccu

SEQ ID NO: 730369 - RNA, 23 nt, Homo sapiens
gaggcacgcaccacugcuuccca

SEQ ID NO: 730370 - RNA, 12 nt, Homo sapiens
gaggcacuucca

SEQ ID NO: 730371 - RNA, 18 nt, Homo sapiens
gaggcagacagcagcuca

SEQ ID NO: 730372 - RNA, 20 nt, Homo sapiens
gaggcagaggcugcauugag

SEQ ID NO: 730373 - RNA, 20 nt, Homo sapiens
gaggcagagguugcagugaa

SEQ ID NO: 730374 - RNA, 22 nt, Homo sapiens
gaggcagccgaggccuggccaa

SEQ ID NO: 730375 - RNA, 23 nt, Homo sapiens
gaggcagcgugaaagcagaugag

SEQ ID NO: 730376 - RNA, 15 nt, Homo sapiens
gaggcaggcauuccu

SEQ ID NO: 730377 - RNA, 16 nt, Homo sapiens
gaggcagguauuagaa

SEQ ID NO: 730378 - RNA, 13 nt, Homo sapiens
gaggcaggugaga

SEQ ID NO: 730379 - RNA, 13 nt, Homo sapiens
gaggcagugacag

SEQ ID NO: 730380 - RNA, 20 nt, Homo sapiens
gaggcaucaguugcuauaua

SEQ ID NO: 730381 - RNA, 21 nt, Homo sapiens
gaggcaugguguguggugcua

SEQ ID NO: 730382 - RNA, 15 nt, Homo sapiens
gaggcauucuucuaa

SEQ ID NO: 730383 - RNA, 14 nt, Homo sapiens
gaggccacccagag

SEQ ID NO: 730384 - RNA, 21 nt, Homo sapiens
gaggccagggcagcaagggac

SEQ ID NO: 730385 - RNA, 12 nt, Homo sapiens
gaggccaucuca

SEQ ID NO: 730386 - RNA, 16 nt, Homo sapiens
gaggcccagcugcuca

SEQ ID NO: 730387 - RNA, 21 nt, Homo sapiens
gaggcccccuggugugucuga

SEQ ID NO: 730388 - RNA, 19 nt, Homo sapiens
gaggcccugagacagggau

SEQ ID NO: 730389 - RNA, 18 nt, Homo sapiens
gaggcccugcccaaugag

SEQ ID NO: 730390 - RNA, 22 nt, Homo sapiens
gaggccgaaggugccucagacu

SEQ ID NO: 730391 - RNA, 16 nt, Homo sapiens
gaggccggaaucucag

SEQ ID NO: 730392 - RNA, 17 nt, Homo sapiens
gaggccgggcgcagugg

SEQ ID NO: 730393 - RNA, 16 nt, Homo sapiens
gaggccucucauucca

SEQ ID NO: 730394 - RNA, 19 nt, Homo sapiens
gaggcggagaauugcuuga

SEQ ID NO: 730395 - RNA, 21 nt, Homo sapiens
gaggcggaucaucuaauucuc

SEQ ID NO: 730396 - RNA, 19 nt, Homo sapiens
gaggcucccaaucagcuuu

SEQ ID NO: 730397 - RNA, 22 nt, Homo sapiens
gaggcugaggcagaaggauuac

SEQ ID NO: 730398 - RNA, 18 nt, Homo sapiens
gaggcugaggcgggugga

SEQ ID NO: 730399 - RNA, 16 nt, Homo sapiens
gaggcugccccucuca

SEQ ID NO: 730400 - RNA, 18 nt, Homo sapiens
gaggcugccccucucacc

SEQ ID NO: 730401 - RNA, 17 nt, Homo sapiens
gaggcugucacaguccu

SEQ ID NO: 730402 - RNA, 12 nt, Homo sapiens
gaggcugugauu

SEQ ID NO: 730403 - RNA, 15 nt, Homo sapiens
gaggcuguucccacc

SEQ ID NO: 730404 - RNA, 12 nt, Homo sapiens
gaggcuuggaaa

SEQ ID NO: 730405 - RNA, 23 nt, Homo sapiens
gaggcuuucuccaggaggauuag

SEQ ID NO: 730406 - RNA, 14 nt, Homo sapiens
gagggaaaaugagu

SEQ ID NO: 730407 - RNA, 21 nt, Homo sapiens
gagggaagaaugaacacuccc

SEQ ID NO: 730408 - RNA, 19 nt, Homo sapiens
gagggaagguucuucauga

SEQ ID NO: 730409 - RNA, 18 nt, Homo sapiens
gagggaagugucaugcaa

SEQ ID NO: 730410 - RNA, 18 nt, Homo sapiens
gagggaauccauugaacu

SEQ ID NO: 730411 - RNA, 23 nt, Homo sapiens
gagggacaaacucacucaguaaa

SEQ ID NO: 730412 - RNA, 17 nt, Homo sapiens
gagggacaggcacucca

SEQ ID NO: 730413 - RNA, 14 nt, Homo sapiens
gagggaccuuggag

SEQ ID NO: 730414 - RNA, 14 nt, Homo sapiens
gagggacucaaggg

SEQ ID NO: 730415 - RNA, 14 nt, Homo sapiens
gagggagacugcaa

SEQ ID NO: 730416 - RNA, 15 nt, Homo sapiens
gagggagagggaggu

SEQ ID NO: 730417 - RNA, 12 nt, Homo sapiens
gagggagcugcu

SEQ ID NO: 730418 - RNA, 14 nt, Homo sapiens
gagggauggugccc

SEQ ID NO: 730419 - RNA, 14 nt, Homo sapiens
gagggcagggacca

SEQ ID NO: 730420 - RNA, 14 nt, Homo sapiens
gagggcgccaugca

SEQ ID NO: 730421 - RNA, 21 nt, Homo sapiens
gagggcucaccucuugccuuc

SEQ ID NO: 730422 - RNA, 20 nt, Homo sapiens
gagggcuggcuggccucacc

SEQ ID NO: 730423 - RNA, 13 nt, Homo sapiens
gagggcuguggug

SEQ ID NO: 730424 - RNA, 22 nt, Homo sapiens
gagggcuuccucuagaagccaa

SEQ ID NO: 730425 - RNA, 20 nt, Homo sapiens
gaggggagagagaaccacca

SEQ ID NO: 730426 - RNA, 15 nt, Homo sapiens
gaggggcaacgaaga

SEQ ID NO: 730427 - RNA, 17 nt, Homo sapiens
gagggggaguagccaag

SEQ ID NO: 730428 - RNA, 21 nt, Homo sapiens
gaggguccuuuaguaccugaa

SEQ ID NO: 730429 - RNA, 12 nt, Homo sapiens
gagggugacugu

SEQ ID NO: 730430 - RNA, 21 nt, Homo sapiens
gagggugggaaggaaacaacc

SEQ ID NO: 730431 - RNA, 12 nt, Homo sapiens
gaggucacugga

SEQ ID NO: 730432 - RNA, 20 nt, Homo sapiens
gaggucagaggggacucuga

SEQ ID NO: 730433 - RNA, 18 nt, Homo sapiens
gaggucugauuggcugcu

SEQ ID NO: 730434 - RNA, 15 nt, Homo sapiens
gaggugcagcuggag

SEQ ID NO: 730435 - RNA, 20 nt, Homo sapiens
gagguggagcuugcagugag

SEQ ID NO: 730436 - RNA, 19 nt, Homo sapiens
gagguggagguugcaguga

SEQ ID NO: 730437 - RNA, 15 nt, Homo sapiens
gagguguacagguac

SEQ ID NO: 730438 - RNA, 14 nt, Homo sapiens
gagguuaggaguag

SEQ ID NO: 730439 - RNA, 15 nt, Homo sapiens
gagguuauaggucac

SEQ ID NO: 730440 - RNA, 19 nt, Homo sapiens
gagguucugggccucugaa

SEQ ID NO: 730441 - RNA, 12 nt, Homo sapiens
gagguugcacug

SEQ ID NO: 730442 - RNA, 14 nt, Homo sapiens
gagguuggggacac

SEQ ID NO: 730443 - RNA, 15 nt, Homo sapiens
gaguaaaauucaguu

SEQ ID NO: 730444 - RNA, 12 nt, Homo sapiens
gaguaccuggac

SEQ ID NO: 730445 - RNA, 21 nt, Homo sapiens
gaguagagaggcccgcccgcc

SEQ ID NO: 730446 - RNA, 12 nt, Homo sapiens
gaguauaccucc

SEQ ID NO: 730447 - RNA, 16 nt, Homo sapiens
gaguauuugaacacag

SEQ ID NO: 730448 - RNA, 15 nt, Homo sapiens
gagucagacugucag

SEQ ID NO: 730449 - RNA, 19 nt, Homo sapiens
gagucagcaccuuggccca

SEQ ID NO: 730450 - RNA, 18 nt, Homo sapiens
gagucaggcuucucuugc

SEQ ID NO: 730451 - RNA, 15 nt, Homo sapiens
gagucauaaaccuua

SEQ ID NO: 730452 - RNA, 19 nt, Homo sapiens
gagucauccagcucuugcu

SEQ ID NO: 730453 - RNA, 21 nt, Homo sapiens
gagucauggcuaauuuaacac

SEQ ID NO: 730454 - RNA, 14 nt, Homo sapiens
gaguccaaagaagg

SEQ ID NO: 730455 - RNA, 14 nt, Homo sapiens
gaguccucacuccc

SEQ ID NO: 730456 - RNA, 15 nt, Homo sapiens
gaguccucacuccca

SEQ ID NO: 730457 - RNA, 22 nt, Homo sapiens
gagucucagagcacagagguag

SEQ ID NO: 730458 - RNA, 21 nt, Homo sapiens
gagucucagcccugaccuucu

SEQ ID NO: 730459 - RNA, 15 nt, Homo sapiens
gagucugaacagcug

SEQ ID NO: 730460 - RNA, 16 nt, Homo sapiens
gagucuuaucauuuga

SEQ ID NO: 730461 - RNA, 20 nt, Homo sapiens
gagugacuacacacaguacg

SEQ ID NO: 730462 - RNA, 15 nt, Homo sapiens
gagugagcacucacg

SEQ ID NO: 730463 - RNA, 13 nt, Homo sapiens
gagugagccagug

SEQ ID NO: 730464 - RNA, 14 nt, Homo sapiens
gagugaggagccca

SEQ ID NO: 730465 - RNA, 19 nt, Homo sapiens
gagugaguacaugcacacu

SEQ ID NO: 730466 - RNA, 13 nt, Homo sapiens
gagugaucuuucc

SEQ ID NO: 730467 - RNA, 20 nt, Homo sapiens
gagugaugguucuggcugau

SEQ ID NO: 730468 - RNA, 15 nt, Homo sapiens
gagugauugcagcuu

SEQ ID NO: 730469 - RNA, 17 nt, Homo sapiens
gcagcugggaacugaca

SEQ ID NO: 730470 - RNA, 19 nt, Homo sapiens
gcagcugucagaacacucc

SEQ ID NO: 730471 - RNA, 13 nt, Homo sapiens
gcagcugugcugc

SEQ ID NO: 730472 - RNA, 14 nt, Homo sapiens
gcagcugugcugca

SEQ ID NO: 730473 - RNA, 20 nt, Homo sapiens
gcagcuuuauguucauuugu

SEQ ID NO: 730474 - RNA, 18 nt, Homo sapiens
gcaggaaagggagggaau

SEQ ID NO: 730475 - RNA, 15 nt, Homo sapiens
gcaggaagggagaac

SEQ ID NO: 730476 - RNA, 21 nt, Homo sapiens
gcaggagaaucacuugcacuc

SEQ ID NO: 730477 - RNA, 17 nt, Homo sapiens
gcaggagaauuacuuga

SEQ ID NO: 730478 - RNA, 13 nt, Homo sapiens
gcaggagcuugug

SEQ ID NO: 730479 - RNA, 16 nt, Homo sapiens
gcaggaguauaugagc

SEQ ID NO: 730480 - RNA, 20 nt, Homo sapiens
gcaggaucccuccugagcuc

SEQ ID NO: 730481 - RNA, 20 nt, Homo sapiens
gcaggauuuggcuaugacau

SEQ ID NO: 730482 - RNA, 21 nt, Homo sapiens
gcaggcaagguuuacacugcg

SEQ ID NO: 730483 - RNA, 15 nt, Homo sapiens
gcaggcagccuugac

SEQ ID NO: 730484 - RNA, 22 nt, Homo sapiens
gcaggcaguucuagaagccaca

SEQ ID NO: 730485 - RNA, 15 nt, Homo sapiens
gcaggccacugggga

SEQ ID NO: 730486 - RNA, 18 nt, Homo sapiens
gcaggcccccaggugcca

SEQ ID NO: 730487 - RNA, 18 nt, Homo sapiens
gcaggccucagcaucucc

SEQ ID NO: 730488 - RNA, 21 nt, Homo sapiens
gcaggcuauuuguucagagag

SEQ ID NO: 730489 - RNA, 14 nt, Homo sapiens
gcaggcuccaugca

SEQ ID NO: 730490 - RNA, 20 nt, Homo sapiens
gcaggcucugccagcccugg

SEQ ID NO: 730491 - RNA, 19 nt, Homo sapiens
gcagggaagcucuaccgca

SEQ ID NO: 730492 - RNA, 14 nt, Homo sapiens
gcagggaaugcaau

SEQ ID NO: 730493 - RNA, 15 nt, Homo sapiens
gcagggacuccaugc

SEQ ID NO: 730494 - RNA, 18 nt, Homo sapiens
gcagggagggcuguggug

SEQ ID NO: 730495 - RNA, 16 nt, Homo sapiens
gcagggagugucugca

SEQ ID NO: 730496 - RNA, 20 nt, Homo sapiens
gcagggccuugcccagagau

SEQ ID NO: 730497 - RNA, 23 nt, Homo sapiens
gcagggcucucuguaucagucuu

SEQ ID NO: 730498 - RNA, 13 nt, Homo sapiens
gcagggcugugau

SEQ ID NO: 730499 - RNA, 22 nt, Homo sapiens
gcaggggacaagggaggcagug

SEQ ID NO: 730500 - RNA, 19 nt, Homo sapiens
gcaggggcuugcuuugcag

SEQ ID NO: 730501 - RNA, 14 nt, Homo sapiens
gcaggggugcugug

SEQ ID NO: 730502 - RNA, 16 nt, Homo sapiens
gcaggugcuacaacau

SEQ ID NO: 730503 - RNA, 19 nt, Homo sapiens
gcagguguugggaccugcu

SEQ ID NO: 730504 - RNA, 20 nt, Homo sapiens
gcagguuccuuaucugucac

SEQ ID NO: 730505 - RNA, 21 nt, Homo sapiens
gcagguuccuuaucugucaca

SEQ ID NO: 730506 - RNA, 22 nt, Homo sapiens
gcagguuuguuuucagcacuga

SEQ ID NO: 730507 - RNA, 13 nt, Homo sapiens
gcaguauccagaa

SEQ ID NO: 730508 - RNA, 15 nt, Homo sapiens
gcaguaugauggcag

SEQ ID NO: 730509 - RNA, 13 nt, Homo sapiens
gcagucacuggag

SEQ ID NO: 730510 - RNA, 22 nt, Homo sapiens
gcagucagcccuuauggccaau

SEQ ID NO: 730511 - RNA, 22 nt, Homo sapiens
gcagucauuaugagaggcaaug

SEQ ID NO: 730512 - RNA, 16 nt, Homo sapiens
gcaguccacaaagcau

SEQ ID NO: 730513 - RNA, 14 nt, Homo sapiens
gcaguccucaggaa

SEQ ID NO: 730514 - RNA, 12 nt, Homo sapiens
gcaguccuuugu

SEQ ID NO: 730515 - RNA, 21 nt, Homo sapiens
gcaguccuuuguaaacagugu

SEQ ID NO: 730516 - RNA, 13 nt, Homo sapiens
gcagugaaguaua

SEQ ID NO: 730517 - RNA, 15 nt, Homo sapiens
gcagugacccaucug

SEQ ID NO: 730518 - RNA, 21 nt, Homo sapiens
gcagugagcugauaucaugcc

SEQ ID NO: 730519 - RNA, 21 nt, Homo sapiens
gcagugagcuguguucuugcc

SEQ ID NO: 730520 - RNA, 15 nt, Homo sapiens
gcagugaucucaggg

SEQ ID NO: 730521 - RNA, 22 nt, Homo sapiens
gcagugaugacuugcuguccag

SEQ ID NO: 730522 - RNA, 12 nt, Homo sapiens
gcagugcaaugc

SEQ ID NO: 730523 - RNA, 15 nt, Homo sapiens
gcagugcaugugaag

SEQ ID NO: 730524 - RNA, 14 nt, Homo sapiens
gcagugccuugcau

SEQ ID NO: 730525 - RNA, 13 nt, Homo sapiens
gcagugcugaggg

SEQ ID NO: 730526 - RNA, 17 nt, Homo sapiens
gcaguggcgcgaucuca

SEQ ID NO: 730527 - RNA, 22 nt, Homo sapiens
gcaguggcgcgaucucagcuca

SEQ ID NO: 730528 - RNA, 17 nt, Homo sapiens
gcaguggcgugaucuca

SEQ ID NO: 730529 - RNA, 14 nt, Homo sapiens
gcaguggugccauc

SEQ ID NO: 730530 - RNA, 22 nt, Homo sapiens
gcaguucuagaagccacagugc

SEQ ID NO: 730531 - RNA, 20 nt, Homo sapiens
gcaguucuggaauggaaggg

SEQ ID NO: 730532 - RNA, 22 nt, Homo sapiens
gcaguugaaacaagaagccaca

SEQ ID NO: 730533 - RNA, 13 nt, Homo sapiens
gcaguugcucagg

SEQ ID NO: 730534 - RNA, 17 nt, Homo sapiens
gcaguuggacucucagg

SEQ ID NO: 730535 - RNA, 19 nt, Homo sapiens
gcaguuggccaagcagaaa

SEQ ID NO: 730536 - RNA, 18 nt, Homo sapiens
gcaguuggccaggcucuu

SEQ ID NO: 730537 - RNA, 17 nt, Homo sapiens
gcaguugggaggaggaa

SEQ ID NO: 730538 - RNA, 19 nt, Homo sapiens
gcaguuucugacacuuguu

SEQ ID NO: 730539 - RNA, 23 nt, Homo sapiens
gcaguuucugacacuuguuguug

SEQ ID NO: 730540 - RNA, 21 nt, Homo sapiens
gcaguuugguccuggggacca

SEQ ID NO: 730541 - RNA, 13 nt, Homo sapiens
gcaguuuuuccca

SEQ ID NO: 730542 - RNA, 15 nt, Homo sapiens
gcaguuuuucccaag

SEQ ID NO: 730543 - RNA, 15 nt, Homo sapiens
gcauaaaagacuuuu

SEQ ID NO: 730544 - RNA, 13 nt, Homo sapiens
gcauaaccugucu

SEQ ID NO: 730545 - RNA, 16 nt, Homo sapiens
gcauaaguuucuggga

SEQ ID NO: 730546 - RNA, 23 nt, Homo sapiens
gcauacagacuggggacccugga

SEQ ID NO: 730547 - RNA, 22 nt, Homo sapiens
gcauaccaauuacccauaaaca

SEQ ID NO: 730548 - RNA, 19 nt, Homo sapiens
gcauacuuugacaaggaaa

SEQ ID NO: 730549 - RNA, 14 nt, Homo sapiens
gcauagauuugcag

SEQ ID NO: 730550 - RNA, 16 nt, Homo sapiens
gcauagauuugcagcu

SEQ ID NO: 730551 - RNA, 15 nt, Homo sapiens
gcauagcagaccaca

SEQ ID NO: 730552 - RNA, 20 nt, Homo sapiens
gcauagcaguauauguuaau

SEQ ID NO: 730553 - RNA, 14 nt, Homo sapiens
gcauaggcucuuaa

SEQ ID NO: 730554 - RNA, 18 nt, Homo sapiens
gcauagguuuagcaguau

SEQ ID NO: 730555 - RNA, 13 nt, Homo sapiens
gcauaguccaaaa

SEQ ID NO: 730556 - RNA, 13 nt, Homo sapiens
gcauauacaguga

SEQ ID NO: 730557 - RNA, 17 nt, Homo sapiens
gcauaugauagaugaca

SEQ ID NO: 730558 - RNA, 20 nt, Homo sapiens
gcauaugcagccaaccaaga

SEQ ID NO: 730559 - RNA, 12 nt, Homo sapiens
gcauauggugcu

SEQ ID NO: 730560 - RNA, 16 nt, Homo sapiens
gcauauggugcuuaaa

SEQ ID NO: 730561 - RNA, 19 nt, Homo sapiens
gcauauuaauuucuucccc

SEQ ID NO: 730562 - RNA, 13 nt, Homo sapiens
gcauauucauggu

SEQ ID NO: 730563 - RNA, 14 nt, Homo sapiens
gcauauuguauuac

SEQ ID NO: 730564 - RNA, 21 nt, Homo sapiens
gcauauuuauugcauugcugg

SEQ ID NO: 730565 - RNA, 18 nt, Homo sapiens
gcauauuuuaaugcaguu

SEQ ID NO: 730566 - RNA, 21 nt, Homo sapiens
gcaucuaaguuauaagacucu

SEQ ID NO: 730567 - RNA, 15 nt, Homo sapiens
gcaucuacacaauuu

SEQ ID NO: 730568 - RNA, 14 nt, Homo sapiens
gcaucuacacagcc

SEQ ID NO: 730569 - RNA, 12 nt, Homo sapiens
gcaucuacucua

SEQ ID NO: 730570 - RNA, 13 nt, Homo sapiens
gcaucuacucuaa

SEQ ID NO: 730571 - RNA, 12 nt, Homo sapiens
gcaucucaaaaa

SEQ ID NO: 730572 - RNA, 21 nt, Homo sapiens
gcaucucaaaauuauucugcc

SEQ ID NO: 730573 - RNA, 17 nt, Homo sapiens
gcaucucccagcaagac

SEQ ID NO: 730574 - RNA, 18 nt, Homo sapiens
gcaucuccccuagcucac

SEQ ID NO: 730575 - RNA, 19 nt, Homo sapiens
gcaucugaaauaggaaaca

SEQ ID NO: 730576 - RNA, 15 nt, Homo sapiens
gcaucugaccaucug

SEQ ID NO: 730577 - RNA, 12 nt, Homo sapiens
gcaucugcagcc

SEQ ID NO: 730578 - RNA, 15 nt, Homo sapiens
gcaucugugccagag

SEQ ID NO: 730579 - RNA, 15 nt, Homo sapiens
gcaucuucuggagaa

SEQ ID NO: 730580 - RNA, 22 nt, Homo sapiens
gcaucuugcuaugagguuugcu

SEQ ID NO: 730581 - RNA, 21 nt, Homo sapiens
gcaugaaucacugugcucagc

SEQ ID NO: 730582 - RNA, 16 nt, Homo sapiens
gcaugacacuuccaaa

SEQ ID NO: 730583 - RNA, 19 nt, Homo sapiens
gcaugagaaagaauuugag

SEQ ID NO: 730584 - RNA, 22 nt, Homo sapiens
gcaugaggaggucccacuugca

SEQ ID NO: 730585 - RNA, 22 nt, Homo sapiens
gcaugaucuuucugcaggaaau

SEQ ID NO: 730586 - RNA, 13 nt, Homo sapiens
gcaugauggugca

SEQ ID NO: 730587 - RNA, 19 nt, Homo sapiens
gcaugcacagcugcuuguc

SEQ ID NO: 730588 - RNA, 16 nt, Homo sapiens
gcaugcagugcccuca

SEQ ID NO: 730589 - RNA, 21 nt, Homo sapiens
gcaugcauuuugcagcaguga

SEQ ID NO: 730590 - RNA, 13 nt, Homo sapiens
gcaugcugaaugc

SEQ ID NO: 730591 - RNA, 20 nt, Homo sapiens
gcaugcugcccagccacucc

SEQ ID NO: 730592 - RNA, 16 nt, Homo sapiens
gcaugcugcuuugcca

SEQ ID NO: 730593 - RNA, 15 nt, Homo sapiens
gcaugcuucuucuca

SEQ ID NO: 730594 - RNA, 17 nt, Homo sapiens
gcauggaacagcauuac

SEQ ID NO: 730595 - RNA, 15 nt, Homo sapiens
gcauggguccagggc

SEQ ID NO: 730596 - RNA, 15 nt, Homo sapiens
gcaugguaaugaagg

SEQ ID NO: 730597 - RNA, 22 nt, Homo sapiens
gcaugguuuugugccaucugua

SEQ ID NO: 730598 - RNA, 21 nt, Homo sapiens
gcaugucacuucccugcuuaa

SEQ ID NO: 730599 - RNA, 19 nt, Homo sapiens
gcaugugugcaugugcugu

SEQ ID NO: 730600 - RNA, 14 nt, Homo sapiens
gcaugugugugaug

SEQ ID NO: 730601 - RNA, 18 nt, Homo sapiens
gcauguucugugacugaa

SEQ ID NO: 730602 - RNA, 16 nt, Homo sapiens
gcauuaaaacaaagga

SEQ ID NO: 730603 - RNA, 19 nt, Homo sapiens
gcauuagggaaaacuuaau

SEQ ID NO: 730604 - RNA, 13 nt, Homo sapiens
gcauucaaauggg

SEQ ID NO: 730605 - RNA, 15 nt, Homo sapiens
gcauucaaaugggcu

SEQ ID NO: 730606 - RNA, 21 nt, Homo sapiens
gcauucauuucucuugcaaua

SEQ ID NO: 730607 - RNA, 22 nt, Homo sapiens
gcauugccauguggaaggcaag

SEQ ID NO: 730608 - RNA, 21 nt, Homo sapiens
gcauuuacagaaacgcaucca

SEQ ID NO: 730609 - RNA, 12 nt, Homo sapiens
gcauuuacuuuu

SEQ ID NO: 730610 - RNA, 9 nt, Homo sapiens
gcauuucaa

SEQ ID NO: 730611 - RNA, 16 nt, Homo sapiens
gcauuucaccugugac

SEQ ID NO: 730612 - RNA, 15 nt, Homo sapiens
gcauuuccagacuug

SEQ ID NO: 730613 - RNA, 12 nt, Homo sapiens
gcauuucuugcg

SEQ ID NO: 730614 - RNA, 20 nt, Homo sapiens
gcauuuggucucacuacuug

SEQ ID NO: 730615 - RNA, 19 nt, Homo sapiens
gcauuugucuguguuugaa

SEQ ID NO: 730616 - RNA, 19 nt, Homo sapiens
gcauuuucuucucugcacu

SEQ ID NO: 730617 - RNA, 17 nt, Homo sapiens
gcauuuugucaguuuua

SEQ ID NO: 730618 - RNA, 13 nt, Homo sapiens
gccaaaauaccag

SEQ ID NO: 730619 - RNA, 21 nt, Homo sapiens
gccaaaaucccaccacugcac

SEQ ID NO: 730620 - RNA, 23 nt, Homo sapiens
gccaaacagcaagaagcuguuac

SEQ ID NO: 730621 - RNA, 14 nt, Homo sapiens
gccaaaccaagcaa

SEQ ID NO: 730622 - RNA, 20 nt, Homo sapiens
gccaaaguuuucaaacugcu

SEQ ID NO: 730623 - RNA, 20 nt, Homo sapiens
gccaaauguuccauaugugg

SEQ ID NO: 730624 - RNA, 22 nt, Homo sapiens
gccaaccagcccgacagugcca

SEQ ID NO: 730625 - RNA, 20 nt, Homo sapiens
gccaaccauaccuuccuucc

SEQ ID NO: 730626 - RNA, 22 nt, Homo sapiens
gccaacccggcacugcccucag

SEQ ID NO: 730627 - RNA, 14 nt, Homo sapiens
gccaacgagacaca

SEQ ID NO: 730628 - RNA, 15 nt, Homo sapiens
gccaacuacuacugg

SEQ ID NO: 730629 - RNA, 12 nt, Homo sapiens
gccaagacuccu

SEQ ID NO: 730630 - RNA, 20 nt, Homo sapiens
gccaagagccugagugacag

SEQ ID NO: 730631 - RNA, 19 nt, Homo sapiens
gccaagagggcugcaaaag

SEQ ID NO: 730632 - RNA, 17 nt, Homo sapiens
gccaagagguacuguaa

SEQ ID NO: 730633 - RNA, 18 nt, Homo sapiens
gccaagagugaagggaag

SEQ ID NO: 730634 - RNA, 21 nt, Homo sapiens
gccaagauucuacucuuguca

SEQ ID NO: 730635 - RNA, 21 nt, Homo sapiens
gccaagauugcaccacugcuc

SEQ ID NO: 730636 - RNA, 23 nt, Homo sapiens
gccaaggaaacccccaguguaau

SEQ ID NO: 730637 - RNA, 18 nt, Homo sapiens
gccaagggcugagugucc

SEQ ID NO: 730638 - RNA, 16 nt, Homo sapiens
gccaagggggugacug

SEQ ID NO: 730639 - RNA, 13 nt, Homo sapiens
gccaagguaggca

SEQ ID NO: 730640 - RNA, 18 nt, Homo sapiens
gccaaguaagaaagugaa

SEQ ID NO: 730641 - RNA, 15 nt, Homo sapiens
gccaaguacacugag

SEQ ID NO: 730642 - RNA, 22 nt, Homo sapiens
gccaauaacuuuucaccaauga

SEQ ID NO: 730643 - RNA, 18 nt, Homo sapiens
gccaauaauaaaugcccu

SEQ ID NO: 730644 - RNA, 19 nt, Homo sapiens
gccaauaccguguggccca

SEQ ID NO: 730645 - RNA, 22 nt, Homo sapiens
gccaauaccguguggcccaaga

SEQ ID NO: 730646 - RNA, 18 nt, Homo sapiens
gccaaucuucaguauuuu

SEQ ID NO: 730647 - RNA, 18 nt, Homo sapiens
gccaauggagacugucuc

SEQ ID NO: 730648 - RNA, 14 nt, Homo sapiens
gccaauuagcaauu

SEQ ID NO: 730649 - RNA, 14 nt, Homo sapiens
gccacaacccuguu

SEQ ID NO: 730650 - RNA, 15 nt, Homo sapiens
gccacaagucuucca

SEQ ID NO: 730651 - RNA, 19 nt, Homo sapiens
gccacacaaacguuuacuu

SEQ ID NO: 730652 - RNA, 15 nt, Homo sapiens
gccacacagugacuu

SEQ ID NO: 730653 - RNA, 18 nt, Homo sapiens
gccacacccagcggcccc

SEQ ID NO: 730654 - RNA, 21 nt, Homo sapiens
gccacagaccuaggauuucau

SEQ ID NO: 730655 - RNA, 15 nt, Homo sapiens
gccacagagcuacau

SEQ ID NO: 730656 - RNA, 16 nt, Homo sapiens
gccacagcaggacuga

SEQ ID NO: 730657 - RNA, 16 nt, Homo sapiens
gccacagucacuggau

SEQ ID NO: 730658 - RNA, 14 nt, Homo sapiens
gccacagugcaauu

SEQ ID NO: 730659 - RNA, 19 nt, Homo sapiens
gccacauggcggagaguuu

SEQ ID NO: 730660 - RNA, 17 nt, Homo sapiens
gccaccaaagcugccca

SEQ ID NO: 730661 - RNA, 21 nt, Homo sapiens
gcccaggaauuagagaagcug

SEQ ID NO: 730662 - RNA, 17 nt, Homo sapiens
gcccaggcaggucugca

SEQ ID NO: 730663 - RNA, 17 nt, Homo sapiens
gcccagggccaccucuu

SEQ ID NO: 730664 - RNA, 20 nt, Homo sapiens
gcccaggguccugugccugg

SEQ ID NO: 730665 - RNA, 15 nt, Homo sapiens
gcccaguacauuuaa

SEQ ID NO: 730666 - RNA, 17 nt, Homo sapiens
gcccagucccuggagcu

SEQ ID NO: 730667 - RNA, 19 nt, Homo sapiens
gcccagugcaugguggcca

SEQ ID NO: 730668 - RNA, 19 nt, Homo sapiens
gcccauaucuacaguacuu

SEQ ID NO: 730669 - RNA, 18 nt, Homo sapiens
gcccauaucugugaaaug

SEQ ID NO: 730670 - RNA, 13 nt, Homo sapiens
gcccaucaacugu

SEQ ID NO: 730671 - RNA, 19 nt, Homo sapiens
gcccaugaugagaagcaga

SEQ ID NO: 730672 - RNA, 22 nt, Homo sapiens
gcccauggcuuuagcuaccuca

SEQ ID NO: 730673 - RNA, 23 nt, Homo sapiens
gcccauggcuuuagcuaccucac

SEQ ID NO: 730674 - RNA, 13 nt, Homo sapiens
gccccacaugucc

SEQ ID NO: 730675 - RNA, 22 nt, Homo sapiens
gccccacugacacccagugucc

SEQ ID NO: 730676 - RNA, 12 nt, Homo sapiens
gccccacuuuga

SEQ ID NO: 730677 - RNA, 13 nt, Homo sapiens
gccccacuuugaa

SEQ ID NO: 730678 - RNA, 18 nt, Homo sapiens
gccccagaaggcagggaa

SEQ ID NO: 730679 - RNA, 20 nt, Homo sapiens
gccccagacgcauagacuga

SEQ ID NO: 730680 - RNA, 18 nt, Homo sapiens
gccccagacugagcucuc

SEQ ID NO: 730681 - RNA, 21 nt, Homo sapiens
gccccaggcucguggacugag

SEQ ID NO: 730682 - RNA, 18 nt, Homo sapiens
gccccagggaucacuggc

SEQ ID NO: 730683 - RNA, 22 nt, Homo sapiens
gccccagugccaagcacagugc

SEQ ID NO: 730684 - RNA, 20 nt, Homo sapiens
gccccagugcgguuccucau

SEQ ID NO: 730685 - RNA, 21 nt, Homo sapiens
gccccaugacuugaugcaguu

SEQ ID NO: 730686 - RNA, 22 nt, Homo sapiens
gcccccacagcaccuccaugug

SEQ ID NO: 730687 - RNA, 17 nt, Homo sapiens
gcccccaccccucgggg

SEQ ID NO: 730688 - RNA, 20 nt, Homo sapiens
gcccccauacuuggcugcuu

SEQ ID NO: 730689 - RNA, 14 nt, Homo sapiens
gccccccacuuuuu

SEQ ID NO: 730690 - RNA, 19 nt, Homo sapiens
gcccccgacggcugugacg

SEQ ID NO: 730691 - RNA, 16 nt, Homo sapiens
gcccccgccacaaccc

SEQ ID NO: 730692 - RNA, 14 nt, Homo sapiens
gcccccgcuguguc

SEQ ID NO: 730693 - RNA, 16 nt, Homo sapiens
gcccccuccucuccca

SEQ ID NO: 730694 - RNA, 17 nt, Homo sapiens
gccccggccuccucgga

SEQ ID NO: 730695 - RNA, 18 nt, Homo sapiens
gccccgggaugcaccggu

SEQ ID NO: 730696 - RNA, 16 nt, Homo sapiens
gccccuacccuggacu

SEQ ID NO: 730697 - RNA, 13 nt, Homo sapiens
gccccuacugcug

SEQ ID NO: 730698 - RNA, 14 nt, Homo sapiens
gccccuccagcaca

SEQ ID NO: 730699 - RNA, 22 nt, Homo sapiens
gccccuccuagacccaggugga

SEQ ID NO: 730700 - RNA, 17 nt, Homo sapiens
gccccucggcucuggag

SEQ ID NO: 730701 - RNA, 19 nt, Homo sapiens
gccccugacuuaacuuuaa

SEQ ID NO: 730702 - RNA, 16 nt, Homo sapiens
gccccugagcccagag

SEQ ID NO: 730703 - RNA, 17 nt, Homo sapiens
gccccugccccaagucc

SEQ ID NO: 730704 - RNA, 18 nt, Homo sapiens
gccccuggucaagugcug

SEQ ID NO: 730705 - RNA, 15 nt, Homo sapiens
gccccuuuucuuugg

SEQ ID NO: 730706 - RNA, 22 nt, Homo sapiens
gcccgcagugcugggaccagag

SEQ ID NO: 730707 - RNA, 15 nt, Homo sapiens
gcccgccaccuguga

SEQ ID NO: 730708 - RNA, 18 nt, Homo sapiens
gcccggcgccgggcacca

SEQ ID NO: 730709 - RNA, 13 nt, Homo sapiens
gcccggcugugau

SEQ ID NO: 730710 - RNA, 19 nt, Homo sapiens
gcccggcugugauugcugc

SEQ ID NO: 730711 - RNA, 17 nt, Homo sapiens
gcccuaaccccuuccag

SEQ ID NO: 730712 - RNA, 21 nt, Homo sapiens
gcccuaaccccuuccagauca

SEQ ID NO: 730713 - RNA, 13 nt, Homo sapiens
gcccuaaucucac

SEQ ID NO: 730714 - RNA, 16 nt, Homo sapiens
gcccuacucccugcag

SEQ ID NO: 730715 - RNA, 20 nt, Homo sapiens
gcccucaccacccacuugau

SEQ ID NO: 730716 - RNA, 13 nt, Homo sapiens
gcccucacugcag

SEQ ID NO: 730717 - RNA, 11 nt, Homo sapiens
gcccucaggag

SEQ ID NO: 730718 - RNA, 16 nt, Homo sapiens
gcccuccccagacucc

SEQ ID NO: 730719 - RNA, 21 nt, Homo sapiens
gcccuccccuccggacuggug

SEQ ID NO: 730720 - RNA, 22 nt, Homo sapiens
gcccucccuggcugugagcagc

SEQ ID NO: 730721 - RNA, 14 nt, Homo sapiens
gcccuccgccauuc

SEQ ID NO: 730722 - RNA, 22 nt, Homo sapiens
gcccuccucgggccgaggccca

SEQ ID NO: 730723 - RNA, 14 nt, Homo sapiens
gcccuccugagcac

SEQ ID NO: 730724 - RNA, 20 nt, Homo sapiens
gcccuccuuugccuuccacc

SEQ ID NO: 730725 - RNA, 14 nt, Homo sapiens
gcccucgcugcuuc

SEQ ID NO: 730726 - RNA, 13 nt, Homo sapiens
gcccucuaccuga

SEQ ID NO: 730727 - RNA, 12 nt, Homo sapiens
gcccucucaggu

SEQ ID NO: 730728 - RNA, 18 nt, Homo sapiens
gcccucugaacuugccuu

SEQ ID NO: 730729 - RNA, 16 nt, Homo sapiens
gcccugaggaccucuc

SEQ ID NO: 730730 - RNA, 20 nt, Homo sapiens
gcccugauguguccucaggg

SEQ ID NO: 730731 - RNA, 18 nt, Homo sapiens
gcccugcaccaugcugcu

SEQ ID NO: 730732 - RNA, 16 nt, Homo sapiens
gcccugcaccugugca

SEQ ID NO: 730733 - RNA, 15 nt, Homo sapiens
gcccugcagccagcu

SEQ ID NO: 730734 - RNA, 22 nt, Homo sapiens
gcccugcaugcugcccagccac

SEQ ID NO: 730735 - RNA, 15 nt, Homo sapiens
gcccugccaucuucc

SEQ ID NO: 730736 - RNA, 17 nt, Homo sapiens
gcccugcugaagcugcu

SEQ ID NO: 730737 - RNA, 21 nt, Homo sapiens
gcccuggggcugaucucaggg

SEQ ID NO: 730738 - RNA, 15 nt, Homo sapiens
gcccugggucuugcc

SEQ ID NO: 730739 - RNA, 15 nt, Homo sapiens
gcccuggugcugcca

SEQ ID NO: 730740 - RNA, 19 nt, Homo sapiens
gcccugguguguuuccaga

SEQ ID NO: 730741 - RNA, 13 nt, Homo sapiens
gcccugucaucca

SEQ ID NO: 730742 - RNA, 22 nt, Homo sapiens
gcccuuacuugcuucucuagcu

SEQ ID NO: 730743 - RNA, 20 nt, Homo sapiens
gcccuucuauacccacccag

SEQ ID NO: 730744 - RNA, 15 nt, Homo sapiens
gcccuuuccuuccag

SEQ ID NO: 730745 - RNA, 16 nt, Homo sapiens
gcccuuuccuuccaga

SEQ ID NO: 730746 - RNA, 14 nt, Homo sapiens
gcccuuuucaggaa

SEQ ID NO: 730747 - RNA, 20 nt, Homo sapiens
gccgaaaaggauaugcagua

SEQ ID NO: 730748 - RNA, 12 nt, Homo sapiens
gccgacugccug

SEQ ID NO: 730749 - RNA, 22 nt, Homo sapiens
gccgagaacaccgagcacugaa

SEQ ID NO: 730750 - RNA, 21 nt, Homo sapiens
gccgagauugcgccacugcag

SEQ ID NO: 730751 - RNA, 15 nt, Homo sapiens
ggagucacaucagug

SEQ ID NO: 730752 - RNA, 16 nt, Homo sapiens
ggagucagacauuuua

SEQ ID NO: 730753 - RNA, 23 nt, Homo sapiens
ggaguccaggguggaugaucuca

SEQ ID NO: 730754 - RNA, 16 nt, Homo sapiens
ggagucccuuuggcaa

SEQ ID NO: 730755 - RNA, 23 nt, Homo sapiens
ggagugaggaugucugggccacu

SEQ ID NO: 730756 - RNA, 23 nt, Homo sapiens
ggagugcaguggcaucaucucag

SEQ ID NO: 730757 - RNA, 22 nt, Homo sapiens
ggagugccaggaccagccugua

SEQ ID NO: 730758 - RNA, 20 nt, Homo sapiens
ggagugccugcuguggaccc

SEQ ID NO: 730759 - RNA, 15 nt, Homo sapiens
ggagugguuccugug

SEQ ID NO: 730760 - RNA, 20 nt, Homo sapiens
ggagugucggauccugugag

SEQ ID NO: 730761 - RNA, 22 nt, Homo sapiens
ggaguucaagaccagccugucc

SEQ ID NO: 730762 - RNA, 17 nt, Homo sapiens
ggaguugaaacugcuau

SEQ ID NO: 730763 - RNA, 22 nt, Homo sapiens
ggauaaauauauaaaaaagcca

SEQ ID NO: 730764 - RNA, 21 nt, Homo sapiens
ggauaagggaguccagggugg

SEQ ID NO: 730765 - RNA, 16 nt, Homo sapiens
ggauaauauacuucca

SEQ ID NO: 730766 - RNA, 15 nt, Homo sapiens
ggauacgacacaugc

SEQ ID NO: 730767 - RNA, 17 nt, Homo sapiens
ggauagaggaaagggau

SEQ ID NO: 730768 - RNA, 19 nt, Homo sapiens
ggauaguacuaagcauuuc

SEQ ID NO: 730769 - RNA, 14 nt, Homo sapiens
ggauaucaaaagca

SEQ ID NO: 730770 - RNA, 17 nt, Homo sapiens
ggauaucaaaagcaaau

SEQ ID NO: 730771 - RNA, 18 nt, Homo sapiens
ggauaucaaaggacaaag

SEQ ID NO: 730772 - RNA, 12 nt, Homo sapiens
ggauaugcagua

SEQ ID NO: 730773 - RNA, 18 nt, Homo sapiens
ggauauuaaauguugcuu

SEQ ID NO: 730774 - RNA, 20 nt, Homo sapiens
ggauauuaacaacaauaaca

SEQ ID NO: 730775 - RNA, 13 nt, Homo sapiens
ggauauugacaag

SEQ ID NO: 730776 - RNA, 17 nt, Homo sapiens
ggauauuuuuuacuuua

SEQ ID NO: 730777 - RNA, 19 nt, Homo sapiens
ggaucacuugaguucagga

SEQ ID NO: 730778 - RNA, 21 nt, Homo sapiens
ggaucccugcccuucucaaga

SEQ ID NO: 730779 - RNA, 14 nt, Homo sapiens
ggaucgaguguagc

SEQ ID NO: 730780 - RNA, 14 nt, Homo sapiens
ggaucgaugugcuc

SEQ ID NO: 730781 - RNA, 18 nt, Homo sapiens
ggaucuaucaccugucau

SEQ ID NO: 730782 - RNA, 17 nt, Homo sapiens
ggaucucucuagugaug

SEQ ID NO: 730783 - RNA, 13 nt, Homo sapiens
ggaucugggcugu

SEQ ID NO: 730784 - RNA, 19 nt, Homo sapiens
ggaucuuguaauccagugc

SEQ ID NO: 730785 - RNA, 23 nt, Homo sapiens
ggaugaaucauauucauaugcag

SEQ ID NO: 730786 - RNA, 14 nt, Homo sapiens
ggaugcacauuucu

SEQ ID NO: 730787 - RNA, 16 nt, Homo sapiens
ggaugcggccauucaa

SEQ ID NO: 730788 - RNA, 21 nt, Homo sapiens
ggauggaaagacaaacugcac

SEQ ID NO: 730789 - RNA, 15 nt, Homo sapiens
ggauggccguggaug

SEQ ID NO: 730790 - RNA, 21 nt, Homo sapiens
ggauggggcagucucugccca

SEQ ID NO: 730791 - RNA, 14 nt, Homo sapiens
ggauguaagccugg

SEQ ID NO: 730792 - RNA, 16 nt, Homo sapiens
ggauguaccagcaucu

SEQ ID NO: 730793 - RNA, 12 nt, Homo sapiens
ggaugucucuca

SEQ ID NO: 730794 - RNA, 18 nt, Homo sapiens
ggaugucuuugcugcagu

SEQ ID NO: 730795 - RNA, 10 nt, Homo sapiens
ggaugugaug

SEQ ID NO: 730796 - RNA, 15 nt, Homo sapiens
ggauguguuuugcac

SEQ ID NO: 730797 - RNA, 21 nt, Homo sapiens
ggauguuaugaacagcugugu

SEQ ID NO: 730798 - RNA, 10 nt, Homo sapiens
ggauguugcc

SEQ ID NO: 730799 - RNA, 17 nt, Homo sapiens
ggauuaaccucugcacu

SEQ ID NO: 730800 - RNA, 13 nt, Homo sapiens
ggauuaaugucaa

SEQ ID NO: 730801 - RNA, 14 nt, Homo sapiens
ggauuaauuugcau

SEQ ID NO: 730802 - RNA, 13 nt, Homo sapiens
ggauuacagggau

SEQ ID NO: 730803 - RNA, 21 nt, Homo sapiens
ggauuacaggugugugccacc

SEQ ID NO: 730804 - RNA, 14 nt, Homo sapiens
ggauuacuauugca

SEQ ID NO: 730805 - RNA, 14 nt, Homo sapiens
ggauuagaaugccg

SEQ ID NO: 730806 - RNA, 22 nt, Homo sapiens
ggauuauuaagugauuauuuaa

SEQ ID NO: 730807 - RNA, 18 nt, Homo sapiens
ggauucaacacugugcac

SEQ ID NO: 730808 - RNA, 19 nt, Homo sapiens
ggauuccaaaccaggacac

SEQ ID NO: 730809 - RNA, 14 nt, Homo sapiens
ggauuccacuaucu

SEQ ID NO: 730810 - RNA, 16 nt, Homo sapiens
ggauucugaaucucaa

SEQ ID NO: 730811 - RNA, 13 nt, Homo sapiens
ggauugaggccag

SEQ ID NO: 730812 - RNA, 15 nt, Homo sapiens
ggauugcaaugcccg

SEQ ID NO: 730813 - RNA, 17 nt, Homo sapiens
ggauugcuaugaaugau

SEQ ID NO: 730814 - RNA, 23 nt, Homo sapiens
ggauuguuuaaagaagcucucca

SEQ ID NO: 730815 - RNA, 23 nt, Homo sapiens
ggauuuaucccccgcaaagacau

SEQ ID NO: 730816 - RNA, 14 nt, Homo sapiens
ggauuugcagguga

SEQ ID NO: 730817 - RNA, 13 nt, Homo sapiens
ggauuugcucagg

SEQ ID NO: 730818 - RNA, 23 nt, Homo sapiens
ggauuuuaaguuugggccaguga

SEQ ID NO: 730819 - RNA, 14 nt, Homo sapiens
ggauuuuaccaaag

SEQ ID NO: 730820 - RNA, 14 nt, Homo sapiens
ggauuuuucuuuaa

SEQ ID NO: 730821 - RNA, 23 nt, Homo sapiens
ggauuuuuuguuauguuugcacu

SEQ ID NO: 730822 - RNA, 19 nt, Homo sapiens
ggcugagagaggaagagcu

SEQ ID NO: 730823 - RNA, 14 nt, Homo sapiens
ggcugagugacaca

SEQ ID NO: 730824 - RNA, 21 nt, Homo sapiens
ggcugauuauuaaaguccuuu

SEQ ID NO: 730825 - RNA, 21 nt, Homo sapiens
ggcugcaggcucuaugggguu

SEQ ID NO: 730826 - RNA, 17 nt, Homo sapiens
ggcugccccucucacca

SEQ ID NO: 730827 - RNA, 22 nt, Homo sapiens
ggcugccgagacagacccucug

SEQ ID NO: 730828 - RNA, 19 nt, Homo sapiens
ggcugccucauuuagagag

SEQ ID NO: 730829 - RNA, 14 nt, Homo sapiens
ggcugccuccuuug

SEQ ID NO: 730830 - RNA, 11 nt, Homo sapiens
ggcugccuugu

SEQ ID NO: 730831 - RNA, 18 nt, Homo sapiens
ggcugcgagagaaaggga

SEQ ID NO: 730832 - RNA, 14 nt, Homo sapiens
ggcugcgcacugug

SEQ ID NO: 730833 - RNA, 16 nt, Homo sapiens
ggcugcgcacuguguc

SEQ ID NO: 730834 - RNA, 20 nt, Homo sapiens
ggcugcugccauccaugugc

SEQ ID NO: 730835 - RNA, 14 nt, Homo sapiens
ggcugcuuccugug

SEQ ID NO: 730836 - RNA, 22 nt, Homo sapiens
ggcugcuuccugugacagugaa

SEQ ID NO: 730837 - RNA, 16 nt, Homo sapiens
ggcuggaaggggucca

SEQ ID NO: 730838 - RNA, 15 nt, Homo sapiens
ggcuggagugcagug

SEQ ID NO: 730839 - RNA, 20 nt, Homo sapiens
ggcuggagugcaguggcgcg

SEQ ID NO: 730840 - RNA, 22 nt, Homo sapiens
ggcugggguggggguggggaga

SEQ ID NO: 730841 - RNA, 17 nt, Homo sapiens
ggcugguaacaguucau

SEQ ID NO: 730842 - RNA, 22 nt, Homo sapiens
ggcugguccagggcuagugacu

SEQ ID NO: 730843 - RNA, 22 nt, Homo sapiens
ggcugguguaugcacagggugu

SEQ ID NO: 730844 - RNA, 15 nt, Homo sapiens
ggcugguuaccacca

SEQ ID NO: 730845 - RNA, 20 nt, Homo sapiens
ggcuguauuugcuguugauu

SEQ ID NO: 730846 - RNA, 23 nt, Homo sapiens
ggcugucaggacaccagccuggu

SEQ ID NO: 730847 - RNA, 13 nt, Homo sapiens
ggcuguguguccu

SEQ ID NO: 730848 - RNA, 17 nt, Homo sapiens
ggcuguguugggugguu

SEQ ID NO: 730849 - RNA, 16 nt, Homo sapiens
ggcuguuauucuucca

SEQ ID NO: 730850 - RNA, 15 nt, Homo sapiens
ggcuuaacacaucuc

SEQ ID NO: 730851 - RNA, 21 nt, Homo sapiens
ggcuuaccuguacacugacuu

SEQ ID NO: 730852 - RNA, 18 nt, Homo sapiens
ggcuuaggaaagugauau

SEQ ID NO: 730853 - RNA, 14 nt, Homo sapiens
ggcuuagugccacc

SEQ ID NO: 730854 - RNA, 16 nt, Homo sapiens
ggcuuauccacuuuga

SEQ ID NO: 730855 - RNA, 14 nt, Homo sapiens
ggcuucacauucau

SEQ ID NO: 730856 - RNA, 22 nt, Homo sapiens
ggcuucagugagccaugaucau

SEQ ID NO: 730857 - RNA, 22 nt, Homo sapiens
ggcuucccaaaguccugggauu

SEQ ID NO: 730858 - RNA, 14 nt, Homo sapiens
ggcuucucagcccu

SEQ ID NO: 730859 - RNA, 19 nt, Homo sapiens
ggcuucucuugagucacac

SEQ ID NO: 730860 - RNA, 16 nt, Homo sapiens
ggcuugaaaugcauua

SEQ ID NO: 730861 - RNA, 17 nt, Homo sapiens
ggcuugaagccaaagaa

SEQ ID NO: 730862 - RNA, 20 nt, Homo sapiens
ggcuugaccaggcuuggccu

SEQ ID NO: 730863 - RNA, 10 nt, Homo sapiens
ggcuugacuc

SEQ ID NO: 730864 - RNA, 23 nt, Homo sapiens
ggcuuggagaugaauaggaugau

SEQ ID NO: 730865 - RNA, 15 nt, Homo sapiens
ggcuuggaguggcca

SEQ ID NO: 730866 - RNA, 19 nt, Homo sapiens
ggcuuggccugcugugauu

SEQ ID NO: 730867 - RNA, 15 nt, Homo sapiens
ggcuuuaucucaggg

SEQ ID NO: 730868 - RNA, 12 nt, Homo sapiens
ggcuuuaugcaa

SEQ ID NO: 730869 - RNA, 14 nt, Homo sapiens
gccacuuucugcca

SEQ ID NO: 730870 - RNA, 13 nt, Homo sapiens
gccagaaauugau

SEQ ID NO: 730871 - RNA, 17 nt, Homo sapiens
gccagaaauugauuaag

SEQ ID NO: 730872 - RNA, 19 nt, Homo sapiens
gccagacaugccacaagga

SEQ ID NO: 730873 - RNA, 11 nt, Homo sapiens
gccagaccuca

SEQ ID NO: 730874 - RNA, 18 nt, Homo sapiens
gccagacuggcacaguuu

SEQ ID NO: 730875 - RNA, 22 nt, Homo sapiens
gccagagcccuucacugccaug

SEQ ID NO: 730876 - RNA, 13 nt, Homo sapiens
gccagagccucug

SEQ ID NO: 730877 - RNA, 17 nt, Homo sapiens
gccagaggagaagacaa

SEQ ID NO: 730878 - RNA, 16 nt, Homo sapiens
gccagaugauuguuca

SEQ ID NO: 730879 - RNA, 18 nt, Homo sapiens
gccagaugauuguucaaa

SEQ ID NO: 730880 - RNA, 22 nt, Homo sapiens
gccagauuaccgacacugucac

SEQ ID NO: 730881 - RNA, 17 nt, Homo sapiens
gccagcaaugaugucca

SEQ ID NO: 730882 - RNA, 11 nt, Homo sapiens
gccagcacuuc

SEQ ID NO: 730883 - RNA, 20 nt, Homo sapiens
gccagcaucugcagccacuu

SEQ ID NO: 730884 - RNA, 14 nt, Homo sapiens
gccagccaucaaau

SEQ ID NO: 730885 - RNA, 17 nt, Homo sapiens
gccagccgugaugcuca

SEQ ID NO: 730886 - RNA, 14 nt, Homo sapiens
gccagccucagaag

SEQ ID NO: 730887 - RNA, 17 nt, Homo sapiens
gccagccucagugccac

SEQ ID NO: 730888 - RNA, 13 nt, Homo sapiens
gccagcgggcaca

SEQ ID NO: 730889 - RNA, 15 nt, Homo sapiens
gccagcucaccuuuu

SEQ ID NO: 730890 - RNA, 23 nt, Homo sapiens
gccagcucugaggggaggcaccu

SEQ ID NO: 730891 - RNA, 14 nt, Homo sapiens
gccagcugggccca

SEQ ID NO: 730892 - RNA, 16 nt, Homo sapiens
gccagcugugcacuuu

SEQ ID NO: 730893 - RNA, 21 nt, Homo sapiens
gccagcuuggggccaccaaag

SEQ ID NO: 730894 - RNA, 16 nt, Homo sapiens
gccaggagaccugcuc

SEQ ID NO: 730895 - RNA, 18 nt, Homo sapiens
gccaggagaccugcucuc

SEQ ID NO: 730896 - RNA, 17 nt, Homo sapiens
gccaggcacugcccuuu

SEQ ID NO: 730897 - RNA, 12 nt, Homo sapiens
gccaggcacugu

SEQ ID NO: 730898 - RNA, 14 nt, Homo sapiens
gccaggcacuuuga

SEQ ID NO: 730899 - RNA, 18 nt, Homo sapiens
gccaggccagagggcagu

SEQ ID NO: 730900 - RNA, 17 nt, Homo sapiens
gccaggccugaccucaa

SEQ ID NO: 730901 - RNA, 19 nt, Homo sapiens
gccaggcugcccaucaggg

SEQ ID NO: 730902 - RNA, 18 nt, Homo sapiens
gccaggcuggagugcagu

SEQ ID NO: 730903 - RNA, 19 nt, Homo sapiens
gccaggcuggagugcagug

SEQ ID NO: 730904 - RNA, 20 nt, Homo sapiens
gccaggucccuuucauuugc

SEQ ID NO: 730905 - RNA, 23 nt, Homo sapiens
gccaggugcaaucuacuggaaau

SEQ ID NO: 730906 - RNA, 12 nt, Homo sapiens
gccagguggcca

SEQ ID NO: 730907 - RNA, 20 nt, Homo sapiens
gccagucuaguuccugauga

SEQ ID NO: 730908 - RNA, 16 nt, Homo sapiens
gccagucuugccuagg

SEQ ID NO: 730909 - RNA, 11 nt, Homo sapiens
gccagugacuu

SEQ ID NO: 730910 - RNA, 17 nt, Homo sapiens
gccagugagggcagucc

SEQ ID NO: 730911 - RNA, 17 nt, Homo sapiens
gccagugccagcaccug

SEQ ID NO: 730912 - RNA, 16 nt, Homo sapiens
gccagugggaccccac

SEQ ID NO: 730913 - RNA, 16 nt, Homo sapiens
gccaguguguguuucc

SEQ ID NO: 730914 - RNA, 18 nt, Homo sapiens
gccaguguguguuuccca

SEQ ID NO: 730915 - RNA, 15 nt, Homo sapiens
gccaguuauggcuau

SEQ ID NO: 730916 - RNA, 21 nt, Homo sapiens
gccaguuccucccaucuucag

SEQ ID NO: 730917 - RNA, 16 nt, Homo sapiens
gccaguuuuaccagcg

SEQ ID NO: 730918 - RNA, 20 nt, Homo sapiens
gccauagaggcccaggcacc

SEQ ID NO: 730919 - RNA, 19 nt, Homo sapiens
gccauagucuuaacugguc

SEQ ID NO: 730920 - RNA, 16 nt, Homo sapiens
gccauauaaguuugaa

SEQ ID NO: 730921 - RNA, 17 nt, Homo sapiens
gccaucaaauagugaau

SEQ ID NO: 730922 - RNA, 12 nt, Homo sapiens
gccaucaugccu

SEQ ID NO: 730923 - RNA, 16 nt, Homo sapiens
gccaucaugccugacu

SEQ ID NO: 730924 - RNA, 17 nt, Homo sapiens
gccaucaugccugacua

SEQ ID NO: 730925 - RNA, 16 nt, Homo sapiens
gccauccaaagaaaca

SEQ ID NO: 730926 - RNA, 21 nt, Homo sapiens
gccauccccaccuucaccucg

SEQ ID NO: 730927 - RNA, 15 nt, Homo sapiens
gccauccucacccag

SEQ ID NO: 730928 - RNA, 20 nt, Homo sapiens
gccaucggugaaacuaacag

SEQ ID NO: 730929 - RNA, 17 nt, Homo sapiens
gccaugacaagaacaaa

SEQ ID NO: 730930 - RNA, 23 nt, Homo sapiens
gccaugacaagaacaaagccacu

SEQ ID NO: 730931 - RNA, 21 nt, Homo sapiens
gccaugaucgagccacugcac

SEQ ID NO: 730932 - RNA, 16 nt, Homo sapiens
gccaugauggccuuac

SEQ ID NO: 730933 - RNA, 22 nt, Homo sapiens
gccaugauggccuuacacugaa

SEQ ID NO: 730934 - RNA, 15 nt, Homo sapiens
gccaugcaaugccaa

SEQ ID NO: 730935 - RNA, 21 nt, Homo sapiens
gccaugcagaccucaugccca

SEQ ID NO: 730936 - RNA, 20 nt, Homo sapiens
gccaugcucaggagccacca

SEQ ID NO: 730937 - RNA, 23 nt, Homo sapiens
gccauggaagguucucugugcuc

SEQ ID NO: 730938 - RNA, 17 nt, Homo sapiens
gccauggcaacuuagag

SEQ ID NO: 730939 - RNA, 19 nt, Homo sapiens
gccauggugacauugugga

SEQ ID NO: 730940 - RNA, 13 nt, Homo sapiens
gccauguccaaag

SEQ ID NO: 730941 - RNA, 16 nt, Homo sapiens
gccauguccaaagagg

SEQ ID NO: 730942 - RNA, 18 nt, Homo sapiens
gccauuaugcaaauggag

SEQ ID NO: 730943 - RNA, 16 nt, Homo sapiens
gccauucaacucggaa

SEQ ID NO: 730944 - RNA, 14 nt, Homo sapiens
gccauucacuuccc

SEQ ID NO: 730945 - RNA, 20 nt, Homo sapiens
gccauucucaagcccugcag

SEQ ID NO: 730946 - RNA, 15 nt, Homo sapiens
gccauucugccucag

SEQ ID NO: 730947 - RNA, 14 nt, Homo sapiens
gccauugcacucca

SEQ ID NO: 730948 - RNA, 17 nt, Homo sapiens
gcccaaagaaagagcua

SEQ ID NO: 730949 - RNA, 15 nt, Homo sapiens
gcccaaauccagugu

SEQ ID NO: 730950 - RNA, 14 nt, Homo sapiens
gcccaacagcacuu

SEQ ID NO: 730951 - RNA, 15 nt, Homo sapiens
gcccaacagcacuuu

SEQ ID NO: 730952 - RNA, 15 nt, Homo sapiens
gcccaagaggacuga

SEQ ID NO: 730953 - RNA, 18 nt, Homo sapiens
gcccaagaggacugagac

SEQ ID NO: 730954 - RNA, 16 nt, Homo sapiens
gcccaaggugcugaug

SEQ ID NO: 730955 - RNA, 15 nt, Homo sapiens
gcccaauacagccau

SEQ ID NO: 730956 - RNA, 17 nt, Homo sapiens
gcccacacacacccacu

SEQ ID NO: 730957 - RNA, 13 nt, Homo sapiens
gcccacaucccac

SEQ ID NO: 730958 - RNA, 17 nt, Homo sapiens
gcccaccaucaccaccg

SEQ ID NO: 730959 - RNA, 19 nt, Homo sapiens
gcccacccccaacaggaau

SEQ ID NO: 730960 - RNA, 18 nt, Homo sapiens
gcccacuagagggcccau

SEQ ID NO: 730961 - RNA, 22 nt, Homo sapiens
gcccacucuguaauaguucagu

SEQ ID NO: 730962 - RNA, 22 nt, Homo sapiens
gggcuguccugagcccccugca

SEQ ID NO: 730963 - RNA, 20 nt, Homo sapiens
gggcuuaguauuucucagga

SEQ ID NO: 730964 - RNA, 15 nt, Homo sapiens
gggcuugaagccaaa

SEQ ID NO: 730965 - RNA, 20 nt, Homo sapiens
ggggaagaccaaaguuugca

SEQ ID NO: 730966 - RNA, 17 nt, Homo sapiens
ggggacaagggauuuga

SEQ ID NO: 730967 - RNA, 17 nt, Homo sapiens
ggggaccucgccuguug

SEQ ID NO: 730968 - RNA, 15 nt, Homo sapiens
ggggacugucuuuca

SEQ ID NO: 730969 - RNA, 13 nt, Homo sapiens
ggggagugugagu

SEQ ID NO: 730970 - RNA, 19 nt, Homo sapiens
ggggaucugggcaaggugg

SEQ ID NO: 730971 - RNA, 17 nt, Homo sapiens
ggggaugccuugguuuu

SEQ ID NO: 730972 - RNA, 19 nt, Homo sapiens
ggggcagcgcaugugugca

SEQ ID NO: 730973 - RNA, 15 nt, Homo sapiens
ggggccagauccagc

SEQ ID NO: 730974 - RNA, 13 nt, Homo sapiens
ggggcccacagga

SEQ ID NO: 730975 - RNA, 17 nt, Homo sapiens
ggggcccgaacagggac

SEQ ID NO: 730976 - RNA, 17 nt, Homo sapiens
ggggccgcugggguccg

SEQ ID NO: 730977 - RNA, 18 nt, Homo sapiens
ggggccgggcgcgguggc

SEQ ID NO: 730978 - RNA, 16 nt, Homo sapiens
ggggccuccucaguga

SEQ ID NO: 730979 - RNA, 11 nt, Homo sapiens
ggggccuguuu

SEQ ID NO: 730980 - RNA, 21 nt, Homo sapiens
ggggccuuccuguguggccug

SEQ ID NO: 730981 - RNA, 18 nt, Homo sapiens
ggggccuugggugagugg

SEQ ID NO: 730982 - RNA, 14 nt, Homo sapiens
ggggcgagcacugu

SEQ ID NO: 730983 - RNA, 18 nt, Homo sapiens
ggggcgagcacugugagc

SEQ ID NO: 730984 - RNA, 14 nt, Homo sapiens
ggggcuacugugac

SEQ ID NO: 730985 - RNA, 11 nt, Homo sapiens
ggggcucagaa

SEQ ID NO: 730986 - RNA, 23 nt, Homo sapiens
ggggcuccugaauaucagucacu

SEQ ID NO: 730987 - RNA, 17 nt, Homo sapiens
gggggaaaaguuaguca

SEQ ID NO: 730988 - RNA, 23 nt, Homo sapiens
gggggaagacuuuaaaccaccua

SEQ ID NO: 730989 - RNA, 15 nt, Homo sapiens
gggggagcaccagcg

SEQ ID NO: 730990 - RNA, 18 nt, Homo sapiens
gggggcuagaaaucuguu

SEQ ID NO: 730991 - RNA, 14 nt, Homo sapiens
gggggcugugccaa

SEQ ID NO: 730992 - RNA, 23 nt, Homo sapiens
gggggucccagugggaggggcag

SEQ ID NO: 730993 - RNA, 13 nt, Homo sapiens
gggguagccugag

SEQ ID NO: 730994 - RNA, 20 nt, Homo sapiens
ggggucgucaccaccucucc

SEQ ID NO: 730995 - RNA, 15 nt, Homo sapiens
ggggugcuguggaca

SEQ ID NO: 730996 - RNA, 15 nt, Homo sapiens
ggggugggauuugga

SEQ ID NO: 730997 - RNA, 12 nt, Homo sapiens
ggggugggccac

SEQ ID NO: 730998 - RNA, 19 nt, Homo sapiens
ggguaagaagaaagcaaaa

SEQ ID NO: 730999 - RNA, 21 nt, Homo sapiens
ggguaagaugcuccugguggc

SEQ ID NO: 731000 - RNA, 21 nt, Homo sapiens
ggguaugucuuuaucaaagga

SEQ ID NO: 731001 - RNA, 15 nt, Homo sapiens
ggguauugaaugugg

SEQ ID NO: 731002 - RNA, 13 nt, Homo sapiens
gggucaacaucuu

SEQ ID NO: 731003 - RNA, 17 nt, Homo sapiens
gggucaacauuuccaaa

SEQ ID NO: 731004 - RNA, 19 nt, Homo sapiens
ggguccuuuugacacugcu

SEQ ID NO: 731005 - RNA, 19 nt, Homo sapiens
gggucucacaguguugccc

SEQ ID NO: 731006 - RNA, 20 nt, Homo sapiens
gggucucacaguguugccca

SEQ ID NO: 731007 - RNA, 18 nt, Homo sapiens
gggucucgcagccugaag

SEQ ID NO: 731008 - RNA, 20 nt, Homo sapiens
gggucucgcuuuguugccca

SEQ ID NO: 731009 - RNA, 11 nt, Homo sapiens
gggucucucau

SEQ ID NO: 731010 - RNA, 16 nt, Homo sapiens
gggucugagacugaaa

SEQ ID NO: 731011 - RNA, 20 nt, Homo sapiens
gggucuuggggacuaaccca

SEQ ID NO: 731012 - RNA, 20 nt, Homo sapiens
gggucuuguuucacauuugu

SEQ ID NO: 731013 - RNA, 12 nt, Homo sapiens
gggucuuugugg

SEQ ID NO: 731014 - RNA, 20 nt, Homo sapiens
gggugaccagccacucaaag

SEQ ID NO: 731015 - RNA, 14 nt, Homo sapiens
gggugagccaagga

SEQ ID NO: 731016 - RNA, 17 nt, Homo sapiens
gggugccaaguccuagc

SEQ ID NO: 731017 - RNA, 22 nt, Homo sapiens
gggugccgcugucucugagggg

SEQ ID NO: 731018 - RNA, 21 nt, Homo sapiens
ggguggaaagugcucagugaa

SEQ ID NO: 731019 - RNA, 15 nt, Homo sapiens
ggguggaucaccuga

SEQ ID NO: 731020 - RNA, 21 nt, Homo sapiens
ggguggcccuugcaguucagc

SEQ ID NO: 731021 - RNA, 13 nt, Homo sapiens
ggguggcggugga

SEQ ID NO: 731022 - RNA, 11 nt, Homo sapiens
gggugggagag

SEQ ID NO: 731023 - RNA, 21 nt, Homo sapiens
gggugggaggggcccacagga

SEQ ID NO: 731024 - RNA, 14 nt, Homo sapiens
ggguggggagcaaa

SEQ ID NO: 731025 - RNA, 14 nt, Homo sapiens
gggugggggugcug

SEQ ID NO: 731026 - RNA, 14 nt, Homo sapiens
gguauuauucuguu

SEQ ID NO: 731027 - RNA, 22 nt, Homo sapiens
gguauuuguucaaaauaaugaa

SEQ ID NO: 731028 - RNA, 22 nt, Homo sapiens
gguauuuuuauucaugugaagu

SEQ ID NO: 731029 - RNA, 18 nt, Homo sapiens
ggucaacuugacaccacu

SEQ ID NO: 731030 - RNA, 15 nt, Homo sapiens
ggucaagaaacagcc

SEQ ID NO: 731031 - RNA, 17 nt, Homo sapiens
ggucaccccuccaggaa

SEQ ID NO: 731032 - RNA, 13 nt, Homo sapiens
ggucagcauguac

SEQ ID NO: 731033 - RNA, 21 nt, Homo sapiens
ggucagccugcugugcccaca

SEQ ID NO: 731034 - RNA, 13 nt, Homo sapiens
ggucauacaugca

SEQ ID NO: 731035 - RNA, 14 nt, Homo sapiens
ggucauacaugcau

SEQ ID NO: 731036 - RNA, 15 nt, Homo sapiens
ggucauacaugcaua

SEQ ID NO: 731037 - RNA, 18 nt, Homo sapiens
ggucaucaaacauuugcc

SEQ ID NO: 731038 - RNA, 14 nt, Homo sapiens
ggucaucacuuuga

SEQ ID NO: 731039 - RNA, 19 nt, Homo sapiens
ggucauuuuuauguuauua

SEQ ID NO: 731040 - RNA, 15 nt, Homo sapiens
gguccaccaugcaga

SEQ ID NO: 731041 - RNA, 16 nt, Homo sapiens
gguccagacccacucc

SEQ ID NO: 731042 - RNA, 15 nt, Homo sapiens
ggucccaauuaagaa

SEQ ID NO: 731043 - RNA, 15 nt, Homo sapiens
ggucccccaugccac

SEQ ID NO: 731044 - RNA, 16 nt, Homo sapiens
ggucccccgacugccu

SEQ ID NO: 731045 - RNA, 13 nt, Homo sapiens
ggucccggggcca

SEQ ID NO: 731046 - RNA, 23 nt, Homo sapiens
gguccucacaagccucuucugaa

SEQ ID NO: 731047 - RNA, 13 nt, Homo sapiens
gguccucucugag

SEQ ID NO: 731048 - RNA, 17 nt, Homo sapiens
gguccucuguugcaaac

SEQ ID NO: 731049 - RNA, 21 nt, Homo sapiens
gguccuguuaacgucaucuca

SEQ ID NO: 731050 - RNA, 22 nt, Homo sapiens
gguccuguuaacgucaucucag

SEQ ID NO: 731051 - RNA, 18 nt, Homo sapiens
ggucgucaaugaugaguc

SEQ ID NO: 731052 - RNA, 15 nt, Homo sapiens
ggucguccaagcaaa

SEQ ID NO: 731053 - RNA, 22 nt, Homo sapiens
ggucuaagcaccuuggugcuua

SEQ ID NO: 731054 - RNA, 21 nt, Homo sapiens
ggucucauuuagaacuugcag

SEQ ID NO: 731055 - RNA, 20 nt, Homo sapiens
ggucuccuggaccuugacag

SEQ ID NO: 731056 - RNA, 17 nt, Homo sapiens
ggucucgcagccugaag

SEQ ID NO: 731057 - RNA, 19 nt, Homo sapiens
ggucucuucuuggggccca

SEQ ID NO: 731058 - RNA, 18 nt, Homo sapiens
ggucugauauuaaucaaa

SEQ ID NO: 731059 - RNA, 16 nt, Homo sapiens
ggucugauuucaggau

SEQ ID NO: 731060 - RNA, 14 nt, Homo sapiens
ggucuugacucuaa

SEQ ID NO: 731061 - RNA, 20 nt, Homo sapiens
ggucuuucugaauugcacau

SEQ ID NO: 731062 - RNA, 17 nt, Homo sapiens
ggugaaaauccaucuca

SEQ ID NO: 731063 - RNA, 22 nt, Homo sapiens
ggugaaaccccaucucuaugaa

SEQ ID NO: 731064 - RNA, 18 nt, Homo sapiens
ggugaaacccccaucucu

SEQ ID NO: 731065 - RNA, 22 nt, Homo sapiens
ggugaaagcuacugaaauaagc

SEQ ID NO: 731066 - RNA, 14 nt, Homo sapiens
ggugaaagugcagu

SEQ ID NO: 731067 - RNA, 16 nt, Homo sapiens
ggugaauuauguuucc

SEQ ID NO: 731068 - RNA, 17 nt, Homo sapiens
ggugacacauuacaaag

SEQ ID NO: 731069 - RNA, 14 nt, Homo sapiens
ggugacaccucccc

SEQ ID NO: 731070 - RNA, 16 nt, Homo sapiens
ggugacagcuccggga

SEQ ID NO: 731071 - RNA, 21 nt, Homo sapiens
ggugaccagccacucaaagga

SEQ ID NO: 731072 - RNA, 20 nt, Homo sapiens
ggugaccucuagagcuggag

SEQ ID NO: 731073 - RNA, 19 nt, Homo sapiens
ggugagccgagauugcacc

SEQ ID NO: 731074 - RNA, 17 nt, Homo sapiens
ggugauucgcccaccuc

SEQ ID NO: 731075 - RNA, 14 nt, Homo sapiens
ggugcaaaucaaug

SEQ ID NO: 731076 - RNA, 13 nt, Homo sapiens
ggugcauagcaga

SEQ ID NO: 731077 - RNA, 21 nt, Homo sapiens
ggugcccaaacaccagucacc

SEQ ID NO: 731078 - RNA, 18 nt, Homo sapiens
ggugcccuuugggguccc

SEQ ID NO: 731079 - RNA, 15 nt, Homo sapiens
ggugccgcucucucu

SEQ ID NO: 731080 - RNA, 20 nt, Homo sapiens
ggugccucagacuccgcccu

SEQ ID NO: 731081 - RNA, 12 nt, Homo sapiens
ggugcugagcuu

SEQ ID NO: 731082 - RNA, 20 nt, Homo sapiens
ggugcuggggagccaaaggc

SEQ ID NO: 731083 - RNA, 19 nt, Homo sapiens
ggugcuggguucccacucc

SEQ ID NO: 731084 - RNA, 18 nt, Homo sapiens
ggugcugugguggggaga

SEQ ID NO: 731085 - RNA, 18 nt, Homo sapiens
gguggagacaaaugaggu

SEQ ID NO: 731086 - RNA, 20 nt, Homo sapiens
gguggaucacaaggucaaga

SEQ ID NO: 731087 - RNA, 21 nt, Homo sapiens
gguggaucacgaggucaggag

SEQ ID NO: 731088 - RNA, 21 nt, Homo sapiens
guaaggccaaguacacugaga

SEQ ID NO: 731089 - RNA, 14 nt, Homo sapiens
guaagucauuuaac

SEQ ID NO: 731090 - RNA, 23 nt, Homo sapiens
guaaguuauugaugagagggaaa

SEQ ID NO: 731091 - RNA, 15 nt, Homo sapiens
guaauaaaaagccuc

SEQ ID NO: 731092 - RNA, 21 nt, Homo sapiens
guaauaaaucuaggaugugau

SEQ ID NO: 731093 - RNA, 20 nt, Homo sapiens
guaauaacuucucugugaac

SEQ ID NO: 731094 - RNA, 13 nt, Homo sapiens
guaauaaguaaaa

SEQ ID NO: 731095 - RNA, 18 nt, Homo sapiens
guaauacuucauucucuc

SEQ ID NO: 731096 - RNA, 18 nt, Homo sapiens
guaaucccagcacuuugg

SEQ ID NO: 731097 - RNA, 20 nt, Homo sapiens
guaaucccagcuacuuggga

SEQ ID NO: 731098 - RNA, 23 nt, Homo sapiens
guaaucuaccaguggugcucaau

SEQ ID NO: 731099 - RNA, 16 nt, Homo sapiens
guaaucucagcacuuu

SEQ ID NO: 731100 - RNA, 18 nt, Homo sapiens
guaaucucucugcagcug

SEQ ID NO: 731101 - RNA, 13 nt, Homo sapiens
guaaugcaggacu

SEQ ID NO: 731102 - RNA, 15 nt, Homo sapiens
guaaugucaccaccu

SEQ ID NO: 731103 - RNA, 20 nt, Homo sapiens
guaauguuuuauacuguuua

SEQ ID NO: 731104 - RNA, 17 nt, Homo sapiens
guaauuagcauggcccc

SEQ ID NO: 731105 - RNA, 18 nt, Homo sapiens
guaauuccagcuacucag

SEQ ID NO: 731106 - RNA, 16 nt, Homo sapiens
guaauugccuacaaua

SEQ ID NO: 731107 - RNA, 22 nt, Homo sapiens
guaauuggaaucuucaccucag

SEQ ID NO: 731108 - RNA, 13 nt, Homo sapiens
guaauuuaugcaa

SEQ ID NO: 731109 - RNA, 16 nt, Homo sapiens
guaauuucaaaauaca

SEQ ID NO: 731110 - RNA, 17 nt, Homo sapiens
guaauuuuaaaagucua

SEQ ID NO: 731111 - RNA, 18 nt, Homo sapiens
guaauuuuucuaagcaua

SEQ ID NO: 731112 - RNA, 17 nt, Homo sapiens
guacaaauguaagcaaa

SEQ ID NO: 731113 - RNA, 16 nt, Homo sapiens
guacaauacaauguac

SEQ ID NO: 731114 - RNA, 14 nt, Homo sapiens
guacacaccagaag

SEQ ID NO: 731115 - RNA, 17 nt, Homo sapiens
guacacguguccuguag

SEQ ID NO: 731116 - RNA, 18 nt, Homo sapiens
guacagaaagcugccugg

SEQ ID NO: 731117 - RNA, 15 nt, Homo sapiens
guacagauacuguga

SEQ ID NO: 731118 - RNA, 16 nt, Homo sapiens
guacagauacugugag

SEQ ID NO: 731119 - RNA, 15 nt, Homo sapiens
guacagauucuuuca

SEQ ID NO: 731120 - RNA, 19 nt, Homo sapiens
guacaggaaugaaccuucu

SEQ ID NO: 731121 - RNA, 18 nt, Homo sapiens
guacaguggugagaucac

SEQ ID NO: 731122 - RNA, 21 nt, Homo sapiens
guacaguucugggguacaugu

SEQ ID NO: 731123 - RNA, 15 nt, Homo sapiens
guacauaacuuagag

SEQ ID NO: 731124 - RNA, 15 nt, Homo sapiens
guacaucugcaauau

SEQ ID NO: 731125 - RNA, 13 nt, Homo sapiens
guacaucuuugga

SEQ ID NO: 731126 - RNA, 18 nt, Homo sapiens
guacauucuagcugagaa

SEQ ID NO: 731127 - RNA, 20 nt, Homo sapiens
guacauucuuccaucaucac

SEQ ID NO: 731128 - RNA, 17 nt, Homo sapiens
guacauugggagucugu

SEQ ID NO: 731129 - RNA, 11 nt, Homo sapiens
guacauuucac

SEQ ID NO: 731130 - RNA, 16 nt, Homo sapiens
guacauuugugcucca

SEQ ID NO: 731131 - RNA, 18 nt, Homo sapiens
guaccauauucagcauuu

SEQ ID NO: 731132 - RNA, 21 nt, Homo sapiens
guacccagcgcuaauuuugaa

SEQ ID NO: 731133 - RNA, 15 nt, Homo sapiens
guaccccauggagcu

SEQ ID NO: 731134 - RNA, 22 nt, Homo sapiens
guacccucgcaugacuguuaca

SEQ ID NO: 731135 - RNA, 14 nt, Homo sapiens
guacccuuccaccu

SEQ ID NO: 731136 - RNA, 13 nt, Homo sapiens
guaccgacuuuga

SEQ ID NO: 731137 - RNA, 18 nt, Homo sapiens
guaccuccucucaguguu

SEQ ID NO: 731138 - RNA, 14 nt, Homo sapiens
guaccugaugcuau

SEQ ID NO: 731139 - RNA, 16 nt, Homo sapiens
guaccugguugguccu

SEQ ID NO: 731140 - RNA, 22 nt, Homo sapiens
guaccuucaggcagccagugug

SEQ ID NO: 731141 - RNA, 18 nt, Homo sapiens
guaccuuccuuaagccag

SEQ ID NO: 731142 - RNA, 19 nt, Homo sapiens
guacuacagcuauauuuga

SEQ ID NO: 731143 - RNA, 17 nt, Homo sapiens
guacuaguucagacacu

SEQ ID NO: 731144 - RNA, 19 nt, Homo sapiens
uaacacagagagacagacu

SEQ ID NO: 731145 - RNA, 15 nt, Homo sapiens
uaacacggugcucau

SEQ ID NO: 731146 - RNA, 14 nt, Homo sapiens
uaacacugugaaug

SEQ ID NO: 731147 - RNA, 17 nt, Homo sapiens
uaacacuguuaagagag

SEQ ID NO: 731148 - RNA, 16 nt, Homo sapiens
uaacacuuuguauuac

SEQ ID NO: 731149 - RNA, 16 nt, Homo sapiens
uaacagaaacuuucaa

SEQ ID NO: 731150 - RNA, 15 nt, Homo sapiens
uaacagaccacugua

SEQ ID NO: 731151 - RNA, 19 nt, Homo sapiens
uaacagagcaucaaaaaca

SEQ ID NO: 731152 - RNA, 15 nt, Homo sapiens
uaacagaugcaaugu

SEQ ID NO: 731153 - RNA, 16 nt, Homo sapiens
uaacaggaaaauuuua

SEQ ID NO: 731154 - RNA, 21 nt, Homo sapiens
uaacagggagacugcaucuca

SEQ ID NO: 731155 - RNA, 18 nt, Homo sapiens
uaacaggucuccucuuaa

SEQ ID NO: 731156 - RNA, 16 nt, Homo sapiens
uaacaggugccuuccc

SEQ ID NO: 731157 - RNA, 20 nt, Homo sapiens
uaacaggugcgguuccucau

SEQ ID NO: 731158 - RNA, 22 nt, Homo sapiens
uaacagucaaauaucauuuacu

SEQ ID NO: 731159 - RNA, 14 nt, Homo sapiens
uaacaguucacuuu

SEQ ID NO: 731160 - RNA, 22 nt, Homo sapiens
uaacauaauuuguacauaugua

SEQ ID NO: 731161 - RNA, 21 nt, Homo sapiens
uaacauagauuuaagugaaua

SEQ ID NO: 731162 - RNA, 13 nt, Homo sapiens
uaacaucaaagau

SEQ ID NO: 731163 - RNA, 15 nt, Homo sapiens
uaacaucacugucuu

SEQ ID NO: 731164 - RNA, 12 nt, Homo sapiens
uaacauccagag

SEQ ID NO: 731165 - RNA, 22 nt, Homo sapiens
uaacaucuuuuaauuguuucca

SEQ ID NO: 731166 - RNA, 15 nt, Homo sapiens
uaacaugcaaagauc

SEQ ID NO: 731167 - RNA, 23 nt, Homo sapiens
uaacauggugaaaccccgucucu

SEQ ID NO: 731168 - RNA, 13 nt, Homo sapiens
uaacauguuauca

SEQ ID NO: 731169 - RNA, 17 nt, Homo sapiens
uaacauguuaucaaauc

SEQ ID NO: 731170 - RNA, 15 nt, Homo sapiens
uaacauucaguuccc

SEQ ID NO: 731171 - RNA, 16 nt, Homo sapiens
uaacauuguacuguaa

SEQ ID NO: 731172 - RNA, 17 nt, Homo sapiens
uaacauuuccuuacaga

SEQ ID NO: 731173 - RNA, 18 nt, Homo sapiens
uaacauuucuguucucau

SEQ ID NO: 731174 - RNA, 21 nt, Homo sapiens
uaaccacaaagcacaguuuga

SEQ ID NO: 731175 - RNA, 16 nt, Homo sapiens
uaaccaggauggucuc

SEQ ID NO: 731176 - RNA, 20 nt, Homo sapiens
uaaccaucacugguugcacu

SEQ ID NO: 731177 - RNA, 18 nt, Homo sapiens
uaacccaagacaugacau

SEQ ID NO: 731178 - RNA, 14 nt, Homo sapiens
uaacccaaugccug

SEQ ID NO: 731179 - RNA, 20 nt, Homo sapiens
uaacccaaugccugugaagc

SEQ ID NO: 731180 - RNA, 16 nt, Homo sapiens
uaacccucccauggca

SEQ ID NO: 731181 - RNA, 13 nt, Homo sapiens
uaacccucucuug

SEQ ID NO: 731182 - RNA, 14 nt, Homo sapiens
uaacccuuauucca

SEQ ID NO: 731183 - RNA, 17 nt, Homo sapiens
uaaccgcacaugcacac

SEQ ID NO: 731184 - RNA, 18 nt, Homo sapiens
uaaccuaauaucacuuaa

SEQ ID NO: 731185 - RNA, 19 nt, Homo sapiens
uaaccuaauaucacuuaaa

SEQ ID NO: 731186 - RNA, 14 nt, Homo sapiens
uaaccucaguguca

SEQ ID NO: 731187 - RNA, 22 nt, Homo sapiens
uaaccuugaaaaaaaacagugg

SEQ ID NO: 731188 - RNA, 22 nt, Homo sapiens
uaaccuuguucucugcuugaca

SEQ ID NO: 731189 - RNA, 16 nt, Homo sapiens
uaaccuuugcuaugua

SEQ ID NO: 731190 - RNA, 18 nt, Homo sapiens
uaacgaaugguacuacaa

SEQ ID NO: 731191 - RNA, 14 nt, Homo sapiens
uaacgacuucaggg

SEQ ID NO: 731192 - RNA, 19 nt, Homo sapiens
uaacgacuucuccaucucc

SEQ ID NO: 731193 - RNA, 13 nt, Homo sapiens
uaacgauacaaau

SEQ ID NO: 731194 - RNA, 15 nt, Homo sapiens
uaacgucaucucagg

SEQ ID NO: 731195 - RNA, 15 nt, Homo sapiens
uaacguucugcugcu

SEQ ID NO: 731196 - RNA, 14 nt, Homo sapiens
uaacuaaacuaacg

SEQ ID NO: 731197 - RNA, 14 nt, Homo sapiens
uaacuaacuggcag

SEQ ID NO: 731198 - RNA, 19 nt, Homo sapiens
uaacuacuuuuuauacucc

SEQ ID NO: 731199 - RNA, 21 nt, Homo sapiens
uaacuacuuuuuauacuccau

SEQ ID NO: 731200 - RNA, 17 nt, Homo sapiens
uagaauuauaucacuuc

SEQ ID NO: 731201 - RNA, 18 nt, Homo sapiens
uagaauuaucaagcuuuu

SEQ ID NO: 731202 - RNA, 20 nt, Homo sapiens
uagaauuugggggaaaauuu

SEQ ID NO: 731203 - RNA, 14 nt, Homo sapiens
uagacaaaguacau

SEQ ID NO: 731204 - RNA, 18 nt, Homo sapiens
uagacaaauagaaaaugg

SEQ ID NO: 731205 - RNA, 21 nt, Homo sapiens
uagacagaguugcuuaaugaa

SEQ ID NO: 731206 - RNA, 23 nt, Homo sapiens
uagacagcagggcucucuguauc

SEQ ID NO: 731207 - RNA, 14 nt, Homo sapiens
uagaccccauacaa

SEQ ID NO: 731208 - RNA, 13 nt, Homo sapiens
uagacuagucuca

SEQ ID NO: 731209 - RNA, 23 nt, Homo sapiens
uagacugacuuguuugucuucca

SEQ ID NO: 731210 - RNA, 22 nt, Homo sapiens
uagacugagguauaaagacaag

SEQ ID NO: 731211 - RNA, 16 nt, Homo sapiens
uagacuuccuguaggg

SEQ ID NO: 731212 - RNA, 18 nt, Homo sapiens
uagagaauaccaguguua

SEQ ID NO: 731213 - RNA, 19 nt, Homo sapiens
uagagacagugaugccugc

SEQ ID NO: 731214 - RNA, 16 nt, Homo sapiens
uagagagagaacuuuu

SEQ ID NO: 731215 - RNA, 20 nt, Homo sapiens
uagagagccgccaaacauuc

SEQ ID NO: 731216 - RNA, 23 nt, Homo sapiens
uagagagccugucaccagagcuu

SEQ ID NO: 731217 - RNA, 21 nt, Homo sapiens
uagagaggacaauacuggggu

SEQ ID NO: 731218 - RNA, 20 nt, Homo sapiens
uagagauagcuacaguguaa

SEQ ID NO: 731219 - RNA, 20 nt, Homo sapiens
uagagaucuauguacuguaa

SEQ ID NO: 731220 - RNA, 22 nt, Homo sapiens
uagagauggggucucacagugu

SEQ ID NO: 731221 - RNA, 19 nt, Homo sapiens
uagagaugugucuauggcu

SEQ ID NO: 731222 - RNA, 14 nt, Homo sapiens
uagagcaaccucug

SEQ ID NO: 731223 - RNA, 16 nt, Homo sapiens
uagagcucgccacgaa

SEQ ID NO: 731224 - RNA, 18 nt, Homo sapiens
uagagcugggaaucuuuu

SEQ ID NO: 731225 - RNA, 21 nt, Homo sapiens
uagaggaaggagauagggaaa

SEQ ID NO: 731226 - RNA, 23 nt, Homo sapiens
uagaggaauccauguaaauugca

SEQ ID NO: 731227 - RNA, 18 nt, Homo sapiens
uagaggauagggagaaua

SEQ ID NO: 731228 - RNA, 15 nt, Homo sapiens
uagagguccucaugg

SEQ ID NO: 731229 - RNA, 21 nt, Homo sapiens
uagagguccucaugggucccu

SEQ ID NO: 731230 - RNA, 21 nt, Homo sapiens
uagaguaacacauaacauugu

SEQ ID NO: 731231 - RNA, 19 nt, Homo sapiens
uagagucggccaccacaga

SEQ ID NO: 731232 - RNA, 17 nt, Homo sapiens
uagagugauuuugaaau

SEQ ID NO: 731233 - RNA, 15 nt, Homo sapiens
uagaguggugcugcu

SEQ ID NO: 731234 - RNA, 18 nt, Homo sapiens
uagagugugguuaugaac

SEQ ID NO: 731235 - RNA, 13 nt, Homo sapiens
uagaguguuauca

SEQ ID NO: 731236 - RNA, 15 nt, Homo sapiens
uagaguuccauauau

SEQ ID NO: 731237 - RNA, 16 nt, Homo sapiens
uagauaaacucagaaa

SEQ ID NO: 731238 - RNA, 14 nt, Homo sapiens
uagauacagaauaa

SEQ ID NO: 731239 - RNA, 15 nt, Homo sapiens
uagauauaugcucug

SEQ ID NO: 731240 - RNA, 19 nt, Homo sapiens
uagaucagaagacuacaaa

SEQ ID NO: 731241 - RNA, 17 nt, Homo sapiens
uagaucccaugucaccu

SEQ ID NO: 731242 - RNA, 20 nt, Homo sapiens
uagauccugguuaccacucu

SEQ ID NO: 731243 - RNA, 21 nt, Homo sapiens
uagaucuaguuuagaaaacau

SEQ ID NO: 731244 - RNA, 18 nt, Homo sapiens
uagaucugauggugagcu

SEQ ID NO: 731245 - RNA, 17 nt, Homo sapiens
uagaugauaaaagagaa

SEQ ID NO: 731246 - RNA, 15 nt, Homo sapiens
uagauggaccugccu

SEQ ID NO: 731247 - RNA, 18 nt, Homo sapiens
uagauggguuauuucaac

SEQ ID NO: 731248 - RNA, 17 nt, Homo sapiens
uagauguauauauuucc

SEQ ID NO: 731249 - RNA, 18 nt, Homo sapiens
uagauguguuauuacuuc

SEQ ID NO: 731250 - RNA, 21 nt, Homo sapiens
uagauguuuauucuucuagag

SEQ ID NO: 731251 - RNA, 13 nt, Homo sapiens
uagauuacugaug

SEQ ID NO: 731252 - RNA, 16 nt, Homo sapiens
uagauuacugauguga

SEQ ID NO: 731253 - RNA, 18 nt, Homo sapiens
uagauuacugaugugaua

SEQ ID NO: 731254 - RNA, 21 nt, Homo sapiens
uagauugcaccauugcacucu

SEQ ID NO: 731255 - RNA, 14 nt, Homo sapiens
ugugugccacucag

SEQ ID NO: 731256 - RNA, 14 nt, Homo sapiens
ugugugcuuuccca

SEQ ID NO: 731257 - RNA, 14 nt, Homo sapiens
ugugugggcuguga

SEQ ID NO: 731258 - RNA, 11 nt, Homo sapiens
uguguggugga

SEQ ID NO: 731259 - RNA, 13 nt, Homo sapiens
uguguguacucug

SEQ ID NO: 731260 - RNA, 12 nt, Homo sapiens
uguguguagcca

SEQ ID NO: 731261 - RNA, 13 nt, Homo sapiens
uguguguagccaa

SEQ ID NO: 731262 - RNA, 22 nt, Homo sapiens
uguguguauauaguaugaaugc

SEQ ID NO: 731263 - RNA, 14 nt, Homo sapiens
ugugugugcaagaa

SEQ ID NO: 731264 - RNA, 14 nt, Homo sapiens
ugugugugugcaca

SEQ ID NO: 731265 - RNA, 16 nt, Homo sapiens
uguguguguguauaca

SEQ ID NO: 731266 - RNA, 14 nt, Homo sapiens
uguguuaucucuua

SEQ ID NO: 731267 - RNA, 20 nt, Homo sapiens
uguguucuagaccucugggg

SEQ ID NO: 731268 - RNA, 19 nt, Homo sapiens
uguguucucuauugcugcu

SEQ ID NO: 731269 - RNA, 14 nt, Homo sapiens
uguguucugucacc

SEQ ID NO: 731270 - RNA, 16 nt, Homo sapiens
uguguugcccucugcc

SEQ ID NO: 731271 - RNA, 14 nt, Homo sapiens
uguguuggguugaa

SEQ ID NO: 731272 - RNA, 21 nt, Homo sapiens
uguguuuauauggaagaaagu

SEQ ID NO: 731273 - RNA, 17 nt, Homo sapiens
uguguuuauuucacuug

SEQ ID NO: 731274 - RNA, 18 nt, Homo sapiens
uguguuucaaguggggcu

SEQ ID NO: 731275 - RNA, 16 nt, Homo sapiens
uguguuugguuuccca

SEQ ID NO: 731276 - RNA, 15 nt, Homo sapiens
uguguuuucaaugca

SEQ ID NO: 731277 - RNA, 20 nt, Homo sapiens
uguguuuucccaaagcacuu

SEQ ID NO: 731278 - RNA, 18 nt, Homo sapiens
uguguuuuuaacauguca

SEQ ID NO: 731279 - RNA, 16 nt, Homo sapiens
uguguuuuuucggaca

SEQ ID NO: 731280 - RNA, 20 nt, Homo sapiens
uguuaaaacaaccaguuaaa

SEQ ID NO: 731281 - RNA, 13 nt, Homo sapiens
uguuaaacacgug

SEQ ID NO: 731282 - RNA, 18 nt, Homo sapiens
uguuaaagcaucagagau

SEQ ID NO: 731283 - RNA, 14 nt, Homo sapiens
uguuaaagcuauuu

SEQ ID NO: 731284 - RNA, 15 nt, Homo sapiens
uguuaaauacaggaa

SEQ ID NO: 731285 - RNA, 21 nt, Homo sapiens
uguuaacacucaugaagcaua

SEQ ID NO: 731286 - RNA, 21 nt, Homo sapiens
uguuaacauggacaugaucuu

SEQ ID NO: 731287 - RNA, 21 nt, Homo sapiens
uguuaaccaggauggucucga

SEQ ID NO: 731288 - RNA, 19 nt, Homo sapiens
uguuaaugucauugcuaaa

SEQ ID NO: 731289 - RNA, 23 nt, Homo sapiens
uguuaauucacagaauagcacaa

SEQ ID NO: 731290 - RNA, 13 nt, Homo sapiens
uguuacccacugc

SEQ ID NO: 731291 - RNA, 13 nt, Homo sapiens
uguuaccuacuuu

SEQ ID NO: 731292 - RNA, 18 nt, Homo sapiens
uguuacuuugcuaugugc

SEQ ID NO: 731293 - RNA, 17 nt, Homo sapiens
uguuaggagaagcugca

SEQ ID NO: 731294 - RNA, 14 nt, Homo sapiens
uguuauagcuuuaa

SEQ ID NO: 731295 - RNA, 14 nt, Homo sapiens
uguuauaucaggga

SEQ ID NO: 731296 - RNA, 18 nt, Homo sapiens
uguuaucuuccacuggaa

SEQ ID NO: 731297 - RNA, 12 nt, Homo sapiens
uguuaugugauc

SEQ ID NO: 731298 - RNA, 14 nt, Homo sapiens
uguuauucauuugg

SEQ ID NO: 731299 - RNA, 21 nt, Homo sapiens
uguuauugccucuacuuugau

SEQ ID NO: 731300 - RNA, 23 nt, Homo sapiens
uguuauuuaaagaagaaacgucu

SEQ ID NO: 731301 - RNA, 13 nt, Homo sapiens
uguuauuuacacu

SEQ ID NO: 731302 - RNA, 15 nt, Homo sapiens
uguuauuuagacuca

SEQ ID NO: 731303 - RNA, 20 nt, Homo sapiens
uguuauuuccccagccacag

SEQ ID NO: 731304 - RNA, 14 nt, Homo sapiens
uguucaaggcagug

SEQ ID NO: 731305 - RNA, 12 nt, Homo sapiens
uguucaauguuu

SEQ ID NO: 731306 - RNA, 17 nt, Homo sapiens
uguucagugucccgggc

SEQ ID NO: 731307 - RNA, 15 nt, Homo sapiens
uguucauauguacuu

SEQ ID NO: 731308 - RNA, 17 nt, Homo sapiens
uguucauccucauugcc

SEQ ID NO: 731309 - RNA, 23 nt, Homo sapiens
uguucaucucagcuuuucugucc

SEQ ID NO: 731310 - RNA, 16 nt, Homo sapiens
uguucauggacuauuc

SEQ ID NO: 731311 - RNA, 22 nt, Homo sapiens
uguucaugugauuaacucuuag

SEQ ID NO: 731312 - RNA, 22 nt, Homo sapiens
uguuccaauuugacaaaaccca

SEQ ID NO: 731313 - RNA, 21 nt, Homo sapiens
uguuccacggaaaaugcuauc

SEQ ID NO: 731314 - RNA, 22 nt, Homo sapiens
uguuccagggagcuucuaccug

SEQ ID NO: 731315 - RNA, 22 nt, Homo sapiens
uguuccuaaaaaucuguggcaa

SEQ ID NO: 731316 - RNA, 17 nt, Homo sapiens
uguuccucaagguccau

SEQ ID NO: 731317 - RNA, 17 nt, Homo sapiens
uguuccugaaaauugca

SEQ ID NO: 731318 - RNA, 21 nt, Homo sapiens
uguuccugaauacaagccuau

SEQ ID NO: 731319 - RNA, 19 nt, Homo sapiens
uguuccuugucacugguag

SEQ ID NO: 731320 - RNA, 19 nt, Homo sapiens
uguuccuuugggucuguga

SEQ ID NO: 731321 - RNA, 18 nt, Homo sapiens
uguucggguuaagugaug

SEQ ID NO: 731322 - RNA, 22 nt, Homo sapiens
uguucuaaagguggugaggcaa

SEQ ID NO: 731323 - RNA, 17 nt, Homo sapiens
uguucucgcaaaaacgu

SEQ ID NO: 731324 - RNA, 16 nt, Homo sapiens
uggaauguacucuguu

SEQ ID NO: 731325 - RNA, 15 nt, Homo sapiens
uggaauucuacugga

SEQ ID NO: 731326 - RNA, 17 nt, Homo sapiens
uggaauucuacuggaaa

SEQ ID NO: 731327 - RNA, 19 nt, Homo sapiens
uggacaaaccgagugcaau

SEQ ID NO: 731328 - RNA, 14 nt, Homo sapiens
uggacaaaggaauc

SEQ ID NO: 731329 - RNA, 17 nt, Homo sapiens
uggacacaacaccaaaa

SEQ ID NO: 731330 - RNA, 11 nt, Homo sapiens
uggacacugag

SEQ ID NO: 731331 - RNA, 17 nt, Homo sapiens
uggacacuggugccaug

SEQ ID NO: 731332 - RNA, 16 nt, Homo sapiens
uggacacuugguuaga

SEQ ID NO: 731333 - RNA, 23 nt, Homo sapiens
uggacacuuugaaauguguuucu

SEQ ID NO: 731334 - RNA, 19 nt, Homo sapiens
uggacagguguuguauaua

SEQ ID NO: 731335 - RNA, 18 nt, Homo sapiens
uggacaguuuuaagcaga

SEQ ID NO: 731336 - RNA, 17 nt, Homo sapiens
uggacauaagacagaca

SEQ ID NO: 731337 - RNA, 15 nt, Homo sapiens
uggacaugaaggaaa

SEQ ID NO: 731338 - RNA, 22 nt, Homo sapiens
uggacaugggccagguuuuuca

SEQ ID NO: 731339 - RNA, 12 nt, Homo sapiens
uggaccaaagga

SEQ ID NO: 731340 - RNA, 22 nt, Homo sapiens
uggaccaaaggguuuacuugac

SEQ ID NO: 731341 - RNA, 15 nt, Homo sapiens
uggaccacugcauga

SEQ ID NO: 731342 - RNA, 15 nt, Homo sapiens
uggaccugccuccug

SEQ ID NO: 731343 - RNA, 16 nt, Homo sapiens
uggaccugggcaugac

SEQ ID NO: 731344 - RNA, 20 nt, Homo sapiens
uggacgacacggccucgcag

SEQ ID NO: 731345 - RNA, 13 nt, Homo sapiens
uggacuaagcaau

SEQ ID NO: 731346 - RNA, 15 nt, Homo sapiens
uggacuaugauuauc

SEQ ID NO: 731347 - RNA, 20 nt, Homo sapiens
uggacucccacucuuugaau

SEQ ID NO: 731348 - RNA, 14 nt, Homo sapiens
uggacucucaggga

SEQ ID NO: 731349 - RNA, 15 nt, Homo sapiens
uggacugaccaaaga

SEQ ID NO: 731350 - RNA, 14 nt, Homo sapiens
uggacugcauuuaa

SEQ ID NO: 731351 - RNA, 18 nt, Homo sapiens
uggacuucagucuugccu

SEQ ID NO: 731352 - RNA, 21 nt, Homo sapiens
uggacuuggcaggugccuguu

SEQ ID NO: 731353 - RNA, 22 nt, Homo sapiens
uggagaaaauggguuuauucac

SEQ ID NO: 731354 - RNA, 22 nt, Homo sapiens
uggagaaacuguagucucagga

SEQ ID NO: 731355 - RNA, 14 nt, Homo sapiens
uggagaaagagcug

SEQ ID NO: 731356 - RNA, 22 nt, Homo sapiens
uggagaaagaugcaguccucag

SEQ ID NO: 731357 - RNA, 13 nt, Homo sapiens
uggagaaagcuca

SEQ ID NO: 731358 - RNA, 23 nt, Homo sapiens
uggagaaccagggcucuucucag

SEQ ID NO: 731359 - RNA, 19 nt, Homo sapiens
uggagaagugucguuuuca

SEQ ID NO: 731360 - RNA, 22 nt, Homo sapiens
uggagacagacugauguguaua

SEQ ID NO: 731361 - RNA, 16 nt, Homo sapiens
uggagaccagccagag

SEQ ID NO: 731362 - RNA, 13 nt, Homo sapiens
uggagaccaucua

SEQ ID NO: 731363 - RNA, 16 nt, Homo sapiens
uggagagacagcuaca

SEQ ID NO: 731364 - RNA, 12 nt, Homo sapiens
uggagagcugcu

SEQ ID NO: 731365 - RNA, 16 nt, Homo sapiens
uggagaggaacccaga

SEQ ID NO: 731366 - RNA, 17 nt, Homo sapiens
uggagaguacauuugcu

SEQ ID NO: 731367 - RNA, 15 nt, Homo sapiens
uggagaguuugccug

SEQ ID NO: 731368 - RNA, 20 nt, Homo sapiens
uggagaugcagcuacuggaa

SEQ ID NO: 731369 - RNA, 22 nt, Homo sapiens
uggagccagcagggcugugaug

SEQ ID NO: 731370 - RNA, 23 nt, Homo sapiens
uggagccaucccuucggagccaa

SEQ ID NO: 731371 - RNA, 17 nt, Homo sapiens
uggagccccagugccaa

SEQ ID NO: 731372 - RNA, 22 nt, Homo sapiens
uggagccccagugccaagcaca

SEQ ID NO: 731373 - RNA, 23 nt, Homo sapiens
uggagccccagugccaagcacag

SEQ ID NO: 731374 - RNA, 16 nt, Homo sapiens
uggagcccgugcagua

SEQ ID NO: 731375 - RNA, 15 nt, Homo sapiens
uguacccgagcacau

SEQ ID NO: 731376 - RNA, 23 nt, Homo sapiens
uguaccgggcuggccugugccua

SEQ ID NO: 731377 - RNA, 22 nt, Homo sapiens
uguaccucgggugggagggaug

SEQ ID NO: 731378 - RNA, 15 nt, Homo sapiens
uguaccugaugcuau

SEQ ID NO: 731379 - RNA, 16 nt, Homo sapiens
uguacgcuuugcucaa

SEQ ID NO: 731380 - RNA, 13 nt, Homo sapiens
uguacuaaucuga

SEQ ID NO: 731381 - RNA, 14 nt, Homo sapiens
uguacuaaucugag

SEQ ID NO: 731382 - RNA, 14 nt, Homo sapiens
uguacuacagcuau

SEQ ID NO: 731383 - RNA, 18 nt, Homo sapiens
uguacucaauggauuuga

SEQ ID NO: 731384 - RNA, 21 nt, Homo sapiens
uguacucacauauaacaugca

SEQ ID NO: 731385 - RNA, 12 nt, Homo sapiens
uguacugauaua

SEQ ID NO: 731386 - RNA, 18 nt, Homo sapiens
uguacugugucucaugga

SEQ ID NO: 731387 - RNA, 23 nt, Homo sapiens
uguacuguucugugucuuucaca

SEQ ID NO: 731388 - RNA, 20 nt, Homo sapiens
uguacuuagcuguacuauaa

SEQ ID NO: 731389 - RNA, 14 nt, Homo sapiens
uguacuuguuugcu

SEQ ID NO: 731390 - RNA, 18 nt, Homo sapiens
uguacuuuucccauuugu

SEQ ID NO: 731391 - RNA, 20 nt, Homo sapiens
uguagaaaauaaaacugagc

SEQ ID NO: 731392 - RNA, 17 nt, Homo sapiens
uguagaacacuaauuca

SEQ ID NO: 731393 - RNA, 21 nt, Homo sapiens
uguagaacucagcaguugaca

SEQ ID NO: 731394 - RNA, 13 nt, Homo sapiens
uguagaacuucaa

SEQ ID NO: 731395 - RNA, 21 nt, Homo sapiens
uguagaagacaaaauguucac

SEQ ID NO: 731396 - RNA, 17 nt, Homo sapiens
uguagacuuaacacuuc

SEQ ID NO: 731397 - RNA, 20 nt, Homo sapiens
uguagagauggggucucaca

SEQ ID NO: 731398 - RNA, 16 nt, Homo sapiens
uguagagcaagccagu

SEQ ID NO: 731399 - RNA, 18 nt, Homo sapiens
uguagaguuguuucuuaa

SEQ ID NO: 731400 - RNA, 19 nt, Homo sapiens
uguagauaaacucagaaau

SEQ ID NO: 731401 - RNA, 15 nt, Homo sapiens
uguagauacuagcua

SEQ ID NO: 731402 - RNA, 14 nt, Homo sapiens
uguagaugugauua

SEQ ID NO: 731403 - RNA, 13 nt, Homo sapiens
uguagaugugcau

SEQ ID NO: 731404 - RNA, 12 nt, Homo sapiens
uguagcacuuac

SEQ ID NO: 731405 - RNA, 20 nt, Homo sapiens
uguagcauuucuugauguug

SEQ ID NO: 731406 - RNA, 21 nt, Homo sapiens
uguagccacuggcauagcccu

SEQ ID NO: 731407 - RNA, 13 nt, Homo sapiens
uguagcugaugaa

SEQ ID NO: 731408 - RNA, 14 nt, Homo sapiens
uguaggaacaagca

SEQ ID NO: 731409 - RNA, 16 nt, Homo sapiens
uguaggcacaagacca

SEQ ID NO: 731410 - RNA, 19 nt, Homo sapiens
uguaggcagucauggcacc

SEQ ID NO: 731411 - RNA, 17 nt, Homo sapiens
uguaggcaucaugcaug

SEQ ID NO: 731412 - RNA, 20 nt, Homo sapiens
uguagggccugcauggagaa

SEQ ID NO: 731413 - RNA, 16 nt, Homo sapiens
uguaggguaaggugcc

SEQ ID NO: 731414 - RNA, 19 nt, Homo sapiens
uguagguaauauuguucua

SEQ ID NO: 731415 - RNA, 13 nt, Homo sapiens
uguaguacuccuu

SEQ ID NO: 731416 - RNA, 21 nt, Homo sapiens
uguagucccagcuacucagga

SEQ ID NO: 731417 - RNA, 13 nt, Homo sapiens
uguagucuugucu

SEQ ID NO: 731418 - RNA, 23 nt, Homo sapiens
uguaguuuucccugcacuguguc

SEQ ID NO: 731419 - RNA, 13 nt, Homo sapiens
uguauaacaagcc

SEQ ID NO: 731420 - RNA, 18 nt, Homo sapiens
uguauaacuggauugcag

SEQ ID NO: 731421 - RNA, 14 nt, Homo sapiens
uguauacacauaua

SEQ ID NO: 731422 - RNA, 16 nt, Homo sapiens
uguauacacauauaua

SEQ ID NO: 731423 - RNA, 14 nt, Homo sapiens
uguauacaugccag

SEQ ID NO: 731424 - RNA, 15 nt, Homo sapiens
uguauacaugugcca

SEQ ID NO: 731425 - RNA, 15 nt, Homo sapiens
uguauaguaucugua

SEQ ID NO: 731426 - RNA, 13 nt, Homo sapiens
uguauauaagcaa

SEQ ID NO: 731427 - RNA, 14 nt, Homo sapiens
uguauauaguauga

SEQ ID NO: 731428 - RNA, 20 nt, Homo sapiens
uguauaucaugaaacacuuc

SEQ ID NO: 731429 - RNA, 11 nt, Homo sapiens
uguauauccaa

SEQ ID NO: 731430 - RNA, 13 nt, Homo sapiens
uguauaugcauuc

SEQ ID NO: 731431 - RNA, 13 nt, Homo sapiens
uguauaugugcca

SEQ ID NO: 731432 - RNA, 20 nt, Homo sapiens
uguauauuccaccauucaca

SEQ ID NO: 731433 - RNA, 22 nt, Homo sapiens
uguauauugguugaaacuguua

SEQ ID NO: 731434 - RNA, 19 nt, Homo sapiens
uguaucagucuuucuugag

SEQ ID NO: 731435 - RNA, 14 nt, Homo sapiens
uguauccauccaug

SEQ ID NO: 731436 - RNA, 19 nt, Homo sapiens
uguauccauccauggggcu

SEQ ID NO: 731437 - RNA, 21 nt, Homo sapiens
uguauccauuaaccugggcau

SEQ ID NO: 731438 - RNA, 13 nt, Homo sapiens
uguauccugauaa

SEQ ID NO: 731439 - RNA, 15 nt, Homo sapiens
uguaucgggcaaaaa

SEQ ID NO: 731440 - RNA, 16 nt, Homo sapiens
uguaucuuauucacau

SEQ ID NO: 731441 - RNA, 18 nt, Homo sapiens
uguaugaaaaauugggga

SEQ ID NO: 731442 - RNA, 16 nt, Homo sapiens
uguaugaaaauccuuu

SEQ ID NO: 731443 - RNA, 22 nt, Homo sapiens
uguauggaaucccacuguauga

SEQ ID NO: 731444 - RNA, 21 nt, Homo sapiens
uguauggguuaaaucaaagau

SEQ ID NO: 731445 - RNA, 18 nt, Homo sapiens
uguauguacguuuguaug

SEQ ID NO: 731446 - RNA, 14 nt, Homo sapiens
uguaugucugugua

SEQ ID NO: 731447 - RNA, 13 nt, Homo sapiens
uguaugugugaau

SEQ ID NO: 731448 - RNA, 14 nt, Homo sapiens
uguauguguggcug

SEQ ID NO: 731449 - RNA, 16 nt, Homo sapiens
uguaugugugugcaug

SEQ ID NO: 731450 - RNA, 11 nt, Homo sapiens
uguauguuaaa

SEQ ID NO: 731451 - RNA, 17 nt, Homo sapiens
uguauguuucuuagccc

SEQ ID NO: 731452 - RNA, 22 nt, Homo sapiens
uguauuacaucuaaugcuucaa

SEQ ID NO: 731453 - RNA, 18 nt, Homo sapiens
uguauucagaggcaguga

SEQ ID NO: 731454 - RNA, 14 nt, Homo sapiens
uguauuccacuuag

SEQ ID NO: 731455 - RNA, 20 nt, Homo sapiens
uguauuccuguagggggcga

SEQ ID NO: 731456 - RNA, 18 nt, Homo sapiens
uguauuccugucauugcg

SEQ ID NO: 731457 - RNA, 14 nt, Homo sapiens
uguauucgugcauu

SEQ ID NO: 731458 - RNA, 19 nt, Homo sapiens
uguauucuagcuaauguaa

SEQ ID NO: 731459 - RNA, 17 nt, Homo sapiens
uguauucucuuccucau

SEQ ID NO: 731460 - RNA, 23 nt, Homo sapiens
uguauucuguuugcguacuugua

SEQ ID NO: 731461 - RNA, 16 nt, Homo sapiens
uguauuuuaugaucuu

SEQ ID NO: 731462 - RNA, 22 nt, Homo sapiens
uguauuuucuuacacuguguca

SEQ ID NO: 731463 - RNA, 19 nt, Homo sapiens
uguauuuuuuguaugcuua

SEQ ID NO: 731464 - RNA, 17 nt, Homo sapiens
ugucaaaacuacugaca

SEQ ID NO: 731465 - RNA, 13 nt, Homo sapiens
ugucaaagcuuug

SEQ ID NO: 731466 - RNA, 21 nt, Homo sapiens
ugucaagaugaugaugaucuu

SEQ ID NO: 731467 - RNA, 14 nt, Homo sapiens
ugucaaguacaagc

SEQ ID NO: 731468 - RNA, 16 nt, Homo sapiens
ugucaaugauuucaaa

SEQ ID NO: 731469 - RNA, 16 nt, Homo sapiens
ugucacaaauugauca

SEQ ID NO: 731470 - RNA, 18 nt, Homo sapiens
ugucacaaccucucugau

SEQ ID NO: 731471 - RNA, 19 nt, Homo sapiens
ugucacacgauaaagggau

SEQ ID NO: 731472 - RNA, 22 nt, Homo sapiens
ugucacaucagcaauuucagaa

SEQ ID NO: 731473 - RNA, 21 nt, Homo sapiens
ugucacauuuagcugugcuca

SEQ ID NO: 731474 - RNA, 23 nt, Homo sapiens
ugucaccaaauuuguaccucuaa

SEQ ID NO: 731475 - RNA, 15 nt, Homo sapiens
ugucaccauugcaca

SEQ ID NO: 731476 - RNA, 23 nt, Homo sapiens
ugucacccagguuggagugcagu

SEQ ID NO: 731477 - RNA, 22 nt, Homo sapiens
ugucacccugcaggacuugcca

SEQ ID NO: 731478 - RNA, 19 nt, Homo sapiens
ugucacccuggauaggcaa

SEQ ID NO: 731479 - RNA, 22 nt, Homo sapiens
ugucacuacgugacuguggcac

SEQ ID NO: 731480 - RNA, 22 nt, Homo sapiens
ugucacuacucacagucucuuu

SEQ ID NO: 731481 - RNA, 14 nt, Homo sapiens
ugucacugguggau

SEQ ID NO: 731482 - RNA, 21 nt, Homo sapiens
ugucacuugaccaauacugac

SEQ ID NO: 731483 - RNA, 18 nt, Homo sapiens
ugucagacgagcagugac

SEQ ID NO: 731484 - RNA, 17 nt, Homo sapiens
ugucagaguagaagauu

SEQ ID NO: 731485 - RNA, 18 nt, Homo sapiens
ugucagcagcucugagac

SEQ ID NO: 731486 - RNA, 16 nt, Homo sapiens
ugucagcuuccaaaca

SEQ ID NO: 731487 - RNA, 14 nt, Homo sapiens
ugucagucagggac

SEQ ID NO: 731488 - RNA, 16 nt, Homo sapiens
ugucagucagggacaa

SEQ ID NO: 731489 - RNA, 16 nt, Homo sapiens
ugucagugcugccagu

SEQ ID NO: 731490 - RNA, 19 nt, Homo sapiens
ugucaguuauucuugcaaa

SEQ ID NO: 731491 - RNA, 18 nt, Homo sapiens
ugucaguucuaaccuccu

SEQ ID NO: 731492 - RNA, 12 nt, Homo sapiens
ugucaguucucu

SEQ ID NO: 731493 - RNA, 19 nt, Homo sapiens
ugucauagaaauauugacu

SEQ ID NO: 731494 - RNA, 17 nt, Homo sapiens
ugucauauaagauucau

SEQ ID NO: 731495 - RNA, 14 nt, Homo sapiens
ugucauaugacuga

SEQ ID NO: 731496 - RNA, 17 nt, Homo sapiens
ugucaucagccugugua

SEQ ID NO: 731497 - RNA, 20 nt, Homo sapiens
ugucaugacggggacagagu

SEQ ID NO: 731498 - RNA, 22 nt, Homo sapiens
ugucauuaguauuucacaagaa

SEQ ID NO: 731499 - RNA, 19 nt, Homo sapiens
ugucauucaagccugugaa

SEQ ID NO: 731500 - RNA, 14 nt, Homo sapiens
ugucauucagaguc

SEQ ID NO: 731501 - RNA, 12 nt, Homo sapiens
ugucauuccaga

SEQ ID NO: 731502 - RNA, 21 nt, Homo sapiens
ugucauucuguuagauacuaa

SEQ ID NO: 731503 - RNA, 19 nt, Homo sapiens
ugucauugcgaccauuucu

SEQ ID NO: 731504 - RNA, 16 nt, Homo sapiens
ugucauuuuuaucuau

SEQ ID NO: 731505 - RNA, 12 nt, Homo sapiens
uguccaaagagg

SEQ ID NO: 731506 - RNA, 23 nt, Homo sapiens
uguccagaaauugugugugcaag

SEQ ID NO: 731507 - RNA, 20 nt, Homo sapiens
uguccagcaccuugugccug

SEQ ID NO: 731508 - RNA, 17 nt, Homo sapiens
uguccauguauucacac

SEQ ID NO: 731509 - RNA, 17 nt, Homo sapiens
uguccaugugaucucau

SEQ ID NO: 731510 - RNA, 15 nt, Homo sapiens
uguccauuugcaaau

SEQ ID NO: 731511 - RNA, 15 nt, Homo sapiens
ugucccagaaaagca

SEQ ID NO: 731512 - RNA, 13 nt, Homo sapiens
uguccccuaagag

SEQ ID NO: 731513 - RNA, 15 nt, Homo sapiens
ugucccucauccaua

SEQ ID NO: 731514 - RNA, 16 nt, Homo sapiens
ugucccugaaaccuag

SEQ ID NO: 731515 - RNA, 21 nt, Homo sapiens
ugucccugaaacuucaccagg

SEQ ID NO: 731516 - RNA, 18 nt, Homo sapiens
ugucccugaacucccaga

SEQ ID NO: 731517 - RNA, 13 nt, Homo sapiens
ugucccugagcag

SEQ ID NO: 731518 - RNA, 14 nt, Homo sapiens
ugucccugccuuca

SEQ ID NO: 731519 - RNA, 24 nt, Homo sapiens
ugucccugugggugaaacagaaca

SEQ ID NO: 731520 - RNA, 15 nt, Homo sapiens
uguccgaugcuggag

SEQ ID NO: 731521 - RNA, 17 nt, Homo sapiens
uguccuaccacucuaau

SEQ ID NO: 731522 - RNA, 13 nt, Homo sapiens
uguccucagcauu

SEQ ID NO: 731523 - RNA, 18 nt, Homo sapiens
uguccucagccuugccag

SEQ ID NO: 731524 - RNA, 20 nt, Homo sapiens
uguccucagggcuacagcag

SEQ ID NO: 731525 - RNA, 15 nt, Homo sapiens
uguccuccaccugcc

SEQ ID NO: 731526 - RNA, 19 nt, Homo sapiens
uguccuccaccugccuucc

SEQ ID NO: 731527 - RNA, 17 nt, Homo sapiens
uguccuccccucaagga

SEQ ID NO: 731528 - RNA, 18 nt, Homo sapiens
uguccuccccucaaggac

SEQ ID NO: 731529 - RNA, 15 nt, Homo sapiens
uguccucuauaccug

SEQ ID NO: 731530 - RNA, 18 nt, Homo sapiens
uguccucuuccaccacag

SEQ ID NO: 731531 - RNA, 15 nt, Homo sapiens
uguccucuugcucaa

SEQ ID NO: 731532 - RNA, 16 nt, Homo sapiens
uguccucuugcucaaa

SEQ ID NO: 731533 - RNA, 15 nt, Homo sapiens
uguccugaagcugcu

SEQ ID NO: 731534 - RNA, 20 nt, Homo sapiens
uguccugacaccugcuucag

SEQ ID NO: 731535 - RNA, 14 nt, Homo sapiens
uguccugaccaccc

SEQ ID NO: 731536 - RNA, 14 nt, Homo sapiens
uguccugccagcug

SEQ ID NO: 731537 - RNA, 19 nt, Homo sapiens
uguccuggugcucucugcc

SEQ ID NO: 731538 - RNA, 14 nt, Homo sapiens
uguccuguccugcu

SEQ ID NO: 731539 - RNA, 16 nt, Homo sapiens
uguccuucuccaucua

SEQ ID NO: 731540 - RNA, 21 nt, Homo sapiens
uguccuuuaaucacugcauuu

SEQ ID NO: 731541 - RNA, 19 nt, Homo sapiens
uguccuuuccaucugucca

SEQ ID NO: 731542 - RNA, 14 nt, Homo sapiens
uguccuuucuugca

SEQ ID NO: 731543 - RNA, 18 nt, Homo sapiens
uguccuuuuucacuuuga

SEQ ID NO: 731544 - RNA, 20 nt, Homo sapiens
uguccuuuuucacuuugaaa

SEQ ID NO: 731545 - RNA, 18 nt, Homo sapiens
uguccuuuuucaggagaa

SEQ ID NO: 731546 - RNA, 20 nt, Homo sapiens
ugucgaggccacauugcugg

SEQ ID NO: 731547 - RNA, 18 nt, Homo sapiens
ugucgaugacuucaucaa

SEQ ID NO: 731548 - RNA, 12 nt, Homo sapiens
ugucgcccagug

SEQ ID NO: 731549 - RNA, 15 nt, Homo sapiens
ugucgcgcacacagc

SEQ ID NO: 731550 - RNA, 18 nt, Homo sapiens
ugucguauaggcauguaa

SEQ ID NO: 731551 - RNA, 16 nt, Homo sapiens
ugucguauuuggcaca

SEQ ID NO: 731552 - RNA, 14 nt, Homo sapiens
ugucgucuuuaugu

SEQ ID NO: 731553 - RNA, 19 nt, Homo sapiens
ugucuaaaaauaaaaugca

SEQ ID NO: 731554 - RNA, 15 nt, Homo sapiens
ugucuaagauucuag

SEQ ID NO: 731555 - RNA, 16 nt, Homo sapiens
ugucuaauaguuauuc

SEQ ID NO: 731556 - RNA, 21 nt, Homo sapiens
ugucuacauagugacaugcac

SEQ ID NO: 731557 - RNA, 11 nt, Homo sapiens
ugucuaccugg

SEQ ID NO: 731558 - RNA, 18 nt, Homo sapiens
ugucuacgggggcacuug

SEQ ID NO: 731559 - RNA, 23 nt, Homo sapiens
ugucuacgugcgcucugccauuc

SEQ ID NO: 731560 - RNA, 12 nt, Homo sapiens
ugucucaaaaaa

SEQ ID NO: 731561 - RNA, 23 nt, Homo sapiens
ugucucaauucuuuguauaugca

SEQ ID NO: 731562 - RNA, 14 nt, Homo sapiens
ugucucagccuccc

SEQ ID NO: 731563 - RNA, 19 nt, Homo sapiens
ugucuccaucucugucuca

SEQ ID NO: 731564 - RNA, 21 nt, Homo sapiens
ugucuccaugugcguccauau

SEQ ID NO: 731565 - RNA, 15 nt, Homo sapiens
ugucucgaguccuaa

SEQ ID NO: 731566 - RNA, 20 nt, Homo sapiens
ugucucuacuuuucccugua

SEQ ID NO: 731567 - RNA, 14 nt, Homo sapiens
ugucugacaaccuc

SEQ ID NO: 731568 - RNA, 21 nt, Homo sapiens
ugucugaguaagcccucagga

SEQ ID NO: 731569 - RNA, 17 nt, Homo sapiens
ugucugauuuuggccau

SEQ ID NO: 731570 - RNA, 15 nt, Homo sapiens
ugucugccuucacaa

SEQ ID NO: 731571 - RNA, 18 nt, Homo sapiens
ugucugccuucacaaaug

SEQ ID NO: 731572 - RNA, 19 nt, Homo sapiens
ugucuggagugacagacca

SEQ ID NO: 731573 - RNA, 12 nt, Homo sapiens
ugucugggguga

SEQ ID NO: 731574 - RNA, 15 nt, Homo sapiens
ugucuggugguggca

SEQ ID NO: 731575 - RNA, 23 nt, Homo sapiens
ugucuguacaguaccuuguugca

SEQ ID NO: 731576 - RNA, 22 nt, Homo sapiens
ugucugucuccagcacccagaa

SEQ ID NO: 731577 - RNA, 21 nt, Homo sapiens
ugucugugcccuccaaagagc

SEQ ID NO: 731578 - RNA, 21 nt, Homo sapiens
ugucuguuucaaugaccugua

SEQ ID NO: 731579 - RNA, 13 nt, Homo sapiens
ugucuuagucaaa

SEQ ID NO: 731580 - RNA, 16 nt, Homo sapiens
ugucuucaaacuguga

SEQ ID NO: 731581 - RNA, 13 nt, Homo sapiens
ugucuucagagca

SEQ ID NO: 731582 - RNA, 18 nt, Homo sapiens
ugucuucauagcagauuu

SEQ ID NO: 731583 - RNA, 12 nt, Homo sapiens
ugucuuccauaa

SEQ ID NO: 731584 - RNA, 20 nt, Homo sapiens
ugucuuccuguguaccucua

SEQ ID NO: 731585 - RNA, 15 nt, Homo sapiens
ugucuucucccugca

SEQ ID NO: 731586 - RNA, 18 nt, Homo sapiens
ugucuuggacacuguaca

SEQ ID NO: 731587 - RNA, 14 nt, Homo sapiens
ugucuuggggccac

SEQ ID NO: 731588 - RNA, 23 nt, Homo sapiens
ugucuuguugcggauggauggaa

SEQ ID NO: 731589 - RNA, 21 nt, Homo sapiens
ugucuuguuucccagauuuca

SEQ ID NO: 731590 - RNA, 18 nt, Homo sapiens
ugucuuuaacucauaaaa

SEQ ID NO: 731591 - RNA, 22 nt, Homo sapiens
ugucuuucucagaggacaauaa

SEQ ID NO: 731592 - RNA, 13 nt, Homo sapiens
ugucuuuugccau

SEQ ID NO: 731593 - RNA, 14 nt, Homo sapiens
ugugaaaacucugg

SEQ ID NO: 731594 - RNA, 23 nt, Homo sapiens
ugugaaacgucccacacuuugaa

SEQ ID NO: 731595 - RNA, 12 nt, Homo sapiens
ugugaaagucag

SEQ ID NO: 731596 - RNA, 17 nt, Homo sapiens
ugugaaauaauuccucu

SEQ ID NO: 731597 - RNA, 14 nt, Homo sapiens
ugugaaauucucag

SEQ ID NO: 731598 - RNA, 19 nt, Homo sapiens
ugugaacacaucagcuugc

SEQ ID NO: 731599 - RNA, 15 nt, Homo sapiens
ugugaacagcuugcu

SEQ ID NO: 731600 - RNA, 21 nt, Homo sapiens
ugugaacagcuugcugucacu

SEQ ID NO: 731601 - RNA, 22 nt, Homo sapiens
ugugaaccuuugagcuuucaua

SEQ ID NO: 731602 - RNA, 23 nt, Homo sapiens
ugugaacuggaagaaagcaacaa

SEQ ID NO: 731603 - RNA, 23 nt, Homo sapiens
ugugaaggaauuauucccaugag

SEQ ID NO: 731604 - RNA, 21 nt, Homo sapiens
ugugaagugaaugaaacacuc

SEQ ID NO: 731605 - RNA, 18 nt, Homo sapiens
ugugaaguuugcuuugua

SEQ ID NO: 731606 - RNA, 16 nt, Homo sapiens
ugugaauaaaaacccu

SEQ ID NO: 731607 - RNA, 20 nt, Homo sapiens
ugugaauaaaaacccuguau

SEQ ID NO: 731608 - RNA, 13 nt, Homo sapiens
ugugaauucaaua

SEQ ID NO: 731609 - RNA, 19 nt, Homo sapiens
ugugaccacauacguguua

SEQ ID NO: 731610 - RNA, 17 nt, Homo sapiens
ugugaccuuacagccau

SEQ ID NO: 731611 - RNA, 12 nt, Homo sapiens
ugugaccuugac

SEQ ID NO: 731612 - RNA, 21 nt, Homo sapiens
ugugacgugcacugugaaucc

SEQ ID NO: 731613 - RNA, 14 nt, Homo sapiens
ugugacuucacugu

SEQ ID NO: 731614 - RNA, 20 nt, Homo sapiens
ugugacuugaacuagauugc

SEQ ID NO: 731615 - RNA, 20 nt, Homo sapiens
ugugacuuuuucagaguugc

SEQ ID NO: 731616 - RNA, 22 nt, Homo sapiens
ugugagagagacugaugggguc

SEQ ID NO: 731617 - RNA, 12 nt, Homo sapiens
ugugagcaagaa

SEQ ID NO: 731618 - RNA, 14 nt, Homo sapiens
ugugagcagggauu

SEQ ID NO: 731619 - RNA, 14 nt, Homo sapiens
ugugagcuaugcaa

SEQ ID NO: 731620 - RNA, 16 nt, Homo sapiens
ugugagcucugguuau

SEQ ID NO: 731621 - RNA, 17 nt, Homo sapiens
ugugagcuuacauugaa

SEQ ID NO: 731622 - RNA, 19 nt, Homo sapiens
ugugaggcggcccugacca

SEQ ID NO: 731623 - RNA, 23 nt, Homo sapiens
ugugaguggcauuugucagggau

SEQ ID NO: 731624 - RNA, 18 nt, Homo sapiens
ugugauuagaagcuaaau

SEQ ID NO: 731625 - RNA, 15 nt, Homo sapiens
ugugauuagaucaca

SEQ ID NO: 731626 - RNA, 14 nt, Homo sapiens
ugugauucugccuu

SEQ ID NO: 731627 - RNA, 19 nt, Homo sapiens
ugugauugcugccauaauu

SEQ ID NO: 731628 - RNA, 16 nt, Homo sapiens
ugugcaagggcaguga

SEQ ID NO: 731629 - RNA, 19 nt, Homo sapiens
ugugcacaagucuuuccag

SEQ ID NO: 731630 - RNA, 23 nt, Homo sapiens
ugugcaccccuccccauucacag

SEQ ID NO: 731631 - RNA, 13 nt, Homo sapiens
ugugcaguagcau

SEQ ID NO: 731632 - RNA, 22 nt, Homo sapiens
ugugcauacuuucccucaucca

SEQ ID NO: 731633 - RNA, 16 nt, Homo sapiens
ugugcaucuguacuca

SEQ ID NO: 731634 - RNA, 13 nt, Homo sapiens
ugugcaugccaug

SEQ ID NO: 731635 - RNA, 17 nt, Homo sapiens
ugugcauguaugucuug

SEQ ID NO: 731636 - RNA, 21 nt, Homo sapiens
ugugccaacuacuacugguga

SEQ ID NO: 731637 - RNA, 17 nt, Homo sapiens
ugugccaccaacauaaa

SEQ ID NO: 731638 - RNA, 14 nt, Homo sapiens
ugugccaccacguc

SEQ ID NO: 731639 - RNA, 22 nt, Homo sapiens
ugugccacucaccgaagccacu

SEQ ID NO: 731640 - RNA, 19 nt, Homo sapiens
ugugccaucauaagaauag

SEQ ID NO: 731641 - RNA, 17 nt, Homo sapiens
ugugccauggaucugau

SEQ ID NO: 731642 - RNA, 21 nt, Homo sapiens
ugugcccagcaggcccagcau

SEQ ID NO: 731643 - RNA, 16 nt, Homo sapiens
ugugccccaccacguc

SEQ ID NO: 731644 - RNA, 20 nt, Homo sapiens
ugugccccucccaacaugcu

SEQ ID NO: 731645 - RNA, 16 nt, Homo sapiens
ugugccccuucacuca

SEQ ID NO: 731646 - RNA, 12 nt, Homo sapiens
ugugcccgggga

SEQ ID NO: 731647 - RNA, 19 nt, Homo sapiens
ugugcccguguguguguau

SEQ ID NO: 731648 - RNA, 20 nt, Homo sapiens
ugugcccuccaaagagccuu

SEQ ID NO: 731649 - RNA, 23 nt, Homo sapiens
ugugcccuugggguaagccagag

SEQ ID NO: 731650 - RNA, 19 nt, Homo sapiens
ugugccugcucagcagagc

SEQ ID NO: 731651 - RNA, 23 nt, Homo sapiens
ugugccugggguguuaguggcac

SEQ ID NO: 731652 - RNA, 15 nt, Homo sapiens
ugugccuuugcauaa

SEQ ID NO: 731653 - RNA, 17 nt, Homo sapiens
ugugcgccgggggaccu

SEQ ID NO: 731654 - RNA, 15 nt, Homo sapiens
ugugcgucucucuuu

SEQ ID NO: 731655 - RNA, 16 nt, Homo sapiens
ugugcuccccugccac

SEQ ID NO: 731656 - RNA, 19 nt, Homo sapiens
ugugcugcaccccaugugg

SEQ ID NO: 731657 - RNA, 11 nt, Homo sapiens
ugugcugccau

SEQ ID NO: 731658 - RNA, 13 nt, Homo sapiens
ugugcuggggucu

SEQ ID NO: 731659 - RNA, 22 nt, Homo sapiens
ugugcuggucauggaauggcag

SEQ ID NO: 731660 - RNA, 17 nt, Homo sapiens
ugugcugugaagugauc

SEQ ID NO: 731661 - RNA, 12 nt, Homo sapiens
ugugcugugacu

SEQ ID NO: 731662 - RNA, 12 nt, Homo sapiens
uguggacugugc

SEQ ID NO: 731663 - RNA, 18 nt, Homo sapiens
uguggaggccugaugcug

SEQ ID NO: 731664 - RNA, 19 nt, Homo sapiens
uguggagugugugucuuuc

SEQ ID NO: 731665 - RNA, 18 nt, Homo sapiens
uguggaugcuccagggca

SEQ ID NO: 731666 - RNA, 23 nt, Homo sapiens
uguggauggugucuccuuuacua

SEQ ID NO: 731667 - RNA, 16 nt, Homo sapiens
uguggauuaaugucaa

SEQ ID NO: 731668 - RNA, 13 nt, Homo sapiens
uguggcagagcca

SEQ ID NO: 731669 - RNA, 19 nt, Homo sapiens
uguggccaacugcaaaaaa

SEQ ID NO: 731670 - RNA, 20 nt, Homo sapiens
uguggcccaucuuacuggaa

SEQ ID NO: 731671 - RNA, 15 nt, Homo sapiens
uguggccccaacaca

SEQ ID NO: 731672 - RNA, 14 nt, Homo sapiens
uguggcccugccau

SEQ ID NO: 731673 - RNA, 13 nt, Homo sapiens
uauaaacuaccaa

SEQ ID NO: 731674 - RNA, 13 nt, Homo sapiens
uauaaacuccuua

SEQ ID NO: 731675 - RNA, 21 nt, Homo sapiens
uauaaagaagaacuugcaugg

SEQ ID NO: 731676 - RNA, 17 nt, Homo sapiens
uauaaagauuguacuua

SEQ ID NO: 731677 - RNA, 16 nt, Homo sapiens
uauaaagcauuacucu

SEQ ID NO: 731678 - RNA, 14 nt, Homo sapiens
uauaaagcuguuau

SEQ ID NO: 731679 - RNA, 19 nt, Homo sapiens
uauaaaguauaacuauaaa

SEQ ID NO: 731680 - RNA, 15 nt, Homo sapiens
uauaaauaaucacac

SEQ ID NO: 731681 - RNA, 15 nt, Homo sapiens
uauaaauacugcaaa

SEQ ID NO: 731682 - RNA, 14 nt, Homo sapiens
uauaaaugccagag

SEQ ID NO: 731683 - RNA, 18 nt, Homo sapiens
uauaaaugccagagccaa

SEQ ID NO: 731684 - RNA, 19 nt, Homo sapiens
uauaaauguuugucuggau

SEQ ID NO: 731685 - RNA, 19 nt, Homo sapiens
uauaaauuuguguucucaa

SEQ ID NO: 731686 - RNA, 20 nt, Homo sapiens
uauaaauuuuauaacagaau

SEQ ID NO: 731687 - RNA, 22 nt, Homo sapiens
uauaaauuuuuugugaucagua

SEQ ID NO: 731688 - RNA, 22 nt, Homo sapiens
uauaacaaucacuggcuaccga

SEQ ID NO: 731689 - RNA, 11 nt, Homo sapiens
uauaacagugu

SEQ ID NO: 731690 - RNA, 19 nt, Homo sapiens
uauaacauucaguucccac

SEQ ID NO: 731691 - RNA, 22 nt, Homo sapiens
uauaaccacaaagcacaguuug

SEQ ID NO: 731692 - RNA, 22 nt, Homo sapiens
uauaacuaagacauaugcauuu

SEQ ID NO: 731693 - RNA, 22 nt, Homo sapiens
uauaacucuccuuugcucucug

SEQ ID NO: 731694 - RNA, 18 nt, Homo sapiens
uauaacucugcacuacuc

SEQ ID NO: 731695 - RNA, 22 nt, Homo sapiens
uauaacuuaggccuagccucuu

SEQ ID NO: 731696 - RNA, 16 nt, Homo sapiens
uauaagguaugugcua

SEQ ID NO: 731697 - RNA, 20 nt, Homo sapiens
uauaaguaauacuucaguaa

SEQ ID NO: 731698 - RNA, 18 nt, Homo sapiens
uauaaguucuauuuuacu

SEQ ID NO: 731699 - RNA, 16 nt, Homo sapiens
uauaauaugugccuua

SEQ ID NO: 731700 - RNA, 14 nt, Homo sapiens
uauaauauuuacug

SEQ ID NO: 731701 - RNA, 18 nt, Homo sapiens
uauaaucaauaagcuaga

SEQ ID NO: 731702 - RNA, 12 nt, Homo sapiens
uauaaucuacuc

SEQ ID NO: 731703 - RNA, 19 nt, Homo sapiens
uauaaucucaccugcuucc

SEQ ID NO: 731704 - RNA, 17 nt, Homo sapiens
uauaauguaagcucuac

SEQ ID NO: 731705 - RNA, 17 nt, Homo sapiens
uauaauguuguauuuaa

SEQ ID NO: 731706 - RNA, 22 nt, Homo sapiens
uauaauucagaagacuacuaua

SEQ ID NO: 731707 - RNA, 16 nt, Homo sapiens
uauaauuggugcauag

SEQ ID NO: 731708 - RNA, 20 nt, Homo sapiens
uauaauuucaaaccacacau

SEQ ID NO: 731709 - RNA, 23 nt, Homo sapiens
uauaauuucaaaccacacauuag

SEQ ID NO: 731710 - RNA, 16 nt, Homo sapiens
uauacaauacagauca

SEQ ID NO: 731711 - RNA, 21 nt, Homo sapiens
uauacacuauuugugagcaaa

SEQ ID NO: 731712 - RNA, 23 nt, Homo sapiens
uauacagauagaguuccauauau

SEQ ID NO: 731713 - RNA, 14 nt, Homo sapiens
uauacaguacacag

SEQ ID NO: 731714 - RNA, 13 nt, Homo sapiens
uauacagugauau

SEQ ID NO: 731715 - RNA, 16 nt, Homo sapiens
uauacaucuguguauu

SEQ ID NO: 731716 - RNA, 21 nt, Homo sapiens
uauacauucuuuaucuugaca

SEQ ID NO: 731717 - RNA, 16 nt, Homo sapiens
uauacauugucuugau

SEQ ID NO: 731718 - RNA, 17 nt, Homo sapiens
uauacauuuauuuacac

SEQ ID NO: 731719 - RNA, 12 nt, Homo sapiens
uauacauuugau

SEQ ID NO: 731720 - RNA, 14 nt, Homo sapiens
uauaccauuuccuc

SEQ ID NO: 731721 - RNA, 22 nt, Homo sapiens
uauacccccccaugcagucuaa

SEQ ID NO: 731722 - RNA, 15 nt, Homo sapiens
uauacuguacuuaau

SEQ ID NO: 731723 - RNA, 18 nt, Homo sapiens
uauacuguggcuaugcaa

SEQ ID NO: 731724 - RNA, 12 nt, Homo sapiens
uauagacaccaa

SEQ ID NO: 731725 - RNA, 19 nt, Homo sapiens
uuaaaauuaucaauaucua

SEQ ID NO: 731726 - RNA, 20 nt, Homo sapiens
uuaaacagaugugaauauuc

SEQ ID NO: 731727 - RNA, 15 nt, Homo sapiens
uuaaacaucaguauu

SEQ ID NO: 731728 - RNA, 18 nt, Homo sapiens
uuaaacauugaaguaaug

SEQ ID NO: 731729 - RNA, 24 nt, Homo sapiens
uuaaacauuugagagcuaacuaua

SEQ ID NO: 731730 - RNA, 12 nt, Homo sapiens
uuaaaccaccua

SEQ ID NO: 731731 - RNA, 15 nt, Homo sapiens
uuaaacccauacaau

SEQ ID NO: 731732 - RNA, 19 nt, Homo sapiens
uuaaacccauacaauguau

SEQ ID NO: 731733 - RNA, 18 nt, Homo sapiens
uuaaacccuuuggugcua

SEQ ID NO: 731734 - RNA, 16 nt, Homo sapiens
uuaaacucaucaaugu

SEQ ID NO: 731735 - RNA, 10 nt, Homo sapiens
uuaaacuggu

SEQ ID NO: 731736 - RNA, 20 nt, Homo sapiens
uuaaacuuucaauugucacu

SEQ ID NO: 731737 - RNA, 20 nt, Homo sapiens
uuaaagaaaaaaaaagucag

SEQ ID NO: 731738 - RNA, 13 nt, Homo sapiens
uuaaagaaagugu

SEQ ID NO: 731739 - RNA, 12 nt, Homo sapiens
uuaaagacacuu

SEQ ID NO: 731740 - RNA, 18 nt, Homo sapiens
uuaaagacguucccuuuu

SEQ ID NO: 731741 - RNA, 15 nt, Homo sapiens
uuaaagagucuagau

SEQ ID NO: 731742 - RNA, 16 nt, Homo sapiens
uuaaagaucaugacau

SEQ ID NO: 731743 - RNA, 14 nt, Homo sapiens
uuaaagaugguuua

SEQ ID NO: 731744 - RNA, 20 nt, Homo sapiens
uuaaagccuuuagagccagc

SEQ ID NO: 731745 - RNA, 20 nt, Homo sapiens
uuaaagcuuauuaaaacuca

SEQ ID NO: 731746 - RNA, 20 nt, Homo sapiens
uuaaaggaacagagugagag

SEQ ID NO: 731747 - RNA, 17 nt, Homo sapiens
uuaaaggggguauguga

SEQ ID NO: 731748 - RNA, 19 nt, Homo sapiens
uuaaaggguguacuuauau

SEQ ID NO: 731749 - RNA, 19 nt, Homo sapiens
uuaaaguggcagcuucacu

SEQ ID NO: 731750 - RNA, 15 nt, Homo sapiens
uuaaaguuacuuugu

SEQ ID NO: 731751 - RNA, 23 nt, Homo sapiens
uuaaauaaaucauaaaacuugau

SEQ ID NO: 731752 - RNA, 19 nt, Homo sapiens
uuaaauaaugcuucagaua

SEQ ID NO: 731753 - RNA, 17 nt, Homo sapiens
uuaaauacccaucuuca

SEQ ID NO: 731754 - RNA, 16 nt, Homo sapiens
uuaaauauccauuuau

SEQ ID NO: 731755 - RNA, 15 nt, Homo sapiens
uuaaauaugaaugaa

SEQ ID NO: 731756 - RNA, 12 nt, Homo sapiens
uuaaaucaaaga

SEQ ID NO: 731757 - RNA, 23 nt, Homo sapiens
uuaaaucaacuuuaucauaugcu

SEQ ID NO: 731758 - RNA, 22 nt, Homo sapiens
uuaaaucacagauggguauuaa

SEQ ID NO: 731759 - RNA, 14 nt, Homo sapiens
uuaaaugaagccaa

SEQ ID NO: 731760 - RNA, 16 nt, Homo sapiens
uuaaaugaccaaagau

SEQ ID NO: 731761 - RNA, 15 nt, Homo sapiens
uuaaauggcuuuaug

SEQ ID NO: 731762 - RNA, 13 nt, Homo sapiens
uuaaaugguaaua

SEQ ID NO: 731763 - RNA, 15 nt, Homo sapiens
uuaacaacaauaaca

SEQ ID NO: 731764 - RNA, 12 nt, Homo sapiens
uuaacacacugg

SEQ ID NO: 731765 - RNA, 12 nt, Homo sapiens
uuaacacuuaaa

SEQ ID NO: 731766 - RNA, 15 nt, Homo sapiens
uuaacagcaugcugc

SEQ ID NO: 731767 - RNA, 18 nt, Homo sapiens
uuaacaggauauuagaca

SEQ ID NO: 731768 - RNA, 16 nt, Homo sapiens
uuaacauguauacaaa

SEQ ID NO: 731769 - RNA, 15 nt, Homo sapiens
uuaaccaagaaacaa

SEQ ID NO: 731770 - RNA, 15 nt, Homo sapiens
uuaaccacaauacca

SEQ ID NO: 731771 - RNA, 18 nt, Homo sapiens
uuaaccccauguccucag

SEQ ID NO: 731772 - RNA, 18 nt, Homo sapiens
uuaaccgcacaugcacac

SEQ ID NO: 731773 - RNA, 19 nt, Homo sapiens
uuaaccuaauaucacuuaa

SEQ ID NO: 731774 - RNA, 21 nt, Homo sapiens
uuaaccugaaccuugagcaaa

SEQ ID NO: 731775 - RNA, 13 nt, Homo sapiens
uuaacggugcuaa

SEQ ID NO: 731776 - RNA, 14 nt, Homo sapiens
uuaacggugcuaaa

SEQ ID NO: 731777 - RNA, 15 nt, Homo sapiens
uuaacuaauaaaaua

SEQ ID NO: 731778 - RNA, 19 nt, Homo sapiens
uuaacucaccucucaaggu

SEQ ID NO: 731779 - RNA, 15 nt, Homo sapiens
uuaacucuuuuggac

SEQ ID NO: 731780 - RNA, 20 nt, Homo sapiens
uuaacugacuuaaguggcau

SEQ ID NO: 731781 - RNA, 12 nt, Homo sapiens
uuaacugagcua

SEQ ID NO: 731782 - RNA, 17 nt, Homo sapiens
uuaacugagcuacuaga

SEQ ID NO: 731783 - RNA, 21 nt, Homo sapiens
uuaacugugaaauaccacaag

SEQ ID NO: 731784 - RNA, 21 nt, Homo sapiens
uuaacuuaaaagaacauguau

SEQ ID NO: 731785 - RNA, 18 nt, Homo sapiens
uuaacuuuuguaccaaau

SEQ ID NO: 731786 - RNA, 13 nt, Homo sapiens
uuaagaaaauaca

SEQ ID NO: 731787 - RNA, 15 nt, Homo sapiens
uuaagaaacuguuuc

SEQ ID NO: 731788 - RNA, 15 nt, Homo sapiens
uuaagaaaucuggcc

SEQ ID NO: 731789 - RNA, 19 nt, Homo sapiens
uuaagaacacuuuuaauaa

SEQ ID NO: 731790 - RNA, 17 nt, Homo sapiens
uuaagaaugucgauuaa

SEQ ID NO: 731791 - RNA, 18 nt, Homo sapiens
uuaagaauuuuuuccuaa

SEQ ID NO: 731792 - RNA, 17 nt, Homo sapiens
uuaagacaguguacaaa

SEQ ID NO: 731793 - RNA, 16 nt, Homo sapiens
uuaagagaccaggucu

SEQ ID NO: 731794 - RNA, 16 nt, Homo sapiens
uuaagauagaacacaa

SEQ ID NO: 731795 - RNA, 13 nt, Homo sapiens
uuaagauucuuga

SEQ ID NO: 731796 - RNA, 20 nt, Homo sapiens
uuaagauucuugacuuauau

SEQ ID NO: 731797 - RNA, 13 nt, Homo sapiens
uuaagcacaagca

SEQ ID NO: 731798 - RNA, 20 nt, Homo sapiens
uuaagcagauggaaugcugu

SEQ ID NO: 731799 - RNA, 23 nt, Homo sapiens
uuaagcauugguuauucaaguau

SEQ ID NO: 731800 - RNA, 15 nt, Homo sapiens
uuaagccaucaggga

SEQ ID NO: 731801 - RNA, 19 nt, Homo sapiens
uuaagccuuacaaagggaa

SEQ ID NO: 731802 - RNA, 19 nt, Homo sapiens
uuaagcugaagaguuuacu

SEQ ID NO: 731803 - RNA, 14 nt, Homo sapiens
uuaagcugauccug

SEQ ID NO: 731804 - RNA, 17 nt, Homo sapiens
uuaagcuuaugucagac

SEQ ID NO: 731805 - RNA, 13 nt, Homo sapiens
uuaaggcacagug

SEQ ID NO: 731806 - RNA, 17 nt, Homo sapiens
uuaaggcucugugccuu

SEQ ID NO: 731807 - RNA, 15 nt, Homo sapiens
uuaaggggaagaaug

SEQ ID NO: 731808 - RNA, 17 nt, Homo sapiens
uuaaggugaaccaaaga

SEQ ID NO: 731809 - RNA, 16 nt, Homo sapiens
uuaagguuaugcacug

SEQ ID NO: 731810 - RNA, 20 nt, Homo sapiens
uuaagguuaugcacugccug

SEQ ID NO: 731811 - RNA, 17 nt, Homo sapiens
uuaaguacaugugccag

SEQ ID NO: 731812 - RNA, 17 nt, Homo sapiens
uuaagugacacagacau

SEQ ID NO: 731813 - RNA, 16 nt, Homo sapiens
uuaagugacuauagaa

SEQ ID NO: 731814 - RNA, 12 nt, Homo sapiens
uuaagugauuau

SEQ ID NO: 731815 - RNA, 13 nt, Homo sapiens
uuaagugugcuua

SEQ ID NO: 731816 - RNA, 23 nt, Homo sapiens
uuaaguucaggcagcacaucaau

SEQ ID NO: 731817 - RNA, 17 nt, Homo sapiens
uuaaguuucucuucacc

SEQ ID NO: 731818 - RNA, 16 nt, Homo sapiens
uuaauaaagacagggu

SEQ ID NO: 731819 - RNA, 14 nt, Homo sapiens
uuaauaaagcauuc

SEQ ID NO: 731820 - RNA, 22 nt, Homo sapiens
uuaauaaagcauucuuuaacag

SEQ ID NO: 731821 - RNA, 18 nt, Homo sapiens
uuaauaaaugaaugauuu

SEQ ID NO: 731822 - RNA, 16 nt, Homo sapiens
uuaauaaauucagaua

SEQ ID NO: 731823 - RNA, 14 nt, Homo sapiens
uuaauacaugcaac

SEQ ID NO: 731824 - RNA, 20 nt, Homo sapiens
uuaauagaaauaaauuccua

SEQ ID NO: 731825 - RNA, 18 nt, Homo sapiens
uuaauagggaauauaucu

SEQ ID NO: 731826 - RNA, 23 nt, Homo sapiens
uuaauauguuaaccucaguguca

SEQ ID NO: 731827 - RNA, 17 nt, Homo sapiens
uuaauccaauauuuugc

SEQ ID NO: 731828 - RNA, 21 nt, Homo sapiens
uuaauccacaucuuuacucag

SEQ ID NO: 731829 - RNA, 21 nt, Homo sapiens
uuaauccugcauuugcagaug

SEQ ID NO: 731830 - RNA, 21 nt, Homo sapiens
uuaaucucugcugaaacucag

SEQ ID NO: 731831 - RNA, 18 nt, Homo sapiens
uuaaucuguuauguacua

SEQ ID NO: 731832 - RNA, 17 nt, Homo sapiens
uuaaucuuaagauucuu

SEQ ID NO: 731833 - RNA, 21 nt, Homo sapiens
uuaaugaacacacaagcuugu

SEQ ID NO: 731834 - RNA, 14 nt, Homo sapiens
uuaaugaaugaguc

SEQ ID NO: 731835 - RNA, 15 nt, Homo sapiens
uuaaugagacaugaa

SEQ ID NO: 731836 - RNA, 17 nt, Homo sapiens
uuaaugagccaucacua

SEQ ID NO: 731837 - RNA, 21 nt, Homo sapiens
uuaaugagggaaaauguuuac

SEQ ID NO: 731838 - RNA, 19 nt, Homo sapiens
uuaaugcacagugcauuau

SEQ ID NO: 731839 - RNA, 17 nt, Homo sapiens
uuaauggauucaguauu

SEQ ID NO: 731840 - RNA, 18 nt, Homo sapiens
uuaauggggauuccacua

SEQ ID NO: 731841 - RNA, 12 nt, Homo sapiens
uuaauguacaaa

SEQ ID NO: 731842 - RNA, 21 nt, Homo sapiens
uuaaugugguucgaaagacuc

SEQ ID NO: 731843 - RNA, 17 nt, Homo sapiens
uuaauguuauaucauau

SEQ ID NO: 731844 - RNA, 15 nt, Homo sapiens
uuaauuaaguacaac

SEQ ID NO: 731845 - RNA, 15 nt, Homo sapiens
uuaauucacagaaua

SEQ ID NO: 731846 - RNA, 17 nt, Homo sapiens
uuaauucauaaaucaca

SEQ ID NO: 731847 - RNA, 14 nt, Homo sapiens
uuaauucaucuuua

SEQ ID NO: 731848 - RNA, 15 nt, Homo sapiens
uuaauucucugcaac

SEQ ID NO: 731849 - RNA, 12 nt, Homo sapiens
uuaauucuuaga

SEQ ID NO: 731850 - RNA, 16 nt, Homo sapiens
uuaauuguaauugcau

SEQ ID NO: 731851 - RNA, 23 nt, Homo sapiens
uuaauuguauaagucaagcacau

SEQ ID NO: 731852 - RNA, 20 nt, Homo sapiens
uuaauuuacuuuaagcauug

SEQ ID NO: 731853 - RNA, 19 nt, Homo sapiens
uuaauuuccuuuuugacac

SEQ ID NO: 731854 - RNA, 22 nt, Homo sapiens
uuaauuuccuuuuugacacuga

SEQ ID NO: 731855 - RNA, 19 nt, Homo sapiens
uuaauuucugucaaaugca

SEQ ID NO: 731856 - RNA, 18 nt, Homo sapiens
uuaauuuuaaccaaaaca

SEQ ID NO: 731857 - RNA, 17 nt, Homo sapiens
uuaauuuuaacugccaa

SEQ ID NO: 731858 - RNA, 17 nt, Homo sapiens
uuaauuuuauugcaaag

SEQ ID NO: 731859 - RNA, 15 nt, Homo sapiens
uuaauuuucuaugug

SEQ ID NO: 731860 - RNA, 18 nt, Homo sapiens
uuacaaaaaaauacaaaa

SEQ ID NO: 731861 - RNA, 12 nt, Homo sapiens
uuacaaacagac

SEQ ID NO: 731862 - RNA, 14 nt, Homo sapiens
uuacaaauggugaa

SEQ ID NO: 731863 - RNA, 15 nt, Homo sapiens
uuacaacagugagaa

SEQ ID NO: 731864 - RNA, 20 nt, Homo sapiens
uuacaacccagggugugaac

SEQ ID NO: 731865 - RNA, 23 nt, Homo sapiens
uuacaacuugaaauugcuuugcu

SEQ ID NO: 731866 - RNA, 21 nt, Homo sapiens
uuacaagauguauuuguugua

SEQ ID NO: 731867 - RNA, 16 nt, Homo sapiens
uuacaaggagggguua

SEQ ID NO: 731868 - RNA, 18 nt, Homo sapiens
uuacaaguuuauauauau

SEQ ID NO: 731869 - RNA, 19 nt, Homo sapiens
uuacacagaaaugcugcug

SEQ ID NO: 731870 - RNA, 17 nt, Homo sapiens
uuacacucuugauucua

SEQ ID NO: 731871 - RNA, 18 nt, Homo sapiens
uuacacugaggacugugg

SEQ ID NO: 731872 - RNA, 12 nt, Homo sapiens
uuacagaauuau

SEQ ID NO: 731873 - RNA, 13 nt, Homo sapiens
uuacagacaggaa

SEQ ID NO: 731874 - RNA, 18 nt, Homo sapiens
uuacagacaugagccucc

SEQ ID NO: 731875 - RNA, 14 nt, Homo sapiens
uuacagacucugau

SEQ ID NO: 731876 - RNA, 20 nt, Homo sapiens
uuacagagagcuugcuguga

SEQ ID NO: 731877 - RNA, 14 nt, Homo sapiens
uuacagagccuuga

SEQ ID NO: 731878 - RNA, 15 nt, Homo sapiens
uuacagcacuacucu

SEQ ID NO: 731879 - RNA, 20 nt, Homo sapiens
uuacaggauaucacauugga

SEQ ID NO: 731880 - RNA, 18 nt, Homo sapiens
uuacagggagcugggaca

SEQ ID NO: 731881 - RNA, 16 nt, Homo sapiens
uuacagugcagacagg

SEQ ID NO: 731882 - RNA, 12 nt, Homo sapiens
uuacaguguaug

SEQ ID NO: 731883 - RNA, 12 nt, Homo sapiens
uuacauacaaau

SEQ ID NO: 731884 - RNA, 23 nt, Homo sapiens
uuacauagaugauaaaagagaag

SEQ ID NO: 731885 - RNA, 22 nt, Homo sapiens
uuacauauauucccauguaaug

SEQ ID NO: 731886 - RNA, 16 nt, Homo sapiens
uuacaugaaacuacuc

SEQ ID NO: 731887 - RNA, 14 nt, Homo sapiens
uuacaugcauuuga

SEQ ID NO: 731888 - RNA, 10 nt, Homo sapiens
uuacauuguu

SEQ ID NO: 731889 - RNA, 11 nt, Homo sapiens
uuacauuuaau

SEQ ID NO: 731890 - RNA, 22 nt, Homo sapiens
uuaccagaugcugacuggcacu

SEQ ID NO: 731891 - RNA, 22 nt, Homo sapiens
uuaccauucugauggcacagaa

SEQ ID NO: 731892 - RNA, 13 nt, Homo sapiens
uuacccacugcca

SEQ ID NO: 731893 - RNA, 19 nt, Homo sapiens
uuacccaggcuggagugca

SEQ ID NO: 731894 - RNA, 22 nt, Homo sapiens
uuaccugggcauucuuguuuca

SEQ ID NO: 731895 - RNA, 20 nt, Homo sapiens
uuaccuguacacugacuuga

SEQ ID NO: 731896 - RNA, 22 nt, Homo sapiens
uuaccuucaaaggccaagagaa

SEQ ID NO: 731897 - RNA, 21 nt, Homo sapiens
uuaccuuguuauuuaacccau

SEQ ID NO: 731898 - RNA, 14 nt, Homo sapiens
uuacgcccaucuca

SEQ ID NO: 731899 - RNA, 20 nt, Homo sapiens
uuacgugcucccucagcucc

SEQ ID NO: 731900 - RNA, 13 nt, Homo sapiens
uuacuaaacauuu

SEQ ID NO: 731901 - RNA, 23 nt, Homo sapiens
uuacuaaauuuucuaauuaaaga

SEQ ID NO: 731902 - RNA, 13 nt, Homo sapiens
uuacuaaugaugc

SEQ ID NO: 731903 - RNA, 17 nt, Homo sapiens
uuacuaauuauacuacu

SEQ ID NO: 731904 - RNA, 16 nt, Homo sapiens
uuacuauaauuugacu

SEQ ID NO: 731905 - RNA, 18 nt, Homo sapiens
uuacuaugugccaguucc

SEQ ID NO: 731906 - RNA, 23 nt, Homo sapiens
uuacuauucacugaugcagaaag

SEQ ID NO: 731907 - RNA, 13 nt, Homo sapiens
uuacuauugcaaa

SEQ ID NO: 731908 - RNA, 21 nt, Homo sapiens
uuacucagaggagcugcaaau

SEQ ID NO: 731909 - RNA, 14 nt, Homo sapiens
uuacucagcccagc

SEQ ID NO: 731910 - RNA, 12 nt, Homo sapiens
uuacugaaguua

SEQ ID NO: 731911 - RNA, 23 nt, Homo sapiens
uuacugagaaugaugguuuccaa

SEQ ID NO: 731912 - RNA, 20 nt, Homo sapiens
uuacugagcuucucugugaa

SEQ ID NO: 731913 - RNA, 12 nt, Homo sapiens
uuacugcuugac

SEQ ID NO: 731914 - RNA, 21 nt, Homo sapiens
uuacuggaauucuucugcaac

SEQ ID NO: 731915 - RNA, 19 nt, Homo sapiens
uuacugguagaaaggcagu

SEQ ID NO: 731916 - RNA, 20 nt, Homo sapiens
uuacuguacccucgcaugac

SEQ ID NO: 731917 - RNA, 21 nt, Homo sapiens
uuacuguacccucgcaugacu

SEQ ID NO: 731918 - RNA, 23 nt, Homo sapiens
uuacuguacccucgcaugacugu

SEQ ID NO: 731919 - RNA, 23 nt, Homo sapiens
uuacuguauuuaagaaaacacca

SEQ ID NO: 731920 - RNA, 23 nt, Homo sapiens
uuacugugauauuuuaaauaucc

SEQ ID NO: 731921 - RNA, 16 nt, Homo sapiens
uuacuucccuaaugaa

SEQ ID NO: 731922 - RNA, 14 nt, Homo sapiens
uuacuuuaagcauu

SEQ ID NO: 731923 - RNA, 21 nt, Homo sapiens
uuacuuugauaucugaucaaa

SEQ ID NO: 731924 - RNA, 23 nt, Homo sapiens
uuacuuuuuccuggcucaucucu

SEQ ID NO: 731925 - RNA, 14 nt, Homo sapiens
uuagaaaaggugau

SEQ ID NO: 731926 - RNA, 23 nt, Homo sapiens
uuagaaaugagaaaaauacagag

SEQ ID NO: 731927 - RNA, 19 nt, Homo sapiens
uuagaaaugagaucuagag

SEQ ID NO: 731928 - RNA, 13 nt, Homo sapiens
uuagaaaugcaaa

SEQ ID NO: 731929 - RNA, 12 nt, Homo sapiens
uuagaaauggau

SEQ ID NO: 731930 - RNA, 16 nt, Homo sapiens
uuagaacuccaguuuu

SEQ ID NO: 731931 - RNA, 18 nt, Homo sapiens
uuagaagccaacuaugau

SEQ ID NO: 731932 - RNA, 16 nt, Homo sapiens
uuagaagcccauucau

SEQ ID NO: 731933 - RNA, 19 nt, Homo sapiens
uuagaagugcuaauuucug

SEQ ID NO: 731934 - RNA, 14 nt, Homo sapiens
uuagaauacaguuu

SEQ ID NO: 731935 - RNA, 18 nt, Homo sapiens
uuagaauauccaugaccu

SEQ ID NO: 731936 - RNA, 23 nt, Homo sapiens
uuagaauauccaugaccuaguuu

SEQ ID NO: 731937 - RNA, 19 nt, Homo sapiens
uuagaccccauacaaguuu

SEQ ID NO: 731938 - RNA, 22 nt, Homo sapiens
uuagagaaacuuugaguacaga

SEQ ID NO: 731939 - RNA, 14 nt, Homo sapiens
uuagagacaucaaa

SEQ ID NO: 731940 - RNA, 13 nt, Homo sapiens
uuagaucagggga

SEQ ID NO: 731941 - RNA, 17 nt, Homo sapiens
uuagaucucauaaugcu

SEQ ID NO: 731942 - RNA, 16 nt, Homo sapiens
uuagaugaugacucaa

SEQ ID NO: 731943 - RNA, 14 nt, Homo sapiens
uuagauuaguauuu

SEQ ID NO: 731944 - RNA, 22 nt, Homo sapiens
uuagauucucugugucuaagau

SEQ ID NO: 731945 - RNA, 20 nt, Homo sapiens
uuagcaaaagcguccagaaa

SEQ ID NO: 731946 - RNA, 16 nt, Homo sapiens
uuagcaaccauaauau

SEQ ID NO: 731947 - RNA, 17 nt, Homo sapiens
uuagcaauugacuguca

SEQ ID NO: 731948 - RNA, 21 nt, Homo sapiens
uuagcauaaaauuuucuacuc

SEQ ID NO: 731949 - RNA, 17 nt, Homo sapiens
uuagccaggaggccagg

SEQ ID NO: 731950 - RNA, 17 nt, Homo sapiens
uuagccagguaauguga

SEQ ID NO: 731951 - RNA, 15 nt, Homo sapiens
uuagccccagggauc

SEQ ID NO: 731952 - RNA, 16 nt, Homo sapiens
uuagccccgaguuuaa

SEQ ID NO: 731953 - RNA, 18 nt, Homo sapiens
uuagccgcccaugcacug

SEQ ID NO: 731954 - RNA, 21 nt, Homo sapiens
uuagccgggcaugauggugca

SEQ ID NO: 731955 - RNA, 16 nt, Homo sapiens
uuagcgucaagacauu

SEQ ID NO: 731956 - RNA, 13 nt, Homo sapiens
uuagcuaccucac

SEQ ID NO: 731957 - RNA, 23 nt, Homo sapiens
uuagcuaccucacuaugcugcuu

SEQ ID NO: 731958 - RNA, 18 nt, Homo sapiens
uuagcucacugaaucuuc

SEQ ID NO: 731959 - RNA, 17 nt, Homo sapiens
uuagcucauuugagaua

SEQ ID NO: 731960 - RNA, 20 nt, Homo sapiens
uuagcuccauaaaguacaaa

SEQ ID NO: 731961 - RNA, 20 nt, Homo sapiens
uuagcugguggcaauaaaua

SEQ ID NO: 731962 - RNA, 18 nt, Homo sapiens
uuagcugucucagagaua

SEQ ID NO: 731963 - RNA, 14 nt, Homo sapiens
uuagcuuuacaaau

SEQ ID NO: 731964 - RNA, 17 nt, Homo sapiens
uuaggaaagaauaaaga

SEQ ID NO: 731965 - RNA, 17 nt, Homo sapiens
uuaggaaaggagaucaa

SEQ ID NO: 731966 - RNA, 16 nt, Homo sapiens
uuaggacaaaucugca

SEQ ID NO: 731967 - RNA, 22 nt, Homo sapiens
uuaggacauaaacccuugccag

SEQ ID NO: 731968 - RNA, 21 nt, Homo sapiens
uuaggcgggauuuaugugcac

SEQ ID NO: 731969 - RNA, 23 nt, Homo sapiens
uuagggcugaaucuucuggagaa

SEQ ID NO: 731970 - RNA, 15 nt, Homo sapiens
uuagggguucauucu

SEQ ID NO: 731971 - RNA, 21 nt, Homo sapiens
uuaggucagcagccucccuga

SEQ ID NO: 731972 - RNA, 13 nt, Homo sapiens
uuagguugcugac

SEQ ID NO: 731973 - RNA, 19 nt, Homo sapiens
uuagucaauccugucauau

SEQ ID NO: 731974 - RNA, 16 nt, Homo sapiens
uuaguccuaauucaau

SEQ ID NO: 731975 - RNA, 15 nt, Homo sapiens
uuagucucaugugaa

SEQ ID NO: 731976 - RNA, 11 nt, Homo sapiens
uuagucuccca

SEQ ID NO: 731977 - RNA, 21 nt, Homo sapiens
uuagugaucaaauugugcagu

SEQ ID NO: 731978 - RNA, 18 nt, Homo sapiens
uuagugcacaagcacuau

SEQ ID NO: 731979 - RNA, 22 nt, Homo sapiens
uuaguggagaugggguuucacc

SEQ ID NO: 731980 - RNA, 23 nt, Homo sapiens
uuaguguucuguuugaaacuaau

SEQ ID NO: 731981 - RNA, 16 nt, Homo sapiens
uuaguguuuugccuca

SEQ ID NO: 731982 - RNA, 13 nt, Homo sapiens
uuaguuggcugga

SEQ ID NO: 731983 - RNA, 20 nt, Homo sapiens
uuaguugguuugugugauca

SEQ ID NO: 731984 - RNA, 14 nt, Homo sapiens
uuaguuuucuagua

SEQ ID NO: 731985 - RNA, 13 nt, Homo sapiens
uuaguuuugcaua

SEQ ID NO: 731986 - RNA, 16 nt, Homo sapiens
uuaguuuuugaucaag

SEQ ID NO: 731987 - RNA, 20 nt, Homo sapiens
uuauaaaaaugagugcuuaa

SEQ ID NO: 731988 - RNA, 18 nt, Homo sapiens
uuauaaaauccugugcaa

SEQ ID NO: 731989 - RNA, 18 nt, Homo sapiens
uuauaaacaacaucaaaa

SEQ ID NO: 731990 - RNA, 20 nt, Homo sapiens
uuauaaacccacauucuuac

SEQ ID NO: 731991 - RNA, 21 nt, Homo sapiens
uuauaaacuuuagaguagcau

SEQ ID NO: 731992 - RNA, 21 nt, Homo sapiens
uuauaaauuuuauaacagaau

SEQ ID NO: 731993 - RNA, 18 nt, Homo sapiens
uuauaacccauauuuucc

SEQ ID NO: 731994 - RNA, 23 nt, Homo sapiens
uuauaagagugccguaacaacug

SEQ ID NO: 731995 - RNA, 12 nt, Homo sapiens
uuauaaucuacu

SEQ ID NO: 731996 - RNA, 18 nt, Homo sapiens
uuauacaaaccuaccaaa

SEQ ID NO: 731997 - RNA, 19 nt, Homo sapiens
uuauacaaaccuaccaaaa

SEQ ID NO: 731998 - RNA, 15 nt, Homo sapiens
uuauacagcaaagga

SEQ ID NO: 731999 - RNA, 23 nt, Homo sapiens
uuauacccccaggaaacuagcuu

SEQ ID NO: 732000 - RNA, 16 nt, Homo sapiens
uuauacgcuggcaaca

SEQ ID NO: 732001 - RNA, 19 nt, Homo sapiens
uuauacuguggcuaugcaa

SEQ ID NO: 732002 - RNA, 12 nt, Homo sapiens
uuauacuuucag

SEQ ID NO: 732003 - RNA, 21 nt, Homo sapiens
uuauagaauauuuauuaccuc

SEQ ID NO: 732004 - RNA, 23 nt, Homo sapiens
uuauagaguguacuuaacuauuc

SEQ ID NO: 732005 - RNA, 12 nt, Homo sapiens
uuauagauucua

SEQ ID NO: 732006 - RNA, 15 nt, Homo sapiens
uuauagcaacuuuaa

SEQ ID NO: 732007 - RNA, 16 nt, Homo sapiens
uuauaguaacaucaaa

SEQ ID NO: 732008 - RNA, 12 nt, Homo sapiens
uuauauaauuca

SEQ ID NO: 732009 - RNA, 14 nt, Homo sapiens
uuauauaauucaag

SEQ ID NO: 732010 - RNA, 18 nt, Homo sapiens
uuauaugauucacaugcu

SEQ ID NO: 732011 - RNA, 17 nt, Homo sapiens
uuauaugccugauucau

SEQ ID NO: 732012 - RNA, 16 nt, Homo sapiens
uuauauggaugauuca

SEQ ID NO: 732013 - RNA, 14 nt, Homo sapiens
uuauauuucacuau

SEQ ID NO: 732014 - RNA, 22 nt, Homo sapiens
uuauauuuggguuaugauguca

SEQ ID NO: 732015 - RNA, 16 nt, Homo sapiens
uuauauuuguuuuaga

SEQ ID NO: 732016 - RNA, 19 nt, Homo sapiens
uuauauuuuggguacugga

SEQ ID NO: 732017 - RNA, 14 nt, Homo sapiens
uuaucaauucugau

SEQ ID NO: 732018 - RNA, 21 nt, Homo sapiens
uuaucaucccaacagccaaga

SEQ ID NO: 732019 - RNA, 21 nt, Homo sapiens
uuaucaugcauguccuguaaa

SEQ ID NO: 732020 - RNA, 19 nt, Homo sapiens
uuaucauuaaaaauuaccu

SEQ ID NO: 732021 - RNA, 13 nt, Homo sapiens
uuaucauugcuaa

SEQ ID NO: 732022 - RNA, 16 nt, Homo sapiens
uuauccaucaauauua

SEQ ID NO: 732023 - RNA, 14 nt, Homo sapiens
uuaucuauaucuca

SEQ ID NO: 732024 - RNA, 21 nt, Homo sapiens
uuaucuauuccugaaauuucu

SEQ ID NO: 732025 - RNA, 23 nt, Homo sapiens
uuaucucaaaaagugacuuccaa

SEQ ID NO: 732026 - RNA, 16 nt, Homo sapiens
uuaucucaaaacugca

SEQ ID NO: 732027 - RNA, 16 nt, Homo sapiens
uuaucucucaaaacaa

SEQ ID NO: 732028 - RNA, 20 nt, Homo sapiens
uuaucucugaggcauggugu

SEQ ID NO: 732029 - RNA, 13 nt, Homo sapiens
uuaucugugcaaa

SEQ ID NO: 732030 - RNA, 15 nt, Homo sapiens
uuaucuuuauaugaa

SEQ ID NO: 732031 - RNA, 17 nt, Homo sapiens
uuaugaaaacuagcauu

SEQ ID NO: 732032 - RNA, 22 nt, Homo sapiens
uuaugaagcaagccccacuuau

SEQ ID NO: 732033 - RNA, 22 nt, Homo sapiens
uuaugaccaugguauauuccua

SEQ ID NO: 732034 - RNA, 22 nt, Homo sapiens
uuaugacuguuuuuguaguggu

SEQ ID NO: 732035 - RNA, 17 nt, Homo sapiens
uuaugaucaauuguuaa

SEQ ID NO: 732036 - RNA, 15 nt, Homo sapiens
uuaugaugcauacag

SEQ ID NO: 732037 - RNA, 18 nt, Homo sapiens
uuaugauggagcaacuga

SEQ ID NO: 732038 - RNA, 15 nt, Homo sapiens
uuaugcaaaagcagc

SEQ ID NO: 732039 - RNA, 17 nt, Homo sapiens
uuaugcaaauacaauca

SEQ ID NO: 732040 - RNA, 18 nt, Homo sapiens
uuaugcaaauacaaucag

SEQ ID NO: 732041 - RNA, 21 nt, Homo sapiens
uuaugcagaauccaaaguaaa

SEQ ID NO: 732042 - RNA, 13 nt, Homo sapiens
uuaugcagagcca

SEQ ID NO: 732043 - RNA, 16 nt, Homo sapiens
uuaugcauaaagucag

SEQ ID NO: 732044 - RNA, 21 nt, Homo sapiens
uuaugccuucacuuuacaaau

SEQ ID NO: 732045 - RNA, 16 nt, Homo sapiens
uuaugcuaugaagagu

SEQ ID NO: 732046 - RNA, 11 nt, Homo sapiens
uuaugcugcug

SEQ ID NO: 732047 - RNA, 19 nt, Homo sapiens
uuauggcauuuuucuggga

SEQ ID NO: 732048 - RNA, 17 nt, Homo sapiens
uuaugguuaauacuauu

SEQ ID NO: 732049 - RNA, 17 nt, Homo sapiens
uuauguagguaagacug

SEQ ID NO: 732050 - RNA, 21 nt, Homo sapiens
uuauguaugaaaaguaacuga

SEQ ID NO: 732051 - RNA, 17 nt, Homo sapiens
uuauguauuuaugaccu

SEQ ID NO: 732052 - RNA, 19 nt, Homo sapiens
uuaugucucuugagcauca

SEQ ID NO: 732053 - RNA, 14 nt, Homo sapiens
uuaugucugcugaa

SEQ ID NO: 732054 - RNA, 21 nt, Homo sapiens
uuaugugcaaaaucuguuaua

SEQ ID NO: 732055 - RNA, 16 nt, Homo sapiens
uuaugugcaaguuuau

SEQ ID NO: 732056 - RNA, 21 nt, Homo sapiens
uuauguggaagaacugugaua

SEQ ID NO: 732057 - RNA, 14 nt, Homo sapiens
uuaugugugccuuu

SEQ ID NO: 732058 - RNA, 13 nt, Homo sapiens
uuauuaacuaaga

SEQ ID NO: 732059 - RNA, 14 nt, Homo sapiens
uuauuaacuuuaau

SEQ ID NO: 732060 - RNA, 13 nt, Homo sapiens
uuauuaaguaaaa

SEQ ID NO: 732061 - RNA, 17 nt, Homo sapiens
uuauuacauggggucua

SEQ ID NO: 732062 - RNA, 16 nt, Homo sapiens
uuauuaccauuagcau

SEQ ID NO: 732063 - RNA, 15 nt, Homo sapiens
uuauuaccucugaua

SEQ ID NO: 732064 - RNA, 21 nt, Homo sapiens
uuauuaccucugauaccucaa

SEQ ID NO: 732065 - RNA, 21 nt, Homo sapiens
uuauuagguacguaacuauuu

SEQ ID NO: 732066 - RNA, 15 nt, Homo sapiens
uuauuauaugacuag

SEQ ID NO: 732067 - RNA, 18 nt, Homo sapiens
uuauuaugagcuacaaca

SEQ ID NO: 732068 - RNA, 13 nt, Homo sapiens
uuauuauugcugu

SEQ ID NO: 732069 - RNA, 16 nt, Homo sapiens
uuauucaaguauucau

SEQ ID NO: 732070 - RNA, 22 nt, Homo sapiens
uuauucauuuggugacugugua

SEQ ID NO: 732071 - RNA, 22 nt, Homo sapiens
uuauuccggaaacuaguguaca

SEQ ID NO: 732072 - RNA, 19 nt, Homo sapiens
uuauucuaaacagacucau

SEQ ID NO: 732073 - RNA, 15 nt, Homo sapiens
uuauucuugcaaaga

SEQ ID NO: 732074 - RNA, 15 nt, Homo sapiens
uuauucuugguuuuc

SEQ ID NO: 732075 - RNA, 20 nt, Homo sapiens
uuauugaauguuauaucauc

SEQ ID NO: 732076 - RNA, 14 nt, Homo sapiens
uuauugagauucau

SEQ ID NO: 732077 - RNA, 23 nt, Homo sapiens
uuauuggaugucaauagcauugu

SEQ ID NO: 732078 - RNA, 19 nt, Homo sapiens
uuauugucucugugacuga

SEQ ID NO: 732079 - RNA, 23 nt, Homo sapiens
uuauuguuuauuuaucagugaca

SEQ ID NO: 732080 - RNA, 12 nt, Homo sapiens
uuauuuacauuu

SEQ ID NO: 732081 - RNA, 19 nt, Homo sapiens
uuauuuagggaacugcuug

SEQ ID NO: 732082 - RNA, 22 nt, Homo sapiens
uuauuucaaagggaaacuuuaa

SEQ ID NO: 732083 - RNA, 14 nt, Homo sapiens
uuauuucacuaaau

SEQ ID NO: 732084 - RNA, 21 nt, Homo sapiens
uuauuucaggaaggucuucaa

SEQ ID NO: 732085 - RNA, 21 nt, Homo sapiens
uuauuuccacuuauaaaggaa

SEQ ID NO: 732086 - RNA, 15 nt, Homo sapiens
uuauuugaaggccag

SEQ ID NO: 732087 - RNA, 21 nt, Homo sapiens
uuauuuggauaucaaaagcaa

SEQ ID NO: 732088 - RNA, 15 nt, Homo sapiens
uuauuuugcauucca

SEQ ID NO: 732089 - RNA, 11 nt, Homo sapiens
uuauuuuggaa

SEQ ID NO: 732090 - RNA, 14 nt, Homo sapiens
uuauuuuggaucua

SEQ ID NO: 732091 - RNA, 16 nt, Homo sapiens
uuauuuuguucauaca

SEQ ID NO: 732092 - RNA, 17 nt, Homo sapiens
uucaaaaaauuauauga

SEQ ID NO: 732093 - RNA, 21 nt, Homo sapiens
uucaaaaaauuauaugaccau

SEQ ID NO: 732094 - RNA, 13 nt, Homo sapiens
uucaaaaguucca

SEQ ID NO: 732095 - RNA, 16 nt, Homo sapiens
uucaaaauccaaaaag

SEQ ID NO: 732096 - RNA, 19 nt, Homo sapiens
uucaaaauguucuauuuaa

SEQ ID NO: 732097 - RNA, 12 nt, Homo sapiens
uucaaacauaua

SEQ ID NO: 732098 - RNA, 13 nt, Homo sapiens
uucaaacugugaa

SEQ ID NO: 732099 - RNA, 12 nt, Homo sapiens
uucaaacuuaaa

SEQ ID NO: 732100 - RNA, 18 nt, Homo sapiens
uucaaagaagucauggcc

SEQ ID NO: 732101 - RNA, 22 nt, Homo sapiens
uucaaagagacauauacuaaga

SEQ ID NO: 732102 - RNA, 13 nt, Homo sapiens
uucaaaguuaaaa

SEQ ID NO: 732103 - RNA, 22 nt, Homo sapiens
uucaaaucacauggaacuuuag

SEQ ID NO: 732104 - RNA, 15 nt, Homo sapiens
uucaaaucagugauc

SEQ ID NO: 732105 - RNA, 15 nt, Homo sapiens
uucaaauuuguacag

SEQ ID NO: 732106 - RNA, 19 nt, Homo sapiens
uucaacaaagaaacaaaga

SEQ ID NO: 732107 - RNA, 23 nt, Homo sapiens
uucaacauggucuaauuauuuac

SEQ ID NO: 732108 - RNA, 11 nt, Homo sapiens
uucaaccacug

SEQ ID NO: 732109 - RNA, 20 nt, Homo sapiens
uucaacccucagccuugaaa

SEQ ID NO: 732110 - RNA, 17 nt, Homo sapiens
uucuuguuuaccaaaga

SEQ ID NO: 732111 - RNA, 22 nt, Homo sapiens
uucuuguuugucagcaucugac

SEQ ID NO: 732112 - RNA, 23 nt, Homo sapiens
uucuuuaacauacaucuaaguca

SEQ ID NO: 732113 - RNA, 20 nt, Homo sapiens
uucuuuaccaaggauauuua

SEQ ID NO: 732114 - RNA, 13 nt, Homo sapiens
uucuuuacuccau

SEQ ID NO: 732115 - RNA, 21 nt, Homo sapiens
uucuuuagaauuuuuacccaa

SEQ ID NO: 732116 - RNA, 16 nt, Homo sapiens
uucuuuagaugccaaa

SEQ ID NO: 732117 - RNA, 23 nt, Homo sapiens
uucuuuagaugccaaaccacaag

SEQ ID NO: 732118 - RNA, 11 nt, Homo sapiens
uucuuuaguuu

SEQ ID NO: 732119 - RNA, 19 nt, Homo sapiens
uucuuucccaaaaugugcc

SEQ ID NO: 732120 - RNA, 14 nt, Homo sapiens
uucuuucuguugaa

SEQ ID NO: 732121 - RNA, 16 nt, Homo sapiens
uucuuugaaauauaau

SEQ ID NO: 732122 - RNA, 19 nt, Homo sapiens
uucuuugcccagacauuua

SEQ ID NO: 732123 - RNA, 12 nt, Homo sapiens
uucuuugccucu

SEQ ID NO: 732124 - RNA, 15 nt, Homo sapiens
uucuuugggcugugg

SEQ ID NO: 732125 - RNA, 20 nt, Homo sapiens
uucuuuguguuuggaucaaa

SEQ ID NO: 732126 - RNA, 21 nt, Homo sapiens
uucuuuuccaagcuccuuauu

SEQ ID NO: 732127 - RNA, 13 nt, Homo sapiens
uucuuuugacuga

SEQ ID NO: 732128 - RNA, 16 nt, Homo sapiens
uucuuuuucuguugaa

SEQ ID NO: 732129 - RNA, 18 nt, Homo sapiens
uucuuuuuugcccccaga

SEQ ID NO: 732130 - RNA, 18 nt, Homo sapiens
uucuuuuuuuugagacaa

SEQ ID NO: 732131 - RNA, 20 nt, Homo sapiens
uugaaaaaaaacaguggauc

SEQ ID NO: 732132 - RNA, 13 nt, Homo sapiens
uugaaaaaguaua

SEQ ID NO: 732133 - RNA, 15 nt, Homo sapiens
uugaaaacugugcaa

SEQ ID NO: 732134 - RNA, 13 nt, Homo sapiens
uugaaaaugggcu

SEQ ID NO: 732135 - RNA, 17 nt, Homo sapiens
uugaaaauguccaggaa

SEQ ID NO: 732136 - RNA, 13 nt, Homo sapiens
uugaaacuuugaa

SEQ ID NO: 732137 - RNA, 15 nt, Homo sapiens
uugaaagaaauggug

SEQ ID NO: 732138 - RNA, 16 nt, Homo sapiens
uugaaagagauccagg

SEQ ID NO: 732139 - RNA, 20 nt, Homo sapiens
uugaaagaucaaaagguuaa

SEQ ID NO: 732140 - RNA, 18 nt, Homo sapiens
uugaaaguuaacauuaau

SEQ ID NO: 732141 - RNA, 23 nt, Homo sapiens
uugaaauaaaugacaauguaauu

SEQ ID NO: 732142 - RNA, 16 nt, Homo sapiens
uugaaauagucugugu

SEQ ID NO: 732143 - RNA, 22 nt, Homo sapiens
uugaaaucaaugcaagagugau

SEQ ID NO: 732144 - RNA, 20 nt, Homo sapiens
uugaaaugaguaaaaacuag

SEQ ID NO: 732145 - RNA, 20 nt, Homo sapiens
uugaaaugauaugaccaaaa

SEQ ID NO: 732146 - RNA, 21 nt, Homo sapiens
uugaacaaaaauguuuccacu

SEQ ID NO: 732147 - RNA, 20 nt, Homo sapiens
uugaacccgggggacagagg

SEQ ID NO: 732148 - RNA, 15 nt, Homo sapiens
uugaacucuguaaaa

SEQ ID NO: 732149 - RNA, 19 nt, Homo sapiens
uugaacuuauuuacacaua

SEQ ID NO: 732150 - RNA, 12 nt, Homo sapiens
uugaacuuguca

SEQ ID NO: 732151 - RNA, 18 nt, Homo sapiens
uugaacuuuauaaaacau

SEQ ID NO: 732152 - RNA, 23 nt, Homo sapiens
uugaagaaaauucagaaugaagu

SEQ ID NO: 732153 - RNA, 18 nt, Homo sapiens
uugaagaagaguuucucc

SEQ ID NO: 732154 - RNA, 21 nt, Homo sapiens
uugaagaagaguuucuccuuu

SEQ ID NO: 732155 - RNA, 22 nt, Homo sapiens
uugaagacaauuugauacauaa

SEQ ID NO: 732156 - RNA, 19 nt, Homo sapiens
uugaagacguggacuccuc

SEQ ID NO: 732157 - RNA, 23 nt, Homo sapiens
uugaagcucuggugacaccagcc

SEQ ID NO: 732158 - RNA, 16 nt, Homo sapiens
uugaagcugacucaaa

SEQ ID NO: 732159 - RNA, 22 nt, Homo sapiens
uugaaggaagagggaccagggu

SEQ ID NO: 732160 - RNA, 23 nt, Homo sapiens
uugaaggccuuauucuacauuuc

SEQ ID NO: 732161 - RNA, 13 nt, Homo sapiens
uugaagggccaga

SEQ ID NO: 732162 - RNA, 19 nt, Homo sapiens
uugaagucagccacacugg

SEQ ID NO: 732163 - RNA, 16 nt, Homo sapiens
uugaagucuguacaga

SEQ ID NO: 732164 - RNA, 20 nt, Homo sapiens
uugaagucuguacagauuca

SEQ ID NO: 732165 - RNA, 18 nt, Homo sapiens
uugaauaaaagugcacac

SEQ ID NO: 732166 - RNA, 19 nt, Homo sapiens
uugaaucagaaugccuuca

SEQ ID NO: 732167 - RNA, 16 nt, Homo sapiens
uugaaucuacauucac

SEQ ID NO: 732168 - RNA, 14 nt, Homo sapiens
uugaaugcacuuuu

SEQ ID NO: 732169 - RNA, 22 nt, Homo sapiens
uugaauggaaaacacauggugu

SEQ ID NO: 732170 - RNA, 19 nt, Homo sapiens
uugaauuucuggaagauuc

SEQ ID NO: 732171 - RNA, 19 nt, Homo sapiens
uugacaaagaaacccaagu

SEQ ID NO: 732172 - RNA, 15 nt, Homo sapiens
uugacaacugugacu

SEQ ID NO: 732173 - RNA, 15 nt, Homo sapiens
uugacaauaauuuca

SEQ ID NO: 732174 - RNA, 17 nt, Homo sapiens
uugacacauaugaacac

SEQ ID NO: 732175 - RNA, 20 nt, Homo sapiens
uugacacuauucacuaaaau

SEQ ID NO: 732176 - RNA, 18 nt, Homo sapiens
uugacacugaaaguuuug

SEQ ID NO: 732177 - RNA, 12 nt, Homo sapiens
uugacacugaac

SEQ ID NO: 732178 - RNA, 15 nt, Homo sapiens
uugacacugcucuaa

SEQ ID NO: 732179 - RNA, 18 nt, Homo sapiens
uugacagcaaaauguuga

SEQ ID NO: 732180 - RNA, 19 nt, Homo sapiens
uugacaguucauauguacc

SEQ ID NO: 732181 - RNA, 16 nt, Homo sapiens
uugacauaauuucacu

SEQ ID NO: 732182 - RNA, 14 nt, Homo sapiens
uugacaucagcauu

SEQ ID NO: 732183 - RNA, 13 nt, Homo sapiens
uugacaugcuguu

SEQ ID NO: 732184 - RNA, 20 nt, Homo sapiens
uugacauugcuuuacuguca

SEQ ID NO: 732185 - RNA, 15 nt, Homo sapiens
uugaccaaauaaagu

SEQ ID NO: 732186 - RNA, 19 nt, Homo sapiens
uugaccaaauaaaguacca

SEQ ID NO: 732187 - RNA, 20 nt, Homo sapiens
uugaccacggacuccagucu

SEQ ID NO: 732188 - RNA, 11 nt, Homo sapiens
uugaccagcag

SEQ ID NO: 732189 - RNA, 21 nt, Homo sapiens
uugaccucuauaaacuucaga

SEQ ID NO: 732190 - RNA, 15 nt, Homo sapiens
uugacgaacuggcua

SEQ ID NO: 732191 - RNA, 20 nt, Homo sapiens
uugacgaacuggcuacagua

SEQ ID NO: 732192 - RNA, 13 nt, Homo sapiens
uugacgucacuga

SEQ ID NO: 732193 - RNA, 19 nt, Homo sapiens
uugacguuucuucuuucua

SEQ ID NO: 732194 - RNA, 24 nt, Homo sapiens
uugacucauggcagcuguuucuca

SEQ ID NO: 732195 - RNA, 13 nt, Homo sapiens
uugacuccaagaa

SEQ ID NO: 732196 - RNA, 13 nt, Homo sapiens
uugacucuacuau

SEQ ID NO: 732197 - RNA, 16 nt, Homo sapiens
uugagaaugguuacaa

SEQ ID NO: 732198 - RNA, 9 nt, Homo sapiens
uugagacag

SEQ ID NO: 732199 - RNA, 12 nt, Homo sapiens
uugagacauuua

SEQ ID NO: 732200 - RNA, 19 nt, Homo sapiens
uugagaccuggaaccagag

SEQ ID NO: 732201 - RNA, 16 nt, Homo sapiens
uugagacuuccaaagg

SEQ ID NO: 732202 - RNA, 18 nt, Homo sapiens
uugagagauaaaaagcua

SEQ ID NO: 732203 - RNA, 17 nt, Homo sapiens
uugagauacuaucauua

SEQ ID NO: 732204 - RNA, 22 nt, Homo sapiens
uugagcacacuuuacacaagaa

SEQ ID NO: 732205 - RNA, 15 nt, Homo sapiens
uugagcagacaggcu

SEQ ID NO: 732206 - RNA, 22 nt, Homo sapiens
uugagcaguggcugguccaggg

SEQ ID NO: 732207 - RNA, 17 nt, Homo sapiens
uugagcaguuagcucau

SEQ ID NO: 732208 - RNA, 16 nt, Homo sapiens
uugagccaguggugcu

SEQ ID NO: 732209 - RNA, 18 nt, Homo sapiens
uugagccaguggugcuaa

SEQ ID NO: 732210 - RNA, 21 nt, Homo sapiens
uugagcuucauauaccagcaa

SEQ ID NO: 732211 - RNA, 14 nt, Homo sapiens
uugaggaauuauca

SEQ ID NO: 732212 - RNA, 21 nt, Homo sapiens
uugaggacaaccauuccagac

SEQ ID NO: 732213 - RNA, 18 nt, Homo sapiens
uugaggacaagauaccaa

SEQ ID NO: 732214 - RNA, 15 nt, Homo sapiens
uugaggagcucaaga

SEQ ID NO: 732215 - RNA, 18 nt, Homo sapiens
uugaggagcugcacugau

SEQ ID NO: 732216 - RNA, 17 nt, Homo sapiens
uugaggcugcagauuuc

SEQ ID NO: 732217 - RNA, 18 nt, Homo sapiens
uugagguaggagaauugc

SEQ ID NO: 732218 - RNA, 20 nt, Homo sapiens
uugaggugcgcucaccucag

SEQ ID NO: 732219 - RNA, 23 nt, Homo sapiens
uugaggugcgcucaccucagagc

SEQ ID NO: 732220 - RNA, 16 nt, Homo sapiens
uugaguaaugugacua

SEQ ID NO: 732221 - RNA, 19 nt, Homo sapiens
uugaguagaguugaucaaa

SEQ ID NO: 732222 - RNA, 17 nt, Homo sapiens
uugaguggaaacuugau

SEQ ID NO: 732223 - RNA, 16 nt, Homo sapiens
uugaguuuguaauuaa

SEQ ID NO: 732224 - RNA, 21 nt, Homo sapiens
uugauaauauuagugauucug

SEQ ID NO: 732225 - RNA, 14 nt, Homo sapiens
uugauaaugggaug

SEQ ID NO: 732226 - RNA, 13 nt, Homo sapiens
uugauagauuucu

SEQ ID NO: 732227 - RNA, 18 nt, Homo sapiens
uugauaguuuggcuauaa

SEQ ID NO: 732228 - RNA, 12 nt, Homo sapiens
uugauaucugau

SEQ ID NO: 732229 - RNA, 16 nt, Homo sapiens
uugauauuuuaggaua

SEQ ID NO: 732230 - RNA, 15 nt, Homo sapiens
uugaucaagaaugca

SEQ ID NO: 732231 - RNA, 13 nt, Homo sapiens
uugaucacuacaa

SEQ ID NO: 732232 - RNA, 20 nt, Homo sapiens
uugaucccuguuacccagag

SEQ ID NO: 732233 - RNA, 14 nt, Homo sapiens
uugaucuacuugcc

SEQ ID NO: 732234 - RNA, 21 nt, Homo sapiens
uugaucuggaacccagacuca

SEQ ID NO: 732235 - RNA, 22 nt, Homo sapiens
uugaucuggaacccagacucag

SEQ ID NO: 732236 - RNA, 15 nt, Homo sapiens
uugaucuguucuggg

SEQ ID NO: 732237 - RNA, 21 nt, Homo sapiens
uugaucuuuugcuaaugcaau

SEQ ID NO: 732238 - RNA, 22 nt, Homo sapiens
uugauggauuaauuaaauaagu

SEQ ID NO: 732239 - RNA, 18 nt, Homo sapiens
uugauguuuguggccuca

SEQ ID NO: 732240 - RNA, 15 nt, Homo sapiens
uugauuagacuccua

SEQ ID NO: 732241 - RNA, 13 nt, Homo sapiens
uugauucacucaa

SEQ ID NO: 732242 - RNA, 15 nt, Homo sapiens
uugauucagucacau

SEQ ID NO: 732243 - RNA, 18 nt, Homo sapiens
uugauucagucuucugga

SEQ ID NO: 732244 - RNA, 14 nt, Homo sapiens
uugauucuccuuca

SEQ ID NO: 732245 - RNA, 20 nt, Homo sapiens
uugauucugauaaugcucac

SEQ ID NO: 732246 - RNA, 10 nt, Homo sapiens
uugauuucaa

SEQ ID NO: 732247 - RNA, 19 nt, Homo sapiens
uugcaaacugaaagaucug

SEQ ID NO: 732248 - RNA, 21 nt, Homo sapiens
uugcaaagguuccaacuguau

SEQ ID NO: 732249 - RNA, 20 nt, Homo sapiens
uugcaacaauaaaguacuuu

SEQ ID NO: 732250 - RNA, 16 nt, Homo sapiens
uugcaacucuguaaau

SEQ ID NO: 732251 - RNA, 19 nt, Homo sapiens
uugcaagacccucccaugg

SEQ ID NO: 732252 - RNA, 17 nt, Homo sapiens
uugcaagaugugaauua

SEQ ID NO: 732253 - RNA, 10 nt, Homo sapiens
uugcaauacc

SEQ ID NO: 732254 - RNA, 16 nt, Homo sapiens
uugcaaucuucuacuu

SEQ ID NO: 732255 - RNA, 21 nt, Homo sapiens
uugcacacuccccugcacugg

SEQ ID NO: 732256 - RNA, 13 nt, Homo sapiens
uugcacaugugac

SEQ ID NO: 732257 - RNA, 15 nt, Homo sapiens
uugcaccauugcacu

SEQ ID NO: 732258 - RNA, 16 nt, Homo sapiens
uugcacuauuuccaca

SEQ ID NO: 732259 - RNA, 11 nt, Homo sapiens
uugcacuccac

SEQ ID NO: 732260 - RNA, 16 nt, Homo sapiens
uugcagccccacagac

SEQ ID NO: 732261 - RNA, 15 nt, Homo sapiens
uugcagcugauguug

SEQ ID NO: 732262 - RNA, 18 nt, Homo sapiens
uugcagugagcugagauc

SEQ ID NO: 732263 - RNA, 13 nt, Homo sapiens
uugcauaugucau

SEQ ID NO: 732264 - RNA, 14 nt, Homo sapiens
uugcaucaguucau

SEQ ID NO: 732265 - RNA, 13 nt, Homo sapiens
uugcauccauugu

SEQ ID NO: 732266 - RNA, 14 nt, Homo sapiens
uugcauccauuguu

SEQ ID NO: 732267 - RNA, 20 nt, Homo sapiens
uugcaucucuaauagagauu

SEQ ID NO: 732268 - RNA, 12 nt, Homo sapiens
uugcaugcaugc

SEQ ID NO: 732269 - RNA, 18 nt, Homo sapiens
uugcauggcuccagaaau

SEQ ID NO: 732270 - RNA, 14 nt, Homo sapiens
uugcaugugaaaau

SEQ ID NO: 732271 - RNA, 21 nt, Homo sapiens
uugcauuuugauaaaauuaau

SEQ ID NO: 732272 - RNA, 23 nt, Homo sapiens
uugccaaaaagggguaugucuuu

SEQ ID NO: 732273 - RNA, 14 nt, Homo sapiens
uugccaaacagcca

SEQ ID NO: 732274 - RNA, 22 nt, Homo sapiens
uugccaaacagccacacugugg

SEQ ID NO: 732275 - RNA, 18 nt, Homo sapiens
uugccaagaaaaugaagg

SEQ ID NO: 732276 - RNA, 12 nt, Homo sapiens
uugccacaaagc

SEQ ID NO: 732277 - RNA, 12 nt, Homo sapiens
uugccacacuga

SEQ ID NO: 732278 - RNA, 23 nt, Homo sapiens
uugccacguucuggacugucuuc

SEQ ID NO: 732279 - RNA, 21 nt, Homo sapiens
uugccagauuaccgacacugu

SEQ ID NO: 732280 - RNA, 17 nt, Homo sapiens
uugccaggacaugcaau

SEQ ID NO: 732281 - RNA, 19 nt, Homo sapiens
uugccaggcuggagugcag

SEQ ID NO: 732282 - RNA, 17 nt, Homo sapiens
uugccaguauuaugcau

SEQ ID NO: 732283 - RNA, 18 nt, Homo sapiens
uugccauuuguagcuuug

SEQ ID NO: 732284 - RNA, 16 nt, Homo sapiens
uugcccaaaacuguca

SEQ ID NO: 732285 - RNA, 13 nt, Homo sapiens
uugcccacaaugc

SEQ ID NO: 732286 - RNA, 17 nt, Homo sapiens
uugcccagacuacaggg

SEQ ID NO: 732287 - RNA, 20 nt, Homo sapiens
uugcccaggcuggagugcaa

SEQ ID NO: 732288 - RNA, 21 nt, Homo sapiens
uugcccaggcuggagugcagu

SEQ ID NO: 732289 - RNA, 14 nt, Homo sapiens
uugccccacucugc

SEQ ID NO: 732290 - RNA, 19 nt, Homo sapiens
uugcccccagauacauggu

SEQ ID NO: 732291 - RNA, 14 nt, Homo sapiens
uugcccccauuuca

SEQ ID NO: 732292 - RNA, 19 nt, Homo sapiens
uugccccuggcuuugccuc

SEQ ID NO: 732293 - RNA, 14 nt, Homo sapiens
uugcccggcuguga

SEQ ID NO: 732294 - RNA, 13 nt, Homo sapiens
uugccguaccaau

SEQ ID NO: 732295 - RNA, 18 nt, Homo sapiens
uugccuaacuaacuggca

SEQ ID NO: 732296 - RNA, 19 nt, Homo sapiens
uugccuaagacuugcccaa

SEQ ID NO: 732297 - RNA, 19 nt, Homo sapiens
uugccuaauaaacauccuu

SEQ ID NO: 732298 - RNA, 18 nt, Homo sapiens
uugccucaacuccaggau

SEQ ID NO: 732299 - RNA, 19 nt, Homo sapiens
uugccucaacuccaggauu

SEQ ID NO: 732300 - RNA, 16 nt, Homo sapiens
uugccucaccugcugu

SEQ ID NO: 732301 - RNA, 14 nt, Homo sapiens
uugccucauauugu

SEQ ID NO: 732302 - RNA, 13 nt, Homo sapiens
uugccugccauuu

SEQ ID NO: 732303 - RNA, 20 nt, Homo sapiens
uugccuuauuggcagcucua

SEQ ID NO: 732304 - RNA, 16 nt, Homo sapiens
uugccuucacccauaa

SEQ ID NO: 732305 - RNA, 18 nt, Homo sapiens
uugccuuggagaucaaaa

SEQ ID NO: 732306 - RNA, 20 nt, Homo sapiens
uugccuuuugcaaccaggaa

SEQ ID NO: 732307 - RNA, 12 nt, Homo sapiens
uugcgcugcuaa

SEQ ID NO: 732308 - RNA, 14 nt, Homo sapiens
uugcguucaaagag

SEQ ID NO: 732309 - RNA, 17 nt, Homo sapiens
uugcuaaaaaagcauau

SEQ ID NO: 732310 - RNA, 17 nt, Homo sapiens
uugcuaacaaugcucug

SEQ ID NO: 732311 - RNA, 22 nt, Homo sapiens
uugcuaauacccaguuacuuau

SEQ ID NO: 732312 - RNA, 15 nt, Homo sapiens
uugcuaugacuacau

SEQ ID NO: 732313 - RNA, 11 nt, Homo sapiens
uugcucaaggc

SEQ ID NO: 732314 - RNA, 22 nt, Homo sapiens
uugcucaguggaucacacacau

SEQ ID NO: 732315 - RNA, 21 nt, Homo sapiens
uugcucaguguccagcuucca

SEQ ID NO: 732316 - RNA, 15 nt, Homo sapiens
uugcucccugcaaga

SEQ ID NO: 732317 - RNA, 18 nt, Homo sapiens
uugcucccuguugcugaa

SEQ ID NO: 732318 - RNA, 21 nt, Homo sapiens
uugcuccuauacuauugaagu

SEQ ID NO: 732319 - RNA, 22 nt, Homo sapiens
uugcuccuggcuggggccuguu

SEQ ID NO: 732320 - RNA, 15 nt, Homo sapiens
uugcucuaugucugc

SEQ ID NO: 732321 - RNA, 13 nt, Homo sapiens
uugcucugaaugu

SEQ ID NO: 732322 - RNA, 13 nt, Homo sapiens
uugcucugccacc

SEQ ID NO: 732323 - RNA, 17 nt, Homo sapiens
uugcucuguuucuuccu

SEQ ID NO: 732324 - RNA, 21 nt, Homo sapiens
uugcucuucagaugccacuuc

SEQ ID NO: 732325 - RNA, 14 nt, Homo sapiens
uugcucuugccaaa

SEQ ID NO: 732326 - RNA, 15 nt, Homo sapiens
uugcucuugccaaaa

SEQ ID NO: 732327 - RNA, 15 nt, Homo sapiens
uugcucuuucagaac

SEQ ID NO: 732328 - RNA, 20 nt, Homo sapiens
uugcugccuuaaugacauuc

SEQ ID NO: 732329 - RNA, 21 nt, Homo sapiens
uugcugcucuucaucccauuc

SEQ ID NO: 732330 - RNA, 14 nt, Homo sapiens
uugcuggaugcauu

SEQ ID NO: 732331 - RNA, 18 nt, Homo sapiens
uugcugguagcacuugcu

SEQ ID NO: 732332 - RNA, 17 nt, Homo sapiens
uugcuguagaaacacau

SEQ ID NO: 732333 - RNA, 13 nt, Homo sapiens
uugcugugagcaa

SEQ ID NO: 732334 - RNA, 20 nt, Homo sapiens
uugcugugucuccucucaga

SEQ ID NO: 732335 - RNA, 17 nt, Homo sapiens
uugcugugugucugucc

SEQ ID NO: 732336 - RNA, 12 nt, Homo sapiens
uugcuguucuac

SEQ ID NO: 732337 - RNA, 14 nt, Homo sapiens
uugcuuaaaucagu

SEQ ID NO: 732338 - RNA, 23 nt, Homo sapiens
uugcuucccggcgucccuaccuc

SEQ ID NO: 732339 - RNA, 18 nt, Homo sapiens
uugcuuccgccacucagc

SEQ ID NO: 732340 - RNA, 14 nt, Homo sapiens
uugcuucucuagcu

SEQ ID NO: 732341 - RNA, 15 nt, Homo sapiens
uugcuucuugccauc

SEQ ID NO: 732342 - RNA, 11 nt, Homo sapiens
uugcuugauau

SEQ ID NO: 732343 - RNA, 20 nt, Homo sapiens
uugcuuuaaaguaccuguag

SEQ ID NO: 732344 - RNA, 12 nt, Homo sapiens
uugcuuuccacu

SEQ ID NO: 732345 - RNA, 18 nt, Homo sapiens
uugcuuucgguacuguaa

SEQ ID NO: 732346 - RNA, 22 nt, Homo sapiens
uugcuuuuguuuuccugcuggu

SEQ ID NO: 732347 - RNA, 17 nt, Homo sapiens
uuggaaaaaacucugaa

SEQ ID NO: 732348 - RNA, 19 nt, Homo sapiens
uuggaaaaagccugugaaa

SEQ ID NO: 732349 - RNA, 13 nt, Homo sapiens
uuggaaacagaga

SEQ ID NO: 732350 - RNA, 13 nt, Homo sapiens
uuggaaaccacag

SEQ ID NO: 732351 - RNA, 16 nt, Homo sapiens
uuggaaaccacaguca

SEQ ID NO: 732352 - RNA, 23 nt, Homo sapiens
uuggaaagcaucaccucaggcca

SEQ ID NO: 732353 - RNA, 22 nt, Homo sapiens
uuggaaaucaguugugaauaca

SEQ ID NO: 732354 - RNA, 15 nt, Homo sapiens
uuggaacacccugga

SEQ ID NO: 732355 - RNA, 18 nt, Homo sapiens
uuggaacagugcuacuga

SEQ ID NO: 732356 - RNA, 19 nt, Homo sapiens
uuggaauaaagucaaccuu

SEQ ID NO: 732357 - RNA, 16 nt, Homo sapiens
uuggaauaaucacuug

SEQ ID NO: 732358 - RNA, 17 nt, Homo sapiens
uuggaauaaucacuugg

SEQ ID NO: 732359 - RNA, 19 nt, Homo sapiens
uuggaauggaacuacugua

SEQ ID NO: 732360 - RNA, 13 nt, Homo sapiens
uuggaauggcaau

SEQ ID NO: 732361 - RNA, 19 nt, Homo sapiens
uuggaauggcugagcaaau

SEQ ID NO: 732362 - RNA, 20 nt, Homo sapiens
uuggaauuaugucugcugaa

SEQ ID NO: 732363 - RNA, 20 nt, Homo sapiens
uuggacaacugcauggagcu

SEQ ID NO: 732364 - RNA, 16 nt, Homo sapiens
uuggacauuuucuuca

SEQ ID NO: 732365 - RNA, 21 nt, Homo sapiens
uuggacuccaggccugaccag

SEQ ID NO: 732366 - RNA, 17 nt, Homo sapiens
uuggacugauaaucucu

SEQ ID NO: 732367 - RNA, 17 nt, Homo sapiens
uuggacugucuauauca

SEQ ID NO: 732368 - RNA, 22 nt, Homo sapiens
uuggagaaccagggcucuucuc

SEQ ID NO: 732369 - RNA, 13 nt, Homo sapiens
uuggagacagggu

SEQ ID NO: 732370 - RNA, 15 nt, Homo sapiens
uuggagagacacagc

SEQ ID NO: 732371 - RNA, 21 nt, Homo sapiens
uuggagaguuugccuguucua

SEQ ID NO: 732372 - RNA, 15 nt, Homo sapiens
uuggagcauuuucaa

SEQ ID NO: 732373 - RNA, 11 nt, Homo sapiens
uuggagcugcc

SEQ ID NO: 732374 - RNA, 17 nt, Homo sapiens
uuggagcuuuuucaaaa

SEQ ID NO: 732375 - RNA, 18 nt, Homo sapiens
uuggauucuaaauacaug

SEQ ID NO: 732376 - RNA, 14 nt, Homo sapiens
uuggauuucugacc

SEQ ID NO: 732377 - RNA, 15 nt, Homo sapiens
uuggcaaugcacuga

SEQ ID NO: 732378 - RNA, 22 nt, Homo sapiens
uuggcaccagacacccaggacu

SEQ ID NO: 732379 - RNA, 23 nt, Homo sapiens
uuggcacucugacuuaaagugca

SEQ ID NO: 732380 - RNA, 15 nt, Homo sapiens
uuggcacugagauau

SEQ ID NO: 732381 - RNA, 23 nt, Homo sapiens
uuggcagaaaggauguuuugucc

SEQ ID NO: 732382 - RNA, 19 nt, Homo sapiens
uuggcagagacacuuuguc

SEQ ID NO: 732383 - RNA, 23 nt, Homo sapiens
uuggcagcucuacucuggagguu

SEQ ID NO: 732384 - RNA, 12 nt, Homo sapiens
uuggcauacaaa

SEQ ID NO: 732385 - RNA, 20 nt, Homo sapiens
uuggcaucgaccacaccagc

SEQ ID NO: 732386 - RNA, 15 nt, Homo sapiens
uuggcauugcaauga

SEQ ID NO: 732387 - RNA, 22 nt, Homo sapiens
uuggcauugcugcauauuugac

SEQ ID NO: 732388 - RNA, 12 nt, Homo sapiens
uuggccacagac

SEQ ID NO: 732389 - RNA, 13 nt, Homo sapiens
uuggccacugucu

SEQ ID NO: 732390 - RNA, 21 nt, Homo sapiens
uuggccgugguccagcucuug

SEQ ID NO: 732391 - RNA, 22 nt, Homo sapiens
uuggccucagaauucacaaaau

SEQ ID NO: 732392 - RNA, 17 nt, Homo sapiens
uuggccucugcuaaggu

SEQ ID NO: 732393 - RNA, 20 nt, Homo sapiens
uuggccuguagaguugcuga

SEQ ID NO: 732394 - RNA, 13 nt, Homo sapiens
uuggccuucuggg

SEQ ID NO: 732395 - RNA, 14 nt, Homo sapiens
uuggcgacugucau

SEQ ID NO: 732396 - RNA, 15 nt, Homo sapiens
uuggcuauugaccau

SEQ ID NO: 732397 - RNA, 14 nt, Homo sapiens
uuggcucacugcaa

SEQ ID NO: 732398 - RNA, 23 nt, Homo sapiens
uuggcucaggcagacaagagcug

SEQ ID NO: 732399 - RNA, 17 nt, Homo sapiens
uuggcuccauaucauuu

SEQ ID NO: 732400 - RNA, 22 nt, Homo sapiens
uuggcuggcuuguuugauuuca

SEQ ID NO: 732401 - RNA, 16 nt, Homo sapiens
uuggcuuaaauccagu

SEQ ID NO: 732402 - RNA, 13 nt, Homo sapiens
uuggcuucagggg

SEQ ID NO: 732403 - RNA, 16 nt, Homo sapiens
uuggcuuuaugcaaau

SEQ ID NO: 732404 - RNA, 18 nt, Homo sapiens
uuggcuuuaugcaaauac

SEQ ID NO: 732405 - RNA, 20 nt, Homo sapiens
uuggcuuuaugcaaauacaa

SEQ ID NO: 732406 - RNA, 12 nt, Homo sapiens
uugggaagacca

SEQ ID NO: 732407 - RNA, 22 nt, Homo sapiens
uugggacucaaggcuugaguca

SEQ ID NO: 732408 - RNA, 18 nt, Homo sapiens
uugggaggauacagagga

SEQ ID NO: 732409 - RNA, 14 nt, Homo sapiens
uugggaggccaagg

SEQ ID NO: 732410 - RNA, 23 nt, Homo sapiens
uugggagggugguucaacaaaga

SEQ ID NO: 732411 - RNA, 11 nt, Homo sapiens
uugggcaguuc

SEQ ID NO: 732412 - RNA, 13 nt, Homo sapiens
uugggcaugccau

SEQ ID NO: 732413 - RNA, 14 nt, Homo sapiens
uugggcaugccauu

SEQ ID NO: 732414 - RNA, 18 nt, Homo sapiens
uugggcuauuuggacuca

SEQ ID NO: 732415 - RNA, 10 nt, Homo sapiens
uugggcuccu

SEQ ID NO: 732416 - RNA, 20 nt, Homo sapiens
uugggcuggaugccgaggua

SEQ ID NO: 732417 - RNA, 23 nt, Homo sapiens
uugggcuuaguauuucucaggaa

SEQ ID NO: 732418 - RNA, 10 nt, Homo sapiens
uuggggacuc

SEQ ID NO: 732419 - RNA, 21 nt, Homo sapiens
uuggggaggggccucccugug

SEQ ID NO: 732420 - RNA, 17 nt, Homo sapiens
uugggggucaucuugga

SEQ ID NO: 732421 - RNA, 12 nt, Homo sapiens
uugggugccuuu

SEQ ID NO: 732422 - RNA, 19 nt, Homo sapiens
uuggguggcucacuacuga

SEQ ID NO: 732423 - RNA, 21 nt, Homo sapiens
uugguacccacugggacauuu

SEQ ID NO: 732424 - RNA, 14 nt, Homo sapiens
uugguacuuuuaug

SEQ ID NO: 732425 - RNA, 23 nt, Homo sapiens
uugguagcaauuggcagcccuau

SEQ ID NO: 732426 - RNA, 20 nt, Homo sapiens
uugguaguggaauagugaau

SEQ ID NO: 732427 - RNA, 20 nt, Homo sapiens
uugguauacuuuugcuucag

SEQ ID NO: 732428 - RNA, 17 nt, Homo sapiens
uuggucauagcauucac

SEQ ID NO: 732429 - RNA, 21 nt, Homo sapiens
uugguccuaccuauuauccuu

SEQ ID NO: 732430 - RNA, 16 nt, Homo sapiens
uugguccuggggacca

SEQ ID NO: 732431 - RNA, 17 nt, Homo sapiens
uuggucucacuacuuga

SEQ ID NO: 732432 - RNA, 14 nt, Homo sapiens
uuggugaacacaca

SEQ ID NO: 732433 - RNA, 20 nt, Homo sapiens
uuggugcacaaguaacacau

SEQ ID NO: 732434 - RNA, 15 nt, Homo sapiens
uugguggaugugaug

SEQ ID NO: 732435 - RNA, 15 nt, Homo sapiens
uugguuaucauggga

SEQ ID NO: 732436 - RNA, 16 nt, Homo sapiens
uugguugcaguuucca

SEQ ID NO: 732437 - RNA, 15 nt, Homo sapiens
uugguuguacuuugg

SEQ ID NO: 732438 - RNA, 12 nt, Homo sapiens
uugguugugaau

SEQ ID NO: 732439 - RNA, 17 nt, Homo sapiens
uugguuuggauuacuau

SEQ ID NO: 732440 - RNA, 13 nt, Homo sapiens
uugguuuuacaca

SEQ ID NO: 732441 - RNA, 18 nt, Homo sapiens
uugguuuuccuguggcau

SEQ ID NO: 732442 - RNA, 20 nt, Homo sapiens
uuguaaaaagcccagcacuu

SEQ ID NO: 732443 - RNA, 18 nt, Homo sapiens
uuguaaaauaauucugag

SEQ ID NO: 732444 - RNA, 15 nt, Homo sapiens
uuguaaaauguucuc

SEQ ID NO: 732445 - RNA, 22 nt, Homo sapiens
uuguaaaguguuagauggaaaa

SEQ ID NO: 732446 - RNA, 15 nt, Homo sapiens
uuguaaauaggauuu

SEQ ID NO: 732447 - RNA, 15 nt, Homo sapiens
uuguaaaucacuugu

SEQ ID NO: 732448 - RNA, 21 nt, Homo sapiens
uuguaagaaaaugagacaaaa

SEQ ID NO: 732449 - RNA, 22 nt, Homo sapiens
uuguaagaaauaacacugugaa

SEQ ID NO: 732450 - RNA, 22 nt, Homo sapiens
uuguaagucagccacugggacc

SEQ ID NO: 732451 - RNA, 17 nt, Homo sapiens
uuguaaugcugcacaga

SEQ ID NO: 732452 - RNA, 14 nt, Homo sapiens
uuguaauugcauga

SEQ ID NO: 732453 - RNA, 16 nt, Homo sapiens
uuguaauugcaugaca

SEQ ID NO: 732454 - RNA, 17 nt, Homo sapiens
uuguaauugcaugacaa

SEQ ID NO: 732455 - RNA, 19 nt, Homo sapiens
uuguacaaaauuaagcaaa

SEQ ID NO: 732456 - RNA, 19 nt, Homo sapiens
uuguacaacauuguggaug

SEQ ID NO: 732457 - RNA, 21 nt, Homo sapiens
uuguaccauauagagguguaa

SEQ ID NO: 732458 - RNA, 23 nt, Homo sapiens
uuguaccauauagagguguaaca

SEQ ID NO: 732459 - RNA, 14 nt, Homo sapiens
uuguacuaaucuga

SEQ ID NO: 732460 - RNA, 11 nt, Homo sapiens
uuguacugaua

SEQ ID NO: 732461 - RNA, 15 nt, Homo sapiens
uuguacugauauaau

SEQ ID NO: 732462 - RNA, 15 nt, Homo sapiens
uuguagagacagggu

SEQ ID NO: 732463 - RNA, 19 nt, Homo sapiens
uuguagaguggugcugcuu

SEQ ID NO: 732464 - RNA, 14 nt, Homo sapiens
uuguagaugcauua

SEQ ID NO: 732465 - RNA, 16 nt, Homo sapiens
uuguagaugugauuaa

SEQ ID NO: 732466 - RNA, 16 nt, Homo sapiens
uuguagugugugcuua

SEQ ID NO: 732467 - RNA, 19 nt, Homo sapiens
uuguauaaucccacccacc

SEQ ID NO: 732468 - RNA, 14 nt, Homo sapiens
uuguauaugcauuc

SEQ ID NO: 732469 - RNA, 19 nt, Homo sapiens
uuguauauugucagauauu

SEQ ID NO: 732470 - RNA, 22 nt, Homo sapiens
uuguauauuuguaaacuacaaa

SEQ ID NO: 732471 - RNA, 16 nt, Homo sapiens
uuguaucaaaguguga

SEQ ID NO: 732472 - RNA, 22 nt, Homo sapiens
uuguauccguucaauaagcauu

SEQ ID NO: 732473 - RNA, 15 nt, Homo sapiens
uuguaucuugccuaa

SEQ ID NO: 732474 - RNA, 19 nt, Homo sapiens
uuguaugcauggaaacaug

SEQ ID NO: 732475 - RNA, 13 nt, Homo sapiens
uuguaugguucca

SEQ ID NO: 732476 - RNA, 15 nt, Homo sapiens
uuguauuaugcugga

SEQ ID NO: 732477 - RNA, 16 nt, Homo sapiens
uuguauucauguucau

SEQ ID NO: 732478 - RNA, 16 nt, Homo sapiens
uuguauuuaccuucua

SEQ ID NO: 732479 - RNA, 21 nt, Homo sapiens
uugucaauauuaaauacagac

SEQ ID NO: 732480 - RNA, 16 nt, Homo sapiens
uugucagaaaccugca

SEQ ID NO: 732481 - RNA, 15 nt, Homo sapiens
uugucagacuuccaa

SEQ ID NO: 732482 - RNA, 21 nt, Homo sapiens
uugucagcugcagccacuuuc

SEQ ID NO: 732483 - RNA, 15 nt, Homo sapiens
uugucaucugcaugu

SEQ ID NO: 732484 - RNA, 18 nt, Homo sapiens
uugucauucaagccugug

SEQ ID NO: 732485 - RNA, 19 nt, Homo sapiens
uugucauugaaauuuggca

SEQ ID NO: 732486 - RNA, 15 nt, Homo sapiens
uuguccaucuugaga

SEQ ID NO: 732487 - RNA, 20 nt, Homo sapiens
uugucccagccuggggcucc

SEQ ID NO: 732488 - RNA, 14 nt, Homo sapiens
uugucccccaacuu

SEQ ID NO: 732489 - RNA, 18 nt, Homo sapiens
uugucccuaugcauauca

SEQ ID NO: 732490 - RNA, 15 nt, Homo sapiens
uuguccgggcucaga

SEQ ID NO: 732491 - RNA, 15 nt, Homo sapiens
uuguccgguuuacuu

SEQ ID NO: 732492 - RNA, 22 nt, Homo sapiens
uuguccguguucauacauuuga

SEQ ID NO: 732493 - RNA, 14 nt, Homo sapiens
uuguccuaugucaa

SEQ ID NO: 732494 - RNA, 17 nt, Homo sapiens
uuguccugccagcugcc

SEQ ID NO: 732495 - RNA, 17 nt, Homo sapiens
uugucgcucaugugugc

SEQ ID NO: 732496 - RNA, 16 nt, Homo sapiens
uugucuaaugacagau

SEQ ID NO: 732497 - RNA, 18 nt, Homo sapiens
uugucucgaagucucuuu

SEQ ID NO: 732498 - RNA, 20 nt, Homo sapiens
uugucucgcuauacugcacu

SEQ ID NO: 732499 - RNA, 13 nt, Homo sapiens
uugucuguuuauu

SEQ ID NO: 732500 - RNA, 21 nt, Homo sapiens
uugucuguuuguuucaagaac

SEQ ID NO: 732501 - RNA, 13 nt, Homo sapiens
uugucuucaugaa

SEQ ID NO: 732502 - RNA, 20 nt, Homo sapiens
uugucuuuccuggcacuaac

SEQ ID NO: 732503 - RNA, 22 nt, Homo sapiens
uugugaacccuagcugugucag

SEQ ID NO: 732504 - RNA, 20 nt, Homo sapiens
uugugaauugcuugguugua

SEQ ID NO: 732505 - RNA, 17 nt, Homo sapiens
uugugacuucacuguau

SEQ ID NO: 732506 - RNA, 13 nt, Homo sapiens
uugugaugaacau

SEQ ID NO: 732507 - RNA, 15 nt, Homo sapiens
uugugaugaacauau

SEQ ID NO: 732508 - RNA, 16 nt, Homo sapiens
uugugaugaacauauu

SEQ ID NO: 732509 - RNA, 15 nt, Homo sapiens
uugugauuauuucac

SEQ ID NO: 732510 - RNA, 23 nt, Homo sapiens
uugugauuuuuuuaauagugcuu

SEQ ID NO: 732511 - RNA, 17 nt, Homo sapiens
uugugcaaacauggaga

SEQ ID NO: 732512 - RNA, 16 nt, Homo sapiens
uugugcuccaaacaaa

SEQ ID NO: 732513 - RNA, 13 nt, Homo sapiens
uugugguacuguc

SEQ ID NO: 732514 - RNA, 20 nt, Homo sapiens
uugugguugaaaaccacagu

SEQ ID NO: 732515 - RNA, 16 nt, Homo sapiens
uuguguaauacuucau

SEQ ID NO: 732516 - RNA, 17 nt, Homo sapiens
uuguguaauaugaaaua

SEQ ID NO: 732517 - RNA, 14 nt, Homo sapiens
uuguguacugauaa

SEQ ID NO: 732518 - RNA, 16 nt, Homo sapiens
uuguguauccaugcac

SEQ ID NO: 732519 - RNA, 14 nt, Homo sapiens
uugugucuggugca

SEQ ID NO: 732520 - RNA, 17 nt, Homo sapiens
uugugugugggcuguga

SEQ ID NO: 732521 - RNA, 18 nt, Homo sapiens
uuguguuguuguugcugc

SEQ ID NO: 732522 - RNA, 22 nt, Homo sapiens
uuguguuuguagucuugucuua

SEQ ID NO: 732523 - RNA, 18 nt, Homo sapiens
uuguuaccuuuaugguuu

SEQ ID NO: 732524 - RNA, 12 nt, Homo sapiens
uuguuacuguga

SEQ ID NO: 732525 - RNA, 13 nt, Homo sapiens
uuguuauaccauu

SEQ ID NO: 732526 - RNA, 14 nt, Homo sapiens
uuguuauuuacacu

SEQ ID NO: 732527 - RNA, 12 nt, Homo sapiens
uuguuauuucag

SEQ ID NO: 732528 - RNA, 12 nt, Homo sapiens
uuguucaccuga

SEQ ID NO: 732529 - RNA, 16 nt, Homo sapiens
uuguuccccacugaca

SEQ ID NO: 732530 - RNA, 16 nt, Homo sapiens
uuguugcaaaugugau

SEQ ID NO: 732531 - RNA, 20 nt, Homo sapiens
uuguugccuucaucuucacu

SEQ ID NO: 732532 - RNA, 11 nt, Homo sapiens
uuguugcucag

SEQ ID NO: 732533 - RNA, 23 nt, Homo sapiens
uuguuggucuguguaacauccaa

SEQ ID NO: 732534 - RNA, 20 nt, Homo sapiens
uuguuguaaccugcugugau

SEQ ID NO: 732535 - RNA, 21 nt, Homo sapiens
uuguugucuacauuaaaucac

SEQ ID NO: 732536 - RNA, 13 nt, Homo sapiens
uuguugucucccu

SEQ ID NO: 732537 - RNA, 17 nt, Homo sapiens
uuguuuaacggcagugu

SEQ ID NO: 732538 - RNA, 14 nt, Homo sapiens
uuguuuauauugca

SEQ ID NO: 732539 - RNA, 21 nt, Homo sapiens
uuguuucaaaugaaacuuuaa

SEQ ID NO: 732540 - RNA, 15 nt, Homo sapiens
uuguuucuuuucaca

SEQ ID NO: 732541 - RNA, 19 nt, Homo sapiens
uuguuuguaaaugccucuu

SEQ ID NO: 732542 - RNA, 19 nt, Homo sapiens
uuguuugugacccugagaa

SEQ ID NO: 732543 - RNA, 21 nt, Homo sapiens
uuguuuuaaaauuaaagcuaa

SEQ ID NO: 732544 - RNA, 22 nt, Homo sapiens
uuguuuuggggacagacuuuua

SEQ ID NO: 732545 - RNA, 14 nt, Homo sapiens
uuguuuuucuccac

SEQ ID NO: 732546 - RNA, 13 nt, Homo sapiens
uuguuuuugcaua

SEQ ID NO: 732547 - RNA, 22 nt, Homo sapiens
uuguuuuugcaugaaauuguau

SEQ ID NO: 732548 - RNA, 17 nt, Homo sapiens
uuguuuuuuucuccauc

SEQ ID NO: 732549 - RNA, 23 nt, Homo sapiens
uuuaaaaaaaaaaaaaaagccaa

SEQ ID NO: 732550 - RNA, 20 nt, Homo sapiens
uuuaaaaaaaaaaacaaagc

SEQ ID NO: 732551 - RNA, 16 nt, Homo sapiens
uuuaaaaaaaagcaua

SEQ ID NO: 732552 - RNA, 21 nt, Homo sapiens
uuuaaaaaaaggagacugugu

SEQ ID NO: 732553 - RNA, 21 nt, Homo sapiens
uuuaaaaaauaacauauucuu

SEQ ID NO: 732554 - RNA, 15 nt, Homo sapiens
uuuaaaaaaucucaa

SEQ ID NO: 732555 - RNA, 13 nt, Homo sapiens
uuuaaaaaaugga

SEQ ID NO: 732556 - RNA, 16 nt, Homo sapiens
uuuaaaaaaugucucu

SEQ ID NO: 732557 - RNA, 15 nt, Homo sapiens
uuuaaaaacauuuuc

SEQ ID NO: 732558 - RNA, 13 nt, Homo sapiens
uuuaaaaagcuag

SEQ ID NO: 732559 - RNA, 16 nt, Homo sapiens
uuuaaaacaggcaaag

SEQ ID NO: 732560 - RNA, 14 nt, Homo sapiens
uuuaaaacaugcac

SEQ ID NO: 732561 - RNA, 22 nt, Homo sapiens
uuuaaaacccaacucuuacucu

SEQ ID NO: 732562 - RNA, 20 nt, Homo sapiens
uuuaaaaccugugugccauu

SEQ ID NO: 732563 - RNA, 15 nt, Homo sapiens
uuuaaaaggcuccca

SEQ ID NO: 732564 - RNA, 15 nt, Homo sapiens
uuuaaaauaaauucc

SEQ ID NO: 732565 - RNA, 13 nt, Homo sapiens
uuuaaaauuucau

SEQ ID NO: 732566 - RNA, 12 nt, Homo sapiens
uuuaaacaguga

SEQ ID NO: 732567 - RNA, 15 nt, Homo sapiens
uuuaaaccacuaaaa

SEQ ID NO: 732568 - RNA, 19 nt, Homo sapiens
uuuaaaccugauuuacuag

SEQ ID NO: 732569 - RNA, 19 nt, Homo sapiens
uuuaaaccuuuuucuugau

SEQ ID NO: 732570 - RNA, 12 nt, Homo sapiens
uuuaaagacaga

SEQ ID NO: 732571 - RNA, 13 nt, Homo sapiens
uuuaaagacaugu

SEQ ID NO: 732572 - RNA, 13 nt, Homo sapiens
uuuaaagcaaaca

SEQ ID NO: 732573 - RNA, 22 nt, Homo sapiens
uuuaaagcauauuggugcuaga

SEQ ID NO: 732574 - RNA, 21 nt, Homo sapiens
uuuaaagcuuauuaaaacuca

SEQ ID NO: 732575 - RNA, 20 nt, Homo sapiens
uuuaaaggaaaaucacaucu

SEQ ID NO: 732576 - RNA, 14 nt, Homo sapiens
uuuaaagugauuaa

SEQ ID NO: 732577 - RNA, 18 nt, Homo sapiens
uuuaaauaaaagcacaag

SEQ ID NO: 732578 - RNA, 16 nt, Homo sapiens
uuuaaauaaaggaaau

SEQ ID NO: 732579 - RNA, 20 nt, Homo sapiens
uuuaaauaaaguuacuugaa

SEQ ID NO: 732580 - RNA, 14 nt, Homo sapiens
uuuaaauagaccuc

SEQ ID NO: 732581 - RNA, 15 nt, Homo sapiens
uuuaaaucaaacuaa

SEQ ID NO: 732582 - RNA, 18 nt, Homo sapiens
uuuaaauggcuacuuugg

SEQ ID NO: 732583 - RNA, 17 nt, Homo sapiens
uuuaaauguuacuggua

SEQ ID NO: 732584 - RNA, 19 nt, Homo sapiens
uuuaacaaaucuaaucucu

SEQ ID NO: 732585 - RNA, 16 nt, Homo sapiens
uuuaacaacauggcuu

SEQ ID NO: 732586 - RNA, 17 nt, Homo sapiens
uuuaaccgcacaugcac

SEQ ID NO: 732587 - RNA, 20 nt, Homo sapiens
uuuaaccucuagagucacug

SEQ ID NO: 732588 - RNA, 19 nt, Homo sapiens
uuuaacugccaauccuuaa

SEQ ID NO: 732589 - RNA, 22 nt, Homo sapiens
uuuaagaagaaauacccacuaa

SEQ ID NO: 732590 - RNA, 14 nt, Homo sapiens
uuuaagaauuucac

SEQ ID NO: 732591 - RNA, 21 nt, Homo sapiens
uuuaagccaaagaaacaagcu

SEQ ID NO: 732592 - RNA, 18 nt, Homo sapiens
uuuaagccugcauucuua

SEQ ID NO: 732593 - RNA, 12 nt, Homo sapiens
uuuaagccuuug

SEQ ID NO: 732594 - RNA, 15 nt, Homo sapiens
uuuaaggauguugcc

SEQ ID NO: 732595 - RNA, 19 nt, Homo sapiens
uuuaaggcaggacagagaa

SEQ ID NO: 732596 - RNA, 23 nt, Homo sapiens
uuuaagggggaaaacuguucucu

SEQ ID NO: 732597 - RNA, 13 nt, Homo sapiens
uuuaagguacuua

SEQ ID NO: 732598 - RNA, 10 nt, Homo sapiens
uuuaagguga

SEQ ID NO: 732599 - RNA, 13 nt, Homo sapiens
uuuaaguacuuga

SEQ ID NO: 732600 - RNA, 17 nt, Homo sapiens
uuuaaguugucaaagaa

SEQ ID NO: 732601 - RNA, 20 nt, Homo sapiens
uuuaauaaaugguuuauucu

SEQ ID NO: 732602 - RNA, 22 nt, Homo sapiens
uuuaauacaggguagauaaccu

SEQ ID NO: 732603 - RNA, 22 nt, Homo sapiens
uuuaauagcacuaaccaaugcc

SEQ ID NO: 732604 - RNA, 17 nt, Homo sapiens
uuuaauagguaaaccaa

SEQ ID NO: 732605 - RNA, 21 nt, Homo sapiens
uuuaaugaugccauggcaacu

SEQ ID NO: 732606 - RNA, 15 nt, Homo sapiens
uuuaauggcauguca

SEQ ID NO: 732607 - RNA, 21 nt, Homo sapiens
uuuaaugugaggaacucacau

SEQ ID NO: 732608 - RNA, 16 nt, Homo sapiens
uuuaauguuuccuuua

SEQ ID NO: 732609 - RNA, 23 nt, Homo sapiens
uuuaauuaugaaaacuagcauua

SEQ ID NO: 732610 - RNA, 22 nt, Homo sapiens
uuuaauucucauuuguucucac

SEQ ID NO: 732611 - RNA, 12 nt, Homo sapiens
uuuacaaaguau

SEQ ID NO: 732612 - RNA, 12 nt, Homo sapiens
uuuacaauccau

SEQ ID NO: 732613 - RNA, 13 nt, Homo sapiens
uuuacacacauga

SEQ ID NO: 732614 - RNA, 21 nt, Homo sapiens
uuuacacagaaacacugccuu

SEQ ID NO: 732615 - RNA, 16 nt, Homo sapiens
uuuacacuacauugua

SEQ ID NO: 732616 - RNA, 11 nt, Homo sapiens
uuuacacuuua

SEQ ID NO: 732617 - RNA, 19 nt, Homo sapiens
uuuacagcacuacucugug

SEQ ID NO: 732618 - RNA, 20 nt, Homo sapiens
uuuacauaucaccucauggc

SEQ ID NO: 732619 - RNA, 15 nt, Homo sapiens
uuuacauguggccca

SEQ ID NO: 732620 - RNA, 17 nt, Homo sapiens
uuuacauuauuaagaaa

SEQ ID NO: 732621 - RNA, 10 nt, Homo sapiens
uuuacauuca

SEQ ID NO: 732622 - RNA, 11 nt, Homo sapiens
uuuacauucau

SEQ ID NO: 732623 - RNA, 16 nt, Homo sapiens
uuuacauuucauacaa

SEQ ID NO: 732624 - RNA, 12 nt, Homo sapiens
uuuacauuugau

SEQ ID NO: 732625 - RNA, 17 nt, Homo sapiens
uuuaccaguugccuuuu

SEQ ID NO: 732626 - RNA, 14 nt, Homo sapiens
uuuaccaucugcau

SEQ ID NO: 732627 - RNA, 16 nt, Homo sapiens
uuuaccuaaucuccac

SEQ ID NO: 732628 - RNA, 16 nt, Homo sapiens
uuuaccugcugggacc

SEQ ID NO: 732629 - RNA, 19 nt, Homo sapiens
uuuaccuguauacagugca

SEQ ID NO: 732630 - RNA, 13 nt, Homo sapiens
uuuacuacugugg

SEQ ID NO: 732631 - RNA, 14 nt, Homo sapiens
uuuacuagugugug

SEQ ID NO: 732632 - RNA, 16 nt, Homo sapiens
uuuacucuuaugauca

SEQ ID NO: 732633 - RNA, 20 nt, Homo sapiens
uuuacugggccugaacucau

SEQ ID NO: 732634 - RNA, 15 nt, Homo sapiens
uuuacugucuaugga

SEQ ID NO: 732635 - RNA, 10 nt, Homo sapiens
uuuacuguug

SEQ ID NO: 732636 - RNA, 17 nt, Homo sapiens
uuuacuuuauugcccua

SEQ ID NO: 732637 - RNA, 23 nt, Homo sapiens
uuuagaaaagaaagcaaacuuaa

SEQ ID NO: 732638 - RNA, 21 nt, Homo sapiens
uuuagaaucuagaaauguuca

SEQ ID NO: 732639 - RNA, 16 nt, Homo sapiens
uuuagaccccauacaa

SEQ ID NO: 732640 - RNA, 21 nt, Homo sapiens
uuuagaccuguguuacuaaaa

SEQ ID NO: 732641 - RNA, 15 nt, Homo sapiens
uuuagacuuccugua

SEQ ID NO: 732642 - RNA, 22 nt, Homo sapiens
uuuagauccuaagucucuuaca

SEQ ID NO: 732643 - RNA, 14 nt, Homo sapiens
uuuagccagugacu

SEQ ID NO: 732644 - RNA, 19 nt, Homo sapiens
uuuagcguagcuaagugaa

SEQ ID NO: 732645 - RNA, 13 nt, Homo sapiens
uuuagcguguaaa

SEQ ID NO: 732646 - RNA, 23 nt, Homo sapiens
uuuagcuaccucacuaugcugcu

SEQ ID NO: 732647 - RNA, 21 nt, Homo sapiens
uuuaggaaaaauaauucuauu

SEQ ID NO: 732648 - RNA, 22 nt, Homo sapiens
uuuaggaaaaucacuuugucua

SEQ ID NO: 732649 - RNA, 19 nt, Homo sapiens
uuuaggaaaugggcaguga

SEQ ID NO: 732650 - RNA, 20 nt, Homo sapiens
uuuaggaaaugggcagugaa

SEQ ID NO: 732651 - RNA, 20 nt, Homo sapiens
uuuaggaaguauggcaaaaa

SEQ ID NO: 732652 - RNA, 19 nt, Homo sapiens
uuuaggaccaauaccuccu

SEQ ID NO: 732653 - RNA, 13 nt, Homo sapiens
uuuaggaugcuuu

SEQ ID NO: 732654 - RNA, 15 nt, Homo sapiens
uuuaggauuacuuag

SEQ ID NO: 732655 - RNA, 18 nt, Homo sapiens
uuuagggcagcuugcccc

SEQ ID NO: 732656 - RNA, 21 nt, Homo sapiens
uuuaguagagacaggguuuca

SEQ ID NO: 732657 - RNA, 12 nt, Homo sapiens
uuuagucacuaa

SEQ ID NO: 732658 - RNA, 12 nt, Homo sapiens
uuuaguggagcc

SEQ ID NO: 732659 - RNA, 16 nt, Homo sapiens
uuuagugugccuucca

SEQ ID NO: 732660 - RNA, 23 nt, Homo sapiens
uuuaguuguaaaccaagugauca

SEQ ID NO: 732661 - RNA, 12 nt, Homo sapiens
uuuaguuucaug

SEQ ID NO: 732662 - RNA, 18 nt, Homo sapiens
uuuauaaacaacaucaaa

SEQ ID NO: 732663 - RNA, 16 nt, Homo sapiens
uuuauaagagcuaaag

SEQ ID NO: 732664 - RNA, 16 nt, Homo sapiens
uuuauaagagugccgu

SEQ ID NO: 732665 - RNA, 13 nt, Homo sapiens
uuuauaauguugu

SEQ ID NO: 732666 - RNA, 14 nt, Homo sapiens
uuuauaucugagca

SEQ ID NO: 732667 - RNA, 11 nt, Homo sapiens
uuuauaugauu

SEQ ID NO: 732668 - RNA, 19 nt, Homo sapiens
uuuauaugauucacaugcu

SEQ ID NO: 732669 - RNA, 18 nt, Homo sapiens
uuuauauuuaaauaaagg

SEQ ID NO: 732670 - RNA, 14 nt, Homo sapiens
uuuaucaaucccag

SEQ ID NO: 732671 - RNA, 19 nt, Homo sapiens
uuuaucacacuucugugag

SEQ ID NO: 732672 - RNA, 19 nt, Homo sapiens
uuuauccugagucccuuaa

SEQ ID NO: 732673 - RNA, 21 nt, Homo sapiens
uuuaucucugaggcauggugu

SEQ ID NO: 732674 - RNA, 19 nt, Homo sapiens
uuuaucuuugauucuccuu

SEQ ID NO: 732675 - RNA, 15 nt, Homo sapiens
uuuaugaaguuaaca

SEQ ID NO: 732676 - RNA, 13 nt, Homo sapiens
uuuaugaguacuu

SEQ ID NO: 732677 - RNA, 20 nt, Homo sapiens
uuuaugauggagcaacugaa

SEQ ID NO: 732678 - RNA, 13 nt, Homo sapiens
uuuaugcauguau

SEQ ID NO: 732679 - RNA, 11 nt, Homo sapiens
uuuaugguucu

SEQ ID NO: 732680 - RNA, 12 nt, Homo sapiens
uuuaugguucuc

SEQ ID NO: 732681 - RNA, 23 nt, Homo sapiens
uuuauguaaaaccaacaaaaaga

SEQ ID NO: 732682 - RNA, 17 nt, Homo sapiens
uuuaugugcacugccug

SEQ ID NO: 732683 - RNA, 16 nt, Homo sapiens
uuuauuaacuacugaa

SEQ ID NO: 732684 - RNA, 19 nt, Homo sapiens
uuuauuaacuugagcuuca

SEQ ID NO: 732685 - RNA, 15 nt, Homo sapiens
uuuauuaaucuuagu

SEQ ID NO: 732686 - RNA, 11 nt, Homo sapiens
uuuauuacaaa

SEQ ID NO: 732687 - RNA, 17 nt, Homo sapiens
uuuauuauuuucaccug

SEQ ID NO: 732688 - RNA, 22 nt, Homo sapiens
uuuauucccaaguaugccuuaa

SEQ ID NO: 732689 - RNA, 14 nt, Homo sapiens
uuuauuccuguaug

SEQ ID NO: 732690 - RNA, 16 nt, Homo sapiens
uuuauugcauugcugg

SEQ ID NO: 732691 - RNA, 20 nt, Homo sapiens
uuuauuggcugagauaugaa

SEQ ID NO: 732692 - RNA, 21 nt, Homo sapiens
uuuauuuacacucuugauucu

SEQ ID NO: 732693 - RNA, 18 nt, Homo sapiens
uuuauuuacuucuguaug

SEQ ID NO: 732694 - RNA, 13 nt, Homo sapiens
uuuauuucaucuc

SEQ ID NO: 732695 - RNA, 14 nt, Homo sapiens
uuuauuuuggaacu

SEQ ID NO: 732696 - RNA, 20 nt, Homo sapiens
uuuauuuuucucucagugca

SEQ ID NO: 732697 - RNA, 22 nt, Homo sapiens
uuucaaaaaaucugaccaaaac

SEQ ID NO: 732698 - RNA, 13 nt, Homo sapiens
uuucaaaaaccau

SEQ ID NO: 732699 - RNA, 14 nt, Homo sapiens
uuucaaacauauau

SEQ ID NO: 732700 - RNA, 13 nt, Homo sapiens
uuucaaagacuua

SEQ ID NO: 732701 - RNA, 21 nt, Homo sapiens
uuucaaagagguauauuugaa

SEQ ID NO: 732702 - RNA, 12 nt, Homo sapiens
uuucaacuauuu

SEQ ID NO: 732703 - RNA, 17 nt, Homo sapiens
uuucaacugugcucuug

SEQ ID NO: 732704 - RNA, 13 nt, Homo sapiens
uuucaacuugcau

SEQ ID NO: 732705 - RNA, 15 nt, Homo sapiens
uuucaagacuagaau

SEQ ID NO: 732706 - RNA, 20 nt, Homo sapiens
uuucaagagugagcuaucaa

SEQ ID NO: 732707 - RNA, 16 nt, Homo sapiens
uuucaagcugcacuga

SEQ ID NO: 732708 - RNA, 12 nt, Homo sapiens
uuucaagucucu

SEQ ID NO: 732709 - RNA, 13 nt, Homo sapiens
uuucaauuacaaa

SEQ ID NO: 732710 - RNA, 16 nt, Homo sapiens
uuucacaauaccucau

SEQ ID NO: 732711 - RNA, 14 nt, Homo sapiens
uuucacaauuccau

SEQ ID NO: 732712 - RNA, 22 nt, Homo sapiens
uuucacaccccauucucaaaaa

SEQ ID NO: 732713 - RNA, 22 nt, Homo sapiens
uuucacacuggauccaucuuga

SEQ ID NO: 732714 - RNA, 15 nt, Homo sapiens
uuucacagucacuga

SEQ ID NO: 732715 - RNA, 16 nt, Homo sapiens
uuucacauaucuagua

SEQ ID NO: 732716 - RNA, 21 nt, Homo sapiens
uuucacauuguuugcugcuau

SEQ ID NO: 732717 - RNA, 19 nt, Homo sapiens
uuucaccaaugagccuuag

SEQ ID NO: 732718 - RNA, 17 nt, Homo sapiens
uuucaccagcagcauag

SEQ ID NO: 732719 - RNA, 14 nt, Homo sapiens
uuucaccuguauug

SEQ ID NO: 732720 - RNA, 16 nt, Homo sapiens
uuucacuuaccugaaa

SEQ ID NO: 732721 - RNA, 16 nt, Homo sapiens
uuucacuucuuccuau

SEQ ID NO: 732722 - RNA, 20 nt, Homo sapiens
uuucagaagcucuucuaaaa

SEQ ID NO: 732723 - RNA, 19 nt, Homo sapiens
uuucagaauauuuucaaaa

SEQ ID NO: 732724 - RNA, 19 nt, Homo sapiens
uuucagacuucaucuucaa

SEQ ID NO: 732725 - RNA, 19 nt, Homo sapiens
uuucagacuuuaaaauucu

SEQ ID NO: 732726 - RNA, 22 nt, Homo sapiens
uuucagagagcuucuuacugga

SEQ ID NO: 732727 - RNA, 21 nt, Homo sapiens
uuucaggaaaauguauugauu

SEQ ID NO: 732728 - RNA, 18 nt, Homo sapiens
uuucaggaagacugacag

SEQ ID NO: 732729 - RNA, 21 nt, Homo sapiens
uuucagguccagaguaguuuc

SEQ ID NO: 732730 - RNA, 16 nt, Homo sapiens
uuucaguaagucucau

SEQ ID NO: 732731 - RNA, 23 nt, Homo sapiens
uuucaguggcuaccuacauacaa

SEQ ID NO: 732732 - RNA, 10 nt, Homo sapiens
uuucauaaac

SEQ ID NO: 732733 - RNA, 13 nt, Homo sapiens
uuucauacaacag

SEQ ID NO: 732734 - RNA, 13 nt, Homo sapiens
uuucauacacuua

SEQ ID NO: 732735 - RNA, 15 nt, Homo sapiens
uuucaucacacuggg

SEQ ID NO: 732736 - RNA, 17 nt, Homo sapiens
uuucaucauaacauaaa

SEQ ID NO: 732737 - RNA, 15 nt, Homo sapiens
uuucaucuaauguga

SEQ ID NO: 732738 - RNA, 22 nt, Homo sapiens
uuucaucugcucuccuuccugg

SEQ ID NO: 732739 - RNA, 14 nt, Homo sapiens
uuucauggacacuu

SEQ ID NO: 732740 - RNA, 19 nt, Homo sapiens
uuucauggucugcugagua

SEQ ID NO: 732741 - RNA, 15 nt, Homo sapiens
uuuccaaacauccaa

SEQ ID NO: 732742 - RNA, 21 nt, Homo sapiens
uuuccaacuuuaucauggaau

SEQ ID NO: 732743 - RNA, 16 nt, Homo sapiens
uuuccaauaugugauu

SEQ ID NO: 732744 - RNA, 23 nt, Homo sapiens
uuuccaauccagaggaacaagca

SEQ ID NO: 732745 - RNA, 12 nt, Homo sapiens
uuuccagaauug

SEQ ID NO: 732746 - RNA, 14 nt, Homo sapiens
uuuccagaccaaua

SEQ ID NO: 732747 - RNA, 20 nt, Homo sapiens
uuuccagaguuugucauuau

SEQ ID NO: 732748 - RNA, 17 nt, Homo sapiens
uuuccagcagaagacaa

SEQ ID NO: 732749 - RNA, 19 nt, Homo sapiens
uuuccagguaauaugucuu

SEQ ID NO: 732750 - RNA, 16 nt, Homo sapiens
uuuccaguguuuacaa

SEQ ID NO: 732751 - RNA, 14 nt, Homo sapiens
uuuccauagucaca

SEQ ID NO: 732752 - RNA, 23 nt, Homo sapiens
uuuccauauuuuauuuuucaaaa

SEQ ID NO: 732753 - RNA, 16 nt, Homo sapiens
uuuccauguugcugcc

SEQ ID NO: 732754 - RNA, 23 nt, Homo sapiens
uuuccauuaaguacaugugccag

SEQ ID NO: 732755 - RNA, 18 nt, Homo sapiens
uuucccaaagccagaacc

SEQ ID NO: 732756 - RNA, 19 nt, Homo sapiens
uuucccagagucaucugau

SEQ ID NO: 732757 - RNA, 12 nt, Homo sapiens
uuucccaggacg

SEQ ID NO: 732758 - RNA, 16 nt, Homo sapiens
uuucccauaguuuauu

SEQ ID NO: 732759 - RNA, 12 nt, Homo sapiens
uuucccauuuca

SEQ ID NO: 732760 - RNA, 23 nt, Homo sapiens
uuuccccaccccagcucaugccc

SEQ ID NO: 732761 - RNA, 15 nt, Homo sapiens
uuuccccagucccag

SEQ ID NO: 732762 - RNA, 20 nt, Homo sapiens
uuuccccuccuuggcuuuau

SEQ ID NO: 732763 - RNA, 20 nt, Homo sapiens
uuuccccuggccucaguucc

SEQ ID NO: 732764 - RNA, 16 nt, Homo sapiens
uuucccuucagucuuc

SEQ ID NO: 732765 - RNA, 22 nt, Homo sapiens
uuucccuuccugggucuaccac

SEQ ID NO: 732766 - RNA, 16 nt, Homo sapiens
uuucccuuuaccuccu

SEQ ID NO: 732767 - RNA, 14 nt, Homo sapiens
uuucccuuugccac

SEQ ID NO: 732768 - RNA, 17 nt, Homo sapiens
uuuccgccagaccucaa

SEQ ID NO: 732769 - RNA, 15 nt, Homo sapiens
uuuccuaauuuugac

SEQ ID NO: 732770 - RNA, 19 nt, Homo sapiens
uuuuccugcuuucaggaaa

SEQ ID NO: 732771 - RNA, 20 nt, Homo sapiens
uuuuccuuuuuugucuauga

SEQ ID NO: 732772 - RNA, 16 nt, Homo sapiens
uuuucgcugaugcugu

SEQ ID NO: 732773 - RNA, 20 nt, Homo sapiens
uuuucuaaaaaaagaaaaaa

SEQ ID NO: 732774 - RNA, 16 nt, Homo sapiens
uuuucuauauucucau

SEQ ID NO: 732775 - RNA, 19 nt, Homo sapiens
uuuucucaaaggcccucag

SEQ ID NO: 732776 - RNA, 12 nt, Homo sapiens
uuuucucaguca

SEQ ID NO: 732777 - RNA, 19 nt, Homo sapiens
uuuucucaguguugguaua

SEQ ID NO: 732778 - RNA, 22 nt, Homo sapiens
uuuucucuggaaugguacaugu

SEQ ID NO: 732779 - RNA, 21 nt, Homo sapiens
uuuucugagcuuuucauggaa

SEQ ID NO: 732780 - RNA, 12 nt, Homo sapiens
uuuucugccacu

SEQ ID NO: 732781 - RNA, 21 nt, Homo sapiens
uuuucuggccaaaagcaguaa

SEQ ID NO: 732782 - RNA, 15 nt, Homo sapiens
uuuucugguggggcu

SEQ ID NO: 732783 - RNA, 15 nt, Homo sapiens
uuuucuguaauguaa

SEQ ID NO: 732784 - RNA, 19 nt, Homo sapiens
uuuucuguggaucauuucc

SEQ ID NO: 732785 - RNA, 22 nt, Homo sapiens
uuuucuuacuagaccuguaacu

SEQ ID NO: 732786 - RNA, 17 nt, Homo sapiens
uuuucuuauugcgcugc

SEQ ID NO: 732787 - RNA, 16 nt, Homo sapiens
uuuucuucuugggaua

SEQ ID NO: 732788 - RNA, 19 nt, Homo sapiens
uuuucuucuuuuugcuuca

SEQ ID NO: 732789 - RNA, 13 nt, Homo sapiens
uuuucuuuugaca

SEQ ID NO: 732790 - RNA, 16 nt, Homo sapiens
uuuugaaaaugggcuc

SEQ ID NO: 732791 - RNA, 16 nt, Homo sapiens
uuuugacacuauaucu

SEQ ID NO: 732792 - RNA, 15 nt, Homo sapiens
uuuugaccauaacug

SEQ ID NO: 732793 - RNA, 21 nt, Homo sapiens
cacaaaucagaccuggcugcu

SEQ ID NO: 732794 - RNA, 18 nt, Homo sapiens
cacaaauuuguaaacuuu

SEQ ID NO: 732795 - RNA, 11 nt, Homo sapiens
cacaacaaucc

SEQ ID NO: 732796 - RNA, 11 nt, Homo sapiens
cacaacacaga

SEQ ID NO: 732797 - RNA, 13 nt, Homo sapiens
cacaacagugaaa

SEQ ID NO: 732798 - RNA, 14 nt, Homo sapiens
cacaacagugaaaa

SEQ ID NO: 732799 - RNA, 18 nt, Homo sapiens
cacaacugacacaggaaa

SEQ ID NO: 732800 - RNA, 17 nt, Homo sapiens
cacaagaaguagcuuca

SEQ ID NO: 732801 - RNA, 17 nt, Homo sapiens
cacaagaccaagguaua

SEQ ID NO: 732802 - RNA, 13 nt, Homo sapiens
cacaagcacaaag

SEQ ID NO: 732803 - RNA, 16 nt, Homo sapiens
cacaagccugagaacu

SEQ ID NO: 732804 - RNA, 22 nt, Homo sapiens
cacaagcgaaucucugccuuuc

SEQ ID NO: 732805 - RNA, 22 nt, Homo sapiens
cacaagcuugucaaugauuuca

SEQ ID NO: 732806 - RNA, 21 nt, Homo sapiens
cacaaggaaaaggccauuaaa

SEQ ID NO: 732807 - RNA, 14 nt, Homo sapiens
cacaaggaaggcau

SEQ ID NO: 732808 - RNA, 18 nt, Homo sapiens
cacaaggaaggcauuugg

SEQ ID NO: 732809 - RNA, 16 nt, Homo sapiens
cacaaggacuuccugu

SEQ ID NO: 732810 - RNA, 15 nt, Homo sapiens
cacaaggccuugccu

SEQ ID NO: 732811 - RNA, 17 nt, Homo sapiens
cacaaggugcaaaucaa

SEQ ID NO: 732812 - RNA, 14 nt, Homo sapiens
cacaauaaccaaga

SEQ ID NO: 732813 - RNA, 19 nt, Homo sapiens
cacaauauaaaacuguacu

SEQ ID NO: 732814 - RNA, 15 nt, Homo sapiens
cacaauauccagcga

SEQ ID NO: 732815 - RNA, 23 nt, Homo sapiens
cacaaucccuguacucugaccca

SEQ ID NO: 732816 - RNA, 12 nt, Homo sapiens
cacaauccucca

SEQ ID NO: 732817 - RNA, 18 nt, Homo sapiens
cacaauguuaaguuauau

SEQ ID NO: 732818 - RNA, 21 nt, Homo sapiens
cacaauuccauuuccaguuca

SEQ ID NO: 732819 - RNA, 13 nt, Homo sapiens
cacacaaaccagu

SEQ ID NO: 732820 - RNA, 16 nt, Homo sapiens
cacacaaggugcaaau

SEQ ID NO: 732821 - RNA, 10 nt, Homo sapiens
cacacacaaa

SEQ ID NO: 732822 - RNA, 12 nt, Homo sapiens
cacacacacaaa

SEQ ID NO: 732823 - RNA, 12 nt, Homo sapiens
cacacaccacca

SEQ ID NO: 732824 - RNA, 21 nt, Homo sapiens
cacacaccccucaaaaaaagc

SEQ ID NO: 732825 - RNA, 18 nt, Homo sapiens
cacacaccuguagcacuu

SEQ ID NO: 732826 - RNA, 14 nt, Homo sapiens
cacacacgaugcau

SEQ ID NO: 732827 - RNA, 14 nt, Homo sapiens
cacacacuuuccau

SEQ ID NO: 732828 - RNA, 17 nt, Homo sapiens
gucaucaucacauucag

SEQ ID NO: 732829 - RNA, 19 nt, Homo sapiens
gucaucaucacccuuucau

SEQ ID NO: 732830 - RNA, 20 nt, Homo sapiens
gucaucaugcuccacagaag

SEQ ID NO: 732831 - RNA, 20 nt, Homo sapiens
gucaucuuucuuuucuuuga

SEQ ID NO: 732832 - RNA, 19 nt, Homo sapiens
gucauggaauggcaggugu

SEQ ID NO: 732833 - RNA, 20 nt, Homo sapiens
gucuccaugcucaccaagga

SEQ ID NO: 732834 - RNA, 17 nt, Homo sapiens
gucuccccaugugccug

SEQ ID NO: 732835 - RNA, 23 nt, Homo sapiens
gucuccggggaggcagggguccu

SEQ ID NO: 732836 - RNA, 21 nt, Homo sapiens
gucuccuaagcuggagugcag

SEQ ID NO: 732837 - RNA, 22 nt, Homo sapiens
gucuccuaagcuggagugcagu

SEQ ID NO: 732838 - RNA, 20 nt, Homo sapiens
gucuccucucagagugacag

SEQ ID NO: 732839 - RNA, 13 nt, Homo sapiens
gucuccucuccau

SEQ ID NO: 732840 - RNA, 16 nt, Homo sapiens
gucuccucucuuggca

SEQ ID NO: 732841 - RNA, 22 nt, Homo sapiens
gucuccucuuaaaaaauaaaaa

SEQ ID NO: 732842 - RNA, 16 nt, Homo sapiens
gucuccuugcacuuuc

SEQ ID NO: 732843 - RNA, 18 nt, Homo sapiens
gucuccuuggcugucugu

SEQ ID NO: 732844 - RNA, 20 nt, Homo sapiens
gucuccuuugcucuugccaa

SEQ ID NO: 732845 - RNA, 19 nt, Homo sapiens
gucucuacuaaaaguacaa

SEQ ID NO: 732846 - RNA, 19 nt, Homo sapiens
gucucuauaccaauaaagu

SEQ ID NO: 732847 - RNA, 22 nt, Homo sapiens
gucucuauaccaauaaagugac

SEQ ID NO: 732848 - RNA, 22 nt, Homo sapiens
gucucucccaccccggccucca

SEQ ID NO: 732849 - RNA, 21 nt, Homo sapiens
gucucucggguucaagcaauu

SEQ ID NO: 732850 - RNA, 13 nt, Homo sapiens
gucucugugagac

SEQ ID NO: 732851 - RNA, 22 nt, Homo sapiens
gucucuuccuuacccuuucugu

SEQ ID NO: 732852 - RNA, 23 nt, Homo sapiens
gucucuucuuuagaacagggaaa

SEQ ID NO: 732853 - RNA, 22 nt, Homo sapiens
gucucuuucucugacacugugu

SEQ ID NO: 732854 - RNA, 16 nt, Homo sapiens
gucucuuuuuuuggcc

SEQ ID NO: 732855 - RNA, 18 nt, Homo sapiens
gucugaacaaagugcuag

SEQ ID NO: 732856 - RNA, 19 nt, Homo sapiens
gucugaacaaagugcuaga

SEQ ID NO: 732857 - RNA, 21 nt, Homo sapiens
gucugacauguuugugcucug

SEQ ID NO: 732858 - RNA, 16 nt, Homo sapiens
gucugagacuccucau

SEQ ID NO: 732859 - RNA, 24 nt, Homo sapiens
gucuggaucccgagguauggcaga

SEQ ID NO: 732860 - RNA, 15 nt, Homo sapiens
gucuggaugcacaga

SEQ ID NO: 732861 - RNA, 16 nt, Homo sapiens
gucugggauauggcug

SEQ ID NO: 732862 - RNA, 16 nt, Homo sapiens
gucugggcaccaccuc

SEQ ID NO: 732863 - RNA, 15 nt, Homo sapiens
gucuguacacguguc

SEQ ID NO: 732864 - RNA, 15 nt, Homo sapiens
gucugucugcagugc

SEQ ID NO: 732865 - RNA, 20 nt, Homo sapiens
gucugugugguggagccagg

SEQ ID NO: 732866 - RNA, 19 nt, Homo sapiens
gucuguguguuuaugugug

SEQ ID NO: 732867 - RNA, 12 nt, Homo sapiens
gucuguuugcaa

SEQ ID NO: 732868 - RNA, 13 nt, Homo sapiens
gucuguuugcauu

SEQ ID NO: 732869 - RNA, 19 nt, Homo sapiens
gucuguuuggacugcagaa

SEQ ID NO: 732870 - RNA, 17 nt, Homo sapiens
gucuuaaguguuucuca

SEQ ID NO: 732871 - RNA, 15 nt, Homo sapiens
gucuuaauguacaca

SEQ ID NO: 732872 - RNA, 18 nt, Homo sapiens
gucuuauaugcuuagcau

SEQ ID NO: 732873 - RNA, 13 nt, Homo sapiens
gucuucaaucucu

SEQ ID NO: 732874 - RNA, 17 nt, Homo sapiens
gucuucacaacuuugac

SEQ ID NO: 732875 - RNA, 13 nt, Homo sapiens
gucuucacuuccc

SEQ ID NO: 732876 - RNA, 18 nt, Homo sapiens
gucuuccaauuaaugcuu

SEQ ID NO: 732877 - RNA, 23 nt, Homo sapiens
gucuuccacaaaaaauacuuuau

SEQ ID NO: 732878 - RNA, 19 nt, Homo sapiens
gucuucccugaucaaguca

SEQ ID NO: 732879 - RNA, 19 nt, Homo sapiens
gucuuccugacacuuuaau

SEQ ID NO: 732880 - RNA, 17 nt, Homo sapiens
gucuuccuguguaccuc

SEQ ID NO: 732881 - RNA, 12 nt, Homo sapiens
gucuucucaggc

SEQ ID NO: 732882 - RNA, 23 nt, Homo sapiens
gucuucugagcgagugcucucac

SEQ ID NO: 732883 - RNA, 18 nt, Homo sapiens
gucuucugggcacagugg

SEQ ID NO: 732884 - RNA, 23 nt, Homo sapiens
gucuugaaaguggcaccagaggu

SEQ ID NO: 732885 - RNA, 16 nt, Homo sapiens
gucuugacucauggca

SEQ ID NO: 732886 - RNA, 15 nt, Homo sapiens
gucuugccagccaga

SEQ ID NO: 732887 - RNA, 12 nt, Homo sapiens
gucuuggcucac

SEQ ID NO: 732888 - RNA, 14 nt, Homo sapiens
gucuuggugcuauc

SEQ ID NO: 732889 - RNA, 20 nt, Homo sapiens
gucuuucacagcuccuccca

SEQ ID NO: 732890 - RNA, 19 nt, Homo sapiens
gucuuucugaauugcacau

SEQ ID NO: 732891 - RNA, 23 nt, Homo sapiens
gucuuucugacaucagcagagaa

SEQ ID NO: 732892 - RNA, 21 nt, Homo sapiens
gucuuucuuuuauacugacac

SEQ ID NO: 732893 - RNA, 14 nt, Homo sapiens
gucuuugaacccuu

SEQ ID NO: 732894 - RNA, 19 nt, Homo sapiens
gucuuugccagucauucag

SEQ ID NO: 732895 - RNA, 12 nt, Homo sapiens
gucuuuuacccg

SEQ ID NO: 732896 - RNA, 14 nt, Homo sapiens
gugaaaaaggaaua

SEQ ID NO: 732897 - RNA, 19 nt, Homo sapiens
gugaaaaaggaaugauaua

SEQ ID NO: 732898 - RNA, 20 nt, Homo sapiens
gugaaaauuuuuacauucau

SEQ ID NO: 732899 - RNA, 15 nt, Homo sapiens
gugaaacagagugau

SEQ ID NO: 732900 - RNA, 16 nt, Homo sapiens
gugaaaccccaucucu

SEQ ID NO: 732901 - RNA, 19 nt, Homo sapiens
gugaaacgucccacacuuu

SEQ ID NO: 732902 - RNA, 21 nt, Homo sapiens
gugaaauuauuuuggagauua

SEQ ID NO: 732903 - RNA, 23 nt, Homo sapiens
gugaacacugugaccaggcuuuu

SEQ ID NO: 732904 - RNA, 20 nt, Homo sapiens
gugaaccaacccccaucucc

SEQ ID NO: 732905 - RNA, 23 nt, Homo sapiens
gugaacucaaacgaugugcaaua

SEQ ID NO: 732906 - RNA, 16 nt, Homo sapiens
gugaacugucuuggcu

SEQ ID NO: 732907 - RNA, 21 nt, Homo sapiens
gugaagacuugauuguacaaa

SEQ ID NO: 732908 - RNA, 20 nt, Homo sapiens
gugaagagggagaagcauga

SEQ ID NO: 732909 - RNA, 18 nt, Homo sapiens
gugaagcagcacugugag

SEQ ID NO: 732910 - RNA, 11 nt, Homo sapiens
gugaagccaug

SEQ ID NO: 732911 - RNA, 14 nt, Homo sapiens
gugaagccucugag

SEQ ID NO: 732912 - RNA, 16 nt, Homo sapiens
gugaagugaaucugau

SEQ ID NO: 732913 - RNA, 12 nt, Homo sapiens
gugaaguguuac

SEQ ID NO: 732914 - RNA, 17 nt, Homo sapiens
gugaaguuuugcaaaua

SEQ ID NO: 732915 - RNA, 18 nt, Homo sapiens
gugaauaaaaacccugua

SEQ ID NO: 732916 - RNA, 14 nt, Homo sapiens
gugaauaaaaccuu

SEQ ID NO: 732917 - RNA, 18 nt, Homo sapiens
gugaauaugugguuucua

SEQ ID NO: 732918 - RNA, 14 nt, Homo sapiens
gugaauuaggcugu

SEQ ID NO: 732919 - RNA, 18 nt, Homo sapiens
gugaauuauugacacuga

SEQ ID NO: 732920 - RNA, 14 nt, Homo sapiens
gugacaaagccaga

SEQ ID NO: 732921 - RNA, 13 nt, Homo sapiens
gugacaacaugcg

SEQ ID NO: 732922 - RNA, 18 nt, Homo sapiens
gugacaagaauuguuacc

SEQ ID NO: 732923 - RNA, 13 nt, Homo sapiens
gugacacagcagc

SEQ ID NO: 732924 - RNA, 12 nt, Homo sapiens
gugacacuggac

SEQ ID NO: 732925 - RNA, 11 nt, Homo sapiens
gugacagucau

SEQ ID NO: 732926 - RNA, 16 nt, Homo sapiens
gugaccacugaagcac

SEQ ID NO: 732927 - RNA, 12 nt, Homo sapiens
gugacccugaga

SEQ ID NO: 732928 - RNA, 21 nt, Homo sapiens
gugacccuucccaaucagcac

SEQ ID NO: 732929 - RNA, 14 nt, Homo sapiens
gugaccgacuaccc

SEQ ID NO: 732930 - RNA, 19 nt, Homo sapiens
gugacuauaaagcuguuau

SEQ ID NO: 732931 - RNA, 20 nt, Homo sapiens
gugacucgagucacacucaa

SEQ ID NO: 732932 - RNA, 17 nt, Homo sapiens
gugacuguggcacacgc

SEQ ID NO: 732933 - RNA, 15 nt, Homo sapiens
gugacuucacuguau

SEQ ID NO: 732934 - RNA, 16 nt, Homo sapiens
gugacuucacuguaua

SEQ ID NO: 732935 - RNA, 21 nt, Homo sapiens
gugacuugaacuagauugcau

SEQ ID NO: 732936 - RNA, 20 nt, Homo sapiens
gugagaacucugcccaggug

SEQ ID NO: 732937 - RNA, 23 nt, Homo sapiens
gugagaagucacucacacuggcc

SEQ ID NO: 732938 - RNA, 20 nt, Homo sapiens
gugagacccugucucaaaaa

SEQ ID NO: 732939 - RNA, 20 nt, Homo sapiens
gugagacuguggcucaaaaa

SEQ ID NO: 732940 - RNA, 14 nt, Homo sapiens
gugagaucaugcca

SEQ ID NO: 732941 - RNA, 20 nt, Homo sapiens
gugagcagagauguacugca

SEQ ID NO: 732942 - RNA, 18 nt, Homo sapiens
gugagccaagauugcacc

SEQ ID NO: 732943 - RNA, 14 nt, Homo sapiens
gugagccacagacc

SEQ ID NO: 732944 - RNA, 16 nt, Homo sapiens
uacauucaacucugau

SEQ ID NO: 732945 - RNA, 16 nt, Homo sapiens
uacauucugcuuucau

SEQ ID NO: 732946 - RNA, 12 nt, Homo sapiens
uacauucuucca

SEQ ID NO: 732947 - RNA, 13 nt, Homo sapiens
uacauugucuuga

SEQ ID NO: 732948 - RNA, 14 nt, Homo sapiens
uacauuuauuuaca

SEQ ID NO: 732949 - RNA, 13 nt, Homo sapiens
uacauuuccaaau

SEQ ID NO: 732950 - RNA, 18 nt, Homo sapiens
uacauuugugaacaaaaa

SEQ ID NO: 732951 - RNA, 18 nt, Homo sapiens
uacauuuguuuguauuca

SEQ ID NO: 732952 - RNA, 13 nt, Homo sapiens
uaccaaagugucu

SEQ ID NO: 732953 - RNA, 16 nt, Homo sapiens
cauuugcaccuaccuc

SEQ ID NO: 732954 - RNA, 16 nt, Homo sapiens
cauuugcuaguucugc

SEQ ID NO: 732955 - RNA, 19 nt, Homo sapiens
cauuugcucuuucaucucu

SEQ ID NO: 732956 - RNA, 17 nt, Homo sapiens
cauuugcuuccucccaa

SEQ ID NO: 732957 - RNA, 21 nt, Homo sapiens
cauuugguagaaggacugaac

SEQ ID NO: 732958 - RNA, 14 nt, Homo sapiens
cauuuggucucagg

SEQ ID NO: 732959 - RNA, 12 nt, Homo sapiens
cauuuguagcaa

SEQ ID NO: 732960 - RNA, 21 nt, Homo sapiens
cauuuguagcucuggaccugu

SEQ ID NO: 732961 - RNA, 12 nt, Homo sapiens
cauuuguagcuu

SEQ ID NO: 732962 - RNA, 14 nt, Homo sapiens
cauuuguagcuuug

SEQ ID NO: 732963 - RNA, 14 nt, Homo sapiens
cauuugugcaaaau

SEQ ID NO: 732964 - RNA, 22 nt, Homo sapiens
cauuuguguuauuauuuugcac

SEQ ID NO: 732965 - RNA, 21 nt, Homo sapiens
cauuuguuggaaugaauuaaa

SEQ ID NO: 732966 - RNA, 18 nt, Homo sapiens
cauuuuaaaaaauggaac

SEQ ID NO: 732967 - RNA, 19 nt, Homo sapiens
cauuuuaacaacugcucuu

SEQ ID NO: 732968 - RNA, 15 nt, Homo sapiens
cauuuuaagaguuac

SEQ ID NO: 732969 - RNA, 14 nt, Homo sapiens
cauuuuacacaaag

SEQ ID NO: 732970 - RNA, 22 nt, Homo sapiens
cauuuuacccuuggcucaaucc

SEQ ID NO: 732971 - RNA, 21 nt, Homo sapiens
cauuuuacucuuaugaucaau

SEQ ID NO: 732972 - RNA, 17 nt, Homo sapiens
cauuuuauguuaaggga

SEQ ID NO: 732973 - RNA, 16 nt, Homo sapiens
cauuuucaagacugaa

SEQ ID NO: 732974 - RNA, 17 nt, Homo sapiens
cauuuugacagcaucuu

SEQ ID NO: 732975 - RNA, 14 nt, Homo sapiens
cauuuugcacugua

SEQ ID NO: 732976 - RNA, 15 nt, Homo sapiens
cauuuugcacuguaa

SEQ ID NO: 732977 - RNA, 22 nt, Homo sapiens
cauuuuggaaguuuucaggacu

SEQ ID NO: 732978 - RNA, 20 nt, Homo sapiens
cauuuugucaguuuuaucuu

SEQ ID NO: 732979 - RNA, 21 nt, Homo sapiens
cauuuuuaacagcaugcugcu

SEQ ID NO: 732980 - RNA, 17 nt, Homo sapiens
cauuuuuaauaugacaa

SEQ ID NO: 732981 - RNA, 21 nt, Homo sapiens
cauuuuuauaaaaaugagugc

SEQ ID NO: 732982 - RNA, 16 nt, Homo sapiens
cauuuuucacaucucu

SEQ ID NO: 732983 - RNA, 19 nt, Homo sapiens
cauuuuucccuauuuuccu

SEQ ID NO: 732984 - RNA, 21 nt, Homo sapiens
cauuuuuugaaaugcugaaaa

SEQ ID NO: 732985 - RNA, 22 nt, Homo sapiens
cauuuuuuucacuggaguuaca

SEQ ID NO: 732986 - RNA, 23 nt, Homo sapiens
cauuuuuuucacuggaguuacau

SEQ ID NO: 732987 - RNA, 16 nt, Homo sapiens
ccaaaaauuacuuugg

SEQ ID NO: 732988 - RNA, 18 nt, Homo sapiens
ccaaaacaagccaaagag

SEQ ID NO: 732989 - RNA, 12 nt, Homo sapiens
ccaaaacacagg

SEQ ID NO: 732990 - RNA, 14 nt, Homo sapiens
ccaaaacaguuaau

SEQ ID NO: 732991 - RNA, 15 nt, Homo sapiens
ccaaaacuaauuucc

SEQ ID NO: 732992 - RNA, 16 nt, Homo sapiens
ccaaaacuuuaaugaa

SEQ ID NO: 732993 - RNA, 13 nt, Homo sapiens
ccaaaauggucuc

SEQ ID NO: 732994 - RNA, 16 nt, Homo sapiens
ccaaaauguguuucau

SEQ ID NO: 732995 - RNA, 12 nt, Homo sapiens
ccaaaauuugau

SEQ ID NO: 732996 - RNA, 18 nt, Homo sapiens
ccaaacacauacaggaag

SEQ ID NO: 732997 - RNA, 12 nt, Homo sapiens
ccaaacaccagu

SEQ ID NO: 732998 - RNA, 17 nt, Homo sapiens
ccaaacaccagucaccu

SEQ ID NO: 732999 - RNA, 11 nt, Homo sapiens
ccaaacacuuc

SEQ ID NO: 733000 - RNA, 11 nt, Homo sapiens
ccaaacauguu

SEQ ID NO: 733001 - RNA, 21 nt, Homo sapiens
ccaaacauguuguacauuuca

SEQ ID NO: 733002 - RNA, 14 nt, Homo sapiens
ccaaaccaagcaaa

SEQ ID NO: 733003 - RNA, 20 nt, Homo sapiens
ccaaaccugucuuggggcca

SEQ ID NO: 733004 - RNA, 22 nt, Homo sapiens
ccaaacucaguucgaccaaacu

SEQ ID NO: 733005 - RNA, 19 nt, Homo sapiens
ccaaacucauucaccaaau

SEQ ID NO: 733006 - RNA, 12 nt, Homo sapiens
ccaaacuccucu

SEQ ID NO: 733007 - RNA, 18 nt, Homo sapiens
ccaaacugggggcucugu

SEQ ID NO: 733008 - RNA, 21 nt, Homo sapiens
ccaaagaagcugcuguucuua

SEQ ID NO: 733009 - RNA, 19 nt, Homo sapiens
ccaaagacggcuccauuaa

SEQ ID NO: 733010 - RNA, 18 nt, Homo sapiens
ccaaagagaccagccucc

SEQ ID NO: 733011 - RNA, 22 nt, Homo sapiens
ccaaagcaucaauacaaccagc

SEQ ID NO: 733012 - RNA, 15 nt, Homo sapiens
ccaaagccacuggaa

SEQ ID NO: 733013 - RNA, 20 nt, Homo sapiens
ccaaagcccuuauguuuaau

SEQ ID NO: 733014 - RNA, 19 nt, Homo sapiens
ccaaaggcauccaggccag

SEQ ID NO: 733015 - RNA, 15 nt, Homo sapiens
ccaauugugcugcca

SEQ ID NO: 733016 - RNA, 17 nt, Homo sapiens
ccaauugugguugugca

SEQ ID NO: 733017 - RNA, 16 nt, Homo sapiens
ccacaaaaaauacuuu

SEQ ID NO: 733018 - RNA, 13 nt, Homo sapiens
ccacaaaugccac

SEQ ID NO: 733019 - RNA, 17 nt, Homo sapiens
ccacaaccaaaaaauuc

SEQ ID NO: 733020 - RNA, 17 nt, Homo sapiens
ccacaacugacacagga

SEQ ID NO: 733021 - RNA, 21 nt, Homo sapiens
ccacaauagcagacaguguuu

SEQ ID NO: 733022 - RNA, 15 nt, Homo sapiens
ccacaauguuuauaa

SEQ ID NO: 733023 - RNA, 24 nt, Homo sapiens
ccacaauuauauaaaucauuucaa

SEQ ID NO: 733024 - RNA, 15 nt, Homo sapiens
ccacacagacuccac

SEQ ID NO: 733025 - RNA, 15 nt, Homo sapiens
ccacacauauugcac

SEQ ID NO: 733026 - RNA, 12 nt, Homo sapiens
ccacacccaaag

SEQ ID NO: 733027 - RNA, 18 nt, Homo sapiens
ccacacccacuuugucca

SEQ ID NO: 733028 - RNA, 11 nt, Homo sapiens
ccacaccucag

SEQ ID NO: 733029 - RNA, 22 nt, Homo sapiens
ccacaccuggcccuugcaaucu

SEQ ID NO: 733030 - RNA, 23 nt, Homo sapiens
ccacacugauggcucaagacaag

SEQ ID NO: 733031 - RNA, 20 nt, Homo sapiens
ccacacuuugaagcaaauac

SEQ ID NO: 733032 - RNA, 17 nt, Homo sapiens
ccacagacgggcacaca

SEQ ID NO: 733033 - RNA, 21 nt, Homo sapiens
ccacagagaaguuuguagcca

SEQ ID NO: 733034 - RNA, 18 nt, Homo sapiens
ccacagagagaggggaga

SEQ ID NO: 733035 - RNA, 17 nt, Homo sapiens
ccacagcacaaacacac

SEQ ID NO: 733036 - RNA, 12 nt, Homo sapiens
ccacagcaguug

SEQ ID NO: 733037 - RNA, 23 nt, Homo sapiens
ccacagcaguugaaaagacucca

SEQ ID NO: 733038 - RNA, 12 nt, Homo sapiens
ccacagcucuuc

SEQ ID NO: 733039 - RNA, 19 nt, Homo sapiens
ccacagcugggcaggguga

SEQ ID NO: 733040 - RNA, 15 nt, Homo sapiens
ccacauaagaaggca

SEQ ID NO: 733041 - RNA, 15 nt, Homo sapiens
ccacauaauguucca

SEQ ID NO: 733042 - RNA, 21 nt, Homo sapiens
ccacauaccaggcaaccuccc

SEQ ID NO: 733043 - RNA, 22 nt, Homo sapiens
ccacauauuuuagacacuuccc

SEQ ID NO: 733044 - RNA, 12 nt, Homo sapiens
ccacauccagcc

SEQ ID NO: 733045 - RNA, 17 nt, Homo sapiens
ccacaugaccuccauuu

SEQ ID NO: 733046 - RNA, 22 nt, Homo sapiens
ccacaugaggccaucucaggag

SEQ ID NO: 733047 - RNA, 17 nt, Homo sapiens
ccacauguacagacaua

SEQ ID NO: 733048 - RNA, 20 nt, Homo sapiens
ccacauguacagacauacau

SEQ ID NO: 733049 - RNA, 20 nt, Homo sapiens
ccacaugugacacauaugca

SEQ ID NO: 733050 - RNA, 17 nt, Homo sapiens
ccaccaaagcugcccac

SEQ ID NO: 733051 - RNA, 17 nt, Homo sapiens
ccaccaacacugcucac

SEQ ID NO: 733052 - RNA, 23 nt, Homo sapiens
ccaccaagaagcacugggugacc

SEQ ID NO: 733053 - RNA, 18 nt, Homo sapiens
ccaccaagggaucugcca

SEQ ID NO: 733054 - RNA, 20 nt, Homo sapiens
ccaccaagggaucugccauu

SEQ ID NO: 733055 - RNA, 15 nt, Homo sapiens
ccaccaaucacgugg

SEQ ID NO: 733056 - RNA, 13 nt, Homo sapiens
ccaccaccaggac

SEQ ID NO: 733057 - RNA, 10 nt, Homo sapiens
ccaccagaga

SEQ ID NO: 733058 - RNA, 18 nt, Homo sapiens
ccaccaguaugacaguau

SEQ ID NO: 733059 - RNA, 19 nt, Homo sapiens
ccaccauaugaauuguaca

SEQ ID NO: 733060 - RNA, 19 nt, Homo sapiens
ccaccauggucaucaccac

SEQ ID NO: 733061 - RNA, 19 nt, Homo sapiens
ccacccaagcuuggcagcc

SEQ ID NO: 733062 - RNA, 21 nt, Homo sapiens
ccacccaauugugguugugca

SEQ ID NO: 733063 - RNA, 15 nt, Homo sapiens
ccacccaccuuugcc

SEQ ID NO: 733064 - RNA, 12 nt, Homo sapiens
ccacccacugac

SEQ ID NO: 733065 - RNA, 13 nt, Homo sapiens
ccacccacugacc

SEQ ID NO: 733066 - RNA, 22 nt, Homo sapiens
ccacccaggcuggagugcagug

SEQ ID NO: 733067 - RNA, 13 nt, Homo sapiens
ccacccagucuca

SEQ ID NO: 733068 - RNA, 15 nt, Homo sapiens
ccacccagugcugaa

SEQ ID NO: 733069 - RNA, 23 nt, Homo sapiens
ccacccccaaauuuucuuuuuau

SEQ ID NO: 733070 - RNA, 15 nt, Homo sapiens
uccauacacuuuguu

SEQ ID NO: 733071 - RNA, 19 nt, Homo sapiens
uccauacguucagaggugc

SEQ ID NO: 733072 - RNA, 15 nt, Homo sapiens
uccauacuucucuca

SEQ ID NO: 733073 - RNA, 21 nt, Homo sapiens
uccauagauccccccacugag

SEQ ID NO: 733074 - RNA, 17 nt, Homo sapiens
uccauauagacaccaag

SEQ ID NO: 733075 - RNA, 17 nt, Homo sapiens
uccauauuuaacaugua

SEQ ID NO: 733076 - RNA, 17 nt, Homo sapiens
uccauauuuuacugauc

SEQ ID NO: 733077 - RNA, 21 nt, Homo sapiens
uccaucacuagccaugauaac

SEQ ID NO: 733078 - RNA, 13 nt, Homo sapiens
uccauccuuccaa

SEQ ID NO: 733079 - RNA, 15 nt, Homo sapiens
uccaucucaaaaaag

SEQ ID NO: 733080 - RNA, 14 nt, Homo sapiens
uccaucucccuuag

SEQ ID NO: 733081 - RNA, 13 nt, Homo sapiens
uccaucucucauc

SEQ ID NO: 733082 - RNA, 16 nt, Homo sapiens
uccaucucugacuuaa

SEQ ID NO: 733083 - RNA, 17 nt, Homo sapiens
uccaucuuuccauccau

SEQ ID NO: 733084 - RNA, 18 nt, Homo sapiens
uccaucuuugaacuucug

SEQ ID NO: 733085 - RNA, 18 nt, Homo sapiens
uccaugagggacuccucc

SEQ ID NO: 733086 - RNA, 20 nt, Homo sapiens
uccaugauuuuaaauuguga

SEQ ID NO: 733087 - RNA, 20 nt, Homo sapiens
uccaugcaccuaccuuagaa

SEQ ID NO: 733088 - RNA, 11 nt, Homo sapiens
uccaugcaugu

SEQ ID NO: 733089 - RNA, 22 nt, Homo sapiens
uccaugcuccucaccugucuag

SEQ ID NO: 733090 - RNA, 12 nt, Homo sapiens
uccaugcugcaa

SEQ ID NO: 733091 - RNA, 11 nt, Homo sapiens
uccaugcugug

SEQ ID NO: 733092 - RNA, 15 nt, Homo sapiens
uccauggaugcaugc

SEQ ID NO: 733093 - RNA, 16 nt, Homo sapiens
uccauggaugcaugcc

SEQ ID NO: 733094 - RNA, 22 nt, Homo sapiens
uccauggccaccccgugccacc

SEQ ID NO: 733095 - RNA, 20 nt, Homo sapiens
uccaugggaugguuagugug

SEQ ID NO: 733096 - RNA, 23 nt, Homo sapiens
uccaugguggaaguuaaagggca

SEQ ID NO: 733097 - RNA, 23 nt, Homo sapiens
uccauguaggaaaguaaaaugga

SEQ ID NO: 733098 - RNA, 14 nt, Homo sapiens
uccauguuucucac

SEQ ID NO: 733099 - RNA, 20 nt, Homo sapiens
uccauguuugauguaucuga

SEQ ID NO: 733100 - RNA, 18 nt, Homo sapiens
uccauuaccuccauccau

SEQ ID NO: 733101 - RNA, 13 nt, Homo sapiens
uccauuagucaau

SEQ ID NO: 733102 - RNA, 19 nt, Homo sapiens
uccauucagaaagcauuua

SEQ ID NO: 733103 - RNA, 16 nt, Homo sapiens
uccauucagaugaaua

SEQ ID NO: 733104 - RNA, 16 nt, Homo sapiens
uccauucauccuucca

SEQ ID NO: 733105 - RNA, 13 nt, Homo sapiens
uccauucucugag

SEQ ID NO: 733106 - RNA, 15 nt, Homo sapiens
uccauucucugaguc

SEQ ID NO: 733107 - RNA, 19 nt, Homo sapiens
uccauucuguagacuuuug

SEQ ID NO: 733108 - RNA, 16 nt, Homo sapiens
uccauugucugagucu

SEQ ID NO: 733109 - RNA, 19 nt, Homo sapiens
uccauuucccacaucuuuc

SEQ ID NO: 733110 - RNA, 13 nt, Homo sapiens
uccauuuuacaca

SEQ ID NO: 733111 - RNA, 17 nt, Homo sapiens
ucccaaacagcugccuc

SEQ ID NO: 733112 - RNA, 15 nt, Homo sapiens
ucccaaacuacagaa

SEQ ID NO: 733113 - RNA, 15 nt, Homo sapiens
ucccaaagcaucccu

SEQ ID NO: 733114 - RNA, 15 nt, Homo sapiens
ucccaaagugcuagu

SEQ ID NO: 733115 - RNA, 19 nt, Homo sapiens
ucccaaagugcugagauua

SEQ ID NO: 733116 - RNA, 16 nt, Homo sapiens
ucccaacaacaugaaa

SEQ ID NO: 733117 - RNA, 22 nt, Homo sapiens
ucccaacccauucacuacaggu

SEQ ID NO: 733118 - RNA, 15 nt, Homo sapiens
ucccaagaaauggaa

SEQ ID NO: 733119 - RNA, 14 nt, Homo sapiens
ucccaagaaugcaa

SEQ ID NO: 733120 - RNA, 15 nt, Homo sapiens
ucccaagaguauccu

SEQ ID NO: 733121 - RNA, 20 nt, Homo sapiens
ucccaaguagcugggauuac

SEQ ID NO: 733122 - RNA, 21 nt, Homo sapiens
ucccaaucaaagaauuacagu

SEQ ID NO: 733123 - RNA, 16 nt, Homo sapiens
ucccacagugcuggga

SEQ ID NO: 733124 - RNA, 20 nt, Homo sapiens
ucccacaugaggccaucuca

SEQ ID NO: 733125 - RNA, 16 nt, Homo sapiens
ucccacccacagccau

SEQ ID NO: 733126 - RNA, 16 nt, Homo sapiens
ucccacccacauguga

SEQ ID NO: 733127 - RNA, 17 nt, Homo sapiens
ucccaccccacuccagc

SEQ ID NO: 733128 - RNA, 23 nt, Homo sapiens
ucccacccccacccccagcucaa

SEQ ID NO: 733129 - RNA, 17 nt, Homo sapiens
ucccacccccaucucuc

SEQ ID NO: 733130 - RNA, 18 nt, Homo sapiens
ucccacccccaucucucc

SEQ ID NO: 733131 - RNA, 16 nt, Homo sapiens
ucccaccuacugcacu

SEQ ID NO: 733132 - RNA, 22 nt, Homo sapiens
ucccacguacuuauaaagaagg

SEQ ID NO: 733133 - RNA, 22 nt, Homo sapiens
ucccacucccuuuccaaccuca

SEQ ID NO: 733134 - RNA, 16 nt, Homo sapiens
ucccacuccugcugca

SEQ ID NO: 733135 - RNA, 15 nt, Homo sapiens
ucccacucuuugaau

SEQ ID NO: 733136 - RNA, 17 nt, Homo sapiens
ucccacugacuguaugg

SEQ ID NO: 733137 - RNA, 16 nt, Homo sapiens
ucccacugagucacau

SEQ ID NO: 733138 - RNA, 18 nt, Homo sapiens
ucccacuguuuaaggagu

SEQ ID NO: 733139 - RNA, 13 nt, Homo sapiens
ucccacuuggcau

SEQ ID NO: 733140 - RNA, 13 nt, Homo sapiens
ucccagacacugg

SEQ ID NO: 733141 - RNA, 19 nt, Homo sapiens
ucccagacaguggauauga

SEQ ID NO: 733142 - RNA, 23 nt, Homo sapiens
ucccagacggucaggaaaacugu

SEQ ID NO: 733143 - RNA, 21 nt, Homo sapiens
ucccagaggagccaccaguuc

SEQ ID NO: 733144 - RNA, 11 nt, Homo sapiens
ucccagcauug

SEQ ID NO: 733145 - RNA, 15 nt, Homo sapiens
ucccagcuacuagag

SEQ ID NO: 733146 - RNA, 17 nt, Homo sapiens
ucccagcuacucaggag

SEQ ID NO: 733147 - RNA, 15 nt, Homo sapiens
ucccagcuacuuggg

SEQ ID NO: 733148 - RNA, 16 nt, Homo sapiens
ucccagcuauugggaa

SEQ ID NO: 733149 - RNA, 20 nt, Homo sapiens
ucccagcugcagaugccaca

SEQ ID NO: 733150 - RNA, 20 nt, Homo sapiens
ucccaggacacgacuuguaa

SEQ ID NO: 733151 - RNA, 16 nt, Homo sapiens
ucccaggaggugcaga

SEQ ID NO: 733152 - RNA, 19 nt, Homo sapiens
ucccaggcccgagauguga

SEQ ID NO: 733153 - RNA, 18 nt, Homo sapiens
ucccaggcuggauacuaa

SEQ ID NO: 733154 - RNA, 20 nt, Homo sapiens
ucccaggggagccagcugcu

SEQ ID NO: 733155 - RNA, 18 nt, Homo sapiens
ucccaggggcagccacac

SEQ ID NO: 733156 - RNA, 12 nt, Homo sapiens
ucccagucccau

SEQ ID NO: 733157 - RNA, 16 nt, Homo sapiens
ucccagucugugaagu

SEQ ID NO: 733158 - RNA, 18 nt, Homo sapiens
ucccaguguggcugaggc

SEQ ID NO: 733159 - RNA, 16 nt, Homo sapiens
ucccauagccaggaaa

SEQ ID NO: 733160 - RNA, 17 nt, Homo sapiens
ucccaugaacacacugu

SEQ ID NO: 733161 - RNA, 15 nt, Homo sapiens
ucccauggaaccacu

SEQ ID NO: 733162 - RNA, 16 nt, Homo sapiens
ucccauggguuaagag

SEQ ID NO: 733163 - RNA, 12 nt, Homo sapiens
ucccauguauuu

SEQ ID NO: 733164 - RNA, 13 nt, Homo sapiens
ucccauugccaug

SEQ ID NO: 733165 - RNA, 20 nt, Homo sapiens
ucccauuuccugagaccaca

SEQ ID NO: 733166 - RNA, 18 nt, Homo sapiens
uccccaaagccacuggaa

SEQ ID NO: 733167 - RNA, 15 nt, Homo sapiens
uccccaacaauguga

SEQ ID NO: 733168 - RNA, 18 nt, Homo sapiens
uccccaacaccccacuga

SEQ ID NO: 733169 - RNA, 15 nt, Homo sapiens
uccccaacaugcacu

SEQ ID NO: 733170 - RNA, 17 nt, Homo sapiens
uccccaagaagaugaaa

SEQ ID NO: 733171 - RNA, 15 nt, Homo sapiens
uccccaagggcccug

SEQ ID NO: 733172 - RNA, 17 nt, Homo sapiens
uccccaauaauugcaga

SEQ ID NO: 733173 - RNA, 23 nt, Homo sapiens
uccccaauaucuugcuugaacuu

SEQ ID NO: 733174 - RNA, 15 nt, Homo sapiens
uccccacaccucccu

SEQ ID NO: 733175 - RNA, 18 nt, Homo sapiens
uccccacagaacugcuua

SEQ ID NO: 733176 - RNA, 15 nt, Homo sapiens
uccccaccuacccag

SEQ ID NO: 733177 - RNA, 20 nt, Homo sapiens
uccccacuucucucucccca

SEQ ID NO: 733178 - RNA, 14 nt, Homo sapiens
uccccagagcugug

SEQ ID NO: 733179 - RNA, 16 nt, Homo sapiens
uccccagcccagagac

SEQ ID NO: 733180 - RNA, 21 nt, Homo sapiens
uccccagcccagagacauacu

SEQ ID NO: 733181 - RNA, 13 nt, Homo sapiens
uccccagccucuu

SEQ ID NO: 733182 - RNA, 23 nt, Homo sapiens
uccccaggucucuccacugcucu

SEQ ID NO: 733183 - RNA, 13 nt, Homo sapiens
uccccagucccag

SEQ ID NO: 733184 - RNA, 16 nt, Homo sapiens
uccccagucccagaca

SEQ ID NO: 733185 - RNA, 17 nt, Homo sapiens
uccccagucccagacaa

SEQ ID NO: 733186 - RNA, 22 nt, Homo sapiens
uccccauauccaaguaccaaug

SEQ ID NO: 733187 - RNA, 20 nt, Homo sapiens
uccccauucacagagccuuu

SEQ ID NO: 733188 - RNA, 17 nt, Homo sapiens
ucccccaaaaugcauuu

SEQ ID NO: 733189 - RNA, 17 nt, Homo sapiens
ucccccagccucaaguc

SEQ ID NO: 733190 - RNA, 19 nt, Homo sapiens
uccccccgagucuccggga

SEQ ID NO: 733191 - RNA, 17 nt, Homo sapiens
ucccccgacacugcugc

SEQ ID NO: 733192 - RNA, 19 nt, Homo sapiens
ucccccgcaaagacaucaa

SEQ ID NO: 733193 - RNA, 14 nt, Homo sapiens
ucccccucuuucac

SEQ ID NO: 733194 - RNA, 15 nt, Homo sapiens
ucccccugcaacuuc

SEQ ID NO: 733195 - RNA, 18 nt, Homo sapiens
uccccgaugcugaccuca

SEQ ID NO: 733196 - RNA, 23 nt, Homo sapiens
uccccgauugaaagaaccagaga

SEQ ID NO: 733197 - RNA, 22 nt, Homo sapiens
uccccgggucucucacuguugc

SEQ ID NO: 733198 - RNA, 13 nt, Homo sapiens
uccccgugccaaa

SEQ ID NO: 733199 - RNA, 15 nt, Homo sapiens
uccccucaaggacaa

SEQ ID NO: 733200 - RNA, 16 nt, Homo sapiens
uccccuccaaccuggg

SEQ ID NO: 733201 - RNA, 15 nt, Homo sapiens
uccccuccucacagu

SEQ ID NO: 733202 - RNA, 16 nt, Homo sapiens
uccccuccucagugac

SEQ ID NO: 733203 - RNA, 17 nt, Homo sapiens
uccccuccuuggcuuua

SEQ ID NO: 733204 - RNA, 21 nt, Homo sapiens
uccccugaaaaacugaucaaa

SEQ ID NO: 733205 - RNA, 22 nt, Homo sapiens
uccccuguucaaagaugcauuu

SEQ ID NO: 733206 - RNA, 16 nt, Homo sapiens
uccccuucaguaccac

SEQ ID NO: 733207 - RNA, 22 nt, Homo sapiens
uccccuugcccagggcucagcc

SEQ ID NO: 733208 - RNA, 22 nt, Homo sapiens
uccccuuggcccaucugugcag

SEQ ID NO: 733209 - RNA, 21 nt, Homo sapiens
uccccuuucuuugcaacuucc

SEQ ID NO: 733210 - RNA, 14 nt, Homo sapiens
ucccgaauccacag

SEQ ID NO: 733211 - RNA, 23 nt, Homo sapiens
ucccgaaugaagcguugccauug

SEQ ID NO: 733212 - RNA, 18 nt, Homo sapiens
ucccgaguaacugagauu

SEQ ID NO: 733213 - RNA, 22 nt, Homo sapiens
ucccggcuccccucccagggga

SEQ ID NO: 733214 - RNA, 17 nt, Homo sapiens
ucccggguucaugccau

SEQ ID NO: 733215 - RNA, 15 nt, Homo sapiens
ucccgucccauaucc

SEQ ID NO: 733216 - RNA, 18 nt, Homo sapiens
ucccuaaauauacaucug

SEQ ID NO: 733217 - RNA, 18 nt, Homo sapiens
ucccuaacuguucccuua

SEQ ID NO: 733218 - RNA, 14 nt, Homo sapiens
ucccuaaugcucac

SEQ ID NO: 733219 - RNA, 20 nt, Homo sapiens
ucccuacauggaguauaugu

SEQ ID NO: 733220 - RNA, 20 nt, Homo sapiens
ucccuacccuaaccaaguuc

SEQ ID NO: 733221 - RNA, 16 nt, Homo sapiens
ucccuaggaaacucac

SEQ ID NO: 733222 - RNA, 23 nt, Homo sapiens
ucccucaagccagacucugccaa

SEQ ID NO: 733223 - RNA, 21 nt, Homo sapiens
ucccucacugaaaccaggugg

SEQ ID NO: 733224 - RNA, 17 nt, Homo sapiens
ucccucagagacaccaa

SEQ ID NO: 733225 - RNA, 17 nt, Homo sapiens
ucccucagcucucuggg

SEQ ID NO: 733226 - RNA, 11 nt, Homo sapiens
ucccucaguga

SEQ ID NO: 733227 - RNA, 19 nt, Homo sapiens
ucccuccaucccagacauu

SEQ ID NO: 733228 - RNA, 17 nt, Homo sapiens
ucccucccugugccaga

SEQ ID NO: 733229 - RNA, 14 nt, Homo sapiens
ucccucgcuguaug

SEQ ID NO: 733230 - RNA, 19 nt, Homo sapiens
ucccucgucuucagcugca

SEQ ID NO: 733231 - RNA, 15 nt, Homo sapiens
ucccucuaaguggaa

SEQ ID NO: 733232 - RNA, 14 nt, Homo sapiens
ucccucuaaugaga

SEQ ID NO: 733233 - RNA, 23 nt, Homo sapiens
ucccucucagaggccugcugcca

SEQ ID NO: 733234 - RNA, 18 nt, Homo sapiens
ucccucugccuucaggcu

SEQ ID NO: 733235 - RNA, 18 nt, Homo sapiens
ucccugaagagaagggca

SEQ ID NO: 733236 - RNA, 20 nt, Homo sapiens
ucccugaagagaagggcagg

SEQ ID NO: 733237 - RNA, 12 nt, Homo sapiens
ucccugacagca

SEQ ID NO: 733238 - RNA, 16 nt, Homo sapiens
ucccugacuguaaaug

SEQ ID NO: 733239 - RNA, 17 nt, Homo sapiens
ucccugaggcaggugag

SEQ ID NO: 733240 - RNA, 13 nt, Homo sapiens
ucccugaucccau

SEQ ID NO: 733241 - RNA, 15 nt, Homo sapiens
ucccugcacagugac

SEQ ID NO: 733242 - RNA, 17 nt, Homo sapiens
ucccugcacagugacuu

SEQ ID NO: 733243 - RNA, 23 nt, Homo sapiens
ucccugcagaggaaagacaggac

SEQ ID NO: 733244 - RNA, 16 nt, Homo sapiens
ucccugcagaugccac

SEQ ID NO: 733245 - RNA, 15 nt, Homo sapiens
ucccugccccuuaac

SEQ ID NO: 733246 - RNA, 24 nt, Homo sapiens
ucccugccucucaucaacugaaug

SEQ ID NO: 733247 - RNA, 18 nt, Homo sapiens
ucccugccuucacugugc

SEQ ID NO: 733248 - RNA, 19 nt, Homo sapiens
ucccugcgccugugaugcu

SEQ ID NO: 733249 - RNA, 13 nt, Homo sapiens
ucccugcucuaac

SEQ ID NO: 733250 - RNA, 19 nt, Homo sapiens
ucccugcuuaaauuucucc

SEQ ID NO: 733251 - RNA, 15 nt, Homo sapiens
ucccugcuuugcauc

SEQ ID NO: 733252 - RNA, 18 nt, Homo sapiens
ucccuggaaaccuuccac

SEQ ID NO: 733253 - RNA, 16 nt, Homo sapiens
ucccuggcuacuuccc

SEQ ID NO: 733254 - RNA, 20 nt, Homo sapiens
ucccugggaagccugugcca

SEQ ID NO: 733255 - RNA, 13 nt, Homo sapiens
ucccugggcauug

SEQ ID NO: 733256 - RNA, 14 nt, Homo sapiens
ucccugggccucag

SEQ ID NO: 733257 - RNA, 19 nt, Homo sapiens
ucccugggggaagcccugg

SEQ ID NO: 733258 - RNA, 20 nt, Homo sapiens
ucccugggguuuacugaggu

SEQ ID NO: 733259 - RNA, 20 nt, Homo sapiens
ucccuggugccucugugcac

SEQ ID NO: 733260 - RNA, 23 nt, Homo sapiens
ucccuggugccucugugcacagu

SEQ ID NO: 733261 - RNA, 16 nt, Homo sapiens
ucccuguccuagucuu

SEQ ID NO: 733262 - RNA, 20 nt, Homo sapiens
ucccugugcugauccugcug

SEQ ID NO: 733263 - RNA, 21 nt, Homo sapiens
ucccugugcugauccugcuga

SEQ ID NO: 733264 - RNA, 18 nt, Homo sapiens
ucccuguguugucucuag

SEQ ID NO: 733265 - RNA, 14 nt, Homo sapiens
ucccuguugcugaa

SEQ ID NO: 733266 - RNA, 19 nt, Homo sapiens
ucccuguuuuaguuucuga

SEQ ID NO: 733267 - RNA, 20 nt, Homo sapiens
ucccuuagccccgaguuuaa

SEQ ID NO: 733268 - RNA, 18 nt, Homo sapiens
ucccuuccucuuccugcc

SEQ ID NO: 733269 - RNA, 19 nt, Homo sapiens
ucccuuccugggucuacca

SEQ ID NO: 733270 - RNA, 18 nt, Homo sapiens
ucccuucuggacacugag

SEQ ID NO: 733271 - RNA, 18 nt, Homo sapiens
uccaacacaagacuggca

SEQ ID NO: 733272 - RNA, 19 nt, Homo sapiens
uccaacagcucaagucuuc

SEQ ID NO: 733273 - RNA, 17 nt, Homo sapiens
uccaacauuaaaagcca

SEQ ID NO: 733274 - RNA, 20 nt, Homo sapiens
uccaacauuucucacugaaa

SEQ ID NO: 733275 - RNA, 21 nt, Homo sapiens
uccaaccaggaguaccuggac

SEQ ID NO: 733276 - RNA, 19 nt, Homo sapiens
uccaaccaggcuccuguga

SEQ ID NO: 733277 - RNA, 19 nt, Homo sapiens
uccaacccauuagccauuu

SEQ ID NO: 733278 - RNA, 16 nt, Homo sapiens
uccaaccucacuuccc

SEQ ID NO: 733279 - RNA, 22 nt, Homo sapiens
uccaaccuuuggaagucaugag

SEQ ID NO: 733280 - RNA, 17 nt, Homo sapiens
uccaacgccccuguggc

SEQ ID NO: 733281 - RNA, 23 nt, Homo sapiens
uccaacguggcccagagaagcca

SEQ ID NO: 733282 - RNA, 15 nt, Homo sapiens
uccaacuccaggaua

SEQ ID NO: 733283 - RNA, 19 nt, Homo sapiens
uccaacuuuaucauggaau

SEQ ID NO: 733284 - RNA, 15 nt, Homo sapiens
uccaacuuucacagu

SEQ ID NO: 733285 - RNA, 20 nt, Homo sapiens
uccaagacucuagaguccaa

SEQ ID NO: 733286 - RNA, 19 nt, Homo sapiens
uccaagauuuaaaugccau

SEQ ID NO: 733287 - RNA, 14 nt, Homo sapiens
uccaagcauuucau

SEQ ID NO: 733288 - RNA, 23 nt, Homo sapiens
uccaagccugaccacgcuuucua

SEQ ID NO: 733289 - RNA, 15 nt, Homo sapiens
uccaaguauuuugcc

SEQ ID NO: 733290 - RNA, 15 nt, Homo sapiens
uccaaucaugaaaag

SEQ ID NO: 733291 - RNA, 15 nt, Homo sapiens
uccaauguagcucag

SEQ ID NO: 733292 - RNA, 16 nt, Homo sapiens
uccaaugucaauguga

SEQ ID NO: 733293 - RNA, 13 nt, Homo sapiens
uccaaugugacua

SEQ ID NO: 733294 - RNA, 18 nt, Homo sapiens
uccaauuucacgcuuuua

SEQ ID NO: 733295 - RNA, 19 nt, Homo sapiens
uccaauuugacaaaaccca

SEQ ID NO: 733296 - RNA, 21 nt, Homo sapiens
uccacaaaauuagaaaggaca

SEQ ID NO: 733297 - RNA, 20 nt, Homo sapiens
uccacaaacagaucaggaag

SEQ ID NO: 733298 - RNA, 20 nt, Homo sapiens
uccacaacuugagaagacau

SEQ ID NO: 733299 - RNA, 18 nt, Homo sapiens
uccacaauucaaaagcac

SEQ ID NO: 733300 - RNA, 14 nt, Homo sapiens
uccacacaucuccc

SEQ ID NO: 733301 - RNA, 22 nt, Homo sapiens
uccacacccacuuuguccauuu

SEQ ID NO: 733302 - RNA, 17 nt, Homo sapiens
uccacacccucacugcu

SEQ ID NO: 733303 - RNA, 18 nt, Homo sapiens
uccacagaaauacaugaa

SEQ ID NO: 733304 - RNA, 22 nt, Homo sapiens
uccacagccgccugaaagccac

SEQ ID NO: 733305 - RNA, 22 nt, Homo sapiens
uccacaggaacaacagcaucuu

SEQ ID NO: 733306 - RNA, 22 nt, Homo sapiens
uccacauccuuucuaaacaaga

SEQ ID NO: 733307 - RNA, 12 nt, Homo sapiens
uccaccaagaaa

SEQ ID NO: 733308 - RNA, 19 nt, Homo sapiens
uccaccauucacauuugau

SEQ ID NO: 733309 - RNA, 20 nt, Homo sapiens
uccacccaggcugcacugca

SEQ ID NO: 733310 - RNA, 15 nt, Homo sapiens
uccaccucagugcac

SEQ ID NO: 733311 - RNA, 21 nt, Homo sapiens
uccaccucccauuacuuugau

SEQ ID NO: 733312 - RNA, 19 nt, Homo sapiens
uccaccucgggcacauuuu

SEQ ID NO: 733313 - RNA, 16 nt, Homo sapiens
uccaccuuaguacuuu

SEQ ID NO: 733314 - RNA, 15 nt, Homo sapiens
uccacucacuccagc

SEQ ID NO: 733315 - RNA, 13 nt, Homo sapiens
uccacucaguugc

SEQ ID NO: 733316 - RNA, 16 nt, Homo sapiens
uccacucccuuugcca

SEQ ID NO: 733317 - RNA, 17 nt, Homo sapiens
uccacucuacccuccca

SEQ ID NO: 733318 - RNA, 15 nt, Homo sapiens
uccacugcucucagc

SEQ ID NO: 733319 - RNA, 18 nt, Homo sapiens
uccacuguggcaaaugga

SEQ ID NO: 733320 - RNA, 12 nt, Homo sapiens
uccacuuaccug

SEQ ID NO: 733321 - RNA, 20 nt, Homo sapiens
uccacuuagaaauugcauuu

SEQ ID NO: 733322 - RNA, 19 nt, Homo sapiens
uccacuucuuguuccccac

SEQ ID NO: 733323 - RNA, 23 nt, Homo sapiens
uccacuucuuguuccccacugac

SEQ ID NO: 733324 - RNA, 15 nt, Homo sapiens
uccacuuguuugcac

SEQ ID NO: 733325 - RNA, 11 nt, Homo sapiens
uccacuuuuau

SEQ ID NO: 733326 - RNA, 21 nt, Homo sapiens
uccagaaagcuaaaauuuaau

SEQ ID NO: 733327 - RNA, 17 nt, Homo sapiens
uccagaacaauaagcag

SEQ ID NO: 733328 - RNA, 16 nt, Homo sapiens
uccagaaggcaaaaag

SEQ ID NO: 733329 - RNA, 16 nt, Homo sapiens
uccagaaucccaagac

SEQ ID NO: 733330 - RNA, 18 nt, Homo sapiens
uccagaccaaccuuccau

SEQ ID NO: 733331 - RNA, 15 nt, Homo sapiens
uccagacggugugca

SEQ ID NO: 733332 - RNA, 18 nt, Homo sapiens
uccagagacaacagguaa

SEQ ID NO: 733333 - RNA, 14 nt, Homo sapiens
uccagagaugguca

SEQ ID NO: 733334 - RNA, 16 nt, Homo sapiens
uccagaguuguucucu

SEQ ID NO: 733335 - RNA, 19 nt, Homo sapiens
uccagaucauuccucagaa

SEQ ID NO: 733336 - RNA, 12 nt, Homo sapiens
uccagauggcaa

SEQ ID NO: 733337 - RNA, 20 nt, Homo sapiens
uccagcaacugcccuuccag

SEQ ID NO: 733338 - RNA, 18 nt, Homo sapiens
uccagcacagaaggaauc

SEQ ID NO: 733339 - RNA, 19 nt, Homo sapiens
uccagcagaagacaaaaag

SEQ ID NO: 733340 - RNA, 13 nt, Homo sapiens
uccagcagcugcg

SEQ ID NO: 733341 - RNA, 22 nt, Homo sapiens
uccagcagugaaugcuagacag

SEQ ID NO: 733342 - RNA, 16 nt, Homo sapiens
uccagcaguuguucca

SEQ ID NO: 733343 - RNA, 15 nt, Homo sapiens
uccagccccaugugu

SEQ ID NO: 733344 - RNA, 15 nt, Homo sapiens
uccagccuccagggc

SEQ ID NO: 733345 - RNA, 21 nt, Homo sapiens
uccagccugaauguuauuucc

SEQ ID NO: 733346 - RNA, 19 nt, Homo sapiens
uccagccuggcuacagggc

SEQ ID NO: 733347 - RNA, 15 nt, Homo sapiens
uccagccugggcaac

SEQ ID NO: 733348 - RNA, 20 nt, Homo sapiens
uccagccugggcaacagagc

SEQ ID NO: 733349 - RNA, 16 nt, Homo sapiens
uccagccugggggaca

SEQ ID NO: 733350 - RNA, 13 nt, Homo sapiens
uccagccuucuac

SEQ ID NO: 733351 - RNA, 15 nt, Homo sapiens
uccagcgaagggaag

SEQ ID NO: 733352 - RNA, 14 nt, Homo sapiens
uccagcugcugucu

SEQ ID NO: 733353 - RNA, 20 nt, Homo sapiens
uccagcuuauagucuuccag

SEQ ID NO: 733354 - RNA, 20 nt, Homo sapiens
uccagcuugggcaacagagc

SEQ ID NO: 733355 - RNA, 15 nt, Homo sapiens
uccagcuuucugcca

SEQ ID NO: 733356 - RNA, 17 nt, Homo sapiens
uccaggaaaguggccaa

SEQ ID NO: 733357 - RNA, 18 nt, Homo sapiens
uccaggaauuuuguguga

SEQ ID NO: 733358 - RNA, 19 nt, Homo sapiens
uccaggaauuuugugugau

SEQ ID NO: 733359 - RNA, 21 nt, Homo sapiens
ucaucauuuguggcagucccu

SEQ ID NO: 733360 - RNA, 23 nt, Homo sapiens
ucauccagacucagagcucucuc

SEQ ID NO: 733361 - RNA, 14 nt, Homo sapiens
ucauccagcucacu

SEQ ID NO: 733362 - RNA, 17 nt, Homo sapiens
ucauccccucguccugu

SEQ ID NO: 733363 - RNA, 13 nt, Homo sapiens
ucaucccugauga

SEQ ID NO: 733364 - RNA, 14 nt, Homo sapiens
ucaucccugcaaaa

SEQ ID NO: 733365 - RNA, 17 nt, Homo sapiens
ucauccgcacuguaaau

SEQ ID NO: 733366 - RNA, 20 nt, Homo sapiens
ucaucuauaaagaagaacuu

SEQ ID NO: 733367 - RNA, 16 nt, Homo sapiens
ucaucuauguauucaa

SEQ ID NO: 733368 - RNA, 20 nt, Homo sapiens
ucaucuauguauucaaguaa

SEQ ID NO: 733369 - RNA, 12 nt, Homo sapiens
ucaucucagcuc

SEQ ID NO: 733370 - RNA, 15 nt, Homo sapiens
ucaucucagcucacu

SEQ ID NO: 733371 - RNA, 16 nt, Homo sapiens
ucaucucagcucacug

SEQ ID NO: 733372 - RNA, 12 nt, Homo sapiens
ucaucucagcuu

SEQ ID NO: 733373 - RNA, 13 nt, Homo sapiens
ucaucucauucca

SEQ ID NO: 733374 - RNA, 13 nt, Homo sapiens
ucaucugacucau

SEQ ID NO: 733375 - RNA, 17 nt, Homo sapiens
ucaucugcaugucuacu

SEQ ID NO: 733376 - RNA, 23 nt, Homo sapiens
ucaucugugauucccuccugcua

SEQ ID NO: 733377 - RNA, 23 nt, Homo sapiens
ucaucuuagugccugagaguauu

SEQ ID NO: 733378 - RNA, 21 nt, Homo sapiens
ucaucuucaaaacugccauua

SEQ ID NO: 733379 - RNA, 15 nt, Homo sapiens
ucaucuugcuaccag

SEQ ID NO: 733380 - RNA, 18 nt, Homo sapiens
ucaucuuggucacauaca

SEQ ID NO: 733381 - RNA, 14 nt, Homo sapiens
ucaucuuuuuccac

SEQ ID NO: 733382 - RNA, 22 nt, Homo sapiens
ucaugaaacuuguuucacugaa

SEQ ID NO: 733383 - RNA, 13 nt, Homo sapiens
ucaugaaaguggg

SEQ ID NO: 733384 - RNA, 14 nt, Homo sapiens
ucaugaaauaugca

SEQ ID NO: 733385 - RNA, 13 nt, Homo sapiens
ucaugaacuggcu

SEQ ID NO: 733386 - RNA, 17 nt, Homo sapiens
ucaugaagcccaaguga

SEQ ID NO: 733387 - RNA, 12 nt, Homo sapiens
ucaugacacugu

SEQ ID NO: 733388 - RNA, 14 nt, Homo sapiens
ucaugacagccaga

SEQ ID NO: 733389 - RNA, 15 nt, Homo sapiens
ucaugacagccagag

SEQ ID NO: 733390 - RNA, 16 nt, Homo sapiens
ucaugagccugcugga

SEQ ID NO: 733391 - RNA, 17 nt, Homo sapiens
ucaugagccugcuggaa

SEQ ID NO: 733392 - RNA, 22 nt, Homo sapiens
ucaugaugcuagccagcaaaga

SEQ ID NO: 733393 - RNA, 15 nt, Homo sapiens
ucaugcacacagaua

SEQ ID NO: 733394 - RNA, 22 nt, Homo sapiens
ucaugcagccgugaucaaggga

SEQ ID NO: 733395 - RNA, 19 nt, Homo sapiens
ucaugcauguccuguaaag

SEQ ID NO: 733396 - RNA, 22 nt, Homo sapiens
ucaugcccccuuucagaugucu

SEQ ID NO: 733397 - RNA, 19 nt, Homo sapiens
ucaugccucagccucucaa

SEQ ID NO: 733398 - RNA, 21 nt, Homo sapiens
ucaugccuucacgugucuguu

SEQ ID NO: 733399 - RNA, 16 nt, Homo sapiens
ucaugcggacccucac

SEQ ID NO: 733400 - RNA, 20 nt, Homo sapiens
ucaugcguuuuauaucuucc

SEQ ID NO: 733401 - RNA, 19 nt, Homo sapiens
ucaugcugaauacuccucc

SEQ ID NO: 733402 - RNA, 18 nt, Homo sapiens
ucaugcuuuugcuugcaa

SEQ ID NO: 733403 - RNA, 17 nt, Homo sapiens
ucauggaaacuggccag

SEQ ID NO: 733404 - RNA, 19 nt, Homo sapiens
ucauggaaguggcagugaa

SEQ ID NO: 733405 - RNA, 16 nt, Homo sapiens
ucauggacacuuugaa

SEQ ID NO: 733406 - RNA, 17 nt, Homo sapiens
ucauggaggccaagaac

SEQ ID NO: 733407 - RNA, 22 nt, Homo sapiens
ucauggcacccaggcaguccac

SEQ ID NO: 733408 - RNA, 17 nt, Homo sapiens
ucaugggaaaguauucu

SEQ ID NO: 733409 - RNA, 22 nt, Homo sapiens
ucaugggacuaaaugaacuaau

SEQ ID NO: 733410 - RNA, 19 nt, Homo sapiens
ucaugggagggggcuugaa

SEQ ID NO: 733411 - RNA, 20 nt, Homo sapiens
ucauguagaacucagcaguu

SEQ ID NO: 733412 - RNA, 22 nt, Homo sapiens
ucauguauauguguucauuaaa

SEQ ID NO: 733413 - RNA, 22 nt, Homo sapiens
ucauguaugaugagcauacaca

SEQ ID NO: 733414 - RNA, 12 nt, Homo sapiens
ucauguaugcau

SEQ ID NO: 733415 - RNA, 16 nt, Homo sapiens
ucauguaugucagaag

SEQ ID NO: 733416 - RNA, 22 nt, Homo sapiens
ucauguauuuaauaaguacaac

SEQ ID NO: 733417 - RNA, 22 nt, Homo sapiens
ucauguggcucagugccuuccu

SEQ ID NO: 733418 - RNA, 13 nt, Homo sapiens
ucaugugugcaug

SEQ ID NO: 733419 - RNA, 15 nt, Homo sapiens
ucauguucacuguga

SEQ ID NO: 733420 - RNA, 21 nt, Homo sapiens
ucauguuguugaggcugucac

SEQ ID NO: 733421 - RNA, 22 nt, Homo sapiens
ucauguuguugaggcugucaca

SEQ ID NO: 733422 - RNA, 22 nt, Homo sapiens
ucauguuugaaucuacauucac

SEQ ID NO: 733423 - RNA, 19 nt, Homo sapiens
ucauuaagguuaugcacug

SEQ ID NO: 733424 - RNA, 14 nt, Homo sapiens
ucauuacaguucuu

SEQ ID NO: 733425 - RNA, 11 nt, Homo sapiens
ucauuaccuca

SEQ ID NO: 733426 - RNA, 13 nt, Homo sapiens
ucauuagcaguug

SEQ ID NO: 733427 - RNA, 22 nt, Homo sapiens
ucauuaguaaaaaugacuucac

SEQ ID NO: 733428 - RNA, 16 nt, Homo sapiens
ucauuaguauuucaca

SEQ ID NO: 733429 - RNA, 14 nt, Homo sapiens
ucauuagugagcca

SEQ ID NO: 733430 - RNA, 14 nt, Homo sapiens
ucauuauaaaaugg

SEQ ID NO: 733431 - RNA, 20 nt, Homo sapiens
ucauuauaaacgugaugauc

SEQ ID NO: 733432 - RNA, 20 nt, Homo sapiens
ucauuaucucaaaacugcac

SEQ ID NO: 733433 - RNA, 14 nt, Homo sapiens
ucauuaugccacuu

SEQ ID NO: 733434 - RNA, 22 nt, Homo sapiens
ucauuauucuuuuucaguuuua

SEQ ID NO: 733435 - RNA, 18 nt, Homo sapiens
ucauucaacucuccaaug

SEQ ID NO: 733436 - RNA, 16 nt, Homo sapiens
ucauucaauauugaca

SEQ ID NO: 733437 - RNA, 23 nt, Homo sapiens
ucauucacucgggugcguguguu

SEQ ID NO: 733438 - RNA, 18 nt, Homo sapiens
ucauucauucaaguaaua

SEQ ID NO: 733439 - RNA, 22 nt, Homo sapiens
ucauuccaaucuauugcuucac

SEQ ID NO: 733440 - RNA, 22 nt, Homo sapiens
ucauucccucucaucucaggua

SEQ ID NO: 733441 - RNA, 20 nt, Homo sapiens
ucauuccuaacacagcaugu

SEQ ID NO: 733442 - RNA, 15 nt, Homo sapiens
ucauucucagaauuc

SEQ ID NO: 733443 - RNA, 14 nt, Homo sapiens
ucauucucagugag

SEQ ID NO: 733444 - RNA, 22 nt, Homo sapiens
ucauucucucucauuauugaga

SEQ ID NO: 733445 - RNA, 22 nt, Homo sapiens
ucauucugcaacccgguuuacc

SEQ ID NO: 733446 - RNA, 22 nt, Homo sapiens
ucauucuuuuauacucagcuuu

SEQ ID NO: 733447 - RNA, 19 nt, Homo sapiens
uagacugaauucagcacca

SEQ ID NO: 733448 - RNA, 12 nt, Homo sapiens
uagacugaggua

SEQ ID NO: 733449 - RNA, 17 nt, Homo sapiens
uagacuuccuguagggg

SEQ ID NO: 733450 - RNA, 21 nt, Homo sapiens
uagacuuccuguagggggcga

SEQ ID NO: 733451 - RNA, 16 nt, Homo sapiens
uagagaacucuuucau

SEQ ID NO: 733452 - RNA, 12 nt, Homo sapiens
uagagaagcaag

SEQ ID NO: 733453 - RNA, 16 nt, Homo sapiens
uagagacuucacccgg

SEQ ID NO: 733454 - RNA, 14 nt, Homo sapiens
uagagagccuuaac

SEQ ID NO: 733455 - RNA, 18 nt, Homo sapiens
uagagaggacaauacugg

SEQ ID NO: 733456 - RNA, 19 nt, Homo sapiens
uagagagggaaggucucag

SEQ ID NO: 733457 - RNA, 17 nt, Homo sapiens
uagagauaaaacagaau

SEQ ID NO: 733458 - RNA, 18 nt, Homo sapiens
uagagauagcuacagugu

SEQ ID NO: 733459 - RNA, 13 nt, Homo sapiens
uagagaucaugaa

SEQ ID NO: 733460 - RNA, 18 nt, Homo sapiens
uagagaucuauguacugu

SEQ ID NO: 733461 - RNA, 17 nt, Homo sapiens
uagagauggaguuugcu

SEQ ID NO: 733462 - RNA, 17 nt, Homo sapiens
uagagauggggguuuca

SEQ ID NO: 733463 - RNA, 21 nt, Homo sapiens
uagagcagccacaaccaaaaa

SEQ ID NO: 733464 - RNA, 16 nt, Homo sapiens
uagagcugcagggugg

SEQ ID NO: 733465 - RNA, 13 nt, Homo sapiens
uagagcugggaau

SEQ ID NO: 733466 - RNA, 14 nt, Homo sapiens
uagaggaaagggau

SEQ ID NO: 733467 - RNA, 15 nt, Homo sapiens
uagaggaauguguuc

SEQ ID NO: 733468 - RNA, 18 nt, Homo sapiens
uagagggguuggucccau

SEQ ID NO: 733469 - RNA, 13 nt, Homo sapiens
uagagguccucau

SEQ ID NO: 733470 - RNA, 13 nt, Homo sapiens
uagaggugagaaa

SEQ ID NO: 733471 - RNA, 15 nt, Homo sapiens
uagaguauaccuccu

SEQ ID NO: 733472 - RNA, 14 nt, Homo sapiens
uagagucaucucca

SEQ ID NO: 733473 - RNA, 18 nt, Homo sapiens
uagagucauguuugcacu

SEQ ID NO: 733474 - RNA, 20 nt, Homo sapiens
uagagucggccaccacagau

SEQ ID NO: 733475 - RNA, 15 nt, Homo sapiens
uagaguggaaucucu

SEQ ID NO: 733476 - RNA, 15 nt, Homo sapiens
uagaguguagcugua

SEQ ID NO: 733477 - RNA, 20 nt, Homo sapiens
uagagugugguuaugaacuu

SEQ ID NO: 733478 - RNA, 17 nt, Homo sapiens
uagaguuuccacuaucc

SEQ ID NO: 733479 - RNA, 20 nt, Homo sapiens
uagaguuuuaucaacuuugg

SEQ ID NO: 733480 - RNA, 22 nt, Homo sapiens
uagauaauaugaaaaucuccau

SEQ ID NO: 733481 - RNA, 14 nt, Homo sapiens
uagauaucaugcaa

SEQ ID NO: 733482 - RNA, 15 nt, Homo sapiens
uagauaucaugcaaa

SEQ ID NO: 733483 - RNA, 14 nt, Homo sapiens
uagauauuacugga

SEQ ID NO: 733484 - RNA, 16 nt, Homo sapiens
uagaucaucagucacc

SEQ ID NO: 733485 - RNA, 19 nt, Homo sapiens
uagaucccaugucaccuca

SEQ ID NO: 733486 - RNA, 17 nt, Homo sapiens
uagauccccccacugag

SEQ ID NO: 733487 - RNA, 12 nt, Homo sapiens
uagaugauuuca

SEQ ID NO: 733488 - RNA, 21 nt, Homo sapiens
uagaugcacuaccauugcugu

SEQ ID NO: 733489 - RNA, 15 nt, Homo sapiens
uagaugggacuacag

SEQ ID NO: 733490 - RNA, 16 nt, Homo sapiens
uagaugggacuacagg

SEQ ID NO: 733491 - RNA, 17 nt, Homo sapiens
uagaugggacuacaggc

SEQ ID NO: 733492 - RNA, 23 nt, Homo sapiens
uagaugucaagcugaaaacaaac

SEQ ID NO: 733493 - RNA, 12 nt, Homo sapiens
uagaugugauua

SEQ ID NO: 733494 - RNA, 12 nt, Homo sapiens
uagaugugcauu

SEQ ID NO: 733495 - RNA, 19 nt, Homo sapiens
uagauguguuauuacuucc

SEQ ID NO: 733496 - RNA, 21 nt, Homo sapiens
uagauguugccauguguuuua

SEQ ID NO: 733497 - RNA, 12 nt, Homo sapiens
uagauguuuaca

SEQ ID NO: 733498 - RNA, 14 nt, Homo sapiens
uagauuaaacaaac

SEQ ID NO: 733499 - RNA, 18 nt, Homo sapiens
uagauuaauggcacugau

SEQ ID NO: 733500 - RNA, 18 nt, Homo sapiens
uagauucucugugucuaa

SEQ ID NO: 733501 - RNA, 21 nt, Homo sapiens
uagauucuuaauucaugagga

SEQ ID NO: 733502 - RNA, 19 nt, Homo sapiens
uagauugggguagagggaa

SEQ ID NO: 733503 - RNA, 18 nt, Homo sapiens
uagcaaaaucaagagaug

SEQ ID NO: 733504 - RNA, 21 nt, Homo sapiens
uagcaaacuuuguaugucauu

SEQ ID NO: 733505 - RNA, 16 nt, Homo sapiens
uagcaagaacugcacg

SEQ ID NO: 733506 - RNA, 12 nt, Homo sapiens
uagcaagguguu

SEQ ID NO: 733507 - RNA, 23 nt, Homo sapiens
uagcaauuggcagcccuauuuca

SEQ ID NO: 733508 - RNA, 18 nt, Homo sapiens
uagcacaauuugcacuaa

SEQ ID NO: 733509 - RNA, 18 nt, Homo sapiens
uagcacacuuuuccacau

SEQ ID NO: 733510 - RNA, 22 nt, Homo sapiens
uagcacacuuuuccacauucca

SEQ ID NO: 733511 - RNA, 22 nt, Homo sapiens
uagcacugaggguggcacucaa

SEQ ID NO: 733512 - RNA, 19 nt, Homo sapiens
uagcagaguuaaaucucaa

SEQ ID NO: 733513 - RNA, 19 nt, Homo sapiens
uagcagggauguuccuuac

SEQ ID NO: 733514 - RNA, 15 nt, Homo sapiens
uagcagucaaaucua

SEQ ID NO: 733515 - RNA, 13 nt, Homo sapiens
uagcagucacuga

SEQ ID NO: 733516 - RNA, 13 nt, Homo sapiens
uagcauaauacag

SEQ ID NO: 733517 - RNA, 15 nt, Homo sapiens
uagcauagauuugca

SEQ ID NO: 733518 - RNA, 22 nt, Homo sapiens
uagcaucagagguuugcuuccu

SEQ ID NO: 733519 - RNA, 12 nt, Homo sapiens
uagcaucucagg

SEQ ID NO: 733520 - RNA, 19 nt, Homo sapiens
uagcaugaguuuaaaucaa

SEQ ID NO: 733521 - RNA, 13 nt, Homo sapiens
uagcauggcauau

SEQ ID NO: 733522 - RNA, 14 nt, Homo sapiens
uagcauguuccucc

SEQ ID NO: 733523 - RNA, 16 nt, Homo sapiens
uagcauugagugcuuu

SEQ ID NO: 733524 - RNA, 15 nt, Homo sapiens
uagcauuuuuauuca

SEQ ID NO: 733525 - RNA, 17 nt, Homo sapiens
uagccaacucucccaaa

SEQ ID NO: 733526 - RNA, 21 nt, Homo sapiens
uagccagauuugucuuuuugu

SEQ ID NO: 733527 - RNA, 22 nt, Homo sapiens
uagccagccccucuuccccaau

SEQ ID NO: 733528 - RNA, 19 nt, Homo sapiens
uagccaggaaguacuucca

SEQ ID NO: 733529 - RNA, 16 nt, Homo sapiens
uagccaggauccacaa

SEQ ID NO: 733530 - RNA, 16 nt, Homo sapiens
uagccaggauggucuc

SEQ ID NO: 733531 - RNA, 23 nt, Homo sapiens
uagccaggguggucuugaucucc

SEQ ID NO: 733532 - RNA, 17 nt, Homo sapiens
uagccaucaagcacuuc

SEQ ID NO: 733533 - RNA, 18 nt, Homo sapiens
uagccaucucucuacucc

SEQ ID NO: 733534 - RNA, 17 nt, Homo sapiens
uagccauuucacucuca

SEQ ID NO: 733535 - RNA, 12 nt, Homo sapiens
uagcccagcacu

SEQ ID NO: 733536 - RNA, 14 nt, Homo sapiens
uagcccagcacugu

SEQ ID NO: 733537 - RNA, 17 nt, Homo sapiens
uagccgaccucagccuu

SEQ ID NO: 733538 - RNA, 12 nt, Homo sapiens
uagccucuugug

SEQ ID NO: 733539 - RNA, 16 nt, Homo sapiens
uagccuuuuuguauaa

SEQ ID NO: 733540 - RNA, 15 nt, Homo sapiens
uagcgauccauguaa

SEQ ID NO: 733541 - RNA, 20 nt, Homo sapiens
uagcgcugccgcaccccaga

SEQ ID NO: 733542 - RNA, 14 nt, Homo sapiens
uagcggagcccagc

SEQ ID NO: 733543 - RNA, 18 nt, Homo sapiens
uagcuacuguaugcaaag

SEQ ID NO: 733544 - RNA, 22 nt, Homo sapiens
uagcuagaauauccuauacugg

SEQ ID NO: 733545 - RNA, 18 nt, Homo sapiens
uagcuaguagcaaugugc

SEQ ID NO: 733546 - RNA, 14 nt, Homo sapiens
uagcuauaacaacu

SEQ ID NO: 733547 - RNA, 23 nt, Homo sapiens
uagcuauauuuuuucuuuugaca

SEQ ID NO: 733548 - RNA, 14 nt, Homo sapiens
uagcucaccaggcc

SEQ ID NO: 733549 - RNA, 12 nt, Homo sapiens
uagcucacugaa

SEQ ID NO: 733550 - RNA, 22 nt, Homo sapiens
uagcuccauaaaguacaaauga

SEQ ID NO: 733551 - RNA, 13 nt, Homo sapiens
ucagcuucucaaa

SEQ ID NO: 733552 - RNA, 16 nt, Homo sapiens
ucagcuuucaaagcau

SEQ ID NO: 733553 - RNA, 21 nt, Homo sapiens
ucagcuuucaaagcauuuaca

SEQ ID NO: 733554 - RNA, 16 nt, Homo sapiens
ucaggaagccagguga

SEQ ID NO: 733555 - RNA, 16 nt, Homo sapiens
ucaggaauugucaaau

SEQ ID NO: 733556 - RNA, 22 nt, Homo sapiens
ucaggagaguagcaacaaaagg

SEQ ID NO: 733557 - RNA, 19 nt, Homo sapiens
ucaggaggcccugguguca

SEQ ID NO: 733558 - RNA, 13 nt, Homo sapiens
ucaggcacacagc

SEQ ID NO: 733559 - RNA, 17 nt, Homo sapiens
ucaggcacacagcuacu

SEQ ID NO: 733560 - RNA, 16 nt, Homo sapiens
ucaggcagcacaucaa

SEQ ID NO: 733561 - RNA, 13 nt, Homo sapiens
ucaggcagcucaa

SEQ ID NO: 733562 - RNA, 19 nt, Homo sapiens
ucaggcagguuugccagug

SEQ ID NO: 733563 - RNA, 18 nt, Homo sapiens
ucaggccccacuccuucc

SEQ ID NO: 733564 - RNA, 17 nt, Homo sapiens
ucaggcgauucuccugc

SEQ ID NO: 733565 - RNA, 16 nt, Homo sapiens
ucagggagaggucacc

SEQ ID NO: 733566 - RNA, 19 nt, Homo sapiens
ucagggagaggucaccagc

SEQ ID NO: 733567 - RNA, 14 nt, Homo sapiens
ucagggaguuacag

SEQ ID NO: 733568 - RNA, 15 nt, Homo sapiens
ucagggccaggugca

SEQ ID NO: 733569 - RNA, 15 nt, Homo sapiens
ucaggggugcauucu

SEQ ID NO: 733570 - RNA, 17 nt, Homo sapiens
ucaggguagcugaagga

SEQ ID NO: 733571 - RNA, 12 nt, Homo sapiens
ucagggucuaag

SEQ ID NO: 733572 - RNA, 14 nt, Homo sapiens
ucaggucaacugac

SEQ ID NO: 733573 - RNA, 13 nt, Homo sapiens
ucaggugauccac

SEQ ID NO: 733574 - RNA, 14 nt, Homo sapiens
ucagguggccagaa

SEQ ID NO: 733575 - RNA, 20 nt, Homo sapiens
ucagguggccagccuggauc

SEQ ID NO: 733576 - RNA, 17 nt, Homo sapiens
ucagguuauauccaaua

SEQ ID NO: 733577 - RNA, 19 nt, Homo sapiens
ucagguucuuucugaaauc

SEQ ID NO: 733578 - RNA, 12 nt, Homo sapiens
ucaguaacauaa

SEQ ID NO: 733579 - RNA, 14 nt, Homo sapiens
ucaguaagucucau

SEQ ID NO: 733580 - RNA, 15 nt, Homo sapiens
ucaguaagucucaua

SEQ ID NO: 733581 - RNA, 19 nt, Homo sapiens
ucaguacaugccuagaccu

SEQ ID NO: 733582 - RNA, 12 nt, Homo sapiens
ucaguaccccau

SEQ ID NO: 733583 - RNA, 23 nt, Homo sapiens
ucaguacuugugaaacacagcug

SEQ ID NO: 733584 - RNA, 23 nt, Homo sapiens
ucaguacuuguuucuaugcagau

SEQ ID NO: 733585 - RNA, 24 nt, Homo sapiens
ucaguacuuguuucuaugcagaug

SEQ ID NO: 733586 - RNA, 22 nt, Homo sapiens
ucaguaggaacuguacaugugu

SEQ ID NO: 733587 - RNA, 15 nt, Homo sapiens
ucaguaguuugcauu

SEQ ID NO: 733588 - RNA, 11 nt, Homo sapiens
ucaguaugugg

SEQ ID NO: 733589 - RNA, 15 nt, Homo sapiens
ucaguauucugacau

SEQ ID NO: 733590 - RNA, 14 nt, Homo sapiens
ucagucaacaacuu

SEQ ID NO: 733591 - RNA, 22 nt, Homo sapiens
ucaguccauugcucuugagucu

SEQ ID NO: 733592 - RNA, 14 nt, Homo sapiens
ucaguccucuuuca

SEQ ID NO: 733593 - RNA, 13 nt, Homo sapiens
ucagucucuauac

SEQ ID NO: 733594 - RNA, 20 nt, Homo sapiens
ucagucuuugcucagugucc

SEQ ID NO: 733595 - RNA, 14 nt, Homo sapiens
ucagugaaagccag

SEQ ID NO: 733596 - RNA, 15 nt, Homo sapiens
ucagugaaagccaga

SEQ ID NO: 733597 - RNA, 15 nt, Homo sapiens
ucagugaacugugag

SEQ ID NO: 733598 - RNA, 22 nt, Homo sapiens
ucagugaagaugcaaucagaca

SEQ ID NO: 733599 - RNA, 20 nt, Homo sapiens
ucagugaagaugccagugaa

SEQ ID NO: 733600 - RNA, 11 nt, Homo sapiens
ucagugacauc

SEQ ID NO: 733601 - RNA, 20 nt, Homo sapiens
ucagugcaguuucuuuucac

SEQ ID NO: 733602 - RNA, 21 nt, Homo sapiens
ucagugcuucccgagugagca

SEQ ID NO: 733603 - RNA, 14 nt, Homo sapiens
ucagugcuuugcau

SEQ ID NO: 733604 - RNA, 17 nt, Homo sapiens
ucagugguuagaagcau

SEQ ID NO: 733605 - RNA, 22 nt, Homo sapiens
ucagugucugaacaaucuccaa

SEQ ID NO: 733606 - RNA, 16 nt, Homo sapiens
ucagugugagucagaa

SEQ ID NO: 733607 - RNA, 13 nt, Homo sapiens
ucagugugucuaa

SEQ ID NO: 733608 - RNA, 18 nt, Homo sapiens
ucaguuaaaucuuugaag

SEQ ID NO: 733609 - RNA, 17 nt, Homo sapiens
ucaguuaauucuuagau

SEQ ID NO: 733610 - RNA, 22 nt, Homo sapiens
ucaguuaugauuuuuuuuucau

SEQ ID NO: 733611 - RNA, 17 nt, Homo sapiens
ucaguucaucaaaucau

SEQ ID NO: 733612 - RNA, 20 nt, Homo sapiens
ucaguucccuuggccucaga

SEQ ID NO: 733613 - RNA, 16 nt, Homo sapiens
ucaguucuacacugau

SEQ ID NO: 733614 - RNA, 15 nt, Homo sapiens
ucaguuucauuuucc

SEQ ID NO: 733615 - RNA, 17 nt, Homo sapiens
ucaguuucccuaucucg

SEQ ID NO: 733616 - RNA, 16 nt, Homo sapiens
ucaguuugacuacucu

SEQ ID NO: 733617 - RNA, 16 nt, Homo sapiens
ucaguuuuuuguuuua

SEQ ID NO: 733618 - RNA, 14 nt, Homo sapiens
ucauaaaaauaacc

SEQ ID NO: 733619 - RNA, 14 nt, Homo sapiens
ucauaaacugccaa

SEQ ID NO: 733620 - RNA, 20 nt, Homo sapiens
ucauaaaugaagcagcuuua

SEQ ID NO: 733621 - RNA, 15 nt, Homo sapiens
ucauaagacaaugga

SEQ ID NO: 733622 - RNA, 18 nt, Homo sapiens
ucauaaggauucagggaa

SEQ ID NO: 733623 - RNA, 16 nt, Homo sapiens
ucauaagggcacugag

SEQ ID NO: 733624 - RNA, 15 nt, Homo sapiens
ucauaaucacaaaua

SEQ ID NO: 733625 - RNA, 20 nt, Homo sapiens
ucauaauucagcacuuaacu

SEQ ID NO: 733626 - RNA, 15 nt, Homo sapiens
ucauaauuuugcaaa

SEQ ID NO: 733627 - RNA, 13 nt, Homo sapiens
ucauacacuuauu

SEQ ID NO: 733628 - RNA, 20 nt, Homo sapiens
ucauacagcugugaagacuu

SEQ ID NO: 733629 - RNA, 20 nt, Homo sapiens
ucauacaugcauacaaagag

SEQ ID NO: 733630 - RNA, 17 nt, Homo sapiens
ucauaccagaaagcucu

SEQ ID NO: 733631 - RNA, 16 nt, Homo sapiens
ucauacccaugcacag

SEQ ID NO: 733632 - RNA, 16 nt, Homo sapiens
ucauaccuaucaucuu

SEQ ID NO: 733633 - RNA, 14 nt, Homo sapiens
ucauaccucagugg

SEQ ID NO: 733634 - RNA, 16 nt, Homo sapiens
ucauaccucugaccaa

SEQ ID NO: 733635 - RNA, 21 nt, Homo sapiens
ucauacgucuuuauuacccaa

SEQ ID NO: 733636 - RNA, 14 nt, Homo sapiens
ucauacuagaauuc

SEQ ID NO: 733637 - RNA, 16 nt, Homo sapiens
ucauacuaguagucau

SEQ ID NO: 733638 - RNA, 14 nt, Homo sapiens
ucauagcauucacu

SEQ ID NO: 733639 - RNA, 15 nt, Homo sapiens
ucauagcugagauuc

SEQ ID NO: 733640 - RNA, 18 nt, Homo sapiens
ucauagguuacuaccuau

SEQ ID NO: 733641 - RNA, 23 nt, Homo sapiens
ucauaguuaaauguuaccucuga

SEQ ID NO: 733642 - RNA, 19 nt, Homo sapiens
gaaaauccccaacuaugca

SEQ ID NO: 733643 - RNA, 13 nt, Homo sapiens
gaaaaugcaaaag

SEQ ID NO: 733644 - RNA, 22 nt, Homo sapiens
gaaaaugccagagcuugugaac

SEQ ID NO: 733645 - RNA, 12 nt, Homo sapiens
gaaaaugccuca

SEQ ID NO: 733646 - RNA, 13 nt, Homo sapiens
gaaaaugccucaa

SEQ ID NO: 733647 - RNA, 19 nt, Homo sapiens
gaaaaugcuauccagcaga

SEQ ID NO: 733648 - RNA, 20 nt, Homo sapiens
gaaaauguaaggauucugga

SEQ ID NO: 733649 - RNA, 11 nt, Homo sapiens
gaaaaugucag

SEQ ID NO: 733650 - RNA, 17 nt, Homo sapiens
gaaaauguccaggaaag

SEQ ID NO: 733651 - RNA, 21 nt, Homo sapiens
gaaaauucuguagguucugug

SEQ ID NO: 733652 - RNA, 12 nt, Homo sapiens
gaaaauugcaau

SEQ ID NO: 733653 - RNA, 19 nt, Homo sapiens
gaaaauuggaacucuacuc

SEQ ID NO: 733654 - RNA, 20 nt, Homo sapiens
gaaaauuggaacucuacuca

SEQ ID NO: 733655 - RNA, 21 nt, Homo sapiens
gaaaauuguuuagugauauua

SEQ ID NO: 733656 - RNA, 22 nt, Homo sapiens
gaaaauuuuuaaauauucacaa

SEQ ID NO: 733657 - RNA, 14 nt, Homo sapiens
gaaacaaaaagccc

SEQ ID NO: 733658 - RNA, 19 nt, Homo sapiens
gaaacaaaauguucugcua

SEQ ID NO: 733659 - RNA, 23 nt, Homo sapiens
gaaacaaauagcuguugacguuu

SEQ ID NO: 733660 - RNA, 14 nt, Homo sapiens
gaaacaacauuuau

SEQ ID NO: 733661 - RNA, 19 nt, Homo sapiens
gaaacaagaagaguaaaca

SEQ ID NO: 733662 - RNA, 22 nt, Homo sapiens
gaaacaauggcuaagauaccaa

SEQ ID NO: 733663 - RNA, 13 nt, Homo sapiens
gaaacacugccuu

SEQ ID NO: 733664 - RNA, 22 nt, Homo sapiens
gaaacaggcgcggggucucagg

SEQ ID NO: 733665 - RNA, 16 nt, Homo sapiens
gaaacauagccucacc

SEQ ID NO: 733666 - RNA, 11 nt, Homo sapiens
gaaacauuuac

SEQ ID NO: 733667 - RNA, 18 nt, Homo sapiens
gaaaccagaaaagcaaua

SEQ ID NO: 733668 - RNA, 16 nt, Homo sapiens
gaaaccagagccuuuc

SEQ ID NO: 733669 - RNA, 15 nt, Homo sapiens
gaaaccauuuuccca

SEQ ID NO: 733670 - RNA, 19 nt, Homo sapiens
gaaaccccaucucuacuaa

SEQ ID NO: 733671 - RNA, 20 nt, Homo sapiens
gaaaccccaucucuacuaaa

SEQ ID NO: 733672 - RNA, 23 nt, Homo sapiens
gaaaccccaucucuacuaaaaau

SEQ ID NO: 733673 - RNA, 14 nt, Homo sapiens
gaaacccccagugu

SEQ ID NO: 733674 - RNA, 20 nt, Homo sapiens
gaaacccccaucucuacuaa

SEQ ID NO: 733675 - RNA, 20 nt, Homo sapiens
gaaaccccccagagcucuuu

SEQ ID NO: 733676 - RNA, 19 nt, Homo sapiens
gaaaccccgucucuacuaa

SEQ ID NO: 733677 - RNA, 17 nt, Homo sapiens
gaaacccuauuucccca

SEQ ID NO: 733678 - RNA, 17 nt, Homo sapiens
gaaacccuugcugcuuu

SEQ ID NO: 733679 - RNA, 18 nt, Homo sapiens
gaaaccgccuaguuuacu

SEQ ID NO: 733680 - RNA, 12 nt, Homo sapiens
gaaaccuuccac

SEQ ID NO: 733681 - RNA, 20 nt, Homo sapiens
gaaacggaggcagauggaga

SEQ ID NO: 733682 - RNA, 17 nt, Homo sapiens
gaaacgggcuccuuccc

SEQ ID NO: 733683 - RNA, 22 nt, Homo sapiens
gaaacuaagagacaguucucug

SEQ ID NO: 733684 - RNA, 17 nt, Homo sapiens
gaaacuagcuuuugcca

SEQ ID NO: 733685 - RNA, 23 nt, Homo sapiens
gaaacuauugugcacaagucuuu

SEQ ID NO: 733686 - RNA, 16 nt, Homo sapiens
gaaacucagugcaaaa

SEQ ID NO: 733687 - RNA, 17 nt, Homo sapiens
gaaacugaguauaauca

SEQ ID NO: 733688 - RNA, 15 nt, Homo sapiens
gaaacugaguugaau

SEQ ID NO: 733689 - RNA, 18 nt, Homo sapiens
gaaacuugugaaguggaa

SEQ ID NO: 733690 - RNA, 14 nt, Homo sapiens
gaaagaaaugccca

SEQ ID NO: 733691 - RNA, 19 nt, Homo sapiens
gaaagaaauuuggcuauaa

SEQ ID NO: 733692 - RNA, 19 nt, Homo sapiens
gaaagaacuuaagucucga

SEQ ID NO: 733693 - RNA, 12 nt, Homo sapiens
gaaagaagacau

SEQ ID NO: 733694 - RNA, 14 nt, Homo sapiens
gaaagaaguaggca

SEQ ID NO: 733695 - RNA, 20 nt, Homo sapiens
gaaagaauagaacacaguuu

SEQ ID NO: 733696 - RNA, 21 nt, Homo sapiens
gaaagacauagccaacugcug

SEQ ID NO: 733697 - RNA, 12 nt, Homo sapiens
gaaagacaucaa

SEQ ID NO: 733698 - RNA, 13 nt, Homo sapiens
gaaagacucuuaa

SEQ ID NO: 733699 - RNA, 21 nt, Homo sapiens
gaaagagagaagccagccaca

SEQ ID NO: 733700 - RNA, 15 nt, Homo sapiens
gaaagaggaagcaaa

SEQ ID NO: 733701 - RNA, 20 nt, Homo sapiens
gaaagauuugugaacuggaa

SEQ ID NO: 733702 - RNA, 22 nt, Homo sapiens
gaaagcacuauuaauacucugc

SEQ ID NO: 733703 - RNA, 18 nt, Homo sapiens
gaaagcauaaagcucaaa

SEQ ID NO: 733704 - RNA, 19 nt, Homo sapiens
gaaagcucacuguagcuuu

SEQ ID NO: 733705 - RNA, 19 nt, Homo sapiens
gaaagcugauuacugucaa

SEQ ID NO: 733706 - RNA, 17 nt, Homo sapiens
gaaagcuggacugacca

SEQ ID NO: 733707 - RNA, 18 nt, Homo sapiens
gaaagcuggacugaccaa

SEQ ID NO: 733708 - RNA, 18 nt, Homo sapiens
gaaagcuucaaacugcau

SEQ ID NO: 733709 - RNA, 20 nt, Homo sapiens
gaaagcuuuauacaguugaa

SEQ ID NO: 733710 - RNA, 13 nt, Homo sapiens
gaaaggacccugu

SEQ ID NO: 733711 - RNA, 17 nt, Homo sapiens
gaaaggaugcacaguca

SEQ ID NO: 733712 - RNA, 21 nt, Homo sapiens
aucacgccacugcacuccagc

SEQ ID NO: 733713 - RNA, 15 nt, Homo sapiens
aucacuaaugcucaa

SEQ ID NO: 733714 - RNA, 21 nt, Homo sapiens
aucacuagaagaaaagcccau

SEQ ID NO: 733715 - RNA, 22 nt, Homo sapiens
aucacucuaauuaauuguaauc

SEQ ID NO: 733716 - RNA, 23 nt, Homo sapiens
aucacucucugcuggcaggauuc

SEQ ID NO: 733717 - RNA, 14 nt, Homo sapiens
aucacugccacacu

SEQ ID NO: 733718 - RNA, 20 nt, Homo sapiens
aucacugccacacucuccau

SEQ ID NO: 733719 - RNA, 19 nt, Homo sapiens
aucacuggcuggccugagc

SEQ ID NO: 733720 - RNA, 19 nt, Homo sapiens
aucacugguauuaacuuua

SEQ ID NO: 733721 - RNA, 17 nt, Homo sapiens
aucacugguugcacuua

SEQ ID NO: 733722 - RNA, 20 nt, Homo sapiens
aucacuuaaacuugcaucac

SEQ ID NO: 733723 - RNA, 22 nt, Homo sapiens
aucacuuaaacuugcaucacuu

SEQ ID NO: 733724 - RNA, 23 nt, Homo sapiens
aucacuuaaacuugcaucacuua

SEQ ID NO: 733725 - RNA, 16 nt, Homo sapiens
aucacuuaaaugucac

SEQ ID NO: 733726 - RNA, 18 nt, Homo sapiens
aucacuucacuguucucu

SEQ ID NO: 733727 - RNA, 14 nt, Homo sapiens
aucacuugagguca

SEQ ID NO: 733728 - RNA, 23 nt, Homo sapiens
aucagaaaauaaaauauucacuc

SEQ ID NO: 733729 - RNA, 15 nt, Homo sapiens
aucagaaagcuuuau

SEQ ID NO: 733730 - RNA, 24 nt, Homo sapiens
aucagaccugucuuccaaggagac

SEQ ID NO: 733731 - RNA, 16 nt, Homo sapiens
aucagacuagugacaa

SEQ ID NO: 733732 - RNA, 13 nt, Homo sapiens
aucagagaacuuu

SEQ ID NO: 733733 - RNA, 24 nt, Homo sapiens
aucagagagcugcccuucagcgau

SEQ ID NO: 733734 - RNA, 15 nt, Homo sapiens
aucagagggugacug

SEQ ID NO: 733735 - RNA, 13 nt, Homo sapiens
aucagaucugucu

SEQ ID NO: 733736 - RNA, 18 nt, Homo sapiens
aucagcaccccaguggag

SEQ ID NO: 733737 - RNA, 12 nt, Homo sapiens
aucagcacugaa

SEQ ID NO: 733738 - RNA, 22 nt, Homo sapiens
aucagcaucacccgggaacuuu

SEQ ID NO: 733739 - RNA, 14 nt, Homo sapiens
aucagcaugaagaa

SEQ ID NO: 733740 - RNA, 17 nt, Homo sapiens
aucagcauucaaaauag

SEQ ID NO: 733741 - RNA, 15 nt, Homo sapiens
aucagccagucucag

SEQ ID NO: 733742 - RNA, 16 nt, Homo sapiens
aucagcccagugcaaa

SEQ ID NO: 733743 - RNA, 21 nt, Homo sapiens
aucagcuccagcugcucuguc

SEQ ID NO: 733744 - RNA, 18 nt, Homo sapiens
aucagcuucagaauggca

SEQ ID NO: 733745 - RNA, 19 nt, Homo sapiens
aucaggaauauuuuccaaa

SEQ ID NO: 733746 - RNA, 17 nt, Homo sapiens
aucaggaugucccugaa

SEQ ID NO: 733747 - RNA, 18 nt, Homo sapiens
aucagggucuaagcaccu

SEQ ID NO: 733748 - RNA, 21 nt, Homo sapiens
aucaggugcauagcaagugaa

SEQ ID NO: 733749 - RNA, 15 nt, Homo sapiens
aucagguuugcccac

SEQ ID NO: 733750 - RNA, 23 nt, Homo sapiens
aucagucaacaacuuacacuuau

SEQ ID NO: 733751 - RNA, 16 nt, Homo sapiens
aucagucauaacuaaa

SEQ ID NO: 733752 - RNA, 13 nt, Homo sapiens
aucagucaugugu

SEQ ID NO: 733753 - RNA, 15 nt, Homo sapiens
aucagucguuuuagu

SEQ ID NO: 733754 - RNA, 14 nt, Homo sapiens
aucagucuuuauua

SEQ ID NO: 733755 - RNA, 20 nt, Homo sapiens
aucaguguccucuugcucaa

SEQ ID NO: 733756 - RNA, 16 nt, Homo sapiens
aucaguguuguugcuc

SEQ ID NO: 733757 - RNA, 14 nt, Homo sapiens
aucaguguuuuaga

SEQ ID NO: 733758 - RNA, 20 nt, Homo sapiens
aucaguucccccaguaccuc

SEQ ID NO: 733759 - RNA, 24 nt, Homo sapiens
aucaguugcaauaauacuucucaa

SEQ ID NO: 733760 - RNA, 14 nt, Homo sapiens
aucaguuggaguuu

SEQ ID NO: 733761 - RNA, 14 nt, Homo sapiens
aucaguuguacagu

SEQ ID NO: 733762 - RNA, 19 nt, Homo sapiens
aucauaagggcacugagcc

SEQ ID NO: 733763 - RNA, 17 nt, Homo sapiens
aucauacaaacucucac

SEQ ID NO: 733764 - RNA, 12 nt, Homo sapiens
aucauaccaguu

SEQ ID NO: 733765 - RNA, 21 nt, Homo sapiens
aucauauccuaugacccagca

SEQ ID NO: 733766 - RNA, 16 nt, Homo sapiens
aucauauucauaugca

SEQ ID NO: 733767 - RNA, 13 nt, Homo sapiens
aucaucaaaaaga

SEQ ID NO: 733768 - RNA, 20 nt, Homo sapiens
aucaucaaagcucacaccaa

SEQ ID NO: 733769 - RNA, 23 nt, Homo sapiens
aucaucaaagcucacaccaaauu

SEQ ID NO: 733770 - RNA, 17 nt, Homo sapiens
aucaucacccuuucauu

SEQ ID NO: 733771 - RNA, 19 nt, Homo sapiens
aucaucauccuacaacuca

SEQ ID NO: 733772 - RNA, 17 nt, Homo sapiens
aucaucccaacagccaa

SEQ ID NO: 733773 - RNA, 13 nt, Homo sapiens
aucaucucagcuc

SEQ ID NO: 733774 - RNA, 14 nt, Homo sapiens
aucaucucagcuca

SEQ ID NO: 733775 - RNA, 17 nt, Homo sapiens
aucaucuguagauacua

SEQ ID NO: 733776 - RNA, 20 nt, Homo sapiens
aucaugaaaaugucuauuca

SEQ ID NO: 733777 - RNA, 22 nt, Homo sapiens
aucaugaagcacaucaauuaca

SEQ ID NO: 733778 - RNA, 23 nt, Homo sapiens
aucaugaauuauauaauuuucca

SEQ ID NO: 733779 - RNA, 23 nt, Homo sapiens
aucaugacccacccagugucuuu

SEQ ID NO: 733780 - RNA, 23 nt, Homo sapiens
aucaugagcaagugaacacuguu

SEQ ID NO: 733781 - RNA, 19 nt, Homo sapiens
aucaugcaaaugcuguauu

SEQ ID NO: 733782 - RNA, 14 nt, Homo sapiens
aucaugcccugccu

SEQ ID NO: 733783 - RNA, 14 nt, Homo sapiens
aucauggaaaugua

SEQ ID NO: 733784 - RNA, 17 nt, Homo sapiens
aucauggcugcuugauu

SEQ ID NO: 733785 - RNA, 20 nt, Homo sapiens
aucaugggaaaguauucucu

SEQ ID NO: 733786 - RNA, 16 nt, Homo sapiens
aucaugguacauuuau

SEQ ID NO: 733787 - RNA, 14 nt, Homo sapiens
aucaugguagucac

SEQ ID NO: 733788 - RNA, 18 nt, Homo sapiens
aucaugguagucacuaac

SEQ ID NO: 733789 - RNA, 23 nt, Homo sapiens
aucauguauggugauagguaucu

SEQ ID NO: 733790 - RNA, 14 nt, Homo sapiens
aucauuacugguaa

SEQ ID NO: 733791 - RNA, 15 nt, Homo sapiens
aucauucagcaucua

SEQ ID NO: 733792 - RNA, 15 nt, Homo sapiens
aucauucccauuuug

SEQ ID NO: 733793 - RNA, 16 nt, Homo sapiens
aucauucccucucauc

SEQ ID NO: 733794 - RNA, 14 nt, Homo sapiens
aucauuccuugaga

SEQ ID NO: 733795 - RNA, 14 nt, Homo sapiens
aucauugcauaaca

SEQ ID NO: 733796 - RNA, 19 nt, Homo sapiens
aucauuguagaaacacagu

SEQ ID NO: 733797 - RNA, 21 nt, Homo sapiens
aucauuucaaaacucauuucc

SEQ ID NO: 733798 - RNA, 18 nt, Homo sapiens
aucauuucugcaucagcu

SEQ ID NO: 733799 - RNA, 20 nt, Homo sapiens
cuugcaugcuugcauaagag

SEQ ID NO: 733800 - RNA, 19 nt, Homo sapiens
cuugcauuuauuauucuca

SEQ ID NO: 733801 - RNA, 20 nt, Homo sapiens
cuugccaagcagugcacauu

SEQ ID NO: 733802 - RNA, 21 nt, Homo sapiens
cuugccagccagaagccucug

SEQ ID NO: 733803 - RNA, 17 nt, Homo sapiens
cuugcccagacuacagg

SEQ ID NO: 733804 - RNA, 19 nt, Homo sapiens
cuugcccagacuacagggc

SEQ ID NO: 733805 - RNA, 21 nt, Homo sapiens
cuugcccagcagcucaagaag

SEQ ID NO: 733806 - RNA, 13 nt, Homo sapiens
cuugcccuuuacg

SEQ ID NO: 733807 - RNA, 19 nt, Homo sapiens
cuugccgacuggcugugag

SEQ ID NO: 733808 - RNA, 17 nt, Homo sapiens
cuugccucaccugcugu

SEQ ID NO: 733809 - RNA, 22 nt, Homo sapiens
cuugcucauccaaggauuaaau

SEQ ID NO: 733810 - RNA, 19 nt, Homo sapiens
cuugcugaauuucaggcau

SEQ ID NO: 733811 - RNA, 19 nt, Homo sapiens
cuugcuucucuagcucucu

SEQ ID NO: 733812 - RNA, 20 nt, Homo sapiens
cuugcuugacucuacuauua

SEQ ID NO: 733813 - RNA, 16 nt, Homo sapiens
cuugcuugcaauaggu

SEQ ID NO: 733814 - RNA, 16 nt, Homo sapiens
cuugcuuuccugcauc

SEQ ID NO: 733815 - RNA, 22 nt, Homo sapiens
cuuggaaagcaucaccucaggc

SEQ ID NO: 733816 - RNA, 23 nt, Homo sapiens
cuuggaaagcaucaccucaggcc

SEQ ID NO: 733817 - RNA, 16 nt, Homo sapiens
cuuggaacauuggaau

SEQ ID NO: 733818 - RNA, 15 nt, Homo sapiens
cuuggaacccggugc

SEQ ID NO: 733819 - RNA, 15 nt, Homo sapiens
cuuggaacuguccca

SEQ ID NO: 733820 - RNA, 13 nt, Homo sapiens
cuuggaagccagg

SEQ ID NO: 733821 - RNA, 19 nt, Homo sapiens
cuuggacuauuauaauuua

SEQ ID NO: 733822 - RNA, 21 nt, Homo sapiens
cuuggacuguguuuuuccucc

SEQ ID NO: 733823 - RNA, 12 nt, Homo sapiens
cuuggagcugcc

SEQ ID NO: 733824 - RNA, 13 nt, Homo sapiens
cuuggaggccacc

SEQ ID NO: 733825 - RNA, 22 nt, Homo sapiens
cuuggaggcugucuucucaggc

SEQ ID NO: 733826 - RNA, 16 nt, Homo sapiens
cuuggagugcauuuga

SEQ ID NO: 733827 - RNA, 11 nt, Homo sapiens
cuuggauccca

SEQ ID NO: 733828 - RNA, 19 nt, Homo sapiens
cuuggaucccaggggcuua

SEQ ID NO: 733829 - RNA, 14 nt, Homo sapiens
cuuggaugugguuu

SEQ ID NO: 733830 - RNA, 16 nt, Homo sapiens
cuuggcaccagacacc

SEQ ID NO: 733831 - RNA, 20 nt, Homo sapiens
cuuggcacuguuagugacag

SEQ ID NO: 733832 - RNA, 19 nt, Homo sapiens
cuuggcagcccgggucauc

SEQ ID NO: 733833 - RNA, 21 nt, Homo sapiens
cuuggcaucgaccacaccagc

SEQ ID NO: 733834 - RNA, 22 nt, Homo sapiens
cuuggcaucgaccacaccagcc

SEQ ID NO: 733835 - RNA, 21 nt, Homo sapiens
cuuggccagcguggcgcagug

SEQ ID NO: 733836 - RNA, 15 nt, Homo sapiens
cuuggcccacacuga

SEQ ID NO: 733837 - RNA, 14 nt, Homo sapiens
cuuggccucccaaa

SEQ ID NO: 733838 - RNA, 15 nt, Homo sapiens
cuuggccuugcagcu

SEQ ID NO: 733839 - RNA, 16 nt, Homo sapiens
cuuggcucgaugcugu

SEQ ID NO: 733840 - RNA, 21 nt, Homo sapiens
auauguauuacaaauggugaa

SEQ ID NO: 733841 - RNA, 21 nt, Homo sapiens
auaugugacugugacuuucaa

SEQ ID NO: 733842 - RNA, 23 nt, Homo sapiens
auauguguaugcacaguaaaaau

SEQ ID NO: 733843 - RNA, 16 nt, Homo sapiens
auauguucaacuggag

SEQ ID NO: 733844 - RNA, 15 nt, Homo sapiens
auauguucagauuau

SEQ ID NO: 733845 - RNA, 13 nt, Homo sapiens
auauguugcuaua

SEQ ID NO: 733846 - RNA, 19 nt, Homo sapiens
auauguuuauauacugggu

SEQ ID NO: 733847 - RNA, 16 nt, Homo sapiens
auauuaaaaucugaug

SEQ ID NO: 733848 - RNA, 16 nt, Homo sapiens
auauuaaauguugcuu

SEQ ID NO: 733849 - RNA, 19 nt, Homo sapiens
auauuaacaacaauaacac

SEQ ID NO: 733850 - RNA, 19 nt, Homo sapiens
auauuaacgguggugaaaa

SEQ ID NO: 733851 - RNA, 18 nt, Homo sapiens
auauuaagcaaacacuug

SEQ ID NO: 733852 - RNA, 14 nt, Homo sapiens
auauuaagcacuuu

SEQ ID NO: 733853 - RNA, 17 nt, Homo sapiens
auauuaauauauuucca

SEQ ID NO: 733854 - RNA, 13 nt, Homo sapiens
auauuaaucaaaa

SEQ ID NO: 733855 - RNA, 17 nt, Homo sapiens
auauuacugacauuucu

SEQ ID NO: 733856 - RNA, 15 nt, Homo sapiens
auauuagaucaaaua

SEQ ID NO: 733857 - RNA, 12 nt, Homo sapiens
auauuaucucau

SEQ ID NO: 733858 - RNA, 13 nt, Homo sapiens
auauuauugauuc

SEQ ID NO: 733859 - RNA, 17 nt, Homo sapiens
auauuauugauucacuu

SEQ ID NO: 733860 - RNA, 21 nt, Homo sapiens
auauucaaugaacuuccauuu

SEQ ID NO: 733861 - RNA, 23 nt, Homo sapiens
auauucacuugacuaaaaucacu

SEQ ID NO: 733862 - RNA, 20 nt, Homo sapiens
auauucagguggccagaaga

SEQ ID NO: 733863 - RNA, 13 nt, Homo sapiens
auauucauauaca

SEQ ID NO: 733864 - RNA, 18 nt, Homo sapiens
auauucaugaaaugugga

SEQ ID NO: 733865 - RNA, 22 nt, Homo sapiens
auauucauuggcagcucaaaga

SEQ ID NO: 733866 - RNA, 17 nt, Homo sapiens
auauuccaccauucaca

SEQ ID NO: 733867 - RNA, 14 nt, Homo sapiens
auauucuucuacca

SEQ ID NO: 733868 - RNA, 15 nt, Homo sapiens
auauucuucuaccac

SEQ ID NO: 733869 - RNA, 12 nt, Homo sapiens
auauucuuucaa

SEQ ID NO: 733870 - RNA, 23 nt, Homo sapiens
auauugauugggaaaacauuugc

SEQ ID NO: 733871 - RNA, 11 nt, Homo sapiens
auauugcccag

SEQ ID NO: 733872 - RNA, 15 nt, Homo sapiens
auauuguagcaguua

SEQ ID NO: 733873 - RNA, 15 nt, Homo sapiens
auauugucagucuuu

SEQ ID NO: 733874 - RNA, 21 nt, Homo sapiens
auauuguugacaacugugacu

SEQ ID NO: 733875 - RNA, 16 nt, Homo sapiens
auauuuaaaacaucau

SEQ ID NO: 733876 - RNA, 14 nt, Homo sapiens
auauuuaacaugua

SEQ ID NO: 733877 - RNA, 23 nt, Homo sapiens
auauuuaauucuaguuucucuca

SEQ ID NO: 733878 - RNA, 14 nt, Homo sapiens
auauuuacuguuag

SEQ ID NO: 733879 - RNA, 19 nt, Homo sapiens
auauuuauggggggagaac

SEQ ID NO: 733880 - RNA, 14 nt, Homo sapiens
auauuuauguagau

SEQ ID NO: 733881 - RNA, 14 nt, Homo sapiens
auauuucccauuug

SEQ ID NO: 733882 - RNA, 17 nt, Homo sapiens
auauuuccugacuugag

SEQ ID NO: 733883 - RNA, 17 nt, Homo sapiens
auauuucugauacugcu

SEQ ID NO: 733884 - RNA, 19 nt, Homo sapiens
auauuucugauacugcuga

SEQ ID NO: 733885 - RNA, 19 nt, Homo sapiens
auauuugaaauaguauaca

SEQ ID NO: 733886 - RNA, 19 nt, Homo sapiens
auauuugagagacauuugu

SEQ ID NO: 733887 - RNA, 13 nt, Homo sapiens
auauuugcuagac

SEQ ID NO: 733888 - RNA, 23 nt, Homo sapiens
auauuugcuagauuucuaaagaa

SEQ ID NO: 733889 - RNA, 18 nt, Homo sapiens
auauuugcugagugaaug

SEQ ID NO: 733890 - RNA, 22 nt, Homo sapiens
auauuuguaucacaaaucuuaa

SEQ ID NO: 733891 - RNA, 23 nt, Homo sapiens
auauuuuaagaauuucacaagcu

SEQ ID NO: 733892 - RNA, 15 nt, Homo sapiens
auauuuuacugaucu

SEQ ID NO: 733893 - RNA, 22 nt, Homo sapiens
auauuuuauaaagauacuaaac

SEQ ID NO: 733894 - RNA, 17 nt, Homo sapiens
auauuuuaugaacauug

SEQ ID NO: 733895 - RNA, 16 nt, Homo sapiens
auauuuugcauaguac

SEQ ID NO: 733896 - RNA, 17 nt, Homo sapiens
auauuuugcuaacuggu

SEQ ID NO: 733897 - RNA, 23 nt, Homo sapiens
auauuuugguucauggaccaaag

SEQ ID NO: 733898 - RNA, 15 nt, Homo sapiens
auauuuuguuuacaa

SEQ ID NO: 733899 - RNA, 16 nt, Homo sapiens
auauuuuuccacuuaa

SEQ ID NO: 733900 - RNA, 17 nt, Homo sapiens
auauuuuuccacuuaaa

SEQ ID NO: 733901 - RNA, 19 nt, Homo sapiens
auauuuuugccauaaugac

SEQ ID NO: 733902 - RNA, 19 nt, Homo sapiens
auauuuuuuaaaaaacacu

SEQ ID NO: 733903 - RNA, 18 nt, Homo sapiens
aucaaaaaaccuuuacag

SEQ ID NO: 733904 - RNA, 14 nt, Homo sapiens
aucaaaaagccuua

SEQ ID NO: 733905 - RNA, 19 nt, Homo sapiens
aucaaaacuaaccaucuga

SEQ ID NO: 733906 - RNA, 20 nt, Homo sapiens
aucaaaauaaaaagugacac

SEQ ID NO: 733907 - RNA, 21 nt, Homo sapiens
aucaaaauaaaaagugacaca

SEQ ID NO: 733908 - RNA, 15 nt, Homo sapiens
aucaaacaugcacac

SEQ ID NO: 733909 - RNA, 11 nt, Homo sapiens
aucaaacauuu

SEQ ID NO: 733910 - RNA, 17 nt, Homo sapiens
aucaaagcauaagcuca

SEQ ID NO: 733911 - RNA, 17 nt, Homo sapiens
aucaaaggagagucaca

SEQ ID NO: 733912 - RNA, 20 nt, Homo sapiens
aucaaauaugcaaagcacug

SEQ ID NO: 733913 - RNA, 22 nt, Homo sapiens
aucaaaucaucauuaaugacuu

SEQ ID NO: 733914 - RNA, 15 nt, Homo sapiens
aucaaaucucuucca

SEQ ID NO: 733915 - RNA, 22 nt, Homo sapiens
aucaaauugugcaguacuuugu

SEQ ID NO: 733916 - RNA, 21 nt, Homo sapiens
aucaaccaggaagaguucuau

SEQ ID NO: 733917 - RNA, 14 nt, Homo sapiens
aucaacucuaauag

SEQ ID NO: 733918 - RNA, 20 nt, Homo sapiens
aucaacuuguguacugauaa

SEQ ID NO: 733919 - RNA, 24 nt, Homo sapiens
aucaacuuuagcuaguaucuucaa

SEQ ID NO: 733920 - RNA, 17 nt, Homo sapiens
aucaagaaaucccugag

SEQ ID NO: 733921 - RNA, 13 nt, Homo sapiens
aucaagaagggcu

SEQ ID NO: 733922 - RNA, 22 nt, Homo sapiens
aucaagcuuuuaaaaacuagag

SEQ ID NO: 733923 - RNA, 17 nt, Homo sapiens
aucaaguccaucugaca

SEQ ID NO: 733924 - RNA, 19 nt, Homo sapiens
aucaagugacuucugccca

SEQ ID NO: 733925 - RNA, 19 nt, Homo sapiens
aucaaguuguugacuguga

SEQ ID NO: 733926 - RNA, 18 nt, Homo sapiens
aucaauaaaaauuucaaa

SEQ ID NO: 733927 - RNA, 19 nt, Homo sapiens
aucaauaaaggacaggcug

SEQ ID NO: 733928 - RNA, 18 nt, Homo sapiens
auaugaguaauacaucaa

SEQ ID NO: 733929 - RNA, 21 nt, Homo sapiens
auaugaguaauacaucaaaga

SEQ ID NO: 733930 - RNA, 21 nt, Homo sapiens
auaugaguuacugaaggugau

SEQ ID NO: 733931 - RNA, 17 nt, Homo sapiens
auaugauagaugacaaa

SEQ ID NO: 733932 - RNA, 16 nt, Homo sapiens
auaugauauguaaaca

SEQ ID NO: 733933 - RNA, 20 nt, Homo sapiens
auaugaugaucuggauccac

SEQ ID NO: 733934 - RNA, 18 nt, Homo sapiens
auaugauugcuccagagc

SEQ ID NO: 733935 - RNA, 19 nt, Homo sapiens
auaugauuuaaaacaugua

SEQ ID NO: 733936 - RNA, 13 nt, Homo sapiens
auaugauuuagca

SEQ ID NO: 733937 - RNA, 15 nt, Homo sapiens
auaugauuuagcaag

SEQ ID NO: 733938 - RNA, 15 nt, Homo sapiens
auaugcaacugcagu

SEQ ID NO: 733939 - RNA, 14 nt, Homo sapiens
auaugcagugauau

SEQ ID NO: 733940 - RNA, 17 nt, Homo sapiens
auaugccugcaaucuga

SEQ ID NO: 733941 - RNA, 19 nt, Homo sapiens
auaugcuggagauggacaa

SEQ ID NO: 733942 - RNA, 15 nt, Homo sapiens
auauggaauuuugca

SEQ ID NO: 733943 - RNA, 19 nt, Homo sapiens
auauggacacuggugccau

SEQ ID NO: 733944 - RNA, 21 nt, Homo sapiens
auauggacucugcacaugaau

SEQ ID NO: 733945 - RNA, 13 nt, Homo sapiens
auauggcugccca

SEQ ID NO: 733946 - RNA, 20 nt, Homo sapiens
auauggggaaaaaacugugc

SEQ ID NO: 733947 - RNA, 15 nt, Homo sapiens
auauggucauauaca

SEQ ID NO: 733948 - RNA, 16 nt, Homo sapiens
auauggugggcacaga

SEQ ID NO: 733949 - RNA, 18 nt, Homo sapiens
auaugguugauaguuuac

SEQ ID NO: 733950 - RNA, 14 nt, Homo sapiens
auauguaccaugua

SEQ ID NO: 733951 - RNA, 23 nt, Homo sapiens
auauguacuuguuugcuaugacu

SEQ ID NO: 733952 - RNA, 12 nt, Homo sapiens
auauguauauau

SEQ ID NO: 733953 - RNA, 23 nt, Homo sapiens
auauguaugcaccucaaggucau

SEQ ID NO: 733954 - RNA, 18 nt, Homo sapiens
aggcucucgcacaccucu

SEQ ID NO: 733955 - RNA, 21 nt, Homo sapiens
aggcucucgcacaccucugca

SEQ ID NO: 733956 - RNA, 16 nt, Homo sapiens
aggcucugaggggcac

SEQ ID NO: 733957 - RNA, 19 nt, Homo sapiens
aggcucugggcucagggcu

SEQ ID NO: 733958 - RNA, 23 nt, Homo sapiens
aggcucugugccuuggucucucc

SEQ ID NO: 733959 - RNA, 15 nt, Homo sapiens
aggcugacuuuugca

SEQ ID NO: 733960 - RNA, 17 nt, Homo sapiens
aggcugaggcaggagaa

SEQ ID NO: 733961 - RNA, 20 nt, Homo sapiens
aggcugcauugagcuaugau

SEQ ID NO: 733962 - RNA, 16 nt, Homo sapiens
aggcugccccucucac

SEQ ID NO: 733963 - RNA, 22 nt, Homo sapiens
aggcugccucagccaguggcac

SEQ ID NO: 733964 - RNA, 16 nt, Homo sapiens
aggcugcugccaucca

SEQ ID NO: 733965 - RNA, 14 nt, Homo sapiens
aggcugcugugaac

SEQ ID NO: 733966 - RNA, 16 nt, Homo sapiens
aggcuggaaugcagug

SEQ ID NO: 733967 - RNA, 15 nt, Homo sapiens
aggcuggacugcaau

SEQ ID NO: 733968 - RNA, 17 nt, Homo sapiens
aggcuggagugcagugc

SEQ ID NO: 733969 - RNA, 20 nt, Homo sapiens
aggcuggagugcaguggcgu

SEQ ID NO: 733970 - RNA, 19 nt, Homo sapiens
aggcuggauggcaccucag

SEQ ID NO: 733971 - RNA, 15 nt, Homo sapiens
aggcacugacugagc

SEQ ID NO: 733972 - RNA, 16 nt, Homo sapiens
aggcacugacugagca

SEQ ID NO: 733973 - RNA, 14 nt, Homo sapiens
aggcacugcccuuu

SEQ ID NO: 733974 - RNA, 16 nt, Homo sapiens
aggcacugguggcauc

SEQ ID NO: 733975 - RNA, 19 nt, Homo sapiens
aggcacuguaguucuaaga

SEQ ID NO: 733976 - RNA, 12 nt, Homo sapiens
aggcacugucag

SEQ ID NO: 733977 - RNA, 17 nt, Homo sapiens
aggcacuguucaucuca

SEQ ID NO: 733978 - RNA, 14 nt, Homo sapiens
aggcagagaaucau

SEQ ID NO: 733979 - RNA, 20 nt, Homo sapiens
aggcagagaaucauacuuag

SEQ ID NO: 733980 - RNA, 16 nt, Homo sapiens
aggcagauagcacugg

SEQ ID NO: 733981 - RNA, 23 nt, Homo sapiens
aggcagaucugugccccaugccu

SEQ ID NO: 733982 - RNA, 15 nt, Homo sapiens
aggcagccagggcuu

SEQ ID NO: 733983 - RNA, 13 nt, Homo sapiens
aggcagcccagcu

SEQ ID NO: 733984 - RNA, 15 nt, Homo sapiens
aggcagcgaccucaa

SEQ ID NO: 733985 - RNA, 16 nt, Homo sapiens
aggcagcuaagacaua

SEQ ID NO: 733986 - RNA, 12 nt, Homo sapiens
aggcagcucaag

SEQ ID NO: 733987 - RNA, 18 nt, Homo sapiens
agcuucuugcugaucaga

SEQ ID NO: 733988 - RNA, 12 nt, Homo sapiens
agcuucuuguuu

SEQ ID NO: 733989 - RNA, 20 nt, Homo sapiens
agcuugaagaggggguuaga

SEQ ID NO: 733990 - RNA, 17 nt, Homo sapiens
agcuugacugcuuuuaa

SEQ ID NO: 733991 - RNA, 22 nt, Homo sapiens
agcuugagcuccccuggagcca

SEQ ID NO: 733992 - RNA, 17 nt, Homo sapiens
agcuugagcugccucug

SEQ ID NO: 733993 - RNA, 21 nt, Homo sapiens
agcuugagggugacuauggag

SEQ ID NO: 733994 - RNA, 23 nt, Homo sapiens
agcuugauuaaaucaaccaccua

SEQ ID NO: 733995 - RNA, 14 nt, Homo sapiens
agcuugcaacaaaa

SEQ ID NO: 733996 - RNA, 22 nt, Homo sapiens
agcuugcacagccaacgagaca

SEQ ID NO: 733997 - RNA, 23 nt, Homo sapiens
agcuugcucuucagugggagaaa

SEQ ID NO: 733998 - RNA, 12 nt, Homo sapiens
agcuugcuugca

SEQ ID NO: 733999 - RNA, 19 nt, Homo sapiens
agcuuggaaaggaccagua

SEQ ID NO: 734000 - RNA, 19 nt, Homo sapiens
agcuuggguccaccaugca

SEQ ID NO: 734001 - RNA, 21 nt, Homo sapiens
agcuuggguccaccaugcaga

SEQ ID NO: 734002 - RNA, 14 nt, Homo sapiens
agcuugucaaagau

SEQ ID NO: 734003 - RNA, 18 nt, Homo sapiens
agcuugucaaugauuuca

SEQ ID NO: 734004 - RNA, 18 nt, Homo sapiens
agcuuuacaaauauguca

SEQ ID NO: 734005 - RNA, 13 nt, Homo sapiens
agcuuuacgcuca

SEQ ID NO: 734006 - RNA, 16 nt, Homo sapiens
agcuuuacuacugugg

SEQ ID NO: 734007 - RNA, 19 nt, Homo sapiens
agcuuucagagccagugaa

SEQ ID NO: 734008 - RNA, 16 nt, Homo sapiens
agcuuuccauguugcu

SEQ ID NO: 734009 - RNA, 19 nt, Homo sapiens
agcuuucucgcgcccuccc

SEQ ID NO: 734010 - RNA, 13 nt, Homo sapiens
agcuuucugccau

SEQ ID NO: 734011 - RNA, 15 nt, Homo sapiens
agcuuugcacuucaa

SEQ ID NO: 734012 - RNA, 13 nt, Homo sapiens
agcuuugcucagc

SEQ ID NO: 734013 - RNA, 18 nt, Homo sapiens
agcuuuuaaaaauguccu

SEQ ID NO: 734014 - RNA, 23 nt, Homo sapiens
agcuuuuauuuaacagugcaaaa

SEQ ID NO: 734015 - RNA, 20 nt, Homo sapiens
agcuuuugaggggcugacuu

SEQ ID NO: 734016 - RNA, 19 nt, Homo sapiens
agcuuuuuuuggaaguaac

SEQ ID NO: 734017 - RNA, 17 nt, Homo sapiens
aggaaaaaaaaacagcc

SEQ ID NO: 734018 - RNA, 19 nt, Homo sapiens
aggaaaaacacaagcaaaa

SEQ ID NO: 734019 - RNA, 22 nt, Homo sapiens
aggaaaaaugaggaauccaaaa

SEQ ID NO: 734020 - RNA, 15 nt, Homo sapiens
aggaaaaaugggagc

SEQ ID NO: 734021 - RNA, 14 nt, Homo sapiens
aggaaaaauugaug

SEQ ID NO: 734022 - RNA, 17 nt, Homo sapiens
aggaaaaauugaugaau

SEQ ID NO: 734023 - RNA, 22 nt, Homo sapiens
aggaaaacacuauuuccaaaag

SEQ ID NO: 734024 - RNA, 18 nt, Homo sapiens
aggaaaauuaaaccaaug

SEQ ID NO: 734025 - RNA, 21 nt, Homo sapiens
aggaaacaaaaaggaaaugag

SEQ ID NO: 734026 - RNA, 19 nt, Homo sapiens
aggaaacaagugaaagcau

SEQ ID NO: 734027 - RNA, 13 nt, Homo sapiens
aggaaacaauaua

SEQ ID NO: 734028 - RNA, 16 nt, Homo sapiens
aggaaacccccagugu

SEQ ID NO: 734029 - RNA, 18 nt, Homo sapiens
aggaaacccccaguguaa

SEQ ID NO: 734030 - RNA, 19 nt, Homo sapiens
aggaaacccccaguguaau

SEQ ID NO: 734031 - RNA, 20 nt, Homo sapiens
aggaaacccccaguguaaua

SEQ ID NO: 734032 - RNA, 16 nt, Homo sapiens
aggaaacgcuaccucu

SEQ ID NO: 734033 - RNA, 22 nt, Homo sapiens
aggaaacuaauuuccugauaca

SEQ ID NO: 734034 - RNA, 17 nt, Homo sapiens
aggaaacucacacuccc

SEQ ID NO: 734035 - RNA, 12 nt, Homo sapiens
aggaaacuugca

SEQ ID NO: 734036 - RNA, 13 nt, Homo sapiens
aggaaagaaucuc

SEQ ID NO: 734037 - RNA, 18 nt, Homo sapiens
aggaaaggggcgagcacc

SEQ ID NO: 734038 - RNA, 22 nt, Homo sapiens
aggaaagucacccaaacacuuc

SEQ ID NO: 734039 - RNA, 21 nt, Homo sapiens
aggaaagugauuuuuuuccac

SEQ ID NO: 734040 - RNA, 19 nt, Homo sapiens
aggaaaguuuacccaugaa

SEQ ID NO: 734041 - RNA, 23 nt, Homo sapiens
aggaaauccauucacaguucuuu

SEQ ID NO: 734042 - RNA, 22 nt, Homo sapiens
aggaaaugaauauucaacagcu

SEQ ID NO: 734043 - RNA, 18 nt, Homo sapiens
aggaaauguaagauuuca

SEQ ID NO: 734044 - RNA, 15 nt, Homo sapiens
aggaacaaacagggc

SEQ ID NO: 734045 - RNA, 21 nt, Homo sapiens
aggaacaacagcaucuuucac

SEQ ID NO: 734046 - RNA, 13 nt, Homo sapiens
aggaacacugaca

SEQ ID NO: 734047 - RNA, 21 nt, Homo sapiens
aggaacagcaaaugcaaaaac

SEQ ID NO: 734048 - RNA, 15 nt, Homo sapiens
aggaacagcacuggg

SEQ ID NO: 734049 - RNA, 22 nt, Homo sapiens
aggaacccugaucucucagccc

SEQ ID NO: 734050 - RNA, 16 nt, Homo sapiens
aggaaccucucgccau

SEQ ID NO: 734051 - RNA, 13 nt, Homo sapiens
aggaaccuuccuu

SEQ ID NO: 734052 - RNA, 22 nt, Homo sapiens
aggaagaacggggcucuucuca

SEQ ID NO: 734053 - RNA, 22 nt, Homo sapiens
aggaagaccaagacacagauca

SEQ ID NO: 734054 - RNA, 16 nt, Homo sapiens
aggaagagcaggacuc

SEQ ID NO: 734055 - RNA, 12 nt, Homo sapiens
aggaagccaaag

SEQ ID NO: 734056 - RNA, 18 nt, Homo sapiens
aggaagccaggugagaaa

SEQ ID NO: 734057 - RNA, 23 nt, Homo sapiens
aggaagcucagccuucuccuccc

SEQ ID NO: 734058 - RNA, 23 nt, Homo sapiens
aggaaggaagcuguugcuuucuu

SEQ ID NO: 734059 - RNA, 17 nt, Homo sapiens
aggaaggcuucuguguc

SEQ ID NO: 734060 - RNA, 21 nt, Homo sapiens
aggaaggcuucugugucaaug

SEQ ID NO: 734061 - RNA, 19 nt, Homo sapiens
aggaagggagaauugagaa

SEQ ID NO: 734062 - RNA, 20 nt, Homo sapiens
aggaagguagcccagcacug

SEQ ID NO: 734063 - RNA, 16 nt, Homo sapiens
aggaaguagaagucau

SEQ ID NO: 734064 - RNA, 17 nt, Homo sapiens
aggaaguagcugucaga

SEQ ID NO: 734065 - RNA, 17 nt, Homo sapiens
aggaaguaucagcacua

SEQ ID NO: 734066 - RNA, 23 nt, Homo sapiens
aggaagucauccugccaacugau

SEQ ID NO: 734067 - RNA, 12 nt, Homo sapiens
aggaaguucucc

SEQ ID NO: 734068 - RNA, 17 nt, Homo sapiens
aggaaucaaugacuuaa

SEQ ID NO: 734069 - RNA, 18 nt, Homo sapiens
aggaauccccaacaugca

SEQ ID NO: 734070 - RNA, 23 nt, Homo sapiens
aggaauccuggcagcccagagac

SEQ ID NO: 734071 - RNA, 15 nt, Homo sapiens
aggaauccuuacuga

SEQ ID NO: 734072 - RNA, 15 nt, Homo sapiens
aggaaucugugcaga

SEQ ID NO: 734073 - RNA, 18 nt, Homo sapiens
aggaaucugugcagauga

SEQ ID NO: 734074 - RNA, 22 nt, Homo sapiens
aggaaucuguuucucugcuguc

SEQ ID NO: 734075 - RNA, 13 nt, Homo sapiens
aggaauguagggc

SEQ ID NO: 734076 - RNA, 20 nt, Homo sapiens
aggaauuggccgcugucacu

SEQ ID NO: 734077 - RNA, 19 nt, Homo sapiens
aggaauuucuuaacuucuu

SEQ ID NO: 734078 - RNA, 15 nt, Homo sapiens
aggacaaagugccca

SEQ ID NO: 734079 - RNA, 18 nt, Homo sapiens
aggacaaccauuccagac

SEQ ID NO: 734080 - RNA, 14 nt, Homo sapiens
aggacaauuucaaa

SEQ ID NO: 734081 - RNA, 23 nt, Homo sapiens
aggacacacauagauaccuucaa

SEQ ID NO: 734082 - RNA, 20 nt, Homo sapiens
aggacacagcacaagggcac

SEQ ID NO: 734083 - RNA, 19 nt, Homo sapiens
aggacaccagccuggugcc

SEQ ID NO: 734084 - RNA, 18 nt, Homo sapiens
aggacaccuuuuaacuca

SEQ ID NO: 734085 - RNA, 23 nt, Homo sapiens
aggacacuacccugagaucugca

SEQ ID NO: 734086 - RNA, 16 nt, Homo sapiens
aggacagaaagaucuu

SEQ ID NO: 734087 - RNA, 18 nt, Homo sapiens
aggacagcuugcuucuuu

SEQ ID NO: 734088 - RNA, 17 nt, Homo sapiens
aggacaguggcagacag

SEQ ID NO: 734089 - RNA, 20 nt, Homo sapiens
aggacaugcaugacacuucc

SEQ ID NO: 734090 - RNA, 21 nt, Homo sapiens
aggaccacucccuaaguaauc

SEQ ID NO: 734091 - RNA, 13 nt, Homo sapiens
aggaccagagcua

SEQ ID NO: 734092 - RNA, 20 nt, Homo sapiens
aggaccaguucacuugcccu

SEQ ID NO: 734093 - RNA, 19 nt, Homo sapiens
aggacccaggaggugugau

SEQ ID NO: 734094 - RNA, 19 nt, Homo sapiens
aggaccuuaagacagagua

SEQ ID NO: 734095 - RNA, 22 nt, Homo sapiens
aggacgagacccccauccagcc

SEQ ID NO: 734096 - RNA, 18 nt, Homo sapiens
aggacggacucacuucuc

SEQ ID NO: 734097 - RNA, 21 nt, Homo sapiens
aggacgguuaacuuguauauu

SEQ ID NO: 734098 - RNA, 20 nt, Homo sapiens
aggacguguuacccacugcc

SEQ ID NO: 734099 - RNA, 14 nt, Homo sapiens
aggacuaaggccuc

SEQ ID NO: 734100 - RNA, 21 nt, Homo sapiens
aggacuacaaccaauuuacac

SEQ ID NO: 734101 - RNA, 15 nt, Homo sapiens
agaaauuuggcuaua

SEQ ID NO: 734102 - RNA, 20 nt, Homo sapiens
agaaauuuugccugccauuu

SEQ ID NO: 734103 - RNA, 23 nt, Homo sapiens
agaaauuuugccugccauuuuca

SEQ ID NO: 734104 - RNA, 21 nt, Homo sapiens
agaacaaaagaauaacauuuu

SEQ ID NO: 734105 - RNA, 15 nt, Homo sapiens
agaacaaagccacug

SEQ ID NO: 734106 - RNA, 14 nt, Homo sapiens
agaacaaauguguu

SEQ ID NO: 734107 - RNA, 18 nt, Homo sapiens
acuuagcgucaagacauu

SEQ ID NO: 734108 - RNA, 23 nt, Homo sapiens
acuuagcuauauucugagacuuu

SEQ ID NO: 734109 - RNA, 14 nt, Homo sapiens
acuuaguaagugcu

SEQ ID NO: 734110 - RNA, 18 nt, Homo sapiens
acuuagucuguacuucau

SEQ ID NO: 734111 - RNA, 19 nt, Homo sapiens
gaggcagagguugcaguga

SEQ ID NO: 734112 - RNA, 20 nt, Homo sapiens
gaggcagagguugcagugag

SEQ ID NO: 734113 - RNA, 17 nt, Homo sapiens
gaggcagauagcacugg

SEQ ID NO: 734114 - RNA, 16 nt, Homo sapiens
gaggcaggagaaucac

SEQ ID NO: 734115 - RNA, 20 nt, Homo sapiens
gaggcaggagaauuacuuga

SEQ ID NO: 734116 - RNA, 16 nt, Homo sapiens
gaggcaggaggaucau

SEQ ID NO: 734117 - RNA, 20 nt, Homo sapiens
gaggcaggaggaucauuuga

SEQ ID NO: 734118 - RNA, 14 nt, Homo sapiens
gaggcagggguccu

SEQ ID NO: 734119 - RNA, 12 nt, Homo sapiens
gaggcaggugag

SEQ ID NO: 734120 - RNA, 19 nt, Homo sapiens
gaggcagguggaucaccug

SEQ ID NO: 734121 - RNA, 10 nt, Homo sapiens
gaggcauuuc

SEQ ID NO: 734122 - RNA, 18 nt, Homo sapiens
gaggccaaggagggugga

SEQ ID NO: 734123 - RNA, 16 nt, Homo sapiens
gaggccaccucuccaa

SEQ ID NO: 734124 - RNA, 18 nt, Homo sapiens
gaggcccagcccucagaa

SEQ ID NO: 734125 - RNA, 19 nt, Homo sapiens
gaggcccccaguauugcag

SEQ ID NO: 734126 - RNA, 19 nt, Homo sapiens
gaggccccuggagccagau

SEQ ID NO: 734127 - RNA, 18 nt, Homo sapiens
gaggccgaggcgggugga

SEQ ID NO: 734128 - RNA, 17 nt, Homo sapiens
gaggccuggacuuuccu

SEQ ID NO: 734129 - RNA, 22 nt, Homo sapiens
gaggccuggacuuuccugcaac

SEQ ID NO: 734130 - RNA, 16 nt, Homo sapiens
gaggccuguccugacc

SEQ ID NO: 734131 - RNA, 23 nt, Homo sapiens
gaggccugugaagccaaacaaua

SEQ ID NO: 734132 - RNA, 23 nt, Homo sapiens
gaggcgacggcuuccaucugccc

SEQ ID NO: 734133 - RNA, 21 nt, Homo sapiens
gaggcgcugcugguguucuua

SEQ ID NO: 734134 - RNA, 20 nt, Homo sapiens
gaggcggagguugcaaugag

SEQ ID NO: 734135 - RNA, 19 nt, Homo sapiens
gaggcggguggaucacuug

SEQ ID NO: 734136 - RNA, 13 nt, Homo sapiens
gaggcuaccucac

SEQ ID NO: 734137 - RNA, 22 nt, Homo sapiens
gaggcuauggaggguccuccuc

SEQ ID NO: 734138 - RNA, 12 nt, Homo sapiens
gaggcuauuaaa

SEQ ID NO: 734139 - RNA, 19 nt, Homo sapiens
gaggcucacacugugcuca

SEQ ID NO: 734140 - RNA, 19 nt, Homo sapiens
gaggcugcuguggggacca

SEQ ID NO: 734141 - RNA, 23 nt, Homo sapiens
gaggcuggaggccggaaucucag

SEQ ID NO: 734142 - RNA, 12 nt, Homo sapiens
gaggcuggccaa

SEQ ID NO: 734143 - RNA, 22 nt, Homo sapiens
gaggcuucuccuucuccuuccc

SEQ ID NO: 734144 - RNA, 15 nt, Homo sapiens
gagggaaagacaaga

SEQ ID NO: 734145 - RNA, 18 nt, Homo sapiens
gagggaagaccagaauuc

SEQ ID NO: 734146 - RNA, 17 nt, Homo sapiens
gagggacuuugcugauu

SEQ ID NO: 734147 - RNA, 15 nt, Homo sapiens
gagggagaagcauga

SEQ ID NO: 734148 - RNA, 21 nt, Homo sapiens
gagggagcgacacuugaaugu

SEQ ID NO: 734149 - RNA, 21 nt, Homo sapiens
gagggaggcgcugcugguguu

SEQ ID NO: 734150 - RNA, 15 nt, Homo sapiens
gagggaggugguccu

SEQ ID NO: 734151 - RNA, 19 nt, Homo sapiens
gagggauaaaaacaauacu

SEQ ID NO: 734152 - RNA, 20 nt, Homo sapiens
gagggcaaucuuugccuuua

SEQ ID NO: 734153 - RNA, 22 nt, Homo sapiens
gagggcccuccgaccacuucca

SEQ ID NO: 734154 - RNA, 21 nt, Homo sapiens
gaggggccggcccugugugca

SEQ ID NO: 734155 - RNA, 18 nt, Homo sapiens
gaggggccugcaggugag

SEQ ID NO: 734156 - RNA, 19 nt, Homo sapiens
gaggguaaauaaaccacug

SEQ ID NO: 734157 - RNA, 17 nt, Homo sapiens
gagggucaccagguugg

SEQ ID NO: 734158 - RNA, 13 nt, Homo sapiens
gaggguccaccug

SEQ ID NO: 734159 - RNA, 15 nt, Homo sapiens
gagggucuucuuaca

SEQ ID NO: 734160 - RNA, 19 nt, Homo sapiens
gaggguggaucacaccuca

SEQ ID NO: 734161 - RNA, 18 nt, Homo sapiens
gagggugggguaaccaaa

SEQ ID NO: 734162 - RNA, 17 nt, Homo sapiens
gagguaaauaaguaaaa

SEQ ID NO: 734163 - RNA, 21 nt, Homo sapiens
gagguauggcagaggugcaag

SEQ ID NO: 734164 - RNA, 13 nt, Homo sapiens
gaggucaccagcu

SEQ ID NO: 734165 - RNA, 17 nt, Homo sapiens
gaggucaggccccacuc

SEQ ID NO: 734166 - RNA, 17 nt, Homo sapiens
gaggucaucacuuugac

SEQ ID NO: 734167 - RNA, 15 nt, Homo sapiens
gaggucccacuugca

SEQ ID NO: 734168 - RNA, 20 nt, Homo sapiens
gaggucugguccgagucuca

SEQ ID NO: 734169 - RNA, 19 nt, Homo sapiens
gaggugaauacucuugaaa

SEQ ID NO: 734170 - RNA, 15 nt, Homo sapiens
auuauaucugugaau

SEQ ID NO: 734171 - RNA, 16 nt, Homo sapiens
auuauauuagucuguu

SEQ ID NO: 734172 - RNA, 14 nt, Homo sapiens
auuauauucacaga

SEQ ID NO: 734173 - RNA, 18 nt, Homo sapiens
auuauauuuuaaauaccc

SEQ ID NO: 734174 - RNA, 23 nt, Homo sapiens
auuaucaggaaauguuuucuuaa

SEQ ID NO: 734175 - RNA, 12 nt, Homo sapiens
auuaucauccca

SEQ ID NO: 734176 - RNA, 21 nt, Homo sapiens
auuaucccuuacagacuugaa

SEQ ID NO: 734177 - RNA, 19 nt, Homo sapiens
auuaucuaaaaucugcuag

SEQ ID NO: 734178 - RNA, 15 nt, Homo sapiens
auuaucugugucaaa

SEQ ID NO: 734179 - RNA, 14 nt, Homo sapiens
auuaugacaguuau

SEQ ID NO: 734180 - RNA, 17 nt, Homo sapiens
auuaugauugcauugua

SEQ ID NO: 734181 - RNA, 11 nt, Homo sapiens
auuauggcauu

SEQ ID NO: 734182 - RNA, 13 nt, Homo sapiens
auuauggcccagg

SEQ ID NO: 734183 - RNA, 14 nt, Homo sapiens
auuaugggaucuca

SEQ ID NO: 734184 - RNA, 19 nt, Homo sapiens
auuauguaauauauuguac

SEQ ID NO: 734185 - RNA, 16 nt, Homo sapiens
auuaugugacuuaaag

SEQ ID NO: 734186 - RNA, 22 nt, Homo sapiens
auuauguuuccgaggcacuguu

SEQ ID NO: 734187 - RNA, 20 nt, Homo sapiens
auuauucaguaguggaaaug

SEQ ID NO: 734188 - RNA, 12 nt, Homo sapiens
auuauucccaug

SEQ ID NO: 734189 - RNA, 21 nt, Homo sapiens
auuauucugauuccacuuuua

SEQ ID NO: 734190 - RNA, 22 nt, Homo sapiens
auuauucuuguaguuuaccucu

SEQ ID NO: 734191 - RNA, 17 nt, Homo sapiens
auuauugugacuucacu

SEQ ID NO: 734192 - RNA, 21 nt, Homo sapiens
auuauugugacuucacuguau

SEQ ID NO: 734193 - RNA, 22 nt, Homo sapiens
auuauuguuccccuaaguggau

SEQ ID NO: 734194 - RNA, 14 nt, Homo sapiens
auuauuucuaaucc

SEQ ID NO: 734195 - RNA, 15 nt, Homo sapiens
auuauuucuucccag

SEQ ID NO: 734196 - RNA, 20 nt, Homo sapiens
auuauuugacaacaauccaa

SEQ ID NO: 734197 - RNA, 17 nt, Homo sapiens
auuauuuuaagcacuug

SEQ ID NO: 734198 - RNA, 15 nt, Homo sapiens
auuauuuuggaucua

SEQ ID NO: 734199 - RNA, 16 nt, Homo sapiens
auuauuuuugagacag

SEQ ID NO: 734200 - RNA, 20 nt, Homo sapiens
auuauuuuuguuagcaaaga

SEQ ID NO: 734201 - RNA, 19 nt, Homo sapiens
auuauuuuuuauacuguau

SEQ ID NO: 734202 - RNA, 18 nt, Homo sapiens
auuauuuuuucugugguc

SEQ ID NO: 734203 - RNA, 20 nt, Homo sapiens
auucaaaaaaaaaagcaaca

SEQ ID NO: 734204 - RNA, 14 nt, Homo sapiens
auucaaaaguauug

SEQ ID NO: 734205 - RNA, 16 nt, Homo sapiens
auucaaaauaguucua

SEQ ID NO: 734206 - RNA, 16 nt, Homo sapiens
auucaaacugcuccaa

SEQ ID NO: 734207 - RNA, 21 nt, Homo sapiens
auucaaagcauggacauuuag

SEQ ID NO: 734208 - RNA, 16 nt, Homo sapiens
auucaaauugcugcuu

SEQ ID NO: 734209 - RNA, 14 nt, Homo sapiens
auucaacaauuuca

SEQ ID NO: 734210 - RNA, 14 nt, Homo sapiens
auucaacacauugg

SEQ ID NO: 734211 - RNA, 17 nt, Homo sapiens
auucaaccaaccaagga

SEQ ID NO: 734212 - RNA, 15 nt, Homo sapiens
auucaagccugugaa

SEQ ID NO: 734213 - RNA, 21 nt, Homo sapiens
auucaaggagaauaugauaaa

SEQ ID NO: 734214 - RNA, 15 nt, Homo sapiens
auucaauaaaaaccu

SEQ ID NO: 734215 - RNA, 19 nt, Homo sapiens
augucagaguagaagauuu

SEQ ID NO: 734216 - RNA, 21 nt, Homo sapiens
augucaggcaaagugcugcug

SEQ ID NO: 734217 - RNA, 14 nt, Homo sapiens
augucaguacuauu

SEQ ID NO: 734218 - RNA, 18 nt, Homo sapiens
augucagucucucaccac

SEQ ID NO: 734219 - RNA, 16 nt, Homo sapiens
augucauagccaaagc

SEQ ID NO: 734220 - RNA, 20 nt, Homo sapiens
augucauagguaagaaacac

SEQ ID NO: 734221 - RNA, 16 nt, Homo sapiens
augucauuuccuucaa

SEQ ID NO: 734222 - RNA, 12 nt, Homo sapiens
auguccacagau

SEQ ID NO: 734223 - RNA, 16 nt, Homo sapiens
auguccaccaugaacu

SEQ ID NO: 734224 - RNA, 22 nt, Homo sapiens
auguccagaaauugugugugca

SEQ ID NO: 734225 - RNA, 17 nt, Homo sapiens
auguccagcaccuugug

SEQ ID NO: 734226 - RNA, 13 nt, Homo sapiens
auguccaggaaag

SEQ ID NO: 734227 - RNA, 22 nt, Homo sapiens
auguccaugauggaauauuccc

SEQ ID NO: 734228 - RNA, 22 nt, Homo sapiens
auguccgcccaccuagugcuuc

SEQ ID NO: 734229 - RNA, 19 nt, Homo sapiens
auguccgugagaacaucau

SEQ ID NO: 734230 - RNA, 16 nt, Homo sapiens
auguccucagcauuuc

SEQ ID NO: 734231 - RNA, 18 nt, Homo sapiens
auguccucuauaccugug

SEQ ID NO: 734232 - RNA, 18 nt, Homo sapiens
auguccugacaccugcuu

SEQ ID NO: 734233 - RNA, 17 nt, Homo sapiens
auguccuuuuaugauuu

SEQ ID NO: 734234 - RNA, 16 nt, Homo sapiens
augucgaugacuucau

SEQ ID NO: 734235 - RNA, 21 nt, Homo sapiens
augucucucagaauucuucag

SEQ ID NO: 734236 - RNA, 21 nt, Homo sapiens
augucucugugagacucgaga

SEQ ID NO: 734237 - RNA, 17 nt, Homo sapiens
augucucuuguagaaga

SEQ ID NO: 734238 - RNA, 21 nt, Homo sapiens
augucucuuuggcgaccuccu

SEQ ID NO: 734239 - RNA, 20 nt, Homo sapiens
augucugaucuaaaugugga

SEQ ID NO: 734240 - RNA, 22 nt, Homo sapiens
augucuguagcuccucaacuca

SEQ ID NO: 734241 - RNA, 15 nt, Homo sapiens
augucuguguaugua

SEQ ID NO: 734242 - RNA, 22 nt, Homo sapiens
augucuuaaaaugggaucucau

SEQ ID NO: 734243 - RNA, 20 nt, Homo sapiens
augucuucucguuaaggaga

SEQ ID NO: 734244 - RNA, 17 nt, Homo sapiens
augucuuggacacugua

SEQ ID NO: 734245 - RNA, 20 nt, Homo sapiens
augucuuggacacuguacaa

SEQ ID NO: 734246 - RNA, 17 nt, Homo sapiens
augucuuuaucaaagga

SEQ ID NO: 734247 - RNA, 16 nt, Homo sapiens
augugaaaacaucuca

SEQ ID NO: 734248 - RNA, 15 nt, Homo sapiens
augugaaacaucuuc

SEQ ID NO: 734249 - RNA, 17 nt, Homo sapiens
augugaacacaucagcu

SEQ ID NO: 734250 - RNA, 23 nt, Homo sapiens
augugaagagggagaagcaugaa

SEQ ID NO: 734251 - RNA, 20 nt, Homo sapiens
augugaagaguuucacaaau

SEQ ID NO: 734252 - RNA, 13 nt, Homo sapiens
augugaagcugaa

SEQ ID NO: 734253 - RNA, 20 nt, Homo sapiens
augugaaguguauaugauuc

SEQ ID NO: 734254 - RNA, 22 nt, Homo sapiens
augugaauaaauucuauaggaa

SEQ ID NO: 734255 - RNA, 18 nt, Homo sapiens
augugaauuauugacacu

SEQ ID NO: 734256 - RNA, 21 nt, Homo sapiens
augugaauuauugacacugaa

SEQ ID NO: 734257 - RNA, 13 nt, Homo sapiens
augugacaccuaa

SEQ ID NO: 734258 - RNA, 13 nt, Homo sapiens
augugacuacuga

SEQ ID NO: 734259 - RNA, 13 nt, Homo sapiens
augugaggauuuu

SEQ ID NO: 734260 - RNA, 16 nt, Homo sapiens
augugauuagugucuc

SEQ ID NO: 734261 - RNA, 20 nt, Homo sapiens
augugcaaagucaucaaaga

SEQ ID NO: 734262 - RNA, 14 nt, Homo sapiens
gaguguccggcuga

SEQ ID NO: 734263 - RNA, 16 nt, Homo sapiens
gaguguccucuucccu

SEQ ID NO: 734264 - RNA, 18 nt, Homo sapiens
gaguguccuggcugugaa

SEQ ID NO: 734265 - RNA, 14 nt, Homo sapiens
gagugugcucuccc

SEQ ID NO: 734266 - RNA, 22 nt, Homo sapiens
gaguuagaagggccagauuuca

SEQ ID NO: 734267 - RNA, 21 nt, Homo sapiens
gaguuaggaccaccaauggau

SEQ ID NO: 734268 - RNA, 21 nt, Homo sapiens
gaguuaguggauuacugccau

SEQ ID NO: 734269 - RNA, 17 nt, Homo sapiens
gaguuccuaacaggaug

SEQ ID NO: 734270 - RNA, 21 nt, Homo sapiens
gaguuccuuaucccucucuuc

SEQ ID NO: 734271 - RNA, 13 nt, Homo sapiens
gaguugaucugga

SEQ ID NO: 734272 - RNA, 17 nt, Homo sapiens
gaguugucaagucucug

SEQ ID NO: 734273 - RNA, 18 nt, Homo sapiens
gaguuguggaaagccucu

SEQ ID NO: 734274 - RNA, 20 nt, Homo sapiens
gaguuguuucugacccacug

SEQ ID NO: 734275 - RNA, 18 nt, Homo sapiens
gaguuucacuguacugca

SEQ ID NO: 734276 - RNA, 17 nt, Homo sapiens
gaguuuccacuauccca

SEQ ID NO: 734277 - RNA, 22 nt, Homo sapiens
gaguuucuccuuuugaccaaau

SEQ ID NO: 734278 - RNA, 23 nt, Homo sapiens
gaguuucuggcucuugaggcauu

SEQ ID NO: 734279 - RNA, 22 nt, Homo sapiens
gaguuugacuuagaauaaugaa

SEQ ID NO: 734280 - RNA, 21 nt, Homo sapiens
gaguuugagcugccuucccua

SEQ ID NO: 734281 - RNA, 22 nt, Homo sapiens
gaguuugccuguucuaugccuu

SEQ ID NO: 734282 - RNA, 22 nt, Homo sapiens
gauaaaagagaagccaaacagc

SEQ ID NO: 734283 - RNA, 13 nt, Homo sapiens
gauaaaagcaauu

SEQ ID NO: 734284 - RNA, 14 nt, Homo sapiens
gauaaaauuaauuu

SEQ ID NO: 734285 - RNA, 23 nt, Homo sapiens
gauaaaauuacaggauaucacau

SEQ ID NO: 734286 - RNA, 23 nt, Homo sapiens
gauaaaauuuaaugacaguuuuu

SEQ ID NO: 734287 - RNA, 22 nt, Homo sapiens
gauaaagaccuuccagcuccug

SEQ ID NO: 734288 - RNA, 16 nt, Homo sapiens
gauaaagaugcaagga

SEQ ID NO: 734289 - RNA, 14 nt, Homo sapiens
gauaaaugauucaa

SEQ ID NO: 734290 - RNA, 17 nt, Homo sapiens
gauaacccuuauuccau

SEQ ID NO: 734291 - RNA, 20 nt, Homo sapiens
gauaaccucggcuguuuaca

SEQ ID NO: 734292 - RNA, 18 nt, Homo sapiens
gauaaguggggacuagug

SEQ ID NO: 734293 - RNA, 12 nt, Homo sapiens
gauaaguguucu

SEQ ID NO: 734294 - RNA, 21 nt, Homo sapiens
gauaauaaugaaggcauguaa

SEQ ID NO: 734295 - RNA, 13 nt, Homo sapiens
gauaauagauucu

SEQ ID NO: 734296 - RNA, 21 nt, Homo sapiens
gauaaucucuuuaaauggcuu

SEQ ID NO: 734297 - RNA, 20 nt, Homo sapiens
gauacaaaaccuuguguaag

SEQ ID NO: 734298 - RNA, 12 nt, Homo sapiens
gauacaaacugc

SEQ ID NO: 734299 - RNA, 13 nt, Homo sapiens
gauacacuugaag

SEQ ID NO: 734300 - RNA, 18 nt, Homo sapiens
gauacacuugaaggacca

SEQ ID NO: 734301 - RNA, 14 nt, Homo sapiens
gauacagaaaugca

SEQ ID NO: 734302 - RNA, 14 nt, Homo sapiens
gauacagaucucag

SEQ ID NO: 734303 - RNA, 21 nt, Homo sapiens
gauacagauuuaagaauaccu

SEQ ID NO: 734304 - RNA, 17 nt, Homo sapiens
gauacaugagccaguga

SEQ ID NO: 734305 - RNA, 14 nt, Homo sapiens
gauaccacugcacu

SEQ ID NO: 734306 - RNA, 15 nt, Homo sapiens
gauaccacugcacug

SEQ ID NO: 734307 - RNA, 20 nt, Homo sapiens
gauacuaagcacaaagccca

SEQ ID NO: 734308 - RNA, 17 nt, Homo sapiens
gauacucucagcaccaa

SEQ ID NO: 734309 - RNA, 19 nt, Homo sapiens
gauacugaguaaauccaug

SEQ ID NO: 734310 - RNA, 11 nt, Homo sapiens
gauacuggaaa

SEQ ID NO: 734311 - RNA, 21 nt, Homo sapiens
gauacuuuuaaaguuuuguca

SEQ ID NO: 734312 - RNA, 12 nt, Homo sapiens
gauagcuuuauu

SEQ ID NO: 734313 - RNA, 16 nt, Homo sapiens
gauagggaacugggga

SEQ ID NO: 734314 - RNA, 15 nt, Homo sapiens
gauaguccaaagacu

SEQ ID NO: 734315 - RNA, 22 nt, Homo sapiens
gauagugggcaccccacugcaa

SEQ ID NO: 734316 - RNA, 11 nt, Homo sapiens
gauaguguucu

SEQ ID NO: 734317 - RNA, 22 nt, Homo sapiens
gauaguuguucuagcagugaag

SEQ ID NO: 734318 - RNA, 15 nt, Homo sapiens
gauaguuuaccugaa

SEQ ID NO: 734319 - RNA, 12 nt, Homo sapiens
cuuugccucaag

SEQ ID NO: 734320 - RNA, 16 nt, Homo sapiens
cuuugcuaugugcucc

SEQ ID NO: 734321 - RNA, 20 nt, Homo sapiens
cuuugcuccagauaacucuc

SEQ ID NO: 734322 - RNA, 17 nt, Homo sapiens
cuuugcucccugcaaga

SEQ ID NO: 734323 - RNA, 21 nt, Homo sapiens
cuuugcucccuguugcugaaa

SEQ ID NO: 734324 - RNA, 15 nt, Homo sapiens
cuuugcugauuuccc

SEQ ID NO: 734325 - RNA, 13 nt, Homo sapiens
cuuugcugcacaa

SEQ ID NO: 734326 - RNA, 12 nt, Homo sapiens
cuuugcugccag

SEQ ID NO: 734327 - RNA, 21 nt, Homo sapiens
cuuugcugccagccacuucau

SEQ ID NO: 734328 - RNA, 11 nt, Homo sapiens
cuuugcugcua

SEQ ID NO: 734329 - RNA, 21 nt, Homo sapiens
cuuugcugucaaaacuacuga

SEQ ID NO: 734330 - RNA, 15 nt, Homo sapiens
cuuugcuucccauug

SEQ ID NO: 734331 - RNA, 18 nt, Homo sapiens
cuuuggaagauggcauaa

SEQ ID NO: 734332 - RNA, 17 nt, Homo sapiens
cuuuggaagucaugagc

SEQ ID NO: 734333 - RNA, 20 nt, Homo sapiens
cuuuggcaaaacuuaggcau

SEQ ID NO: 734334 - RNA, 17 nt, Homo sapiens
cuuuggcugcagguguu

SEQ ID NO: 734335 - RNA, 19 nt, Homo sapiens
cuuuggcuggaauuacaaa

SEQ ID NO: 734336 - RNA, 21 nt, Homo sapiens
cuuugggauugcuaugaauga

SEQ ID NO: 734337 - RNA, 20 nt, Homo sapiens
cuuugggccagacaugccac

SEQ ID NO: 734338 - RNA, 19 nt, Homo sapiens
cuuuggggacaguuggcag

SEQ ID NO: 734339 - RNA, 18 nt, Homo sapiens
cuuuggucauaugagcuu

SEQ ID NO: 734340 - RNA, 16 nt, Homo sapiens
cuuugguggcauggaa

SEQ ID NO: 734341 - RNA, 19 nt, Homo sapiens
cuuugguuggcagcauucc

SEQ ID NO: 734342 - RNA, 15 nt, Homo sapiens
cuuuguauaugcauu

SEQ ID NO: 734343 - RNA, 16 nt, Homo sapiens
cuuuguauaugcauuc

SEQ ID NO: 734344 - RNA, 15 nt, Homo sapiens
cuuuguauauuacau

SEQ ID NO: 734345 - RNA, 17 nt, Homo sapiens
cuuuguaugacagugaa

SEQ ID NO: 734346 - RNA, 22 nt, Homo sapiens
cuuugucauucaagccugugaa

SEQ ID NO: 734347 - RNA, 13 nt, Homo sapiens
cuuugucccagaa

SEQ ID NO: 734348 - RNA, 17 nt, Homo sapiens
cuuugucccggggcucc

SEQ ID NO: 734349 - RNA, 23 nt, Homo sapiens
cuuugucccggggcuccacugaa

SEQ ID NO: 734350 - RNA, 14 nt, Homo sapiens
cuuugucucaaaau

SEQ ID NO: 734351 - RNA, 22 nt, Homo sapiens
cuuuguggauggugucuccuuu

SEQ ID NO: 734352 - RNA, 13 nt, Homo sapiens
cuuuguguaguau

SEQ ID NO: 734353 - RNA, 15 nt, Homo sapiens
cuuuguguguauuca

SEQ ID NO: 734354 - RNA, 15 nt, Homo sapiens
cuuuguuacugucca

SEQ ID NO: 734355 - RNA, 17 nt, Homo sapiens
cuuuguuacuuccuuau

SEQ ID NO: 734356 - RNA, 23 nt, Homo sapiens
cuuuguugcuuccguucauggaa

SEQ ID NO: 734357 - RNA, 21 nt, Homo sapiens
cuuuguuuagccugaaaaccu

SEQ ID NO: 734358 - RNA, 18 nt, Homo sapiens
cuuuuaaaaaaaaauacu

SEQ ID NO: 734359 - RNA, 15 nt, Homo sapiens
cuuuuaaaaaugucc

SEQ ID NO: 734360 - RNA, 22 nt, Homo sapiens
cuuuuaaaaauucaaaugauuu

SEQ ID NO: 734361 - RNA, 23 nt, Homo sapiens
cuuuuaaagaaaaauaugauacu

SEQ ID NO: 734362 - RNA, 15 nt, Homo sapiens
uuuuaacugccaaga

SEQ ID NO: 734363 - RNA, 18 nt, Homo sapiens
uuuuaagcagacucagcu

SEQ ID NO: 734364 - RNA, 20 nt, Homo sapiens
uuucauaaacuucagggauc

SEQ ID NO: 734365 - RNA, 16 nt, Homo sapiens
uuucauaauaccucac

SEQ ID NO: 734366 - RNA, 14 nt, Homo sapiens
uuucauacaacaga

SEQ ID NO: 734367 - RNA, 16 nt, Homo sapiens
uuucauaccacuugaa

SEQ ID NO: 734368 - RNA, 20 nt, Homo sapiens
uuucauacuguaacauucag

SEQ ID NO: 734369 - RNA, 18 nt, Homo sapiens
uuucauagcgaguuuucu

SEQ ID NO: 734370 - RNA, 14 nt, Homo sapiens
uuucauaguguuca

SEQ ID NO: 734371 - RNA, 21 nt, Homo sapiens
uuucaucacacuggguggugg

SEQ ID NO: 734372 - RNA, 15 nt, Homo sapiens
uuucauccuugacua

SEQ ID NO: 734373 - RNA, 16 nt, Homo sapiens
uuucaucucuauuuag

SEQ ID NO: 734374 - RNA, 17 nt, Homo sapiens
uuucaucuggauucuac

SEQ ID NO: 734375 - RNA, 22 nt, Homo sapiens
uuucauggaaguggcagugaaa

SEQ ID NO: 734376 - RNA, 17 nt, Homo sapiens
uuucauguaaauuuugu

SEQ ID NO: 734377 - RNA, 20 nt, Homo sapiens
uuucauguaacauacauauu

SEQ ID NO: 734378 - RNA, 18 nt, Homo sapiens
uuucauuaaagaauguuu

SEQ ID NO: 734379 - RNA, 22 nt, Homo sapiens
uuucauuccuaacacagcaugu

SEQ ID NO: 734380 - RNA, 21 nt, Homo sapiens
uuucauugcccgaaaccagag

SEQ ID NO: 734381 - RNA, 18 nt, Homo sapiens
uuucauuguguucucuau

SEQ ID NO: 734382 - RNA, 18 nt, Homo sapiens
uuucauuuauccagauga

SEQ ID NO: 734383 - RNA, 17 nt, Homo sapiens
uuucauuuuuuuccagg

SEQ ID NO: 734384 - RNA, 16 nt, Homo sapiens
uuuccaaaacauuucu

SEQ ID NO: 734385 - RNA, 14 nt, Homo sapiens
uuuccaaaacuuua

SEQ ID NO: 734386 - RNA, 23 nt, Homo sapiens
uuuccaaugaugaaauauaauca

SEQ ID NO: 734387 - RNA, 13 nt, Homo sapiens
uuuccaauuucau

SEQ ID NO: 734388 - RNA, 17 nt, Homo sapiens
uuuccacauuugucaca

SEQ ID NO: 734389 - RNA, 15 nt, Homo sapiens
uuuccacuacugcua

SEQ ID NO: 734390 - RNA, 18 nt, Homo sapiens
uuuccacuacugcuacca

SEQ ID NO: 734391 - RNA, 15 nt, Homo sapiens
uuuccacuccauugu

SEQ ID NO: 734392 - RNA, 19 nt, Homo sapiens
uuuccagacuuccuugaga

SEQ ID NO: 734393 - RNA, 12 nt, Homo sapiens
uuuccagaguau

SEQ ID NO: 734394 - RNA, 19 nt, Homo sapiens
uuuccauccauuaccucca

SEQ ID NO: 734395 - RNA, 11 nt, Homo sapiens
uuuccaucucu

SEQ ID NO: 734396 - RNA, 17 nt, Homo sapiens
uuuccauuauguucauc

SEQ ID NO: 734397 - RNA, 20 nt, Homo sapiens
uuuccauugaccagcucucu

SEQ ID NO: 734398 - RNA, 17 nt, Homo sapiens
uuuccauuuaguaacag

SEQ ID NO: 734399 - RNA, 17 nt, Homo sapiens
uuuccauuuuaaggaua

SEQ ID NO: 734400 - RNA, 17 nt, Homo sapiens
uuucccacgaggaaucu

SEQ ID NO: 734401 - RNA, 18 nt, Homo sapiens
uuucccaggaauauccca

SEQ ID NO: 734402 - RNA, 17 nt, Homo sapiens
uuucccaucuccauugu

SEQ ID NO: 734403 - RNA, 14 nt, Homo sapiens
uuucccauguauuu

SEQ ID NO: 734404 - RNA, 18 nt, Homo sapiens
uuuccccaccccagcuca

SEQ ID NO: 734405 - RNA, 23 nt, Homo sapiens
uuucccccuccucagauggggca

SEQ ID NO: 734406 - RNA, 22 nt, Homo sapiens
uuucccccuucccgccuuccaa

SEQ ID NO: 734407 - RNA, 23 nt, Homo sapiens
uuucccccuugaggauuguggaa

SEQ ID NO: 734408 - RNA, 19 nt, Homo sapiens
uuuccccuccuuggcuuua

SEQ ID NO: 734409 - RNA, 18 nt, Homo sapiens
uuuccgccagaccucaac

SEQ ID NO: 734410 - RNA, 18 nt, Homo sapiens
uuuccuaaacccagugcu

SEQ ID NO: 734411 - RNA, 22 nt, Homo sapiens
uuuccucagugcauuugugcua

SEQ ID NO: 734412 - RNA, 21 nt, Homo sapiens
uuuccuccugcuucaugggaa

SEQ ID NO: 734413 - RNA, 13 nt, Homo sapiens
uuuccucuaauga

SEQ ID NO: 734414 - RNA, 17 nt, Homo sapiens
uuuccugauacauuaaa

SEQ ID NO: 734415 - RNA, 16 nt, Homo sapiens
uuuccugcagggccag

SEQ ID NO: 734416 - RNA, 21 nt, Homo sapiens
uuuccuggaauugccagcuga

SEQ ID NO: 734417 - RNA, 16 nt, Homo sapiens
uuuccuuaaacugugu

SEQ ID NO: 734418 - RNA, 19 nt, Homo sapiens
uuuccuuaguuuucuagua

SEQ ID NO: 734419 - RNA, 19 nt, Homo sapiens
uuuccuuuuugacacugaa

SEQ ID NO: 734420 - RNA, 16 nt, Homo sapiens
uuucgggauucuuuga

SEQ ID NO: 734421 - RNA, 16 nt, Homo sapiens
uuucgugcacucugcu

SEQ ID NO: 734422 - RNA, 20 nt, Homo sapiens
uuucuaagcaguuaugguga

SEQ ID NO: 734423 - RNA, 21 nt, Homo sapiens
uuucuacaacugauugcaaca

SEQ ID NO: 734424 - RNA, 22 nt, Homo sapiens
uuucuacuaaaaauacaaaaau

SEQ ID NO: 734425 - RNA, 15 nt, Homo sapiens
uuucuagaagcacau

SEQ ID NO: 734426 - RNA, 15 nt, Homo sapiens
uuucuagagacacau

SEQ ID NO: 734427 - RNA, 20 nt, Homo sapiens
uuucuauagaaaaaguaaaa

SEQ ID NO: 734428 - RNA, 14 nt, Homo sapiens
uuucuauaucaaaa

SEQ ID NO: 734429 - RNA, 16 nt, Homo sapiens
uuucuaucacauauuu

SEQ ID NO: 734430 - RNA, 21 nt, Homo sapiens
uuucuaucagccuugcuaaag

SEQ ID NO: 734431 - RNA, 14 nt, Homo sapiens
uuucuaugugacaa

SEQ ID NO: 734432 - RNA, 20 nt, Homo sapiens
uuucucaaaagagguuacuu

SEQ ID NO: 734433 - RNA, 17 nt, Homo sapiens
uuucucacauugcugua

SEQ ID NO: 734434 - RNA, 23 nt, Homo sapiens
uuucucaguaucaguauuuacau

SEQ ID NO: 734435 - RNA, 13 nt, Homo sapiens
uuucucaugaagc

SEQ ID NO: 734436 - RNA, 13 nt, Homo sapiens
uuucucauuaaau

SEQ ID NO: 734437 - RNA, 15 nt, Homo sapiens
uuucuccauaucaaa

SEQ ID NO: 734438 - RNA, 22 nt, Homo sapiens
uuucuccccauuugggacauca

SEQ ID NO: 734439 - RNA, 21 nt, Homo sapiens
uuucuccuuuugaccaaauaa

SEQ ID NO: 734440 - RNA, 21 nt, Homo sapiens
uuucucgacagaugauuuucu

SEQ ID NO: 734441 - RNA, 13 nt, Homo sapiens
uuucucucuggcu

SEQ ID NO: 734442 - RNA, 16 nt, Homo sapiens
uuucucugccagugac

SEQ ID NO: 734443 - RNA, 21 nt, Homo sapiens
uuucucuuagaaaaggugaua

SEQ ID NO: 734444 - RNA, 14 nt, Homo sapiens
uuucucuuaugcuu

SEQ ID NO: 734445 - RNA, 17 nt, Homo sapiens
uuucugaccuugagcca

SEQ ID NO: 734446 - RNA, 17 nt, Homo sapiens
uuucugacucugagcua

SEQ ID NO: 734447 - RNA, 22 nt, Homo sapiens
uuucugauaacagaauugccaa

SEQ ID NO: 734448 - RNA, 15 nt, Homo sapiens
uuucugauaccacug

SEQ ID NO: 734449 - RNA, 17 nt, Homo sapiens
uuucugcguguguauau

SEQ ID NO: 734450 - RNA, 19 nt, Homo sapiens
uuucugcuaaaaaguccuu

SEQ ID NO: 734451 - RNA, 19 nt, Homo sapiens
uuucugcuuacaaagacaa

SEQ ID NO: 734452 - RNA, 17 nt, Homo sapiens
uuucuggaaaacugccu

SEQ ID NO: 734453 - RNA, 15 nt, Homo sapiens
uuucuggcucuccca

SEQ ID NO: 734454 - RNA, 11 nt, Homo sapiens
uuucugggacc

SEQ ID NO: 734455 - RNA, 18 nt, Homo sapiens
uuucugguaaaacuuuag

SEQ ID NO: 734456 - RNA, 14 nt, Homo sapiens
uuucuggugccauu

SEQ ID NO: 734457 - RNA, 15 nt, Homo sapiens
uuucuggugccauuu

SEQ ID NO: 734458 - RNA, 18 nt, Homo sapiens
uuucuguagcaccagaga

SEQ ID NO: 734459 - RNA, 12 nt, Homo sapiens
uuucugugaaua

SEQ ID NO: 734460 - RNA, 16 nt, Homo sapiens
uuucugugcagagaug

SEQ ID NO: 734461 - RNA, 18 nt, Homo sapiens
uuucugugcauucaugca

SEQ ID NO: 734462 - RNA, 22 nt, Homo sapiens
uuucugugggaggagaagggga

SEQ ID NO: 734463 - RNA, 12 nt, Homo sapiens
uuucuguucuca

SEQ ID NO: 734464 - RNA, 17 nt, Homo sapiens
uuucuguuucaaagcac

SEQ ID NO: 734465 - RNA, 18 nt, Homo sapiens
uuucuuaaaacauuauga

SEQ ID NO: 734466 - RNA, 20 nt, Homo sapiens
uuucuuagaauugaccaaau

SEQ ID NO: 734467 - RNA, 22 nt, Homo sapiens
uuucuuagaauugaccaaauaa

SEQ ID NO: 734468 - RNA, 23 nt, Homo sapiens
uuucuucaaauguuuaaaccacu

SEQ ID NO: 734469 - RNA, 21 nt, Homo sapiens
uuucuuccuuucuguagguuu

SEQ ID NO: 734470 - RNA, 13 nt, Homo sapiens
uuucuuccuuuga

SEQ ID NO: 734471 - RNA, 12 nt, Homo sapiens
uuucuugcagau

SEQ ID NO: 734472 - RNA, 22 nt, Homo sapiens
uuucuugccuuaaccagucucu

SEQ ID NO: 734473 - RNA, 21 nt, Homo sapiens
uuucuuguuugauuuuugaca

SEQ ID NO: 734474 - RNA, 12 nt, Homo sapiens
uuucuuugccuc

SEQ ID NO: 734475 - RNA, 18 nt, Homo sapiens
uuucuuuuaaaauuuuga

SEQ ID NO: 734476 - RNA, 15 nt, Homo sapiens
uuucuuuuccauuua

SEQ ID NO: 734477 - RNA, 20 nt, Homo sapiens
uuugaaauaaauuuuaauuc

SEQ ID NO: 734478 - RNA, 20 nt, Homo sapiens
uuugaaauagucugugugaa

SEQ ID NO: 734479 - RNA, 14 nt, Homo sapiens
uuuaagaacuguau

SEQ ID NO: 734480 - RNA, 18 nt, Homo sapiens
uuuaagaauaucuguaau

SEQ ID NO: 734481 - RNA, 14 nt, Homo sapiens
uuuaagacuaugau

SEQ ID NO: 734482 - RNA, 15 nt, Homo sapiens
uuuaagcaacacaga

SEQ ID NO: 734483 - RNA, 14 nt, Homo sapiens
uuuaaggagcaaaa

SEQ ID NO: 734484 - RNA, 23 nt, Homo sapiens
uuuaaggauguugccacuggcaa

SEQ ID NO: 734485 - RNA, 14 nt, Homo sapiens
uuuaagguaacaaa

SEQ ID NO: 734486 - RNA, 12 nt, Homo sapiens
uuuaagucucac

SEQ ID NO: 734487 - RNA, 19 nt, Homo sapiens
uuuaauaaaacugcgagga

SEQ ID NO: 734488 - RNA, 19 nt, Homo sapiens
uuuaauacaaaaagcaaaa

SEQ ID NO: 734489 - RNA, 19 nt, Homo sapiens
uuuaauacagugagcucua

SEQ ID NO: 734490 - RNA, 19 nt, Homo sapiens
uuuaauagaaauaaauucc

SEQ ID NO: 734491 - RNA, 16 nt, Homo sapiens
uuuaauagaauauaau

SEQ ID NO: 734492 - RNA, 16 nt, Homo sapiens
uuuaauauacuuuaaa

SEQ ID NO: 734493 - RNA, 20 nt, Homo sapiens
uuuaauaucuggcacuguua

SEQ ID NO: 734494 - RNA, 15 nt, Homo sapiens
uuuaauaugcuuaaa

SEQ ID NO: 734495 - RNA, 23 nt, Homo sapiens
uuuaaucagcuuaaaauccaaag

SEQ ID NO: 734496 - RNA, 17 nt, Homo sapiens
uuuaauccaaagaaaga

SEQ ID NO: 734497 - RNA, 19 nt, Homo sapiens
uuuaaugaacuaccaucug

SEQ ID NO: 734498 - RNA, 21 nt, Homo sapiens
uuuaaugaacuaccaucugau

SEQ ID NO: 734499 - RNA, 17 nt, Homo sapiens
uuuaaugagucagucaa

SEQ ID NO: 734500 - RNA, 18 nt, Homo sapiens
uuuaauggaaaguuguau

SEQ ID NO: 734501 - RNA, 17 nt, Homo sapiens
uuuaauggcaugucaga

SEQ ID NO: 734502 - RNA, 19 nt, Homo sapiens
uuuaauguuuuuugccaca

SEQ ID NO: 734503 - RNA, 12 nt, Homo sapiens
uuuaauuaucuu

SEQ ID NO: 734504 - RNA, 17 nt, Homo sapiens
uuuaauuuguuaucuca

SEQ ID NO: 734505 - RNA, 17 nt, Homo sapiens
uuuaauuuucuuguaua

SEQ ID NO: 734506 - RNA, 19 nt, Homo sapiens
uuuaauuuugacacuauau

SEQ ID NO: 734507 - RNA, 15 nt, Homo sapiens
uuuacacaaagggaa

SEQ ID NO: 734508 - RNA, 17 nt, Homo sapiens
uuuacacaggaagagaa

SEQ ID NO: 734509 - RNA, 11 nt, Homo sapiens
uuuacauuuca

SEQ ID NO: 734510 - RNA, 20 nt, Homo sapiens
uuuaccaaggauauuuacag

SEQ ID NO: 734511 - RNA, 20 nt, Homo sapiens
uuuaccccucauccaaaguu

SEQ ID NO: 734512 - RNA, 14 nt, Homo sapiens
uuuacccucaggca

SEQ ID NO: 734513 - RNA, 22 nt, Homo sapiens
uuuaccuuucagugcaguuucu

SEQ ID NO: 734514 - RNA, 19 nt, Homo sapiens
uuuacguggcaaaaugaac

SEQ ID NO: 734515 - RNA, 15 nt, Homo sapiens
uuuacugaggugaug

SEQ ID NO: 734516 - RNA, 16 nt, Homo sapiens
uuuacugaugauguag

SEQ ID NO: 734517 - RNA, 19 nt, Homo sapiens
uuuacuuaauucagucuca

SEQ ID NO: 734518 - RNA, 15 nt, Homo sapiens
uuuacuuaucucuca

SEQ ID NO: 734519 - RNA, 19 nt, Homo sapiens
uuuacuuaucuuaugccac

SEQ ID NO: 734520 - RNA, 24 nt, Homo sapiens
uuuacuuccauaggacauacugca

SEQ ID NO: 734521 - RNA, 14 nt, Homo sapiens
uuuagaacagggaa

SEQ ID NO: 734522 - RNA, 22 nt, Homo sapiens
uuuagaacuuuaccuauggaag

SEQ ID NO: 734523 - RNA, 20 nt, Homo sapiens
uuuagacuuccuguaggggg

SEQ ID NO: 734524 - RNA, 20 nt, Homo sapiens
uuuagaucccaugucaccuc

SEQ ID NO: 734525 - RNA, 18 nt, Homo sapiens
uuuagauuuucuuuugcc

SEQ ID NO: 734526 - RNA, 17 nt, Homo sapiens
uuuagcaagguguuucu

SEQ ID NO: 734527 - RNA, 20 nt, Homo sapiens
uuuagcaauuuauacaauau

SEQ ID NO: 734528 - RNA, 16 nt, Homo sapiens
uuuagccagugacuuu

SEQ ID NO: 734529 - RNA, 13 nt, Homo sapiens
uuuagcccuaaaa

SEQ ID NO: 734530 - RNA, 17 nt, Homo sapiens
uuuaggcuacagugucu

SEQ ID NO: 734531 - RNA, 12 nt, Homo sapiens
uuuaguggcuca

SEQ ID NO: 734532 - RNA, 15 nt, Homo sapiens
uuuagugugccuucc

SEQ ID NO: 734533 - RNA, 16 nt, Homo sapiens
uuuaguuuugauuuug

SEQ ID NO: 734534 - RNA, 22 nt, Homo sapiens
uuuauaaaaaugagugcuuaaa

SEQ ID NO: 734535 - RNA, 23 nt, Homo sapiens
uuuauaaaagaauaaaauugcac

SEQ ID NO: 734536 - RNA, 14 nt, Homo sapiens
uuuauaaacagaaa

SEQ ID NO: 734537 - RNA, 15 nt, Homo sapiens
uuuauaaccuggcaa

SEQ ID NO: 734538 - RNA, 18 nt, Homo sapiens
uuuauaaggcugauguca

SEQ ID NO: 734539 - RNA, 13 nt, Homo sapiens
uuuauaagucauu

SEQ ID NO: 734540 - RNA, 16 nt, Homo sapiens
uuuauacucacugagu

SEQ ID NO: 734541 - RNA, 18 nt, Homo sapiens
uuuauagaggcuagcuuc

SEQ ID NO: 734542 - RNA, 19 nt, Homo sapiens
uuuauaggagaaagcaaaa

SEQ ID NO: 734543 - RNA, 23 nt, Homo sapiens
uuuauaucccccuaaacuaccuu

SEQ ID NO: 734544 - RNA, 13 nt, Homo sapiens
uuuauauguugcu

SEQ ID NO: 734545 - RNA, 19 nt, Homo sapiens
uuuauauguugcuauaaua

SEQ ID NO: 734546 - RNA, 18 nt, Homo sapiens
uuuaucaccucauucuga

SEQ ID NO: 734547 - RNA, 13 nt, Homo sapiens
uuuaucauaugcu

SEQ ID NO: 734548 - RNA, 20 nt, Homo sapiens
uuuaucaugaagcacaucaa

SEQ ID NO: 734549 - RNA, 14 nt, Homo sapiens
uuuauccagaugac

SEQ ID NO: 734550 - RNA, 18 nt, Homo sapiens
uuuaucccccgcaaagac

SEQ ID NO: 734551 - RNA, 23 nt, Homo sapiens
uuuaucccccgcaaagacaucaa

SEQ ID NO: 734552 - RNA, 13 nt, Homo sapiens
uuuaucucaaaaa

SEQ ID NO: 734553 - RNA, 14 nt, Homo sapiens
uuuaucugugcaaa

SEQ ID NO: 734554 - RNA, 14 nt, Homo sapiens
uuuaucuguucuug

SEQ ID NO: 734555 - RNA, 18 nt, Homo sapiens
uuuaucuguuuccugaca

SEQ ID NO: 734556 - RNA, 16 nt, Homo sapiens
uuuaugaugacugcuu

SEQ ID NO: 734557 - RNA, 11 nt, Homo sapiens
uuuaugcacau

SEQ ID NO: 734558 - RNA, 13 nt, Homo sapiens
uuuaugccuuuau

SEQ ID NO: 734559 - RNA, 16 nt, Homo sapiens
uuuaugguuaauacua

SEQ ID NO: 734560 - RNA, 15 nt, Homo sapiens
uuuauguagcacuac

SEQ ID NO: 734561 - RNA, 21 nt, Homo sapiens
uuuauguuuggaauaaaguca

SEQ ID NO: 734562 - RNA, 11 nt, Homo sapiens
uuuauucacau

SEQ ID NO: 734563 - RNA, 21 nt, Homo sapiens
uuuauugcaggauggugucuc

SEQ ID NO: 734564 - RNA, 15 nt, Homo sapiens
uuuauuucugaucua

SEQ ID NO: 734565 - RNA, 16 nt, Homo sapiens
uuuauuucugaucuau

SEQ ID NO: 734566 - RNA, 16 nt, Homo sapiens
uuuauuuuucucauga

SEQ ID NO: 734567 - RNA, 23 nt, Homo sapiens
uuucaaaauucaaaaaaaaaagc

SEQ ID NO: 734568 - RNA, 19 nt, Homo sapiens
uuucaaagauguguugcua

SEQ ID NO: 734569 - RNA, 13 nt, Homo sapiens
uuucaaagcacaa

SEQ ID NO: 734570 - RNA, 13 nt, Homo sapiens
uuucaaagcuaaa

SEQ ID NO: 734571 - RNA, 12 nt, Homo sapiens
uuucaaagggaa

SEQ ID NO: 734572 - RNA, 15 nt, Homo sapiens
uuucaaauuggcacu

SEQ ID NO: 734573 - RNA, 20 nt, Homo sapiens
uuucaaauuuuuacugagaa

SEQ ID NO: 734574 - RNA, 12 nt, Homo sapiens
uuucaaccauaa

SEQ ID NO: 734575 - RNA, 23 nt, Homo sapiens
uuucaagacauuaaaucuaugaa

SEQ ID NO: 734576 - RNA, 12 nt, Homo sapiens
uuucaagagauc

SEQ ID NO: 734577 - RNA, 12 nt, Homo sapiens
uuucaagcugca

SEQ ID NO: 734578 - RNA, 16 nt, Homo sapiens
uuucaaggaaagugaa

SEQ ID NO: 734579 - RNA, 22 nt, Homo sapiens
uuucaaggcacucuagauucca

SEQ ID NO: 734580 - RNA, 17 nt, Homo sapiens
uuucaaggcauuugucu

SEQ ID NO: 734581 - RNA, 13 nt, Homo sapiens
uuucaagugccua

SEQ ID NO: 734582 - RNA, 15 nt, Homo sapiens
uuucaauagcacaua

SEQ ID NO: 734583 - RNA, 15 nt, Homo sapiens
uuucaauuacaaagc

SEQ ID NO: 734584 - RNA, 15 nt, Homo sapiens
uuucaauugucacuu

SEQ ID NO: 734585 - RNA, 16 nt, Homo sapiens
uuucacaacauuugca

SEQ ID NO: 734586 - RNA, 11 nt, Homo sapiens
uuucacaagcu

SEQ ID NO: 734587 - RNA, 13 nt, Homo sapiens
uuucacaauguga

SEQ ID NO: 734588 - RNA, 15 nt, Homo sapiens
uuucaccauguuggc

SEQ ID NO: 734589 - RNA, 20 nt, Homo sapiens
uuucacgcaugugugcugca

SEQ ID NO: 734590 - RNA, 22 nt, Homo sapiens
uuucacuacaaucgcuaccuga

SEQ ID NO: 734591 - RNA, 14 nt, Homo sapiens
uuucacugcaaugu

SEQ ID NO: 734592 - RNA, 14 nt, Homo sapiens
uuucagaauuuugc

SEQ ID NO: 734593 - RNA, 17 nt, Homo sapiens
uuucagagccagugaag

SEQ ID NO: 734594 - RNA, 14 nt, Homo sapiens
uuucaggauauaau

SEQ ID NO: 734595 - RNA, 17 nt, Homo sapiens
uuauauaaaauacauaa

SEQ ID NO: 734596 - RNA, 17 nt, Homo sapiens
uuauauaaaucauuuca

SEQ ID NO: 734597 - RNA, 13 nt, Homo sapiens
uuauauaaucaau

SEQ ID NO: 734598 - RNA, 22 nt, Homo sapiens
uuauauauacaguaacuuuaug

SEQ ID NO: 734599 - RNA, 14 nt, Homo sapiens
uuauaucagccuga

SEQ ID NO: 734600 - RNA, 15 nt, Homo sapiens
uuauaucagccugag

SEQ ID NO: 734601 - RNA, 17 nt, Homo sapiens
uuauaucauguaccuca

SEQ ID NO: 734602 - RNA, 21 nt, Homo sapiens
uuauaucugugaauugcaggu

SEQ ID NO: 734603 - RNA, 15 nt, Homo sapiens
uuauauguacuguuu

SEQ ID NO: 734604 - RNA, 19 nt, Homo sapiens
uuauauguagccuuuacug

SEQ ID NO: 734605 - RNA, 17 nt, Homo sapiens
uuauauuaauguacuug

SEQ ID NO: 734606 - RNA, 15 nt, Homo sapiens
uugucagcaucugac

SEQ ID NO: 734607 - RNA, 14 nt, Homo sapiens
uugucauccuuuga

SEQ ID NO: 734608 - RNA, 12 nt, Homo sapiens
uugucauucaag

SEQ ID NO: 734609 - RNA, 13 nt, Homo sapiens
uugucauuuauaa

SEQ ID NO: 734610 - RNA, 18 nt, Homo sapiens
uuguccccacuuacagau

SEQ ID NO: 734611 - RNA, 15 nt, Homo sapiens
uugucccguggcauu

SEQ ID NO: 734612 - RNA, 18 nt, Homo sapiens
uugucuaaacaaugcuga

SEQ ID NO: 734613 - RNA, 23 nt, Homo sapiens
uugucuaaauaaguuugcaauuu

SEQ ID NO: 734614 - RNA, 18 nt, Homo sapiens
uugucuacauagugacau

SEQ ID NO: 734615 - RNA, 23 nt, Homo sapiens
uugucuacauuaaaucacuugaa

SEQ ID NO: 734616 - RNA, 17 nt, Homo sapiens
uugucucugugacugaa

SEQ ID NO: 734617 - RNA, 17 nt, Homo sapiens
uugucugaacaaagugc

SEQ ID NO: 734618 - RNA, 13 nt, Homo sapiens
uugucugagacag

SEQ ID NO: 734619 - RNA, 21 nt, Homo sapiens
uugucuggcaaggacuuugua

SEQ ID NO: 734620 - RNA, 19 nt, Homo sapiens
uugucuuaaucguccugcu

SEQ ID NO: 734621 - RNA, 18 nt, Homo sapiens
uugucuugccccuaggaa

SEQ ID NO: 734622 - RNA, 14 nt, Homo sapiens
uugucuuguucacc

SEQ ID NO: 734623 - RNA, 22 nt, Homo sapiens
uugucuuuaaauagauacaaau

SEQ ID NO: 734624 - RNA, 13 nt, Homo sapiens
uugugaacugucu

SEQ ID NO: 734625 - RNA, 23 nt, Homo sapiens
uugugaaguggaaauguucuaaa

SEQ ID NO: 734626 - RNA, 18 nt, Homo sapiens
uugugaauuaggcuguaa

SEQ ID NO: 734627 - RNA, 17 nt, Homo sapiens
uugugaauuauucugau

SEQ ID NO: 734628 - RNA, 22 nt, Homo sapiens
uugugaccacugaauucacucc

SEQ ID NO: 734629 - RNA, 20 nt, Homo sapiens
uugugauuccauggauugau

SEQ ID NO: 734630 - RNA, 20 nt, Homo sapiens
uugugauuuuuauaauacaa

SEQ ID NO: 734631 - RNA, 18 nt, Homo sapiens
uugugcaaaauauuugac

SEQ ID NO: 734632 - RNA, 19 nt, Homo sapiens
uugugccacuguacuccag

SEQ ID NO: 734633 - RNA, 16 nt, Homo sapiens
uugugcugccauuuga

SEQ ID NO: 734634 - RNA, 16 nt, Homo sapiens
uugugcuuucaccaga

SEQ ID NO: 734635 - RNA, 19 nt, Homo sapiens
uugugggacacaacacaga

SEQ ID NO: 734636 - RNA, 21 nt, Homo sapiens
uugugggacacaacacagaua

SEQ ID NO: 734637 - RNA, 23 nt, Homo sapiens
uugugguugaaaaccacagucag

SEQ ID NO: 734638 - RNA, 15 nt, Homo sapiens
uuguguaaaaagcaa

SEQ ID NO: 734639 - RNA, 17 nt, Homo sapiens
uuguguagaaagccaaa

SEQ ID NO: 734640 - RNA, 21 nt, Homo sapiens
uuguguauuccacuuaggaag

SEQ ID NO: 734641 - RNA, 16 nt, Homo sapiens
uugugucagaaacaug

SEQ ID NO: 734642 - RNA, 15 nt, Homo sapiens
uugugucuguacacg

SEQ ID NO: 734643 - RNA, 12 nt, Homo sapiens
uugugugcugug

SEQ ID NO: 734644 - RNA, 16 nt, Homo sapiens
uuguguguaugcugau

SEQ ID NO: 734645 - RNA, 19 nt, Homo sapiens
uuguguguauuuguauuaa

SEQ ID NO: 734646 - RNA, 15 nt, Homo sapiens
uugugugucaugcca

SEQ ID NO: 734647 - RNA, 22 nt, Homo sapiens
uuguguguguguguugauccca

SEQ ID NO: 734648 - RNA, 21 nt, Homo sapiens
uuguguguuuauuucacuuga

SEQ ID NO: 734649 - RNA, 22 nt, Homo sapiens
uuguguugacacauaugaacac

SEQ ID NO: 734650 - RNA, 21 nt, Homo sapiens
uuguuaaacacgugucuauaa

SEQ ID NO: 734651 - RNA, 17 nt, Homo sapiens
uuguuacuucugaggua

SEQ ID NO: 734652 - RNA, 19 nt, Homo sapiens
uuguuaucuuccacuggaa

SEQ ID NO: 734653 - RNA, 17 nt, Homo sapiens
uuguucaaagcacagaa

SEQ ID NO: 734654 - RNA, 20 nt, Homo sapiens
uuguucaauguuccauucuu

SEQ ID NO: 734655 - RNA, 16 nt, Homo sapiens
uuguucaguaugcaaa

SEQ ID NO: 734656 - RNA, 23 nt, Homo sapiens
uuguucaucagacuccugugcaa

SEQ ID NO: 734657 - RNA, 16 nt, Homo sapiens
uuguuccacuuguuug

SEQ ID NO: 734658 - RNA, 14 nt, Homo sapiens
uuguucuacugaga

SEQ ID NO: 734659 - RNA, 12 nt, Homo sapiens
uuguucucagaa

SEQ ID NO: 734660 - RNA, 17 nt, Homo sapiens
uuguucuuggccaaaga

SEQ ID NO: 734661 - RNA, 11 nt, Homo sapiens
uuguugccaug

SEQ ID NO: 734662 - RNA, 18 nt, Homo sapiens
uuguuguaaaaagcccag

SEQ ID NO: 734663 - RNA, 13 nt, Homo sapiens
uuguugugcuauu

SEQ ID NO: 734664 - RNA, 13 nt, Homo sapiens
uuguuguuauuaa

SEQ ID NO: 734665 - RNA, 13 nt, Homo sapiens
uuguuguuugcca

SEQ ID NO: 734666 - RNA, 12 nt, Homo sapiens
uuguuuacuuaa

SEQ ID NO: 734667 - RNA, 16 nt, Homo sapiens
uuguuuagagcccucc

SEQ ID NO: 734668 - RNA, 21 nt, Homo sapiens
uuguuucccagauuucaggaa

SEQ ID NO: 734669 - RNA, 14 nt, Homo sapiens
uuguuucuugccug

SEQ ID NO: 734670 - RNA, 16 nt, Homo sapiens
uuguuugucaucuuca

SEQ ID NO: 734671 - RNA, 14 nt, Homo sapiens
uuguuugucuucca

SEQ ID NO: 734672 - RNA, 21 nt, Homo sapiens
uuguuuuaacguucugcugcu

SEQ ID NO: 734673 - RNA, 21 nt, Homo sapiens
uuguuuuaugcucagggucaa

SEQ ID NO: 734674 - RNA, 14 nt, Homo sapiens
uuguuuucagugaa

SEQ ID NO: 734675 - RNA, 18 nt, Homo sapiens
uuguuuucauuaucucaa

SEQ ID NO: 734676 - RNA, 14 nt, Homo sapiens
uuguuuucuacuuu

SEQ ID NO: 734677 - RNA, 19 nt, Homo sapiens
uuguuuugacggaugauug

SEQ ID NO: 734678 - RNA, 12 nt, Homo sapiens
uuguuuugugaa

SEQ ID NO: 734679 - RNA, 15 nt, Homo sapiens
uuguuuuugcaugaa

SEQ ID NO: 734680 - RNA, 19 nt, Homo sapiens
uuuaaaaaaagaacauaaa

SEQ ID NO: 734681 - RNA, 19 nt, Homo sapiens
uuuaaaaaaagagcuaaga

SEQ ID NO: 734682 - RNA, 13 nt, Homo sapiens
uuuaaaaacucac

SEQ ID NO: 734683 - RNA, 16 nt, Homo sapiens
uuuaaaaagaaacaag

SEQ ID NO: 734684 - RNA, 19 nt, Homo sapiens
uuuaaaaagcuaguucuau

SEQ ID NO: 734685 - RNA, 13 nt, Homo sapiens
uuuaaaacaaaga

SEQ ID NO: 734686 - RNA, 12 nt, Homo sapiens
uuuaaaacacaa

SEQ ID NO: 734687 - RNA, 15 nt, Homo sapiens
uuuaaaagcaucuca

SEQ ID NO: 734688 - RNA, 18 nt, Homo sapiens
uuuaaaauacacacucaa

SEQ ID NO: 734689 - RNA, 16 nt, Homo sapiens
uuuaaaauuacauucu

SEQ ID NO: 734690 - RNA, 14 nt, Homo sapiens
uuuaaaauugugau

SEQ ID NO: 734691 - RNA, 22 nt, Homo sapiens
uuuaaacacuuaucuucuggau

SEQ ID NO: 734692 - RNA, 18 nt, Homo sapiens
uuuaaacuuguuugcugu

SEQ ID NO: 734693 - RNA, 23 nt, Homo sapiens
uuuaaagaaaaauaugauacucu

SEQ ID NO: 734694 - RNA, 18 nt, Homo sapiens
uuuaaagacuaccuggga

SEQ ID NO: 734695 - RNA, 17 nt, Homo sapiens
uuuaaagccauucugau

SEQ ID NO: 734696 - RNA, 22 nt, Homo sapiens
uuuaaagcucauaaacugccaa

SEQ ID NO: 734697 - RNA, 11 nt, Homo sapiens
uuuaaaguaaa

SEQ ID NO: 734698 - RNA, 14 nt, Homo sapiens
uuuaaaguaugcau

SEQ ID NO: 734699 - RNA, 14 nt, Homo sapiens
uuuaaauagccuaa

SEQ ID NO: 734700 - RNA, 18 nt, Homo sapiens
uuuaaaucguacuacaga

SEQ ID NO: 734701 - RNA, 14 nt, Homo sapiens
uuuaaaucugugau

SEQ ID NO: 734702 - RNA, 15 nt, Homo sapiens
uuuaaaucugugaug

SEQ ID NO: 734703 - RNA, 21 nt, Homo sapiens
uuuaaauggcuuuaugcuagu

SEQ ID NO: 734704 - RNA, 19 nt, Homo sapiens
uuuaaauguaacuugcugu

SEQ ID NO: 734705 - RNA, 15 nt, Homo sapiens
uuuaaauuauacugu

SEQ ID NO: 734706 - RNA, 23 nt, Homo sapiens
uuuaacacccuuuagaaccuuaa

SEQ ID NO: 734707 - RNA, 21 nt, Homo sapiens
uuuaacauugcugauguagua

SEQ ID NO: 734708 - RNA, 13 nt, Homo sapiens
uuuaaccaaaaca

SEQ ID NO: 734709 - RNA, 18 nt, Homo sapiens
uuuaacccauuugucucu

SEQ ID NO: 734710 - RNA, 19 nt, Homo sapiens
uuuaaccccuugguacuga

SEQ ID NO: 734711 - RNA, 20 nt, Homo sapiens
uuuaaccuaauaucacuuaa

SEQ ID NO: 734712 - RNA, 17 nt, Homo sapiens
uuuaaccucuagaguca

SEQ ID NO: 734713 - RNA, 11 nt, Homo sapiens
uuuaaccuuaa

SEQ ID NO: 734714 - RNA, 14 nt, Homo sapiens
uuuaacugcauaau

SEQ ID NO: 734715 - RNA, 19 nt, Homo sapiens
uuuaagaacaaacucugaa

SEQ ID NO: 734716 - RNA, 22 nt, Homo sapiens
uuaccugauuugaugauacauu

SEQ ID NO: 734717 - RNA, 16 nt, Homo sapiens
uuaccugcugggaccu

SEQ ID NO: 734718 - RNA, 20 nt, Homo sapiens
uuaccugggaccucacacgc

SEQ ID NO: 734719 - RNA, 14 nt, Homo sapiens
uuaccuggggaucc

SEQ ID NO: 734720 - RNA, 19 nt, Homo sapiens
uuaccugucauuuugcacu

SEQ ID NO: 734721 - RNA, 20 nt, Homo sapiens
uuaccuucuaccucuuggcu

SEQ ID NO: 734722 - RNA, 22 nt, Homo sapiens
uuaccuuguuauuuaacccauu

SEQ ID NO: 734723 - RNA, 12 nt, Homo sapiens
uuacgacgugau

SEQ ID NO: 734724 - RNA, 21 nt, Homo sapiens
uuacgcuauccaguugcaggu

SEQ ID NO: 734725 - RNA, 12 nt, Homo sapiens
uuacuacugugg

SEQ ID NO: 734726 - RNA, 19 nt, Homo sapiens
uuacuagaagaugaauaca

SEQ ID NO: 734727 - RNA, 16 nt, Homo sapiens
uuacuaucacacauga

SEQ ID NO: 734728 - RNA, 14 nt, Homo sapiens
uuacuaugaucuca

SEQ ID NO: 734729 - RNA, 18 nt, Homo sapiens
uuacuauugcaaaaggga

SEQ ID NO: 734730 - RNA, 17 nt, Homo sapiens
uuacucagguuugagaa

SEQ ID NO: 734731 - RNA, 16 nt, Homo sapiens
uuacucaugacuccuu

SEQ ID NO: 734732 - RNA, 21 nt, Homo sapiens
uuacucaugugcagguuuuga

SEQ ID NO: 734733 - RNA, 16 nt, Homo sapiens
uuacucuuaugaucaa

SEQ ID NO: 734734 - RNA, 18 nt, Homo sapiens
uuacucuuuccuauuuca

SEQ ID NO: 734735 - RNA, 14 nt, Homo sapiens
uuacugaccagcaa

SEQ ID NO: 734736 - RNA, 14 nt, Homo sapiens
uuacugaugugaua

SEQ ID NO: 734737 - RNA, 15 nt, Homo sapiens
uuacugauucaauua

SEQ ID NO: 734738 - RNA, 22 nt, Homo sapiens
uuacugcauagcagaccacaca

SEQ ID NO: 734739 - RNA, 15 nt, Homo sapiens
uuacugcucugagaa

SEQ ID NO: 734740 - RNA, 16 nt, Homo sapiens
uuacugcuugaccaaa

SEQ ID NO: 734741 - RNA, 18 nt, Homo sapiens
uuacugcuugaccaaaga

SEQ ID NO: 734742 - RNA, 17 nt, Homo sapiens
uuacugugaaacuggca

SEQ ID NO: 734743 - RNA, 23 nt, Homo sapiens
uuacugugaaacuggcacugaau

SEQ ID NO: 734744 - RNA, 11 nt, Homo sapiens
uuacugugauc

SEQ ID NO: 734745 - RNA, 20 nt, Homo sapiens
uuacuuaaagauuuaucaaa

SEQ ID NO: 734746 - RNA, 17 nt, Homo sapiens
uuacuuaauucagucuc

SEQ ID NO: 734747 - RNA, 20 nt, Homo sapiens
uuacuuaugaugaugaaggg

SEQ ID NO: 734748 - RNA, 20 nt, Homo sapiens
uuacuuccuaucaagccagu

SEQ ID NO: 734749 - RNA, 16 nt, Homo sapiens
uuacuugcauugaaua

SEQ ID NO: 734750 - RNA, 20 nt, Homo sapiens
uuacuuguaaauaaagucua

SEQ ID NO: 734751 - RNA, 17 nt, Homo sapiens
uuacuuuuaccacuauu

SEQ ID NO: 734752 - RNA, 16 nt, Homo sapiens
uuacuuuuccagucug

SEQ ID NO: 734753 - RNA, 19 nt, Homo sapiens
uuacuuuuuccuggcucau

SEQ ID NO: 734754 - RNA, 20 nt, Homo sapiens
uuacuuuuuuuuaugaucaa

SEQ ID NO: 734755 - RNA, 23 nt, Homo sapiens
uuagaaauauucuacuucucugu

SEQ ID NO: 734756 - RNA, 14 nt, Homo sapiens
uuagaaaugcaaaa

SEQ ID NO: 734757 - RNA, 21 nt, Homo sapiens
uuagaacaaaagaauaacauu

SEQ ID NO: 734758 - RNA, 21 nt, Homo sapiens
uuagaacucuagagagccuua

SEQ ID NO: 734759 - RNA, 13 nt, Homo sapiens
uuagaagacauuu

SEQ ID NO: 734760 - RNA, 20 nt, Homo sapiens
uuagaauaaaucaaauauuc

SEQ ID NO: 734761 - RNA, 17 nt, Homo sapiens
uuagaauccgaagggaa

SEQ ID NO: 734762 - RNA, 23 nt, Homo sapiens
uuagaaugccgguuaaauuccau

SEQ ID NO: 734763 - RNA, 15 nt, Homo sapiens
uuagaauuauaucac

SEQ ID NO: 734764 - RNA, 20 nt, Homo sapiens
uuagacaaccauagaacugu

SEQ ID NO: 734765 - RNA, 17 nt, Homo sapiens
uuagaccuguguuacua

SEQ ID NO: 734766 - RNA, 21 nt, Homo sapiens
uuagagaaagaacuaugaaau

SEQ ID NO: 734767 - RNA, 17 nt, Homo sapiens
uuagagcaaccucugua

SEQ ID NO: 734768 - RNA, 17 nt, Homo sapiens
uuagaguugcucuacaa

SEQ ID NO: 734769 - RNA, 20 nt, Homo sapiens
uuagauauuaggggggaaag

SEQ ID NO: 734770 - RNA, 22 nt, Homo sapiens
uuagaugcacuaccauugcugu

SEQ ID NO: 734771 - RNA, 22 nt, Homo sapiens
uuagauguuucaacugugcucu

SEQ ID NO: 734772 - RNA, 14 nt, Homo sapiens
uuagauguuucaca

SEQ ID NO: 734773 - RNA, 20 nt, Homo sapiens
uuagauuguuaaaauaacua

SEQ ID NO: 734774 - RNA, 22 nt, Homo sapiens
uuagcagucccuccacauuucc

SEQ ID NO: 734775 - RNA, 16 nt, Homo sapiens
uuagcaucaaguucuc

SEQ ID NO: 734776 - RNA, 17 nt, Homo sapiens
uuagcaugcuacaguua

SEQ ID NO: 734777 - RNA, 22 nt, Homo sapiens
uuagcuaccucacuaugcugcu

SEQ ID NO: 734778 - RNA, 17 nt, Homo sapiens
uuagcugggaagaccaa

SEQ ID NO: 734779 - RNA, 15 nt, Homo sapiens
uuagcuguacuauaa

SEQ ID NO: 734780 - RNA, 18 nt, Homo sapiens
uuaggaaguauggcaaaa

SEQ ID NO: 734781 - RNA, 14 nt, Homo sapiens
uuaggaaucaauga

SEQ ID NO: 734782 - RNA, 21 nt, Homo sapiens
uuaggaccaauaccuccucca

SEQ ID NO: 734783 - RNA, 14 nt, Homo sapiens
uuaggagaaaccag

SEQ ID NO: 734784 - RNA, 17 nt, Homo sapiens
uuaggagugauuacuaa

SEQ ID NO: 734785 - RNA, 17 nt, Homo sapiens
uuaggagugguucucau

SEQ ID NO: 734786 - RNA, 18 nt, Homo sapiens
uuaggauuuucacauucu

SEQ ID NO: 734787 - RNA, 13 nt, Homo sapiens
uuaggcacacaga

SEQ ID NO: 734788 - RNA, 22 nt, Homo sapiens
uuagggauaguacuaagcauuu

SEQ ID NO: 734789 - RNA, 13 nt, Homo sapiens
uuagguagcuuua

SEQ ID NO: 734790 - RNA, 11 nt, Homo sapiens
uuaggugcuga

SEQ ID NO: 734791 - RNA, 21 nt, Homo sapiens
uuaggugucuguccuuuauga

SEQ ID NO: 734792 - RNA, 12 nt, Homo sapiens
uuaguaauuucu

SEQ ID NO: 734793 - RNA, 21 nt, Homo sapiens
uuaguagagacggguuucacc

SEQ ID NO: 734794 - RNA, 18 nt, Homo sapiens
uuaguaugcaguugauaa

SEQ ID NO: 734795 - RNA, 14 nt, Homo sapiens
uuaguauuucacaa

SEQ ID NO: 734796 - RNA, 17 nt, Homo sapiens
uuagucaggaauggcug

SEQ ID NO: 734797 - RNA, 18 nt, Homo sapiens
uuagugaaguugugcaac

SEQ ID NO: 734798 - RNA, 19 nt, Homo sapiens
uuagugaaguugugcaacg

SEQ ID NO: 734799 - RNA, 19 nt, Homo sapiens
uuagugaaugacuuuucuc

SEQ ID NO: 734800 - RNA, 14 nt, Homo sapiens
uuaguggagccagg

SEQ ID NO: 734801 - RNA, 18 nt, Homo sapiens
uuaguggauuacugccau

SEQ ID NO: 734802 - RNA, 13 nt, Homo sapiens
uuaguuccacaaa

SEQ ID NO: 734803 - RNA, 18 nt, Homo sapiens
uuaguugaggccuucuag

SEQ ID NO: 734804 - RNA, 20 nt, Homo sapiens
uuaguuuacaaucagccaca

SEQ ID NO: 734805 - RNA, 14 nt, Homo sapiens
uuaguuucacauug

SEQ ID NO: 734806 - RNA, 11 nt, Homo sapiens
uuaguuucaug

SEQ ID NO: 734807 - RNA, 18 nt, Homo sapiens
uuaguuuucuaguaacua

SEQ ID NO: 734808 - RNA, 18 nt, Homo sapiens
uuaguuuuuaacaaucua

SEQ ID NO: 734809 - RNA, 14 nt, Homo sapiens
uuaguuuuugauca

SEQ ID NO: 734810 - RNA, 13 nt, Homo sapiens
uuauaaaaaaugg

SEQ ID NO: 734811 - RNA, 15 nt, Homo sapiens
uuauaaaaagaauga

SEQ ID NO: 734812 - RNA, 23 nt, Homo sapiens
uuauaaaagaauaaaauugcacu

SEQ ID NO: 734813 - RNA, 16 nt, Homo sapiens
uuauaaacaagaauga

SEQ ID NO: 734814 - RNA, 20 nt, Homo sapiens
uuauaaauucagaacaagca

SEQ ID NO: 734815 - RNA, 13 nt, Homo sapiens
uuauaacaagugu

SEQ ID NO: 734816 - RNA, 14 nt, Homo sapiens
uuauaacauguaaa

SEQ ID NO: 734817 - RNA, 17 nt, Homo sapiens
uuauaagacuacuauac

SEQ ID NO: 734818 - RNA, 14 nt, Homo sapiens
uuauaagacuggaa

SEQ ID NO: 734819 - RNA, 20 nt, Homo sapiens
uuauaauuguucucagaauc

SEQ ID NO: 734820 - RNA, 19 nt, Homo sapiens
uuauacaaaauaagaacga

SEQ ID NO: 734821 - RNA, 14 nt, Homo sapiens
uuauacaauacaga

SEQ ID NO: 734822 - RNA, 15 nt, Homo sapiens
uuauacacaguggau

SEQ ID NO: 734823 - RNA, 23 nt, Homo sapiens
uuauaccugcucuuguucuacug

SEQ ID NO: 734824 - RNA, 14 nt, Homo sapiens
uuauacuacuuugu

SEQ ID NO: 734825 - RNA, 16 nt, Homo sapiens
uuauacuccauacaua

SEQ ID NO: 734826 - RNA, 13 nt, Homo sapiens
uuauagaacaguu

SEQ ID NO: 734827 - RNA, 14 nt, Homo sapiens
uuauagaacaguug

SEQ ID NO: 734828 - RNA, 16 nt, Homo sapiens
uuauagaaguagcaaa

SEQ ID NO: 734829 - RNA, 18 nt, Homo sapiens
uuauaggacgaaugccaa

SEQ ID NO: 734830 - RNA, 20 nt, Homo sapiens
uuauagugaauacugcuaca

SEQ ID NO: 734831 - RNA, 22 nt, Homo sapiens
uguuuuuaaagaaaagcauuca

SEQ ID NO: 734832 - RNA, 14 nt, Homo sapiens
uguuuuugaucaaa

SEQ ID NO: 734833 - RNA, 17 nt, Homo sapiens
uguuuuuuaaagcaagu

SEQ ID NO: 734834 - RNA, 15 nt, Homo sapiens
uguuuuuucuugcca

SEQ ID NO: 734835 - RNA, 22 nt, Homo sapiens
uguuuuuuggugguucugcugu

SEQ ID NO: 734836 - RNA, 22 nt, Homo sapiens
uuaaaaaaaaaaagaacacagg

SEQ ID NO: 734837 - RNA, 22 nt, Homo sapiens
uuaaaaaaaagaauaaagguau

SEQ ID NO: 734838 - RNA, 22 nt, Homo sapiens
uuaaaaaaaauuaaaaccaauu

SEQ ID NO: 734839 - RNA, 14 nt, Homo sapiens
uuaaaaaaacaauc

SEQ ID NO: 734840 - RNA, 22 nt, Homo sapiens
uuaaaaaaacaaucccaaguaa

SEQ ID NO: 734841 - RNA, 14 nt, Homo sapiens
uuaaaaaaacugga

SEQ ID NO: 734842 - RNA, 14 nt, Homo sapiens
uuaaaaaaagaaca

SEQ ID NO: 734843 - RNA, 19 nt, Homo sapiens
uuaaaaaaagaacauaaaa

SEQ ID NO: 734844 - RNA, 14 nt, Homo sapiens
uuaaaaaaauaaca

SEQ ID NO: 734845 - RNA, 15 nt, Homo sapiens
uuaaaaaaauaacau

SEQ ID NO: 734846 - RNA, 21 nt, Homo sapiens
uuaaaaaauacucugcuauuu

SEQ ID NO: 734847 - RNA, 13 nt, Homo sapiens
uuaaaaaaucuca

SEQ ID NO: 734848 - RNA, 22 nt, Homo sapiens
uuaaaaaaucucaaauuuggau

SEQ ID NO: 734849 - RNA, 15 nt, Homo sapiens
uuaaaaacauaacau

SEQ ID NO: 734850 - RNA, 13 nt, Homo sapiens
uuaaaaacuacca

SEQ ID NO: 734851 - RNA, 18 nt, Homo sapiens
uuaaaaacuaccacaugu

SEQ ID NO: 734852 - RNA, 20 nt, Homo sapiens
uuaaaaacuagagcacagaa

SEQ ID NO: 734853 - RNA, 21 nt, Homo sapiens
uuaaaaagccaguuuggguaa

SEQ ID NO: 734854 - RNA, 17 nt, Homo sapiens
uuaaaaauagcaguauu

SEQ ID NO: 734855 - RNA, 13 nt, Homo sapiens
uuaaaaauuguca

SEQ ID NO: 734856 - RNA, 20 nt, Homo sapiens
uuaaaacaaaggaaguucuc

SEQ ID NO: 734857 - RNA, 13 nt, Homo sapiens
uuaaaacacagcu

SEQ ID NO: 734858 - RNA, 13 nt, Homo sapiens
uuaaaacauuucu

SEQ ID NO: 734859 - RNA, 14 nt, Homo sapiens
uuaaaaccaaagag

SEQ ID NO: 734860 - RNA, 14 nt, Homo sapiens
uuaaaagcccuuuu

SEQ ID NO: 734861 - RNA, 18 nt, Homo sapiens
uuaaaauaaaaauuuaau

SEQ ID NO: 734862 - RNA, 17 nt, Homo sapiens
uuaaaauauccugugua

SEQ ID NO: 734863 - RNA, 15 nt, Homo sapiens
uuaaaaucagcuauu

SEQ ID NO: 734864 - RNA, 14 nt, Homo sapiens
uuaaaaucaguauu

SEQ ID NO: 734865 - RNA, 14 nt, Homo sapiens
uuaaaaucugugaa

SEQ ID NO: 734866 - RNA, 13 nt, Homo sapiens
uuaaaaugccaau

SEQ ID NO: 734867 - RNA, 20 nt, Homo sapiens
uuaaaauguacacuggauau

SEQ ID NO: 734868 - RNA, 14 nt, Homo sapiens
uuaaaaugugaaga

SEQ ID NO: 734869 - RNA, 12 nt, Homo sapiens
uuaaaaugugua

SEQ ID NO: 734870 - RNA, 13 nt, Homo sapiens
uuaaaauucaauu

SEQ ID NO: 734871 - RNA, 22 nt, Homo sapiens
uuaaaauucuccuguaacucaa

SEQ ID NO: 734872 - RNA, 11 nt, Homo sapiens
uuaaacacauu

SEQ ID NO: 734873 - RNA, 15 nt, Homo sapiens
uuaaaccacuguaua

SEQ ID NO: 734874 - RNA, 18 nt, Homo sapiens
uuaaaccucucuucuacc

SEQ ID NO: 734875 - RNA, 16 nt, Homo sapiens
uuaaacuccaaaugag

SEQ ID NO: 734876 - RNA, 17 nt, Homo sapiens
uuaaacuggaacaugcu

SEQ ID NO: 734877 - RNA, 20 nt, Homo sapiens
uuaaacuguguggacuguga

SEQ ID NO: 734878 - RNA, 23 nt, Homo sapiens
uuaaacuuaagggaaaaguucuc

SEQ ID NO: 734879 - RNA, 23 nt, Homo sapiens
uuaaacuuucaauugucacuuuu

SEQ ID NO: 734880 - RNA, 17 nt, Homo sapiens
uuaaagacucaaggugg

SEQ ID NO: 734881 - RNA, 18 nt, Homo sapiens
uuaaagacucaagguggu

SEQ ID NO: 734882 - RNA, 16 nt, Homo sapiens
uuaaagaugcacagaa

SEQ ID NO: 734883 - RNA, 20 nt, Homo sapiens
uuaaagcaucuauaaggugc

SEQ ID NO: 734884 - RNA, 18 nt, Homo sapiens
uuaaagcuaaggaccuua

SEQ ID NO: 734885 - RNA, 15 nt, Homo sapiens
uuaaagcugcuguca

SEQ ID NO: 734886 - RNA, 22 nt, Homo sapiens
uuaaaggaaaaucacaucucca

SEQ ID NO: 734887 - RNA, 13 nt, Homo sapiens
uuaaaguaccugu

SEQ ID NO: 734888 - RNA, 18 nt, Homo sapiens
uuaaaguaccuguaguga

SEQ ID NO: 734889 - RNA, 23 nt, Homo sapiens
uuaaagugaacacacacaaggga

SEQ ID NO: 734890 - RNA, 15 nt, Homo sapiens
uuaaaguucauugca

SEQ ID NO: 734891 - RNA, 16 nt, Homo sapiens
uuaaauaaaagcacaa

SEQ ID NO: 734892 - RNA, 21 nt, Homo sapiens
uuaaauaaaggaaauuuagau

SEQ ID NO: 734893 - RNA, 21 nt, Homo sapiens
uuaaauaaagucucucugacu

SEQ ID NO: 734894 - RNA, 17 nt, Homo sapiens
uuaaauaauuucuacuc

SEQ ID NO: 734895 - RNA, 14 nt, Homo sapiens
uuaaauaugcaucu

SEQ ID NO: 734896 - RNA, 16 nt, Homo sapiens
uuaaaucaaaagggag

SEQ ID NO: 734897 - RNA, 17 nt, Homo sapiens
uuaaauccaacuuucac

SEQ ID NO: 734898 - RNA, 16 nt, Homo sapiens
uuaaaucuaugaagua

SEQ ID NO: 734899 - RNA, 16 nt, Homo sapiens
uuaaaugccuuguaua

SEQ ID NO: 734900 - RNA, 18 nt, Homo sapiens
uuaaauguccguguaaaa

SEQ ID NO: 734901 - RNA, 23 nt, Homo sapiens
uuaaauguuuuuuuuaaucauca

SEQ ID NO: 734902 - RNA, 17 nt, Homo sapiens
uuaaauuacaauuuuau

SEQ ID NO: 734903 - RNA, 20 nt, Homo sapiens
uuaaauuauggaacugcuaa

SEQ ID NO: 734904 - RNA, 20 nt, Homo sapiens
uuaaauugaauaaaauacuc

SEQ ID NO: 734905 - RNA, 17 nt, Homo sapiens
uuaaauugcuugaaugu

SEQ ID NO: 734906 - RNA, 21 nt, Homo sapiens
uuaaauugggcuucaaucacu

SEQ ID NO: 734907 - RNA, 21 nt, Homo sapiens
uuaaauuucuccaguggauuc

SEQ ID NO: 734908 - RNA, 21 nt, Homo sapiens
uuaaauuugagaaucaaacau

SEQ ID NO: 734909 - RNA, 17 nt, Homo sapiens
uuaaauuugauuuccau

SEQ ID NO: 734910 - RNA, 17 nt, Homo sapiens
uuaaauuuuaacuaaau

SEQ ID NO: 734911 - RNA, 20 nt, Homo sapiens
uuaacaaaucuaaucucuua

SEQ ID NO: 734912 - RNA, 15 nt, Homo sapiens
uuaacaaaugagcca

SEQ ID NO: 734913 - RNA, 15 nt, Homo sapiens
uuaacacacuggcca

SEQ ID NO: 734914 - RNA, 14 nt, Homo sapiens
uuaacacaucucaa

SEQ ID NO: 734915 - RNA, 21 nt, Homo sapiens
uuaacacuuuggacuucucug

SEQ ID NO: 734916 - RNA, 18 nt, Homo sapiens
uuaacagguaugaaccac

SEQ ID NO: 734917 - RNA, 19 nt, Homo sapiens
uuaacaucauugcauaaca

SEQ ID NO: 734918 - RNA, 18 nt, Homo sapiens
uuaacaugggcucuucac

SEQ ID NO: 734919 - RNA, 20 nt, Homo sapiens
uuaaccacauuucugaaugu

SEQ ID NO: 734920 - RNA, 17 nt, Homo sapiens
uuaacccauuugucucu

SEQ ID NO: 734921 - RNA, 17 nt, Homo sapiens
uuaaccccauguccuca

SEQ ID NO: 734922 - RNA, 13 nt, Homo sapiens
uuaaccuuuccag

SEQ ID NO: 734923 - RNA, 16 nt, Homo sapiens
uuaaccuuugcuaugu

SEQ ID NO: 734924 - RNA, 22 nt, Homo sapiens
uuaacguaacucuuucuaugcc

SEQ ID NO: 734925 - RNA, 16 nt, Homo sapiens
uuaacgucaucucagg

SEQ ID NO: 734926 - RNA, 19 nt, Homo sapiens
uuaacucccuccaccagcc

SEQ ID NO: 734927 - RNA, 18 nt, Homo sapiens
uuaacucuuuuggacaaa

SEQ ID NO: 734928 - RNA, 17 nt, Homo sapiens
uuaacugcauuuuacca

SEQ ID NO: 734929 - RNA, 15 nt, Homo sapiens
uuaacugccaagaaa

SEQ ID NO: 734930 - RNA, 21 nt, Homo sapiens
uuaacugguauauacauauau

SEQ ID NO: 734931 - RNA, 22 nt, Homo sapiens
uuaacugugaaauaccacaagc

SEQ ID NO: 734932 - RNA, 18 nt, Homo sapiens
uuaacuuccaauuuacau

SEQ ID NO: 734933 - RNA, 20 nt, Homo sapiens
ugaaggcaguggcaggggag

SEQ ID NO: 734934 - RNA, 17 nt, Homo sapiens
ugaaggcaucaaauaaa

SEQ ID NO: 734935 - RNA, 19 nt, Homo sapiens
ugaaggcgggccugcaagc

SEQ ID NO: 734936 - RNA, 13 nt, Homo sapiens
ugaaggcugagug

SEQ ID NO: 734937 - RNA, 17 nt, Homo sapiens
ugaaggcugaguguccg

SEQ ID NO: 734938 - RNA, 15 nt, Homo sapiens
ugaagggguucucac

SEQ ID NO: 734939 - RNA, 22 nt, Homo sapiens
ugaagguaacuagaaagugagu

SEQ ID NO: 734940 - RNA, 17 nt, Homo sapiens
ugaagguccccuggcag

SEQ ID NO: 734941 - RNA, 12 nt, Homo sapiens
ugaaggugaccu

SEQ ID NO: 734942 - RNA, 18 nt, Homo sapiens
ugaaggugauucaccaaa

SEQ ID NO: 734943 - RNA, 16 nt, Homo sapiens
ugaaguaaaauugagu

SEQ ID NO: 734944 - RNA, 15 nt, Homo sapiens
ugaaguaugccuuga

SEQ ID NO: 734945 - RNA, 15 nt, Homo sapiens
ugaaguauuucucac

SEQ ID NO: 734946 - RNA, 18 nt, Homo sapiens
ugaagucagccacacugg

SEQ ID NO: 734947 - RNA, 17 nt, Homo sapiens
ugaagucuucuccucca

SEQ ID NO: 734948 - RNA, 18 nt, Homo sapiens
ugaagucuugcucugcca

SEQ ID NO: 734949 - RNA, 14 nt, Homo sapiens
ugaagugaaucuga

SEQ ID NO: 734950 - RNA, 18 nt, Homo sapiens
ugaagugcccuucccuug

SEQ ID NO: 734951 - RNA, 21 nt, Homo sapiens
ugaagugccuuuuuccuagaa

SEQ ID NO: 734952 - RNA, 12 nt, Homo sapiens
ugaagugucaca

SEQ ID NO: 734953 - RNA, 16 nt, Homo sapiens
ugaaguuaugcuguca

SEQ ID NO: 734954 - RNA, 22 nt, Homo sapiens
ugaaguuauggcuucacauuca

SEQ ID NO: 734955 - RNA, 23 nt, Homo sapiens
ugaaguuauggcuucacauucau

SEQ ID NO: 734956 - RNA, 16 nt, Homo sapiens
ugaaguucaaaugccc

SEQ ID NO: 734957 - RNA, 14 nt, Homo sapiens
ugaaguugugcaac

SEQ ID NO: 734958 - RNA, 14 nt, Homo sapiens
ugaaguuuuacugu

SEQ ID NO: 734959 - RNA, 17 nt, Homo sapiens
ugaaguuuuacugucua

SEQ ID NO: 734960 - RNA, 23 nt, Homo sapiens
ugaaguuuugcaaauauaaucca

SEQ ID NO: 734961 - RNA, 13 nt, Homo sapiens
ugaauaaccacuu

SEQ ID NO: 734962 - RNA, 16 nt, Homo sapiens
ugaauaaccacuuaaa

SEQ ID NO: 734963 - RNA, 15 nt, Homo sapiens
ugaauaacuaugcca

SEQ ID NO: 734964 - RNA, 20 nt, Homo sapiens
ugaauacauuuccaaaaugg

SEQ ID NO: 734965 - RNA, 13 nt, Homo sapiens
ugaauacugggaa

SEQ ID NO: 734966 - RNA, 17 nt, Homo sapiens
ugaauacugggaaucaa

SEQ ID NO: 734967 - RNA, 15 nt, Homo sapiens
ugaauagacuaucua

SEQ ID NO: 734968 - RNA, 15 nt, Homo sapiens
ugaauagauggaauu

SEQ ID NO: 734969 - RNA, 16 nt, Homo sapiens
ugaauaggaugauucc

SEQ ID NO: 734970 - RNA, 15 nt, Homo sapiens
ugaauaguugcuuaa

SEQ ID NO: 734971 - RNA, 21 nt, Homo sapiens
ugaauauaaauguuuuacuca

SEQ ID NO: 734972 - RNA, 22 nt, Homo sapiens
ugaauauaaauuuguguucuca

SEQ ID NO: 734973 - RNA, 14 nt, Homo sapiens
ugaauaugacaaag

SEQ ID NO: 734974 - RNA, 16 nt, Homo sapiens
ugaauauucaacagcu

SEQ ID NO: 734975 - RNA, 20 nt, Homo sapiens
ugaauauuuauauuucacua

SEQ ID NO: 734976 - RNA, 21 nt, Homo sapiens
ugaauauuuguuauguagaua

SEQ ID NO: 734977 - RNA, 14 nt, Homo sapiens
ugaaucaagcaaua

SEQ ID NO: 734978 - RNA, 19 nt, Homo sapiens
ugaaucacuuaaaugucac

SEQ ID NO: 734979 - RNA, 17 nt, Homo sapiens
ugaaucagacccuaccc

SEQ ID NO: 734980 - RNA, 20 nt, Homo sapiens
ugaaucagcugcugacuggc

SEQ ID NO: 734981 - RNA, 16 nt, Homo sapiens
ugaauccaacguguaa

SEQ ID NO: 734982 - RNA, 23 nt, Homo sapiens
ugaauccacccaaaucuauuguu

SEQ ID NO: 734983 - RNA, 18 nt, Homo sapiens
ugaaugaguaaacugaga

SEQ ID NO: 734984 - RNA, 15 nt, Homo sapiens
ugaaugauacccuga

SEQ ID NO: 734985 - RNA, 16 nt, Homo sapiens
ugaaugauccugucuc

SEQ ID NO: 734986 - RNA, 12 nt, Homo sapiens
ugaaugaugcuu

SEQ ID NO: 734987 - RNA, 14 nt, Homo sapiens
ugaaugcaaaguag

SEQ ID NO: 734988 - RNA, 19 nt, Homo sapiens
ugaaugcaccauggucaaa

SEQ ID NO: 734989 - RNA, 21 nt, Homo sapiens
ugaaugcagggaaugcaaucc

SEQ ID NO: 734990 - RNA, 19 nt, Homo sapiens
ugaaugccggggacagaga

SEQ ID NO: 734991 - RNA, 15 nt, Homo sapiens
ugaaugcggcccaac

SEQ ID NO: 734992 - RNA, 23 nt, Homo sapiens
ugaaugcuccauuaauccaggga

SEQ ID NO: 734993 - RNA, 14 nt, Homo sapiens
ugaaugcugccaca

SEQ ID NO: 734994 - RNA, 19 nt, Homo sapiens
ugaaugguuucaacaaaga

SEQ ID NO: 734995 - RNA, 19 nt, Homo sapiens
ugaaugucuuacugugauc

SEQ ID NO: 734996 - RNA, 22 nt, Homo sapiens
ugaaugugcuggugaacacugu

SEQ ID NO: 734997 - RNA, 17 nt, Homo sapiens
ugaaugugguuacuucc

SEQ ID NO: 734998 - RNA, 12 nt, Homo sapiens
ugaauguucaau

SEQ ID NO: 734999 - RNA, 19 nt, Homo sapiens
ugaauguuuaccaugaaga

SEQ ID NO: 735000 - RNA, 15 nt, Homo sapiens
ugaauuaaucaucua

SEQ ID NO: 735001 - RNA, 18 nt, Homo sapiens
ugaauuauauguucagau

SEQ ID NO: 735002 - RNA, 20 nt, Homo sapiens
ugaauuccauggaauuucua

SEQ ID NO: 735003 - RNA, 17 nt, Homo sapiens
ugaauugggaucugauu

SEQ ID NO: 735004 - RNA, 17 nt, Homo sapiens
ugaauuguuaauucaca

SEQ ID NO: 735005 - RNA, 22 nt, Homo sapiens
auaaaggcagcugccucugcuc

SEQ ID NO: 735006 - RNA, 14 nt, Homo sapiens
auaaaggucccuua

SEQ ID NO: 735007 - RNA, 20 nt, Homo sapiens
auaaaguaccacacauauug

SEQ ID NO: 735008 - RNA, 11 nt, Homo sapiens
auaaagucaac

SEQ ID NO: 735009 - RNA, 14 nt, Homo sapiens
auaaagucucucug

SEQ ID NO: 735010 - RNA, 14 nt, Homo sapiens
auaaagugacccug

SEQ ID NO: 735011 - RNA, 18 nt, Homo sapiens
auaaaguguaaguucaca

SEQ ID NO: 735012 - RNA, 15 nt, Homo sapiens
auaaaguuacuugaa

SEQ ID NO: 735013 - RNA, 16 nt, Homo sapiens
auaaaguugcugugaa

SEQ ID NO: 735014 - RNA, 17 nt, Homo sapiens
auaaaguugcugugaau

SEQ ID NO: 735015 - RNA, 17 nt, Homo sapiens
auaaaguuggugacaga

SEQ ID NO: 735016 - RNA, 18 nt, Homo sapiens
auaaauacugcaaaucag

SEQ ID NO: 735017 - RNA, 19 nt, Homo sapiens
auaaauauaucuaccccag

SEQ ID NO: 735018 - RNA, 17 nt, Homo sapiens
auaaauauuacagugaa

SEQ ID NO: 735019 - RNA, 21 nt, Homo sapiens
auaaauauuucucaacugagg

SEQ ID NO: 735020 - RNA, 21 nt, Homo sapiens
auaaaucauuaagacaacuga

SEQ ID NO: 735021 - RNA, 12 nt, Homo sapiens
auaaauccauca

SEQ ID NO: 735022 - RNA, 21 nt, Homo sapiens
auaaaucguccucccaggcca

SEQ ID NO: 735023 - RNA, 23 nt, Homo sapiens
auaaaucguccucccaggccagg

SEQ ID NO: 735024 - RNA, 17 nt, Homo sapiens
auaaaucuaauaauuau

SEQ ID NO: 735025 - RNA, 17 nt, Homo sapiens
auaaaugccagagccaa

SEQ ID NO: 735026 - RNA, 16 nt, Homo sapiens
auaaaugggaaaucag

SEQ ID NO: 735027 - RNA, 16 nt, Homo sapiens
auaaauguaccagaga

SEQ ID NO: 735028 - RNA, 23 nt, Homo sapiens
auaaauguaccagagagaguugu

SEQ ID NO: 735029 - RNA, 20 nt, Homo sapiens
auaaauuacuaucuguugaa

SEQ ID NO: 735030 - RNA, 21 nt, Homo sapiens
auaaauuauuaguuuacauca

SEQ ID NO: 735031 - RNA, 18 nt, Homo sapiens
auaaauucagaacaagca

SEQ ID NO: 735032 - RNA, 14 nt, Homo sapiens
auaaauucuacucu

SEQ ID NO: 735033 - RNA, 13 nt, Homo sapiens
auaaauuugcacu

SEQ ID NO: 735034 - RNA, 20 nt, Homo sapiens
auaaauuuggacugucuaua

SEQ ID NO: 735035 - RNA, 15 nt, Homo sapiens
auaacaaagcccuua

SEQ ID NO: 735036 - RNA, 13 nt, Homo sapiens
auaacaagccaaa

SEQ ID NO: 735037 - RNA, 13 nt, Homo sapiens
auaacaaucacaa

SEQ ID NO: 735038 - RNA, 13 nt, Homo sapiens
auaacagcauucu

SEQ ID NO: 735039 - RNA, 16 nt, Homo sapiens
auaacauccagagcuu

SEQ ID NO: 735040 - RNA, 12 nt, Homo sapiens
auaaccacuuaa

SEQ ID NO: 735041 - RNA, 20 nt, Homo sapiens
auaaccccagcucccuagga

SEQ ID NO: 735042 - RNA, 16 nt, Homo sapiens
auaacuaaacuaacga

SEQ ID NO: 735043 - RNA, 11 nt, Homo sapiens
auaacuaccuu

SEQ ID NO: 735044 - RNA, 14 nt, Homo sapiens
auaacuaccuucca

SEQ ID NO: 735045 - RNA, 13 nt, Homo sapiens
auaacuaugccag

SEQ ID NO: 735046 - RNA, 22 nt, Homo sapiens
auaacuauugauauaauuucca

SEQ ID NO: 735047 - RNA, 17 nt, Homo sapiens
auaacucggauuccagc

SEQ ID NO: 735048 - RNA, 23 nt, Homo sapiens
auaacucuacccuggcacuauaa

SEQ ID NO: 735049 - RNA, 14 nt, Homo sapiens
auaacucuccagua

SEQ ID NO: 735050 - RNA, 17 nt, Homo sapiens
auaacucugcacuacuc

SEQ ID NO: 735051 - RNA, 18 nt, Homo sapiens
auaacugaaaaugugcua

SEQ ID NO: 735052 - RNA, 13 nt, Homo sapiens
ucuaccagucuau

SEQ ID NO: 735053 - RNA, 23 nt, Homo sapiens
ucuaccagucuauuuccacugaa

SEQ ID NO: 735054 - RNA, 20 nt, Homo sapiens
ucuaccucuuggcugccuug

SEQ ID NO: 735055 - RNA, 15 nt, Homo sapiens
ucuaccuguacacau

SEQ ID NO: 735056 - RNA, 16 nt, Homo sapiens
ucuaccuuuacuacau

SEQ ID NO: 735057 - RNA, 15 nt, Homo sapiens
ucuacuaaaaacaca

SEQ ID NO: 735058 - RNA, 15 nt, Homo sapiens
ucuacuaaaaauaca

SEQ ID NO: 735059 - RNA, 21 nt, Homo sapiens
ucuacuacaaacuucaaagag

SEQ ID NO: 735060 - RNA, 20 nt, Homo sapiens
ucuacuacaugugacuggca

SEQ ID NO: 735061 - RNA, 13 nt, Homo sapiens
ucuacucuugaga

SEQ ID NO: 735062 - RNA, 19 nt, Homo sapiens
ucuacugaaaauacaaaaa

SEQ ID NO: 735063 - RNA, 16 nt, Homo sapiens
ucuacugaggugcuau

SEQ ID NO: 735064 - RNA, 14 nt, Homo sapiens
ucuacugcaagagc

SEQ ID NO: 735065 - RNA, 18 nt, Homo sapiens
ucuacuggucuuguggaa

SEQ ID NO: 735066 - RNA, 20 nt, Homo sapiens
ucuagaaagcuuugaaugca

SEQ ID NO: 735067 - RNA, 22 nt, Homo sapiens
ucuagaacacaggcaaaauccu

SEQ ID NO: 735068 - RNA, 12 nt, Homo sapiens
ucuagaagccaa

SEQ ID NO: 735069 - RNA, 20 nt, Homo sapiens
ucuagacauggagguucuaa

SEQ ID NO: 735070 - RNA, 20 nt, Homo sapiens
ucuagacuagcaaucucuuc

SEQ ID NO: 735071 - RNA, 17 nt, Homo sapiens
ucuagagaacacgucuu

SEQ ID NO: 735072 - RNA, 17 nt, Homo sapiens
ucuagagacacauugga

SEQ ID NO: 735073 - RNA, 18 nt, Homo sapiens
ucuagauccugcacccca

SEQ ID NO: 735074 - RNA, 14 nt, Homo sapiens
ucuagaucucagcc

SEQ ID NO: 735075 - RNA, 15 nt, Homo sapiens
ucuagcaaauaugcu

SEQ ID NO: 735076 - RNA, 20 nt, Homo sapiens
ucuagcaagauagucuucag

SEQ ID NO: 735077 - RNA, 15 nt, Homo sapiens
ucuagcugugggggu

SEQ ID NO: 735078 - RNA, 13 nt, Homo sapiens
ucuaggaugugau

SEQ ID NO: 735079 - RNA, 15 nt, Homo sapiens
ucuaggaugugauga

SEQ ID NO: 735080 - RNA, 19 nt, Homo sapiens
ucuaggcuggaagagccaa

SEQ ID NO: 735081 - RNA, 18 nt, Homo sapiens
ucuagggaaucuggauua

SEQ ID NO: 735082 - RNA, 21 nt, Homo sapiens
ucuaguaagaugcacugaaaa

SEQ ID NO: 735083 - RNA, 17 nt, Homo sapiens
ucuagugaaugaaucuc

SEQ ID NO: 735084 - RNA, 20 nt, Homo sapiens
ucuaguucaaauuauuugga

SEQ ID NO: 735085 - RNA, 13 nt, Homo sapiens
ucuauaaauaacc

SEQ ID NO: 735086 - RNA, 20 nt, Homo sapiens
ucuauaauggaaacauuuac

SEQ ID NO: 735087 - RNA, 14 nt, Homo sapiens
ucuauaauuuaccu

SEQ ID NO: 735088 - RNA, 19 nt, Homo sapiens
ucuauaauuuugccuuuaa

SEQ ID NO: 735089 - RNA, 23 nt, Homo sapiens
ucuauaccaaccaaaccaauuca

SEQ ID NO: 735090 - RNA, 16 nt, Homo sapiens
ucuauaccaauaaagu

SEQ ID NO: 735091 - RNA, 13 nt, Homo sapiens
ucuauaccugugu

SEQ ID NO: 735092 - RNA, 15 nt, Homo sapiens
ucuauagaacaucca

SEQ ID NO: 735093 - RNA, 16 nt, Homo sapiens
ucuauaggaacauaug

SEQ ID NO: 735094 - RNA, 13 nt, Homo sapiens
ucuauauucucau

SEQ ID NO: 735095 - RNA, 14 nt, Homo sapiens
ucuauauuucauau

SEQ ID NO: 735096 - RNA, 15 nt, Homo sapiens
ucuaucaacuuuaau

SEQ ID NO: 735097 - RNA, 16 nt, Homo sapiens
ucuauccuuuugccug

SEQ ID NO: 735098 - RNA, 19 nt, Homo sapiens
ucuaucugcuuaugcaguu

SEQ ID NO: 735099 - RNA, 17 nt, Homo sapiens
ucuaucuuuuccuucag

SEQ ID NO: 735100 - RNA, 20 nt, Homo sapiens
ucuaugaacuuagaguuuac

SEQ ID NO: 735101 - RNA, 19 nt, Homo sapiens
ucuaugaaguugcuguuua

SEQ ID NO: 735102 - RNA, 21 nt, Homo sapiens
ucuaugccagcucagucccau

SEQ ID NO: 735103 - RNA, 23 nt, Homo sapiens
ucuauggcaguccagccagcucc

SEQ ID NO: 735104 - RNA, 13 nt, Homo sapiens
ucuauguacugua

SEQ ID NO: 735105 - RNA, 13 nt, Homo sapiens
ucuauguauauuc

SEQ ID NO: 735106 - RNA, 16 nt, Homo sapiens
ucuauguauucaagua

SEQ ID NO: 735107 - RNA, 11 nt, Homo sapiens
ucuauguccaa

SEQ ID NO: 735108 - RNA, 14 nt, Homo sapiens
ucuauguggcugua

SEQ ID NO: 735109 - RNA, 14 nt, Homo sapiens
ucuauuaaucaccu

SEQ ID NO: 735110 - RNA, 14 nt, Homo sapiens
ucuauuauacugua

SEQ ID NO: 735111 - RNA, 13 nt, Homo sapiens
ucuauucuaagua

SEQ ID NO: 735112 - RNA, 12 nt, Homo sapiens
ucuauucuagcc

SEQ ID NO: 735113 - RNA, 21 nt, Homo sapiens
ucuauugcucaucagcuuuau

SEQ ID NO: 735114 - RNA, 23 nt, Homo sapiens
ucuauugcuucaccauggccuua

SEQ ID NO: 735115 - RNA, 16 nt, Homo sapiens
ucuauuuaacaacugg

SEQ ID NO: 735116 - RNA, 23 nt, Homo sapiens
ucuauuuaacaacugggucaugu

SEQ ID NO: 735117 - RNA, 14 nt, Homo sapiens
ucuauuuguacaau

SEQ ID NO: 735118 - RNA, 16 nt, Homo sapiens
ucucaaaacaauauua

SEQ ID NO: 735119 - RNA, 11 nt, Homo sapiens
ucucaaaagga

SEQ ID NO: 735120 - RNA, 22 nt, Homo sapiens
ucucaaaccaagcaaaggaagg

SEQ ID NO: 735121 - RNA, 16 nt, Homo sapiens
ucucucccagguccca

SEQ ID NO: 735122 - RNA, 23 nt, Homo sapiens
ucucucccaggucccagccccuu

SEQ ID NO: 735123 - RNA, 20 nt, Homo sapiens
ucucucggcuccccaugugu

SEQ ID NO: 735124 - RNA, 15 nt, Homo sapiens
ucucucuaccuccac

SEQ ID NO: 735125 - RNA, 15 nt, Homo sapiens
ucucucugcaagaca

SEQ ID NO: 735126 - RNA, 12 nt, Homo sapiens
ucucucugggcu

SEQ ID NO: 735127 - RNA, 21 nt, Homo sapiens
ucucugagucaaauccagugg

SEQ ID NO: 735128 - RNA, 20 nt, Homo sapiens
ucucugcagaaacuacugac

SEQ ID NO: 735129 - RNA, 17 nt, Homo sapiens
ucucugcagacuuccca

SEQ ID NO: 735130 - RNA, 13 nt, Homo sapiens
ucucugccuguga

SEQ ID NO: 735131 - RNA, 18 nt, Homo sapiens
ucucugcuccaccacauc

SEQ ID NO: 735132 - RNA, 18 nt, Homo sapiens
ucucugcuugcuuggccc

SEQ ID NO: 735133 - RNA, 21 nt, Homo sapiens
ucucuggcugucugucugcag

SEQ ID NO: 735134 - RNA, 22 nt, Homo sapiens
ucucugggaaucaacagcauau

SEQ ID NO: 735135 - RNA, 16 nt, Homo sapiens
ucucugguuuacuuca

SEQ ID NO: 735136 - RNA, 22 nt, Homo sapiens
ucucugucccuugcuguaugcu

SEQ ID NO: 735137 - RNA, 13 nt, Homo sapiens
ucucugugccauc

SEQ ID NO: 735138 - RNA, 14 nt, Homo sapiens
ucucugugccuucg

SEQ ID NO: 735139 - RNA, 16 nt, Homo sapiens
ucucugugugcacaaa

SEQ ID NO: 735140 - RNA, 14 nt, Homo sapiens
ucucuuaauuuuuc

SEQ ID NO: 735141 - RNA, 15 nt, Homo sapiens
ucucuuagcaacuca

SEQ ID NO: 735142 - RNA, 18 nt, Homo sapiens
ucucuucagaaaacccuu

SEQ ID NO: 735143 - RNA, 23 nt, Homo sapiens
ucucuucagucucuauaccaaua

SEQ ID NO: 735144 - RNA, 15 nt, Homo sapiens
ucucuucccagugaa

SEQ ID NO: 735145 - RNA, 16 nt, Homo sapiens
ucucuucggaagaccu

SEQ ID NO: 735146 - RNA, 22 nt, Homo sapiens
ucucuucuuuuggcuuccauga

SEQ ID NO: 735147 - RNA, 17 nt, Homo sapiens
ucucuugacguuuacau

SEQ ID NO: 735148 - RNA, 20 nt, Homo sapiens
ucucuugagauaagguuuua

SEQ ID NO: 735149 - RNA, 19 nt, Homo sapiens
ucucuugccauuuguagcu

SEQ ID NO: 735150 - RNA, 17 nt, Homo sapiens
ucucuugcuaccuguga

SEQ ID NO: 735151 - RNA, 20 nt, Homo sapiens
ucucuuucacauuguuugcu

SEQ ID NO: 735152 - RNA, 14 nt, Homo sapiens
ucucuuucugcaaa

SEQ ID NO: 735153 - RNA, 12 nt, Homo sapiens
ucucuuugauaa

SEQ ID NO: 735154 - RNA, 14 nt, Homo sapiens
ucucuuuguaaaac

SEQ ID NO: 735155 - RNA, 12 nt, Homo sapiens
ucugaaacuggg

SEQ ID NO: 735156 - RNA, 17 nt, Homo sapiens
ucugaaaggauguggaa

SEQ ID NO: 735157 - RNA, 18 nt, Homo sapiens
ucugaaauaggaaacaag

SEQ ID NO: 735158 - RNA, 19 nt, Homo sapiens
ucugaaaucuccuuuagcc

SEQ ID NO: 735159 - RNA, 17 nt, Homo sapiens
ucugaacuacacugcau

SEQ ID NO: 735160 - RNA, 19 nt, Homo sapiens
ucugaacucaaacugagga

SEQ ID NO: 735161 - RNA, 18 nt, Homo sapiens
ucugaagaaacuucccaa

SEQ ID NO: 735162 - RNA, 15 nt, Homo sapiens
ucugaagacagucuu

SEQ ID NO: 735163 - RNA, 23 nt, Homo sapiens
ucugaagcccucccagguguuaa

SEQ ID NO: 735164 - RNA, 23 nt, Homo sapiens
ucugaaguagccugaucuuucua

SEQ ID NO: 735165 - RNA, 12 nt, Homo sapiens
ucugaauauucu

SEQ ID NO: 735166 - RNA, 15 nt, Homo sapiens
ucugaauauucuaga

SEQ ID NO: 735167 - RNA, 13 nt, Homo sapiens
ucugaaucagcca

SEQ ID NO: 735168 - RNA, 14 nt, Homo sapiens
auacccagugaugu

SEQ ID NO: 735169 - RNA, 15 nt, Homo sapiens
auacccauauguccu

SEQ ID NO: 735170 - RNA, 16 nt, Homo sapiens
auacccaugcuuuguu

SEQ ID NO: 735171 - RNA, 15 nt, Homo sapiens
auaccucaguuugca

SEQ ID NO: 735172 - RNA, 20 nt, Homo sapiens
auaccuggcccugugccuug

SEQ ID NO: 735173 - RNA, 13 nt, Homo sapiens
auaccuggcuuuu

SEQ ID NO: 735174 - RNA, 19 nt, Homo sapiens
auaccuggcuuuuacuuua

SEQ ID NO: 735175 - RNA, 21 nt, Homo sapiens
auaccuguugagacugauuca

SEQ ID NO: 735176 - RNA, 12 nt, Homo sapiens
auaccuuaucca

SEQ ID NO: 735177 - RNA, 19 nt, Homo sapiens
auaccuuccccacaucuga

SEQ ID NO: 735178 - RNA, 19 nt, Homo sapiens
auacgaaacacaaaccaca

SEQ ID NO: 735179 - RNA, 20 nt, Homo sapiens
auacgcaucagacagaugga

SEQ ID NO: 735180 - RNA, 21 nt, Homo sapiens
auacgccuguaguccuagcca

SEQ ID NO: 735181 - RNA, 19 nt, Homo sapiens
auacggcccaugcaauuuu

SEQ ID NO: 735182 - RNA, 19 nt, Homo sapiens
auacggcuuuuccaaugau

SEQ ID NO: 735183 - RNA, 13 nt, Homo sapiens
auacguucagagg

SEQ ID NO: 735184 - RNA, 18 nt, Homo sapiens
auacuaagggaagaaaca

SEQ ID NO: 735185 - RNA, 20 nt, Homo sapiens
auacuagaguugauuauaga

SEQ ID NO: 735186 - RNA, 15 nt, Homo sapiens
auacuauccaguuac

SEQ ID NO: 735187 - RNA, 18 nt, Homo sapiens
auacuauugaaguaugua

SEQ ID NO: 735188 - RNA, 20 nt, Homo sapiens
auacuauugaaguauguagu

SEQ ID NO: 735189 - RNA, 12 nt, Homo sapiens
auacucauuccu

SEQ ID NO: 735190 - RNA, 21 nt, Homo sapiens
auacuccaacugaaauguuaa

SEQ ID NO: 735191 - RNA, 14 nt, Homo sapiens
auacuccugucacc

SEQ ID NO: 735192 - RNA, 18 nt, Homo sapiens
auacucucaccauuugga

SEQ ID NO: 735193 - RNA, 12 nt, Homo sapiens
auacucugcuau

SEQ ID NO: 735194 - RNA, 21 nt, Homo sapiens
auacucuuuuuucauggacac

SEQ ID NO: 735195 - RNA, 17 nt, Homo sapiens
auacugcauuuacagug

SEQ ID NO: 735196 - RNA, 14 nt, Homo sapiens
auacuggaaaccua

SEQ ID NO: 735197 - RNA, 16 nt, Homo sapiens
auacuggacucaggaa

SEQ ID NO: 735198 - RNA, 17 nt, Homo sapiens
auacugggaaucaagac

SEQ ID NO: 735199 - RNA, 22 nt, Homo sapiens
auacuggguucuuaguugacaa

SEQ ID NO: 735200 - RNA, 19 nt, Homo sapiens
auacuguaacauucaggaa

SEQ ID NO: 735201 - RNA, 14 nt, Homo sapiens
auacugucaaacaa

SEQ ID NO: 735202 - RNA, 18 nt, Homo sapiens
auacuguuuccuaugaca

SEQ ID NO: 735203 - RNA, 22 nt, Homo sapiens
auacuguuuccuaugacauuac

SEQ ID NO: 735204 - RNA, 15 nt, Homo sapiens
auacuuaaugcauau

SEQ ID NO: 735205 - RNA, 13 nt, Homo sapiens
auacuuacuauaa

SEQ ID NO: 735206 - RNA, 18 nt, Homo sapiens
auacuuacuauaauuuga

SEQ ID NO: 735207 - RNA, 13 nt, Homo sapiens
auacuucauuaaa

SEQ ID NO: 735208 - RNA, 13 nt, Homo sapiens
auacuucauucuc

SEQ ID NO: 735209 - RNA, 22 nt, Homo sapiens
auacuugagcgcugcugaaaag

SEQ ID NO: 735210 - RNA, 20 nt, Homo sapiens
auacuuggaugcagcucuug

SEQ ID NO: 735211 - RNA, 18 nt, Homo sapiens
auacuuuaauguuuuaac

SEQ ID NO: 735212 - RNA, 13 nt, Homo sapiens
auacuuuacaugg

SEQ ID NO: 735213 - RNA, 13 nt, Homo sapiens
auacuuucaggca

SEQ ID NO: 735214 - RNA, 16 nt, Homo sapiens
auacuuugcaauccaa

SEQ ID NO: 735215 - RNA, 18 nt, Homo sapiens
auacuuugcaauccaaau

SEQ ID NO: 735216 - RNA, 18 nt, Homo sapiens
auacuuuggggacuugua

SEQ ID NO: 735217 - RNA, 21 nt, Homo sapiens
auacuuuuaaagccuauucac

SEQ ID NO: 735218 - RNA, 19 nt, Homo sapiens
auacuuuuuucuaguuuca

SEQ ID NO: 735219 - RNA, 13 nt, Homo sapiens
auagaaaccucuc

SEQ ID NO: 735220 - RNA, 22 nt, Homo sapiens
auagaaaugguuuccucuggau

SEQ ID NO: 735221 - RNA, 17 nt, Homo sapiens
auagaacaacauauaca

SEQ ID NO: 735222 - RNA, 19 nt, Homo sapiens
auagaagaugaaucauuga

SEQ ID NO: 735223 - RNA, 18 nt, Homo sapiens
auagaauaaaauauaauu

SEQ ID NO: 735224 - RNA, 14 nt, Homo sapiens
auagaauacaugga

SEQ ID NO: 735225 - RNA, 13 nt, Homo sapiens
auagaauagcaca

SEQ ID NO: 735226 - RNA, 14 nt, Homo sapiens
auagacaccaagga

SEQ ID NO: 735227 - RNA, 23 nt, Homo sapiens
auagaccucucaauuucuggaaa

SEQ ID NO: 735228 - RNA, 16 nt, Homo sapiens
auagacggugcucacu

SEQ ID NO: 735229 - RNA, 24 nt, Homo sapiens
auagacugauugauuauucaacac

SEQ ID NO: 735230 - RNA, 20 nt, Homo sapiens
auagacuguaagcuccauga

SEQ ID NO: 735231 - RNA, 23 nt, Homo sapiens
auagacuugcaccuuaugucaug

SEQ ID NO: 735232 - RNA, 23 nt, Homo sapiens
auagagaccaucuuugccaacau

SEQ ID NO: 735233 - RNA, 23 nt, Homo sapiens
auagagcuuuuaaaaauguccug

SEQ ID NO: 735234 - RNA, 15 nt, Homo sapiens
auagaggaaagggau

SEQ ID NO: 735235 - RNA, 14 nt, Homo sapiens
auagaggcuagcuu

SEQ ID NO: 735236 - RNA, 15 nt, Homo sapiens
aucaaugcauguuac

SEQ ID NO: 735237 - RNA, 12 nt, Homo sapiens
aucaauguuucu

SEQ ID NO: 735238 - RNA, 20 nt, Homo sapiens
aucaauuacugguccaaaag

SEQ ID NO: 735239 - RNA, 22 nt, Homo sapiens
aucacaaaggaaagauuugcca

SEQ ID NO: 735240 - RNA, 15 nt, Homo sapiens
aucacaaggucaaga

SEQ ID NO: 735241 - RNA, 13 nt, Homo sapiens
aucacacaauaua

SEQ ID NO: 735242 - RNA, 14 nt, Homo sapiens
aucacaccucagug

SEQ ID NO: 735243 - RNA, 15 nt, Homo sapiens
aucacaccucagugg

SEQ ID NO: 735244 - RNA, 19 nt, Homo sapiens
aucacacugggugguggcc

SEQ ID NO: 735245 - RNA, 22 nt, Homo sapiens
aucacacuuuguaauuugcaaa

SEQ ID NO: 735246 - RNA, 21 nt, Homo sapiens
aucacagauguaaauuaacuc

SEQ ID NO: 735247 - RNA, 13 nt, Homo sapiens
aucacaguacuuu

SEQ ID NO: 735248 - RNA, 22 nt, Homo sapiens
aucacaucuuaaagcuaaaaau

SEQ ID NO: 735249 - RNA, 23 nt, Homo sapiens
aucacaugaauauaaaugggaaa

SEQ ID NO: 735250 - RNA, 21 nt, Homo sapiens
aucacauuauuugcauguuac

SEQ ID NO: 735251 - RNA, 23 nt, Homo sapiens
aucaccacaguaaguuccuacua

SEQ ID NO: 735252 - RNA, 13 nt, Homo sapiens
aucaccagagguc

SEQ ID NO: 735253 - RNA, 17 nt, Homo sapiens
aucaccauguauuuugu

SEQ ID NO: 735254 - RNA, 17 nt, Homo sapiens
aucaccauuucuuggca

SEQ ID NO: 735255 - RNA, 22 nt, Homo sapiens
aucaccucugauggcugaagaa

SEQ ID NO: 735256 - RNA, 19 nt, Homo sapiens
aucacgcuuuccugaaucc

SEQ ID NO: 735257 - RNA, 17 nt, Homo sapiens
aucacggauggugcaug

SEQ ID NO: 735258 - RNA, 21 nt, Homo sapiens
aucacgucacugcacuccagc

SEQ ID NO: 735259 - RNA, 17 nt, Homo sapiens
aucacuagccaugauaa

SEQ ID NO: 735260 - RNA, 17 nt, Homo sapiens
aucacucuaauucggau

SEQ ID NO: 735261 - RNA, 16 nt, Homo sapiens
aucacugaucuuguca

SEQ ID NO: 735262 - RNA, 16 nt, Homo sapiens
aucacugccacacucu

SEQ ID NO: 735263 - RNA, 21 nt, Homo sapiens
aucacugccacacucuccauc

SEQ ID NO: 735264 - RNA, 22 nt, Homo sapiens
aucacugcccuuuuugaaauca

SEQ ID NO: 735265 - RNA, 16 nt, Homo sapiens
aucacuguaaagacaa

SEQ ID NO: 735266 - RNA, 16 nt, Homo sapiens
aucacuguacuuguag

SEQ ID NO: 735267 - RNA, 15 nt, Homo sapiens
aucacuuaguucuca

SEQ ID NO: 735268 - RNA, 16 nt, Homo sapiens
aucacuuaguucucag

SEQ ID NO: 735269 - RNA, 18 nt, Homo sapiens
aucacuuaguucucaggc

SEQ ID NO: 735270 - RNA, 19 nt, Homo sapiens
aucagaaaaagcaguauua

SEQ ID NO: 735271 - RNA, 13 nt, Homo sapiens
aucagacauacag

SEQ ID NO: 735272 - RNA, 22 nt, Homo sapiens
aucagaccauaauguuacauua

SEQ ID NO: 735273 - RNA, 13 nt, Homo sapiens
aucagacuaguga

SEQ ID NO: 735274 - RNA, 17 nt, Homo sapiens
aucagacuccugugcaa

SEQ ID NO: 735275 - RNA, 13 nt, Homo sapiens
aucagacugacag

SEQ ID NO: 735276 - RNA, 17 nt, Homo sapiens
aucagagccagucucac

SEQ ID NO: 735277 - RNA, 21 nt, Homo sapiens
aucagauccgugcgugaagua

SEQ ID NO: 735278 - RNA, 13 nt, Homo sapiens
aucagcauuaguc

SEQ ID NO: 735279 - RNA, 15 nt, Homo sapiens
aucagccacauucua

SEQ ID NO: 735280 - RNA, 12 nt, Homo sapiens
aucagccagguc

SEQ ID NO: 735281 - RNA, 17 nt, Homo sapiens
aucagcgggucuccucc

SEQ ID NO: 735282 - RNA, 19 nt, Homo sapiens
aucagcucuugaugccuuu

SEQ ID NO: 735283 - RNA, 22 nt, Homo sapiens
aucaggaugucccugaaacuuc

SEQ ID NO: 735284 - RNA, 21 nt, Homo sapiens
aaccagacuugaauacaacau

SEQ ID NO: 735285 - RNA, 18 nt, Homo sapiens
aaccagccacaguacaua

SEQ ID NO: 735286 - RNA, 19 nt, Homo sapiens
aaccagccacaguacauau

SEQ ID NO: 735287 - RNA, 23 nt, Homo sapiens
aaccagccagcgucccuugguga

SEQ ID NO: 735288 - RNA, 18 nt, Homo sapiens
aaccaggcaccucuuccu

SEQ ID NO: 735289 - RNA, 20 nt, Homo sapiens
aaccaguggccgguugccac

SEQ ID NO: 735290 - RNA, 17 nt, Homo sapiens
aaccaguuaaagccaca

SEQ ID NO: 735291 - RNA, 14 nt, Homo sapiens
aaccaguugaauca

SEQ ID NO: 735292 - RNA, 18 nt, Homo sapiens
aaccaucacccccaggac

SEQ ID NO: 735293 - RNA, 17 nt, Homo sapiens
aaccauccagugacaaa

SEQ ID NO: 735294 - RNA, 13 nt, Homo sapiens
aaccaucccugau

SEQ ID NO: 735295 - RNA, 13 nt, Homo sapiens
aaccaugaacuca

SEQ ID NO: 735296 - RNA, 15 nt, Homo sapiens
aaccaugagaauuug

SEQ ID NO: 735297 - RNA, 22 nt, Homo sapiens
aaccauucaaaugacgccugau

SEQ ID NO: 735298 - RNA, 18 nt, Homo sapiens
aacccaagugcugcacaa

SEQ ID NO: 735299 - RNA, 13 nt, Homo sapiens
aacccaaugccug

SEQ ID NO: 735300 - RNA, 13 nt, Homo sapiens
aacccacaugggg

SEQ ID NO: 735301 - RNA, 20 nt, Homo sapiens
aacccacucagagaugcauu

SEQ ID NO: 735302 - RNA, 19 nt, Homo sapiens
aacccagagguggauguua

SEQ ID NO: 735303 - RNA, 23 nt, Homo sapiens
aacccauauuucauccaggaggc

SEQ ID NO: 735304 - RNA, 13 nt, Homo sapiens
aaccccaguggau

SEQ ID NO: 735305 - RNA, 15 nt, Homo sapiens
gcgucccuguacaga

SEQ ID NO: 735306 - RNA, 16 nt, Homo sapiens
gcgucucuaaugucug

SEQ ID NO: 735307 - RNA, 15 nt, Homo sapiens
gcgugaaucuguauc

SEQ ID NO: 735308 - RNA, 11 nt, Homo sapiens
gcgugcacuug

SEQ ID NO: 735309 - RNA, 16 nt, Homo sapiens
gcguggacucugcaca

SEQ ID NO: 735310 - RNA, 18 nt, Homo sapiens
gcgugucccucucggaag

SEQ ID NO: 735311 - RNA, 11 nt, Homo sapiens
gcgugugacag

SEQ ID NO: 735312 - RNA, 18 nt, Homo sapiens
gcgugugggucucugggc

SEQ ID NO: 735313 - RNA, 12 nt, Homo sapiens
gcguuacugcuu

SEQ ID NO: 735314 - RNA, 19 nt, Homo sapiens
gcguuacugcuugaccaaa

SEQ ID NO: 735315 - RNA, 15 nt, Homo sapiens
gcguuaugugcagua

SEQ ID NO: 735316 - RNA, 24 nt, Homo sapiens
gcguucugcaagcaucaguucuac

SEQ ID NO: 735317 - RNA, 13 nt, Homo sapiens
gcuaaaacugcuc

SEQ ID NO: 735318 - RNA, 20 nt, Homo sapiens
gcuaaaauuagaugaacuca

SEQ ID NO: 735319 - RNA, 17 nt, Homo sapiens
gcuaaacugaugacuua

SEQ ID NO: 735320 - RNA, 13 nt, Homo sapiens
gcuaaagacugau

SEQ ID NO: 735321 - RNA, 21 nt, Homo sapiens
gcuaaagagcuuugugauaua

SEQ ID NO: 735322 - RNA, 20 nt, Homo sapiens
gcuaacugcuugaacccaga

SEQ ID NO: 735323 - RNA, 17 nt, Homo sapiens
gcuaacugguuaaacau

SEQ ID NO: 735324 - RNA, 19 nt, Homo sapiens
gcuaacuuaguaagugcuu

SEQ ID NO: 735325 - RNA, 21 nt, Homo sapiens
gcuaacuuggagccccagugc

SEQ ID NO: 735326 - RNA, 14 nt, Homo sapiens
gcuaagcacuuuau

SEQ ID NO: 735327 - RNA, 20 nt, Homo sapiens
gcuaauacccaguuacuuau

SEQ ID NO: 735328 - RNA, 13 nt, Homo sapiens
gcuaauucuuugc

SEQ ID NO: 735329 - RNA, 15 nt, Homo sapiens
gcuaauucuuugcaa

SEQ ID NO: 735330 - RNA, 19 nt, Homo sapiens
gcuaauuguacuaaucuga

SEQ ID NO: 735331 - RNA, 15 nt, Homo sapiens
gcuaauuucuggccc

SEQ ID NO: 735332 - RNA, 17 nt, Homo sapiens
gcuacaguuauuaaucu

SEQ ID NO: 735333 - RNA, 16 nt, Homo sapiens
gcuaccucacuggggu

SEQ ID NO: 735334 - RNA, 10 nt, Homo sapiens
gcuaccuccc

SEQ ID NO: 735335 - RNA, 22 nt, Homo sapiens
gcuacuaccuagggcacuuuaa

SEQ ID NO: 735336 - RNA, 16 nt, Homo sapiens
gcuacuccauccugaa

SEQ ID NO: 735337 - RNA, 21 nt, Homo sapiens
gcuacucuguuccuucacauc

SEQ ID NO: 735338 - RNA, 22 nt, Homo sapiens
gcuacugacuauggcuaccaaa

SEQ ID NO: 735339 - RNA, 22 nt, Homo sapiens
gcuacuugggaggcugagccag

SEQ ID NO: 735340 - RNA, 23 nt, Homo sapiens
gcuacuuuaacaccagguuuaug

SEQ ID NO: 735341 - RNA, 22 nt, Homo sapiens
gcuagacaagcuuguccaugua

SEQ ID NO: 735342 - RNA, 17 nt, Homo sapiens
gcuagaugcugugacag

SEQ ID NO: 735343 - RNA, 17 nt, Homo sapiens
gcuaggaaugaaauccu

SEQ ID NO: 735344 - RNA, 12 nt, Homo sapiens
gcuagugccuuu

SEQ ID NO: 735345 - RNA, 15 nt, Homo sapiens
gcuaguguaccuccu

SEQ ID NO: 735346 - RNA, 19 nt, Homo sapiens
gcuaguguaccuccucuca

SEQ ID NO: 735347 - RNA, 14 nt, Homo sapiens
gcuauaagugcuca

SEQ ID NO: 735348 - RNA, 23 nt, Homo sapiens
gcuauaagugcucaauagcuuga

SEQ ID NO: 735349 - RNA, 18 nt, Homo sapiens
gcuauagaaugagugcag

SEQ ID NO: 735350 - RNA, 20 nt, Homo sapiens
gcuauagaaugagugcaggu

SEQ ID NO: 735351 - RNA, 21 nt, Homo sapiens
gcuauauucugagacuuugaa

SEQ ID NO: 735352 - RNA, 15 nt, Homo sapiens
gcuauccaaauaacu

SEQ ID NO: 735353 - RNA, 13 nt, Homo sapiens
gcuaucugugcag

SEQ ID NO: 735354 - RNA, 11 nt, Homo sapiens
gcuaugaauga

SEQ ID NO: 735355 - RNA, 12 nt, Homo sapiens
gcuaugcaaaau

SEQ ID NO: 735356 - RNA, 20 nt, Homo sapiens
gcuaugcccggaccuccauc

SEQ ID NO: 735357 - RNA, 17 nt, Homo sapiens
gcuauggcccagaaaca

SEQ ID NO: 735358 - RNA, 11 nt, Homo sapiens
gcuauggugcu

SEQ ID NO: 735359 - RNA, 18 nt, Homo sapiens
gcuauguaaacaaaccac

SEQ ID NO: 735360 - RNA, 20 nt, Homo sapiens
gcuauuaaaaaaaaagaagg

SEQ ID NO: 735361 - RNA, 16 nt, Homo sapiens
gcuauuuacacuauua

SEQ ID NO: 735362 - RNA, 13 nt, Homo sapiens
gcuauuuaugcaa

SEQ ID NO: 735363 - RNA, 22 nt, Homo sapiens
gcuauuucaucuauuuuuggca

SEQ ID NO: 735364 - RNA, 19 nt, Homo sapiens
gcuauuuccucuaaugaag

SEQ ID NO: 735365 - RNA, 19 nt, Homo sapiens
gcuauuucuucuacugcua

SEQ ID NO: 735366 - RNA, 17 nt, Homo sapiens
gcuauuugagcaugcac

SEQ ID NO: 735367 - RNA, 17 nt, Homo sapiens
gcuauuuggacucaggu

SEQ ID NO: 735368 - RNA, 15 nt, Homo sapiens
gcuauuuguauuucu

SEQ ID NO: 735369 - RNA, 17 nt, Homo sapiens
gcuauuuguucagagag

SEQ ID NO: 735370 - RNA, 19 nt, Homo sapiens
gcuauuuugugaagccaug

SEQ ID NO: 735371 - RNA, 22 nt, Homo sapiens
gcucaaccacuguggcguucug

SEQ ID NO: 735372 - RNA, 15 nt, Homo sapiens
gcucaagaacacaug

SEQ ID NO: 735373 - RNA, 17 nt, Homo sapiens
gcucaaggcugugcagg

SEQ ID NO: 735374 - RNA, 18 nt, Homo sapiens
gcucaagguuacugggag

SEQ ID NO: 735375 - RNA, 20 nt, Homo sapiens
gcucacaccuguaaucccag

SEQ ID NO: 735376 - RNA, 17 nt, Homo sapiens
gcucacccguaggcaaa

SEQ ID NO: 735377 - RNA, 20 nt, Homo sapiens
gcucaccguggauuuucuca

SEQ ID NO: 735378 - RNA, 17 nt, Homo sapiens
gcucacgucacacuugg

SEQ ID NO: 735379 - RNA, 16 nt, Homo sapiens
gcucacuacaaccucc

SEQ ID NO: 735380 - RNA, 12 nt, Homo sapiens
gcucacuacuga

SEQ ID NO: 735381 - RNA, 16 nt, Homo sapiens
gcucacugcaaccucu

SEQ ID NO: 735382 - RNA, 13 nt, Homo sapiens
gcucacuuuucau

SEQ ID NO: 735383 - RNA, 18 nt, Homo sapiens
gcucagaaggaauggugc

SEQ ID NO: 735384 - RNA, 16 nt, Homo sapiens
gcucagacuugccagg

SEQ ID NO: 735385 - RNA, 18 nt, Homo sapiens
gcucagaggcccaggaau

SEQ ID NO: 735386 - RNA, 23 nt, Homo sapiens
gcucagaggcccaggaaucggag

SEQ ID NO: 735387 - RNA, 21 nt, Homo sapiens
gcucagcccugcaccaugcug

SEQ ID NO: 735388 - RNA, 22 nt, Homo sapiens
gcucagcccugcaccaugcugc

SEQ ID NO: 735389 - RNA, 15 nt, Homo sapiens
gcucaggcacauaca

SEQ ID NO: 735390 - RNA, 22 nt, Homo sapiens
gcucaguaaacgggaacaugcc

SEQ ID NO: 735391 - RNA, 15 nt, Homo sapiens
gcucaguaacugugc

SEQ ID NO: 735392 - RNA, 13 nt, Homo sapiens
gcucagugccuuc

SEQ ID NO: 735393 - RNA, 20 nt, Homo sapiens
gcucaguggaucacacacau

SEQ ID NO: 735394 - RNA, 21 nt, Homo sapiens
gcucaguguuuuugugaauug

SEQ ID NO: 735395 - RNA, 15 nt, Homo sapiens
gcucauaaacugcca

SEQ ID NO: 735396 - RNA, 13 nt, Homo sapiens
gcucaucacugga

SEQ ID NO: 735397 - RNA, 23 nt, Homo sapiens
gcucaucagguccagccugggcu

SEQ ID NO: 735398 - RNA, 15 nt, Homo sapiens
gcucaucauauucca

SEQ ID NO: 735399 - RNA, 14 nt, Homo sapiens
aacuuauccaucuu

SEQ ID NO: 735400 - RNA, 18 nt, Homo sapiens
aacuuauggaaagcccau

SEQ ID NO: 735401 - RNA, 18 nt, Homo sapiens
aacuuauuugcugcagaa

SEQ ID NO: 735402 - RNA, 18 nt, Homo sapiens
aacuuauuuuuguucaua

SEQ ID NO: 735403 - RNA, 13 nt, Homo sapiens
aacuucaagcaaa

SEQ ID NO: 735404 - RNA, 16 nt, Homo sapiens
aacuucaauuuacuua

SEQ ID NO: 735405 - RNA, 13 nt, Homo sapiens
aacuucauucuaa

SEQ ID NO: 735406 - RNA, 16 nt, Homo sapiens
aacuucauuugacaca

SEQ ID NO: 735407 - RNA, 22 nt, Homo sapiens
aacuuccagguuccauccacca

SEQ ID NO: 735408 - RNA, 17 nt, Homo sapiens
aacuucucugugaacua

SEQ ID NO: 735409 - RNA, 21 nt, Homo sapiens
aacuucucugugaacuauuaa

SEQ ID NO: 735410 - RNA, 21 nt, Homo sapiens
aacuucuugaaucuagggagg

SEQ ID NO: 735411 - RNA, 22 nt, Homo sapiens
aacuugaaauauauaauauuca

SEQ ID NO: 735412 - RNA, 18 nt, Homo sapiens
aacuugauuaacuccucc

SEQ ID NO: 735413 - RNA, 18 nt, Homo sapiens
aacuugcaauaccaaugu

SEQ ID NO: 735414 - RNA, 16 nt, Homo sapiens
aacuugcauugugauu

SEQ ID NO: 735415 - RNA, 20 nt, Homo sapiens
aacuuggagccccagugcca

SEQ ID NO: 735416 - RNA, 18 nt, Homo sapiens
aacuuggguucuucucag

SEQ ID NO: 735417 - RNA, 22 nt, Homo sapiens
aacuugguucugcuucaauaaa

SEQ ID NO: 735418 - RNA, 12 nt, Homo sapiens
aacuuguaaaua

SEQ ID NO: 735419 - RNA, 22 nt, Homo sapiens
aacuuucagaggcaauagguaa

SEQ ID NO: 735420 - RNA, 19 nt, Homo sapiens
gcugcugccauccaugugc

SEQ ID NO: 735421 - RNA, 22 nt, Homo sapiens
gcugcugccccuuaaacacagg

SEQ ID NO: 735422 - RNA, 17 nt, Homo sapiens
gcugcuggggaagacag

SEQ ID NO: 735423 - RNA, 22 nt, Homo sapiens
gcugcuguggggaccacacuga

SEQ ID NO: 735424 - RNA, 21 nt, Homo sapiens
gcugcuucuguguguggugag

SEQ ID NO: 735425 - RNA, 14 nt, Homo sapiens
gcugcuuuguucaa

SEQ ID NO: 735426 - RNA, 17 nt, Homo sapiens
gcugcuuuguucaaugc

SEQ ID NO: 735427 - RNA, 15 nt, Homo sapiens
gcuggaaggggucca

SEQ ID NO: 735428 - RNA, 19 nt, Homo sapiens
gcuggaauuacaaaacuca

SEQ ID NO: 735429 - RNA, 22 nt, Homo sapiens
gcuggacgugcgcgaugccugg

SEQ ID NO: 735430 - RNA, 21 nt, Homo sapiens
gcuggacuacccacguucuca

SEQ ID NO: 735431 - RNA, 23 nt, Homo sapiens
gcuggagagagauucuguugcau

SEQ ID NO: 735432 - RNA, 14 nt, Homo sapiens
gcuggagagcugcu

SEQ ID NO: 735433 - RNA, 16 nt, Homo sapiens
gcuggagauguuuuag

SEQ ID NO: 735434 - RNA, 21 nt, Homo sapiens
gcuggagcaaaagucauuaca

SEQ ID NO: 735435 - RNA, 17 nt, Homo sapiens
gcuggagcccgcacugu

SEQ ID NO: 735436 - RNA, 15 nt, Homo sapiens
gcuggaggaaccaga

SEQ ID NO: 735437 - RNA, 23 nt, Homo sapiens
gcuggaggccucaggugcugucc

SEQ ID NO: 735438 - RNA, 23 nt, Homo sapiens
gcuggaggcugcuguggggacca

SEQ ID NO: 735439 - RNA, 12 nt, Homo sapiens
gcuggagugcaa

SEQ ID NO: 735440 - RNA, 19 nt, Homo sapiens
gcuggagugcaguggugca

SEQ ID NO: 735441 - RNA, 13 nt, Homo sapiens
gcuggcaaccacu

SEQ ID NO: 735442 - RNA, 16 nt, Homo sapiens
gcuggcaagcagggaa

SEQ ID NO: 735443 - RNA, 22 nt, Homo sapiens
gcuggcagaugcuuuacaguca

SEQ ID NO: 735444 - RNA, 14 nt, Homo sapiens
gcuggcaguagugc

SEQ ID NO: 735445 - RNA, 21 nt, Homo sapiens
gcuggcaguagugcuucagua

SEQ ID NO: 735446 - RNA, 15 nt, Homo sapiens
gcuggccagugcugc

SEQ ID NO: 735447 - RNA, 15 nt, Homo sapiens
gcuggcccagccaaa

SEQ ID NO: 735448 - RNA, 19 nt, Homo sapiens
gcuggccucucuagcacaa

SEQ ID NO: 735449 - RNA, 14 nt, Homo sapiens
gcuggccuggcaca

SEQ ID NO: 735450 - RNA, 13 nt, Homo sapiens
gcuggcugcagug

SEQ ID NO: 735451 - RNA, 14 nt, Homo sapiens
gcuggcugcaguga

SEQ ID NO: 735452 - RNA, 23 nt, Homo sapiens
gcugggaacaugacccagccuga

SEQ ID NO: 735453 - RNA, 15 nt, Homo sapiens
gcugggacuggccag

SEQ ID NO: 735454 - RNA, 17 nt, Homo sapiens
gcugggacuuggauccc

SEQ ID NO: 735455 - RNA, 18 nt, Homo sapiens
gcugggcagaaggccaag

SEQ ID NO: 735456 - RNA, 18 nt, Homo sapiens
gcugggcaugguggcgca

SEQ ID NO: 735457 - RNA, 14 nt, Homo sapiens
gcugggccccaccu

SEQ ID NO: 735458 - RNA, 17 nt, Homo sapiens
gcugggcugagugacac

SEQ ID NO: 735459 - RNA, 14 nt, Homo sapiens
gcuggggaugucuc

SEQ ID NO: 735460 - RNA, 20 nt, Homo sapiens
gcuggggccgcugggguccg

SEQ ID NO: 735461 - RNA, 18 nt, Homo sapiens
gcugggucaccagaaaua

SEQ ID NO: 735462 - RNA, 17 nt, Homo sapiens
gcugggugggcaucuca

SEQ ID NO: 735463 - RNA, 22 nt, Homo sapiens
gcuggucuuggugaacacacau

SEQ ID NO: 735464 - RNA, 16 nt, Homo sapiens
gcuggugccccacuga

SEQ ID NO: 735465 - RNA, 15 nt, Homo sapiens
gcugguggugcugca

SEQ ID NO: 735466 - RNA, 19 nt, Homo sapiens
gcugguuagguccaccugc

SEQ ID NO: 735467 - RNA, 19 nt, Homo sapiens
gcugguugaaaaauggcaa

SEQ ID NO: 735468 - RNA, 15 nt, Homo sapiens
gcugguuguugccag

SEQ ID NO: 735469 - RNA, 20 nt, Homo sapiens
gcugguuuuccuaaaugcag

SEQ ID NO: 735470 - RNA, 23 nt, Homo sapiens
gcuguauuuucuuuuauaucugu

SEQ ID NO: 735471 - RNA, 19 nt, Homo sapiens
gcugucaaaacuacugaca

SEQ ID NO: 735472 - RNA, 20 nt, Homo sapiens
gcugucaccacgugcaguau

SEQ ID NO: 735473 - RNA, 18 nt, Homo sapiens
gcugucagauacccuguu

SEQ ID NO: 735474 - RNA, 24 nt, Homo sapiens
gcuguccugagcccccugcaccca

SEQ ID NO: 735475 - RNA, 14 nt, Homo sapiens
gcuguccugcagca

SEQ ID NO: 735476 - RNA, 16 nt, Homo sapiens
gcuguccugcugcccu

SEQ ID NO: 735477 - RNA, 17 nt, Homo sapiens
gcugucuucacauguau

SEQ ID NO: 735478 - RNA, 21 nt, Homo sapiens
gcugugaauauuccuaacuua

SEQ ID NO: 735479 - RNA, 23 nt, Homo sapiens
gcugugaccauuuauaauguuag

SEQ ID NO: 735480 - RNA, 14 nt, Homo sapiens
gcugugaucaguga

SEQ ID NO: 735481 - RNA, 21 nt, Homo sapiens
gcugugaucagugauuuucaa

SEQ ID NO: 735482 - RNA, 15 nt, Homo sapiens
gcuguggacuguccu

SEQ ID NO: 735483 - RNA, 19 nt, Homo sapiens
gcuguggcucacgccugua

SEQ ID NO: 735484 - RNA, 17 nt, Homo sapiens
gcuguggggaacacagc

SEQ ID NO: 735485 - RNA, 16 nt, Homo sapiens
gcuguguuuccaucuc

SEQ ID NO: 735486 - RNA, 16 nt, Homo sapiens
gcuguuauucuuccac

SEQ ID NO: 735487 - RNA, 17 nt, Homo sapiens
gcuguuauuucuucccu

SEQ ID NO: 735488 - RNA, 15 nt, Homo sapiens
gcuguugacaucagc

SEQ ID NO: 735489 - RNA, 13 nt, Homo sapiens
gcuguugccucau

SEQ ID NO: 735490 - RNA, 20 nt, Homo sapiens
gcuguuguguuguuguuauu

SEQ ID NO: 735491 - RNA, 14 nt, Homo sapiens
gcuguuuacugcuu

SEQ ID NO: 735492 - RNA, 19 nt, Homo sapiens
gcuguuuuuuuugcugcua

SEQ ID NO: 735493 - RNA, 23 nt, Homo sapiens
gcuuaaacaagccaacauaugaa

SEQ ID NO: 735494 - RNA, 22 nt, Homo sapiens
gcuuaagguuuguuuucauuaa

SEQ ID NO: 735495 - RNA, 13 nt, Homo sapiens
gcuuaauaaguau

SEQ ID NO: 735496 - RNA, 22 nt, Homo sapiens
gcuuaauggcucaugaccugga

SEQ ID NO: 735497 - RNA, 20 nt, Homo sapiens
gcuuacacugaggacugugg

SEQ ID NO: 735498 - RNA, 22 nt, Homo sapiens
gcuuacccaagcuguggcagcc

SEQ ID NO: 735499 - RNA, 12 nt, Homo sapiens
gcuuacccuuca

SEQ ID NO: 735500 - RNA, 17 nt, Homo sapiens
gcuuaccuccucauggc

SEQ ID NO: 735501 - RNA, 18 nt, Homo sapiens
gcuuacuagcacuuugag

SEQ ID NO: 735502 - RNA, 19 nt, Homo sapiens
gcuuagaaugcaucucauc

SEQ ID NO: 735503 - RNA, 16 nt, Homo sapiens
gcuuagcugucucaga

SEQ ID NO: 735504 - RNA, 15 nt, Homo sapiens
gcuuaggacuuucca

SEQ ID NO: 735505 - RNA, 13 nt, Homo sapiens
gcuuaggucucau

SEQ ID NO: 735506 - RNA, 16 nt, Homo sapiens
gcuuaguuuguguguu

SEQ ID NO: 735507 - RNA, 20 nt, Homo sapiens
gcuuauaagagggcauauac

SEQ ID NO: 735508 - RNA, 15 nt, Homo sapiens
gcuuaucagggaguu

SEQ ID NO: 735509 - RNA, 16 nt, Homo sapiens
gcuuauggauucauau

SEQ ID NO: 735510 - RNA, 19 nt, Homo sapiens
gcuucaacauucuuugcaa

SEQ ID NO: 735511 - RNA, 18 nt, Homo sapiens
gcuucaccagagcauuuc

SEQ ID NO: 735512 - RNA, 18 nt, Homo sapiens
gcuucagagccuagccac

SEQ ID NO: 735513 - RNA, 22 nt, Homo sapiens
ggaaagcaucaccucaggccag

SEQ ID NO: 735514 - RNA, 22 nt, Homo sapiens
ggaaagccuuaaaaauauccuu

SEQ ID NO: 735515 - RNA, 14 nt, Homo sapiens
ggaaaggggugcuu

SEQ ID NO: 735516 - RNA, 12 nt, Homo sapiens
ggaaagugaaac

SEQ ID NO: 735517 - RNA, 20 nt, Homo sapiens
ggaaagugauuuuuuuccac

SEQ ID NO: 735518 - RNA, 15 nt, Homo sapiens
ggaaauaaagcgucc

SEQ ID NO: 735519 - RNA, 19 nt, Homo sapiens
ggaaauaaagcguccucuc

SEQ ID NO: 735520 - RNA, 23 nt, Homo sapiens
ggaaauaaagcguccucucagua

SEQ ID NO: 735521 - RNA, 21 nt, Homo sapiens
ggaaauauuaagaaagacuau

SEQ ID NO: 735522 - RNA, 13 nt, Homo sapiens
ggaaaucucuauu

SEQ ID NO: 735523 - RNA, 15 nt, Homo sapiens
ggaaaugcugacuuu

SEQ ID NO: 735524 - RNA, 18 nt, Homo sapiens
ggaaaugguggugcuuua

SEQ ID NO: 735525 - RNA, 17 nt, Homo sapiens
ggaaauuaaugcugaga

SEQ ID NO: 735526 - RNA, 19 nt, Homo sapiens
ggaacaagacagccuucac

SEQ ID NO: 735527 - RNA, 18 nt, Homo sapiens
ggaacaauagaauaaucu

SEQ ID NO: 735528 - RNA, 20 nt, Homo sapiens
ggaacauauagaaugcagag

SEQ ID NO: 735529 - RNA, 18 nt, Homo sapiens
ggaacauuccaaauauuc

SEQ ID NO: 735530 - RNA, 21 nt, Homo sapiens
ggaacauuggagcugacuguu

SEQ ID NO: 735531 - RNA, 20 nt, Homo sapiens
ggaaccucagccuggccaga

SEQ ID NO: 735532 - RNA, 22 nt, Homo sapiens
ggaaccucagccuggccagaca

SEQ ID NO: 735533 - RNA, 14 nt, Homo sapiens
ggaacucucuccac

SEQ ID NO: 735534 - RNA, 23 nt, Homo sapiens
ggaacucugcuugauuuuugccu

SEQ ID NO: 735535 - RNA, 11 nt, Homo sapiens
aagacucugac

SEQ ID NO: 735536 - RNA, 23 nt, Homo sapiens
aagacugauuuuaauagggaaua

SEQ ID NO: 735537 - RNA, 18 nt, Homo sapiens
aagacugggugaggauaa

SEQ ID NO: 735538 - RNA, 19 nt, Homo sapiens
aagacugucagcuuccaaa

SEQ ID NO: 735539 - RNA, 15 nt, Homo sapiens
aagacuguugcucaa

SEQ ID NO: 735540 - RNA, 15 nt, Homo sapiens
aagacuuaacugguu

SEQ ID NO: 735541 - RNA, 17 nt, Homo sapiens
aagacuuaauucugauu

SEQ ID NO: 735542 - RNA, 17 nt, Homo sapiens
aagacuuaucaacauuu

SEQ ID NO: 735543 - RNA, 23 nt, Homo sapiens
aagacuucgcgcauaucacuaau

SEQ ID NO: 735544 - RNA, 17 nt, Homo sapiens
aagacuugagccaucca

SEQ ID NO: 735545 - RNA, 19 nt, Homo sapiens
aagacuuuugucugaucaa

SEQ ID NO: 735546 - RNA, 15 nt, Homo sapiens
aagagaaaagcccaa

SEQ ID NO: 735547 - RNA, 18 nt, Homo sapiens
aagagaaaauaagcagga

SEQ ID NO: 735548 - RNA, 15 nt, Homo sapiens
aagagaaacugugua

SEQ ID NO: 735549 - RNA, 16 nt, Homo sapiens
aagagaaccgagcaaa

SEQ ID NO: 735550 - RNA, 11 nt, Homo sapiens
aagagaagcuu

SEQ ID NO: 735551 - RNA, 22 nt, Homo sapiens
aagagaauauuagcuuuacugu

SEQ ID NO: 735552 - RNA, 14 nt, Homo sapiens
aagagaaugucuga

SEQ ID NO: 735553 - RNA, 17 nt, Homo sapiens
aagagacagagaaucuu

SEQ ID NO: 735554 - RNA, 18 nt, Homo sapiens
aagagaccaagacucuga

SEQ ID NO: 735555 - RNA, 20 nt, Homo sapiens
aagagaucacaauacucaaa

SEQ ID NO: 735556 - RNA, 14 nt, Homo sapiens
aagagaucuacaca

SEQ ID NO: 735557 - RNA, 17 nt, Homo sapiens
aagagaucuuucuuucc

SEQ ID NO: 735558 - RNA, 19 nt, Homo sapiens
aagagaucuuucuuuccaa

SEQ ID NO: 735559 - RNA, 22 nt, Homo sapiens
aagagcaaaucaauucuaguca

SEQ ID NO: 735560 - RNA, 16 nt, Homo sapiens
aagagcaauauuccag

SEQ ID NO: 735561 - RNA, 18 nt, Homo sapiens
aagagcaauauuccagua

SEQ ID NO: 735562 - RNA, 20 nt, Homo sapiens
aagagcagucuaucauugca

SEQ ID NO: 735563 - RNA, 20 nt, Homo sapiens
aagagccaaagaauauucca

SEQ ID NO: 735564 - RNA, 19 nt, Homo sapiens
aagagccauauaaguuuga

SEQ ID NO: 735565 - RNA, 18 nt, Homo sapiens
aagagccgggaacagaga

SEQ ID NO: 735566 - RNA, 19 nt, Homo sapiens
aagagccgggaacagagaa

SEQ ID NO: 735567 - RNA, 19 nt, Homo sapiens
aagagcgagacuccguuuc

SEQ ID NO: 735568 - RNA, 22 nt, Homo sapiens
aagagcuaaguucuaaguucau

SEQ ID NO: 735569 - RNA, 13 nt, Homo sapiens
aagagcuaauaaa

SEQ ID NO: 735570 - RNA, 15 nt, Homo sapiens
aagagcuugcuccag

SEQ ID NO: 735571 - RNA, 18 nt, Homo sapiens
aagaggagccucagaaga

SEQ ID NO: 735572 - RNA, 15 nt, Homo sapiens
aagaggauagaauac

SEQ ID NO: 735573 - RNA, 18 nt, Homo sapiens
aagaggcugccccucuca

SEQ ID NO: 735574 - RNA, 20 nt, Homo sapiens
aagagggcauauacagugaa

SEQ ID NO: 735575 - RNA, 23 nt, Homo sapiens
aagaggguccuuuaguaccugaa

SEQ ID NO: 735576 - RNA, 15 nt, Homo sapiens
aagagguugaagcua

SEQ ID NO: 735577 - RNA, 13 nt, Homo sapiens
aagaguaguaaua

SEQ ID NO: 735578 - RNA, 14 nt, Homo sapiens
aagaguaguaauag

SEQ ID NO: 735579 - RNA, 13 nt, Homo sapiens
aagagucuuccaa

SEQ ID NO: 735580 - RNA, 12 nt, Homo sapiens
aagagugaauuu

SEQ ID NO: 735581 - RNA, 18 nt, Homo sapiens
aagagugauugcagcuuu

SEQ ID NO: 735582 - RNA, 21 nt, Homo sapiens
aagagugucacugagcugugu

SEQ ID NO: 735583 - RNA, 14 nt, Homo sapiens
aagaguuacuuaau

SEQ ID NO: 735584 - RNA, 13 nt, Homo sapiens
aagaguugccaaa

SEQ ID NO: 735585 - RNA, 19 nt, Homo sapiens
aagaguuucacaaauccuu

SEQ ID NO: 735586 - RNA, 18 nt, Homo sapiens
aagaguuugacuuagaau

SEQ ID NO: 735587 - RNA, 19 nt, Homo sapiens
aagauaaaauauccucagg

SEQ ID NO: 735588 - RNA, 17 nt, Homo sapiens
aagauaaaccaguugaa

SEQ ID NO: 735589 - RNA, 19 nt, Homo sapiens
aagauaaaugugcugaaug

SEQ ID NO: 735590 - RNA, 16 nt, Homo sapiens
aagauaacuuacugua

SEQ ID NO: 735591 - RNA, 15 nt, Homo sapiens
aagauacagacauuc

SEQ ID NO: 735592 - RNA, 19 nt, Homo sapiens
aagauaccaaaaccacagu

SEQ ID NO: 735593 - RNA, 16 nt, Homo sapiens
aagauauaacauucag

SEQ ID NO: 735594 - RNA, 18 nt, Homo sapiens
aagauauagaaacucuca

SEQ ID NO: 735595 - RNA, 19 nt, Homo sapiens
aagauauagaaacucucau

SEQ ID NO: 735596 - RNA, 13 nt, Homo sapiens
aagauauaugaau

SEQ ID NO: 735597 - RNA, 18 nt, Homo sapiens
aagauauccacuuaccug

SEQ ID NO: 735598 - RNA, 20 nt, Homo sapiens
aagauauccacuuaccugag

SEQ ID NO: 735599 - RNA, 21 nt, Homo sapiens
aagauauccacuuaccugagu

SEQ ID NO: 735600 - RNA, 19 nt, Homo sapiens
aagauaugugggugcuccu

SEQ ID NO: 735601 - RNA, 22 nt, Homo sapiens
aagaucaaaauaaaaagugaca

SEQ ID NO: 735602 - RNA, 12 nt, Homo sapiens
aagaucaaagac

SEQ ID NO: 735603 - RNA, 19 nt, Homo sapiens
aagaucaacgccucacuga

SEQ ID NO: 735604 - RNA, 21 nt, Homo sapiens
aagauccaagaaggccuucau

SEQ ID NO: 735605 - RNA, 17 nt, Homo sapiens
aagauccuccugcugca

SEQ ID NO: 735606 - RNA, 17 nt, Homo sapiens
aagauccugaagcaguu

SEQ ID NO: 735607 - RNA, 23 nt, Homo sapiens
aagaucuccaacagccagugugu

SEQ ID NO: 735608 - RNA, 15 nt, Homo sapiens
aagaugaaguuuuau

SEQ ID NO: 735609 - RNA, 17 nt, Homo sapiens
aagaugaugaugaucuu

SEQ ID NO: 735610 - RNA, 14 nt, Homo sapiens
aagaugauugacuc

SEQ ID NO: 735611 - RNA, 12 nt, Homo sapiens
aagaugcuccug

SEQ ID NO: 735612 - RNA, 17 nt, Homo sapiens
aagauggagacacccuc

SEQ ID NO: 735613 - RNA, 18 nt, Homo sapiens
aagauggcuuuuucuccu

SEQ ID NO: 735614 - RNA, 17 nt, Homo sapiens
aagaugguuaagucaau

SEQ ID NO: 735615 - RNA, 20 nt, Homo sapiens
aagaugugauauucuaagac

SEQ ID NO: 735616 - RNA, 17 nt, Homo sapiens
aagauguguaaacaggu

SEQ ID NO: 735617 - RNA, 22 nt, Homo sapiens
aagauguugauuuuuacugugu

SEQ ID NO: 735618 - RNA, 16 nt, Homo sapiens
aagauuaacacauuug

SEQ ID NO: 735619 - RNA, 20 nt, Homo sapiens
aagauucauauuuacuucuu

SEQ ID NO: 735620 - RNA, 21 nt, Homo sapiens
aagauucauauuuacuucuua

SEQ ID NO: 735621 - RNA, 23 nt, Homo sapiens
aagauuccugguuaaauuugaau

SEQ ID NO: 735622 - RNA, 20 nt, Homo sapiens
aagauucuauaguucuagac

SEQ ID NO: 735623 - RNA, 17 nt, Homo sapiens
aagauucuccugugcua

SEQ ID NO: 735624 - RNA, 14 nt, Homo sapiens
aagauucuguguca

SEQ ID NO: 735625 - RNA, 14 nt, Homo sapiens
aagauugaacuuaa

SEQ ID NO: 735626 - RNA, 17 nt, Homo sapiens
aagauugagaagccaug

SEQ ID NO: 735627 - RNA, 22 nt, Homo sapiens
acaaacauguauguauacauga

SEQ ID NO: 735628 - RNA, 18 nt, Homo sapiens
acaaaccacaacugacac

SEQ ID NO: 735629 - RNA, 14 nt, Homo sapiens
acaaaccacaccac

SEQ ID NO: 735630 - RNA, 20 nt, Homo sapiens
acaaacucucaccaugaugu

SEQ ID NO: 735631 - RNA, 12 nt, Homo sapiens
acaaacugcaau

SEQ ID NO: 735632 - RNA, 12 nt, Homo sapiens
acaaacugcaca

SEQ ID NO: 735633 - RNA, 19 nt, Homo sapiens
acaaacuuuguuugucaca

SEQ ID NO: 735634 - RNA, 15 nt, Homo sapiens
acaaagaaacaaaga

SEQ ID NO: 735635 - RNA, 17 nt, Homo sapiens
acaaagacaugcuuucc

SEQ ID NO: 735636 - RNA, 16 nt, Homo sapiens
acaaagagguguacag

SEQ ID NO: 735637 - RNA, 19 nt, Homo sapiens
acaaagagguguacaggua

SEQ ID NO: 735638 - RNA, 18 nt, Homo sapiens
acaaagccuuugcuuugu

SEQ ID NO: 735639 - RNA, 19 nt, Homo sapiens
acaaagcucaaaguaugca

SEQ ID NO: 735640 - RNA, 21 nt, Homo sapiens
acaaaggaaauaucaaagugu

SEQ ID NO: 735641 - RNA, 16 nt, Homo sapiens
acaaaggaaguucucc

SEQ ID NO: 735642 - RNA, 15 nt, Homo sapiens
acaaagggauguuca

SEQ ID NO: 735643 - RNA, 19 nt, Homo sapiens
acaaaguccacuuuacuca

SEQ ID NO: 735644 - RNA, 19 nt, Homo sapiens
acaaagucuaaggaagaau

SEQ ID NO: 735645 - RNA, 19 nt, Homo sapiens
acaaauaaaccugaggcag

SEQ ID NO: 735646 - RNA, 18 nt, Homo sapiens
acaaauaaacucauuuaa

SEQ ID NO: 735647 - RNA, 17 nt, Homo sapiens
acaaauaaagugcaguu

SEQ ID NO: 735648 - RNA, 19 nt, Homo sapiens
acaaauaaagugcaguuua

SEQ ID NO: 735649 - RNA, 15 nt, Homo sapiens
acaaauaauagcaau

SEQ ID NO: 735650 - RNA, 17 nt, Homo sapiens
acaaauaaucacauuga

SEQ ID NO: 735651 - RNA, 13 nt, Homo sapiens
acaaauacuacag

SEQ ID NO: 735652 - RNA, 19 nt, Homo sapiens
acaaauauagagaauuccu

SEQ ID NO: 735653 - RNA, 13 nt, Homo sapiens
guaccacuacuua

SEQ ID NO: 735654 - RNA, 21 nt, Homo sapiens
guaccacucaggccaacaagc

SEQ ID NO: 735655 - RNA, 17 nt, Homo sapiens
guacccagccaucugcc

SEQ ID NO: 735656 - RNA, 13 nt, Homo sapiens
guaccucuaagua

SEQ ID NO: 735657 - RNA, 16 nt, Homo sapiens
guacuagcaguguuuc

SEQ ID NO: 735658 - RNA, 22 nt, Homo sapiens
guacucacauauaacaugcaaa

SEQ ID NO: 735659 - RNA, 16 nt, Homo sapiens
guacucacuuuuucca

SEQ ID NO: 735660 - RNA, 16 nt, Homo sapiens
guacuccuuaagaaca

SEQ ID NO: 735661 - RNA, 13 nt, Homo sapiens
guacucuccugga

SEQ ID NO: 735662 - RNA, 18 nt, Homo sapiens
guacucuguccaguuccu

SEQ ID NO: 735663 - RNA, 18 nt, Homo sapiens
guacugaaagccuuaggg

SEQ ID NO: 735664 - RNA, 17 nt, Homo sapiens
guacugacuuugcuugc

SEQ ID NO: 735665 - RNA, 21 nt, Homo sapiens
guacugccaauacugccaacc

SEQ ID NO: 735666 - RNA, 23 nt, Homo sapiens
guacuguaauggguaauucugac

SEQ ID NO: 735667 - RNA, 11 nt, Homo sapiens
guacuguguuu

SEQ ID NO: 735668 - RNA, 14 nt, Homo sapiens
guacuuauguugca

SEQ ID NO: 735669 - RNA, 20 nt, Homo sapiens
guacuuauguugcacaauga

SEQ ID NO: 735670 - RNA, 17 nt, Homo sapiens
guacuuauuacugcuaa

SEQ ID NO: 735671 - RNA, 14 nt, Homo sapiens
guacuucagugcac

SEQ ID NO: 735672 - RNA, 12 nt, Homo sapiens
guacuucuugaa

SEQ ID NO: 735673 - RNA, 20 nt, Homo sapiens
guacuugugaaacacagcug

SEQ ID NO: 735674 - RNA, 22 nt, Homo sapiens
guacuuugaguauaacaucaag

SEQ ID NO: 735675 - RNA, 23 nt, Homo sapiens
guacuuugcugaaugucauuuua

SEQ ID NO: 735676 - RNA, 14 nt, Homo sapiens
guacuuuugagugu

SEQ ID NO: 735677 - RNA, 15 nt, Homo sapiens
guacuuuuuccagac

SEQ ID NO: 735678 - RNA, 22 nt, Homo sapiens
guacuuuuucuaccuguacaca

SEQ ID NO: 735679 - RNA, 18 nt, Homo sapiens
guacuuuuuuuaaacugu

SEQ ID NO: 735680 - RNA, 23 nt, Homo sapiens
guagaaagauccuucgggugcug

SEQ ID NO: 735681 - RNA, 14 nt, Homo sapiens
guagaaagccaaau

SEQ ID NO: 735682 - RNA, 18 nt, Homo sapiens
guagaaauaauaugcauu

SEQ ID NO: 735683 - RNA, 22 nt, Homo sapiens
guagaaauuaacaaaugugcug

SEQ ID NO: 735684 - RNA, 22 nt, Homo sapiens
guagaacagauaaucagugugu

SEQ ID NO: 735685 - RNA, 13 nt, Homo sapiens
guagaacugagaa

SEQ ID NO: 735686 - RNA, 21 nt, Homo sapiens
guagaaggggaggacacuggu

SEQ ID NO: 735687 - RNA, 23 nt, Homo sapiens
guagaaguuuggcugcugucaua

SEQ ID NO: 735688 - RNA, 21 nt, Homo sapiens
guagaaucucuucaugcuuga

SEQ ID NO: 735689 - RNA, 20 nt, Homo sapiens
guagacugaauucagcacca

SEQ ID NO: 735690 - RNA, 12 nt, Homo sapiens
guagacuuugcu

SEQ ID NO: 735691 - RNA, 18 nt, Homo sapiens
guagagacaauacaguaa

SEQ ID NO: 735692 - RNA, 21 nt, Homo sapiens
guagagacgguguuuugccau

SEQ ID NO: 735693 - RNA, 13 nt, Homo sapiens
guagagccagcuu

SEQ ID NO: 735694 - RNA, 15 nt, Homo sapiens
guagaggagcagggu

SEQ ID NO: 735695 - RNA, 14 nt, Homo sapiens
guagaguuuuguca

SEQ ID NO: 735696 - RNA, 14 nt, Homo sapiens
guagcauacuggcu

SEQ ID NO: 735697 - RNA, 12 nt, Homo sapiens
guagccagguac

SEQ ID NO: 735698 - RNA, 20 nt, Homo sapiens
guagccaucaagcacuuccc

SEQ ID NO: 735699 - RNA, 14 nt, Homo sapiens
guagcccagcacug

SEQ ID NO: 735700 - RNA, 21 nt, Homo sapiens
guagccugggcucacugugcu

SEQ ID NO: 735701 - RNA, 17 nt, Homo sapiens
guagccugugcauguau

SEQ ID NO: 735702 - RNA, 15 nt, Homo sapiens
guagccuucuucccu

SEQ ID NO: 735703 - RNA, 14 nt, Homo sapiens
guagcuacaggaca

SEQ ID NO: 735704 - RNA, 16 nt, Homo sapiens
guagcuacaggacauu

SEQ ID NO: 735705 - RNA, 19 nt, Homo sapiens
guagcuaugggccauaacc

SEQ ID NO: 735706 - RNA, 19 nt, Homo sapiens
guagcugagacuacaggca

SEQ ID NO: 735707 - RNA, 12 nt, Homo sapiens
guagcugaugaa

SEQ ID NO: 735708 - RNA, 11 nt, Homo sapiens
guagcugugcg

SEQ ID NO: 735709 - RNA, 22 nt, Homo sapiens
guagcugugucauguauauacc

SEQ ID NO: 735710 - RNA, 15 nt, Homo sapiens
guagcuucugcaguu

SEQ ID NO: 735711 - RNA, 22 nt, Homo sapiens
guagcuuuccacauuugucaca

SEQ ID NO: 735712 - RNA, 17 nt, Homo sapiens
guaggaaagucacccaa

SEQ ID NO: 735713 - RNA, 14 nt, Homo sapiens
guaggaacugcugg

SEQ ID NO: 735714 - RNA, 14 nt, Homo sapiens
guaggaucaccuga

SEQ ID NO: 735715 - RNA, 15 nt, Homo sapiens
guaggggauguggag

SEQ ID NO: 735716 - RNA, 19 nt, Homo sapiens
guaggggguuauugccucu

SEQ ID NO: 735717 - RNA, 17 nt, Homo sapiens
guaggucggcacuugga

SEQ ID NO: 735718 - RNA, 14 nt, Homo sapiens
guaggugauguuuc

SEQ ID NO: 735719 - RNA, 16 nt, Homo sapiens
guagguggaucaccug

SEQ ID NO: 735720 - RNA, 17 nt, Homo sapiens
guaggugugacuugaac

SEQ ID NO: 735721 - RNA, 16 nt, Homo sapiens
guagucauucuuacaa

SEQ ID NO: 735722 - RNA, 17 nt, Homo sapiens
guagugaaauuauacag

SEQ ID NO: 735723 - RNA, 11 nt, Homo sapiens
guagugcaagc

SEQ ID NO: 735724 - RNA, 15 nt, Homo sapiens
guagugccacuguug

SEQ ID NO: 735725 - RNA, 14 nt, Homo sapiens
guaguuacuguggu

SEQ ID NO: 735726 - RNA, 14 nt, Homo sapiens
guaguuauucugcc

SEQ ID NO: 735727 - RNA, 18 nt, Homo sapiens
guaguuguugaguucaag

SEQ ID NO: 735728 - RNA, 19 nt, Homo sapiens
guaguuuuguacauaacuu

SEQ ID NO: 735729 - RNA, 21 nt, Homo sapiens
guaguuuuuacagcuguguua

SEQ ID NO: 735730 - RNA, 13 nt, Homo sapiens
guauaaacacucu

SEQ ID NO: 735731 - RNA, 17 nt, Homo sapiens
guauaaagucacuucca

SEQ ID NO: 735732 - RNA, 16 nt, Homo sapiens
guauaaauauacagua

SEQ ID NO: 735733 - RNA, 16 nt, Homo sapiens
guauaaauuuuuaccu

SEQ ID NO: 735734 - RNA, 21 nt, Homo sapiens
guauaacaagccaaacauucu

SEQ ID NO: 735735 - RNA, 18 nt, Homo sapiens
guauaaguauucaaguau

SEQ ID NO: 735736 - RNA, 21 nt, Homo sapiens
guauaaguuauuuuuguacau

SEQ ID NO: 735737 - RNA, 15 nt, Homo sapiens
guauaaucccaccca

SEQ ID NO: 735738 - RNA, 20 nt, Homo sapiens
guauaauugaccuacuuugg

SEQ ID NO: 735739 - RNA, 15 nt, Homo sapiens
guauacauguguaca

SEQ ID NO: 735740 - RNA, 19 nt, Homo sapiens
guauacauguguacauaua

SEQ ID NO: 735741 - RNA, 19 nt, Homo sapiens
guauacugugugggauacu

SEQ ID NO: 735742 - RNA, 23 nt, Homo sapiens
guauaggacucucaggcuuuuau

SEQ ID NO: 735743 - RNA, 21 nt, Homo sapiens
guauaggggcaacuguaugaa

SEQ ID NO: 735744 - RNA, 17 nt, Homo sapiens
guauaguugcuugccug

SEQ ID NO: 735745 - RNA, 13 nt, Homo sapiens
guauauccaaaag

SEQ ID NO: 735746 - RNA, 10 nt, Homo sapiens
guauaugcac

SEQ ID NO: 735747 - RNA, 12 nt, Homo sapiens
guauaugcauuc

SEQ ID NO: 735748 - RNA, 16 nt, Homo sapiens
guauaugucauuuacu

SEQ ID NO: 735749 - RNA, 20 nt, Homo sapiens
guauauucugguuacugugg

SEQ ID NO: 735750 - RNA, 14 nt, Homo sapiens
guauauugucagau

SEQ ID NO: 735751 - RNA, 14 nt, Homo sapiens
guaucaaugaguaa

SEQ ID NO: 735752 - RNA, 19 nt, Homo sapiens
guauccccccaucuugcuu

SEQ ID NO: 735753 - RNA, 20 nt, Homo sapiens
guaucuagcucuaguucaaa

SEQ ID NO: 735754 - RNA, 17 nt, Homo sapiens
guaucucuucagucucu

SEQ ID NO: 735755 - RNA, 21 nt, Homo sapiens
guaucucuuuugaauccaugc

SEQ ID NO: 735756 - RNA, 18 nt, Homo sapiens
guaucuuccaaguacuca

SEQ ID NO: 735757 - RNA, 19 nt, Homo sapiens
guaucuugccuaaggugcg

SEQ ID NO: 735758 - RNA, 21 nt, Homo sapiens
guaucuuucauccuugacuaa

SEQ ID NO: 735759 - RNA, 14 nt, Homo sapiens
guaugacuaaagag

SEQ ID NO: 735760 - RNA, 17 nt, Homo sapiens
guaugagucuucuguaa

SEQ ID NO: 735761 - RNA, 19 nt, Homo sapiens
guaugaucaauaaaggaca

SEQ ID NO: 735762 - RNA, 15 nt, Homo sapiens
guaugcaaaccucau

SEQ ID NO: 735763 - RNA, 17 nt, Homo sapiens
guauggacgugugugaa

SEQ ID NO: 735764 - RNA, 16 nt, Homo sapiens
guauggcagaggugca

SEQ ID NO: 735765 - RNA, 18 nt, Homo sapiens
guauggcaugaacaucuu

SEQ ID NO: 735766 - RNA, 18 nt, Homo sapiens
guauggcguugguuugug

SEQ ID NO: 735767 - RNA, 20 nt, Homo sapiens
guauguccccauaagacaaa

SEQ ID NO: 735768 - RNA, 12 nt, Homo sapiens
acaaauaugcaa

SEQ ID NO: 735769 - RNA, 22 nt, Homo sapiens
acaaauauggggaaaaaacugu

SEQ ID NO: 735770 - RNA, 22 nt, Homo sapiens
acaaaucuuuuucuauauucuc

SEQ ID NO: 735771 - RNA, 18 nt, Homo sapiens
acaaaugauuuccacaaa

SEQ ID NO: 735772 - RNA, 21 nt, Homo sapiens
acaaaugguggguacaaaaag

SEQ ID NO: 735773 - RNA, 17 nt, Homo sapiens
acaaaugguuaccuugu

SEQ ID NO: 735774 - RNA, 18 nt, Homo sapiens
acaaauuaagauguucag

SEQ ID NO: 735775 - RNA, 17 nt, Homo sapiens
acaaauuagccauuuca

SEQ ID NO: 735776 - RNA, 18 nt, Homo sapiens
acaaauuauaaaaaccau

SEQ ID NO: 735777 - RNA, 16 nt, Homo sapiens
acaaauuauguuacau

SEQ ID NO: 735778 - RNA, 17 nt, Homo sapiens
acaaauuuggccuuaag

SEQ ID NO: 735779 - RNA, 17 nt, Homo sapiens
acaaauuugugugacag

SEQ ID NO: 735780 - RNA, 12 nt, Homo sapiens
acaacaacaaaa

SEQ ID NO: 735781 - RNA, 15 nt, Homo sapiens
acaacaagaugaaau

SEQ ID NO: 735782 - RNA, 16 nt, Homo sapiens
acaacaauccuucuau

SEQ ID NO: 735783 - RNA, 14 nt, Homo sapiens
acaacagaagucau

SEQ ID NO: 735784 - RNA, 22 nt, Homo sapiens
acaacagcaaaacuccaucuca

SEQ ID NO: 735785 - RNA, 13 nt, Homo sapiens
acaacauaucuca

SEQ ID NO: 735786 - RNA, 19 nt, Homo sapiens
acaacauuucucaaaugca

SEQ ID NO: 735787 - RNA, 20 nt, Homo sapiens
acaaccaaaaaauucuacaa

SEQ ID NO: 735788 - RNA, 14 nt, Homo sapiens
acaaccagauuuga

SEQ ID NO: 735789 - RNA, 19 nt, Homo sapiens
acaacccaccccgcuuucg

SEQ ID NO: 735790 - RNA, 10 nt, Homo sapiens
acaacccagg

SEQ ID NO: 735791 - RNA, 15 nt, Homo sapiens
acaaccucaucagcu

SEQ ID NO: 735792 - RNA, 18 nt, Homo sapiens
acaacgccgagugcacug

SEQ ID NO: 735793 - RNA, 13 nt, Homo sapiens
acaacuaccuaug

SEQ ID NO: 735794 - RNA, 16 nt, Homo sapiens
acaacuauuuuuccaa

SEQ ID NO: 735795 - RNA, 17 nt, Homo sapiens
acaacucaagggcacau

SEQ ID NO: 735796 - RNA, 21 nt, Homo sapiens
acaacucugcuugcucaucca

SEQ ID NO: 735797 - RNA, 13 nt, Homo sapiens
acaacugauugca

SEQ ID NO: 735798 - RNA, 14 nt, Homo sapiens
acaacugugugauu

SEQ ID NO: 735799 - RNA, 22 nt, Homo sapiens
acaacuuccucccuuacagagc

SEQ ID NO: 735800 - RNA, 21 nt, Homo sapiens
acaacuugcuacugacuggac

SEQ ID NO: 735801 - RNA, 16 nt, Homo sapiens
acaacuuguauuucca

SEQ ID NO: 735802 - RNA, 23 nt, Homo sapiens
acaacuuucuccuacucuuccuu

SEQ ID NO: 735803 - RNA, 14 nt, Homo sapiens
acaagaaaucugac

SEQ ID NO: 735804 - RNA, 16 nt, Homo sapiens
acaagaacaaagccac

SEQ ID NO: 735805 - RNA, 20 nt, Homo sapiens
acaagaacuuuaaauugugu

SEQ ID NO: 735806 - RNA, 11 nt, Homo sapiens
acaagaagcug

SEQ ID NO: 735807 - RNA, 16 nt, Homo sapiens
acaagaaugcauuccc

SEQ ID NO: 735808 - RNA, 18 nt, Homo sapiens
acaagaaugcauucccug

SEQ ID NO: 735809 - RNA, 15 nt, Homo sapiens
acaagaccaccacuu

SEQ ID NO: 735810 - RNA, 17 nt, Homo sapiens
acaagaccccgucucaa

SEQ ID NO: 735811 - RNA, 15 nt, Homo sapiens
acaagaccucagugc

SEQ ID NO: 735812 - RNA, 17 nt, Homo sapiens
acaagagaucuacacau

SEQ ID NO: 735813 - RNA, 14 nt, Homo sapiens
acaagagaugggau

SEQ ID NO: 735814 - RNA, 16 nt, Homo sapiens
acaagagugaauuuga

SEQ ID NO: 735815 - RNA, 15 nt, Homo sapiens
acaagauaccaaggc

SEQ ID NO: 735816 - RNA, 20 nt, Homo sapiens
acaagauccuccugcugcag

SEQ ID NO: 735817 - RNA, 13 nt, Homo sapiens
acaagaugagauu

SEQ ID NO: 735818 - RNA, 17 nt, Homo sapiens
acaagaugguucuagca

SEQ ID NO: 735819 - RNA, 20 nt, Homo sapiens
acaagauuaccccaccuugc

SEQ ID NO: 735820 - RNA, 14 nt, Homo sapiens
acaagauugcuuaa

SEQ ID NO: 735821 - RNA, 16 nt, Homo sapiens
acaagcaaaaccaaag

SEQ ID NO: 735822 - RNA, 19 nt, Homo sapiens
acaagcccguuagccccag

SEQ ID NO: 735823 - RNA, 19 nt, Homo sapiens
acaagcgaaucucugccuu

SEQ ID NO: 735824 - RNA, 22 nt, Homo sapiens
acaaggagauuucuuaguucau

SEQ ID NO: 735825 - RNA, 16 nt, Homo sapiens
acaaggaugacaagaa

SEQ ID NO: 735826 - RNA, 16 nt, Homo sapiens
acaaggcccuucagcc

SEQ ID NO: 735827 - RNA, 23 nt, Homo sapiens
acaaggcgaguggauaauuccaa

SEQ ID NO: 735828 - RNA, 16 nt, Homo sapiens
acaaggcugaccaaga

SEQ ID NO: 735829 - RNA, 17 nt, Homo sapiens
acaaguaaaacuguggu

SEQ ID NO: 735830 - RNA, 21 nt, Homo sapiens
acaaguaccacucuuggucag

SEQ ID NO: 735831 - RNA, 18 nt, Homo sapiens
acaagugggugaaugugg

SEQ ID NO: 735832 - RNA, 17 nt, Homo sapiens
acaagugugaugccaua

SEQ ID NO: 735833 - RNA, 19 nt, Homo sapiens
acaauaaaaaauccucaac

SEQ ID NO: 735834 - RNA, 18 nt, Homo sapiens
acaauaaaaauuccaaau

SEQ ID NO: 735835 - RNA, 13 nt, Homo sapiens
acaauaaaagcuu

SEQ ID NO: 735836 - RNA, 15 nt, Homo sapiens
acaauaacacugucu

SEQ ID NO: 735837 - RNA, 16 nt, Homo sapiens
acaauaauuacauugg

SEQ ID NO: 735838 - RNA, 14 nt, Homo sapiens
acaauacaguauua

SEQ ID NO: 735839 - RNA, 23 nt, Homo sapiens
acaauacugggguuggacuguaa

SEQ ID NO: 735840 - RNA, 18 nt, Homo sapiens
acaauagugauugauaga

SEQ ID NO: 735841 - RNA, 21 nt, Homo sapiens
acaauauuccagaucuuucag

SEQ ID NO: 735842 - RNA, 16 nt, Homo sapiens
acaaucaacaaaaugg

SEQ ID NO: 735843 - RNA, 17 nt, Homo sapiens
acaaucaccgaugcaaa

SEQ ID NO: 735844 - RNA, 14 nt, Homo sapiens
acaaucacugccaa

SEQ ID NO: 735845 - RNA, 19 nt, Homo sapiens
acaaucaugaaauaugcau

SEQ ID NO: 735846 - RNA, 15 nt, Homo sapiens
acaauccaucucuca

SEQ ID NO: 735847 - RNA, 12 nt, Homo sapiens
acaauccuccaa

SEQ ID NO: 735848 - RNA, 17 nt, Homo sapiens
acaauccugauaaauuu

SEQ ID NO: 735849 - RNA, 16 nt, Homo sapiens
acaaucuuugcuguau

SEQ ID NO: 735850 - RNA, 11 nt, Homo sapiens
acaaugcauuu

SEQ ID NO: 735851 - RNA, 15 nt, Homo sapiens
acaaugcugagguua

SEQ ID NO: 735852 - RNA, 11 nt, Homo sapiens
acaaugcugau

SEQ ID NO: 735853 - RNA, 14 nt, Homo sapiens
acaauguacaauua

SEQ ID NO: 735854 - RNA, 11 nt, Homo sapiens
acaauguaucu

SEQ ID NO: 735855 - RNA, 21 nt, Homo sapiens
acaauuauuuuuacaguucuc

SEQ ID NO: 735856 - RNA, 16 nt, Homo sapiens
acaauuccuagauaaa

SEQ ID NO: 735857 - RNA, 18 nt, Homo sapiens
acaauuguaauugacagg

SEQ ID NO: 735858 - RNA, 19 nt, Homo sapiens
acagaaacgagauuugcca

SEQ ID NO: 735859 - RNA, 12 nt, Homo sapiens
acagaaacugca

SEQ ID NO: 735860 - RNA, 18 nt, Homo sapiens
acagaaagacugagcuca

SEQ ID NO: 735861 - RNA, 20 nt, Homo sapiens
acagaaagagacuccgucuc

SEQ ID NO: 735862 - RNA, 19 nt, Homo sapiens
acagaaauacugcucugaa

SEQ ID NO: 735863 - RNA, 22 nt, Homo sapiens
acagaacacuuauguuauacaa

SEQ ID NO: 735864 - RNA, 18 nt, Homo sapiens
acagaacauauguugcaa

SEQ ID NO: 735865 - RNA, 18 nt, Homo sapiens
acagaacuauguacuuua

SEQ ID NO: 735866 - RNA, 16 nt, Homo sapiens
acagaacugaucucag

SEQ ID NO: 735867 - RNA, 21 nt, Homo sapiens
acagaacuucagaaagacuug

SEQ ID NO: 735868 - RNA, 12 nt, Homo sapiens
acagaacuugaa

SEQ ID NO: 735869 - RNA, 22 nt, Homo sapiens
acagaagcagcuaaaccaagga

SEQ ID NO: 735870 - RNA, 20 nt, Homo sapiens
acagaaggaaucugugcaga

SEQ ID NO: 735871 - RNA, 13 nt, Homo sapiens
acagaagugacuu

SEQ ID NO: 735872 - RNA, 14 nt, Homo sapiens
acagaauagcacaa

SEQ ID NO: 735873 - RNA, 20 nt, Homo sapiens
acagaauguuuuacugugaa

SEQ ID NO: 735874 - RNA, 18 nt, Homo sapiens
acagaauucucccagcgu

SEQ ID NO: 735875 - RNA, 21 nt, Homo sapiens
acagacaaaaauauuucagca

SEQ ID NO: 735876 - RNA, 15 nt, Homo sapiens
acagacacucccacu

SEQ ID NO: 735877 - RNA, 20 nt, Homo sapiens
acagacacuggcauggauau

SEQ ID NO: 735878 - RNA, 17 nt, Homo sapiens
acagacauuuuguguga

SEQ ID NO: 735879 - RNA, 19 nt, Homo sapiens
acagacauuuugugugaga

SEQ ID NO: 735880 - RNA, 16 nt, Homo sapiens
acagaccugugugugc

SEQ ID NO: 735881 - RNA, 12 nt, Homo sapiens
acagagaagcuc

SEQ ID NO: 735882 - RNA, 20 nt, Homo sapiens
acagagcaagacucugucuc

SEQ ID NO: 735883 - RNA, 18 nt, Homo sapiens
acagagcaagacugucuc

SEQ ID NO: 735884 - RNA, 14 nt, Homo sapiens
acagagcacauuug

SEQ ID NO: 735885 - RNA, 22 nt, Homo sapiens
acagagccagcggcuccaacuc

SEQ ID NO: 735886 - RNA, 19 nt, Homo sapiens
gucauggcuaauuuaacac

SEQ ID NO: 735887 - RNA, 16 nt, Homo sapiens
gucauguguuuugcca

SEQ ID NO: 735888 - RNA, 18 nt, Homo sapiens
gucauuaaacaugacauu

SEQ ID NO: 735889 - RNA, 20 nt, Homo sapiens
gucauuaagguuaugcacug

SEQ ID NO: 735890 - RNA, 16 nt, Homo sapiens
gucauuauuuuuguua

SEQ ID NO: 735891 - RNA, 21 nt, Homo sapiens
gucauuauuuuuguuagcaaa

SEQ ID NO: 735892 - RNA, 13 nt, Homo sapiens
gucauucauucaa

SEQ ID NO: 735893 - RNA, 20 nt, Homo sapiens
gucauuccaaauaugagaug

SEQ ID NO: 735894 - RNA, 19 nt, Homo sapiens
gucauugagcaguauauau

SEQ ID NO: 735895 - RNA, 13 nt, Homo sapiens
gucauuuauucaa

SEQ ID NO: 735896 - RNA, 11 nt, Homo sapiens
guccaaaaagc

SEQ ID NO: 735897 - RNA, 20 nt, Homo sapiens
guccaacaagaaugcauucc

SEQ ID NO: 735898 - RNA, 15 nt, Homo sapiens
guccaaccagaaaca

SEQ ID NO: 735899 - RNA, 20 nt, Homo sapiens
guccaaccagaaacaccccu

SEQ ID NO: 735900 - RNA, 15 nt, Homo sapiens
guccacaugaccucc

SEQ ID NO: 735901 - RNA, 21 nt, Homo sapiens
guccacccaggcugcacugca

SEQ ID NO: 735902 - RNA, 22 nt, Homo sapiens
guccaccucccauuacuuugau

SEQ ID NO: 735903 - RNA, 17 nt, Homo sapiens
guccacgauucacucau

SEQ ID NO: 735904 - RNA, 22 nt, Homo sapiens
guccagaaauugugugugcaag

SEQ ID NO: 735905 - RNA, 15 nt, Homo sapiens
guccagcucugacau

SEQ ID NO: 735906 - RNA, 18 nt, Homo sapiens
guccagcuugcucuucag

SEQ ID NO: 735907 - RNA, 23 nt, Homo sapiens
guccagguaaaugguaugaucaa

SEQ ID NO: 735908 - RNA, 16 nt, Homo sapiens
guccauccauucagaa

SEQ ID NO: 735909 - RNA, 15 nt, Homo sapiens
guccaugugaucuca

SEQ ID NO: 735910 - RNA, 11 nt, Homo sapiens
guccauucucu

SEQ ID NO: 735911 - RNA, 16 nt, Homo sapiens
gucccaaccccagugg

SEQ ID NO: 735912 - RNA, 17 nt, Homo sapiens
gucccaauagcucuacu

SEQ ID NO: 735913 - RNA, 23 nt, Homo sapiens
gucccacaccgcuggucccugcc

SEQ ID NO: 735914 - RNA, 17 nt, Homo sapiens
gucccagcuacucagaa

SEQ ID NO: 735915 - RNA, 15 nt, Homo sapiens
gucccaggcagggag

SEQ ID NO: 735916 - RNA, 19 nt, Homo sapiens
gucccaggccaggcuuugu

SEQ ID NO: 735917 - RNA, 12 nt, Homo sapiens
gucccagucucu

SEQ ID NO: 735918 - RNA, 18 nt, Homo sapiens
gucccauccccacauccc

SEQ ID NO: 735919 - RNA, 22 nt, Homo sapiens
gucccauggguuaagagcucac

SEQ ID NO: 735920 - RNA, 17 nt, Homo sapiens
guccccacccuccacuc

SEQ ID NO: 735921 - RNA, 13 nt, Homo sapiens
guccccagggaca

SEQ ID NO: 735922 - RNA, 21 nt, Homo sapiens
guccccccucaagaguacaga

SEQ ID NO: 735923 - RNA, 14 nt, Homo sapiens
guccccgaugcuga

SEQ ID NO: 735924 - RNA, 23 nt, Homo sapiens
guccccgggguuccccacacagg

SEQ ID NO: 735925 - RNA, 14 nt, Homo sapiens
guccccuccaggaa

SEQ ID NO: 735926 - RNA, 19 nt, Homo sapiens
guccccuucucucaucucu

SEQ ID NO: 735927 - RNA, 15 nt, Homo sapiens
guccccuuuccucua

SEQ ID NO: 735928 - RNA, 18 nt, Homo sapiens
guccccuuuccucuaacu

SEQ ID NO: 735929 - RNA, 20 nt, Homo sapiens
gucccggggcuccacugaac

SEQ ID NO: 735930 - RNA, 13 nt, Homo sapiens
gucccguggcauu

SEQ ID NO: 735931 - RNA, 17 nt, Homo sapiens
gucccguggcauuucaa

SEQ ID NO: 735932 - RNA, 14 nt, Homo sapiens
gucccucagugaua

SEQ ID NO: 735933 - RNA, 14 nt, Homo sapiens
gucccugcccuccc

SEQ ID NO: 735934 - RNA, 18 nt, Homo sapiens
gucccugucaccaagcuc

SEQ ID NO: 735935 - RNA, 18 nt, Homo sapiens
gucccuuggaaccuuugu

SEQ ID NO: 735936 - RNA, 13 nt, Homo sapiens
gucccuuggagac

SEQ ID NO: 735937 - RNA, 12 nt, Homo sapiens
guccgagucuca

SEQ ID NO: 735938 - RNA, 16 nt, Homo sapiens
guccgguguucuaaga

SEQ ID NO: 735939 - RNA, 18 nt, Homo sapiens
guccuaaggacacacuaa

SEQ ID NO: 735940 - RNA, 22 nt, Homo sapiens
guccuaaggcaucuaucugugc

SEQ ID NO: 735941 - RNA, 15 nt, Homo sapiens
guccuagacaggugu

SEQ ID NO: 735942 - RNA, 21 nt, Homo sapiens
guccuaugucaauuuguauau

SEQ ID NO: 735943 - RNA, 14 nt, Homo sapiens
guccucacaggugu

SEQ ID NO: 735944 - RNA, 23 nt, Homo sapiens
guccucacccaucaaaagcacca

SEQ ID NO: 735945 - RNA, 19 nt, Homo sapiens
guccucacgcagacacacc

SEQ ID NO: 735946 - RNA, 17 nt, Homo sapiens
guccucacucccagucc

SEQ ID NO: 735947 - RNA, 21 nt, Homo sapiens
guccucagccuugccagagau

SEQ ID NO: 735948 - RNA, 20 nt, Homo sapiens
guccucaugggucccuugaa

SEQ ID NO: 735949 - RNA, 14 nt, Homo sapiens
guccuccaccaugc

SEQ ID NO: 735950 - RNA, 15 nt, Homo sapiens
guccuccaccaugca

SEQ ID NO: 735951 - RNA, 16 nt, Homo sapiens
guccucucagaacucc

SEQ ID NO: 735952 - RNA, 13 nt, Homo sapiens
guccucucaguaa

SEQ ID NO: 735953 - RNA, 17 nt, Homo sapiens
guccucucccugccaag

SEQ ID NO: 735954 - RNA, 15 nt, Homo sapiens
guccucuucugggcc

SEQ ID NO: 735955 - RNA, 15 nt, Homo sapiens
guccucuugcucaaa

SEQ ID NO: 735956 - RNA, 12 nt, Homo sapiens
guccucuuuaca

SEQ ID NO: 735957 - RNA, 14 nt, Homo sapiens
guccugacaccugc

SEQ ID NO: 735958 - RNA, 20 nt, Homo sapiens
guccugagaaagcucaaagg

SEQ ID NO: 735959 - RNA, 20 nt, Homo sapiens
guccugcagcaaacacucca

SEQ ID NO: 735960 - RNA, 21 nt, Homo sapiens
guccugcuccgcugccuggaa

SEQ ID NO: 735961 - RNA, 14 nt, Homo sapiens
guccugcucucuuc

SEQ ID NO: 735962 - RNA, 23 nt, Homo sapiens
guccugggguauaaaacuuuccu

SEQ ID NO: 735963 - RNA, 12 nt, Homo sapiens
guccuggucaag

SEQ ID NO: 735964 - RNA, 13 nt, Homo sapiens
guccuguuugcag

SEQ ID NO: 735965 - RNA, 19 nt, Homo sapiens
guccuucaaacaauguaaa

SEQ ID NO: 735966 - RNA, 15 nt, Homo sapiens
guccuugcauggccu

SEQ ID NO: 735967 - RNA, 21 nt, Homo sapiens
guccuugugaguccaucuaac

SEQ ID NO: 735968 - RNA, 11 nt, Homo sapiens
guccuuuaugu

SEQ ID NO: 735969 - RNA, 18 nt, Homo sapiens
guccuuucccaccauucc

SEQ ID NO: 735970 - RNA, 15 nt, Homo sapiens
guccuuuuucacuuu

SEQ ID NO: 735971 - RNA, 21 nt, Homo sapiens
guccuuuuuuauacaggaaaa

SEQ ID NO: 735972 - RNA, 13 nt, Homo sapiens
gucgagacuucac

SEQ ID NO: 735973 - RNA, 20 nt, Homo sapiens
uaacucuucuaacacaaaau

SEQ ID NO: 735974 - RNA, 19 nt, Homo sapiens
uaacucuuuuggacaaagg

SEQ ID NO: 735975 - RNA, 21 nt, Homo sapiens
uaacugaaggagaaggugccc

SEQ ID NO: 735976 - RNA, 17 nt, Homo sapiens
uaacugauaaaccaaaa

SEQ ID NO: 735977 - RNA, 19 nt, Homo sapiens
uaacugauuaccugccaau

SEQ ID NO: 735978 - RNA, 21 nt, Homo sapiens
uaacugauuaccugccaauug

SEQ ID NO: 735979 - RNA, 15 nt, Homo sapiens
uaacugauuugcaau

SEQ ID NO: 735980 - RNA, 21 nt, Homo sapiens
uaacugcaaagugaaguugcu

SEQ ID NO: 735981 - RNA, 19 nt, Homo sapiens
uaacugcaccaacgagcug

SEQ ID NO: 735982 - RNA, 14 nt, Homo sapiens
uaacugccaagaaa

SEQ ID NO: 735983 - RNA, 20 nt, Homo sapiens
uaacuggagccccaucagcu

SEQ ID NO: 735984 - RNA, 15 nt, Homo sapiens
uaacuggcaguuuuc

SEQ ID NO: 735985 - RNA, 22 nt, Homo sapiens
uaacuggcuucugcuugucauc

SEQ ID NO: 735986 - RNA, 18 nt, Homo sapiens
uaacugugaaauaccaca

SEQ ID NO: 735987 - RNA, 19 nt, Homo sapiens
uaacugugaaauaccacaa

SEQ ID NO: 735988 - RNA, 19 nt, Homo sapiens
uaacugugacugaugacuu

SEQ ID NO: 735989 - RNA, 20 nt, Homo sapiens
uaacuuauuuuaaauaugcc

SEQ ID NO: 735990 - RNA, 19 nt, Homo sapiens
uaacuugagcuucacuguc

SEQ ID NO: 735991 - RNA, 13 nt, Homo sapiens
uaacuugcugcuu

SEQ ID NO: 735992 - RNA, 17 nt, Homo sapiens
uaacuuggucagagcca

SEQ ID NO: 735993 - RNA, 18 nt, Homo sapiens
uaacuuggucagagccac

SEQ ID NO: 735994 - RNA, 20 nt, Homo sapiens
uaacuuuauacacuuggauu

SEQ ID NO: 735995 - RNA, 15 nt, Homo sapiens
uaacuuuauguguaa

SEQ ID NO: 735996 - RNA, 18 nt, Homo sapiens
uaacuuucagaggcaaua

SEQ ID NO: 735997 - RNA, 14 nt, Homo sapiens
uaacuuucauacca

SEQ ID NO: 735998 - RNA, 17 nt, Homo sapiens
uaacuuucauaccacuu

SEQ ID NO: 735999 - RNA, 20 nt, Homo sapiens
uaacuuuucaaugacauuuu

SEQ ID NO: 736000 - RNA, 19 nt, Homo sapiens
uaacuuuucaccaaugagc

SEQ ID NO: 736001 - RNA, 20 nt, Homo sapiens
uaacuuuuuuuucucucuuu

SEQ ID NO: 736002 - RNA, 18 nt, Homo sapiens
uaagaaaaaaacuugucu

SEQ ID NO: 736003 - RNA, 14 nt, Homo sapiens
uaagaaaacuaaga

SEQ ID NO: 736004 - RNA, 16 nt, Homo sapiens
uaagaaacacugacuc

SEQ ID NO: 736005 - RNA, 14 nt, Homo sapiens
uaagaaauacucau

SEQ ID NO: 736006 - RNA, 12 nt, Homo sapiens
acugaaacugga

SEQ ID NO: 736007 - RNA, 21 nt, Homo sapiens
acugaaauuacggguaccuga

SEQ ID NO: 736008 - RNA, 13 nt, Homo sapiens
acugaacauguuu

SEQ ID NO: 736009 - RNA, 15 nt, Homo sapiens
acugaaccaguccag

SEQ ID NO: 736010 - RNA, 18 nt, Homo sapiens
acugaaccaguccaggug

SEQ ID NO: 736011 - RNA, 20 nt, Homo sapiens
acugaaccauuccaacuuca

SEQ ID NO: 736012 - RNA, 15 nt, Homo sapiens
acugaagacagaggu

SEQ ID NO: 736013 - RNA, 18 nt, Homo sapiens
acugaaggcauaugcaca

SEQ ID NO: 736014 - RNA, 17 nt, Homo sapiens
acugaaggccacuugag

SEQ ID NO: 736015 - RNA, 14 nt, Homo sapiens
acugaaggggcaca

SEQ ID NO: 736016 - RNA, 17 nt, Homo sapiens
acugaagggguucucac

SEQ ID NO: 736017 - RNA, 14 nt, Homo sapiens
acugaaguggcuaa

SEQ ID NO: 736018 - RNA, 22 nt, Homo sapiens
acugaauagauaugaaagcuga

SEQ ID NO: 736019 - RNA, 23 nt, Homo sapiens
acugaauauuaaaaagauagacu

SEQ ID NO: 736020 - RNA, 14 nt, Homo sapiens
acugaaucucaccu

SEQ ID NO: 736021 - RNA, 18 nt, Homo sapiens
acugaaucucaccugcug

SEQ ID NO: 736022 - RNA, 16 nt, Homo sapiens
acugaaugaauccauu

SEQ ID NO: 736023 - RNA, 14 nt, Homo sapiens
acugaaugagguca

SEQ ID NO: 736024 - RNA, 12 nt, Homo sapiens
acugaaugcacc

SEQ ID NO: 736025 - RNA, 18 nt, Homo sapiens
acugaauguguuugaaca

SEQ ID NO: 736026 - RNA, 12 nt, Homo sapiens
acugacacagga

SEQ ID NO: 736027 - RNA, 15 nt, Homo sapiens
acugacuccugugga

SEQ ID NO: 736028 - RNA, 17 nt, Homo sapiens
acugacugccuugcuaa

SEQ ID NO: 736029 - RNA, 12 nt, Homo sapiens
acugacuuucau

SEQ ID NO: 736030 - RNA, 15 nt, Homo sapiens
acugagaccaaagaa

SEQ ID NO: 736031 - RNA, 20 nt, Homo sapiens
acugagacuuggaaccucau

SEQ ID NO: 736032 - RNA, 15 nt, Homo sapiens
acugagauggaguga

SEQ ID NO: 736033 - RNA, 18 nt, Homo sapiens
acugagcagccgccagcu

SEQ ID NO: 736034 - RNA, 18 nt, Homo sapiens
acugaggagcggacucac

SEQ ID NO: 736035 - RNA, 23 nt, Homo sapiens
acugaggcccagggaggugaccc

SEQ ID NO: 736036 - RNA, 15 nt, Homo sapiens
acugagguaaccuua

SEQ ID NO: 736037 - RNA, 17 nt, Homo sapiens
acugagucaucuuguga

SEQ ID NO: 736038 - RNA, 13 nt, Homo sapiens
acugauccuggag

SEQ ID NO: 736039 - RNA, 21 nt, Homo sapiens
acugauccuggagaaaaggga

SEQ ID NO: 736040 - RNA, 15 nt, Homo sapiens
acugaucuuacucac

SEQ ID NO: 736041 - RNA, 21 nt, Homo sapiens
acugaugaguuucacuguacu

SEQ ID NO: 736042 - RNA, 14 nt, Homo sapiens
acugauguacaauu

SEQ ID NO: 736043 - RNA, 15 nt, Homo sapiens
acugauucaagaaca

SEQ ID NO: 736044 - RNA, 19 nt, Homo sapiens
acugauucaagaacaagca

SEQ ID NO: 736045 - RNA, 15 nt, Homo sapiens
acugauucacugcau

SEQ ID NO: 736046 - RNA, 24 nt, Homo sapiens
acugauuccuuuaugaugacugcu

SEQ ID NO: 736047 - RNA, 16 nt, Homo sapiens
acugcaaaccauggug

SEQ ID NO: 736048 - RNA, 20 nt, Homo sapiens
acugcaaaccauggugagaa

SEQ ID NO: 736049 - RNA, 19 nt, Homo sapiens
acugcaaagcucggugcuc

SEQ ID NO: 736050 - RNA, 20 nt, Homo sapiens
acugcaaaugcuauugucag

SEQ ID NO: 736051 - RNA, 19 nt, Homo sapiens
acugcaacaacgccuggug

SEQ ID NO: 736052 - RNA, 12 nt, Homo sapiens
acugcaaccucu

SEQ ID NO: 736053 - RNA, 15 nt, Homo sapiens
acugcacaaacaaua

SEQ ID NO: 736054 - RNA, 16 nt, Homo sapiens
acugcacaguagagca

SEQ ID NO: 736055 - RNA, 19 nt, Homo sapiens
acugcacagugcaucucag

SEQ ID NO: 736056 - RNA, 16 nt, Homo sapiens
acugcaccaacgagcu

SEQ ID NO: 736057 - RNA, 20 nt, Homo sapiens
acugcacuccaaucugggug

SEQ ID NO: 736058 - RNA, 20 nt, Homo sapiens
acugcacuccagccugggca

SEQ ID NO: 736059 - RNA, 15 nt, Homo sapiens
acugcacuccagucu

SEQ ID NO: 736060 - RNA, 13 nt, Homo sapiens
acugcauaauucu

SEQ ID NO: 736061 - RNA, 14 nt, Homo sapiens
acugcauacaaucu

SEQ ID NO: 736062 - RNA, 17 nt, Homo sapiens
acugcauagcagaccac

SEQ ID NO: 736063 - RNA, 21 nt, Homo sapiens
acugcauaugaaaggacacua

SEQ ID NO: 736064 - RNA, 16 nt, Homo sapiens
acugcaugaaugaaac

SEQ ID NO: 736065 - RNA, 16 nt, Homo sapiens
acugcauguaagccaa

SEQ ID NO: 736066 - RNA, 18 nt, Homo sapiens
acugcauucuucugagca

SEQ ID NO: 736067 - RNA, 22 nt, Homo sapiens
acugcauucuucugagcacugu

SEQ ID NO: 736068 - RNA, 23 nt, Homo sapiens
acugcauucuucugagcacuguu

SEQ ID NO: 736069 - RNA, 16 nt, Homo sapiens
acugcauuuacagugu

SEQ ID NO: 736070 - RNA, 19 nt, Homo sapiens
acugcauuuuuaaauacaa

SEQ ID NO: 736071 - RNA, 20 nt, Homo sapiens
acugccacacucuccaucac

SEQ ID NO: 736072 - RNA, 13 nt, Homo sapiens
acugccacccaca

SEQ ID NO: 736073 - RNA, 21 nt, Homo sapiens
acugccaucuuuaucaugaag

SEQ ID NO: 736074 - RNA, 20 nt, Homo sapiens
acugccaugcuagacaagcu

SEQ ID NO: 736075 - RNA, 15 nt, Homo sapiens
acugccgacaucccu

SEQ ID NO: 736076 - RNA, 13 nt, Homo sapiens
acugccucuggaa

SEQ ID NO: 736077 - RNA, 23 nt, Homo sapiens
acugccuggagggcagggagugg

SEQ ID NO: 736078 - RNA, 19 nt, Homo sapiens
acugccuguagagacaaua

SEQ ID NO: 736079 - RNA, 18 nt, Homo sapiens
acugccuuccacaauuca

SEQ ID NO: 736080 - RNA, 19 nt, Homo sapiens
acugcgccgaccccgccac

SEQ ID NO: 736081 - RNA, 15 nt, Homo sapiens
acugcuaaauccuca

SEQ ID NO: 736082 - RNA, 16 nt, Homo sapiens
acugcuauuagucaug

SEQ ID NO: 736083 - RNA, 19 nt, Homo sapiens
acugcucguggacugugcu

SEQ ID NO: 736084 - RNA, 16 nt, Homo sapiens
acugcugauucuugua

SEQ ID NO: 736085 - RNA, 13 nt, Homo sapiens
acugcuguagaca

SEQ ID NO: 736086 - RNA, 20 nt, Homo sapiens
acugcuucccuuacuuugcu

SEQ ID NO: 736087 - RNA, 22 nt, Homo sapiens
acugcuuuuaaaugaccaaaga

SEQ ID NO: 736088 - RNA, 19 nt, Homo sapiens
acuggaacaugcuuuuacu

SEQ ID NO: 736089 - RNA, 15 nt, Homo sapiens
acuggaagacacuuc

SEQ ID NO: 736090 - RNA, 16 nt, Homo sapiens
acuggaagacacuuca

SEQ ID NO: 736091 - RNA, 21 nt, Homo sapiens
acuggaagagaguuccgggaa

SEQ ID NO: 736092 - RNA, 19 nt, Homo sapiens
acuggaccgcugacugcac

SEQ ID NO: 736093 - RNA, 14 nt, Homo sapiens
acuggauauguugu

SEQ ID NO: 736094 - RNA, 19 nt, Homo sapiens
acuggauauguuguuaaac

SEQ ID NO: 736095 - RNA, 21 nt, Homo sapiens
acuggauggaaagacaaacug

SEQ ID NO: 736096 - RNA, 15 nt, Homo sapiens
acuggaugugauuau

SEQ ID NO: 736097 - RNA, 23 nt, Homo sapiens
acuggauucuuaaccaagaaaca

SEQ ID NO: 736098 - RNA, 20 nt, Homo sapiens
acuggauugcagacuguucu

SEQ ID NO: 736099 - RNA, 21 nt, Homo sapiens
acuggcacagagguagucuca

SEQ ID NO: 736100 - RNA, 14 nt, Homo sapiens
acuggcagcuccuc

SEQ ID NO: 736101 - RNA, 21 nt, Homo sapiens
acuggcaguaaccuagugaau

SEQ ID NO: 736102 - RNA, 16 nt, Homo sapiens
acuggcaugagccacu

SEQ ID NO: 736103 - RNA, 22 nt, Homo sapiens
acuggccagggccacgcuccag

SEQ ID NO: 736104 - RNA, 21 nt, Homo sapiens
acuggccauucuuauguucca

SEQ ID NO: 736105 - RNA, 13 nt, Homo sapiens
acuggcucuccaa

SEQ ID NO: 736106 - RNA, 17 nt, Homo sapiens
acuggcugucaguauga

SEQ ID NO: 736107 - RNA, 21 nt, Homo sapiens
acuggcuuaccuccucauggc

SEQ ID NO: 736108 - RNA, 19 nt, Homo sapiens
acuggcuucucuugaguca

SEQ ID NO: 736109 - RNA, 17 nt, Homo sapiens
acuggcuuuugccugua

SEQ ID NO: 736110 - RNA, 21 nt, Homo sapiens
acugggaaacuggguuucuca

SEQ ID NO: 736111 - RNA, 16 nt, Homo sapiens
acugggacagcccagg

SEQ ID NO: 736112 - RNA, 14 nt, Homo sapiens
acugggcucaagag

SEQ ID NO: 736113 - RNA, 15 nt, Homo sapiens
acugggucaugugca

SEQ ID NO: 736114 - RNA, 19 nt, Homo sapiens
acugggugaggauaacaca

SEQ ID NO: 736115 - RNA, 20 nt, Homo sapiens
acugggugcgucuccaguca

SEQ ID NO: 736116 - RNA, 21 nt, Homo sapiens
acuggguuuggaccccagcug

SEQ ID NO: 736117 - RNA, 16 nt, Homo sapiens
acugguauuaacuuua

SEQ ID NO: 736118 - RNA, 20 nt, Homo sapiens
acuggucccaagguguaaag

SEQ ID NO: 736119 - RNA, 13 nt, Homo sapiens
acuggugggccau

SEQ ID NO: 736120 - RNA, 22 nt, Homo sapiens
acuggugguucuacugacccaa

SEQ ID NO: 736121 - RNA, 17 nt, Homo sapiens
uaagaaaucuggcccag

SEQ ID NO: 736122 - RNA, 12 nt, Homo sapiens
uaagaaauucca

SEQ ID NO: 736123 - RNA, 17 nt, Homo sapiens
uaagaagaaaauugcug

SEQ ID NO: 736124 - RNA, 16 nt, Homo sapiens
uaagaagagaauuccu

SEQ ID NO: 736125 - RNA, 17 nt, Homo sapiens
uaagaagaggagccuca

SEQ ID NO: 736126 - RNA, 12 nt, Homo sapiens
uaagaagcaaua

SEQ ID NO: 736127 - RNA, 21 nt, Homo sapiens
uaagaagcugugaauauuccu

SEQ ID NO: 736128 - RNA, 14 nt, Homo sapiens
uaagaaugcuuugc

SEQ ID NO: 736129 - RNA, 20 nt, Homo sapiens
uaagaauuguuuuugaauuu

SEQ ID NO: 736130 - RNA, 18 nt, Homo sapiens
uaagacaaacacugccau

SEQ ID NO: 736131 - RNA, 15 nt, Homo sapiens
uaagaccccaucucu

SEQ ID NO: 736132 - RNA, 18 nt, Homo sapiens
uaagacuagauacucgug

SEQ ID NO: 736133 - RNA, 17 nt, Homo sapiens
uaagagacuggugacau

SEQ ID NO: 736134 - RNA, 21 nt, Homo sapiens
uaagagccauauaaguuugaa

SEQ ID NO: 736135 - RNA, 19 nt, Homo sapiens
uaagagcgaacuucacaua

SEQ ID NO: 736136 - RNA, 18 nt, Homo sapiens
uaagagcuuaagaaccau

SEQ ID NO: 736137 - RNA, 19 nt, Homo sapiens
uaagaggugaucucuggga

SEQ ID NO: 736138 - RNA, 24 nt, Homo sapiens
uaagaguggaaccaacacuaacau

SEQ ID NO: 736139 - RNA, 16 nt, Homo sapiens
uaagauagaacacaaa

SEQ ID NO: 736140 - RNA, 13 nt, Homo sapiens
uaagauccacaaa

SEQ ID NO: 736141 - RNA, 14 nt, Homo sapiens
uaagaugcacugaa

SEQ ID NO: 736142 - RNA, 15 nt, Homo sapiens
uaagaugcacugaaa

SEQ ID NO: 736143 - RNA, 13 nt, Homo sapiens
uaagaugugaaaa

SEQ ID NO: 736144 - RNA, 17 nt, Homo sapiens
uaagauguucacugugg

SEQ ID NO: 736145 - RNA, 18 nt, Homo sapiens
uaagauugauaucuauaa

SEQ ID NO: 736146 - RNA, 18 nt, Homo sapiens
uaagauuuuuuguaggca

SEQ ID NO: 736147 - RNA, 16 nt, Homo sapiens
uaagcacaaagcccau

SEQ ID NO: 736148 - RNA, 21 nt, Homo sapiens
uaagcagacucagcugcuaua

SEQ ID NO: 736149 - RNA, 14 nt, Homo sapiens
uaagcagaggaaua

SEQ ID NO: 736150 - RNA, 17 nt, Homo sapiens
uaagcagcuuacuuagu

SEQ ID NO: 736151 - RNA, 14 nt, Homo sapiens
uaagcccacuguua

SEQ ID NO: 736152 - RNA, 15 nt, Homo sapiens
uaagcccuuugcucu

SEQ ID NO: 736153 - RNA, 20 nt, Homo sapiens
uaagccugcauucuuaacaa

SEQ ID NO: 736154 - RNA, 16 nt, Homo sapiens
uaagcuaggaaugaaa

SEQ ID NO: 736155 - RNA, 20 nt, Homo sapiens
uaagcucacguccugagaaa

SEQ ID NO: 736156 - RNA, 20 nt, Homo sapiens
uaagcugagcuccuuagccu

SEQ ID NO: 736157 - RNA, 12 nt, Homo sapiens
uaagcugggaua

SEQ ID NO: 736158 - RNA, 20 nt, Homo sapiens
uaagcuguggcuggaauuga

SEQ ID NO: 736159 - RNA, 12 nt, Homo sapiens
uaagcuuuuugg

SEQ ID NO: 736160 - RNA, 16 nt, Homo sapiens
uaaggaagaaucuucu

SEQ ID NO: 736161 - RNA, 15 nt, Homo sapiens
uaaggaauuaccaag

SEQ ID NO: 736162 - RNA, 14 nt, Homo sapiens
uaaggacauuuccc

SEQ ID NO: 736163 - RNA, 16 nt, Homo sapiens
uaaggaccaauagcau

SEQ ID NO: 736164 - RNA, 12 nt, Homo sapiens
uaaggagcaaaa

SEQ ID NO: 736165 - RNA, 14 nt, Homo sapiens
uaaggaucucucag

SEQ ID NO: 736166 - RNA, 13 nt, Homo sapiens
uaaggaugaaggu

SEQ ID NO: 736167 - RNA, 21 nt, Homo sapiens
uaaggcaacuuauugcagugu

SEQ ID NO: 736168 - RNA, 16 nt, Homo sapiens
uaaggcaggagaauca

SEQ ID NO: 736169 - RNA, 17 nt, Homo sapiens
uaaggcuuuuucuuccc

SEQ ID NO: 736170 - RNA, 16 nt, Homo sapiens
uaagggaaacugccag

SEQ ID NO: 736171 - RNA, 14 nt, Homo sapiens
uaagggacaacauc

SEQ ID NO: 736172 - RNA, 21 nt, Homo sapiens
uaagggcacugagcccuuccc

SEQ ID NO: 736173 - RNA, 21 nt, Homo sapiens
uaagggccggggauggaucuu

SEQ ID NO: 736174 - RNA, 20 nt, Homo sapiens
uaaggguuaguuuacaauca

SEQ ID NO: 736175 - RNA, 16 nt, Homo sapiens
uaaggugaaccaaaga

SEQ ID NO: 736176 - RNA, 18 nt, Homo sapiens
uaaggugaagaaucuuuu

SEQ ID NO: 736177 - RNA, 16 nt, Homo sapiens
uaagguggguccagga

SEQ ID NO: 736178 - RNA, 19 nt, Homo sapiens
uaagguuaugcacugccug

SEQ ID NO: 736179 - RNA, 17 nt, Homo sapiens
uaagguucuaaggccua

SEQ ID NO: 736180 - RNA, 17 nt, Homo sapiens
uaagguuggagauguca

SEQ ID NO: 736181 - RNA, 20 nt, Homo sapiens
uaagguugucuacgggggca

SEQ ID NO: 736182 - RNA, 18 nt, Homo sapiens
uaagguuuguuuucauua

SEQ ID NO: 736183 - RNA, 13 nt, Homo sapiens
uaaguaauuauuc

SEQ ID NO: 736184 - RNA, 21 nt, Homo sapiens
uaaguacaacuaccuaugcca

SEQ ID NO: 736185 - RNA, 13 nt, Homo sapiens
uaaguacauauag

SEQ ID NO: 736186 - RNA, 15 nt, Homo sapiens
uaaguacaugugcca

SEQ ID NO: 736187 - RNA, 17 nt, Homo sapiens
uaaguacuugagacucu

SEQ ID NO: 736188 - RNA, 20 nt, Homo sapiens
uaaguaguugguuuccuuca

SEQ ID NO: 736189 - RNA, 14 nt, Homo sapiens
uaaguaucagaggu

SEQ ID NO: 736190 - RNA, 14 nt, Homo sapiens
uaagucaagcacau

SEQ ID NO: 736191 - RNA, 14 nt, Homo sapiens
uaagucucugugaa

SEQ ID NO: 736192 - RNA, 19 nt, Homo sapiens
uaagugcuuuguaauggga

SEQ ID NO: 736193 - RNA, 18 nt, Homo sapiens
uaaguguugguagcacuu

SEQ ID NO: 736194 - RNA, 18 nt, Homo sapiens
uaaguuccuacuaggcaa

SEQ ID NO: 736195 - RNA, 13 nt, Homo sapiens
uaaguugaaggaa

SEQ ID NO: 736196 - RNA, 13 nt, Homo sapiens
uaaguugucaaag

SEQ ID NO: 736197 - RNA, 16 nt, Homo sapiens
uaaguuguuauuucag

SEQ ID NO: 736198 - RNA, 16 nt, Homo sapiens
uaaguuucucuucacc

SEQ ID NO: 736199 - RNA, 15 nt, Homo sapiens
uaaguuugauuucau

SEQ ID NO: 736200 - RNA, 21 nt, Homo sapiens
uaaguuuuuccaaaaccucag

SEQ ID NO: 736201 - RNA, 18 nt, Homo sapiens
uaauaaaaaucauggcaa

SEQ ID NO: 736202 - RNA, 18 nt, Homo sapiens
uaauaaaaauuauuacca

SEQ ID NO: 736203 - RNA, 13 nt, Homo sapiens
uaauuuaugcaag

SEQ ID NO: 736204 - RNA, 17 nt, Homo sapiens
uaauuuccuuuuugaca

SEQ ID NO: 736205 - RNA, 21 nt, Homo sapiens
uaauuuccuuuuugacacuga

SEQ ID NO: 736206 - RNA, 17 nt, Homo sapiens
uaauuucuuacuaaaca

SEQ ID NO: 736207 - RNA, 16 nt, Homo sapiens
uaauuuugaaugcccu

SEQ ID NO: 736208 - RNA, 18 nt, Homo sapiens
uaauuuugagggcaugaa

SEQ ID NO: 736209 - RNA, 14 nt, Homo sapiens
uaauuuugauuucu

SEQ ID NO: 736210 - RNA, 22 nt, Homo sapiens
uaauuuuuccuauauugcauua

SEQ ID NO: 736211 - RNA, 14 nt, Homo sapiens
uaauuuuuugucug

SEQ ID NO: 736212 - RNA, 15 nt, Homo sapiens
uacaaaaaacaacaa

SEQ ID NO: 736213 - RNA, 16 nt, Homo sapiens
uacaaaaaaguaaccu

SEQ ID NO: 736214 - RNA, 14 nt, Homo sapiens
uacaaaaacacagc

SEQ ID NO: 736215 - RNA, 15 nt, Homo sapiens
uacaaaaacacagca

SEQ ID NO: 736216 - RNA, 17 nt, Homo sapiens
uacaaaaacacagcaag

SEQ ID NO: 736217 - RNA, 13 nt, Homo sapiens
uacaaaaagucaa

SEQ ID NO: 736218 - RNA, 17 nt, Homo sapiens
uacaaaaauuagcugug

SEQ ID NO: 736219 - RNA, 17 nt, Homo sapiens
uacaaaacaaucucuca

SEQ ID NO: 736220 - RNA, 12 nt, Homo sapiens
uacaaacccaaa

SEQ ID NO: 736221 - RNA, 18 nt, Homo sapiens
uacaaacuuuguuuguca

SEQ ID NO: 736222 - RNA, 22 nt, Homo sapiens
uacaaagccacccuaccaugaa

SEQ ID NO: 736223 - RNA, 15 nt, Homo sapiens
uacaaauucuucuaa

SEQ ID NO: 736224 - RNA, 17 nt, Homo sapiens
uacaaccaagcucucug

SEQ ID NO: 736225 - RNA, 20 nt, Homo sapiens
uacaacugcaccugucauca

SEQ ID NO: 736226 - RNA, 17 nt, Homo sapiens
uacaacuucaagugcau

SEQ ID NO: 736227 - RNA, 18 nt, Homo sapiens
uacaacuugcauauguca

SEQ ID NO: 736228 - RNA, 17 nt, Homo sapiens
uacaacuuguauuucca

SEQ ID NO: 736229 - RNA, 12 nt, Homo sapiens
uacaagaacaau

SEQ ID NO: 736230 - RNA, 20 nt, Homo sapiens
uacaagauugaaaaucuugu

SEQ ID NO: 736231 - RNA, 19 nt, Homo sapiens
uacaaggcuuuaucucagg

SEQ ID NO: 736232 - RNA, 14 nt, Homo sapiens
uacaagguaauugu

SEQ ID NO: 736233 - RNA, 13 nt, Homo sapiens
uacaaguuucaga

SEQ ID NO: 736234 - RNA, 19 nt, Homo sapiens
uacaaucaaggccacugcu

SEQ ID NO: 736235 - RNA, 20 nt, Homo sapiens
uacaaucagccacauucuag

SEQ ID NO: 736236 - RNA, 15 nt, Homo sapiens
uacaaucagcccagu

SEQ ID NO: 736237 - RNA, 19 nt, Homo sapiens
acuucuggaagucaucuca

SEQ ID NO: 736238 - RNA, 19 nt, Homo sapiens
acuucuggagaaagcucau

SEQ ID NO: 736239 - RNA, 19 nt, Homo sapiens
acuucugguauaauugugu

SEQ ID NO: 736240 - RNA, 16 nt, Homo sapiens
acuucuguauguguau

SEQ ID NO: 736241 - RNA, 20 nt, Homo sapiens
acuucugucuccugucuuca

SEQ ID NO: 736242 - RNA, 19 nt, Homo sapiens
acuucuucaccucuuccac

SEQ ID NO: 736243 - RNA, 13 nt, Homo sapiens
acuucuugaauau

SEQ ID NO: 736244 - RNA, 20 nt, Homo sapiens
acuucuugcuggucuaguca

SEQ ID NO: 736245 - RNA, 19 nt, Homo sapiens
acuucuugcuucuuucuag

SEQ ID NO: 736246 - RNA, 16 nt, Homo sapiens
acuucuuuuuaaucuu

SEQ ID NO: 736247 - RNA, 22 nt, Homo sapiens
acuugaaacagauucaggccag

SEQ ID NO: 736248 - RNA, 21 nt, Homo sapiens
acuugaaagaaauggugaaug

SEQ ID NO: 736249 - RNA, 14 nt, Homo sapiens
acuugaaaugcucu

SEQ ID NO: 736250 - RNA, 20 nt, Homo sapiens
acuugagaaaauaucuugcu

SEQ ID NO: 736251 - RNA, 13 nt, Homo sapiens
acuugagcaccgu

SEQ ID NO: 736252 - RNA, 23 nt, Homo sapiens
acuugaguuagcauaauacagaa

SEQ ID NO: 736253 - RNA, 19 nt, Homo sapiens
acuugauguguuaucucuu

SEQ ID NO: 736254 - RNA, 14 nt, Homo sapiens
acuugauugucucc

SEQ ID NO: 736255 - RNA, 15 nt, Homo sapiens
acuugcauacagaga

SEQ ID NO: 736256 - RNA, 15 nt, Homo sapiens
acuugccaugcagga

SEQ ID NO: 736257 - RNA, 13 nt, Homo sapiens
acuugccugcuag

SEQ ID NO: 736258 - RNA, 21 nt, Homo sapiens
acuugccuguucagagcacuc

SEQ ID NO: 736259 - RNA, 16 nt, Homo sapiens
acuugcuaaagcacuu

SEQ ID NO: 736260 - RNA, 19 nt, Homo sapiens
acuugcuccuuuugcucuu

SEQ ID NO: 736261 - RNA, 20 nt, Homo sapiens
acuugcugaauuucaggcau

SEQ ID NO: 736262 - RNA, 17 nt, Homo sapiens
acuugcugcugucuugu

SEQ ID NO: 736263 - RNA, 15 nt, Homo sapiens
acuuggaacuaggcu

SEQ ID NO: 736264 - RNA, 21 nt, Homo sapiens
acuuggaaguggggacaucag

SEQ ID NO: 736265 - RNA, 14 nt, Homo sapiens
acuuggcugcauuu

SEQ ID NO: 736266 - RNA, 17 nt, Homo sapiens
acuuggcugcauuugcc

SEQ ID NO: 736267 - RNA, 23 nt, Homo sapiens
acuuggggagauggaguucuugu

SEQ ID NO: 736268 - RNA, 21 nt, Homo sapiens
acuuggucagagccacucuau

SEQ ID NO: 736269 - RNA, 20 nt, Homo sapiens
acuuggugggaccaugaaca

SEQ ID NO: 736270 - RNA, 20 nt, Homo sapiens
acuugguuuccuauuucccc

SEQ ID NO: 736271 - RNA, 18 nt, Homo sapiens
acuugucaccaugagaua

SEQ ID NO: 736272 - RNA, 13 nt, Homo sapiens
acuuguccugacu

SEQ ID NO: 736273 - RNA, 17 nt, Homo sapiens
acuugugaaacacagcu

SEQ ID NO: 736274 - RNA, 16 nt, Homo sapiens
acuugugauccuaaaa

SEQ ID NO: 736275 - RNA, 21 nt, Homo sapiens
acuuguuagaucaaccuccaa

SEQ ID NO: 736276 - RNA, 14 nt, Homo sapiens
acuuguuugcacug

SEQ ID NO: 736277 - RNA, 16 nt, Homo sapiens
acuuguuugcacugug

SEQ ID NO: 736278 - RNA, 17 nt, Homo sapiens
acuuguuuuuauauuga

SEQ ID NO: 736279 - RNA, 16 nt, Homo sapiens
acuuuaaaagacugaa

SEQ ID NO: 736280 - RNA, 17 nt, Homo sapiens
acuuuaaaagugaucua

SEQ ID NO: 736281 - RNA, 21 nt, Homo sapiens
acuuuaagaacaaacucugaa

SEQ ID NO: 736282 - RNA, 12 nt, Homo sapiens
acuuuaagcauu

SEQ ID NO: 736283 - RNA, 18 nt, Homo sapiens
acuuuaagucucacccau

SEQ ID NO: 736284 - RNA, 14 nt, Homo sapiens
acuuuacacaagaa

SEQ ID NO: 736285 - RNA, 23 nt, Homo sapiens
acuuuacaggagguuguggaugc

SEQ ID NO: 736286 - RNA, 13 nt, Homo sapiens
acuuuaccugcug

SEQ ID NO: 736287 - RNA, 17 nt, Homo sapiens
acuuuacuguaauauaa

SEQ ID NO: 736288 - RNA, 22 nt, Homo sapiens
acuuuagacuucccacuguucu

SEQ ID NO: 736289 - RNA, 17 nt, Homo sapiens
acuuuagcaacaguuau

SEQ ID NO: 736290 - RNA, 21 nt, Homo sapiens
acuuuagcaacaguuaucaca

SEQ ID NO: 736291 - RNA, 14 nt, Homo sapiens
acuuuagguucaca

SEQ ID NO: 736292 - RNA, 18 nt, Homo sapiens
acuuuaguagacauuuau

SEQ ID NO: 736293 - RNA, 18 nt, Homo sapiens
acuuuauaaauccaguga

SEQ ID NO: 736294 - RNA, 15 nt, Homo sapiens
acuuuaucauaugcu

SEQ ID NO: 736295 - RNA, 22 nt, Homo sapiens
acuuuaucuauaucucauuuca

SEQ ID NO: 736296 - RNA, 19 nt, Homo sapiens
acuuuaugccggaugugcu

SEQ ID NO: 736297 - RNA, 22 nt, Homo sapiens
acuuuauguaguuuuuauaugu

SEQ ID NO: 736298 - RNA, 19 nt, Homo sapiens
acuuuauucagagcuaaua

SEQ ID NO: 736299 - RNA, 22 nt, Homo sapiens
acuuuauuucugaucuauacaa

SEQ ID NO: 736300 - RNA, 13 nt, Homo sapiens
acuuucaaacaua

SEQ ID NO: 736301 - RNA, 16 nt, Homo sapiens
acuuucaauugucacu

SEQ ID NO: 736302 - RNA, 16 nt, Homo sapiens
acuuucacacuaagaa

SEQ ID NO: 736303 - RNA, 20 nt, Homo sapiens
acuuucacagugaagugccu

SEQ ID NO: 736304 - RNA, 22 nt, Homo sapiens
acuuucagugcuuuuacuaucu

SEQ ID NO: 736305 - RNA, 12 nt, Homo sapiens
acuuucauguca

SEQ ID NO: 736306 - RNA, 17 nt, Homo sapiens
acuuuccucgccugaca

SEQ ID NO: 736307 - RNA, 16 nt, Homo sapiens
acuuuccugaaugugu

SEQ ID NO: 736308 - RNA, 22 nt, Homo sapiens
acuuucuaaguaggaugaauca

SEQ ID NO: 736309 - RNA, 22 nt, Homo sapiens
acuuucuguugccacaacccug

SEQ ID NO: 736310 - RNA, 22 nt, Homo sapiens
acuuucuucaccaagugcaaua

SEQ ID NO: 736311 - RNA, 13 nt, Homo sapiens
acuuugaagacca

SEQ ID NO: 736312 - RNA, 14 nt, Homo sapiens
acuuugacaguguu

SEQ ID NO: 736313 - RNA, 18 nt, Homo sapiens
acuuugaguuagugccau

SEQ ID NO: 736314 - RNA, 15 nt, Homo sapiens
acuuugcacagcucu

SEQ ID NO: 736315 - RNA, 13 nt, Homo sapiens
acuuugcacuuaa

SEQ ID NO: 736316 - RNA, 21 nt, Homo sapiens
acuuugccaaauauaaucuca

SEQ ID NO: 736317 - RNA, 23 nt, Homo sapiens
acuuugccauuaugcaaauggag

SEQ ID NO: 736318 - RNA, 20 nt, Homo sapiens
agcccucgaaccaaggcagc

SEQ ID NO: 736319 - RNA, 13 nt, Homo sapiens
agcccucuugccc

SEQ ID NO: 736320 - RNA, 15 nt, Homo sapiens
agcccugaacgugag

SEQ ID NO: 736321 - RNA, 20 nt, Homo sapiens
agcccugcaccaugcugcug

SEQ ID NO: 736322 - RNA, 13 nt, Homo sapiens
agcccugccaguu

SEQ ID NO: 736323 - RNA, 15 nt, Homo sapiens
agcccugucugcuag

SEQ ID NO: 736324 - RNA, 14 nt, Homo sapiens
agcccuguguccug

SEQ ID NO: 736325 - RNA, 17 nt, Homo sapiens
agcccuuccuaccucug

SEQ ID NO: 736326 - RNA, 14 nt, Homo sapiens
agcccuuuacuuga

SEQ ID NO: 736327 - RNA, 15 nt, Homo sapiens
agcccuuuacuugac

SEQ ID NO: 736328 - RNA, 13 nt, Homo sapiens
agccgacucuggc

SEQ ID NO: 736329 - RNA, 23 nt, Homo sapiens
agccgagauggcgcuauugcacu

SEQ ID NO: 736330 - RNA, 14 nt, Homo sapiens
agccgagauugcac

SEQ ID NO: 736331 - RNA, 20 nt, Homo sapiens
agccgagauugcgccacugc

SEQ ID NO: 736332 - RNA, 12 nt, Homo sapiens
agccgcccugag

SEQ ID NO: 736333 - RNA, 17 nt, Homo sapiens
agccgccgaccugugac

SEQ ID NO: 736334 - RNA, 16 nt, Homo sapiens
agccgcuucugacugc

SEQ ID NO: 736335 - RNA, 15 nt, Homo sapiens
agccggacagcugcc

SEQ ID NO: 736336 - RNA, 14 nt, Homo sapiens
agccggcacagggu

SEQ ID NO: 736337 - RNA, 18 nt, Homo sapiens
agccgggcaugauggugc

SEQ ID NO: 736338 - RNA, 17 nt, Homo sapiens
agccgggcaugguggca

SEQ ID NO: 736339 - RNA, 19 nt, Homo sapiens
agccgggguguaacuuccu

SEQ ID NO: 736340 - RNA, 15 nt, Homo sapiens
agccguguguucaaa

SEQ ID NO: 736341 - RNA, 19 nt, Homo sapiens
agccuaacaugauuauuug

SEQ ID NO: 736342 - RNA, 12 nt, Homo sapiens
agccuagacaac

SEQ ID NO: 736343 - RNA, 18 nt, Homo sapiens
agccuagcggagcccagc

SEQ ID NO: 736344 - RNA, 14 nt, Homo sapiens
agccucaaacucaa

SEQ ID NO: 736345 - RNA, 23 nt, Homo sapiens
agccucaagucuuauuuccucaa

SEQ ID NO: 736346 - RNA, 17 nt, Homo sapiens
agccucaccaaggugac

SEQ ID NO: 736347 - RNA, 22 nt, Homo sapiens
agccucacguauuucacagagc

SEQ ID NO: 736348 - RNA, 13 nt, Homo sapiens
agccucagaaagg

SEQ ID NO: 736349 - RNA, 21 nt, Homo sapiens
agccucagaaagggauugcuu

SEQ ID NO: 736350 - RNA, 16 nt, Homo sapiens
agccucagaaggcccc

SEQ ID NO: 736351 - RNA, 22 nt, Homo sapiens
agccucagaaggccccagagag

SEQ ID NO: 736352 - RNA, 14 nt, Homo sapiens
agccucaucucuuu

SEQ ID NO: 736353 - RNA, 19 nt, Homo sapiens
agccucauucagcaugggu

SEQ ID NO: 736354 - RNA, 22 nt, Homo sapiens
agccuccacagcgagggcagcu

SEQ ID NO: 736355 - RNA, 14 nt, Homo sapiens
agccuccaccugau

SEQ ID NO: 736356 - RNA, 23 nt, Homo sapiens
agccuccaccugauauucaggcu

SEQ ID NO: 736357 - RNA, 14 nt, Homo sapiens
agccuccagcaccu

SEQ ID NO: 736358 - RNA, 18 nt, Homo sapiens
uauuuaaagccuccucau

SEQ ID NO: 736359 - RNA, 23 nt, Homo sapiens
uauuuaaaggaaaaucacaucuc

SEQ ID NO: 736360 - RNA, 14 nt, Homo sapiens
uauuuaagauguga

SEQ ID NO: 736361 - RNA, 17 nt, Homo sapiens
uauuuaaguauauagua

SEQ ID NO: 736362 - RNA, 22 nt, Homo sapiens
uauuuaaucaaacaguaaucua

SEQ ID NO: 736363 - RNA, 13 nt, Homo sapiens
uauuuaauuccau

SEQ ID NO: 736364 - RNA, 23 nt, Homo sapiens
uauuuaauucuaguuucucucaa

SEQ ID NO: 736365 - RNA, 19 nt, Homo sapiens
uauuuacuuuuaccacuau

SEQ ID NO: 736366 - RNA, 22 nt, Homo sapiens
uauuuagaagccaacuaugauu

SEQ ID NO: 736367 - RNA, 20 nt, Homo sapiens
uauuuagauauaacacuaug

SEQ ID NO: 736368 - RNA, 13 nt, Homo sapiens
uauuuaguggaac

SEQ ID NO: 736369 - RNA, 17 nt, Homo sapiens
uauuuauacucacugag

SEQ ID NO: 736370 - RNA, 12 nt, Homo sapiens
uauuuauacucu

SEQ ID NO: 736371 - RNA, 15 nt, Homo sapiens
uauuuauacuuugca

SEQ ID NO: 736372 - RNA, 17 nt, Homo sapiens
uauuuaucaauuuuucc

SEQ ID NO: 736373 - RNA, 20 nt, Homo sapiens
uauuuauccuaguauuccua

SEQ ID NO: 736374 - RNA, 12 nt, Homo sapiens
uauuuaugcaag

SEQ ID NO: 736375 - RNA, 14 nt, Homo sapiens
uauuuaugccucug

SEQ ID NO: 736376 - RNA, 20 nt, Homo sapiens
uauuucaaaauauacauuca

SEQ ID NO: 736377 - RNA, 13 nt, Homo sapiens
uauuucaaaggga

SEQ ID NO: 736378 - RNA, 18 nt, Homo sapiens
uauuucaagucucucacc

SEQ ID NO: 736379 - RNA, 15 nt, Homo sapiens
uauuucacuugauga

SEQ ID NO: 736380 - RNA, 17 nt, Homo sapiens
uauuucaggaaggucuu

SEQ ID NO: 736381 - RNA, 14 nt, Homo sapiens
uauuucauaucuau

SEQ ID NO: 736382 - RNA, 17 nt, Homo sapiens
uauuucauuccaguuug

SEQ ID NO: 736383 - RNA, 16 nt, Homo sapiens
uauuuccaaaagcaca

SEQ ID NO: 736384 - RNA, 17 nt, Homo sapiens
uauuuccccagccacag

SEQ ID NO: 736385 - RNA, 20 nt, Homo sapiens
uauuucuaagcuuauuucua

SEQ ID NO: 736386 - RNA, 21 nt, Homo sapiens
uauuucuaucugcaaauaguu

SEQ ID NO: 736387 - RNA, 16 nt, Homo sapiens
uauuucuuacccuguc

SEQ ID NO: 736388 - RNA, 22 nt, Homo sapiens
uauuucuucuacugcuaucuac

SEQ ID NO: 736389 - RNA, 17 nt, Homo sapiens
uauuugaagcaugcucu

SEQ ID NO: 736390 - RNA, 17 nt, Homo sapiens
uauuugagagacauuug

SEQ ID NO: 736391 - RNA, 18 nt, Homo sapiens
uauuugagagacugccau

SEQ ID NO: 736392 - RNA, 22 nt, Homo sapiens
uauuugauaagcuccuauuaau

SEQ ID NO: 736393 - RNA, 14 nt, Homo sapiens
uauuugcacuauuu

SEQ ID NO: 736394 - RNA, 20 nt, Homo sapiens
uauuugcacuauuuccacau

SEQ ID NO: 736395 - RNA, 19 nt, Homo sapiens
uauuugcauguuaccuccu

SEQ ID NO: 736396 - RNA, 15 nt, Homo sapiens
uauuuggauaucaaa

SEQ ID NO: 736397 - RNA, 21 nt, Homo sapiens
uauuuguaauuaaaagcaaau

SEQ ID NO: 736398 - RNA, 14 nt, Homo sapiens
uauuuguaucacaa

SEQ ID NO: 736399 - RNA, 23 nt, Homo sapiens
uauuugucuguaaaaaauggagc

SEQ ID NO: 736400 - RNA, 17 nt, Homo sapiens
uauuuguuugcaauuuu

SEQ ID NO: 736401 - RNA, 23 nt, Homo sapiens
uauuuuaaauuauggaacugcua

SEQ ID NO: 736402 - RNA, 18 nt, Homo sapiens
uauuuuaaguaucagagg

SEQ ID NO: 736403 - RNA, 17 nt, Homo sapiens
uauuuuaauuacugcua

SEQ ID NO: 736404 - RNA, 15 nt, Homo sapiens
uauuuuacugaucuc

SEQ ID NO: 736405 - RNA, 19 nt, Homo sapiens
uauuuuauucccuuucaca

SEQ ID NO: 736406 - RNA, 20 nt, Homo sapiens
uauuuuauucccuuucacaa

SEQ ID NO: 736407 - RNA, 16 nt, Homo sapiens
uauuuucaaagacuua

SEQ ID NO: 736408 - RNA, 17 nt, Homo sapiens
uauuuucacacugguaa

SEQ ID NO: 736409 - RNA, 24 nt, Homo sapiens
uauuuucauuuauccagaugacca

SEQ ID NO: 736410 - RNA, 19 nt, Homo sapiens
uauuuucuuuucuuucaac

SEQ ID NO: 736411 - RNA, 14 nt, Homo sapiens
uauuuugacuguga

SEQ ID NO: 736412 - RNA, 22 nt, Homo sapiens
uauuuugcauaguaccaaucau

SEQ ID NO: 736413 - RNA, 15 nt, Homo sapiens
uauuuugcauuccag

SEQ ID NO: 736414 - RNA, 16 nt, Homo sapiens
uauuuugccagacuua

SEQ ID NO: 736415 - RNA, 14 nt, Homo sapiens
uauuuuguguccuc

SEQ ID NO: 736416 - RNA, 16 nt, Homo sapiens
uauuuuguugccuuca

SEQ ID NO: 736417 - RNA, 12 nt, Homo sapiens
uauuuuuacuaa

SEQ ID NO: 736418 - RNA, 21 nt, Homo sapiens
uauuuuuauacaaaccuacca

SEQ ID NO: 736419 - RNA, 23 nt, Homo sapiens
uauuuuucaaagauguguugcua

SEQ ID NO: 736420 - RNA, 21 nt, Homo sapiens
uauuuuuguacugaaucucau

SEQ ID NO: 736421 - RNA, 20 nt, Homo sapiens
uauuuuuguguuuucuugua

SEQ ID NO: 736422 - RNA, 17 nt, Homo sapiens
uauuuuuuaaguauuua

SEQ ID NO: 736423 - RNA, 22 nt, Homo sapiens
uauuuuuucgugcacucugcua

SEQ ID NO: 736424 - RNA, 15 nt, Homo sapiens
uauuuuuucuacaca

SEQ ID NO: 736425 - RNA, 17 nt, Homo sapiens
uauuuuuuuaaccuaau

SEQ ID NO: 736426 - RNA, 20 nt, Homo sapiens
ucaaaaaaucugaccaaaac

SEQ ID NO: 736427 - RNA, 15 nt, Homo sapiens
ucaaaaacauucuua

SEQ ID NO: 736428 - RNA, 16 nt, Homo sapiens
ucaaaacacucaucuc

SEQ ID NO: 736429 - RNA, 20 nt, Homo sapiens
ucaaaacagagggcugcauu

SEQ ID NO: 736430 - RNA, 14 nt, Homo sapiens
ucaaaacauugaua

SEQ ID NO: 736431 - RNA, 15 nt, Homo sapiens
ucaaaacccuaaaau

SEQ ID NO: 736432 - RNA, 18 nt, Homo sapiens
ucaaaagagguuacuuua

SEQ ID NO: 736433 - RNA, 22 nt, Homo sapiens
ucaagugauucuccugccucag

SEQ ID NO: 736434 - RNA, 12 nt, Homo sapiens
ucaaguggcaug

SEQ ID NO: 736435 - RNA, 22 nt, Homo sapiens
ucaaguucuggaccugggcaug

SEQ ID NO: 736436 - RNA, 21 nt, Homo sapiens
ucaaguuuuggguauguuuaa

SEQ ID NO: 736437 - RNA, 14 nt, Homo sapiens
ucaauaaagcacug

SEQ ID NO: 736438 - RNA, 22 nt, Homo sapiens
ucaauacauagugcugcugugu

SEQ ID NO: 736439 - RNA, 15 nt, Homo sapiens
ucaauagaucuccag

SEQ ID NO: 736440 - RNA, 12 nt, Homo sapiens
ucaauagcuguc

SEQ ID NO: 736441 - RNA, 14 nt, Homo sapiens
ucaauauuccugaa

SEQ ID NO: 736442 - RNA, 16 nt, Homo sapiens
ucaauauuuuuguaua

SEQ ID NO: 736443 - RNA, 15 nt, Homo sapiens
ucaaucauugagugg

SEQ ID NO: 736444 - RNA, 12 nt, Homo sapiens
ucaauccuguca

SEQ ID NO: 736445 - RNA, 16 nt, Homo sapiens
ucaaucugcaguuuaa

SEQ ID NO: 736446 - RNA, 21 nt, Homo sapiens
ucaaucuuuggaggcuuuuaa

SEQ ID NO: 736447 - RNA, 21 nt, Homo sapiens
ucaaugacuuaacagaacuca

SEQ ID NO: 736448 - RNA, 20 nt, Homo sapiens
ucaaugcaagagugauugca

SEQ ID NO: 736449 - RNA, 17 nt, Homo sapiens
ucaaugguagcauuuag

SEQ ID NO: 736450 - RNA, 15 nt, Homo sapiens
ucaauguacauagac

SEQ ID NO: 736451 - RNA, 19 nt, Homo sapiens
ucaauuauacuaaaccuca

SEQ ID NO: 736452 - RNA, 20 nt, Homo sapiens
ucaauuauacuaaaccucac

SEQ ID NO: 736453 - RNA, 20 nt, Homo sapiens
ucaauuccaccugcaaucaa

SEQ ID NO: 736454 - RNA, 15 nt, Homo sapiens
ucaauucuagucaua

SEQ ID NO: 736455 - RNA, 15 nt, Homo sapiens
ucaauuuaaauaacc

SEQ ID NO: 736456 - RNA, 14 nt, Homo sapiens
ucaauuucuacuuc

SEQ ID NO: 736457 - RNA, 16 nt, Homo sapiens
ucacaaaguccacuuu

SEQ ID NO: 736458 - RNA, 16 nt, Homo sapiens
ucacaaauccuucaaa

SEQ ID NO: 736459 - RNA, 17 nt, Homo sapiens
ucacaaccagauuugag

SEQ ID NO: 736460 - RNA, 18 nt, Homo sapiens
ucacaagaaguagcuuca

SEQ ID NO: 736461 - RNA, 15 nt, Homo sapiens
ucacaagauggaauu

SEQ ID NO: 736462 - RNA, 18 nt, Homo sapiens
ucacaaggcaacugugag

SEQ ID NO: 736463 - RNA, 14 nt, Homo sapiens
ucacacaacacuga

SEQ ID NO: 736464 - RNA, 21 nt, Homo sapiens
ucacacaacacugaugugacu

SEQ ID NO: 736465 - RNA, 13 nt, Homo sapiens
ucacaccacugua

SEQ ID NO: 736466 - RNA, 22 nt, Homo sapiens
ucacaccauuuuguuuagacaa

SEQ ID NO: 736467 - RNA, 14 nt, Homo sapiens
ucacacccuaccuu

SEQ ID NO: 736468 - RNA, 18 nt, Homo sapiens
ucacacuggccacaagga

SEQ ID NO: 736469 - RNA, 12 nt, Homo sapiens
ucacacuguaaa

SEQ ID NO: 736470 - RNA, 17 nt, Homo sapiens
ucacacuucauuguaaa

SEQ ID NO: 736471 - RNA, 21 nt, Homo sapiens
ucacacuuccaccagccugca

SEQ ID NO: 736472 - RNA, 16 nt, Homo sapiens
ucacagaauagcacaa

SEQ ID NO: 736473 - RNA, 17 nt, Homo sapiens
ucacagaguagaaacuc

SEQ ID NO: 736474 - RNA, 20 nt, Homo sapiens
agcucaguaauuccuguuac

SEQ ID NO: 736475 - RNA, 21 nt, Homo sapiens
agcucaguaguauaugguguu

SEQ ID NO: 736476 - RNA, 17 nt, Homo sapiens
agcucauaaacugccaa

SEQ ID NO: 736477 - RNA, 15 nt, Homo sapiens
agcucaugacacugu

SEQ ID NO: 736478 - RNA, 22 nt, Homo sapiens
agcucauuugagauaaagucaa

SEQ ID NO: 736479 - RNA, 17 nt, Homo sapiens
agcuccaauuucaagag

SEQ ID NO: 736480 - RNA, 22 nt, Homo sapiens
agcuccacacccucucccagga

SEQ ID NO: 736481 - RNA, 23 nt, Homo sapiens
agcuccaugagggcaggcacaug

SEQ ID NO: 736482 - RNA, 14 nt, Homo sapiens
agcucccacucccu

SEQ ID NO: 736483 - RNA, 20 nt, Homo sapiens
agcucccacucccuuuccaa

SEQ ID NO: 736484 - RNA, 21 nt, Homo sapiens
agcucccuccucccaucuccu

SEQ ID NO: 736485 - RNA, 17 nt, Homo sapiens
agcuccgcaagcaucau

SEQ ID NO: 736486 - RNA, 18 nt, Homo sapiens
agcuccuguguucuagac

SEQ ID NO: 736487 - RNA, 21 nt, Homo sapiens
agcucgcuggcuuucucucug

SEQ ID NO: 736488 - RNA, 14 nt, Homo sapiens
agcucuacugaggu

SEQ ID NO: 736489 - RNA, 12 nt, Homo sapiens
agcucucuggga

SEQ ID NO: 736490 - RNA, 23 nt, Homo sapiens
agcucugaggggaggcaccucca

SEQ ID NO: 736491 - RNA, 14 nt, Homo sapiens
agcucuggaugaag

SEQ ID NO: 736492 - RNA, 22 nt, Homo sapiens
agcucuggccccaggcuuguca

SEQ ID NO: 736493 - RNA, 14 nt, Homo sapiens
agcucuggggacag

SEQ ID NO: 736494 - RNA, 20 nt, Homo sapiens
agcucuggggugggcaguuu

SEQ ID NO: 736495 - RNA, 22 nt, Homo sapiens
agcucuggggugggcaguuuuu

SEQ ID NO: 736496 - RNA, 18 nt, Homo sapiens
agcucugguggagacaaa

SEQ ID NO: 736497 - RNA, 17 nt, Homo sapiens
agcucuucaggccuccc

SEQ ID NO: 736498 - RNA, 14 nt, Homo sapiens
agcucuuccuaucc

SEQ ID NO: 736499 - RNA, 18 nt, Homo sapiens
agcugaaaaagauggaau

SEQ ID NO: 736500 - RNA, 20 nt, Homo sapiens
agcugaaaagggcacuccca

SEQ ID NO: 736501 - RNA, 15 nt, Homo sapiens
agcugaaaggaugau

SEQ ID NO: 736502 - RNA, 18 nt, Homo sapiens
agcugaaaugcugcauuu

SEQ ID NO: 736503 - RNA, 18 nt, Homo sapiens
agcugaacaauaggcugu

SEQ ID NO: 736504 - RNA, 16 nt, Homo sapiens
agcugaauucacuuaa

SEQ ID NO: 736505 - RNA, 14 nt, Homo sapiens
agcugacaucucag

SEQ ID NO: 736506 - RNA, 13 nt, Homo sapiens
agcugacuguucu

SEQ ID NO: 736507 - RNA, 18 nt, Homo sapiens
agcugagaauguggaaua

SEQ ID NO: 736508 - RNA, 20 nt, Homo sapiens
agcugagaucgugcuacugc

SEQ ID NO: 736509 - RNA, 15 nt, Homo sapiens
agcugagauguggac

SEQ ID NO: 736510 - RNA, 20 nt, Homo sapiens
agcugagauugugccacugu

SEQ ID NO: 736511 - RNA, 22 nt, Homo sapiens
agcugagggcccuguggagucc

SEQ ID NO: 736512 - RNA, 22 nt, Homo sapiens
agcugagugcuagaguaggugc

SEQ ID NO: 736513 - RNA, 23 nt, Homo sapiens
agcugagugcuagaguaggugca

SEQ ID NO: 736514 - RNA, 23 nt, Homo sapiens
agcugaguuuccuaugggaacaa

SEQ ID NO: 736515 - RNA, 14 nt, Homo sapiens
agcugauacuuuga

SEQ ID NO: 736516 - RNA, 22 nt, Homo sapiens
agcugauauuauggcaagugau

SEQ ID NO: 736517 - RNA, 14 nt, Homo sapiens
agcugauccauagg

SEQ ID NO: 736518 - RNA, 21 nt, Homo sapiens
agcugcaaauugccugcaaaa

SEQ ID NO: 736519 - RNA, 14 nt, Homo sapiens
agcugcaacggaau

SEQ ID NO: 736520 - RNA, 13 nt, Homo sapiens
agcugcaccugcc

SEQ ID NO: 736521 - RNA, 14 nt, Homo sapiens
agcugcaccugcca

SEQ ID NO: 736522 - RNA, 19 nt, Homo sapiens
agcugcacugaucacccaa

SEQ ID NO: 736523 - RNA, 12 nt, Homo sapiens
agcugcacugca

SEQ ID NO: 736524 - RNA, 21 nt, Homo sapiens
agcugcagucaacaguucaaa

SEQ ID NO: 736525 - RNA, 18 nt, Homo sapiens
agcugcauccuccaagaa

SEQ ID NO: 736526 - RNA, 19 nt, Homo sapiens
agcugcauuucacaugccu

SEQ ID NO: 736527 - RNA, 14 nt, Homo sapiens
agcugccaagcacu

SEQ ID NO: 736528 - RNA, 10 nt, Homo sapiens
agcugccauu

SEQ ID NO: 736529 - RNA, 16 nt, Homo sapiens
agcugccucacuuccu

SEQ ID NO: 736530 - RNA, 14 nt, Homo sapiens
agcugccucugcuc

SEQ ID NO: 736531 - RNA, 15 nt, Homo sapiens
agcugccucugcucc

SEQ ID NO: 736532 - RNA, 15 nt, Homo sapiens
agcugccucugggcc

SEQ ID NO: 736533 - RNA, 13 nt, Homo sapiens
agcugccugguau

SEQ ID NO: 736534 - RNA, 16 nt, Homo sapiens
agcugccuuggcucag

SEQ ID NO: 736535 - RNA, 22 nt, Homo sapiens
agcugcgggcacccauccgcuc

SEQ ID NO: 736536 - RNA, 15 nt, Homo sapiens
agcugcucugagcca

SEQ ID NO: 736537 - RNA, 17 nt, Homo sapiens
agcugcucugagccaca

SEQ ID NO: 736538 - RNA, 13 nt, Homo sapiens
agcugcugauaca

SEQ ID NO: 736539 - RNA, 19 nt, Homo sapiens
agcugcugcagcccugcca

SEQ ID NO: 736540 - RNA, 23 nt, Homo sapiens
agcugcugucuucuggacaggcu

SEQ ID NO: 736541 - RNA, 14 nt, Homo sapiens
agcuggaaaaccuc

SEQ ID NO: 736542 - RNA, 15 nt, Homo sapiens
agcuggaaaaccucc

SEQ ID NO: 736543 - RNA, 20 nt, Homo sapiens
agcuggagugaagugguaca

SEQ ID NO: 736544 - RNA, 17 nt, Homo sapiens
agcuggauuacaggcau

SEQ ID NO: 736545 - RNA, 16 nt, Homo sapiens
agcuggcccacugcug

SEQ ID NO: 736546 - RNA, 16 nt, Homo sapiens
agcuggccucucuagc

SEQ ID NO: 736547 - RNA, 16 nt, Homo sapiens
agcugggaagaccaau

SEQ ID NO: 736548 - RNA, 18 nt, Homo sapiens
agcugggacuacaggcuc

SEQ ID NO: 736549 - RNA, 17 nt, Homo sapiens
agcugggacuacagggg

SEQ ID NO: 736550 - RNA, 15 nt, Homo sapiens
agcugggacuggcag

SEQ ID NO: 736551 - RNA, 17 nt, Homo sapiens
agcugggccccaugcuc

SEQ ID NO: 736552 - RNA, 22 nt, Homo sapiens
agcuggggaccugguacccucc

SEQ ID NO: 736553 - RNA, 19 nt, Homo sapiens
agcuggugccccacugaau

SEQ ID NO: 736554 - RNA, 20 nt, Homo sapiens
agcuggugccccacugaauu

SEQ ID NO: 736555 - RNA, 15 nt, Homo sapiens
agcugguggcaauaa

SEQ ID NO: 736556 - RNA, 16 nt, Homo sapiens
agcugguggcaauaaa

SEQ ID NO: 736557 - RNA, 16 nt, Homo sapiens
agcugucccacaucac

SEQ ID NO: 736558 - RNA, 22 nt, Homo sapiens
agcugucccaucuccacuguua

SEQ ID NO: 736559 - RNA, 23 nt, Homo sapiens
agcuguccugcagcaaacacucc

SEQ ID NO: 736560 - RNA, 19 nt, Homo sapiens
agcugucgacuucaugaca

SEQ ID NO: 736561 - RNA, 13 nt, Homo sapiens
agcugucugcuca

SEQ ID NO: 736562 - RNA, 15 nt, Homo sapiens
agcugucuucacaug

SEQ ID NO: 736563 - RNA, 20 nt, Homo sapiens
agcugucuuccuguguaccu

SEQ ID NO: 736564 - RNA, 18 nt, Homo sapiens
agcugugacauauucuga

SEQ ID NO: 736565 - RNA, 19 nt, Homo sapiens
agcugugcgcaauugcuca

SEQ ID NO: 736566 - RNA, 22 nt, Homo sapiens
agcuguggccuaggcuaccuca

SEQ ID NO: 736567 - RNA, 22 nt, Homo sapiens
agcuguggcuggaggagcuggc

SEQ ID NO: 736568 - RNA, 13 nt, Homo sapiens
agcuguuagggcu

SEQ ID NO: 736569 - RNA, 14 nt, Homo sapiens
agcuguucuggacu

SEQ ID NO: 736570 - RNA, 17 nt, Homo sapiens
agcuguugcggacauca

SEQ ID NO: 736571 - RNA, 13 nt, Homo sapiens
agcuguugcuauu

SEQ ID NO: 736572 - RNA, 12 nt, Homo sapiens
agcuguuuauuu

SEQ ID NO: 736573 - RNA, 16 nt, Homo sapiens
agcuuaaaaucuguga

SEQ ID NO: 736574 - RNA, 17 nt, Homo sapiens
agcuuaaaaucugugaa

SEQ ID NO: 736575 - RNA, 14 nt, Homo sapiens
agcuuaagaaccau

SEQ ID NO: 736576 - RNA, 18 nt, Homo sapiens
agcuuaagaaccauugau

SEQ ID NO: 736577 - RNA, 17 nt, Homo sapiens
agcuuaaugauucugau

SEQ ID NO: 736578 - RNA, 19 nt, Homo sapiens
agcuuaaugcuacauguga

SEQ ID NO: 736579 - RNA, 21 nt, Homo sapiens
agcuuaauggcucaugaccug

SEQ ID NO: 736580 - RNA, 18 nt, Homo sapiens
agcuuaauuuucugugga

SEQ ID NO: 736581 - RNA, 12 nt, Homo sapiens
agcuuacacuga

SEQ ID NO: 736582 - RNA, 13 nt, Homo sapiens
agcuuaccugaca

SEQ ID NO: 736583 - RNA, 15 nt, Homo sapiens
agcuuaccugacaca

SEQ ID NO: 736584 - RNA, 20 nt, Homo sapiens
agcuuacugauaaaccuaau

SEQ ID NO: 736585 - RNA, 22 nt, Homo sapiens
agcuuauaagagggcauauaca

SEQ ID NO: 736586 - RNA, 17 nt, Homo sapiens
agcuuauagucuuccag

SEQ ID NO: 736587 - RNA, 14 nt, Homo sapiens
agcuuaugucagac

SEQ ID NO: 736588 - RNA, 16 nt, Homo sapiens
agcuuauuaaaacuca

SEQ ID NO: 736589 - RNA, 19 nt, Homo sapiens
ucacagaugaagacaucag

SEQ ID NO: 736590 - RNA, 15 nt, Homo sapiens
ucacagcccucauga

SEQ ID NO: 736591 - RNA, 21 nt, Homo sapiens
ucacagccuuucugaggacac

SEQ ID NO: 736592 - RNA, 19 nt, Homo sapiens
ucacaggaagaaagcagaa

SEQ ID NO: 736593 - RNA, 22 nt, Homo sapiens
ucacaggcuucugagcacagcu

SEQ ID NO: 736594 - RNA, 15 nt, Homo sapiens
ucacagugacacugg

SEQ ID NO: 736595 - RNA, 19 nt, Homo sapiens
ucacaguguguuugugauu

SEQ ID NO: 736596 - RNA, 19 nt, Homo sapiens
ucacaguuagguagcuuua

SEQ ID NO: 736597 - RNA, 15 nt, Homo sapiens
ucacaguuccucgcc

SEQ ID NO: 736598 - RNA, 16 nt, Homo sapiens
ucacauaagcucagaa

SEQ ID NO: 736599 - RNA, 23 nt, Homo sapiens
ucacauacauaagcagcauuuca

SEQ ID NO: 736600 - RNA, 17 nt, Homo sapiens
ucacauagagugaucuu

SEQ ID NO: 736601 - RNA, 19 nt, Homo sapiens
ucacauaguuuauuucaac

SEQ ID NO: 736602 - RNA, 13 nt, Homo sapiens
ucacauccauccc

SEQ ID NO: 736603 - RNA, 21 nt, Homo sapiens
ucacaucccauugggacucca

SEQ ID NO: 736604 - RNA, 14 nt, Homo sapiens
ucacauccuguguu

SEQ ID NO: 736605 - RNA, 15 nt, Homo sapiens
ucacaugaugcauac

SEQ ID NO: 736606 - RNA, 13 nt, Homo sapiens
ucacaugccuugc

SEQ ID NO: 736607 - RNA, 18 nt, Homo sapiens
ucacaugccuugcaaugg

SEQ ID NO: 736608 - RNA, 23 nt, Homo sapiens
ucacauggccuaugcacauaugg

SEQ ID NO: 736609 - RNA, 15 nt, Homo sapiens
ucacauggcugucga

SEQ ID NO: 736610 - RNA, 20 nt, Homo sapiens
ucacaugggcagaaaaaugg

SEQ ID NO: 736611 - RNA, 16 nt, Homo sapiens
ucacauucauugcagu

SEQ ID NO: 736612 - RNA, 23 nt, Homo sapiens
ucaccaacacaguugggacccaa

SEQ ID NO: 736613 - RNA, 14 nt, Homo sapiens
ucaccaacuugcca

SEQ ID NO: 736614 - RNA, 12 nt, Homo sapiens
ucaccaaugagc

SEQ ID NO: 736615 - RNA, 20 nt, Homo sapiens
ucaccacgugcaguaucuca

SEQ ID NO: 736616 - RNA, 18 nt, Homo sapiens
ucaccacguggggcucac

SEQ ID NO: 736617 - RNA, 14 nt, Homo sapiens
ucaccagagcauuu

SEQ ID NO: 736618 - RNA, 18 nt, Homo sapiens
ucaccagagcauuuccaa

SEQ ID NO: 736619 - RNA, 19 nt, Homo sapiens
ucaccaggggaggagccug

SEQ ID NO: 736620 - RNA, 18 nt, Homo sapiens
ucaccaugcccagcuaau

SEQ ID NO: 736621 - RNA, 23 nt, Homo sapiens
ucaccaugcugaauguacacuga

SEQ ID NO: 736622 - RNA, 20 nt, Homo sapiens
ucaccauguacauagcuuga

SEQ ID NO: 736623 - RNA, 22 nt, Homo sapiens
ucaccauuucuuggcauuggaa

SEQ ID NO: 736624 - RNA, 23 nt, Homo sapiens
ucaccauuucuuggcauuggaau

SEQ ID NO: 736625 - RNA, 15 nt, Homo sapiens
ucacccaagccacaa

SEQ ID NO: 736626 - RNA, 17 nt, Homo sapiens
ucacccacccuguggcu

SEQ ID NO: 736627 - RNA, 19 nt, Homo sapiens
ucacccacccuguggcuca

SEQ ID NO: 736628 - RNA, 22 nt, Homo sapiens
ucaccccagguucucaccucag

SEQ ID NO: 736629 - RNA, 18 nt, Homo sapiens
ucaccccugcccugggau

SEQ ID NO: 736630 - RNA, 18 nt, Homo sapiens
ucaccccugguucucauc

SEQ ID NO: 736631 - RNA, 18 nt, Homo sapiens
ucacccucauaccaucug

SEQ ID NO: 736632 - RNA, 14 nt, Homo sapiens
ucacccucaugaaa

SEQ ID NO: 736633 - RNA, 20 nt, Homo sapiens
ucacccuugcaccguccuca

SEQ ID NO: 736634 - RNA, 14 nt, Homo sapiens
ucaccggagcuuuc

SEQ ID NO: 736635 - RNA, 18 nt, Homo sapiens
ucaccuaagucucuguga

SEQ ID NO: 736636 - RNA, 20 nt, Homo sapiens
ucaccuaagucucugugaau

SEQ ID NO: 736637 - RNA, 21 nt, Homo sapiens
ucaccuaagucucugugaauu

SEQ ID NO: 736638 - RNA, 16 nt, Homo sapiens
ucaccuacauuaucuc

SEQ ID NO: 736639 - RNA, 15 nt, Homo sapiens
ucaccucagcugaua

SEQ ID NO: 736640 - RNA, 16 nt, Homo sapiens
ucaccucagcugauau

SEQ ID NO: 736641 - RNA, 12 nt, Homo sapiens
ucaccucaggcc

SEQ ID NO: 736642 - RNA, 18 nt, Homo sapiens
ucaccucagggguuaaga

SEQ ID NO: 736643 - RNA, 22 nt, Homo sapiens
ucaccucagggguuaagagcuc

SEQ ID NO: 736644 - RNA, 18 nt, Homo sapiens
ucaccuccaagcauuuca

SEQ ID NO: 736645 - RNA, 18 nt, Homo sapiens
ucaccucccgaagccacc

SEQ ID NO: 736646 - RNA, 18 nt, Homo sapiens
ucaccuccucugugauuu

SEQ ID NO: 736647 - RNA, 15 nt, Homo sapiens
ucaccucugccucaa

SEQ ID NO: 736648 - RNA, 17 nt, Homo sapiens
ucaccucuuaugcacac

SEQ ID NO: 736649 - RNA, 21 nt, Homo sapiens
ucaccucuuaugcacaccucc

SEQ ID NO: 736650 - RNA, 15 nt, Homo sapiens
ucaccucuuccacuc

SEQ ID NO: 736651 - RNA, 18 nt, Homo sapiens
ucaccugagaagauuuua

SEQ ID NO: 736652 - RNA, 16 nt, Homo sapiens
ucaccugagaccucca

SEQ ID NO: 736653 - RNA, 12 nt, Homo sapiens
ucaccugagguc

SEQ ID NO: 736654 - RNA, 23 nt, Homo sapiens
ucaccugcuaaaggagauuuaca

SEQ ID NO: 736655 - RNA, 18 nt, Homo sapiens
ucaccugcuggggaccuc

SEQ ID NO: 736656 - RNA, 18 nt, Homo sapiens
ucaccuggcuaacugaug

SEQ ID NO: 736657 - RNA, 15 nt, Homo sapiens
ucaccugugugccca

SEQ ID NO: 736658 - RNA, 12 nt, Homo sapiens
ucaccuuauuca

SEQ ID NO: 736659 - RNA, 14 nt, Homo sapiens
ucaccuuccagugu

SEQ ID NO: 736660 - RNA, 21 nt, Homo sapiens
ucaccuucuagucuuggccag

SEQ ID NO: 736661 - RNA, 19 nt, Homo sapiens
ucaccuuggaggccuuccc

SEQ ID NO: 736662 - RNA, 15 nt, Homo sapiens
aaaaaacaaucugga

SEQ ID NO: 736663 - RNA, 12 nt, Homo sapiens
aaaaaacauaua

SEQ ID NO: 736664 - RNA, 12 nt, Homo sapiens
aaaaaaccagga

SEQ ID NO: 736665 - RNA, 14 nt, Homo sapiens
aaaaaagcauauau

SEQ ID NO: 736666 - RNA, 14 nt, Homo sapiens
aaaaaagcaugcau

SEQ ID NO: 736667 - RNA, 20 nt, Homo sapiens
aaaaaaguaaguaccacuca

SEQ ID NO: 736668 - RNA, 17 nt, Homo sapiens
aaaaaauaaaguaccac

SEQ ID NO: 736669 - RNA, 18 nt, Homo sapiens
aaaaaauuuuugcaaaua

SEQ ID NO: 736670 - RNA, 14 nt, Homo sapiens
aaaaaccugccuaa

SEQ ID NO: 736671 - RNA, 22 nt, Homo sapiens
aaaaaccuuggcauaagacaga

SEQ ID NO: 736672 - RNA, 11 nt, Homo sapiens
aaaaacuaaaa

SEQ ID NO: 736673 - RNA, 18 nt, Homo sapiens
aaaaacuccccuuccuca

SEQ ID NO: 736674 - RNA, 12 nt, Homo sapiens
aaaaacucugaa

SEQ ID NO: 736675 - RNA, 12 nt, Homo sapiens
aaaaagaacaaa

SEQ ID NO: 736676 - RNA, 19 nt, Homo sapiens
aaaaagaccuaugagcaca

SEQ ID NO: 736677 - RNA, 14 nt, Homo sapiens
aaaaagauccaggg

SEQ ID NO: 736678 - RNA, 18 nt, Homo sapiens
aaaaagcaucuaucucau

SEQ ID NO: 736679 - RNA, 15 nt, Homo sapiens
aaaaagccaucugau

SEQ ID NO: 736680 - RNA, 15 nt, Homo sapiens
aaaaaggaauacauu

SEQ ID NO: 736681 - RNA, 17 nt, Homo sapiens
aaaaaggugccaucuca

SEQ ID NO: 736682 - RNA, 13 nt, Homo sapiens
aaaaaguccagau

SEQ ID NO: 736683 - RNA, 13 nt, Homo sapiens
acuuggcaaaaag

SEQ ID NO: 736684 - RNA, 23 nt, Homo sapiens
acuuggcucgaaucucugugccu

SEQ ID NO: 736685 - RNA, 20 nt, Homo sapiens
acuuggggguaaaggucugu

SEQ ID NO: 736686 - RNA, 16 nt, Homo sapiens
acuuggucaccuugcc

SEQ ID NO: 736687 - RNA, 18 nt, Homo sapiens
acuugguuuuuggcucuu

SEQ ID NO: 736688 - RNA, 13 nt, Homo sapiens
acuuguaauccca

SEQ ID NO: 736689 - RNA, 17 nt, Homo sapiens
acuuguagggaugccuu

SEQ ID NO: 736690 - RNA, 16 nt, Homo sapiens
acuuguccaguucaaa

SEQ ID NO: 736691 - RNA, 16 nt, Homo sapiens
acuuguccugacucaa

SEQ ID NO: 736692 - RNA, 18 nt, Homo sapiens
acuugucuuguucaccuu

SEQ ID NO: 736693 - RNA, 22 nt, Homo sapiens
acuugugauuuuuauaauacaa

SEQ ID NO: 736694 - RNA, 16 nt, Homo sapiens
acuugugcacccucua

SEQ ID NO: 736695 - RNA, 16 nt, Homo sapiens
acuugugucccaugau

SEQ ID NO: 736696 - RNA, 16 nt, Homo sapiens
acuuguuccagcucuu

SEQ ID NO: 736697 - RNA, 19 nt, Homo sapiens
acuuguuuuaaacuugccu

SEQ ID NO: 736698 - RNA, 14 nt, Homo sapiens
acuuuaaaaugcca

SEQ ID NO: 736699 - RNA, 14 nt, Homo sapiens
acuuuaacugacuu

SEQ ID NO: 736700 - RNA, 13 nt, Homo sapiens
acuuuaagucuca

SEQ ID NO: 736701 - RNA, 15 nt, Homo sapiens
acuuuaagugaaaga

SEQ ID NO: 736702 - RNA, 22 nt, Homo sapiens
acuuuaauccuuccacuaucau

SEQ ID NO: 736703 - RNA, 13 nt, Homo sapiens
acuuuaaugaacu

SEQ ID NO: 736704 - RNA, 17 nt, Homo sapiens
acuuuaauucucuuacu

SEQ ID NO: 736705 - RNA, 14 nt, Homo sapiens
acuuuacaaaccau

SEQ ID NO: 736706 - RNA, 14 nt, Homo sapiens
acuuuagaugcuga

SEQ ID NO: 736707 - RNA, 19 nt, Homo sapiens
acuuuagcaacaguuauca

SEQ ID NO: 736708 - RNA, 13 nt, Homo sapiens
acuuuagcugcau

SEQ ID NO: 736709 - RNA, 14 nt, Homo sapiens
acuuuaucacuuaa

SEQ ID NO: 736710 - RNA, 18 nt, Homo sapiens
acuuuaucauggaauuua

SEQ ID NO: 736711 - RNA, 20 nt, Homo sapiens
acuuuauuguacagacuguu

SEQ ID NO: 736712 - RNA, 13 nt, Homo sapiens
acuuucaucuuaa

SEQ ID NO: 736713 - RNA, 22 nt, Homo sapiens
acuuuccacuccuggcugagag

SEQ ID NO: 736714 - RNA, 22 nt, Homo sapiens
acuuuccauagggccuccuuag

SEQ ID NO: 736715 - RNA, 15 nt, Homo sapiens
acuuucccucaucca

SEQ ID NO: 736716 - RNA, 16 nt, Homo sapiens
acuuuccuucccucuc

SEQ ID NO: 736717 - RNA, 12 nt, Homo sapiens
acuuucugccag

SEQ ID NO: 736718 - RNA, 17 nt, Homo sapiens
acuuucugccagcaucu

SEQ ID NO: 736719 - RNA, 21 nt, Homo sapiens
acuuucugccagcaucugcag

SEQ ID NO: 736720 - RNA, 16 nt, Homo sapiens
acuuucuugcaugaau

SEQ ID NO: 736721 - RNA, 22 nt, Homo sapiens
acuuugacguaauuaaauccaa

SEQ ID NO: 736722 - RNA, 18 nt, Homo sapiens
acuuugacuuugcccagg

SEQ ID NO: 736723 - RNA, 19 nt, Homo sapiens
acuuugagcacacuuuaca

SEQ ID NO: 736724 - RNA, 15 nt, Homo sapiens
acuuugauaucugau

SEQ ID NO: 736725 - RNA, 18 nt, Homo sapiens
acuuugauaucugaucaa

SEQ ID NO: 736726 - RNA, 14 nt, Homo sapiens
acuuugcuggugua

SEQ ID NO: 736727 - RNA, 22 nt, Homo sapiens
acuuugcugucaaaacuacuga

SEQ ID NO: 736728 - RNA, 20 nt, Homo sapiens
acuuugcuugagaauccucu

SEQ ID NO: 736729 - RNA, 11 nt, Homo sapiens
acuuugggacg

SEQ ID NO: 736730 - RNA, 17 nt, Homo sapiens
acuuugggaggccaagg

SEQ ID NO: 736731 - RNA, 18 nt, Homo sapiens
acuuugggccgggcagca

SEQ ID NO: 736732 - RNA, 16 nt, Homo sapiens
acuuugguaguggaau

SEQ ID NO: 736733 - RNA, 21 nt, Homo sapiens
acuuugguaguggaauaguga

SEQ ID NO: 736734 - RNA, 14 nt, Homo sapiens
acuuuguacauuug

SEQ ID NO: 736735 - RNA, 19 nt, Homo sapiens
acuuuguauauuuguuaca

SEQ ID NO: 736736 - RNA, 23 nt, Homo sapiens
acuuuguauuuguucaguaugca

SEQ ID NO: 736737 - RNA, 23 nt, Homo sapiens
acuuuguuuucaagaugguguua

SEQ ID NO: 736738 - RNA, 18 nt, Homo sapiens
acuuuuaaaaacauaaca

SEQ ID NO: 736739 - RNA, 16 nt, Homo sapiens
acuuuuaaucagugaa

SEQ ID NO: 736740 - RNA, 13 nt, Homo sapiens
acuuuuacaguaa

SEQ ID NO: 736741 - RNA, 22 nt, Homo sapiens
acuuuuaguagagacaggguuu

SEQ ID NO: 736742 - RNA, 23 nt, Homo sapiens
acuuuuauuuuuugguggugaaa

SEQ ID NO: 736743 - RNA, 17 nt, Homo sapiens
acuuuucaccaaugagc

SEQ ID NO: 736744 - RNA, 18 nt, Homo sapiens
acuuuuccauugaccagc

SEQ ID NO: 736745 - RNA, 17 nt, Homo sapiens
acuuuucuaacauaugu

SEQ ID NO: 736746 - RNA, 17 nt, Homo sapiens
acuuuugaaaagcuuuu

SEQ ID NO: 736747 - RNA, 13 nt, Homo sapiens
acuuuugaagucc

SEQ ID NO: 736748 - RNA, 18 nt, Homo sapiens
acuuuuggcuccucuagu

SEQ ID NO: 736749 - RNA, 19 nt, Homo sapiens
acuuuuuaaaauaauaaca

SEQ ID NO: 736750 - RNA, 21 nt, Homo sapiens
acuuuuuaaaauaauaacaau

SEQ ID NO: 736751 - RNA, 17 nt, Homo sapiens
acuuuuuagccagugac

SEQ ID NO: 736752 - RNA, 22 nt, Homo sapiens
acuuuuucagaguugcuuuaaa

SEQ ID NO: 736753 - RNA, 21 nt, Homo sapiens
acuuuuuuagaaaugcaaaau

SEQ ID NO: 736754 - RNA, 22 nt, Homo sapiens
acuuuuuuuuaacacuuuggac

SEQ ID NO: 736755 - RNA, 19 nt, Homo sapiens
agaaaaaaaccacacaaag

SEQ ID NO: 736756 - RNA, 15 nt, Homo sapiens
agaaaaaaguuuaca

SEQ ID NO: 736757 - RNA, 24 nt, Homo sapiens
agaaaaaaguuuacaacauaaucu

SEQ ID NO: 736758 - RNA, 14 nt, Homo sapiens
agaaaaacaacuuu

SEQ ID NO: 736759 - RNA, 18 nt, Homo sapiens
agaaaaaggcaguggccu

SEQ ID NO: 736760 - RNA, 20 nt, Homo sapiens
agaaaaauaagcucgaguga

SEQ ID NO: 736761 - RNA, 15 nt, Homo sapiens
agaaaaaugcugaau

SEQ ID NO: 736762 - RNA, 12 nt, Homo sapiens
agaaaacacugu

SEQ ID NO: 736763 - RNA, 15 nt, Homo sapiens
agaaaacauaaucuu

SEQ ID NO: 736764 - RNA, 12 nt, Homo sapiens
agaaaacaucuu

SEQ ID NO: 736765 - RNA, 22 nt, Homo sapiens
agaaaaccucuccugaccccug

SEQ ID NO: 736766 - RNA, 12 nt, Homo sapiens
agaaaagaccuu

SEQ ID NO: 736767 - RNA, 14 nt, Homo sapiens
agaaaagaccuuuu

SEQ ID NO: 736768 - RNA, 13 nt, Homo sapiens
agaaaagcccauu

SEQ ID NO: 736769 - RNA, 20 nt, Homo sapiens
agaaaaggcagcuaaaggaa

SEQ ID NO: 736770 - RNA, 14 nt, Homo sapiens
agaaaagugcauau

SEQ ID NO: 736771 - RNA, 15 nt, Homo sapiens
agaaaauaauuaauu

SEQ ID NO: 736772 - RNA, 20 nt, Homo sapiens
agaaaauaugaccagaucag

SEQ ID NO: 736773 - RNA, 19 nt, Homo sapiens
agaaaaucaaauauauaac

SEQ ID NO: 736774 - RNA, 20 nt, Homo sapiens
agaaaauccccaacuaugca

SEQ ID NO: 736775 - RNA, 16 nt, Homo sapiens
agaaaaucuuuuacua

SEQ ID NO: 736776 - RNA, 16 nt, Homo sapiens
agaaaaugcagucauu

SEQ ID NO: 736777 - RNA, 16 nt, Homo sapiens
agaaaauguaaaggag

SEQ ID NO: 736778 - RNA, 23 nt, Homo sapiens
agaaaauuuuguaaaacaaugcc

SEQ ID NO: 736779 - RNA, 21 nt, Homo sapiens
agaaacaccacccauuucuac

SEQ ID NO: 736780 - RNA, 12 nt, Homo sapiens
agaaacagccac

SEQ ID NO: 736781 - RNA, 18 nt, Homo sapiens
agaaacaugacacugacc

SEQ ID NO: 736782 - RNA, 19 nt, Homo sapiens
agaaacaugacacugaccu

SEQ ID NO: 736783 - RNA, 13 nt, Homo sapiens
agaaaccaagcca

SEQ ID NO: 736784 - RNA, 15 nt, Homo sapiens
agaaaccacuagaaa

SEQ ID NO: 736785 - RNA, 18 nt, Homo sapiens
agaaacccuugcugcuuu

SEQ ID NO: 736786 - RNA, 14 nt, Homo sapiens
agaaaccugacuca

SEQ ID NO: 736787 - RNA, 21 nt, Homo sapiens
agaaaccuuauuguaccucuc

SEQ ID NO: 736788 - RNA, 19 nt, Homo sapiens
agaaacugagaccaaagaa

SEQ ID NO: 736789 - RNA, 17 nt, Homo sapiens
agaaacuguagucucag

SEQ ID NO: 736790 - RNA, 19 nt, Homo sapiens
agaaacuguagucucagga

SEQ ID NO: 736791 - RNA, 15 nt, Homo sapiens
agaaacuuauuucuc

SEQ ID NO: 736792 - RNA, 21 nt, Homo sapiens
agaaacuuauuucucauauca

SEQ ID NO: 736793 - RNA, 22 nt, Homo sapiens
agaaagacuuaucaacauuugu

SEQ ID NO: 736794 - RNA, 19 nt, Homo sapiens
agaaagagacuccgucuca

SEQ ID NO: 736795 - RNA, 17 nt, Homo sapiens
agaaagcaaagauuauu

SEQ ID NO: 736796 - RNA, 12 nt, Homo sapiens
agaaagcacuua

SEQ ID NO: 736797 - RNA, 13 nt, Homo sapiens
agaaagcuaaaau

SEQ ID NO: 736798 - RNA, 17 nt, Homo sapiens
acagggcugguguggcu

SEQ ID NO: 736799 - RNA, 24 nt, Homo sapiens
acagggucugcucuuucucugcca

SEQ ID NO: 736800 - RNA, 20 nt, Homo sapiens
acagggugucguucugucgc

SEQ ID NO: 736801 - RNA, 16 nt, Homo sapiens
acagguaaaacagggc

SEQ ID NO: 736802 - RNA, 17 nt, Homo sapiens
acaggugccuucccaga

SEQ ID NO: 736803 - RNA, 18 nt, Homo sapiens
acagguggcaacaaugcc

SEQ ID NO: 736804 - RNA, 21 nt, Homo sapiens
acagguggccuagcaggcaca

SEQ ID NO: 736805 - RNA, 22 nt, Homo sapiens
acagguguggggacacagcagu

SEQ ID NO: 736806 - RNA, 13 nt, Homo sapiens
acagguugcugaa

SEQ ID NO: 736807 - RNA, 23 nt, Homo sapiens
acagguuuuguguuuugucauua

SEQ ID NO: 736808 - RNA, 16 nt, Homo sapiens
acaguaaaaacuugua

SEQ ID NO: 736809 - RNA, 18 nt, Homo sapiens
acaguaaaaggacagaga

SEQ ID NO: 736810 - RNA, 22 nt, Homo sapiens
acaguaacaaauaaagugcagu

SEQ ID NO: 736811 - RNA, 22 nt, Homo sapiens
acaguaacugugacugaugacu

SEQ ID NO: 736812 - RNA, 19 nt, Homo sapiens
acaguaacuuuauguguaa

SEQ ID NO: 736813 - RNA, 17 nt, Homo sapiens
acaguaaguccaguaaa

SEQ ID NO: 736814 - RNA, 19 nt, Homo sapiens
acaguacacagauaccuug

SEQ ID NO: 736815 - RNA, 17 nt, Homo sapiens
acaguacagaaggcaaa

SEQ ID NO: 736816 - RNA, 18 nt, Homo sapiens
acaguaccggauucucuc

SEQ ID NO: 736817 - RNA, 20 nt, Homo sapiens
acaguacucacuuuuuccaa

SEQ ID NO: 736818 - RNA, 22 nt, Homo sapiens
acaguagagcaaaucuaugaga

SEQ ID NO: 736819 - RNA, 13 nt, Homo sapiens
acaguagagccag

SEQ ID NO: 736820 - RNA, 14 nt, Homo sapiens
acaguaucccacau

SEQ ID NO: 736821 - RNA, 16 nt, Homo sapiens
acaguauuacaguguc

SEQ ID NO: 736822 - RNA, 21 nt, Homo sapiens
acaguauuuuagguaugauuu

SEQ ID NO: 736823 - RNA, 20 nt, Homo sapiens
acagucaccgacaacaugcu

SEQ ID NO: 736824 - RNA, 22 nt, Homo sapiens
acagucacugauguacaauuaa

SEQ ID NO: 736825 - RNA, 19 nt, Homo sapiens
acuguuugauauaccaaau

SEQ ID NO: 736826 - RNA, 18 nt, Homo sapiens
acuguuuugaaucucaua

SEQ ID NO: 736827 - RNA, 17 nt, Homo sapiens
acuguuuuucagggagg

SEQ ID NO: 736828 - RNA, 17 nt, Homo sapiens
acuuaaaaaaaugacag

SEQ ID NO: 736829 - RNA, 14 nt, Homo sapiens
acuuaaaauuacca

SEQ ID NO: 736830 - RNA, 14 nt, Homo sapiens
acuuaaacuuccac

SEQ ID NO: 736831 - RNA, 19 nt, Homo sapiens
acuuaaaugguaauaagca

SEQ ID NO: 736832 - RNA, 22 nt, Homo sapiens
acuuaagcccagugcacugaaa

SEQ ID NO: 736833 - RNA, 20 nt, Homo sapiens
acuuaagggaaaaguucucc

SEQ ID NO: 736834 - RNA, 16 nt, Homo sapiens
acuuaaguggcauuaa

SEQ ID NO: 736835 - RNA, 22 nt, Homo sapiens
acuuaauaaauauuacagugaa

SEQ ID NO: 736836 - RNA, 16 nt, Homo sapiens
acuuaaugcacagugc

SEQ ID NO: 736837 - RNA, 16 nt, Homo sapiens
acuuagagauauguau

SEQ ID NO: 736838 - RNA, 23 nt, Homo sapiens
acuuagcagcuaucucucaguga

SEQ ID NO: 736839 - RNA, 17 nt, Homo sapiens
acuuagcaugucccuac

SEQ ID NO: 736840 - RNA, 17 nt, Homo sapiens
acuuagcgucaagacau

SEQ ID NO: 736841 - RNA, 18 nt, Homo sapiens
acuuagguuauuuugcuu

SEQ ID NO: 736842 - RNA, 14 nt, Homo sapiens
acuuaguaugcagu

SEQ ID NO: 736843 - RNA, 18 nt, Homo sapiens
acuuaguuauuuaccaaa

SEQ ID NO: 736844 - RNA, 23 nt, Homo sapiens
acuuauauugaagacaauuugau

SEQ ID NO: 736845 - RNA, 17 nt, Homo sapiens
acuuauccaucuuugaa

SEQ ID NO: 736846 - RNA, 13 nt, Homo sapiens
acuuaugauuuca

SEQ ID NO: 736847 - RNA, 21 nt, Homo sapiens
acuuauuaugcauaaagccaa

SEQ ID NO: 736848 - RNA, 22 nt, Homo sapiens
acuuauuggaacucugcuugau

SEQ ID NO: 736849 - RNA, 19 nt, Homo sapiens
acuuauuucauaaacaacu

SEQ ID NO: 736850 - RNA, 23 nt, Homo sapiens
acuuauuuuauuuuuuaccauaa

SEQ ID NO: 736851 - RNA, 14 nt, Homo sapiens
acuucaaauagcaa

SEQ ID NO: 736852 - RNA, 19 nt, Homo sapiens
acuucaaguuaaagugaau

SEQ ID NO: 736853 - RNA, 20 nt, Homo sapiens
acuucaaugggcucuuccaa

SEQ ID NO: 736854 - RNA, 15 nt, Homo sapiens
acuucacacuaugga

SEQ ID NO: 736855 - RNA, 16 nt, Homo sapiens
acuucacccccaacuu

SEQ ID NO: 736856 - RNA, 23 nt, Homo sapiens
acuucacccgaguuccucugggu

SEQ ID NO: 736857 - RNA, 18 nt, Homo sapiens
acuucacuaaugaucaca

SEQ ID NO: 736858 - RNA, 20 nt, Homo sapiens
acuucagugggacucgguga

SEQ ID NO: 736859 - RNA, 19 nt, Homo sapiens
acuucaguuuaaugucucc

SEQ ID NO: 736860 - RNA, 17 nt, Homo sapiens
acuucauagaaaccucu

SEQ ID NO: 736861 - RNA, 15 nt, Homo sapiens
acuucauuugacaca

SEQ ID NO: 736862 - RNA, 16 nt, Homo sapiens
acuuccauuaacuuag

SEQ ID NO: 736863 - RNA, 20 nt, Homo sapiens
acuuccauucccguggucuc

SEQ ID NO: 736864 - RNA, 13 nt, Homo sapiens
acuuccauuugcu

SEQ ID NO: 736865 - RNA, 18 nt, Homo sapiens
acuucccagagcaucuug

SEQ ID NO: 736866 - RNA, 20 nt, Homo sapiens
acuucccagagcaucuugca

SEQ ID NO: 736867 - RNA, 14 nt, Homo sapiens
acuuccccacaggc

SEQ ID NO: 736868 - RNA, 19 nt, Homo sapiens
acuuccccacugcucucug

SEQ ID NO: 736869 - RNA, 16 nt, Homo sapiens
acuuccccagcucuca

SEQ ID NO: 736870 - RNA, 17 nt, Homo sapiens
acuuccccugggcaaga

SEQ ID NO: 736871 - RNA, 22 nt, Homo sapiens
acuucccgucccauauccugcc

SEQ ID NO: 736872 - RNA, 14 nt, Homo sapiens
acuucccuaaugaa

SEQ ID NO: 736873 - RNA, 21 nt, Homo sapiens
acuuccuuuuaacugccaaga

SEQ ID NO: 736874 - RNA, 23 nt, Homo sapiens
acuucuaacuagaaaucugccaa

SEQ ID NO: 736875 - RNA, 22 nt, Homo sapiens
acuucuaagaaaagccuaauca

SEQ ID NO: 736876 - RNA, 14 nt, Homo sapiens
acuucuagacucac

SEQ ID NO: 736877 - RNA, 13 nt, Homo sapiens
acuucuagcugua

SEQ ID NO: 736878 - RNA, 11 nt, Homo sapiens
acuucucacca

SEQ ID NO: 736879 - RNA, 22 nt, Homo sapiens
acuucucuaaaacccuguguuc

SEQ ID NO: 736880 - RNA, 18 nt, Homo sapiens
acuucucucuaaggagaa

SEQ ID NO: 736881 - RNA, 15 nt, Homo sapiens
acuucuggaagucau

SEQ ID NO: 736882 - RNA, 13 nt, Homo sapiens
acuucugugccac

SEQ ID NO: 736883 - RNA, 21 nt, Homo sapiens
acuucuuacuucccuaaugaa

SEQ ID NO: 736884 - RNA, 18 nt, Homo sapiens
acuucuuauacauuugau

SEQ ID NO: 736885 - RNA, 18 nt, Homo sapiens
acuucuucaccucuucca

SEQ ID NO: 736886 - RNA, 19 nt, Homo sapiens
acuucuugguacccaguca

SEQ ID NO: 736887 - RNA, 22 nt, Homo sapiens
acuugaaaugcucuuuugcaca

SEQ ID NO: 736888 - RNA, 17 nt, Homo sapiens
acuugaaauucucauca

SEQ ID NO: 736889 - RNA, 19 nt, Homo sapiens
acuugaacguucugaccag

SEQ ID NO: 736890 - RNA, 13 nt, Homo sapiens
acuugaagcacuu

SEQ ID NO: 736891 - RNA, 14 nt, Homo sapiens
acuugaagcacuua

SEQ ID NO: 736892 - RNA, 15 nt, Homo sapiens
acuugaagugagaag

SEQ ID NO: 736893 - RNA, 16 nt, Homo sapiens
acuugaauauguagcu

SEQ ID NO: 736894 - RNA, 15 nt, Homo sapiens
acuugaauccauuga

SEQ ID NO: 736895 - RNA, 19 nt, Homo sapiens
acuugaaugcuaguuauac

SEQ ID NO: 736896 - RNA, 14 nt, Homo sapiens
acuugauguguaga

SEQ ID NO: 736897 - RNA, 15 nt, Homo sapiens
acuugauugucuccu

SEQ ID NO: 736898 - RNA, 22 nt, Homo sapiens
acuugauuuuuuucauuuugcc

SEQ ID NO: 736899 - RNA, 14 nt, Homo sapiens
acuugcaagccuca

SEQ ID NO: 736900 - RNA, 11 nt, Homo sapiens
acuugcaauac

SEQ ID NO: 736901 - RNA, 12 nt, Homo sapiens
acuugcaauacc

SEQ ID NO: 736902 - RNA, 17 nt, Homo sapiens
acuugcaauaccaaugu

SEQ ID NO: 736903 - RNA, 15 nt, Homo sapiens
acuugcagguacuuu

SEQ ID NO: 736904 - RNA, 15 nt, Homo sapiens
acuugcaucacuuaa

SEQ ID NO: 736905 - RNA, 15 nt, Homo sapiens
acuugcauugugauu

SEQ ID NO: 736906 - RNA, 12 nt, Homo sapiens
acuugccaagaa

SEQ ID NO: 736907 - RNA, 16 nt, Homo sapiens
acuugccucugcacac

SEQ ID NO: 736908 - RNA, 20 nt, Homo sapiens
acuugccugcuagggaccuc

SEQ ID NO: 736909 - RNA, 14 nt, Homo sapiens
acuugccuucugau

SEQ ID NO: 736910 - RNA, 19 nt, Homo sapiens
acuugcugugucugaggua

SEQ ID NO: 736911 - RNA, 22 nt, Homo sapiens
acuugcugugugaccucaggcc

SEQ ID NO: 736912 - RNA, 16 nt, Homo sapiens
acuugcuuuaugccuu

SEQ ID NO: 736913 - RNA, 21 nt, Homo sapiens
acuugcuuuaugccuucuuau

SEQ ID NO: 736914 - RNA, 15 nt, Homo sapiens
acuuggaaccucauu

SEQ ID NO: 736915 - RNA, 20 nt, Homo sapiens
acuuggaaguggggacauca

SEQ ID NO: 736916 - RNA, 21 nt, Homo sapiens
acaaaguccacuuuacucaaa

SEQ ID NO: 736917 - RNA, 15 nt, Homo sapiens
acaaagucucacugu

SEQ ID NO: 736918 - RNA, 13 nt, Homo sapiens
acaaauaauagca

SEQ ID NO: 736919 - RNA, 21 nt, Homo sapiens
acaaaucagaaauaugacaau

SEQ ID NO: 736920 - RNA, 18 nt, Homo sapiens
acaaaugaacgauaugua

SEQ ID NO: 736921 - RNA, 13 nt, Homo sapiens
acaaaugagccau

SEQ ID NO: 736922 - RNA, 22 nt, Homo sapiens
acaaaugagugagagaguucag

SEQ ID NO: 736923 - RNA, 18 nt, Homo sapiens
acaaauuguauggugaua

SEQ ID NO: 736924 - RNA, 24 nt, Homo sapiens
acaaauuuggccuuaagaacugug

SEQ ID NO: 736925 - RNA, 15 nt, Homo sapiens
acaacaaaaggacuu

SEQ ID NO: 736926 - RNA, 15 nt, Homo sapiens
acaacacucaucaca

SEQ ID NO: 736927 - RNA, 21 nt, Homo sapiens
acaacacugauacuagauucc

SEQ ID NO: 736928 - RNA, 22 nt, Homo sapiens
acaacaggcaguggaagcaguu

SEQ ID NO: 736929 - RNA, 23 nt, Homo sapiens
acaacaggcauagcaaaugacau

SEQ ID NO: 736930 - RNA, 23 nt, Homo sapiens
acaacaguugcacagugccucaa

SEQ ID NO: 736931 - RNA, 15 nt, Homo sapiens
acaacauaucucagg

SEQ ID NO: 736932 - RNA, 15 nt, Homo sapiens
acaacauuaugaucu

SEQ ID NO: 736933 - RNA, 19 nt, Homo sapiens
acaacauuuacuuaacaga

SEQ ID NO: 736934 - RNA, 14 nt, Homo sapiens
acaacauuucucaa

SEQ ID NO: 736935 - RNA, 14 nt, Homo sapiens
acaacauuugcaga

SEQ ID NO: 736936 - RNA, 14 nt, Homo sapiens
acaaccuuccagcu

SEQ ID NO: 736937 - RNA, 17 nt, Homo sapiens
acaaccuuuuacauugu

SEQ ID NO: 736938 - RNA, 22 nt, Homo sapiens
acaaccuuuuacauugugacug

SEQ ID NO: 736939 - RNA, 14 nt, Homo sapiens
acaacgaugaugcu

SEQ ID NO: 736940 - RNA, 17 nt, Homo sapiens
acaacgccugucacaga

SEQ ID NO: 736941 - RNA, 12 nt, Homo sapiens
acaacuaccuga

SEQ ID NO: 736942 - RNA, 13 nt, Homo sapiens
acaacuauguaau

SEQ ID NO: 736943 - RNA, 12 nt, Homo sapiens
acaacugugacu

SEQ ID NO: 736944 - RNA, 18 nt, Homo sapiens
acacaguccagacucaaa

SEQ ID NO: 736945 - RNA, 19 nt, Homo sapiens
acacagucuuggcucacug

SEQ ID NO: 736946 - RNA, 20 nt, Homo sapiens
acacaguggauuccagugca

SEQ ID NO: 736947 - RNA, 22 nt, Homo sapiens
acacaguggauuccagugcaug

SEQ ID NO: 736948 - RNA, 24 nt, Homo sapiens
acacauagaaaacaaucaaauauu

SEQ ID NO: 736949 - RNA, 18 nt, Homo sapiens
acacaucccggcacuguu

SEQ ID NO: 736950 - RNA, 17 nt, Homo sapiens
acacaucuuucuugaau

SEQ ID NO: 736951 - RNA, 16 nt, Homo sapiens
acacaugggcuuguga

SEQ ID NO: 736952 - RNA, 12 nt, Homo sapiens
acacaugugcac

SEQ ID NO: 736953 - RNA, 19 nt, Homo sapiens
acacaugugcagucacugg

SEQ ID NO: 736954 - RNA, 16 nt, Homo sapiens
acacauuaaacaggau

SEQ ID NO: 736955 - RNA, 21 nt, Homo sapiens
acacauuuggccacaaaacac

SEQ ID NO: 736956 - RNA, 16 nt, Homo sapiens
acaccaacgaggugau

SEQ ID NO: 736957 - RNA, 17 nt, Homo sapiens
acaccaacgaggugauc

SEQ ID NO: 736958 - RNA, 19 nt, Homo sapiens
acaccaaguaccaguauaa

SEQ ID NO: 736959 - RNA, 11 nt, Homo sapiens
acaccaucucc

SEQ ID NO: 736960 - RNA, 13 nt, Homo sapiens
acaccaugugcaa

SEQ ID NO: 736961 - RNA, 17 nt, Homo sapiens
acacccaaagcauggac

SEQ ID NO: 736962 - RNA, 23 nt, Homo sapiens
acacccaagaagaaaugcuuucc

SEQ ID NO: 736963 - RNA, 14 nt, Homo sapiens
acacccaguguccu

SEQ ID NO: 736964 - RNA, 12 nt, Homo sapiens
acaccccagugg

SEQ ID NO: 736965 - RNA, 21 nt, Homo sapiens
acacccccaccuccugcaaua

SEQ ID NO: 736966 - RNA, 17 nt, Homo sapiens
acaccccucccugccac

SEQ ID NO: 736967 - RNA, 16 nt, Homo sapiens
acacccgugugcacac

SEQ ID NO: 736968 - RNA, 14 nt, Homo sapiens
acacccuggcccag

SEQ ID NO: 736969 - RNA, 22 nt, Homo sapiens
acacccuggccugaacugagga

SEQ ID NO: 736970 - RNA, 16 nt, Homo sapiens
acacccugguucccac

SEQ ID NO: 736971 - RNA, 23 nt, Homo sapiens
acacccugguucccaccauuccc

SEQ ID NO: 736972 - RNA, 13 nt, Homo sapiens
acaccuaagagaa

SEQ ID NO: 736973 - RNA, 12 nt, Homo sapiens
acaccuaccuga

SEQ ID NO: 736974 - RNA, 20 nt, Homo sapiens
acaccuccauuucucuccag

SEQ ID NO: 736975 - RNA, 19 nt, Homo sapiens
acaccucccccugcugcug

SEQ ID NO: 736976 - RNA, 23 nt, Homo sapiens
acaccucccccuuucacacugga

SEQ ID NO: 736977 - RNA, 24 nt, Homo sapiens
acaccucccccuuucacacuggau

SEQ ID NO: 736978 - RNA, 15 nt, Homo sapiens
acaccucccuacucc

SEQ ID NO: 736979 - RNA, 21 nt, Homo sapiens
acaccucccuccccacaccuc

SEQ ID NO: 736980 - RNA, 20 nt, Homo sapiens
acaccucuccuuugugacuu

SEQ ID NO: 736981 - RNA, 14 nt, Homo sapiens
acaccugaggacag

SEQ ID NO: 736982 - RNA, 18 nt, Homo sapiens
acaccugaugaccuguua

SEQ ID NO: 736983 - RNA, 22 nt, Homo sapiens
acaccugggagaaggucuccaa

SEQ ID NO: 736984 - RNA, 16 nt, Homo sapiens
acaccuguguccaaga

SEQ ID NO: 736985 - RNA, 11 nt, Homo sapiens
acaccuuccag

SEQ ID NO: 736986 - RNA, 13 nt, Homo sapiens
acacgaugcauuu

SEQ ID NO: 736987 - RNA, 14 nt, Homo sapiens
acacgaugcauuua

SEQ ID NO: 736988 - RNA, 20 nt, Homo sapiens
acacgaugcauuuaauaaag

SEQ ID NO: 736989 - RNA, 19 nt, Homo sapiens
acacgcgugugcuccucuc

SEQ ID NO: 736990 - RNA, 20 nt, Homo sapiens
acacggugaaaccccgucuc

SEQ ID NO: 736991 - RNA, 15 nt, Homo sapiens
acacuaacauauaau

SEQ ID NO: 736992 - RNA, 18 nt, Homo sapiens
acacuaacauauaauguu

SEQ ID NO: 736993 - RNA, 20 nt, Homo sapiens
acacuacugcuaaauccuca

SEQ ID NO: 736994 - RNA, 21 nt, Homo sapiens
acacuaguuuugugccagccg

SEQ ID NO: 736995 - RNA, 19 nt, Homo sapiens
acacuauaaagguugacaa

SEQ ID NO: 736996 - RNA, 20 nt, Homo sapiens
acacuaugaagauguuucaa

SEQ ID NO: 736997 - RNA, 15 nt, Homo sapiens
acacuauuuccaaaa

SEQ ID NO: 736998 - RNA, 14 nt, Homo sapiens
acacucaugaagca

SEQ ID NO: 736999 - RNA, 15 nt, Homo sapiens
acacuccacuugaag

SEQ ID NO: 737000 - RNA, 21 nt, Homo sapiens
acacuccacuugaagcacuua

SEQ ID NO: 737001 - RNA, 23 nt, Homo sapiens
acacuccacuugaagcacuuaag

SEQ ID NO: 737002 - RNA, 20 nt, Homo sapiens
acacuccuacaagauuuaga

SEQ ID NO: 737003 - RNA, 23 nt, Homo sapiens
acacucugccugaaggcucacac

SEQ ID NO: 737004 - RNA, 14 nt, Homo sapiens
acacucuucaguga

SEQ ID NO: 737005 - RNA, 23 nt, Homo sapiens
acacugaagaagucacugaacaa

SEQ ID NO: 737006 - RNA, 16 nt, Homo sapiens
acacugaaucucaccu

SEQ ID NO: 737007 - RNA, 13 nt, Homo sapiens
acacugauacacu

SEQ ID NO: 737008 - RNA, 15 nt, Homo sapiens
acacugauggcucaa

SEQ ID NO: 737009 - RNA, 17 nt, Homo sapiens
acacugcacacagugac

SEQ ID NO: 737010 - RNA, 18 nt, Homo sapiens
acacugcggaagccaaag

SEQ ID NO: 737011 - RNA, 14 nt, Homo sapiens
acacuggugccaug

SEQ ID NO: 737012 - RNA, 15 nt, Homo sapiens
acacuggugguucua

SEQ ID NO: 737013 - RNA, 14 nt, Homo sapiens
acacugucuucccg

SEQ ID NO: 737014 - RNA, 16 nt, Homo sapiens
acacugugggacucuu

SEQ ID NO: 737015 - RNA, 18 nt, Homo sapiens
acacuguuacuuucguac

SEQ ID NO: 737016 - RNA, 15 nt, Homo sapiens
acacuguucugaaag

SEQ ID NO: 737017 - RNA, 20 nt, Homo sapiens
acacuuaaauuucuuggcaa

SEQ ID NO: 737018 - RNA, 15 nt, Homo sapiens
acacuucagaucuga

SEQ ID NO: 737019 - RNA, 23 nt, Homo sapiens
acacuucauuguaaaucacuugu

SEQ ID NO: 737020 - RNA, 17 nt, Homo sapiens
acacuucugacuucacu

SEQ ID NO: 737021 - RNA, 18 nt, Homo sapiens
acacuucugcuuucacuu

SEQ ID NO: 737022 - RNA, 20 nt, Homo sapiens
acacuucugcuuucacuuaa

SEQ ID NO: 737023 - RNA, 23 nt, Homo sapiens
acacuugugugugggcugugagu

SEQ ID NO: 737024 - RNA, 20 nt, Homo sapiens
acacuuugaagcaaauacaa

SEQ ID NO: 737025 - RNA, 21 nt, Homo sapiens
acacuuuggacuucucugaaa

SEQ ID NO: 737026 - RNA, 20 nt, Homo sapiens
acacuuuuuuuuaaagcuca

SEQ ID NO: 737027 - RNA, 23 nt, Homo sapiens
acagaaaagacucugaccagaga

SEQ ID NO: 737028 - RNA, 21 nt, Homo sapiens
acagaaaaggcugcugugaac

SEQ ID NO: 737029 - RNA, 14 nt, Homo sapiens
acagaaacacugcc

SEQ ID NO: 737030 - RNA, 17 nt, Homo sapiens
acagagaagaccaaagc

SEQ ID NO: 737031 - RNA, 20 nt, Homo sapiens
acagagcaagacuccaucuc

SEQ ID NO: 737032 - RNA, 20 nt, Homo sapiens
acagagccaagcacugcuca

SEQ ID NO: 737033 - RNA, 20 nt, Homo sapiens
acagagcgagacuccaucuc

SEQ ID NO: 737034 - RNA, 20 nt, Homo sapiens
acagagcgagacuccgucuc

SEQ ID NO: 737035 - RNA, 20 nt, Homo sapiens
acagagcgagauuccaucuc

SEQ ID NO: 737036 - RNA, 15 nt, Homo sapiens
acagagcguccuucc

SEQ ID NO: 737037 - RNA, 18 nt, Homo sapiens
acagaggaagagcaggca

SEQ ID NO: 737038 - RNA, 18 nt, Homo sapiens
acagagggcucaccucuu

SEQ ID NO: 737039 - RNA, 15 nt, Homo sapiens
acagagggcugcauu

SEQ ID NO: 737040 - RNA, 19 nt, Homo sapiens
acagaggugucauccacag

SEQ ID NO: 737041 - RNA, 15 nt, Homo sapiens
acagaguaucagauc

SEQ ID NO: 737042 - RNA, 20 nt, Homo sapiens
acagagucuuccucugucuc

SEQ ID NO: 737043 - RNA, 17 nt, Homo sapiens
acagaguugcuuaauga

SEQ ID NO: 737044 - RNA, 13 nt, Homo sapiens
acagauaacugcu

SEQ ID NO: 737045 - RNA, 14 nt, Homo sapiens
acagauacugugag

SEQ ID NO: 737046 - RNA, 16 nt, Homo sapiens
acagaucaucuuggaa

SEQ ID NO: 737047 - RNA, 16 nt, Homo sapiens
acagaucuaucuccuc

SEQ ID NO: 737048 - RNA, 18 nt, Homo sapiens
acagaugaagacaucagg

SEQ ID NO: 737049 - RNA, 19 nt, Homo sapiens
acagaugcaaugugcuacu

SEQ ID NO: 737050 - RNA, 19 nt, Homo sapiens
acagauggauagucugucc

SEQ ID NO: 737051 - RNA, 14 nt, Homo sapiens
acagauugccuguu

SEQ ID NO: 737052 - RNA, 16 nt, Homo sapiens
acagauugcugccuca

SEQ ID NO: 737053 - RNA, 22 nt, Homo sapiens
acagauuuuaccuauccacaau

SEQ ID NO: 737054 - RNA, 14 nt, Homo sapiens
acagcaaaacucca

SEQ ID NO: 737055 - RNA, 20 nt, Homo sapiens
acagcaaaacuccaucucaa

SEQ ID NO: 737056 - RNA, 17 nt, Homo sapiens
acagcaauaacucggug

SEQ ID NO: 737057 - RNA, 15 nt, Homo sapiens
acagcacaucaccuc

SEQ ID NO: 737058 - RNA, 18 nt, Homo sapiens
acagcagcucaggcacac

SEQ ID NO: 737059 - RNA, 23 nt, Homo sapiens
acagcagcuucaccagagcauuu

SEQ ID NO: 737060 - RNA, 15 nt, Homo sapiens
acagcagugaucuca

SEQ ID NO: 737061 - RNA, 16 nt, Homo sapiens
acagcaugguaaugaa

SEQ ID NO: 737062 - RNA, 12 nt, Homo sapiens
acagccaagggg

SEQ ID NO: 737063 - RNA, 18 nt, Homo sapiens
acagccaccguuucuucc

SEQ ID NO: 737064 - RNA, 21 nt, Homo sapiens
acagccacuaaaacacaaaaa

SEQ ID NO: 737065 - RNA, 15 nt, Homo sapiens
acagcccagagccug

SEQ ID NO: 737066 - RNA, 15 nt, Homo sapiens
acagccccaaccucc

SEQ ID NO: 737067 - RNA, 21 nt, Homo sapiens
acagccucccacccccaucuc

SEQ ID NO: 737068 - RNA, 17 nt, Homo sapiens
acagccucuaguguccg

SEQ ID NO: 737069 - RNA, 20 nt, Homo sapiens
acagccugagucaccugcag

SEQ ID NO: 737070 - RNA, 14 nt, Homo sapiens
acagccuucacuuu

SEQ ID NO: 737071 - RNA, 23 nt, Homo sapiens
acagccuuucguucugcugacca

SEQ ID NO: 737072 - RNA, 18 nt, Homo sapiens
acagcgagacuccgucuc

SEQ ID NO: 737073 - RNA, 19 nt, Homo sapiens
acagcgagacuccgucuca

SEQ ID NO: 737074 - RNA, 17 nt, Homo sapiens
acagcuacucuccccac

SEQ ID NO: 737075 - RNA, 20 nt, Homo sapiens
acagcuauaccucacaauaa

SEQ ID NO: 737076 - RNA, 14 nt, Homo sapiens
acagcucagcugcc

SEQ ID NO: 737077 - RNA, 22 nt, Homo sapiens
acagcucccggcgggugcucug

SEQ ID NO: 737078 - RNA, 20 nt, Homo sapiens
acagcucuagacacugccac

SEQ ID NO: 737079 - RNA, 17 nt, Homo sapiens
acagcucuucucagugu

SEQ ID NO: 737080 - RNA, 15 nt, Homo sapiens
acagcugaguuauga

SEQ ID NO: 737081 - RNA, 15 nt, Homo sapiens
acagcuguaauaaca

SEQ ID NO: 737082 - RNA, 15 nt, Homo sapiens
acagcugucccuguc

SEQ ID NO: 737083 - RNA, 18 nt, Homo sapiens
acagcugugcaugcucag

SEQ ID NO: 737084 - RNA, 22 nt, Homo sapiens
acagcugugucugccaaacaca

SEQ ID NO: 737085 - RNA, 13 nt, Homo sapiens
acagcuucagcca

SEQ ID NO: 737086 - RNA, 15 nt, Homo sapiens
acagcuucaugccuu

SEQ ID NO: 737087 - RNA, 16 nt, Homo sapiens
acagcuuucugugcag

SEQ ID NO: 737088 - RNA, 23 nt, Homo sapiens
acagcuuuugcaacuuaauacuc

SEQ ID NO: 737089 - RNA, 14 nt, Homo sapiens
acaggaaaaugcca

SEQ ID NO: 737090 - RNA, 19 nt, Homo sapiens
acaggaaaccuacuuuuua

SEQ ID NO: 737091 - RNA, 23 nt, Homo sapiens
acaggaagguagaaauaucugaa

SEQ ID NO: 737092 - RNA, 16 nt, Homo sapiens
acaggaaguaguucua

SEQ ID NO: 737093 - RNA, 19 nt, Homo sapiens
acaggaauacuuaacucaa

SEQ ID NO: 737094 - RNA, 15 nt, Homo sapiens
acaggacagcgggaa

SEQ ID NO: 737095 - RNA, 21 nt, Homo sapiens
acaggaccccaagaaugagcu

SEQ ID NO: 737096 - RNA, 13 nt, Homo sapiens
acaggagauucca

SEQ ID NO: 737097 - RNA, 13 nt, Homo sapiens
acaggaguguccu

SEQ ID NO: 737098 - RNA, 23 nt, Homo sapiens
acaggaguguccucuucccucuc

SEQ ID NO: 737099 - RNA, 22 nt, Homo sapiens
acaggcaaauguacuucucacc

SEQ ID NO: 737100 - RNA, 12 nt, Homo sapiens
acaggcacucca

SEQ ID NO: 737101 - RNA, 20 nt, Homo sapiens
acaggcagauguuugccuca

SEQ ID NO: 737102 - RNA, 16 nt, Homo sapiens
acaggccagcaggggc

SEQ ID NO: 737103 - RNA, 15 nt, Homo sapiens
acaggccauacuuua

SEQ ID NO: 737104 - RNA, 18 nt, Homo sapiens
acaggccauacuuuacaa

SEQ ID NO: 737105 - RNA, 14 nt, Homo sapiens
acaggcccaagaga

SEQ ID NO: 737106 - RNA, 13 nt, Homo sapiens
acaggcccagcgc

SEQ ID NO: 737107 - RNA, 15 nt, Homo sapiens
acaggccgagugaag

SEQ ID NO: 737108 - RNA, 14 nt, Homo sapiens
acaggccugagauu

SEQ ID NO: 737109 - RNA, 20 nt, Homo sapiens
acaggcgccugccaucaugc

SEQ ID NO: 737110 - RNA, 18 nt, Homo sapiens
acaggcgcuguggcucac

SEQ ID NO: 737111 - RNA, 18 nt, Homo sapiens
acaggcuggugcuaacau

SEQ ID NO: 737112 - RNA, 19 nt, Homo sapiens
acaggcuguucugcacuga

SEQ ID NO: 737113 - RNA, 19 nt, Homo sapiens
acagggacaugcccugugu

SEQ ID NO: 737114 - RNA, 20 nt, Homo sapiens
acagggacaugcccugugug

SEQ ID NO: 737115 - RNA, 21 nt, Homo sapiens
acagggagacccguccauuug

SEQ ID NO: 737116 - RNA, 20 nt, Homo sapiens
acagggcgagacucugucuc

SEQ ID NO: 737117 - RNA, 21 nt, Homo sapiens
aagaaauuccuuccuuaccug

SEQ ID NO: 737118 - RNA, 22 nt, Homo sapiens
aagaaauuccuuccuuaccuga

SEQ ID NO: 737119 - RNA, 16 nt, Homo sapiens
aagaacaauucacagu

SEQ ID NO: 737120 - RNA, 18 nt, Homo sapiens
aagaacacuacugcuaaa

SEQ ID NO: 737121 - RNA, 17 nt, Homo sapiens
aagaaccaaaagagauc

SEQ ID NO: 737122 - RNA, 15 nt, Homo sapiens
aagaaccauugauuu

SEQ ID NO: 737123 - RNA, 20 nt, Homo sapiens
aagaaccgguuuccaaagac

SEQ ID NO: 737124 - RNA, 14 nt, Homo sapiens
aagaacgagaagca

SEQ ID NO: 737125 - RNA, 12 nt, Homo sapiens
aagaacuaugaa

SEQ ID NO: 737126 - RNA, 20 nt, Homo sapiens
aagaacugacuagugagaug

SEQ ID NO: 737127 - RNA, 20 nt, Homo sapiens
aagaacugucuauuuucuca

SEQ ID NO: 737128 - RNA, 24 nt, Homo sapiens
aagaacugucuauuuucucaguca

SEQ ID NO: 737129 - RNA, 20 nt, Homo sapiens
aagaagaaacgucuaugugu

SEQ ID NO: 737130 - RNA, 12 nt, Homo sapiens
aagaagaaagca

SEQ ID NO: 737131 - RNA, 12 nt, Homo sapiens
aagaagacauga

SEQ ID NO: 737132 - RNA, 15 nt, Homo sapiens
aagaagagacuggga

SEQ ID NO: 737133 - RNA, 21 nt, Homo sapiens
aagaagaugagccuugcagau

SEQ ID NO: 737134 - RNA, 19 nt, Homo sapiens
aagaagcacugggugacca

SEQ ID NO: 737135 - RNA, 14 nt, Homo sapiens
aagaagcugugaca

SEQ ID NO: 737136 - RNA, 17 nt, Homo sapiens
aagaagcugugacauau

SEQ ID NO: 737137 - RNA, 20 nt, Homo sapiens
aagaaggccagcaacauugg

SEQ ID NO: 737138 - RNA, 21 nt, Homo sapiens
aagaagggauaucuacugugg

SEQ ID NO: 737139 - RNA, 14 nt, Homo sapiens
aagaagguggucau

SEQ ID NO: 737140 - RNA, 14 nt, Homo sapiens
aagaagucacugaa

SEQ ID NO: 737141 - RNA, 20 nt, Homo sapiens
aagaagucggaaugucauag

SEQ ID NO: 737142 - RNA, 16 nt, Homo sapiens
aagaagugagcagugu

SEQ ID NO: 737143 - RNA, 14 nt, Homo sapiens
aagaauacaucaga

SEQ ID NO: 737144 - RNA, 14 nt, Homo sapiens
aagaauagguugcc

SEQ ID NO: 737145 - RNA, 15 nt, Homo sapiens
aagaaucacuugaac

SEQ ID NO: 737146 - RNA, 17 nt, Homo sapiens
aagaaucuagaaaauca

SEQ ID NO: 737147 - RNA, 17 nt, Homo sapiens
aagaaugaauaauaauu

SEQ ID NO: 737148 - RNA, 12 nt, Homo sapiens
aagaaugcucuu

SEQ ID NO: 737149 - RNA, 18 nt, Homo sapiens
aagaauucaaaccugacc

SEQ ID NO: 737150 - RNA, 12 nt, Homo sapiens
aagaauuucaca

SEQ ID NO: 737151 - RNA, 16 nt, Homo sapiens
aagacaaacacugcca

SEQ ID NO: 737152 - RNA, 12 nt, Homo sapiens
aagacaaagccu

SEQ ID NO: 737153 - RNA, 15 nt, Homo sapiens
aagacaacucugcuu

SEQ ID NO: 737154 - RNA, 14 nt, Homo sapiens
aagacaaucacugc

SEQ ID NO: 737155 - RNA, 17 nt, Homo sapiens
aagacaaucacugccaa

SEQ ID NO: 737156 - RNA, 21 nt, Homo sapiens
aagacaauucauucauuugca

SEQ ID NO: 737157 - RNA, 21 nt, Homo sapiens
aagacacuuuugaugacgauu

SEQ ID NO: 737158 - RNA, 18 nt, Homo sapiens
aagacagaaaagugccug

SEQ ID NO: 737159 - RNA, 22 nt, Homo sapiens
aagacaggcaaauguacuucuc

SEQ ID NO: 737160 - RNA, 22 nt, Homo sapiens
aagacagugccuauacugccuc

SEQ ID NO: 737161 - RNA, 20 nt, Homo sapiens
aagacauacuccuuccauca

SEQ ID NO: 737162 - RNA, 19 nt, Homo sapiens
aagacaucuuaauccugaa

SEQ ID NO: 737163 - RNA, 14 nt, Homo sapiens
aagacauucuucca

SEQ ID NO: 737164 - RNA, 22 nt, Homo sapiens
aagacauuucucuaacuccugc

SEQ ID NO: 737165 - RNA, 17 nt, Homo sapiens
aagaccagccuggccaa

SEQ ID NO: 737166 - RNA, 11 nt, Homo sapiens
aagaccagcuu

SEQ ID NO: 737167 - RNA, 15 nt, Homo sapiens
aagaccagcuuugca

SEQ ID NO: 737168 - RNA, 19 nt, Homo sapiens
aagaccagcuuugcaguga

SEQ ID NO: 737169 - RNA, 13 nt, Homo sapiens
aagaccauggauu

SEQ ID NO: 737170 - RNA, 22 nt, Homo sapiens
aagaccucgagcagaugaugcc

SEQ ID NO: 737171 - RNA, 12 nt, Homo sapiens
aagaccucuucc

SEQ ID NO: 737172 - RNA, 22 nt, Homo sapiens
aagaccugcugagggaccagcc

SEQ ID NO: 737173 - RNA, 21 nt, Homo sapiens
aagacgauuugucaguuauuu

SEQ ID NO: 737174 - RNA, 16 nt, Homo sapiens
aagacgcguagcagca

SEQ ID NO: 737175 - RNA, 21 nt, Homo sapiens
aagacuaaucgaaugaacaaa

SEQ ID NO: 737176 - RNA, 13 nt, Homo sapiens
aagacuacuauac

SEQ ID NO: 737177 - RNA, 15 nt, Homo sapiens
aagacuacuauacaa

SEQ ID NO: 737178 - RNA, 13 nt, Homo sapiens
aagacucaccuca

SEQ ID NO: 737179 - RNA, 15 nt, Homo sapiens
aagacuccaucucaa

SEQ ID NO: 737180 - RNA, 17 nt, Homo sapiens
aagacugaaucuaccug

SEQ ID NO: 737181 - RNA, 15 nt, Homo sapiens
aagacugaauuccaa

SEQ ID NO: 737182 - RNA, 23 nt, Homo sapiens
aagacugagcucaaggugggaac

SEQ ID NO: 737183 - RNA, 18 nt, Homo sapiens
aagacugcagcugcugaa

SEQ ID NO: 737184 - RNA, 13 nt, Homo sapiens
aagacugucucaa

SEQ ID NO: 737185 - RNA, 19 nt, Homo sapiens
aagacuguugccacuuaac

SEQ ID NO: 737186 - RNA, 18 nt, Homo sapiens
aagacuuuaaaccaccua

SEQ ID NO: 737187 - RNA, 19 nt, Homo sapiens
aagacuuuguccccacuua

SEQ ID NO: 737188 - RNA, 23 nt, Homo sapiens
aagacuuuuuuuuaacacuuugg

SEQ ID NO: 737189 - RNA, 13 nt, Homo sapiens
aagagaaaaugua

SEQ ID NO: 737190 - RNA, 16 nt, Homo sapiens
aagagaaaauugagag

SEQ ID NO: 737191 - RNA, 21 nt, Homo sapiens
aagagaacucgcgcucaguaa

SEQ ID NO: 737192 - RNA, 15 nt, Homo sapiens
aagagaagaaauagc

SEQ ID NO: 737193 - RNA, 14 nt, Homo sapiens
aagagacacuccaa

SEQ ID NO: 737194 - RNA, 20 nt, Homo sapiens
aagagacaggagacaugagu

SEQ ID NO: 737195 - RNA, 18 nt, Homo sapiens
aagagacauauacuaaga

SEQ ID NO: 737196 - RNA, 21 nt, Homo sapiens
aagagagaaagaaguaggcau

SEQ ID NO: 737197 - RNA, 21 nt, Homo sapiens
aagagagaucuugauccacag

SEQ ID NO: 737198 - RNA, 20 nt, Homo sapiens
aagagaguuaaaagcagcag

SEQ ID NO: 737199 - RNA, 17 nt, Homo sapiens
aagagaucacaauacuc

SEQ ID NO: 737200 - RNA, 23 nt, Homo sapiens
aagagaucacaauacucaaaaga

SEQ ID NO: 737201 - RNA, 22 nt, Homo sapiens
aagagauccuucuguaaagguu

SEQ ID NO: 737202 - RNA, 18 nt, Homo sapiens
aagagaucuacacauguu

SEQ ID NO: 737203 - RNA, 23 nt, Homo sapiens
aagagaucuuucuuuccaaaaca

SEQ ID NO: 737204 - RNA, 18 nt, Homo sapiens
aagagauuguuguuugcc

SEQ ID NO: 737205 - RNA, 19 nt, Homo sapiens
aagagauuuucacccaucc

SEQ ID NO: 737206 - RNA, 19 nt, Homo sapiens
aagagcaaaacuccgucuc

SEQ ID NO: 737207 - RNA, 20 nt, Homo sapiens
aagagcaaaacuccgucuca

SEQ ID NO: 737208 - RNA, 22 nt, Homo sapiens
aagagcaggacuccaggcccaa

SEQ ID NO: 737209 - RNA, 19 nt, Homo sapiens
aagagccaaagaauauucc

SEQ ID NO: 737210 - RNA, 16 nt, Homo sapiens
aagagccaaguuccaa

SEQ ID NO: 737211 - RNA, 15 nt, Homo sapiens
aagagccacuuucaa

SEQ ID NO: 737212 - RNA, 16 nt, Homo sapiens
aagagccgccguggcu

SEQ ID NO: 737213 - RNA, 21 nt, Homo sapiens
aagagcugccuggaugagaaa

SEQ ID NO: 737214 - RNA, 12 nt, Homo sapiens
aagagcuguuau

SEQ ID NO: 737215 - RNA, 16 nt, Homo sapiens
aagagcuuaagaacca

SEQ ID NO: 737216 - RNA, 19 nt, Homo sapiens
aagagcuuagaaacuggaa

SEQ ID NO: 737217 - RNA, 15 nt, Homo sapiens
aagagcuugucagca

SEQ ID NO: 737218 - RNA, 19 nt, Homo sapiens
aagaggcaccacuaaaaga

SEQ ID NO: 737219 - RNA, 23 nt, Homo sapiens
aagaggcagcuugaaacugagau

SEQ ID NO: 737220 - RNA, 22 nt, Homo sapiens
aagaggcccacuagagggccca

SEQ ID NO: 737221 - RNA, 16 nt, Homo sapiens
aagagggcccagccca

SEQ ID NO: 737222 - RNA, 18 nt, Homo sapiens
aagagggccugugggagc

SEQ ID NO: 737223 - RNA, 13 nt, Homo sapiens
aagagggcuuccu

SEQ ID NO: 737224 - RNA, 21 nt, Homo sapiens
aagagggcuuccucuagaagc

SEQ ID NO: 737225 - RNA, 12 nt, Homo sapiens
aagaggggaaaa

SEQ ID NO: 737226 - RNA, 16 nt, Homo sapiens
aagagggucugcauuu

SEQ ID NO: 737227 - RNA, 21 nt, Homo sapiens
aagagggucuuccuaagaaga

SEQ ID NO: 737228 - RNA, 23 nt, Homo sapiens
aagaguauuuuuaacacuuaaau

SEQ ID NO: 737229 - RNA, 14 nt, Homo sapiens
aagagucauuguua

SEQ ID NO: 737230 - RNA, 13 nt, Homo sapiens
aagaguccaagaa

SEQ ID NO: 737231 - RNA, 20 nt, Homo sapiens
aagagugagacuccaccuca

SEQ ID NO: 737232 - RNA, 21 nt, Homo sapiens
aagagugagacuccaccucaa

SEQ ID NO: 737233 - RNA, 16 nt, Homo sapiens
aagagugauugcagcu

SEQ ID NO: 737234 - RNA, 19 nt, Homo sapiens
aagagugccguaacaacug

SEQ ID NO: 737235 - RNA, 15 nt, Homo sapiens
aagaguggacugaau

SEQ ID NO: 737236 - RNA, 22 nt, Homo sapiens
aagaguggguuucacaagugaa

SEQ ID NO: 737237 - RNA, 11 nt, Homo sapiens
aagaguggucu

SEQ ID NO: 737238 - RNA, 22 nt, Homo sapiens
aagaguucccuugaaacuuugg

SEQ ID NO: 737239 - RNA, 21 nt, Homo sapiens
aagaguucuuaaggauuguga

SEQ ID NO: 737240 - RNA, 17 nt, Homo sapiens
aagaguugccaaaauac

SEQ ID NO: 737241 - RNA, 22 nt, Homo sapiens
aagaguugcuuugccagagcag

SEQ ID NO: 737242 - RNA, 18 nt, Homo sapiens
aagaguuucuccuuuuga

SEQ ID NO: 737243 - RNA, 19 nt, Homo sapiens
aagaguuucuccuuuugac

SEQ ID NO: 737244 - RNA, 24 nt, Homo sapiens
aagaguuucuccuuuugaccaaau

SEQ ID NO: 737245 - RNA, 23 nt, Homo sapiens
aagauaccuaaaagagauuucaa

SEQ ID NO: 737246 - RNA, 14 nt, Homo sapiens
aagauaguaacaau

SEQ ID NO: 737247 - RNA, 16 nt, Homo sapiens
aagauaguuuucuccu

SEQ ID NO: 737248 - RNA, 13 nt, Homo sapiens
aagauauaaguaa

SEQ ID NO: 737249 - RNA, 14 nt, Homo sapiens
aagauauccacuua

SEQ ID NO: 737250 - RNA, 19 nt, Homo sapiens
aagauccugaagcaguuca

SEQ ID NO: 737251 - RNA, 17 nt, Homo sapiens
aagauccuucgggugcu

SEQ ID NO: 737252 - RNA, 17 nt, Homo sapiens
aagaucguucucugccu

SEQ ID NO: 737253 - RNA, 18 nt, Homo sapiens
aagaucuguccucagccu

SEQ ID NO: 737254 - RNA, 21 nt, Homo sapiens
aagaugacgaguaacuccccu

SEQ ID NO: 737255 - RNA, 18 nt, Homo sapiens
aagaugagagaacuggag

SEQ ID NO: 737256 - RNA, 20 nt, Homo sapiens
aagaugagccuugcagauau

SEQ ID NO: 737257 - RNA, 16 nt, Homo sapiens
aagaugaugaugaucu

SEQ ID NO: 737258 - RNA, 15 nt, Homo sapiens
aagaugaugauguua

SEQ ID NO: 737259 - RNA, 19 nt, Homo sapiens
aagaugauuuaaguauaca

SEQ ID NO: 737260 - RNA, 17 nt, Homo sapiens
aagaugauuucaguuca

SEQ ID NO: 737261 - RNA, 13 nt, Homo sapiens
aagaugcacugaa

SEQ ID NO: 737262 - RNA, 15 nt, Homo sapiens
aagaugcacugaaaa

SEQ ID NO: 737263 - RNA, 21 nt, Homo sapiens
aagaugcagaguaaguauuau

SEQ ID NO: 737264 - RNA, 11 nt, Homo sapiens
aagaugcugcc

SEQ ID NO: 737265 - RNA, 20 nt, Homo sapiens
aagauggccuuugcuuauga

SEQ ID NO: 737266 - RNA, 16 nt, Homo sapiens
aagaugggaacacugg

SEQ ID NO: 737267 - RNA, 22 nt, Homo sapiens
aagaugggacagcaacaaaauc

SEQ ID NO: 737268 - RNA, 16 nt, Homo sapiens
aagaugggucacugaa

SEQ ID NO: 737269 - RNA, 22 nt, Homo sapiens
aagaugguauauuugguacugu

SEQ ID NO: 737270 - RNA, 18 nt, Homo sapiens
aagaugguccgugcccag

SEQ ID NO: 737271 - RNA, 21 nt, Homo sapiens
aagaugguucuagcauggcau

SEQ ID NO: 737272 - RNA, 18 nt, Homo sapiens
aagaugguuuaugcaugu

SEQ ID NO: 737273 - RNA, 18 nt, Homo sapiens
aagaugucacaagggauu

SEQ ID NO: 737274 - RNA, 22 nt, Homo sapiens
aagaugugggcagugaugucac

SEQ ID NO: 737275 - RNA, 22 nt, Homo sapiens
aagauguguugcuauccugaaa

SEQ ID NO: 737276 - RNA, 18 nt, Homo sapiens
aagauguuucaaaaaauc

SEQ ID NO: 737277 - RNA, 18 nt, Homo sapiens
aagauguuuuauuuugcc

SEQ ID NO: 737278 - RNA, 16 nt, Homo sapiens
aagauuaaaaagcaca

SEQ ID NO: 737279 - RNA, 16 nt, Homo sapiens
aagauuagaagcugaa

SEQ ID NO: 737280 - RNA, 17 nt, Homo sapiens
aagauuaggcacacaga

SEQ ID NO: 737281 - RNA, 20 nt, Homo sapiens
aagauuauagaaguagcaaa

SEQ ID NO: 737282 - RNA, 12 nt, Homo sapiens
aagauucaguga

SEQ ID NO: 737283 - RNA, 20 nt, Homo sapiens
aagauucuggggcuguguua

SEQ ID NO: 737284 - RNA, 20 nt, Homo sapiens
aagauucuuaaaaauugaau

SEQ ID NO: 737285 - RNA, 15 nt, Homo sapiens
aagauugcaccacug

SEQ ID NO: 737286 - RNA, 21 nt, Homo sapiens
aagauugcgccauugcacucc

SEQ ID NO: 737287 - RNA, 14 nt, Homo sapiens
aagauuguugauag

SEQ ID NO: 737288 - RNA, 21 nt, Homo sapiens
aagauuuuauucuuauuucau

SEQ ID NO: 737289 - RNA, 18 nt, Homo sapiens
aagauuuucccagucugu

SEQ ID NO: 737290 - RNA, 14 nt, Homo sapiens
aagauuuucuauua

SEQ ID NO: 737291 - RNA, 19 nt, Homo sapiens
aagauuuugggagaguaaa

SEQ ID NO: 737292 - RNA, 18 nt, Homo sapiens
aagauuuuuuuugucaga

SEQ ID NO: 737293 - RNA, 17 nt, Homo sapiens
aagcaaaagucagucuu

SEQ ID NO: 737294 - RNA, 13 nt, Homo sapiens
aagcaaacacuua

SEQ ID NO: 737295 - RNA, 14 nt, Homo sapiens
aagcaaacuuauuu

SEQ ID NO: 737296 - RNA, 15 nt, Homo sapiens
aagcaaauguuggga

SEQ ID NO: 737297 - RNA, 17 nt, Homo sapiens
aagcaacaaauuaacua

SEQ ID NO: 737298 - RNA, 14 nt, Homo sapiens
aagcaacacagagc

SEQ ID NO: 737299 - RNA, 23 nt, Homo sapiens
aagcaacagauggauagucuguc

SEQ ID NO: 737300 - RNA, 20 nt, Homo sapiens
aagcaacaucuagcaaaugu

SEQ ID NO: 737301 - RNA, 15 nt, Homo sapiens
aagcaaggcuuuaaa

SEQ ID NO: 737302 - RNA, 16 nt, Homo sapiens
aagcaagggaccuuca

SEQ ID NO: 737303 - RNA, 14 nt, Homo sapiens
aagcaagggcucca

SEQ ID NO: 737304 - RNA, 19 nt, Homo sapiens
aagcaaguguucacaacag

SEQ ID NO: 737305 - RNA, 19 nt, Homo sapiens
aagcaauaauggucccauc

SEQ ID NO: 737306 - RNA, 13 nt, Homo sapiens
aagcaauugucug

SEQ ID NO: 737307 - RNA, 15 nt, Homo sapiens
aagcacaaguacuuu

SEQ ID NO: 737308 - RNA, 18 nt, Homo sapiens
aagcacaagugcauggca

SEQ ID NO: 737309 - RNA, 18 nt, Homo sapiens
aagcacagaauuugucag

SEQ ID NO: 737310 - RNA, 18 nt, Homo sapiens
aacccucuggggagcuca

SEQ ID NO: 737311 - RNA, 22 nt, Homo sapiens
aacccuggaucaguccuuugau

SEQ ID NO: 737312 - RNA, 20 nt, Homo sapiens
aacccugggcuauugcugcu

SEQ ID NO: 737313 - RNA, 12 nt, Homo sapiens
aacccugucuga

SEQ ID NO: 737314 - RNA, 14 nt, Homo sapiens
aacccugugcuguc

SEQ ID NO: 737315 - RNA, 15 nt, Homo sapiens
aacccuguguucaca

SEQ ID NO: 737316 - RNA, 14 nt, Homo sapiens
aacccuuauuccau

SEQ ID NO: 737317 - RNA, 20 nt, Homo sapiens
aacccuucagauuugccuua

SEQ ID NO: 737318 - RNA, 23 nt, Homo sapiens
aacccuucccucaccuuggcacc

SEQ ID NO: 737319 - RNA, 14 nt, Homo sapiens
aacccuugcuugca

SEQ ID NO: 737320 - RNA, 16 nt, Homo sapiens
aaccgagaagguuuau

SEQ ID NO: 737321 - RNA, 16 nt, Homo sapiens
aaccgcacaugcacac

SEQ ID NO: 737322 - RNA, 21 nt, Homo sapiens
aaccgggagaaggcaugagaa

SEQ ID NO: 737323 - RNA, 16 nt, Homo sapiens
aaccgugauaagccuu

SEQ ID NO: 737324 - RNA, 16 nt, Homo sapiens
aaccguguccagcaca

SEQ ID NO: 737325 - RNA, 23 nt, Homo sapiens
aaccuaacugcaauguggauguu

SEQ ID NO: 737326 - RNA, 23 nt, Homo sapiens
aaccuacaguuuuaacuguggau

SEQ ID NO: 737327 - RNA, 12 nt, Homo sapiens
aaccuaccuccc

SEQ ID NO: 737328 - RNA, 13 nt, Homo sapiens
aaccuacuaccca

SEQ ID NO: 737329 - RNA, 12 nt, Homo sapiens
aaccuacugucu

SEQ ID NO: 737330 - RNA, 19 nt, Homo sapiens
aaccuacuuuuuaugugcu

SEQ ID NO: 737331 - RNA, 20 nt, Homo sapiens
aaccuauuuuuaaugaaacu

SEQ ID NO: 737332 - RNA, 13 nt, Homo sapiens
aaccucaaaaugu

SEQ ID NO: 737333 - RNA, 13 nt, Homo sapiens
aaccucacuuccc

SEQ ID NO: 737334 - RNA, 22 nt, Homo sapiens
aaccucagggcucccagggguc

SEQ ID NO: 737335 - RNA, 12 nt, Homo sapiens
aaccucaucucu

SEQ ID NO: 737336 - RNA, 14 nt, Homo sapiens
aaccucaucugccu

SEQ ID NO: 737337 - RNA, 21 nt, Homo sapiens
aaccucauuccccaaccacuu

SEQ ID NO: 737338 - RNA, 17 nt, Homo sapiens
aaccucauugcuaccac

SEQ ID NO: 737339 - RNA, 14 nt, Homo sapiens
aaccuccuaagcaa

SEQ ID NO: 737340 - RNA, 14 nt, Homo sapiens
aaccuccuuuacca

SEQ ID NO: 737341 - RNA, 18 nt, Homo sapiens
aaccucuagagucacuga

SEQ ID NO: 737342 - RNA, 14 nt, Homo sapiens
aaccucuaugcaau

SEQ ID NO: 737343 - RNA, 20 nt, Homo sapiens
aaccucugccuuccagguuc

SEQ ID NO: 737344 - RNA, 13 nt, Homo sapiens
aaccugaguauca

SEQ ID NO: 737345 - RNA, 18 nt, Homo sapiens
aaccugccaugccaggaa

SEQ ID NO: 737346 - RNA, 17 nt, Homo sapiens
aaccuggacacucucuu

SEQ ID NO: 737347 - RNA, 16 nt, Homo sapiens
aaccuguccuugcaca

SEQ ID NO: 737348 - RNA, 17 nt, Homo sapiens
aaccuuaaauauauaau

SEQ ID NO: 737349 - RNA, 24 nt, Homo sapiens
aaccuuaaguaaucaucuaaguca

SEQ ID NO: 737350 - RNA, 14 nt, Homo sapiens
aaccuuccaucucg

SEQ ID NO: 737351 - RNA, 17 nt, Homo sapiens
aaccuugaaugcugcca

SEQ ID NO: 737352 - RNA, 20 nt, Homo sapiens
aaccuugaaugcugccagug

SEQ ID NO: 737353 - RNA, 18 nt, Homo sapiens
aaccuugucucuaugcca

SEQ ID NO: 737354 - RNA, 21 nt, Homo sapiens
aaccuuguuuggggcacagua

SEQ ID NO: 737355 - RNA, 17 nt, Homo sapiens
aaccuuuggaagucaug

SEQ ID NO: 737356 - RNA, 17 nt, Homo sapiens
aacgaaucgauucugca

SEQ ID NO: 737357 - RNA, 20 nt, Homo sapiens
aacgagcauaguccaaaaag

SEQ ID NO: 737358 - RNA, 22 nt, Homo sapiens
aacgcagaagaaaggguggaaa

SEQ ID NO: 737359 - RNA, 13 nt, Homo sapiens
aacgccgagugca

SEQ ID NO: 737360 - RNA, 18 nt, Homo sapiens
aacgccgcugacugccac

SEQ ID NO: 737361 - RNA, 17 nt, Homo sapiens
aacgcuuuuugggagaa

SEQ ID NO: 737362 - RNA, 16 nt, Homo sapiens
aacggagagugcuugg

SEQ ID NO: 737363 - RNA, 22 nt, Homo sapiens
aacgggcugcccucagcucaca

SEQ ID NO: 737364 - RNA, 13 nt, Homo sapiens
aacgguccaugaa

SEQ ID NO: 737365 - RNA, 15 nt, Homo sapiens
aacgucaucucaggg

SEQ ID NO: 737366 - RNA, 14 nt, Homo sapiens
aacguggcacuggu

SEQ ID NO: 737367 - RNA, 15 nt, Homo sapiens
aacguggcacuggua

SEQ ID NO: 737368 - RNA, 20 nt, Homo sapiens
aacguguuaaagguuuucuc

SEQ ID NO: 737369 - RNA, 16 nt, Homo sapiens
aacguucugcugcuug

SEQ ID NO: 737370 - RNA, 15 nt, Homo sapiens
aacguugacaaguuu

SEQ ID NO: 737371 - RNA, 20 nt, Homo sapiens
aacuaaaauuaaguauauau

SEQ ID NO: 737372 - RNA, 16 nt, Homo sapiens
aacuaaacucauuuau

SEQ ID NO: 737373 - RNA, 15 nt, Homo sapiens
aacuaacuccagaag

SEQ ID NO: 737374 - RNA, 16 nt, Homo sapiens
aacuaacuccagaagc

SEQ ID NO: 737375 - RNA, 16 nt, Homo sapiens
aacuaagacauaugca

SEQ ID NO: 737376 - RNA, 17 nt, Homo sapiens
aacuaagacauaugcau

SEQ ID NO: 737377 - RNA, 19 nt, Homo sapiens
aacuaagagaaacugugua

SEQ ID NO: 737378 - RNA, 22 nt, Homo sapiens
aacuaaucaagaaaaacaucuu

SEQ ID NO: 737379 - RNA, 13 nt, Homo sapiens
aacuaauuugaau

SEQ ID NO: 737380 - RNA, 22 nt, Homo sapiens
aacuacagaguuuaugauuuaa

SEQ ID NO: 737381 - RNA, 12 nt, Homo sapiens
aacuacauguaa

SEQ ID NO: 737382 - RNA, 16 nt, Homo sapiens
aacuacauguaaucca

SEQ ID NO: 737383 - RNA, 16 nt, Homo sapiens
aacuacauuuugcaac

SEQ ID NO: 737384 - RNA, 13 nt, Homo sapiens
aacuaccaucuga

SEQ ID NO: 737385 - RNA, 14 nt, Homo sapiens
aacuaccaucugau

SEQ ID NO: 737386 - RNA, 22 nt, Homo sapiens
aacuacccagguauuacacaag

SEQ ID NO: 737387 - RNA, 22 nt, Homo sapiens
aacuacugacggaguccugugu

SEQ ID NO: 737388 - RNA, 18 nt, Homo sapiens
agccuccccgugccaaaa

SEQ ID NO: 737389 - RNA, 20 nt, Homo sapiens
agccucccugaagaccaaaa

SEQ ID NO: 737390 - RNA, 19 nt, Homo sapiens
agccuccgcgccuugccuc

SEQ ID NO: 737391 - RNA, 15 nt, Homo sapiens
agccuccucucucaa

SEQ ID NO: 737392 - RNA, 16 nt, Homo sapiens
agccuccugaguagau

SEQ ID NO: 737393 - RNA, 19 nt, Homo sapiens
agccucuaguguccgggga

SEQ ID NO: 737394 - RNA, 14 nt, Homo sapiens
agccucuccaggaa

SEQ ID NO: 737395 - RNA, 22 nt, Homo sapiens
agccugacagaaggaacacugc

SEQ ID NO: 737396 - RNA, 23 nt, Homo sapiens
agccugacauggacccacuaccc

SEQ ID NO: 737397 - RNA, 18 nt, Homo sapiens
agccugagucaccugcag

SEQ ID NO: 737398 - RNA, 20 nt, Homo sapiens
agccugauuuuccugaugcu

SEQ ID NO: 737399 - RNA, 15 nt, Homo sapiens
agccugcaccuggug

SEQ ID NO: 737400 - RNA, 15 nt, Homo sapiens
agccugcagaaucca

SEQ ID NO: 737401 - RNA, 16 nt, Homo sapiens
agccugcagucacugg

SEQ ID NO: 737402 - RNA, 20 nt, Homo sapiens
agccugcauugagcuugcau

SEQ ID NO: 737403 - RNA, 23 nt, Homo sapiens
agccugccaagagguacuguaau

SEQ ID NO: 737404 - RNA, 23 nt, Homo sapiens
agccugccucccaagguccucuc

SEQ ID NO: 737405 - RNA, 21 nt, Homo sapiens
agccugcucccccacccccuc

SEQ ID NO: 737406 - RNA, 20 nt, Homo sapiens
agccugcucuagugggacag

SEQ ID NO: 737407 - RNA, 15 nt, Homo sapiens
agccugcuucuuccc

SEQ ID NO: 737408 - RNA, 16 nt, Homo sapiens
agccuggacugcuacc

SEQ ID NO: 737409 - RNA, 21 nt, Homo sapiens
agccuggcacagggcaguggg

SEQ ID NO: 737410 - RNA, 14 nt, Homo sapiens
agccuggccagaca

SEQ ID NO: 737411 - RNA, 19 nt, Homo sapiens
agccuggcucccaggacac

SEQ ID NO: 737412 - RNA, 18 nt, Homo sapiens
agccuggcucuaucuucc

SEQ ID NO: 737413 - RNA, 20 nt, Homo sapiens
agccuggcuggagagcugcu

SEQ ID NO: 737414 - RNA, 22 nt, Homo sapiens
agccuggcuggagagcugcuau

SEQ ID NO: 737415 - RNA, 15 nt, Homo sapiens
agccuggcuggcaca

SEQ ID NO: 737416 - RNA, 16 nt, Homo sapiens
agccugggagcccaga

SEQ ID NO: 737417 - RNA, 20 nt, Homo sapiens
agccugggcaacaagagcaa

SEQ ID NO: 737418 - RNA, 21 nt, Homo sapiens
agccugggcagcauagcaaga

SEQ ID NO: 737419 - RNA, 17 nt, Homo sapiens
agccugggccagagaag

SEQ ID NO: 737420 - RNA, 22 nt, Homo sapiens
agccuguaaacuuuaucacuua

SEQ ID NO: 737421 - RNA, 15 nt, Homo sapiens
agccuguauguggug

SEQ ID NO: 737422 - RNA, 18 nt, Homo sapiens
agccuguccaacauggug

SEQ ID NO: 737423 - RNA, 13 nt, Homo sapiens
agccugucuuuca

SEQ ID NO: 737424 - RNA, 18 nt, Homo sapiens
agccugugccagcaccuu

SEQ ID NO: 737425 - RNA, 21 nt, Homo sapiens
agccugugcgccgggggaccu

SEQ ID NO: 737426 - RNA, 23 nt, Homo sapiens
agccugugcgucccagcugaagg

SEQ ID NO: 737427 - RNA, 22 nt, Homo sapiens
agccuguggcuuggaguggcca

SEQ ID NO: 737428 - RNA, 21 nt, Homo sapiens
agccugugguuacagugcaga

SEQ ID NO: 737429 - RNA, 17 nt, Homo sapiens
agccuuaauuugcacag

SEQ ID NO: 737430 - RNA, 12 nt, Homo sapiens
agccuuacaaac

SEQ ID NO: 737431 - RNA, 23 nt, Homo sapiens
agccuucaaauuauaaaccaagg

SEQ ID NO: 737432 - RNA, 17 nt, Homo sapiens
agccuucagcagcagcu

SEQ ID NO: 737433 - RNA, 16 nt, Homo sapiens
agccuucggacagaca

SEQ ID NO: 737434 - RNA, 19 nt, Homo sapiens
agccuucgggcgucugugu

SEQ ID NO: 737435 - RNA, 17 nt, Homo sapiens
agccuuggcucuacccu

SEQ ID NO: 737436 - RNA, 13 nt, Homo sapiens
agccuuuccauaa

SEQ ID NO: 737437 - RNA, 20 nt, Homo sapiens
agccuuuguugaacuguuag

SEQ ID NO: 737438 - RNA, 17 nt, Homo sapiens
agcgagacuccaucucu

SEQ ID NO: 737439 - RNA, 19 nt, Homo sapiens
agcgaugaggggacauuuu

SEQ ID NO: 737440 - RNA, 13 nt, Homo sapiens
agcgcacagggag

SEQ ID NO: 737441 - RNA, 18 nt, Homo sapiens
agcgcaucaggccuggca

SEQ ID NO: 737442 - RNA, 22 nt, Homo sapiens
agcgccaaauguucauccucau

SEQ ID NO: 737443 - RNA, 20 nt, Homo sapiens
agcgccugacccuggugggc

SEQ ID NO: 737444 - RNA, 23 nt, Homo sapiens
agcgcuaauuuugaaugcccuca

SEQ ID NO: 737445 - RNA, 17 nt, Homo sapiens
agcgcuacccaccucca

SEQ ID NO: 737446 - RNA, 18 nt, Homo sapiens
agcgcuucaguucagcuu

SEQ ID NO: 737447 - RNA, 21 nt, Homo sapiens
agcgcuucugcaccaacucac

SEQ ID NO: 737448 - RNA, 15 nt, Homo sapiens
agcggagagagccaa

SEQ ID NO: 737449 - RNA, 18 nt, Homo sapiens
agcggaggagaccagcuc

SEQ ID NO: 737450 - RNA, 22 nt, Homo sapiens
agcggcccuaagggagugucua

SEQ ID NO: 737451 - RNA, 17 nt, Homo sapiens
agcgggacucuguccaa

SEQ ID NO: 737452 - RNA, 14 nt, Homo sapiens
agcgggcacagggc

SEQ ID NO: 737453 - RNA, 13 nt, Homo sapiens
agcgguccaaagu

SEQ ID NO: 737454 - RNA, 19 nt, Homo sapiens
agcgucccagucucuggca

SEQ ID NO: 737455 - RNA, 13 nt, Homo sapiens
agcgucugcucau

SEQ ID NO: 737456 - RNA, 14 nt, Homo sapiens
agcgucuugcucug

SEQ ID NO: 737457 - RNA, 15 nt, Homo sapiens
agcgugaaucuguau

SEQ ID NO: 737458 - RNA, 24 nt, Homo sapiens
agcgugcauaaguuaacuuccaau

SEQ ID NO: 737459 - RNA, 13 nt, Homo sapiens
agcguuaugugca

SEQ ID NO: 737460 - RNA, 19 nt, Homo sapiens
agcguuccaaguuccccau

SEQ ID NO: 737461 - RNA, 15 nt, Homo sapiens
agcuaaagaggcuga

SEQ ID NO: 737462 - RNA, 12 nt, Homo sapiens
agcuaaccauca

SEQ ID NO: 737463 - RNA, 14 nt, Homo sapiens
agcuaauaagugcu

SEQ ID NO: 737464 - RNA, 13 nt, Homo sapiens
agcuaaugugcag

SEQ ID NO: 737465 - RNA, 19 nt, Homo sapiens
agcuacacaaggaaggcau

SEQ ID NO: 737466 - RNA, 17 nt, Homo sapiens
agcuacagggcugauac

SEQ ID NO: 737467 - RNA, 12 nt, Homo sapiens
agcuacauuccu

SEQ ID NO: 737468 - RNA, 13 nt, Homo sapiens
agcuaccaggugu

SEQ ID NO: 737469 - RNA, 19 nt, Homo sapiens
agcuaccuguggugauguu

SEQ ID NO: 737470 - RNA, 16 nt, Homo sapiens
agcuacuaaugauguu

SEQ ID NO: 737471 - RNA, 16 nt, Homo sapiens
agcuacuagagauauu

SEQ ID NO: 737472 - RNA, 18 nt, Homo sapiens
agcuacucgggaggcuga

SEQ ID NO: 737473 - RNA, 21 nt, Homo sapiens
agcuacucuccccacgagggc

SEQ ID NO: 737474 - RNA, 13 nt, Homo sapiens
agcuacugaugaa

SEQ ID NO: 737475 - RNA, 12 nt, Homo sapiens
agcuacuggaau

SEQ ID NO: 737476 - RNA, 18 nt, Homo sapiens
agcuacuugggaggcuga

SEQ ID NO: 737477 - RNA, 16 nt, Homo sapiens
agcuacuuuauguaaa

SEQ ID NO: 737478 - RNA, 21 nt, Homo sapiens
agcuagaagugggccaggaca

SEQ ID NO: 737479 - RNA, 14 nt, Homo sapiens
agcuagaauaccac

SEQ ID NO: 737480 - RNA, 14 nt, Homo sapiens
agcuagaggccacc

SEQ ID NO: 737481 - RNA, 20 nt, Homo sapiens
agcuagcuucugcaauguuu

SEQ ID NO: 737482 - RNA, 19 nt, Homo sapiens
agcuaggaugguucuguga

SEQ ID NO: 737483 - RNA, 16 nt, Homo sapiens
agcuaguguaccuccu

SEQ ID NO: 737484 - RNA, 18 nt, Homo sapiens
agcuauaacaacucuauu

SEQ ID NO: 737485 - RNA, 17 nt, Homo sapiens
agcuauccacagcuuac

SEQ ID NO: 737486 - RNA, 16 nt, Homo sapiens
agcuaucucucaguga

SEQ ID NO: 737487 - RNA, 15 nt, Homo sapiens
agcuauggugcuugc

SEQ ID NO: 737488 - RNA, 15 nt, Homo sapiens
agcuauucaccucag

SEQ ID NO: 737489 - RNA, 16 nt, Homo sapiens
agcuauuuaucuguag

SEQ ID NO: 737490 - RNA, 20 nt, Homo sapiens
agcuauuuugugaagccaug

SEQ ID NO: 737491 - RNA, 10 nt, Homo sapiens
agcucaccag

SEQ ID NO: 737492 - RNA, 12 nt, Homo sapiens
agcucacugaau

SEQ ID NO: 737493 - RNA, 19 nt, Homo sapiens
agcucagaaacgaaaucua

SEQ ID NO: 737494 - RNA, 16 nt, Homo sapiens
agcucagccacuguga

SEQ ID NO: 737495 - RNA, 15 nt, Homo sapiens
agcucaggauggcuc

SEQ ID NO: 737496 - RNA, 17 nt, Homo sapiens
agcucagucccaucaga

SEQ ID NO: 737497 - RNA, 20 nt, Homo sapiens
agcucaguuucaccguccac

SEQ ID NO: 737498 - RNA, 23 nt, Homo sapiens
agcucauuugagauaaagucaaa

SEQ ID NO: 737499 - RNA, 15 nt, Homo sapiens
agcuccaaccugcaa

SEQ ID NO: 737500 - RNA, 15 nt, Homo sapiens
agcuccaauuucaag

SEQ ID NO: 737501 - RNA, 22 nt, Homo sapiens
agcuccccaggacucacccuca

SEQ ID NO: 737502 - RNA, 19 nt, Homo sapiens
agcuccccugcgccuccau

SEQ ID NO: 737503 - RNA, 12 nt, Homo sapiens
agaaaugucuaa

SEQ ID NO: 737504 - RNA, 15 nt, Homo sapiens
agaaauuaacaaaug

SEQ ID NO: 737505 - RNA, 22 nt, Homo sapiens
agaaauugacacaaguggaccu

SEQ ID NO: 737506 - RNA, 22 nt, Homo sapiens
agaaauugcauuuccugacaga

SEQ ID NO: 737507 - RNA, 21 nt, Homo sapiens
agaaauuggaagaagcacuga

SEQ ID NO: 737508 - RNA, 19 nt, Homo sapiens
agaaauugugugugcaaga

SEQ ID NO: 737509 - RNA, 20 nt, Homo sapiens
agaaauuuggcuauaaucuu

SEQ ID NO: 737510 - RNA, 19 nt, Homo sapiens
agaaauuuugccugccauu

SEQ ID NO: 737511 - RNA, 15 nt, Homo sapiens
agaacaaacaccucc

SEQ ID NO: 737512 - RNA, 16 nt, Homo sapiens
agaacaaacucugaaa

SEQ ID NO: 737513 - RNA, 22 nt, Homo sapiens
agaacaaaggacagaguaugaa

SEQ ID NO: 737514 - RNA, 16 nt, Homo sapiens
agaacaacuacuguga

SEQ ID NO: 737515 - RNA, 14 nt, Homo sapiens
agaacaacuugcua

SEQ ID NO: 737516 - RNA, 20 nt, Homo sapiens
agaacacaugugcagucacu

SEQ ID NO: 737517 - RNA, 22 nt, Homo sapiens
agaacaccccaugcgugcugag

SEQ ID NO: 737518 - RNA, 14 nt, Homo sapiens
agaacacuaacuca

SEQ ID NO: 737519 - RNA, 17 nt, Homo sapiens
agaacacuacugcuaaa

SEQ ID NO: 737520 - RNA, 12 nt, Homo sapiens
agaacagccgcu

SEQ ID NO: 737521 - RNA, 15 nt, Homo sapiens
agaacaguugauuuc

SEQ ID NO: 737522 - RNA, 22 nt, Homo sapiens
agaacauaaaaaauaaaguacc

SEQ ID NO: 737523 - RNA, 16 nt, Homo sapiens
agaacauacacuguga

SEQ ID NO: 737524 - RNA, 22 nt, Homo sapiens
agaacaucauuagaacaaagga

SEQ ID NO: 737525 - RNA, 16 nt, Homo sapiens
agaacaugcacauuua

SEQ ID NO: 737526 - RNA, 12 nt, Homo sapiens
agaacauguuaa

SEQ ID NO: 737527 - RNA, 18 nt, Homo sapiens
agaacccuuggagccaau

SEQ ID NO: 737528 - RNA, 12 nt, Homo sapiens
agaaccucaggc

SEQ ID NO: 737529 - RNA, 15 nt, Homo sapiens
agaaccuucaaccca

SEQ ID NO: 737530 - RNA, 23 nt, Homo sapiens
agaacguggugaccuuucacgaa

SEQ ID NO: 737531 - RNA, 11 nt, Homo sapiens
agaacuacuuc

SEQ ID NO: 737532 - RNA, 20 nt, Homo sapiens
agaacuagccaaaccaggac

SEQ ID NO: 737533 - RNA, 15 nt, Homo sapiens
agaacucacucuggg

SEQ ID NO: 737534 - RNA, 19 nt, Homo sapiens
agaacucuaaccaguguac

SEQ ID NO: 737535 - RNA, 11 nt, Homo sapiens
agaacucugcc

SEQ ID NO: 737536 - RNA, 15 nt, Homo sapiens
agaacugagggcucu

SEQ ID NO: 737537 - RNA, 12 nt, Homo sapiens
agaacugugaua

SEQ ID NO: 737538 - RNA, 13 nt, Homo sapiens
agaacugugccac

SEQ ID NO: 737539 - RNA, 17 nt, Homo sapiens
agaacuguucauuucca

SEQ ID NO: 737540 - RNA, 20 nt, Homo sapiens
agaacuuccccucccuuccc

SEQ ID NO: 737541 - RNA, 15 nt, Homo sapiens
agaacuugaauuucu

SEQ ID NO: 737542 - RNA, 13 nt, Homo sapiens
agaacuugcaaua

SEQ ID NO: 737543 - RNA, 20 nt, Homo sapiens
agaacuugcaauaccaaugu

SEQ ID NO: 737544 - RNA, 19 nt, Homo sapiens
agaacuugcagcugauguu

SEQ ID NO: 737545 - RNA, 18 nt, Homo sapiens
agaacuuuucgacauauu

SEQ ID NO: 737546 - RNA, 15 nt, Homo sapiens
agaagaaacagaagc

SEQ ID NO: 737547 - RNA, 15 nt, Homo sapiens
agaagaaacuuugcc

SEQ ID NO: 737548 - RNA, 22 nt, Homo sapiens
agaagaaacuuugccucaagac

SEQ ID NO: 737549 - RNA, 18 nt, Homo sapiens
agaagaaauucugucaua

SEQ ID NO: 737550 - RNA, 17 nt, Homo sapiens
agaagaacauccaagga

SEQ ID NO: 737551 - RNA, 18 nt, Homo sapiens
agaagaagcccauaucac

SEQ ID NO: 737552 - RNA, 15 nt, Homo sapiens
agaagacaacauuaa

SEQ ID NO: 737553 - RNA, 19 nt, Homo sapiens
agaagacaacauuucucaa

SEQ ID NO: 737554 - RNA, 12 nt, Homo sapiens
agaagacauuuu

SEQ ID NO: 737555 - RNA, 21 nt, Homo sapiens
agaagaccccugacucaucau

SEQ ID NO: 737556 - RNA, 17 nt, Homo sapiens
agaagaccuugggccaa

SEQ ID NO: 737557 - RNA, 18 nt, Homo sapiens
agaagaccuugggccaag

SEQ ID NO: 737558 - RNA, 14 nt, Homo sapiens
agaagagacuggga

SEQ ID NO: 737559 - RNA, 14 nt, Homo sapiens
agaagagauuucuc

SEQ ID NO: 737560 - RNA, 18 nt, Homo sapiens
agaagagggucugcauuu

SEQ ID NO: 737561 - RNA, 13 nt, Homo sapiens
agaagaguggcag

SEQ ID NO: 737562 - RNA, 23 nt, Homo sapiens
agaagaguuucuccuuuugacca

SEQ ID NO: 737563 - RNA, 21 nt, Homo sapiens
agaagaugagccuugcagaua

SEQ ID NO: 737564 - RNA, 22 nt, Homo sapiens
agaagauggcaaaaucaucuua

SEQ ID NO: 737565 - RNA, 16 nt, Homo sapiens
agaagcaaucuuugaa

SEQ ID NO: 737566 - RNA, 13 nt, Homo sapiens
agaagcacuacac

SEQ ID NO: 737567 - RNA, 17 nt, Homo sapiens
agaagcagguucuugau

SEQ ID NO: 737568 - RNA, 18 nt, Homo sapiens
agaagccacagugcccac

SEQ ID NO: 737569 - RNA, 14 nt, Homo sapiens
agaagccagccaca

SEQ ID NO: 737570 - RNA, 14 nt, Homo sapiens
agaagcccauauca

SEQ ID NO: 737571 - RNA, 20 nt, Homo sapiens
agaagccuagugugugugcu

SEQ ID NO: 737572 - RNA, 21 nt, Homo sapiens
agaagccuccaagccugccuc

SEQ ID NO: 737573 - RNA, 22 nt, Homo sapiens
agaagcucucgauggacaauga

SEQ ID NO: 737574 - RNA, 16 nt, Homo sapiens
agaagcucuggcccca

SEQ ID NO: 737575 - RNA, 20 nt, Homo sapiens
agaagcugaggcuaguucca

SEQ ID NO: 737576 - RNA, 12 nt, Homo sapiens
agaagcuuccau

SEQ ID NO: 737577 - RNA, 15 nt, Homo sapiens
agaaggaacauugca

SEQ ID NO: 737578 - RNA, 18 nt, Homo sapiens
agaaggaacauugcagag

SEQ ID NO: 737579 - RNA, 13 nt, Homo sapiens
agaaggcaaaaag

SEQ ID NO: 737580 - RNA, 22 nt, Homo sapiens
agaaggcaugaaauugucuagc

SEQ ID NO: 737581 - RNA, 15 nt, Homo sapiens
agaaggcaugagaaa

SEQ ID NO: 737582 - RNA, 23 nt, Homo sapiens
agaaggcuauguaaacaaaccac

SEQ ID NO: 737583 - RNA, 16 nt, Homo sapiens
agaagggauaucuacu

SEQ ID NO: 737584 - RNA, 22 nt, Homo sapiens
agaagggccagauuucauucuc

SEQ ID NO: 737585 - RNA, 19 nt, Homo sapiens
agaaggggaagcacucgug

SEQ ID NO: 737586 - RNA, 19 nt, Homo sapiens
agaaggggaggacacuggu

SEQ ID NO: 737587 - RNA, 14 nt, Homo sapiens
agaagguccuuaau

SEQ ID NO: 737588 - RNA, 13 nt, Homo sapiens
agaaggugccacu

SEQ ID NO: 737589 - RNA, 19 nt, Homo sapiens
agaaguacuuuauugcaac

SEQ ID NO: 737590 - RNA, 18 nt, Homo sapiens
agaaguagcuaguagcaa

SEQ ID NO: 737591 - RNA, 23 nt, Homo sapiens
agaaguauuccuguugcugucuu

SEQ ID NO: 737592 - RNA, 14 nt, Homo sapiens
agaagucaacgccu

SEQ ID NO: 737593 - RNA, 22 nt, Homo sapiens
agaagucaugaagcccaaguga

SEQ ID NO: 737594 - RNA, 21 nt, Homo sapiens
agaagucauggcccaaaucca

SEQ ID NO: 737595 - RNA, 13 nt, Homo sapiens
agugaucucaggg

SEQ ID NO: 737596 - RNA, 19 nt, Homo sapiens
agugaucugcccaccucag

SEQ ID NO: 737597 - RNA, 15 nt, Homo sapiens
agugauguguggucu

SEQ ID NO: 737598 - RNA, 15 nt, Homo sapiens
agugauuaucucuuu

SEQ ID NO: 737599 - RNA, 17 nt, Homo sapiens
agugauucccaacuccu

SEQ ID NO: 737600 - RNA, 13 nt, Homo sapiens
agugauucuagag

SEQ ID NO: 737601 - RNA, 16 nt, Homo sapiens
agugauucucuugacg

SEQ ID NO: 737602 - RNA, 23 nt, Homo sapiens
agugauuuucaaaccucaaauau

SEQ ID NO: 737603 - RNA, 19 nt, Homo sapiens
agugcaaaaagcuucugug

SEQ ID NO: 737604 - RNA, 13 nt, Homo sapiens
agugcaacccagu

SEQ ID NO: 737605 - RNA, 20 nt, Homo sapiens
agugcaaccucgcugagggc

SEQ ID NO: 737606 - RNA, 12 nt, Homo sapiens
agugcaccacuu

SEQ ID NO: 737607 - RNA, 21 nt, Homo sapiens
agugcacugcauuccugugcc

SEQ ID NO: 737608 - RNA, 16 nt, Homo sapiens
agugcacuguauauag

SEQ ID NO: 737609 - RNA, 19 nt, Homo sapiens
agugcagaccccuuggcca

SEQ ID NO: 737610 - RNA, 23 nt, Homo sapiens
agugcaguggcgugaucuuggcu

SEQ ID NO: 737611 - RNA, 20 nt, Homo sapiens
agugcaguggugccaucacc

SEQ ID NO: 737612 - RNA, 15 nt, Homo sapiens
agugcaguugugauu

SEQ ID NO: 737613 - RNA, 12 nt, Homo sapiens
agugcauaugca

SEQ ID NO: 737614 - RNA, 14 nt, Homo sapiens
agugcaucucagcc

SEQ ID NO: 737615 - RNA, 16 nt, Homo sapiens
agugcauuauguacac

SEQ ID NO: 737616 - RNA, 17 nt, Homo sapiens
agugccaauauuucuga

SEQ ID NO: 737617 - RNA, 21 nt, Homo sapiens
agugccacuuaauguauguua

SEQ ID NO: 737618 - RNA, 22 nt, Homo sapiens
agugccccagacugagcucucc

SEQ ID NO: 737619 - RNA, 9 nt, Homo sapiens
agugcccua

SEQ ID NO: 737620 - RNA, 19 nt, Homo sapiens
agugccgacagcucuccaa

SEQ ID NO: 737621 - RNA, 20 nt, Homo sapiens
agugccguagggaguaccug

SEQ ID NO: 737622 - RNA, 20 nt, Homo sapiens
agugccuggagucagguguc

SEQ ID NO: 737623 - RNA, 13 nt, Homo sapiens
agugccugggaau

SEQ ID NO: 737624 - RNA, 22 nt, Homo sapiens
agugcucaagguuacugggagu

SEQ ID NO: 737625 - RNA, 23 nt, Homo sapiens
agugcuccuccguguggacugug

SEQ ID NO: 737626 - RNA, 12 nt, Homo sapiens
agugcugagauu

SEQ ID NO: 737627 - RNA, 18 nt, Homo sapiens
agugcugccaguuuccca

SEQ ID NO: 737628 - RNA, 19 nt, Homo sapiens
agugcugccaguuucccaa

SEQ ID NO: 737629 - RNA, 13 nt, Homo sapiens
agugcugcugaag

SEQ ID NO: 737630 - RNA, 22 nt, Homo sapiens
agugcuucuccagccucagccu

SEQ ID NO: 737631 - RNA, 18 nt, Homo sapiens
aguggaaauuaagacuuu

SEQ ID NO: 737632 - RNA, 15 nt, Homo sapiens
aguggaauagugaau

SEQ ID NO: 737633 - RNA, 15 nt, Homo sapiens
aguggagacaguccu

SEQ ID NO: 737634 - RNA, 20 nt, Homo sapiens
aguggagauuuacacuacau

SEQ ID NO: 737635 - RNA, 12 nt, Homo sapiens
aguggagccagg

SEQ ID NO: 737636 - RNA, 17 nt, Homo sapiens
aguggaguaacuauuca

SEQ ID NO: 737637 - RNA, 16 nt, Homo sapiens
aguggaguuggugaau

SEQ ID NO: 737638 - RNA, 14 nt, Homo sapiens
aguggauggaauau

SEQ ID NO: 737639 - RNA, 15 nt, Homo sapiens
aguggauuggcuuug

SEQ ID NO: 737640 - RNA, 21 nt, Homo sapiens
aguggauuggcuuugugcuug

SEQ ID NO: 737641 - RNA, 19 nt, Homo sapiens
aguggcacaggagacucca

SEQ ID NO: 737642 - RNA, 22 nt, Homo sapiens
aguggcacggagagaaggccca

SEQ ID NO: 737643 - RNA, 14 nt, Homo sapiens
aguggcagccaugc

SEQ ID NO: 737644 - RNA, 19 nt, Homo sapiens
aguggcaggugggcugccu

SEQ ID NO: 737645 - RNA, 19 nt, Homo sapiens
aguggcauuaaacauuuga

SEQ ID NO: 737646 - RNA, 19 nt, Homo sapiens
aguggcauuuccuggucag

SEQ ID NO: 737647 - RNA, 14 nt, Homo sapiens
aguggccaucauuu

SEQ ID NO: 737648 - RNA, 14 nt, Homo sapiens
aguggccaugccac

SEQ ID NO: 737649 - RNA, 15 nt, Homo sapiens
aguggcgugaucucg

SEQ ID NO: 737650 - RNA, 20 nt, Homo sapiens
aguggcgugaucucggcuca

SEQ ID NO: 737651 - RNA, 21 nt, Homo sapiens
aguggcgugaucuuggcucac

SEQ ID NO: 737652 - RNA, 13 nt, Homo sapiens
aguggcuagcgca

SEQ ID NO: 737653 - RNA, 14 nt, Homo sapiens
aguggcugccaugg

SEQ ID NO: 737654 - RNA, 13 nt, Homo sapiens
aguggcuggucuc

SEQ ID NO: 737655 - RNA, 15 nt, Homo sapiens
aguggcugugccacc

SEQ ID NO: 737656 - RNA, 19 nt, Homo sapiens
aguggcuucccagcucuga

SEQ ID NO: 737657 - RNA, 15 nt, Homo sapiens
agugggaucccagac

SEQ ID NO: 737658 - RNA, 18 nt, Homo sapiens
agugggccauuaaaaacu

SEQ ID NO: 737659 - RNA, 23 nt, Homo sapiens
agugggguggugucagacccugg

SEQ ID NO: 737660 - RNA, 16 nt, Homo sapiens
agugguaggucagcua

SEQ ID NO: 737661 - RNA, 15 nt, Homo sapiens
agugguauccuguga

SEQ ID NO: 737662 - RNA, 16 nt, Homo sapiens
agugguauccugugac

SEQ ID NO: 737663 - RNA, 17 nt, Homo sapiens
agugguauccugugaca

SEQ ID NO: 737664 - RNA, 12 nt, Homo sapiens
aguggugcaauc

SEQ ID NO: 737665 - RNA, 22 nt, Homo sapiens
agugguucuauguccauucuca

SEQ ID NO: 737666 - RNA, 23 nt, Homo sapiens
agugguucucauuuggucugcca

SEQ ID NO: 737667 - RNA, 17 nt, Homo sapiens
aguguaacagauaucag

SEQ ID NO: 737668 - RNA, 15 nt, Homo sapiens
aguguaaguucacaa

SEQ ID NO: 737669 - RNA, 14 nt, Homo sapiens
aguguacacagacu

SEQ ID NO: 737670 - RNA, 12 nt, Homo sapiens
aguguacaugga

SEQ ID NO: 737671 - RNA, 13 nt, Homo sapiens
aguguacauggaa

SEQ ID NO: 737672 - RNA, 18 nt, Homo sapiens
aguguaugacugcacaug

SEQ ID NO: 737673 - RNA, 13 nt, Homo sapiens
aguguaugauuac

SEQ ID NO: 737674 - RNA, 23 nt, Homo sapiens
aguguauuuauuuuacagcucau

SEQ ID NO: 737675 - RNA, 21 nt, Homo sapiens
aguguauuuuauguguggccc

SEQ ID NO: 737676 - RNA, 18 nt, Homo sapiens
agugucauugagcaguau

SEQ ID NO: 737677 - RNA, 20 nt, Homo sapiens
aguguccccuuauacagugg

SEQ ID NO: 737678 - RNA, 17 nt, Homo sapiens
aguguccuaagugcuaa

SEQ ID NO: 737679 - RNA, 14 nt, Homo sapiens
aguguccucuugcu

SEQ ID NO: 737680 - RNA, 18 nt, Homo sapiens
aguguccucuugcucaaa

SEQ ID NO: 737681 - RNA, 18 nt, Homo sapiens
agugucuccccguguccu

SEQ ID NO: 737682 - RNA, 12 nt, Homo sapiens
agugugauccca

SEQ ID NO: 737683 - RNA, 18 nt, Homo sapiens
aguguggacuuggcaggu

SEQ ID NO: 737684 - RNA, 22 nt, Homo sapiens
aguguggcccagggaagccaaa

SEQ ID NO: 737685 - RNA, 21 nt, Homo sapiens
agugugugauuagaagcuaaa

SEQ ID NO: 737686 - RNA, 13 nt, Homo sapiens
agugugugucuuu

SEQ ID NO: 737687 - RNA, 18 nt, Homo sapiens
agugugugugugcaugug

SEQ ID NO: 737688 - RNA, 14 nt, Homo sapiens
aguguuaccuguua

SEQ ID NO: 737689 - RNA, 22 nt, Homo sapiens
aguguuaucagucauaacuaaa

SEQ ID NO: 737690 - RNA, 19 nt, Homo sapiens
aguguucaaauaccaguga

SEQ ID NO: 737691 - RNA, 21 nt, Homo sapiens
aguguucauuuuagugacugu

SEQ ID NO: 737692 - RNA, 18 nt, Homo sapiens
aguguucuucaguguaau

SEQ ID NO: 737693 - RNA, 21 nt, Homo sapiens
aguguuuuggacuccaucucu

SEQ ID NO: 737694 - RNA, 16 nt, Homo sapiens
aguguuuuugugaauu

SEQ ID NO: 737695 - RNA, 20 nt, Homo sapiens
aguuaaaauguuuacuguaa

SEQ ID NO: 737696 - RNA, 21 nt, Homo sapiens
aguuaaauagaguauaugcac

SEQ ID NO: 737697 - RNA, 16 nt, Homo sapiens
aguuaaauaugcaucu

SEQ ID NO: 737698 - RNA, 20 nt, Homo sapiens
aguuaagaaugucgauuaaa

SEQ ID NO: 737699 - RNA, 19 nt, Homo sapiens
aguuaauccacaucuuuac

SEQ ID NO: 737700 - RNA, 12 nt, Homo sapiens
auaacagaauua

SEQ ID NO: 737701 - RNA, 11 nt, Homo sapiens
auaacaguguu

SEQ ID NO: 737702 - RNA, 15 nt, Homo sapiens
auaacaucaccacug

SEQ ID NO: 737703 - RNA, 21 nt, Homo sapiens
auaacaugucuuucagcauua

SEQ ID NO: 737704 - RNA, 23 nt, Homo sapiens
auaaccucggcuguuuacagugu

SEQ ID NO: 737705 - RNA, 17 nt, Homo sapiens
auaacuccugucccuuu

SEQ ID NO: 737706 - RNA, 18 nt, Homo sapiens
auaacucugcacuacucc

SEQ ID NO: 737707 - RNA, 14 nt, Homo sapiens
aguuucuuuucaca

SEQ ID NO: 737708 - RNA, 17 nt, Homo sapiens
aguuugaaaauaguuac

SEQ ID NO: 737709 - RNA, 22 nt, Homo sapiens
aguuugaggcugcaaugagcca

SEQ ID NO: 737710 - RNA, 19 nt, Homo sapiens
aguuugcaaauaggcagaa

SEQ ID NO: 737711 - RNA, 11 nt, Homo sapiens
aguuugcaguu

SEQ ID NO: 737712 - RNA, 22 nt, Homo sapiens
aguuugccggauacaaacuggu

SEQ ID NO: 737713 - RNA, 13 nt, Homo sapiens
aguuugcuugaua

SEQ ID NO: 737714 - RNA, 15 nt, Homo sapiens
aguuuguagccaggu

SEQ ID NO: 737715 - RNA, 23 nt, Homo sapiens
aguuuguguguauuuguauuaau

SEQ ID NO: 737716 - RNA, 14 nt, Homo sapiens
aguuuuaacuguaa

SEQ ID NO: 737717 - RNA, 17 nt, Homo sapiens
aguuuuagaaaugagaa

SEQ ID NO: 737718 - RNA, 19 nt, Homo sapiens
aguuuuaggguacaugugc

SEQ ID NO: 737719 - RNA, 19 nt, Homo sapiens
aguuuuaguuuucucuuag

SEQ ID NO: 737720 - RNA, 14 nt, Homo sapiens
aguuuuaucuucag

SEQ ID NO: 737721 - RNA, 19 nt, Homo sapiens
aguuuucugaccagcuuuu

SEQ ID NO: 737722 - RNA, 20 nt, Homo sapiens
aguuuucuggagugagcacu

SEQ ID NO: 737723 - RNA, 21 nt, Homo sapiens
aguuuugccaguucaagaauu

SEQ ID NO: 737724 - RNA, 13 nt, Homo sapiens
aguuuuuauacau

SEQ ID NO: 737725 - RNA, 21 nt, Homo sapiens
aguuuuucccucagugaaggc

SEQ ID NO: 737726 - RNA, 21 nt, Homo sapiens
aguuuuuccuggaauugccag

SEQ ID NO: 737727 - RNA, 17 nt, Homo sapiens
aguuuuugauagcuuua

SEQ ID NO: 737728 - RNA, 14 nt, Homo sapiens
auaaaaaacacuaa

SEQ ID NO: 737729 - RNA, 17 nt, Homo sapiens
auaaaaaacacuaaaca

SEQ ID NO: 737730 - RNA, 20 nt, Homo sapiens
auaaaaaauuaugacaaugu

SEQ ID NO: 737731 - RNA, 12 nt, Homo sapiens
auaaaaacccaa

SEQ ID NO: 737732 - RNA, 13 nt, Homo sapiens
auaaaaaggaaua

SEQ ID NO: 737733 - RNA, 23 nt, Homo sapiens
auaaaaaguuucacaggucaaua

SEQ ID NO: 737734 - RNA, 19 nt, Homo sapiens
auaaaaauacaugcaaaua

SEQ ID NO: 737735 - RNA, 21 nt, Homo sapiens
auaaaaauauuguguugugaa

SEQ ID NO: 737736 - RNA, 22 nt, Homo sapiens
auaaaaaucauggcaacauaau

SEQ ID NO: 737737 - RNA, 15 nt, Homo sapiens
auaaaaaugagugcu

SEQ ID NO: 737738 - RNA, 18 nt, Homo sapiens
auaaaaauugacaaugau

SEQ ID NO: 737739 - RNA, 16 nt, Homo sapiens
auaaaacacuaacuua

SEQ ID NO: 737740 - RNA, 14 nt, Homo sapiens
auaaaacagucaug

SEQ ID NO: 737741 - RNA, 16 nt, Homo sapiens
auaaaagagaagccaa

SEQ ID NO: 737742 - RNA, 18 nt, Homo sapiens
auaaaagauuuacauucc

SEQ ID NO: 737743 - RNA, 14 nt, Homo sapiens
auaaaagcuagaua

SEQ ID NO: 737744 - RNA, 18 nt, Homo sapiens
auaaaaguguucauuguu

SEQ ID NO: 737745 - RNA, 17 nt, Homo sapiens
auaaaauauucacucuc

SEQ ID NO: 737746 - RNA, 15 nt, Homo sapiens
auaaaaucagaguug

SEQ ID NO: 737747 - RNA, 15 nt, Homo sapiens
auaaaauccagcuca

SEQ ID NO: 737748 - RNA, 17 nt, Homo sapiens
auaaaauccugugcaau

SEQ ID NO: 737749 - RNA, 13 nt, Homo sapiens
auaaaaugaacau

SEQ ID NO: 737750 - RNA, 17 nt, Homo sapiens
auaaaaugaacaucucu

SEQ ID NO: 737751 - RNA, 13 nt, Homo sapiens
auaaaaugcauuu

SEQ ID NO: 737752 - RNA, 20 nt, Homo sapiens
auaaaaugcauuuaaacuca

SEQ ID NO: 737753 - RNA, 13 nt, Homo sapiens
auaaaaugugauu

SEQ ID NO: 737754 - RNA, 14 nt, Homo sapiens
auaaaauguuucau

SEQ ID NO: 737755 - RNA, 11 nt, Homo sapiens
auaaaauuccu

SEQ ID NO: 737756 - RNA, 16 nt, Homo sapiens
auaaaauuccuaucuc

SEQ ID NO: 737757 - RNA, 20 nt, Homo sapiens
auaaaauuugauaaacauuc

SEQ ID NO: 737758 - RNA, 23 nt, Homo sapiens
auaaacaacgcauugccacggaa

SEQ ID NO: 737759 - RNA, 18 nt, Homo sapiens
auaaacaugcuugcauua

SEQ ID NO: 737760 - RNA, 19 nt, Homo sapiens
auaaacauuaaacacugua

SEQ ID NO: 737761 - RNA, 23 nt, Homo sapiens
auaaacauuaauuuugugcauuc

SEQ ID NO: 737762 - RNA, 12 nt, Homo sapiens
auaaaccacuuu

SEQ ID NO: 737763 - RNA, 17 nt, Homo sapiens
auaaaccagauuccaga

SEQ ID NO: 737764 - RNA, 19 nt, Homo sapiens
auaaacuaguuuccagugg

SEQ ID NO: 737765 - RNA, 21 nt, Homo sapiens
auaaacuaguuuccaguggau

SEQ ID NO: 737766 - RNA, 16 nt, Homo sapiens
auaaacucagaaauuu

SEQ ID NO: 737767 - RNA, 18 nt, Homo sapiens
auaaacugacuaaacuua

SEQ ID NO: 737768 - RNA, 12 nt, Homo sapiens
auaaacugccaa

SEQ ID NO: 737769 - RNA, 11 nt, Homo sapiens
auaaagacagg

SEQ ID NO: 737770 - RNA, 16 nt, Homo sapiens
auaaagauauuuccaa

SEQ ID NO: 737771 - RNA, 14 nt, Homo sapiens
auaaagaugaucua

SEQ ID NO: 737772 - RNA, 13 nt, Homo sapiens
auaaagauguuau

SEQ ID NO: 737773 - RNA, 13 nt, Homo sapiens
auaaagauuuaua

SEQ ID NO: 737774 - RNA, 23 nt, Homo sapiens
auaaagcacagauuugcauuuca

SEQ ID NO: 737775 - RNA, 11 nt, Homo sapiens
auaaagcauuc

SEQ ID NO: 737776 - RNA, 14 nt, Homo sapiens
auaaaggucccaug

SEQ ID NO: 737777 - RNA, 13 nt, Homo sapiens
auaaaguaccaca

SEQ ID NO: 737778 - RNA, 16 nt, Homo sapiens
auaaaguaccacacau

SEQ ID NO: 737779 - RNA, 21 nt, Homo sapiens
auaaaguaccacacauauugc

SEQ ID NO: 737780 - RNA, 17 nt, Homo sapiens
auaaaguaccauuaguu

SEQ ID NO: 737781 - RNA, 21 nt, Homo sapiens
auaaaguauccaugcaugugc

SEQ ID NO: 737782 - RNA, 14 nt, Homo sapiens
auaaagucacuucc

SEQ ID NO: 737783 - RNA, 14 nt, Homo sapiens
auaaaguccugaca

SEQ ID NO: 737784 - RNA, 19 nt, Homo sapiens
auaaagugacccuguucuc

SEQ ID NO: 737785 - RNA, 12 nt, Homo sapiens
auaaagugcagu

SEQ ID NO: 737786 - RNA, 19 nt, Homo sapiens
auaaauaaacuguugcucg

SEQ ID NO: 737787 - RNA, 23 nt, Homo sapiens
auaaauacaugcacacacuugca

SEQ ID NO: 737788 - RNA, 20 nt, Homo sapiens
auaaauacugucaaacaaua

SEQ ID NO: 737789 - RNA, 22 nt, Homo sapiens
auaaauaguguacacagacuga

SEQ ID NO: 737790 - RNA, 17 nt, Homo sapiens
auaaauauagagaugug

SEQ ID NO: 737791 - RNA, 16 nt, Homo sapiens
auaaauauuacaguga

SEQ ID NO: 737792 - RNA, 13 nt, Homo sapiens
auaaauauuucuc

SEQ ID NO: 737793 - RNA, 18 nt, Homo sapiens
auaaauauuuuugccaua

SEQ ID NO: 737794 - RNA, 13 nt, Homo sapiens
auaaaucauaaaa

SEQ ID NO: 737795 - RNA, 17 nt, Homo sapiens
auaaaucauuaagacaa

SEQ ID NO: 737796 - RNA, 13 nt, Homo sapiens
auaaauccaguga

SEQ ID NO: 737797 - RNA, 14 nt, Homo sapiens
auaaauccagugac

SEQ ID NO: 737798 - RNA, 17 nt, Homo sapiens
auaaauccaucacuaua

SEQ ID NO: 737799 - RNA, 18 nt, Homo sapiens
auaaauccuuaacauuuc

SEQ ID NO: 737800 - RNA, 17 nt, Homo sapiens
auaaaucucuccuauaa

SEQ ID NO: 737801 - RNA, 14 nt, Homo sapiens
auaaaugacaaugu

SEQ ID NO: 737802 - RNA, 17 nt, Homo sapiens
auaaauguacauuaauu

SEQ ID NO: 737803 - RNA, 18 nt, Homo sapiens
auaaauuccuacaacuua

SEQ ID NO: 737804 - RNA, 22 nt, Homo sapiens
auaaauuuaaacuuacaaacuu

SEQ ID NO: 737805 - RNA, 14 nt, Homo sapiens
auaaauuugguucu

SEQ ID NO: 737806 - RNA, 19 nt, Homo sapiens
auaaauuuguaacuuugca

SEQ ID NO: 737807 - RNA, 23 nt, Homo sapiens
auaaauuuuauaacagaauuaaa

SEQ ID NO: 737808 - RNA, 22 nt, Homo sapiens
auaacaaagaaccuaacauuua

SEQ ID NO: 737809 - RNA, 14 nt, Homo sapiens
auaacaacuuugaa

SEQ ID NO: 737810 - RNA, 16 nt, Homo sapiens
auaacaagaguuuuaa

SEQ ID NO: 737811 - RNA, 20 nt, Homo sapiens
auaacaagaucuuucaggaa

SEQ ID NO: 737812 - RNA, 19 nt, Homo sapiens
auaacaagccaaacauucu

SEQ ID NO: 737813 - RNA, 17 nt, Homo sapiens
auaacaccagugggaau

SEQ ID NO: 737814 - RNA, 12 nt, Homo sapiens
auaacacugucu

SEQ ID NO: 737815 - RNA, 12 nt, Homo sapiens
aguuacuugaau

SEQ ID NO: 737816 - RNA, 17 nt, Homo sapiens
aguuagaggagaaaaag

SEQ ID NO: 737817 - RNA, 20 nt, Homo sapiens
aguuaggcuauucacaacca

SEQ ID NO: 737818 - RNA, 13 nt, Homo sapiens
aguuagucaaucc

SEQ ID NO: 737819 - RNA, 22 nt, Homo sapiens
aguuagucaauccugucauaua

SEQ ID NO: 737820 - RNA, 13 nt, Homo sapiens
aguuagugccaua

SEQ ID NO: 737821 - RNA, 22 nt, Homo sapiens
aguuauagaagagaaaugcugc

SEQ ID NO: 737822 - RNA, 21 nt, Homo sapiens
aguuauaggaacaauucucuu

SEQ ID NO: 737823 - RNA, 20 nt, Homo sapiens
aguuaugccucugacagucc

SEQ ID NO: 737824 - RNA, 20 nt, Homo sapiens
aguuauggcuucacauucau

SEQ ID NO: 737825 - RNA, 20 nt, Homo sapiens
aguuauuacauguaauuuga

SEQ ID NO: 737826 - RNA, 19 nt, Homo sapiens
aguuauucucuucacuccc

SEQ ID NO: 737827 - RNA, 22 nt, Homo sapiens
aguuauucuugcaaagauuucu

SEQ ID NO: 737828 - RNA, 22 nt, Homo sapiens
aguucaaauucuucugaacuca

SEQ ID NO: 737829 - RNA, 13 nt, Homo sapiens
aguucaacuguau

SEQ ID NO: 737830 - RNA, 13 nt, Homo sapiens
aguucacugcaac

SEQ ID NO: 737831 - RNA, 12 nt, Homo sapiens
aguucacuucag

SEQ ID NO: 737832 - RNA, 23 nt, Homo sapiens
aguucagaguuguacacugugua

SEQ ID NO: 737833 - RNA, 13 nt, Homo sapiens
aguucagugcuca

SEQ ID NO: 737834 - RNA, 17 nt, Homo sapiens
aguucagugcucauacg

SEQ ID NO: 737835 - RNA, 11 nt, Homo sapiens
aguucauacau

SEQ ID NO: 737836 - RNA, 18 nt, Homo sapiens
aguucauagggucucuuc

SEQ ID NO: 737837 - RNA, 20 nt, Homo sapiens
aguucauauuucauuuccaa

SEQ ID NO: 737838 - RNA, 13 nt, Homo sapiens
aguucaucuugca

SEQ ID NO: 737839 - RNA, 18 nt, Homo sapiens
aguucauggugaucagug

SEQ ID NO: 737840 - RNA, 21 nt, Homo sapiens
aguucaugucugaaacagaga

SEQ ID NO: 737841 - RNA, 15 nt, Homo sapiens
aguuccaagagucua

SEQ ID NO: 737842 - RNA, 23 nt, Homo sapiens
aguuccaguugaaguuaguggaa

SEQ ID NO: 737843 - RNA, 19 nt, Homo sapiens
aguucccccaguaccucca

SEQ ID NO: 737844 - RNA, 19 nt, Homo sapiens
aguucccuaaacuuuagaa

SEQ ID NO: 737845 - RNA, 14 nt, Homo sapiens
aguucccucuugcu

SEQ ID NO: 737846 - RNA, 13 nt, Homo sapiens
aguucccuuggcc

SEQ ID NO: 737847 - RNA, 17 nt, Homo sapiens
aguucccuuggccucag

SEQ ID NO: 737848 - RNA, 15 nt, Homo sapiens
aguuccgucuucccu

SEQ ID NO: 737849 - RNA, 20 nt, Homo sapiens
aguuccuaugacacaguuau

SEQ ID NO: 737850 - RNA, 12 nt, Homo sapiens
aguuccugauga

SEQ ID NO: 737851 - RNA, 21 nt, Homo sapiens
aguuccugcuccguggacugc

SEQ ID NO: 737852 - RNA, 20 nt, Homo sapiens
aguuccuguagaacugagaa

SEQ ID NO: 737853 - RNA, 18 nt, Homo sapiens
aguuccuugaucuguaua

SEQ ID NO: 737854 - RNA, 15 nt, Homo sapiens
aguuccuugccuuaa

SEQ ID NO: 737855 - RNA, 16 nt, Homo sapiens
aguuccuugccuuaau

SEQ ID NO: 737856 - RNA, 21 nt, Homo sapiens
aguucgaccaaacucaguuca

SEQ ID NO: 737857 - RNA, 16 nt, Homo sapiens
aguucuaaacuaucaa

SEQ ID NO: 737858 - RNA, 18 nt, Homo sapiens
aguucuaaacuaucaaua

SEQ ID NO: 737859 - RNA, 19 nt, Homo sapiens
aguucuaaccuccuaagca

SEQ ID NO: 737860 - RNA, 16 nt, Homo sapiens
aguucuaagauucuaa

SEQ ID NO: 737861 - RNA, 13 nt, Homo sapiens
aguucuaggcacu

SEQ ID NO: 737862 - RNA, 22 nt, Homo sapiens
aguucuaggcacuguaguucua

SEQ ID NO: 737863 - RNA, 15 nt, Homo sapiens
aguucuaguuugcau

SEQ ID NO: 737864 - RNA, 17 nt, Homo sapiens
aguucuccuaucuugau

SEQ ID NO: 737865 - RNA, 15 nt, Homo sapiens
aguucugaacuggaa

SEQ ID NO: 737866 - RNA, 19 nt, Homo sapiens
aguucugagcaccguguca

SEQ ID NO: 737867 - RNA, 23 nt, Homo sapiens
aguucugcaaaaaugaccuauaa

SEQ ID NO: 737868 - RNA, 22 nt, Homo sapiens
aguucuggaagggacuuuagag

SEQ ID NO: 737869 - RNA, 14 nt, Homo sapiens
aguucuggaccugg

SEQ ID NO: 737870 - RNA, 20 nt, Homo sapiens
aguucuggucagaugauaua

SEQ ID NO: 737871 - RNA, 20 nt, Homo sapiens
aguucuggugaauguucaau

SEQ ID NO: 737872 - RNA, 18 nt, Homo sapiens
aguucugguucaugcaga

SEQ ID NO: 737873 - RNA, 21 nt, Homo sapiens
aguucugguugauucacucaa

SEQ ID NO: 737874 - RNA, 21 nt, Homo sapiens
aguucuguauauagggcacaa

SEQ ID NO: 737875 - RNA, 17 nt, Homo sapiens
aguucuuggucccucca

SEQ ID NO: 737876 - RNA, 15 nt, Homo sapiens
aguucuugugccaua

SEQ ID NO: 737877 - RNA, 17 nt, Homo sapiens
aguugaagggaggugaa

SEQ ID NO: 737878 - RNA, 14 nt, Homo sapiens
aguugaggccagga

SEQ ID NO: 737879 - RNA, 21 nt, Homo sapiens
aguugauuccucaaguuauga

SEQ ID NO: 737880 - RNA, 14 nt, Homo sapiens
aguugauuuuacaa

SEQ ID NO: 737881 - RNA, 23 nt, Homo sapiens
aguugcugugaacuuucauguca

SEQ ID NO: 737882 - RNA, 13 nt, Homo sapiens
aguugcugugaau

SEQ ID NO: 737883 - RNA, 18 nt, Homo sapiens
aguugcugugaauacuua

SEQ ID NO: 737884 - RNA, 22 nt, Homo sapiens
aguugcuuuaaaguaccuguag

SEQ ID NO: 737885 - RNA, 13 nt, Homo sapiens
aguugcuuuucag

SEQ ID NO: 737886 - RNA, 20 nt, Homo sapiens
aguuggaaccguguccagca

SEQ ID NO: 737887 - RNA, 17 nt, Homo sapiens
aguuggacucucaggga

SEQ ID NO: 737888 - RNA, 22 nt, Homo sapiens
aguuggcaggagcuccuggaag

SEQ ID NO: 737889 - RNA, 15 nt, Homo sapiens
aguuggcaugacucu

SEQ ID NO: 737890 - RNA, 20 nt, Homo sapiens
aguuggccagcgucuugcuc

SEQ ID NO: 737891 - RNA, 18 nt, Homo sapiens
aguuggccaugaugucuu

SEQ ID NO: 737892 - RNA, 23 nt, Homo sapiens
aguugggacccaaaacacaggaa

SEQ ID NO: 737893 - RNA, 11 nt, Homo sapiens
aguugggaugc

SEQ ID NO: 737894 - RNA, 21 nt, Homo sapiens
aguuggugacugggaaaguua

SEQ ID NO: 737895 - RNA, 15 nt, Homo sapiens
aguuggugagcagag

SEQ ID NO: 737896 - RNA, 19 nt, Homo sapiens
aguugguuuagcuuuggaa

SEQ ID NO: 737897 - RNA, 14 nt, Homo sapiens
aguuguacacugug

SEQ ID NO: 737898 - RNA, 22 nt, Homo sapiens
aguuguauucagcguacuugaa

SEQ ID NO: 737899 - RNA, 21 nt, Homo sapiens
aguuguccuauggacaacuua

SEQ ID NO: 737900 - RNA, 22 nt, Homo sapiens
aguugugucuaggcuggaagag

SEQ ID NO: 737901 - RNA, 18 nt, Homo sapiens
aguuguucuagcagugaa

SEQ ID NO: 737902 - RNA, 16 nt, Homo sapiens
aguuguugacugugau

SEQ ID NO: 737903 - RNA, 18 nt, Homo sapiens
aguuguuuggaugauuaa

SEQ ID NO: 737904 - RNA, 19 nt, Homo sapiens
aguuguuuuauauguugcu

SEQ ID NO: 737905 - RNA, 15 nt, Homo sapiens
aguuuaaagacacuu

SEQ ID NO: 737906 - RNA, 18 nt, Homo sapiens
aguuuaaguaauugccua

SEQ ID NO: 737907 - RNA, 23 nt, Homo sapiens
aguuuaauuuuugaaaacuggcu

SEQ ID NO: 737908 - RNA, 12 nt, Homo sapiens
aguuuaccucuu

SEQ ID NO: 737909 - RNA, 17 nt, Homo sapiens
aguuuaguucuguugac

SEQ ID NO: 737910 - RNA, 21 nt, Homo sapiens
aguuuauacaguguacaugua

SEQ ID NO: 737911 - RNA, 17 nt, Homo sapiens
aguuuauauacaauuau

SEQ ID NO: 737912 - RNA, 14 nt, Homo sapiens
aguuuaucauguca

SEQ ID NO: 737913 - RNA, 14 nt, Homo sapiens
aguuuaugauggaa

SEQ ID NO: 737914 - RNA, 17 nt, Homo sapiens
aguuucacuguacugca

SEQ ID NO: 737915 - RNA, 21 nt, Homo sapiens
aguuucagagaaauacuuuca

SEQ ID NO: 737916 - RNA, 22 nt, Homo sapiens
aguuucagagaaauacuuucag

SEQ ID NO: 737917 - RNA, 21 nt, Homo sapiens
aguuucagagaccauugcaau

SEQ ID NO: 737918 - RNA, 13 nt, Homo sapiens
aguuucaguuugu

SEQ ID NO: 737919 - RNA, 17 nt, Homo sapiens
aguuuccaaaaccagaa

SEQ ID NO: 737920 - RNA, 15 nt, Homo sapiens
aguuuccauauguua

SEQ ID NO: 737921 - RNA, 16 nt, Homo sapiens
cauuagucacuuugaa

SEQ ID NO: 737922 - RNA, 17 nt, Homo sapiens
cauuauaaacgugauga

SEQ ID NO: 737923 - RNA, 18 nt, Homo sapiens
cauuauaacugaaggaga

SEQ ID NO: 737924 - RNA, 18 nt, Homo sapiens
cauuaucgggagcagugu

SEQ ID NO: 737925 - RNA, 17 nt, Homo sapiens
cauuauuggaugucaau

SEQ ID NO: 737926 - RNA, 22 nt, Homo sapiens
cauuauuuuuguuagcaaagau

SEQ ID NO: 737927 - RNA, 14 nt, Homo sapiens
cauucaacugaaaa

SEQ ID NO: 737928 - RNA, 21 nt, Homo sapiens
cauucaauauugacauuugua

SEQ ID NO: 737929 - RNA, 12 nt, Homo sapiens
cauucacaccag

SEQ ID NO: 737930 - RNA, 19 nt, Homo sapiens
cauucacccagacagcucc

SEQ ID NO: 737931 - RNA, 17 nt, Homo sapiens
cauucacuacaggugaa

SEQ ID NO: 737932 - RNA, 18 nt, Homo sapiens
cauucagagcuauggugc

SEQ ID NO: 737933 - RNA, 21 nt, Homo sapiens
cauucauuugcauccaugggc

SEQ ID NO: 737934 - RNA, 15 nt, Homo sapiens
cauuccaaauaugag

SEQ ID NO: 737935 - RNA, 17 nt, Homo sapiens
cauuccaacuucaauuu

SEQ ID NO: 737936 - RNA, 13 nt, Homo sapiens
cauuccauuugaa

SEQ ID NO: 737937 - RNA, 21 nt, Homo sapiens
cauucccugagucaccaggaa

SEQ ID NO: 737938 - RNA, 17 nt, Homo sapiens
cauuccucaugaaugua

SEQ ID NO: 737939 - RNA, 18 nt, Homo sapiens
cauuccucaugaauguaa

SEQ ID NO: 737940 - RNA, 19 nt, Homo sapiens
cauuccucaugaauguaaa

SEQ ID NO: 737941 - RNA, 23 nt, Homo sapiens
cauucucagugagggcucuggau

SEQ ID NO: 737942 - RNA, 13 nt, Homo sapiens
cauucucucucau

SEQ ID NO: 737943 - RNA, 13 nt, Homo sapiens
cauucucugaguc

SEQ ID NO: 737944 - RNA, 16 nt, Homo sapiens
cauucugcaaguauac

SEQ ID NO: 737945 - RNA, 18 nt, Homo sapiens
cauucugcauugcuagau

SEQ ID NO: 737946 - RNA, 23 nt, Homo sapiens
cauucugccgcccccuccugaac

SEQ ID NO: 737947 - RNA, 17 nt, Homo sapiens
cauucuggaaaagcaaa

SEQ ID NO: 737948 - RNA, 22 nt, Homo sapiens
cauucugguuuugacaucagca

SEQ ID NO: 737949 - RNA, 16 nt, Homo sapiens
cauucuuaacaaacuc

SEQ ID NO: 737950 - RNA, 17 nt, Homo sapiens
cauugaaacuacacuaa

SEQ ID NO: 737951 - RNA, 10 nt, Homo sapiens
cauugaacaa

SEQ ID NO: 737952 - RNA, 19 nt, Homo sapiens
cauugaagccgacucuggc

SEQ ID NO: 737953 - RNA, 18 nt, Homo sapiens
cauugaaguaaugaauuu

SEQ ID NO: 737954 - RNA, 15 nt, Homo sapiens
cauugagaaacugaa

SEQ ID NO: 737955 - RNA, 19 nt, Homo sapiens
cauugagccaguggugcua

SEQ ID NO: 737956 - RNA, 23 nt, Homo sapiens
cauugagcgugaccuugcaaugu

SEQ ID NO: 737957 - RNA, 14 nt, Homo sapiens
cauugagucccugc

SEQ ID NO: 737958 - RNA, 19 nt, Homo sapiens
cauugaucaaauauuucaa

SEQ ID NO: 737959 - RNA, 18 nt, Homo sapiens
cauugaucuuuugcuaau

SEQ ID NO: 737960 - RNA, 20 nt, Homo sapiens
cauugaugacccucugaccc

SEQ ID NO: 737961 - RNA, 23 nt, Homo sapiens
cauugaugagcaagacauacuua

SEQ ID NO: 737962 - RNA, 20 nt, Homo sapiens
cauugauguaaggacuguaa

SEQ ID NO: 737963 - RNA, 20 nt, Homo sapiens
cauugauucguaugccagcu

SEQ ID NO: 737964 - RNA, 21 nt, Homo sapiens
cauugccacggaaacauacag

SEQ ID NO: 737965 - RNA, 15 nt, Homo sapiens
cauugccuucucugc

SEQ ID NO: 737966 - RNA, 18 nt, Homo sapiens
cauugcgaccauuucuca

SEQ ID NO: 737967 - RNA, 15 nt, Homo sapiens
cauugcuaaccacug

SEQ ID NO: 737968 - RNA, 17 nt, Homo sapiens
cauugcuauuuaucuca

SEQ ID NO: 737969 - RNA, 13 nt, Homo sapiens
cauugcuuaccuu

SEQ ID NO: 737970 - RNA, 15 nt, Homo sapiens
cauugcuuuccacug

SEQ ID NO: 737971 - RNA, 15 nt, Homo sapiens
cauugcuuucgugua

SEQ ID NO: 737972 - RNA, 15 nt, Homo sapiens
cauuggacuuccucc

SEQ ID NO: 737973 - RNA, 22 nt, Homo sapiens
cauuggauucaucagcauuugg

SEQ ID NO: 737974 - RNA, 12 nt, Homo sapiens
cauuggcacaau

SEQ ID NO: 737975 - RNA, 13 nt, Homo sapiens
cauuggcacaaug

SEQ ID NO: 737976 - RNA, 16 nt, Homo sapiens
cauuguaaaucacuug

SEQ ID NO: 737977 - RNA, 17 nt, Homo sapiens
cauuguagaaacacagu

SEQ ID NO: 737978 - RNA, 12 nt, Homo sapiens
cauuguauccuc

SEQ ID NO: 737979 - RNA, 13 nt, Homo sapiens
cauuguaugugcu

SEQ ID NO: 737980 - RNA, 18 nt, Homo sapiens
cauuguauucagcucuua

SEQ ID NO: 737981 - RNA, 14 nt, Homo sapiens
cauuguugucaagg

SEQ ID NO: 737982 - RNA, 19 nt, Homo sapiens
cauuguuucguaacacagc

SEQ ID NO: 737983 - RNA, 20 nt, Homo sapiens
cauuuaaaaggacugcugau

SEQ ID NO: 737984 - RNA, 13 nt, Homo sapiens
cauuuaaccccuu

SEQ ID NO: 737985 - RNA, 23 nt, Homo sapiens
cauuuaaccccuugguacugaaa

SEQ ID NO: 737986 - RNA, 17 nt, Homo sapiens
cauuuaauaaagaugag

SEQ ID NO: 737987 - RNA, 21 nt, Homo sapiens
cauuuaauacagauaaguguu

SEQ ID NO: 737988 - RNA, 12 nt, Homo sapiens
cauuuacagugu

SEQ ID NO: 737989 - RNA, 14 nt, Homo sapiens
cauuuaccaguaua

SEQ ID NO: 737990 - RNA, 23 nt, Homo sapiens
cauuuacuuaacagaacagucac

SEQ ID NO: 737991 - RNA, 13 nt, Homo sapiens
cauuuagaacuug

SEQ ID NO: 737992 - RNA, 22 nt, Homo sapiens
cauuuagaggacauucuggaaa

SEQ ID NO: 737993 - RNA, 19 nt, Homo sapiens
cauuuagaugcacuaccau

SEQ ID NO: 737994 - RNA, 14 nt, Homo sapiens
cauuuauggcauga

SEQ ID NO: 737995 - RNA, 15 nt, Homo sapiens
cauuuauguguagaa

SEQ ID NO: 737996 - RNA, 21 nt, Homo sapiens
cauuuauuaagcacguauuua

SEQ ID NO: 737997 - RNA, 20 nt, Homo sapiens
cauuuauucaaaguuaaaag

SEQ ID NO: 737998 - RNA, 20 nt, Homo sapiens
cauuuauuuugagaagcucu

SEQ ID NO: 737999 - RNA, 15 nt, Homo sapiens
cauuucaaaguuugg

SEQ ID NO: 738000 - RNA, 12 nt, Homo sapiens
cauuucaagaca

SEQ ID NO: 738001 - RNA, 16 nt, Homo sapiens
cauuucacuacuggug

SEQ ID NO: 738002 - RNA, 22 nt, Homo sapiens
cauuucauuaagguuccaguua

SEQ ID NO: 738003 - RNA, 20 nt, Homo sapiens
cauuucauugucuuagucaa

SEQ ID NO: 738004 - RNA, 12 nt, Homo sapiens
cauuuccaaaag

SEQ ID NO: 738005 - RNA, 15 nt, Homo sapiens
cauccauauuguuga

SEQ ID NO: 738006 - RNA, 24 nt, Homo sapiens
cauccaucuuuccauccauuaccu

SEQ ID NO: 738007 - RNA, 13 nt, Homo sapiens
cauccaugugcua

SEQ ID NO: 738008 - RNA, 18 nt, Homo sapiens
cauccaugugcuagucac

SEQ ID NO: 738009 - RNA, 13 nt, Homo sapiens
caucccacagugg

SEQ ID NO: 738010 - RNA, 16 nt, Homo sapiens
cauccccaacuccaug

SEQ ID NO: 738011 - RNA, 19 nt, Homo sapiens
caucccccaaaguucacaa

SEQ ID NO: 738012 - RNA, 18 nt, Homo sapiens
caucccguaucacagugu

SEQ ID NO: 738013 - RNA, 21 nt, Homo sapiens
caucccucaacugagggccag

SEQ ID NO: 738014 - RNA, 19 nt, Homo sapiens
caucccuuuuucugcuaau

SEQ ID NO: 738015 - RNA, 14 nt, Homo sapiens
cauccgcuacuaca

SEQ ID NO: 738016 - RNA, 14 nt, Homo sapiens
cauccgcuccguga

SEQ ID NO: 738017 - RNA, 15 nt, Homo sapiens
cauccgcuccgugac

SEQ ID NO: 738018 - RNA, 14 nt, Homo sapiens
cauccuaagacaga

SEQ ID NO: 738019 - RNA, 20 nt, Homo sapiens
cauccuaccccuuugcacuu

SEQ ID NO: 738020 - RNA, 18 nt, Homo sapiens
cauccuccagauagugua

SEQ ID NO: 738021 - RNA, 16 nt, Homo sapiens
cauccuccauugcucc

SEQ ID NO: 738022 - RNA, 22 nt, Homo sapiens
cauccugagcagugccagcuuu

SEQ ID NO: 738023 - RNA, 23 nt, Homo sapiens
cauccugauuauugaauguuaua

SEQ ID NO: 738024 - RNA, 12 nt, Homo sapiens
cauccuggcacg

SEQ ID NO: 738025 - RNA, 17 nt, Homo sapiens
cauccuggccuggcaca

SEQ ID NO: 738026 - RNA, 21 nt, Homo sapiens
cauccuggcuaacacggugaa

SEQ ID NO: 738027 - RNA, 21 nt, Homo sapiens
cauccuguguuaucugugguu

SEQ ID NO: 738028 - RNA, 14 nt, Homo sapiens
cauccuguuugaaa

SEQ ID NO: 738029 - RNA, 24 nt, Homo sapiens
cauccuuaaaacaauucugugaca

SEQ ID NO: 738030 - RNA, 21 nt, Homo sapiens
cauccuugaugcaagugcaac

SEQ ID NO: 738031 - RNA, 23 nt, Homo sapiens
caucgauauacauuuauuuacac

SEQ ID NO: 738032 - RNA, 17 nt, Homo sapiens
caucgcauccucuucca

SEQ ID NO: 738033 - RNA, 13 nt, Homo sapiens
caucuaacucauc

SEQ ID NO: 738034 - RNA, 14 nt, Homo sapiens
caucuaaugaaugu

SEQ ID NO: 738035 - RNA, 17 nt, Homo sapiens
caucuaauuaaauguag

SEQ ID NO: 738036 - RNA, 17 nt, Homo sapiens
caucuaccccuuccuuu

SEQ ID NO: 738037 - RNA, 17 nt, Homo sapiens
caucuacccugcugacc

SEQ ID NO: 738038 - RNA, 13 nt, Homo sapiens
caucuauucaagc

SEQ ID NO: 738039 - RNA, 17 nt, Homo sapiens
caucuauucaagcacuu

SEQ ID NO: 738040 - RNA, 17 nt, Homo sapiens
caucucaaagaaggcau

SEQ ID NO: 738041 - RNA, 13 nt, Homo sapiens
caucuccagcuau

SEQ ID NO: 738042 - RNA, 22 nt, Homo sapiens
caucuccagggagcaagacaga

SEQ ID NO: 738043 - RNA, 19 nt, Homo sapiens
caucucccagccaagucca

SEQ ID NO: 738044 - RNA, 16 nt, Homo sapiens
caucucccucccacau

SEQ ID NO: 738045 - RNA, 19 nt, Homo sapiens
caucuccucuguaaugauc

SEQ ID NO: 738046 - RNA, 15 nt, Homo sapiens
caucuccugauuucu

SEQ ID NO: 738047 - RNA, 19 nt, Homo sapiens
caucucggaguucagacuc

SEQ ID NO: 738048 - RNA, 13 nt, Homo sapiens
caucucuacuaaa

SEQ ID NO: 738049 - RNA, 15 nt, Homo sapiens
caucucugcagguuu

SEQ ID NO: 738050 - RNA, 15 nt, Homo sapiens
caucucugccuguca

SEQ ID NO: 738051 - RNA, 11 nt, Homo sapiens
caucucugucu

SEQ ID NO: 738052 - RNA, 21 nt, Homo sapiens
caucucuugaaaccuguuaaa

SEQ ID NO: 738053 - RNA, 22 nt, Homo sapiens
caucucuugaaaccuguuaaaa

SEQ ID NO: 738054 - RNA, 14 nt, Homo sapiens
caucucuuguauau

SEQ ID NO: 738055 - RNA, 16 nt, Homo sapiens
caucucuuucugcaaa

SEQ ID NO: 738056 - RNA, 17 nt, Homo sapiens
caucugaccaucuguga

SEQ ID NO: 738057 - RNA, 14 nt, Homo sapiens
caucugacuaugac

SEQ ID NO: 738058 - RNA, 15 nt, Homo sapiens
caucugagaggcucu

SEQ ID NO: 738059 - RNA, 11 nt, Homo sapiens
caucugcaaua

SEQ ID NO: 738060 - RNA, 22 nt, Homo sapiens
caucugcuuuucccauugccau

SEQ ID NO: 738061 - RNA, 16 nt, Homo sapiens
caucuggcucagcaua

SEQ ID NO: 738062 - RNA, 20 nt, Homo sapiens
caucugggguggacccauca

SEQ ID NO: 738063 - RNA, 14 nt, Homo sapiens
caucuggugcucuu

SEQ ID NO: 738064 - RNA, 15 nt, Homo sapiens
caucuguacauacug

SEQ ID NO: 738065 - RNA, 12 nt, Homo sapiens
caucuuaaacua

SEQ ID NO: 738066 - RNA, 21 nt, Homo sapiens
caucuuccaacccacuggccc

SEQ ID NO: 738067 - RNA, 13 nt, Homo sapiens
caucuugcagcau

SEQ ID NO: 738068 - RNA, 16 nt, Homo sapiens
caucuugcagcauuua

SEQ ID NO: 738069 - RNA, 14 nt, Homo sapiens
caucuugcuaccag

SEQ ID NO: 738070 - RNA, 13 nt, Homo sapiens
caucuugugagug

SEQ ID NO: 738071 - RNA, 23 nt, Homo sapiens
caucuugugguaacuugcugcuu

SEQ ID NO: 738072 - RNA, 11 nt, Homo sapiens
caucuuuacaa

SEQ ID NO: 738073 - RNA, 16 nt, Homo sapiens
caucuuuccuguucca

SEQ ID NO: 738074 - RNA, 14 nt, Homo sapiens
caucuuugaacuuc

SEQ ID NO: 738075 - RNA, 14 nt, Homo sapiens
caucuuuggcugag

SEQ ID NO: 738076 - RNA, 16 nt, Homo sapiens
caucuuuggcugagcu

SEQ ID NO: 738077 - RNA, 18 nt, Homo sapiens
caucuuuucuagagacac

SEQ ID NO: 738078 - RNA, 23 nt, Homo sapiens
caucuuuuuccacuuugacuaca

SEQ ID NO: 738079 - RNA, 15 nt, Homo sapiens
caugaaaauaccauu

SEQ ID NO: 738080 - RNA, 14 nt, Homo sapiens
caugaaacugucca

SEQ ID NO: 738081 - RNA, 20 nt, Homo sapiens
caugaaaucuuuaugugaua

SEQ ID NO: 738082 - RNA, 18 nt, Homo sapiens
caugaaauucuuccuaau

SEQ ID NO: 738083 - RNA, 22 nt, Homo sapiens
caugaacaucuuuagugucuga

SEQ ID NO: 738084 - RNA, 19 nt, Homo sapiens
caugaagcacaucaauuac

SEQ ID NO: 738085 - RNA, 19 nt, Homo sapiens
caugaauauuucauaucua

SEQ ID NO: 738086 - RNA, 13 nt, Homo sapiens
caugaauguauca

SEQ ID NO: 738087 - RNA, 17 nt, Homo sapiens
caugacacuuccaaaga

SEQ ID NO: 738088 - RNA, 23 nt, Homo sapiens
caugaccaaaugcuuuuccucaa

SEQ ID NO: 738089 - RNA, 18 nt, Homo sapiens
caugacccaccccugugc

SEQ ID NO: 738090 - RNA, 16 nt, Homo sapiens
cauguuauucucucac

SEQ ID NO: 738091 - RNA, 23 nt, Homo sapiens
cauguuauucucucacaguguac

SEQ ID NO: 738092 - RNA, 22 nt, Homo sapiens
cauguucaagcgauucuccugc

SEQ ID NO: 738093 - RNA, 15 nt, Homo sapiens
cauguucacugugag

SEQ ID NO: 738094 - RNA, 20 nt, Homo sapiens
cauguucauauguacuuguu

SEQ ID NO: 738095 - RNA, 15 nt, Homo sapiens
cauguucaugugauu

SEQ ID NO: 738096 - RNA, 16 nt, Homo sapiens
cauguucaugugauua

SEQ ID NO: 738097 - RNA, 13 nt, Homo sapiens
cauguucugugac

SEQ ID NO: 738098 - RNA, 21 nt, Homo sapiens
cauguuguugaggcugucaca

SEQ ID NO: 738099 - RNA, 15 nt, Homo sapiens
cauguuucacagugg

SEQ ID NO: 738100 - RNA, 12 nt, Homo sapiens
cauguuucucac

SEQ ID NO: 738101 - RNA, 17 nt, Homo sapiens
cauguuugcacuuggca

SEQ ID NO: 738102 - RNA, 15 nt, Homo sapiens
cauguuuuagcauuu

SEQ ID NO: 738103 - RNA, 18 nt, Homo sapiens
cauguuuuguauguuaaa

SEQ ID NO: 738104 - RNA, 22 nt, Homo sapiens
cauuaaagaugaccuacagugc

SEQ ID NO: 738105 - RNA, 20 nt, Homo sapiens
cauuaaauaccuauaugaau

SEQ ID NO: 738106 - RNA, 20 nt, Homo sapiens
cauuaaauauaauaugcaca

SEQ ID NO: 738107 - RNA, 21 nt, Homo sapiens
cauuaauagcugccuucaagg

SEQ ID NO: 738108 - RNA, 13 nt, Homo sapiens
cauuaaugcaaug

SEQ ID NO: 738109 - RNA, 17 nt, Homo sapiens
cauuacaacaguagaga

SEQ ID NO: 738110 - RNA, 13 nt, Homo sapiens
cauuacacacaaa

SEQ ID NO: 738111 - RNA, 15 nt, Homo sapiens
cauuacaggugugag

SEQ ID NO: 738112 - RNA, 13 nt, Homo sapiens
cauuacaguucuu

SEQ ID NO: 738113 - RNA, 16 nt, Homo sapiens
cauuacaguucuuucc

SEQ ID NO: 738114 - RNA, 18 nt, Homo sapiens
cauuacuauucacugaug

SEQ ID NO: 738115 - RNA, 22 nt, Homo sapiens
cauuacugccaucuuuaucaug

SEQ ID NO: 738116 - RNA, 17 nt, Homo sapiens
cauuacugguaaagccu

SEQ ID NO: 738117 - RNA, 18 nt, Homo sapiens
cauuagaccaagcuuguc

SEQ ID NO: 738118 - RNA, 19 nt, Homo sapiens
cauuaggucccucacucca

SEQ ID NO: 738119 - RNA, 15 nt, Homo sapiens
cauuagucacuuuga

SEQ ID NO: 738120 - RNA, 16 nt, Homo sapiens
cauacauauuaucuca

SEQ ID NO: 738121 - RNA, 22 nt, Homo sapiens
cauacaucuaagucaguuucac

SEQ ID NO: 738122 - RNA, 18 nt, Homo sapiens
cauacaugucacauuuag

SEQ ID NO: 738123 - RNA, 22 nt, Homo sapiens
cauacauuguacgaagaguauu

SEQ ID NO: 738124 - RNA, 15 nt, Homo sapiens
cauacauuuaugcac

SEQ ID NO: 738125 - RNA, 17 nt, Homo sapiens
cauacauuuaugcacau

SEQ ID NO: 738126 - RNA, 13 nt, Homo sapiens
cauaccucugacc

SEQ ID NO: 738127 - RNA, 17 nt, Homo sapiens
cauaccucugaccaaca

SEQ ID NO: 738128 - RNA, 22 nt, Homo sapiens
cauaccuggcccugugccuugg

SEQ ID NO: 738129 - RNA, 13 nt, Homo sapiens
cauacugcaugua

SEQ ID NO: 738130 - RNA, 18 nt, Homo sapiens
cauacuggccuggacugu

SEQ ID NO: 738131 - RNA, 16 nt, Homo sapiens
cauacuuaaugcauau

SEQ ID NO: 738132 - RNA, 22 nt, Homo sapiens
cauacuuccguccauccauuca

SEQ ID NO: 738133 - RNA, 14 nt, Homo sapiens
cauacuucucucag

SEQ ID NO: 738134 - RNA, 16 nt, Homo sapiens
cauacuucuucauuca

SEQ ID NO: 738135 - RNA, 18 nt, Homo sapiens
cauagaaauauugacuca

SEQ ID NO: 738136 - RNA, 16 nt, Homo sapiens
cauagacuuaggcauu

SEQ ID NO: 738137 - RNA, 13 nt, Homo sapiens
cauagagcuuuuu

SEQ ID NO: 738138 - RNA, 13 nt, Homo sapiens
cauagaggcuucu

SEQ ID NO: 738139 - RNA, 21 nt, Homo sapiens
cauagauccccccacugagcu

SEQ ID NO: 738140 - RNA, 19 nt, Homo sapiens
cauagcaagacacaucccu

SEQ ID NO: 738141 - RNA, 13 nt, Homo sapiens
cauagcacugggc

SEQ ID NO: 738142 - RNA, 14 nt, Homo sapiens
cauagcauagccag

SEQ ID NO: 738143 - RNA, 16 nt, Homo sapiens
cauagcugacuacaaa

SEQ ID NO: 738144 - RNA, 22 nt, Homo sapiens
cauagcugucuagaguagcuua

SEQ ID NO: 738145 - RNA, 23 nt, Homo sapiens
cauaggcugacuuuugcagaugg

SEQ ID NO: 738146 - RNA, 15 nt, Homo sapiens
cauagggccuccuua

SEQ ID NO: 738147 - RNA, 19 nt, Homo sapiens
cauagggucacuuugccau

SEQ ID NO: 738148 - RNA, 13 nt, Homo sapiens
cauaguaaaguau

SEQ ID NO: 738149 - RNA, 14 nt, Homo sapiens
cauaguccaaaaag

SEQ ID NO: 738150 - RNA, 14 nt, Homo sapiens
cauagugacaugca

SEQ ID NO: 738151 - RNA, 18 nt, Homo sapiens
cauaguggagagaacuga

SEQ ID NO: 738152 - RNA, 16 nt, Homo sapiens
cauaguggaucacuca

SEQ ID NO: 738153 - RNA, 21 nt, Homo sapiens
cauauaacuaagacauaugca

SEQ ID NO: 738154 - RNA, 14 nt, Homo sapiens
cauauaaguuugaa

SEQ ID NO: 738155 - RNA, 13 nt, Homo sapiens
cauauaauguugu

SEQ ID NO: 738156 - RNA, 12 nt, Homo sapiens
cauauaccagca

SEQ ID NO: 738157 - RNA, 23 nt, Homo sapiens
cauauacugccauguacuaguuu

SEQ ID NO: 738158 - RNA, 16 nt, Homo sapiens
cauauaggacacacau

SEQ ID NO: 738159 - RNA, 20 nt, Homo sapiens
cauauauaagguaugugcua

SEQ ID NO: 738160 - RNA, 17 nt, Homo sapiens
cauauauaaguuuacac

SEQ ID NO: 738161 - RNA, 20 nt, Homo sapiens
cauauauacaggcauaaaau

SEQ ID NO: 738162 - RNA, 18 nt, Homo sapiens
cauauauauacauauaua

SEQ ID NO: 738163 - RNA, 13 nt, Homo sapiens
cauauauauguca

SEQ ID NO: 738164 - RNA, 16 nt, Homo sapiens
cauauauauuaauacu

SEQ ID NO: 738165 - RNA, 13 nt, Homo sapiens
cauauauauuaca

SEQ ID NO: 738166 - RNA, 14 nt, Homo sapiens
cauauauauuacaa

SEQ ID NO: 738167 - RNA, 19 nt, Homo sapiens
cauauauucccauguaaug

SEQ ID NO: 738168 - RNA, 23 nt, Homo sapiens
cauaucacccuucccugcuccca

SEQ ID NO: 738169 - RNA, 15 nt, Homo sapiens
cauaucagaacugug

SEQ ID NO: 738170 - RNA, 18 nt, Homo sapiens
cauaucaguugagcuuca

SEQ ID NO: 738171 - RNA, 17 nt, Homo sapiens
cauaucccuuccucuca

SEQ ID NO: 738172 - RNA, 15 nt, Homo sapiens
cauauccugagccau

SEQ ID NO: 738173 - RNA, 15 nt, Homo sapiens
cauaucuauaaaaug

SEQ ID NO: 738174 - RNA, 14 nt, Homo sapiens
cauaugaacacaga

SEQ ID NO: 738175 - RNA, 19 nt, Homo sapiens
cauaugagaauauaccuua

SEQ ID NO: 738176 - RNA, 22 nt, Homo sapiens
cauaugagcuuccuucugugaa

SEQ ID NO: 738177 - RNA, 11 nt, Homo sapiens
cauaugcauuu

SEQ ID NO: 738178 - RNA, 20 nt, Homo sapiens
cauauggacucugcacauga

SEQ ID NO: 738179 - RNA, 17 nt, Homo sapiens
cauauguaccauguaca

SEQ ID NO: 738180 - RNA, 23 nt, Homo sapiens
cauauguaguauaauuucuagaa

SEQ ID NO: 738181 - RNA, 20 nt, Homo sapiens
cauauguauauauauauaug

SEQ ID NO: 738182 - RNA, 14 nt, Homo sapiens
cauauguugcaaga

SEQ ID NO: 738183 - RNA, 16 nt, Homo sapiens
cauauuaagcacuuua

SEQ ID NO: 738184 - RNA, 19 nt, Homo sapiens
cauauuaauauauuuccau

SEQ ID NO: 738185 - RNA, 15 nt, Homo sapiens
cauauucaugcaagu

SEQ ID NO: 738186 - RNA, 21 nt, Homo sapiens
cauauuggacugauaaucucu

SEQ ID NO: 738187 - RNA, 14 nt, Homo sapiens
cauauuuaaaacaa

SEQ ID NO: 738188 - RNA, 21 nt, Homo sapiens
cauauuucuaccugagugaag

SEQ ID NO: 738189 - RNA, 23 nt, Homo sapiens
cauauuuguauaguugcuugccu

SEQ ID NO: 738190 - RNA, 20 nt, Homo sapiens
cauauuuuuuuuacugucag

SEQ ID NO: 738191 - RNA, 16 nt, Homo sapiens
caucaaaaagccuuau

SEQ ID NO: 738192 - RNA, 20 nt, Homo sapiens
caucaaacauuggauuuuuc

SEQ ID NO: 738193 - RNA, 12 nt, Homo sapiens
caucaaaccuca

SEQ ID NO: 738194 - RNA, 13 nt, Homo sapiens
caucaaaccugag

SEQ ID NO: 738195 - RNA, 19 nt, Homo sapiens
caucaaauaaacucaaagu

SEQ ID NO: 738196 - RNA, 13 nt, Homo sapiens
caucaaguucucc

SEQ ID NO: 738197 - RNA, 14 nt, Homo sapiens
caucaauacaacca

SEQ ID NO: 738198 - RNA, 14 nt, Homo sapiens
caucaauaucacaa

SEQ ID NO: 738199 - RNA, 17 nt, Homo sapiens
caucacaaccagauuug

SEQ ID NO: 738200 - RNA, 11 nt, Homo sapiens
caucaccacug

SEQ ID NO: 738201 - RNA, 19 nt, Homo sapiens
caucacccucuuccuguga

SEQ ID NO: 738202 - RNA, 22 nt, Homo sapiens
caucaccuugauaaugggauga

SEQ ID NO: 738203 - RNA, 22 nt, Homo sapiens
caucacuagaagaaaagcccau

SEQ ID NO: 738204 - RNA, 22 nt, Homo sapiens
caucacugaucuaagcaguggc

SEQ ID NO: 738205 - RNA, 14 nt, Homo sapiens
caucacugguugca

SEQ ID NO: 738206 - RNA, 19 nt, Homo sapiens
auguucuuuaaaggcaucu

SEQ ID NO: 738207 - RNA, 12 nt, Homo sapiens
auguugauacua

SEQ ID NO: 738208 - RNA, 15 nt, Homo sapiens
auguugaucauguac

SEQ ID NO: 738209 - RNA, 16 nt, Homo sapiens
auguugcccacaccua

SEQ ID NO: 738210 - RNA, 17 nt, Homo sapiens
auguugcccacaccuaa

SEQ ID NO: 738211 - RNA, 11 nt, Homo sapiens
auguugcccag

SEQ ID NO: 738212 - RNA, 15 nt, Homo sapiens
auguugccuuuaugg

SEQ ID NO: 738213 - RNA, 16 nt, Homo sapiens
auguugggaaaguauu

SEQ ID NO: 738214 - RNA, 16 nt, Homo sapiens
auguuguaaugcugca

SEQ ID NO: 738215 - RNA, 22 nt, Homo sapiens
auguuguguggcaaugggauuu

SEQ ID NO: 738216 - RNA, 21 nt, Homo sapiens
auguuguguuuuuaacauguc

SEQ ID NO: 738217 - RNA, 20 nt, Homo sapiens
auguuguuagccgccuguga

SEQ ID NO: 738218 - RNA, 21 nt, Homo sapiens
auguuguuccuuuugaaagaa

SEQ ID NO: 738219 - RNA, 20 nt, Homo sapiens
auguuguugaggcugucaca

SEQ ID NO: 738220 - RNA, 18 nt, Homo sapiens
auguuuaaauagccuaaa

SEQ ID NO: 738221 - RNA, 13 nt, Homo sapiens
auguuuacuguaa

SEQ ID NO: 738222 - RNA, 15 nt, Homo sapiens
auguuuaugagccag

SEQ ID NO: 738223 - RNA, 12 nt, Homo sapiens
auguuuccuuaa

SEQ ID NO: 738224 - RNA, 13 nt, Homo sapiens
auguuucuauucu

SEQ ID NO: 738225 - RNA, 13 nt, Homo sapiens
auguuucugcuau

SEQ ID NO: 738226 - RNA, 22 nt, Homo sapiens
auguuucugugaaauucucaga

SEQ ID NO: 738227 - RNA, 23 nt, Homo sapiens
auguuugaaaauuagagaucaug

SEQ ID NO: 738228 - RNA, 24 nt, Homo sapiens
auguuugacaaaacacagccaagg

SEQ ID NO: 738229 - RNA, 18 nt, Homo sapiens
auguuugcacacuugugu

SEQ ID NO: 738230 - RNA, 15 nt, Homo sapiens
auguuugccuagaca

SEQ ID NO: 738231 - RNA, 17 nt, Homo sapiens
auguuugcuauugacaa

SEQ ID NO: 738232 - RNA, 22 nt, Homo sapiens
auguuugcuauugacaagucau

SEQ ID NO: 738233 - RNA, 17 nt, Homo sapiens
auguuuggaaaccacag

SEQ ID NO: 738234 - RNA, 20 nt, Homo sapiens
auguuuggaaaccacaguca

SEQ ID NO: 738235 - RNA, 19 nt, Homo sapiens
auguuuggaauaaagucaa

SEQ ID NO: 738236 - RNA, 18 nt, Homo sapiens
auguuuguaagacuuaca

SEQ ID NO: 738237 - RNA, 17 nt, Homo sapiens
auguuuguggccucaga

SEQ ID NO: 738238 - RNA, 20 nt, Homo sapiens
auguuuguuauuuacacugg

SEQ ID NO: 738239 - RNA, 21 nt, Homo sapiens
auguuuguuauuuacacuggu

SEQ ID NO: 738240 - RNA, 20 nt, Homo sapiens
auguuuuaaaauacucucau

SEQ ID NO: 738241 - RNA, 15 nt, Homo sapiens
auguuuuauuuugcc

SEQ ID NO: 738242 - RNA, 18 nt, Homo sapiens
auguuuucuaccagugug

SEQ ID NO: 738243 - RNA, 21 nt, Homo sapiens
auguuuucuagucacuuccuc

SEQ ID NO: 738244 - RNA, 14 nt, Homo sapiens
auguuuucuuaagc

SEQ ID NO: 738245 - RNA, 15 nt, Homo sapiens
auguuuugacaugaa

SEQ ID NO: 738246 - RNA, 22 nt, Homo sapiens
auguuuugucccauuuccuugg

SEQ ID NO: 738247 - RNA, 18 nt, Homo sapiens
auguuuuuaggaguauua

SEQ ID NO: 738248 - RNA, 18 nt, Homo sapiens
auguuuuuugccacagcu

SEQ ID NO: 738249 - RNA, 15 nt, Homo sapiens
auuaaaaaaauucca

SEQ ID NO: 738250 - RNA, 15 nt, Homo sapiens
auuaaaaaccugaug

SEQ ID NO: 738251 - RNA, 23 nt, Homo sapiens
auuaaaacacaaaguccuuaaca

SEQ ID NO: 738252 - RNA, 12 nt, Homo sapiens
auuaaaacauua

SEQ ID NO: 738253 - RNA, 19 nt, Homo sapiens
auuaaaacuaagcacaaag

SEQ ID NO: 738254 - RNA, 14 nt, Homo sapiens
auuaaaacuaugaa

SEQ ID NO: 738255 - RNA, 19 nt, Homo sapiens
auuaaaagaauaucuggca

SEQ ID NO: 738256 - RNA, 13 nt, Homo sapiens
auuaaaagaaucc

SEQ ID NO: 738257 - RNA, 18 nt, Homo sapiens
auuaaaaucacucucagu

SEQ ID NO: 738258 - RNA, 12 nt, Homo sapiens
auuaaacacagg

SEQ ID NO: 738259 - RNA, 13 nt, Homo sapiens
auuaaaguuauaa

SEQ ID NO: 738260 - RNA, 18 nt, Homo sapiens
auuaaauggugccuccaa

SEQ ID NO: 738261 - RNA, 13 nt, Homo sapiens
auuaaauuaggaa

SEQ ID NO: 738262 - RNA, 20 nt, Homo sapiens
auuaacaacaauaacacugu

SEQ ID NO: 738263 - RNA, 16 nt, Homo sapiens
auuaacauaagaaaag

SEQ ID NO: 738264 - RNA, 11 nt, Homo sapiens
auuaacuaauc

SEQ ID NO: 738265 - RNA, 14 nt, Homo sapiens
auuaagaagcaaua

SEQ ID NO: 738266 - RNA, 17 nt, Homo sapiens
auuaagacaacugaguu

SEQ ID NO: 738267 - RNA, 20 nt, Homo sapiens
auuaagaucagcaaagggag

SEQ ID NO: 738268 - RNA, 14 nt, Homo sapiens
auuaagauucuuga

SEQ ID NO: 738269 - RNA, 23 nt, Homo sapiens
auuaagcauguuuuguugcucag

SEQ ID NO: 738270 - RNA, 17 nt, Homo sapiens
auuaagguuaugcacug

SEQ ID NO: 738271 - RNA, 15 nt, Homo sapiens
auuaauaaagcauuc

SEQ ID NO: 738272 - RNA, 16 nt, Homo sapiens
auuaauaaagcauucu

SEQ ID NO: 738273 - RNA, 17 nt, Homo sapiens
auuaauacucugcagug

SEQ ID NO: 738274 - RNA, 18 nt, Homo sapiens
auuaauaguucaguguau

SEQ ID NO: 738275 - RNA, 14 nt, Homo sapiens
auuaaucaccucuc

SEQ ID NO: 738276 - RNA, 19 nt, Homo sapiens
auuaaucuuaguguaugau

SEQ ID NO: 738277 - RNA, 19 nt, Homo sapiens
auuaaugaaauaucuguau

SEQ ID NO: 738278 - RNA, 18 nt, Homo sapiens
auuaaugauaaacucaga

SEQ ID NO: 738279 - RNA, 19 nt, Homo sapiens
auuaaugauaaacucagau

SEQ ID NO: 738280 - RNA, 20 nt, Homo sapiens
auuaauguguuaagugcagg

SEQ ID NO: 738281 - RNA, 13 nt, Homo sapiens
auuaauguuaauu

SEQ ID NO: 738282 - RNA, 14 nt, Homo sapiens
auuaauuacauaca

SEQ ID NO: 738283 - RNA, 23 nt, Homo sapiens
auuaauuacucuaacaaacaaga

SEQ ID NO: 738284 - RNA, 19 nt, Homo sapiens
auuaauuccaacuguacuu

SEQ ID NO: 738285 - RNA, 22 nt, Homo sapiens
auuaauuucuucccccaaagcc

SEQ ID NO: 738286 - RNA, 23 nt, Homo sapiens
auuaauuuuuaaggauguugcca

SEQ ID NO: 738287 - RNA, 19 nt, Homo sapiens
auuacaaggcuuuaucuca

SEQ ID NO: 738288 - RNA, 21 nt, Homo sapiens
auuacaaggcuuuaucucagg

SEQ ID NO: 738289 - RNA, 17 nt, Homo sapiens
auuacacuuugaaguau

SEQ ID NO: 738290 - RNA, 14 nt, Homo sapiens
auuacauacagauu

SEQ ID NO: 738291 - RNA, 14 nt, Homo sapiens
auuacaucuuucac

SEQ ID NO: 738292 - RNA, 19 nt, Homo sapiens
auuacccccuccuucagac

SEQ ID NO: 738293 - RNA, 14 nt, Homo sapiens
auuaccuccaucca

SEQ ID NO: 738294 - RNA, 17 nt, Homo sapiens
auuaccucugauaccuc

SEQ ID NO: 738295 - RNA, 21 nt, Homo sapiens
auuaccugccaauugcuaccg

SEQ ID NO: 738296 - RNA, 18 nt, Homo sapiens
auuacugaaaaugauucc

SEQ ID NO: 738297 - RNA, 15 nt, Homo sapiens
auuacugaugugaua

SEQ ID NO: 738298 - RNA, 14 nt, Homo sapiens
auuacugauuuugu

SEQ ID NO: 738299 - RNA, 15 nt, Homo sapiens
auuacugguccaaaa

SEQ ID NO: 738300 - RNA, 16 nt, Homo sapiens
auuacugguccaaaag

SEQ ID NO: 738301 - RNA, 18 nt, Homo sapiens
auuacugugugugagcca

SEQ ID NO: 738302 - RNA, 15 nt, Homo sapiens
auuacuuguguuacu

SEQ ID NO: 738303 - RNA, 11 nt, Homo sapiens
auuacuuugau

SEQ ID NO: 738304 - RNA, 19 nt, Homo sapiens
auuagaaaauuuuauggac

SEQ ID NO: 738305 - RNA, 14 nt, Homo sapiens
auuagaaacuacca

SEQ ID NO: 738306 - RNA, 14 nt, Homo sapiens
auuagaaaguuaac

SEQ ID NO: 738307 - RNA, 24 nt, Homo sapiens
auuagaagacaacaggcauagcaa

SEQ ID NO: 738308 - RNA, 16 nt, Homo sapiens
auuagaauauccauga

SEQ ID NO: 738309 - RNA, 17 nt, Homo sapiens
auuagaauauccaugac

SEQ ID NO: 738310 - RNA, 17 nt, Homo sapiens
auuagacagaacaccua

SEQ ID NO: 738311 - RNA, 13 nt, Homo sapiens
auuagaccaagcu

SEQ ID NO: 738312 - RNA, 16 nt, Homo sapiens
auuagaccaagcuugu

SEQ ID NO: 738313 - RNA, 18 nt, Homo sapiens
auuagaggucuccaaaau

SEQ ID NO: 738314 - RNA, 16 nt, Homo sapiens
auuagauaaacacagg

SEQ ID NO: 738315 - RNA, 20 nt, Homo sapiens
auuagauacaguagugucau

SEQ ID NO: 738316 - RNA, 19 nt, Homo sapiens
cacugaaaugaccaagaca

SEQ ID NO: 738317 - RNA, 16 nt, Homo sapiens
cacugaacaaaaccua

SEQ ID NO: 738318 - RNA, 13 nt, Homo sapiens
cacugaagccgga

SEQ ID NO: 738319 - RNA, 19 nt, Homo sapiens
cacugaaucucaccugcug

SEQ ID NO: 738320 - RNA, 15 nt, Homo sapiens
cacugaauucacucc

SEQ ID NO: 738321 - RNA, 21 nt, Homo sapiens
cacugaauucacuccagucaa

SEQ ID NO: 738322 - RNA, 15 nt, Homo sapiens
cacugacagauuucc

SEQ ID NO: 738323 - RNA, 17 nt, Homo sapiens
cacugacagauuuccau

SEQ ID NO: 738324 - RNA, 21 nt, Homo sapiens
cacugaccuuggagagacaca

SEQ ID NO: 738325 - RNA, 16 nt, Homo sapiens
cacugacuccugugga

SEQ ID NO: 738326 - RNA, 13 nt, Homo sapiens
cacugacuguaug

SEQ ID NO: 738327 - RNA, 23 nt, Homo sapiens
cacugacuucuaaguaaaaccac

SEQ ID NO: 738328 - RNA, 16 nt, Homo sapiens
cacugaucacccaaug

SEQ ID NO: 738329 - RNA, 21 nt, Homo sapiens
cacugaucacccaaugcauca

SEQ ID NO: 738330 - RNA, 18 nt, Homo sapiens
cacugcacugucugagaa

SEQ ID NO: 738331 - RNA, 15 nt, Homo sapiens
cacugccauuaccca

SEQ ID NO: 738332 - RNA, 18 nt, Homo sapiens
cacugccauuacccagug

SEQ ID NO: 738333 - RNA, 13 nt, Homo sapiens
aaaaggggcuccu

SEQ ID NO: 738334 - RNA, 21 nt, Homo sapiens
aaaaggggcuccuugcuccac

SEQ ID NO: 738335 - RNA, 22 nt, Homo sapiens
aaaagguagcuuaccugacaca

SEQ ID NO: 738336 - RNA, 13 nt, Homo sapiens
aaaaggucauaua

SEQ ID NO: 738337 - RNA, 19 nt, Homo sapiens
aaaagguuaaauauuguca

SEQ ID NO: 738338 - RNA, 15 nt, Homo sapiens
aaaagguuauauacc

SEQ ID NO: 738339 - RNA, 14 nt, Homo sapiens
aaaaguaaugacuu

SEQ ID NO: 738340 - RNA, 18 nt, Homo sapiens
aaaaguauccugcuucug

SEQ ID NO: 738341 - RNA, 10 nt, Homo sapiens
aaaagugaug

SEQ ID NO: 738342 - RNA, 12 nt, Homo sapiens
aaaagugauuau

SEQ ID NO: 738343 - RNA, 14 nt, Homo sapiens
aaaaguggcauuuc

SEQ ID NO: 738344 - RNA, 19 nt, Homo sapiens
aaaaguuccaagagucuaa

SEQ ID NO: 738345 - RNA, 14 nt, Homo sapiens
aaaaguuguuuguu

SEQ ID NO: 738346 - RNA, 17 nt, Homo sapiens
aaaaguuuaaagacacu

SEQ ID NO: 738347 - RNA, 14 nt, Homo sapiens
aaaaguuucacagg

SEQ ID NO: 738348 - RNA, 22 nt, Homo sapiens
aaaauaaaaaagaucuccaagc

SEQ ID NO: 738349 - RNA, 19 nt, Homo sapiens
aaaauaaacaccauuauuc

SEQ ID NO: 738350 - RNA, 18 nt, Homo sapiens
aaaauaaacuaguuucca

SEQ ID NO: 738351 - RNA, 22 nt, Homo sapiens
aaaauaaauauaucuaccccag

SEQ ID NO: 738352 - RNA, 12 nt, Homo sapiens
aaaauaaucaug

SEQ ID NO: 738353 - RNA, 19 nt, Homo sapiens
aaaauacaucagcuuggua

SEQ ID NO: 738354 - RNA, 17 nt, Homo sapiens
aaaauacaugcaucuca

SEQ ID NO: 738355 - RNA, 21 nt, Homo sapiens
aaaauacggcuuuuccaauga

SEQ ID NO: 738356 - RNA, 19 nt, Homo sapiens
aaaauagccuauccuuaau

SEQ ID NO: 738357 - RNA, 16 nt, Homo sapiens
aaaauaguaaacauua

SEQ ID NO: 738358 - RNA, 22 nt, Homo sapiens
aaaauaguguaagaacuguaca

SEQ ID NO: 738359 - RNA, 16 nt, Homo sapiens
aaaauauagacauucu

SEQ ID NO: 738360 - RNA, 15 nt, Homo sapiens
aaaauauauucuuuc

SEQ ID NO: 738361 - RNA, 16 nt, Homo sapiens
aaaauauugacauuga

SEQ ID NO: 738362 - RNA, 22 nt, Homo sapiens
aaaauauugcugugucuucauu

SEQ ID NO: 738363 - RNA, 15 nt, Homo sapiens
aaaauauuugagaau

SEQ ID NO: 738364 - RNA, 22 nt, Homo sapiens
aaaauauuuguaucacaaaucu

SEQ ID NO: 738365 - RNA, 19 nt, Homo sapiens
aaaaucaagccugauucaa

SEQ ID NO: 738366 - RNA, 12 nt, Homo sapiens
aaaaucacucaa

SEQ ID NO: 738367 - RNA, 13 nt, Homo sapiens
aaaaucacucuca

SEQ ID NO: 738368 - RNA, 15 nt, Homo sapiens
aaaaucauuucugca

SEQ ID NO: 738369 - RNA, 13 nt, Homo sapiens
aaaauccauuuua

SEQ ID NO: 738370 - RNA, 18 nt, Homo sapiens
aaaaucccaagucauuuc

SEQ ID NO: 738371 - RNA, 16 nt, Homo sapiens
aaaaucuaagcagcuu

SEQ ID NO: 738372 - RNA, 15 nt, Homo sapiens
aaaaucuccaucuca

SEQ ID NO: 738373 - RNA, 16 nt, Homo sapiens
aaaaucuccaucucaa

SEQ ID NO: 738374 - RNA, 21 nt, Homo sapiens
aaaaucucuacugcuuuggau

SEQ ID NO: 738375 - RNA, 19 nt, Homo sapiens
aaaaucugaauuuugcaau

SEQ ID NO: 738376 - RNA, 19 nt, Homo sapiens
aaaaucuguaauugauaau

SEQ ID NO: 738377 - RNA, 20 nt, Homo sapiens
aaaaucuguuauagcuuuaa

SEQ ID NO: 738378 - RNA, 17 nt, Homo sapiens
aaaaucuugugcuagaa

SEQ ID NO: 738379 - RNA, 12 nt, Homo sapiens
aaaaugagacaa

SEQ ID NO: 738380 - RNA, 18 nt, Homo sapiens
aaaaugagagcuguaacu

SEQ ID NO: 738381 - RNA, 22 nt, Homo sapiens
aaaaugagguucaacuguugau

SEQ ID NO: 738382 - RNA, 18 nt, Homo sapiens
aaaaugaugggacaauaa

SEQ ID NO: 738383 - RNA, 17 nt, Homo sapiens
aaaaugcaguccugagg

SEQ ID NO: 738384 - RNA, 18 nt, Homo sapiens
aaaaugccucaauucaca

SEQ ID NO: 738385 - RNA, 22 nt, Homo sapiens
aaaaugccucaauucacauaga

SEQ ID NO: 738386 - RNA, 17 nt, Homo sapiens
auggaaguggcagugaa

SEQ ID NO: 738387 - RNA, 18 nt, Homo sapiens
auggaaguggcagugaaa

SEQ ID NO: 738388 - RNA, 23 nt, Homo sapiens
auggaaguugcagugagcugaua

SEQ ID NO: 738389 - RNA, 20 nt, Homo sapiens
auggaaguuuuccuacacuu

SEQ ID NO: 738390 - RNA, 18 nt, Homo sapiens
auggaauaagcagaaacu

SEQ ID NO: 738391 - RNA, 20 nt, Homo sapiens
auggaaugcuugcagagcau

SEQ ID NO: 738392 - RNA, 22 nt, Homo sapiens
auggaaugcuugcagagcauga

SEQ ID NO: 738393 - RNA, 15 nt, Homo sapiens
auggaauuacaugua

SEQ ID NO: 738394 - RNA, 18 nt, Homo sapiens
auggaauuuugcaaagau

SEQ ID NO: 738395 - RNA, 14 nt, Homo sapiens
auggacagcgauga

SEQ ID NO: 738396 - RNA, 15 nt, Homo sapiens
auggacauaagacag

SEQ ID NO: 738397 - RNA, 18 nt, Homo sapiens
auggacaugaucuucuuu

SEQ ID NO: 738398 - RNA, 22 nt, Homo sapiens
auggacuaaccccaacgcacag

SEQ ID NO: 738399 - RNA, 17 nt, Homo sapiens
auggacucuguggugcc

SEQ ID NO: 738400 - RNA, 15 nt, Homo sapiens
auggacuguguuucc

SEQ ID NO: 738401 - RNA, 18 nt, Homo sapiens
auggagaacaaguuguua

SEQ ID NO: 738402 - RNA, 18 nt, Homo sapiens
auggagaaucugcugcau

SEQ ID NO: 738403 - RNA, 21 nt, Homo sapiens
auggagauauuuacaugaauu

SEQ ID NO: 738404 - RNA, 18 nt, Homo sapiens
auggagccaugacaagaa

SEQ ID NO: 738405 - RNA, 17 nt, Homo sapiens
auggaggaacaguauua

SEQ ID NO: 738406 - RNA, 17 nt, Homo sapiens
auggaggcaugccaaau

SEQ ID NO: 738407 - RNA, 14 nt, Homo sapiens
auggaggucauaca

SEQ ID NO: 738408 - RNA, 16 nt, Homo sapiens
auggaguauaugucaa

SEQ ID NO: 738409 - RNA, 17 nt, Homo sapiens
auggauaaacugagccu

SEQ ID NO: 738410 - RNA, 14 nt, Homo sapiens
auggauaugcugcu

SEQ ID NO: 738411 - RNA, 15 nt, Homo sapiens
auggauauuauuaga

SEQ ID NO: 738412 - RNA, 18 nt, Homo sapiens
auggaucccuggggccaa

SEQ ID NO: 738413 - RNA, 17 nt, Homo sapiens
auggaugauucagaaau

SEQ ID NO: 738414 - RNA, 18 nt, Homo sapiens
auggaugggggaacucag

SEQ ID NO: 738415 - RNA, 17 nt, Homo sapiens
auggauuucauggugau

SEQ ID NO: 738416 - RNA, 16 nt, Homo sapiens
auggauuugaugcugu

SEQ ID NO: 738417 - RNA, 22 nt, Homo sapiens
auggcaccacugcacuccagcc

SEQ ID NO: 738418 - RNA, 20 nt, Homo sapiens
auggcaccuuuugcacauaa

SEQ ID NO: 738419 - RNA, 20 nt, Homo sapiens
auggcagaggugcaagaccu

SEQ ID NO: 738420 - RNA, 18 nt, Homo sapiens
auggcagcuguuucucau

SEQ ID NO: 738421 - RNA, 20 nt, Homo sapiens
auggcagcuguuucucauga

SEQ ID NO: 738422 - RNA, 16 nt, Homo sapiens
auggcaggggcaaagg

SEQ ID NO: 738423 - RNA, 21 nt, Homo sapiens
auggcagguccucuguugcaa

SEQ ID NO: 738424 - RNA, 18 nt, Homo sapiens
auggcaggugucauauga

SEQ ID NO: 738425 - RNA, 16 nt, Homo sapiens
auggccaaacccucac

SEQ ID NO: 738426 - RNA, 13 nt, Homo sapiens
auggccacuguga

SEQ ID NO: 738427 - RNA, 14 nt, Homo sapiens
auggccagcaaaug

SEQ ID NO: 738428 - RNA, 13 nt, Homo sapiens
auggccagccaac

SEQ ID NO: 738429 - RNA, 15 nt, Homo sapiens
auggcccaaauccag

SEQ ID NO: 738430 - RNA, 18 nt, Homo sapiens
auggcccaaauccagugu

SEQ ID NO: 738431 - RNA, 18 nt, Homo sapiens
auggccccaguccaugcu

SEQ ID NO: 738432 - RNA, 23 nt, Homo sapiens
auggcccccaauaaaggcagcug

SEQ ID NO: 738433 - RNA, 13 nt, Homo sapiens
auggccugugcug

SEQ ID NO: 738434 - RNA, 14 nt, Homo sapiens
auggccugugcugg

SEQ ID NO: 738435 - RNA, 21 nt, Homo sapiens
auggcuacuuugguuucuguc

SEQ ID NO: 738436 - RNA, 16 nt, Homo sapiens
auggcuauaggugcua

SEQ ID NO: 738437 - RNA, 13 nt, Homo sapiens
auggcucccaagg

SEQ ID NO: 738438 - RNA, 20 nt, Homo sapiens
auggcuccggccucugccuu

SEQ ID NO: 738439 - RNA, 19 nt, Homo sapiens
auggcugaacaucagggug

SEQ ID NO: 738440 - RNA, 22 nt, Homo sapiens
auggcuggcaggcaguucuaga

SEQ ID NO: 738441 - RNA, 17 nt, Homo sapiens
auggcugggaacaugac

SEQ ID NO: 738442 - RNA, 22 nt, Homo sapiens
auggcuuaauguuuauuccuga

SEQ ID NO: 738443 - RNA, 16 nt, Homo sapiens
auggcuugaggccaga

SEQ ID NO: 738444 - RNA, 23 nt, Homo sapiens
auggcuugccuaagacuugccca

SEQ ID NO: 738445 - RNA, 20 nt, Homo sapiens
augggaaccuaguacucucu

SEQ ID NO: 738446 - RNA, 19 nt, Homo sapiens
augggaggacuccagaaga

SEQ ID NO: 738447 - RNA, 18 nt, Homo sapiens
augggaucccaggccagg

SEQ ID NO: 738448 - RNA, 16 nt, Homo sapiens
augggcagaaaaaugg

SEQ ID NO: 738449 - RNA, 22 nt, Homo sapiens
augggcagacugaaccagucca

SEQ ID NO: 738450 - RNA, 21 nt, Homo sapiens
augggcagcccaacagcacuu

SEQ ID NO: 738451 - RNA, 22 nt, Homo sapiens
augggcagcccaacagcacuuu

SEQ ID NO: 738452 - RNA, 17 nt, Homo sapiens
augggcccuaugucuca

SEQ ID NO: 738453 - RNA, 14 nt, Homo sapiens
augggccuggccac

SEQ ID NO: 738454 - RNA, 18 nt, Homo sapiens
augggcucccacccuccc

SEQ ID NO: 738455 - RNA, 19 nt, Homo sapiens
auggggaagguuaucagug

SEQ ID NO: 738456 - RNA, 15 nt, Homo sapiens
auggggauagaggaa

SEQ ID NO: 738457 - RNA, 16 nt, Homo sapiens
auggggcauguccuuu

SEQ ID NO: 738458 - RNA, 13 nt, Homo sapiens
auggggccagauc

SEQ ID NO: 738459 - RNA, 18 nt, Homo sapiens
auggggccagucaggccc

SEQ ID NO: 738460 - RNA, 17 nt, Homo sapiens
augggggaacucagauc

SEQ ID NO: 738461 - RNA, 21 nt, Homo sapiens
auggggguuggggugcuuccu

SEQ ID NO: 738462 - RNA, 13 nt, Homo sapiens
auggggucuguga

SEQ ID NO: 738463 - RNA, 14 nt, Homo sapiens
auggggugggccca

SEQ ID NO: 738464 - RNA, 16 nt, Homo sapiens
augggucaugacaaga

SEQ ID NO: 738465 - RNA, 21 nt, Homo sapiens
auggguccuugaugccagagg

SEQ ID NO: 738466 - RNA, 17 nt, Homo sapiens
augggucuaggacacag

SEQ ID NO: 738467 - RNA, 22 nt, Homo sapiens
auggguuauauaaagacugccu

SEQ ID NO: 738468 - RNA, 16 nt, Homo sapiens
augguaacgucuccca

SEQ ID NO: 738469 - RNA, 11 nt, Homo sapiens
augguagucac

SEQ ID NO: 738470 - RNA, 20 nt, Homo sapiens
auggucaacacuuaaggguu

SEQ ID NO: 738471 - RNA, 21 nt, Homo sapiens
auggucacgagguccagaccc

SEQ ID NO: 738472 - RNA, 16 nt, Homo sapiens
auggucuaacacuggc

SEQ ID NO: 738473 - RNA, 20 nt, Homo sapiens
auggucugcauuagucucau

SEQ ID NO: 738474 - RNA, 19 nt, Homo sapiens
auggugaaaccccaucucu

SEQ ID NO: 738475 - RNA, 19 nt, Homo sapiens
auggugaaaccccgucucu

SEQ ID NO: 738476 - RNA, 23 nt, Homo sapiens
auggugaaaccccgucucuacua

SEQ ID NO: 738477 - RNA, 15 nt, Homo sapiens
auggugaauggauuu

SEQ ID NO: 738478 - RNA, 17 nt, Homo sapiens
auggugagcucugggaa

SEQ ID NO: 738479 - RNA, 19 nt, Homo sapiens
auggugaggcgaaggccag

SEQ ID NO: 738480 - RNA, 16 nt, Homo sapiens
auggugccccaggacc

SEQ ID NO: 738481 - RNA, 12 nt, Homo sapiens
auggugcugaau

SEQ ID NO: 738482 - RNA, 13 nt, Homo sapiens
auggugcuuaaaa

SEQ ID NO: 738483 - RNA, 13 nt, Homo sapiens
augguggguacaa

SEQ ID NO: 738484 - RNA, 20 nt, Homo sapiens
auggugguggacaccuguaa

SEQ ID NO: 738485 - RNA, 16 nt, Homo sapiens
augguguuuugucaga

SEQ ID NO: 738486 - RNA, 13 nt, Homo sapiens
augguuaauacua

SEQ ID NO: 738487 - RNA, 16 nt, Homo sapiens
augguuacucuuguca

SEQ ID NO: 738488 - RNA, 20 nt, Homo sapiens
augguucucagaucuugaca

SEQ ID NO: 738489 - RNA, 15 nt, Homo sapiens
augguucuccaagaa

SEQ ID NO: 738490 - RNA, 17 nt, Homo sapiens
augguuuccaauuucau

SEQ ID NO: 738491 - RNA, 19 nt, Homo sapiens
augguuuccacaggaacaa

SEQ ID NO: 738492 - RNA, 19 nt, Homo sapiens
augguuuuacucaugugca

SEQ ID NO: 738493 - RNA, 19 nt, Homo sapiens
auguaaaaagauucccaaa

SEQ ID NO: 738494 - RNA, 21 nt, Homo sapiens
auguaaagauauuuuuaucuu

SEQ ID NO: 738495 - RNA, 13 nt, Homo sapiens
auguaaaguaaga

SEQ ID NO: 738496 - RNA, 15 nt, Homo sapiens
auguaaauaauugau

SEQ ID NO: 738497 - RNA, 17 nt, Homo sapiens
auguaagccaagucaug

SEQ ID NO: 738498 - RNA, 12 nt, Homo sapiens
auguaagcucuu

SEQ ID NO: 738499 - RNA, 20 nt, Homo sapiens
auguaaggaggaaucaagaa

SEQ ID NO: 738500 - RNA, 16 nt, Homo sapiens
auguaaugcauaggaa

SEQ ID NO: 738501 - RNA, 21 nt, Homo sapiens
auguaauugaauaaaguugaa

SEQ ID NO: 738502 - RNA, 23 nt, Homo sapiens
auguaauuggaaucuucaccuca

SEQ ID NO: 738503 - RNA, 18 nt, Homo sapiens
auguacagaagagcaaaa

SEQ ID NO: 738504 - RNA, 21 nt, Homo sapiens
auguacaugaagaagcuaaau

SEQ ID NO: 738505 - RNA, 16 nt, Homo sapiens
auguacuacagcuaua

SEQ ID NO: 738506 - RNA, 19 nt, Homo sapiens
auguacucaaguaccacca

SEQ ID NO: 738507 - RNA, 18 nt, Homo sapiens
auguacuguuugcugcca

SEQ ID NO: 738508 - RNA, 14 nt, Homo sapiens
auguacuucucacc

SEQ ID NO: 738509 - RNA, 15 nt, Homo sapiens
auguagcccauccuu

SEQ ID NO: 738510 - RNA, 22 nt, Homo sapiens
auguagccuuuacuguuugaua

SEQ ID NO: 738511 - RNA, 20 nt, Homo sapiens
auguaucccaacuccuauaa

SEQ ID NO: 738512 - RNA, 15 nt, Homo sapiens
auguaugacuuaaua

SEQ ID NO: 738513 - RNA, 17 nt, Homo sapiens
auguauggggaaucuaa

SEQ ID NO: 738514 - RNA, 17 nt, Homo sapiens
auguauguacaauacaa

SEQ ID NO: 738515 - RNA, 13 nt, Homo sapiens
auguauguaucau

SEQ ID NO: 738516 - RNA, 13 nt, Homo sapiens
auguaugugucac

SEQ ID NO: 738517 - RNA, 21 nt, Homo sapiens
auguauuaguaugguucaaga

SEQ ID NO: 738518 - RNA, 16 nt, Homo sapiens
auguauuaugagccaa

SEQ ID NO: 738519 - RNA, 13 nt, Homo sapiens
augucaagcacca

SEQ ID NO: 738520 - RNA, 14 nt, Homo sapiens
augucaagccauaa

SEQ ID NO: 738521 - RNA, 18 nt, Homo sapiens
augucacaaccucucuga

SEQ ID NO: 738522 - RNA, 17 nt, Homo sapiens
augucacuaaacaagaa

SEQ ID NO: 738523 - RNA, 16 nt, Homo sapiens
augucagaacagagug

SEQ ID NO: 738524 - RNA, 15 nt, Homo sapiens
augucauagccaaag

SEQ ID NO: 738525 - RNA, 16 nt, Homo sapiens
augucauguacuuccu

SEQ ID NO: 738526 - RNA, 12 nt, Homo sapiens
augucauuuagu

SEQ ID NO: 738527 - RNA, 14 nt, Homo sapiens
auguccaccaugaa

SEQ ID NO: 738528 - RNA, 23 nt, Homo sapiens
augucccuugcugugagcaagaa

SEQ ID NO: 738529 - RNA, 21 nt, Homo sapiens
augucccuuucuuggccaguu

SEQ ID NO: 738530 - RNA, 20 nt, Homo sapiens
auguccggagagacagugac

SEQ ID NO: 738531 - RNA, 23 nt, Homo sapiens
auguccggcugaaggcugagugu

SEQ ID NO: 738532 - RNA, 21 nt, Homo sapiens
auguccucaguguaccacuac

SEQ ID NO: 738533 - RNA, 17 nt, Homo sapiens
auguccugacaccugcu

SEQ ID NO: 738534 - RNA, 19 nt, Homo sapiens
augucuaucaacuuuaauc

SEQ ID NO: 738535 - RNA, 16 nt, Homo sapiens
augucuauucagcuuc

SEQ ID NO: 738536 - RNA, 22 nt, Homo sapiens
augucuccaucucugucucaaa

SEQ ID NO: 738537 - RNA, 18 nt, Homo sapiens
augucuccucaacccaca

SEQ ID NO: 738538 - RNA, 21 nt, Homo sapiens
augucucuaagccaacuuuaa

SEQ ID NO: 738539 - RNA, 19 nt, Homo sapiens
augucucucuugagcuaca

SEQ ID NO: 738540 - RNA, 18 nt, Homo sapiens
augucucuugagcaucaa

SEQ ID NO: 738541 - RNA, 16 nt, Homo sapiens
augucucuuguagaag

SEQ ID NO: 738542 - RNA, 18 nt, Homo sapiens
augucugccauguugccc

SEQ ID NO: 738543 - RNA, 18 nt, Homo sapiens
augucuguagcuccucaa

SEQ ID NO: 738544 - RNA, 21 nt, Homo sapiens
augucuguuaccuuguuaaua

SEQ ID NO: 738545 - RNA, 19 nt, Homo sapiens
augucuguucuacauagau

SEQ ID NO: 738546 - RNA, 12 nt, Homo sapiens
augucuucccac

SEQ ID NO: 738547 - RNA, 22 nt, Homo sapiens
augucuuuuacccggcacauuc

SEQ ID NO: 738548 - RNA, 21 nt, Homo sapiens
augugaaaauuacaguccaaa

SEQ ID NO: 738549 - RNA, 18 nt, Homo sapiens
augugaaaggaacauuuu

SEQ ID NO: 738550 - RNA, 13 nt, Homo sapiens
augugaacauuua

SEQ ID NO: 738551 - RNA, 18 nt, Homo sapiens
augugacaacaugcaaga

SEQ ID NO: 738552 - RNA, 19 nt, Homo sapiens
augugacccaccagugccu

SEQ ID NO: 738553 - RNA, 15 nt, Homo sapiens
augugagcaugucac

SEQ ID NO: 738554 - RNA, 19 nt, Homo sapiens
augugagcucuuccuaucc

SEQ ID NO: 738555 - RNA, 16 nt, Homo sapiens
augugaucagcuuuca

SEQ ID NO: 738556 - RNA, 16 nt, Homo sapiens
augugaugcaagccag

SEQ ID NO: 738557 - RNA, 17 nt, Homo sapiens
augugauuuacauuuca

SEQ ID NO: 738558 - RNA, 14 nt, Homo sapiens
augugcaacauucu

SEQ ID NO: 738559 - RNA, 16 nt, Homo sapiens
augugcacugccugca

SEQ ID NO: 738560 - RNA, 13 nt, Homo sapiens
augugccaaagcu

SEQ ID NO: 738561 - RNA, 14 nt, Homo sapiens
augugccaguuccu

SEQ ID NO: 738562 - RNA, 20 nt, Homo sapiens
augugccuugauugauuaga

SEQ ID NO: 738563 - RNA, 16 nt, Homo sapiens
augugcuagucacugg

SEQ ID NO: 738564 - RNA, 16 nt, Homo sapiens
augugcucagccaaau

SEQ ID NO: 738565 - RNA, 16 nt, Homo sapiens
augugcugagcauuuu

SEQ ID NO: 738566 - RNA, 23 nt, Homo sapiens
augugcugugugagugagcacac

SEQ ID NO: 738567 - RNA, 23 nt, Homo sapiens
augugcuuuuaaaaaaaaauacu

SEQ ID NO: 738568 - RNA, 13 nt, Homo sapiens
augugcuuuucuc

SEQ ID NO: 738569 - RNA, 21 nt, Homo sapiens
auguggacuggugcaaguuga

SEQ ID NO: 738570 - RNA, 19 nt, Homo sapiens
auguggagcuacugaugaa

SEQ ID NO: 738571 - RNA, 20 nt, Homo sapiens
auguggagugagaacagcau

SEQ ID NO: 738572 - RNA, 22 nt, Homo sapiens
auguggagugagaacagcauuu

SEQ ID NO: 738573 - RNA, 21 nt, Homo sapiens
auguggccacuaggaggaaug

SEQ ID NO: 738574 - RNA, 16 nt, Homo sapiens
auguggcccaacacaa

SEQ ID NO: 738575 - RNA, 21 nt, Homo sapiens
augugggggucuguguguuua

SEQ ID NO: 738576 - RNA, 20 nt, Homo sapiens
augugggugucagucaggga

SEQ ID NO: 738577 - RNA, 19 nt, Homo sapiens
auguggguguccugcagaa

SEQ ID NO: 738578 - RNA, 15 nt, Homo sapiens
auguggucaauggaa

SEQ ID NO: 738579 - RNA, 13 nt, Homo sapiens
auguggugcuuuu

SEQ ID NO: 738580 - RNA, 18 nt, Homo sapiens
augugguucagugccuuc

SEQ ID NO: 738581 - RNA, 22 nt, Homo sapiens
auguguaagaacaacuaccuga

SEQ ID NO: 738582 - RNA, 20 nt, Homo sapiens
auguguaauuguuuuggaau

SEQ ID NO: 738583 - RNA, 19 nt, Homo sapiens
auguguacagucuuugcag

SEQ ID NO: 738584 - RNA, 14 nt, Homo sapiens
auguguagaauuug

SEQ ID NO: 738585 - RNA, 18 nt, Homo sapiens
auguguagccugugcaug

SEQ ID NO: 738586 - RNA, 23 nt, Homo sapiens
auguguauggguuaaaucaaaga

SEQ ID NO: 738587 - RNA, 17 nt, Homo sapiens
augugucagaauaggaa

SEQ ID NO: 738588 - RNA, 22 nt, Homo sapiens
augugucaggugacccugauga

SEQ ID NO: 738589 - RNA, 17 nt, Homo sapiens
augugucaucaggagaa

SEQ ID NO: 738590 - RNA, 20 nt, Homo sapiens
auguguccuuucaaggggaa

SEQ ID NO: 738591 - RNA, 16 nt, Homo sapiens
augugucuuuauagca

SEQ ID NO: 738592 - RNA, 15 nt, Homo sapiens
augugugaggagcug

SEQ ID NO: 738593 - RNA, 16 nt, Homo sapiens
auguguguguauauau

SEQ ID NO: 738594 - RNA, 15 nt, Homo sapiens
auguguucauucaag

SEQ ID NO: 738595 - RNA, 18 nt, Homo sapiens
auguguucauucaagcua

SEQ ID NO: 738596 - RNA, 15 nt, Homo sapiens
auguguuuuucacau

SEQ ID NO: 738597 - RNA, 16 nt, Homo sapiens
auguuaaagcaucaga

SEQ ID NO: 738598 - RNA, 22 nt, Homo sapiens
auguuaacacucaugaagcaua

SEQ ID NO: 738599 - RNA, 13 nt, Homo sapiens
auguuaacuagaa

SEQ ID NO: 738600 - RNA, 17 nt, Homo sapiens
auguuacacuaagggug

SEQ ID NO: 738601 - RNA, 21 nt, Homo sapiens
auguuacucaugacuccuuuc

SEQ ID NO: 738602 - RNA, 17 nt, Homo sapiens
auguuagaaagugcuga

SEQ ID NO: 738603 - RNA, 21 nt, Homo sapiens
auguuaguagaaauuuuacaa

SEQ ID NO: 738604 - RNA, 21 nt, Homo sapiens
auguuaucuucucaaguucua

SEQ ID NO: 738605 - RNA, 16 nt, Homo sapiens
auguuauuuccugaga

SEQ ID NO: 738606 - RNA, 15 nt, Homo sapiens
auaccauuuccucag

SEQ ID NO: 738607 - RNA, 19 nt, Homo sapiens
auaccauuuucaauggaaa

SEQ ID NO: 738608 - RNA, 21 nt, Homo sapiens
auacccaaguuauugggaugu

SEQ ID NO: 738609 - RNA, 18 nt, Homo sapiens
auacccaccucuguggau

SEQ ID NO: 738610 - RNA, 19 nt, Homo sapiens
auacccaugcacaguacaa

SEQ ID NO: 738611 - RNA, 14 nt, Homo sapiens
auaccgcucaguau

SEQ ID NO: 738612 - RNA, 19 nt, Homo sapiens
gaucuggaacccagacuca

SEQ ID NO: 738613 - RNA, 18 nt, Homo sapiens
gaucuggaaccucagccu

SEQ ID NO: 738614 - RNA, 19 nt, Homo sapiens
gaucuggcacacucccucu

SEQ ID NO: 738615 - RNA, 19 nt, Homo sapiens
gaucuggcccuugcuuacc

SEQ ID NO: 738616 - RNA, 21 nt, Homo sapiens
gaucuggucuaguuaaccuag

SEQ ID NO: 738617 - RNA, 23 nt, Homo sapiens
gaucuuaauuuacuuuaagcauu

SEQ ID NO: 738618 - RNA, 15 nt, Homo sapiens
gaucuucccacagga

SEQ ID NO: 738619 - RNA, 17 nt, Homo sapiens
gaucuuccguggucaga

SEQ ID NO: 738620 - RNA, 23 nt, Homo sapiens
gaucuuccguggucagagugcca

SEQ ID NO: 738621 - RNA, 22 nt, Homo sapiens
gaucuuucucaaucuugaacuc

SEQ ID NO: 738622 - RNA, 18 nt, Homo sapiens
gaucuuuugcuaaugcaa

SEQ ID NO: 738623 - RNA, 23 nt, Homo sapiens
gaugaaaacauagcaucucagga

SEQ ID NO: 738624 - RNA, 14 nt, Homo sapiens
gaugaaaacauuca

SEQ ID NO: 738625 - RNA, 14 nt, Homo sapiens
gaugaaacuccuga

SEQ ID NO: 738626 - RNA, 16 nt, Homo sapiens
gaugaaagcugauuac

SEQ ID NO: 738627 - RNA, 22 nt, Homo sapiens
gaugaagaacacagcaugugcc

SEQ ID NO: 738628 - RNA, 15 nt, Homo sapiens
gaugaaucauauuca

SEQ ID NO: 738629 - RNA, 17 nt, Homo sapiens
gaugagcaagacauacu

SEQ ID NO: 738630 - RNA, 18 nt, Homo sapiens
gaugagcaagacauacuu

SEQ ID NO: 738631 - RNA, 18 nt, Homo sapiens
gaugagcagucacacugu

SEQ ID NO: 738632 - RNA, 15 nt, Homo sapiens
gaugaggguggcaug

SEQ ID NO: 738633 - RNA, 14 nt, Homo sapiens
gaugaguuuugcca

SEQ ID NO: 738634 - RNA, 16 nt, Homo sapiens
gaugauacacuaugaa

SEQ ID NO: 738635 - RNA, 12 nt, Homo sapiens
gaugaucuucag

SEQ ID NO: 738636 - RNA, 23 nt, Homo sapiens
gaugauuuuguaaaaguggcauu

SEQ ID NO: 738637 - RNA, 15 nt, Homo sapiens
gaugcaaugugcuac

SEQ ID NO: 738638 - RNA, 13 nt, Homo sapiens
gaugcacauuucu

SEQ ID NO: 738639 - RNA, 17 nt, Homo sapiens
gaugcacguggggccca

SEQ ID NO: 738640 - RNA, 17 nt, Homo sapiens
gaugcacuuauucaaua

SEQ ID NO: 738641 - RNA, 20 nt, Homo sapiens
gaugcacuuccuggucuucc

SEQ ID NO: 738642 - RNA, 13 nt, Homo sapiens
gaugcagacacag

SEQ ID NO: 738643 - RNA, 15 nt, Homo sapiens
gaugcagacacagau

SEQ ID NO: 738644 - RNA, 15 nt, Homo sapiens
gaugcagcuucaaga

SEQ ID NO: 738645 - RNA, 19 nt, Homo sapiens
gaugcaggauguucaggga

SEQ ID NO: 738646 - RNA, 13 nt, Homo sapiens
gaugcaugagcuc

SEQ ID NO: 738647 - RNA, 13 nt, Homo sapiens
gaugcauucgaga

SEQ ID NO: 738648 - RNA, 11 nt, Homo sapiens
gaugcauuuaa

SEQ ID NO: 738649 - RNA, 12 nt, Homo sapiens
gaugcauuuaau

SEQ ID NO: 738650 - RNA, 13 nt, Homo sapiens
gaugccacuuccc

SEQ ID NO: 738651 - RNA, 18 nt, Homo sapiens
gaugccagagggccagca

SEQ ID NO: 738652 - RNA, 21 nt, Homo sapiens
gaugccauggcaacuuagaga

SEQ ID NO: 738653 - RNA, 17 nt, Homo sapiens
gaugcccaugguccagg

SEQ ID NO: 738654 - RNA, 20 nt, Homo sapiens
gaugccccugacaucaucau

SEQ ID NO: 738655 - RNA, 18 nt, Homo sapiens
gaugccguucccugaaca

SEQ ID NO: 738656 - RNA, 16 nt, Homo sapiens
gaugcggccauucaag

SEQ ID NO: 738657 - RNA, 14 nt, Homo sapiens
gaugcuaaaccuua

SEQ ID NO: 738658 - RNA, 17 nt, Homo sapiens
gaugcuccugguggcug

SEQ ID NO: 738659 - RNA, 21 nt, Homo sapiens
gaugcugaccucaccuggucc

SEQ ID NO: 738660 - RNA, 20 nt, Homo sapiens
gaugcugccccucaucucuc

SEQ ID NO: 738661 - RNA, 14 nt, Homo sapiens
gaugcuguuugaca

SEQ ID NO: 738662 - RNA, 15 nt, Homo sapiens
gauggaaaauaccag

SEQ ID NO: 738663 - RNA, 17 nt, Homo sapiens
gauggaauaacucugug

SEQ ID NO: 738664 - RNA, 13 nt, Homo sapiens
gauggacaacuca

SEQ ID NO: 738665 - RNA, 19 nt, Homo sapiens
gauggaccagugguuucca

SEQ ID NO: 738666 - RNA, 22 nt, Homo sapiens
gauggacucugaaaaacauucc

SEQ ID NO: 738667 - RNA, 13 nt, Homo sapiens
gauggagacaccc

SEQ ID NO: 738668 - RNA, 17 nt, Homo sapiens
gauggaucugugguccu

SEQ ID NO: 738669 - RNA, 21 nt, Homo sapiens
gauggaugucuucuagcugca

SEQ ID NO: 738670 - RNA, 18 nt, Homo sapiens
gauggcccauagaccuga

SEQ ID NO: 738671 - RNA, 20 nt, Homo sapiens
gauggcgccaccgcacucca

SEQ ID NO: 738672 - RNA, 19 nt, Homo sapiens
gauggcuuuuucuccuugg

SEQ ID NO: 738673 - RNA, 22 nt, Homo sapiens
gaugggaucccaggccagggaa

SEQ ID NO: 738674 - RNA, 12 nt, Homo sapiens
gaugggcaaagc

SEQ ID NO: 738675 - RNA, 21 nt, Homo sapiens
gaugggcagcccaacagcacu

SEQ ID NO: 738676 - RNA, 14 nt, Homo sapiens
gauggggcaucggu

SEQ ID NO: 738677 - RNA, 17 nt, Homo sapiens
gaugggguuucaccaug

SEQ ID NO: 738678 - RNA, 14 nt, Homo sapiens
gauggguccucacg

SEQ ID NO: 738679 - RNA, 14 nt, Homo sapiens
gauggguggcacca

SEQ ID NO: 738680 - RNA, 18 nt, Homo sapiens
gauggugacauugaaacu

SEQ ID NO: 738681 - RNA, 21 nt, Homo sapiens
gaugguucuagcauggcauau

SEQ ID NO: 738682 - RNA, 22 nt, Homo sapiens
gaugguucuucuccaguuagaa

SEQ ID NO: 738683 - RNA, 19 nt, Homo sapiens
gauguacaaaacaguuuga

SEQ ID NO: 738684 - RNA, 11 nt, Homo sapiens
gauguacaauu

SEQ ID NO: 738685 - RNA, 19 nt, Homo sapiens
gauguaccaggcucucgca

SEQ ID NO: 738686 - RNA, 15 nt, Homo sapiens
gauguagucaguuag

SEQ ID NO: 738687 - RNA, 20 nt, Homo sapiens
gauguaucccugccccgugg

SEQ ID NO: 738688 - RNA, 16 nt, Homo sapiens
gauguaugaaggcuuu

SEQ ID NO: 738689 - RNA, 13 nt, Homo sapiens
gaugucaucuucc

SEQ ID NO: 738690 - RNA, 17 nt, Homo sapiens
gauguccacagaugccu

SEQ ID NO: 738691 - RNA, 22 nt, Homo sapiens
gaugucuuugcugcagucuucu

SEQ ID NO: 738692 - RNA, 17 nt, Homo sapiens
gaugugaaaaucaugaa

SEQ ID NO: 738693 - RNA, 16 nt, Homo sapiens
gaugugacagcccuga

SEQ ID NO: 738694 - RNA, 16 nt, Homo sapiens
gaugugaucacugaga

SEQ ID NO: 738695 - RNA, 17 nt, Homo sapiens
gaugugaucacugagac

SEQ ID NO: 738696 - RNA, 23 nt, Homo sapiens
gaugugcauuucaccugugacaa

SEQ ID NO: 738697 - RNA, 11 nt, Homo sapiens
gaugugccagu

SEQ ID NO: 738698 - RNA, 18 nt, Homo sapiens
gaugugugagcuaugcaa

SEQ ID NO: 738699 - RNA, 14 nt, Homo sapiens
gaugugugaggcac

SEQ ID NO: 738700 - RNA, 22 nt, Homo sapiens
gauguguuuugcacgucuugcu

SEQ ID NO: 738701 - RNA, 16 nt, Homo sapiens
gauguuagcagaccca

SEQ ID NO: 738702 - RNA, 22 nt, Homo sapiens
gauguuagcagacccagcuuag

SEQ ID NO: 738703 - RNA, 17 nt, Homo sapiens
gauguuaguuaccaagc

SEQ ID NO: 738704 - RNA, 12 nt, Homo sapiens
gauguucacugu

SEQ ID NO: 738705 - RNA, 20 nt, Homo sapiens
gauguucugacccugcuuca

SEQ ID NO: 738706 - RNA, 16 nt, Homo sapiens
gauguugaacugguca

SEQ ID NO: 738707 - RNA, 21 nt, Homo sapiens
gauguuuaacaaaucuaaucu

SEQ ID NO: 738708 - RNA, 19 nt, Homo sapiens
gauguuuacagacugugag

SEQ ID NO: 738709 - RNA, 19 nt, Homo sapiens
gauguuugaccuucagagc

SEQ ID NO: 738710 - RNA, 17 nt, Homo sapiens
gauguuuggaaaccaca

SEQ ID NO: 738711 - RNA, 20 nt, Homo sapiens
gauuaaauuuaauauacugc

SEQ ID NO: 738712 - RNA, 19 nt, Homo sapiens
ugggaauuuggagugacca

SEQ ID NO: 738713 - RNA, 16 nt, Homo sapiens
ugggacaaaggacauu

SEQ ID NO: 738714 - RNA, 19 nt, Homo sapiens
ugggacacaacacagauaa

SEQ ID NO: 738715 - RNA, 21 nt, Homo sapiens
ugggacccuucagccacuaca

SEQ ID NO: 738716 - RNA, 23 nt, Homo sapiens
ugggaccucaguuuuaucauuuu

SEQ ID NO: 738717 - RNA, 18 nt, Homo sapiens
ugggacgggaugguucug

SEQ ID NO: 738718 - RNA, 17 nt, Homo sapiens
ugggacguggacaugcc

SEQ ID NO: 738719 - RNA, 15 nt, Homo sapiens
ugggacuauucauug

SEQ ID NO: 738720 - RNA, 13 nt, Homo sapiens
ugggacugagaug

SEQ ID NO: 738721 - RNA, 18 nt, Homo sapiens
ugggagacugaagacuca

SEQ ID NO: 738722 - RNA, 20 nt, Homo sapiens
ugggagacugaagacucagc

SEQ ID NO: 738723 - RNA, 13 nt, Homo sapiens
ugggagacuggaa

SEQ ID NO: 738724 - RNA, 16 nt, Homo sapiens
ugggagauacagccau

SEQ ID NO: 738725 - RNA, 19 nt, Homo sapiens
ugggagcacggacugucag

SEQ ID NO: 738726 - RNA, 17 nt, Homo sapiens
ugggagcagcuaaagau

SEQ ID NO: 738727 - RNA, 18 nt, Homo sapiens
ugggagcaggaacaauga

SEQ ID NO: 738728 - RNA, 20 nt, Homo sapiens
ugggagccaggcccagaaag

SEQ ID NO: 738729 - RNA, 21 nt, Homo sapiens
ugggagcgggggggacagugc

SEQ ID NO: 738730 - RNA, 13 nt, Homo sapiens
ugggaggcaagaa

SEQ ID NO: 738731 - RNA, 20 nt, Homo sapiens
ugggaggcagagguugcagu

SEQ ID NO: 738732 - RNA, 21 nt, Homo sapiens
ugggaggcccugagacaggga

SEQ ID NO: 738733 - RNA, 18 nt, Homo sapiens
ugggaggcugugauuugc

SEQ ID NO: 738734 - RNA, 23 nt, Homo sapiens
ugggagguagaaggggaggacac

SEQ ID NO: 738735 - RNA, 16 nt, Homo sapiens
ugggagguggaagaag

SEQ ID NO: 738736 - RNA, 21 nt, Homo sapiens
ugggagguggagguugcagug

SEQ ID NO: 738737 - RNA, 15 nt, Homo sapiens
ugggagucacacagu

SEQ ID NO: 738738 - RNA, 18 nt, Homo sapiens
ugggagucugaggccuga

SEQ ID NO: 738739 - RNA, 19 nt, Homo sapiens
ugggagugugucugcugag

SEQ ID NO: 738740 - RNA, 19 nt, Homo sapiens
ugggaguuuagugugauaa

SEQ ID NO: 738741 - RNA, 13 nt, Homo sapiens
ugggauacagauc

SEQ ID NO: 738742 - RNA, 23 nt, Homo sapiens
ugggauacuuagugguaugucuc

SEQ ID NO: 738743 - RNA, 14 nt, Homo sapiens
ugggaugaugccuc

SEQ ID NO: 738744 - RNA, 17 nt, Homo sapiens
ugggauggcucaaagga

SEQ ID NO: 738745 - RNA, 13 nt, Homo sapiens
ugggaugggaucc

SEQ ID NO: 738746 - RNA, 15 nt, Homo sapiens
ugggaugggcuccca

SEQ ID NO: 738747 - RNA, 21 nt, Homo sapiens
ugggauuaugggucacaggaa

SEQ ID NO: 738748 - RNA, 14 nt, Homo sapiens
ugggauuugagaua

SEQ ID NO: 738749 - RNA, 19 nt, Homo sapiens
ugggcaacaacagcaaaac

SEQ ID NO: 738750 - RNA, 18 nt, Homo sapiens
ugggcaacacagcgagac

SEQ ID NO: 738751 - RNA, 18 nt, Homo sapiens
ugggcaacagagcaagac

SEQ ID NO: 738752 - RNA, 16 nt, Homo sapiens
ugggcaccccacugca

SEQ ID NO: 738753 - RNA, 16 nt, Homo sapiens
ugggcaccgggacccc

SEQ ID NO: 738754 - RNA, 16 nt, Homo sapiens
ugggcacuucaucuga

SEQ ID NO: 738755 - RNA, 17 nt, Homo sapiens
ugggcagcauaaaguca

SEQ ID NO: 738756 - RNA, 15 nt, Homo sapiens
ugggcagcuugagag

SEQ ID NO: 738757 - RNA, 18 nt, Homo sapiens
ugggcaggguacagacac

SEQ ID NO: 738758 - RNA, 18 nt, Homo sapiens
ugggcagggugacccuga

SEQ ID NO: 738759 - RNA, 19 nt, Homo sapiens
ugggcaggugguggcacug

SEQ ID NO: 738760 - RNA, 18 nt, Homo sapiens
ugggcaucauagcaagac

SEQ ID NO: 738761 - RNA, 18 nt, Homo sapiens
ugggcaucucaagcccca

SEQ ID NO: 738762 - RNA, 18 nt, Homo sapiens
uggugacaccucaccuca

SEQ ID NO: 738763 - RNA, 13 nt, Homo sapiens
uggugacugggaa

SEQ ID NO: 738764 - RNA, 13 nt, Homo sapiens
uggugaggcaaua

SEQ ID NO: 738765 - RNA, 20 nt, Homo sapiens
uggugaugguuuccacagga

SEQ ID NO: 738766 - RNA, 11 nt, Homo sapiens
uggugauucuc

SEQ ID NO: 738767 - RNA, 17 nt, Homo sapiens
uggugcacugagcugca

SEQ ID NO: 738768 - RNA, 20 nt, Homo sapiens
uggugccaccagccuuccug

SEQ ID NO: 738769 - RNA, 22 nt, Homo sapiens
uggugccauuucugaacuguua

SEQ ID NO: 738770 - RNA, 23 nt, Homo sapiens
uggugcuaaaugcuacauacucc

SEQ ID NO: 738771 - RNA, 20 nt, Homo sapiens
uggugcuagaagacagacau

SEQ ID NO: 738772 - RNA, 21 nt, Homo sapiens
ugguggaacccccaucucuac

SEQ ID NO: 738773 - RNA, 19 nt, Homo sapiens
ugguggagaaagcacugac

SEQ ID NO: 738774 - RNA, 12 nt, Homo sapiens
uggugggaauca

SEQ ID NO: 738775 - RNA, 14 nt, Homo sapiens
uggugggacacugg

SEQ ID NO: 738776 - RNA, 19 nt, Homo sapiens
uggugggagagacugugag

SEQ ID NO: 738777 - RNA, 14 nt, Homo sapiens
ugguggggggucca

SEQ ID NO: 738778 - RNA, 23 nt, Homo sapiens
ugguguacagaccaccuuucaca

SEQ ID NO: 738779 - RNA, 13 nt, Homo sapiens
ugguguagacugu

SEQ ID NO: 738780 - RNA, 23 nt, Homo sapiens
uggugugaucucggcucacugca

SEQ ID NO: 738781 - RNA, 13 nt, Homo sapiens
uggugugcuguau

SEQ ID NO: 738782 - RNA, 18 nt, Homo sapiens
ugguguuuacccaguauu

SEQ ID NO: 738783 - RNA, 19 nt, Homo sapiens
ugguuaaacagcagcacuu

SEQ ID NO: 738784 - RNA, 12 nt, Homo sapiens
ugguuacaagaa

SEQ ID NO: 738785 - RNA, 23 nt, Homo sapiens
ugguuacgucagccgguccaugg

SEQ ID NO: 738786 - RNA, 14 nt, Homo sapiens
ugguuagacgccuu

SEQ ID NO: 738787 - RNA, 10 nt, Homo sapiens
ugguuaucau

SEQ ID NO: 738788 - RNA, 22 nt, Homo sapiens
ugguuauggccgaaaaggauau

SEQ ID NO: 738789 - RNA, 12 nt, Homo sapiens
ugguuccauuuu

SEQ ID NO: 738790 - RNA, 20 nt, Homo sapiens
ugguuccgccaggcgcugca

SEQ ID NO: 738791 - RNA, 18 nt, Homo sapiens
ugguucguucuguacugu

SEQ ID NO: 738792 - RNA, 12 nt, Homo sapiens
ugguucuugucc

SEQ ID NO: 738793 - RNA, 17 nt, Homo sapiens
ugguugaaaaccacagu

SEQ ID NO: 738794 - RNA, 16 nt, Homo sapiens
ugguuggcagcauucc

SEQ ID NO: 738795 - RNA, 16 nt, Homo sapiens
ugguuguauuguggaa

SEQ ID NO: 738796 - RNA, 16 nt, Homo sapiens
ugguuuaaaugauaca

SEQ ID NO: 738797 - RNA, 20 nt, Homo sapiens
ugguuuaaaugauacaguau

SEQ ID NO: 738798 - RNA, 22 nt, Homo sapiens
ugguuuaccuggggauccaauu

SEQ ID NO: 738799 - RNA, 15 nt, Homo sapiens
ugguuucaacaaaga

SEQ ID NO: 738800 - RNA, 21 nt, Homo sapiens
ugguuugccugaggcuguaac

SEQ ID NO: 738801 - RNA, 12 nt, Homo sapiens
ugguuugggauc

SEQ ID NO: 738802 - RNA, 14 nt, Homo sapiens
ugguuuuccagaag

SEQ ID NO: 738803 - RNA, 14 nt, Homo sapiens
ugguuuucuugggg

SEQ ID NO: 738804 - RNA, 21 nt, Homo sapiens
ugguuuugauggcuggguccu

SEQ ID NO: 738805 - RNA, 18 nt, Homo sapiens
ugguuuuuguagccuucc

SEQ ID NO: 738806 - RNA, 13 nt, Homo sapiens
uguaaaagaugca

SEQ ID NO: 738807 - RNA, 22 nt, Homo sapiens
uguaaaauggaggccauugugu

SEQ ID NO: 738808 - RNA, 21 nt, Homo sapiens
uguaaaauuuauuuauauucc

SEQ ID NO: 738809 - RNA, 18 nt, Homo sapiens
uguaaacaucagcaagac

SEQ ID NO: 738810 - RNA, 13 nt, Homo sapiens
uguaaacugugua

SEQ ID NO: 738811 - RNA, 15 nt, Homo sapiens
uguaaaggauauuaa

SEQ ID NO: 738812 - RNA, 20 nt, Homo sapiens
uguaaaguagaauaagccuu

SEQ ID NO: 738813 - RNA, 19 nt, Homo sapiens
uguaaaguuucuagaauuu

SEQ ID NO: 738814 - RNA, 17 nt, Homo sapiens
uguaaauacacauagca

SEQ ID NO: 738815 - RNA, 20 nt, Homo sapiens
uguaaauaugaaucugcuca

SEQ ID NO: 738816 - RNA, 22 nt, Homo sapiens
uguaaaucaauuacagauuaaa

SEQ ID NO: 738817 - RNA, 20 nt, Homo sapiens
uguaaaugcucgugugauuu

SEQ ID NO: 738818 - RNA, 20 nt, Homo sapiens
uguaaauggaagcacugcca

SEQ ID NO: 738819 - RNA, 13 nt, Homo sapiens
uguaaaugugcuu

SEQ ID NO: 738820 - RNA, 14 nt, Homo sapiens
uguaaauuaacuca

SEQ ID NO: 738821 - RNA, 16 nt, Homo sapiens
uguaaauuaauacuuc

SEQ ID NO: 738822 - RNA, 17 nt, Homo sapiens
uguaaauugcaaauaaa

SEQ ID NO: 738823 - RNA, 22 nt, Homo sapiens
uguaaauugcaaauaaaccacu

SEQ ID NO: 738824 - RNA, 23 nt, Homo sapiens
uguaaauugcaaauaaaccacuu

SEQ ID NO: 738825 - RNA, 16 nt, Homo sapiens
uguaaauuuaacugca

SEQ ID NO: 738826 - RNA, 21 nt, Homo sapiens
uguaacacagucauucuagga

SEQ ID NO: 738827 - RNA, 21 nt, Homo sapiens
uguaacccccaguucaagacu

SEQ ID NO: 738828 - RNA, 16 nt, Homo sapiens
auucaugaaaugugga

SEQ ID NO: 738829 - RNA, 22 nt, Homo sapiens
auucaugugggcauuucuugcg

SEQ ID NO: 738830 - RNA, 13 nt, Homo sapiens
auucauucaguga

SEQ ID NO: 738831 - RNA, 22 nt, Homo sapiens
auucauucauacuuccguccau

SEQ ID NO: 738832 - RNA, 19 nt, Homo sapiens
auucauucugcauugcuag

SEQ ID NO: 738833 - RNA, 18 nt, Homo sapiens
auucauuggcagcucaaa

SEQ ID NO: 738834 - RNA, 23 nt, Homo sapiens
auucauuucauugugaucagcua

SEQ ID NO: 738835 - RNA, 13 nt, Homo sapiens
auucauuugcauc

SEQ ID NO: 738836 - RNA, 18 nt, Homo sapiens
auucauuugcauccaugg

SEQ ID NO: 738837 - RNA, 21 nt, Homo sapiens
auuccaaauauguaugcaccu

SEQ ID NO: 738838 - RNA, 13 nt, Homo sapiens
auuccacaggugg

SEQ ID NO: 738839 - RNA, 13 nt, Homo sapiens
auuccagaagaag

SEQ ID NO: 738840 - RNA, 23 nt, Homo sapiens
auuccagcugucacucugugccu

SEQ ID NO: 738841 - RNA, 19 nt, Homo sapiens
auuccaggcaugcacaauc

SEQ ID NO: 738842 - RNA, 14 nt, Homo sapiens
auuccagucuacuu

SEQ ID NO: 738843 - RNA, 22 nt, Homo sapiens
auuccauaauacauaacauuca

SEQ ID NO: 738844 - RNA, 22 nt, Homo sapiens
auuccaugguguauaugugcca

SEQ ID NO: 738845 - RNA, 23 nt, Homo sapiens
auucccaucacaacauuccucag

SEQ ID NO: 738846 - RNA, 23 nt, Homo sapiens
auuccccuguagcagucacugac

SEQ ID NO: 738847 - RNA, 22 nt, Homo sapiens
auucccgacgacacauauacau

SEQ ID NO: 738848 - RNA, 19 nt, Homo sapiens
auucccuaucuuuuaguuu

SEQ ID NO: 738849 - RNA, 13 nt, Homo sapiens
auucccuccauuu

SEQ ID NO: 738850 - RNA, 16 nt, Homo sapiens
auucccuccugcuacu

SEQ ID NO: 738851 - RNA, 14 nt, Homo sapiens
auucccugccuugc

SEQ ID NO: 738852 - RNA, 22 nt, Homo sapiens
auucccugccuugcugacaaua

SEQ ID NO: 738853 - RNA, 19 nt, Homo sapiens
auucccuuggauguagucu

SEQ ID NO: 738854 - RNA, 22 nt, Homo sapiens
auucccuuuuaacccaguguac

SEQ ID NO: 738855 - RNA, 14 nt, Homo sapiens
auuccgauacaaag

SEQ ID NO: 738856 - RNA, 20 nt, Homo sapiens
auuccuauauaguuuauuga

SEQ ID NO: 738857 - RNA, 15 nt, Homo sapiens
auuccucagcugcca

SEQ ID NO: 738858 - RNA, 14 nt, Homo sapiens
auuccucauuugga

SEQ ID NO: 738859 - RNA, 13 nt, Homo sapiens
auuccugauaaua

SEQ ID NO: 738860 - RNA, 15 nt, Homo sapiens
auuccugaugaccaa

SEQ ID NO: 738861 - RNA, 16 nt, Homo sapiens
auuccuguugcugucu

SEQ ID NO: 738862 - RNA, 15 nt, Homo sapiens
auuccuuagucucaa

SEQ ID NO: 738863 - RNA, 16 nt, Homo sapiens
auuccuucuuucacag

SEQ ID NO: 738864 - RNA, 20 nt, Homo sapiens
auucgaaccaggaaauggaa

SEQ ID NO: 738865 - RNA, 19 nt, Homo sapiens
auucgcugaaauacuuaau

SEQ ID NO: 738866 - RNA, 13 nt, Homo sapiens
auucuaaaccaaa

SEQ ID NO: 738867 - RNA, 22 nt, Homo sapiens
auucuaauaaauauacuaugaa

SEQ ID NO: 738868 - RNA, 18 nt, Homo sapiens
auucuaauggggacacag

SEQ ID NO: 738869 - RNA, 19 nt, Homo sapiens
auucuaaugguagucagau

SEQ ID NO: 738870 - RNA, 19 nt, Homo sapiens
auucuacaaaaaaccagga

SEQ ID NO: 738871 - RNA, 16 nt, Homo sapiens
auucuagagccagcug

SEQ ID NO: 738872 - RNA, 18 nt, Homo sapiens
auucuaggaaaucagaag

SEQ ID NO: 738873 - RNA, 13 nt, Homo sapiens
auucuaguacuug

SEQ ID NO: 738874 - RNA, 20 nt, Homo sapiens
auucuagucucugauuugca

SEQ ID NO: 738875 - RNA, 16 nt, Homo sapiens
auucuaguuucucuca

SEQ ID NO: 738876 - RNA, 15 nt, Homo sapiens
auucuauccaucucc

SEQ ID NO: 738877 - RNA, 20 nt, Homo sapiens
auucuauugaguggcagugu

SEQ ID NO: 738878 - RNA, 15 nt, Homo sapiens
auucucacaaggaaa

SEQ ID NO: 738879 - RNA, 16 nt, Homo sapiens
auucucacccugugaa

SEQ ID NO: 738880 - RNA, 18 nt, Homo sapiens
auucucacccugugaaac

SEQ ID NO: 738881 - RNA, 21 nt, Homo sapiens
auucucacuccaccacccaaa

SEQ ID NO: 738882 - RNA, 22 nt, Homo sapiens
auucucaguguagggcagagag

SEQ ID NO: 738883 - RNA, 24 nt, Homo sapiens
auucucauuaaaagaauaucuggc

SEQ ID NO: 738884 - RNA, 15 nt, Homo sapiens
auucuccugccucac

SEQ ID NO: 738885 - RNA, 15 nt, Homo sapiens
uucaugaacuuggcu

SEQ ID NO: 738886 - RNA, 16 nt, Homo sapiens
uucaugacaagcauuu

SEQ ID NO: 738887 - RNA, 12 nt, Homo sapiens
uucaugccagcu

SEQ ID NO: 738888 - RNA, 13 nt, Homo sapiens
uucauggacacuu

SEQ ID NO: 738889 - RNA, 13 nt, Homo sapiens
uucauggccccag

SEQ ID NO: 738890 - RNA, 22 nt, Homo sapiens
uucauggugcacugagcugcaa

SEQ ID NO: 738891 - RNA, 17 nt, Homo sapiens
uucaugguuuccuccag

SEQ ID NO: 738892 - RNA, 19 nt, Homo sapiens
uucauguaauagcaaugca

SEQ ID NO: 738893 - RNA, 16 nt, Homo sapiens
uucaugucacuaaaca

SEQ ID NO: 738894 - RNA, 19 nt, Homo sapiens
uucaugucugaaacagaga

SEQ ID NO: 738895 - RNA, 20 nt, Homo sapiens
uucaugugguucagugccuu

SEQ ID NO: 738896 - RNA, 23 nt, Homo sapiens
uucaugugguucagugccuuccu

SEQ ID NO: 738897 - RNA, 17 nt, Homo sapiens
uucaugugucaacuuca

SEQ ID NO: 738898 - RNA, 16 nt, Homo sapiens
uucauguucaugugau

SEQ ID NO: 738899 - RNA, 18 nt, Homo sapiens
uucauguucaugugauua

SEQ ID NO: 738900 - RNA, 22 nt, Homo sapiens
uucauguuggucugacaucaag

SEQ ID NO: 738901 - RNA, 20 nt, Homo sapiens
uucauguuugcuucauaaau

SEQ ID NO: 738902 - RNA, 23 nt, Homo sapiens
uucauuaaaguauauuuaacuca

SEQ ID NO: 738903 - RNA, 19 nt, Homo sapiens
uucauuaaaucaacuuuau

SEQ ID NO: 738904 - RNA, 18 nt, Homo sapiens
uucauuaaauuagcuauu

SEQ ID NO: 738905 - RNA, 18 nt, Homo sapiens
uucauuaauacagggcau

SEQ ID NO: 738906 - RNA, 17 nt, Homo sapiens
uucauuaaugaugaucu

SEQ ID NO: 738907 - RNA, 17 nt, Homo sapiens
uucauuaauuaguucca

SEQ ID NO: 738908 - RNA, 23 nt, Homo sapiens
uucauuaauuaguuccaguuucu

SEQ ID NO: 738909 - RNA, 15 nt, Homo sapiens
uucauuauaaucuca

SEQ ID NO: 738910 - RNA, 19 nt, Homo sapiens
uucauucauuucauuguga

SEQ ID NO: 738911 - RNA, 15 nt, Homo sapiens
uucauuccauugacu

SEQ ID NO: 738912 - RNA, 23 nt, Homo sapiens
uucauuccuaaagaaaaauaucu

SEQ ID NO: 738913 - RNA, 16 nt, Homo sapiens
uucauucuaaaccaaa

SEQ ID NO: 738914 - RNA, 22 nt, Homo sapiens
uucauucucccuuucacuaaaa

SEQ ID NO: 738915 - RNA, 13 nt, Homo sapiens
uucauucugcaag

SEQ ID NO: 738916 - RNA, 16 nt, Homo sapiens
uucauucugcaaguau

SEQ ID NO: 738917 - RNA, 20 nt, Homo sapiens
uucauucuuuacugcacuca

SEQ ID NO: 738918 - RNA, 13 nt, Homo sapiens
uucauugaugacc

SEQ ID NO: 738919 - RNA, 17 nt, Homo sapiens
uucauuguuuugcaaaa

SEQ ID NO: 738920 - RNA, 22 nt, Homo sapiens
uucauuugugcaccaauuauca

SEQ ID NO: 738921 - RNA, 13 nt, Homo sapiens
uucauuuugccaa

SEQ ID NO: 738922 - RNA, 17 nt, Homo sapiens
uucauuuuuuucacugg

SEQ ID NO: 738923 - RNA, 16 nt, Homo sapiens
uuccaaaaacauuuua

SEQ ID NO: 738924 - RNA, 23 nt, Homo sapiens
uuccaaaacuuuaaugaacuaac

SEQ ID NO: 738925 - RNA, 13 nt, Homo sapiens
uuccaaacaucca

SEQ ID NO: 738926 - RNA, 19 nt, Homo sapiens
uuccaaagcagccugugaa

SEQ ID NO: 738927 - RNA, 14 nt, Homo sapiens
uuccaacaccacag

SEQ ID NO: 738928 - RNA, 12 nt, Homo sapiens
uuccaagacaga

SEQ ID NO: 738929 - RNA, 23 nt, Homo sapiens
uuccaagacucuagaguccaagg

SEQ ID NO: 738930 - RNA, 14 nt, Homo sapiens
uuccaagagucuaa

SEQ ID NO: 738931 - RNA, 15 nt, Homo sapiens
uuccaagcuccuuau

SEQ ID NO: 738932 - RNA, 17 nt, Homo sapiens
uuccaaguauuuugcca

SEQ ID NO: 738933 - RNA, 18 nt, Homo sapiens
uuccaaguauuuugccac

SEQ ID NO: 738934 - RNA, 14 nt, Homo sapiens
uuccaauuuacaua

SEQ ID NO: 738935 - RNA, 14 nt, Homo sapiens
uuccaccugccaca

SEQ ID NO: 738936 - RNA, 23 nt, Homo sapiens
uuccacucccuuugccagugccu

SEQ ID NO: 738937 - RNA, 20 nt, Homo sapiens
uuccacuggaaaaguguaau

SEQ ID NO: 738938 - RNA, 15 nt, Homo sapiens
uuccacuucuaugca

SEQ ID NO: 738939 - RNA, 16 nt, Homo sapiens
uuccacuucuaugcaa

SEQ ID NO: 738940 - RNA, 20 nt, Homo sapiens
uuccacuuugacuacaaaga

SEQ ID NO: 738941 - RNA, 14 nt, Homo sapiens
uuccagaguaugca

SEQ ID NO: 738942 - RNA, 15 nt, Homo sapiens
uuccagaucuuucag

SEQ ID NO: 738943 - RNA, 23 nt, Homo sapiens
uuccagauguggauuuggcaaaa

SEQ ID NO: 738944 - RNA, 11 nt, Homo sapiens
uuccagcugcu

SEQ ID NO: 738945 - RNA, 22 nt, Homo sapiens
uuccagcuuagaaugcaucuca

SEQ ID NO: 738946 - RNA, 20 nt, Homo sapiens
uuccaggaauuuugugugau

SEQ ID NO: 738947 - RNA, 20 nt, Homo sapiens
uuccaggcugagccaugagg

SEQ ID NO: 738948 - RNA, 16 nt, Homo sapiens
uuccaguaacccaaau

SEQ ID NO: 738949 - RNA, 17 nt, Homo sapiens
uuccauaaugcuacugu

SEQ ID NO: 738950 - RNA, 20 nt, Homo sapiens
uuccauaguguuaacuguca

SEQ ID NO: 738951 - RNA, 13 nt, Homo sapiens
uuccaucuuguaa

SEQ ID NO: 738952 - RNA, 22 nt, Homo sapiens
uuccaugagaacagcaggguag

SEQ ID NO: 738953 - RNA, 15 nt, Homo sapiens
uuccauuagaacaaa

SEQ ID NO: 738954 - RNA, 18 nt, Homo sapiens
uuccauuuccaagcacuu

SEQ ID NO: 738955 - RNA, 16 nt, Homo sapiens
uuccauuuuaugcaga

SEQ ID NO: 738956 - RNA, 14 nt, Homo sapiens
uucccaaaacugau

SEQ ID NO: 738957 - RNA, 18 nt, Homo sapiens
uucccaaauuucauaccu

SEQ ID NO: 738958 - RNA, 19 nt, Homo sapiens
uucccaagaguauccuacc

SEQ ID NO: 738959 - RNA, 18 nt, Homo sapiens
uucccaaguaugccuuaa

SEQ ID NO: 738960 - RNA, 23 nt, Homo sapiens
uucccaaguaugccuuaagcaga

SEQ ID NO: 738961 - RNA, 20 nt, Homo sapiens
uucccaaucagcacugaaaa

SEQ ID NO: 738962 - RNA, 14 nt, Homo sapiens
uucccuuaacucca

SEQ ID NO: 738963 - RNA, 19 nt, Homo sapiens
uucccuuagccucucccac

SEQ ID NO: 738964 - RNA, 22 nt, Homo sapiens
uucccuucuacaaggacuccau

SEQ ID NO: 738965 - RNA, 21 nt, Homo sapiens
uucccuuucuacccaguacuc

SEQ ID NO: 738966 - RNA, 17 nt, Homo sapiens
uucccuuugagguugcu

SEQ ID NO: 738967 - RNA, 21 nt, Homo sapiens
uuccgucaccacgacuggcca

SEQ ID NO: 738968 - RNA, 17 nt, Homo sapiens
uuccguggcacugcaua

SEQ ID NO: 738969 - RNA, 17 nt, Homo sapiens
uuccuaaccugucagaa

SEQ ID NO: 738970 - RNA, 12 nt, Homo sapiens
uuccuaggucau

SEQ ID NO: 738971 - RNA, 22 nt, Homo sapiens
uuccuaugaauacuauugcaga

SEQ ID NO: 738972 - RNA, 22 nt, Homo sapiens
uuccuauuguaaucgugugcca

SEQ ID NO: 738973 - RNA, 21 nt, Homo sapiens
uuccucaccaggagcccggcu

SEQ ID NO: 738974 - RNA, 16 nt, Homo sapiens
uuccucagaucaucca

SEQ ID NO: 738975 - RNA, 20 nt, Homo sapiens
uuccucagggacagagacac

SEQ ID NO: 738976 - RNA, 20 nt, Homo sapiens
uuccuccucaggcacacagc

SEQ ID NO: 738977 - RNA, 18 nt, Homo sapiens
uuccuccuuuaccuuuca

SEQ ID NO: 738978 - RNA, 21 nt, Homo sapiens
uuccuccuuugggcccagcgg

SEQ ID NO: 738979 - RNA, 14 nt, Homo sapiens
uuccucgccugaca

SEQ ID NO: 738980 - RNA, 19 nt, Homo sapiens
uuccucuaacucacugccu

SEQ ID NO: 738981 - RNA, 18 nt, Homo sapiens
uuccucuccacugcugga

SEQ ID NO: 738982 - RNA, 12 nt, Homo sapiens
uuccucucucua

SEQ ID NO: 738983 - RNA, 21 nt, Homo sapiens
uuccucucucuaccagucuau

SEQ ID NO: 738984 - RNA, 15 nt, Homo sapiens
uuccucucuuggcaa

SEQ ID NO: 738985 - RNA, 18 nt, Homo sapiens
uuccucuuggugucauau

SEQ ID NO: 738986 - RNA, 13 nt, Homo sapiens
uuccugaagggaa

SEQ ID NO: 738987 - RNA, 15 nt, Homo sapiens
uuccugaaugaaaua

SEQ ID NO: 738988 - RNA, 22 nt, Homo sapiens
uuccugaccuccgccauccacc

SEQ ID NO: 738989 - RNA, 13 nt, Homo sapiens
uuccugauacauu

SEQ ID NO: 738990 - RNA, 22 nt, Homo sapiens
uuccugccacuguguacugugg

SEQ ID NO: 738991 - RNA, 21 nt, Homo sapiens
uuccugcccuugaacccccuc

SEQ ID NO: 738992 - RNA, 22 nt, Homo sapiens
uuccugcgcgucaucucugaca

SEQ ID NO: 738993 - RNA, 22 nt, Homo sapiens
uuccugcuggccccuucugggg

SEQ ID NO: 738994 - RNA, 15 nt, Homo sapiens
uuccuggaaacagca

SEQ ID NO: 738995 - RNA, 16 nt, Homo sapiens
uuccuggaauugccag

SEQ ID NO: 738996 - RNA, 20 nt, Homo sapiens
uuccuggcccacucuguaau

SEQ ID NO: 738997 - RNA, 15 nt, Homo sapiens
uuccuggcugaugau

SEQ ID NO: 738998 - RNA, 18 nt, Homo sapiens
uuccuggcugaugaucca

SEQ ID NO: 738999 - RNA, 19 nt, Homo sapiens
uuccuguguaccucuagaa

SEQ ID NO: 739000 - RNA, 15 nt, Homo sapiens
uuccuguucaguaau

SEQ ID NO: 739001 - RNA, 16 nt, Homo sapiens
uuccuuaaacugugug

SEQ ID NO: 739002 - RNA, 23 nt, Homo sapiens
uuccuuaaagcauuugcaacagc

SEQ ID NO: 739003 - RNA, 15 nt, Homo sapiens
uuccuuagacuuacu

SEQ ID NO: 739004 - RNA, 19 nt, Homo sapiens
uuccuuaguuuucuaguaa

SEQ ID NO: 739005 - RNA, 19 nt, Homo sapiens
uuccuuccagauccugggu

SEQ ID NO: 739006 - RNA, 13 nt, Homo sapiens
uuccuuccuuccu

SEQ ID NO: 739007 - RNA, 14 nt, Homo sapiens
uuccuucucugggu

SEQ ID NO: 739008 - RNA, 17 nt, Homo sapiens
uuccuugaucuguauau

SEQ ID NO: 739009 - RNA, 13 nt, Homo sapiens
uuccuugccuuaa

SEQ ID NO: 739010 - RNA, 22 nt, Homo sapiens
uuccuugugguugaaaaccaca

SEQ ID NO: 739011 - RNA, 17 nt, Homo sapiens
uuccuuugggucuguga

SEQ ID NO: 739012 - RNA, 15 nt, Homo sapiens
uuccuuuucauuuaa

SEQ ID NO: 739013 - RNA, 20 nt, Homo sapiens
uuccuuuucccugcuuccag

SEQ ID NO: 739014 - RNA, 19 nt, Homo sapiens
uuccuuuugauggggagaa

SEQ ID NO: 739015 - RNA, 19 nt, Homo sapiens
uuccuuuuggaacauuucu

SEQ ID NO: 739016 - RNA, 20 nt, Homo sapiens
uucgaaaagcacuuugaaaa

SEQ ID NO: 739017 - RNA, 14 nt, Homo sapiens
uucgaacaccaaaa

SEQ ID NO: 739018 - RNA, 15 nt, Homo sapiens
uucgaagccuugccu

SEQ ID NO: 739019 - RNA, 18 nt, Homo sapiens
uucgaaggaugaagacga

SEQ ID NO: 739020 - RNA, 20 nt, Homo sapiens
uucgagaccagccuggccaa

SEQ ID NO: 739021 - RNA, 15 nt, Homo sapiens
uucgagguggaucac

SEQ ID NO: 739022 - RNA, 16 nt, Homo sapiens
uucgauauuucaggaa

SEQ ID NO: 739023 - RNA, 20 nt, Homo sapiens
uucgaugccugcaugcugaa

SEQ ID NO: 739024 - RNA, 17 nt, Homo sapiens
uucgcacucaaugccaa

SEQ ID NO: 739025 - RNA, 19 nt, Homo sapiens
uucgcauggcagccaucaa

SEQ ID NO: 739026 - RNA, 20 nt, Homo sapiens
uucgccauucauucauacuu

SEQ ID NO: 739027 - RNA, 15 nt, Homo sapiens
uucgcccaccucagc

SEQ ID NO: 739028 - RNA, 20 nt, Homo sapiens
uucgcgugcccucgcugcuu

SEQ ID NO: 739029 - RNA, 15 nt, Homo sapiens
uucgcugaaauacuu

SEQ ID NO: 739030 - RNA, 19 nt, Homo sapiens
uucgcuuaguaacuaguga

SEQ ID NO: 739031 - RNA, 19 nt, Homo sapiens
uucggaagggguuccucaa

SEQ ID NO: 739032 - RNA, 14 nt, Homo sapiens
uucguaagaaggaa

SEQ ID NO: 739033 - RNA, 21 nt, Homo sapiens
uucgucggaggcaucauggaa

SEQ ID NO: 739034 - RNA, 20 nt, Homo sapiens
uucguucugcugaccaaaug

SEQ ID NO: 739035 - RNA, 13 nt, Homo sapiens
uucuaaaacugcc

SEQ ID NO: 739036 - RNA, 17 nt, Homo sapiens
uucuaaaguucuaagau

SEQ ID NO: 739037 - RNA, 21 nt, Homo sapiens
uucuaaauccgacuugaauau

SEQ ID NO: 739038 - RNA, 23 nt, Homo sapiens
uucuaaaugaauguuuacacucu

SEQ ID NO: 739039 - RNA, 14 nt, Homo sapiens
uucuaaaugcauau

SEQ ID NO: 739040 - RNA, 22 nt, Homo sapiens
gagcucccaccucccuucccac

SEQ ID NO: 739041 - RNA, 17 nt, Homo sapiens
gagcucuagcaagggag

SEQ ID NO: 739042 - RNA, 15 nt, Homo sapiens
gagcucugcgccagg

SEQ ID NO: 739043 - RNA, 19 nt, Homo sapiens
gagcucugguggagacaaa

SEQ ID NO: 739044 - RNA, 16 nt, Homo sapiens
gagcugaaaugcugca

SEQ ID NO: 739045 - RNA, 20 nt, Homo sapiens
gagcugacccagaguggagu

SEQ ID NO: 739046 - RNA, 15 nt, Homo sapiens
gagcugcagguuccu

SEQ ID NO: 739047 - RNA, 15 nt, Homo sapiens
gagcuggaucacuug

SEQ ID NO: 739048 - RNA, 16 nt, Homo sapiens
gagcuggcaaccagcc

SEQ ID NO: 739049 - RNA, 19 nt, Homo sapiens
gagcuggcccagggggccu

SEQ ID NO: 739050 - RNA, 18 nt, Homo sapiens
gagcugggagacaaagga

SEQ ID NO: 739051 - RNA, 16 nt, Homo sapiens
gagcuggggaucccuc

SEQ ID NO: 739052 - RNA, 22 nt, Homo sapiens
gagcuggggaugucucucauga

SEQ ID NO: 739053 - RNA, 23 nt, Homo sapiens
gagcuggguacugacugagauaa

SEQ ID NO: 739054 - RNA, 14 nt, Homo sapiens
gagcuguuacugaa

SEQ ID NO: 739055 - RNA, 18 nt, Homo sapiens
gagcuuaaacagaagcag

SEQ ID NO: 739056 - RNA, 15 nt, Homo sapiens
gagcuuaaucuuuga

SEQ ID NO: 739057 - RNA, 14 nt, Homo sapiens
gagcuuacauugaa

SEQ ID NO: 739058 - RNA, 19 nt, Homo sapiens
gagcuuagccuugugcccu

SEQ ID NO: 739059 - RNA, 17 nt, Homo sapiens
gagcuucccacaccugc

SEQ ID NO: 739060 - RNA, 16 nt, Homo sapiens
gagcuugcaagaagca

SEQ ID NO: 739061 - RNA, 13 nt, Homo sapiens
gagcuugcaguga

SEQ ID NO: 739062 - RNA, 23 nt, Homo sapiens
gagcuugcuccagauucugaugc

SEQ ID NO: 739063 - RNA, 16 nt, Homo sapiens
gagcuuggcagcugaa

SEQ ID NO: 739064 - RNA, 21 nt, Homo sapiens
gagcuuuccuacuugcacucu

SEQ ID NO: 739065 - RNA, 20 nt, Homo sapiens
gagcuuuccuucuccaggaa

SEQ ID NO: 739066 - RNA, 15 nt, Homo sapiens
gagcuuucuuugcac

SEQ ID NO: 739067 - RNA, 16 nt, Homo sapiens
gagcuuucuuugcacu

SEQ ID NO: 739068 - RNA, 19 nt, Homo sapiens
gagcuuucuuugcacuuaa

SEQ ID NO: 739069 - RNA, 16 nt, Homo sapiens
gagcuuugggugacca

SEQ ID NO: 739070 - RNA, 20 nt, Homo sapiens
gagcuuuuuaauagcacuaa

SEQ ID NO: 739071 - RNA, 22 nt, Homo sapiens
gaggaaaaggaaaaaaagcaaa

SEQ ID NO: 739072 - RNA, 22 nt, Homo sapiens
gaggaaaaggccccugcaaugu

SEQ ID NO: 739073 - RNA, 20 nt, Homo sapiens
gaggaaaagugcaaguccau

SEQ ID NO: 739074 - RNA, 13 nt, Homo sapiens
gaggaaagacagg

SEQ ID NO: 739075 - RNA, 21 nt, Homo sapiens
gaggaaagggaaggcuggcag

SEQ ID NO: 739076 - RNA, 14 nt, Homo sapiens
gaggaaauagggcu

SEQ ID NO: 739077 - RNA, 18 nt, Homo sapiens
gaggaacaagcaugucuc

SEQ ID NO: 739078 - RNA, 12 nt, Homo sapiens
gaggaacauuca

SEQ ID NO: 739079 - RNA, 15 nt, Homo sapiens
gaggaaccuacugcc

SEQ ID NO: 739080 - RNA, 17 nt, Homo sapiens
gaggaaccuacugccag

SEQ ID NO: 739081 - RNA, 16 nt, Homo sapiens
gaggaacucgccucag

SEQ ID NO: 739082 - RNA, 16 nt, Homo sapiens
gaggaagaaaaacagg

SEQ ID NO: 739083 - RNA, 23 nt, Homo sapiens
gaggaagaagauguccgugagaa

SEQ ID NO: 739084 - RNA, 17 nt, Homo sapiens
gaggaagacaggcaaau

SEQ ID NO: 739085 - RNA, 16 nt, Homo sapiens
gaggaagcccaggcuc

SEQ ID NO: 739086 - RNA, 23 nt, Homo sapiens
gaggaagggcaaaaccacuagaa

SEQ ID NO: 739087 - RNA, 23 nt, Homo sapiens
gaggaauuucuugauuaauguug

SEQ ID NO: 739088 - RNA, 22 nt, Homo sapiens
gaggaccagguuugaugccugu

SEQ ID NO: 739089 - RNA, 16 nt, Homo sapiens
gaggacccgggaccac

SEQ ID NO: 739090 - RNA, 16 nt, Homo sapiens
gaggacucaccacugc

SEQ ID NO: 739091 - RNA, 18 nt, Homo sapiens
gaggacucaccacugccc

SEQ ID NO: 739092 - RNA, 19 nt, Homo sapiens
gaggacuucuggcagggaa

SEQ ID NO: 739093 - RNA, 18 nt, Homo sapiens
gaggacuuugauugcaca

SEQ ID NO: 739094 - RNA, 15 nt, Homo sapiens
gaggagagaaggggg

SEQ ID NO: 739095 - RNA, 17 nt, Homo sapiens
gaggagauauggaguga

SEQ ID NO: 739096 - RNA, 16 nt, Homo sapiens
gaggagccaccaguuc

SEQ ID NO: 739097 - RNA, 14 nt, Homo sapiens
gaggagccucagaa

SEQ ID NO: 739098 - RNA, 12 nt, Homo sapiens
gaggagcucaag

SEQ ID NO: 739099 - RNA, 16 nt, Homo sapiens
gaggagcuggaaccau

SEQ ID NO: 739100 - RNA, 16 nt, Homo sapiens
gaggagggaggccagg

SEQ ID NO: 739101 - RNA, 22 nt, Homo sapiens
gaggagggaugcugccugaguc

SEQ ID NO: 739102 - RNA, 12 nt, Homo sapiens
gaggagggaugu

SEQ ID NO: 739103 - RNA, 14 nt, Homo sapiens
gaggaguuccuuga

SEQ ID NO: 739104 - RNA, 12 nt, Homo sapiens
gaggaucauuug

SEQ ID NO: 739105 - RNA, 20 nt, Homo sapiens
gaggaucguggccaacgugg

SEQ ID NO: 739106 - RNA, 16 nt, Homo sapiens
gaggcaccaguguccu

SEQ ID NO: 739107 - RNA, 12 nt, Homo sapiens
gaggcaccucca

SEQ ID NO: 739108 - RNA, 15 nt, Homo sapiens
gaggcagaacaggcu

SEQ ID NO: 739109 - RNA, 20 nt, Homo sapiens
gaggcagagcuugcagugag

SEQ ID NO: 739110 - RNA, 14 nt, Homo sapiens
gaggcagaucuuug

SEQ ID NO: 739111 - RNA, 20 nt, Homo sapiens
gaggcaggagaaucgcuuga

SEQ ID NO: 739112 - RNA, 21 nt, Homo sapiens
gaggcaggagaauggugugaa

SEQ ID NO: 739113 - RNA, 20 nt, Homo sapiens
gaggcaggagaauugcuuga

SEQ ID NO: 739114 - RNA, 20 nt, Homo sapiens
gaggcaggggacaagggagg

SEQ ID NO: 739115 - RNA, 23 nt, Homo sapiens
gaggcagugugguuauguuccca

SEQ ID NO: 739116 - RNA, 13 nt, Homo sapiens
gaggcaucaguug

SEQ ID NO: 739117 - RNA, 17 nt, Homo sapiens
gaggccaagucuaauga

SEQ ID NO: 739118 - RNA, 21 nt, Homo sapiens
gaggccacauugcuggcugcc

SEQ ID NO: 739119 - RNA, 21 nt, Homo sapiens
gaggccucaggugcuguccau

SEQ ID NO: 739120 - RNA, 17 nt, Homo sapiens
gaggccugaucugccca

SEQ ID NO: 739121 - RNA, 20 nt, Homo sapiens
gaggccugcauguccggcug

SEQ ID NO: 739122 - RNA, 23 nt, Homo sapiens
gaggccuuauuuugaacugccuc

SEQ ID NO: 739123 - RNA, 18 nt, Homo sapiens
gaggcgcguuugugcaua

SEQ ID NO: 739124 - RNA, 19 nt, Homo sapiens
gaggcgggcagaucaccag

SEQ ID NO: 739125 - RNA, 15 nt, Homo sapiens
gaggcuaauucugca

SEQ ID NO: 739126 - RNA, 16 nt, Homo sapiens
gaggcuaccucaccug

SEQ ID NO: 739127 - RNA, 21 nt, Homo sapiens
gaggcugagccuacagaugaa

SEQ ID NO: 739128 - RNA, 19 nt, Homo sapiens
gaggcugcagcaggugcug

SEQ ID NO: 739129 - RNA, 18 nt, Homo sapiens
gaggcugcugcugcugca

SEQ ID NO: 739130 - RNA, 19 nt, Homo sapiens
gaggcuggguucauuugug

SEQ ID NO: 739131 - RNA, 21 nt, Homo sapiens
gaggcuucuccgccagccucc

SEQ ID NO: 739132 - RNA, 15 nt, Homo sapiens
gaggcuuuacagugu

SEQ ID NO: 739133 - RNA, 23 nt, Homo sapiens
gagggaagaaugaacacucccca

SEQ ID NO: 739134 - RNA, 16 nt, Homo sapiens
gagggagacugcaaau

SEQ ID NO: 739135 - RNA, 17 nt, Homo sapiens
gagggagacuuguucua

SEQ ID NO: 739136 - RNA, 23 nt, Homo sapiens
gagggaggaacguggucaacuca

SEQ ID NO: 739137 - RNA, 16 nt, Homo sapiens
gagggaggagaaugag

SEQ ID NO: 739138 - RNA, 17 nt, Homo sapiens
gagggaggccaggcggg

SEQ ID NO: 739139 - RNA, 13 nt, Homo sapiens
gagggaggcgcug

SEQ ID NO: 739140 - RNA, 20 nt, Homo sapiens
gagggaguggguuaaacaca

SEQ ID NO: 739141 - RNA, 16 nt, Homo sapiens
gagggaucacugccaa

SEQ ID NO: 739142 - RNA, 13 nt, Homo sapiens
gagggcagcugcu

SEQ ID NO: 739143 - RNA, 23 nt, Homo sapiens
gauaacacaaguaaaacuguggu

SEQ ID NO: 739144 - RNA, 14 nt, Homo sapiens
gauaacugcaauuu

SEQ ID NO: 739145 - RNA, 17 nt, Homo sapiens
gauaacuugagcaccgu

SEQ ID NO: 739146 - RNA, 20 nt, Homo sapiens
gauaacuuggggaggcaaga

SEQ ID NO: 739147 - RNA, 20 nt, Homo sapiens
gauaagacacccccucaaac

SEQ ID NO: 739148 - RNA, 15 nt, Homo sapiens
gauaagagaauaccu

SEQ ID NO: 739149 - RNA, 20 nt, Homo sapiens
gauaaguaaguuugauuuca

SEQ ID NO: 739150 - RNA, 13 nt, Homo sapiens
gauaagucuuuca

SEQ ID NO: 739151 - RNA, 16 nt, Homo sapiens
gauaauagauucucuu

SEQ ID NO: 739152 - RNA, 13 nt, Homo sapiens
gauaauaugagaa

SEQ ID NO: 739153 - RNA, 16 nt, Homo sapiens
gauaaugaaauaauca

SEQ ID NO: 739154 - RNA, 23 nt, Homo sapiens
gauaauuuauuaaaggugguccu

SEQ ID NO: 739155 - RNA, 15 nt, Homo sapiens
uuugaaguccacuug

SEQ ID NO: 739156 - RNA, 15 nt, Homo sapiens
uuugaauacugugaa

SEQ ID NO: 739157 - RNA, 19 nt, Homo sapiens
uuugaaugaacacuaugca

SEQ ID NO: 739158 - RNA, 16 nt, Homo sapiens
uuugaaugcggcccaa

SEQ ID NO: 739159 - RNA, 19 nt, Homo sapiens
uuugaauuauccacaugaa

SEQ ID NO: 739160 - RNA, 18 nt, Homo sapiens
uuugaauucauacuagaa

SEQ ID NO: 739161 - RNA, 13 nt, Homo sapiens
uuugaauucuucc

SEQ ID NO: 739162 - RNA, 15 nt, Homo sapiens
uuugaauucuugaua

SEQ ID NO: 739163 - RNA, 17 nt, Homo sapiens
uuugacaaauuacaaaa

SEQ ID NO: 739164 - RNA, 12 nt, Homo sapiens
uuugacacugaa

SEQ ID NO: 739165 - RNA, 16 nt, Homo sapiens
uuugacucaguuccag

SEQ ID NO: 739166 - RNA, 20 nt, Homo sapiens
uuugacuguucaaugauuau

SEQ ID NO: 739167 - RNA, 16 nt, Homo sapiens
uuugagaauacauaaa

SEQ ID NO: 739168 - RNA, 13 nt, Homo sapiens
uuugagacacugg

SEQ ID NO: 739169 - RNA, 19 nt, Homo sapiens
uuugagacggagucucuca

SEQ ID NO: 739170 - RNA, 21 nt, Homo sapiens
uuugagccaacaacucugauu

SEQ ID NO: 739171 - RNA, 15 nt, Homo sapiens
uuugaguugaauuua

SEQ ID NO: 739172 - RNA, 15 nt, Homo sapiens
uuugaguuucucucc

SEQ ID NO: 739173 - RNA, 13 nt, Homo sapiens
uuugauagaaaga

SEQ ID NO: 739174 - RNA, 20 nt, Homo sapiens
uuugauaguugguguucaaa

SEQ ID NO: 739175 - RNA, 18 nt, Homo sapiens
uuugauauacaugcucaa

SEQ ID NO: 739176 - RNA, 19 nt, Homo sapiens
uuugaucaagaaugcaaua

SEQ ID NO: 739177 - RNA, 18 nt, Homo sapiens
uuugaucuacuugccuca

SEQ ID NO: 739178 - RNA, 15 nt, Homo sapiens
uuugaugaaacucau

SEQ ID NO: 739179 - RNA, 14 nt, Homo sapiens
uuugaugauacaga

SEQ ID NO: 739180 - RNA, 14 nt, Homo sapiens
uuugauggugccag

SEQ ID NO: 739181 - RNA, 20 nt, Homo sapiens
uuugaugugaaaaucaugaa

SEQ ID NO: 739182 - RNA, 20 nt, Homo sapiens
uuugauucagcaaaaaucuc

SEQ ID NO: 739183 - RNA, 23 nt, Homo sapiens
uuugauuuuucuaaccuugaaug

SEQ ID NO: 739184 - RNA, 14 nt, Homo sapiens
uuugcaaaagugua

SEQ ID NO: 739185 - RNA, 13 nt, Homo sapiens
uuugcaacuuaau

SEQ ID NO: 739186 - RNA, 18 nt, Homo sapiens
uuugcaauaaaaaugaua

SEQ ID NO: 739187 - RNA, 18 nt, Homo sapiens
uuugcaauaccaaguaua

SEQ ID NO: 739188 - RNA, 21 nt, Homo sapiens
uuugcacuuaauggcuguuga

SEQ ID NO: 739189 - RNA, 16 nt, Homo sapiens
uuugcacuucaaaaaa

SEQ ID NO: 739190 - RNA, 15 nt, Homo sapiens
uuugcaguucaccug

SEQ ID NO: 739191 - RNA, 23 nt, Homo sapiens
uuugcauuugcucuuucaucucu

SEQ ID NO: 739192 - RNA, 17 nt, Homo sapiens
uuugccagugccucuca

SEQ ID NO: 739193 - RNA, 17 nt, Homo sapiens
uuugcccaaaacuguca

SEQ ID NO: 739194 - RNA, 20 nt, Homo sapiens
uuugcccccgacggcuguga

SEQ ID NO: 739195 - RNA, 14 nt, Homo sapiens
uuugccugcaagag

SEQ ID NO: 739196 - RNA, 15 nt, Homo sapiens
uuugcuaacuggguu

SEQ ID NO: 739197 - RNA, 22 nt, Homo sapiens
uuugcuaaugcaauuagcauua

SEQ ID NO: 739198 - RNA, 15 nt, Homo sapiens
uuugcuagcagaaau

SEQ ID NO: 739199 - RNA, 18 nt, Homo sapiens
uuugcuagcagaaaucua

SEQ ID NO: 739200 - RNA, 17 nt, Homo sapiens
uuugcuagcaguaaaag

SEQ ID NO: 739201 - RNA, 15 nt, Homo sapiens
uuugcuaucugggcu

SEQ ID NO: 739202 - RNA, 22 nt, Homo sapiens
uuugcucaguggaucacacaca

SEQ ID NO: 739203 - RNA, 15 nt, Homo sapiens
uuugcucuugccaaa

SEQ ID NO: 739204 - RNA, 17 nt, Homo sapiens
uuugcucuugccaaaaa

SEQ ID NO: 739205 - RNA, 14 nt, Homo sapiens
uuugcugguuucau

SEQ ID NO: 739206 - RNA, 19 nt, Homo sapiens
uuugcuucaaaaacauucu

SEQ ID NO: 739207 - RNA, 14 nt, Homo sapiens
uuugcuucaagugu

SEQ ID NO: 739208 - RNA, 13 nt, Homo sapiens
uuuggaaaccaca

SEQ ID NO: 739209 - RNA, 15 nt, Homo sapiens
uuuggaauauuaaaa

SEQ ID NO: 739210 - RNA, 14 nt, Homo sapiens
uuuggaauuauguc

SEQ ID NO: 739211 - RNA, 18 nt, Homo sapiens
uuuggaauuaugucugcu

SEQ ID NO: 739212 - RNA, 17 nt, Homo sapiens
uuuggagccugccaaga

SEQ ID NO: 739213 - RNA, 13 nt, Homo sapiens
uuuggagcuauca

SEQ ID NO: 739214 - RNA, 13 nt, Homo sapiens
uuuggaguacaaa

SEQ ID NO: 739215 - RNA, 15 nt, Homo sapiens
uuuggauuguaucaa

SEQ ID NO: 739216 - RNA, 21 nt, Homo sapiens
uuuggcacuugccauuccaaa

SEQ ID NO: 739217 - RNA, 18 nt, Homo sapiens
uuuggcaguucaaaagac

SEQ ID NO: 739218 - RNA, 14 nt, Homo sapiens
uuuggccauuccaa

SEQ ID NO: 739219 - RNA, 15 nt, Homo sapiens
uuuggcucaacuuca

SEQ ID NO: 739220 - RNA, 16 nt, Homo sapiens
uuugggauaacuucaa

SEQ ID NO: 739221 - RNA, 14 nt, Homo sapiens
uuugggccagacau

SEQ ID NO: 739222 - RNA, 13 nt, Homo sapiens
uuugggcugucuu

SEQ ID NO: 739223 - RNA, 22 nt, Homo sapiens
uuuggggagaaauaaauuuugu

SEQ ID NO: 739224 - RNA, 16 nt, Homo sapiens
uuuggggccucaagaa

SEQ ID NO: 739225 - RNA, 20 nt, Homo sapiens
uuuggggcucagaguggggu

SEQ ID NO: 739226 - RNA, 17 nt, Homo sapiens
uuuggguuuugggucuu

SEQ ID NO: 739227 - RNA, 21 nt, Homo sapiens
uuugguagaaggacugaacaa

SEQ ID NO: 739228 - RNA, 16 nt, Homo sapiens
uuuggucauagcauuc

SEQ ID NO: 739229 - RNA, 17 nt, Homo sapiens
uuugguuggcagcauuc

SEQ ID NO: 739230 - RNA, 13 nt, Homo sapiens
uuugguuugaccc

SEQ ID NO: 739231 - RNA, 18 nt, Homo sapiens
uuuguaaaacaaugccau

SEQ ID NO: 739232 - RNA, 16 nt, Homo sapiens
uuuguaaaacauuagu

SEQ ID NO: 739233 - RNA, 17 nt, Homo sapiens
uuuguaaacgacaagaa

SEQ ID NO: 739234 - RNA, 17 nt, Homo sapiens
uuuguaaaucugccaca

SEQ ID NO: 739235 - RNA, 18 nt, Homo sapiens
uuuguaaaucugccacaa

SEQ ID NO: 739236 - RNA, 16 nt, Homo sapiens
uuuguaaccauaugau

SEQ ID NO: 739237 - RNA, 23 nt, Homo sapiens
uuuguaagaaauaacacugugaa

SEQ ID NO: 739238 - RNA, 19 nt, Homo sapiens
uuuguagcucuggaccugu

SEQ ID NO: 739239 - RNA, 17 nt, Homo sapiens
uuuguaggagacuugcc

SEQ ID NO: 739240 - RNA, 17 nt, Homo sapiens
uuuguaugacagugaag

SEQ ID NO: 739241 - RNA, 19 nt, Homo sapiens
uuuguauuauuucaccagc

SEQ ID NO: 739242 - RNA, 14 nt, Homo sapiens
uuuguauucaugaa

SEQ ID NO: 739243 - RNA, 20 nt, Homo sapiens
uuuguauuuugcauacucaa

SEQ ID NO: 739244 - RNA, 19 nt, Homo sapiens
uuugucagaaaagagccac

SEQ ID NO: 739245 - RNA, 22 nt, Homo sapiens
uuuguccaucagauucugugag

SEQ ID NO: 739246 - RNA, 14 nt, Homo sapiens
uuuguccuacauuc

SEQ ID NO: 739247 - RNA, 19 nt, Homo sapiens
uuuguccuggucaugcaca

SEQ ID NO: 739248 - RNA, 22 nt, Homo sapiens
uuugucuguacucaugucauuc

SEQ ID NO: 739249 - RNA, 14 nt, Homo sapiens
uuugugaacucaaa

SEQ ID NO: 739250 - RNA, 19 nt, Homo sapiens
uuugugaaguauucacaaa

SEQ ID NO: 739251 - RNA, 16 nt, Homo sapiens
uuuguggucacagcca

SEQ ID NO: 739252 - RNA, 18 nt, Homo sapiens
uuugugucaaaaggacau

SEQ ID NO: 739253 - RNA, 11 nt, Homo sapiens
uuugugugauc

SEQ ID NO: 739254 - RNA, 20 nt, Homo sapiens
uuuguguguaccugugacua

SEQ ID NO: 739255 - RNA, 21 nt, Homo sapiens
uuuguguucuguuuguuaaaa

SEQ ID NO: 739256 - RNA, 18 nt, Homo sapiens
uuuguuacauaaggauga

SEQ ID NO: 739257 - RNA, 12 nt, Homo sapiens
uuuguuacugau

SEQ ID NO: 739258 - RNA, 15 nt, Homo sapiens
uuuguuagcaaagau

SEQ ID NO: 739259 - RNA, 21 nt, Homo sapiens
uuuguuauauauaauaaauac

SEQ ID NO: 739260 - RNA, 23 nt, Homo sapiens
uuuguuccccuccuccacucucc

SEQ ID NO: 739261 - RNA, 12 nt, Homo sapiens
uuuguugcccag

SEQ ID NO: 739262 - RNA, 16 nt, Homo sapiens
uuuguuucauauauac

SEQ ID NO: 739263 - RNA, 21 nt, Homo sapiens
uuuguuugccaggacaugcaa

SEQ ID NO: 739264 - RNA, 18 nt, Homo sapiens
uuuuaaagagcauggaaa

SEQ ID NO: 739265 - RNA, 23 nt, Homo sapiens
uuuuaaauaaaaauaaguguaca

SEQ ID NO: 739266 - RNA, 19 nt, Homo sapiens
uuuuaacacuucuagaucu

SEQ ID NO: 739267 - RNA, 12 nt, Homo sapiens
uuuuaacugcau

SEQ ID NO: 739268 - RNA, 20 nt, Homo sapiens
ucuucugaacucaaacugag

SEQ ID NO: 739269 - RNA, 24 nt, Homo sapiens
ucuucuuugcccacaaugcuuugc

SEQ ID NO: 739270 - RNA, 23 nt, Homo sapiens
ucuugaagaaaauucagaaugaa

SEQ ID NO: 739271 - RNA, 17 nt, Homo sapiens
ucuugaauauuugccac

SEQ ID NO: 739272 - RNA, 20 nt, Homo sapiens
ucuugaauccuuccauucca

SEQ ID NO: 739273 - RNA, 20 nt, Homo sapiens
ucuugacauucaaggcauuu

SEQ ID NO: 739274 - RNA, 15 nt, Homo sapiens
ucuugacuuccccac

SEQ ID NO: 739275 - RNA, 14 nt, Homo sapiens
ucuugagagcugcu

SEQ ID NO: 739276 - RNA, 14 nt, Homo sapiens
ucuugauguaaaau

SEQ ID NO: 739277 - RNA, 24 nt, Homo sapiens
ucuugcacagucacugcucuucag

SEQ ID NO: 739278 - RNA, 13 nt, Homo sapiens
ucuugcaccccaa

SEQ ID NO: 739279 - RNA, 14 nt, Homo sapiens
ucuugccacugcac

SEQ ID NO: 739280 - RNA, 13 nt, Homo sapiens
ucuugccaucacu

SEQ ID NO: 739281 - RNA, 13 nt, Homo sapiens
ucuugccaugugc

SEQ ID NO: 739282 - RNA, 23 nt, Homo sapiens
ucuugccuaaggugcguagucca

SEQ ID NO: 739283 - RNA, 19 nt, Homo sapiens
ucuugcuagacacacucca

SEQ ID NO: 739284 - RNA, 19 nt, Homo sapiens
ucuugcucugccacccagg

SEQ ID NO: 739285 - RNA, 17 nt, Homo sapiens
ucuugcugggcauacuu

SEQ ID NO: 739286 - RNA, 23 nt, Homo sapiens
ucuuggaaagacacaaaaaaaga

SEQ ID NO: 739287 - RNA, 20 nt, Homo sapiens
ucuuggagaaaauaacaaga

SEQ ID NO: 739288 - RNA, 15 nt, Homo sapiens
ucuuggauuaccaau

SEQ ID NO: 739289 - RNA, 16 nt, Homo sapiens
ucuuggccuaaaccuc

SEQ ID NO: 739290 - RNA, 20 nt, Homo sapiens
ucuuggcguauuuauacuca

SEQ ID NO: 739291 - RNA, 20 nt, Homo sapiens
ucuugggcuacuggcagcuc

SEQ ID NO: 739292 - RNA, 12 nt, Homo sapiens
ucuuggggacua

SEQ ID NO: 739293 - RNA, 20 nt, Homo sapiens
ucuuggggacuaacccaaug

SEQ ID NO: 739294 - RNA, 18 nt, Homo sapiens
ucuuggggcccagugcau

SEQ ID NO: 739295 - RNA, 12 nt, Homo sapiens
ucuugguauuau

SEQ ID NO: 739296 - RNA, 15 nt, Homo sapiens
ucuuguaaaucuuuu

SEQ ID NO: 739297 - RNA, 22 nt, Homo sapiens
ucuuguaagucaucuacuuaau

SEQ ID NO: 739298 - RNA, 16 nt, Homo sapiens
ucuuguagaugcauua

SEQ ID NO: 739299 - RNA, 17 nt, Homo sapiens
ucuuguauacacauaua

SEQ ID NO: 739300 - RNA, 20 nt, Homo sapiens
ucuuguauacacauauauac

SEQ ID NO: 739301 - RNA, 13 nt, Homo sapiens
ucuugugaacugu

SEQ ID NO: 739302 - RNA, 21 nt, Homo sapiens
ucuugugguaacuugcugcuu

SEQ ID NO: 739303 - RNA, 14 nt, Homo sapiens
ucuuguggugcauu

SEQ ID NO: 739304 - RNA, 15 nt, Homo sapiens
ucuuguuacugcuga

SEQ ID NO: 739305 - RNA, 14 nt, Homo sapiens
ucuuguuacuguga

SEQ ID NO: 739306 - RNA, 15 nt, Homo sapiens
ucuuguuacugugau

SEQ ID NO: 739307 - RNA, 17 nt, Homo sapiens
ucuuguugagugccagc

SEQ ID NO: 739308 - RNA, 16 nt, Homo sapiens
ucuuguuguuauugau

SEQ ID NO: 739309 - RNA, 19 nt, Homo sapiens
ucuuuaaaaacucacuuac

SEQ ID NO: 739310 - RNA, 21 nt, Homo sapiens
ucuuuaaaccacuaaaauaca

SEQ ID NO: 739311 - RNA, 14 nt, Homo sapiens
ucuuuaacauacau

SEQ ID NO: 739312 - RNA, 18 nt, Homo sapiens
ucuuuaacauacaucuaa

SEQ ID NO: 739313 - RNA, 16 nt, Homo sapiens
ugaaagugacagagac

SEQ ID NO: 739314 - RNA, 13 nt, Homo sapiens
ugaaaguggacaa

SEQ ID NO: 739315 - RNA, 18 nt, Homo sapiens
ugaaauaauuacagaaua

SEQ ID NO: 739316 - RNA, 14 nt, Homo sapiens
ugaaauaccacaag

SEQ ID NO: 739317 - RNA, 15 nt, Homo sapiens
ugaaaucaacugaca

SEQ ID NO: 739318 - RNA, 19 nt, Homo sapiens
ugaaaucugcuagaaaguu

SEQ ID NO: 739319 - RNA, 21 nt, Homo sapiens
ugaaaugaccaagacagguuc

SEQ ID NO: 739320 - RNA, 18 nt, Homo sapiens
ugaaaugccacugggaca

SEQ ID NO: 739321 - RNA, 13 nt, Homo sapiens
ugaaaugcucuuu

SEQ ID NO: 739322 - RNA, 17 nt, Homo sapiens
ugaaauguagaauugaa

SEQ ID NO: 739323 - RNA, 22 nt, Homo sapiens
ugaaauguaggcaucaugcaug

SEQ ID NO: 739324 - RNA, 17 nt, Homo sapiens
ugaaauguaugugcucu

SEQ ID NO: 739325 - RNA, 17 nt, Homo sapiens
ugaaauguuugcauaaa

SEQ ID NO: 739326 - RNA, 19 nt, Homo sapiens
ugaaauuacggguaccuga

SEQ ID NO: 739327 - RNA, 17 nt, Homo sapiens
ugaaauucacaguaaua

SEQ ID NO: 739328 - RNA, 13 nt, Homo sapiens
ugaaauucuuccu

SEQ ID NO: 739329 - RNA, 19 nt, Homo sapiens
ugaaauugcauacuuugua

SEQ ID NO: 739330 - RNA, 16 nt, Homo sapiens
ugaaauugcuuugcug

SEQ ID NO: 739331 - RNA, 16 nt, Homo sapiens
ugaaauugguuuucca

SEQ ID NO: 739332 - RNA, 16 nt, Homo sapiens
ugaaauuguaucucag

SEQ ID NO: 739333 - RNA, 14 nt, Homo sapiens
ugaaauuuacaguu

SEQ ID NO: 739334 - RNA, 16 nt, Homo sapiens
ugaaauuuauucacau

SEQ ID NO: 739335 - RNA, 16 nt, Homo sapiens
ugaaauuuuaauugaa

SEQ ID NO: 739336 - RNA, 20 nt, Homo sapiens
ugaaauuuuagaaauauuca

SEQ ID NO: 739337 - RNA, 20 nt, Homo sapiens
ugaacaaagacuacuaauga

SEQ ID NO: 739338 - RNA, 18 nt, Homo sapiens
ugaacaagauuucccuaa

SEQ ID NO: 739339 - RNA, 13 nt, Homo sapiens
ugaacacacugug

SEQ ID NO: 739340 - RNA, 12 nt, Homo sapiens
ugaacacaucuu

SEQ ID NO: 739341 - RNA, 15 nt, Homo sapiens
ugaacacuagccaga

SEQ ID NO: 739342 - RNA, 12 nt, Homo sapiens
ugaacacucccc

SEQ ID NO: 739343 - RNA, 12 nt, Homo sapiens
ugaacacugggg

SEQ ID NO: 739344 - RNA, 15 nt, Homo sapiens
ugaacagaaaugcau

SEQ ID NO: 739345 - RNA, 11 nt, Homo sapiens
ugaacagaauu

SEQ ID NO: 739346 - RNA, 20 nt, Homo sapiens
ugaacagccacgucagcuuu

SEQ ID NO: 739347 - RNA, 19 nt, Homo sapiens
ugaacagcuugcugucacu

SEQ ID NO: 739348 - RNA, 23 nt, Homo sapiens
ugaacaggaauccuuacugauau

SEQ ID NO: 739349 - RNA, 18 nt, Homo sapiens
ugaacaguguauaggaag

SEQ ID NO: 739350 - RNA, 23 nt, Homo sapiens
ugaacauaggaaaauagaaacuu

SEQ ID NO: 739351 - RNA, 14 nt, Homo sapiens
ugaacauauguaau

SEQ ID NO: 739352 - RNA, 11 nt, Homo sapiens
ugaacaucucu

SEQ ID NO: 739353 - RNA, 17 nt, Homo sapiens
ugaacauguucuccauu

SEQ ID NO: 739354 - RNA, 20 nt, Homo sapiens
ugaacauguuuugagauuuu

SEQ ID NO: 739355 - RNA, 22 nt, Homo sapiens
ugaacauuuaucaaucaguaua

SEQ ID NO: 739356 - RNA, 12 nt, Homo sapiens
ugaaccaaagaa

SEQ ID NO: 739357 - RNA, 15 nt, Homo sapiens
ugaacccagaaggca

SEQ ID NO: 739358 - RNA, 15 nt, Homo sapiens
ugaaccuauaagcag

SEQ ID NO: 739359 - RNA, 19 nt, Homo sapiens
ugaacguggggugagggau

SEQ ID NO: 739360 - RNA, 14 nt, Homo sapiens
ugaacuaacugaca

SEQ ID NO: 739361 - RNA, 14 nt, Homo sapiens
ugaacuacacugca

SEQ ID NO: 739362 - RNA, 14 nt, Homo sapiens
ugaacuaccaucug

SEQ ID NO: 739363 - RNA, 22 nt, Homo sapiens
ugaacuagauugcaugcuuccu

SEQ ID NO: 739364 - RNA, 19 nt, Homo sapiens
ugaacucccagaaccacua

SEQ ID NO: 739365 - RNA, 16 nt, Homo sapiens
ugaacuccuuccccac

SEQ ID NO: 739366 - RNA, 22 nt, Homo sapiens
ugaacucuuucuggccugccuu

SEQ ID NO: 739367 - RNA, 18 nt, Homo sapiens
ugaacugaaggcucagau

SEQ ID NO: 739368 - RNA, 17 nt, Homo sapiens
ugaacugagccuagcua

SEQ ID NO: 739369 - RNA, 18 nt, Homo sapiens
ugaacuggcuuguacauu

SEQ ID NO: 739370 - RNA, 17 nt, Homo sapiens
ugaacuugcauugugau

SEQ ID NO: 739371 - RNA, 24 nt, Homo sapiens
ugaacuuggaaagaaaugcccauc

SEQ ID NO: 739372 - RNA, 17 nt, Homo sapiens
ugaagaacccugcaggg

SEQ ID NO: 739373 - RNA, 12 nt, Homo sapiens
ugaagaaguagu

SEQ ID NO: 739374 - RNA, 17 nt, Homo sapiens
ugaagaauacacuguga

SEQ ID NO: 739375 - RNA, 19 nt, Homo sapiens
ugaagaauacacugugacu

SEQ ID NO: 739376 - RNA, 13 nt, Homo sapiens
ugaagaauguaga

SEQ ID NO: 739377 - RNA, 19 nt, Homo sapiens
ugaagacccccuccaaaga

SEQ ID NO: 739378 - RNA, 12 nt, Homo sapiens
ugaagacugggu

SEQ ID NO: 739379 - RNA, 14 nt, Homo sapiens
ugaagagauuucaa

SEQ ID NO: 739380 - RNA, 19 nt, Homo sapiens
ugaagagauuucaacaaga

SEQ ID NO: 739381 - RNA, 15 nt, Homo sapiens
ugaagagcuauuaua

SEQ ID NO: 739382 - RNA, 22 nt, Homo sapiens
ugaagaggaagggcaaaaccac

SEQ ID NO: 739383 - RNA, 22 nt, Homo sapiens
ugaagaggcugcuucucuacag

SEQ ID NO: 739384 - RNA, 18 nt, Homo sapiens
ugaagaggguugguauaa

SEQ ID NO: 739385 - RNA, 21 nt, Homo sapiens
ugaagaguuuacugaagcaaa

SEQ ID NO: 739386 - RNA, 19 nt, Homo sapiens
ugaagauucuccugugcua

SEQ ID NO: 739387 - RNA, 16 nt, Homo sapiens
ugaagcaaaucagaaa

SEQ ID NO: 739388 - RNA, 23 nt, Homo sapiens
ugaagcaaaucagaaacuuguga

SEQ ID NO: 739389 - RNA, 15 nt, Homo sapiens
ugaagcagcacugug

SEQ ID NO: 739390 - RNA, 18 nt, Homo sapiens
ugaagcagucagcccuua

SEQ ID NO: 739391 - RNA, 17 nt, Homo sapiens
ugaagcagucuugcucu

SEQ ID NO: 739392 - RNA, 14 nt, Homo sapiens
ugaagcugagcuuu

SEQ ID NO: 739393 - RNA, 15 nt, Homo sapiens
ugaaggaacauuccu

SEQ ID NO: 739394 - RNA, 18 nt, Homo sapiens
ugaaggauuuguguuuua

SEQ ID NO: 739395 - RNA, 21 nt, Homo sapiens
ugaaggcaaaaacuguacugu

SEQ ID NO: 739396 - RNA, 16 nt, Homo sapiens
ugaaggcaucaaauaa

SEQ ID NO: 739397 - RNA, 15 nt, Homo sapiens
ugaaggcccugcuga

SEQ ID NO: 739398 - RNA, 21 nt, Homo sapiens
ugaaggccucuuguugagugc

SEQ ID NO: 739399 - RNA, 23 nt, Homo sapiens
ugaaggcugucaggauucuucaa

SEQ ID NO: 739400 - RNA, 13 nt, Homo sapiens
ugaaggggccaug

SEQ ID NO: 739401 - RNA, 20 nt, Homo sapiens
ugaaggggguggggaagaag

SEQ ID NO: 739402 - RNA, 19 nt, Homo sapiens
ugaaggugauucaccaaaa

SEQ ID NO: 739403 - RNA, 19 nt, Homo sapiens
ugaaggugcuggaaaggga

SEQ ID NO: 739404 - RNA, 23 nt, Homo sapiens
ugaaguaaugaauuuuuaugaua

SEQ ID NO: 739405 - RNA, 17 nt, Homo sapiens
ugaagucaucagcuuug

SEQ ID NO: 739406 - RNA, 16 nt, Homo sapiens
ugaagugcuguggcug

SEQ ID NO: 739407 - RNA, 19 nt, Homo sapiens
ugaagugcuuaguguacuu

SEQ ID NO: 739408 - RNA, 18 nt, Homo sapiens
ugaaguguauaugauucu

SEQ ID NO: 739409 - RNA, 17 nt, Homo sapiens
ugaagugucacagccug

SEQ ID NO: 739410 - RNA, 16 nt, Homo sapiens
ugaaguucaucuugca

SEQ ID NO: 739411 - RNA, 17 nt, Homo sapiens
ugaaguuuacauuguaa

SEQ ID NO: 739412 - RNA, 14 nt, Homo sapiens
ugaauaaaacaaua

SEQ ID NO: 739413 - RNA, 16 nt, Homo sapiens
ugaauaaaagugcaca

SEQ ID NO: 739414 - RNA, 22 nt, Homo sapiens
ugaauaaaguguaaguucacaa

SEQ ID NO: 739415 - RNA, 19 nt, Homo sapiens
ugaauaaaguugaagcuaa

SEQ ID NO: 739416 - RNA, 18 nt, Homo sapiens
ugaauaaauugaacuaaa

SEQ ID NO: 739417 - RNA, 14 nt, Homo sapiens
ugaauacugcuaca

SEQ ID NO: 739418 - RNA, 23 nt, Homo sapiens
ugaauagccaggccugaccucaa

SEQ ID NO: 739419 - RNA, 23 nt, Homo sapiens
ugaauauaaauguuuuacucaga

SEQ ID NO: 739420 - RNA, 20 nt, Homo sapiens
ugaauaucgagaacugccau

SEQ ID NO: 739421 - RNA, 22 nt, Homo sapiens
ugaauaucugccccaguaguca

SEQ ID NO: 739422 - RNA, 13 nt, Homo sapiens
ugaauauucccaa

SEQ ID NO: 739423 - RNA, 13 nt, Homo sapiens
ugaaucacuucug

SEQ ID NO: 739424 - RNA, 19 nt, Homo sapiens
ugaaucauauucauaugca

SEQ ID NO: 739425 - RNA, 18 nt, Homo sapiens
ugaauccaaaucuguccu

SEQ ID NO: 739426 - RNA, 14 nt, Homo sapiens
ugaaucuaugccaa

SEQ ID NO: 739427 - RNA, 13 nt, Homo sapiens
ugaaucuauuaua

SEQ ID NO: 739428 - RNA, 14 nt, Homo sapiens
uggagccugccaag

SEQ ID NO: 739429 - RNA, 18 nt, Homo sapiens
uggaggacggucagucca

SEQ ID NO: 739430 - RNA, 19 nt, Homo sapiens
uggaggaggaaggcaagag

SEQ ID NO: 739431 - RNA, 20 nt, Homo sapiens
uggaggaucauuugagccca

SEQ ID NO: 739432 - RNA, 16 nt, Homo sapiens
uggaggcagcagcucc

SEQ ID NO: 739433 - RNA, 21 nt, Homo sapiens
uggaggccaagaacuugcaau

SEQ ID NO: 739434 - RNA, 22 nt, Homo sapiens
uggaggccaagaacuugcaaua

SEQ ID NO: 739435 - RNA, 22 nt, Homo sapiens
uggaggcccaguucacccugau

SEQ ID NO: 739436 - RNA, 22 nt, Homo sapiens
uggagggaaggauaaagccacu

SEQ ID NO: 739437 - RNA, 23 nt, Homo sapiens
uggagggagaagcuagagcuuca

SEQ ID NO: 739438 - RNA, 20 nt, Homo sapiens
uggaggugggcaaagggaag

SEQ ID NO: 739439 - RNA, 16 nt, Homo sapiens
uggagguugaagccaa

SEQ ID NO: 739440 - RNA, 15 nt, Homo sapiens
uggagguugcaguga

SEQ ID NO: 739441 - RNA, 23 nt, Homo sapiens
uggaguacuuagcuaguuuuauu

SEQ ID NO: 739442 - RNA, 22 nt, Homo sapiens
uggaguccccucaccuccucua

SEQ ID NO: 739443 - RNA, 13 nt, Homo sapiens
uggagugauucuc

SEQ ID NO: 739444 - RNA, 22 nt, Homo sapiens
uggaguuuaauacagugagcuc

SEQ ID NO: 739445 - RNA, 15 nt, Homo sapiens
uggauaaaaugaggu

SEQ ID NO: 739446 - RNA, 17 nt, Homo sapiens
uggauaaagaccuucca

SEQ ID NO: 739447 - RNA, 13 nt, Homo sapiens
uggauacuaagca

SEQ ID NO: 739448 - RNA, 18 nt, Homo sapiens
uggauaucaaaagcaaau

SEQ ID NO: 739449 - RNA, 13 nt, Homo sapiens
uggauaugcugcu

SEQ ID NO: 739450 - RNA, 22 nt, Homo sapiens
uggaucaaaaaugaaucacuuc

SEQ ID NO: 739451 - RNA, 17 nt, Homo sapiens
uggaucacucaccauuc

SEQ ID NO: 739452 - RNA, 23 nt, Homo sapiens
uggauccugggucaaaaaaaaga

SEQ ID NO: 739453 - RNA, 12 nt, Homo sapiens
uggaucugugag

SEQ ID NO: 739454 - RNA, 21 nt, Homo sapiens
uggaucuuauacccaacacac

SEQ ID NO: 739455 - RNA, 13 nt, Homo sapiens
uggaugacagaga

SEQ ID NO: 739456 - RNA, 19 nt, Homo sapiens
uggaugaggagacagaaua

SEQ ID NO: 739457 - RNA, 19 nt, Homo sapiens
uggaugcacagaugccaug

SEQ ID NO: 739458 - RNA, 13 nt, Homo sapiens
uggaugcagcucu

SEQ ID NO: 739459 - RNA, 19 nt, Homo sapiens
uggaugcaugcccuaagag

SEQ ID NO: 739460 - RNA, 17 nt, Homo sapiens
uggaugcgcagugccuu

SEQ ID NO: 739461 - RNA, 16 nt, Homo sapiens
uggauggaaagggagg

SEQ ID NO: 739462 - RNA, 16 nt, Homo sapiens
uggauggcaccucagg

SEQ ID NO: 739463 - RNA, 23 nt, Homo sapiens
uggauggccgggcugcugcugau

SEQ ID NO: 739464 - RNA, 16 nt, Homo sapiens
uggauguaaagugugg

SEQ ID NO: 739465 - RNA, 18 nt, Homo sapiens
uggaugucgaugacuuca

SEQ ID NO: 739466 - RNA, 23 nt, Homo sapiens
uggaugucuccaucucugucuca

SEQ ID NO: 739467 - RNA, 23 nt, Homo sapiens
uggaugugguuuaauuguuuguc

SEQ ID NO: 739468 - RNA, 13 nt, Homo sapiens
uggauuaauguca

SEQ ID NO: 739469 - RNA, 16 nt, Homo sapiens
uggauuacuauugcaa

SEQ ID NO: 739470 - RNA, 14 nt, Homo sapiens
uggauucaacacug

SEQ ID NO: 739471 - RNA, 17 nt, Homo sapiens
uggauucauauaggcca

SEQ ID NO: 739472 - RNA, 15 nt, Homo sapiens
uggauucaucagcau

SEQ ID NO: 739473 - RNA, 17 nt, Homo sapiens
uggauucuuaaccaaga

SEQ ID NO: 739474 - RNA, 12 nt, Homo sapiens
uggauugagggu

SEQ ID NO: 739475 - RNA, 15 nt, Homo sapiens
uggauugcacguggc

SEQ ID NO: 739476 - RNA, 21 nt, Homo sapiens
uggauuggguaugucuaccug

SEQ ID NO: 739477 - RNA, 15 nt, Homo sapiens
uggauugugguucca

SEQ ID NO: 739478 - RNA, 22 nt, Homo sapiens
uggauuucacaccccauucuca

SEQ ID NO: 739479 - RNA, 17 nt, Homo sapiens
uggauuucauacuguaa

SEQ ID NO: 739480 - RNA, 16 nt, Homo sapiens
uggauuugauucauuu

SEQ ID NO: 739481 - RNA, 21 nt, Homo sapiens
uggauuuuacauguggcccaa

SEQ ID NO: 739482 - RNA, 19 nt, Homo sapiens
uggauuuucuuucuaugua

SEQ ID NO: 739483 - RNA, 13 nt, Homo sapiens
uggcaaaagaaaa

SEQ ID NO: 739484 - RNA, 14 nt, Homo sapiens
uggcaaagccuuca

SEQ ID NO: 739485 - RNA, 23 nt, Homo sapiens
uggcaacagaucuggaaccucag

SEQ ID NO: 739486 - RNA, 16 nt, Homo sapiens
uggcaacaucuuggcu

SEQ ID NO: 739487 - RNA, 20 nt, Homo sapiens
uggcaagucaguggggacag

SEQ ID NO: 739488 - RNA, 20 nt, Homo sapiens
uggcaaugaaaaauucucag

SEQ ID NO: 739489 - RNA, 19 nt, Homo sapiens
uggcacaguuuucugagaa

SEQ ID NO: 739490 - RNA, 22 nt, Homo sapiens
uggcacauggguggacacggau

SEQ ID NO: 739491 - RNA, 14 nt, Homo sapiens
uucuuaaagccuua

SEQ ID NO: 739492 - RNA, 14 nt, Homo sapiens
uucuuaacaaccga

SEQ ID NO: 739493 - RNA, 16 nt, Homo sapiens
uucuuaaccuuugcua

SEQ ID NO: 739494 - RNA, 21 nt, Homo sapiens
uucuuaagugcccacauuuga

SEQ ID NO: 739495 - RNA, 12 nt, Homo sapiens
uucuuacacugu

SEQ ID NO: 739496 - RNA, 14 nt, Homo sapiens
uucuuaguucauau

SEQ ID NO: 739497 - RNA, 23 nt, Homo sapiens
uucuuauuauuuuugagacagag

SEQ ID NO: 739498 - RNA, 19 nt, Homo sapiens
uucuucacagugcagugaa

SEQ ID NO: 739499 - RNA, 22 nt, Homo sapiens
uucuucaccuaagucucuguga

SEQ ID NO: 739500 - RNA, 16 nt, Homo sapiens
uucuucaccucuucca

SEQ ID NO: 739501 - RNA, 22 nt, Homo sapiens
uucuucaccucuuccacuccuu

SEQ ID NO: 739502 - RNA, 15 nt, Homo sapiens
uucuucacuuaccca

SEQ ID NO: 739503 - RNA, 14 nt, Homo sapiens
uucuucagagugaa

SEQ ID NO: 739504 - RNA, 17 nt, Homo sapiens
uucuucagcuugauccu

SEQ ID NO: 739505 - RNA, 14 nt, Homo sapiens
uucuucaugaggcc

SEQ ID NO: 739506 - RNA, 14 nt, Homo sapiens
uucuucaugaucca

SEQ ID NO: 739507 - RNA, 17 nt, Homo sapiens
uucuucaugcaaugaca

SEQ ID NO: 739508 - RNA, 12 nt, Homo sapiens
uucuucauuuca

SEQ ID NO: 739509 - RNA, 12 nt, Homo sapiens
uucuuccagaau

SEQ ID NO: 739510 - RNA, 19 nt, Homo sapiens
uucuucccagaaucucuga

SEQ ID NO: 739511 - RNA, 17 nt, Homo sapiens
uucuucuacucuugaga

SEQ ID NO: 739512 - RNA, 13 nt, Homo sapiens
uucuucuauucca

SEQ ID NO: 739513 - RNA, 15 nt, Homo sapiens
uucuucuccauuaau

SEQ ID NO: 739514 - RNA, 17 nt, Homo sapiens
uucuucucuuaauuuca

SEQ ID NO: 739515 - RNA, 15 nt, Homo sapiens
uucuucucuuauccu

SEQ ID NO: 739516 - RNA, 16 nt, Homo sapiens
uucuucuguccugaga

SEQ ID NO: 739517 - RNA, 22 nt, Homo sapiens
uucuucuucagaagacacugca

SEQ ID NO: 739518 - RNA, 23 nt, Homo sapiens
uucuugaguugucuuuugccauu

SEQ ID NO: 739519 - RNA, 20 nt, Homo sapiens
uucuugauuaaagugauuga

SEQ ID NO: 739520 - RNA, 18 nt, Homo sapiens
uucuugccuugaguucca

SEQ ID NO: 739521 - RNA, 20 nt, Homo sapiens
uucuugcuuucaauuacaaa

SEQ ID NO: 739522 - RNA, 13 nt, Homo sapiens
uucuuguauugua

SEQ ID NO: 739523 - RNA, 20 nt, Homo sapiens
uucuuguccucauucuugcc

SEQ ID NO: 739524 - RNA, 13 nt, Homo sapiens
uucuuguugauag

SEQ ID NO: 739525 - RNA, 15 nt, Homo sapiens
aaaaaaacauaucca

SEQ ID NO: 739526 - RNA, 22 nt, Homo sapiens
aaaaaaaccaaaacugugcaga

SEQ ID NO: 739527 - RNA, 14 nt, Homo sapiens
aaaaaacaacggug

SEQ ID NO: 739528 - RNA, 12 nt, Homo sapiens
aaaaaacagugg

SEQ ID NO: 739529 - RNA, 14 nt, Homo sapiens
aaaaaacucuugau

SEQ ID NO: 739530 - RNA, 13 nt, Homo sapiens
aaaaaacuuugac

SEQ ID NO: 739531 - RNA, 12 nt, Homo sapiens
aaaaaagccaaa

SEQ ID NO: 739532 - RNA, 14 nt, Homo sapiens
aaaaaagccuacau

SEQ ID NO: 739533 - RNA, 14 nt, Homo sapiens
aaaaaauacucugc

SEQ ID NO: 739534 - RNA, 22 nt, Homo sapiens
aaaaacaaugugcugcugcuuc

SEQ ID NO: 739535 - RNA, 21 nt, Homo sapiens
aaaaacauagaaaaauucagc

SEQ ID NO: 739536 - RNA, 16 nt, Homo sapiens
aaaaacaugucaugua

SEQ ID NO: 739537 - RNA, 13 nt, Homo sapiens
aaaaacauucuua

SEQ ID NO: 739538 - RNA, 18 nt, Homo sapiens
aaaaaccauaggcugcuc

SEQ ID NO: 739539 - RNA, 12 nt, Homo sapiens
aaaaaccugccu

SEQ ID NO: 739540 - RNA, 21 nt, Homo sapiens
aaaaacggcaguaucacagau

SEQ ID NO: 739541 - RNA, 17 nt, Homo sapiens
aaaaacguaucuccuaa

SEQ ID NO: 739542 - RNA, 12 nt, Homo sapiens
aaaaacuacuuc

SEQ ID NO: 739543 - RNA, 13 nt, Homo sapiens
aaaaacucacuua

SEQ ID NO: 739544 - RNA, 14 nt, Homo sapiens
aaaaacuguacugu

SEQ ID NO: 739545 - RNA, 15 nt, Homo sapiens
aaaaacuguacugug

SEQ ID NO: 739546 - RNA, 15 nt, Homo sapiens
aaaaacuuacuuugg

SEQ ID NO: 739547 - RNA, 12 nt, Homo sapiens
aaaaagaacaac

SEQ ID NO: 739548 - RNA, 12 nt, Homo sapiens
aaaaagauguac

SEQ ID NO: 739549 - RNA, 21 nt, Homo sapiens
aaaaagcaaagguuacaugug

SEQ ID NO: 739550 - RNA, 12 nt, Homo sapiens
aaaaagccaaaa

SEQ ID NO: 739551 - RNA, 17 nt, Homo sapiens
aaaaagccaguuugggu

SEQ ID NO: 739552 - RNA, 18 nt, Homo sapiens
aaaaaggaauuuuguaaa

SEQ ID NO: 739553 - RNA, 17 nt, Homo sapiens
aaaaaguauguucuaaa

SEQ ID NO: 739554 - RNA, 14 nt, Homo sapiens
aaaaaguauugcau

SEQ ID NO: 739555 - RNA, 13 nt, Homo sapiens
aaaaagucacaaa

SEQ ID NO: 739556 - RNA, 21 nt, Homo sapiens
aaaaagucaccaaauagugug

SEQ ID NO: 739557 - RNA, 14 nt, Homo sapiens
aaaaagugucucaa

SEQ ID NO: 739558 - RNA, 17 nt, Homo sapiens
aaaaauaaaguaccaca

SEQ ID NO: 739559 - RNA, 14 nt, Homo sapiens
aaaaauaacaucug

SEQ ID NO: 739560 - RNA, 18 nt, Homo sapiens
aaaaauacucugcuauuu

SEQ ID NO: 739561 - RNA, 11 nt, Homo sapiens
aaaaauacuuu

SEQ ID NO: 739562 - RNA, 19 nt, Homo sapiens
aaaaauauauuuaaugaua

SEQ ID NO: 739563 - RNA, 16 nt, Homo sapiens
aaaaauauuugcugag

SEQ ID NO: 739564 - RNA, 20 nt, Homo sapiens
aaaaauauuugcugagugaa

SEQ ID NO: 739565 - RNA, 14 nt, Homo sapiens
aaaaaucugagaaa

SEQ ID NO: 739566 - RNA, 17 nt, Homo sapiens
aaaaaucuuuucauuaa

SEQ ID NO: 739567 - RNA, 17 nt, Homo sapiens
aaaaaugaugggacaau

SEQ ID NO: 739568 - RNA, 12 nt, Homo sapiens
aaaaaugcugcu

SEQ ID NO: 739569 - RNA, 16 nt, Homo sapiens
aaaaaugggagccagg

SEQ ID NO: 739570 - RNA, 14 nt, Homo sapiens
aaaaauggguguua

SEQ ID NO: 739571 - RNA, 20 nt, Homo sapiens
aaaaauguauuuuuccuaaa

SEQ ID NO: 739572 - RNA, 12 nt, Homo sapiens
aaaaauugucau

SEQ ID NO: 739573 - RNA, 13 nt, Homo sapiens
aaaaauugucauu

SEQ ID NO: 739574 - RNA, 14 nt, Homo sapiens
aaaaauuuacuuga

SEQ ID NO: 739575 - RNA, 19 nt, Homo sapiens
aaaaauuuuggucauagca

SEQ ID NO: 739576 - RNA, 15 nt, Homo sapiens
aaaacaaugccauga

SEQ ID NO: 739577 - RNA, 14 nt, Homo sapiens
aaaacacaaagaag

SEQ ID NO: 739578 - RNA, 12 nt, Homo sapiens
aaaacaccacca

SEQ ID NO: 739579 - RNA, 17 nt, Homo sapiens
aaaacaccuagcuuuau

SEQ ID NO: 739580 - RNA, 15 nt, Homo sapiens
aaaacagacgggucu

SEQ ID NO: 739581 - RNA, 19 nt, Homo sapiens
aaaacaucuuuaaggggag

SEQ ID NO: 739582 - RNA, 19 nt, Homo sapiens
aaaacauucuuuaacauac

SEQ ID NO: 739583 - RNA, 19 nt, Homo sapiens
aaaacauugauuauaagca

SEQ ID NO: 739584 - RNA, 11 nt, Homo sapiens
aaaacauuucu

SEQ ID NO: 739585 - RNA, 18 nt, Homo sapiens
aaaaccaaaacugugcag

SEQ ID NO: 739586 - RNA, 18 nt, Homo sapiens
aaaaccacagucagugga

SEQ ID NO: 739587 - RNA, 22 nt, Homo sapiens
aaaaccuacacacauaccuuca

SEQ ID NO: 739588 - RNA, 23 nt, Homo sapiens
aaaaccuacacacauaccuucau

SEQ ID NO: 739589 - RNA, 20 nt, Homo sapiens
aaaaccucaugacagccaga

SEQ ID NO: 739590 - RNA, 11 nt, Homo sapiens
aaaaccugcuu

SEQ ID NO: 739591 - RNA, 18 nt, Homo sapiens
aaaaccugugugccauuu

SEQ ID NO: 739592 - RNA, 18 nt, Homo sapiens
aaaaccuucaagaucuca

SEQ ID NO: 739593 - RNA, 18 nt, Homo sapiens
aaaaccuuccuucccugg

SEQ ID NO: 739594 - RNA, 13 nt, Homo sapiens
aaaacgacacugc

SEQ ID NO: 739595 - RNA, 21 nt, Homo sapiens
aaaacgaugaaguuaugcugu

SEQ ID NO: 739596 - RNA, 14 nt, Homo sapiens
aaaacuaaccaucu

SEQ ID NO: 739597 - RNA, 19 nt, Homo sapiens
aaaacuacugauacuuuca

SEQ ID NO: 739598 - RNA, 13 nt, Homo sapiens
aaaacuagcauua

SEQ ID NO: 739599 - RNA, 19 nt, Homo sapiens
aaaacuaggaauccuccaa

SEQ ID NO: 739600 - RNA, 20 nt, Homo sapiens
aaaacuauccugauuccaaa

SEQ ID NO: 739601 - RNA, 21 nt, Homo sapiens
aaaacuccacagucaauauua

SEQ ID NO: 739602 - RNA, 11 nt, Homo sapiens
aaaacucuccu

SEQ ID NO: 739603 - RNA, 16 nt, Homo sapiens
aaaacugacauagaga

SEQ ID NO: 739604 - RNA, 11 nt, Homo sapiens
aaaacugccuc

SEQ ID NO: 739605 - RNA, 20 nt, Homo sapiens
aaaacugccuuuuaucugcc

SEQ ID NO: 739606 - RNA, 17 nt, Homo sapiens
aaaacugucauccuaac

SEQ ID NO: 739607 - RNA, 17 nt, Homo sapiens
aaaggggguaugugaua

SEQ ID NO: 739608 - RNA, 20 nt, Homo sapiens
aaagggucuuaugaaacaau

SEQ ID NO: 739609 - RNA, 23 nt, Homo sapiens
aaagguacgauuauacuugagau

SEQ ID NO: 739610 - RNA, 18 nt, Homo sapiens
aaagguagcuuaccugac

SEQ ID NO: 739611 - RNA, 23 nt, Homo sapiens
aaagguauuaaauugauguugcu

SEQ ID NO: 739612 - RNA, 15 nt, Homo sapiens
aaaggucagcccguu

SEQ ID NO: 739613 - RNA, 13 nt, Homo sapiens
aaaggugacuggg

SEQ ID NO: 739614 - RNA, 18 nt, Homo sapiens
aaaggugauugcagcuuu

SEQ ID NO: 739615 - RNA, 22 nt, Homo sapiens
aaaggugucuucuuugacuuaa

SEQ ID NO: 739616 - RNA, 16 nt, Homo sapiens
aaaggugugcugguca

SEQ ID NO: 739617 - RNA, 21 nt, Homo sapiens
aaagguuucauguucacugug

SEQ ID NO: 739618 - RNA, 22 nt, Homo sapiens
aaagguuuuaaccgcacaugca

SEQ ID NO: 739619 - RNA, 19 nt, Homo sapiens
aaaguaaaaacacuaccuc

SEQ ID NO: 739620 - RNA, 19 nt, Homo sapiens
aaaguaacagagcaucaaa

SEQ ID NO: 739621 - RNA, 22 nt, Homo sapiens
aaaguaaccugaacuaaucuga

SEQ ID NO: 739622 - RNA, 16 nt, Homo sapiens
aaaguaagacaucuca

SEQ ID NO: 739623 - RNA, 14 nt, Homo sapiens
aaaguaauugagug

SEQ ID NO: 739624 - RNA, 13 nt, Homo sapiens
aaaguacauaaca

SEQ ID NO: 739625 - RNA, 20 nt, Homo sapiens
aaaguagaauaagccuucaa

SEQ ID NO: 739626 - RNA, 21 nt, Homo sapiens
aaaguagaggaauccauguaa

SEQ ID NO: 739627 - RNA, 21 nt, Homo sapiens
aaaguauaaccauaugauacu

SEQ ID NO: 739628 - RNA, 17 nt, Homo sapiens
aaaguauauuuaacuca

SEQ ID NO: 739629 - RNA, 16 nt, Homo sapiens
aaaguauucuguacuc

SEQ ID NO: 739630 - RNA, 23 nt, Homo sapiens
aaaguauuuucuucucugugaga

SEQ ID NO: 739631 - RNA, 16 nt, Homo sapiens
aaagucacaggaagaa

SEQ ID NO: 739632 - RNA, 21 nt, Homo sapiens
aaagucacggcugcgcacugu

SEQ ID NO: 739633 - RNA, 14 nt, Homo sapiens
aaagucaucaaaga

SEQ ID NO: 739634 - RNA, 18 nt, Homo sapiens
aaaguccccuuaagccaa

SEQ ID NO: 739635 - RNA, 15 nt, Homo sapiens
aaagucgccagucac

SEQ ID NO: 739636 - RNA, 14 nt, Homo sapiens
aaagugacccuguu

SEQ ID NO: 739637 - RNA, 20 nt, Homo sapiens
aaagugagaaaaugccucaa

SEQ ID NO: 739638 - RNA, 19 nt, Homo sapiens
aaagugcuaguauuauggg

SEQ ID NO: 739639 - RNA, 20 nt, Homo sapiens
aaagugcugggauuacaggu

SEQ ID NO: 739640 - RNA, 15 nt, Homo sapiens
aaagugcuuuccaug

SEQ ID NO: 739641 - RNA, 19 nt, Homo sapiens
aaagugguaaauacuguga

SEQ ID NO: 739642 - RNA, 19 nt, Homo sapiens
aaaguguaacaauugugua

SEQ ID NO: 739643 - RNA, 17 nt, Homo sapiens
aaaguguaaguucacaa

SEQ ID NO: 739644 - RNA, 12 nt, Homo sapiens
aaagugucucaa

SEQ ID NO: 739645 - RNA, 12 nt, Homo sapiens
aaagugugaaug

SEQ ID NO: 739646 - RNA, 14 nt, Homo sapiens
aaagugugagcaaa

SEQ ID NO: 739647 - RNA, 17 nt, Homo sapiens
aaaguguugaccacaga

SEQ ID NO: 739648 - RNA, 17 nt, Homo sapiens
aaaguuacuauucugua

SEQ ID NO: 739649 - RNA, 22 nt, Homo sapiens
aaaguuagucaauccugucaua

SEQ ID NO: 739650 - RNA, 16 nt, Homo sapiens
aaaguucaacuuccaa

SEQ ID NO: 739651 - RNA, 19 nt, Homo sapiens
aaaguucaacuuccaaagg

SEQ ID NO: 739652 - RNA, 13 nt, Homo sapiens
aaaguuccagaaa

SEQ ID NO: 739653 - RNA, 18 nt, Homo sapiens
aaaguucccacuccuuca

SEQ ID NO: 739654 - RNA, 15 nt, Homo sapiens
aaaguuccuuccuaa

SEQ ID NO: 739655 - RNA, 22 nt, Homo sapiens
aaaguucucagaacuguuggcu

SEQ ID NO: 739656 - RNA, 16 nt, Homo sapiens
aaaguugagcgucauu

SEQ ID NO: 739657 - RNA, 16 nt, Homo sapiens
aaaguuuaaagacacu

SEQ ID NO: 739658 - RNA, 14 nt, Homo sapiens
aaaguuuacaacau

SEQ ID NO: 739659 - RNA, 20 nt, Homo sapiens
aaaguuuacauuguccugua

SEQ ID NO: 739660 - RNA, 19 nt, Homo sapiens
aaaguuuaucacacagugu

SEQ ID NO: 739661 - RNA, 14 nt, Homo sapiens
aaaguuucagagaa

SEQ ID NO: 739662 - RNA, 13 nt, Homo sapiens
aaaguuugacagg

SEQ ID NO: 739663 - RNA, 17 nt, Homo sapiens
aaaguuuuuaauuugau

SEQ ID NO: 739664 - RNA, 18 nt, Homo sapiens
aaauaaaaaggaaguacu

SEQ ID NO: 739665 - RNA, 16 nt, Homo sapiens
aaauaaaaaucucuuu

SEQ ID NO: 739666 - RNA, 23 nt, Homo sapiens
aaauaaaaauucauaaccaaaga

SEQ ID NO: 739667 - RNA, 13 nt, Homo sapiens
aaauaaaacugag

SEQ ID NO: 739668 - RNA, 14 nt, Homo sapiens
aaauaaacaucagu

SEQ ID NO: 739669 - RNA, 17 nt, Homo sapiens
aaauaaagauauuguuc

SEQ ID NO: 739670 - RNA, 20 nt, Homo sapiens
aaauaaaggcaaaguggaau

SEQ ID NO: 739671 - RNA, 18 nt, Homo sapiens
aaauaaaguaccacacau

SEQ ID NO: 739672 - RNA, 24 nt, Homo sapiens
aaauaaaguaccacacauauugca

SEQ ID NO: 739673 - RNA, 13 nt, Homo sapiens
aaauaaaugacaa

SEQ ID NO: 739674 - RNA, 16 nt, Homo sapiens
aaauaaauuugcacug

SEQ ID NO: 739675 - RNA, 16 nt, Homo sapiens
aaauaacuaccuucca

SEQ ID NO: 739676 - RNA, 20 nt, Homo sapiens
aaauaacuggaaaacagaac

SEQ ID NO: 739677 - RNA, 17 nt, Homo sapiens
aaauaagacuuccacuc

SEQ ID NO: 739678 - RNA, 20 nt, Homo sapiens
aaauaagcauguuuucacua

SEQ ID NO: 739679 - RNA, 23 nt, Homo sapiens
aaauaaggacaagccuaacuuca

SEQ ID NO: 739680 - RNA, 19 nt, Homo sapiens
aaauaaucacacacacacu

SEQ ID NO: 739681 - RNA, 21 nt, Homo sapiens
aaauaaucacacacacacuug

SEQ ID NO: 739682 - RNA, 23 nt, Homo sapiens
aaauaaucacacacacacuugcu

SEQ ID NO: 739683 - RNA, 20 nt, Homo sapiens
aaauaauuuuauuaugcaac

SEQ ID NO: 739684 - RNA, 21 nt, Homo sapiens
aaauacaaaaaauuagccaga

SEQ ID NO: 739685 - RNA, 16 nt, Homo sapiens
aaauacaaucagccca

SEQ ID NO: 739686 - RNA, 20 nt, Homo sapiens
aaauacaaucagcccagugc

SEQ ID NO: 739687 - RNA, 11 nt, Homo sapiens
aaauacaugua

SEQ ID NO: 739688 - RNA, 16 nt, Homo sapiens
aaauaccaacuguaca

SEQ ID NO: 739689 - RNA, 13 nt, Homo sapiens
aaauaccacugua

SEQ ID NO: 739690 - RNA, 15 nt, Homo sapiens
aaauaccacuguaau

SEQ ID NO: 739691 - RNA, 15 nt, Homo sapiens
aaauaccuuuucuca

SEQ ID NO: 739692 - RNA, 19 nt, Homo sapiens
aaauacuuuuacucugccu

SEQ ID NO: 739693 - RNA, 22 nt, Homo sapiens
aaauacuuuuguacuuaaucca

SEQ ID NO: 739694 - RNA, 15 nt, Homo sapiens
aaauagaacauucca

SEQ ID NO: 739695 - RNA, 17 nt, Homo sapiens
aaauagaaccacuauga

SEQ ID NO: 739696 - RNA, 15 nt, Homo sapiens
aaauagagaauccca

SEQ ID NO: 739697 - RNA, 22 nt, Homo sapiens
aaauagagcuuuuaaaaauguc

SEQ ID NO: 739698 - RNA, 15 nt, Homo sapiens
aaauagcugccuuuu

SEQ ID NO: 739699 - RNA, 19 nt, Homo sapiens
aaauaggcagaauggaauc

SEQ ID NO: 739700 - RNA, 13 nt, Homo sapiens
aaauauacauuca

SEQ ID NO: 739701 - RNA, 14 nt, Homo sapiens
aaauauacauucaa

SEQ ID NO: 739702 - RNA, 14 nt, Homo sapiens
aaauauacccauuu

SEQ ID NO: 739703 - RNA, 20 nt, Homo sapiens
aaauauauacccccccaugc

SEQ ID NO: 739704 - RNA, 14 nt, Homo sapiens
aaauauccauuuau

SEQ ID NO: 739705 - RNA, 18 nt, Homo sapiens
aaauauccuccaaugugu

SEQ ID NO: 739706 - RNA, 17 nt, Homo sapiens
aaauaucuugcuuucaa

SEQ ID NO: 739707 - RNA, 18 nt, Homo sapiens
aaauaucuuggccuaaac

SEQ ID NO: 739708 - RNA, 12 nt, Homo sapiens
aaauaugcaucu

SEQ ID NO: 739709 - RNA, 16 nt, Homo sapiens
aaauauuaacauucuu

SEQ ID NO: 739710 - RNA, 12 nt, Homo sapiens
aaauauuauuca

SEQ ID NO: 739711 - RNA, 23 nt, Homo sapiens
aaauauucgugguaucugugaac

SEQ ID NO: 739712 - RNA, 16 nt, Homo sapiens
aaauauuuccuuaaac

SEQ ID NO: 739713 - RNA, 16 nt, Homo sapiens
aaauauuucugauacu

SEQ ID NO: 739714 - RNA, 22 nt, Homo sapiens
aaauauuugagaauaaguucau

SEQ ID NO: 739715 - RNA, 16 nt, Homo sapiens
aaauauuuuaaaggua

SEQ ID NO: 739716 - RNA, 16 nt, Homo sapiens
aaauauuuugguucau

SEQ ID NO: 739717 - RNA, 14 nt, Homo sapiens
aaauauuuuugcca

SEQ ID NO: 739718 - RNA, 15 nt, Homo sapiens
aaauauuuuugccau

SEQ ID NO: 739719 - RNA, 11 nt, Homo sapiens
aaaucaaagau

SEQ ID NO: 739720 - RNA, 13 nt, Homo sapiens
aaaucaaauauuc

SEQ ID NO: 739721 - RNA, 18 nt, Homo sapiens
aaaucaauacacuaguug

SEQ ID NO: 739722 - RNA, 14 nt, Homo sapiens
aacaccacagacac

SEQ ID NO: 739723 - RNA, 20 nt, Homo sapiens
aacaccaggagagcuucucc

SEQ ID NO: 739724 - RNA, 14 nt, Homo sapiens
aacacuacagggga

SEQ ID NO: 739725 - RNA, 13 nt, Homo sapiens
aacacuaccucuu

SEQ ID NO: 739726 - RNA, 12 nt, Homo sapiens
aacacucaugaa

SEQ ID NO: 739727 - RNA, 16 nt, Homo sapiens
aacacugcagcccucu

SEQ ID NO: 739728 - RNA, 11 nt, Homo sapiens
aacacuggcau

SEQ ID NO: 739729 - RNA, 20 nt, Homo sapiens
aacacuuauguuauacaaua

SEQ ID NO: 739730 - RNA, 16 nt, Homo sapiens
aacacuucugcuuuca

SEQ ID NO: 739731 - RNA, 17 nt, Homo sapiens
aacacuuucugcacuua

SEQ ID NO: 739732 - RNA, 21 nt, Homo sapiens
aacagaaaccagaaaagcaau

SEQ ID NO: 739733 - RNA, 23 nt, Homo sapiens
aacagaaacgagauuugccaaaa

SEQ ID NO: 739734 - RNA, 12 nt, Homo sapiens
aacagaaagcau

SEQ ID NO: 739735 - RNA, 17 nt, Homo sapiens
aacagaaagcauccuaa

SEQ ID NO: 739736 - RNA, 20 nt, Homo sapiens
aacagaacuucacagugaca

SEQ ID NO: 739737 - RNA, 16 nt, Homo sapiens
aacagaagcuuccauu

SEQ ID NO: 739738 - RNA, 21 nt, Homo sapiens
aacagacgggucugagacuga

SEQ ID NO: 739739 - RNA, 13 nt, Homo sapiens
aacagacuugaau

SEQ ID NO: 739740 - RNA, 13 nt, Homo sapiens
aacagaggccaca

SEQ ID NO: 739741 - RNA, 19 nt, Homo sapiens
aacagaucaggaauucuaa

SEQ ID NO: 739742 - RNA, 21 nt, Homo sapiens
aacagauggauagucugucca

SEQ ID NO: 739743 - RNA, 22 nt, Homo sapiens
aacagauggauagucuguccaa

SEQ ID NO: 739744 - RNA, 17 nt, Homo sapiens
aacagauggcacuuuga

SEQ ID NO: 739745 - RNA, 21 nt, Homo sapiens
aacagauggggucugugacug

SEQ ID NO: 739746 - RNA, 20 nt, Homo sapiens
aacagauuuuguuggcauag

SEQ ID NO: 739747 - RNA, 22 nt, Homo sapiens
aacagcauuacccuccucucuc

SEQ ID NO: 739748 - RNA, 15 nt, Homo sapiens
aacagccaacuagcc

SEQ ID NO: 739749 - RNA, 21 nt, Homo sapiens
aacagccuaucuuugugugac

SEQ ID NO: 739750 - RNA, 23 nt, Homo sapiens
aacagccuucuagcacacuuuuu

SEQ ID NO: 739751 - RNA, 21 nt, Homo sapiens
aacagcgggagaccugugcua

SEQ ID NO: 739752 - RNA, 14 nt, Homo sapiens
aacagcucucaccu

SEQ ID NO: 739753 - RNA, 18 nt, Homo sapiens
aacaggaaggaaccagaa

SEQ ID NO: 739754 - RNA, 19 nt, Homo sapiens
aacaggaauucuauaguaa

SEQ ID NO: 739755 - RNA, 17 nt, Homo sapiens
aacaggcuguaauucca

SEQ ID NO: 739756 - RNA, 21 nt, Homo sapiens
aacaggcuguucugcacugaa

SEQ ID NO: 739757 - RNA, 15 nt, Homo sapiens
aacagggggcaaaga

SEQ ID NO: 739758 - RNA, 17 nt, Homo sapiens
aacagguaaaacagggc

SEQ ID NO: 739759 - RNA, 18 nt, Homo sapiens
aacagguuauaacagugu

SEQ ID NO: 739760 - RNA, 22 nt, Homo sapiens
aacaguaaaagccuuauucuaa

SEQ ID NO: 739761 - RNA, 16 nt, Homo sapiens
aacaguaacugccauc

SEQ ID NO: 739762 - RNA, 23 nt, Homo sapiens
aacaguagcuuagcaucagaggu

SEQ ID NO: 739763 - RNA, 11 nt, Homo sapiens
aacaguggcug

SEQ ID NO: 739764 - RNA, 19 nt, Homo sapiens
aacagugguggcaacauuc

SEQ ID NO: 739765 - RNA, 17 nt, Homo sapiens
aacagugucuugagcuc

SEQ ID NO: 739766 - RNA, 21 nt, Homo sapiens
aacaguucugagcuguaauuu

SEQ ID NO: 739767 - RNA, 21 nt, Homo sapiens
aacaguuguauguuugcugau

SEQ ID NO: 739768 - RNA, 22 nt, Homo sapiens
aacauaaaacaaaaccaagccu

SEQ ID NO: 739769 - RNA, 19 nt, Homo sapiens
aacauaagguacuagcagu

SEQ ID NO: 739770 - RNA, 18 nt, Homo sapiens
aacauaauguaucaugaa

SEQ ID NO: 739771 - RNA, 20 nt, Homo sapiens
aacauacacugugaacucaa

SEQ ID NO: 739772 - RNA, 12 nt, Homo sapiens
aacauacuucuu

SEQ ID NO: 739773 - RNA, 16 nt, Homo sapiens
aacauagagaucuaug

SEQ ID NO: 739774 - RNA, 20 nt, Homo sapiens
aacauauagcagaccaaucu

SEQ ID NO: 739775 - RNA, 13 nt, Homo sapiens
aacauauccaaaa

SEQ ID NO: 739776 - RNA, 12 nt, Homo sapiens
aacaucaaagau

SEQ ID NO: 739777 - RNA, 13 nt, Homo sapiens
aacaucaccacug

SEQ ID NO: 739778 - RNA, 21 nt, Homo sapiens
aacaucacugucuugccagau

SEQ ID NO: 739779 - RNA, 19 nt, Homo sapiens
aacaucaguuacucugaag

SEQ ID NO: 739780 - RNA, 18 nt, Homo sapiens
aacaucauaacccaugaa

SEQ ID NO: 739781 - RNA, 18 nt, Homo sapiens
aacaucauggacugagcu

SEQ ID NO: 739782 - RNA, 22 nt, Homo sapiens
aacaucauuccaaaaagaacaa

SEQ ID NO: 739783 - RNA, 13 nt, Homo sapiens
aacaucauugcau

SEQ ID NO: 739784 - RNA, 15 nt, Homo sapiens
aacaucccacagugg

SEQ ID NO: 739785 - RNA, 22 nt, Homo sapiens
aacaucgugaaaccccaucucu

SEQ ID NO: 739786 - RNA, 15 nt, Homo sapiens
aacaugacacugacc

SEQ ID NO: 739787 - RNA, 18 nt, Homo sapiens
aacaugacacugaccuug

SEQ ID NO: 739788 - RNA, 19 nt, Homo sapiens
aacaugauuguuuacagcu

SEQ ID NO: 739789 - RNA, 18 nt, Homo sapiens
aacaugcaaggcacugac

SEQ ID NO: 739790 - RNA, 14 nt, Homo sapiens
aacaugcacgguga

SEQ ID NO: 739791 - RNA, 16 nt, Homo sapiens
aacaugccauaucuca

SEQ ID NO: 739792 - RNA, 16 nt, Homo sapiens
aacaugcuugcauuau

SEQ ID NO: 739793 - RNA, 23 nt, Homo sapiens
aacauggugaaacccccaucucu

SEQ ID NO: 739794 - RNA, 14 nt, Homo sapiens
aacauguacuacag

SEQ ID NO: 739795 - RNA, 16 nt, Homo sapiens
aacauguacuacagcu

SEQ ID NO: 739796 - RNA, 14 nt, Homo sapiens
aacauguaugugca

SEQ ID NO: 739797 - RNA, 15 nt, Homo sapiens
aacauguaugugcau

SEQ ID NO: 739798 - RNA, 20 nt, Homo sapiens
aacauguuuuguauguuaaa

SEQ ID NO: 739799 - RNA, 16 nt, Homo sapiens
aacauuaguugcacua

SEQ ID NO: 739800 - RNA, 20 nt, Homo sapiens
aacauuccuguugaugggaa

SEQ ID NO: 739801 - RNA, 19 nt, Homo sapiens
aacauugcaauaaauggcu

SEQ ID NO: 739802 - RNA, 20 nt, Homo sapiens
aacauuguacuguaauggag

SEQ ID NO: 739803 - RNA, 15 nt, Homo sapiens
aacauuuacauguau

SEQ ID NO: 739804 - RNA, 20 nt, Homo sapiens
aacauuucucaaaugcacau

SEQ ID NO: 739805 - RNA, 20 nt, Homo sapiens
aacauuucuggacaguaccu

SEQ ID NO: 739806 - RNA, 16 nt, Homo sapiens
aacauuucuguucuca

SEQ ID NO: 739807 - RNA, 14 nt, Homo sapiens
aaccaaagucacaa

SEQ ID NO: 739808 - RNA, 19 nt, Homo sapiens
aaccaaagucacaaaucau

SEQ ID NO: 739809 - RNA, 14 nt, Homo sapiens
aaccaacaaaaaga

SEQ ID NO: 739810 - RNA, 20 nt, Homo sapiens
aaccaacagaaaacauccca

SEQ ID NO: 739811 - RNA, 23 nt, Homo sapiens
aaccaaccaccuuuccagccaua

SEQ ID NO: 739812 - RNA, 23 nt, Homo sapiens
aaccaaccuaagggcccaaaggc

SEQ ID NO: 739813 - RNA, 14 nt, Homo sapiens
aaccaagcaaauua

SEQ ID NO: 739814 - RNA, 22 nt, Homo sapiens
aaccaagccuuggcucguucuc

SEQ ID NO: 739815 - RNA, 17 nt, Homo sapiens
aaccaagcuguacccuu

SEQ ID NO: 739816 - RNA, 20 nt, Homo sapiens
aaccaauagugaaaugccac

SEQ ID NO: 739817 - RNA, 13 nt, Homo sapiens
aaccaaugcuuuc

SEQ ID NO: 739818 - RNA, 17 nt, Homo sapiens
aaccaauuuacacugcc

SEQ ID NO: 739819 - RNA, 17 nt, Homo sapiens
aaccacacaaagacauu

SEQ ID NO: 739820 - RNA, 14 nt, Homo sapiens
aaccacacuugaaa

SEQ ID NO: 739821 - RNA, 15 nt, Homo sapiens
aaccacaugugcaac

SEQ ID NO: 739822 - RNA, 12 nt, Homo sapiens
aaccacauuaua

SEQ ID NO: 739823 - RNA, 15 nt, Homo sapiens
aaccaccauagugaa

SEQ ID NO: 739824 - RNA, 14 nt, Homo sapiens
aaccacccagagug

SEQ ID NO: 739825 - RNA, 13 nt, Homo sapiens
aaccaccuuucca

SEQ ID NO: 739826 - RNA, 21 nt, Homo sapiens
aaccaccuuuccagccauaga

SEQ ID NO: 739827 - RNA, 15 nt, Homo sapiens
aaccacucauugucu

SEQ ID NO: 739828 - RNA, 11 nt, Homo sapiens
aaccacugugg

SEQ ID NO: 739829 - RNA, 21 nt, Homo sapiens
aaccacuuaaaaaauguccau

SEQ ID NO: 739830 - RNA, 19 nt, Homo sapiens
aaccagaaacaccccucug

SEQ ID NO: 739831 - RNA, 19 nt, Homo sapiens
aaccagacucuugccuguu

SEQ ID NO: 739832 - RNA, 16 nt, Homo sapiens
aaccagagcagcucac

SEQ ID NO: 739833 - RNA, 17 nt, Homo sapiens
aaccagggcucuucuca

SEQ ID NO: 739834 - RNA, 18 nt, Homo sapiens
aaccaguuaugugaauga

SEQ ID NO: 739835 - RNA, 20 nt, Homo sapiens
aaccauacacaggcuaucaa

SEQ ID NO: 739836 - RNA, 19 nt, Homo sapiens
aaccauaccuuccuucccu

SEQ ID NO: 739837 - RNA, 17 nt, Homo sapiens
aauucccuuuuaaucaa

SEQ ID NO: 739838 - RNA, 13 nt, Homo sapiens
aauuccucuggga

SEQ ID NO: 739839 - RNA, 16 nt, Homo sapiens
aauuccucuuacugua

SEQ ID NO: 739840 - RNA, 10 nt, Homo sapiens
aauuccuguu

SEQ ID NO: 739841 - RNA, 22 nt, Homo sapiens
aauuccuuagcuuagaccucag

SEQ ID NO: 739842 - RNA, 19 nt, Homo sapiens
aauucgugauuuucaagca

SEQ ID NO: 739843 - RNA, 23 nt, Homo sapiens
aauucuaacccagguauccaaaa

SEQ ID NO: 739844 - RNA, 21 nt, Homo sapiens
aauucuaaguuauuuacuuuu

SEQ ID NO: 739845 - RNA, 19 nt, Homo sapiens
aauucuaguauuuuaucug

SEQ ID NO: 739846 - RNA, 13 nt, Homo sapiens
aauucuagucaua

SEQ ID NO: 739847 - RNA, 15 nt, Homo sapiens
aauucuagugcugcu

SEQ ID NO: 739848 - RNA, 17 nt, Homo sapiens
aauucuauucugaucuu

SEQ ID NO: 739849 - RNA, 16 nt, Homo sapiens
aauucuccuguaacuc

SEQ ID NO: 739850 - RNA, 18 nt, Homo sapiens
aauucucuucgcugugau

SEQ ID NO: 739851 - RNA, 18 nt, Homo sapiens
aauucugagccugauauu

SEQ ID NO: 739852 - RNA, 15 nt, Homo sapiens
aauucugauguuucu

SEQ ID NO: 739853 - RNA, 16 nt, Homo sapiens
aauucugugacauaca

SEQ ID NO: 739854 - RNA, 17 nt, Homo sapiens
aauucuuacauguuuuc

SEQ ID NO: 739855 - RNA, 19 nt, Homo sapiens
aauucuuccuaaugucaga

SEQ ID NO: 739856 - RNA, 13 nt, Homo sapiens
aauucuuguagau

SEQ ID NO: 739857 - RNA, 20 nt, Homo sapiens
aauucuuuguauaugcauuc

SEQ ID NO: 739858 - RNA, 20 nt, Homo sapiens
aauucuuuuaucaaucccag

SEQ ID NO: 739859 - RNA, 18 nt, Homo sapiens
aauugaaaaguacaacua

SEQ ID NO: 739860 - RNA, 15 nt, Homo sapiens
aauugaaaaugcauu

SEQ ID NO: 739861 - RNA, 17 nt, Homo sapiens
aauugacaguugcagaa

SEQ ID NO: 739862 - RNA, 21 nt, Homo sapiens
aauugaccuuuugacuuaaag

SEQ ID NO: 739863 - RNA, 22 nt, Homo sapiens
aauugacuaccguuguuugcaa

SEQ ID NO: 739864 - RNA, 14 nt, Homo sapiens
aauugacucucaca

SEQ ID NO: 739865 - RNA, 19 nt, Homo sapiens
aauugacucucacacugaa

SEQ ID NO: 739866 - RNA, 13 nt, Homo sapiens
aauugagcauagu

SEQ ID NO: 739867 - RNA, 23 nt, Homo sapiens
aauugaguugcacuuauugacca

SEQ ID NO: 739868 - RNA, 13 nt, Homo sapiens
aauugcaauacau

SEQ ID NO: 739869 - RNA, 17 nt, Homo sapiens
aauugcaauacauuuca

SEQ ID NO: 739870 - RNA, 18 nt, Homo sapiens
aauugcaauacauuucaa

SEQ ID NO: 739871 - RNA, 22 nt, Homo sapiens
aauugcagaauucaaaagugau

SEQ ID NO: 739872 - RNA, 15 nt, Homo sapiens
aauugcauacuuugu

SEQ ID NO: 739873 - RNA, 12 nt, Homo sapiens
aauugcauuucc

SEQ ID NO: 739874 - RNA, 11 nt, Homo sapiens
aauugcucaag

SEQ ID NO: 739875 - RNA, 21 nt, Homo sapiens
aauugcucccuaccagcugaa

SEQ ID NO: 739876 - RNA, 16 nt, Homo sapiens
aauugcuucaagcauu

SEQ ID NO: 739877 - RNA, 20 nt, Homo sapiens
aauuggccucuguaugcagu

SEQ ID NO: 739878 - RNA, 20 nt, Homo sapiens
aauuguaaaauuuaaaucau

SEQ ID NO: 739879 - RNA, 19 nt, Homo sapiens
aauuguagcaucuaaugaa

SEQ ID NO: 739880 - RNA, 20 nt, Homo sapiens
aauuguauaagucaagcaca

SEQ ID NO: 739881 - RNA, 21 nt, Homo sapiens
aauuguccacauacguggaaa

SEQ ID NO: 739882 - RNA, 20 nt, Homo sapiens
aauugucuuuguucugugau

SEQ ID NO: 739883 - RNA, 19 nt, Homo sapiens
aauugugaucagaccauaa

SEQ ID NO: 739884 - RNA, 18 nt, Homo sapiens
aauuguuaauaugcagcc

SEQ ID NO: 739885 - RNA, 13 nt, Homo sapiens
aauuguugagaua

SEQ ID NO: 739886 - RNA, 20 nt, Homo sapiens
aauuguuuagugauauuaca

SEQ ID NO: 739887 - RNA, 19 nt, Homo sapiens
aauuguuucuugacaagcu

SEQ ID NO: 739888 - RNA, 22 nt, Homo sapiens
aauuguuuuuuaaagcaaguca

SEQ ID NO: 739889 - RNA, 14 nt, Homo sapiens
aauuuaaaagcaca

SEQ ID NO: 739890 - RNA, 18 nt, Homo sapiens
aauuuaaaggguguacuu

SEQ ID NO: 739891 - RNA, 16 nt, Homo sapiens
aauuuaaguacuugag

SEQ ID NO: 739892 - RNA, 14 nt, Homo sapiens
aauuuaauuccucu

SEQ ID NO: 739893 - RNA, 17 nt, Homo sapiens
aauuuacaagagcuguu

SEQ ID NO: 739894 - RNA, 17 nt, Homo sapiens
aauuuacacacuugcau

SEQ ID NO: 739895 - RNA, 20 nt, Homo sapiens
aauuuacauuuaauacagau

SEQ ID NO: 739896 - RNA, 12 nt, Homo sapiens
aauuuacuugau

SEQ ID NO: 739897 - RNA, 18 nt, Homo sapiens
aauuuacuuuaagcauug

SEQ ID NO: 739898 - RNA, 14 nt, Homo sapiens
aauuuaggaccaau

SEQ ID NO: 739899 - RNA, 20 nt, Homo sapiens
aauuuaucaaacccuagccu

SEQ ID NO: 739900 - RNA, 14 nt, Homo sapiens
aauuuauccauuca

SEQ ID NO: 739901 - RNA, 16 nt, Homo sapiens
aauuuauccauucaau

SEQ ID NO: 739902 - RNA, 20 nt, Homo sapiens
aauuuaucuugucucugggc

SEQ ID NO: 739903 - RNA, 15 nt, Homo sapiens
aauuuauugaguuuu

SEQ ID NO: 739904 - RNA, 18 nt, Homo sapiens
aauuucaauuucucccuu

SEQ ID NO: 739905 - RNA, 12 nt, Homo sapiens
aauuucacaagc

SEQ ID NO: 739906 - RNA, 23 nt, Homo sapiens
aauuucacauuaauauuugcuga

SEQ ID NO: 739907 - RNA, 20 nt, Homo sapiens
aauuucaccaccaaaugcca

SEQ ID NO: 739908 - RNA, 22 nt, Homo sapiens
aauuucacgcuuuuaauucuca

SEQ ID NO: 739909 - RNA, 15 nt, Homo sapiens
aauuucaguaaacaa

SEQ ID NO: 739910 - RNA, 21 nt, Homo sapiens
aauuucauaccuaucaucuua

SEQ ID NO: 739911 - RNA, 19 nt, Homo sapiens
aauuucauuuccagcauuu

SEQ ID NO: 739912 - RNA, 22 nt, Homo sapiens
aauuuccaaagcagccugugaa

SEQ ID NO: 739913 - RNA, 21 nt, Homo sapiens
aauuucccaguuaaagauuau

SEQ ID NO: 739914 - RNA, 19 nt, Homo sapiens
aauuucuaaaaaacagagg

SEQ ID NO: 739915 - RNA, 21 nt, Homo sapiens
aauuucuacuucuggaaguca

SEQ ID NO: 739916 - RNA, 15 nt, Homo sapiens
aauuucucauacuua

SEQ ID NO: 739917 - RNA, 22 nt, Homo sapiens
aauuucuccaguggauucccag

SEQ ID NO: 739918 - RNA, 19 nt, Homo sapiens
aauuucuggaaaacugccu

SEQ ID NO: 739919 - RNA, 20 nt, Homo sapiens
aauuugaaaugguugucacc

SEQ ID NO: 739920 - RNA, 13 nt, Homo sapiens
aauuugacauaca

SEQ ID NO: 739921 - RNA, 23 nt, Homo sapiens
aauuugagaaccuuggaccacuc

SEQ ID NO: 739922 - RNA, 14 nt, Homo sapiens
aauuugaggacaag

SEQ ID NO: 739923 - RNA, 16 nt, Homo sapiens
aauuugaggacaagau

SEQ ID NO: 739924 - RNA, 12 nt, Homo sapiens
aauuugaugaaa

SEQ ID NO: 739925 - RNA, 17 nt, Homo sapiens
aauuugcuagcaguaaa

SEQ ID NO: 739926 - RNA, 18 nt, Homo sapiens
aauuuggaaaggaccaaa

SEQ ID NO: 739927 - RNA, 18 nt, Homo sapiens
aauuuggagacucugugg

SEQ ID NO: 739928 - RNA, 16 nt, Homo sapiens
aauuuggcauugaucu

SEQ ID NO: 739929 - RNA, 24 nt, Homo sapiens
aauuuggguugacuccugagcaua

SEQ ID NO: 739930 - RNA, 20 nt, Homo sapiens
aauuugguaaaaaugcugcu

SEQ ID NO: 739931 - RNA, 17 nt, Homo sapiens
aauuuguaacuuugcag

SEQ ID NO: 739932 - RNA, 19 nt, Homo sapiens
aauuuguaauugcuuacau

SEQ ID NO: 739933 - RNA, 13 nt, Homo sapiens
aauuuuaaccuau

SEQ ID NO: 739934 - RNA, 15 nt, Homo sapiens
aauuuuaaguaggaa

SEQ ID NO: 739935 - RNA, 13 nt, Homo sapiens
aauuuuaauugaa

SEQ ID NO: 739936 - RNA, 13 nt, Homo sapiens
aauuuuaauugau

SEQ ID NO: 739937 - RNA, 20 nt, Homo sapiens
aauuuuacuccauaaacaga

SEQ ID NO: 739938 - RNA, 17 nt, Homo sapiens
aauuuuagugugccuuc

SEQ ID NO: 739939 - RNA, 14 nt, Homo sapiens
aauuuuauaucuug

SEQ ID NO: 739940 - RNA, 19 nt, Homo sapiens
aauuuuauuaaaugcauca

SEQ ID NO: 739941 - RNA, 20 nt, Homo sapiens
aauuuuauucaagaaugcca

SEQ ID NO: 739942 - RNA, 15 nt, Homo sapiens
aauuuucagcauuaa

SEQ ID NO: 739943 - RNA, 15 nt, Homo sapiens
aauuuuccaguauaa

SEQ ID NO: 739944 - RNA, 18 nt, Homo sapiens
aauuuucuaaaagcuuuc

SEQ ID NO: 739945 - RNA, 14 nt, Homo sapiens
aauuuucuguaaga

SEQ ID NO: 739946 - RNA, 22 nt, Homo sapiens
aauuuucuuccuuugaagcuuu

SEQ ID NO: 739947 - RNA, 15 nt, Homo sapiens
aauuuugaaugcccu

SEQ ID NO: 739948 - RNA, 20 nt, Homo sapiens
aauuuuggucauagcauuca

SEQ ID NO: 739949 - RNA, 20 nt, Homo sapiens
aauuuugguuuaugacucuu

SEQ ID NO: 739950 - RNA, 20 nt, Homo sapiens
aauuuuguaaaacaaugcca

SEQ ID NO: 739951 - RNA, 13 nt, Homo sapiens
acagcucucaccu

SEQ ID NO: 739952 - RNA, 19 nt, Homo sapiens
acagcucuucucagugucu

SEQ ID NO: 739953 - RNA, 15 nt, Homo sapiens
acagcugaacuauuu

SEQ ID NO: 739954 - RNA, 14 nt, Homo sapiens
acagcugcauuaaa

SEQ ID NO: 739955 - RNA, 17 nt, Homo sapiens
acagcugccucugccac

SEQ ID NO: 739956 - RNA, 21 nt, Homo sapiens
acagcugccugugugggacug

SEQ ID NO: 739957 - RNA, 18 nt, Homo sapiens
acagcugcugcuggaaau

SEQ ID NO: 739958 - RNA, 15 nt, Homo sapiens
acagcugguucgugg

SEQ ID NO: 739959 - RNA, 19 nt, Homo sapiens
acagcuucuccaagcauca

SEQ ID NO: 739960 - RNA, 21 nt, Homo sapiens
acagcuugaguggguucucug

SEQ ID NO: 739961 - RNA, 23 nt, Homo sapiens
acagcuugggaauccugcuaaag

SEQ ID NO: 739962 - RNA, 23 nt, Homo sapiens
acagcuugucugguaaguggcuu

SEQ ID NO: 739963 - RNA, 15 nt, Homo sapiens
acagcuuuccucaaa

SEQ ID NO: 739964 - RNA, 18 nt, Homo sapiens
acagcuuuugcaacuuaa

SEQ ID NO: 739965 - RNA, 16 nt, Homo sapiens
acaggaaaguuccaga

SEQ ID NO: 739966 - RNA, 13 nt, Homo sapiens
acaggaaauugac

SEQ ID NO: 739967 - RNA, 16 nt, Homo sapiens
acaggaaauugacuua

SEQ ID NO: 739968 - RNA, 20 nt, Homo sapiens
acaggaagcaccccaugcca

SEQ ID NO: 739969 - RNA, 13 nt, Homo sapiens
acaggaauccuua

SEQ ID NO: 739970 - RNA, 20 nt, Homo sapiens
acaggaauggaacacacuug

SEQ ID NO: 739971 - RNA, 13 nt, Homo sapiens
acaggacugauuc

SEQ ID NO: 739972 - RNA, 20 nt, Homo sapiens
acaggaggcagacaaugacc

SEQ ID NO: 739973 - RNA, 17 nt, Homo sapiens
acaggaggcaggcaugg

SEQ ID NO: 739974 - RNA, 13 nt, Homo sapiens
acaggagugggaa

SEQ ID NO: 739975 - RNA, 21 nt, Homo sapiens
acaggaugaaaguucccccau

SEQ ID NO: 739976 - RNA, 19 nt, Homo sapiens
acaggcaaaacucaguaga

SEQ ID NO: 739977 - RNA, 23 nt, Homo sapiens
acaggcaaauguacuucucaccc

SEQ ID NO: 739978 - RNA, 22 nt, Homo sapiens
acaggcagauguuugccucaua

SEQ ID NO: 739979 - RNA, 21 nt, Homo sapiens
acaggcaguggaagcaguuuc

SEQ ID NO: 739980 - RNA, 18 nt, Homo sapiens
acaggccucuccauuugc

SEQ ID NO: 739981 - RNA, 22 nt, Homo sapiens
acaggcgugauccaccacaccu

SEQ ID NO: 739982 - RNA, 18 nt, Homo sapiens
acaggcucugaggggcac

SEQ ID NO: 739983 - RNA, 21 nt, Homo sapiens
acaggcucuuagcagcuucca

SEQ ID NO: 739984 - RNA, 23 nt, Homo sapiens
acaggcuucugagcacagcugca

SEQ ID NO: 739985 - RNA, 15 nt, Homo sapiens
acagggaaaggucag

SEQ ID NO: 739986 - RNA, 18 nt, Homo sapiens
acagggaagaaacuuucu

SEQ ID NO: 739987 - RNA, 15 nt, Homo sapiens
acagggagugcacau

SEQ ID NO: 739988 - RNA, 19 nt, Homo sapiens
acagggcaugcauuuugca

SEQ ID NO: 739989 - RNA, 13 nt, Homo sapiens
acagggcauucaa

SEQ ID NO: 739990 - RNA, 17 nt, Homo sapiens
acagggccacaacugcc

SEQ ID NO: 739991 - RNA, 22 nt, Homo sapiens
acagggcgguaccuugugccca

SEQ ID NO: 739992 - RNA, 16 nt, Homo sapiens
acaggggaucauguua

SEQ ID NO: 739993 - RNA, 19 nt, Homo sapiens
acagggucugcucuuucuc

SEQ ID NO: 739994 - RNA, 21 nt, Homo sapiens
acagguauuuuuuuaaaucaa

SEQ ID NO: 739995 - RNA, 14 nt, Homo sapiens
acaggucaacuuca

SEQ ID NO: 739996 - RNA, 14 nt, Homo sapiens
acagguccccagau

SEQ ID NO: 739997 - RNA, 20 nt, Homo sapiens
acaggugcugaacugugcau

SEQ ID NO: 739998 - RNA, 18 nt, Homo sapiens
acagguguauauaagcaa

SEQ ID NO: 739999 - RNA, 23 nt, Homo sapiens
acaggugugcagauuuuggccau

SEQ ID NO: 740000 - RNA, 17 nt, Homo sapiens
acagguucuuaaaaagg

SEQ ID NO: 740001 - RNA, 22 nt, Homo sapiens
acagguuuuguguuuugucauu

SEQ ID NO: 740002 - RNA, 14 nt, Homo sapiens
acaguaacugccau

SEQ ID NO: 740003 - RNA, 12 nt, Homo sapiens
acaguaagcaua

SEQ ID NO: 740004 - RNA, 18 nt, Homo sapiens
acaguaaugugucauauc

SEQ ID NO: 740005 - RNA, 19 nt, Homo sapiens
acaguaaugugucauauca

SEQ ID NO: 740006 - RNA, 12 nt, Homo sapiens
acaguaccugau

SEQ ID NO: 740007 - RNA, 20 nt, Homo sapiens
acaguaccuuguugcagaug

SEQ ID NO: 740008 - RNA, 13 nt, Homo sapiens
acaguacugauac

SEQ ID NO: 740009 - RNA, 22 nt, Homo sapiens
acaguacugauacauaauuuaa

SEQ ID NO: 740010 - RNA, 16 nt, Homo sapiens
acaguacuuccagaug

SEQ ID NO: 740011 - RNA, 17 nt, Homo sapiens
acaguacuuuauuguac

SEQ ID NO: 740012 - RNA, 16 nt, Homo sapiens
acaguagauuuuccaa

SEQ ID NO: 740013 - RNA, 18 nt, Homo sapiens
acaguaggauaagccacu

SEQ ID NO: 740014 - RNA, 17 nt, Homo sapiens
acaguagugucaucacu

SEQ ID NO: 740015 - RNA, 22 nt, Homo sapiens
acaguaguuagaauuauaucac

SEQ ID NO: 740016 - RNA, 21 nt, Homo sapiens
acaguaucccacauccaacuc

SEQ ID NO: 740017 - RNA, 14 nt, Homo sapiens
acaguaugaugaaa

SEQ ID NO: 740018 - RNA, 16 nt, Homo sapiens
acaguauuuugacaaa

SEQ ID NO: 740019 - RNA, 16 nt, Homo sapiens
acagucacugauguac

SEQ ID NO: 740020 - RNA, 12 nt, Homo sapiens
acagucacugga

SEQ ID NO: 740021 - RNA, 17 nt, Homo sapiens
acagucccagauacacu

SEQ ID NO: 740022 - RNA, 21 nt, Homo sapiens
acagucguucccaguguggcu

SEQ ID NO: 740023 - RNA, 17 nt, Homo sapiens
acagugacuucugagau

SEQ ID NO: 740024 - RNA, 18 nt, Homo sapiens
acagugacuucugagauc

SEQ ID NO: 740025 - RNA, 15 nt, Homo sapiens
acagugauauacuua

SEQ ID NO: 740026 - RNA, 12 nt, Homo sapiens
acagugaugcug

SEQ ID NO: 740027 - RNA, 12 nt, Homo sapiens
acagugcaguga

SEQ ID NO: 740028 - RNA, 17 nt, Homo sapiens
acagugccgacagcucu

SEQ ID NO: 740029 - RNA, 14 nt, Homo sapiens
acagugccucuucc

SEQ ID NO: 740030 - RNA, 19 nt, Homo sapiens
acagugcucgaccuugaua

SEQ ID NO: 740031 - RNA, 14 nt, Homo sapiens
acagugcuguguac

SEQ ID NO: 740032 - RNA, 15 nt, Homo sapiens
acagugggagccagg

SEQ ID NO: 740033 - RNA, 13 nt, Homo sapiens
acaguggggccag

SEQ ID NO: 740034 - RNA, 19 nt, Homo sapiens
acaguguauguacuaagca

SEQ ID NO: 740035 - RNA, 22 nt, Homo sapiens
acagugucgcuaagugcauuuc

SEQ ID NO: 740036 - RNA, 20 nt, Homo sapiens
acaguguuuuguagauuuca

SEQ ID NO: 740037 - RNA, 15 nt, Homo sapiens
acaguuacaguugau

SEQ ID NO: 740038 - RNA, 18 nt, Homo sapiens
acaguucagaccaaugcu

SEQ ID NO: 740039 - RNA, 24 nt, Homo sapiens
acaguuuacagacgcugcugucac

SEQ ID NO: 740040 - RNA, 13 nt, Homo sapiens
acaguuugagacu

SEQ ID NO: 740041 - RNA, 15 nt, Homo sapiens
acaguuuuaagcaga

SEQ ID NO: 740042 - RNA, 24 nt, Homo sapiens
acaguuuugaaagaaaaauaccau

SEQ ID NO: 740043 - RNA, 18 nt, Homo sapiens
acaguuuugccugcuaaa

SEQ ID NO: 740044 - RNA, 23 nt, Homo sapiens
acaguuuuuccuggaauugccag

SEQ ID NO: 740045 - RNA, 19 nt, Homo sapiens
acaguuuuuuacauauuaa

SEQ ID NO: 740046 - RNA, 19 nt, Homo sapiens
acauaaaaacaacuuuaua

SEQ ID NO: 740047 - RNA, 13 nt, Homo sapiens
acauaaaauccaa

SEQ ID NO: 740048 - RNA, 22 nt, Homo sapiens
acauaacacuauaaagguugac

SEQ ID NO: 740049 - RNA, 18 nt, Homo sapiens
acauaacauuguaugcau

SEQ ID NO: 740050 - RNA, 12 nt, Homo sapiens
acauaagacaga

SEQ ID NO: 740051 - RNA, 15 nt, Homo sapiens
acauaagacagacag

SEQ ID NO: 740052 - RNA, 13 nt, Homo sapiens
acauaaggaugaa

SEQ ID NO: 740053 - RNA, 18 nt, Homo sapiens
acauaaguguugguagca

SEQ ID NO: 740054 - RNA, 22 nt, Homo sapiens
acauaaguguugguagcacuua

SEQ ID NO: 740055 - RNA, 17 nt, Homo sapiens
acauaauguaucaugaa

SEQ ID NO: 740056 - RNA, 13 nt, Homo sapiens
acauaauguucca

SEQ ID NO: 740057 - RNA, 12 nt, Homo sapiens
acauacaauuau

SEQ ID NO: 740058 - RNA, 22 nt, Homo sapiens
acauacaggccauacuuuacaa

SEQ ID NO: 740059 - RNA, 17 nt, Homo sapiens
acauacauaagcagcau

SEQ ID NO: 740060 - RNA, 15 nt, Homo sapiens
acauacauccaacau

SEQ ID NO: 740061 - RNA, 15 nt, Homo sapiens
acauacgugugcaug

SEQ ID NO: 740062 - RNA, 19 nt, Homo sapiens
acauacuugaagggccaga

SEQ ID NO: 740063 - RNA, 22 nt, Homo sapiens
acauagagcuuuuuaauagcac

SEQ ID NO: 740064 - RNA, 18 nt, Homo sapiens
acauagagugaucuuucc

SEQ ID NO: 740065 - RNA, 14 nt, Homo sapiens
accccaugccaaag

SEQ ID NO: 740066 - RNA, 18 nt, Homo sapiens
accccauguccucagcau

SEQ ID NO: 740067 - RNA, 12 nt, Homo sapiens
acccccagugua

SEQ ID NO: 740068 - RNA, 17 nt, Homo sapiens
acccccaucucuacuaa

SEQ ID NO: 740069 - RNA, 22 nt, Homo sapiens
accccccagaaccuguccuugc

SEQ ID NO: 740070 - RNA, 18 nt, Homo sapiens
acccccgacccugcccug

SEQ ID NO: 740071 - RNA, 19 nt, Homo sapiens
acccccguguccaccguga

SEQ ID NO: 740072 - RNA, 13 nt, Homo sapiens
acccccuuccuuc

SEQ ID NO: 740073 - RNA, 17 nt, Homo sapiens
accccgcugauggagcc

SEQ ID NO: 740074 - RNA, 23 nt, Homo sapiens
accccggugugccuguggaggaa

SEQ ID NO: 740075 - RNA, 13 nt, Homo sapiens
accccuacaugaa

SEQ ID NO: 740076 - RNA, 21 nt, Homo sapiens
accccuagagacagugaugcc

SEQ ID NO: 740077 - RNA, 18 nt, Homo sapiens
accccucagggguuucau

SEQ ID NO: 740078 - RNA, 15 nt, Homo sapiens
accccucauccaaag

SEQ ID NO: 740079 - RNA, 20 nt, Homo sapiens
accccuccaggaaugaucuc

SEQ ID NO: 740080 - RNA, 18 nt, Homo sapiens
accccuccuuccuugacc

SEQ ID NO: 740081 - RNA, 14 nt, Homo sapiens
accccugcacuacu

SEQ ID NO: 740082 - RNA, 15 nt, Homo sapiens
accccugcuaaggag

SEQ ID NO: 740083 - RNA, 19 nt, Homo sapiens
accccugucucccaaaaau

SEQ ID NO: 740084 - RNA, 14 nt, Homo sapiens
accccuuagccucc

SEQ ID NO: 740085 - RNA, 21 nt, Homo sapiens
accccuuccagaucacugcca

SEQ ID NO: 740086 - RNA, 14 nt, Homo sapiens
accccuuugcccuu

SEQ ID NO: 740087 - RNA, 18 nt, Homo sapiens
acccgacugaaacuggaa

SEQ ID NO: 740088 - RNA, 22 nt, Homo sapiens
acccgagcccagcuacauuccu

SEQ ID NO: 740089 - RNA, 17 nt, Homo sapiens
acccgcccgagggaugg

SEQ ID NO: 740090 - RNA, 23 nt, Homo sapiens
acccggaagaucagaugcaauug

SEQ ID NO: 740091 - RNA, 17 nt, Homo sapiens
acccgggggagcccagu

SEQ ID NO: 740092 - RNA, 20 nt, Homo sapiens
acccgggggagcccagugaa

SEQ ID NO: 740093 - RNA, 12 nt, Homo sapiens
acccggugcucc

SEQ ID NO: 740094 - RNA, 15 nt, Homo sapiens
acccuaccaugaauc

SEQ ID NO: 740095 - RNA, 20 nt, Homo sapiens
acccuacuucuuuugcucuu

SEQ ID NO: 740096 - RNA, 15 nt, Homo sapiens
acccuagcuguguca

SEQ ID NO: 740097 - RNA, 21 nt, Homo sapiens
acccuagggauuugcacuaaa

SEQ ID NO: 740098 - RNA, 18 nt, Homo sapiens
acccuauacaacuggaca

SEQ ID NO: 740099 - RNA, 20 nt, Homo sapiens
acccuauacuguaguauucu

SEQ ID NO: 740100 - RNA, 16 nt, Homo sapiens
acccuaucuccugaca

SEQ ID NO: 740101 - RNA, 20 nt, Homo sapiens
acccuauuuagaaauggauu

SEQ ID NO: 740102 - RNA, 10 nt, Homo sapiens
acccucacaa

SEQ ID NO: 740103 - RNA, 16 nt, Homo sapiens
acccucagcacuguua

SEQ ID NO: 740104 - RNA, 22 nt, Homo sapiens
acccuccagagacaacagguaa

SEQ ID NO: 740105 - RNA, 16 nt, Homo sapiens
acccuccccuagucac

SEQ ID NO: 740106 - RNA, 19 nt, Homo sapiens
acccuccccuagucacuca

SEQ ID NO: 740107 - RNA, 20 nt, Homo sapiens
acccuccccuagucacucau

SEQ ID NO: 740108 - RNA, 20 nt, Homo sapiens
acccucgcaugacuguuaca

SEQ ID NO: 740109 - RNA, 21 nt, Homo sapiens
acccucgggccccauccucau

SEQ ID NO: 740110 - RNA, 13 nt, Homo sapiens
acccucucagcuc

SEQ ID NO: 740111 - RNA, 16 nt, Homo sapiens
acccugaagauuucag

SEQ ID NO: 740112 - RNA, 17 nt, Homo sapiens
acccugaaggggccaug

SEQ ID NO: 740113 - RNA, 19 nt, Homo sapiens
acccugaaggggccaugau

SEQ ID NO: 740114 - RNA, 20 nt, Homo sapiens
acccugagcuuaaauaacaa

SEQ ID NO: 740115 - RNA, 18 nt, Homo sapiens
acccugaggucacugcua

SEQ ID NO: 740116 - RNA, 18 nt, Homo sapiens
acccugaguugcuuuuca

SEQ ID NO: 740117 - RNA, 21 nt, Homo sapiens
acccugcagagcacacaggua

SEQ ID NO: 740118 - RNA, 16 nt, Homo sapiens
acccugcccaccaaga

SEQ ID NO: 740119 - RNA, 18 nt, Homo sapiens
acccugccccugccuuga

SEQ ID NO: 740120 - RNA, 21 nt, Homo sapiens
acccugcugaacacagugucu

SEQ ID NO: 740121 - RNA, 16 nt, Homo sapiens
acccugcugaccuccc

SEQ ID NO: 740122 - RNA, 16 nt, Homo sapiens
acccugcuucaaauau

SEQ ID NO: 740123 - RNA, 21 nt, Homo sapiens
acccugggagccaguccucca

SEQ ID NO: 740124 - RNA, 14 nt, Homo sapiens
acccugggggcaca

SEQ ID NO: 740125 - RNA, 22 nt, Homo sapiens
acccugucaaguuaacaaggaa

SEQ ID NO: 740126 - RNA, 13 nt, Homo sapiens
acccuguccaaac

SEQ ID NO: 740127 - RNA, 22 nt, Homo sapiens
acccuguccggcccagugccac

SEQ ID NO: 740128 - RNA, 16 nt, Homo sapiens
acccugucucuacuaa

SEQ ID NO: 740129 - RNA, 13 nt, Homo sapiens
acccugugcuguc

SEQ ID NO: 740130 - RNA, 21 nt, Homo sapiens
acccuguuucuggagucacau

SEQ ID NO: 740131 - RNA, 14 nt, Homo sapiens
acccuuaccaaaaa

SEQ ID NO: 740132 - RNA, 13 nt, Homo sapiens
acccuucaacgcu

SEQ ID NO: 740133 - RNA, 15 nt, Homo sapiens
acccuugauuauacu

SEQ ID NO: 740134 - RNA, 20 nt, Homo sapiens
acccuugcccggcugugauu

SEQ ID NO: 740135 - RNA, 19 nt, Homo sapiens
acccuuggagccaauggag

SEQ ID NO: 740136 - RNA, 22 nt, Homo sapiens
acccuugugagagcccauuccc

SEQ ID NO: 740137 - RNA, 20 nt, Homo sapiens
acccuuuagacuguagccug

SEQ ID NO: 740138 - RNA, 14 nt, Homo sapiens
acccuuugcuguga

SEQ ID NO: 740139 - RNA, 20 nt, Homo sapiens
acccuuuugucgccuggaug

SEQ ID NO: 740140 - RNA, 13 nt, Homo sapiens
accgagcaauuuu

SEQ ID NO: 740141 - RNA, 18 nt, Homo sapiens
accgagcaggggcagcuu

SEQ ID NO: 740142 - RNA, 16 nt, Homo sapiens
accgaggacacagugg

SEQ ID NO: 740143 - RNA, 16 nt, Homo sapiens
accgaguggcugucau

SEQ ID NO: 740144 - RNA, 14 nt, Homo sapiens
accgcucaguauuu

SEQ ID NO: 740145 - RNA, 20 nt, Homo sapiens
accggaaggaggccaaccag

SEQ ID NO: 740146 - RNA, 22 nt, Homo sapiens
accggaaggaggccaaccagcc

SEQ ID NO: 740147 - RNA, 18 nt, Homo sapiens
accgggacuucaaagccg

SEQ ID NO: 740148 - RNA, 21 nt, Homo sapiens
accgggacuucaaagccguga

SEQ ID NO: 740149 - RNA, 21 nt, Homo sapiens
accgggcuggccugugccuau

SEQ ID NO: 740150 - RNA, 23 nt, Homo sapiens
accggggccuacuagagucugaa

SEQ ID NO: 740151 - RNA, 15 nt, Homo sapiens
accguaaauguccau

SEQ ID NO: 740152 - RNA, 18 nt, Homo sapiens
accgucacacucuucagu

SEQ ID NO: 740153 - RNA, 20 nt, Homo sapiens
accgucacacucuucaguga

SEQ ID NO: 740154 - RNA, 21 nt, Homo sapiens
accgucuucucccuauucccu

SEQ ID NO: 740155 - RNA, 11 nt, Homo sapiens
accgucuuucu

SEQ ID NO: 740156 - RNA, 15 nt, Homo sapiens
accgugaccaggaac

SEQ ID NO: 740157 - RNA, 21 nt, Homo sapiens
accgugagugacauagccuca

SEQ ID NO: 740158 - RNA, 15 nt, Homo sapiens
accguguggcccaag

SEQ ID NO: 740159 - RNA, 14 nt, Homo sapiens
accguuguuugcaa

SEQ ID NO: 740160 - RNA, 16 nt, Homo sapiens
accuaaauuugguucu

SEQ ID NO: 740161 - RNA, 18 nt, Homo sapiens
accuaagucucugugaau

SEQ ID NO: 740162 - RNA, 23 nt, Homo sapiens
accuaagucucugugaauugaaa

SEQ ID NO: 740163 - RNA, 21 nt, Homo sapiens
accuaauauucaaugaacuuc

SEQ ID NO: 740164 - RNA, 14 nt, Homo sapiens
accuaauccaggca

SEQ ID NO: 740165 - RNA, 15 nt, Homo sapiens
accuaauccaggcag

SEQ ID NO: 740166 - RNA, 21 nt, Homo sapiens
accuaauguuuaugagccaga

SEQ ID NO: 740167 - RNA, 23 nt, Homo sapiens
accuaauucuuguagaugcauua

SEQ ID NO: 740168 - RNA, 21 nt, Homo sapiens
accuacacaggagucuucaga

SEQ ID NO: 740169 - RNA, 14 nt, Homo sapiens
accuacagugcugu

SEQ ID NO: 740170 - RNA, 17 nt, Homo sapiens
accuaccaaaauggaau

SEQ ID NO: 740171 - RNA, 18 nt, Homo sapiens
accuacccacaugcacuc

SEQ ID NO: 740172 - RNA, 12 nt, Homo sapiens
accuacugcacu

SEQ ID NO: 740173 - RNA, 19 nt, Homo sapiens
accuacugcuuacuguugc

SEQ ID NO: 740174 - RNA, 20 nt, Homo sapiens
accuacugcuuacuguugcu

SEQ ID NO: 740175 - RNA, 20 nt, Homo sapiens
accuacuuugguaguggaau

SEQ ID NO: 740176 - RNA, 12 nt, Homo sapiens
accuacuuugua

SEQ ID NO: 740177 - RNA, 20 nt, Homo sapiens
accuagaaugucagauuucu

SEQ ID NO: 740178 - RNA, 16 nt, Homo sapiens
accuagcagccucaaa

SEQ ID NO: 740179 - RNA, 20 nt, Homo sapiens
acugaggcagacagcagcuc

SEQ ID NO: 740180 - RNA, 14 nt, Homo sapiens
acugauaaaccaaa

SEQ ID NO: 740181 - RNA, 15 nt, Homo sapiens
acugauaaaccaaaa

SEQ ID NO: 740182 - RNA, 16 nt, Homo sapiens
acugauaaaccuaaua

SEQ ID NO: 740183 - RNA, 21 nt, Homo sapiens
acugauaacaaccuuuuacau

SEQ ID NO: 740184 - RNA, 18 nt, Homo sapiens
acugauagcuuacacuga

SEQ ID NO: 740185 - RNA, 22 nt, Homo sapiens
acugaucucaaguauaugucau

SEQ ID NO: 740186 - RNA, 20 nt, Homo sapiens
acugaucugcuagugcugua

SEQ ID NO: 740187 - RNA, 17 nt, Homo sapiens
acugauggcagacaucu

SEQ ID NO: 740188 - RNA, 12 nt, Homo sapiens
acugaugucauc

SEQ ID NO: 740189 - RNA, 17 nt, Homo sapiens
acugauuaccugccaau

SEQ ID NO: 740190 - RNA, 23 nt, Homo sapiens
acugauucaagaacaagcaauga

SEQ ID NO: 740191 - RNA, 20 nt, Homo sapiens
acugcaaagcucggugcucc

SEQ ID NO: 740192 - RNA, 12 nt, Homo sapiens
acugcaaccucc

SEQ ID NO: 740193 - RNA, 15 nt, Homo sapiens
acugcaaccucugcc

SEQ ID NO: 740194 - RNA, 16 nt, Homo sapiens
acugcaaccucugccu

SEQ ID NO: 740195 - RNA, 21 nt, Homo sapiens
acugcaacuuccgccuccugu

SEQ ID NO: 740196 - RNA, 16 nt, Homo sapiens
acugcaguucaucuca

SEQ ID NO: 740197 - RNA, 17 nt, Homo sapiens
acugcauuuacagugua

SEQ ID NO: 740198 - RNA, 15 nt, Homo sapiens
acugccaaccagagc

SEQ ID NO: 740199 - RNA, 12 nt, Homo sapiens
acugccaagaaa

SEQ ID NO: 740200 - RNA, 16 nt, Homo sapiens
acugccacacucucca

SEQ ID NO: 740201 - RNA, 13 nt, Homo sapiens
acugccagcagca

SEQ ID NO: 740202 - RNA, 19 nt, Homo sapiens
acugccaucuuuaucauga

SEQ ID NO: 740203 - RNA, 10 nt, Homo sapiens
acugccauua

SEQ ID NO: 740204 - RNA, 14 nt, Homo sapiens
acugcccccgccac

SEQ ID NO: 740205 - RNA, 19 nt, Homo sapiens
acugcccgaggcgccagcu

SEQ ID NO: 740206 - RNA, 22 nt, Homo sapiens
acugccucuggaauugcucaag

SEQ ID NO: 740207 - RNA, 19 nt, Homo sapiens
acugcgaggacaucaaagu

SEQ ID NO: 740208 - RNA, 17 nt, Homo sapiens
acugcgcaucaccuacc

SEQ ID NO: 740209 - RNA, 17 nt, Homo sapiens
acugcucaucauuccuu

SEQ ID NO: 740210 - RNA, 19 nt, Homo sapiens
acugcugcaaauacuguau

SEQ ID NO: 740211 - RNA, 16 nt, Homo sapiens
acugcugggcuuggca

SEQ ID NO: 740212 - RNA, 17 nt, Homo sapiens
acugcugggcuuggcag

SEQ ID NO: 740213 - RNA, 16 nt, Homo sapiens
acugcuugaccaaaga

SEQ ID NO: 740214 - RNA, 19 nt, Homo sapiens
acugcuuuaaacugcauuu

SEQ ID NO: 740215 - RNA, 14 nt, Homo sapiens
acuggaaaacagaa

SEQ ID NO: 740216 - RNA, 17 nt, Homo sapiens
acuggaaaacagaacac

SEQ ID NO: 740217 - RNA, 17 nt, Homo sapiens
acuggaacggugaaggu

SEQ ID NO: 740218 - RNA, 16 nt, Homo sapiens
acuggacaugaaggaa

SEQ ID NO: 740219 - RNA, 12 nt, Homo sapiens
acuggaccgcug

SEQ ID NO: 740220 - RNA, 20 nt, Homo sapiens
acuggacuugagcuuggcag

SEQ ID NO: 740221 - RNA, 16 nt, Homo sapiens
acuggagccaucucuu

SEQ ID NO: 740222 - RNA, 18 nt, Homo sapiens
acuggagcugcacugcau

SEQ ID NO: 740223 - RNA, 22 nt, Homo sapiens
acuggaucuucuaucauuccaa

SEQ ID NO: 740224 - RNA, 17 nt, Homo sapiens
acuggauggucaucucg

SEQ ID NO: 740225 - RNA, 22 nt, Homo sapiens
acuggaugugauuauuaauauc

SEQ ID NO: 740226 - RNA, 18 nt, Homo sapiens
acuggauucuuaaccaag

SEQ ID NO: 740227 - RNA, 22 nt, Homo sapiens
acuggauuggccaaacaucaga

SEQ ID NO: 740228 - RNA, 18 nt, Homo sapiens
acuggcaaccugcuuuca

SEQ ID NO: 740229 - RNA, 16 nt, Homo sapiens
acuggcagcaucuuca

SEQ ID NO: 740230 - RNA, 16 nt, Homo sapiens
acuggcaguuuuccau

SEQ ID NO: 740231 - RNA, 18 nt, Homo sapiens
acuggcaucugacacaaa

SEQ ID NO: 740232 - RNA, 14 nt, Homo sapiens
acuggcaugagcca

SEQ ID NO: 740233 - RNA, 19 nt, Homo sapiens
acuggccccuacuuugugg

SEQ ID NO: 740234 - RNA, 22 nt, Homo sapiens
acuggccuguaaucuaccagug

SEQ ID NO: 740235 - RNA, 20 nt, Homo sapiens
acuggcuacaguaccaugcc

SEQ ID NO: 740236 - RNA, 18 nt, Homo sapiens
acuggcugucugccugua

SEQ ID NO: 740237 - RNA, 15 nt, Homo sapiens
acuggcugugagacg

SEQ ID NO: 740238 - RNA, 19 nt, Homo sapiens
acuggcuucugcuugucau

SEQ ID NO: 740239 - RNA, 20 nt, Homo sapiens
acugggagaaaugacuuuga

SEQ ID NO: 740240 - RNA, 18 nt, Homo sapiens
acuggggagucuuugugg

SEQ ID NO: 740241 - RNA, 15 nt, Homo sapiens
acugggucucacucc

SEQ ID NO: 740242 - RNA, 12 nt, Homo sapiens
acugggugacca

SEQ ID NO: 740243 - RNA, 18 nt, Homo sapiens
acugggugguccaaagaa

SEQ ID NO: 740244 - RNA, 21 nt, Homo sapiens
acugguaaaaagauccaggga

SEQ ID NO: 740245 - RNA, 14 nt, Homo sapiens
acugguaaagccuc

SEQ ID NO: 740246 - RNA, 15 nt, Homo sapiens
acugguaaagccuca

SEQ ID NO: 740247 - RNA, 20 nt, Homo sapiens
acugguaaagccucauuuga

SEQ ID NO: 740248 - RNA, 19 nt, Homo sapiens
acugguagaaaggcaguuc

SEQ ID NO: 740249 - RNA, 23 nt, Homo sapiens
acugguauguguggaugaugcug

SEQ ID NO: 740250 - RNA, 12 nt, Homo sapiens
acugguccaaaa

SEQ ID NO: 740251 - RNA, 21 nt, Homo sapiens
acuggucuuguggaauuggga

SEQ ID NO: 740252 - RNA, 19 nt, Homo sapiens
acuggugucacccuggaua

SEQ ID NO: 740253 - RNA, 24 nt, Homo sapiens
acugguuaaaaaacaaauguucau

SEQ ID NO: 740254 - RNA, 18 nt, Homo sapiens
acugguuugccaggccaa

SEQ ID NO: 740255 - RNA, 16 nt, Homo sapiens
acuguaaacuucugca

SEQ ID NO: 740256 - RNA, 13 nt, Homo sapiens
acuguaaagacaa

SEQ ID NO: 740257 - RNA, 22 nt, Homo sapiens
acuguaaauaugaaucugcuca

SEQ ID NO: 740258 - RNA, 17 nt, Homo sapiens
acuguaaccugauucau

SEQ ID NO: 740259 - RNA, 19 nt, Homo sapiens
acuguaacuacuuccugau

SEQ ID NO: 740260 - RNA, 15 nt, Homo sapiens
acuguaaugaggaaa

SEQ ID NO: 740261 - RNA, 12 nt, Homo sapiens
acuguacauuua

SEQ ID NO: 740262 - RNA, 22 nt, Homo sapiens
acuguacccucgcaugacuguu

SEQ ID NO: 740263 - RNA, 23 nt, Homo sapiens
acuguacuuguagaguggugcug

SEQ ID NO: 740264 - RNA, 12 nt, Homo sapiens
acuguagaugau

SEQ ID NO: 740265 - RNA, 16 nt, Homo sapiens
acuguaggaacaagca

SEQ ID NO: 740266 - RNA, 15 nt, Homo sapiens
acuguagucucagga

SEQ ID NO: 740267 - RNA, 14 nt, Homo sapiens
acuguaucuaaaaa

SEQ ID NO: 740268 - RNA, 16 nt, Homo sapiens
acuguauucgugcauu

SEQ ID NO: 740269 - RNA, 19 nt, Homo sapiens
acuguauuuaagaaaacac

SEQ ID NO: 740270 - RNA, 21 nt, Homo sapiens
acugucacugccgacaucccu

SEQ ID NO: 740271 - RNA, 21 nt, Homo sapiens
acugucagcugagcuugagcu

SEQ ID NO: 740272 - RNA, 14 nt, Homo sapiens
acugucaguucucu

SEQ ID NO: 740273 - RNA, 14 nt, Homo sapiens
acugucaucuucaa

SEQ ID NO: 740274 - RNA, 14 nt, Homo sapiens
acugucauguggcu

SEQ ID NO: 740275 - RNA, 18 nt, Homo sapiens
acuguccaagugccacau

SEQ ID NO: 740276 - RNA, 14 nt, Homo sapiens
acugucccacaaaa

SEQ ID NO: 740277 - RNA, 11 nt, Homo sapiens
acuguccucag

SEQ ID NO: 740278 - RNA, 14 nt, Homo sapiens
acuguccuggcuac

SEQ ID NO: 740279 - RNA, 20 nt, Homo sapiens
acugucuauuuucucaguca

SEQ ID NO: 740280 - RNA, 19 nt, Homo sapiens
acugucuccuuucucuuau

SEQ ID NO: 740281 - RNA, 16 nt, Homo sapiens
acugucucgaacuauu

SEQ ID NO: 740282 - RNA, 14 nt, Homo sapiens
acugucuugccaga

SEQ ID NO: 740283 - RNA, 21 nt, Homo sapiens
acugucuuucagauacauggu

SEQ ID NO: 740284 - RNA, 17 nt, Homo sapiens
acugucuuugucaccac

SEQ ID NO: 740285 - RNA, 13 nt, Homo sapiens
acugugaaacugg

SEQ ID NO: 740286 - RNA, 20 nt, Homo sapiens
acugugaaauaccacaagcc

SEQ ID NO: 740287 - RNA, 21 nt, Homo sapiens
acugugaaauaccacaagccu

SEQ ID NO: 740288 - RNA, 23 nt, Homo sapiens
acugugaaccaacccccaucucc

SEQ ID NO: 740289 - RNA, 22 nt, Homo sapiens
acugugacuaggcauacacugu

SEQ ID NO: 740290 - RNA, 12 nt, Homo sapiens
acugugacugua

SEQ ID NO: 740291 - RNA, 12 nt, Homo sapiens
acugugacuuaa

SEQ ID NO: 740292 - RNA, 14 nt, Homo sapiens
acugugagcaagga

SEQ ID NO: 740293 - RNA, 18 nt, Homo sapiens
acugugccaacuacuacu

SEQ ID NO: 740294 - RNA, 19 nt, Homo sapiens
agcuauauucugagacuuu

SEQ ID NO: 740295 - RNA, 13 nt, Homo sapiens
agcuaucaccuag

SEQ ID NO: 740296 - RNA, 15 nt, Homo sapiens
agcuauccacagcuu

SEQ ID NO: 740297 - RNA, 23 nt, Homo sapiens
agcuaucucucagugaacuguga

SEQ ID NO: 740298 - RNA, 17 nt, Homo sapiens
agcuaugaaaccacugc

SEQ ID NO: 740299 - RNA, 20 nt, Homo sapiens
agcuaugaucgcgccacuac

SEQ ID NO: 740300 - RNA, 22 nt, Homo sapiens
agcuaugauuaugccacugcuu

SEQ ID NO: 740301 - RNA, 21 nt, Homo sapiens
agcuauggcccagaaacaaca

SEQ ID NO: 740302 - RNA, 13 nt, Homo sapiens
agcuauguauuaa

SEQ ID NO: 740303 - RNA, 16 nt, Homo sapiens
agcuauucaccucagu

SEQ ID NO: 740304 - RNA, 17 nt, Homo sapiens
agcuauucucaugccuc

SEQ ID NO: 740305 - RNA, 20 nt, Homo sapiens
agcuauuuaucuguaguaaa

SEQ ID NO: 740306 - RNA, 15 nt, Homo sapiens
agcucaagaacacau

SEQ ID NO: 740307 - RNA, 21 nt, Homo sapiens
agcucacccugcccgcuccca

SEQ ID NO: 740308 - RNA, 16 nt, Homo sapiens
agcucacgucacacuu

SEQ ID NO: 740309 - RNA, 17 nt, Homo sapiens
agcucacuacaaccucc

SEQ ID NO: 740310 - RNA, 18 nt, Homo sapiens
agcucacugaaucuucac

SEQ ID NO: 740311 - RNA, 14 nt, Homo sapiens
agcucacugcugcu

SEQ ID NO: 740312 - RNA, 16 nt, Homo sapiens
agcucagacuugccag

SEQ ID NO: 740313 - RNA, 23 nt, Homo sapiens
agcucaggaaggggugugcugag

SEQ ID NO: 740314 - RNA, 15 nt, Homo sapiens
agcucaggcacacuu

SEQ ID NO: 740315 - RNA, 16 nt, Homo sapiens
agcucaggcacacuuc

SEQ ID NO: 740316 - RNA, 14 nt, Homo sapiens
agcucaggcauuug

SEQ ID NO: 740317 - RNA, 17 nt, Homo sapiens
agcucaguaacugugca

SEQ ID NO: 740318 - RNA, 16 nt, Homo sapiens
agcucauaaacugcca

SEQ ID NO: 740319 - RNA, 19 nt, Homo sapiens
agcucaucuguuaugcaua

SEQ ID NO: 740320 - RNA, 11 nt, Homo sapiens
agcucaugccc

SEQ ID NO: 740321 - RNA, 18 nt, Homo sapiens
agcuccagggccagauga

SEQ ID NO: 740322 - RNA, 18 nt, Homo sapiens
agcucccaggccaacagu

SEQ ID NO: 740323 - RNA, 17 nt, Homo sapiens
agcuccccucacucugu

SEQ ID NO: 740324 - RNA, 22 nt, Homo sapiens
agcucccuguggggcaggagug

SEQ ID NO: 740325 - RNA, 16 nt, Homo sapiens
agcuccuaguuugugg

SEQ ID NO: 740326 - RNA, 18 nt, Homo sapiens
agcuccucucacucuuca

SEQ ID NO: 740327 - RNA, 18 nt, Homo sapiens
agcuccucuccuugggcu

SEQ ID NO: 740328 - RNA, 15 nt, Homo sapiens
agcuccuguguuaca

SEQ ID NO: 740329 - RNA, 17 nt, Homo sapiens
agcuccuguugucauga

SEQ ID NO: 740330 - RNA, 16 nt, Homo sapiens
agcuccuugaguaaaa

SEQ ID NO: 740331 - RNA, 19 nt, Homo sapiens
agcuccuugucugucucca

SEQ ID NO: 740332 - RNA, 19 nt, Homo sapiens
agcucuacgugcuccucag

SEQ ID NO: 740333 - RNA, 13 nt, Homo sapiens
agcucuacucugg

SEQ ID NO: 740334 - RNA, 15 nt, Homo sapiens
agcucuauguuuaca

SEQ ID NO: 740335 - RNA, 21 nt, Homo sapiens
agcucuauguuuacaaaugga

SEQ ID NO: 740336 - RNA, 19 nt, Homo sapiens
agcucucaauuuuauguau

SEQ ID NO: 740337 - RNA, 20 nt, Homo sapiens
agcucucccaacucuugcac

SEQ ID NO: 740338 - RNA, 15 nt, Homo sapiens
agcucucuuccuguc

SEQ ID NO: 740339 - RNA, 13 nt, Homo sapiens
agcucugaaguca

SEQ ID NO: 740340 - RNA, 22 nt, Homo sapiens
agcucugagacccuuuucucag

SEQ ID NO: 740341 - RNA, 23 nt, Homo sapiens
agcucugcagcacucuuaucuac

SEQ ID NO: 740342 - RNA, 17 nt, Homo sapiens
agcucugcgccaaucac

SEQ ID NO: 740343 - RNA, 18 nt, Homo sapiens
agcucuggagaacagugg

SEQ ID NO: 740344 - RNA, 15 nt, Homo sapiens
agcucuggaugaagg

SEQ ID NO: 740345 - RNA, 17 nt, Homo sapiens
agcucuggaugaaggca

SEQ ID NO: 740346 - RNA, 22 nt, Homo sapiens
agcucuggggacagcuuccuca

SEQ ID NO: 740347 - RNA, 18 nt, Homo sapiens
agcucuggguugugcaca

SEQ ID NO: 740348 - RNA, 20 nt, Homo sapiens
agcucuguuuauaaaaacaa

SEQ ID NO: 740349 - RNA, 21 nt, Homo sapiens
agcucuucaggccucccucuc

SEQ ID NO: 740350 - RNA, 23 nt, Homo sapiens
agcucuucgguuucugagcauaa

SEQ ID NO: 740351 - RNA, 13 nt, Homo sapiens
agcugaaagggag

SEQ ID NO: 740352 - RNA, 23 nt, Homo sapiens
agcugaaauuuuagaaauauuca

SEQ ID NO: 740353 - RNA, 14 nt, Homo sapiens
agcugaacaauagg

SEQ ID NO: 740354 - RNA, 16 nt, Homo sapiens
agcugaagaauugaaa

SEQ ID NO: 740355 - RNA, 17 nt, Homo sapiens
agcugaagaccauggau

SEQ ID NO: 740356 - RNA, 15 nt, Homo sapiens
agcugaauacauucu

SEQ ID NO: 740357 - RNA, 16 nt, Homo sapiens
agcugacaucuugcac

SEQ ID NO: 740358 - RNA, 22 nt, Homo sapiens
agcugaccccgagaagugcucu

SEQ ID NO: 740359 - RNA, 22 nt, Homo sapiens
agcugaccccuucgugguuaua

SEQ ID NO: 740360 - RNA, 21 nt, Homo sapiens
agcugacucucgugcauuuca

SEQ ID NO: 740361 - RNA, 18 nt, Homo sapiens
agcugacuguucuuggua

SEQ ID NO: 740362 - RNA, 15 nt, Homo sapiens
agcugagaagcaaug

SEQ ID NO: 740363 - RNA, 16 nt, Homo sapiens
agcugagaucgugcua

SEQ ID NO: 740364 - RNA, 16 nt, Homo sapiens
agcugagauugcacua

SEQ ID NO: 740365 - RNA, 14 nt, Homo sapiens
agcugagccugcag

SEQ ID NO: 740366 - RNA, 21 nt, Homo sapiens
agcugaguaggaggccuccac

SEQ ID NO: 740367 - RNA, 14 nt, Homo sapiens
agcugaguguagug

SEQ ID NO: 740368 - RNA, 19 nt, Homo sapiens
agcugauccagagcacaga

SEQ ID NO: 740369 - RNA, 13 nt, Homo sapiens
agcugauccugcg

SEQ ID NO: 740370 - RNA, 23 nt, Homo sapiens
agcugaucugcggaucucagcuu

SEQ ID NO: 740371 - RNA, 15 nt, Homo sapiens
agcugcacauuccug

SEQ ID NO: 740372 - RNA, 12 nt, Homo sapiens
agcugcacugau

SEQ ID NO: 740373 - RNA, 19 nt, Homo sapiens
agcugcagaugccacaccu

SEQ ID NO: 740374 - RNA, 12 nt, Homo sapiens
agcugcaucauc

SEQ ID NO: 740375 - RNA, 12 nt, Homo sapiens
agcugcauuaaa

SEQ ID NO: 740376 - RNA, 22 nt, Homo sapiens
agcugcauuucacaugccuugc

SEQ ID NO: 740377 - RNA, 22 nt, Homo sapiens
agcugccacuuucacguggccu

SEQ ID NO: 740378 - RNA, 19 nt, Homo sapiens
agcugcccuggcugugaug

SEQ ID NO: 740379 - RNA, 23 nt, Homo sapiens
agcugccgcccccggacucugau

SEQ ID NO: 740380 - RNA, 16 nt, Homo sapiens
agcugccugcagcaca

SEQ ID NO: 740381 - RNA, 22 nt, Homo sapiens
agcugccuuggcucagacaugu

SEQ ID NO: 740382 - RNA, 17 nt, Homo sapiens
agcugcucagugcaacu

SEQ ID NO: 740383 - RNA, 13 nt, Homo sapiens
agcugcucuugca

SEQ ID NO: 740384 - RNA, 21 nt, Homo sapiens
agcugcugaaacaacaaauag

SEQ ID NO: 740385 - RNA, 13 nt, Homo sapiens
agcugcuggccag

SEQ ID NO: 740386 - RNA, 16 nt, Homo sapiens
agcugcugucacuaga

SEQ ID NO: 740387 - RNA, 22 nt, Homo sapiens
agcuggaagggucaacaucuuu

SEQ ID NO: 740388 - RNA, 19 nt, Homo sapiens
agcuggacucccucaagcc

SEQ ID NO: 740389 - RNA, 15 nt, Homo sapiens
agcuggacugaccaa

SEQ ID NO: 740390 - RNA, 22 nt, Homo sapiens
agcuggagcagcggauugcucu

SEQ ID NO: 740391 - RNA, 21 nt, Homo sapiens
agcuggauagacuugggaugg

SEQ ID NO: 740392 - RNA, 21 nt, Homo sapiens
agcuggcagacucgggaccaa

SEQ ID NO: 740393 - RNA, 13 nt, Homo sapiens
agcuggccugaga

SEQ ID NO: 740394 - RNA, 16 nt, Homo sapiens
agcuggcucugugagg

SEQ ID NO: 740395 - RNA, 20 nt, Homo sapiens
agcuggcuuuucccauuuca

SEQ ID NO: 740396 - RNA, 13 nt, Homo sapiens
agcugggagacaa

SEQ ID NO: 740397 - RNA, 14 nt, Homo sapiens
agcugggagacccu

SEQ ID NO: 740398 - RNA, 17 nt, Homo sapiens
agcugggagcacuggug

SEQ ID NO: 740399 - RNA, 17 nt, Homo sapiens
agcugggauaaucacau

SEQ ID NO: 740400 - RNA, 18 nt, Homo sapiens
agcugggauuacaggugu

SEQ ID NO: 740401 - RNA, 20 nt, Homo sapiens
agcugggcccgacauggcuc

SEQ ID NO: 740402 - RNA, 19 nt, Homo sapiens
agcuggggaugucucucau

SEQ ID NO: 740403 - RNA, 20 nt, Homo sapiens
agcuggggggcuguccugag

SEQ ID NO: 740404 - RNA, 16 nt, Homo sapiens
agcuggguacugacug

SEQ ID NO: 740405 - RNA, 21 nt, Homo sapiens
agcugguaggauguaagccug

SEQ ID NO: 740406 - RNA, 12 nt, Homo sapiens
agcugguguccu

SEQ ID NO: 740407 - RNA, 20 nt, Homo sapiens
agcuguaauuucgccuuaaa

SEQ ID NO: 740408 - RNA, 19 nt, Homo sapiens
aggcucucgcacaccucug

SEQ ID NO: 740409 - RNA, 21 nt, Homo sapiens
aggcucugcacagacaagcag

SEQ ID NO: 740410 - RNA, 22 nt, Homo sapiens
aggcucugcccugcccuagcuc

SEQ ID NO: 740411 - RNA, 23 nt, Homo sapiens
aggcucugcccugcccuagcucc

SEQ ID NO: 740412 - RNA, 15 nt, Homo sapiens
aggcucugugccuug

SEQ ID NO: 740413 - RNA, 22 nt, Homo sapiens
aggcucugugccuuggucucuc

SEQ ID NO: 740414 - RNA, 13 nt, Homo sapiens
aggcucuuagcag

SEQ ID NO: 740415 - RNA, 12 nt, Homo sapiens
aggcucuucucc

SEQ ID NO: 740416 - RNA, 18 nt, Homo sapiens
aggcugaauuacagugaa

SEQ ID NO: 740417 - RNA, 18 nt, Homo sapiens
aggcugaggcaggaggau

SEQ ID NO: 740418 - RNA, 21 nt, Homo sapiens
aggcugaggugguaggaucac

SEQ ID NO: 740419 - RNA, 14 nt, Homo sapiens
aggcugcaaugagc

SEQ ID NO: 740420 - RNA, 15 nt, Homo sapiens
aggcugcagauuucc

SEQ ID NO: 740421 - RNA, 20 nt, Homo sapiens
aggcugcagcgagcuaugau

SEQ ID NO: 740422 - RNA, 15 nt, Homo sapiens
aggcugcaugcucug

SEQ ID NO: 740423 - RNA, 18 nt, Homo sapiens
aggcugcccacucuccau

SEQ ID NO: 740424 - RNA, 15 nt, Homo sapiens
aggcugccccucuca

SEQ ID NO: 740425 - RNA, 19 nt, Homo sapiens
aggcugccccucucaccaa

SEQ ID NO: 740426 - RNA, 16 nt, Homo sapiens
aggcugcucagggcug

SEQ ID NO: 740427 - RNA, 20 nt, Homo sapiens
aggcuggaguacaguggcac

SEQ ID NO: 740428 - RNA, 18 nt, Homo sapiens
aggcuggagugcaaugca

SEQ ID NO: 740429 - RNA, 16 nt, Homo sapiens
aggcuggagugcagug

SEQ ID NO: 740430 - RNA, 20 nt, Homo sapiens
aggcuggagugcagugccac

SEQ ID NO: 740431 - RNA, 15 nt, Homo sapiens
aggcuggccagucca

SEQ ID NO: 740432 - RNA, 22 nt, Homo sapiens
aggcugggaacucaucugguug

SEQ ID NO: 740433 - RNA, 12 nt, Homo sapiens
aggcugggccau

SEQ ID NO: 740434 - RNA, 13 nt, Homo sapiens
aggcuggucucaa

SEQ ID NO: 740435 - RNA, 23 nt, Homo sapiens
aggcugucaggauucuucaagga

SEQ ID NO: 740436 - RNA, 15 nt, Homo sapiens
aggcugucuucucag

SEQ ID NO: 740437 - RNA, 17 nt, Homo sapiens
aggcugucuucucaggc

SEQ ID NO: 740438 - RNA, 21 nt, Homo sapiens
aggcuucaguuuuacucugcu

SEQ ID NO: 740439 - RNA, 16 nt, Homo sapiens
aggcuucuauguccaa

SEQ ID NO: 740440 - RNA, 14 nt, Homo sapiens
aggcuucucuccac

SEQ ID NO: 740441 - RNA, 14 nt, Homo sapiens
aggcuuuacagugu

SEQ ID NO: 740442 - RNA, 16 nt, Homo sapiens
aggcuuuaucucaggg

SEQ ID NO: 740443 - RNA, 21 nt, Homo sapiens
aggcuuuguacagagugcuuu

SEQ ID NO: 740444 - RNA, 18 nt, Homo sapiens
agggaaaaggaguaggga

SEQ ID NO: 740445 - RNA, 14 nt, Homo sapiens
agggaaaaugagua

SEQ ID NO: 740446 - RNA, 14 nt, Homo sapiens
agggaaagcauuua

SEQ ID NO: 740447 - RNA, 21 nt, Homo sapiens
agggaaccugguacauccagu

SEQ ID NO: 740448 - RNA, 18 nt, Homo sapiens
agggaacgggguccuuca

SEQ ID NO: 740449 - RNA, 17 nt, Homo sapiens
agggaacgguccaugaa

SEQ ID NO: 740450 - RNA, 20 nt, Homo sapiens
agggaagaaugaacacuccc

SEQ ID NO: 740451 - RNA, 20 nt, Homo sapiens
agggaagagugcauuuuccc

SEQ ID NO: 740452 - RNA, 19 nt, Homo sapiens
agggaagccccacuugaag

SEQ ID NO: 740453 - RNA, 22 nt, Homo sapiens
agggaagguucuucaugaucca

SEQ ID NO: 740454 - RNA, 13 nt, Homo sapiens
agggaauccuccu

SEQ ID NO: 740455 - RNA, 22 nt, Homo sapiens
agggaaugagaguuccuucuca

SEQ ID NO: 740456 - RNA, 23 nt, Homo sapiens
agggaaugagaguuccuucucac

SEQ ID NO: 740457 - RNA, 13 nt, Homo sapiens
agggaaugcucag

SEQ ID NO: 740458 - RNA, 15 nt, Homo sapiens
agggacaaacucacu

SEQ ID NO: 740459 - RNA, 17 nt, Homo sapiens
agggacaggcacuccaa

SEQ ID NO: 740460 - RNA, 20 nt, Homo sapiens
agggacaggcuccucugggg

SEQ ID NO: 740461 - RNA, 21 nt, Homo sapiens
agggacaugcccuguguggcu

SEQ ID NO: 740462 - RNA, 13 nt, Homo sapiens
agggaccugcuca

SEQ ID NO: 740463 - RNA, 20 nt, Homo sapiens
agggaccuuggagagcucag

SEQ ID NO: 740464 - RNA, 14 nt, Homo sapiens
agggacuccaugcu

SEQ ID NO: 740465 - RNA, 14 nt, Homo sapiens
agggacuccuccug

SEQ ID NO: 740466 - RNA, 20 nt, Homo sapiens
agggacugacaaaagacuug

SEQ ID NO: 740467 - RNA, 22 nt, Homo sapiens
agggacuucugucuucacaaca

SEQ ID NO: 740468 - RNA, 21 nt, Homo sapiens
agggacuugaaugcacuuuug

SEQ ID NO: 740469 - RNA, 15 nt, Homo sapiens
agggagaacuugaaa

SEQ ID NO: 740470 - RNA, 20 nt, Homo sapiens
agggagaacuugaaacagau

SEQ ID NO: 740471 - RNA, 15 nt, Homo sapiens
agggagaagcaugaa

SEQ ID NO: 740472 - RNA, 14 nt, Homo sapiens
agggagaagggaug

SEQ ID NO: 740473 - RNA, 18 nt, Homo sapiens
agggagacugcaucucaa

SEQ ID NO: 740474 - RNA, 14 nt, Homo sapiens
agggagcaccagau

SEQ ID NO: 740475 - RNA, 14 nt, Homo sapiens
agggagcacugggu

SEQ ID NO: 740476 - RNA, 16 nt, Homo sapiens
agggagcccccagagg

SEQ ID NO: 740477 - RNA, 18 nt, Homo sapiens
agggagcccccagaggac

SEQ ID NO: 740478 - RNA, 16 nt, Homo sapiens
agggagggcuguggug

SEQ ID NO: 740479 - RNA, 19 nt, Homo sapiens
agggagggguuauagcuuc

SEQ ID NO: 740480 - RNA, 15 nt, Homo sapiens
agggaguccagggug

SEQ ID NO: 740481 - RNA, 18 nt, Homo sapiens
agggagugcacauaucca

SEQ ID NO: 740482 - RNA, 12 nt, Homo sapiens
agggagugcaug

SEQ ID NO: 740483 - RNA, 20 nt, Homo sapiens
agggauauuuuuuucuauua

SEQ ID NO: 740484 - RNA, 16 nt, Homo sapiens
agggaucacugccaaa

SEQ ID NO: 740485 - RNA, 18 nt, Homo sapiens
agggaugagauacuuaug

SEQ ID NO: 740486 - RNA, 18 nt, Homo sapiens
agggaugcggauccugcu

SEQ ID NO: 740487 - RNA, 17 nt, Homo sapiens
agggaugcugccugagu

SEQ ID NO: 740488 - RNA, 19 nt, Homo sapiens
agggauggagcugaaaaag

SEQ ID NO: 740489 - RNA, 23 nt, Homo sapiens
agggauggggcagucucugccca

SEQ ID NO: 740490 - RNA, 18 nt, Homo sapiens
agggauuuggggcucaga

SEQ ID NO: 740491 - RNA, 22 nt, Homo sapiens
agggcacccuaguucuaccuca

SEQ ID NO: 740492 - RNA, 15 nt, Homo sapiens
agggcagacagcaga

SEQ ID NO: 740493 - RNA, 15 nt, Homo sapiens
agggcagagaauggc

SEQ ID NO: 740494 - RNA, 19 nt, Homo sapiens
agggcagggccaguuccuc

SEQ ID NO: 740495 - RNA, 17 nt, Homo sapiens
agggcaggggugcugug

SEQ ID NO: 740496 - RNA, 17 nt, Homo sapiens
agggcaguucugagugu

SEQ ID NO: 740497 - RNA, 17 nt, Homo sapiens
agggcauggccaggugg

SEQ ID NO: 740498 - RNA, 19 nt, Homo sapiens
agggccaagagaucugugu

SEQ ID NO: 740499 - RNA, 23 nt, Homo sapiens
agggccacauagaugcugaugga

SEQ ID NO: 740500 - RNA, 18 nt, Homo sapiens
agggcccaucaggcagug

SEQ ID NO: 740501 - RNA, 17 nt, Homo sapiens
agggcccuccgaccacu

SEQ ID NO: 740502 - RNA, 14 nt, Homo sapiens
agggccgcccgggc

SEQ ID NO: 740503 - RNA, 22 nt, Homo sapiens
agggccucaguuucauuaacug

SEQ ID NO: 740504 - RNA, 18 nt, Homo sapiens
agggcuagcaucccugag

SEQ ID NO: 740505 - RNA, 15 nt, Homo sapiens
agggcuagugacuug

SEQ ID NO: 740506 - RNA, 16 nt, Homo sapiens
agggcucacucagcca

SEQ ID NO: 740507 - RNA, 22 nt, Homo sapiens
agggcucugcaggccacuguga

SEQ ID NO: 740508 - RNA, 14 nt, Homo sapiens
agggcucuuugaug

SEQ ID NO: 740509 - RNA, 13 nt, Homo sapiens
agggcugacauuu

SEQ ID NO: 740510 - RNA, 21 nt, Homo sapiens
agggcugaccugccucucaca

SEQ ID NO: 740511 - RNA, 18 nt, Homo sapiens
agggcugauggaggaaaa

SEQ ID NO: 740512 - RNA, 14 nt, Homo sapiens
agggcugcaaaagu

SEQ ID NO: 740513 - RNA, 15 nt, Homo sapiens
agggcugcaaugccc

SEQ ID NO: 740514 - RNA, 18 nt, Homo sapiens
agggcugcacauugccug

SEQ ID NO: 740515 - RNA, 18 nt, Homo sapiens
agggcuggcaccucucaa

SEQ ID NO: 740516 - RNA, 15 nt, Homo sapiens
agggcuggggacaga

SEQ ID NO: 740517 - RNA, 16 nt, Homo sapiens
agggcugucuucguau

SEQ ID NO: 740518 - RNA, 21 nt, Homo sapiens
agggcuguggugccggugcuu

SEQ ID NO: 740519 - RNA, 15 nt, Homo sapiens
aggggaaauuuggcu

SEQ ID NO: 740520 - RNA, 16 nt, Homo sapiens
aggggacccauguaau

SEQ ID NO: 740521 - RNA, 16 nt, Homo sapiens
aggggaggcaccucca

SEQ ID NO: 740522 - RNA, 17 nt, Homo sapiens
aggggagucccuguggu

SEQ ID NO: 740523 - RNA, 17 nt, Homo sapiens
agugaaaacaaguccuu

SEQ ID NO: 740524 - RNA, 23 nt, Homo sapiens
agugaaagaagccacagcucuuc

SEQ ID NO: 740525 - RNA, 16 nt, Homo sapiens
agugaaagccagauuc

SEQ ID NO: 740526 - RNA, 18 nt, Homo sapiens
agugaaauuauacagaua

SEQ ID NO: 740527 - RNA, 14 nt, Homo sapiens
agugaacauucuga

SEQ ID NO: 740528 - RNA, 13 nt, Homo sapiens
agugaaccuuuag

SEQ ID NO: 740529 - RNA, 15 nt, Homo sapiens
agugaagaacacuac

SEQ ID NO: 740530 - RNA, 18 nt, Homo sapiens
agugaagaaucuaaugaa

SEQ ID NO: 740531 - RNA, 16 nt, Homo sapiens
agugaagaugccagug

SEQ ID NO: 740532 - RNA, 16 nt, Homo sapiens
agugaaggucaccugg

SEQ ID NO: 740533 - RNA, 16 nt, Homo sapiens
agugaagugaaucuga

SEQ ID NO: 740534 - RNA, 16 nt, Homo sapiens
agugaaguugugcaac

SEQ ID NO: 740535 - RNA, 22 nt, Homo sapiens
agugaaguugugcaacggccag

SEQ ID NO: 740536 - RNA, 22 nt, Homo sapiens
agugaaguuuuacugucuauua

SEQ ID NO: 740537 - RNA, 18 nt, Homo sapiens
agugacaacaucgcaaua

SEQ ID NO: 740538 - RNA, 12 nt, Homo sapiens
agugacacugga

SEQ ID NO: 740539 - RNA, 18 nt, Homo sapiens
agugacagcagucaggga

SEQ ID NO: 740540 - RNA, 20 nt, Homo sapiens
agugacagcuugaguggguu

SEQ ID NO: 740541 - RNA, 20 nt, Homo sapiens
agugacaguugcagcccuug

SEQ ID NO: 740542 - RNA, 14 nt, Homo sapiens
agugacuccugcug

SEQ ID NO: 740543 - RNA, 15 nt, Homo sapiens
agugacuucugagau

SEQ ID NO: 740544 - RNA, 22 nt, Homo sapiens
agugacuugugucccaugaucc

SEQ ID NO: 740545 - RNA, 21 nt, Homo sapiens
agugagaaagaauaggggcug

SEQ ID NO: 740546 - RNA, 13 nt, Homo sapiens
agugagaacagca

SEQ ID NO: 740547 - RNA, 18 nt, Homo sapiens
agugagacuccaccucaa

SEQ ID NO: 740548 - RNA, 22 nt, Homo sapiens
agugagcacucacgcccuaagc

SEQ ID NO: 740549 - RNA, 15 nt, Homo sapiens
agugagccaagauca

SEQ ID NO: 740550 - RNA, 18 nt, Homo sapiens
agugagcguagcagcuca

SEQ ID NO: 740551 - RNA, 15 nt, Homo sapiens
agugaggaacccuga

SEQ ID NO: 740552 - RNA, 17 nt, Homo sapiens
agugagggcucacucag

SEQ ID NO: 740553 - RNA, 13 nt, Homo sapiens
agugagucucuuc

SEQ ID NO: 740554 - RNA, 21 nt, Homo sapiens
agugauaucccccagccucaa

SEQ ID NO: 740555 - RNA, 16 nt, Homo sapiens
agugauaugcauuucc

SEQ ID NO: 740556 - RNA, 18 nt, Homo sapiens
agugaucuacguagcucg

SEQ ID NO: 740557 - RNA, 18 nt, Homo sapiens
agugaucuugagaaccuu

SEQ ID NO: 740558 - RNA, 17 nt, Homo sapiens
agugaugaaaacauuca

SEQ ID NO: 740559 - RNA, 15 nt, Homo sapiens
agugauguuagcaga

SEQ ID NO: 740560 - RNA, 21 nt, Homo sapiens
agugauugacacacagcacuc

SEQ ID NO: 740561 - RNA, 17 nt, Homo sapiens
agugauugcagcuuuau

SEQ ID NO: 740562 - RNA, 18 nt, Homo sapiens
agugcaacaucucugaau

SEQ ID NO: 740563 - RNA, 17 nt, Homo sapiens
agugcaacccagucaca

SEQ ID NO: 740564 - RNA, 18 nt, Homo sapiens
agugcaauaaaucugacc

SEQ ID NO: 740565 - RNA, 17 nt, Homo sapiens
agugcaaugcacgaucu

SEQ ID NO: 740566 - RNA, 12 nt, Homo sapiens
agugcacagcug

SEQ ID NO: 740567 - RNA, 16 nt, Homo sapiens
agugcaccugccucca

SEQ ID NO: 740568 - RNA, 19 nt, Homo sapiens
agugcagaucugugcucau

SEQ ID NO: 740569 - RNA, 12 nt, Homo sapiens
agugcagccacu

SEQ ID NO: 740570 - RNA, 13 nt, Homo sapiens
agugcagugccac

SEQ ID NO: 740571 - RNA, 20 nt, Homo sapiens
agugcaguggcgcgaucuca

SEQ ID NO: 740572 - RNA, 23 nt, Homo sapiens
agugcaguggcgcgaucucagcu

SEQ ID NO: 740573 - RNA, 16 nt, Homo sapiens
agugcaguggugcaau

SEQ ID NO: 740574 - RNA, 18 nt, Homo sapiens
agugcaguggugccauca

SEQ ID NO: 740575 - RNA, 16 nt, Homo sapiens
agugcaguugugauuu

SEQ ID NO: 740576 - RNA, 13 nt, Homo sapiens
agugcaucuugcu

SEQ ID NO: 740577 - RNA, 18 nt, Homo sapiens
agugcaucuuugccucaa

SEQ ID NO: 740578 - RNA, 13 nt, Homo sapiens
agugcauuugacu

SEQ ID NO: 740579 - RNA, 13 nt, Homo sapiens
agugccaagcaca

SEQ ID NO: 740580 - RNA, 18 nt, Homo sapiens
agugccacaugccuacga

SEQ ID NO: 740581 - RNA, 13 nt, Homo sapiens
agugccagcuuuc

SEQ ID NO: 740582 - RNA, 17 nt, Homo sapiens
agugccgaggacaugca

SEQ ID NO: 740583 - RNA, 17 nt, Homo sapiens
agugccggcugccaaga

SEQ ID NO: 740584 - RNA, 21 nt, Homo sapiens
agugccguaacaacugugguc

SEQ ID NO: 740585 - RNA, 21 nt, Homo sapiens
agugccuacccaccugugagg

SEQ ID NO: 740586 - RNA, 13 nt, Homo sapiens
agugccugagaca

SEQ ID NO: 740587 - RNA, 17 nt, Homo sapiens
agugccugccuaugaaa

SEQ ID NO: 740588 - RNA, 22 nt, Homo sapiens
agugccuuccucucucuaccag

SEQ ID NO: 740589 - RNA, 14 nt, Homo sapiens
agugccuucucuca

SEQ ID NO: 740590 - RNA, 14 nt, Homo sapiens
agugccuuuaguuu

SEQ ID NO: 740591 - RNA, 14 nt, Homo sapiens
agugcucaauagcu

SEQ ID NO: 740592 - RNA, 16 nt, Homo sapiens
agugcugagggaccga

SEQ ID NO: 740593 - RNA, 11 nt, Homo sapiens
agugcugccau

SEQ ID NO: 740594 - RNA, 13 nt, Homo sapiens
agugcugggauga

SEQ ID NO: 740595 - RNA, 16 nt, Homo sapiens
agugcuuccacuucua

SEQ ID NO: 740596 - RNA, 16 nt, Homo sapiens
agugcuuggguggugg

SEQ ID NO: 740597 - RNA, 19 nt, Homo sapiens
agugcuuuuacuaucugug

SEQ ID NO: 740598 - RNA, 14 nt, Homo sapiens
aguggaacaugcaa

SEQ ID NO: 740599 - RNA, 23 nt, Homo sapiens
aguggaacaugcaaggcacugac

SEQ ID NO: 740600 - RNA, 19 nt, Homo sapiens
aguggaacuaaaauucugu

SEQ ID NO: 740601 - RNA, 14 nt, Homo sapiens
aguggaaugcuucc

SEQ ID NO: 740602 - RNA, 13 nt, Homo sapiens
aguggaggcauug

SEQ ID NO: 740603 - RNA, 16 nt, Homo sapiens
aguggauuacugccau

SEQ ID NO: 740604 - RNA, 20 nt, Homo sapiens
aguggcaaguaaguuauaga

SEQ ID NO: 740605 - RNA, 17 nt, Homo sapiens
aguggcaccagaggugc

SEQ ID NO: 740606 - RNA, 19 nt, Homo sapiens
aguggcaggggacaggagu

SEQ ID NO: 740607 - RNA, 18 nt, Homo sapiens
aguggcaugugcugugac

SEQ ID NO: 740608 - RNA, 12 nt, Homo sapiens
aguggccaguuc

SEQ ID NO: 740609 - RNA, 20 nt, Homo sapiens
aguggccaugccacccuguu

SEQ ID NO: 740610 - RNA, 15 nt, Homo sapiens
aguggccgaugauuu

SEQ ID NO: 740611 - RNA, 15 nt, Homo sapiens
aguggcgcaugccug

SEQ ID NO: 740612 - RNA, 20 nt, Homo sapiens
aguggcgcgaucucagcuca

SEQ ID NO: 740613 - RNA, 20 nt, Homo sapiens
aguggcgcgaucucggcuca

SEQ ID NO: 740614 - RNA, 20 nt, Homo sapiens
aguggcgugaucucagcuca

SEQ ID NO: 740615 - RNA, 19 nt, Homo sapiens
aguggcgugggagccagcc

SEQ ID NO: 740616 - RNA, 18 nt, Homo sapiens
aguggcuaccuacauaca

SEQ ID NO: 740617 - RNA, 14 nt, Homo sapiens
aguggcugcuucuc

SEQ ID NO: 740618 - RNA, 14 nt, Homo sapiens
aguggcuggucuca

SEQ ID NO: 740619 - RNA, 20 nt, Homo sapiens
aguggcuucccagcucugac

SEQ ID NO: 740620 - RNA, 17 nt, Homo sapiens
agugggaauccgggaca

SEQ ID NO: 740621 - RNA, 15 nt, Homo sapiens
agugggcauugccau

SEQ ID NO: 740622 - RNA, 22 nt, Homo sapiens
agugggccccgggcuggagaaa

SEQ ID NO: 740623 - RNA, 16 nt, Homo sapiens
agugggccuccaagga

SEQ ID NO: 740624 - RNA, 19 nt, Homo sapiens
aguggguaauccaggcaca

SEQ ID NO: 740625 - RNA, 20 nt, Homo sapiens
agugggugccccccuugcca

SEQ ID NO: 740626 - RNA, 13 nt, Homo sapiens
agugguacaggaa

SEQ ID NO: 740627 - RNA, 17 nt, Homo sapiens
aguggucgagugacaca

SEQ ID NO: 740628 - RNA, 15 nt, Homo sapiens
aguggugacauaguc

SEQ ID NO: 740629 - RNA, 13 nt, Homo sapiens
aguggugccaaac

SEQ ID NO: 740630 - RNA, 23 nt, Homo sapiens
agugguggguaauuguacaauaa

SEQ ID NO: 740631 - RNA, 18 nt, Homo sapiens
agugguguaggugggggu

SEQ ID NO: 740632 - RNA, 15 nt, Homo sapiens
aguggugugaucucg

SEQ ID NO: 740633 - RNA, 22 nt, Homo sapiens
agugguucaagcacacuggaau

SEQ ID NO: 740634 - RNA, 16 nt, Homo sapiens
agugguuuccagucau

SEQ ID NO: 740635 - RNA, 13 nt, Homo sapiens
aguguaaacugaa

SEQ ID NO: 740636 - RNA, 10 nt, Homo sapiens
aguguaagaa

SEQ ID NO: 740637 - RNA, 15 nt, Homo sapiens
aguguaaugugacuu

SEQ ID NO: 740638 - RNA, 22 nt, Homo sapiens
aguguaaugugacuucaugcua

SEQ ID NO: 740639 - RNA, 14 nt, Homo sapiens
auaaauguauucaa

SEQ ID NO: 740640 - RNA, 14 nt, Homo sapiens
auaaaugugaacuu

SEQ ID NO: 740641 - RNA, 13 nt, Homo sapiens
auaaauguuuaaa

SEQ ID NO: 740642 - RNA, 22 nt, Homo sapiens
auaaauucuauaggaacauaug

SEQ ID NO: 740643 - RNA, 13 nt, Homo sapiens
auaaauuuaucag

SEQ ID NO: 740644 - RNA, 15 nt, Homo sapiens
auaaauuugcacugu

SEQ ID NO: 740645 - RNA, 16 nt, Homo sapiens
auaaauuugcacuguu

SEQ ID NO: 740646 - RNA, 17 nt, Homo sapiens
auaacaagauuuucuua

SEQ ID NO: 740647 - RNA, 19 nt, Homo sapiens
auaacaagugggugaaugu

SEQ ID NO: 740648 - RNA, 15 nt, Homo sapiens
auaacaaugacacua

SEQ ID NO: 740649 - RNA, 22 nt, Homo sapiens
auaacacagagagacagacuug

SEQ ID NO: 740650 - RNA, 12 nt, Homo sapiens
auaacacuguga

SEQ ID NO: 740651 - RNA, 13 nt, Homo sapiens
auaacagaauuaa

SEQ ID NO: 740652 - RNA, 16 nt, Homo sapiens
auaacauccaacuaac

SEQ ID NO: 740653 - RNA, 21 nt, Homo sapiens
auaacauguaaaauccagggu

SEQ ID NO: 740654 - RNA, 11 nt, Homo sapiens
auaaccaaaga

SEQ ID NO: 740655 - RNA, 12 nt, Homo sapiens
auaaccaaagag

SEQ ID NO: 740656 - RNA, 23 nt, Homo sapiens
auaaccagcugaaguugcagaug

SEQ ID NO: 740657 - RNA, 17 nt, Homo sapiens
auaaccucucugugcca

SEQ ID NO: 740658 - RNA, 18 nt, Homo sapiens
auaacuaguguugcuugg

SEQ ID NO: 740659 - RNA, 13 nt, Homo sapiens
auaacucaauaua

SEQ ID NO: 740660 - RNA, 13 nt, Homo sapiens
auaacucuucuaa

SEQ ID NO: 740661 - RNA, 15 nt, Homo sapiens
auaacucuucuaaca

SEQ ID NO: 740662 - RNA, 15 nt, Homo sapiens
auaacugaugaagga

SEQ ID NO: 740663 - RNA, 23 nt, Homo sapiens
auaacuggaaaacagaacacuua

SEQ ID NO: 740664 - RNA, 16 nt, Homo sapiens
auaacuggauugcaga

SEQ ID NO: 740665 - RNA, 13 nt, Homo sapiens
auaacuugauaua

SEQ ID NO: 740666 - RNA, 17 nt, Homo sapiens
auaagaacugugcagua

SEQ ID NO: 740667 - RNA, 21 nt, Homo sapiens
auaagaagaaguucaugucca

SEQ ID NO: 740668 - RNA, 13 nt, Homo sapiens
auaagacuacuau

SEQ ID NO: 740669 - RNA, 21 nt, Homo sapiens
auaagacuacugaaucugcua

SEQ ID NO: 740670 - RNA, 17 nt, Homo sapiens
auaagaggugaucucug

SEQ ID NO: 740671 - RNA, 18 nt, Homo sapiens
auaagagugccguaacaa

SEQ ID NO: 740672 - RNA, 15 nt, Homo sapiens
auaagauacacagcu

SEQ ID NO: 740673 - RNA, 23 nt, Homo sapiens
auaagcaaagggagcacuggguu

SEQ ID NO: 740674 - RNA, 17 nt, Homo sapiens
auaagccacucuguccc

SEQ ID NO: 740675 - RNA, 14 nt, Homo sapiens
auaagcccaguuca

SEQ ID NO: 740676 - RNA, 16 nt, Homo sapiens
auaaggaaagcaauaa

SEQ ID NO: 740677 - RNA, 21 nt, Homo sapiens
auaaggacagcagcuggugcc

SEQ ID NO: 740678 - RNA, 21 nt, Homo sapiens
auaaggacucacacaaauuaa

SEQ ID NO: 740679 - RNA, 13 nt, Homo sapiens
auaaggcccagag

SEQ ID NO: 740680 - RNA, 20 nt, Homo sapiens
auaagggaaaaaucaaguau

SEQ ID NO: 740681 - RNA, 20 nt, Homo sapiens
auaaggggaaagauaauauu

SEQ ID NO: 740682 - RNA, 23 nt, Homo sapiens
auaagguuuuaaguuguuugcau

SEQ ID NO: 740683 - RNA, 16 nt, Homo sapiens
auaaguaaagaauuac

SEQ ID NO: 740684 - RNA, 16 nt, Homo sapiens
auaaguauuuauugca

SEQ ID NO: 740685 - RNA, 15 nt, Homo sapiens
auaagucaagcacau

SEQ ID NO: 740686 - RNA, 22 nt, Homo sapiens
auaagugaagugauacuaucca

SEQ ID NO: 740687 - RNA, 16 nt, Homo sapiens
auaaguggccuugaca

SEQ ID NO: 740688 - RNA, 15 nt, Homo sapiens
auaauaaaaagcauu

SEQ ID NO: 740689 - RNA, 15 nt, Homo sapiens
auaauaaauacucag

SEQ ID NO: 740690 - RNA, 16 nt, Homo sapiens
auaauaaauacucagu

SEQ ID NO: 740691 - RNA, 18 nt, Homo sapiens
auaauaaaugcccucuuc

SEQ ID NO: 740692 - RNA, 16 nt, Homo sapiens
auaauaagcuaaagag

SEQ ID NO: 740693 - RNA, 17 nt, Homo sapiens
auaauaggaacaaucuu

SEQ ID NO: 740694 - RNA, 15 nt, Homo sapiens
auaauagguauauag

SEQ ID NO: 740695 - RNA, 12 nt, Homo sapiens
auaauagucaau

SEQ ID NO: 740696 - RNA, 17 nt, Homo sapiens
auaauaguccaccuccc

SEQ ID NO: 740697 - RNA, 15 nt, Homo sapiens
auaauaucugugagg

SEQ ID NO: 740698 - RNA, 19 nt, Homo sapiens
auaauauucagccagcuua

SEQ ID NO: 740699 - RNA, 19 nt, Homo sapiens
auaauauuucaagugccua

SEQ ID NO: 740700 - RNA, 21 nt, Homo sapiens
auaaucaaucauuucuauuaa

SEQ ID NO: 740701 - RNA, 15 nt, Homo sapiens
auaaucacucuaauu

SEQ ID NO: 740702 - RNA, 16 nt, Homo sapiens
auaaucagucaugugu

SEQ ID NO: 740703 - RNA, 15 nt, Homo sapiens
auaaucccacccacc

SEQ ID NO: 740704 - RNA, 12 nt, Homo sapiens
auaaucuacucc

SEQ ID NO: 740705 - RNA, 14 nt, Homo sapiens
auaaugaggaugau

SEQ ID NO: 740706 - RNA, 11 nt, Homo sapiens
auaaugcagaa

SEQ ID NO: 740707 - RNA, 11 nt, Homo sapiens
auaaugcucac

SEQ ID NO: 740708 - RNA, 17 nt, Homo sapiens
auaauggaaacauuuac

SEQ ID NO: 740709 - RNA, 20 nt, Homo sapiens
auaaugucauuaaacaugac

SEQ ID NO: 740710 - RNA, 21 nt, Homo sapiens
auaaugucauuaaacaugaca

SEQ ID NO: 740711 - RNA, 21 nt, Homo sapiens
auaauguuacauuauuaucaa

SEQ ID NO: 740712 - RNA, 22 nt, Homo sapiens
auaauguuaucuguguagcaag

SEQ ID NO: 740713 - RNA, 22 nt, Homo sapiens
auaauguucugcuaaauuucaa

SEQ ID NO: 740714 - RNA, 21 nt, Homo sapiens
auaauuaaauuuugaguucua

SEQ ID NO: 740715 - RNA, 20 nt, Homo sapiens
auaauuaaccaccaauccaa

SEQ ID NO: 740716 - RNA, 16 nt, Homo sapiens
auaauuauaauguugc

SEQ ID NO: 740717 - RNA, 14 nt, Homo sapiens
auaauucaagucag

SEQ ID NO: 740718 - RNA, 15 nt, Homo sapiens
auaauucagcacuua

SEQ ID NO: 740719 - RNA, 22 nt, Homo sapiens
auaauucuaaguuauuuacuuu

SEQ ID NO: 740720 - RNA, 16 nt, Homo sapiens
auaauucucucacaaa

SEQ ID NO: 740721 - RNA, 17 nt, Homo sapiens
auaauugcaucaguuca

SEQ ID NO: 740722 - RNA, 16 nt, Homo sapiens
auaauuuaccuaagau

SEQ ID NO: 740723 - RNA, 14 nt, Homo sapiens
auaauuuauacagg

SEQ ID NO: 740724 - RNA, 17 nt, Homo sapiens
auaauuucaaaccacac

SEQ ID NO: 740725 - RNA, 19 nt, Homo sapiens
auaauuucaaaccacacau

SEQ ID NO: 740726 - RNA, 14 nt, Homo sapiens
auaauuucuaaugu

SEQ ID NO: 740727 - RNA, 19 nt, Homo sapiens
auaauuucuauuaauauca

SEQ ID NO: 740728 - RNA, 15 nt, Homo sapiens
auaauuuucauucau

SEQ ID NO: 740729 - RNA, 20 nt, Homo sapiens
auaauuuucauucauucacu

SEQ ID NO: 740730 - RNA, 12 nt, Homo sapiens
auaauuuugccu

SEQ ID NO: 740731 - RNA, 19 nt, Homo sapiens
auaauuuugcuugcugaag

SEQ ID NO: 740732 - RNA, 20 nt, Homo sapiens
auaauuuuuaccuaaucucc

SEQ ID NO: 740733 - RNA, 20 nt, Homo sapiens
auacaaaaaauuagccagau

SEQ ID NO: 740734 - RNA, 14 nt, Homo sapiens
auacaaaccuacca

SEQ ID NO: 740735 - RNA, 14 nt, Homo sapiens
auacaaauuccaca

SEQ ID NO: 740736 - RNA, 18 nt, Homo sapiens
auacaacagaaaccagaa

SEQ ID NO: 740737 - RNA, 15 nt, Homo sapiens
auacaacaggcagug

SEQ ID NO: 740738 - RNA, 16 nt, Homo sapiens
auacaaucagcccagu

SEQ ID NO: 740739 - RNA, 22 nt, Homo sapiens
auacaauuauuuuuacaguucu

SEQ ID NO: 740740 - RNA, 20 nt, Homo sapiens
auacaauucacagcacagua

SEQ ID NO: 740741 - RNA, 19 nt, Homo sapiens
auacaauuccaaacacaua

SEQ ID NO: 740742 - RNA, 12 nt, Homo sapiens
auacacacucaa

SEQ ID NO: 740743 - RNA, 22 nt, Homo sapiens
auacacagcuuuaugauaucaa

SEQ ID NO: 740744 - RNA, 21 nt, Homo sapiens
auacacgguauuuauagagag

SEQ ID NO: 740745 - RNA, 20 nt, Homo sapiens
auacacucauccuacuucaa

SEQ ID NO: 740746 - RNA, 23 nt, Homo sapiens
auacacuguaucuaaaaaauaac

SEQ ID NO: 740747 - RNA, 15 nt, Homo sapiens
auacacuuacacuuu

SEQ ID NO: 740748 - RNA, 16 nt, Homo sapiens
auacagaaaugcaaaa

SEQ ID NO: 740749 - RNA, 21 nt, Homo sapiens
auacagaagcagugugagcag

SEQ ID NO: 740750 - RNA, 21 nt, Homo sapiens
auacagaguuuuagaaaugag

SEQ ID NO: 740751 - RNA, 15 nt, Homo sapiens
auacagaucaucuug

SEQ ID NO: 740752 - RNA, 13 nt, Homo sapiens
auacagccugcaa

SEQ ID NO: 740753 - RNA, 16 nt, Homo sapiens
auacagcucuucucag

SEQ ID NO: 740754 - RNA, 21 nt, Homo sapiens
auuagucuuuuguaauaucaa

SEQ ID NO: 740755 - RNA, 23 nt, Homo sapiens
auuagugggauuuuaugccaguu

SEQ ID NO: 740756 - RNA, 21 nt, Homo sapiens
auuauaaaaaauaaaggcaaa

SEQ ID NO: 740757 - RNA, 14 nt, Homo sapiens
auuauaaacccaca

SEQ ID NO: 740758 - RNA, 22 nt, Homo sapiens
auuauaaauaaauagauguguc

SEQ ID NO: 740759 - RNA, 19 nt, Homo sapiens
auuauaaaugacaaccuga

SEQ ID NO: 740760 - RNA, 23 nt, Homo sapiens
auuauacgcuggcaacacagagg

SEQ ID NO: 740761 - RNA, 12 nt, Homo sapiens
auuauacuguau

SEQ ID NO: 740762 - RNA, 15 nt, Homo sapiens
auuauacuguauuaa

SEQ ID NO: 740763 - RNA, 12 nt, Homo sapiens
auuauacuugag

SEQ ID NO: 740764 - RNA, 15 nt, Homo sapiens
auuauauaacuguau

SEQ ID NO: 740765 - RNA, 14 nt, Homo sapiens
auuauauguucaga

SEQ ID NO: 740766 - RNA, 14 nt, Homo sapiens
auuaucaagcuuuu

SEQ ID NO: 740767 - RNA, 13 nt, Homo sapiens
auuaucaucugaa

SEQ ID NO: 740768 - RNA, 21 nt, Homo sapiens
auuaucccccaaaaugcauuu

SEQ ID NO: 740769 - RNA, 17 nt, Homo sapiens
auuauccuucuacuugu

SEQ ID NO: 740770 - RNA, 17 nt, Homo sapiens
auuaucgggaacagugu

SEQ ID NO: 740771 - RNA, 18 nt, Homo sapiens
auuaucgggaacaguguu

SEQ ID NO: 740772 - RNA, 17 nt, Homo sapiens
auuaucgggagcagugu

SEQ ID NO: 740773 - RNA, 16 nt, Homo sapiens
auuaucuauuaucuca

SEQ ID NO: 740774 - RNA, 17 nt, Homo sapiens
auuaucuauuaucucaa

SEQ ID NO: 740775 - RNA, 17 nt, Homo sapiens
auuaucucuuugaucua

SEQ ID NO: 740776 - RNA, 11 nt, Homo sapiens
auuaugacaau

SEQ ID NO: 740777 - RNA, 16 nt, Homo sapiens
auuaugagaggcaaug

SEQ ID NO: 740778 - RNA, 23 nt, Homo sapiens
auuaugagcuuucuuugcacuua

SEQ ID NO: 740779 - RNA, 20 nt, Homo sapiens
auuaugaguaguguggaauu

SEQ ID NO: 740780 - RNA, 16 nt, Homo sapiens
auuaugaucuaauaaa

SEQ ID NO: 740781 - RNA, 15 nt, Homo sapiens
auuaugccacuuccu

SEQ ID NO: 740782 - RNA, 18 nt, Homo sapiens
auuaugccauagcaagau

SEQ ID NO: 740783 - RNA, 16 nt, Homo sapiens
auuauggaauacaaaa

SEQ ID NO: 740784 - RNA, 20 nt, Homo sapiens
auuaugggcgugaaccacca

SEQ ID NO: 740785 - RNA, 19 nt, Homo sapiens
auuauggggacuuugguuu

SEQ ID NO: 740786 - RNA, 12 nt, Homo sapiens
auuauguacaaa

SEQ ID NO: 740787 - RNA, 18 nt, Homo sapiens
auuauguccacuguguau

SEQ ID NO: 740788 - RNA, 19 nt, Homo sapiens
auuauguuuucaacacuuu

SEQ ID NO: 740789 - RNA, 13 nt, Homo sapiens
auuauuaauugca

SEQ ID NO: 740790 - RNA, 13 nt, Homo sapiens
auuauuauuucca

SEQ ID NO: 740791 - RNA, 11 nt, Homo sapiens
auuauucugau

SEQ ID NO: 740792 - RNA, 13 nt, Homo sapiens
auuauugacacug

SEQ ID NO: 740793 - RNA, 14 nt, Homo sapiens
auuauugacacuga

SEQ ID NO: 740794 - RNA, 21 nt, Homo sapiens
auuauuuaucagcccuauucu

SEQ ID NO: 740795 - RNA, 17 nt, Homo sapiens
auuauuucaacuaaugu

SEQ ID NO: 740796 - RNA, 22 nt, Homo sapiens
auuauuucacuuuagaugcuga

SEQ ID NO: 740797 - RNA, 21 nt, Homo sapiens
auuauuugacaacaauccaaa

SEQ ID NO: 740798 - RNA, 22 nt, Homo sapiens
auuauuugcuauggcaggauaa

SEQ ID NO: 740799 - RNA, 14 nt, Homo sapiens
auuauuugugcuac

SEQ ID NO: 740800 - RNA, 17 nt, Homo sapiens
auuauuuuacaaucaac

SEQ ID NO: 740801 - RNA, 20 nt, Homo sapiens
auuauuuucucuuaacaaga

SEQ ID NO: 740802 - RNA, 17 nt, Homo sapiens
auuauuuucuucaucca

SEQ ID NO: 740803 - RNA, 16 nt, Homo sapiens
auuauuuuguucauac

SEQ ID NO: 740804 - RNA, 23 nt, Homo sapiens
auucaaaaguauugaaagccaac

SEQ ID NO: 740805 - RNA, 19 nt, Homo sapiens
auucaaagcccaacugugg

SEQ ID NO: 740806 - RNA, 18 nt, Homo sapiens
auucaaaguguuguguuc

SEQ ID NO: 740807 - RNA, 21 nt, Homo sapiens
auucaaaguuaaaagcaaaca

SEQ ID NO: 740808 - RNA, 18 nt, Homo sapiens
auucaaauuuguacagga

SEQ ID NO: 740809 - RNA, 22 nt, Homo sapiens
auucaaauuuguacaggacugu

SEQ ID NO: 740810 - RNA, 15 nt, Homo sapiens
auucaacaauuucaa

SEQ ID NO: 740811 - RNA, 16 nt, Homo sapiens
auucaacacugugcac

SEQ ID NO: 740812 - RNA, 21 nt, Homo sapiens
auucaacucuccaauguucua

SEQ ID NO: 740813 - RNA, 15 nt, Homo sapiens
auucaagaaugccag

SEQ ID NO: 740814 - RNA, 19 nt, Homo sapiens
auucaagaggaaaugucac

SEQ ID NO: 740815 - RNA, 14 nt, Homo sapiens
auucaagccuguga

SEQ ID NO: 740816 - RNA, 18 nt, Homo sapiens
auucaaguauuugaucag

SEQ ID NO: 740817 - RNA, 15 nt, Homo sapiens
auucaagugccucuu

SEQ ID NO: 740818 - RNA, 21 nt, Homo sapiens
auucaauaccgcucaguauuu

SEQ ID NO: 740819 - RNA, 15 nt, Homo sapiens
auucaauauugacau

SEQ ID NO: 740820 - RNA, 14 nt, Homo sapiens
auucaauccuacuu

SEQ ID NO: 740821 - RNA, 23 nt, Homo sapiens
auucaaucuuuggaggcuuuuaa

SEQ ID NO: 740822 - RNA, 16 nt, Homo sapiens
auucaaugaacuucca

SEQ ID NO: 740823 - RNA, 15 nt, Homo sapiens
auucaaugcauuuaa

SEQ ID NO: 740824 - RNA, 17 nt, Homo sapiens
auucaauuaguggucau

SEQ ID NO: 740825 - RNA, 17 nt, Homo sapiens
auucacaaaauuuccac

SEQ ID NO: 740826 - RNA, 20 nt, Homo sapiens
auucacacaccccucaaaaa

SEQ ID NO: 740827 - RNA, 13 nt, Homo sapiens
auucacagaauag

SEQ ID NO: 740828 - RNA, 13 nt, Homo sapiens
auucacagcaagu

SEQ ID NO: 740829 - RNA, 14 nt, Homo sapiens
auucacagugcucu

SEQ ID NO: 740830 - RNA, 16 nt, Homo sapiens
auucacauuugaugua

SEQ ID NO: 740831 - RNA, 13 nt, Homo sapiens
auucaccaaaaua

SEQ ID NO: 740832 - RNA, 23 nt, Homo sapiens
auucacuuauggcagaggaauau

SEQ ID NO: 740833 - RNA, 11 nt, Homo sapiens
auucacuuccc

SEQ ID NO: 740834 - RNA, 16 nt, Homo sapiens
auucagaaagucauag

SEQ ID NO: 740835 - RNA, 16 nt, Homo sapiens
auucagaagacuacua

SEQ ID NO: 740836 - RNA, 22 nt, Homo sapiens
auucagacuguuuuucagggag

SEQ ID NO: 740837 - RNA, 22 nt, Homo sapiens
auucagcaaaaaucucccagug

SEQ ID NO: 740838 - RNA, 12 nt, Homo sapiens
auucagcacuua

SEQ ID NO: 740839 - RNA, 19 nt, Homo sapiens
auucagcauggguccuuga

SEQ ID NO: 740840 - RNA, 13 nt, Homo sapiens
auucagcucuuaa

SEQ ID NO: 740841 - RNA, 17 nt, Homo sapiens
auucaggccagcccagc

SEQ ID NO: 740842 - RNA, 22 nt, Homo sapiens
auucaguaguggaaaugaguga

SEQ ID NO: 740843 - RNA, 22 nt, Homo sapiens
auucagucucuucuaagcaaaa

SEQ ID NO: 740844 - RNA, 16 nt, Homo sapiens
auucagucuucuggau

SEQ ID NO: 740845 - RNA, 22 nt, Homo sapiens
auucagugacggaugucuuaaa

SEQ ID NO: 740846 - RNA, 18 nt, Homo sapiens
auucaguucccaccaucu

SEQ ID NO: 740847 - RNA, 16 nt, Homo sapiens
auucauaaaucacaaa

SEQ ID NO: 740848 - RNA, 18 nt, Homo sapiens
auucauaaaucacaaaua

SEQ ID NO: 740849 - RNA, 16 nt, Homo sapiens
auucauaaccaaagag

SEQ ID NO: 740850 - RNA, 13 nt, Homo sapiens
auucauaaucaca

SEQ ID NO: 740851 - RNA, 13 nt, Homo sapiens
auucauaugcaga

SEQ ID NO: 740852 - RNA, 21 nt, Homo sapiens
auucauauuaagacaguguac

SEQ ID NO: 740853 - RNA, 20 nt, Homo sapiens
auucaucauuccauaugacu

SEQ ID NO: 740854 - RNA, 14 nt, Homo sapiens
auucauccauauug

SEQ ID NO: 740855 - RNA, 14 nt, Homo sapiens
auucauccuuccau

SEQ ID NO: 740856 - RNA, 13 nt, Homo sapiens
auucaucuaaugu

SEQ ID NO: 740857 - RNA, 18 nt, Homo sapiens
auucaucugggaggcaga

SEQ ID NO: 740858 - RNA, 12 nt, Homo sapiens
auucaugcaaga

SEQ ID NO: 740859 - RNA, 19 nt, Homo sapiens
auucaugcaaguauucuca

SEQ ID NO: 740860 - RNA, 14 nt, Homo sapiens
auucauuguugauc

SEQ ID NO: 740861 - RNA, 19 nt, Homo sapiens
auucauuguuuugcaaaag

SEQ ID NO: 740862 - RNA, 20 nt, Homo sapiens
auucauuuaaaaugauuaga

SEQ ID NO: 740863 - RNA, 14 nt, Homo sapiens
auucauuuccugcc

SEQ ID NO: 740864 - RNA, 20 nt, Homo sapiens
auucauuuccugcccuuccu

SEQ ID NO: 740865 - RNA, 17 nt, Homo sapiens
auucauuucuagacuca

SEQ ID NO: 740866 - RNA, 20 nt, Homo sapiens
auucauuuuuuucacuggag

SEQ ID NO: 740867 - RNA, 15 nt, Homo sapiens
auuccaaagucucua

SEQ ID NO: 740868 - RNA, 14 nt, Homo sapiens
auuccaacagcuca

SEQ ID NO: 740869 - RNA, 21 nt, Homo sapiens
auuucuuuucuggccaaaagc

SEQ ID NO: 740870 - RNA, 15 nt, Homo sapiens
auuugaaaugguugu

SEQ ID NO: 740871 - RNA, 14 nt, Homo sapiens
auuugaaaugucau

SEQ ID NO: 740872 - RNA, 17 nt, Homo sapiens
auuugaagaagaguuuc

SEQ ID NO: 740873 - RNA, 14 nt, Homo sapiens
auuugaaggccagc

SEQ ID NO: 740874 - RNA, 15 nt, Homo sapiens
auuugaaugaacacu

SEQ ID NO: 740875 - RNA, 18 nt, Homo sapiens
auuugaauuucaguaaac

SEQ ID NO: 740876 - RNA, 14 nt, Homo sapiens
auuugacuguucaa

SEQ ID NO: 740877 - RNA, 17 nt, Homo sapiens
auuugagaaaugcauau

SEQ ID NO: 740878 - RNA, 19 nt, Homo sapiens
auuugaggucaaguaagaa

SEQ ID NO: 740879 - RNA, 16 nt, Homo sapiens
auuugauacauaauaa

SEQ ID NO: 740880 - RNA, 19 nt, Homo sapiens
auuugauauacaugcucaa

SEQ ID NO: 740881 - RNA, 14 nt, Homo sapiens
auuugaugcauguc

SEQ ID NO: 740882 - RNA, 15 nt, Homo sapiens
auuugauguacaugu

SEQ ID NO: 740883 - RNA, 22 nt, Homo sapiens
auuugauucgcccuccucccug

SEQ ID NO: 740884 - RNA, 22 nt, Homo sapiens
auuugauugggaugaaugccau

SEQ ID NO: 740885 - RNA, 19 nt, Homo sapiens
auuugcaaaggcgacaaua

SEQ ID NO: 740886 - RNA, 15 nt, Homo sapiens
auuugccauagccuu

SEQ ID NO: 740887 - RNA, 20 nt, Homo sapiens
auuugcgacucacccacaau

SEQ ID NO: 740888 - RNA, 11 nt, Homo sapiens
auuugcucagg

SEQ ID NO: 740889 - RNA, 19 nt, Homo sapiens
auuugcugagcauguacug

SEQ ID NO: 740890 - RNA, 20 nt, Homo sapiens
auuugcugcucuucauccca

SEQ ID NO: 740891 - RNA, 15 nt, Homo sapiens
auuuggaaucuucuc

SEQ ID NO: 740892 - RNA, 18 nt, Homo sapiens
auuuggagccugccaaga

SEQ ID NO: 740893 - RNA, 18 nt, Homo sapiens
auuuggcauugaucuuaa

SEQ ID NO: 740894 - RNA, 13 nt, Homo sapiens
auuuggucugcca

SEQ ID NO: 740895 - RNA, 17 nt, Homo sapiens
auuugguggaugugaug

SEQ ID NO: 740896 - RNA, 20 nt, Homo sapiens
auuuguaacacagucauucu

SEQ ID NO: 740897 - RNA, 20 nt, Homo sapiens
auuuguaauuaaaagcaaau

SEQ ID NO: 740898 - RNA, 21 nt, Homo sapiens
auuuguaccucuaaguacaua

SEQ ID NO: 740899 - RNA, 13 nt, Homo sapiens
auuuguagcacug

SEQ ID NO: 740900 - RNA, 21 nt, Homo sapiens
auuuguauaacgguuuaauuc

SEQ ID NO: 740901 - RNA, 20 nt, Homo sapiens
auuuguaugcucauugaacu

SEQ ID NO: 740902 - RNA, 23 nt, Homo sapiens
auuuguaugguuccaaagacacu

SEQ ID NO: 740903 - RNA, 23 nt, Homo sapiens
auuugucaggacaagggcucaga

SEQ ID NO: 740904 - RNA, 17 nt, Homo sapiens
auuugucauucauucaa

SEQ ID NO: 740905 - RNA, 20 nt, Homo sapiens
auuuguccaaauaaauucaa

SEQ ID NO: 740906 - RNA, 20 nt, Homo sapiens
auuugucccuaugcauauca

SEQ ID NO: 740907 - RNA, 18 nt, Homo sapiens
auuugugaacuggaagaa

SEQ ID NO: 740908 - RNA, 19 nt, Homo sapiens
auuuguuaaaauuaucaau

SEQ ID NO: 740909 - RNA, 21 nt, Homo sapiens
auuuguucauuauuugugcua

SEQ ID NO: 740910 - RNA, 13 nt, Homo sapiens
auuuguuccugcu

SEQ ID NO: 740911 - RNA, 12 nt, Homo sapiens
auuuguucucac

SEQ ID NO: 740912 - RNA, 16 nt, Homo sapiens
auuuguuuguauucau

SEQ ID NO: 740913 - RNA, 20 nt, Homo sapiens
auuuuaaaaaauaacauauu

SEQ ID NO: 740914 - RNA, 18 nt, Homo sapiens
auuuuaaaaacuaaaaag

SEQ ID NO: 740915 - RNA, 19 nt, Homo sapiens
auuuuaaaguaaaagucua

SEQ ID NO: 740916 - RNA, 19 nt, Homo sapiens
auuuuaagaauuucacaag

SEQ ID NO: 740917 - RNA, 21 nt, Homo sapiens
auuuuaagauccagaaauacu

SEQ ID NO: 740918 - RNA, 22 nt, Homo sapiens
auuuuaagguucucagaccucc

SEQ ID NO: 740919 - RNA, 19 nt, Homo sapiens
auuuuaaguaucagagguc

SEQ ID NO: 740920 - RNA, 13 nt, Homo sapiens
auuuuaagugcuu

SEQ ID NO: 740921 - RNA, 17 nt, Homo sapiens
auuuuaauuacugcuau

SEQ ID NO: 740922 - RNA, 23 nt, Homo sapiens
auuuuaauuuuuuuuaguauuua

SEQ ID NO: 740923 - RNA, 17 nt, Homo sapiens
auuuuacacaaagggaa

SEQ ID NO: 740924 - RNA, 19 nt, Homo sapiens
auuuuaccaaagcaucaau

SEQ ID NO: 740925 - RNA, 22 nt, Homo sapiens
auuuuacccugaggucacugcu

SEQ ID NO: 740926 - RNA, 23 nt, Homo sapiens
auuuuacuauuggaaucugauau

SEQ ID NO: 740927 - RNA, 13 nt, Homo sapiens
auuuuacugcuua

SEQ ID NO: 740928 - RNA, 20 nt, Homo sapiens
auuuuaggagcuaaggcucu

SEQ ID NO: 740929 - RNA, 17 nt, Homo sapiens
auuuuauagacuaccaa

SEQ ID NO: 740930 - RNA, 18 nt, Homo sapiens
auuuuaucuugaaacuga

SEQ ID NO: 740931 - RNA, 14 nt, Homo sapiens
auuuuaugcugcug

SEQ ID NO: 740932 - RNA, 21 nt, Homo sapiens
auuuuaugcugcuguuuacaa

SEQ ID NO: 740933 - RNA, 19 nt, Homo sapiens
auuuuauggcucacuauga

SEQ ID NO: 740934 - RNA, 18 nt, Homo sapiens
auuuuauucccuuucaca

SEQ ID NO: 740935 - RNA, 18 nt, Homo sapiens
auuuuauuuuucucauga

SEQ ID NO: 740936 - RNA, 19 nt, Homo sapiens
auuuucaagaaacugagga

SEQ ID NO: 740937 - RNA, 14 nt, Homo sapiens
auuuucaaguaauu

SEQ ID NO: 740938 - RNA, 19 nt, Homo sapiens
auuuucacugcaaugucaa

SEQ ID NO: 740939 - RNA, 16 nt, Homo sapiens
auuuucaucaaaacca

SEQ ID NO: 740940 - RNA, 17 nt, Homo sapiens
auuuucaucaaaaccaa

SEQ ID NO: 740941 - RNA, 15 nt, Homo sapiens
auuuucauucauuca

SEQ ID NO: 740942 - RNA, 20 nt, Homo sapiens
auuuuccgggaacuuugcag

SEQ ID NO: 740943 - RNA, 21 nt, Homo sapiens
auuuuccuggugccaauuuca

SEQ ID NO: 740944 - RNA, 19 nt, Homo sapiens
auuuucuaauguugacuuu

SEQ ID NO: 740945 - RNA, 16 nt, Homo sapiens
auuuucuaauuaaaga

SEQ ID NO: 740946 - RNA, 20 nt, Homo sapiens
auuuucuccuugguuugcua

SEQ ID NO: 740947 - RNA, 21 nt, Homo sapiens
auuuucuuacacugugucauu

SEQ ID NO: 740948 - RNA, 19 nt, Homo sapiens
auuuucuuguaugcuucuu

SEQ ID NO: 740949 - RNA, 17 nt, Homo sapiens
auuuucuuuuuauacua

SEQ ID NO: 740950 - RNA, 23 nt, Homo sapiens
auuuugaaaugaaacaagcuuac

SEQ ID NO: 740951 - RNA, 23 nt, Homo sapiens
auuuugacacuauaucuguauau

SEQ ID NO: 740952 - RNA, 12 nt, Homo sapiens
auuuugacuuaa

SEQ ID NO: 740953 - RNA, 14 nt, Homo sapiens
auuuugaguauucc

SEQ ID NO: 740954 - RNA, 13 nt, Homo sapiens
auuuugcacuguu

SEQ ID NO: 740955 - RNA, 14 nt, Homo sapiens
auuuugcauuccag

SEQ ID NO: 740956 - RNA, 15 nt, Homo sapiens
auuuugcauuccaga

SEQ ID NO: 740957 - RNA, 18 nt, Homo sapiens
auuuugccauaaagucaa

SEQ ID NO: 740958 - RNA, 20 nt, Homo sapiens
auuuugccauaaagucaaau

SEQ ID NO: 740959 - RNA, 23 nt, Homo sapiens
auuuugcccucuccuuagcucuu

SEQ ID NO: 740960 - RNA, 13 nt, Homo sapiens
auuuugcuaaaaa

SEQ ID NO: 740961 - RNA, 19 nt, Homo sapiens
auuuugggguuguguuguc

SEQ ID NO: 740962 - RNA, 21 nt, Homo sapiens
auuuugggguuguguugucac

SEQ ID NO: 740963 - RNA, 13 nt, Homo sapiens
auuuugguacuuu

SEQ ID NO: 740964 - RNA, 21 nt, Homo sapiens
auuuuguagaauaaggaacaa

SEQ ID NO: 740965 - RNA, 17 nt, Homo sapiens
auuuuguagaugugauu

SEQ ID NO: 740966 - RNA, 14 nt, Homo sapiens
auuuuguaugaaaa

SEQ ID NO: 740967 - RNA, 18 nt, Homo sapiens
auuuugucaacuacccac

SEQ ID NO: 740968 - RNA, 14 nt, Homo sapiens
auuuugucuaccau

SEQ ID NO: 740969 - RNA, 20 nt, Homo sapiens
auuuugugaugaaucuacau

SEQ ID NO: 740970 - RNA, 15 nt, Homo sapiens
auuuuguucauacau

SEQ ID NO: 740971 - RNA, 16 nt, Homo sapiens
auuuuuaaaaugucaa

SEQ ID NO: 740972 - RNA, 15 nt, Homo sapiens
auuuuuaaauauuca

SEQ ID NO: 740973 - RNA, 19 nt, Homo sapiens
auuuuuaaggauguugcca

SEQ ID NO: 740974 - RNA, 17 nt, Homo sapiens
auuuuuaauauuacugu

SEQ ID NO: 740975 - RNA, 15 nt, Homo sapiens
auuuuuacaucaaaa

SEQ ID NO: 740976 - RNA, 13 nt, Homo sapiens
auuuuuacauuca

SEQ ID NO: 740977 - RNA, 18 nt, Homo sapiens
auuuuuaccuaaucucca

SEQ ID NO: 740978 - RNA, 16 nt, Homo sapiens
auuuuuaccuguuuaa

SEQ ID NO: 740979 - RNA, 13 nt, Homo sapiens
auuuuuacugugu

SEQ ID NO: 740980 - RNA, 15 nt, Homo sapiens
auuuuuagaauuaaa

SEQ ID NO: 740981 - RNA, 21 nt, Homo sapiens
auuuuuauaaaaaugagugcu

SEQ ID NO: 740982 - RNA, 21 nt, Homo sapiens
auuuuuauacaaaccuaccaa

SEQ ID NO: 740983 - RNA, 22 nt, Homo sapiens
caagaccuucuccccauucugc

SEQ ID NO: 740984 - RNA, 18 nt, Homo sapiens
caagacggagaugcaugg

SEQ ID NO: 740985 - RNA, 16 nt, Homo sapiens
caagacucaccucauc

SEQ ID NO: 740986 - RNA, 19 nt, Homo sapiens
caagacucugucucaaaaa

SEQ ID NO: 740987 - RNA, 15 nt, Homo sapiens
caagacuuuagcuuu

SEQ ID NO: 740988 - RNA, 21 nt, Homo sapiens
caagagaacucgcgcucagua

SEQ ID NO: 740989 - RNA, 17 nt, Homo sapiens
caagagaaucugaucaa

SEQ ID NO: 740990 - RNA, 23 nt, Homo sapiens
caagagagaaagaaguaggcaug

SEQ ID NO: 740991 - RNA, 13 nt, Homo sapiens
caagagagaugua

SEQ ID NO: 740992 - RNA, 23 nt, Homo sapiens
caagagauagagaccaucuuugc

SEQ ID NO: 740993 - RNA, 12 nt, Homo sapiens
caagagaucuac

SEQ ID NO: 740994 - RNA, 19 nt, Homo sapiens
caagagaucuuucuuucca

SEQ ID NO: 740995 - RNA, 20 nt, Homo sapiens
caagagaugggaaugaggug

SEQ ID NO: 740996 - RNA, 22 nt, Homo sapiens
caagagcacuaggauugugaua

SEQ ID NO: 740997 - RNA, 18 nt, Homo sapiens
caagagcagcugggaacu

SEQ ID NO: 740998 - RNA, 16 nt, Homo sapiens
caagagcaugcacaug

SEQ ID NO: 740999 - RNA, 13 nt, Homo sapiens
caagagcugagaa

SEQ ID NO: 741000 - RNA, 16 nt, Homo sapiens
caagaggacugagacu

SEQ ID NO: 741001 - RNA, 22 nt, Homo sapiens
caagaggacugagacuggcacu

SEQ ID NO: 741002 - RNA, 15 nt, Homo sapiens
caagaggcuaacuca

SEQ ID NO: 741003 - RNA, 13 nt, Homo sapiens
caagaggggaaaa

SEQ ID NO: 741004 - RNA, 22 nt, Homo sapiens
caagaggguccuuuaguaccug

SEQ ID NO: 741005 - RNA, 22 nt, Homo sapiens
caagaguacagaagcuuuagca

SEQ ID NO: 741006 - RNA, 18 nt, Homo sapiens
caagagugaaaauagagg

SEQ ID NO: 741007 - RNA, 15 nt, Homo sapiens
caagaguggacugaa

SEQ ID NO: 741008 - RNA, 21 nt, Homo sapiens
caagauagucuucaguuucau

SEQ ID NO: 741009 - RNA, 19 nt, Homo sapiens
caagauauccacuuaccug

SEQ ID NO: 741010 - RNA, 19 nt, Homo sapiens
caagauccuccugcugcag

SEQ ID NO: 741011 - RNA, 18 nt, Homo sapiens
caagauccuuaaugcaga

SEQ ID NO: 741012 - RNA, 20 nt, Homo sapiens
caagaucgcaccacugcacu

SEQ ID NO: 741013 - RNA, 19 nt, Homo sapiens
caagaucugaaauaaauga

SEQ ID NO: 741014 - RNA, 15 nt, Homo sapiens
caagaucuguaaugu

SEQ ID NO: 741015 - RNA, 13 nt, Homo sapiens
caagaucuuucag

SEQ ID NO: 741016 - RNA, 17 nt, Homo sapiens
caagaucuuucaggaaa

SEQ ID NO: 741017 - RNA, 19 nt, Homo sapiens
caagaugaggcaccaggaa

SEQ ID NO: 741018 - RNA, 20 nt, Homo sapiens
caagauggauggaaagggag

SEQ ID NO: 741019 - RNA, 12 nt, Homo sapiens
caagauggucca

SEQ ID NO: 741020 - RNA, 18 nt, Homo sapiens
caagaugguuaagucaau

SEQ ID NO: 741021 - RNA, 16 nt, Homo sapiens
caagauguguucuccu

SEQ ID NO: 741022 - RNA, 23 nt, Homo sapiens
caagauguugauuuuuacugugu

SEQ ID NO: 741023 - RNA, 12 nt, Homo sapiens
caagauugcacc

SEQ ID NO: 741024 - RNA, 20 nt, Homo sapiens
caagauugcaccacugcucu

SEQ ID NO: 741025 - RNA, 14 nt, Homo sapiens
caagcaaaaccaaa

SEQ ID NO: 741026 - RNA, 19 nt, Homo sapiens
caagcacagugccugcaug

SEQ ID NO: 741027 - RNA, 13 nt, Homo sapiens
caagcacuuuaau

SEQ ID NO: 741028 - RNA, 15 nt, Homo sapiens
caagcagagugcaca

SEQ ID NO: 741029 - RNA, 18 nt, Homo sapiens
caagcaggugaacuggga

SEQ ID NO: 741030 - RNA, 12 nt, Homo sapiens
caagcauuucau

SEQ ID NO: 741031 - RNA, 21 nt, Homo sapiens
caagccacagcagguccucca

SEQ ID NO: 741032 - RNA, 16 nt, Homo sapiens
caagccagcccggccg

SEQ ID NO: 741033 - RNA, 22 nt, Homo sapiens
caagccagcuuacuagcacuuu

SEQ ID NO: 741034 - RNA, 19 nt, Homo sapiens
caagccaggcucacucaca

SEQ ID NO: 741035 - RNA, 16 nt, Homo sapiens
caagccccacuuauuc

SEQ ID NO: 741036 - RNA, 17 nt, Homo sapiens
caagccccauuuccuca

SEQ ID NO: 741037 - RNA, 17 nt, Homo sapiens
caagccccucagcccuu

SEQ ID NO: 741038 - RNA, 17 nt, Homo sapiens
caagccuaauugugcaa

SEQ ID NO: 741039 - RNA, 22 nt, Homo sapiens
caagccugccauggguccucuc

SEQ ID NO: 741040 - RNA, 20 nt, Homo sapiens
caagccuguccuuccugacc

SEQ ID NO: 741041 - RNA, 15 nt, Homo sapiens
caagccugugcaaug

SEQ ID NO: 741042 - RNA, 14 nt, Homo sapiens
caagcgauucuccc

SEQ ID NO: 741043 - RNA, 21 nt, Homo sapiens
caagcgauucuccugucucag

SEQ ID NO: 741044 - RNA, 14 nt, Homo sapiens
caagcuaacugcuu

SEQ ID NO: 741045 - RNA, 20 nt, Homo sapiens
caagcugaaaacaaacaaga

SEQ ID NO: 741046 - RNA, 16 nt, Homo sapiens
caagcugguauuuuca

SEQ ID NO: 741047 - RNA, 17 nt, Homo sapiens
caagcugguauuuucau

SEQ ID NO: 741048 - RNA, 15 nt, Homo sapiens
caagcugucccugca

SEQ ID NO: 741049 - RNA, 15 nt, Homo sapiens
caagcugugcaggca

SEQ ID NO: 741050 - RNA, 16 nt, Homo sapiens
caagcuucacauuugc

SEQ ID NO: 741051 - RNA, 16 nt, Homo sapiens
caagcuugaggccaag

SEQ ID NO: 741052 - RNA, 14 nt, Homo sapiens
caaggaaaaggagg

SEQ ID NO: 741053 - RNA, 23 nt, Homo sapiens
caaggaaauaaagcguccucuca

SEQ ID NO: 741054 - RNA, 14 nt, Homo sapiens
caaggacaccauag

SEQ ID NO: 741055 - RNA, 18 nt, Homo sapiens
caaggacccuccaggagu

SEQ ID NO: 741056 - RNA, 22 nt, Homo sapiens
caaggaccuggagauugugcuc

SEQ ID NO: 741057 - RNA, 19 nt, Homo sapiens
caaggacguggaugacccu

SEQ ID NO: 741058 - RNA, 22 nt, Homo sapiens
caaggacgugggccuccagagu

SEQ ID NO: 741059 - RNA, 13 nt, Homo sapiens
caaggacucuucc

SEQ ID NO: 741060 - RNA, 15 nt, Homo sapiens
caaggacucuuccac

SEQ ID NO: 741061 - RNA, 14 nt, Homo sapiens
caaggacuuugcag

SEQ ID NO: 741062 - RNA, 15 nt, Homo sapiens
caaggagaauaugau

SEQ ID NO: 741063 - RNA, 22 nt, Homo sapiens
caaggagaaugaauacugggaa

SEQ ID NO: 741064 - RNA, 22 nt, Homo sapiens
caaggaguuuauuacaauguau

SEQ ID NO: 741065 - RNA, 19 nt, Homo sapiens
caaggaugucugagaccac

SEQ ID NO: 741066 - RNA, 17 nt, Homo sapiens
caaggauuaaaucuggu

SEQ ID NO: 741067 - RNA, 16 nt, Homo sapiens
caaggauuuuuagccc

SEQ ID NO: 741068 - RNA, 20 nt, Homo sapiens
caaggcagcccugucugaag

SEQ ID NO: 741069 - RNA, 20 nt, Homo sapiens
caaggcagccugaacacuca

SEQ ID NO: 741070 - RNA, 20 nt, Homo sapiens
caaggcccaggagaccucca

SEQ ID NO: 741071 - RNA, 19 nt, Homo sapiens
caaggcccauaucugugaa

SEQ ID NO: 741072 - RNA, 14 nt, Homo sapiens
caaggccugugcug

SEQ ID NO: 741073 - RNA, 16 nt, Homo sapiens
caaggccugugcugca

SEQ ID NO: 741074 - RNA, 11 nt, Homo sapiens
caaggccuuca

SEQ ID NO: 741075 - RNA, 17 nt, Homo sapiens
caaggcugaccaagaga

SEQ ID NO: 741076 - RNA, 14 nt, Homo sapiens
caaggcuucaguga

SEQ ID NO: 741077 - RNA, 19 nt, Homo sapiens
caaggcuuuauauuuuuaa

SEQ ID NO: 741078 - RNA, 16 nt, Homo sapiens
caaggcuuuugcaaag

SEQ ID NO: 741079 - RNA, 22 nt, Homo sapiens
caagggaaaaauuuuuauguaa

SEQ ID NO: 741080 - RNA, 21 nt, Homo sapiens
caagggaacuugagcgugaau

SEQ ID NO: 741081 - RNA, 17 nt, Homo sapiens
caagggacaaguauuaa

SEQ ID NO: 741082 - RNA, 17 nt, Homo sapiens
caagggaccugcucauc

SEQ ID NO: 741083 - RNA, 21 nt, Homo sapiens
caagggaggaacaaaugaaga

SEQ ID NO: 741084 - RNA, 22 nt, Homo sapiens
caaggguaaucuuggguuucua

SEQ ID NO: 741085 - RNA, 12 nt, Homo sapiens
caaggucugcuc

SEQ ID NO: 741086 - RNA, 12 nt, Homo sapiens
caaggugacaaa

SEQ ID NO: 741087 - RNA, 16 nt, Homo sapiens
caaggugagugugacu

SEQ ID NO: 741088 - RNA, 12 nt, Homo sapiens
caaggugaucaa

SEQ ID NO: 741089 - RNA, 21 nt, Homo sapiens
caagguggucaguaaauaaca

SEQ ID NO: 741090 - RNA, 17 nt, Homo sapiens
caagguuuuagguucua

SEQ ID NO: 741091 - RNA, 19 nt, Homo sapiens
caagguuuuggagucagua

SEQ ID NO: 741092 - RNA, 18 nt, Homo sapiens
caaguaaaacaaaaccac

SEQ ID NO: 741093 - RNA, 18 nt, Homo sapiens
caaguacagagauucuau

SEQ ID NO: 741094 - RNA, 19 nt, Homo sapiens
caaguagcugggauuacag

SEQ ID NO: 741095 - RNA, 18 nt, Homo sapiens
caaguauccaaccaacuu

SEQ ID NO: 741096 - RNA, 23 nt, Homo sapiens
caaguauuaauaguucaguguau

SEQ ID NO: 741097 - RNA, 20 nt, Homo sapiens
caccagcugcugugccccac

SEQ ID NO: 741098 - RNA, 22 nt, Homo sapiens
caccaggaauccccaacaugca

SEQ ID NO: 741099 - RNA, 20 nt, Homo sapiens
caccaggggaggagccugug

SEQ ID NO: 741100 - RNA, 20 nt, Homo sapiens
caccaggggugcucaccucu

SEQ ID NO: 741101 - RNA, 11 nt, Homo sapiens
caccaggguuu

SEQ ID NO: 741102 - RNA, 13 nt, Homo sapiens
caccaguguccuc

SEQ ID NO: 741103 - RNA, 15 nt, Homo sapiens
caccaguuauuccuu

SEQ ID NO: 741104 - RNA, 11 nt, Homo sapiens
caccaguucuc

SEQ ID NO: 741105 - RNA, 18 nt, Homo sapiens
caccauaaaucacaucau

SEQ ID NO: 741106 - RNA, 23 nt, Homo sapiens
caccauacuccuugcuuccugau

SEQ ID NO: 741107 - RNA, 15 nt, Homo sapiens
caccaucugauuaaa

SEQ ID NO: 741108 - RNA, 20 nt, Homo sapiens
caccaugaugugaagaguuu

SEQ ID NO: 741109 - RNA, 23 nt, Homo sapiens
caccaugcucggcuuuugcauua

SEQ ID NO: 741110 - RNA, 23 nt, Homo sapiens
caccauggcaccuuuugcacaua

SEQ ID NO: 741111 - RNA, 17 nt, Homo sapiens
caccauguauuuuguaa

SEQ ID NO: 741112 - RNA, 15 nt, Homo sapiens
caccauguuggccag

SEQ ID NO: 741113 - RNA, 20 nt, Homo sapiens
caccauucacauuugaugua

SEQ ID NO: 741114 - RNA, 12 nt, Homo sapiens
caccauucccug

SEQ ID NO: 741115 - RNA, 21 nt, Homo sapiens
caccauuuuguuuagacaauu

SEQ ID NO: 741116 - RNA, 14 nt, Homo sapiens
cacccaaaagucaa

SEQ ID NO: 741117 - RNA, 13 nt, Homo sapiens
cacccaaagcaug

SEQ ID NO: 741118 - RNA, 12 nt, Homo sapiens
cacccacaugug

SEQ ID NO: 741119 - RNA, 13 nt, Homo sapiens
cacccaccagagu

SEQ ID NO: 741120 - RNA, 22 nt, Homo sapiens
cacccaccccacaccugcagug

SEQ ID NO: 741121 - RNA, 19 nt, Homo sapiens
cacccacccuguggcucac

SEQ ID NO: 741122 - RNA, 16 nt, Homo sapiens
cacccaccucaccaaa

SEQ ID NO: 741123 - RNA, 13 nt, Homo sapiens
cacccaccuccac

SEQ ID NO: 741124 - RNA, 15 nt, Homo sapiens
cacccacgcauacac

SEQ ID NO: 741125 - RNA, 14 nt, Homo sapiens
cacccagaacagug

SEQ ID NO: 741126 - RNA, 20 nt, Homo sapiens
cacccaggcuggagugcagu

SEQ ID NO: 741127 - RNA, 21 nt, Homo sapiens
cacccagggaaggugcugaau

SEQ ID NO: 741128 - RNA, 20 nt, Homo sapiens
cacccagguuggagugcagu

SEQ ID NO: 741129 - RNA, 23 nt, Homo sapiens
cacccaguccucccagcugccau

SEQ ID NO: 741130 - RNA, 13 nt, Homo sapiens
cacccagucucau

SEQ ID NO: 741131 - RNA, 16 nt, Homo sapiens
cacccagugcugccau

SEQ ID NO: 741132 - RNA, 14 nt, Homo sapiens
caccccaacacuuc

SEQ ID NO: 741133 - RNA, 21 nt, Homo sapiens
cacccccaacaggaauucuau

SEQ ID NO: 741134 - RNA, 23 nt, Homo sapiens
cacccccaggaaggccacagugc

SEQ ID NO: 741135 - RNA, 13 nt, Homo sapiens
cacccccauggaa

SEQ ID NO: 741136 - RNA, 18 nt, Homo sapiens
caccccgccugcccucau

SEQ ID NO: 741137 - RNA, 15 nt, Homo sapiens
caccccuaaagagau

SEQ ID NO: 741138 - RNA, 13 nt, Homo sapiens
caccccucaaaaa

SEQ ID NO: 741139 - RNA, 15 nt, Homo sapiens
caccccucccugcuu

SEQ ID NO: 741140 - RNA, 16 nt, Homo sapiens
cacccgcccacagcca

SEQ ID NO: 741141 - RNA, 22 nt, Homo sapiens
cacccgcccgagggauggugcc

SEQ ID NO: 741142 - RNA, 22 nt, Homo sapiens
cacccggcucguguauuuauua

SEQ ID NO: 741143 - RNA, 20 nt, Homo sapiens
cacccucauucuacugaaaa

SEQ ID NO: 741144 - RNA, 17 nt, Homo sapiens
cacccuccaugcuccuc

SEQ ID NO: 741145 - RNA, 20 nt, Homo sapiens
cacccuccaugcuccucacc

SEQ ID NO: 741146 - RNA, 18 nt, Homo sapiens
cacccucuccuccagugu

SEQ ID NO: 741147 - RNA, 14 nt, Homo sapiens
cacccucugugcuu

SEQ ID NO: 741148 - RNA, 22 nt, Homo sapiens
cacccucugugcuugugacaaa

SEQ ID NO: 741149 - RNA, 18 nt, Homo sapiens
cacccucuuccugugauc

SEQ ID NO: 741150 - RNA, 21 nt, Homo sapiens
cacccugccaagacuccucag

SEQ ID NO: 741151 - RNA, 23 nt, Homo sapiens
cacccuggaaucaagaugucaga

SEQ ID NO: 741152 - RNA, 19 nt, Homo sapiens
cacccuggaugcuguugag

SEQ ID NO: 741153 - RNA, 22 nt, Homo sapiens
cacccuggcaggcuuccauccc

SEQ ID NO: 741154 - RNA, 15 nt, Homo sapiens
cacccuggcccagcu

SEQ ID NO: 741155 - RNA, 14 nt, Homo sapiens
cacccugggagcca

SEQ ID NO: 741156 - RNA, 23 nt, Homo sapiens
cacccuggggccuggaccugccu

SEQ ID NO: 741157 - RNA, 22 nt, Homo sapiens
cacccuguuuaaagauuucaag

SEQ ID NO: 741158 - RNA, 21 nt, Homo sapiens
cacccuuccccuccuucuccc

SEQ ID NO: 741159 - RNA, 21 nt, Homo sapiens
cacccuugcccggcugugauu

SEQ ID NO: 741160 - RNA, 21 nt, Homo sapiens
cacccuuguccuugagugcuc

SEQ ID NO: 741161 - RNA, 20 nt, Homo sapiens
caccgagaauguuguauuca

SEQ ID NO: 741162 - RNA, 12 nt, Homo sapiens
caccgcaguuuu

SEQ ID NO: 741163 - RNA, 23 nt, Homo sapiens
caccgggggagagggacacuccu

SEQ ID NO: 741164 - RNA, 17 nt, Homo sapiens
caccguacaucugcaau

SEQ ID NO: 741165 - RNA, 18 nt, Homo sapiens
caccgucccucagugaua

SEQ ID NO: 741166 - RNA, 17 nt, Homo sapiens
caccguuaggauucagg

SEQ ID NO: 741167 - RNA, 22 nt, Homo sapiens
caccuaagaucucgguuugcca

SEQ ID NO: 741168 - RNA, 19 nt, Homo sapiens
caccuaauaauaguaauuc

SEQ ID NO: 741169 - RNA, 17 nt, Homo sapiens
caccuacauuaucucac

SEQ ID NO: 741170 - RNA, 16 nt, Homo sapiens
caccuagaacacuaac

SEQ ID NO: 741171 - RNA, 12 nt, Homo sapiens
caccuagcuuua

SEQ ID NO: 741172 - RNA, 22 nt, Homo sapiens
caccuauucuguaguugcagcu

SEQ ID NO: 741173 - RNA, 19 nt, Homo sapiens
caccucaacuccgugcuua

SEQ ID NO: 741174 - RNA, 16 nt, Homo sapiens
caccucagcugauauu

SEQ ID NO: 741175 - RNA, 13 nt, Homo sapiens
caccucauccuua

SEQ ID NO: 741176 - RNA, 14 nt, Homo sapiens
caccucauucugaa

SEQ ID NO: 741177 - RNA, 17 nt, Homo sapiens
caccucccauuacuuug

SEQ ID NO: 741178 - RNA, 11 nt, Homo sapiens
caccuccucau

SEQ ID NO: 741179 - RNA, 20 nt, Homo sapiens
caccuccucauguacauacc

SEQ ID NO: 741180 - RNA, 15 nt, Homo sapiens
caccuccuccacuca

SEQ ID NO: 741181 - RNA, 14 nt, Homo sapiens
caccuccugcaaua

SEQ ID NO: 741182 - RNA, 16 nt, Homo sapiens
caccuccugcaauaaa

SEQ ID NO: 741183 - RNA, 11 nt, Homo sapiens
caccucuccaa

SEQ ID NO: 741184 - RNA, 20 nt, Homo sapiens
caccucugccucaaugugaa

SEQ ID NO: 741185 - RNA, 15 nt, Homo sapiens
caccucuuccuugau

SEQ ID NO: 741186 - RNA, 13 nt, Homo sapiens
caccugagaagau

SEQ ID NO: 741187 - RNA, 16 nt, Homo sapiens
caccugcagugccagc

SEQ ID NO: 741188 - RNA, 12 nt, Homo sapiens
caccugcaucug

SEQ ID NO: 741189 - RNA, 21 nt, Homo sapiens
caccugcggggccacccaucg

SEQ ID NO: 741190 - RNA, 19 nt, Homo sapiens
caccugcuccaauuucccc

SEQ ID NO: 741191 - RNA, 16 nt, Homo sapiens
caccugcuguccugca

SEQ ID NO: 741192 - RNA, 18 nt, Homo sapiens
caccugcuucugaacuca

SEQ ID NO: 741193 - RNA, 20 nt, Homo sapiens
caccuggagaguacauuugc

SEQ ID NO: 741194 - RNA, 22 nt, Homo sapiens
caccuggaugggggucccugug

SEQ ID NO: 741195 - RNA, 20 nt, Homo sapiens
caccuguaaucccagcacuu

SEQ ID NO: 741196 - RNA, 22 nt, Homo sapiens
caccuguagucccagcuacuca

SEQ ID NO: 741197 - RNA, 18 nt, Homo sapiens
caccugucaucauggagg

SEQ ID NO: 741198 - RNA, 15 nt, Homo sapiens
caccugugaccagca

SEQ ID NO: 741199 - RNA, 16 nt, Homo sapiens
caccuguguuccagcc

SEQ ID NO: 741200 - RNA, 18 nt, Homo sapiens
caccuguuaaaauguaca

SEQ ID NO: 741201 - RNA, 19 nt, Homo sapiens
caccuguucucacucccug

SEQ ID NO: 741202 - RNA, 21 nt, Homo sapiens
caccuuagagcaaccucugua

SEQ ID NO: 741203 - RNA, 15 nt, Homo sapiens
caccuucaagcagcu

SEQ ID NO: 741204 - RNA, 19 nt, Homo sapiens
caccuucagaggcugaggu

SEQ ID NO: 741205 - RNA, 15 nt, Homo sapiens
caccuuggauuaaaa

SEQ ID NO: 741206 - RNA, 22 nt, Homo sapiens
caccuuggcaccagacacccag

SEQ ID NO: 741207 - RNA, 13 nt, Homo sapiens
caccuuggccucc

SEQ ID NO: 741208 - RNA, 12 nt, Homo sapiens
caccuuugccac

SEQ ID NO: 741209 - RNA, 17 nt, Homo sapiens
caccuuugccacaaagc

SEQ ID NO: 741210 - RNA, 22 nt, Homo sapiens
caccuuugcuacgcaaggaaau

SEQ ID NO: 741211 - RNA, 17 nt, Homo sapiens
cauccaggcccaacugu

SEQ ID NO: 741212 - RNA, 17 nt, Homo sapiens
cauccaguucaugagaa

SEQ ID NO: 741213 - RNA, 19 nt, Homo sapiens
cauccaucccuccauucau

SEQ ID NO: 741214 - RNA, 14 nt, Homo sapiens
cauccaucuuucca

SEQ ID NO: 741215 - RNA, 17 nt, Homo sapiens
cauccaucuuuccaucc

SEQ ID NO: 741216 - RNA, 21 nt, Homo sapiens
cauccaugugcuagucacugg

SEQ ID NO: 741217 - RNA, 14 nt, Homo sapiens
cauccauuaccucc

SEQ ID NO: 741218 - RNA, 17 nt, Homo sapiens
caucccacugacuguau

SEQ ID NO: 741219 - RNA, 22 nt, Homo sapiens
cauccccaacugcgacugugac

SEQ ID NO: 741220 - RNA, 20 nt, Homo sapiens
caucccgcgcgcccuuccuu

SEQ ID NO: 741221 - RNA, 15 nt, Homo sapiens
caucccggcacuguu

SEQ ID NO: 741222 - RNA, 14 nt, Homo sapiens
caucccuccauuca

SEQ ID NO: 741223 - RNA, 16 nt, Homo sapiens
cauccgcgugugccug

SEQ ID NO: 741224 - RNA, 19 nt, Homo sapiens
cauccgcuacuacaucaag

SEQ ID NO: 741225 - RNA, 21 nt, Homo sapiens
cauccgguggccuauuccagg

SEQ ID NO: 741226 - RNA, 18 nt, Homo sapiens
cauccuaccccuuugcac

SEQ ID NO: 741227 - RNA, 16 nt, Homo sapiens
cauccuaguaauaaag

SEQ ID NO: 741228 - RNA, 14 nt, Homo sapiens
cauccucacugugg

SEQ ID NO: 741229 - RNA, 23 nt, Homo sapiens
cauccuuaaaacaauucugugac

SEQ ID NO: 741230 - RNA, 17 nt, Homo sapiens
cauccuucaagaacucu

SEQ ID NO: 741231 - RNA, 15 nt, Homo sapiens
cauccuuccauccau

SEQ ID NO: 741232 - RNA, 20 nt, Homo sapiens
cauccuucuguguaccacuu

SEQ ID NO: 741233 - RNA, 22 nt, Homo sapiens
cauccuuggacugagaaauuau

SEQ ID NO: 741234 - RNA, 14 nt, Homo sapiens
cauccuuguaauac

SEQ ID NO: 741235 - RNA, 22 nt, Homo sapiens
cauccuuucuuuuaaugaugcc

SEQ ID NO: 741236 - RNA, 12 nt, Homo sapiens
caucgggagcac

SEQ ID NO: 741237 - RNA, 16 nt, Homo sapiens
caucguaggcagccac

SEQ ID NO: 741238 - RNA, 18 nt, Homo sapiens
caucgugaagaagccugu

SEQ ID NO: 741239 - RNA, 21 nt, Homo sapiens
caucguggccuugaccuccaa

SEQ ID NO: 741240 - RNA, 19 nt, Homo sapiens
caucuaauaaguauauaau

SEQ ID NO: 741241 - RNA, 20 nt, Homo sapiens
caucuacccugcugaccucc

SEQ ID NO: 741242 - RNA, 19 nt, Homo sapiens
caucuauucucuccaaaaa

SEQ ID NO: 741243 - RNA, 21 nt, Homo sapiens
caucucaaaaauaaugcauaa

SEQ ID NO: 741244 - RNA, 17 nt, Homo sapiens
caucucaagccccaaau

SEQ ID NO: 741245 - RNA, 12 nt, Homo sapiens
caucucagccua

SEQ ID NO: 741246 - RNA, 15 nt, Homo sapiens
caucucaucaacuua

SEQ ID NO: 741247 - RNA, 15 nt, Homo sapiens
caucuccagcuauuu

SEQ ID NO: 741248 - RNA, 16 nt, Homo sapiens
caucucuuuaccuccu

SEQ ID NO: 741249 - RNA, 11 nt, Homo sapiens
caucugaccau

SEQ ID NO: 741250 - RNA, 21 nt, Homo sapiens
caucugagugggcccagcaca

SEQ ID NO: 741251 - RNA, 13 nt, Homo sapiens
caucugauuuacu

SEQ ID NO: 741252 - RNA, 14 nt, Homo sapiens
caucugauuuacuu

SEQ ID NO: 741253 - RNA, 20 nt, Homo sapiens
caucugauuuacuuaauuca

SEQ ID NO: 741254 - RNA, 19 nt, Homo sapiens
caucugccuuaaaaccaaa

SEQ ID NO: 741255 - RNA, 14 nt, Homo sapiens
caucugcugugguc

SEQ ID NO: 741256 - RNA, 15 nt, Homo sapiens
caucuggaaucugga

SEQ ID NO: 741257 - RNA, 23 nt, Homo sapiens
caucuggcuuuuucugccacuga

SEQ ID NO: 741258 - RNA, 14 nt, Homo sapiens
caucuguaccucug

SEQ ID NO: 741259 - RNA, 23 nt, Homo sapiens
caucugucuugccagccagaagc

SEQ ID NO: 741260 - RNA, 15 nt, Homo sapiens
caucugugccagaga

SEQ ID NO: 741261 - RNA, 11 nt, Homo sapiens
caucuguggag

SEQ ID NO: 741262 - RNA, 18 nt, Homo sapiens
caucuuacuguaccuguu

SEQ ID NO: 741263 - RNA, 23 nt, Homo sapiens
caucuucaauuuauuacugaaaa

SEQ ID NO: 741264 - RNA, 21 nt, Homo sapiens
caucuugcuaugagguuugcu

SEQ ID NO: 741265 - RNA, 14 nt, Homo sapiens
caucuuggucacau

SEQ ID NO: 741266 - RNA, 17 nt, Homo sapiens
caucuuggucacauaca

SEQ ID NO: 741267 - RNA, 19 nt, Homo sapiens
caucuuggucacauacaau

SEQ ID NO: 741268 - RNA, 23 nt, Homo sapiens
caucuuggucagauuugaacucu

SEQ ID NO: 741269 - RNA, 14 nt, Homo sapiens
caucuuguacccag

SEQ ID NO: 741270 - RNA, 10 nt, Homo sapiens
caucuuuaag

SEQ ID NO: 741271 - RNA, 21 nt, Homo sapiens
caucuuuaucaugaagcacau

SEQ ID NO: 741272 - RNA, 21 nt, Homo sapiens
caucuuuccaauccagaggaa

SEQ ID NO: 741273 - RNA, 16 nt, Homo sapiens
caucuuucuugaauga

SEQ ID NO: 741274 - RNA, 23 nt, Homo sapiens
caucuuuguggcgggagugcuca

SEQ ID NO: 741275 - RNA, 15 nt, Homo sapiens
caucuuuucuaauca

SEQ ID NO: 741276 - RNA, 21 nt, Homo sapiens
caucuuuucuaaucacagugu

SEQ ID NO: 741277 - RNA, 20 nt, Homo sapiens
caugaaaaauauugcugaac

SEQ ID NO: 741278 - RNA, 18 nt, Homo sapiens
caugaaaacacacauaca

SEQ ID NO: 741279 - RNA, 19 nt, Homo sapiens
caugaaaguggacaaggag

SEQ ID NO: 741280 - RNA, 21 nt, Homo sapiens
caugaaauaaugcacugagua

SEQ ID NO: 741281 - RNA, 15 nt, Homo sapiens
caugaaaugcuucca

SEQ ID NO: 741282 - RNA, 15 nt, Homo sapiens
caugaacacacugug

SEQ ID NO: 741283 - RNA, 19 nt, Homo sapiens
caugaacaucauggacuga

SEQ ID NO: 741284 - RNA, 20 nt, Homo sapiens
caugaagaauguuucuggaa

SEQ ID NO: 741285 - RNA, 13 nt, Homo sapiens
caugaaguggaaa

SEQ ID NO: 741286 - RNA, 21 nt, Homo sapiens
caugaaguggaaaaaggagag

SEQ ID NO: 741287 - RNA, 14 nt, Homo sapiens
caugaaucacugug

SEQ ID NO: 741288 - RNA, 15 nt, Homo sapiens
caugaaucacugugc

SEQ ID NO: 741289 - RNA, 22 nt, Homo sapiens
caugaaucccacccacauguga

SEQ ID NO: 741290 - RNA, 13 nt, Homo sapiens
caugaaugcacac

SEQ ID NO: 741291 - RNA, 22 nt, Homo sapiens
caugaaugugcuggugaacacu

SEQ ID NO: 741292 - RNA, 17 nt, Homo sapiens
caugaauuaguucuccu

SEQ ID NO: 741293 - RNA, 13 nt, Homo sapiens
caugacauaugac

SEQ ID NO: 741294 - RNA, 20 nt, Homo sapiens
caugacccaccccugugcuc

SEQ ID NO: 741295 - RNA, 18 nt, Homo sapiens
caugaccugugaccagca

SEQ ID NO: 741296 - RNA, 15 nt, Homo sapiens
caugacguguuucuu

SEQ ID NO: 741297 - RNA, 21 nt, Homo sapiens
caugacucggggguggggaaa

SEQ ID NO: 741298 - RNA, 17 nt, Homo sapiens
caugacuuauuaugcau

SEQ ID NO: 741299 - RNA, 20 nt, Homo sapiens
caugacuuauuaugcauaaa

SEQ ID NO: 741300 - RNA, 18 nt, Homo sapiens
caugagaaagaauuugag

SEQ ID NO: 741301 - RNA, 15 nt, Homo sapiens
caugagaauaaagau

SEQ ID NO: 741302 - RNA, 17 nt, Homo sapiens
caugagacucagugcag

SEQ ID NO: 741303 - RNA, 18 nt, Homo sapiens
caugagacucagugcaga

SEQ ID NO: 741304 - RNA, 19 nt, Homo sapiens
caugagacucagugcagau

SEQ ID NO: 741305 - RNA, 20 nt, Homo sapiens
caugagacucagugcagaug

SEQ ID NO: 741306 - RNA, 22 nt, Homo sapiens
caugaggaggucccacuugcaa

SEQ ID NO: 741307 - RNA, 15 nt, Homo sapiens
caugaggccaucuca

SEQ ID NO: 741308 - RNA, 16 nt, Homo sapiens
caugaggccaucucag

SEQ ID NO: 741309 - RNA, 17 nt, Homo sapiens
caugagguacagcagaa

SEQ ID NO: 741310 - RNA, 18 nt, Homo sapiens
caugaguuaucaugaauu

SEQ ID NO: 741311 - RNA, 17 nt, Homo sapiens
caugaguuggcugggaa

SEQ ID NO: 741312 - RNA, 15 nt, Homo sapiens
caugauaacugcaau

SEQ ID NO: 741313 - RNA, 15 nt, Homo sapiens
caugauaaggcucuu

SEQ ID NO: 741314 - RNA, 21 nt, Homo sapiens
caugauaccaccuuuacugug

SEQ ID NO: 741315 - RNA, 14 nt, Homo sapiens
caugaucaguguau

SEQ ID NO: 741316 - RNA, 14 nt, Homo sapiens
caugaucaugccac

SEQ ID NO: 741317 - RNA, 21 nt, Homo sapiens
caugaucaugccacugcacuc

SEQ ID NO: 741318 - RNA, 14 nt, Homo sapiens
caugaugagaguuu

SEQ ID NO: 741319 - RNA, 16 nt, Homo sapiens
caugauggugcaugcc

SEQ ID NO: 741320 - RNA, 16 nt, Homo sapiens
caugaugucaacucac

SEQ ID NO: 741321 - RNA, 19 nt, Homo sapiens
caugauguuaaccagaaua

SEQ ID NO: 741322 - RNA, 16 nt, Homo sapiens
caugauucaugagcug

SEQ ID NO: 741323 - RNA, 13 nt, Homo sapiens
caugauuguuuga

SEQ ID NO: 741324 - RNA, 22 nt, Homo sapiens
caugauuucauuucaacuguuu

SEQ ID NO: 741325 - RNA, 15 nt, Homo sapiens
caugcaaggcacuga

SEQ ID NO: 741326 - RNA, 15 nt, Homo sapiens
ccaacaguagccaaa

SEQ ID NO: 741327 - RNA, 15 nt, Homo sapiens
ccaaccaaaccaauu

SEQ ID NO: 741328 - RNA, 14 nt, Homo sapiens
ccaacccaucagaa

SEQ ID NO: 741329 - RNA, 20 nt, Homo sapiens
ccaaccccaguggauucuca

SEQ ID NO: 741330 - RNA, 19 nt, Homo sapiens
ccaacccuaucuccugaca

SEQ ID NO: 741331 - RNA, 15 nt, Homo sapiens
ccaaccucuggagca

SEQ ID NO: 741332 - RNA, 19 nt, Homo sapiens
ccaacgagacacauugccu

SEQ ID NO: 741333 - RNA, 18 nt, Homo sapiens
ccaacgaggugaucuagc

SEQ ID NO: 741334 - RNA, 13 nt, Homo sapiens
ccaacgcacagga

SEQ ID NO: 741335 - RNA, 14 nt, Homo sapiens
ccaacguccccucc

SEQ ID NO: 741336 - RNA, 17 nt, Homo sapiens
ccaacguggcccagaga

SEQ ID NO: 741337 - RNA, 15 nt, Homo sapiens
ccaacuaaaauuuga

SEQ ID NO: 741338 - RNA, 14 nt, Homo sapiens
ccaacuaacuccag

SEQ ID NO: 741339 - RNA, 13 nt, Homo sapiens
ccaacuacuacug

SEQ ID NO: 741340 - RNA, 19 nt, Homo sapiens
ccaacuagcucuauguuua

SEQ ID NO: 741341 - RNA, 22 nt, Homo sapiens
ccaacuagcucuauguuuacaa

SEQ ID NO: 741342 - RNA, 13 nt, Homo sapiens
ccaacucugggaa

SEQ ID NO: 741343 - RNA, 23 nt, Homo sapiens
ccaacugcuguucauguuacuca

SEQ ID NO: 741344 - RNA, 17 nt, Homo sapiens
ccaacuguuucccugcu

SEQ ID NO: 741345 - RNA, 19 nt, Homo sapiens
ccaacuucauuugaugcua

SEQ ID NO: 741346 - RNA, 21 nt, Homo sapiens
ccaacuucauuugaugcuaaa

SEQ ID NO: 741347 - RNA, 20 nt, Homo sapiens
ccaacuugguucugcuucaa

SEQ ID NO: 741348 - RNA, 16 nt, Homo sapiens
ccaacuuuuuguuaca

SEQ ID NO: 741349 - RNA, 21 nt, Homo sapiens
ccaacuuuuuguuacagauua

SEQ ID NO: 741350 - RNA, 13 nt, Homo sapiens
ccaagaacuugca

SEQ ID NO: 741351 - RNA, 16 nt, Homo sapiens
ccaagaacuugcaaua

SEQ ID NO: 741352 - RNA, 19 nt, Homo sapiens
ccaagaaugcaagauuuca

SEQ ID NO: 741353 - RNA, 16 nt, Homo sapiens
ccaagacacagaucac

SEQ ID NO: 741354 - RNA, 10 nt, Homo sapiens
ccaagacaga

SEQ ID NO: 741355 - RNA, 18 nt, Homo sapiens
ccaagacaugacauucuu

SEQ ID NO: 741356 - RNA, 23 nt, Homo sapiens
ccaagacucuuuaugaucuggcc

SEQ ID NO: 741357 - RNA, 20 nt, Homo sapiens
ccaagacuuuugucugauca

SEQ ID NO: 741358 - RNA, 22 nt, Homo sapiens
ccaagagaacucgcgcucagua

SEQ ID NO: 741359 - RNA, 22 nt, Homo sapiens
ccaagagccugagugacagagc

SEQ ID NO: 741360 - RNA, 17 nt, Homo sapiens
ccaagagguacuguaau

SEQ ID NO: 741361 - RNA, 19 nt, Homo sapiens
ccaagaugucaaaacaaga

SEQ ID NO: 741362 - RNA, 13 nt, Homo sapiens
ccaagauguguuc

SEQ ID NO: 741363 - RNA, 11 nt, Homo sapiens
ccaagcaccuc

SEQ ID NO: 741364 - RNA, 22 nt, Homo sapiens
ccaagcaccuccaaccaaauaa

SEQ ID NO: 741365 - RNA, 15 nt, Homo sapiens
ccaagcagagcucac

SEQ ID NO: 741366 - RNA, 17 nt, Homo sapiens
ccaagcagaguguuuua

SEQ ID NO: 741367 - RNA, 23 nt, Homo sapiens
ccaagcagugccugccuaugaaa

SEQ ID NO: 741368 - RNA, 14 nt, Homo sapiens
ccaagccauucacu

SEQ ID NO: 741369 - RNA, 20 nt, Homo sapiens
ccaagcccaauacagccauu

SEQ ID NO: 741370 - RNA, 17 nt, Homo sapiens
ccaagccccugccucca

SEQ ID NO: 741371 - RNA, 17 nt, Homo sapiens
ccaagccugauacuuua

SEQ ID NO: 741372 - RNA, 23 nt, Homo sapiens
ccaagcguuucccagucuuagcc

SEQ ID NO: 741373 - RNA, 18 nt, Homo sapiens
ccaagcuggccacuauca

SEQ ID NO: 741374 - RNA, 19 nt, Homo sapiens
ccaaggaaacccccagugu

SEQ ID NO: 741375 - RNA, 22 nt, Homo sapiens
ccaaggaaacuuugccaaauau

SEQ ID NO: 741376 - RNA, 16 nt, Homo sapiens
ccaaggacucuuccac

SEQ ID NO: 741377 - RNA, 18 nt, Homo sapiens
ccaaggacugagggcagu

SEQ ID NO: 741378 - RNA, 15 nt, Homo sapiens
ccaaggaugaaauca

SEQ ID NO: 741379 - RNA, 18 nt, Homo sapiens
ccaaggcuuuugcaaaga

SEQ ID NO: 741380 - RNA, 15 nt, Homo sapiens
ccaaggggaaucaga

SEQ ID NO: 741381 - RNA, 18 nt, Homo sapiens
ccaaggguuucgacuggu

SEQ ID NO: 741382 - RNA, 19 nt, Homo sapiens
ccaagguuuuggagucagu

SEQ ID NO: 741383 - RNA, 13 nt, Homo sapiens
ccaagucauggag

SEQ ID NO: 741384 - RNA, 22 nt, Homo sapiens
ccaagugauccuuccaccucag

SEQ ID NO: 741385 - RNA, 16 nt, Homo sapiens
ccaagugccaauauuu

SEQ ID NO: 741386 - RNA, 18 nt, Homo sapiens
ccaauaaaagugacucuc

SEQ ID NO: 741387 - RNA, 13 nt, Homo sapiens
ccaauacauuugu

SEQ ID NO: 741388 - RNA, 13 nt, Homo sapiens
ccaauacccagac

SEQ ID NO: 741389 - RNA, 21 nt, Homo sapiens
ccaauaccuccuccagaucag

SEQ ID NO: 741390 - RNA, 18 nt, Homo sapiens
ccaauacugccaaccaga

SEQ ID NO: 741391 - RNA, 15 nt, Homo sapiens
ccaaucagcacugaa

SEQ ID NO: 741392 - RNA, 23 nt, Homo sapiens
ccaaucccuuuauuacccccucc

SEQ ID NO: 741393 - RNA, 21 nt, Homo sapiens
ccaaugacacccaugccagag

SEQ ID NO: 741394 - RNA, 11 nt, Homo sapiens
ccaaugccugu

SEQ ID NO: 741395 - RNA, 18 nt, Homo sapiens
ccaaugccugugaagcag

SEQ ID NO: 741396 - RNA, 22 nt, Homo sapiens
ccaauggaugaagacccccucc

SEQ ID NO: 741397 - RNA, 21 nt, Homo sapiens
ccaauguucuaaaguuuugca

SEQ ID NO: 741398 - RNA, 22 nt, Homo sapiens
ccaauguuugacaaaacacagc

SEQ ID NO: 741399 - RNA, 18 nt, Homo sapiens
ccaauugugcugccauuu

SEQ ID NO: 741400 - RNA, 14 nt, Homo sapiens
ccaauuuacauacu

SEQ ID NO: 741401 - RNA, 15 nt, Homo sapiens
ccaauuucagacucc

SEQ ID NO: 741402 - RNA, 17 nt, Homo sapiens
ccaauuucagacuccca

SEQ ID NO: 741403 - RNA, 16 nt, Homo sapiens
ccaauuugacaaaacc

SEQ ID NO: 741404 - RNA, 22 nt, Homo sapiens
ccaauuugguaaaaaugcugcu

SEQ ID NO: 741405 - RNA, 21 nt, Homo sapiens
ccacaacuauauuaucaugca

SEQ ID NO: 741406 - RNA, 18 nt, Homo sapiens
ccacaacugacacaggaa

SEQ ID NO: 741407 - RNA, 16 nt, Homo sapiens
ccacaagagugaauuu

SEQ ID NO: 741408 - RNA, 13 nt, Homo sapiens
ccacaaggcacag

SEQ ID NO: 741409 - RNA, 14 nt, Homo sapiens
ccacaagucuucca

SEQ ID NO: 741410 - RNA, 14 nt, Homo sapiens
ccacacacagagga

SEQ ID NO: 741411 - RNA, 17 nt, Homo sapiens
ccacacacuuuccaucu

SEQ ID NO: 741412 - RNA, 12 nt, Homo sapiens
ccacacauauug

SEQ ID NO: 741413 - RNA, 14 nt, Homo sapiens
ccacacauauugca

SEQ ID NO: 741414 - RNA, 16 nt, Homo sapiens
ccacacauuaguacuu

SEQ ID NO: 741415 - RNA, 13 nt, Homo sapiens
ccacaccaucucc

SEQ ID NO: 741416 - RNA, 22 nt, Homo sapiens
ccacacccuggaggauuucauc

SEQ ID NO: 741417 - RNA, 15 nt, Homo sapiens
ccacaccugcagugc

SEQ ID NO: 741418 - RNA, 21 nt, Homo sapiens
ccacaccuggaaacagaccaa

SEQ ID NO: 741419 - RNA, 16 nt, Homo sapiens
ccacacuccacugaca

SEQ ID NO: 741420 - RNA, 15 nt, Homo sapiens
ccacacucuccauca

SEQ ID NO: 741421 - RNA, 21 nt, Homo sapiens
ccacacuuguuccagcucuuu

SEQ ID NO: 741422 - RNA, 15 nt, Homo sapiens
ccacagaugccucca

SEQ ID NO: 741423 - RNA, 20 nt, Homo sapiens
ccacagccaaacuaggacac

SEQ ID NO: 741424 - RNA, 23 nt, Homo sapiens
ccacagccuucggacagacauau

SEQ ID NO: 741425 - RNA, 21 nt, Homo sapiens
ccacaggagugggaaaacacu

SEQ ID NO: 741426 - RNA, 15 nt, Homo sapiens
ccacagguacagagc

SEQ ID NO: 741427 - RNA, 14 nt, Homo sapiens
ccacagucacugga

SEQ ID NO: 741428 - RNA, 21 nt, Homo sapiens
ccacauaaccucucugugcca

SEQ ID NO: 741429 - RNA, 14 nt, Homo sapiens
ccacauaccuggcc

SEQ ID NO: 741430 - RNA, 15 nt, Homo sapiens
ccacaugcuggugca

SEQ ID NO: 741431 - RNA, 19 nt, Homo sapiens
ccacaugugacacauaugc

SEQ ID NO: 741432 - RNA, 13 nt, Homo sapiens
ccacaugugucca

SEQ ID NO: 741433 - RNA, 15 nt, Homo sapiens
ccaccaaaacugcuc

SEQ ID NO: 741434 - RNA, 14 nt, Homo sapiens
ccaccaacaccagg

SEQ ID NO: 741435 - RNA, 17 nt, Homo sapiens
ccaccaagaagcacugg

SEQ ID NO: 741436 - RNA, 13 nt, Homo sapiens
ccaccacauagca

SEQ ID NO: 741437 - RNA, 17 nt, Homo sapiens
ccaccaccuucuucucc

SEQ ID NO: 741438 - RNA, 13 nt, Homo sapiens
ccaccaguucuca

SEQ ID NO: 741439 - RNA, 16 nt, Homo sapiens
ccaccaucauagcuca

SEQ ID NO: 741440 - RNA, 11 nt, Homo sapiens
ccaccauuccc

SEQ ID NO: 741441 - RNA, 12 nt, Homo sapiens
ccaggcugccuc

SEQ ID NO: 741442 - RNA, 13 nt, Homo sapiens
ccaggcugccuga

SEQ ID NO: 741443 - RNA, 16 nt, Homo sapiens
ccaggcuggagugcaa

SEQ ID NO: 741444 - RNA, 17 nt, Homo sapiens
ccaggcuggagugcaau

SEQ ID NO: 741445 - RNA, 20 nt, Homo sapiens
ccaggcuggagugcaaugac

SEQ ID NO: 741446 - RNA, 19 nt, Homo sapiens
ccaggcuggagugcaaugc

SEQ ID NO: 741447 - RNA, 19 nt, Homo sapiens
ccaggcuggagugcaguga

SEQ ID NO: 741448 - RNA, 23 nt, Homo sapiens
ccaggcuggagugcaguggugca

SEQ ID NO: 741449 - RNA, 13 nt, Homo sapiens
ccaggcuggauac

SEQ ID NO: 741450 - RNA, 23 nt, Homo sapiens
ccaggcuggauacuaagcacaaa

SEQ ID NO: 741451 - RNA, 21 nt, Homo sapiens
ccaggcuguuggaaaauccag

SEQ ID NO: 741452 - RNA, 19 nt, Homo sapiens
ccaggcuugucacuagcag

SEQ ID NO: 741453 - RNA, 19 nt, Homo sapiens
ccagggacaaaacacugug

SEQ ID NO: 741454 - RNA, 23 nt, Homo sapiens
ccagggacccaggugugccugug

SEQ ID NO: 741455 - RNA, 17 nt, Homo sapiens
ccagggagaagcuccuc

SEQ ID NO: 741456 - RNA, 15 nt, Homo sapiens
ccagggagcaagaca

SEQ ID NO: 741457 - RNA, 18 nt, Homo sapiens
ccagggaugacauguccc

SEQ ID NO: 741458 - RNA, 13 nt, Homo sapiens
ccagggaugggca

SEQ ID NO: 741459 - RNA, 16 nt, Homo sapiens
ccaggggcagccacac

SEQ ID NO: 741460 - RNA, 15 nt, Homo sapiens
ccagggguguagaug

SEQ ID NO: 741461 - RNA, 17 nt, Homo sapiens
ccaggguacccgccuga

SEQ ID NO: 741462 - RNA, 22 nt, Homo sapiens
ccagggucuugggcuacuggca

SEQ ID NO: 741463 - RNA, 18 nt, Homo sapiens
ccaggguggaugaucuca

SEQ ID NO: 741464 - RNA, 19 nt, Homo sapiens
ccaggguggaugaucucaa

SEQ ID NO: 741465 - RNA, 18 nt, Homo sapiens
ccagguagaaacuuuuau

SEQ ID NO: 741466 - RNA, 20 nt, Homo sapiens
ccaggucguccaagcaaaaa

SEQ ID NO: 741467 - RNA, 22 nt, Homo sapiens
ccaggucucuccacugcucuca

SEQ ID NO: 741468 - RNA, 18 nt, Homo sapiens
ccaggugggugugggaca

SEQ ID NO: 741469 - RNA, 15 nt, Homo sapiens
ccagguggugaauuu

SEQ ID NO: 741470 - RNA, 19 nt, Homo sapiens
ccagguguucuacacucau

SEQ ID NO: 741471 - RNA, 22 nt, Homo sapiens
ccagguguucuacacucaucuu

SEQ ID NO: 741472 - RNA, 14 nt, Homo sapiens
ccagguguugccau

SEQ ID NO: 741473 - RNA, 15 nt, Homo sapiens
ccagguuccauccac

SEQ ID NO: 741474 - RNA, 18 nt, Homo sapiens
ccagguuggagugcagug

SEQ ID NO: 741475 - RNA, 17 nt, Homo sapiens
ccagguugggggcagug

SEQ ID NO: 741476 - RNA, 22 nt, Homo sapiens
ccagguugggggcaguguugug

SEQ ID NO: 741477 - RNA, 14 nt, Homo sapiens
ccaguaaagccuua

SEQ ID NO: 741478 - RNA, 16 nt, Homo sapiens
ccaguaauugguccga

SEQ ID NO: 741479 - RNA, 18 nt, Homo sapiens
ccaguauaagacuacuga

SEQ ID NO: 741480 - RNA, 13 nt, Homo sapiens
ccaguaucgcuca

SEQ ID NO: 741481 - RNA, 23 nt, Homo sapiens
ccaguaucucuucagucucuaua

SEQ ID NO: 741482 - RNA, 22 nt, Homo sapiens
ccaguauuuuuauuucuuuaau

SEQ ID NO: 741483 - RNA, 15 nt, Homo sapiens
ccagucacugcugca

SEQ ID NO: 741484 - RNA, 16 nt, Homo sapiens
ccagucacugcugcaa

SEQ ID NO: 741485 - RNA, 18 nt, Homo sapiens
ccagucuauuuccacuga

SEQ ID NO: 741486 - RNA, 17 nt, Homo sapiens
ccagucuggaaaacaga

SEQ ID NO: 741487 - RNA, 19 nt, Homo sapiens
ccagucuguugaguuaguu

SEQ ID NO: 741488 - RNA, 19 nt, Homo sapiens
ccagucuuccugacacuuu

SEQ ID NO: 741489 - RNA, 21 nt, Homo sapiens
ccagucuuccugacacuuuaa

SEQ ID NO: 741490 - RNA, 23 nt, Homo sapiens
ccagucuuuucuggcaaauaaca

SEQ ID NO: 741491 - RNA, 20 nt, Homo sapiens
ccagugaggaugcugcagug

SEQ ID NO: 741492 - RNA, 16 nt, Homo sapiens
ccagugcaaaccacuu

SEQ ID NO: 741493 - RNA, 13 nt, Homo sapiens
ccagugcagccac

SEQ ID NO: 741494 - RNA, 16 nt, Homo sapiens
ccagugccaagcacag

SEQ ID NO: 741495 - RNA, 15 nt, Homo sapiens
ccagugccagcaccu

SEQ ID NO: 741496 - RNA, 18 nt, Homo sapiens
ccagugccuagaugcaug

SEQ ID NO: 741497 - RNA, 22 nt, Homo sapiens
ccaguggaacagcgggagaccu

SEQ ID NO: 741498 - RNA, 18 nt, Homo sapiens
ccagugggcauagucagu

SEQ ID NO: 741499 - RNA, 14 nt, Homo sapiens
ccaguggugcguuu

SEQ ID NO: 741500 - RNA, 19 nt, Homo sapiens
ccagugugacacugcuuua

SEQ ID NO: 741501 - RNA, 14 nt, Homo sapiens
ccagugugcaaggg

SEQ ID NO: 741502 - RNA, 21 nt, Homo sapiens
ccagugugcaagggcagugaa

SEQ ID NO: 741503 - RNA, 18 nt, Homo sapiens
ccaguguuauuaaugaca

SEQ ID NO: 741504 - RNA, 12 nt, Homo sapiens
ccaguguucucc

SEQ ID NO: 741505 - RNA, 20 nt, Homo sapiens
ccaguguuuacaaggugaca

SEQ ID NO: 741506 - RNA, 14 nt, Homo sapiens
ccaguugccuuuua

SEQ ID NO: 741507 - RNA, 20 nt, Homo sapiens
ccaguuugcaccugucccca

SEQ ID NO: 741508 - RNA, 23 nt, Homo sapiens
ccaguuuggguaaaauacuuuua

SEQ ID NO: 741509 - RNA, 15 nt, Homo sapiens
ccauaaagacaauca

SEQ ID NO: 741510 - RNA, 15 nt, Homo sapiens
ccauaagaaagcacu

SEQ ID NO: 741511 - RNA, 16 nt, Homo sapiens
ccauaagaaagcacua

SEQ ID NO: 741512 - RNA, 23 nt, Homo sapiens
ccauaagaggugaucucugggag

SEQ ID NO: 741513 - RNA, 20 nt, Homo sapiens
ccauaauaagagaauguucc

SEQ ID NO: 741514 - RNA, 23 nt, Homo sapiens
ccauaauucuaaguuauuuacuu

SEQ ID NO: 741515 - RNA, 13 nt, Homo sapiens
ccauacacauucu

SEQ ID NO: 741516 - RNA, 14 nt, Homo sapiens
ccauacuucucuca

SEQ ID NO: 741517 - RNA, 15 nt, Homo sapiens
ccauacuucucucag

SEQ ID NO: 741518 - RNA, 18 nt, Homo sapiens
ccauacuuugucugaaaa

SEQ ID NO: 741519 - RNA, 13 nt, Homo sapiens
ccauagaaacaug

SEQ ID NO: 741520 - RNA, 21 nt, Homo sapiens
ccauaggaaggcacuacauga

SEQ ID NO: 741521 - RNA, 15 nt, Homo sapiens
ccauagucacauggc

SEQ ID NO: 741522 - RNA, 23 nt, Homo sapiens
ccauauaccaucuccagcuauuu

SEQ ID NO: 741523 - RNA, 16 nt, Homo sapiens
ccauaucugugaaaug

SEQ ID NO: 741524 - RNA, 14 nt, Homo sapiens
ccauaugugggugu

SEQ ID NO: 741525 - RNA, 15 nt, Homo sapiens
ccauauuaaaaucug

SEQ ID NO: 741526 - RNA, 16 nt, Homo sapiens
ccauauuuaacaugua

SEQ ID NO: 741527 - RNA, 17 nt, Homo sapiens
ccauauuugauaguaua

SEQ ID NO: 741528 - RNA, 18 nt, Homo sapiens
ccauauuuuacugaucuc

SEQ ID NO: 741529 - RNA, 20 nt, Homo sapiens
ccaucaaacauaauucucuc

SEQ ID NO: 741530 - RNA, 14 nt, Homo sapiens
ccaucaacuguauu

SEQ ID NO: 741531 - RNA, 22 nt, Homo sapiens
ccaucaauauuauauucaagau

SEQ ID NO: 741532 - RNA, 17 nt, Homo sapiens
ccaucaggauccagucu

SEQ ID NO: 741533 - RNA, 13 nt, Homo sapiens
ccaucaggguucu

SEQ ID NO: 741534 - RNA, 15 nt, Homo sapiens
ccaucaucacuguaa

SEQ ID NO: 741535 - RNA, 23 nt, Homo sapiens
ccaucaugggcuggacauuggac

SEQ ID NO: 741536 - RNA, 14 nt, Homo sapiens
ccaucaugucugua

SEQ ID NO: 741537 - RNA, 19 nt, Homo sapiens
ccauccaccccguugcuca

SEQ ID NO: 741538 - RNA, 20 nt, Homo sapiens
ccauccaucuuuccauccau

SEQ ID NO: 741539 - RNA, 10 nt, Homo sapiens
ccauccucac

SEQ ID NO: 741540 - RNA, 16 nt, Homo sapiens
ccauccugaccagcug

SEQ ID NO: 741541 - RNA, 21 nt, Homo sapiens
ccauccuuccaacauauauuu

SEQ ID NO: 741542 - RNA, 14 nt, Homo sapiens
ccaucuaugagcug

SEQ ID NO: 741543 - RNA, 17 nt, Homo sapiens
ccaucuccuuucaggga

SEQ ID NO: 741544 - RNA, 14 nt, Homo sapiens
ccaucucuacuaaa

SEQ ID NO: 741545 - RNA, 14 nt, Homo sapiens
ccaucucuacugaa

SEQ ID NO: 741546 - RNA, 19 nt, Homo sapiens
ccaucugaagaaacuuccc

SEQ ID NO: 741547 - RNA, 14 nt, Homo sapiens
ccaucugacaaaau

SEQ ID NO: 741548 - RNA, 22 nt, Homo sapiens
ccaucugagccgucagagcagu

SEQ ID NO: 741549 - RNA, 17 nt, Homo sapiens
ccaucuggcucagcaua

SEQ ID NO: 741550 - RNA, 15 nt, Homo sapiens
ccaucugugacuaua

SEQ ID NO: 741551 - RNA, 22 nt, Homo sapiens
ccaucuuuaucaugaagcacau

SEQ ID NO: 741552 - RNA, 14 nt, Homo sapiens
ccaucuuuccaucc

SEQ ID NO: 741553 - RNA, 22 nt, Homo sapiens
ccaugaaacuuuagagauuaac

SEQ ID NO: 741554 - RNA, 17 nt, Homo sapiens
ccaugaacaucauggac

SEQ ID NO: 741555 - RNA, 16 nt, Homo sapiens
cccugacucaucauuu

SEQ ID NO: 741556 - RNA, 14 nt, Homo sapiens
cccugacugaauca

SEQ ID NO: 741557 - RNA, 17 nt, Homo sapiens
cccugacuucuggagau

SEQ ID NO: 741558 - RNA, 17 nt, Homo sapiens
cccugauacaggcaugg

SEQ ID NO: 741559 - RNA, 13 nt, Homo sapiens
cccugcaccacuc

SEQ ID NO: 741560 - RNA, 15 nt, Homo sapiens
cccugcaccaugcug

SEQ ID NO: 741561 - RNA, 13 nt, Homo sapiens
cccugcagaggaa

SEQ ID NO: 741562 - RNA, 16 nt, Homo sapiens
cccugcagucacagcu

SEQ ID NO: 741563 - RNA, 23 nt, Homo sapiens
cccugccaagacuccucaggcag

SEQ ID NO: 741564 - RNA, 15 nt, Homo sapiens
cccugcccaaugaga

SEQ ID NO: 741565 - RNA, 23 nt, Homo sapiens
cccugcccaccaagaagcacugg

SEQ ID NO: 741566 - RNA, 16 nt, Homo sapiens
cccugccggugcacag

SEQ ID NO: 741567 - RNA, 11 nt, Homo sapiens
cccugccugag

SEQ ID NO: 741568 - RNA, 14 nt, Homo sapiens
cccugccugccaua

SEQ ID NO: 741569 - RNA, 20 nt, Homo sapiens
cccugcucaguaaagcacuu

SEQ ID NO: 741570 - RNA, 14 nt, Homo sapiens
cccugcuccagucc

SEQ ID NO: 741571 - RNA, 19 nt, Homo sapiens
cccugcuccucccuggcug

SEQ ID NO: 741572 - RNA, 12 nt, Homo sapiens
cccugcuugcac

SEQ ID NO: 741573 - RNA, 22 nt, Homo sapiens
cccuggcaccuguguuccagcc

SEQ ID NO: 741574 - RNA, 18 nt, Homo sapiens
cccuggcagcaugacuca

SEQ ID NO: 741575 - RNA, 15 nt, Homo sapiens
cccuggcagugcuga

SEQ ID NO: 741576 - RNA, 16 nt, Homo sapiens
cccuggccagcucuga

SEQ ID NO: 741577 - RNA, 20 nt, Homo sapiens
cccuggcugugagcagccuc

SEQ ID NO: 741578 - RNA, 14 nt, Homo sapiens
cccugggaaccacu

SEQ ID NO: 741579 - RNA, 16 nt, Homo sapiens
cccugggauguccaca

SEQ ID NO: 741580 - RNA, 16 nt, Homo sapiens
cccugggccucagugu

SEQ ID NO: 741581 - RNA, 22 nt, Homo sapiens
cccugggcuaccaucugcaugg

SEQ ID NO: 741582 - RNA, 21 nt, Homo sapiens
cccuggggcuucuccugaccc

SEQ ID NO: 741583 - RNA, 20 nt, Homo sapiens
cccugggggcugugauauua

SEQ ID NO: 741584 - RNA, 14 nt, Homo sapiens
cccugggguggcca

SEQ ID NO: 741585 - RNA, 16 nt, Homo sapiens
cccuggucaccagagg

SEQ ID NO: 741586 - RNA, 13 nt, Homo sapiens
cccuggugucaca

SEQ ID NO: 741587 - RNA, 19 nt, Homo sapiens
cccuguaaccugacugguu

SEQ ID NO: 741588 - RNA, 19 nt, Homo sapiens
cccuguagacuagugccgu

SEQ ID NO: 741589 - RNA, 18 nt, Homo sapiens
cccuguaucuacuaaaaa

SEQ ID NO: 741590 - RNA, 14 nt, Homo sapiens
cccuguaugauucc

SEQ ID NO: 741591 - RNA, 17 nt, Homo sapiens
cccugucauccagcuca

SEQ ID NO: 741592 - RNA, 22 nt, Homo sapiens
cccuguccaaacugccuaagcc

SEQ ID NO: 741593 - RNA, 21 nt, Homo sapiens
cccugucccaccaacucugca

SEQ ID NO: 741594 - RNA, 16 nt, Homo sapiens
cccuguccccugaaaa

SEQ ID NO: 741595 - RNA, 17 nt, Homo sapiens
cccuguccccugaaaaa

SEQ ID NO: 741596 - RNA, 15 nt, Homo sapiens
cccugucgcgucuca

SEQ ID NO: 741597 - RNA, 16 nt, Homo sapiens
cccugucucccaaaaa

SEQ ID NO: 741598 - RNA, 14 nt, Homo sapiens
cccugucuuccaca

SEQ ID NO: 741599 - RNA, 17 nt, Homo sapiens
cccugugccagaccuca

SEQ ID NO: 741600 - RNA, 12 nt, Homo sapiens
cccugugcuguc

SEQ ID NO: 741601 - RNA, 21 nt, Homo sapiens
cccuguggcaggacacacaug

SEQ ID NO: 741602 - RNA, 20 nt, Homo sapiens
cccuguguauucaccaccaa

SEQ ID NO: 741603 - RNA, 16 nt, Homo sapiens
cccuguuucucuugaa

SEQ ID NO: 741604 - RNA, 20 nt, Homo sapiens
cccuuaauauugaggcugca

SEQ ID NO: 741605 - RNA, 20 nt, Homo sapiens
cccuuacuaugaucucagga

SEQ ID NO: 741606 - RNA, 16 nt, Homo sapiens
cccuucagguguuacu

SEQ ID NO: 741607 - RNA, 13 nt, Homo sapiens
cccuucagucuuc

SEQ ID NO: 741608 - RNA, 22 nt, Homo sapiens
cccuuccaggugggugugggac

SEQ ID NO: 741609 - RNA, 11 nt, Homo sapiens
cccuuccccag

SEQ ID NO: 741610 - RNA, 20 nt, Homo sapiens
cccuucccucaccuuggcac

SEQ ID NO: 741611 - RNA, 13 nt, Homo sapiens
cccuuccuggaaa

SEQ ID NO: 741612 - RNA, 22 nt, Homo sapiens
cccuuccuggaaacagcaugaa

SEQ ID NO: 741613 - RNA, 14 nt, Homo sapiens
cccuucguguuucc

SEQ ID NO: 741614 - RNA, 18 nt, Homo sapiens
cccuucuauacccaccca

SEQ ID NO: 741615 - RNA, 20 nt, Homo sapiens
cccuucuauacccacccaga

SEQ ID NO: 741616 - RNA, 21 nt, Homo sapiens
cccuugcaaucuucuacuuua

SEQ ID NO: 741617 - RNA, 16 nt, Homo sapiens
cccuuggagccaaugg

SEQ ID NO: 741618 - RNA, 14 nt, Homo sapiens
cccuuggagcugcc

SEQ ID NO: 741619 - RNA, 21 nt, Homo sapiens
cccuuggaggcugucuucuca

SEQ ID NO: 741620 - RNA, 20 nt, Homo sapiens
cccuuggccuccauuucugu

SEQ ID NO: 741621 - RNA, 17 nt, Homo sapiens
cccuuggcuucugugau

SEQ ID NO: 741622 - RNA, 17 nt, Homo sapiens
cccuugucgugggaugg

SEQ ID NO: 741623 - RNA, 21 nt, Homo sapiens
cccuugugagagcccauuccc

SEQ ID NO: 741624 - RNA, 21 nt, Homo sapiens
cccuugugucaagacauuucu

SEQ ID NO: 741625 - RNA, 11 nt, Homo sapiens
cccuuucacaa

SEQ ID NO: 741626 - RNA, 14 nt, Homo sapiens
cccuuucuuugcaa

SEQ ID NO: 741627 - RNA, 14 nt, Homo sapiens
cccuuugccuucau

SEQ ID NO: 741628 - RNA, 14 nt, Homo sapiens
cccuuugcuucaaa

SEQ ID NO: 741629 - RNA, 21 nt, Homo sapiens
cccuuuggagaacgccagucu

SEQ ID NO: 741630 - RNA, 20 nt, Homo sapiens
cccuuuucauauacuuauuu

SEQ ID NO: 741631 - RNA, 19 nt, Homo sapiens
cccuuuuucuccagcuggg

SEQ ID NO: 741632 - RNA, 20 nt, Homo sapiens
ccgaaaaggauaugcaguau

SEQ ID NO: 741633 - RNA, 15 nt, Homo sapiens
ccgaauggggcagca

SEQ ID NO: 741634 - RNA, 15 nt, Homo sapiens
ccgaaugucacuggu

SEQ ID NO: 741635 - RNA, 23 nt, Homo sapiens
ccgacacugcugcaccagaguga

SEQ ID NO: 741636 - RNA, 11 nt, Homo sapiens
ccgacucuggc

SEQ ID NO: 741637 - RNA, 18 nt, Homo sapiens
ccgacuuccccugggcaa

SEQ ID NO: 741638 - RNA, 13 nt, Homo sapiens
ccgagaccccauc

SEQ ID NO: 741639 - RNA, 16 nt, Homo sapiens
ccgaguaaugacgugu

SEQ ID NO: 741640 - RNA, 15 nt, Homo sapiens
ccgagucucuucucc

SEQ ID NO: 741641 - RNA, 11 nt, Homo sapiens
ccgagugcaau

SEQ ID NO: 741642 - RNA, 12 nt, Homo sapiens
ccgagugcaaug

SEQ ID NO: 741643 - RNA, 17 nt, Homo sapiens
ccgagugcaaugaauga

SEQ ID NO: 741644 - RNA, 12 nt, Homo sapiens
ccgauaccaugc

SEQ ID NO: 741645 - RNA, 21 nt, Homo sapiens
ccgauacuaguuugcuuugcu

SEQ ID NO: 741646 - RNA, 23 nt, Homo sapiens
ccgaugcugaggccacccacuga

SEQ ID NO: 741647 - RNA, 14 nt, Homo sapiens
ccgcaaacgugaaa

SEQ ID NO: 741648 - RNA, 23 nt, Homo sapiens
ccgcaacaguuuuuuaugcuaau

SEQ ID NO: 741649 - RNA, 19 nt, Homo sapiens
ccgcaagaaagcaugacuu

SEQ ID NO: 741650 - RNA, 12 nt, Homo sapiens
ccgcacaugcac

SEQ ID NO: 741651 - RNA, 14 nt, Homo sapiens
ccgcaccgcuggga

SEQ ID NO: 741652 - RNA, 16 nt, Homo sapiens
ccgcaccuugucaugu

SEQ ID NO: 741653 - RNA, 23 nt, Homo sapiens
ccgcauccgggguucaagccauu

SEQ ID NO: 741654 - RNA, 19 nt, Homo sapiens
ccgccacugggccugucac

SEQ ID NO: 741655 - RNA, 23 nt, Homo sapiens
ccgccauggugcuggggagccaa

SEQ ID NO: 741656 - RNA, 14 nt, Homo sapiens
ccgcccacagccag

SEQ ID NO: 741657 - RNA, 20 nt, Homo sapiens
ccgccuggccggcuccaguu

SEQ ID NO: 741658 - RNA, 12 nt, Homo sapiens
ccgcucucucug

SEQ ID NO: 741659 - RNA, 19 nt, Homo sapiens
ccgcugacugcaccagcgc

SEQ ID NO: 741660 - RNA, 17 nt, Homo sapiens
ccgcugauaagcauuga

SEQ ID NO: 741661 - RNA, 16 nt, Homo sapiens
ccgcugcgggcccacg

SEQ ID NO: 741662 - RNA, 21 nt, Homo sapiens
ccgcugcuuccuggcugggaa

SEQ ID NO: 741663 - RNA, 16 nt, Homo sapiens
ccggaaggaaugucag

SEQ ID NO: 741664 - RNA, 23 nt, Homo sapiens
ccggaauccuuggggagcacuug

SEQ ID NO: 741665 - RNA, 21 nt, Homo sapiens
ccggaucuacacccaccagag

SEQ ID NO: 741666 - RNA, 19 nt, Homo sapiens
ccggcacccugauccucac

SEQ ID NO: 741667 - RNA, 20 nt, Homo sapiens
ccggccagcgggcacagggc

SEQ ID NO: 741668 - RNA, 22 nt, Homo sapiens
ccggccgccgccaggacugugu

SEQ ID NO: 741669 - RNA, 16 nt, Homo sapiens
ccggcgccccugccac

SEQ ID NO: 741670 - RNA, 17 nt, Homo sapiens
ccggcgggugcucugag

SEQ ID NO: 741671 - RNA, 15 nt, Homo sapiens
ccggcuccugugcug

SEQ ID NO: 741672 - RNA, 22 nt, Homo sapiens
ccgggaagcggagguugcaggg

SEQ ID NO: 741673 - RNA, 15 nt, Homo sapiens
ccgggacugggcuag

SEQ ID NO: 741674 - RNA, 21 nt, Homo sapiens
ccgggacuucaaagccgugau

SEQ ID NO: 741675 - RNA, 23 nt, Homo sapiens
ccgggaggcagagguugcagugu

SEQ ID NO: 741676 - RNA, 15 nt, Homo sapiens
ccgggcccugcugag

SEQ ID NO: 741677 - RNA, 20 nt, Homo sapiens
ccgggccggacgcaggugcu

SEQ ID NO: 741678 - RNA, 14 nt, Homo sapiens
ccgggcuggagaaa

SEQ ID NO: 741679 - RNA, 15 nt, Homo sapiens
ccgggcuggagaaag

SEQ ID NO: 741680 - RNA, 16 nt, Homo sapiens
ccggggccagcacuuc

SEQ ID NO: 741681 - RNA, 17 nt, Homo sapiens
ccgggucccugagcucc

SEQ ID NO: 741682 - RNA, 17 nt, Homo sapiens
ccggucccccaugccac

SEQ ID NO: 741683 - RNA, 17 nt, Homo sapiens
ccguacaucugcaauau

SEQ ID NO: 741684 - RNA, 16 nt, Homo sapiens
ccguaucacaguguuu

SEQ ID NO: 741685 - RNA, 16 nt, Homo sapiens
ccguauugguauacuu

SEQ ID NO: 741686 - RNA, 14 nt, Homo sapiens
ccgucccucaguga

SEQ ID NO: 741687 - RNA, 20 nt, Homo sapiens
ccguccucgagcaacugcug

SEQ ID NO: 741688 - RNA, 12 nt, Homo sapiens
ccgucucaaaaa

SEQ ID NO: 741689 - RNA, 21 nt, Homo sapiens
ccgucuucucccuauucccuc

SEQ ID NO: 741690 - RNA, 21 nt, Homo sapiens
ccgucuuggcuuauccacuuu

SEQ ID NO: 741691 - RNA, 13 nt, Homo sapiens
ccgugacccugag

SEQ ID NO: 741692 - RNA, 13 nt, Homo sapiens
ccgugccaaaaau

SEQ ID NO: 741693 - RNA, 11 nt, Homo sapiens
ccgugccuuca

SEQ ID NO: 741694 - RNA, 15 nt, Homo sapiens
ccguggagacugaga

SEQ ID NO: 741695 - RNA, 16 nt, Homo sapiens
ccguggccuaccuggg

SEQ ID NO: 741696 - RNA, 11 nt, Homo sapiens
ccgugguccaa

SEQ ID NO: 741697 - RNA, 16 nt, Homo sapiens
ccguggucccugagga

SEQ ID NO: 741698 - RNA, 14 nt, Homo sapiens
ccgugucaagcugc

SEQ ID NO: 741699 - RNA, 15 nt, Homo sapiens
ccguguggacugugc

SEQ ID NO: 741700 - RNA, 21 nt, Homo sapiens
ccguguggcccaagaccccca

SEQ ID NO: 741701 - RNA, 19 nt, Homo sapiens
ccguugcgggguggaguga

SEQ ID NO: 741702 - RNA, 18 nt, Homo sapiens
ccguuuagaaaaaacaau

SEQ ID NO: 741703 - RNA, 21 nt, Homo sapiens
ccguuucuuaaaaaacauaua

SEQ ID NO: 741704 - RNA, 18 nt, Homo sapiens
ccuaaaaggaaaucucac

SEQ ID NO: 741705 - RNA, 19 nt, Homo sapiens
ccuaaagcuuuuauuuaac

SEQ ID NO: 741706 - RNA, 19 nt, Homo sapiens
ccuaaauaauguuaucugu

SEQ ID NO: 741707 - RNA, 14 nt, Homo sapiens
ccuaaaucacuuug

SEQ ID NO: 741708 - RNA, 16 nt, Homo sapiens
ccuaaaucacuuugag

SEQ ID NO: 741709 - RNA, 16 nt, Homo sapiens
ccuaaauguaaucacg

SEQ ID NO: 741710 - RNA, 15 nt, Homo sapiens
ccuaaccccuuccag

SEQ ID NO: 741711 - RNA, 19 nt, Homo sapiens
ccuaacguuugucauucca

SEQ ID NO: 741712 - RNA, 21 nt, Homo sapiens
ccuaacugaaagaugaucauu

SEQ ID NO: 741713 - RNA, 20 nt, Homo sapiens
ccuaacugaauacagucuca

SEQ ID NO: 741714 - RNA, 13 nt, Homo sapiens
ccuaacugaauuu

SEQ ID NO: 741715 - RNA, 22 nt, Homo sapiens
ccuaagcaacagaaauaaucug

SEQ ID NO: 741716 - RNA, 22 nt, Homo sapiens
ccuaagcggcuguuuacugcuu

SEQ ID NO: 741717 - RNA, 17 nt, Homo sapiens
ccuaagcuggagugcag

SEQ ID NO: 741718 - RNA, 19 nt, Homo sapiens
ccuaagcuggagugcagug

SEQ ID NO: 741719 - RNA, 18 nt, Homo sapiens
ccuaaggaucucucagga

SEQ ID NO: 741720 - RNA, 17 nt, Homo sapiens
ccuaaggcacccacaaa

SEQ ID NO: 741721 - RNA, 19 nt, Homo sapiens
ccuaaggccuuagggguca

SEQ ID NO: 741722 - RNA, 20 nt, Homo sapiens
ccuaagguccuaaggcaucu

SEQ ID NO: 741723 - RNA, 22 nt, Homo sapiens
ccuaaucuauggucgggagaca

SEQ ID NO: 741724 - RNA, 12 nt, Homo sapiens
ccuaaugaaguu

SEQ ID NO: 741725 - RNA, 19 nt, Homo sapiens
ccuaaugcuuuauccauca

SEQ ID NO: 741726 - RNA, 16 nt, Homo sapiens
ccuaauguguuuagau

SEQ ID NO: 741727 - RNA, 14 nt, Homo sapiens
ccuaauucuuguag

SEQ ID NO: 741728 - RNA, 11 nt, Homo sapiens
ccuacaacuua

SEQ ID NO: 741729 - RNA, 19 nt, Homo sapiens
ccuacagaacuucagaaag

SEQ ID NO: 741730 - RNA, 20 nt, Homo sapiens
ccuacagaccuggcucucag

SEQ ID NO: 741731 - RNA, 22 nt, Homo sapiens
ccuacagcugucuucacaugua

SEQ ID NO: 741732 - RNA, 15 nt, Homo sapiens
ccuaccacagugucu

SEQ ID NO: 741733 - RNA, 23 nt, Homo sapiens
ccuaccaguuggccaugaugucu

SEQ ID NO: 741734 - RNA, 15 nt, Homo sapiens
ccuacccaauuugau

SEQ ID NO: 741735 - RNA, 15 nt, Homo sapiens
ccuacccacaugcac

SEQ ID NO: 741736 - RNA, 14 nt, Homo sapiens
ccuacccacuucca

SEQ ID NO: 741737 - RNA, 21 nt, Homo sapiens
ccuacccccuaagagccauuu

SEQ ID NO: 741738 - RNA, 21 nt, Homo sapiens
ccuaccgcuggcccugccguu

SEQ ID NO: 741739 - RNA, 21 nt, Homo sapiens
ccuaccucacagagugcauug

SEQ ID NO: 741740 - RNA, 21 nt, Homo sapiens
ccuaccuuagaaaacaaguau

SEQ ID NO: 741741 - RNA, 11 nt, Homo sapiens
ccuaccuuuau

SEQ ID NO: 741742 - RNA, 14 nt, Homo sapiens
ccuacguuaaccca

SEQ ID NO: 741743 - RNA, 17 nt, Homo sapiens
ccuacugucccucucag

SEQ ID NO: 741744 - RNA, 18 nt, Homo sapiens
ccuacugucuaagcaguu

SEQ ID NO: 741745 - RNA, 16 nt, Homo sapiens
ccuacuugauaauauu

SEQ ID NO: 741746 - RNA, 16 nt, Homo sapiens
ccuacuuugacuuuuu

SEQ ID NO: 741747 - RNA, 20 nt, Homo sapiens
ccuacuuuucuuuccucaga

SEQ ID NO: 741748 - RNA, 18 nt, Homo sapiens
ccuagacagcuuuucuca

SEQ ID NO: 741749 - RNA, 12 nt, Homo sapiens
ccuagacuguua

SEQ ID NO: 741750 - RNA, 15 nt, Homo sapiens
ccuagagacagugau

SEQ ID NO: 741751 - RNA, 15 nt, Homo sapiens
ccuagagcacacugu

SEQ ID NO: 741752 - RNA, 23 nt, Homo sapiens
ccuagagguggaguucuuagcua

SEQ ID NO: 741753 - RNA, 22 nt, Homo sapiens
ccuagagucggccaccacagau

SEQ ID NO: 741754 - RNA, 20 nt, Homo sapiens
ccuagaucugcacucaccuc

SEQ ID NO: 741755 - RNA, 23 nt, Homo sapiens
ccuagcaaggcaugauguuaacc

SEQ ID NO: 741756 - RNA, 20 nt, Homo sapiens
ccuagccccgagacaccauc

SEQ ID NO: 741757 - RNA, 15 nt, Homo sapiens
ccuagccgaccucag

SEQ ID NO: 741758 - RNA, 15 nt, Homo sapiens
ccuagccuugcacuu

SEQ ID NO: 741759 - RNA, 17 nt, Homo sapiens
ccuagcuccacacccuc

SEQ ID NO: 741760 - RNA, 21 nt, Homo sapiens
ccuagcuggcucugugagggu

SEQ ID NO: 741761 - RNA, 13 nt, Homo sapiens
ccuagcuguccca

SEQ ID NO: 741762 - RNA, 21 nt, Homo sapiens
ccuaggacuuaaaauuagucu

SEQ ID NO: 741763 - RNA, 17 nt, Homo sapiens
ccuaggaggcuggccaa

SEQ ID NO: 741764 - RNA, 12 nt, Homo sapiens
ccuagggacaca

SEQ ID NO: 741765 - RNA, 17 nt, Homo sapiens
ccuaggggacacuuccc

SEQ ID NO: 741766 - RNA, 20 nt, Homo sapiens
ccuaguagcugggaugacag

SEQ ID NO: 741767 - RNA, 13 nt, Homo sapiens
ccuagugcuauuc

SEQ ID NO: 741768 - RNA, 18 nt, Homo sapiens
ccuaguuucccugaagga

SEQ ID NO: 741769 - RNA, 21 nt, Homo sapiens
ccuaguuugaccucacaguga

SEQ ID NO: 741770 - RNA, 16 nt, Homo sapiens
ccuauaacacugugaa

SEQ ID NO: 741771 - RNA, 20 nt, Homo sapiens
ccuauagucccagcuacuca

SEQ ID NO: 741772 - RNA, 18 nt, Homo sapiens
ccuauauugcauuaauuu

SEQ ID NO: 741773 - RNA, 16 nt, Homo sapiens
ccuauauuguuuucag

SEQ ID NO: 741774 - RNA, 19 nt, Homo sapiens
ccuauauuguuuucagugu

SEQ ID NO: 741775 - RNA, 17 nt, Homo sapiens
ccuauccacaauaguca

SEQ ID NO: 741776 - RNA, 13 nt, Homo sapiens
ccuaucuuccuuc

SEQ ID NO: 741777 - RNA, 23 nt, Homo sapiens
ccuaugccaauaaaaaugucuca

SEQ ID NO: 741778 - RNA, 17 nt, Homo sapiens
ccuauuaaaacacagcu

SEQ ID NO: 741779 - RNA, 18 nt, Homo sapiens
ccuauuccaggaauuccu

SEQ ID NO: 741780 - RNA, 16 nt, Homo sapiens
ccuauucuauugcagu

SEQ ID NO: 741781 - RNA, 22 nt, Homo sapiens
ccuauuggaagcauacaaagca

SEQ ID NO: 741782 - RNA, 17 nt, Homo sapiens
ccuauuguucacuuuau

SEQ ID NO: 741783 - RNA, 19 nt, Homo sapiens
ccuauuuagaaauggauuu

SEQ ID NO: 741784 - RNA, 17 nt, Homo sapiens
ccuauuuuucaauggga

SEQ ID NO: 741785 - RNA, 18 nt, Homo sapiens
cucaugacuuuugguuaa

SEQ ID NO: 741786 - RNA, 13 nt, Homo sapiens
cucaugauccaac

SEQ ID NO: 741787 - RNA, 20 nt, Homo sapiens
cucaugccccuaaucccagc

SEQ ID NO: 741788 - RNA, 12 nt, Homo sapiens
cucaugccugua

SEQ ID NO: 741789 - RNA, 20 nt, Homo sapiens
cucaugccuguaaucccaac

SEQ ID NO: 741790 - RNA, 20 nt, Homo sapiens
cucaugccuguaaucccagc

SEQ ID NO: 741791 - RNA, 17 nt, Homo sapiens
cucaugccuguaaucuc

SEQ ID NO: 741792 - RNA, 21 nt, Homo sapiens
cucaugcugcagaggguacuu

SEQ ID NO: 741793 - RNA, 20 nt, Homo sapiens
cucauggcagcuaagccaca

SEQ ID NO: 741794 - RNA, 21 nt, Homo sapiens
cucauggcagcuaagccacau

SEQ ID NO: 741795 - RNA, 18 nt, Homo sapiens
cucaugugaaaggggaau

SEQ ID NO: 741796 - RNA, 13 nt, Homo sapiens
cucaugugcagua

SEQ ID NO: 741797 - RNA, 22 nt, Homo sapiens
cucauguuucugcuaugaccau

SEQ ID NO: 741798 - RNA, 17 nt, Homo sapiens
cucauuaauagcugccu

SEQ ID NO: 741799 - RNA, 12 nt, Homo sapiens
cucauuaauucu

SEQ ID NO: 741800 - RNA, 19 nt, Homo sapiens
cucauucuuuucagcuugu

SEQ ID NO: 741801 - RNA, 19 nt, Homo sapiens
cucauuuaaaacaggcaaa

SEQ ID NO: 741802 - RNA, 21 nt, Homo sapiens
cucauuuaaaagcauaaggcc

SEQ ID NO: 741803 - RNA, 17 nt, Homo sapiens
cucauuucacagccuuu

SEQ ID NO: 741804 - RNA, 20 nt, Homo sapiens
cucauuugagauaaagucaa

SEQ ID NO: 741805 - RNA, 14 nt, Homo sapiens
cucauuuguucuca

SEQ ID NO: 741806 - RNA, 16 nt, Homo sapiens
cucauuuuacacaaag

SEQ ID NO: 741807 - RNA, 19 nt, Homo sapiens
cuccaaaauauuaacauuc

SEQ ID NO: 741808 - RNA, 16 nt, Homo sapiens
cuccaaaccugaaguu

SEQ ID NO: 741809 - RNA, 23 nt, Homo sapiens
cuccaaccuggggggcaguggug

SEQ ID NO: 741810 - RNA, 13 nt, Homo sapiens
cuccaacuggauu

SEQ ID NO: 741811 - RNA, 15 nt, Homo sapiens
cuccaagaccacccu

SEQ ID NO: 741812 - RNA, 19 nt, Homo sapiens
cuccaagccauucacuucc

SEQ ID NO: 741813 - RNA, 20 nt, Homo sapiens
cuccaauggggccagcacug

SEQ ID NO: 741814 - RNA, 21 nt, Homo sapiens
cuccaauggggccagcacugg

SEQ ID NO: 741815 - RNA, 22 nt, Homo sapiens
cuccacagagugagccagugag

SEQ ID NO: 741816 - RNA, 16 nt, Homo sapiens
cuccacaggcacaggu

SEQ ID NO: 741817 - RNA, 15 nt, Homo sapiens
cuccacagugcugcu

SEQ ID NO: 741818 - RNA, 24 nt, Homo sapiens
cuccacaucugcaucacucaugga

SEQ ID NO: 741819 - RNA, 13 nt, Homo sapiens
cuccacaucugcc

SEQ ID NO: 741820 - RNA, 17 nt, Homo sapiens
cuccacaucugccuuaa

SEQ ID NO: 741821 - RNA, 15 nt, Homo sapiens
cuccacaugcuggug

SEQ ID NO: 741822 - RNA, 18 nt, Homo sapiens
cuccaccaacccaucaga

SEQ ID NO: 741823 - RNA, 20 nt, Homo sapiens
cuccaccccacaacccaaaa

SEQ ID NO: 741824 - RNA, 14 nt, Homo sapiens
cuccaccccacaga

SEQ ID NO: 741825 - RNA, 12 nt, Homo sapiens
cuccacccuaua

SEQ ID NO: 741826 - RNA, 19 nt, Homo sapiens
cuccacccuauauguagua

SEQ ID NO: 741827 - RNA, 22 nt, Homo sapiens
cuccacccugcauuuuccucuu

SEQ ID NO: 741828 - RNA, 22 nt, Homo sapiens
cuccaccgaccaacugcccuaa

SEQ ID NO: 741829 - RNA, 20 nt, Homo sapiens
cuccaccgucuuucuuuuau

SEQ ID NO: 741830 - RNA, 23 nt, Homo sapiens
cuccaccuacaccccugugcucc

SEQ ID NO: 741831 - RNA, 16 nt, Homo sapiens
cuccaccuagacugua

SEQ ID NO: 741832 - RNA, 18 nt, Homo sapiens
cuccaccuagacuguaaa

SEQ ID NO: 741833 - RNA, 12 nt, Homo sapiens
cuccacugccuc

SEQ ID NO: 741834 - RNA, 22 nt, Homo sapiens
cuccagacuugggaaacuauuc

SEQ ID NO: 741835 - RNA, 15 nt, Homo sapiens
cuccagagacaggga

SEQ ID NO: 741836 - RNA, 15 nt, Homo sapiens
cuccagagaugguca

SEQ ID NO: 741837 - RNA, 11 nt, Homo sapiens
cuccagaguug

SEQ ID NO: 741838 - RNA, 15 nt, Homo sapiens
cuccagcaacugccc

SEQ ID NO: 741839 - RNA, 14 nt, Homo sapiens
cuccagcacccaga

SEQ ID NO: 741840 - RNA, 14 nt, Homo sapiens
cuccagccaucuca

SEQ ID NO: 741841 - RNA, 19 nt, Homo sapiens
cuccagcccagacccagug

SEQ ID NO: 741842 - RNA, 21 nt, Homo sapiens
cuccagccuggcuacagggcg

SEQ ID NO: 741843 - RNA, 15 nt, Homo sapiens
cuccagccuggguca

SEQ ID NO: 741844 - RNA, 16 nt, Homo sapiens
cuccagcgauggugcu

SEQ ID NO: 741845 - RNA, 19 nt, Homo sapiens
cuccaggagccuacccccu

SEQ ID NO: 741846 - RNA, 16 nt, Homo sapiens
cuccaggaucuauuga

SEQ ID NO: 741847 - RNA, 16 nt, Homo sapiens
cuccaggccugaccag

SEQ ID NO: 741848 - RNA, 18 nt, Homo sapiens
cuccaggcuuucaauguu

SEQ ID NO: 741849 - RNA, 21 nt, Homo sapiens
cuccagggcuuugcuccagaa

SEQ ID NO: 741850 - RNA, 15 nt, Homo sapiens
cuccaguaucuccaa

SEQ ID NO: 741851 - RNA, 21 nt, Homo sapiens
cuccaguggcagacaaacaga

SEQ ID NO: 741852 - RNA, 21 nt, Homo sapiens
cuccaguuagaaugcaccaug

SEQ ID NO: 741853 - RNA, 22 nt, Homo sapiens
cuccaguuuacccuucagguug

SEQ ID NO: 741854 - RNA, 15 nt, Homo sapiens
cuccaguuuccccau

SEQ ID NO: 741855 - RNA, 18 nt, Homo sapiens
cuccauacauaacuugau

SEQ ID NO: 741856 - RNA, 15 nt, Homo sapiens
cuccauacguucaga

SEQ ID NO: 741857 - RNA, 19 nt, Homo sapiens
cuccauacucaagcugucu

SEQ ID NO: 741858 - RNA, 22 nt, Homo sapiens
cuccaucgccaucuucuucccu

SEQ ID NO: 741859 - RNA, 20 nt, Homo sapiens
cuccaugaauuaguucuccu

SEQ ID NO: 741860 - RNA, 14 nt, Homo sapiens
cuccaugcugccag

SEQ ID NO: 741861 - RNA, 23 nt, Homo sapiens
cuccauggccaccccgugccacc

SEQ ID NO: 741862 - RNA, 13 nt, Homo sapiens
cuccauggcucug

SEQ ID NO: 741863 - RNA, 16 nt, Homo sapiens
cuccauguuugaugua

SEQ ID NO: 741864 - RNA, 19 nt, Homo sapiens
cuccauucugaccauuuca

SEQ ID NO: 741865 - RNA, 20 nt, Homo sapiens
cuccauuuaccaguaacuua

SEQ ID NO: 741866 - RNA, 20 nt, Homo sapiens
cucccaaagggcacaccccu

SEQ ID NO: 741867 - RNA, 12 nt, Homo sapiens
cucccaaagugc

SEQ ID NO: 741868 - RNA, 18 nt, Homo sapiens
cucccaaagugcugagau

SEQ ID NO: 741869 - RNA, 20 nt, Homo sapiens
cucccaaagugcugagauua

SEQ ID NO: 741870 - RNA, 21 nt, Homo sapiens
cucccaaagugcugagauuac

SEQ ID NO: 741871 - RNA, 20 nt, Homo sapiens
cucccaaagugcugggauua

SEQ ID NO: 741872 - RNA, 19 nt, Homo sapiens
cucccaaauugcugggauu

SEQ ID NO: 741873 - RNA, 14 nt, Homo sapiens
cucccaaccucaau

SEQ ID NO: 741874 - RNA, 18 nt, Homo sapiens
cucccaacucuugcacag

SEQ ID NO: 741875 - RNA, 23 nt, Homo sapiens
cucccaagggucucacugcucac

SEQ ID NO: 741876 - RNA, 17 nt, Homo sapiens
cucccacaaugcugaau

SEQ ID NO: 741877 - RNA, 19 nt, Homo sapiens
cucccacagugcugggauu

SEQ ID NO: 741878 - RNA, 18 nt, Homo sapiens
cucccaccccacccccuu

SEQ ID NO: 741879 - RNA, 17 nt, Homo sapiens
cucccaccccacuccag

SEQ ID NO: 741880 - RNA, 12 nt, Homo sapiens
cucccaccucag

SEQ ID NO: 741881 - RNA, 22 nt, Homo sapiens
cucccagaggagccaccaguuc

SEQ ID NO: 741882 - RNA, 22 nt, Homo sapiens
cucccaguccaaauguccucca

SEQ ID NO: 741883 - RNA, 11 nt, Homo sapiens
cucccagugac

SEQ ID NO: 741884 - RNA, 21 nt, Homo sapiens
cucccauaauugcuuugccaa

SEQ ID NO: 741885 - RNA, 22 nt, Homo sapiens
cucccauaauugcuuugccaaa

SEQ ID NO: 741886 - RNA, 23 nt, Homo sapiens
cucccauaauugcuuugccaaaa

SEQ ID NO: 741887 - RNA, 14 nt, Homo sapiens
cucccaucuucagg

SEQ ID NO: 741888 - RNA, 17 nt, Homo sapiens
cuccccaacaccccacu

SEQ ID NO: 741889 - RNA, 11 nt, Homo sapiens
cuccccaacuc

SEQ ID NO: 741890 - RNA, 14 nt, Homo sapiens
cuccccacagugcc

SEQ ID NO: 741891 - RNA, 23 nt, Homo sapiens
cuccccaccccacacacacuggc

SEQ ID NO: 741892 - RNA, 13 nt, Homo sapiens
cuccccaccuuca

SEQ ID NO: 741893 - RNA, 13 nt, Homo sapiens
cuccccacucuag

SEQ ID NO: 741894 - RNA, 15 nt, Homo sapiens
cuccccacucuaggg

SEQ ID NO: 741895 - RNA, 21 nt, Homo sapiens
cuccccagaugugacuacuga

SEQ ID NO: 741896 - RNA, 21 nt, Homo sapiens
cuccccaguucauugcacuuu

SEQ ID NO: 741897 - RNA, 18 nt, Homo sapiens
cucccccuuucacacugg

SEQ ID NO: 741898 - RNA, 20 nt, Homo sapiens
cuccccggcaggccugagaa

SEQ ID NO: 741899 - RNA, 14 nt, Homo sapiens
cugaaucaugagcc

SEQ ID NO: 741900 - RNA, 12 nt, Homo sapiens
cugaauccucau

SEQ ID NO: 741901 - RNA, 17 nt, Homo sapiens
cugaaucgagaugucca

SEQ ID NO: 741902 - RNA, 23 nt, Homo sapiens
cugaaucuuccuuuguugcacaa

SEQ ID NO: 741903 - RNA, 19 nt, Homo sapiens
cugaaugcuccauuaaucc

SEQ ID NO: 741904 - RNA, 20 nt, Homo sapiens
cugaauguauugaacuugga

SEQ ID NO: 741905 - RNA, 21 nt, Homo sapiens
cugaauguccugacaccugcu

SEQ ID NO: 741906 - RNA, 21 nt, Homo sapiens
cugaaugucuuacugugauca

SEQ ID NO: 741907 - RNA, 21 nt, Homo sapiens
cugaauguuuaaagaucauga

SEQ ID NO: 741908 - RNA, 19 nt, Homo sapiens
cugaauucuucuagcuccu

SEQ ID NO: 741909 - RNA, 16 nt, Homo sapiens
cugacaagauggucca

SEQ ID NO: 741910 - RNA, 21 nt, Homo sapiens
cugacaaguuaaaaaggucua

SEQ ID NO: 741911 - RNA, 17 nt, Homo sapiens
cugacaauaaagauauu

SEQ ID NO: 741912 - RNA, 21 nt, Homo sapiens
cugacaauaaagauauuucca

SEQ ID NO: 741913 - RNA, 18 nt, Homo sapiens
cugacacaagaauggucu

SEQ ID NO: 741914 - RNA, 13 nt, Homo sapiens
cugacacaggaaa

SEQ ID NO: 741915 - RNA, 21 nt, Homo sapiens
cugacacauagaaaacaauca

SEQ ID NO: 741916 - RNA, 20 nt, Homo sapiens
cugacaccgucccucaguga

SEQ ID NO: 741917 - RNA, 20 nt, Homo sapiens
cugacacuguguaagaagcu

SEQ ID NO: 741918 - RNA, 24 nt, Homo sapiens
cugacacuguguaagaagcuguga

SEQ ID NO: 741919 - RNA, 17 nt, Homo sapiens
cugacacuuaccugcuu

SEQ ID NO: 741920 - RNA, 23 nt, Homo sapiens
cugacagaaggaacacugcuuga

SEQ ID NO: 741921 - RNA, 18 nt, Homo sapiens
cugacagaaggacucagg

SEQ ID NO: 741922 - RNA, 21 nt, Homo sapiens
cugacagaaggugccacuuua

SEQ ID NO: 741923 - RNA, 21 nt, Homo sapiens
cugacagcaucacgcugcauc

SEQ ID NO: 741924 - RNA, 23 nt, Homo sapiens
cugacaguguggggaaguguccc

SEQ ID NO: 741925 - RNA, 19 nt, Homo sapiens
cugacaugcucacacauua

SEQ ID NO: 741926 - RNA, 15 nt, Homo sapiens
cugaccaaauggcca

SEQ ID NO: 741927 - RNA, 15 nt, Homo sapiens
cugaccaagagagaa

SEQ ID NO: 741928 - RNA, 19 nt, Homo sapiens
cugaccaaugugugaagua

SEQ ID NO: 741929 - RNA, 20 nt, Homo sapiens
cugaccaauugugcugccau

SEQ ID NO: 741930 - RNA, 16 nt, Homo sapiens
cugaccaucugugacu

SEQ ID NO: 741931 - RNA, 17 nt, Homo sapiens
cugaccuaccucaaagg

SEQ ID NO: 741932 - RNA, 14 nt, Homo sapiens
cugaccucaaguga

SEQ ID NO: 741933 - RNA, 17 nt, Homo sapiens
cugaccucacugugacc

SEQ ID NO: 741934 - RNA, 16 nt, Homo sapiens
cugaccucccagugac

SEQ ID NO: 741935 - RNA, 15 nt, Homo sapiens
cugaccugaccccau

SEQ ID NO: 741936 - RNA, 14 nt, Homo sapiens
cugaccuguguucc

SEQ ID NO: 741937 - RNA, 15 nt, Homo sapiens
cugacgacaguacug

SEQ ID NO: 741938 - RNA, 20 nt, Homo sapiens
cugacuagaagggccagucc

SEQ ID NO: 741939 - RNA, 18 nt, Homo sapiens
cugacuauucuugaugua

SEQ ID NO: 741940 - RNA, 22 nt, Homo sapiens
cugacuauucuugauguaaaau

SEQ ID NO: 741941 - RNA, 21 nt, Homo sapiens
cugacuauugaaguugcagau

SEQ ID NO: 741942 - RNA, 20 nt, Homo sapiens
cugacucucgugcauuucaa

SEQ ID NO: 741943 - RNA, 15 nt, Homo sapiens
cugacucugacucau

SEQ ID NO: 741944 - RNA, 17 nt, Homo sapiens
cugacugagcaauaugc

SEQ ID NO: 741945 - RNA, 22 nt, Homo sapiens
cugacugauagcuuacacugag

SEQ ID NO: 741946 - RNA, 15 nt, Homo sapiens
cugacuggugcugca

SEQ ID NO: 741947 - RNA, 12 nt, Homo sapiens
cugacuguaaau

SEQ ID NO: 741948 - RNA, 16 nt, Homo sapiens
cugacuguacuccucc

SEQ ID NO: 741949 - RNA, 20 nt, Homo sapiens
cugacuuaaguggcauuaaa

SEQ ID NO: 741950 - RNA, 21 nt, Homo sapiens
cugacuuggaucccaaagcaa

SEQ ID NO: 741951 - RNA, 19 nt, Homo sapiens
cugacuuguuugucuucca

SEQ ID NO: 741952 - RNA, 20 nt, Homo sapiens
cugacuuguuugucuuccau

SEQ ID NO: 741953 - RNA, 15 nt, Homo sapiens
cugacuuucucucca

SEQ ID NO: 741954 - RNA, 16 nt, Homo sapiens
cugacuuucucuccag

SEQ ID NO: 741955 - RNA, 17 nt, Homo sapiens
cugacuuucugauuacu

SEQ ID NO: 741956 - RNA, 18 nt, Homo sapiens
cugacuuuugcagaugga

SEQ ID NO: 741957 - RNA, 18 nt, Homo sapiens
cugagaaagacuauucaa

SEQ ID NO: 741958 - RNA, 17 nt, Homo sapiens
cugagaaggaacaggga

SEQ ID NO: 741959 - RNA, 18 nt, Homo sapiens
cugagaaggcaguaguuu

SEQ ID NO: 741960 - RNA, 17 nt, Homo sapiens
cugagaaggcccugugc

SEQ ID NO: 741961 - RNA, 15 nt, Homo sapiens
cugagaauguggaau

SEQ ID NO: 741962 - RNA, 14 nt, Homo sapiens
cugagaauuguuga

SEQ ID NO: 741963 - RNA, 13 nt, Homo sapiens
cugagaauuucca

SEQ ID NO: 741964 - RNA, 9 nt, Homo sapiens
cugagacag

SEQ ID NO: 741965 - RNA, 13 nt, Homo sapiens
cugagaccaaaga

SEQ ID NO: 741966 - RNA, 17 nt, Homo sapiens
cugagaccaaaguagau

SEQ ID NO: 741967 - RNA, 23 nt, Homo sapiens
cugagaccaguugggagcacugg

SEQ ID NO: 741968 - RNA, 17 nt, Homo sapiens
cugagacuaaguuguag

SEQ ID NO: 741969 - RNA, 20 nt, Homo sapiens
cugagacuuggaaccucauu

SEQ ID NO: 741970 - RNA, 14 nt, Homo sapiens
cugagagaccugcc

SEQ ID NO: 741971 - RNA, 17 nt, Homo sapiens
cugagaguggugcccug

SEQ ID NO: 741972 - RNA, 20 nt, Homo sapiens
cugagaguuggcucaggcag

SEQ ID NO: 741973 - RNA, 15 nt, Homo sapiens
cugagauggggacag

SEQ ID NO: 741974 - RNA, 19 nt, Homo sapiens
cugagcaaugucugugcua

SEQ ID NO: 741975 - RNA, 17 nt, Homo sapiens
cugagcacccgcugaca

SEQ ID NO: 741976 - RNA, 15 nt, Homo sapiens
cugagcaccguguca

SEQ ID NO: 741977 - RNA, 16 nt, Homo sapiens
cugagcagaauacugg

SEQ ID NO: 741978 - RNA, 21 nt, Homo sapiens
cugagcagcuuagacagcagg

SEQ ID NO: 741979 - RNA, 13 nt, Homo sapiens
cugagcaggauuu

SEQ ID NO: 741980 - RNA, 16 nt, Homo sapiens
cugagcaggggaacaa

SEQ ID NO: 741981 - RNA, 16 nt, Homo sapiens
cugagcagugccagcu

SEQ ID NO: 741982 - RNA, 15 nt, Homo sapiens
cugagcauaaugcuc

SEQ ID NO: 741983 - RNA, 13 nt, Homo sapiens
cugagcaucacua

SEQ ID NO: 741984 - RNA, 14 nt, Homo sapiens
cugagcauggggcg

SEQ ID NO: 741985 - RNA, 21 nt, Homo sapiens
cugagccacucgcagucgcag

SEQ ID NO: 741986 - RNA, 18 nt, Homo sapiens
cugagcccccacauucuc

SEQ ID NO: 741987 - RNA, 18 nt, Homo sapiens
cugagccuacagaugaac

SEQ ID NO: 741988 - RNA, 13 nt, Homo sapiens
cugagcucaaggu

SEQ ID NO: 741989 - RNA, 17 nt, Homo sapiens
cugagcucgguggaccc

SEQ ID NO: 741990 - RNA, 20 nt, Homo sapiens
cugagcugccuguaacuuga

SEQ ID NO: 741991 - RNA, 23 nt, Homo sapiens
cugaggacgagacccccauccag

SEQ ID NO: 741992 - RNA, 22 nt, Homo sapiens
cugaggccuccagcuucaggca

SEQ ID NO: 741993 - RNA, 19 nt, Homo sapiens
cugaggccuggacuuuccu

SEQ ID NO: 741994 - RNA, 16 nt, Homo sapiens
cugagggcagacuggg

SEQ ID NO: 741995 - RNA, 14 nt, Homo sapiens
cugagggcagugcc

SEQ ID NO: 741996 - RNA, 15 nt, Homo sapiens
cugagggcaguucug

SEQ ID NO: 741997 - RNA, 20 nt, Homo sapiens
cugaggggaggcaccuccag

SEQ ID NO: 741998 - RNA, 13 nt, Homo sapiens
cugagggugggag

SEQ ID NO: 741999 - RNA, 17 nt, Homo sapiens
cugaggguguuucuucc

SEQ ID NO: 742000 - RNA, 16 nt, Homo sapiens
cugaggugaaagggag

SEQ ID NO: 742001 - RNA, 23 nt, Homo sapiens
cugaggugugugccacucagaga

SEQ ID NO: 742002 - RNA, 19 nt, Homo sapiens
cugagguucccgacaccag

SEQ ID NO: 742003 - RNA, 17 nt, Homo sapiens
cugagguuugcacuucc

SEQ ID NO: 742004 - RNA, 15 nt, Homo sapiens
cugagucaaauccag

SEQ ID NO: 742005 - RNA, 19 nt, Homo sapiens
cugagugaaugaacaaaug

SEQ ID NO: 742006 - RNA, 19 nt, Homo sapiens
cugagugagccacagacca

SEQ ID NO: 742007 - RNA, 15 nt, Homo sapiens
cugagugcaccacuu

SEQ ID NO: 742008 - RNA, 22 nt, Homo sapiens
cugagugcaccacuucaaguga

SEQ ID NO: 742009 - RNA, 17 nt, Homo sapiens
cugaguggggagcaguu

SEQ ID NO: 742010 - RNA, 14 nt, Homo sapiens
cugaguguccguga

SEQ ID NO: 742011 - RNA, 17 nt, Homo sapiens
cugaguguuuaauuuca

SEQ ID NO: 742012 - RNA, 22 nt, Homo sapiens
cugaguugaagaggggagcuca

SEQ ID NO: 742013 - RNA, 14 nt, Homo sapiens
cuggagugauucua

SEQ ID NO: 742014 - RNA, 13 nt, Homo sapiens
cuggagugcagug

SEQ ID NO: 742015 - RNA, 16 nt, Homo sapiens
cuggagugcaguggcg

SEQ ID NO: 742016 - RNA, 16 nt, Homo sapiens
cuggauacuaagcaca

SEQ ID NO: 742017 - RNA, 20 nt, Homo sapiens
cuggaucguuugacgggacu

SEQ ID NO: 742018 - RNA, 19 nt, Homo sapiens
cuggaugagacuuccaaac

SEQ ID NO: 742019 - RNA, 13 nt, Homo sapiens
cuggaugucucca

SEQ ID NO: 742020 - RNA, 23 nt, Homo sapiens
cuggauuauguuauacaaggcaa

SEQ ID NO: 742021 - RNA, 15 nt, Homo sapiens
cuggauucgugacaa

SEQ ID NO: 742022 - RNA, 13 nt, Homo sapiens
cuggauucuacaa

SEQ ID NO: 742023 - RNA, 17 nt, Homo sapiens
cuggauucuuaaccaag

SEQ ID NO: 742024 - RNA, 18 nt, Homo sapiens
cuggauugcagacuguuc

SEQ ID NO: 742025 - RNA, 23 nt, Homo sapiens
cuggcaaaaucuuguuaauguca

SEQ ID NO: 742026 - RNA, 15 nt, Homo sapiens
cuggcaagaaagcuu

SEQ ID NO: 742027 - RNA, 22 nt, Homo sapiens
cuggcaagaaagcuugagucuc

SEQ ID NO: 742028 - RNA, 19 nt, Homo sapiens
cuggcaagccugucuucag

SEQ ID NO: 742029 - RNA, 21 nt, Homo sapiens
cuggcaauacgacgugggaau

SEQ ID NO: 742030 - RNA, 13 nt, Homo sapiens
cuggcacacuccc

SEQ ID NO: 742031 - RNA, 14 nt, Homo sapiens
cuggcacagaggua

SEQ ID NO: 742032 - RNA, 22 nt, Homo sapiens
cuggcacaguguaauccagggg

SEQ ID NO: 742033 - RNA, 17 nt, Homo sapiens
cuggcaccgcaguuuug

SEQ ID NO: 742034 - RNA, 17 nt, Homo sapiens
cuggcacuauaauguaa

SEQ ID NO: 742035 - RNA, 22 nt, Homo sapiens
cuggcagaaagcaaaugugacc

SEQ ID NO: 742036 - RNA, 21 nt, Homo sapiens
cuggcaggagccggcugccua

SEQ ID NO: 742037 - RNA, 23 nt, Homo sapiens
cuggcaggagccggcugccuacc

SEQ ID NO: 742038 - RNA, 19 nt, Homo sapiens
cuggcauauguuucugcua

SEQ ID NO: 742039 - RNA, 16 nt, Homo sapiens
cuggcaucucacuuua

SEQ ID NO: 742040 - RNA, 17 nt, Homo sapiens
cuggcauggcaccuguc

SEQ ID NO: 742041 - RNA, 21 nt, Homo sapiens
cuggccacaguaauuggucau

SEQ ID NO: 742042 - RNA, 23 nt, Homo sapiens
cuggccaguccugguccuggcug

SEQ ID NO: 742043 - RNA, 23 nt, Homo sapiens
cuggccauucuuauguuccagau

SEQ ID NO: 742044 - RNA, 14 nt, Homo sapiens
cuggcccagccaau

SEQ ID NO: 742045 - RNA, 23 nt, Homo sapiens
cuggcccagggggccuggagcau

SEQ ID NO: 742046 - RNA, 20 nt, Homo sapiens
cuggccccgggcucuggcca

SEQ ID NO: 742047 - RNA, 19 nt, Homo sapiens
cuggcccgcaauacuguag

SEQ ID NO: 742048 - RNA, 14 nt, Homo sapiens
cuggcccugaggug

SEQ ID NO: 742049 - RNA, 16 nt, Homo sapiens
cuggcccuugcuuacc

SEQ ID NO: 742050 - RNA, 18 nt, Homo sapiens
cuggccuauguggucuaa

SEQ ID NO: 742051 - RNA, 22 nt, Homo sapiens
cuggccucccacccgaugcugc

SEQ ID NO: 742052 - RNA, 20 nt, Homo sapiens
cuggccucucuagcacaauu

SEQ ID NO: 742053 - RNA, 15 nt, Homo sapiens
cuggccucugcugaa

SEQ ID NO: 742054 - RNA, 17 nt, Homo sapiens
cuggccugaacugagga

SEQ ID NO: 742055 - RNA, 15 nt, Homo sapiens
cuggccugagaguca

SEQ ID NO: 742056 - RNA, 23 nt, Homo sapiens
cuggccuggaucuccccacucua

SEQ ID NO: 742057 - RNA, 17 nt, Homo sapiens
cuggcgccccuuccuag

SEQ ID NO: 742058 - RNA, 19 nt, Homo sapiens
cuggcugaacccugugcug

SEQ ID NO: 742059 - RNA, 14 nt, Homo sapiens
cuggcugagguucc

SEQ ID NO: 742060 - RNA, 12 nt, Homo sapiens
cuggcugaugau

SEQ ID NO: 742061 - RNA, 19 nt, Homo sapiens
cuggcugaugauccagaac

SEQ ID NO: 742062 - RNA, 22 nt, Homo sapiens
cuggcugauuuguuugugaugu

SEQ ID NO: 742063 - RNA, 13 nt, Homo sapiens
cuggcugcaauug

SEQ ID NO: 742064 - RNA, 12 nt, Homo sapiens
cuggcugccagg

SEQ ID NO: 742065 - RNA, 22 nt, Homo sapiens
cuggcuggagucucagagcaca

SEQ ID NO: 742066 - RNA, 18 nt, Homo sapiens
cuggcuggggccuguuga

SEQ ID NO: 742067 - RNA, 17 nt, Homo sapiens
cuggcugucugccugua

SEQ ID NO: 742068 - RNA, 20 nt, Homo sapiens
cuggcuuagugccacccacc

SEQ ID NO: 742069 - RNA, 14 nt, Homo sapiens
cuggcuuggaacac

SEQ ID NO: 742070 - RNA, 23 nt, Homo sapiens
cuggcuuggggucaagaaacagc

SEQ ID NO: 742071 - RNA, 14 nt, Homo sapiens
cuggcuuugccucu

SEQ ID NO: 742072 - RNA, 21 nt, Homo sapiens
cugggaaaggaaagaagaaau

SEQ ID NO: 742073 - RNA, 21 nt, Homo sapiens
cugggaacaacuucaguccaa

SEQ ID NO: 742074 - RNA, 13 nt, Homo sapiens
cugggaacagccg

SEQ ID NO: 742075 - RNA, 18 nt, Homo sapiens
cugggaacaugacccagc

SEQ ID NO: 742076 - RNA, 16 nt, Homo sapiens
cugggaauggggacac

SEQ ID NO: 742077 - RNA, 15 nt, Homo sapiens
cugggacacagauca

SEQ ID NO: 742078 - RNA, 18 nt, Homo sapiens
cugggacaccauuaccaa

SEQ ID NO: 742079 - RNA, 18 nt, Homo sapiens
cugggacacuuaacagau

SEQ ID NO: 742080 - RNA, 17 nt, Homo sapiens
cugggacagcccaggaa

SEQ ID NO: 742081 - RNA, 16 nt, Homo sapiens
cugggagacugaagac

SEQ ID NO: 742082 - RNA, 15 nt, Homo sapiens
cugggagacuuugaa

SEQ ID NO: 742083 - RNA, 22 nt, Homo sapiens
cugggagcagcucugugacucc

SEQ ID NO: 742084 - RNA, 19 nt, Homo sapiens
cugggagccauggggagca

SEQ ID NO: 742085 - RNA, 14 nt, Homo sapiens
cugggaucugagua

SEQ ID NO: 742086 - RNA, 19 nt, Homo sapiens
cugggaugacuggcuuuga

SEQ ID NO: 742087 - RNA, 16 nt, Homo sapiens
cugggauuaaggggau

SEQ ID NO: 742088 - RNA, 18 nt, Homo sapiens
cugggauuacagguguga

SEQ ID NO: 742089 - RNA, 22 nt, Homo sapiens
cugggauuucucccucucagug

SEQ ID NO: 742090 - RNA, 15 nt, Homo sapiens
cugggcaacacagcg

SEQ ID NO: 742091 - RNA, 13 nt, Homo sapiens
cugggcaccaccu

SEQ ID NO: 742092 - RNA, 20 nt, Homo sapiens
cugggcaggguucuccaagg

SEQ ID NO: 742093 - RNA, 22 nt, Homo sapiens
cugggccaaguuccucuagugc

SEQ ID NO: 742094 - RNA, 15 nt, Homo sapiens
cugggccauguccaa

SEQ ID NO: 742095 - RNA, 22 nt, Homo sapiens
cugggcccaagugauccuucca

SEQ ID NO: 742096 - RNA, 23 nt, Homo sapiens
cugggcccaguaccuagcuggcu

SEQ ID NO: 742097 - RNA, 15 nt, Homo sapiens
cugggccccaccacc

SEQ ID NO: 742098 - RNA, 22 nt, Homo sapiens
cugggcccggaagggcuuuggu

SEQ ID NO: 742099 - RNA, 12 nt, Homo sapiens
cugggccugaac

SEQ ID NO: 742100 - RNA, 17 nt, Homo sapiens
cugggcuaaggaaguau

SEQ ID NO: 742101 - RNA, 22 nt, Homo sapiens
cugggcuaaguaaauaggaauu

SEQ ID NO: 742102 - RNA, 14 nt, Homo sapiens
cugggcuauauucc

SEQ ID NO: 742103 - RNA, 17 nt, Homo sapiens
cugggcuauugcugcug

SEQ ID NO: 742104 - RNA, 17 nt, Homo sapiens
cugggcucacugugcug

SEQ ID NO: 742105 - RNA, 17 nt, Homo sapiens
cugggcugagugacaca

SEQ ID NO: 742106 - RNA, 22 nt, Homo sapiens
cugggcugauggaagauggucc

SEQ ID NO: 742107 - RNA, 14 nt, Homo sapiens
cugggcuggacugg

SEQ ID NO: 742108 - RNA, 14 nt, Homo sapiens
cuggggaagacagu

SEQ ID NO: 742109 - RNA, 20 nt, Homo sapiens
cuggggaagagaaaagccca

SEQ ID NO: 742110 - RNA, 19 nt, Homo sapiens
cuggggaagcugugaaaga

SEQ ID NO: 742111 - RNA, 19 nt, Homo sapiens
cuggggacagcuuccucac

SEQ ID NO: 742112 - RNA, 23 nt, Homo sapiens
cuggggaggcaggcauuccugaa

SEQ ID NO: 742113 - RNA, 15 nt, Homo sapiens
cuggggccacccagc

SEQ ID NO: 742114 - RNA, 20 nt, Homo sapiens
cuggggcugaucucagggaa

SEQ ID NO: 742115 - RNA, 18 nt, Homo sapiens
cugggggagguccaagca

SEQ ID NO: 742116 - RNA, 17 nt, Homo sapiens
cuggggggacccagugc

SEQ ID NO: 742117 - RNA, 16 nt, Homo sapiens
cugggguccauucucu

SEQ ID NO: 742118 - RNA, 16 nt, Homo sapiens
cuggggucuccgaaga

SEQ ID NO: 742119 - RNA, 20 nt, Homo sapiens
cuggguaagaagaaagcaaa

SEQ ID NO: 742120 - RNA, 23 nt, Homo sapiens
cuggguacugaaagccuuaggga

SEQ ID NO: 742121 - RNA, 16 nt, Homo sapiens
cugggucucacuccug

SEQ ID NO: 742122 - RNA, 16 nt, Homo sapiens
cugggugggcaucuca

SEQ ID NO: 742123 - RNA, 19 nt, Homo sapiens
cuggguuaaauauuuugcu

SEQ ID NO: 742124 - RNA, 20 nt, Homo sapiens
cuggguuaacaaaugagcca

SEQ ID NO: 742125 - RNA, 21 nt, Homo sapiens
cuggguuaggguguguguuca

SEQ ID NO: 742126 - RNA, 23 nt, Homo sapiens
cuggguuuauagaugugagccag

SEQ ID NO: 742127 - RNA, 17 nt, Homo sapiens
cuucucuccacaguguu

SEQ ID NO: 742128 - RNA, 14 nt, Homo sapiens
cuucucuccagcug

SEQ ID NO: 742129 - RNA, 13 nt, Homo sapiens
cuucucugugaau

SEQ ID NO: 742130 - RNA, 15 nt, Homo sapiens
cuucugaagauggaa

SEQ ID NO: 742131 - RNA, 20 nt, Homo sapiens
cuucugacaaaggugguaaa

SEQ ID NO: 742132 - RNA, 21 nt, Homo sapiens
cuucugagaucuguugauuga

SEQ ID NO: 742133 - RNA, 23 nt, Homo sapiens
cuucugagcacagcugcauuaaa

SEQ ID NO: 742134 - RNA, 14 nt, Homo sapiens
cuucugagcacugu

SEQ ID NO: 742135 - RNA, 15 nt, Homo sapiens
cuucugagcacuguu

SEQ ID NO: 742136 - RNA, 12 nt, Homo sapiens
cuucugcaaugu

SEQ ID NO: 742137 - RNA, 17 nt, Homo sapiens
cuucugcaccaacucac

SEQ ID NO: 742138 - RNA, 15 nt, Homo sapiens
cuucugccuucucag

SEQ ID NO: 742139 - RNA, 21 nt, Homo sapiens
cuucugcuaauaccucuuacu

SEQ ID NO: 742140 - RNA, 16 nt, Homo sapiens
cuucugggaacuuccu

SEQ ID NO: 742141 - RNA, 23 nt, Homo sapiens
cuucuggggcaggcugggccaug

SEQ ID NO: 742142 - RNA, 16 nt, Homo sapiens
cuucugguugcuucag

SEQ ID NO: 742143 - RNA, 22 nt, Homo sapiens
cuucuguggaccacugcaugag

SEQ ID NO: 742144 - RNA, 14 nt, Homo sapiens
cuucuuacuauuaa

SEQ ID NO: 742145 - RNA, 12 nt, Homo sapiens
cuucuuacugau

SEQ ID NO: 742146 - RNA, 16 nt, Homo sapiens
cuucuuacuggugcua

SEQ ID NO: 742147 - RNA, 17 nt, Homo sapiens
cuucuuacuugucugua

SEQ ID NO: 742148 - RNA, 14 nt, Homo sapiens
cuucuuauuaauca

SEQ ID NO: 742149 - RNA, 23 nt, Homo sapiens
cuucuucacuuacccauuagcca

SEQ ID NO: 742150 - RNA, 14 nt, Homo sapiens
cuucuucauauucu

SEQ ID NO: 742151 - RNA, 15 nt, Homo sapiens
cuucuucuuccaaau

SEQ ID NO: 742152 - RNA, 11 nt, Homo sapiens
cuucuugccuc

SEQ ID NO: 742153 - RNA, 20 nt, Homo sapiens
cuucuuggggcccagugcau

SEQ ID NO: 742154 - RNA, 16 nt, Homo sapiens
cuucuuuaccaaggau

SEQ ID NO: 742155 - RNA, 17 nt, Homo sapiens
cuucuuuagaugccaaa

SEQ ID NO: 742156 - RNA, 18 nt, Homo sapiens
cuucuuuagaugccaaac

SEQ ID NO: 742157 - RNA, 12 nt, Homo sapiens
cuucuuugccca

SEQ ID NO: 742158 - RNA, 13 nt, Homo sapiens
cuucuuugcccac

SEQ ID NO: 742159 - RNA, 20 nt, Homo sapiens
cuucuuuuaguuguaucucu

SEQ ID NO: 742160 - RNA, 20 nt, Homo sapiens
cuucuuuuggcuuccaugau

SEQ ID NO: 742161 - RNA, 22 nt, Homo sapiens
cuugaaacaagcaacagaugga

SEQ ID NO: 742162 - RNA, 21 nt, Homo sapiens
cuugaaacagauucaggccag

SEQ ID NO: 742163 - RNA, 22 nt, Homo sapiens
cuugaaacauagagaucuaugu

SEQ ID NO: 742164 - RNA, 16 nt, Homo sapiens
cuugaacauacuuggu

SEQ ID NO: 742165 - RNA, 22 nt, Homo sapiens
cuugaacccccucccuguccca

SEQ ID NO: 742166 - RNA, 15 nt, Homo sapiens
cuugaagacagagca

SEQ ID NO: 742167 - RNA, 20 nt, Homo sapiens
cuugaagacaucgauauaca

SEQ ID NO: 742168 - RNA, 21 nt, Homo sapiens
cuugaagacaucgauauacau

SEQ ID NO: 742169 - RNA, 12 nt, Homo sapiens
cuugacauuccu

SEQ ID NO: 742170 - RNA, 15 nt, Homo sapiens
cuugaccauucucac

SEQ ID NO: 742171 - RNA, 20 nt, Homo sapiens
cuugaccucaggugauccac

SEQ ID NO: 742172 - RNA, 18 nt, Homo sapiens
cuugaccucgugauccac

SEQ ID NO: 742173 - RNA, 14 nt, Homo sapiens
cuugacucauggca

SEQ ID NO: 742174 - RNA, 20 nt, Homo sapiens
cuugacuugaaaugcucuuu

SEQ ID NO: 742175 - RNA, 21 nt, Homo sapiens
cuugagagaaaaagugccccu

SEQ ID NO: 742176 - RNA, 13 nt, Homo sapiens
cuugagagcugcu

SEQ ID NO: 742177 - RNA, 16 nt, Homo sapiens
cuugagagcugcugag

SEQ ID NO: 742178 - RNA, 20 nt, Homo sapiens
cuugagcaagaugauguaau

SEQ ID NO: 742179 - RNA, 21 nt, Homo sapiens
cuugagcaagaugauguaaug

SEQ ID NO: 742180 - RNA, 19 nt, Homo sapiens
cuugagccacagucacugg

SEQ ID NO: 742181 - RNA, 15 nt, Homo sapiens
cuugagcuacuucaa

SEQ ID NO: 742182 - RNA, 15 nt, Homo sapiens
cuugaggauugugga

SEQ ID NO: 742183 - RNA, 20 nt, Homo sapiens
cuugaggccaagauggcugc

SEQ ID NO: 742184 - RNA, 20 nt, Homo sapiens
cuugagggugcuuguucccu

SEQ ID NO: 742185 - RNA, 22 nt, Homo sapiens
cuugagugagaagagcuugcac

SEQ ID NO: 742186 - RNA, 16 nt, Homo sapiens
cuugauaaagggccaa

SEQ ID NO: 742187 - RNA, 13 nt, Homo sapiens
cuugauauuuucc

SEQ ID NO: 742188 - RNA, 13 nt, Homo sapiens
cuugaucacaugc

SEQ ID NO: 742189 - RNA, 13 nt, Homo sapiens
cuugaucuguaua

SEQ ID NO: 742190 - RNA, 13 nt, Homo sapiens
cuugaugauacaa

SEQ ID NO: 742191 - RNA, 12 nt, Homo sapiens
cuugauuccagu

SEQ ID NO: 742192 - RNA, 21 nt, Homo sapiens
cuugauuccugguuugacuca

SEQ ID NO: 742193 - RNA, 20 nt, Homo sapiens
cuugauuuagcacuauuuac

SEQ ID NO: 742194 - RNA, 13 nt, Homo sapiens
cuugauuuuugcc

SEQ ID NO: 742195 - RNA, 21 nt, Homo sapiens
cuugauuuuuuucauuuugcc

SEQ ID NO: 742196 - RNA, 16 nt, Homo sapiens
cuugcaauguagucaa

SEQ ID NO: 742197 - RNA, 20 nt, Homo sapiens
cuugcacuccggagguagag

SEQ ID NO: 742198 - RNA, 19 nt, Homo sapiens
cuugcagagcaugaccuga

SEQ ID NO: 742199 - RNA, 21 nt, Homo sapiens
cuugcagugagccgagauugc

SEQ ID NO: 742200 - RNA, 24 nt, Homo sapiens
cuugcauaggcucuuaagcagcau

SEQ ID NO: 742201 - RNA, 20 nt, Homo sapiens
cuugcauuugugguaaucua

SEQ ID NO: 742202 - RNA, 21 nt, Homo sapiens
cuugcauuugugguaaucuac

SEQ ID NO: 742203 - RNA, 14 nt, Homo sapiens
cuugccagauuacc

SEQ ID NO: 742204 - RNA, 12 nt, Homo sapiens
cuugccaugcag

SEQ ID NO: 742205 - RNA, 14 nt, Homo sapiens
cuugccaugugcug

SEQ ID NO: 742206 - RNA, 20 nt, Homo sapiens
cuugccauuuguagcuuugc

SEQ ID NO: 742207 - RNA, 22 nt, Homo sapiens
cuugcccagggccacagagcua

SEQ ID NO: 742208 - RNA, 18 nt, Homo sapiens
cuugcccaguacauuuaa

SEQ ID NO: 742209 - RNA, 16 nt, Homo sapiens
cuugcccccauuucac

SEQ ID NO: 742210 - RNA, 15 nt, Homo sapiens
cuugcccucccuuuc

SEQ ID NO: 742211 - RNA, 20 nt, Homo sapiens
cuugccuaaauacaagggcu

SEQ ID NO: 742212 - RNA, 14 nt, Homo sapiens
cuugccuaagacuu

SEQ ID NO: 742213 - RNA, 15 nt, Homo sapiens
cuugccuaggccaaa

SEQ ID NO: 742214 - RNA, 15 nt, Homo sapiens
cuugccuaggcgauu

SEQ ID NO: 742215 - RNA, 19 nt, Homo sapiens
cuugcuagacacacuccau

SEQ ID NO: 742216 - RNA, 21 nt, Homo sapiens
cuugcuagacagccagguuag

SEQ ID NO: 742217 - RNA, 18 nt, Homo sapiens
cuugcucauaugcaugua

SEQ ID NO: 742218 - RNA, 15 nt, Homo sapiens
cuugcucuucaaugc

SEQ ID NO: 742219 - RNA, 15 nt, Homo sapiens
cuugcugacaauaaa

SEQ ID NO: 742220 - RNA, 21 nt, Homo sapiens
cuugcugacaauaaagauauu

SEQ ID NO: 742221 - RNA, 19 nt, Homo sapiens
cuugcugccacauucuaaa

SEQ ID NO: 742222 - RNA, 17 nt, Homo sapiens
cuugcugugugaccuca

SEQ ID NO: 742223 - RNA, 15 nt, Homo sapiens
cuugcuuaccucuca

SEQ ID NO: 742224 - RNA, 21 nt, Homo sapiens
cuugcuuaguaugguucucag

SEQ ID NO: 742225 - RNA, 22 nt, Homo sapiens
cuugcuuaugacaucacuugua

SEQ ID NO: 742226 - RNA, 23 nt, Homo sapiens
cuugcuuuccugggccuuugcaa

SEQ ID NO: 742227 - RNA, 19 nt, Homo sapiens
cuuggaaaggcucccuguc

SEQ ID NO: 742228 - RNA, 22 nt, Homo sapiens
cuuggaagggggagacaggaag

SEQ ID NO: 742229 - RNA, 14 nt, Homo sapiens
cuuggacuacacaa

SEQ ID NO: 742230 - RNA, 20 nt, Homo sapiens
cuuggagacaaaaucuuaaa

SEQ ID NO: 742231 - RNA, 16 nt, Homo sapiens
cuuggagccccagugc

SEQ ID NO: 742232 - RNA, 18 nt, Homo sapiens
cuuggagcccgugcagua

SEQ ID NO: 742233 - RNA, 21 nt, Homo sapiens
cuuggauuuuccugaaagugu

SEQ ID NO: 742234 - RNA, 21 nt, Homo sapiens
cuuggcaggaugaugcuguca

SEQ ID NO: 742235 - RNA, 16 nt, Homo sapiens
cuuggcauaagacaga

SEQ ID NO: 742236 - RNA, 21 nt, Homo sapiens
cuuggccucccagaaugcugg

SEQ ID NO: 742237 - RNA, 16 nt, Homo sapiens
cuuggcugaauagcac

SEQ ID NO: 742238 - RNA, 16 nt, Homo sapiens
cuuggcugauguugca

SEQ ID NO: 742239 - RNA, 14 nt, Homo sapiens
cuuggcuuuaugca

SEQ ID NO: 742240 - RNA, 14 nt, Homo sapiens
cuugggaugaucuu

SEQ ID NO: 742241 - RNA, 14 nt, Homo sapiens
cuugggaugcuuau

SEQ ID NO: 742242 - RNA, 19 nt, Homo sapiens
gagaggccacagugcaauu

SEQ ID NO: 742243 - RNA, 17 nt, Homo sapiens
gagagggacucaaggga

SEQ ID NO: 742244 - RNA, 19 nt, Homo sapiens
gagagggacucaagggaaa

SEQ ID NO: 742245 - RNA, 18 nt, Homo sapiens
gagagucccagagcucau

SEQ ID NO: 742246 - RNA, 21 nt, Homo sapiens
gagagugcagaucugugcuca

SEQ ID NO: 742247 - RNA, 12 nt, Homo sapiens
gagagugugcuc

SEQ ID NO: 742248 - RNA, 22 nt, Homo sapiens
gagagugugugauuagaagcua

SEQ ID NO: 742249 - RNA, 19 nt, Homo sapiens
gagaguuauccugauaaau

SEQ ID NO: 742250 - RNA, 14 nt, Homo sapiens
gagaguuccuucuc

SEQ ID NO: 742251 - RNA, 16 nt, Homo sapiens
gagaguuuugucuuga

SEQ ID NO: 742252 - RNA, 16 nt, Homo sapiens
gagauaaacaccacca

SEQ ID NO: 742253 - RNA, 17 nt, Homo sapiens
gagauaauaucugugag

SEQ ID NO: 742254 - RNA, 14 nt, Homo sapiens
gagauagaaccugg

SEQ ID NO: 742255 - RNA, 20 nt, Homo sapiens
gagauagaggaugggcagcu

SEQ ID NO: 742256 - RNA, 13 nt, Homo sapiens
gagauagggaaaa

SEQ ID NO: 742257 - RNA, 17 nt, Homo sapiens
gagauauucuuauuuca

SEQ ID NO: 742258 - RNA, 21 nt, Homo sapiens
gagaucaugccacuacacucc

SEQ ID NO: 742259 - RNA, 20 nt, Homo sapiens
gagaucgcgccacugcacuc

SEQ ID NO: 742260 - RNA, 21 nt, Homo sapiens
gagaucgcgccacugcacucc

SEQ ID NO: 742261 - RNA, 21 nt, Homo sapiens
gagaucgugcuacugcacucc

SEQ ID NO: 742262 - RNA, 17 nt, Homo sapiens
gagaucuuucuuuccaa

SEQ ID NO: 742263 - RNA, 11 nt, Homo sapiens
gagaugcccau

SEQ ID NO: 742264 - RNA, 20 nt, Homo sapiens
gagauggaaguugcagugag

SEQ ID NO: 742265 - RNA, 18 nt, Homo sapiens
gagauggacaacucaaug

SEQ ID NO: 742266 - RNA, 23 nt, Homo sapiens
gagauggccuggggaagcuguga

SEQ ID NO: 742267 - RNA, 21 nt, Homo sapiens
gagauggcgcuauugcacucc

SEQ ID NO: 742268 - RNA, 21 nt, Homo sapiens
gagaugggguuucaccauguu

SEQ ID NO: 742269 - RNA, 18 nt, Homo sapiens
gagauguccauagucaaa

SEQ ID NO: 742270 - RNA, 21 nt, Homo sapiens
gagauguggcaaagugcugua

SEQ ID NO: 742271 - RNA, 19 nt, Homo sapiens
gagauguuuggaaaccaca

SEQ ID NO: 742272 - RNA, 22 nt, Homo sapiens
gagauguuuuagaguuaacaau

SEQ ID NO: 742273 - RNA, 22 nt, Homo sapiens
gagauucaaagcccaacugugg

SEQ ID NO: 742274 - RNA, 13 nt, Homo sapiens
gagauucuucccc

SEQ ID NO: 742275 - RNA, 20 nt, Homo sapiens
gagauuuacacuacauugua

SEQ ID NO: 742276 - RNA, 21 nt, Homo sapiens
gagauuugucuaauugcaucu

SEQ ID NO: 742277 - RNA, 17 nt, Homo sapiens
gagauuuuaauucugug

SEQ ID NO: 742278 - RNA, 13 nt, Homo sapiens
gagcaaaagccuc

SEQ ID NO: 742279 - RNA, 21 nt, Homo sapiens
gagcaaauaaagaccugagaa

SEQ ID NO: 742280 - RNA, 19 nt, Homo sapiens
gagcaaaucaucugcauuc

SEQ ID NO: 742281 - RNA, 21 nt, Homo sapiens
gagcaaaucaucugcauuccu

SEQ ID NO: 742282 - RNA, 17 nt, Homo sapiens
gagcaaauggugcugaa

SEQ ID NO: 742283 - RNA, 20 nt, Homo sapiens
gagcaaauugacaugcuguu

SEQ ID NO: 742284 - RNA, 16 nt, Homo sapiens
gagcaagacugucuca

SEQ ID NO: 742285 - RNA, 22 nt, Homo sapiens
gagcaagaucuugucuccacua

SEQ ID NO: 742286 - RNA, 14 nt, Homo sapiens
gagcacaagccaca

SEQ ID NO: 742287 - RNA, 13 nt, Homo sapiens
gagcacacccgug

SEQ ID NO: 742288 - RNA, 16 nt, Homo sapiens
gagcacagaaggaaua

SEQ ID NO: 742289 - RNA, 17 nt, Homo sapiens
gagcacauacuguguuc

SEQ ID NO: 742290 - RNA, 20 nt, Homo sapiens
gagcacauuuaccaguauag

SEQ ID NO: 742291 - RNA, 16 nt, Homo sapiens
gagcacccuacaggga

SEQ ID NO: 742292 - RNA, 20 nt, Homo sapiens
gagcacccuugcccggcugu

SEQ ID NO: 742293 - RNA, 21 nt, Homo sapiens
gagcacggacugucaguucuc

SEQ ID NO: 742294 - RNA, 17 nt, Homo sapiens
gagcacuggagugcagg

SEQ ID NO: 742295 - RNA, 13 nt, Homo sapiens
gagcagaacaggu

SEQ ID NO: 742296 - RNA, 22 nt, Homo sapiens
gagcagagggcaggggugcugu

SEQ ID NO: 742297 - RNA, 12 nt, Homo sapiens
gagcagccugug

SEQ ID NO: 742298 - RNA, 16 nt, Homo sapiens
gagcaggaacaaugac

SEQ ID NO: 742299 - RNA, 17 nt, Homo sapiens
gagcaggcuacugucag

SEQ ID NO: 742300 - RNA, 20 nt, Homo sapiens
gagcaggcuacugucagcuc

SEQ ID NO: 742301 - RNA, 17 nt, Homo sapiens
gagcaggggcaggguga

SEQ ID NO: 742302 - RNA, 22 nt, Homo sapiens
gagcagugccaaucgggcagaa

SEQ ID NO: 742303 - RNA, 17 nt, Homo sapiens
gagcaguggcuggucca

SEQ ID NO: 742304 - RNA, 18 nt, Homo sapiens
gagcaguugcccucaggc

SEQ ID NO: 742305 - RNA, 16 nt, Homo sapiens
gagcauacacacaggu

SEQ ID NO: 742306 - RNA, 22 nt, Homo sapiens
gagcauccucucucacauggaa

SEQ ID NO: 742307 - RNA, 19 nt, Homo sapiens
gagcaucucuugaggccag

SEQ ID NO: 742308 - RNA, 24 nt, Homo sapiens
gagcaucuugcauccaaaccugua

SEQ ID NO: 742309 - RNA, 14 nt, Homo sapiens
gagcaugaccugag

SEQ ID NO: 742310 - RNA, 15 nt, Homo sapiens
gagcauggaacacuu

SEQ ID NO: 742311 - RNA, 15 nt, Homo sapiens
gagcauggacagugu

SEQ ID NO: 742312 - RNA, 18 nt, Homo sapiens
gagcaugggccuggccac

SEQ ID NO: 742313 - RNA, 20 nt, Homo sapiens
gagcauugcuauuuaucuca

SEQ ID NO: 742314 - RNA, 22 nt, Homo sapiens
gagcauuuccaacaccacagac

SEQ ID NO: 742315 - RNA, 21 nt, Homo sapiens
gagccaaaaucccaccacugc

SEQ ID NO: 742316 - RNA, 16 nt, Homo sapiens
gagccaaaggcaucca

SEQ ID NO: 742317 - RNA, 19 nt, Homo sapiens
gagccaaaggcauccaggc

SEQ ID NO: 742318 - RNA, 21 nt, Homo sapiens
gagccaagauugcaccacugc

SEQ ID NO: 742319 - RNA, 22 nt, Homo sapiens
gagccaagucauuaaaauggaa

SEQ ID NO: 742320 - RNA, 22 nt, Homo sapiens
gagccaccacauccagccuaac

SEQ ID NO: 742321 - RNA, 18 nt, Homo sapiens
gagccaccagcaaagcgc

SEQ ID NO: 742322 - RNA, 15 nt, Homo sapiens
gagccaccaugccug

SEQ ID NO: 742323 - RNA, 17 nt, Homo sapiens
gagccaccccuaaagag

SEQ ID NO: 742324 - RNA, 19 nt, Homo sapiens
gagccaccgcguccggccu

SEQ ID NO: 742325 - RNA, 21 nt, Homo sapiens
gagccagcagggcugugaugg

SEQ ID NO: 742326 - RNA, 17 nt, Homo sapiens
gagccagcggcuccaac

SEQ ID NO: 742327 - RNA, 18 nt, Homo sapiens
gagccauauaaguuugaa

SEQ ID NO: 742328 - RNA, 13 nt, Homo sapiens
gagccauccuccu

SEQ ID NO: 742329 - RNA, 12 nt, Homo sapiens
gagccaugucau

SEQ ID NO: 742330 - RNA, 20 nt, Homo sapiens
gagcccagaaaaccuccagu

SEQ ID NO: 742331 - RNA, 24 nt, Homo sapiens
gagcccagggcaucuugcuggcua

SEQ ID NO: 742332 - RNA, 12 nt, Homo sapiens
gagcccagugaa

SEQ ID NO: 742333 - RNA, 14 nt, Homo sapiens
gagccccacacgga

SEQ ID NO: 742334 - RNA, 14 nt, Homo sapiens
gagccccacgcugu

SEQ ID NO: 742335 - RNA, 21 nt, Homo sapiens
gagcccugaggaccucucagc

SEQ ID NO: 742336 - RNA, 16 nt, Homo sapiens
gagccgagauugcacc

SEQ ID NO: 742337 - RNA, 17 nt, Homo sapiens
gagccgauggaucugug

SEQ ID NO: 742338 - RNA, 21 nt, Homo sapiens
gagccggcugccuaccagggg

SEQ ID NO: 742339 - RNA, 19 nt, Homo sapiens
gagccuacuucuagcugua

SEQ ID NO: 742340 - RNA, 19 nt, Homo sapiens
gagccucaaccuucugggg

SEQ ID NO: 742341 - RNA, 13 nt, Homo sapiens
gagccucacugau

SEQ ID NO: 742342 - RNA, 15 nt, Homo sapiens
gagccugaacaugcc

SEQ ID NO: 742343 - RNA, 18 nt, Homo sapiens
gagccugagccacaaaaa

SEQ ID NO: 742344 - RNA, 15 nt, Homo sapiens
gagccuggcacagga

SEQ ID NO: 742345 - RNA, 17 nt, Homo sapiens
gagccuggcuggcacag

SEQ ID NO: 742346 - RNA, 20 nt, Homo sapiens
gagccugggugguacccagg

SEQ ID NO: 742347 - RNA, 23 nt, Homo sapiens
gagccuguaaacuuuaucacuua

SEQ ID NO: 742348 - RNA, 22 nt, Homo sapiens
gagccugucuuucagcauucag

SEQ ID NO: 742349 - RNA, 20 nt, Homo sapiens
gagcgagugcucucacugua

SEQ ID NO: 742350 - RNA, 20 nt, Homo sapiens
gagcgcaagauagauuugga

SEQ ID NO: 742351 - RNA, 16 nt, Homo sapiens
gagcguucucuguccu

SEQ ID NO: 742352 - RNA, 13 nt, Homo sapiens
gagcuacaacaaa

SEQ ID NO: 742353 - RNA, 12 nt, Homo sapiens
gagcuacaguag

SEQ ID NO: 742354 - RNA, 15 nt, Homo sapiens
gagcucacagcugga

SEQ ID NO: 742355 - RNA, 22 nt, Homo sapiens
gagcucaccccagguucucacc

SEQ ID NO: 742356 - RNA, 14 nt, Homo sapiens
gaugcgucuaccca

SEQ ID NO: 742357 - RNA, 15 nt, Homo sapiens
gaugcuaagcugaua

SEQ ID NO: 742358 - RNA, 19 nt, Homo sapiens
gaugcuccagcaacacagc

SEQ ID NO: 742359 - RNA, 22 nt, Homo sapiens
gaugcugaggguguuucuuccu

SEQ ID NO: 742360 - RNA, 19 nt, Homo sapiens
gaugcugugauacacugaa

SEQ ID NO: 742361 - RNA, 14 nt, Homo sapiens
gaugcugugcuaug

SEQ ID NO: 742362 - RNA, 21 nt, Homo sapiens
gaugcuucuauaauuuugccu

SEQ ID NO: 742363 - RNA, 14 nt, Homo sapiens
gauggaagcuuguu

SEQ ID NO: 742364 - RNA, 22 nt, Homo sapiens
gauggaauauuccccuaucucu

SEQ ID NO: 742365 - RNA, 20 nt, Homo sapiens
gauggaaugcuugcagagca

SEQ ID NO: 742366 - RNA, 23 nt, Homo sapiens
gauggaauuuggaacaauagaau

SEQ ID NO: 742367 - RNA, 16 nt, Homo sapiens
gauggaccccagcauu

SEQ ID NO: 742368 - RNA, 22 nt, Homo sapiens
gauggagagcagccagcaccca

SEQ ID NO: 742369 - RNA, 19 nt, Homo sapiens
gauggagauauuuacauga

SEQ ID NO: 742370 - RNA, 23 nt, Homo sapiens
gauggaggggugguccugacuca

SEQ ID NO: 742371 - RNA, 22 nt, Homo sapiens
gauggagugugcagacagccau

SEQ ID NO: 742372 - RNA, 18 nt, Homo sapiens
gauggauagucuguccaa

SEQ ID NO: 742373 - RNA, 20 nt, Homo sapiens
gauggcagauucccacugcc

SEQ ID NO: 742374 - RNA, 14 nt, Homo sapiens
gauggccacuguga

SEQ ID NO: 742375 - RNA, 22 nt, Homo sapiens
gauggccacugugaauaacugu

SEQ ID NO: 742376 - RNA, 15 nt, Homo sapiens
gauggccccuccagc

SEQ ID NO: 742377 - RNA, 18 nt, Homo sapiens
gauggccgggcugcugcu

SEQ ID NO: 742378 - RNA, 12 nt, Homo sapiens
gauggccuggau

SEQ ID NO: 742379 - RNA, 17 nt, Homo sapiens
gauggccuuacacugaa

SEQ ID NO: 742380 - RNA, 19 nt, Homo sapiens
gauggcuggaaggggucca

SEQ ID NO: 742381 - RNA, 17 nt, Homo sapiens
gaugggcccuaugucuc

SEQ ID NO: 742382 - RNA, 20 nt, Homo sapiens
gaugggcggacggcugugga

SEQ ID NO: 742383 - RNA, 16 nt, Homo sapiens
gauggggacauuugaa

SEQ ID NO: 742384 - RNA, 18 nt, Homo sapiens
gauggggcaagggcacaa

SEQ ID NO: 742385 - RNA, 20 nt, Homo sapiens
gaugguuccucucuuggcaa

SEQ ID NO: 742386 - RNA, 13 nt, Homo sapiens
gauguacaauuaa

SEQ ID NO: 742387 - RNA, 22 nt, Homo sapiens
gauguaccaggcucucgcacac

SEQ ID NO: 742388 - RNA, 17 nt, Homo sapiens
gauguagaacuucaaga

SEQ ID NO: 742389 - RNA, 17 nt, Homo sapiens
gauguaugaaggcuuuu

SEQ ID NO: 742390 - RNA, 20 nt, Homo sapiens
gauguaugugugaaacaaug

SEQ ID NO: 742391 - RNA, 15 nt, Homo sapiens
gaugucauagccaaa

SEQ ID NO: 742392 - RNA, 17 nt, Homo sapiens
gaugucuuugcugcagu

SEQ ID NO: 742393 - RNA, 19 nt, Homo sapiens
gaugugaauuauugacacu

SEQ ID NO: 742394 - RNA, 17 nt, Homo sapiens
gauguguaaacaggcac

SEQ ID NO: 742395 - RNA, 16 nt, Homo sapiens
gauguguccucaggga

SEQ ID NO: 742396 - RNA, 13 nt, Homo sapiens
gauguguggacac

SEQ ID NO: 742397 - RNA, 20 nt, Homo sapiens
gauguuaacaagaggggaaa

SEQ ID NO: 742398 - RNA, 13 nt, Homo sapiens
gauguuaaccaau

SEQ ID NO: 742399 - RNA, 19 nt, Homo sapiens
gauguuauuagauguuaca

SEQ ID NO: 742400 - RNA, 15 nt, Homo sapiens
gauguucacuguggc

SEQ ID NO: 742401 - RNA, 18 nt, Homo sapiens
gauguuccaccugccaca

SEQ ID NO: 742402 - RNA, 17 nt, Homo sapiens
gauguugaaacuuugaa

SEQ ID NO: 742403 - RNA, 18 nt, Homo sapiens
gauguugcuggacuguca

SEQ ID NO: 742404 - RNA, 15 nt, Homo sapiens
gauguuucaaaaaau

SEQ ID NO: 742405 - RNA, 14 nt, Homo sapiens
gauguuuccagacu

SEQ ID NO: 742406 - RNA, 18 nt, Homo sapiens
gauguuuccagacuuccu

SEQ ID NO: 742407 - RNA, 18 nt, Homo sapiens
gauguuugaggcuuucag

SEQ ID NO: 742408 - RNA, 17 nt, Homo sapiens
gauuaacaacaggaaau

SEQ ID NO: 742409 - RNA, 16 nt, Homo sapiens
gauuaacggccuggau

SEQ ID NO: 742410 - RNA, 14 nt, Homo sapiens
gauuaagaaugcca

SEQ ID NO: 742411 - RNA, 14 nt, Homo sapiens
gauuaauauuauua

SEQ ID NO: 742412 - RNA, 20 nt, Homo sapiens
gauuacaggugcgcacuacc

SEQ ID NO: 742413 - RNA, 19 nt, Homo sapiens
gauuacaggugugagccac

SEQ ID NO: 742414 - RNA, 20 nt, Homo sapiens
gauuacuauugcaaaaggga

SEQ ID NO: 742415 - RNA, 21 nt, Homo sapiens
gauuacugaauuguaucaauu

SEQ ID NO: 742416 - RNA, 14 nt, Homo sapiens
gauuacugucaaua

SEQ ID NO: 742417 - RNA, 22 nt, Homo sapiens
gauuacuguccagcuuauaguc

SEQ ID NO: 742418 - RNA, 23 nt, Homo sapiens
gauuagguagacuuugcuuagua

SEQ ID NO: 742419 - RNA, 18 nt, Homo sapiens
gauuaguaaaagugcuuu

SEQ ID NO: 742420 - RNA, 18 nt, Homo sapiens
gauuagugucucaugugg

SEQ ID NO: 742421 - RNA, 14 nt, Homo sapiens
gauuauaaacugac

SEQ ID NO: 742422 - RNA, 20 nt, Homo sapiens
gauuauaauaugugccuuaa

SEQ ID NO: 742423 - RNA, 14 nt, Homo sapiens
gauuaucuacagaa

SEQ ID NO: 742424 - RNA, 12 nt, Homo sapiens
gauuauucugau

SEQ ID NO: 742425 - RNA, 12 nt, Homo sapiens
gauuauuugaac

SEQ ID NO: 742426 - RNA, 13 nt, Homo sapiens
gauuauuugcacg

SEQ ID NO: 742427 - RNA, 18 nt, Homo sapiens
gauuauuuuuuauacugu

SEQ ID NO: 742428 - RNA, 14 nt, Homo sapiens
gauucaaagcccaa

SEQ ID NO: 742429 - RNA, 14 nt, Homo sapiens
gauucaaaucuaug

SEQ ID NO: 742430 - RNA, 16 nt, Homo sapiens
gauucaaauugcugcu

SEQ ID NO: 742431 - RNA, 21 nt, Homo sapiens
gauucacauaguuuauuucaa

SEQ ID NO: 742432 - RNA, 11 nt, Homo sapiens
gauucaccucu

SEQ ID NO: 742433 - RNA, 22 nt, Homo sapiens
gauucagaaauuggaacagaau

SEQ ID NO: 742434 - RNA, 21 nt, Homo sapiens
gauucagaucgaaauuggacu

SEQ ID NO: 742435 - RNA, 16 nt, Homo sapiens
gauucagcccucagaa

SEQ ID NO: 742436 - RNA, 11 nt, Homo sapiens
gauucaguauu

SEQ ID NO: 742437 - RNA, 13 nt, Homo sapiens
gauuccacuuuua

SEQ ID NO: 742438 - RNA, 12 nt, Homo sapiens
gauuccagagag

SEQ ID NO: 742439 - RNA, 16 nt, Homo sapiens
gauuccucucuaagug

SEQ ID NO: 742440 - RNA, 18 nt, Homo sapiens
gauuccucuuuguuuauc

SEQ ID NO: 742441 - RNA, 16 nt, Homo sapiens
gauucuaaaacauucu

SEQ ID NO: 742442 - RNA, 23 nt, Homo sapiens
gauucuaaaaugugauguucuaa

SEQ ID NO: 742443 - RNA, 13 nt, Homo sapiens
gauucuacaacac

SEQ ID NO: 742444 - RNA, 21 nt, Homo sapiens
gauucuaugaagcccacccag

SEQ ID NO: 742445 - RNA, 12 nt, Homo sapiens
gauucuccagua

SEQ ID NO: 742446 - RNA, 14 nt, Homo sapiens
gauucucugugguu

SEQ ID NO: 742447 - RNA, 14 nt, Homo sapiens
gauucugugucaga

SEQ ID NO: 742448 - RNA, 15 nt, Homo sapiens
gauucuucagcuuga

SEQ ID NO: 742449 - RNA, 14 nt, Homo sapiens
gauucuuuguuaca

SEQ ID NO: 742450 - RNA, 22 nt, Homo sapiens
gauucuuuucaucaaaaagccu

SEQ ID NO: 742451 - RNA, 16 nt, Homo sapiens
gauugaaucugaacca

SEQ ID NO: 742452 - RNA, 17 nt, Homo sapiens
gauugacacacagcacu

SEQ ID NO: 742453 - RNA, 24 nt, Homo sapiens
gauugagaaauguguagcugcaaa

SEQ ID NO: 742454 - RNA, 12 nt, Homo sapiens
gauugauuagau

SEQ ID NO: 742455 - RNA, 12 nt, Homo sapiens
gauugauuuucu

SEQ ID NO: 742456 - RNA, 20 nt, Homo sapiens
gauugcacguggccucuuga

SEQ ID NO: 742457 - RNA, 20 nt, Homo sapiens
gauugcgccauugcacucca

SEQ ID NO: 742458 - RNA, 18 nt, Homo sapiens
gauugcuuaaaauagcaa

SEQ ID NO: 742459 - RNA, 13 nt, Homo sapiens
gauuggcacagac

SEQ ID NO: 742460 - RNA, 16 nt, Homo sapiens
gauugguccuuuucaa

SEQ ID NO: 742461 - RNA, 22 nt, Homo sapiens
gauuguuaggagugguucucau

SEQ ID NO: 742462 - RNA, 20 nt, Homo sapiens
gauuguuuaaagaagcucuc

SEQ ID NO: 742463 - RNA, 20 nt, Homo sapiens
gauuuaaacucaucaaugug

SEQ ID NO: 742464 - RNA, 17 nt, Homo sapiens
gauuuaaaucuuuucaa

SEQ ID NO: 742465 - RNA, 22 nt, Homo sapiens
gauuuacuaaaucaaucugcag

SEQ ID NO: 742466 - RNA, 21 nt, Homo sapiens
gauuuauuuuaauuguugaua

SEQ ID NO: 742467 - RNA, 15 nt, Homo sapiens
gauuucaaagcaagu

SEQ ID NO: 742468 - RNA, 18 nt, Homo sapiens
gauuucaauagcuuugua

SEQ ID NO: 742469 - RNA, 15 nt, Homo sapiens
gauuucacagugugu

SEQ ID NO: 742470 - RNA, 15 nt, Homo sapiens
gauuucagcagggau

SEQ ID NO: 742471 - RNA, 14 nt, Homo sapiens
gcaguuggacucuc

SEQ ID NO: 742472 - RNA, 21 nt, Homo sapiens
gcaguuugcuuuguaugcacu

SEQ ID NO: 742473 - RNA, 16 nt, Homo sapiens
gcauaaaaacauuuua

SEQ ID NO: 742474 - RNA, 14 nt, Homo sapiens
gcauaaaagacuuu

SEQ ID NO: 742475 - RNA, 20 nt, Homo sapiens
gcauaaagccaaauuuccag

SEQ ID NO: 742476 - RNA, 19 nt, Homo sapiens
gcauaagaaaacuaagaaa

SEQ ID NO: 742477 - RNA, 23 nt, Homo sapiens
gcauaaguuuggagcacuaguuu

SEQ ID NO: 742478 - RNA, 23 nt, Homo sapiens
gcauacaaagagguguacaggua

SEQ ID NO: 742479 - RNA, 16 nt, Homo sapiens
gcauacuuucccucau

SEQ ID NO: 742480 - RNA, 17 nt, Homo sapiens
gcauagaaauggaagaa

SEQ ID NO: 742481 - RNA, 16 nt, Homo sapiens
gcauagcagaccacac

SEQ ID NO: 742482 - RNA, 20 nt, Homo sapiens
gcauagggucacuuugccau

SEQ ID NO: 742483 - RNA, 15 nt, Homo sapiens
gcauaguccaaaaag

SEQ ID NO: 742484 - RNA, 18 nt, Homo sapiens
gcauaugauagaugacaa

SEQ ID NO: 742485 - RNA, 23 nt, Homo sapiens
gcauauuuauccaaaauguguau

SEQ ID NO: 742486 - RNA, 21 nt, Homo sapiens
gcaucaauuuucaaacaaccg

SEQ ID NO: 742487 - RNA, 22 nt, Homo sapiens
gcaucacuuaacggaccaaagc

SEQ ID NO: 742488 - RNA, 11 nt, Homo sapiens
gcaucagagau

SEQ ID NO: 742489 - RNA, 16 nt, Homo sapiens
gcaucagguccuuugg

SEQ ID NO: 742490 - RNA, 14 nt, Homo sapiens
gcaucaguacuugu

SEQ ID NO: 742491 - RNA, 20 nt, Homo sapiens
gcaucagucugaaagccagg

SEQ ID NO: 742492 - RNA, 22 nt, Homo sapiens
gcaucagugggaucccagacau

SEQ ID NO: 742493 - RNA, 15 nt, Homo sapiens
gcaucauaauggacu

SEQ ID NO: 742494 - RNA, 21 nt, Homo sapiens
gcaucaucccuggauguggau

SEQ ID NO: 742495 - RNA, 17 nt, Homo sapiens
gcaucauuaguacaucu

SEQ ID NO: 742496 - RNA, 23 nt, Homo sapiens
gcauccuggacaacaacgcggcc

SEQ ID NO: 742497 - RNA, 23 nt, Homo sapiens
gcaucgggagcacccagagcacc

SEQ ID NO: 742498 - RNA, 16 nt, Homo sapiens
gcaucuacacaauuua

SEQ ID NO: 742499 - RNA, 15 nt, Homo sapiens
gcaucucaagcccca

SEQ ID NO: 742500 - RNA, 14 nt, Homo sapiens
gcaucucacuuuau

SEQ ID NO: 742501 - RNA, 16 nt, Homo sapiens
gcaucucccagcaaga

SEQ ID NO: 742502 - RNA, 17 nt, Homo sapiens
gcaucucccaguucaua

SEQ ID NO: 742503 - RNA, 21 nt, Homo sapiens
gcaucucggggaccugcuuca

SEQ ID NO: 742504 - RNA, 19 nt, Homo sapiens
gcaucugaccaucugugac

SEQ ID NO: 742505 - RNA, 17 nt, Homo sapiens
gcaucugcagccacuuu

SEQ ID NO: 742506 - RNA, 16 nt, Homo sapiens
gcaucugcagccagca

SEQ ID NO: 742507 - RNA, 17 nt, Homo sapiens
gcaucugugccagagau

SEQ ID NO: 742508 - RNA, 16 nt, Homo sapiens
gcaucuugcuggcuac

SEQ ID NO: 742509 - RNA, 14 nt, Homo sapiens
gcaucuuguuucau

SEQ ID NO: 742510 - RNA, 16 nt, Homo sapiens
gcaugaaccacccaga

SEQ ID NO: 742511 - RNA, 20 nt, Homo sapiens
gcaugaccugugaccagcac

SEQ ID NO: 742512 - RNA, 22 nt, Homo sapiens
gcaugagacuuucugcugggau

SEQ ID NO: 742513 - RNA, 11 nt, Homo sapiens
gcaugagccac

SEQ ID NO: 742514 - RNA, 19 nt, Homo sapiens
gcaugagcuggcaaccagc

SEQ ID NO: 742515 - RNA, 13 nt, Homo sapiens
gcaugaguuuaaa

SEQ ID NO: 742516 - RNA, 15 nt, Homo sapiens
gcaugauaagagcau

SEQ ID NO: 742517 - RNA, 20 nt, Homo sapiens
gcaugaucuuguuacuguga

SEQ ID NO: 742518 - RNA, 21 nt, Homo sapiens
gcaugcacaauccugauaaau

SEQ ID NO: 742519 - RNA, 12 nt, Homo sapiens
gcaugcggccca

SEQ ID NO: 742520 - RNA, 17 nt, Homo sapiens
gcauggaaacauggagg

SEQ ID NO: 742521 - RNA, 14 nt, Homo sapiens
gcauggaacagcau

SEQ ID NO: 742522 - RNA, 16 nt, Homo sapiens
gcauggaaggggcuuc

SEQ ID NO: 742523 - RNA, 15 nt, Homo sapiens
gcauggcuggcacau

SEQ ID NO: 742524 - RNA, 23 nt, Homo sapiens
gcaugguggaacccccaucucua

SEQ ID NO: 742525 - RNA, 18 nt, Homo sapiens
gcauguaagccaagucau

SEQ ID NO: 742526 - RNA, 24 nt, Homo sapiens
gcauguaugucuuggacacuguac

SEQ ID NO: 742527 - RNA, 21 nt, Homo sapiens
gcaugucagacagaacuugaa

SEQ ID NO: 742528 - RNA, 22 nt, Homo sapiens
gcaugucuacucagcauuugau

SEQ ID NO: 742529 - RNA, 21 nt, Homo sapiens
gcaugucuccucaacccacau

SEQ ID NO: 742530 - RNA, 13 nt, Homo sapiens
gcaugugaucucc

SEQ ID NO: 742531 - RNA, 21 nt, Homo sapiens
gcaugugcugugaccauuuau

SEQ ID NO: 742532 - RNA, 19 nt, Homo sapiens
gcauguggccuuuaucuca

SEQ ID NO: 742533 - RNA, 14 nt, Homo sapiens
gcauguugauuucu

SEQ ID NO: 742534 - RNA, 16 nt, Homo sapiens
gcauguuucacagugg

SEQ ID NO: 742535 - RNA, 15 nt, Homo sapiens
gcauguuugccuaga

SEQ ID NO: 742536 - RNA, 15 nt, Homo sapiens
gcauuaaacauuuga

SEQ ID NO: 742537 - RNA, 17 nt, Homo sapiens
gcauuaauagucccauu

SEQ ID NO: 742538 - RNA, 12 nt, Homo sapiens
gcauuacuuuau

SEQ ID NO: 742539 - RNA, 20 nt, Homo sapiens
gcauuauguacacaggucaa

SEQ ID NO: 742540 - RNA, 19 nt, Homo sapiens
gcauucacaaggugacugg

SEQ ID NO: 742541 - RNA, 13 nt, Homo sapiens
gcauucagacucc

SEQ ID NO: 742542 - RNA, 14 nt, Homo sapiens
gcauuccugaaggg

SEQ ID NO: 742543 - RNA, 19 nt, Homo sapiens
gcauucuucugagcacugu

SEQ ID NO: 742544 - RNA, 22 nt, Homo sapiens
gcauugaauauauuauaaucuu

SEQ ID NO: 742545 - RNA, 20 nt, Homo sapiens
gcauugagccaguggugcua

SEQ ID NO: 742546 - RNA, 23 nt, Homo sapiens
gcauugcucucccucgugcuccc

SEQ ID NO: 742547 - RNA, 10 nt, Homo sapiens
gcauugcugg

SEQ ID NO: 742548 - RNA, 18 nt, Homo sapiens
gcauugucuguaaugaca

SEQ ID NO: 742549 - RNA, 23 nt, Homo sapiens
gcauuguuuuugucauguagcug

SEQ ID NO: 742550 - RNA, 21 nt, Homo sapiens
gcauuuaaaauaccacuguaa

SEQ ID NO: 742551 - RNA, 22 nt, Homo sapiens
gcauuuaaaauaccacuguaau

SEQ ID NO: 742552 - RNA, 19 nt, Homo sapiens
gcauuuaaauuugauuucc

SEQ ID NO: 742553 - RNA, 16 nt, Homo sapiens
gcauuuagucuugcca

SEQ ID NO: 742554 - RNA, 19 nt, Homo sapiens
gcauuucaaggaacagcca

SEQ ID NO: 742555 - RNA, 19 nt, Homo sapiens
gcauuuccaacaccacaga

SEQ ID NO: 742556 - RNA, 19 nt, Homo sapiens
gcauuuggugagagucaaa

SEQ ID NO: 742557 - RNA, 21 nt, Homo sapiens
gcauuugucaaugacaguuuc

SEQ ID NO: 742558 - RNA, 14 nt, Homo sapiens
gcauuuuacaggug

SEQ ID NO: 742559 - RNA, 15 nt, Homo sapiens
gcauuuuccucuugu

SEQ ID NO: 742560 - RNA, 14 nt, Homo sapiens
gcauuuuucuggga

SEQ ID NO: 742561 - RNA, 22 nt, Homo sapiens
gccaaagaccaaauuccuuggc

SEQ ID NO: 742562 - RNA, 21 nt, Homo sapiens
gccaaauaggagggagacugu

SEQ ID NO: 742563 - RNA, 14 nt, Homo sapiens
gccaacauggugaa

SEQ ID NO: 742564 - RNA, 15 nt, Homo sapiens
gccaagaacuugcaa

SEQ ID NO: 742565 - RNA, 22 nt, Homo sapiens
gccaagacccaacaggugcuga

SEQ ID NO: 742566 - RNA, 13 nt, Homo sapiens
gccaagacuccuc

SEQ ID NO: 742567 - RNA, 22 nt, Homo sapiens
gccaagauugcgccauugcacu

SEQ ID NO: 742568 - RNA, 13 nt, Homo sapiens
gccaagcacugcu

SEQ ID NO: 742569 - RNA, 19 nt, Homo sapiens
gccaagcagugccugccua

SEQ ID NO: 742570 - RNA, 20 nt, Homo sapiens
gccaaggaaacccccagugu

SEQ ID NO: 742571 - RNA, 18 nt, Homo sapiens
gccaaggcuuuugcaaag

SEQ ID NO: 742572 - RNA, 19 nt, Homo sapiens
gccaagggaaccugugucc

SEQ ID NO: 742573 - RNA, 19 nt, Homo sapiens
gccaagggccgacuaagag

SEQ ID NO: 742574 - RNA, 20 nt, Homo sapiens
gccaagggggugacuggaag

SEQ ID NO: 742575 - RNA, 21 nt, Homo sapiens
gccaaggggugggccugugaa

SEQ ID NO: 742576 - RNA, 17 nt, Homo sapiens
gccaaggugggauuugu

SEQ ID NO: 742577 - RNA, 16 nt, Homo sapiens
gccaagucuaaugaag

SEQ ID NO: 742578 - RNA, 18 nt, Homo sapiens
gccaauauuucugauaua

SEQ ID NO: 742579 - RNA, 19 nt, Homo sapiens
gccaaugccccacuggcag

SEQ ID NO: 742580 - RNA, 23 nt, Homo sapiens
gccaauuuccucuccacugcugg

SEQ ID NO: 742581 - RNA, 14 nt, Homo sapiens
gccacaacugcccc

SEQ ID NO: 742582 - RNA, 16 nt, Homo sapiens
gccacaagucuuccag

SEQ ID NO: 742583 - RNA, 19 nt, Homo sapiens
gccacaaugcaguucugag

SEQ ID NO: 742584 - RNA, 14 nt, Homo sapiens
gccacaauucuguc

SEQ ID NO: 742585 - RNA, 16 nt, Homo sapiens
gccuggaacaccagca

SEQ ID NO: 742586 - RNA, 20 nt, Homo sapiens
gccuggaacaccagcagcac

SEQ ID NO: 742587 - RNA, 19 nt, Homo sapiens
gccuggacacuguaccgac

SEQ ID NO: 742588 - RNA, 22 nt, Homo sapiens
gccuggacuguuuucucucggc

SEQ ID NO: 742589 - RNA, 15 nt, Homo sapiens
gccuggacuuuccug

SEQ ID NO: 742590 - RNA, 23 nt, Homo sapiens
gccuggaucuccccacucuaggg

SEQ ID NO: 742591 - RNA, 17 nt, Homo sapiens
gccuggaugggggugca

SEQ ID NO: 742592 - RNA, 20 nt, Homo sapiens
gccuggauuuaucauugggu

SEQ ID NO: 742593 - RNA, 20 nt, Homo sapiens
gccuggccaacauggugaaa

SEQ ID NO: 742594 - RNA, 15 nt, Homo sapiens
gccuggccaucugua

SEQ ID NO: 742595 - RNA, 22 nt, Homo sapiens
gccuggcccccacccucugcca

SEQ ID NO: 742596 - RNA, 18 nt, Homo sapiens
gccuggccggcuccaguu

SEQ ID NO: 742597 - RNA, 20 nt, Homo sapiens
gccuggccuccaaaauauua

SEQ ID NO: 742598 - RNA, 21 nt, Homo sapiens
gccuggcuccccacgagucac

SEQ ID NO: 742599 - RNA, 15 nt, Homo sapiens
gccugggacccagcu

SEQ ID NO: 742600 - RNA, 15 nt, Homo sapiens
gccugggaugaugca

SEQ ID NO: 742601 - RNA, 18 nt, Homo sapiens
gccuggggauguaaccaa

SEQ ID NO: 742602 - RNA, 18 nt, Homo sapiens
gccugggggcagccucuc

SEQ ID NO: 742603 - RNA, 16 nt, Homo sapiens
gccugggggcagugac

SEQ ID NO: 742604 - RNA, 19 nt, Homo sapiens
gccugggggcuuuugccac

SEQ ID NO: 742605 - RNA, 21 nt, Homo sapiens
gccugggguguuaguggcacc

SEQ ID NO: 742606 - RNA, 21 nt, Homo sapiens
gccugggugacagagugagug

SEQ ID NO: 742607 - RNA, 17 nt, Homo sapiens
gccuggucccugguccu

SEQ ID NO: 742608 - RNA, 23 nt, Homo sapiens
gccuguaaacuuuaucacuuaaa

SEQ ID NO: 742609 - RNA, 23 nt, Homo sapiens
gccuguaaucccaacacuuugag

SEQ ID NO: 742610 - RNA, 14 nt, Homo sapiens
gccuguaaucccag

SEQ ID NO: 742611 - RNA, 21 nt, Homo sapiens
gccuguaaucccagcacuuug

SEQ ID NO: 742612 - RNA, 22 nt, Homo sapiens
gccuguaaucccagcacuuugg

SEQ ID NO: 742613 - RNA, 13 nt, Homo sapiens
gccuguaguccca

SEQ ID NO: 742614 - RNA, 20 nt, Homo sapiens
gccuguagucucagcuaguu

SEQ ID NO: 742615 - RNA, 22 nt, Homo sapiens
gccuguauuuaacucauaugau

SEQ ID NO: 742616 - RNA, 18 nt, Homo sapiens
gccuguccaacaugguga

SEQ ID NO: 742617 - RNA, 13 nt, Homo sapiens
gccugucucuagc

SEQ ID NO: 742618 - RNA, 14 nt, Homo sapiens
gccugugaugcugg

SEQ ID NO: 742619 - RNA, 20 nt, Homo sapiens
gccugugcauguaugucuug

SEQ ID NO: 742620 - RNA, 15 nt, Homo sapiens
gccugugcugugacu

SEQ ID NO: 742621 - RNA, 11 nt, Homo sapiens
gccuguggcau

SEQ ID NO: 742622 - RNA, 23 nt, Homo sapiens
gccuguggcgccgucuccagggg

SEQ ID NO: 742623 - RNA, 15 nt, Homo sapiens
gccugugguuaacau

SEQ ID NO: 742624 - RNA, 19 nt, Homo sapiens
gccugugguuacagugcag

SEQ ID NO: 742625 - RNA, 14 nt, Homo sapiens
gccuguuccaugaa

SEQ ID NO: 742626 - RNA, 22 nt, Homo sapiens
gccuuaaaaggggcccaagccc

SEQ ID NO: 742627 - RNA, 18 nt, Homo sapiens
gccuuaacacacuggcca

SEQ ID NO: 742628 - RNA, 15 nt, Homo sapiens
gccuuaacuucuuaa

SEQ ID NO: 742629 - RNA, 12 nt, Homo sapiens
gccuuaauacuu

SEQ ID NO: 742630 - RNA, 21 nt, Homo sapiens
gccuuacaaacucacuaugaa

SEQ ID NO: 742631 - RNA, 13 nt, Homo sapiens
gccuuacacugaa

SEQ ID NO: 742632 - RNA, 22 nt, Homo sapiens
gccuuaccuccugcccaggaga

SEQ ID NO: 742633 - RNA, 15 nt, Homo sapiens
gccuuacugaccuca

SEQ ID NO: 742634 - RNA, 17 nt, Homo sapiens
gccuuauuaauauccaa

SEQ ID NO: 742635 - RNA, 15 nt, Homo sapiens
gccuuauuggcagcu

SEQ ID NO: 742636 - RNA, 18 nt, Homo sapiens
gccuuauuuugcuucuug

SEQ ID NO: 742637 - RNA, 20 nt, Homo sapiens
gccuucaacgacccuggaca

SEQ ID NO: 742638 - RNA, 14 nt, Homo sapiens
gccuucacauuugg

SEQ ID NO: 742639 - RNA, 12 nt, Homo sapiens
gccuucacccau

SEQ ID NO: 742640 - RNA, 13 nt, Homo sapiens
gccuucacugaca

SEQ ID NO: 742641 - RNA, 21 nt, Homo sapiens
gccuucaucuucacugcaauu

SEQ ID NO: 742642 - RNA, 14 nt, Homo sapiens
gccuuccacaguga

SEQ ID NO: 742643 - RNA, 12 nt, Homo sapiens
gccuuccagguc

SEQ ID NO: 742644 - RNA, 21 nt, Homo sapiens
gccuucccaaguugugcuuga

SEQ ID NO: 742645 - RNA, 16 nt, Homo sapiens
gccuuccucugcagcu

SEQ ID NO: 742646 - RNA, 10 nt, Homo sapiens
gccuuccuuu

SEQ ID NO: 742647 - RNA, 19 nt, Homo sapiens
gccuucgcacucaaugcca

SEQ ID NO: 742648 - RNA, 18 nt, Homo sapiens
gccuucuaguuaccacau

SEQ ID NO: 742649 - RNA, 19 nt, Homo sapiens
gccuucucuaaacauuuca

SEQ ID NO: 742650 - RNA, 13 nt, Homo sapiens
gccuucuggagcu

SEQ ID NO: 742651 - RNA, 13 nt, Homo sapiens
gccuucugggaac

SEQ ID NO: 742652 - RNA, 20 nt, Homo sapiens
gccuucuuacaacagagaug

SEQ ID NO: 742653 - RNA, 18 nt, Homo sapiens
gccuugccagagauccaa

SEQ ID NO: 742654 - RNA, 12 nt, Homo sapiens
gccuugcugaca

SEQ ID NO: 742655 - RNA, 16 nt, Homo sapiens
gccuuggagaucaaaa

SEQ ID NO: 742656 - RNA, 16 nt, Homo sapiens
gccuuggcucguucuc

SEQ ID NO: 742657 - RNA, 16 nt, Homo sapiens
gccuugugucacuggc

SEQ ID NO: 742658 - RNA, 17 nt, Homo sapiens
gccuugugucacuggcu

SEQ ID NO: 742659 - RNA, 22 nt, Homo sapiens
gccuuguucaauaauuacugua

SEQ ID NO: 742660 - RNA, 12 nt, Homo sapiens
gccuuguuucau

SEQ ID NO: 742661 - RNA, 16 nt, Homo sapiens
gccuuuaagccaaaga

SEQ ID NO: 742662 - RNA, 16 nt, Homo sapiens
gccuuuagccuggacc

SEQ ID NO: 742663 - RNA, 15 nt, Homo sapiens
gccuuuaucucugag

SEQ ID NO: 742664 - RNA, 13 nt, Homo sapiens
gccuuuaucuuga

SEQ ID NO: 742665 - RNA, 15 nt, Homo sapiens
gccuuuauggcugcu

SEQ ID NO: 742666 - RNA, 20 nt, Homo sapiens
gccuuuccaagucacuagaa

SEQ ID NO: 742667 - RNA, 23 nt, Homo sapiens
gccuuucguucugcugaccaaau

SEQ ID NO: 742668 - RNA, 19 nt, Homo sapiens
gccuuucuccgcaacagcc

SEQ ID NO: 742669 - RNA, 23 nt, Homo sapiens
gccuuuggauugacucugcauuu

SEQ ID NO: 742670 - RNA, 14 nt, Homo sapiens
gccuuuguugcuca

SEQ ID NO: 742671 - RNA, 15 nt, Homo sapiens
gccuuuguugcucag

SEQ ID NO: 742672 - RNA, 22 nt, Homo sapiens
gccuuuuuauuuauauguacug

SEQ ID NO: 742673 - RNA, 20 nt, Homo sapiens
gccuuuuuguauaaaauaga

SEQ ID NO: 742674 - RNA, 22 nt, Homo sapiens
gcgaaaguaaaaacacuaccuc

SEQ ID NO: 742675 - RNA, 17 nt, Homo sapiens
gcgaacugcacugcugu

SEQ ID NO: 742676 - RNA, 11 nt, Homo sapiens
gcgaagggaag

SEQ ID NO: 742677 - RNA, 16 nt, Homo sapiens
gcgagacuccaucucu

SEQ ID NO: 742678 - RNA, 14 nt, Homo sapiens
gcgaggacaucaaa

SEQ ID NO: 742679 - RNA, 17 nt, Homo sapiens
gcgagucuuacuuugag

SEQ ID NO: 742680 - RNA, 11 nt, Homo sapiens
gcgaguucucu

SEQ ID NO: 742681 - RNA, 22 nt, Homo sapiens
gcgauccaccugucucagccuc

SEQ ID NO: 742682 - RNA, 14 nt, Homo sapiens
gcgaucucagcuca

SEQ ID NO: 742683 - RNA, 18 nt, Homo sapiens
gcgauucucccgccucag

SEQ ID NO: 742684 - RNA, 16 nt, Homo sapiens
gcgauucuggauaaag

SEQ ID NO: 742685 - RNA, 19 nt, Homo sapiens
gcgccagaacccagauuuc

SEQ ID NO: 742686 - RNA, 15 nt, Homo sapiens
gcgccuccagagguc

SEQ ID NO: 742687 - RNA, 18 nt, Homo sapiens
gcgccuugccuccucacc

SEQ ID NO: 742688 - RNA, 14 nt, Homo sapiens
gcgcgcgugcacac

SEQ ID NO: 742689 - RNA, 14 nt, Homo sapiens
gcgcgugcacacac

SEQ ID NO: 742690 - RNA, 18 nt, Homo sapiens
gcgcucucccuaccuugc

SEQ ID NO: 742691 - RNA, 21 nt, Homo sapiens
gcgcugcagccucccuuccau

SEQ ID NO: 742692 - RNA, 20 nt, Homo sapiens
gcgcugguggaccacaggca

SEQ ID NO: 742693 - RNA, 18 nt, Homo sapiens
gcgcuguguacaauguga

SEQ ID NO: 742694 - RNA, 19 nt, Homo sapiens
gcggaaggucccucagaca

SEQ ID NO: 742695 - RNA, 18 nt, Homo sapiens
gcggccauaagaggugau

SEQ ID NO: 742696 - RNA, 23 nt, Homo sapiens
gcggcccugaccaaugugugaag

SEQ ID NO: 742697 - RNA, 20 nt, Homo sapiens
gcggcucaaaaggaaaccaa

SEQ ID NO: 742698 - RNA, 18 nt, Homo sapiens
gcggcuggugcagggccu

SEQ ID NO: 742699 - RNA, 17 nt, Homo sapiens
gcggcuucaccugcgug

SEQ ID NO: 742700 - RNA, 16 nt, Homo sapiens
ggucucaaacuccuga

SEQ ID NO: 742701 - RNA, 20 nt, Homo sapiens
ggucucaaacuccugaccuc

SEQ ID NO: 742702 - RNA, 20 nt, Homo sapiens
ggucucaggagaagggauag

SEQ ID NO: 742703 - RNA, 14 nt, Homo sapiens
ggucuccaagggag

SEQ ID NO: 742704 - RNA, 14 nt, Homo sapiens
ggucucccaaacgc

SEQ ID NO: 742705 - RNA, 21 nt, Homo sapiens
ggucugacaugaacacuuuuu

SEQ ID NO: 742706 - RNA, 22 nt, Homo sapiens
ggucugcuuaaagcuucccucu

SEQ ID NO: 742707 - RNA, 23 nt, Homo sapiens
ggucuggccaagguggacggggu

SEQ ID NO: 742708 - RNA, 15 nt, Homo sapiens
ggucuguagggauuu

SEQ ID NO: 742709 - RNA, 13 nt, Homo sapiens
ggucugugacugg

SEQ ID NO: 742710 - RNA, 21 nt, Homo sapiens
ggucugugugugugugugugc

SEQ ID NO: 742711 - RNA, 23 nt, Homo sapiens
ggucuguuguaggguugccagau

SEQ ID NO: 742712 - RNA, 14 nt, Homo sapiens
ggucuuacauugga

SEQ ID NO: 742713 - RNA, 20 nt, Homo sapiens
ggucuucaagacgacagcuc

SEQ ID NO: 742714 - RNA, 15 nt, Homo sapiens
ggucuucccuaccuc

SEQ ID NO: 742715 - RNA, 13 nt, Homo sapiens
ggucuucuuacau

SEQ ID NO: 742716 - RNA, 17 nt, Homo sapiens
ggucuuggguuccugua

SEQ ID NO: 742717 - RNA, 13 nt, Homo sapiens
ggucuuucugugc

SEQ ID NO: 742718 - RNA, 18 nt, Homo sapiens
ggucuuugguuggcagaa

SEQ ID NO: 742719 - RNA, 16 nt, Homo sapiens
ggugaaagauggaacu

SEQ ID NO: 742720 - RNA, 12 nt, Homo sapiens
ggugaaugagaa

SEQ ID NO: 742721 - RNA, 15 nt, Homo sapiens
ggugaauuucacaag

SEQ ID NO: 742722 - RNA, 21 nt, Homo sapiens
ggugacagugccuucucuauu

SEQ ID NO: 742723 - RNA, 13 nt, Homo sapiens
ggugaggaccacu

SEQ ID NO: 742724 - RNA, 21 nt, Homo sapiens
ggugauaaguuccaaauaugu

SEQ ID NO: 742725 - RNA, 19 nt, Homo sapiens
ggugaucaauuaaauguag

SEQ ID NO: 742726 - RNA, 17 nt, Homo sapiens
ggugauccgccuaccuc

SEQ ID NO: 742727 - RNA, 21 nt, Homo sapiens
ggugcaugauaagagcaucuc

SEQ ID NO: 742728 - RNA, 13 nt, Homo sapiens
ggugcaugcaguu

SEQ ID NO: 742729 - RNA, 17 nt, Homo sapiens
ggugccaugccugcucc

SEQ ID NO: 742730 - RNA, 15 nt, Homo sapiens
ggugcccucucaggu

SEQ ID NO: 742731 - RNA, 19 nt, Homo sapiens
ggugcuacagggaauuugu

SEQ ID NO: 742732 - RNA, 15 nt, Homo sapiens
ggugcugcagcaccg

SEQ ID NO: 742733 - RNA, 20 nt, Homo sapiens
ggugcugugugccccacucc

SEQ ID NO: 742734 - RNA, 20 nt, Homo sapiens
gguggaaaucaacccucucc

SEQ ID NO: 742735 - RNA, 16 nt, Homo sapiens
gguggaccuggcagug

SEQ ID NO: 742736 - RNA, 15 nt, Homo sapiens
gguggacuucagugu

SEQ ID NO: 742737 - RNA, 15 nt, Homo sapiens
gguggagcagccaga

SEQ ID NO: 742738 - RNA, 17 nt, Homo sapiens
gguggagcuugcaguga

SEQ ID NO: 742739 - RNA, 15 nt, Homo sapiens
gguggagguugcagu

SEQ ID NO: 742740 - RNA, 16 nt, Homo sapiens
gguggcaggugccuug

SEQ ID NO: 742741 - RNA, 14 nt, Homo sapiens
gguggcccugugcc

SEQ ID NO: 742742 - RNA, 17 nt, Homo sapiens
gguggcucacgccugua

SEQ ID NO: 742743 - RNA, 12 nt, Homo sapiens
ggugggaacuca

SEQ ID NO: 742744 - RNA, 19 nt, Homo sapiens
ggugggauuuuuggugcaa

SEQ ID NO: 742745 - RNA, 23 nt, Homo sapiens
ggugggcaggaucucaagccagc

SEQ ID NO: 742746 - RNA, 16 nt, Homo sapiens
ggugggcccccaauga

SEQ ID NO: 742747 - RNA, 22 nt, Homo sapiens
gguggggagcaaaucaucugca

SEQ ID NO: 742748 - RNA, 15 nt, Homo sapiens
ggugggggugccgcu

SEQ ID NO: 742749 - RNA, 13 nt, Homo sapiens
ggugggugggaug

SEQ ID NO: 742750 - RNA, 13 nt, Homo sapiens
ggugguaccugag

SEQ ID NO: 742751 - RNA, 21 nt, Homo sapiens
ggugguggcgugcauauguaa

SEQ ID NO: 742752 - RNA, 16 nt, Homo sapiens
ggugguuuuugcucuc

SEQ ID NO: 742753 - RNA, 23 nt, Homo sapiens
gguguacuuauauccacacugca

SEQ ID NO: 742754 - RNA, 18 nt, Homo sapiens
gguguaugcacagggugu

SEQ ID NO: 742755 - RNA, 16 nt, Homo sapiens
ggugucauccugugaa

SEQ ID NO: 742756 - RNA, 15 nt, Homo sapiens
gguguccugaagcug

SEQ ID NO: 742757 - RNA, 15 nt, Homo sapiens
ggugugaaagucaga

SEQ ID NO: 742758 - RNA, 21 nt, Homo sapiens
ggugugaccauguucauuaua

SEQ ID NO: 742759 - RNA, 14 nt, Homo sapiens
ggugugaguccaaa

SEQ ID NO: 742760 - RNA, 12 nt, Homo sapiens
ggugugcuguau

SEQ ID NO: 742761 - RNA, 15 nt, Homo sapiens
ggugugggggcugca

SEQ ID NO: 742762 - RNA, 22 nt, Homo sapiens
gguguuaauuuugcuaacuggg

SEQ ID NO: 742763 - RNA, 21 nt, Homo sapiens
gguuaaacagcagcacuuuuu

SEQ ID NO: 742764 - RNA, 20 nt, Homo sapiens
gguuaaacauuaauauuuac

SEQ ID NO: 742765 - RNA, 14 nt, Homo sapiens
gguuaaauuugaau

SEQ ID NO: 742766 - RNA, 12 nt, Homo sapiens
gguuaagagcuc

SEQ ID NO: 742767 - RNA, 14 nt, Homo sapiens
gguuaagagcucag

SEQ ID NO: 742768 - RNA, 21 nt, Homo sapiens
gguuacaagaaacagccacug

SEQ ID NO: 742769 - RNA, 17 nt, Homo sapiens
gguuagccuuugcccug

SEQ ID NO: 742770 - RNA, 17 nt, Homo sapiens
gguuauaacaguguuua

SEQ ID NO: 742771 - RNA, 17 nt, Homo sapiens
gguuauagcuucaggag

SEQ ID NO: 742772 - RNA, 14 nt, Homo sapiens
gguucaaacgggug

SEQ ID NO: 742773 - RNA, 13 nt, Homo sapiens
gguucaacaaagg

SEQ ID NO: 742774 - RNA, 17 nt, Homo sapiens
gguucaagugugcacug

SEQ ID NO: 742775 - RNA, 19 nt, Homo sapiens
gguucaccauguugcccag

SEQ ID NO: 742776 - RNA, 16 nt, Homo sapiens
gguucagaaaugcugc

SEQ ID NO: 742777 - RNA, 13 nt, Homo sapiens
gguucaugccauu

SEQ ID NO: 742778 - RNA, 21 nt, Homo sapiens
gguucauuagcgauccaugua

SEQ ID NO: 742779 - RNA, 22 nt, Homo sapiens
gguuccagggucccucugugua

SEQ ID NO: 742780 - RNA, 12 nt, Homo sapiens
gguuccauccac

SEQ ID NO: 742781 - RNA, 16 nt, Homo sapiens
gguuccccacacaggg

SEQ ID NO: 742782 - RNA, 11 nt, Homo sapiens
gguucucaggc

SEQ ID NO: 742783 - RNA, 16 nt, Homo sapiens
gguucuuacagcacau

SEQ ID NO: 742784 - RNA, 14 nt, Homo sapiens
gguucuugagccag

SEQ ID NO: 742785 - RNA, 22 nt, Homo sapiens
gguucuuuccaugcagacuccu

SEQ ID NO: 742786 - RNA, 13 nt, Homo sapiens
gguugaaaaccac

SEQ ID NO: 742787 - RNA, 21 nt, Homo sapiens
gguugaaacuguuaucacuua

SEQ ID NO: 742788 - RNA, 16 nt, Homo sapiens
gguugagggaaauugc

SEQ ID NO: 742789 - RNA, 16 nt, Homo sapiens
gguugcagugcugagc

SEQ ID NO: 742790 - RNA, 22 nt, Homo sapiens
gguugcagugcugagcuguggg

SEQ ID NO: 742791 - RNA, 18 nt, Homo sapiens
gguugcuguccucucauu

SEQ ID NO: 742792 - RNA, 15 nt, Homo sapiens
gguuggagugcagug

SEQ ID NO: 742793 - RNA, 22 nt, Homo sapiens
gguuggucaaggccaccucugc

SEQ ID NO: 742794 - RNA, 21 nt, Homo sapiens
gguuggucccauggguuaaga

SEQ ID NO: 742795 - RNA, 17 nt, Homo sapiens
gguuguuguuaaugaau

SEQ ID NO: 742796 - RNA, 15 nt, Homo sapiens
gguuuaccaguuuau

SEQ ID NO: 742797 - RNA, 19 nt, Homo sapiens
gguuuauucccaaguaugc

SEQ ID NO: 742798 - RNA, 20 nt, Homo sapiens
gguuucauguucacugugag

SEQ ID NO: 742799 - RNA, 23 nt, Homo sapiens
gguuuccgaaggguuuugcuaca

SEQ ID NO: 742800 - RNA, 22 nt, Homo sapiens
gguuuccuuuuggaacauuucu

SEQ ID NO: 742801 - RNA, 17 nt, Homo sapiens
gguuucucagaauccaa

SEQ ID NO: 742802 - RNA, 13 nt, Homo sapiens
gguuucuugcaag

SEQ ID NO: 742803 - RNA, 19 nt, Homo sapiens
gguuugaaagaugcagugg

SEQ ID NO: 742804 - RNA, 21 nt, Homo sapiens
gguuugccaaaauucauuucu

SEQ ID NO: 742805 - RNA, 16 nt, Homo sapiens
gguuugggcugucuua

SEQ ID NO: 742806 - RNA, 17 nt, Homo sapiens
gguuuuguguuuuguca

SEQ ID NO: 742807 - RNA, 22 nt, Homo sapiens
gguuuuuccuacuguccucaga

SEQ ID NO: 742808 - RNA, 18 nt, Homo sapiens
gguuuuuguuaccuuuau

SEQ ID NO: 742809 - RNA, 20 nt, Homo sapiens
gguuuuuuucuuuggcugca

SEQ ID NO: 742810 - RNA, 14 nt, Homo sapiens
guaaaaaaauauga

SEQ ID NO: 742811 - RNA, 14 nt, Homo sapiens
guaaaaacuuguac

SEQ ID NO: 742812 - RNA, 15 nt, Homo sapiens
guaaaacaaucuguu

SEQ ID NO: 742813 - RNA, 16 nt, Homo sapiens
guaaaacaaugccaug

SEQ ID NO: 742814 - RNA, 18 nt, Homo sapiens
guaaaacaugcuggugaa

SEQ ID NO: 742815 - RNA, 21 nt, Homo sapiens
gucauauuaauauauuuccau

SEQ ID NO: 742816 - RNA, 19 nt, Homo sapiens
gucaucaaacauuugccaa

SEQ ID NO: 742817 - RNA, 18 nt, Homo sapiens
gucaucaugaacuggcuu

SEQ ID NO: 742818 - RNA, 22 nt, Homo sapiens
gucauccaaacucaaacuugag

SEQ ID NO: 742819 - RNA, 23 nt, Homo sapiens
gucauccagucuauucacagaag

SEQ ID NO: 742820 - RNA, 16 nt, Homo sapiens
gucauccucccaccuc

SEQ ID NO: 742821 - RNA, 19 nt, Homo sapiens
gucauccugugaagggaca

SEQ ID NO: 742822 - RNA, 20 nt, Homo sapiens
gucaucuccaucagcuguaa

SEQ ID NO: 742823 - RNA, 20 nt, Homo sapiens
gucaucugcaugucuacuca

SEQ ID NO: 742824 - RNA, 21 nt, Homo sapiens
gucaucuuuuuccacuuugac

SEQ ID NO: 742825 - RNA, 15 nt, Homo sapiens
gucaugaagugcaca

SEQ ID NO: 742826 - RNA, 21 nt, Homo sapiens
gucaugacggggacagaguga

SEQ ID NO: 742827 - RNA, 15 nt, Homo sapiens
gucaugcacaugccu

SEQ ID NO: 742828 - RNA, 14 nt, Homo sapiens
gucauggaggccaa

SEQ ID NO: 742829 - RNA, 15 nt, Homo sapiens
gucauggcaccaaag

SEQ ID NO: 742830 - RNA, 23 nt, Homo sapiens
gucauggccugagaugcagguga

SEQ ID NO: 742831 - RNA, 16 nt, Homo sapiens
gucaugugcaccuuug

SEQ ID NO: 742832 - RNA, 23 nt, Homo sapiens
gucauuauagaugaguuuugcca

SEQ ID NO: 742833 - RNA, 14 nt, Homo sapiens
gucauucauucaag

SEQ ID NO: 742834 - RNA, 14 nt, Homo sapiens
gucauuguauguua

SEQ ID NO: 742835 - RNA, 17 nt, Homo sapiens
gucauuuuuaacagcau

SEQ ID NO: 742836 - RNA, 13 nt, Homo sapiens
guccaaaacugcc

SEQ ID NO: 742837 - RNA, 17 nt, Homo sapiens
guccaacgccgccuugg

SEQ ID NO: 742838 - RNA, 15 nt, Homo sapiens
guccacaaggggcuu

SEQ ID NO: 742839 - RNA, 14 nt, Homo sapiens
guccacacaucucc

SEQ ID NO: 742840 - RNA, 16 nt, Homo sapiens
guccaccccagugugc

SEQ ID NO: 742841 - RNA, 14 nt, Homo sapiens
guccacccuuccau

SEQ ID NO: 742842 - RNA, 18 nt, Homo sapiens
guccacucucggggcccu

SEQ ID NO: 742843 - RNA, 16 nt, Homo sapiens
guccacuuuacucaaa

SEQ ID NO: 742844 - RNA, 21 nt, Homo sapiens
guccagacccugaagauuuca

SEQ ID NO: 742845 - RNA, 12 nt, Homo sapiens
guccagcaaacu

SEQ ID NO: 742846 - RNA, 13 nt, Homo sapiens
guccagcacagaa

SEQ ID NO: 742847 - RNA, 18 nt, Homo sapiens
guccagccuuccaggugg

SEQ ID NO: 742848 - RNA, 15 nt, Homo sapiens
guccaggacuggguc

SEQ ID NO: 742849 - RNA, 17 nt, Homo sapiens
guccagggcuagugacu

SEQ ID NO: 742850 - RNA, 18 nt, Homo sapiens
guccagggcuagugacuu

SEQ ID NO: 742851 - RNA, 17 nt, Homo sapiens
guccaggucucacugcu

SEQ ID NO: 742852 - RNA, 23 nt, Homo sapiens
guccaugaaaucuuuaugugaua

SEQ ID NO: 742853 - RNA, 21 nt, Homo sapiens
guccauugauuuuaaccaaug

SEQ ID NO: 742854 - RNA, 19 nt, Homo sapiens
guccauuuugcccuuccau

SEQ ID NO: 742855 - RNA, 20 nt, Homo sapiens
gucccaauagcucuacugcc

SEQ ID NO: 742856 - RNA, 16 nt, Homo sapiens
gucccacccucccuag

SEQ ID NO: 742857 - RNA, 23 nt, Homo sapiens
gucccagaaugccuccugcaggg

SEQ ID NO: 742858 - RNA, 15 nt, Homo sapiens
gucccagacaauucc

SEQ ID NO: 742859 - RNA, 19 nt, Homo sapiens
gucccagagguuaucugcc

SEQ ID NO: 742860 - RNA, 14 nt, Homo sapiens
gucccagcuacuca

SEQ ID NO: 742861 - RNA, 18 nt, Homo sapiens
gucccagcuacucaggag

SEQ ID NO: 742862 - RNA, 13 nt, Homo sapiens
gucccaugaccca

SEQ ID NO: 742863 - RNA, 14 nt, Homo sapiens
gucccauuccucag

SEQ ID NO: 742864 - RNA, 17 nt, Homo sapiens
guccccacgaacuggcc

SEQ ID NO: 742865 - RNA, 20 nt, Homo sapiens
guccccgaugcugaccucac

SEQ ID NO: 742866 - RNA, 16 nt, Homo sapiens
guccccuacucccucu

SEQ ID NO: 742867 - RNA, 18 nt, Homo sapiens
gucccggggccagcacuu

SEQ ID NO: 742868 - RNA, 15 nt, Homo sapiens
gucccuccaaagggc

SEQ ID NO: 742869 - RNA, 16 nt, Homo sapiens
gucccuccacauuucc

SEQ ID NO: 742870 - RNA, 16 nt, Homo sapiens
gucccucucagugccu

SEQ ID NO: 742871 - RNA, 15 nt, Homo sapiens
gucccuggacacagc

SEQ ID NO: 742872 - RNA, 22 nt, Homo sapiens
gucccuguuuucccacgaggaa

SEQ ID NO: 742873 - RNA, 13 nt, Homo sapiens
gucccuugccucu

SEQ ID NO: 742874 - RNA, 22 nt, Homo sapiens
gucccuugcuugccugcagggc

SEQ ID NO: 742875 - RNA, 19 nt, Homo sapiens
guccgagucucagcccuga

SEQ ID NO: 742876 - RNA, 14 nt, Homo sapiens
guccgcaccagcug

SEQ ID NO: 742877 - RNA, 20 nt, Homo sapiens
guccgcgcgccagcacagaa

SEQ ID NO: 742878 - RNA, 22 nt, Homo sapiens
guccgugaauggucucugucaa

SEQ ID NO: 742879 - RNA, 14 nt, Homo sapiens
guccuaccuauuau

SEQ ID NO: 742880 - RNA, 16 nt, Homo sapiens
guccuaggacuuaaaa

SEQ ID NO: 742881 - RNA, 15 nt, Homo sapiens
guccucauucuugcc

SEQ ID NO: 742882 - RNA, 21 nt, Homo sapiens
guccuccaccaugcacucacc

SEQ ID NO: 742883 - RNA, 20 nt, Homo sapiens
guccucccaauuucagacuc

SEQ ID NO: 742884 - RNA, 16 nt, Homo sapiens
guccucccagcugcca

SEQ ID NO: 742885 - RNA, 16 nt, Homo sapiens
guccucccaggccagg

SEQ ID NO: 742886 - RNA, 14 nt, Homo sapiens
guccucgagcaacu

SEQ ID NO: 742887 - RNA, 15 nt, Homo sapiens
guccucucugaguca

SEQ ID NO: 742888 - RNA, 15 nt, Homo sapiens
guccugaagcugcug

SEQ ID NO: 742889 - RNA, 16 nt, Homo sapiens
guccugaccugucuca

SEQ ID NO: 742890 - RNA, 16 nt, Homo sapiens
guccugauggcccaaa

SEQ ID NO: 742891 - RNA, 13 nt, Homo sapiens
guccugccggugg

SEQ ID NO: 742892 - RNA, 15 nt, Homo sapiens
guccugcuguggaaa

SEQ ID NO: 742893 - RNA, 19 nt, Homo sapiens
guccuggaaucacauucuu

SEQ ID NO: 742894 - RNA, 18 nt, Homo sapiens
guccugggauuacaggug

SEQ ID NO: 742895 - RNA, 19 nt, Homo sapiens
guccugggauuacaggugu

SEQ ID NO: 742896 - RNA, 22 nt, Homo sapiens
guccugggcauggguccagggc

SEQ ID NO: 742897 - RNA, 14 nt, Homo sapiens
guccuguucuuccu

SEQ ID NO: 742898 - RNA, 22 nt, Homo sapiens
guccuuagcaaggggcucagaa

SEQ ID NO: 742899 - RNA, 21 nt, Homo sapiens
guccuuccuaccucuguggug

SEQ ID NO: 742900 - RNA, 18 nt, Homo sapiens
guccuucgcccugugcac

SEQ ID NO: 742901 - RNA, 22 nt, Homo sapiens
guccuuucccaccauuccugcc

SEQ ID NO: 742902 - RNA, 13 nt, Homo sapiens
guccuuucuugca

SEQ ID NO: 742903 - RNA, 16 nt, Homo sapiens
gucgaaagcucuagaa

SEQ ID NO: 742904 - RNA, 13 nt, Homo sapiens
gucgacuagggga

SEQ ID NO: 742905 - RNA, 16 nt, Homo sapiens
gucgacuucaugacaa

SEQ ID NO: 742906 - RNA, 13 nt, Homo sapiens
gucgagaucucag

SEQ ID NO: 742907 - RNA, 11 nt, Homo sapiens
gucgucucuuc

SEQ ID NO: 742908 - RNA, 23 nt, Homo sapiens
gucuaaaaauaaaaugcauuuaa

SEQ ID NO: 742909 - RNA, 14 nt, Homo sapiens
gucuaaaagcagaa

SEQ ID NO: 742910 - RNA, 13 nt, Homo sapiens
gucuaaagcuuug

SEQ ID NO: 742911 - RNA, 14 nt, Homo sapiens
gucuaacaguuaau

SEQ ID NO: 742912 - RNA, 13 nt, Homo sapiens
gucuaacugcugu

SEQ ID NO: 742913 - RNA, 14 nt, Homo sapiens
gucuacaugugcca

SEQ ID NO: 742914 - RNA, 18 nt, Homo sapiens
gucuacucagcauuugau

SEQ ID NO: 742915 - RNA, 18 nt, Homo sapiens
gucuacuugaguuagcau

SEQ ID NO: 742916 - RNA, 18 nt, Homo sapiens
gucuagucacgcaugcag

SEQ ID NO: 742917 - RNA, 15 nt, Homo sapiens
gucuauuuucagagc

SEQ ID NO: 742918 - RNA, 21 nt, Homo sapiens
gucuauuuucucagucauuuu

SEQ ID NO: 742919 - RNA, 16 nt, Homo sapiens
gucucaaaccaagcaa

SEQ ID NO: 742920 - RNA, 21 nt, Homo sapiens
gucucaaaccaagcaaaggaa

SEQ ID NO: 742921 - RNA, 19 nt, Homo sapiens
gucucaaacuccugaccuc

SEQ ID NO: 742922 - RNA, 19 nt, Homo sapiens
gucucaauucuuuguauau

SEQ ID NO: 742923 - RNA, 17 nt, Homo sapiens
gucucagcuaagcucac

SEQ ID NO: 742924 - RNA, 15 nt, Homo sapiens
gucucaguuucacuu

SEQ ID NO: 742925 - RNA, 13 nt, Homo sapiens
gucucauguggaa

SEQ ID NO: 742926 - RNA, 16 nt, Homo sapiens
gucucauuuagaacuu

SEQ ID NO: 742927 - RNA, 22 nt, Homo sapiens
gucucauuucucauaauuuugc

SEQ ID NO: 742928 - RNA, 17 nt, Homo sapiens
gucuccaggggccugca

SEQ ID NO: 742929 - RNA, 18 nt, Homo sapiens
gucuccaucucugucuca

SEQ ID NO: 742930 - RNA, 22 nt, Homo sapiens
guuaacuuuuguaccaaauagc

SEQ ID NO: 742931 - RNA, 17 nt, Homo sapiens
guuaagaacaucaaaac

SEQ ID NO: 742932 - RNA, 14 nt, Homo sapiens
guuaaguccuuggc

SEQ ID NO: 742933 - RNA, 21 nt, Homo sapiens
guuaaguuucucuucaccccu

SEQ ID NO: 742934 - RNA, 16 nt, Homo sapiens
guuaauaccagcuuaa

SEQ ID NO: 742935 - RNA, 16 nt, Homo sapiens
guuaauucagcacuga

SEQ ID NO: 742936 - RNA, 14 nt, Homo sapiens
guuacauaagauaa

SEQ ID NO: 742937 - RNA, 15 nt, Homo sapiens
guuaccuacuuugac

SEQ ID NO: 742938 - RNA, 14 nt, Homo sapiens
guuaccucugcaug

SEQ ID NO: 742939 - RNA, 17 nt, Homo sapiens
guuaccucugcauggaa

SEQ ID NO: 742940 - RNA, 20 nt, Homo sapiens
guuacuaaauuuucuaauua

SEQ ID NO: 742941 - RNA, 19 nt, Homo sapiens
guuacugcaguucaucuca

SEQ ID NO: 742942 - RNA, 11 nt, Homo sapiens
guuacugcuga

SEQ ID NO: 742943 - RNA, 19 nt, Homo sapiens
guuacugcuugaccaaaga

SEQ ID NO: 742944 - RNA, 16 nt, Homo sapiens
guuacuguggucacuu

SEQ ID NO: 742945 - RNA, 16 nt, Homo sapiens
guuacuguugcacuga

SEQ ID NO: 742946 - RNA, 21 nt, Homo sapiens
guuagaggccagccuggcgaa

SEQ ID NO: 742947 - RNA, 13 nt, Homo sapiens
guuagcagcacgu

SEQ ID NO: 742948 - RNA, 15 nt, Homo sapiens
guuaggauucaggca

SEQ ID NO: 742949 - RNA, 14 nt, Homo sapiens
guuaggcucacagu

SEQ ID NO: 742950 - RNA, 19 nt, Homo sapiens
guuagucaauccugucaua

SEQ ID NO: 742951 - RNA, 24 nt, Homo sapiens
guuagucaauccugucauauaaua

SEQ ID NO: 742952 - RNA, 22 nt, Homo sapiens
guuagugcuaguggauuuuaca

SEQ ID NO: 742953 - RNA, 17 nt, Homo sapiens
guuauaaaucaauguca

SEQ ID NO: 742954 - RNA, 20 nt, Homo sapiens
guuauaagcagcaagacaaa

SEQ ID NO: 742955 - RNA, 22 nt, Homo sapiens
guuauaauaauguuaacaugga

SEQ ID NO: 742956 - RNA, 18 nt, Homo sapiens
guuauaauuacuaaugua

SEQ ID NO: 742957 - RNA, 14 nt, Homo sapiens
guuauaguugauau

SEQ ID NO: 742958 - RNA, 16 nt, Homo sapiens
guuauauccaauagua

SEQ ID NO: 742959 - RNA, 18 nt, Homo sapiens
guuaucaaaaaguauuau

SEQ ID NO: 742960 - RNA, 12 nt, Homo sapiens
guuaucacuuau

SEQ ID NO: 742961 - RNA, 16 nt, Homo sapiens
guuauccccuccuuua

SEQ ID NO: 742962 - RNA, 17 nt, Homo sapiens
guuaucuuccacuggaa

SEQ ID NO: 742963 - RNA, 17 nt, Homo sapiens
guuaugauguaaucucu

SEQ ID NO: 742964 - RNA, 18 nt, Homo sapiens
guuaugggcacaugccuu

SEQ ID NO: 742965 - RNA, 16 nt, Homo sapiens
guuaugugcaguacuu

SEQ ID NO: 742966 - RNA, 14 nt, Homo sapiens
guuauguuugcacu

SEQ ID NO: 742967 - RNA, 17 nt, Homo sapiens
guuauguuugcacuuug

SEQ ID NO: 742968 - RNA, 18 nt, Homo sapiens
guuauguuugcacuuugu

SEQ ID NO: 742969 - RNA, 14 nt, Homo sapiens
guuauuauuuacug

SEQ ID NO: 742970 - RNA, 17 nt, Homo sapiens
guuauuauuuugcacug

SEQ ID NO: 742971 - RNA, 16 nt, Homo sapiens
guuauucaaguauuca

SEQ ID NO: 742972 - RNA, 13 nt, Homo sapiens
guuauucucuuca

SEQ ID NO: 742973 - RNA, 11 nt, Homo sapiens
guuauucuguu

SEQ ID NO: 742974 - RNA, 15 nt, Homo sapiens
guuauucuuugcacu

SEQ ID NO: 742975 - RNA, 21 nt, Homo sapiens
guuauuuagggaacugcuuga

SEQ ID NO: 742976 - RNA, 16 nt, Homo sapiens
guucaaagaugcauuu

SEQ ID NO: 742977 - RNA, 20 nt, Homo sapiens
guucaaucucccgcugcugc

SEQ ID NO: 742978 - RNA, 16 nt, Homo sapiens
guucacaaacuaccuc

SEQ ID NO: 742979 - RNA, 18 nt, Homo sapiens
guucaccauguugcccag

SEQ ID NO: 742980 - RNA, 22 nt, Homo sapiens
guucagaccaaugcucaacucc

SEQ ID NO: 742981 - RNA, 20 nt, Homo sapiens
guucaggagucccaaggaaa

SEQ ID NO: 742982 - RNA, 12 nt, Homo sapiens
guucaggccagu

SEQ ID NO: 742983 - RNA, 20 nt, Homo sapiens
guucagugagguucuugggu

SEQ ID NO: 742984 - RNA, 20 nt, Homo sapiens
guucaucccugagaggucug

SEQ ID NO: 742985 - RNA, 16 nt, Homo sapiens
guucauccgcacugua

SEQ ID NO: 742986 - RNA, 17 nt, Homo sapiens
guucauuuuagugacug

SEQ ID NO: 742987 - RNA, 18 nt, Homo sapiens
guuccaaguauuuugcca

SEQ ID NO: 742988 - RNA, 17 nt, Homo sapiens
guuccaaugucaaugug

SEQ ID NO: 742989 - RNA, 19 nt, Homo sapiens
guuccaaugucaaugugaa

SEQ ID NO: 742990 - RNA, 21 nt, Homo sapiens
guuccauauagacaccaagga

SEQ ID NO: 742991 - RNA, 13 nt, Homo sapiens
guucccauuauua

SEQ ID NO: 742992 - RNA, 17 nt, Homo sapiens
guucccauuucagcuga

SEQ ID NO: 742993 - RNA, 13 nt, Homo sapiens
guuccccacugac

SEQ ID NO: 742994 - RNA, 18 nt, Homo sapiens
guuccccgauaccaugcu

SEQ ID NO: 742995 - RNA, 15 nt, Homo sapiens
guuccccuucaguac

SEQ ID NO: 742996 - RNA, 16 nt, Homo sapiens
guucccgacaccagaa

SEQ ID NO: 742997 - RNA, 21 nt, Homo sapiens
guuccgaagaagaugcuccag

SEQ ID NO: 742998 - RNA, 12 nt, Homo sapiens
guuccucaaaag

SEQ ID NO: 742999 - RNA, 19 nt, Homo sapiens
guuccugaaaauugcaaua

SEQ ID NO: 743000 - RNA, 15 nt, Homo sapiens
guuccugcgcugcaa

SEQ ID NO: 743001 - RNA, 17 nt, Homo sapiens
guuccugcuccaugacu

SEQ ID NO: 743002 - RNA, 18 nt, Homo sapiens
guuccuucacauccugug

SEQ ID NO: 743003 - RNA, 13 nt, Homo sapiens
guucgcuuaucaa

SEQ ID NO: 743004 - RNA, 12 nt, Homo sapiens
guucgugcugug

SEQ ID NO: 743005 - RNA, 20 nt, Homo sapiens
guucguucuguacuguuacu

SEQ ID NO: 743006 - RNA, 17 nt, Homo sapiens
guucuaaaguucuaaga

SEQ ID NO: 743007 - RNA, 13 nt, Homo sapiens
guucuacacugau

SEQ ID NO: 743008 - RNA, 15 nt, Homo sapiens
guucuagucaugugu

SEQ ID NO: 743009 - RNA, 16 nt, Homo sapiens
guucuauccccaagcu

SEQ ID NO: 743010 - RNA, 20 nt, Homo sapiens
guucuauuuaacaacugggu

SEQ ID NO: 743011 - RNA, 22 nt, Homo sapiens
guucucaaauauuugcuaugaa

SEQ ID NO: 743012 - RNA, 20 nt, Homo sapiens
guucucagguguugccaaau

SEQ ID NO: 743013 - RNA, 13 nt, Homo sapiens
guucucauuugau

SEQ ID NO: 743014 - RNA, 20 nt, Homo sapiens
guucucuucuuuaaagggau

SEQ ID NO: 743015 - RNA, 14 nt, Homo sapiens
guucugaacuggaa

SEQ ID NO: 743016 - RNA, 15 nt, Homo sapiens
guucugagcaccgug

SEQ ID NO: 743017 - RNA, 14 nt, Homo sapiens
guucugcacugaaa

SEQ ID NO: 743018 - RNA, 22 nt, Homo sapiens
guucuguauuuuuaaauugcca

SEQ ID NO: 743019 - RNA, 15 nt, Homo sapiens
guucugucuucccaa

SEQ ID NO: 743020 - RNA, 16 nt, Homo sapiens
guucuguuuggcacuu

SEQ ID NO: 743021 - RNA, 11 nt, Homo sapiens
guucuuaccug

SEQ ID NO: 743022 - RNA, 13 nt, Homo sapiens
guucuuagagugu

SEQ ID NO: 743023 - RNA, 13 nt, Homo sapiens
guucuuaguguca

SEQ ID NO: 743024 - RNA, 19 nt, Homo sapiens
guucuucuguucugcagac

SEQ ID NO: 743025 - RNA, 16 nt, Homo sapiens
guucuucuucauugaa

SEQ ID NO: 743026 - RNA, 23 nt, Homo sapiens
guucuuguguccugguaauuccu

SEQ ID NO: 743027 - RNA, 12 nt, Homo sapiens
guucuuuccucc

SEQ ID NO: 743028 - RNA, 15 nt, Homo sapiens
guucuuugggccaga

SEQ ID NO: 743029 - RNA, 12 nt, Homo sapiens
guugaaaaccac

SEQ ID NO: 743030 - RNA, 14 nt, Homo sapiens
guugaaaaccacag

SEQ ID NO: 743031 - RNA, 15 nt, Homo sapiens
guugaaaaccacagu

SEQ ID NO: 743032 - RNA, 17 nt, Homo sapiens
guugaaaaccacaguca

SEQ ID NO: 743033 - RNA, 20 nt, Homo sapiens
guugaaaaccacagucagug

SEQ ID NO: 743034 - RNA, 14 nt, Homo sapiens
guugaaagacauca

SEQ ID NO: 743035 - RNA, 21 nt, Homo sapiens
guugacguuugcucauuuaag

SEQ ID NO: 743036 - RNA, 21 nt, Homo sapiens
guugacugugauuagaucaca

SEQ ID NO: 743037 - RNA, 15 nt, Homo sapiens
guugagaaguuccca

SEQ ID NO: 743038 - RNA, 19 nt, Homo sapiens
guugagaguugcuggugua

SEQ ID NO: 743039 - RNA, 13 nt, Homo sapiens
guugagauccagu

SEQ ID NO: 743040 - RNA, 15 nt, Homo sapiens
guugagauccagugc

SEQ ID NO: 743041 - RNA, 13 nt, Homo sapiens
guugagauuugac

SEQ ID NO: 743042 - RNA, 18 nt, Homo sapiens
guugagccccaaguccug

SEQ ID NO: 743043 - RNA, 12 nt, Homo sapiens
guugaguguuca

SEQ ID NO: 743044 - RNA, 21 nt, Homo sapiens
guugaguuaugauaacaccag

SEQ ID NO: 743045 - RNA, 12 nt, Homo sapiens
guugaguucaag

SEQ ID NO: 743046 - RNA, 18 nt, Homo sapiens
uaaauaagagauuuggag

SEQ ID NO: 743047 - RNA, 14 nt, Homo sapiens
uaaauaauugcucc

SEQ ID NO: 743048 - RNA, 12 nt, Homo sapiens
uaaauacagaca

SEQ ID NO: 743049 - RNA, 11 nt, Homo sapiens
uaaauacaggu

SEQ ID NO: 743050 - RNA, 13 nt, Homo sapiens
uaaauacagguag

SEQ ID NO: 743051 - RNA, 13 nt, Homo sapiens
uaaauacccauau

SEQ ID NO: 743052 - RNA, 18 nt, Homo sapiens
uaaauacccaucuucauu

SEQ ID NO: 743053 - RNA, 17 nt, Homo sapiens
uaaauacucagugauga

SEQ ID NO: 743054 - RNA, 15 nt, Homo sapiens
uaaauagaccucuca

SEQ ID NO: 743055 - RNA, 21 nt, Homo sapiens
uaaauagaguauaugcacuuu

SEQ ID NO: 743056 - RNA, 17 nt, Homo sapiens
uaaauaggaaucauuca

SEQ ID NO: 743057 - RNA, 13 nt, Homo sapiens
uaaauaguuugaa

SEQ ID NO: 743058 - RNA, 16 nt, Homo sapiens
uaaauauacuaugaaa

SEQ ID NO: 743059 - RNA, 15 nt, Homo sapiens
uaaauauauauguca

SEQ ID NO: 743060 - RNA, 18 nt, Homo sapiens
uaaauauccacaguacuc

SEQ ID NO: 743061 - RNA, 19 nt, Homo sapiens
uaaauauccacaguacuca

SEQ ID NO: 743062 - RNA, 13 nt, Homo sapiens
uaaauaugaagga

SEQ ID NO: 743063 - RNA, 15 nt, Homo sapiens
uaaauaugaaugaac

SEQ ID NO: 743064 - RNA, 13 nt, Homo sapiens
uaaauaugcaucu

SEQ ID NO: 743065 - RNA, 21 nt, Homo sapiens
uaaauauuagaagccugcaga

SEQ ID NO: 743066 - RNA, 14 nt, Homo sapiens
uaaauauugucaua

SEQ ID NO: 743067 - RNA, 17 nt, Homo sapiens
uaaauauuuugguucau

SEQ ID NO: 743068 - RNA, 14 nt, Homo sapiens
uaaaucaaauauuc

SEQ ID NO: 743069 - RNA, 18 nt, Homo sapiens
uaaaucaauuacagauua

SEQ ID NO: 743070 - RNA, 22 nt, Homo sapiens
uaaauccaacuuucacagugaa

SEQ ID NO: 743071 - RNA, 19 nt, Homo sapiens
uaaauccaucacuauaaua

SEQ ID NO: 743072 - RNA, 17 nt, Homo sapiens
uaaauccauccauccaa

SEQ ID NO: 743073 - RNA, 16 nt, Homo sapiens
uaaauccaugcaccua

SEQ ID NO: 743074 - RNA, 21 nt, Homo sapiens
uaaaucccaagaaauggaauc

SEQ ID NO: 743075 - RNA, 20 nt, Homo sapiens
uaaauccucauguuacucag

SEQ ID NO: 743076 - RNA, 18 nt, Homo sapiens
uaaauccuuugcuucauu

SEQ ID NO: 743077 - RNA, 12 nt, Homo sapiens
uaaaucuaacaa

SEQ ID NO: 743078 - RNA, 18 nt, Homo sapiens
uaaaucuagaguuuauac

SEQ ID NO: 743079 - RNA, 14 nt, Homo sapiens
uaaaucugugauga

SEQ ID NO: 743080 - RNA, 20 nt, Homo sapiens
uaaaucugugaugauccuca

SEQ ID NO: 743081 - RNA, 18 nt, Homo sapiens
uaaaucuuccuugugagg

SEQ ID NO: 743082 - RNA, 24 nt, Homo sapiens
uaaaugaagaaaaguauugcaccu

SEQ ID NO: 743083 - RNA, 14 nt, Homo sapiens
uaaaugacaaugua

SEQ ID NO: 743084 - RNA, 16 nt, Homo sapiens
uaaaugacacuacuug

SEQ ID NO: 743085 - RNA, 15 nt, Homo sapiens
uaaaugagcuaugua

SEQ ID NO: 743086 - RNA, 18 nt, Homo sapiens
uaaaugauuauauucaca

SEQ ID NO: 743087 - RNA, 19 nt, Homo sapiens
uaaaugggaauucucaggu

SEQ ID NO: 743088 - RNA, 17 nt, Homo sapiens
uaaaugggacuggaguc

SEQ ID NO: 743089 - RNA, 16 nt, Homo sapiens
uaaauguaaucacgag

SEQ ID NO: 743090 - RNA, 14 nt, Homo sapiens
uaaauguaucuuau

SEQ ID NO: 743091 - RNA, 16 nt, Homo sapiens
uaaauguauuccugua

SEQ ID NO: 743092 - RNA, 21 nt, Homo sapiens
uaaauguauuuaauuccauau

SEQ ID NO: 743093 - RNA, 23 nt, Homo sapiens
uaaauuaacucaccagauuuacu

SEQ ID NO: 743094 - RNA, 14 nt, Homo sapiens
uaaauuauugcugu

SEQ ID NO: 743095 - RNA, 22 nt, Homo sapiens
uaaauuauuuauuuauggagga

SEQ ID NO: 743096 - RNA, 16 nt, Homo sapiens
uaaauucaacuuugua

SEQ ID NO: 743097 - RNA, 18 nt, Homo sapiens
uaaauucagaaagucaua

SEQ ID NO: 743098 - RNA, 17 nt, Homo sapiens
uaaauucagaacaagca

SEQ ID NO: 743099 - RNA, 17 nt, Homo sapiens
uaaauucuaagccauau

SEQ ID NO: 743100 - RNA, 17 nt, Homo sapiens
uaaauuuaauauacugc

SEQ ID NO: 743101 - RNA, 15 nt, Homo sapiens
uaaauuuaauuuaca

SEQ ID NO: 743102 - RNA, 17 nt, Homo sapiens
uaaauuuggacugucua

SEQ ID NO: 743103 - RNA, 17 nt, Homo sapiens
uaaauuugguucuaggc

SEQ ID NO: 743104 - RNA, 18 nt, Homo sapiens
uaaauuuguaacuuugca

SEQ ID NO: 743105 - RNA, 21 nt, Homo sapiens
uaaauuuguacuauuuaacug

SEQ ID NO: 743106 - RNA, 14 nt, Homo sapiens
uaaauuuguguucu

SEQ ID NO: 743107 - RNA, 16 nt, Homo sapiens
uaaauuuguguucuca

SEQ ID NO: 743108 - RNA, 18 nt, Homo sapiens
uaaauuuuauaacagaau

SEQ ID NO: 743109 - RNA, 21 nt, Homo sapiens
uaaauuuugaaaacugugcaa

SEQ ID NO: 743110 - RNA, 18 nt, Homo sapiens
uaaauuuuuuuuggucaa

SEQ ID NO: 743111 - RNA, 19 nt, Homo sapiens
uaacaacaauaacacuguc

SEQ ID NO: 743112 - RNA, 17 nt, Homo sapiens
uaacaagaccucagugc

SEQ ID NO: 743113 - RNA, 15 nt, Homo sapiens
uaacaagaguuuuaa

SEQ ID NO: 743114 - RNA, 21 nt, Homo sapiens
uaacaagggcugcaaugcccu

SEQ ID NO: 743115 - RNA, 20 nt, Homo sapiens
uaacaaguagcacccuggau

SEQ ID NO: 743116 - RNA, 16 nt, Homo sapiens
uaacacacuggccauu

SEQ ID NO: 743117 - RNA, 21 nt, Homo sapiens
uaacacagccguguguucaaa

SEQ ID NO: 743118 - RNA, 20 nt, Homo sapiens
uaacaccaucgaucaugaug

SEQ ID NO: 743119 - RNA, 21 nt, Homo sapiens
uaacacccuuuagaaccuuaa

SEQ ID NO: 743120 - RNA, 13 nt, Homo sapiens
uaacaccugccua

SEQ ID NO: 743121 - RNA, 17 nt, Homo sapiens
uaacacgcugccugguc

SEQ ID NO: 743122 - RNA, 16 nt, Homo sapiens
uaacacggugcucauu

SEQ ID NO: 743123 - RNA, 13 nt, Homo sapiens
uaacacugugaag

SEQ ID NO: 743124 - RNA, 17 nt, Homo sapiens
uaacagaguaucagauc

SEQ ID NO: 743125 - RNA, 20 nt, Homo sapiens
uaacagaguaucagaucuau

SEQ ID NO: 743126 - RNA, 21 nt, Homo sapiens
uaacagauggaaaaacugagg

SEQ ID NO: 743127 - RNA, 22 nt, Homo sapiens
uaacagauggaaaaacugaggc

SEQ ID NO: 743128 - RNA, 18 nt, Homo sapiens
uaacagaugggcuggaag

SEQ ID NO: 743129 - RNA, 14 nt, Homo sapiens
uaacagcaaauaac

SEQ ID NO: 743130 - RNA, 18 nt, Homo sapiens
uaacaggauauuuaauga

SEQ ID NO: 743131 - RNA, 20 nt, Homo sapiens
uaacagggagacugcaucuc

SEQ ID NO: 743132 - RNA, 21 nt, Homo sapiens
uaacaguucauguuugcuuca

SEQ ID NO: 743133 - RNA, 15 nt, Homo sapiens
uaacaguuuuuuaca

SEQ ID NO: 743134 - RNA, 15 nt, Homo sapiens
uaacaucaccacugu

SEQ ID NO: 743135 - RNA, 14 nt, Homo sapiens
uaacaucugaccug

SEQ ID NO: 743136 - RNA, 18 nt, Homo sapiens
uaacaugauuguuugaca

SEQ ID NO: 743137 - RNA, 15 nt, Homo sapiens
uaacauguauacaaa

SEQ ID NO: 743138 - RNA, 14 nt, Homo sapiens
uaacauucaguucc

SEQ ID NO: 743139 - RNA, 12 nt, Homo sapiens
uaacauucccac

SEQ ID NO: 743140 - RNA, 14 nt, Homo sapiens
uaaccaaauuuuga

SEQ ID NO: 743141 - RNA, 19 nt, Homo sapiens
uaaccauccccaacuccau

SEQ ID NO: 743142 - RNA, 20 nt, Homo sapiens
uaacccaaaucuuguuuaca

SEQ ID NO: 743143 - RNA, 23 nt, Homo sapiens
uaacccaugaaggauaaaagccc

SEQ ID NO: 743144 - RNA, 20 nt, Homo sapiens
uaacccgcucaucacuggau

SEQ ID NO: 743145 - RNA, 22 nt, Homo sapiens
uaacccuauccuaauuguccac

SEQ ID NO: 743146 - RNA, 21 nt, Homo sapiens
uaacccucacaagcaugaagu

SEQ ID NO: 743147 - RNA, 16 nt, Homo sapiens
uaaccgcacaugcaca

SEQ ID NO: 743148 - RNA, 15 nt, Homo sapiens
uaaccuagauguuua

SEQ ID NO: 743149 - RNA, 17 nt, Homo sapiens
uaaccucaaagugacua

SEQ ID NO: 743150 - RNA, 19 nt, Homo sapiens
uaaccucagugucauuuau

SEQ ID NO: 743151 - RNA, 18 nt, Homo sapiens
uaaccucugcacuacuga

SEQ ID NO: 743152 - RNA, 16 nt, Homo sapiens
uaaccucuucaccuua

SEQ ID NO: 743153 - RNA, 23 nt, Homo sapiens
uaaccugacagaggugucaucca

SEQ ID NO: 743154 - RNA, 17 nt, Homo sapiens
uaacguccacuagcuua

SEQ ID NO: 743155 - RNA, 16 nt, Homo sapiens
uaacguucugcugcuu

SEQ ID NO: 743156 - RNA, 21 nt, Homo sapiens
uaacuaaaagguaugcaauca

SEQ ID NO: 743157 - RNA, 17 nt, Homo sapiens
uaacuagaauuuauuca

SEQ ID NO: 743158 - RNA, 17 nt, Homo sapiens
uaacuauaacaaucacu

SEQ ID NO: 743159 - RNA, 18 nt, Homo sapiens
uaacuauaacaaucacug

SEQ ID NO: 743160 - RNA, 15 nt, Homo sapiens
uaacuauacuugaua

SEQ ID NO: 743161 - RNA, 23 nt, Homo sapiens
uauuccccccacuuaagacugug

SEQ ID NO: 743162 - RNA, 19 nt, Homo sapiens
uauucucacuccaccaccc

SEQ ID NO: 743163 - RNA, 15 nt, Homo sapiens
uauucucugcaauuu

SEQ ID NO: 743164 - RNA, 16 nt, Homo sapiens
uauucucugcaauuug

SEQ ID NO: 743165 - RNA, 17 nt, Homo sapiens
uauucucuuaaaagaca

SEQ ID NO: 743166 - RNA, 19 nt, Homo sapiens
uauucugccuuccaguuug

SEQ ID NO: 743167 - RNA, 16 nt, Homo sapiens
uauucuguaguugcag

SEQ ID NO: 743168 - RNA, 21 nt, Homo sapiens
uauucuguuugcguacuugua

SEQ ID NO: 743169 - RNA, 15 nt, Homo sapiens
uauucuuguucaggg

SEQ ID NO: 743170 - RNA, 21 nt, Homo sapiens
uauugaacuuuuguacugaau

SEQ ID NO: 743171 - RNA, 23 nt, Homo sapiens
uauugaagguuuuagacccauag

SEQ ID NO: 743172 - RNA, 15 nt, Homo sapiens
uauugacuucaauga

SEQ ID NO: 743173 - RNA, 18 nt, Homo sapiens
uauugaugagagggaaaa

SEQ ID NO: 743174 - RNA, 19 nt, Homo sapiens
uauugcaugcucaacuuag

SEQ ID NO: 743175 - RNA, 14 nt, Homo sapiens
uauugcgcugcuac

SEQ ID NO: 743176 - RNA, 17 nt, Homo sapiens
uauugcugcaaacacuu

SEQ ID NO: 743177 - RNA, 19 nt, Homo sapiens
uauugcuguugcuuaucau

SEQ ID NO: 743178 - RNA, 19 nt, Homo sapiens
uauugcuuaccugaucuca

SEQ ID NO: 743179 - RNA, 17 nt, Homo sapiens
uauuggaagcauacaaa

SEQ ID NO: 743180 - RNA, 19 nt, Homo sapiens
uauuggacuccaggccuga

SEQ ID NO: 743181 - RNA, 14 nt, Homo sapiens
uauuggcagcucua

SEQ ID NO: 743182 - RNA, 13 nt, Homo sapiens
uauuggggaacag

SEQ ID NO: 743183 - RNA, 16 nt, Homo sapiens
uauugguauggacaaa

SEQ ID NO: 743184 - RNA, 14 nt, Homo sapiens
uauugguguuuacc

SEQ ID NO: 743185 - RNA, 23 nt, Homo sapiens
uauugucauaggauuaagcaguu

SEQ ID NO: 743186 - RNA, 22 nt, Homo sapiens
uauugucugucucuauauugcu

SEQ ID NO: 743187 - RNA, 17 nt, Homo sapiens
uauugugaaguacauau

SEQ ID NO: 743188 - RNA, 21 nt, Homo sapiens
uauugugcacaagucuuucca

SEQ ID NO: 743189 - RNA, 22 nt, Homo sapiens
uauuguggauguguucauucaa

SEQ ID NO: 743190 - RNA, 20 nt, Homo sapiens
uauuuaaauuguuuuggacg

SEQ ID NO: 743191 - RNA, 13 nt, Homo sapiens
uauuuaacaugua

SEQ ID NO: 743192 - RNA, 14 nt, Homo sapiens
uauuuaagccuuuu

SEQ ID NO: 743193 - RNA, 20 nt, Homo sapiens
uauuuaauuuuaacugccaa

SEQ ID NO: 743194 - RNA, 22 nt, Homo sapiens
uauuuacagaaaagacucugac

SEQ ID NO: 743195 - RNA, 18 nt, Homo sapiens
uauuuacauacaggccau

SEQ ID NO: 743196 - RNA, 18 nt, Homo sapiens
uauuuagacucaucuuac

SEQ ID NO: 743197 - RNA, 13 nt, Homo sapiens
uauuuagaucuca

SEQ ID NO: 743198 - RNA, 22 nt, Homo sapiens
uauuuaguuuuuaacaaucuaa

SEQ ID NO: 743199 - RNA, 18 nt, Homo sapiens
uauuuauaagagugccgu

SEQ ID NO: 743200 - RNA, 16 nt, Homo sapiens
uauuuauacuuugcaa

SEQ ID NO: 743201 - RNA, 15 nt, Homo sapiens
uauuuauagucacaa

SEQ ID NO: 743202 - RNA, 19 nt, Homo sapiens
uauuuaucagugacagagu

SEQ ID NO: 743203 - RNA, 20 nt, Homo sapiens
uauuuauccaaaauguguau

SEQ ID NO: 743204 - RNA, 21 nt, Homo sapiens
uauuuauccagaaaacuguga

SEQ ID NO: 743205 - RNA, 16 nt, Homo sapiens
uauuuaucugugcaaa

SEQ ID NO: 743206 - RNA, 13 nt, Homo sapiens
uauuuaugaaggc

SEQ ID NO: 743207 - RNA, 21 nt, Homo sapiens
uauuuaugaccuuauaguguu

SEQ ID NO: 743208 - RNA, 15 nt, Homo sapiens
uauuuaugugugagg

SEQ ID NO: 743209 - RNA, 18 nt, Homo sapiens
uauuuauguuugcacuug

SEQ ID NO: 743210 - RNA, 13 nt, Homo sapiens
uauuuauucacug

SEQ ID NO: 743211 - RNA, 23 nt, Homo sapiens
uauuuauugcuguguaacacugu

SEQ ID NO: 743212 - RNA, 13 nt, Homo sapiens
uauuuauuuacug

SEQ ID NO: 743213 - RNA, 14 nt, Homo sapiens
uauuucaaagggaa

SEQ ID NO: 743214 - RNA, 23 nt, Homo sapiens
uauuucaaauuguuuucagugaa

SEQ ID NO: 743215 - RNA, 14 nt, Homo sapiens
uauuucauaaacaa

SEQ ID NO: 743216 - RNA, 14 nt, Homo sapiens
uauuucaucugguu

SEQ ID NO: 743217 - RNA, 14 nt, Homo sapiens
uauuuccaaaagca

SEQ ID NO: 743218 - RNA, 15 nt, Homo sapiens
uauuuccaacaaacu

SEQ ID NO: 743219 - RNA, 21 nt, Homo sapiens
uauuuccacuuauaaaggaaa

SEQ ID NO: 743220 - RNA, 20 nt, Homo sapiens
uauuuccuuuaugugaauuu

SEQ ID NO: 743221 - RNA, 17 nt, Homo sapiens
uauuucuagaagcacau

SEQ ID NO: 743222 - RNA, 16 nt, Homo sapiens
uauuucucugaauuca

SEQ ID NO: 743223 - RNA, 13 nt, Homo sapiens
uauuucucuugcu

SEQ ID NO: 743224 - RNA, 16 nt, Homo sapiens
uauuucugaaucgaga

SEQ ID NO: 743225 - RNA, 20 nt, Homo sapiens
uauuucuucgugaacauaga

SEQ ID NO: 743226 - RNA, 15 nt, Homo sapiens
uauuucuugcauuca

SEQ ID NO: 743227 - RNA, 21 nt, Homo sapiens
uauuugaaaauuuuacuucca

SEQ ID NO: 743228 - RNA, 21 nt, Homo sapiens
uauuugaagcaucacauaaaa

SEQ ID NO: 743229 - RNA, 17 nt, Homo sapiens
uauuugacaacaaucca

SEQ ID NO: 743230 - RNA, 22 nt, Homo sapiens
uauuugacaacaauccaaaaaa

SEQ ID NO: 743231 - RNA, 18 nt, Homo sapiens
uauuugaccggaucuaca

SEQ ID NO: 743232 - RNA, 20 nt, Homo sapiens
uauuugagaauaaguucaua

SEQ ID NO: 743233 - RNA, 15 nt, Homo sapiens
uauuugaugguggua

SEQ ID NO: 743234 - RNA, 20 nt, Homo sapiens
uauuugcagaauacauucaa

SEQ ID NO: 743235 - RNA, 19 nt, Homo sapiens
uauuugcaguucaccugca

SEQ ID NO: 743236 - RNA, 22 nt, Homo sapiens
uauuugcuaccacagcaacuau

SEQ ID NO: 743237 - RNA, 14 nt, Homo sapiens
uauuugcuaugucc

SEQ ID NO: 743238 - RNA, 22 nt, Homo sapiens
uauuugggauauguauggguag

SEQ ID NO: 743239 - RNA, 13 nt, Homo sapiens
uauuugguacugu

SEQ ID NO: 743240 - RNA, 20 nt, Homo sapiens
uauuuguaauagugacauau

SEQ ID NO: 743241 - RNA, 13 nt, Homo sapiens
uauuuguauuaau

SEQ ID NO: 743242 - RNA, 21 nt, Homo sapiens
uauuuguauuaauaaagcauu

SEQ ID NO: 743243 - RNA, 11 nt, Homo sapiens
uauuugucauu

SEQ ID NO: 743244 - RNA, 20 nt, Homo sapiens
uauuugugugugugauauau

SEQ ID NO: 743245 - RNA, 12 nt, Homo sapiens
uauuuuaaauac

SEQ ID NO: 743246 - RNA, 17 nt, Homo sapiens
uauuuuaagaauuucac

SEQ ID NO: 743247 - RNA, 19 nt, Homo sapiens
uauuuuaagagaaaacugc

SEQ ID NO: 743248 - RNA, 13 nt, Homo sapiens
uauuuuacacaga

SEQ ID NO: 743249 - RNA, 17 nt, Homo sapiens
uauuuuaucuucuuucc

SEQ ID NO: 743250 - RNA, 17 nt, Homo sapiens
uauuuuaugaacauugu

SEQ ID NO: 743251 - RNA, 23 nt, Homo sapiens
uauuuuauguaaacccucaaggg

SEQ ID NO: 743252 - RNA, 17 nt, Homo sapiens
uauuuuauuuagacaag

SEQ ID NO: 743253 - RNA, 14 nt, Homo sapiens
uauuuucaaaauag

SEQ ID NO: 743254 - RNA, 16 nt, Homo sapiens
uauuuucaguauacug

SEQ ID NO: 743255 - RNA, 19 nt, Homo sapiens
uauuuugagaagcucugau

SEQ ID NO: 743256 - RNA, 12 nt, Homo sapiens
uauuuugcacug

SEQ ID NO: 743257 - RNA, 11 nt, Homo sapiens
uauuuugccac

SEQ ID NO: 743258 - RNA, 16 nt, Homo sapiens
uauuuuggaucuauca

SEQ ID NO: 743259 - RNA, 17 nt, Homo sapiens
uauuuuguaaugcugca

SEQ ID NO: 743260 - RNA, 21 nt, Homo sapiens
uauuuuguaaugcugcacaga

SEQ ID NO: 743261 - RNA, 23 nt, Homo sapiens
uauuuuguauauuuguaaacuac

SEQ ID NO: 743262 - RNA, 16 nt, Homo sapiens
uauuuuucauaaacaa

SEQ ID NO: 743263 - RNA, 13 nt, Homo sapiens
uauuuuugacaga

SEQ ID NO: 743264 - RNA, 23 nt, Homo sapiens
uauuuuugcccugaguccaagag

SEQ ID NO: 743265 - RNA, 19 nt, Homo sapiens
uauuuuugugaaguauuca

SEQ ID NO: 743266 - RNA, 16 nt, Homo sapiens
uauuuuuuaaacauac

SEQ ID NO: 743267 - RNA, 17 nt, Homo sapiens
uauuuuuuauacuguau

SEQ ID NO: 743268 - RNA, 16 nt, Homo sapiens
uauuuuuuauauauac

SEQ ID NO: 743269 - RNA, 14 nt, Homo sapiens
uauuuuuuuuacug

SEQ ID NO: 743270 - RNA, 18 nt, Homo sapiens
ucaaaaaaaaaagcaaca

SEQ ID NO: 743271 - RNA, 17 nt, Homo sapiens
ucaaaaaaucugaccaa

SEQ ID NO: 743272 - RNA, 14 nt, Homo sapiens
ucaaaaagaacaac

SEQ ID NO: 743273 - RNA, 22 nt, Homo sapiens
ucaaaaagaacaacauaucuca

SEQ ID NO: 743274 - RNA, 19 nt, Homo sapiens
ucaaaaauccuaacauuca

SEQ ID NO: 743275 - RNA, 23 nt, Homo sapiens
ucagaaauuuaauucauguuucu

SEQ ID NO: 743276 - RNA, 14 nt, Homo sapiens
ucagaacacacaga

SEQ ID NO: 743277 - RNA, 22 nt, Homo sapiens
ucagaacagcugaaacauuccg

SEQ ID NO: 743278 - RNA, 12 nt, Homo sapiens
ucagaaccagag

SEQ ID NO: 743279 - RNA, 22 nt, Homo sapiens
ucagaagagguugggcuuccau

SEQ ID NO: 743280 - RNA, 13 nt, Homo sapiens
ucagaagccugag

SEQ ID NO: 743281 - RNA, 18 nt, Homo sapiens
ucagaagucaucuugcua

SEQ ID NO: 743282 - RNA, 14 nt, Homo sapiens
ucagaagugcagaa

SEQ ID NO: 743283 - RNA, 15 nt, Homo sapiens
ucagaauccaaguga

SEQ ID NO: 743284 - RNA, 17 nt, Homo sapiens
ucagaauccacucuucu

SEQ ID NO: 743285 - RNA, 19 nt, Homo sapiens
ucagacagggucugaagga

SEQ ID NO: 743286 - RNA, 12 nt, Homo sapiens
ucagacauacag

SEQ ID NO: 743287 - RNA, 16 nt, Homo sapiens
ucagacauuuucacug

SEQ ID NO: 743288 - RNA, 17 nt, Homo sapiens
ucagacauuuucacugg

SEQ ID NO: 743289 - RNA, 16 nt, Homo sapiens
ucagacccacaacgaa

SEQ ID NO: 743290 - RNA, 16 nt, Homo sapiens
ucagacgagcagugac

SEQ ID NO: 743291 - RNA, 17 nt, Homo sapiens
ucagacgggcacagugg

SEQ ID NO: 743292 - RNA, 16 nt, Homo sapiens
ucagacgugugaccuc

SEQ ID NO: 743293 - RNA, 17 nt, Homo sapiens
ucagacuucaucuucaa

SEQ ID NO: 743294 - RNA, 17 nt, Homo sapiens
ucagagaaauacuuuca

SEQ ID NO: 743295 - RNA, 16 nt, Homo sapiens
ucagagacuaucugau

SEQ ID NO: 743296 - RNA, 21 nt, Homo sapiens
ucagagagcuucuuacuggau

SEQ ID NO: 743297 - RNA, 14 nt, Homo sapiens
ucagagaugaacau

SEQ ID NO: 743298 - RNA, 12 nt, Homo sapiens
ucagagcaguga

SEQ ID NO: 743299 - RNA, 12 nt, Homo sapiens
ucagagcuaaac

SEQ ID NO: 743300 - RNA, 17 nt, Homo sapiens
ucagagcuccucacuua

SEQ ID NO: 743301 - RNA, 21 nt, Homo sapiens
ucagaggacuggacgugcuca

SEQ ID NO: 743302 - RNA, 23 nt, Homo sapiens
ucagaggccugcugccagugcag

SEQ ID NO: 743303 - RNA, 18 nt, Homo sapiens
ucagaggugcagcuggag

SEQ ID NO: 743304 - RNA, 19 nt, Homo sapiens
ucagaguccucauuauaaa

SEQ ID NO: 743305 - RNA, 16 nt, Homo sapiens
ucagagugacagucau

SEQ ID NO: 743306 - RNA, 12 nt, Homo sapiens
ucagagugccac

SEQ ID NO: 743307 - RNA, 16 nt, Homo sapiens
ucagauaggagugaau

SEQ ID NO: 743308 - RNA, 16 nt, Homo sapiens
ucagauaucaaaauuc

SEQ ID NO: 743309 - RNA, 17 nt, Homo sapiens
ucagauauuguaagcau

SEQ ID NO: 743310 - RNA, 18 nt, Homo sapiens
ucagauauuguaagcauu

SEQ ID NO: 743311 - RNA, 14 nt, Homo sapiens
ucagaucauuauca

SEQ ID NO: 743312 - RNA, 20 nt, Homo sapiens
ucagaucugaacacaguuua

SEQ ID NO: 743313 - RNA, 20 nt, Homo sapiens
ucagaugcuccaagauucua

SEQ ID NO: 743314 - RNA, 12 nt, Homo sapiens
ucagauggacaa

SEQ ID NO: 743315 - RNA, 16 nt, Homo sapiens
ucagauucuucucuua

SEQ ID NO: 743316 - RNA, 18 nt, Homo sapiens
ucagauugaggagcucaa

SEQ ID NO: 743317 - RNA, 17 nt, Homo sapiens
ucagauuugccauucaa

SEQ ID NO: 743318 - RNA, 12 nt, Homo sapiens
ucagauuugccu

SEQ ID NO: 743319 - RNA, 21 nt, Homo sapiens
ucagcaaaaaucucccaguga

SEQ ID NO: 743320 - RNA, 13 nt, Homo sapiens
ucagcaaaccauu

SEQ ID NO: 743321 - RNA, 21 nt, Homo sapiens
ucagcaacuuauuuugcuuua

SEQ ID NO: 743322 - RNA, 17 nt, Homo sapiens
ucagcaagaauuugauc

SEQ ID NO: 743323 - RNA, 18 nt, Homo sapiens
ucagcaaggggcucugcc

SEQ ID NO: 743324 - RNA, 21 nt, Homo sapiens
ucagcacaggaauucucaaga

SEQ ID NO: 743325 - RNA, 17 nt, Homo sapiens
ucagcaccugacccugu

SEQ ID NO: 743326 - RNA, 19 nt, Homo sapiens
ucagcacguguggccuguu

SEQ ID NO: 743327 - RNA, 23 nt, Homo sapiens
ucagcacugauggaaaauaccag

SEQ ID NO: 743328 - RNA, 19 nt, Homo sapiens
ucagcacugucccuugccu

SEQ ID NO: 743329 - RNA, 22 nt, Homo sapiens
ucagcagccgccuuaagcugau

SEQ ID NO: 743330 - RNA, 20 nt, Homo sapiens
ucagcagcgugcacaucugc

SEQ ID NO: 743331 - RNA, 19 nt, Homo sapiens
ucagcaguccacaaagcau

SEQ ID NO: 743332 - RNA, 14 nt, Homo sapiens
ucagcagugaugcu

SEQ ID NO: 743333 - RNA, 20 nt, Homo sapiens
ucagcaucgugcuguuugcc

SEQ ID NO: 743334 - RNA, 15 nt, Homo sapiens
ucagcaucugaccau

SEQ ID NO: 743335 - RNA, 22 nt, Homo sapiens
ucagcaucugaccaucugugac

SEQ ID NO: 743336 - RNA, 18 nt, Homo sapiens
ucagcauucucacuccua

SEQ ID NO: 743337 - RNA, 16 nt, Homo sapiens
ucagcauuggccucug

SEQ ID NO: 743338 - RNA, 21 nt, Homo sapiens
ucagcauuuagucuugccagg

SEQ ID NO: 743339 - RNA, 22 nt, Homo sapiens
ucagcauuucuuuucuggccaa

SEQ ID NO: 743340 - RNA, 21 nt, Homo sapiens
ucagccaauccgauugccuua

SEQ ID NO: 743341 - RNA, 14 nt, Homo sapiens
ucagccacauucua

SEQ ID NO: 743342 - RNA, 14 nt, Homo sapiens
ucagccaccaucug

SEQ ID NO: 743343 - RNA, 13 nt, Homo sapiens
ucagccacugagg

SEQ ID NO: 743344 - RNA, 21 nt, Homo sapiens
ucagccaguggcuagcgcaag

SEQ ID NO: 743345 - RNA, 12 nt, Homo sapiens
ucagccaugagg

SEQ ID NO: 743346 - RNA, 15 nt, Homo sapiens
ucagcccagugcaaa

SEQ ID NO: 743347 - RNA, 15 nt, Homo sapiens
ucagccccacugaca

SEQ ID NO: 743348 - RNA, 19 nt, Homo sapiens
ucagccgcuucugacugcu

SEQ ID NO: 743349 - RNA, 14 nt, Homo sapiens
ucagccuuaggaag

SEQ ID NO: 743350 - RNA, 17 nt, Homo sapiens
ucagccuugaaaaacaa

SEQ ID NO: 743351 - RNA, 17 nt, Homo sapiens
ucagcgccagcacugua

SEQ ID NO: 743352 - RNA, 19 nt, Homo sapiens
ucagcuaaaguaacagagc

SEQ ID NO: 743353 - RNA, 18 nt, Homo sapiens
ucagcuccgcaagcauca

SEQ ID NO: 743354 - RNA, 19 nt, Homo sapiens
ucagcucggggagccuuag

SEQ ID NO: 743355 - RNA, 23 nt, Homo sapiens
ucagcucuuuggaucagucuuug

SEQ ID NO: 743356 - RNA, 12 nt, Homo sapiens
ucagcugagcuu

SEQ ID NO: 743357 - RNA, 12 nt, Homo sapiens
ucagcugcugaa

SEQ ID NO: 743358 - RNA, 20 nt, Homo sapiens
ucagcuggguacgguggcac

SEQ ID NO: 743359 - RNA, 13 nt, Homo sapiens
ucagcuuaucucu

SEQ ID NO: 743360 - RNA, 14 nt, Homo sapiens
ucagcuuggcugua

SEQ ID NO: 743361 - RNA, 19 nt, Homo sapiens
ucagcuuucaaagcauuua

SEQ ID NO: 743362 - RNA, 19 nt, Homo sapiens
ucagcuuugggguuccuuu

SEQ ID NO: 743363 - RNA, 18 nt, Homo sapiens
ucagcuuuuguucuagac

SEQ ID NO: 743364 - RNA, 19 nt, Homo sapiens
ucagcuuuuguucuagacu

SEQ ID NO: 743365 - RNA, 18 nt, Homo sapiens
ucaggaaaacuacugaua

SEQ ID NO: 743366 - RNA, 20 nt, Homo sapiens
ucaggaaaacuguuccaauc

SEQ ID NO: 743367 - RNA, 22 nt, Homo sapiens
ucaggaaaucaaauaugcaaag

SEQ ID NO: 743368 - RNA, 20 nt, Homo sapiens
ucaggaagccuguggugugc

SEQ ID NO: 743369 - RNA, 18 nt, Homo sapiens
ucaggaaggggugugcug

SEQ ID NO: 743370 - RNA, 15 nt, Homo sapiens
ucaggaauacauuug

SEQ ID NO: 743371 - RNA, 17 nt, Homo sapiens
ucaggaauacauuugga

SEQ ID NO: 743372 - RNA, 20 nt, Homo sapiens
ucaggaauucagugccuuca

SEQ ID NO: 743373 - RNA, 19 nt, Homo sapiens
ucaggacaagggcucagag

SEQ ID NO: 743374 - RNA, 14 nt, Homo sapiens
ucaggacagaugcc

SEQ ID NO: 743375 - RNA, 16 nt, Homo sapiens
ucaggacagaugccac

SEQ ID NO: 743376 - RNA, 17 nt, Homo sapiens
ucaggacagaugccaca

SEQ ID NO: 743377 - RNA, 20 nt, Homo sapiens
ucaggagaguagcaacaaaa

SEQ ID NO: 743378 - RNA, 18 nt, Homo sapiens
ucaggagaucgagaccau

SEQ ID NO: 743379 - RNA, 17 nt, Homo sapiens
ucaggaggcacugcuca

SEQ ID NO: 743380 - RNA, 15 nt, Homo sapiens
ucaggagucaacgug

SEQ ID NO: 743381 - RNA, 13 nt, Homo sapiens
ucaggagucccaa

SEQ ID NO: 743382 - RNA, 16 nt, Homo sapiens
ucaggagucugccacu

SEQ ID NO: 743383 - RNA, 21 nt, Homo sapiens
ucaggagucugccacuuguca

SEQ ID NO: 743384 - RNA, 20 nt, Homo sapiens
ucaggaugauacacuaugaa

SEQ ID NO: 743385 - RNA, 14 nt, Homo sapiens
ucaggaugcacauu

SEQ ID NO: 743386 - RNA, 17 nt, Homo sapiens
ucaggaugcacauuucu

SEQ ID NO: 743387 - RNA, 16 nt, Homo sapiens
ucaggauggcucagac

SEQ ID NO: 743388 - RNA, 14 nt, Homo sapiens
ucaggauucuucaa

SEQ ID NO: 743389 - RNA, 17 nt, Homo sapiens
ucaggcaaagugcugcu

SEQ ID NO: 743390 - RNA, 20 nt, Homo sapiens
uccaagauuuaaaugccaua

SEQ ID NO: 743391 - RNA, 18 nt, Homo sapiens
uccaagcaaguagcuuuc

SEQ ID NO: 743392 - RNA, 20 nt, Homo sapiens
uccaagcagaguguuuuauu

SEQ ID NO: 743393 - RNA, 20 nt, Homo sapiens
uccaaggaaacuuugccaaa

SEQ ID NO: 743394 - RNA, 18 nt, Homo sapiens
uccaaggauuaaaucugg

SEQ ID NO: 743395 - RNA, 17 nt, Homo sapiens
uccaaggguacuaagga

SEQ ID NO: 743396 - RNA, 19 nt, Homo sapiens
uccaagguguaacucuaau

SEQ ID NO: 743397 - RNA, 19 nt, Homo sapiens
uccaaguuuuaauuuuuaa

SEQ ID NO: 743398 - RNA, 14 nt, Homo sapiens
uccaauaaauguga

SEQ ID NO: 743399 - RNA, 12 nt, Homo sapiens
uccaauacucag

SEQ ID NO: 743400 - RNA, 23 nt, Homo sapiens
uccaauaucagugcucgagacac

SEQ ID NO: 743401 - RNA, 23 nt, Homo sapiens
uccaauccagaggaacaagcaug

SEQ ID NO: 743402 - RNA, 19 nt, Homo sapiens
uccaaugcauuggccucug

SEQ ID NO: 743403 - RNA, 18 nt, Homo sapiens
uccaaugucaaugugaac

SEQ ID NO: 743404 - RNA, 22 nt, Homo sapiens
uccaaugugugcauggaacaaa

SEQ ID NO: 743405 - RNA, 13 nt, Homo sapiens
uccaauuucaaga

SEQ ID NO: 743406 - RNA, 17 nt, Homo sapiens
uccacaaaaucugucca

SEQ ID NO: 743407 - RNA, 11 nt, Homo sapiens
uccacaaggaa

SEQ ID NO: 743408 - RNA, 18 nt, Homo sapiens
uccacaauaaccaagaua

SEQ ID NO: 743409 - RNA, 19 nt, Homo sapiens
uccacaccccaucuugcuc

SEQ ID NO: 743410 - RNA, 16 nt, Homo sapiens
uccacacccucuccca

SEQ ID NO: 743411 - RNA, 15 nt, Homo sapiens
uccacaccugggcau

SEQ ID NO: 743412 - RNA, 14 nt, Homo sapiens
uccacacgcauuaa

SEQ ID NO: 743413 - RNA, 14 nt, Homo sapiens
uccacacuaccaca

SEQ ID NO: 743414 - RNA, 11 nt, Homo sapiens
uccacagcuua

SEQ ID NO: 743415 - RNA, 18 nt, Homo sapiens
uccacaugaaaauaaaga

SEQ ID NO: 743416 - RNA, 15 nt, Homo sapiens
uccacauuugucaca

SEQ ID NO: 743417 - RNA, 13 nt, Homo sapiens
uccaccagcagca

SEQ ID NO: 743418 - RNA, 21 nt, Homo sapiens
uccaccagcaucaccugccug

SEQ ID NO: 743419 - RNA, 10 nt, Homo sapiens
uccaccagcc

SEQ ID NO: 743420 - RNA, 17 nt, Homo sapiens
uccaccagccugcacua

SEQ ID NO: 743421 - RNA, 17 nt, Homo sapiens
uccaccagccugcugac

SEQ ID NO: 743422 - RNA, 14 nt, Homo sapiens
uccacccaccucag

SEQ ID NO: 743423 - RNA, 15 nt, Homo sapiens
uccacccagugcugc

SEQ ID NO: 743424 - RNA, 15 nt, Homo sapiens
uccaccccagugugc

SEQ ID NO: 743425 - RNA, 19 nt, Homo sapiens
uccaccccauccaauuuau

SEQ ID NO: 743426 - RNA, 14 nt, Homo sapiens
uccaccccccagaa

SEQ ID NO: 743427 - RNA, 21 nt, Homo sapiens
uccaccgaccaacugcccuaa

SEQ ID NO: 743428 - RNA, 16 nt, Homo sapiens
uccaccgucagcugua

SEQ ID NO: 743429 - RNA, 15 nt, Homo sapiens
uccaccuagacugua

SEQ ID NO: 743430 - RNA, 20 nt, Homo sapiens
uccaccucccaacacuguca

SEQ ID NO: 743431 - RNA, 22 nt, Homo sapiens
uccaccuccucuccaccugcug

SEQ ID NO: 743432 - RNA, 20 nt, Homo sapiens
uccaccucgcagguucaagc

SEQ ID NO: 743433 - RNA, 19 nt, Homo sapiens
uccaccugaggaacugucu

SEQ ID NO: 743434 - RNA, 11 nt, Homo sapiens
uccaccugcua

SEQ ID NO: 743435 - RNA, 19 nt, Homo sapiens
uccaccugcuaaucacauc

SEQ ID NO: 743436 - RNA, 21 nt, Homo sapiens
uccaccugcuaaucacaucca

SEQ ID NO: 743437 - RNA, 12 nt, Homo sapiens
uccaccuucuac

SEQ ID NO: 743438 - RNA, 19 nt, Homo sapiens
uccaccuucuacgcaauug

SEQ ID NO: 743439 - RNA, 14 nt, Homo sapiens
uccaccuugcucuu

SEQ ID NO: 743440 - RNA, 17 nt, Homo sapiens
uccacgucaacagaauu

SEQ ID NO: 743441 - RNA, 17 nt, Homo sapiens
uccacuauuuucaaaga

SEQ ID NO: 743442 - RNA, 14 nt, Homo sapiens
uccacucaaugucu

SEQ ID NO: 743443 - RNA, 14 nt, Homo sapiens
uccacucacuccag

SEQ ID NO: 743444 - RNA, 20 nt, Homo sapiens
uccacucuacuaaugccucu

SEQ ID NO: 743445 - RNA, 19 nt, Homo sapiens
uccacuggaaaaguguaau

SEQ ID NO: 743446 - RNA, 16 nt, Homo sapiens
uccacuugaagcacuu

SEQ ID NO: 743447 - RNA, 17 nt, Homo sapiens
uccacuugaagcacuua

SEQ ID NO: 743448 - RNA, 22 nt, Homo sapiens
uccacuuguucuguacuuguaa

SEQ ID NO: 743449 - RNA, 18 nt, Homo sapiens
uccagaaacaaaaagccc

SEQ ID NO: 743450 - RNA, 15 nt, Homo sapiens
uccagaacaaagcac

SEQ ID NO: 743451 - RNA, 17 nt, Homo sapiens
uccagaacucaaaugag

SEQ ID NO: 743452 - RNA, 21 nt, Homo sapiens
uccagacaaugccagcauaaa

SEQ ID NO: 743453 - RNA, 16 nt, Homo sapiens
uccagaccaaccuucc

SEQ ID NO: 743454 - RNA, 22 nt, Homo sapiens
uccagacccugccugagcccag

SEQ ID NO: 743455 - RNA, 20 nt, Homo sapiens
uccagacuuccuugagacac

SEQ ID NO: 743456 - RNA, 16 nt, Homo sapiens
uccagaguaagugaug

SEQ ID NO: 743457 - RNA, 15 nt, Homo sapiens
uccagaucacugcca

SEQ ID NO: 743458 - RNA, 16 nt, Homo sapiens
uccagaucagauucuu

SEQ ID NO: 743459 - RNA, 22 nt, Homo sapiens
uccagcacacacacauaagcac

SEQ ID NO: 743460 - RNA, 13 nt, Homo sapiens
uccagcacccaga

SEQ ID NO: 743461 - RNA, 20 nt, Homo sapiens
uccagcaccuucccucucac

SEQ ID NO: 743462 - RNA, 20 nt, Homo sapiens
uccagcccagacccagugga

SEQ ID NO: 743463 - RNA, 19 nt, Homo sapiens
uccagcccaucuccgggga

SEQ ID NO: 743464 - RNA, 17 nt, Homo sapiens
uccagccucuccuccau

SEQ ID NO: 743465 - RNA, 23 nt, Homo sapiens
uccagccuggcucuaucuuccuc

SEQ ID NO: 743466 - RNA, 21 nt, Homo sapiens
uccagccugggcaacacagcg

SEQ ID NO: 743467 - RNA, 17 nt, Homo sapiens
uccagccuggggacccc

SEQ ID NO: 743468 - RNA, 23 nt, Homo sapiens
uccagccuucuacugcucuccuc

SEQ ID NO: 743469 - RNA, 16 nt, Homo sapiens
uccagcggcccuguca

SEQ ID NO: 743470 - RNA, 18 nt, Homo sapiens
uccagcuccaaccugcaa

SEQ ID NO: 743471 - RNA, 10 nt, Homo sapiens
uccagcugcc

SEQ ID NO: 743472 - RNA, 19 nt, Homo sapiens
uccagcugcucugucuucu

SEQ ID NO: 743473 - RNA, 23 nt, Homo sapiens
uccagcugcucugucuucuuugc

SEQ ID NO: 743474 - RNA, 21 nt, Homo sapiens
uccagcuuagaaugcaucuca

SEQ ID NO: 743475 - RNA, 18 nt, Homo sapiens
uccagcuuauagucuucc

SEQ ID NO: 743476 - RNA, 16 nt, Homo sapiens
uccaggaaggcagcug

SEQ ID NO: 743477 - RNA, 23 nt, Homo sapiens
uccaggaagguagcccagcacug

SEQ ID NO: 743478 - RNA, 16 nt, Homo sapiens
uccaggacugggucug

SEQ ID NO: 743479 - RNA, 14 nt, Homo sapiens
uccaggaucuuuga

SEQ ID NO: 743480 - RNA, 13 nt, Homo sapiens
uccaggcacagcu

SEQ ID NO: 743481 - RNA, 18 nt, Homo sapiens
uccaggcccaacugugag

SEQ ID NO: 743482 - RNA, 19 nt, Homo sapiens
uccagggaggcgaugccag

SEQ ID NO: 743483 - RNA, 15 nt, Homo sapiens
uccagggaguccccu

SEQ ID NO: 743484 - RNA, 20 nt, Homo sapiens
uccaggguggaugaucucaa

SEQ ID NO: 743485 - RNA, 23 nt, Homo sapiens
uccaggucaggaugcacauuucu

SEQ ID NO: 743486 - RNA, 17 nt, Homo sapiens
uccaggugaggcccaag

SEQ ID NO: 743487 - RNA, 19 nt, Homo sapiens
uccaggugaggcccaagag

SEQ ID NO: 743488 - RNA, 22 nt, Homo sapiens
uccagguuccauccaccaccuu

SEQ ID NO: 743489 - RNA, 20 nt, Homo sapiens
uccagguuugguuauuauga

SEQ ID NO: 743490 - RNA, 15 nt, Homo sapiens
uccaguacaguauuc

SEQ ID NO: 743491 - RNA, 15 nt, Homo sapiens
uccagugagcacuag

SEQ ID NO: 743492 - RNA, 21 nt, Homo sapiens
uccagugguuugagacacugg

SEQ ID NO: 743493 - RNA, 14 nt, Homo sapiens
uccaguucaaauaa

SEQ ID NO: 743494 - RNA, 15 nt, Homo sapiens
uccaguucugacaca

SEQ ID NO: 743495 - RNA, 16 nt, Homo sapiens
uccaguuuaaguaauu

SEQ ID NO: 743496 - RNA, 20 nt, Homo sapiens
uccaguuuaaugaacuacca

SEQ ID NO: 743497 - RNA, 21 nt, Homo sapiens
uccaguuugaguuaaugugcu

SEQ ID NO: 743498 - RNA, 16 nt, Homo sapiens
uccaguuugcauuugg

SEQ ID NO: 743499 - RNA, 21 nt, Homo sapiens
uccauaggcgcaggugcacag

SEQ ID NO: 743500 - RNA, 23 nt, Homo sapiens
uccauauguuauaucaacagaua

SEQ ID NO: 743501 - RNA, 15 nt, Homo sapiens
uccaucaaaccucac

SEQ ID NO: 743502 - RNA, 15 nt, Homo sapiens
uccaucaacucccaa

SEQ ID NO: 743503 - RNA, 18 nt, Homo sapiens
uccaucaauggugagcac

SEQ ID NO: 743504 - RNA, 16 nt, Homo sapiens
uccuaacguuugucau

SEQ ID NO: 743505 - RNA, 17 nt, Homo sapiens
uccuaacguuugucauu

SEQ ID NO: 743506 - RNA, 14 nt, Homo sapiens
uccuaacuagaauu

SEQ ID NO: 743507 - RNA, 19 nt, Homo sapiens
uccuaagcuggagugcagu

SEQ ID NO: 743508 - RNA, 16 nt, Homo sapiens
uccuaaggacacacua

SEQ ID NO: 743509 - RNA, 18 nt, Homo sapiens
uccuaaguauauuaauau

SEQ ID NO: 743510 - RNA, 13 nt, Homo sapiens
uccuaauacuguc

SEQ ID NO: 743511 - RNA, 14 nt, Homo sapiens
uccuaauacuguca

SEQ ID NO: 743512 - RNA, 14 nt, Homo sapiens
uccuacaagcuaaa

SEQ ID NO: 743513 - RNA, 23 nt, Homo sapiens
uccuacacguuagauuugccgua

SEQ ID NO: 743514 - RNA, 12 nt, Homo sapiens
uccuacacuuga

SEQ ID NO: 743515 - RNA, 19 nt, Homo sapiens
uccuacagcuaacccucac

SEQ ID NO: 743516 - RNA, 14 nt, Homo sapiens
uccuaccagcaaag

SEQ ID NO: 743517 - RNA, 22 nt, Homo sapiens
uccuacccacuggucugcuuaa

SEQ ID NO: 743518 - RNA, 16 nt, Homo sapiens
uccuacucacacuuca

SEQ ID NO: 743519 - RNA, 21 nt, Homo sapiens
uccuagaagaaccaaauaccu

SEQ ID NO: 743520 - RNA, 14 nt, Homo sapiens
uccuagacccguga

SEQ ID NO: 743521 - RNA, 19 nt, Homo sapiens
uccuagaggugggcagcug

SEQ ID NO: 743522 - RNA, 19 nt, Homo sapiens
uccuagccaacaucgugaa

SEQ ID NO: 743523 - RNA, 23 nt, Homo sapiens
uccuagugggccauuaaaaacua

SEQ ID NO: 743524 - RNA, 14 nt, Homo sapiens
uccuaguuugaccu

SEQ ID NO: 743525 - RNA, 16 nt, Homo sapiens
uccuauagacuguaag

SEQ ID NO: 743526 - RNA, 13 nt, Homo sapiens
uccuauuccaugc

SEQ ID NO: 743527 - RNA, 17 nt, Homo sapiens
uccuauucuauugcagu

SEQ ID NO: 743528 - RNA, 14 nt, Homo sapiens
uccuauuuaucaua

SEQ ID NO: 743529 - RNA, 18 nt, Homo sapiens
uccuauuuuucaauggga

SEQ ID NO: 743530 - RNA, 22 nt, Homo sapiens
uccucaaagggagagagugcua

SEQ ID NO: 743531 - RNA, 22 nt, Homo sapiens
uccucacagaguuaaauaugca

SEQ ID NO: 743532 - RNA, 18 nt, Homo sapiens
uccucacaguugccaugu

SEQ ID NO: 743533 - RNA, 19 nt, Homo sapiens
uccucacccaucaaaagca

SEQ ID NO: 743534 - RNA, 11 nt, Homo sapiens
uccucagggag

SEQ ID NO: 743535 - RNA, 21 nt, Homo sapiens
uccucaggugauuuguaugcu

SEQ ID NO: 743536 - RNA, 13 nt, Homo sapiens
uccucauguacau

SEQ ID NO: 743537 - RNA, 12 nt, Homo sapiens
uccuccaacagc

SEQ ID NO: 743538 - RNA, 17 nt, Homo sapiens
uccuccacaauagcaga

SEQ ID NO: 743539 - RNA, 18 nt, Homo sapiens
uccuccacagugcugcuu

SEQ ID NO: 743540 - RNA, 16 nt, Homo sapiens
uccuccacauccuuuc

SEQ ID NO: 743541 - RNA, 17 nt, Homo sapiens
uccucccccagcuaucu

SEQ ID NO: 743542 - RNA, 16 nt, Homo sapiens
uccucccugucauaga

SEQ ID NO: 743543 - RNA, 20 nt, Homo sapiens
uccucccuuccuuuucccug

SEQ ID NO: 743544 - RNA, 12 nt, Homo sapiens
uccuccugaugg

SEQ ID NO: 743545 - RNA, 23 nt, Homo sapiens
uccuccugugcuauuuguacaaa

SEQ ID NO: 743546 - RNA, 23 nt, Homo sapiens
uccuccuguucugaaaccuuagu

SEQ ID NO: 743547 - RNA, 21 nt, Homo sapiens
uccucgaauuuuaucugugga

SEQ ID NO: 743548 - RNA, 13 nt, Homo sapiens
uccucgcugccag

SEQ ID NO: 743549 - RNA, 15 nt, Homo sapiens
uccucgggcacagac

SEQ ID NO: 743550 - RNA, 13 nt, Homo sapiens
uccucuauugaug

SEQ ID NO: 743551 - RNA, 16 nt, Homo sapiens
uccucucccaagucca

SEQ ID NO: 743552 - RNA, 19 nt, Homo sapiens
uccucucccauccuugaug

SEQ ID NO: 743553 - RNA, 14 nt, Homo sapiens
uccucuccuacuuu

SEQ ID NO: 743554 - RNA, 23 nt, Homo sapiens
uccucucuaagugggcauugcca

SEQ ID NO: 743555 - RNA, 14 nt, Homo sapiens
uccucucucuacca

SEQ ID NO: 743556 - RNA, 12 nt, Homo sapiens
uccucucugagu

SEQ ID NO: 743557 - RNA, 13 nt, Homo sapiens
uccucucuuggca

SEQ ID NO: 743558 - RNA, 13 nt, Homo sapiens
uccucugagcagc

SEQ ID NO: 743559 - RNA, 17 nt, Homo sapiens
uccucugcauuuacaca

SEQ ID NO: 743560 - RNA, 18 nt, Homo sapiens
uccucuguaaugaucaga

SEQ ID NO: 743561 - RNA, 12 nt, Homo sapiens
uccucugugauu

SEQ ID NO: 743562 - RNA, 22 nt, Homo sapiens
uccucuuuaacaagggcugcaa

SEQ ID NO: 743563 - RNA, 14 nt, Homo sapiens
uccugaaagcuuac

SEQ ID NO: 743564 - RNA, 19 nt, Homo sapiens
uccugaauccaaacuaauc

SEQ ID NO: 743565 - RNA, 15 nt, Homo sapiens
uccugacacuuuaau

SEQ ID NO: 743566 - RNA, 19 nt, Homo sapiens
uccugacagaaggacucag

SEQ ID NO: 743567 - RNA, 16 nt, Homo sapiens
uccugaccucagguga

SEQ ID NO: 743568 - RNA, 15 nt, Homo sapiens
uccugaccuugucau

SEQ ID NO: 743569 - RNA, 19 nt, Homo sapiens
uccugaccuugugauccac

SEQ ID NO: 743570 - RNA, 20 nt, Homo sapiens
uccugacugaaaguaggggg

SEQ ID NO: 743571 - RNA, 14 nt, Homo sapiens
uccugagaccucaa

SEQ ID NO: 743572 - RNA, 22 nt, Homo sapiens
uccugaggaagagggacuguuc

SEQ ID NO: 743573 - RNA, 19 nt, Homo sapiens
uccugaguagcuggauuac

SEQ ID NO: 743574 - RNA, 12 nt, Homo sapiens
uccugaguuucu

SEQ ID NO: 743575 - RNA, 14 nt, Homo sapiens
uccugauaaacauu

SEQ ID NO: 743576 - RNA, 14 nt, Homo sapiens
uccugauuccaaau

SEQ ID NO: 743577 - RNA, 16 nt, Homo sapiens
uccugauuucucugaa

SEQ ID NO: 743578 - RNA, 20 nt, Homo sapiens
uccugcaacgcugccuuuca

SEQ ID NO: 743579 - RNA, 21 nt, Homo sapiens
uccugcaucccgauaccucag

SEQ ID NO: 743580 - RNA, 19 nt, Homo sapiens
uccugcauccucacugugg

SEQ ID NO: 743581 - RNA, 23 nt, Homo sapiens
uccugccagggugagcaggguca

SEQ ID NO: 743582 - RNA, 18 nt, Homo sapiens
uccugccuuuaagccaaa

SEQ ID NO: 743583 - RNA, 16 nt, Homo sapiens
uccugcuagcuguaga

SEQ ID NO: 743584 - RNA, 23 nt, Homo sapiens
uccugcucucuggaggacgguca

SEQ ID NO: 743585 - RNA, 19 nt, Homo sapiens
uccugcucuuuugugauga

SEQ ID NO: 743586 - RNA, 22 nt, Homo sapiens
uccugcugcggaggagcugccu

SEQ ID NO: 743587 - RNA, 21 nt, Homo sapiens
uccugcugggcgugugugaca

SEQ ID NO: 743588 - RNA, 13 nt, Homo sapiens
uccuggaaccaau

SEQ ID NO: 743589 - RNA, 13 nt, Homo sapiens
uccuggacaacaa

SEQ ID NO: 743590 - RNA, 22 nt, Homo sapiens
uccuggacaaggcuaacauccc

SEQ ID NO: 743591 - RNA, 15 nt, Homo sapiens
uccuggcagcccugu

SEQ ID NO: 743592 - RNA, 21 nt, Homo sapiens
uccuggcccuccacuccucau

SEQ ID NO: 743593 - RNA, 13 nt, Homo sapiens
uccuggccugaga

SEQ ID NO: 743594 - RNA, 16 nt, Homo sapiens
uccuggcuaacacgug

SEQ ID NO: 743595 - RNA, 18 nt, Homo sapiens
uccuggcuaacacgugaa

SEQ ID NO: 743596 - RNA, 19 nt, Homo sapiens
uccuggcuaacauggugaa

SEQ ID NO: 743597 - RNA, 19 nt, Homo sapiens
uccuggcugcacucuugaa

SEQ ID NO: 743598 - RNA, 14 nt, Homo sapiens
uccuggcugggaac

SEQ ID NO: 743599 - RNA, 14 nt, Homo sapiens
uccuggcugugaca

SEQ ID NO: 743600 - RNA, 23 nt, Homo sapiens
uccugggaaggagggagcugcuc

SEQ ID NO: 743601 - RNA, 20 nt, Homo sapiens
uccugggagaaccucaggcu

SEQ ID NO: 743602 - RNA, 18 nt, Homo sapiens
uccuggggcagcacuccc

SEQ ID NO: 743603 - RNA, 18 nt, Homo sapiens
uccugggucuaccacuca

SEQ ID NO: 743604 - RNA, 17 nt, Homo sapiens
uccuguaaagaaacauu

SEQ ID NO: 743605 - RNA, 22 nt, Homo sapiens
uccuguacauugugggauguuc

SEQ ID NO: 743606 - RNA, 19 nt, Homo sapiens
uccuguauucuacagcaga

SEQ ID NO: 743607 - RNA, 11 nt, Homo sapiens
uccugucauau

SEQ ID NO: 743608 - RNA, 14 nt, Homo sapiens
uccugucauauaau

SEQ ID NO: 743609 - RNA, 17 nt, Homo sapiens
uccuguccuaucacucu

SEQ ID NO: 743610 - RNA, 16 nt, Homo sapiens
uccugugaaaauauga

SEQ ID NO: 743611 - RNA, 19 nt, Homo sapiens
uccugugacaacacucauc

SEQ ID NO: 743612 - RNA, 11 nt, Homo sapiens
uccugugcaau

SEQ ID NO: 743613 - RNA, 17 nt, Homo sapiens
uccuguggcagcugccc

SEQ ID NO: 743614 - RNA, 22 nt, Homo sapiens
uccuguguccaugugaucucau

SEQ ID NO: 743615 - RNA, 21 nt, Homo sapiens
uccuguguggccugccuucac

SEQ ID NO: 743616 - RNA, 20 nt, Homo sapiens
uccuguguguacucugucca

SEQ ID NO: 743617 - RNA, 15 nt, Homo sapiens
uccuguuacuauggu

SEQ ID NO: 743618 - RNA, 14 nt, Homo sapiens
uccuguucagugag

SEQ ID NO: 743619 - RNA, 23 nt, Homo sapiens
ucucuccccauccccacccaguc

SEQ ID NO: 743620 - RNA, 19 nt, Homo sapiens
ucucuccuuauagacacuu

SEQ ID NO: 743621 - RNA, 16 nt, Homo sapiens
ucucuccuuggccaca

SEQ ID NO: 743622 - RNA, 14 nt, Homo sapiens
ucucucgcucgcuc

SEQ ID NO: 743623 - RNA, 14 nt, Homo sapiens
ucucucuccagggu

SEQ ID NO: 743624 - RNA, 14 nt, Homo sapiens
ucucucucugugcu

SEQ ID NO: 743625 - RNA, 16 nt, Homo sapiens
ucucucugaccuuuca

SEQ ID NO: 743626 - RNA, 21 nt, Homo sapiens
ucucucugggaccacugggua

SEQ ID NO: 743627 - RNA, 13 nt, Homo sapiens
ucucucuuuauac

SEQ ID NO: 743628 - RNA, 22 nt, Homo sapiens
ucucugaauuuucagagacuuu

SEQ ID NO: 743629 - RNA, 18 nt, Homo sapiens
ucucugacgcuugugaca

SEQ ID NO: 743630 - RNA, 14 nt, Homo sapiens
ucucugccaugugg

SEQ ID NO: 743631 - RNA, 17 nt, Homo sapiens
ucucugccauguggcag

SEQ ID NO: 743632 - RNA, 16 nt, Homo sapiens
ucucugggacucuccu

SEQ ID NO: 743633 - RNA, 20 nt, Homo sapiens
ucucugggauuuaugcucau

SEQ ID NO: 743634 - RNA, 11 nt, Homo sapiens
ucucugggcug

SEQ ID NO: 743635 - RNA, 19 nt, Homo sapiens
ucucugucccuugcuguau

SEQ ID NO: 743636 - RNA, 21 nt, Homo sapiens
ucucuuacaaaagcuuugaau

SEQ ID NO: 743637 - RNA, 18 nt, Homo sapiens
ucucuuaccugggaccuc

SEQ ID NO: 743638 - RNA, 20 nt, Homo sapiens
ucucuucacagugccaggaa

SEQ ID NO: 743639 - RNA, 23 nt, Homo sapiens
ucucuucaccccuacacugugaa

SEQ ID NO: 743640 - RNA, 12 nt, Homo sapiens
ucucuucacuac

SEQ ID NO: 743641 - RNA, 22 nt, Homo sapiens
ucucuucagccccuagugcuau

SEQ ID NO: 743642 - RNA, 23 nt, Homo sapiens
ucucuucccugcgccugugaugc

SEQ ID NO: 743643 - RNA, 22 nt, Homo sapiens
ucucuuccucauauuucagcag

SEQ ID NO: 743644 - RNA, 22 nt, Homo sapiens
ucucuuccugucuuuguugucu

SEQ ID NO: 743645 - RNA, 14 nt, Homo sapiens
ucucuucucaccuu

SEQ ID NO: 743646 - RNA, 14 nt, Homo sapiens
ucucuucuuuaaag

SEQ ID NO: 743647 - RNA, 18 nt, Homo sapiens
ucucuugcacucaaagcu

SEQ ID NO: 743648 - RNA, 16 nt, Homo sapiens
ucucuugcauugugac

SEQ ID NO: 743649 - RNA, 13 nt, Homo sapiens
ucucuugccauuu

SEQ ID NO: 743650 - RNA, 20 nt, Homo sapiens
ucucuugcuaccugugagca

SEQ ID NO: 743651 - RNA, 15 nt, Homo sapiens
ucucuugcugccaca

SEQ ID NO: 743652 - RNA, 21 nt, Homo sapiens
ucucuuuaaauggcuuuaugc

SEQ ID NO: 743653 - RNA, 20 nt, Homo sapiens
ucucuuuaaguuuugauuaa

SEQ ID NO: 743654 - RNA, 15 nt, Homo sapiens
ucucuuuaccuccua

SEQ ID NO: 743655 - RNA, 21 nt, Homo sapiens
ucucuuuaguauaauugaccu

SEQ ID NO: 743656 - RNA, 20 nt, Homo sapiens
ucugaaaaacauuccaggaa

SEQ ID NO: 743657 - RNA, 20 nt, Homo sapiens
ucugaaaaauuuguaguuua

SEQ ID NO: 743658 - RNA, 13 nt, Homo sapiens
ucugaaacagaaa

SEQ ID NO: 743659 - RNA, 20 nt, Homo sapiens
ucugaaagauaagaaucacu

SEQ ID NO: 743660 - RNA, 23 nt, Homo sapiens
ucugaaaggauguggaagagcau

SEQ ID NO: 743661 - RNA, 13 nt, Homo sapiens
ucugaaauccaua

SEQ ID NO: 743662 - RNA, 19 nt, Homo sapiens
ucugaaauccauaaacuaa

SEQ ID NO: 743663 - RNA, 12 nt, Homo sapiens
ucugaaaugccu

SEQ ID NO: 743664 - RNA, 20 nt, Homo sapiens
ucugaaauuuuaauugaacu

SEQ ID NO: 743665 - RNA, 14 nt, Homo sapiens
ucugaacuguuaca

SEQ ID NO: 743666 - RNA, 19 nt, Homo sapiens
ucugaacuugcauugugau

SEQ ID NO: 743667 - RNA, 14 nt, Homo sapiens
ucugaagaguagaa

SEQ ID NO: 743668 - RNA, 22 nt, Homo sapiens
ucugaaggacacuuccugccua

SEQ ID NO: 743669 - RNA, 19 nt, Homo sapiens
ucugaaggucccaccucca

SEQ ID NO: 743670 - RNA, 12 nt, Homo sapiens
ucugaaguacuu

SEQ ID NO: 743671 - RNA, 21 nt, Homo sapiens
ucugaaguacuuaaacuucca

SEQ ID NO: 743672 - RNA, 23 nt, Homo sapiens
ucugaagucacaucacaggacac

SEQ ID NO: 743673 - RNA, 21 nt, Homo sapiens
ucugaauaaaguguaacaauu

SEQ ID NO: 743674 - RNA, 13 nt, Homo sapiens
ucugaauccucau

SEQ ID NO: 743675 - RNA, 22 nt, Homo sapiens
ucugaaucgagauguccauagu

SEQ ID NO: 743676 - RNA, 21 nt, Homo sapiens
ucugaauugcacaugugagca

SEQ ID NO: 743677 - RNA, 18 nt, Homo sapiens
ucugacaaugcugagguu

SEQ ID NO: 743678 - RNA, 15 nt, Homo sapiens
ucugacacuaccuua

SEQ ID NO: 743679 - RNA, 16 nt, Homo sapiens
ucugaccaucugugac

SEQ ID NO: 743680 - RNA, 19 nt, Homo sapiens
ucugaccaucugugacuau

SEQ ID NO: 743681 - RNA, 13 nt, Homo sapiens
ucugaccauuuca

SEQ ID NO: 743682 - RNA, 12 nt, Homo sapiens
ucugaccuguac

SEQ ID NO: 743683 - RNA, 14 nt, Homo sapiens
ucugacgucucuuu

SEQ ID NO: 743684 - RNA, 13 nt, Homo sapiens
ucugacuacuugu

SEQ ID NO: 743685 - RNA, 21 nt, Homo sapiens
ucugacuacuuguuguaucug

SEQ ID NO: 743686 - RNA, 15 nt, Homo sapiens
ucugacucugagcua

SEQ ID NO: 743687 - RNA, 11 nt, Homo sapiens
ucugacugcug

SEQ ID NO: 743688 - RNA, 13 nt, Homo sapiens
ucugagaaacucu

SEQ ID NO: 743689 - RNA, 19 nt, Homo sapiens
ucugagaaagacuauucaa

SEQ ID NO: 743690 - RNA, 15 nt, Homo sapiens
ucugagaagacacaa

SEQ ID NO: 743691 - RNA, 14 nt, Homo sapiens
ucugagaauuucca

SEQ ID NO: 743692 - RNA, 17 nt, Homo sapiens
ucugagacagaaucuca

SEQ ID NO: 743693 - RNA, 19 nt, Homo sapiens
ucugagagaugacagggaa

SEQ ID NO: 743694 - RNA, 20 nt, Homo sapiens
ucugagaggcucuccgugca

SEQ ID NO: 743695 - RNA, 20 nt, Homo sapiens
ucugagcacagcugcauuaa

SEQ ID NO: 743696 - RNA, 17 nt, Homo sapiens
ucugagcagagagcagc

SEQ ID NO: 743697 - RNA, 15 nt, Homo sapiens
ucugagcuccaccuc

SEQ ID NO: 743698 - RNA, 16 nt, Homo sapiens
ucugaggaauggacau

SEQ ID NO: 743699 - RNA, 17 nt, Homo sapiens
ucugaggaccuccaaag

SEQ ID NO: 743700 - RNA, 17 nt, Homo sapiens
ucugaggaugcauucga

SEQ ID NO: 743701 - RNA, 20 nt, Homo sapiens
ucugaggcccugcccaauga

SEQ ID NO: 743702 - RNA, 19 nt, Homo sapiens
ucugaggccugagugagug

SEQ ID NO: 743703 - RNA, 19 nt, Homo sapiens
ucugagggagacugcaaau

SEQ ID NO: 743704 - RNA, 17 nt, Homo sapiens
ucugagggagcugagua

SEQ ID NO: 743705 - RNA, 22 nt, Homo sapiens
ucugagggggugggggugcugc

SEQ ID NO: 743706 - RNA, 16 nt, Homo sapiens
ucugaggggugggggu

SEQ ID NO: 743707 - RNA, 13 nt, Homo sapiens
ucugaguccuuug

SEQ ID NO: 743708 - RNA, 22 nt, Homo sapiens
ucugaguucuuguguccuggua

SEQ ID NO: 743709 - RNA, 22 nt, Homo sapiens
ucugauaaacacaaucugcuag

SEQ ID NO: 743710 - RNA, 16 nt, Homo sapiens
ucugauaccacugcac

SEQ ID NO: 743711 - RNA, 17 nt, Homo sapiens
ucugauaccacugcacu

SEQ ID NO: 743712 - RNA, 22 nt, Homo sapiens
ucugaucucccuuggucuucca

SEQ ID NO: 743713 - RNA, 15 nt, Homo sapiens
ucugaucugugaauu

SEQ ID NO: 743714 - RNA, 15 nt, Homo sapiens
ucugaugaucauugc

SEQ ID NO: 743715 - RNA, 16 nt, Homo sapiens
ucugaugaucauugcu

SEQ ID NO: 743716 - RNA, 13 nt, Homo sapiens
ucugauggccagc

SEQ ID NO: 743717 - RNA, 21 nt, Homo sapiens
ucugauggcugcuccacuggg

SEQ ID NO: 743718 - RNA, 18 nt, Homo sapiens
ucugauuacuguccagcu

SEQ ID NO: 743719 - RNA, 18 nt, Homo sapiens
ucugauuuccuaauguca

SEQ ID NO: 743720 - RNA, 20 nt, Homo sapiens
ucugcaaaaauggauauuau

SEQ ID NO: 743721 - RNA, 18 nt, Homo sapiens
ucugcaacagggggcaaa

SEQ ID NO: 743722 - RNA, 22 nt, Homo sapiens
ucugcaacauuugacaaaacua

SEQ ID NO: 743723 - RNA, 23 nt, Homo sapiens
ucugcaauaugaauucaagaaag

SEQ ID NO: 743724 - RNA, 15 nt, Homo sapiens
ucugcacaugucuug

SEQ ID NO: 743725 - RNA, 11 nt, Homo sapiens
ucugcacggga

SEQ ID NO: 743726 - RNA, 13 nt, Homo sapiens
ucugcacuacucc

SEQ ID NO: 743727 - RNA, 13 nt, Homo sapiens
ucugcacugaaaa

SEQ ID NO: 743728 - RNA, 18 nt, Homo sapiens
ucugcagagucacucaca

SEQ ID NO: 743729 - RNA, 21 nt, Homo sapiens
ucugcagggggugugucugcu

SEQ ID NO: 743730 - RNA, 23 nt, Homo sapiens
ucugcagggggugugucugcuca

SEQ ID NO: 743731 - RNA, 14 nt, Homo sapiens
ucugcaguuuaaca

SEQ ID NO: 743732 - RNA, 19 nt, Homo sapiens
ucugcauggaacagcauua

SEQ ID NO: 743733 - RNA, 20 nt, Homo sapiens
ugcccaccugugaucccagc

SEQ ID NO: 743734 - RNA, 23 nt, Homo sapiens
ugcccagccugugcgccggggga

SEQ ID NO: 743735 - RNA, 18 nt, Homo sapiens
ugcccaggcagucuuugc

SEQ ID NO: 743736 - RNA, 21 nt, Homo sapiens
ugcccaggcuggagugcaaug

SEQ ID NO: 743737 - RNA, 20 nt, Homo sapiens
ugcccaggcuggagugcagu

SEQ ID NO: 743738 - RNA, 22 nt, Homo sapiens
ugcccaucgugaagaagccugu

SEQ ID NO: 743739 - RNA, 18 nt, Homo sapiens
ugcccauuuaaugugguu

SEQ ID NO: 743740 - RNA, 18 nt, Homo sapiens
ugccccacauguggccau

SEQ ID NO: 743741 - RNA, 19 nt, Homo sapiens
ugccccaccccaccucaca

SEQ ID NO: 743742 - RNA, 20 nt, Homo sapiens
ugccccaguguggucaagca

SEQ ID NO: 743743 - RNA, 17 nt, Homo sapiens
ugccccccuugccagac

SEQ ID NO: 743744 - RNA, 17 nt, Homo sapiens
ugcccccuccaggagag

SEQ ID NO: 743745 - RNA, 15 nt, Homo sapiens
ugccccgacacccag

SEQ ID NO: 743746 - RNA, 18 nt, Homo sapiens
ugccccgccuccccgaaa

SEQ ID NO: 743747 - RNA, 19 nt, Homo sapiens
ugccccugcaguuggcaga

SEQ ID NO: 743748 - RNA, 13 nt, Homo sapiens
ugcccucauggcc

SEQ ID NO: 743749 - RNA, 16 nt, Homo sapiens
ugcccucuccaaaggc

SEQ ID NO: 743750 - RNA, 22 nt, Homo sapiens
ugcccugaugcgucuacccaga

SEQ ID NO: 743751 - RNA, 13 nt, Homo sapiens
ugcccugccccac

SEQ ID NO: 743752 - RNA, 11 nt, Homo sapiens
ugcccuggcag

SEQ ID NO: 743753 - RNA, 17 nt, Homo sapiens
ugcccugugcaugccau

SEQ ID NO: 743754 - RNA, 23 nt, Homo sapiens
ugcccuguuguguauagaugcaa

SEQ ID NO: 743755 - RNA, 17 nt, Homo sapiens
ugcccuuuaacuuucag

SEQ ID NO: 743756 - RNA, 13 nt, Homo sapiens
ugcccuuuuccag

SEQ ID NO: 743757 - RNA, 17 nt, Homo sapiens
ugccgacuggcugugag

SEQ ID NO: 743758 - RNA, 16 nt, Homo sapiens
ugccgagccuaaugaa

SEQ ID NO: 743759 - RNA, 20 nt, Homo sapiens
ugccgcagacgggcacagac

SEQ ID NO: 743760 - RNA, 20 nt, Homo sapiens
ugccgcagggagggcugugg

SEQ ID NO: 743761 - RNA, 15 nt, Homo sapiens
ugccgccagcugccg

SEQ ID NO: 743762 - RNA, 14 nt, Homo sapiens
ugccgccuacugga

SEQ ID NO: 743763 - RNA, 20 nt, Homo sapiens
ugccgccuccuugugcacaa

SEQ ID NO: 743764 - RNA, 19 nt, Homo sapiens
ugccgcugucucugagggg

SEQ ID NO: 743765 - RNA, 17 nt, Homo sapiens
ugccgcuuucucugagg

SEQ ID NO: 743766 - RNA, 19 nt, Homo sapiens
ugccgcuuucucugagggg

SEQ ID NO: 743767 - RNA, 20 nt, Homo sapiens
ugccggccgggugugguggc

SEQ ID NO: 743768 - RNA, 23 nt, Homo sapiens
ugccgucaccucuccgcucauac

SEQ ID NO: 743769 - RNA, 16 nt, Homo sapiens
ugccgucuucacuucc

SEQ ID NO: 743770 - RNA, 12 nt, Homo sapiens
ugccgugagcag

SEQ ID NO: 743771 - RNA, 17 nt, Homo sapiens
ugccuaaaauuguauga

SEQ ID NO: 743772 - RNA, 20 nt, Homo sapiens
ugccuacacacacagccuau

SEQ ID NO: 743773 - RNA, 15 nt, Homo sapiens
ugccuagacuguuac

SEQ ID NO: 743774 - RNA, 17 nt, Homo sapiens
ugccuaugaaauuucaa

SEQ ID NO: 743775 - RNA, 15 nt, Homo sapiens
ugccucaaugccagu

SEQ ID NO: 743776 - RNA, 14 nt, Homo sapiens
ugccucagccuccc

SEQ ID NO: 743777 - RNA, 18 nt, Homo sapiens
ugccucagccucccgagu

SEQ ID NO: 743778 - RNA, 15 nt, Homo sapiens
ugccucauagcauag

SEQ ID NO: 743779 - RNA, 13 nt, Homo sapiens
ugccuccaccagc

SEQ ID NO: 743780 - RNA, 17 nt, Homo sapiens
ugccuccaccccccaga

SEQ ID NO: 743781 - RNA, 18 nt, Homo sapiens
ugccuccaccccccagaa

SEQ ID NO: 743782 - RNA, 16 nt, Homo sapiens
ugccucccagguucca

SEQ ID NO: 743783 - RNA, 20 nt, Homo sapiens
ugccucccucugcuguguuc

SEQ ID NO: 743784 - RNA, 21 nt, Homo sapiens
ugccucucccgucgucucuuc

SEQ ID NO: 743785 - RNA, 23 nt, Homo sapiens
ugccucugagcagagagcagcag

SEQ ID NO: 743786 - RNA, 16 nt, Homo sapiens
ugccucugcucccucu

SEQ ID NO: 743787 - RNA, 15 nt, Homo sapiens
ugccucuucuuuaug

SEQ ID NO: 743788 - RNA, 15 nt, Homo sapiens
ugccucuucuuugug

SEQ ID NO: 743789 - RNA, 20 nt, Homo sapiens
ugccucuucuuugugccuuu

SEQ ID NO: 743790 - RNA, 14 nt, Homo sapiens
ugccugagauucuu

SEQ ID NO: 743791 - RNA, 14 nt, Homo sapiens
ugccugagcccagg

SEQ ID NO: 743792 - RNA, 19 nt, Homo sapiens
ugccugauccuccaacagc

SEQ ID NO: 743793 - RNA, 23 nt, Homo sapiens
ugccugccccaaacaaauaugca

SEQ ID NO: 743794 - RNA, 15 nt, Homo sapiens
ugccuggccuggcac

SEQ ID NO: 743795 - RNA, 16 nt, Homo sapiens
ugccuggccuggcaca

SEQ ID NO: 743796 - RNA, 21 nt, Homo sapiens
ugccuggggccucaccugcug

SEQ ID NO: 743797 - RNA, 20 nt, Homo sapiens
ugccugggggcuuuugccac

SEQ ID NO: 743798 - RNA, 20 nt, Homo sapiens
ugccuggggucugagcauga

SEQ ID NO: 743799 - RNA, 16 nt, Homo sapiens
ugccuguaacuugaga

SEQ ID NO: 743800 - RNA, 14 nt, Homo sapiens
ugccuguaauccca

SEQ ID NO: 743801 - RNA, 18 nt, Homo sapiens
ugccuguaaucccaacac

SEQ ID NO: 743802 - RNA, 15 nt, Homo sapiens
ugccuguauuuccaa

SEQ ID NO: 743803 - RNA, 16 nt, Homo sapiens
ugccugucccagagag

SEQ ID NO: 743804 - RNA, 13 nt, Homo sapiens
ugccugucucuag

SEQ ID NO: 743805 - RNA, 22 nt, Homo sapiens
ugccugugcagcgggugcugcu

SEQ ID NO: 743806 - RNA, 20 nt, Homo sapiens
ugccuguuauaacucugcac

SEQ ID NO: 743807 - RNA, 15 nt, Homo sapiens
ugccuuaaacacuca

SEQ ID NO: 743808 - RNA, 16 nt, Homo sapiens
ugccuuccucucucua

SEQ ID NO: 743809 - RNA, 15 nt, Homo sapiens
ugccuucucaggaaa

SEQ ID NO: 743810 - RNA, 18 nt, Homo sapiens
ugccuucucaugauccaa

SEQ ID NO: 743811 - RNA, 20 nt, Homo sapiens
ugccuucucuaaacauuuca

SEQ ID NO: 743812 - RNA, 18 nt, Homo sapiens
ugccuucugggaagggag

SEQ ID NO: 743813 - RNA, 15 nt, Homo sapiens
ugccuugaagccacu

SEQ ID NO: 743814 - RNA, 16 nt, Homo sapiens
ugccuugcuucuguau

SEQ ID NO: 743815 - RNA, 21 nt, Homo sapiens
ugccuuggaugagaagugucu

SEQ ID NO: 743816 - RNA, 16 nt, Homo sapiens
ugccuuggugugcugu

SEQ ID NO: 743817 - RNA, 17 nt, Homo sapiens
ugccuuguccucagggc

SEQ ID NO: 743818 - RNA, 16 nt, Homo sapiens
ugccuuuaaaguauga

SEQ ID NO: 743819 - RNA, 19 nt, Homo sapiens
ugccuuucuacaacugauu

SEQ ID NO: 743820 - RNA, 22 nt, Homo sapiens
ugccuuuggauugacucugcau

SEQ ID NO: 743821 - RNA, 20 nt, Homo sapiens
ugccuuuucaucuaauguga

SEQ ID NO: 743822 - RNA, 17 nt, Homo sapiens
ugccuuuuuaaugaaca

SEQ ID NO: 743823 - RNA, 15 nt, Homo sapiens
ugcgacccaagaccc

SEQ ID NO: 743824 - RNA, 17 nt, Homo sapiens
ugcgaccgugaccagga

SEQ ID NO: 743825 - RNA, 21 nt, Homo sapiens
ugcgagacgcacacagcugag

SEQ ID NO: 743826 - RNA, 15 nt, Homo sapiens
ugcgagagaaaggga

SEQ ID NO: 743827 - RNA, 22 nt, Homo sapiens
ugcgccaguccugcuaccuccc

SEQ ID NO: 743828 - RNA, 11 nt, Homo sapiens
ugcgcccuuca

SEQ ID NO: 743829 - RNA, 17 nt, Homo sapiens
ugcgcgcgugcaugugu

SEQ ID NO: 743830 - RNA, 14 nt, Homo sapiens
ugcgcucaccucag

SEQ ID NO: 743831 - RNA, 14 nt, Homo sapiens
ugcgcucuguggau

SEQ ID NO: 743832 - RNA, 16 nt, Homo sapiens
ugcggaagccaaaggc

SEQ ID NO: 743833 - RNA, 12 nt, Homo sapiens
ugcggugcauac

SEQ ID NO: 743834 - RNA, 13 nt, Homo sapiens
ugcguacacagag

SEQ ID NO: 743835 - RNA, 14 nt, Homo sapiens
ugcgugcgcaucuu

SEQ ID NO: 743836 - RNA, 16 nt, Homo sapiens
ugcguggacucugcac

SEQ ID NO: 743837 - RNA, 13 nt, Homo sapiens
ugcgugggggcca

SEQ ID NO: 743838 - RNA, 23 nt, Homo sapiens
ugcgugggugugugcguguuugg

SEQ ID NO: 743839 - RNA, 23 nt, Homo sapiens
ugcguuacacccuuucuugacaa

SEQ ID NO: 743840 - RNA, 16 nt, Homo sapiens
ugcguuuuauaucuuc

SEQ ID NO: 743841 - RNA, 19 nt, Homo sapiens
ugcuaaaggagauuuacac

SEQ ID NO: 743842 - RNA, 21 nt, Homo sapiens
ugcuaaaugcuacauacucca

SEQ ID NO: 743843 - RNA, 22 nt, Homo sapiens
ugcuaaaugcuacauacuccaa

SEQ ID NO: 743844 - RNA, 22 nt, Homo sapiens
ugcuaaauggucgcccaggaga

SEQ ID NO: 743845 - RNA, 23 nt, Homo sapiens
ugcuaaauggucgcccaggagac

SEQ ID NO: 743846 - RNA, 12 nt, Homo sapiens
ugcuaacaaugc

SEQ ID NO: 743847 - RNA, 11 nt, Homo sapiens
ugcuaacuggg

SEQ ID NO: 743848 - RNA, 17 nt, Homo sapiens
uggauaaagccacugaa

SEQ ID NO: 743849 - RNA, 13 nt, Homo sapiens
uggauaauuccaa

SEQ ID NO: 743850 - RNA, 20 nt, Homo sapiens
uggauaauuccaacacaaga

SEQ ID NO: 743851 - RNA, 18 nt, Homo sapiens
uggauagaaccaccauag

SEQ ID NO: 743852 - RNA, 14 nt, Homo sapiens
uggauagucugucc

SEQ ID NO: 743853 - RNA, 21 nt, Homo sapiens
uggauaugacccacacugcca

SEQ ID NO: 743854 - RNA, 21 nt, Homo sapiens
uggaucaaaaagaaacuuugu

SEQ ID NO: 743855 - RNA, 15 nt, Homo sapiens
uggaucacaccucag

SEQ ID NO: 743856 - RNA, 13 nt, Homo sapiens
uggauccugugug

SEQ ID NO: 743857 - RNA, 21 nt, Homo sapiens
uggaucgaguguagcugugaa

SEQ ID NO: 743858 - RNA, 14 nt, Homo sapiens
uggaucuaccagca

SEQ ID NO: 743859 - RNA, 15 nt, Homo sapiens
uggaucuaccagcau

SEQ ID NO: 743860 - RNA, 17 nt, Homo sapiens
uggaucuaccagcauaa

SEQ ID NO: 743861 - RNA, 22 nt, Homo sapiens
uggaucuuggagaaugugagaa

SEQ ID NO: 743862 - RNA, 21 nt, Homo sapiens
uggaugacccuccccuaguca

SEQ ID NO: 743863 - RNA, 13 nt, Homo sapiens
uggaugaucucaa

SEQ ID NO: 743864 - RNA, 20 nt, Homo sapiens
uggaugauuuuuuaagcaga

SEQ ID NO: 743865 - RNA, 15 nt, Homo sapiens
uggaugcacuuccug

SEQ ID NO: 743866 - RNA, 15 nt, Homo sapiens
uggaugcagcucuug

SEQ ID NO: 743867 - RNA, 13 nt, Homo sapiens
uggaugcggccau

SEQ ID NO: 743868 - RNA, 14 nt, Homo sapiens
uggauggaauauca

SEQ ID NO: 743869 - RNA, 18 nt, Homo sapiens
uggauggcacccuggaac

SEQ ID NO: 743870 - RNA, 16 nt, Homo sapiens
uggaugggggaacuca

SEQ ID NO: 743871 - RNA, 23 nt, Homo sapiens
uggauguauggggaaucuaagag

SEQ ID NO: 743872 - RNA, 13 nt, Homo sapiens
uggauguucugac

SEQ ID NO: 743873 - RNA, 22 nt, Homo sapiens
uggauguucugacccugcuuca

SEQ ID NO: 743874 - RNA, 15 nt, Homo sapiens
uggauuacuauugca

SEQ ID NO: 743875 - RNA, 15 nt, Homo sapiens
uggauucagcauguc

SEQ ID NO: 743876 - RNA, 18 nt, Homo sapiens
uggauucaucagcauuug

SEQ ID NO: 743877 - RNA, 20 nt, Homo sapiens
uggauucuuuaaacgcucua

SEQ ID NO: 743878 - RNA, 17 nt, Homo sapiens
uggauuguuacagcuuc

SEQ ID NO: 743879 - RNA, 23 nt, Homo sapiens
uggauuugcaggugaacagccuc

SEQ ID NO: 743880 - RNA, 18 nt, Homo sapiens
uggauuuucaucaggggc

SEQ ID NO: 743881 - RNA, 19 nt, Homo sapiens
uggauuuuuaaaaugucaa

SEQ ID NO: 743882 - RNA, 18 nt, Homo sapiens
uggauuuuucuuuaacug

SEQ ID NO: 743883 - RNA, 19 nt, Homo sapiens
uggcaaacccucccagaaa

SEQ ID NO: 743884 - RNA, 17 nt, Homo sapiens
uggcaaacguuucucaa

SEQ ID NO: 743885 - RNA, 14 nt, Homo sapiens
uggcaaagugcugu

SEQ ID NO: 743886 - RNA, 20 nt, Homo sapiens
uggcaacaacuuagaagaaa

SEQ ID NO: 743887 - RNA, 14 nt, Homo sapiens
uggcaacaaugccc

SEQ ID NO: 743888 - RNA, 22 nt, Homo sapiens
uggcaaccugcuuucaagaccc

SEQ ID NO: 743889 - RNA, 14 nt, Homo sapiens
uggcaagaaagcuu

SEQ ID NO: 743890 - RNA, 22 nt, Homo sapiens
uggcaaggacuuuguacauuug

SEQ ID NO: 743891 - RNA, 21 nt, Homo sapiens
uggcaaggcuuaggaaaguga

SEQ ID NO: 743892 - RNA, 22 nt, Homo sapiens
uggcaagucaccugcagcccau

SEQ ID NO: 743893 - RNA, 14 nt, Homo sapiens
uggcaagugauauc

SEQ ID NO: 743894 - RNA, 13 nt, Homo sapiens
uggcacacaccug

SEQ ID NO: 743895 - RNA, 15 nt, Homo sapiens
uggcacacgccugua

SEQ ID NO: 743896 - RNA, 16 nt, Homo sapiens
uggcaccuucagacuu

SEQ ID NO: 743897 - RNA, 23 nt, Homo sapiens
uggcacgcgccuguaaucccagc

SEQ ID NO: 743898 - RNA, 15 nt, Homo sapiens
uggcacguaagcucc

SEQ ID NO: 743899 - RNA, 18 nt, Homo sapiens
uggcacgugccugugauc

SEQ ID NO: 743900 - RNA, 17 nt, Homo sapiens
uggcacucaacucugag

SEQ ID NO: 743901 - RNA, 15 nt, Homo sapiens
uggcacucagucucu

SEQ ID NO: 743902 - RNA, 13 nt, Homo sapiens
uggcacugcauac

SEQ ID NO: 743903 - RNA, 19 nt, Homo sapiens
uggcacuuugaaggggccu

SEQ ID NO: 743904 - RNA, 19 nt, Homo sapiens
uggcagaaccaaagcucaa

SEQ ID NO: 743905 - RNA, 12 nt, Homo sapiens
uggcagacaucu

SEQ ID NO: 743906 - RNA, 20 nt, Homo sapiens
uggcagaccgugaccaucuu

SEQ ID NO: 743907 - RNA, 20 nt, Homo sapiens
uggcagagccagagcuugaa

SEQ ID NO: 743908 - RNA, 19 nt, Homo sapiens
uggcagaguuacaguucug

SEQ ID NO: 743909 - RNA, 14 nt, Homo sapiens
uggcagauuuuaca

SEQ ID NO: 743910 - RNA, 21 nt, Homo sapiens
uggcagcaucuucacuucuaa

SEQ ID NO: 743911 - RNA, 20 nt, Homo sapiens
uggcagcccuguguguguca

SEQ ID NO: 743912 - RNA, 16 nt, Homo sapiens
uggcaggaugaugcug

SEQ ID NO: 743913 - RNA, 12 nt, Homo sapiens
uggcaggcccac

SEQ ID NO: 743914 - RNA, 21 nt, Homo sapiens
uggcaggugucauaugacuga

SEQ ID NO: 743915 - RNA, 17 nt, Homo sapiens
uggcagucccuuauaau

SEQ ID NO: 743916 - RNA, 21 nt, Homo sapiens
uggcaguguggcagugaccau

SEQ ID NO: 743917 - RNA, 17 nt, Homo sapiens
uggcauaaccugucuca

SEQ ID NO: 743918 - RNA, 16 nt, Homo sapiens
uggcauagccccggcc

SEQ ID NO: 743919 - RNA, 21 nt, Homo sapiens
uggcauauauguucaaauuca

SEQ ID NO: 743920 - RNA, 21 nt, Homo sapiens
uggcauauuuuucacauaucu

SEQ ID NO: 743921 - RNA, 21 nt, Homo sapiens
uggcauccaagacucuuuaug

SEQ ID NO: 743922 - RNA, 22 nt, Homo sapiens
uggcauccaagacucuuuauga

SEQ ID NO: 743923 - RNA, 23 nt, Homo sapiens
uggcaugacucuugacucuugcc

SEQ ID NO: 743924 - RNA, 14 nt, Homo sapiens
uggcaugccuucca

SEQ ID NO: 743925 - RNA, 15 nt, Homo sapiens
uggcaugccuuccag

SEQ ID NO: 743926 - RNA, 23 nt, Homo sapiens
uggcauuacaggugugagccacg

SEQ ID NO: 743927 - RNA, 17 nt, Homo sapiens
uggcauuuccuggucag

SEQ ID NO: 743928 - RNA, 14 nt, Homo sapiens
uggccaaagaccaa

SEQ ID NO: 743929 - RNA, 14 nt, Homo sapiens
uggccaacuguuac

SEQ ID NO: 743930 - RNA, 22 nt, Homo sapiens
uggccaagaagcaguggccuua

SEQ ID NO: 743931 - RNA, 12 nt, Homo sapiens
uggccaagcaga

SEQ ID NO: 743932 - RNA, 20 nt, Homo sapiens
uggccacaguaauuggucau

SEQ ID NO: 743933 - RNA, 16 nt, Homo sapiens
uggccacagugucacu

SEQ ID NO: 743934 - RNA, 12 nt, Homo sapiens
uggccacgcagc

SEQ ID NO: 743935 - RNA, 20 nt, Homo sapiens
uggccacgcagccaggacac

SEQ ID NO: 743936 - RNA, 21 nt, Homo sapiens
uggccacugucuccacucaca

SEQ ID NO: 743937 - RNA, 16 nt, Homo sapiens
uggccagaggugucac

SEQ ID NO: 743938 - RNA, 22 nt, Homo sapiens
uggccagccuggaucuccucaa

SEQ ID NO: 743939 - RNA, 21 nt, Homo sapiens
uggccagcgucuugcucuguu

SEQ ID NO: 743940 - RNA, 18 nt, Homo sapiens
uggccaggcuggucucaa

SEQ ID NO: 743941 - RNA, 13 nt, Homo sapiens
uggccaguucauu

SEQ ID NO: 743942 - RNA, 17 nt, Homo sapiens
uggccaucagccuggau

SEQ ID NO: 743943 - RNA, 14 nt, Homo sapiens
uggccaucuguauu

SEQ ID NO: 743944 - RNA, 13 nt, Homo sapiens
uggccaugcagaa

SEQ ID NO: 743945 - RNA, 18 nt, Homo sapiens
uggccauggugacauugu

SEQ ID NO: 743946 - RNA, 18 nt, Homo sapiens
uggccauuccaacagcuc

SEQ ID NO: 743947 - RNA, 15 nt, Homo sapiens
uggcccaacacaauu

SEQ ID NO: 743948 - RNA, 13 nt, Homo sapiens
uggcccaagaccc

SEQ ID NO: 743949 - RNA, 23 nt, Homo sapiens
uggcccagccggccucucuggcc

SEQ ID NO: 743950 - RNA, 15 nt, Homo sapiens
uggcccagcuuuuag

SEQ ID NO: 743951 - RNA, 17 nt, Homo sapiens
uggcccagggaagccaa

SEQ ID NO: 743952 - RNA, 16 nt, Homo sapiens
uggcccauaaugugaa

SEQ ID NO: 743953 - RNA, 20 nt, Homo sapiens
uggcccauagaaacaugaca

SEQ ID NO: 743954 - RNA, 14 nt, Homo sapiens
uggccccacuuuga

SEQ ID NO: 743955 - RNA, 19 nt, Homo sapiens
uggccccaguccaugcuuc

SEQ ID NO: 743956 - RNA, 14 nt, Homo sapiens
uggccccaugucuc

SEQ ID NO: 743957 - RNA, 17 nt, Homo sapiens
uggcccccacagaaaga

SEQ ID NO: 743958 - RNA, 21 nt, Homo sapiens
uggccgaaaaggauaugcagu

SEQ ID NO: 743959 - RNA, 23 nt, Homo sapiens
uggccgaggacuuugauugcaca

SEQ ID NO: 743960 - RNA, 23 nt, Homo sapiens
uggccgucccuaagcaugugucc

SEQ ID NO: 743961 - RNA, 14 nt, Homo sapiens
uggccuaugcacau

SEQ ID NO: 743962 - RNA, 14 nt, Homo sapiens
uguaaugcugcaca

SEQ ID NO: 743963 - RNA, 14 nt, Homo sapiens
uguaauuccagcua

SEQ ID NO: 743964 - RNA, 22 nt, Homo sapiens
uguaauuggaaucuucaccuca

SEQ ID NO: 743965 - RNA, 21 nt, Homo sapiens
uguaauuguggauuaauguca

SEQ ID NO: 743966 - RNA, 16 nt, Homo sapiens
uguaauuucgccuuaa

SEQ ID NO: 743967 - RNA, 16 nt, Homo sapiens
uguacaacuuaacuca

SEQ ID NO: 743968 - RNA, 18 nt, Homo sapiens
uguacaaugguuuauucc

SEQ ID NO: 743969 - RNA, 14 nt, Homo sapiens
uguacacagucagc

SEQ ID NO: 743970 - RNA, 13 nt, Homo sapiens
uguacaccaaggu

SEQ ID NO: 743971 - RNA, 17 nt, Homo sapiens
uguacacugacuugaga

SEQ ID NO: 743972 - RNA, 22 nt, Homo sapiens
uguacacugacuugagaccagu

SEQ ID NO: 743973 - RNA, 15 nt, Homo sapiens
uguacagacauacau

SEQ ID NO: 743974 - RNA, 20 nt, Homo sapiens
uguacagaccaccuuucaca

SEQ ID NO: 743975 - RNA, 13 nt, Homo sapiens
uguacagacuguu

SEQ ID NO: 743976 - RNA, 11 nt, Homo sapiens
uguacagguac

SEQ ID NO: 743977 - RNA, 21 nt, Homo sapiens
uguacaguagauuuuccaaau

SEQ ID NO: 743978 - RNA, 23 nt, Homo sapiens
uguacauaacuuagagacuuuag

SEQ ID NO: 743979 - RNA, 18 nt, Homo sapiens
uguacauguaacauuaaa

SEQ ID NO: 743980 - RNA, 20 nt, Homo sapiens
uguacauguguagccugugc

SEQ ID NO: 743981 - RNA, 22 nt, Homo sapiens
uguacauguguagccugugcau

SEQ ID NO: 743982 - RNA, 15 nt, Homo sapiens
uguacauugugggau

SEQ ID NO: 743983 - RNA, 15 nt, Homo sapiens
uguaccaaugaugaa

SEQ ID NO: 743984 - RNA, 20 nt, Homo sapiens
uguaccacuacuuagagaua

SEQ ID NO: 743985 - RNA, 13 nt, Homo sapiens
uguaccaguuugu

SEQ ID NO: 743986 - RNA, 22 nt, Homo sapiens
uguaccauauucagcauuugau

SEQ ID NO: 743987 - RNA, 16 nt, Homo sapiens
uguacccgagcacaua

SEQ ID NO: 743988 - RNA, 17 nt, Homo sapiens
uguacuaaaccaccuca

SEQ ID NO: 743989 - RNA, 19 nt, Homo sapiens
uguacuauguuaauaacuu

SEQ ID NO: 743990 - RNA, 13 nt, Homo sapiens
uguacuauuuaac

SEQ ID NO: 743991 - RNA, 18 nt, Homo sapiens
uguacucaaguaccacca

SEQ ID NO: 743992 - RNA, 23 nt, Homo sapiens
uguacugcaaagucgccagucac

SEQ ID NO: 743993 - RNA, 22 nt, Homo sapiens
uguacuuauauccacacugcac

SEQ ID NO: 743994 - RNA, 17 nt, Homo sapiens
uguacuuccuguguacu

SEQ ID NO: 743995 - RNA, 19 nt, Homo sapiens
uguacuuuaaaaagaugua

SEQ ID NO: 743996 - RNA, 15 nt, Homo sapiens
uguagaagauggacu

SEQ ID NO: 743997 - RNA, 16 nt, Homo sapiens
uguagacaaaguacau

SEQ ID NO: 743998 - RNA, 15 nt, Homo sapiens
uguagacuauuugcu

SEQ ID NO: 743999 - RNA, 17 nt, Homo sapiens
uguagagagaacaggug

SEQ ID NO: 744000 - RNA, 12 nt, Homo sapiens
uguagauauugu

SEQ ID NO: 744001 - RNA, 17 nt, Homo sapiens
uguagauauugugaagu

SEQ ID NO: 744002 - RNA, 20 nt, Homo sapiens
uguagaugggggaacuguga

SEQ ID NO: 744003 - RNA, 22 nt, Homo sapiens
uguagcagcuauauauuucccc

SEQ ID NO: 744004 - RNA, 16 nt, Homo sapiens
uguagcauuggaucaa

SEQ ID NO: 744005 - RNA, 22 nt, Homo sapiens
uguagcauuucuugauguugcu

SEQ ID NO: 744006 - RNA, 19 nt, Homo sapiens
uguagccauggcucaggca

SEQ ID NO: 744007 - RNA, 16 nt, Homo sapiens
uguagcccauccuucc

SEQ ID NO: 744008 - RNA, 14 nt, Homo sapiens
uguagccugugcau

SEQ ID NO: 744009 - RNA, 17 nt, Homo sapiens
uguagcuccucaacuca

SEQ ID NO: 744010 - RNA, 23 nt, Homo sapiens
uguagcuuugcucuuugguagaa

SEQ ID NO: 744011 - RNA, 15 nt, Homo sapiens
uguaggauucaaguc

SEQ ID NO: 744012 - RNA, 18 nt, Homo sapiens
uguaggcacagagcugca

SEQ ID NO: 744013 - RNA, 18 nt, Homo sapiens
uguaggcuuaucagggag

SEQ ID NO: 744014 - RNA, 18 nt, Homo sapiens
uguagucccagcuacuca

SEQ ID NO: 744015 - RNA, 20 nt, Homo sapiens
uguagucccagcuacuugag

SEQ ID NO: 744016 - RNA, 18 nt, Homo sapiens
uguaguccuagccacuca

SEQ ID NO: 744017 - RNA, 21 nt, Homo sapiens
uguagugcauuuuuaaacuug

SEQ ID NO: 744018 - RNA, 15 nt, Homo sapiens
uguaguuacuguggu

SEQ ID NO: 744019 - RNA, 23 nt, Homo sapiens
uguaguugggccuaaauaaauga

SEQ ID NO: 744020 - RNA, 18 nt, Homo sapiens
uguaguuuuacuuuccua

SEQ ID NO: 744021 - RNA, 16 nt, Homo sapiens
uguauaaaauagacaa

SEQ ID NO: 744022 - RNA, 14 nt, Homo sapiens
uguauacuuguaua

SEQ ID NO: 744023 - RNA, 18 nt, Homo sapiens
uguauagcuuaccugaac

SEQ ID NO: 744024 - RNA, 15 nt, Homo sapiens
uguauaggacucuca

SEQ ID NO: 744025 - RNA, 20 nt, Homo sapiens
uguauauaaauacaugcaca

SEQ ID NO: 744026 - RNA, 17 nt, Homo sapiens
uguauauaaaugaacaa

SEQ ID NO: 744027 - RNA, 21 nt, Homo sapiens
uguauauagaguggaaucucu

SEQ ID NO: 744028 - RNA, 19 nt, Homo sapiens
uguauauucaggacuugaa

SEQ ID NO: 744029 - RNA, 20 nt, Homo sapiens
uguauauuguggauguguuc

SEQ ID NO: 744030 - RNA, 18 nt, Homo sapiens
uguaucaaaaucacuauc

SEQ ID NO: 744031 - RNA, 19 nt, Homo sapiens
uguaucccaacuccuauaa

SEQ ID NO: 744032 - RNA, 21 nt, Homo sapiens
uguaucccuacaucuaacuca

SEQ ID NO: 744033 - RNA, 23 nt, Homo sapiens
uguaucuaaaaaauaacugugca

SEQ ID NO: 744034 - RNA, 12 nt, Homo sapiens
uguaucugaggg

SEQ ID NO: 744035 - RNA, 14 nt, Homo sapiens
uguaucuugccuaa

SEQ ID NO: 744036 - RNA, 13 nt, Homo sapiens
uguaugacaguga

SEQ ID NO: 744037 - RNA, 14 nt, Homo sapiens
uguaugacuaaaga

SEQ ID NO: 744038 - RNA, 19 nt, Homo sapiens
uguaugagcuucuaacuca

SEQ ID NO: 744039 - RNA, 23 nt, Homo sapiens
uguaugaguaucuguauguauau

SEQ ID NO: 744040 - RNA, 15 nt, Homo sapiens
uguaugaugagcaua

SEQ ID NO: 744041 - RNA, 19 nt, Homo sapiens
uguaugcagggagcacugu

SEQ ID NO: 744042 - RNA, 16 nt, Homo sapiens
uguauggaucuauauu

SEQ ID NO: 744043 - RNA, 11 nt, Homo sapiens
uguauguauag

SEQ ID NO: 744044 - RNA, 23 nt, Homo sapiens
uguaugugagagauucugugauc

SEQ ID NO: 744045 - RNA, 17 nt, Homo sapiens
uguauguguggcugugg

SEQ ID NO: 744046 - RNA, 17 nt, Homo sapiens
uguaugugugugcaugu

SEQ ID NO: 744047 - RNA, 17 nt, Homo sapiens
uguauguuccucuauga

SEQ ID NO: 744048 - RNA, 18 nt, Homo sapiens
uguauguuccucuaugaa

SEQ ID NO: 744049 - RNA, 22 nt, Homo sapiens
uguauguuuacauaucaccuca

SEQ ID NO: 744050 - RNA, 23 nt, Homo sapiens
uguauguuuacauaucaccucau

SEQ ID NO: 744051 - RNA, 15 nt, Homo sapiens
uguauuaauaaagca

SEQ ID NO: 744052 - RNA, 12 nt, Homo sapiens
uguauuacaaau

SEQ ID NO: 744053 - RNA, 23 nt, Homo sapiens
uguauucacgccauugguuggaa

SEQ ID NO: 744054 - RNA, 16 nt, Homo sapiens
uguauucagaggcagu

SEQ ID NO: 744055 - RNA, 19 nt, Homo sapiens
uguauucaugaacuuggcu

SEQ ID NO: 744056 - RNA, 15 nt, Homo sapiens
uguauuccugucauu

SEQ ID NO: 744057 - RNA, 13 nt, Homo sapiens
uguauugccaucc

SEQ ID NO: 744058 - RNA, 16 nt, Homo sapiens
uguauuguauugccca

SEQ ID NO: 744059 - RNA, 15 nt, Homo sapiens
uguauuuaacugccu

SEQ ID NO: 744060 - RNA, 18 nt, Homo sapiens
uguauuuaauuuuaacug

SEQ ID NO: 744061 - RNA, 15 nt, Homo sapiens
uguauuuacaguuuc

SEQ ID NO: 744062 - RNA, 11 nt, Homo sapiens
uguauuuacuu

SEQ ID NO: 744063 - RNA, 18 nt, Homo sapiens
uguauuuauggagugccu

SEQ ID NO: 744064 - RNA, 14 nt, Homo sapiens
uguauuuauuucau

SEQ ID NO: 744065 - RNA, 20 nt, Homo sapiens
uguauuuccagugcaauugu

SEQ ID NO: 744066 - RNA, 19 nt, Homo sapiens
uguauuuuaauaacauauc

SEQ ID NO: 744067 - RNA, 18 nt, Homo sapiens
uguauuuuuaaugggggu

SEQ ID NO: 744068 - RNA, 14 nt, Homo sapiens
ugucaaaagccaga

SEQ ID NO: 744069 - RNA, 14 nt, Homo sapiens
ugucaaagaagcuu

SEQ ID NO: 744070 - RNA, 13 nt, Homo sapiens
ugucaacaucaaa

SEQ ID NO: 744071 - RNA, 17 nt, Homo sapiens
ugucaaugauuucaaaa

SEQ ID NO: 744072 - RNA, 20 nt, Homo sapiens
ugucaaugugaacguccaca

SEQ ID NO: 744073 - RNA, 13 nt, Homo sapiens
ugucacaaccaag

SEQ ID NO: 744074 - RNA, 21 nt, Homo sapiens
ugucacaaccucucugaucuu

SEQ ID NO: 744075 - RNA, 23 nt, Homo sapiens
ugucaccaacugaaguggcuaaa

SEQ ID NO: 744076 - RNA, 22 nt, Homo sapiens
ugucacccuuguccuugagugc

SEQ ID NO: 744077 - RNA, 15 nt, Homo sapiens
uuaagaaaaaagugu

SEQ ID NO: 744078 - RNA, 17 nt, Homo sapiens
uuaagaaaaacauguca

SEQ ID NO: 744079 - RNA, 19 nt, Homo sapiens
uuaagaaaaacaugucaug

SEQ ID NO: 744080 - RNA, 15 nt, Homo sapiens
uuaagaaacacaggg

SEQ ID NO: 744081 - RNA, 14 nt, Homo sapiens
uuaagaaacuagca

SEQ ID NO: 744082 - RNA, 13 nt, Homo sapiens
uuaagaaauucca

SEQ ID NO: 744083 - RNA, 19 nt, Homo sapiens
uuaagaacaaacucugaaa

SEQ ID NO: 744084 - RNA, 21 nt, Homo sapiens
uuaagaacaucaaaacuaacc

SEQ ID NO: 744085 - RNA, 16 nt, Homo sapiens
uuaagaaccugaauau

SEQ ID NO: 744086 - RNA, 18 nt, Homo sapiens
uuaagaauuucacaagcu

SEQ ID NO: 744087 - RNA, 13 nt, Homo sapiens
uuaagacagugua

SEQ ID NO: 744088 - RNA, 19 nt, Homo sapiens
uuaagaccuacuguucuaa

SEQ ID NO: 744089 - RNA, 14 nt, Homo sapiens
uuaagagacacucc

SEQ ID NO: 744090 - RNA, 15 nt, Homo sapiens
uuaagagacacucca

SEQ ID NO: 744091 - RNA, 12 nt, Homo sapiens
uuaagagcucac

SEQ ID NO: 744092 - RNA, 17 nt, Homo sapiens
uuaagauacaaauuaau

SEQ ID NO: 744093 - RNA, 19 nt, Homo sapiens
uuaagauccacaaaugaag

SEQ ID NO: 744094 - RNA, 13 nt, Homo sapiens
uuaagcaagaaug

SEQ ID NO: 744095 - RNA, 13 nt, Homo sapiens
uuaagcacuuuaa

SEQ ID NO: 744096 - RNA, 14 nt, Homo sapiens
uuaagcagaacaaa

SEQ ID NO: 744097 - RNA, 11 nt, Homo sapiens
uuaagcagcuc

SEQ ID NO: 744098 - RNA, 18 nt, Homo sapiens
uuaagcccuaagguccua

SEQ ID NO: 744099 - RNA, 23 nt, Homo sapiens
uuaagccugauuuuccugaugcu

SEQ ID NO: 744100 - RNA, 16 nt, Homo sapiens
uuaagcgugucuguau

SEQ ID NO: 744101 - RNA, 15 nt, Homo sapiens
uuaagcguuguagua

SEQ ID NO: 744102 - RNA, 21 nt, Homo sapiens
uuaagcuaggauguugcucag

SEQ ID NO: 744103 - RNA, 19 nt, Homo sapiens
uuaagcugggauaaucaca

SEQ ID NO: 744104 - RNA, 22 nt, Homo sapiens
uuaagcugggauaaucacauua

SEQ ID NO: 744105 - RNA, 14 nt, Homo sapiens
uuaaggauguugcc

SEQ ID NO: 744106 - RNA, 14 nt, Homo sapiens
uuaaggccugaauc

SEQ ID NO: 744107 - RNA, 15 nt, Homo sapiens
uuaagguuaugcacu

SEQ ID NO: 744108 - RNA, 14 nt, Homo sapiens
uuaaguauauauau

SEQ ID NO: 744109 - RNA, 23 nt, Homo sapiens
uuaaguaucuuuuuucaaaaaca

SEQ ID NO: 744110 - RNA, 20 nt, Homo sapiens
uuaagucaagaauauaauau

SEQ ID NO: 744111 - RNA, 14 nt, Homo sapiens
uuaagucagugaca

SEQ ID NO: 744112 - RNA, 23 nt, Homo sapiens
uuaagugaaagagauuacuuaaa

SEQ ID NO: 744113 - RNA, 20 nt, Homo sapiens
uuaagugacuauagaaugca

SEQ ID NO: 744114 - RNA, 12 nt, Homo sapiens
uuaagugccuuu

SEQ ID NO: 744115 - RNA, 16 nt, Homo sapiens
uuaaguggguuugccc

SEQ ID NO: 744116 - RNA, 23 nt, Homo sapiens
uuaaguguaacuggcaguuuucc

SEQ ID NO: 744117 - RNA, 13 nt, Homo sapiens
uuaaguuugaaaa

SEQ ID NO: 744118 - RNA, 20 nt, Homo sapiens
uuaauaaaaauacacaugaa

SEQ ID NO: 744119 - RNA, 18 nt, Homo sapiens
uuaauaaagacgauuugu

SEQ ID NO: 744120 - RNA, 21 nt, Homo sapiens
uuaauaacuuguccuauguca

SEQ ID NO: 744121 - RNA, 22 nt, Homo sapiens
uuaauaagaacuugaauuucug

SEQ ID NO: 744122 - RNA, 21 nt, Homo sapiens
uuaauaaguauuuauugcaua

SEQ ID NO: 744123 - RNA, 23 nt, Homo sapiens
uuaauaaucagcaagaauuugau

SEQ ID NO: 744124 - RNA, 18 nt, Homo sapiens
uuaauacaugcaacagaa

SEQ ID NO: 744125 - RNA, 16 nt, Homo sapiens
uuaauaccagcuuaaa

SEQ ID NO: 744126 - RNA, 19 nt, Homo sapiens
uuaauacucaaaugaguaa

SEQ ID NO: 744127 - RNA, 15 nt, Homo sapiens
uuaauacuccagaga

SEQ ID NO: 744128 - RNA, 18 nt, Homo sapiens
uuaauagacugagucaga

SEQ ID NO: 744129 - RNA, 21 nt, Homo sapiens
uuaauaguuuugauccuaaau

SEQ ID NO: 744130 - RNA, 13 nt, Homo sapiens
uuaauauacuaga

SEQ ID NO: 744131 - RNA, 17 nt, Homo sapiens
uuaauaucaacucugaa

SEQ ID NO: 744132 - RNA, 21 nt, Homo sapiens
uuaauaugccuguuauuccua

SEQ ID NO: 744133 - RNA, 14 nt, Homo sapiens
uuaauauugaggcu

SEQ ID NO: 744134 - RNA, 21 nt, Homo sapiens
uuaaucagugaagaugcaauc

SEQ ID NO: 744135 - RNA, 16 nt, Homo sapiens
uuaaucaucaaaaaga

SEQ ID NO: 744136 - RNA, 20 nt, Homo sapiens
uuaaucaugaaauuacuuau

SEQ ID NO: 744137 - RNA, 14 nt, Homo sapiens
uuaaucaugaaugu

SEQ ID NO: 744138 - RNA, 14 nt, Homo sapiens
uuaauccagggaag

SEQ ID NO: 744139 - RNA, 22 nt, Homo sapiens
uuaaucuagagaaggcauuuca

SEQ ID NO: 744140 - RNA, 20 nt, Homo sapiens
uuaaucuuucuuuaccugag

SEQ ID NO: 744141 - RNA, 13 nt, Homo sapiens
uuaaugaacuaac

SEQ ID NO: 744142 - RNA, 18 nt, Homo sapiens
uuaaugaacuaacugaca

SEQ ID NO: 744143 - RNA, 15 nt, Homo sapiens
uuaaugacagagcca

SEQ ID NO: 744144 - RNA, 17 nt, Homo sapiens
uuaaugagucagucaau

SEQ ID NO: 744145 - RNA, 16 nt, Homo sapiens
uuaaugauaaacucag

SEQ ID NO: 744146 - RNA, 22 nt, Homo sapiens
uuaaugauaaacucagaucuga

SEQ ID NO: 744147 - RNA, 20 nt, Homo sapiens
uuaaugccugcuuuuuggaa

SEQ ID NO: 744148 - RNA, 15 nt, Homo sapiens
uuaaugcuucauuca

SEQ ID NO: 744149 - RNA, 15 nt, Homo sapiens
uuaauggauucagua

SEQ ID NO: 744150 - RNA, 14 nt, Homo sapiens
uuaauggcacugau

SEQ ID NO: 744151 - RNA, 21 nt, Homo sapiens
uuaauggcagcuagugccuuu

SEQ ID NO: 744152 - RNA, 17 nt, Homo sapiens
uuaauggguaugcucag

SEQ ID NO: 744153 - RNA, 18 nt, Homo sapiens
uuaaugugcugagcauuu

SEQ ID NO: 744154 - RNA, 15 nt, Homo sapiens
uuaauguguauucau

SEQ ID NO: 744155 - RNA, 17 nt, Homo sapiens
uuaauuaaguacaacca

SEQ ID NO: 744156 - RNA, 18 nt, Homo sapiens
uuaauuagggguugcuaa

SEQ ID NO: 744157 - RNA, 21 nt, Homo sapiens
uuaauuaguuuauauuacucu

SEQ ID NO: 744158 - RNA, 16 nt, Homo sapiens
uuaauucacucccaca

SEQ ID NO: 744159 - RNA, 18 nt, Homo sapiens
uuaauuuuuuacuuucag

SEQ ID NO: 744160 - RNA, 16 nt, Homo sapiens
uuacaaaccauuaccu

SEQ ID NO: 744161 - RNA, 12 nt, Homo sapiens
uuacaaacugca

SEQ ID NO: 744162 - RNA, 21 nt, Homo sapiens
uuacaaacuuuguuugucaca

SEQ ID NO: 744163 - RNA, 18 nt, Homo sapiens
uuacaaauggacauagga

SEQ ID NO: 744164 - RNA, 15 nt, Homo sapiens
uuacaaaugugaaac

SEQ ID NO: 744165 - RNA, 20 nt, Homo sapiens
uuacaacaguagagagggaa

SEQ ID NO: 744166 - RNA, 19 nt, Homo sapiens
uuacaaggcccuuuccuuu

SEQ ID NO: 744167 - RNA, 14 nt, Homo sapiens
uuacaaggugacaa

SEQ ID NO: 744168 - RNA, 19 nt, Homo sapiens
uuacaaucagccacauucu

SEQ ID NO: 744169 - RNA, 19 nt, Homo sapiens
uuacacaguugcugucaua

SEQ ID NO: 744170 - RNA, 12 nt, Homo sapiens
uuacacauaccc

SEQ ID NO: 744171 - RNA, 16 nt, Homo sapiens
uuacaccaacuccuaa

SEQ ID NO: 744172 - RNA, 18 nt, Homo sapiens
uuacacccuuucuugaca

SEQ ID NO: 744173 - RNA, 15 nt, Homo sapiens
uuacacguaccucuc

SEQ ID NO: 744174 - RNA, 13 nt, Homo sapiens
uuacacucuugau

SEQ ID NO: 744175 - RNA, 17 nt, Homo sapiens
uuacacugugucauucu

SEQ ID NO: 744176 - RNA, 19 nt, Homo sapiens
uuacacugugucauucugu

SEQ ID NO: 744177 - RNA, 19 nt, Homo sapiens
uuacagaaaagacucugac

SEQ ID NO: 744178 - RNA, 21 nt, Homo sapiens
uuacagaaaagacucugacca

SEQ ID NO: 744179 - RNA, 23 nt, Homo sapiens
uuacagaaaauuguugugcuuag

SEQ ID NO: 744180 - RNA, 14 nt, Homo sapiens
uuacagaaacugca

SEQ ID NO: 744181 - RNA, 14 nt, Homo sapiens
uuacagacugugag

SEQ ID NO: 744182 - RNA, 17 nt, Homo sapiens
uuacagaggacccuuac

SEQ ID NO: 744183 - RNA, 20 nt, Homo sapiens
uuacaggaagucccuugcca

SEQ ID NO: 744184 - RNA, 17 nt, Homo sapiens
uuacaggcgugauccac

SEQ ID NO: 744185 - RNA, 19 nt, Homo sapiens
uuacaguaaucccauuucc

SEQ ID NO: 744186 - RNA, 18 nt, Homo sapiens
uuacaguccaaaauacug

SEQ ID NO: 744187 - RNA, 23 nt, Homo sapiens
uuacagugagccaagauugcacc

SEQ ID NO: 744188 - RNA, 11 nt, Homo sapiens
uuacaguucug

SEQ ID NO: 744189 - RNA, 12 nt, Homo sapiens
uuacaguuucca

SEQ ID NO: 744190 - RNA, 11 nt, Homo sapiens
uuacauaugcc

SEQ ID NO: 744191 - RNA, 17 nt, Homo sapiens
uuacaugaagcuguaua

SEQ ID NO: 744192 - RNA, 14 nt, Homo sapiens
uuuaguuauaaaca

SEQ ID NO: 744193 - RNA, 14 nt, Homo sapiens
uuuaguucagugac

SEQ ID NO: 744194 - RNA, 16 nt, Homo sapiens
uuuauaaaaguguuca

SEQ ID NO: 744195 - RNA, 16 nt, Homo sapiens
uuuauaaaauuuugcu

SEQ ID NO: 744196 - RNA, 15 nt, Homo sapiens
uuuauaaaggccaaa

SEQ ID NO: 744197 - RNA, 23 nt, Homo sapiens
uuuauaaagucuaagcaagaugu

SEQ ID NO: 744198 - RNA, 19 nt, Homo sapiens
uuuauaaaucuuaugcucu

SEQ ID NO: 744199 - RNA, 13 nt, Homo sapiens
uuuauaaauuacu

SEQ ID NO: 744200 - RNA, 22 nt, Homo sapiens
uuuauaauucagaagacuacua

SEQ ID NO: 744201 - RNA, 12 nt, Homo sapiens
uuuauacaggaa

SEQ ID NO: 744202 - RNA, 15 nt, Homo sapiens
uuuauacaggucaua

SEQ ID NO: 744203 - RNA, 13 nt, Homo sapiens
uuuauacuguaug

SEQ ID NO: 744204 - RNA, 12 nt, Homo sapiens
uuuauacuuugc

SEQ ID NO: 744205 - RNA, 22 nt, Homo sapiens
uuuauagaugggcaacuggcug

SEQ ID NO: 744206 - RNA, 13 nt, Homo sapiens
uuuauauacuggg

SEQ ID NO: 744207 - RNA, 20 nt, Homo sapiens
uuuauauggaguagcaaagg

SEQ ID NO: 744208 - RNA, 18 nt, Homo sapiens
uuuauauuuuuauagaca

SEQ ID NO: 744209 - RNA, 13 nt, Homo sapiens
uuuaucaccucau

SEQ ID NO: 744210 - RNA, 14 nt, Homo sapiens
uuuaucccauggaa

SEQ ID NO: 744211 - RNA, 16 nt, Homo sapiens
uuuaucuuuauaugaa

SEQ ID NO: 744212 - RNA, 19 nt, Homo sapiens
uuuaugaucuuggcuguau

SEQ ID NO: 744213 - RNA, 12 nt, Homo sapiens
uuuaugcaaaua

SEQ ID NO: 744214 - RNA, 19 nt, Homo sapiens
uuuaugcaaauacaaucag

SEQ ID NO: 744215 - RNA, 22 nt, Homo sapiens
uuuaugcagaagcauauuuugc

SEQ ID NO: 744216 - RNA, 19 nt, Homo sapiens
uuuaugugcaaaaucuguu

SEQ ID NO: 744217 - RNA, 18 nt, Homo sapiens
uuuaugugcucuccaaau

SEQ ID NO: 744218 - RNA, 22 nt, Homo sapiens
uuuauguguuaugaacauccaa

SEQ ID NO: 744219 - RNA, 13 nt, Homo sapiens
uuuauguuguaug

SEQ ID NO: 744220 - RNA, 16 nt, Homo sapiens
uuuauuaaaugcauca

SEQ ID NO: 744221 - RNA, 12 nt, Homo sapiens
uuuauuacaacu

SEQ ID NO: 744222 - RNA, 21 nt, Homo sapiens
uuuauucccaaguaugccuua

SEQ ID NO: 744223 - RNA, 20 nt, Homo sapiens
uuuauugaguaccuacugug

SEQ ID NO: 744224 - RNA, 21 nt, Homo sapiens
uuuauugucugucuacauuuc

SEQ ID NO: 744225 - RNA, 15 nt, Homo sapiens
uuuauuuaacuauuu

SEQ ID NO: 744226 - RNA, 18 nt, Homo sapiens
uuuauuuacacucuugau

SEQ ID NO: 744227 - RNA, 20 nt, Homo sapiens
uuuauuuaguuuuuaacaau

SEQ ID NO: 744228 - RNA, 16 nt, Homo sapiens
uuucaaaaaaucugac

SEQ ID NO: 744229 - RNA, 19 nt, Homo sapiens
uuucaaaauauacauucaa

SEQ ID NO: 744230 - RNA, 13 nt, Homo sapiens
uuucaaacacaaa

SEQ ID NO: 744231 - RNA, 20 nt, Homo sapiens
uuucaaagaaaauagauuag

SEQ ID NO: 744232 - RNA, 23 nt, Homo sapiens
uuucaaagaaggaauucuaggca

SEQ ID NO: 744233 - RNA, 20 nt, Homo sapiens
uuucaacucuuaaagacauc

SEQ ID NO: 744234 - RNA, 19 nt, Homo sapiens
uuucaacugucuuccucaa

SEQ ID NO: 744235 - RNA, 19 nt, Homo sapiens
uuucaagagugagcuauca

SEQ ID NO: 744236 - RNA, 18 nt, Homo sapiens
uuucaagcauuaagaaca

SEQ ID NO: 744237 - RNA, 17 nt, Homo sapiens
uuucaagcuucacauuu

SEQ ID NO: 744238 - RNA, 12 nt, Homo sapiens
uuucaaggccuu

SEQ ID NO: 744239 - RNA, 19 nt, Homo sapiens
uuucaaguguaacuuauua

SEQ ID NO: 744240 - RNA, 19 nt, Homo sapiens
uuucaaucuucuacuuuua

SEQ ID NO: 744241 - RNA, 23 nt, Homo sapiens
uuucaauuauagugucaugcaga

SEQ ID NO: 744242 - RNA, 16 nt, Homo sapiens
uuucacaaugugaaac

SEQ ID NO: 744243 - RNA, 18 nt, Homo sapiens
uuucacacacgugagaau

SEQ ID NO: 744244 - RNA, 16 nt, Homo sapiens
uuucacauucuuggcu

SEQ ID NO: 744245 - RNA, 19 nt, Homo sapiens
uuucaccaggggugcucac

SEQ ID NO: 744246 - RNA, 22 nt, Homo sapiens
uuucacccauccaugagcugcu

SEQ ID NO: 744247 - RNA, 15 nt, Homo sapiens
uuucacccucaugaa

SEQ ID NO: 744248 - RNA, 12 nt, Homo sapiens
uuucaccugaga

SEQ ID NO: 744249 - RNA, 13 nt, Homo sapiens
uuucaccuguaaa

SEQ ID NO: 744250 - RNA, 17 nt, Homo sapiens
uuucaccuguauugaau

SEQ ID NO: 744251 - RNA, 21 nt, Homo sapiens
uuucaccuguuuuuaagcugu

SEQ ID NO: 744252 - RNA, 22 nt, Homo sapiens
uuucacucucaaacuucacuaa

SEQ ID NO: 744253 - RNA, 17 nt, Homo sapiens
uuucacuuuauugcuau

SEQ ID NO: 744254 - RNA, 17 nt, Homo sapiens
uuucacuuugugauuau

SEQ ID NO: 744255 - RNA, 15 nt, Homo sapiens
uuucagaaaauauua

SEQ ID NO: 744256 - RNA, 16 nt, Homo sapiens
uuucagaaagccuuuc

SEQ ID NO: 744257 - RNA, 13 nt, Homo sapiens
uuucagaacaaac

SEQ ID NO: 744258 - RNA, 21 nt, Homo sapiens
uuucagaauauuuucaaaaua

SEQ ID NO: 744259 - RNA, 20 nt, Homo sapiens
uuucagagaaauacuuucag

SEQ ID NO: 744260 - RNA, 23 nt, Homo sapiens
uuucagagugacuacacacagua

SEQ ID NO: 744261 - RNA, 17 nt, Homo sapiens
uuucagauaaacaacaa

SEQ ID NO: 744262 - RNA, 18 nt, Homo sapiens
uuucagauaaacaacaaa

SEQ ID NO: 744263 - RNA, 16 nt, Homo sapiens
uuucaguauacugugu

SEQ ID NO: 744264 - RNA, 19 nt, Homo sapiens
uuucagugcuuuuacuauc

SEQ ID NO: 744265 - RNA, 12 nt, Homo sapiens
uuucaguucauc

SEQ ID NO: 744266 - RNA, 19 nt, Homo sapiens
uuucauaaacuucagggau

SEQ ID NO: 744267 - RNA, 18 nt, Homo sapiens
uuucauaaugcagaagua

SEQ ID NO: 744268 - RNA, 17 nt, Homo sapiens
uuucauaccacuugaau

SEQ ID NO: 744269 - RNA, 19 nt, Homo sapiens
uuucauaccuaucaucuua

SEQ ID NO: 744270 - RNA, 15 nt, Homo sapiens
uuucauacuauuuag

SEQ ID NO: 744271 - RNA, 19 nt, Homo sapiens
uuucauagagauuugucua

SEQ ID NO: 744272 - RNA, 21 nt, Homo sapiens
uuucauagcgaguuuucugac

SEQ ID NO: 744273 - RNA, 12 nt, Homo sapiens
uuucauaguuuc

SEQ ID NO: 744274 - RNA, 15 nt, Homo sapiens
uuucaucugcucucc

SEQ ID NO: 744275 - RNA, 16 nt, Homo sapiens
uuucaucuuuguggau

SEQ ID NO: 744276 - RNA, 20 nt, Homo sapiens
uuucaugauucaugagcugg

SEQ ID NO: 744277 - RNA, 13 nt, Homo sapiens
uuucaugcaaaag

SEQ ID NO: 744278 - RNA, 20 nt, Homo sapiens
uuucaugcuuuuucagccau

SEQ ID NO: 744279 - RNA, 16 nt, Homo sapiens
uuucauggacacuuug

SEQ ID NO: 744280 - RNA, 16 nt, Homo sapiens
uuucaugggacuaaau

SEQ ID NO: 744281 - RNA, 20 nt, Homo sapiens
uuucauuaaauaaauuugac

SEQ ID NO: 744282 - RNA, 18 nt, Homo sapiens
uuucauugaugagcaaga

SEQ ID NO: 744283 - RNA, 12 nt, Homo sapiens
uuucauuucuca

SEQ ID NO: 744284 - RNA, 13 nt, Homo sapiens
uuucauuuugcca

SEQ ID NO: 744285 - RNA, 14 nt, Homo sapiens
uuucauuuugccaa

SEQ ID NO: 744286 - RNA, 22 nt, Homo sapiens
uuucauuuugccaaaaaggggu

SEQ ID NO: 744287 - RNA, 11 nt, Homo sapiens
uuuccaaagag

SEQ ID NO: 744288 - RNA, 21 nt, Homo sapiens
uuuccaacaaacuuacuguca

SEQ ID NO: 744289 - RNA, 21 nt, Homo sapiens
uuuccaagacagagucuugcu

SEQ ID NO: 744290 - RNA, 22 nt, Homo sapiens
uuuccacaagauucccagagac

SEQ ID NO: 744291 - RNA, 18 nt, Homo sapiens
uuuccacuuugacuacaa

SEQ ID NO: 744292 - RNA, 20 nt, Homo sapiens
uuuccaguguucuauuugcu

SEQ ID NO: 744293 - RNA, 23 nt, Homo sapiens
uuuccaguguucuauuugcuuua

SEQ ID NO: 744294 - RNA, 20 nt, Homo sapiens
uuuccaguucaucuauggca

SEQ ID NO: 744295 - RNA, 23 nt, Homo sapiens
uuuccaguuuauaagacuggaau

SEQ ID NO: 744296 - RNA, 15 nt, Homo sapiens
uuucccaaagcacuu

SEQ ID NO: 744297 - RNA, 20 nt, Homo sapiens
uuucccacaucuuuccucaa

SEQ ID NO: 744298 - RNA, 22 nt, Homo sapiens
uuucccacgaggaaucuguggg

SEQ ID NO: 744299 - RNA, 21 nt, Homo sapiens
uuucccagucccauuccucag

SEQ ID NO: 744300 - RNA, 18 nt, Homo sapiens
uuuccccacacaugccua

SEQ ID NO: 744301 - RNA, 18 nt, Homo sapiens
uuuccccaggagcagaag

SEQ ID NO: 744302 - RNA, 21 nt, Homo sapiens
uuucccuaaguuuacuucucu

SEQ ID NO: 744303 - RNA, 22 nt, Homo sapiens
uuucccuuugccuucauucugc

SEQ ID NO: 744304 - RNA, 13 nt, Homo sapiens
uuuccgaaucucu

SEQ ID NO: 744305 - RNA, 18 nt, Homo sapiens
uuuccuaaaugcagugaa

SEQ ID NO: 744306 - RNA, 18 nt, Homo sapiens
augaagcccacccagaaa

SEQ ID NO: 744307 - RNA, 16 nt, Homo sapiens
aaaacuuagugacaaa

SEQ ID NO: 744308 - RNA, 18 nt, Homo sapiens
aaaacuuuggaaccagac

SEQ ID NO: 744309 - RNA, 12 nt, Homo sapiens
aaaagaacauaa

SEQ ID NO: 744310 - RNA, 16 nt, Homo sapiens
aaaagaauacagaaag

SEQ ID NO: 744311 - RNA, 16 nt, Homo sapiens
aaaagacuaagccaga

SEQ ID NO: 744312 - RNA, 23 nt, Homo sapiens
aaaagacuugagccauccaaaga

SEQ ID NO: 744313 - RNA, 15 nt, Homo sapiens
aaaagaugcagagua

SEQ ID NO: 744314 - RNA, 13 nt, Homo sapiens
aaaagauggaaug

SEQ ID NO: 744315 - RNA, 18 nt, Homo sapiens
aaaagauuuucagaaaau

SEQ ID NO: 744316 - RNA, 17 nt, Homo sapiens
aaaagcaaaaaugacaa

SEQ ID NO: 744317 - RNA, 15 nt, Homo sapiens
aaaagcaaagaugca

SEQ ID NO: 744318 - RNA, 22 nt, Homo sapiens
aaaagcaagacuguugcucaaa

SEQ ID NO: 744319 - RNA, 14 nt, Homo sapiens
aaaagcaauacugu

SEQ ID NO: 744320 - RNA, 11 nt, Homo sapiens
aaaagccaaaa

SEQ ID NO: 744321 - RNA, 12 nt, Homo sapiens
aaaagccaaaaa

SEQ ID NO: 744322 - RNA, 15 nt, Homo sapiens
aaaagccacuggaau

SEQ ID NO: 744323 - RNA, 15 nt, Homo sapiens
aaaagcccccaguua

SEQ ID NO: 744324 - RNA, 16 nt, Homo sapiens
aaaagcccccaguuaa

SEQ ID NO: 744325 - RNA, 10 nt, Homo sapiens
aaaagcuuuc

SEQ ID NO: 744326 - RNA, 21 nt, Homo sapiens
aaaaggaaaccaaguggucag

SEQ ID NO: 744327 - RNA, 16 nt, Homo sapiens
aaaaggagagauuaaa

SEQ ID NO: 744328 - RNA, 20 nt, Homo sapiens
aaaaggaguagggaguucau

SEQ ID NO: 744329 - RNA, 13 nt, Homo sapiens
aaaaggcugagaa

SEQ ID NO: 744330 - RNA, 20 nt, Homo sapiens
aaaagggagauucagacugu

SEQ ID NO: 744331 - RNA, 18 nt, Homo sapiens
aaaagggcagggcaucuc

SEQ ID NO: 744332 - RNA, 20 nt, Homo sapiens
aaaagggcagggcaucuccu

SEQ ID NO: 744333 - RNA, 23 nt, Homo sapiens
aaaagggcggaagaguuacaaua

SEQ ID NO: 744334 - RNA, 19 nt, Homo sapiens
aaaagggcugacauuuucu

SEQ ID NO: 744335 - RNA, 24 nt, Homo sapiens
aaaagguauuuugaauaccauuaa

SEQ ID NO: 744336 - RNA, 14 nt, Homo sapiens
aaaagguugccaaa

SEQ ID NO: 744337 - RNA, 18 nt, Homo sapiens
aaaaguaaauucauguaa

SEQ ID NO: 744338 - RNA, 23 nt, Homo sapiens
aaaaguaaccugaacuaaucuga

SEQ ID NO: 744339 - RNA, 18 nt, Homo sapiens
aaaaguaaguaccacuca

SEQ ID NO: 744340 - RNA, 18 nt, Homo sapiens
aaaaguaaugaagaaaau

SEQ ID NO: 744341 - RNA, 15 nt, Homo sapiens
aaaaguagcuuauag

SEQ ID NO: 744342 - RNA, 19 nt, Homo sapiens
aaaaguagguuuacauuca

SEQ ID NO: 744343 - RNA, 13 nt, Homo sapiens
aaaagucaaguuu

SEQ ID NO: 744344 - RNA, 13 nt, Homo sapiens
aaaagucagucuu

SEQ ID NO: 744345 - RNA, 14 nt, Homo sapiens
aaaagucagucuua

SEQ ID NO: 744346 - RNA, 19 nt, Homo sapiens
aaaaguccuugauuuagca

SEQ ID NO: 744347 - RNA, 21 nt, Homo sapiens
aaaagugaucaauaaaaugug

SEQ ID NO: 744348 - RNA, 12 nt, Homo sapiens
aaaagugcuaua

SEQ ID NO: 744349 - RNA, 13 nt, Homo sapiens
aaaagugucucaa

SEQ ID NO: 744350 - RNA, 13 nt, Homo sapiens
aaaaguuagucaa

SEQ ID NO: 744351 - RNA, 21 nt, Homo sapiens
aaaaguuagucaauccuguca

SEQ ID NO: 744352 - RNA, 23 nt, Homo sapiens
aaaaguuagucaauccugucaua

SEQ ID NO: 744353 - RNA, 23 nt, Homo sapiens
aaaaguucagggaccguccaggg

SEQ ID NO: 744354 - RNA, 18 nt, Homo sapiens
aaaauaaaauauacccau

SEQ ID NO: 744355 - RNA, 23 nt, Homo sapiens
aaaauaaaauguuucauuaugca

SEQ ID NO: 744356 - RNA, 15 nt, Homo sapiens
aaaauaaacaucagu

SEQ ID NO: 744357 - RNA, 17 nt, Homo sapiens
aaaauaaagcaaugugu

SEQ ID NO: 744358 - RNA, 18 nt, Homo sapiens
aaaauaaaguaccacaca

SEQ ID NO: 744359 - RNA, 14 nt, Homo sapiens
aaaauaaauuauua

SEQ ID NO: 744360 - RNA, 17 nt, Homo sapiens
aaaauacaaaaagcaaa

SEQ ID NO: 744361 - RNA, 20 nt, Homo sapiens
aaaauaccuuuguaacggcu

SEQ ID NO: 744362 - RNA, 20 nt, Homo sapiens
aaaauagaaauauagccaaa

SEQ ID NO: 744363 - RNA, 13 nt, Homo sapiens
aaaauagcaacac

SEQ ID NO: 744364 - RNA, 20 nt, Homo sapiens
aaaauagggguuaagacuga

SEQ ID NO: 744365 - RNA, 14 nt, Homo sapiens
aaaauagucuucca

SEQ ID NO: 744366 - RNA, 15 nt, Homo sapiens
aaaauauacauucaa

SEQ ID NO: 744367 - RNA, 22 nt, Homo sapiens
aaaauaucagacaagcacuauu

SEQ ID NO: 744368 - RNA, 10 nt, Homo sapiens
aaaauaugcc

SEQ ID NO: 744369 - RNA, 16 nt, Homo sapiens
aaaauauuucagauau

SEQ ID NO: 744370 - RNA, 14 nt, Homo sapiens
aaaaucaaguucua

SEQ ID NO: 744371 - RNA, 22 nt, Homo sapiens
aaaaucacaaggcaacugugag

SEQ ID NO: 744372 - RNA, 15 nt, Homo sapiens
aaaaucacacuguaa

SEQ ID NO: 744373 - RNA, 16 nt, Homo sapiens
aaaaucauaguacucu

SEQ ID NO: 744374 - RNA, 13 nt, Homo sapiens
aaaauccaaggca

SEQ ID NO: 744375 - RNA, 19 nt, Homo sapiens
aaaauccaugaacaauuua

SEQ ID NO: 744376 - RNA, 19 nt, Homo sapiens
aaaauccccuguugugugg

SEQ ID NO: 744377 - RNA, 22 nt, Homo sapiens
aaaaucuauauuugucuuccga

SEQ ID NO: 744378 - RNA, 15 nt, Homo sapiens
aaaaugaaaauucua

SEQ ID NO: 744379 - RNA, 14 nt, Homo sapiens
aaaaugagcaaaag

SEQ ID NO: 744380 - RNA, 14 nt, Homo sapiens
aaaaugcaaaagca

SEQ ID NO: 744381 - RNA, 17 nt, Homo sapiens
aaaaugcaaaagcacau

SEQ ID NO: 744382 - RNA, 17 nt, Homo sapiens
aaaaugcaucacaugau

SEQ ID NO: 744383 - RNA, 20 nt, Homo sapiens
aaaaugccugucucuagcug

SEQ ID NO: 744384 - RNA, 22 nt, Homo sapiens
aaaauggagcucaguaacauaa

SEQ ID NO: 744385 - RNA, 22 nt, Homo sapiens
aaaaugggagacagccucuuac

SEQ ID NO: 744386 - RNA, 22 nt, Homo sapiens
aaaauguaacaucauaauuaca

SEQ ID NO: 744387 - RNA, 14 nt, Homo sapiens
aaaauguacacugg

SEQ ID NO: 744388 - RNA, 14 nt, Homo sapiens
aaaaugucaucuca

SEQ ID NO: 744389 - RNA, 13 nt, Homo sapiens
aaaauguccauga

SEQ ID NO: 744390 - RNA, 19 nt, Homo sapiens
aaaauguccaugauggaau

SEQ ID NO: 744391 - RNA, 21 nt, Homo sapiens
aaaaugucucuuguggcccau

SEQ ID NO: 744392 - RNA, 17 nt, Homo sapiens
aaaaugugauguucuaa

SEQ ID NO: 744393 - RNA, 14 nt, Homo sapiens
aaaaugugccuccc

SEQ ID NO: 744394 - RNA, 18 nt, Homo sapiens
aaaauguguccuaucuau

SEQ ID NO: 744395 - RNA, 22 nt, Homo sapiens
aaaauguuaccacuacuuuaau

SEQ ID NO: 744396 - RNA, 18 nt, Homo sapiens
aaaauguucuauuuaaca

SEQ ID NO: 744397 - RNA, 12 nt, Homo sapiens
aaaauguucucu

SEQ ID NO: 744398 - RNA, 15 nt, Homo sapiens
aaaauuagagaucau

SEQ ID NO: 744399 - RNA, 17 nt, Homo sapiens
aaaauuauaguagcuua

SEQ ID NO: 744400 - RNA, 19 nt, Homo sapiens
aaaauuaucaaaaagcuaa

SEQ ID NO: 744401 - RNA, 12 nt, Homo sapiens
aaaauuaugcaa

SEQ ID NO: 744402 - RNA, 20 nt, Homo sapiens
aaaauuauuuauuguuacag

SEQ ID NO: 744403 - RNA, 14 nt, Homo sapiens
aaaauucagaugcu

SEQ ID NO: 744404 - RNA, 18 nt, Homo sapiens
aaaauuccucuuacugua

SEQ ID NO: 744405 - RNA, 21 nt, Homo sapiens
aaaauucugauguuucuguga

SEQ ID NO: 744406 - RNA, 22 nt, Homo sapiens
aaaauucugauguuucugugaa

SEQ ID NO: 744407 - RNA, 17 nt, Homo sapiens
aaaauucuuaaguaugu

SEQ ID NO: 744408 - RNA, 13 nt, Homo sapiens
aaaauuggacaga

SEQ ID NO: 744409 - RNA, 20 nt, Homo sapiens
aaaauuguuuucacuuguau

SEQ ID NO: 744410 - RNA, 20 nt, Homo sapiens
aaaauuuuguaaaacaaugc

SEQ ID NO: 744411 - RNA, 22 nt, Homo sapiens
aaaauuuuuuuuguaacuggag

SEQ ID NO: 744412 - RNA, 22 nt, Homo sapiens
aaacaaaaaaaccucuaugcaa

SEQ ID NO: 744413 - RNA, 19 nt, Homo sapiens
aaacaaaacuugcaucuaa

SEQ ID NO: 744414 - RNA, 21 nt, Homo sapiens
aaacaaaaggguguauagugu

SEQ ID NO: 744415 - RNA, 15 nt, Homo sapiens
aaacaaauaauagca

SEQ ID NO: 744416 - RNA, 23 nt, Homo sapiens
aaacaaaugauuuccacaaacag

SEQ ID NO: 744417 - RNA, 13 nt, Homo sapiens
aaacaaauucauu

SEQ ID NO: 744418 - RNA, 15 nt, Homo sapiens
aaacaaccaugucau

SEQ ID NO: 744419 - RNA, 21 nt, Homo sapiens
aaacaagacuccucaucauga

SEQ ID NO: 744420 - RNA, 16 nt, Homo sapiens
aaacaagcaacagaug

SEQ ID NO: 744421 - RNA, 14 nt, Homo sapiens
aaacaagccaaaga

SEQ ID NO: 744422 - RNA, 15 nt, Homo sapiens
aaaucaaugucacuu

SEQ ID NO: 744423 - RNA, 21 nt, Homo sapiens
aaaucacaaggauuucucuaa

SEQ ID NO: 744424 - RNA, 14 nt, Homo sapiens
aaaucacacuguaa

SEQ ID NO: 744425 - RNA, 18 nt, Homo sapiens
aaaucacucagcacucca

SEQ ID NO: 744426 - RNA, 10 nt, Homo sapiens
aaaucacuuu

SEQ ID NO: 744427 - RNA, 16 nt, Homo sapiens
aaaucacuuuaccugc

SEQ ID NO: 744428 - RNA, 18 nt, Homo sapiens
aaaucacuuuaccugcag

SEQ ID NO: 744429 - RNA, 21 nt, Homo sapiens
aaaucagacccacaacgaaug

SEQ ID NO: 744430 - RNA, 18 nt, Homo sapiens
aaaucagaccuggcugcu

SEQ ID NO: 744431 - RNA, 20 nt, Homo sapiens
aaaucagacgggcacagugg

SEQ ID NO: 744432 - RNA, 17 nt, Homo sapiens
aaaucagcugcuacuac

SEQ ID NO: 744433 - RNA, 22 nt, Homo sapiens
aaaucaguugugaauacauucu

SEQ ID NO: 744434 - RNA, 21 nt, Homo sapiens
aaaucauauccuaugacccag

SEQ ID NO: 744435 - RNA, 20 nt, Homo sapiens
aaaucaucauuaaugacuuu

SEQ ID NO: 744436 - RNA, 21 nt, Homo sapiens
aaaucauggcaacauaauuca

SEQ ID NO: 744437 - RNA, 15 nt, Homo sapiens
aaaucauuguagaaa

SEQ ID NO: 744438 - RNA, 13 nt, Homo sapiens
aaauccaaaaaga

SEQ ID NO: 744439 - RNA, 11 nt, Homo sapiens
aaauccaaaga

SEQ ID NO: 744440 - RNA, 20 nt, Homo sapiens
aaauccaacuuucacaguga

SEQ ID NO: 744441 - RNA, 13 nt, Homo sapiens
aaauccaggucau

SEQ ID NO: 744442 - RNA, 18 nt, Homo sapiens
aaauccagugagcacuag

SEQ ID NO: 744443 - RNA, 20 nt, Homo sapiens
aaauccagugagcacuagaa

SEQ ID NO: 744444 - RNA, 21 nt, Homo sapiens
aaauccagugagcacuagaau

SEQ ID NO: 744445 - RNA, 21 nt, Homo sapiens
aaaucccauggaauauuucca

SEQ ID NO: 744446 - RNA, 15 nt, Homo sapiens
aaauccgacuugaau

SEQ ID NO: 744447 - RNA, 19 nt, Homo sapiens
aaauccuaguaugccaaaa

SEQ ID NO: 744448 - RNA, 22 nt, Homo sapiens
aaauccucaccauccacagcaa

SEQ ID NO: 744449 - RNA, 13 nt, Homo sapiens
aaauccucaggug

SEQ ID NO: 744450 - RNA, 18 nt, Homo sapiens
aaauccucauguuacuca

SEQ ID NO: 744451 - RNA, 22 nt, Homo sapiens
aaauccucauguuacucagugu

SEQ ID NO: 744452 - RNA, 22 nt, Homo sapiens
aaauccuggaaggacacaguga

SEQ ID NO: 744453 - RNA, 16 nt, Homo sapiens
aaauccuuaugcauga

SEQ ID NO: 744454 - RNA, 17 nt, Homo sapiens
aaaucuaauaauuauuc

SEQ ID NO: 744455 - RNA, 15 nt, Homo sapiens
aaaucuaccacugua

SEQ ID NO: 744456 - RNA, 16 nt, Homo sapiens
aaaucuaccacuguau

SEQ ID NO: 744457 - RNA, 12 nt, Homo sapiens
aaaucuccagug

SEQ ID NO: 744458 - RNA, 19 nt, Homo sapiens
aaaucuccuaacaaaagaa

SEQ ID NO: 744459 - RNA, 18 nt, Homo sapiens
aaaucuccuggcuuuaca

SEQ ID NO: 744460 - RNA, 13 nt, Homo sapiens
aaaucucuuccac

SEQ ID NO: 744461 - RNA, 14 nt, Homo sapiens
aaaucugacaauag

SEQ ID NO: 744462 - RNA, 22 nt, Homo sapiens
aaaucugaggaaucaacagggc

SEQ ID NO: 744463 - RNA, 12 nt, Homo sapiens
aaaucugaggga

SEQ ID NO: 744464 - RNA, 18 nt, Homo sapiens
aaaucugauggccuuaau

SEQ ID NO: 744465 - RNA, 22 nt, Homo sapiens
aaaucuuaaaugagaccaaagu

SEQ ID NO: 744466 - RNA, 13 nt, Homo sapiens
aaaucuuguuaau

SEQ ID NO: 744467 - RNA, 17 nt, Homo sapiens
aaaucuuuuaaaucuuu

SEQ ID NO: 744468 - RNA, 23 nt, Homo sapiens
aaaucuuuuugcuucuacuuuca

SEQ ID NO: 744469 - RNA, 12 nt, Homo sapiens
aaaugaacauau

SEQ ID NO: 744470 - RNA, 14 nt, Homo sapiens
aaaugaacauuuca

SEQ ID NO: 744471 - RNA, 14 nt, Homo sapiens
aaaugaauacugaa

SEQ ID NO: 744472 - RNA, 22 nt, Homo sapiens
aaaugacaaccugaauuaucua

SEQ ID NO: 744473 - RNA, 14 nt, Homo sapiens
aaaugacacuacuu

SEQ ID NO: 744474 - RNA, 17 nt, Homo sapiens
aaaugacaugcacugac

SEQ ID NO: 744475 - RNA, 22 nt, Homo sapiens
aaaugacgguguuaauuuugcu

SEQ ID NO: 744476 - RNA, 23 nt, Homo sapiens
aaaugacgguguuaauuuugcua

SEQ ID NO: 744477 - RNA, 14 nt, Homo sapiens
aaaugagcaaaagu

SEQ ID NO: 744478 - RNA, 12 nt, Homo sapiens
aaaugagcauug

SEQ ID NO: 744479 - RNA, 16 nt, Homo sapiens
aaaugauuauauucac

SEQ ID NO: 744480 - RNA, 11 nt, Homo sapiens
aaaugcaacuu

SEQ ID NO: 744481 - RNA, 22 nt, Homo sapiens
aaaugcaauguaagcauacuuu

SEQ ID NO: 744482 - RNA, 12 nt, Homo sapiens
aaaugcagucau

SEQ ID NO: 744483 - RNA, 17 nt, Homo sapiens
aaaugcaguccugagga

SEQ ID NO: 744484 - RNA, 20 nt, Homo sapiens
aaaugccuccaagccauuca

SEQ ID NO: 744485 - RNA, 21 nt, Homo sapiens
aaaugcuacuuaacaaaguaa

SEQ ID NO: 744486 - RNA, 14 nt, Homo sapiens
aaaugcuauauugc

SEQ ID NO: 744487 - RNA, 18 nt, Homo sapiens
aaaugcuaugacuguauc

SEQ ID NO: 744488 - RNA, 19 nt, Homo sapiens
aaaugcucuuuugcacaag

SEQ ID NO: 744489 - RNA, 12 nt, Homo sapiens
aaaugcuuccaa

SEQ ID NO: 744490 - RNA, 14 nt, Homo sapiens
aaaugcuucugcac

SEQ ID NO: 744491 - RNA, 15 nt, Homo sapiens
aaaugcuucugcaca

SEQ ID NO: 744492 - RNA, 22 nt, Homo sapiens
aaauggaacuaucuccaaauuu

SEQ ID NO: 744493 - RNA, 16 nt, Homo sapiens
aaauggaggaauauga

SEQ ID NO: 744494 - RNA, 13 nt, Homo sapiens
aaauggcaaagaa

SEQ ID NO: 744495 - RNA, 15 nt, Homo sapiens
aaauggccaaauaua

SEQ ID NO: 744496 - RNA, 20 nt, Homo sapiens
aaauggcuacacucaucuga

SEQ ID NO: 744497 - RNA, 13 nt, Homo sapiens
aaauggcugagau

SEQ ID NO: 744498 - RNA, 21 nt, Homo sapiens
aaauggggccagauccagccu

SEQ ID NO: 744499 - RNA, 15 nt, Homo sapiens
aaauggguuacuuga

SEQ ID NO: 744500 - RNA, 13 nt, Homo sapiens
aaauguaacugug

SEQ ID NO: 744501 - RNA, 20 nt, Homo sapiens
aaauguaauacuccuaagac

SEQ ID NO: 744502 - RNA, 15 nt, Homo sapiens
aaauguaauugaaua

SEQ ID NO: 744503 - RNA, 21 nt, Homo sapiens
aaauguaggcaucaugcaugu

SEQ ID NO: 744504 - RNA, 17 nt, Homo sapiens
aaauguagguaugaaua

SEQ ID NO: 744505 - RNA, 19 nt, Homo sapiens
aaauguauucaaauaccaa

SEQ ID NO: 744506 - RNA, 20 nt, Homo sapiens
aaauguauuuuagacuuccu

SEQ ID NO: 744507 - RNA, 15 nt, Homo sapiens
aaaugucucauguca

SEQ ID NO: 744508 - RNA, 16 nt, Homo sapiens
aaaugucuggucuguc

SEQ ID NO: 744509 - RNA, 21 nt, Homo sapiens
aaaugugaagauggacuucau

SEQ ID NO: 744510 - RNA, 16 nt, Homo sapiens
aaaugugaagugaaug

SEQ ID NO: 744511 - RNA, 17 nt, Homo sapiens
aaaugugcuauacugca

SEQ ID NO: 744512 - RNA, 15 nt, Homo sapiens
aaaugugcuggucac

SEQ ID NO: 744513 - RNA, 16 nt, Homo sapiens
aaauguguaagaacaa

SEQ ID NO: 744514 - RNA, 16 nt, Homo sapiens
aaauguuacacauuaa

SEQ ID NO: 744515 - RNA, 22 nt, Homo sapiens
aaauguucaagucaugccugag

SEQ ID NO: 744516 - RNA, 15 nt, Homo sapiens
aaauguugcuuuaac

SEQ ID NO: 744517 - RNA, 21 nt, Homo sapiens
aaauguuggaacucugugcag

SEQ ID NO: 744518 - RNA, 23 nt, Homo sapiens
aaauguuuguuauuuacacuggu

SEQ ID NO: 744519 - RNA, 14 nt, Homo sapiens
aaauguuuuacuca

SEQ ID NO: 744520 - RNA, 19 nt, Homo sapiens
aaauguuuugaaaugauau

SEQ ID NO: 744521 - RNA, 21 nt, Homo sapiens
aaauguuuuuaaaaaggucau

SEQ ID NO: 744522 - RNA, 14 nt, Homo sapiens
aaauuaaaaccaau

SEQ ID NO: 744523 - RNA, 15 nt, Homo sapiens
aaauuaaaaccaauu

SEQ ID NO: 744524 - RNA, 15 nt, Homo sapiens
aaauuaacacaaagg

SEQ ID NO: 744525 - RNA, 15 nt, Homo sapiens
aaauuacaauuguca

SEQ ID NO: 744526 - RNA, 19 nt, Homo sapiens
aaauuacagcuucacccug

SEQ ID NO: 744527 - RNA, 14 nt, Homo sapiens
aaauuaccugugga

SEQ ID NO: 744528 - RNA, 19 nt, Homo sapiens
aaauuacguuuauguacua

SEQ ID NO: 744529 - RNA, 14 nt, Homo sapiens
aaauuagagaucau

SEQ ID NO: 744530 - RNA, 21 nt, Homo sapiens
aaauuagauuugugcaaacau

SEQ ID NO: 744531 - RNA, 18 nt, Homo sapiens
aaauuagccauuucacuc

SEQ ID NO: 744532 - RNA, 13 nt, Homo sapiens
aaauuagcuugag

SEQ ID NO: 744533 - RNA, 19 nt, Homo sapiens
aaauuagcuugagcaaccu

SEQ ID NO: 744534 - RNA, 16 nt, Homo sapiens
aaauuagugaaccaaa

SEQ ID NO: 744535 - RNA, 21 nt, Homo sapiens
aaauuaguugguuugugugau

SEQ ID NO: 744536 - RNA, 23 nt, Homo sapiens
aaauuauacuguagcugaugaaa

SEQ ID NO: 744537 - RNA, 22 nt, Homo sapiens
aaucucuucuuugcugcaguca

SEQ ID NO: 744538 - RNA, 14 nt, Homo sapiens
aaucucuugcacuc

SEQ ID NO: 744539 - RNA, 19 nt, Homo sapiens
aaucucuuggaugcagcuu

SEQ ID NO: 744540 - RNA, 21 nt, Homo sapiens
aaucugaagaagaaaugaaua

SEQ ID NO: 744541 - RNA, 14 nt, Homo sapiens
aaucugaccaaaac

SEQ ID NO: 744542 - RNA, 21 nt, Homo sapiens
aaucugaccaaaacaaacaaa

SEQ ID NO: 744543 - RNA, 23 nt, Homo sapiens
aaucugagccagugcuuuaaugg

SEQ ID NO: 744544 - RNA, 23 nt, Homo sapiens
aaucugaggccuccucucucagu

SEQ ID NO: 744545 - RNA, 21 nt, Homo sapiens
aaucugccuagaaaaccucuc

SEQ ID NO: 744546 - RNA, 14 nt, Homo sapiens
aaucugcuuugugg

SEQ ID NO: 744547 - RNA, 18 nt, Homo sapiens
aaucuggcuuagugccac

SEQ ID NO: 744548 - RNA, 14 nt, Homo sapiens
aaucuggucucuuc

SEQ ID NO: 744549 - RNA, 19 nt, Homo sapiens
aaucuguggccacucgagu

SEQ ID NO: 744550 - RNA, 17 nt, Homo sapiens
aaucuguguaacuguaa

SEQ ID NO: 744551 - RNA, 18 nt, Homo sapiens
aaucuuaagauucuuugu

SEQ ID NO: 744552 - RNA, 17 nt, Homo sapiens
aaucuuauggggccgga

SEQ ID NO: 744553 - RNA, 14 nt, Homo sapiens
aaucuucaccucag

SEQ ID NO: 744554 - RNA, 19 nt, Homo sapiens
aaucuucuccuaugcauuu

SEQ ID NO: 744555 - RNA, 15 nt, Homo sapiens
aaucuuuaccuguau

SEQ ID NO: 744556 - RNA, 20 nt, Homo sapiens
aaucuuucugcagaaacaga

SEQ ID NO: 744557 - RNA, 21 nt, Homo sapiens
aaucuuugcuguauacuuuua

SEQ ID NO: 744558 - RNA, 19 nt, Homo sapiens
aaucuuuuaaaaauucaaa

SEQ ID NO: 744559 - RNA, 17 nt, Homo sapiens
aaucuuuuaaaucuuug

SEQ ID NO: 744560 - RNA, 20 nt, Homo sapiens
aaugaaaagcugaauccaga

SEQ ID NO: 744561 - RNA, 19 nt, Homo sapiens
aaugaaagggaaacuggga

SEQ ID NO: 744562 - RNA, 12 nt, Homo sapiens
aaugaaauccag

SEQ ID NO: 744563 - RNA, 16 nt, Homo sapiens
aaugaaauccagugag

SEQ ID NO: 744564 - RNA, 13 nt, Homo sapiens
aaugaacaucucu

SEQ ID NO: 744565 - RNA, 22 nt, Homo sapiens
aaugaagcuaauaauucuucac

SEQ ID NO: 744566 - RNA, 15 nt, Homo sapiens
aaugaauggacucaa

SEQ ID NO: 744567 - RNA, 14 nt, Homo sapiens
aaugaauguuccac

SEQ ID NO: 744568 - RNA, 16 nt, Homo sapiens
aaugaauuuaucuuua

SEQ ID NO: 744569 - RNA, 21 nt, Homo sapiens
aaugaauuuuguaugcugaau

SEQ ID NO: 744570 - RNA, 15 nt, Homo sapiens
aaugacaagccuucu

SEQ ID NO: 744571 - RNA, 12 nt, Homo sapiens
aaugacaaugau

SEQ ID NO: 744572 - RNA, 15 nt, Homo sapiens
aaugacacagucuug

SEQ ID NO: 744573 - RNA, 14 nt, Homo sapiens
aaugacaucuucaa

SEQ ID NO: 744574 - RNA, 13 nt, Homo sapiens
aaugaccaaagau

SEQ ID NO: 744575 - RNA, 23 nt, Homo sapiens
aaugaccaacgaaauuguuacaa

SEQ ID NO: 744576 - RNA, 12 nt, Homo sapiens
aaugaccuguau

SEQ ID NO: 744577 - RNA, 14 nt, Homo sapiens
aaugacugcauuug

SEQ ID NO: 744578 - RNA, 23 nt, Homo sapiens
aaugagaagccaagcucuucaag

SEQ ID NO: 744579 - RNA, 20 nt, Homo sapiens
aaugagacauaggccaugaa

SEQ ID NO: 744580 - RNA, 15 nt, Homo sapiens
aaugagguaaauaag

SEQ ID NO: 744581 - RNA, 10 nt, Homo sapiens
aaugagucag

SEQ ID NO: 744582 - RNA, 14 nt, Homo sapiens
aaugagugcuuaaa

SEQ ID NO: 744583 - RNA, 18 nt, Homo sapiens
aaugaguuuaaugccaua

SEQ ID NO: 744584 - RNA, 13 nt, Homo sapiens
aaugauacaguau

SEQ ID NO: 744585 - RNA, 14 nt, Homo sapiens
aaugauacugaugg

SEQ ID NO: 744586 - RNA, 23 nt, Homo sapiens
aaugauacugcuuuucaccaaaa

SEQ ID NO: 744587 - RNA, 15 nt, Homo sapiens
aaugauacugugaga

SEQ ID NO: 744588 - RNA, 16 nt, Homo sapiens
aaugaucauaagucua

SEQ ID NO: 744589 - RNA, 20 nt, Homo sapiens
aaugauccguuccauugcaa

SEQ ID NO: 744590 - RNA, 22 nt, Homo sapiens
aaugaucuuaauuuacuuuaag

SEQ ID NO: 744591 - RNA, 15 nt, Homo sapiens
aaugaugaucuucag

SEQ ID NO: 744592 - RNA, 12 nt, Homo sapiens
aaugaugaugac

SEQ ID NO: 744593 - RNA, 19 nt, Homo sapiens
aaugauuuagguacgucaa

SEQ ID NO: 744594 - RNA, 20 nt, Homo sapiens
aaugauuugggaaaacaauu

SEQ ID NO: 744595 - RNA, 11 nt, Homo sapiens
aaugcaacuuc

SEQ ID NO: 744596 - RNA, 16 nt, Homo sapiens
aaugcaauccuucccu

SEQ ID NO: 744597 - RNA, 12 nt, Homo sapiens
aaugcaauggaa

SEQ ID NO: 744598 - RNA, 13 nt, Homo sapiens
aaugcaguccuga

SEQ ID NO: 744599 - RNA, 14 nt, Homo sapiens
aaugcaucaauaug

SEQ ID NO: 744600 - RNA, 22 nt, Homo sapiens
aaugcauuguuguucugcucaa

SEQ ID NO: 744601 - RNA, 20 nt, Homo sapiens
aaugcauuuaaacucauuug

SEQ ID NO: 744602 - RNA, 19 nt, Homo sapiens
aaugccaaaauucauucag

SEQ ID NO: 744603 - RNA, 13 nt, Homo sapiens
aaugccagcauaa

SEQ ID NO: 744604 - RNA, 13 nt, Homo sapiens
aaugccucuucau

SEQ ID NO: 744605 - RNA, 18 nt, Homo sapiens
aaugccucuucuuuaugu

SEQ ID NO: 744606 - RNA, 22 nt, Homo sapiens
aaugccugguaccagaggaugg

SEQ ID NO: 744607 - RNA, 13 nt, Homo sapiens
aaugccugugaag

SEQ ID NO: 744608 - RNA, 13 nt, Homo sapiens
aaugcggcccaac

SEQ ID NO: 744609 - RNA, 13 nt, Homo sapiens
aaugcuacaugug

SEQ ID NO: 744610 - RNA, 22 nt, Homo sapiens
aaugcuccauuaauccagggaa

SEQ ID NO: 744611 - RNA, 11 nt, Homo sapiens
aaugcucugac

SEQ ID NO: 744612 - RNA, 12 nt, Homo sapiens
aaugcugcacuu

SEQ ID NO: 744613 - RNA, 14 nt, Homo sapiens
aaugcuucauucaa

SEQ ID NO: 744614 - RNA, 15 nt, Homo sapiens
aauggaaaguuguau

SEQ ID NO: 744615 - RNA, 16 nt, Homo sapiens
aauggacaaaauccau

SEQ ID NO: 744616 - RNA, 19 nt, Homo sapiens
aauggacaaaauccaugaa

SEQ ID NO: 744617 - RNA, 20 nt, Homo sapiens
aauggacauaagacagacag

SEQ ID NO: 744618 - RNA, 20 nt, Homo sapiens
aauggacguuauccucucag

SEQ ID NO: 744619 - RNA, 18 nt, Homo sapiens
aauggagccaugacaaga

SEQ ID NO: 744620 - RNA, 19 nt, Homo sapiens
aauggaggaagaacaacaa

SEQ ID NO: 744621 - RNA, 20 nt, Homo sapiens
aauggagggaauaauaccua

SEQ ID NO: 744622 - RNA, 22 nt, Homo sapiens
aauggauucaacacugugcacg

SEQ ID NO: 744623 - RNA, 19 nt, Homo sapiens
aauggcagcuagugccuuu

SEQ ID NO: 744624 - RNA, 13 nt, Homo sapiens
aauggcagguguc

SEQ ID NO: 744625 - RNA, 19 nt, Homo sapiens
aauggccuuuaucaucuag

SEQ ID NO: 744626 - RNA, 20 nt, Homo sapiens
aauggcuaagauaccaaaac

SEQ ID NO: 744627 - RNA, 14 nt, Homo sapiens
aauggcuacacuca

SEQ ID NO: 744628 - RNA, 21 nt, Homo sapiens
aauggcuuuaugcuaguuuga

SEQ ID NO: 744629 - RNA, 22 nt, Homo sapiens
aaugggacugaugucaucuuga

SEQ ID NO: 744630 - RNA, 22 nt, Homo sapiens
aaugggauggucggaucucaca

SEQ ID NO: 744631 - RNA, 12 nt, Homo sapiens
aauggggccaga

SEQ ID NO: 744632 - RNA, 18 nt, Homo sapiens
aauggggggcgggccagg

SEQ ID NO: 744633 - RNA, 23 nt, Homo sapiens
aauggguuugcuagaaugugaua

SEQ ID NO: 744634 - RNA, 13 nt, Homo sapiens
aaugguacuucau

SEQ ID NO: 744635 - RNA, 18 nt, Homo sapiens
aaugguagcaacugaaag

SEQ ID NO: 744636 - RNA, 23 nt, Homo sapiens
aaugguauaaaagguugccaaau

SEQ ID NO: 744637 - RNA, 22 nt, Homo sapiens
aaugguauggaacucucuccac

SEQ ID NO: 744638 - RNA, 12 nt, Homo sapiens
aauggucaucca

SEQ ID NO: 744639 - RNA, 15 nt, Homo sapiens
aauggucauccaaac

SEQ ID NO: 744640 - RNA, 12 nt, Homo sapiens
aaugguuaucau

SEQ ID NO: 744641 - RNA, 15 nt, Homo sapiens
aaugguuccauucuc

SEQ ID NO: 744642 - RNA, 16 nt, Homo sapiens
aaugguuccauucucu

SEQ ID NO: 744643 - RNA, 15 nt, Homo sapiens
aauguaaaguuacac

SEQ ID NO: 744644 - RNA, 12 nt, Homo sapiens
aauguaagauuu

SEQ ID NO: 744645 - RNA, 19 nt, Homo sapiens
aauguaagauuucauucug

SEQ ID NO: 744646 - RNA, 22 nt, Homo sapiens
aauguaagggaaacugccagca

SEQ ID NO: 744647 - RNA, 10 nt, Homo sapiens
aauguacaaa

SEQ ID NO: 744648 - RNA, 21 nt, Homo sapiens
aauguacaauuaugucucuug

SEQ ID NO: 744649 - RNA, 21 nt, Homo sapiens
aauguacacuaccaaacacuc

SEQ ID NO: 744650 - RNA, 20 nt, Homo sapiens
aauguaccuucuuucacucu

SEQ ID NO: 744651 - RNA, 18 nt, Homo sapiens
aauguagacagauauuuc

SEQ ID NO: 744652 - RNA, 14 nt, Homo sapiens
acaagucuuccaga

SEQ ID NO: 744653 - RNA, 14 nt, Homo sapiens
acaagugagacaaa

SEQ ID NO: 744654 - RNA, 15 nt, Homo sapiens
acaagugcugaacag

SEQ ID NO: 744655 - RNA, 19 nt, Homo sapiens
acaagugcuguugggauau

SEQ ID NO: 744656 - RNA, 21 nt, Homo sapiens
acaagugguguuuauugcaau

SEQ ID NO: 744657 - RNA, 21 nt, Homo sapiens
acaaguugcgacggagagaaa

SEQ ID NO: 744658 - RNA, 19 nt, Homo sapiens
acaaguuggaugcggccau

SEQ ID NO: 744659 - RNA, 23 nt, Homo sapiens
acaaguuggaugcggccauucaa

SEQ ID NO: 744660 - RNA, 21 nt, Homo sapiens
acaaguuguuaaaacauuuaa

SEQ ID NO: 744661 - RNA, 21 nt, Homo sapiens
acaaguuucugauaccacugc

SEQ ID NO: 744662 - RNA, 21 nt, Homo sapiens
acaauaaaauggaaagguccu

SEQ ID NO: 744663 - RNA, 21 nt, Homo sapiens
acaauaaacgguacuugucau

SEQ ID NO: 744664 - RNA, 15 nt, Homo sapiens
acaauaaaguacuuu

SEQ ID NO: 744665 - RNA, 13 nt, Homo sapiens
acaauacaguauu

SEQ ID NO: 744666 - RNA, 21 nt, Homo sapiens
acaauaggugcuuauucucaa

SEQ ID NO: 744667 - RNA, 17 nt, Homo sapiens
acaauaugggcacuuua

SEQ ID NO: 744668 - RNA, 17 nt, Homo sapiens
acaaucagcccagugca

SEQ ID NO: 744669 - RNA, 18 nt, Homo sapiens
acaaucaugaaauaugca

SEQ ID NO: 744670 - RNA, 23 nt, Homo sapiens
acaauccuucuauucuagccugc

SEQ ID NO: 744671 - RNA, 13 nt, Homo sapiens
acaaucuggcuca

SEQ ID NO: 744672 - RNA, 21 nt, Homo sapiens
acaaucuguuuuggcuuuaug

SEQ ID NO: 744673 - RNA, 17 nt, Homo sapiens
acaaucuuugcuguaua

SEQ ID NO: 744674 - RNA, 23 nt, Homo sapiens
acaaucuuugcuguauacuuuua

SEQ ID NO: 744675 - RNA, 22 nt, Homo sapiens
acaauguauacuucagugcuca

SEQ ID NO: 744676 - RNA, 19 nt, Homo sapiens
acaauuauauaaaucauuu

SEQ ID NO: 744677 - RNA, 18 nt, Homo sapiens
acaauuauaucaguccuc

SEQ ID NO: 744678 - RNA, 18 nt, Homo sapiens
acaauucauucauuugca

SEQ ID NO: 744679 - RNA, 23 nt, Homo sapiens
acaauugggagauuaucuuucaa

SEQ ID NO: 744680 - RNA, 22 nt, Homo sapiens
acaauuguaaaauuuaaaucau

SEQ ID NO: 744681 - RNA, 21 nt, Homo sapiens
acaauuucucauacuuagaaa

SEQ ID NO: 744682 - RNA, 17 nt, Homo sapiens
acacaaaccacaccaca

SEQ ID NO: 744683 - RNA, 14 nt, Homo sapiens
acacaaauucuaaa

SEQ ID NO: 744684 - RNA, 13 nt, Homo sapiens
acacaagaaucua

SEQ ID NO: 744685 - RNA, 18 nt, Homo sapiens
acacaaggauagaugcug

SEQ ID NO: 744686 - RNA, 17 nt, Homo sapiens
acacaauucuucuucca

SEQ ID NO: 744687 - RNA, 17 nt, Homo sapiens
acacaauugauacuuca

SEQ ID NO: 744688 - RNA, 23 nt, Homo sapiens
acacaauuucauuuccagcauuu

SEQ ID NO: 744689 - RNA, 21 nt, Homo sapiens
acacacaaaccuacugcccac

SEQ ID NO: 744690 - RNA, 12 nt, Homo sapiens
acacacaaagag

SEQ ID NO: 744691 - RNA, 12 nt, Homo sapiens
acacacacaaac

SEQ ID NO: 744692 - RNA, 14 nt, Homo sapiens
acacacacgaugca

SEQ ID NO: 744693 - RNA, 22 nt, Homo sapiens
acacacacucuacccuauacaa

SEQ ID NO: 744694 - RNA, 15 nt, Homo sapiens
acacaccguggccua

SEQ ID NO: 744695 - RNA, 16 nt, Homo sapiens
acacacgaugcauuua

SEQ ID NO: 744696 - RNA, 17 nt, Homo sapiens
acacacgaugcauuuaa

SEQ ID NO: 744697 - RNA, 22 nt, Homo sapiens
acacacguaccuucaugugauu

SEQ ID NO: 744698 - RNA, 17 nt, Homo sapiens
acacagaagccuuugau

SEQ ID NO: 744699 - RNA, 16 nt, Homo sapiens
acacagacaaagugcu

SEQ ID NO: 744700 - RNA, 15 nt, Homo sapiens
acacagaucacagcu

SEQ ID NO: 744701 - RNA, 17 nt, Homo sapiens
acacagcaacauccaga

SEQ ID NO: 744702 - RNA, 22 nt, Homo sapiens
acacagcaagggugaugggaaa

SEQ ID NO: 744703 - RNA, 20 nt, Homo sapiens
acacagcgagacuccgucuc

SEQ ID NO: 744704 - RNA, 22 nt, Homo sapiens
acacagcgagacuccgucucaa

SEQ ID NO: 744705 - RNA, 12 nt, Homo sapiens
acacagcuccuc

SEQ ID NO: 744706 - RNA, 14 nt, Homo sapiens
acacaggcaaaauc

SEQ ID NO: 744707 - RNA, 15 nt, Homo sapiens
acacagugacuuccu

SEQ ID NO: 744708 - RNA, 23 nt, Homo sapiens
acacaguguuggagguuaaggca

SEQ ID NO: 744709 - RNA, 15 nt, Homo sapiens
acacaguuacagagu

SEQ ID NO: 744710 - RNA, 18 nt, Homo sapiens
acacauaacaaagggcag

SEQ ID NO: 744711 - RNA, 17 nt, Homo sapiens
acacauacagagugggc

SEQ ID NO: 744712 - RNA, 13 nt, Homo sapiens
acacauaugcacc

SEQ ID NO: 744713 - RNA, 16 nt, Homo sapiens
acacaugcccaugaug

SEQ ID NO: 744714 - RNA, 23 nt, Homo sapiens
acacauggugugaguccaaagaa

SEQ ID NO: 744715 - RNA, 13 nt, Homo sapiens
acacauguucugu

SEQ ID NO: 744716 - RNA, 12 nt, Homo sapiens
acacauuacaaa

SEQ ID NO: 744717 - RNA, 17 nt, Homo sapiens
acacauuacgugcuccc

SEQ ID NO: 744718 - RNA, 20 nt, Homo sapiens
acacauuccugcauucaugu

SEQ ID NO: 744719 - RNA, 16 nt, Homo sapiens
acacauuuacccuuug

SEQ ID NO: 744720 - RNA, 21 nt, Homo sapiens
acacauuuagaugcacuacca

SEQ ID NO: 744721 - RNA, 17 nt, Homo sapiens
acacauuuggcaguuua

SEQ ID NO: 744722 - RNA, 15 nt, Homo sapiens
acaccaaaacaugcc

SEQ ID NO: 744723 - RNA, 19 nt, Homo sapiens
acaccaaugaaaacaugua

SEQ ID NO: 744724 - RNA, 12 nt, Homo sapiens
acaccaccaauc

SEQ ID NO: 744725 - RNA, 17 nt, Homo sapiens
acaccagcagcacugga

SEQ ID NO: 744726 - RNA, 14 nt, Homo sapiens
acaccagcagcccu

SEQ ID NO: 744727 - RNA, 20 nt, Homo sapiens
acaccagcagcccugucacg

SEQ ID NO: 744728 - RNA, 18 nt, Homo sapiens
acaccaggccguccuccc

SEQ ID NO: 744729 - RNA, 20 nt, Homo sapiens
acaccaguacaagaucucag

SEQ ID NO: 744730 - RNA, 20 nt, Homo sapiens
acacccacccaauuggccca

SEQ ID NO: 744731 - RNA, 17 nt, Homo sapiens
acacccaugcacacuca

SEQ ID NO: 744732 - RNA, 17 nt, Homo sapiens
acacccaugccagagag

SEQ ID NO: 744733 - RNA, 15 nt, Homo sapiens
acaccccaacacuuc

SEQ ID NO: 744734 - RNA, 16 nt, Homo sapiens
acacccgacuccucaa

SEQ ID NO: 744735 - RNA, 19 nt, Homo sapiens
acaccguacaucugcaaua

SEQ ID NO: 744736 - RNA, 20 nt, Homo sapiens
acaccguacaucugcaauau

SEQ ID NO: 744737 - RNA, 19 nt, Homo sapiens
acaccgucccucagugaua

SEQ ID NO: 744738 - RNA, 22 nt, Homo sapiens
acaccuaagagaaaaagaucga

SEQ ID NO: 744739 - RNA, 23 nt, Homo sapiens
acaccucaguucccuuggccuca

SEQ ID NO: 744740 - RNA, 12 nt, Homo sapiens
acaccugccuag

SEQ ID NO: 744741 - RNA, 20 nt, Homo sapiens
acaccugccucuuccugcag

SEQ ID NO: 744742 - RNA, 20 nt, Homo sapiens
acaccugcuucagagcucaa

SEQ ID NO: 744743 - RNA, 14 nt, Homo sapiens
acaccuggccuuaa

SEQ ID NO: 744744 - RNA, 19 nt, Homo sapiens
acaccugggccgggcugua

SEQ ID NO: 744745 - RNA, 15 nt, Homo sapiens
acaccuguaauccca

SEQ ID NO: 744746 - RNA, 17 nt, Homo sapiens
acaccuguaaucccagc

SEQ ID NO: 744747 - RNA, 17 nt, Homo sapiens
acaccuguguccaagaa

SEQ ID NO: 744748 - RNA, 12 nt, Homo sapiens
acaccuuggccu

SEQ ID NO: 744749 - RNA, 20 nt, Homo sapiens
acacgagcaggcuacuguca

SEQ ID NO: 744750 - RNA, 16 nt, Homo sapiens
acacgaguuccagacc

SEQ ID NO: 744751 - RNA, 15 nt, Homo sapiens
acacgauaaagggau

SEQ ID NO: 744752 - RNA, 21 nt, Homo sapiens
acacgcugcaccuaaagccua

SEQ ID NO: 744753 - RNA, 21 nt, Homo sapiens
acacggaggcccccaguauug

SEQ ID NO: 744754 - RNA, 21 nt, Homo sapiens
acacggaugacuuaacugcau

SEQ ID NO: 744755 - RNA, 20 nt, Homo sapiens
acacggccucccucugcuac

SEQ ID NO: 744756 - RNA, 23 nt, Homo sapiens
acacggccuggggcgagcacugu

SEQ ID NO: 744757 - RNA, 21 nt, Homo sapiens
acacggcugugacgagguggc

SEQ ID NO: 744758 - RNA, 18 nt, Homo sapiens
acacguaccuucauguga

SEQ ID NO: 744759 - RNA, 22 nt, Homo sapiens
acacguaucucuugguaugcau

SEQ ID NO: 744760 - RNA, 20 nt, Homo sapiens
acacgugcgugcgagcacac

SEQ ID NO: 744761 - RNA, 15 nt, Homo sapiens
acacuaaagagaaau

SEQ ID NO: 744762 - RNA, 14 nt, Homo sapiens
acacuaacauauaa

SEQ ID NO: 744763 - RNA, 20 nt, Homo sapiens
acacuaaccuggguucccuu

SEQ ID NO: 744764 - RNA, 14 nt, Homo sapiens
acacuaacucacca

SEQ ID NO: 744765 - RNA, 12 nt, Homo sapiens
acacuaccacau

SEQ ID NO: 744766 - RNA, 21 nt, Homo sapiens
acauagauuaauggcacugau

SEQ ID NO: 744767 - RNA, 15 nt, Homo sapiens
acauagccagcauuu

SEQ ID NO: 744768 - RNA, 20 nt, Homo sapiens
acauagccucaccaagguga

SEQ ID NO: 744769 - RNA, 18 nt, Homo sapiens
acauagucagcucugauc

SEQ ID NO: 744770 - RNA, 16 nt, Homo sapiens
acauaguuuauuucaa

SEQ ID NO: 744771 - RNA, 13 nt, Homo sapiens
acauauccaaaau

SEQ ID NO: 744772 - RNA, 18 nt, Homo sapiens
acauauccuuucaagaca

SEQ ID NO: 744773 - RNA, 12 nt, Homo sapiens
acauaucuagua

SEQ ID NO: 744774 - RNA, 13 nt, Homo sapiens
acauaucuaguau

SEQ ID NO: 744775 - RNA, 14 nt, Homo sapiens
acauaugacuugau

SEQ ID NO: 744776 - RNA, 20 nt, Homo sapiens
acauauggacucugcacaug

SEQ ID NO: 744777 - RNA, 19 nt, Homo sapiens
acauauuacuccacaccuu

SEQ ID NO: 744778 - RNA, 15 nt, Homo sapiens
acauauucaaauucc

SEQ ID NO: 744779 - RNA, 23 nt, Homo sapiens
acauauuccugguguagcacuua

SEQ ID NO: 744780 - RNA, 10 nt, Homo sapiens
acaucaaaga

SEQ ID NO: 744781 - RNA, 20 nt, Homo sapiens
acaucaaagagcacauuuac

SEQ ID NO: 744782 - RNA, 19 nt, Homo sapiens
acaucaaauaaacugacuu

SEQ ID NO: 744783 - RNA, 22 nt, Homo sapiens
acaucaagccuagcaucucggg

SEQ ID NO: 744784 - RNA, 16 nt, Homo sapiens
acaucacaacauuuac

SEQ ID NO: 744785 - RNA, 14 nt, Homo sapiens
acaucagcaagacu

SEQ ID NO: 744786 - RNA, 17 nt, Homo sapiens
acaucagcaauuucaga

SEQ ID NO: 744787 - RNA, 18 nt, Homo sapiens
acaucagcuugcccuguu

SEQ ID NO: 744788 - RNA, 20 nt, Homo sapiens
acaucaggguagcugaagga

SEQ ID NO: 744789 - RNA, 14 nt, Homo sapiens
acaucagucuccaa

SEQ ID NO: 744790 - RNA, 16 nt, Homo sapiens
acaucaguuacucuga

SEQ ID NO: 744791 - RNA, 18 nt, Homo sapiens
acaucaguuacucugaag

SEQ ID NO: 744792 - RNA, 20 nt, Homo sapiens
acaucaguuguuuguuugau

SEQ ID NO: 744793 - RNA, 15 nt, Homo sapiens
acaucauaauuacau

SEQ ID NO: 744794 - RNA, 13 nt, Homo sapiens
acaucauggacug

SEQ ID NO: 744795 - RNA, 14 nt, Homo sapiens
acaucauggacuga

SEQ ID NO: 744796 - RNA, 24 nt, Homo sapiens
acaucauuacugccaucuuuauca

SEQ ID NO: 744797 - RNA, 23 nt, Homo sapiens
acaucauuacuuaugaugaugaa

SEQ ID NO: 744798 - RNA, 15 nt, Homo sapiens
acauccaacuccagc

SEQ ID NO: 744799 - RNA, 21 nt, Homo sapiens
acauccaaggagaaacagaga

SEQ ID NO: 744800 - RNA, 16 nt, Homo sapiens
acauccacaaaacccu

SEQ ID NO: 744801 - RNA, 15 nt, Homo sapiens
acauccagucacuuu

SEQ ID NO: 744802 - RNA, 22 nt, Homo sapiens
acauccaucccuccauucaucc

SEQ ID NO: 744803 - RNA, 14 nt, Homo sapiens
acaucccacagugg

SEQ ID NO: 744804 - RNA, 22 nt, Homo sapiens
acaucccuuccuggaaacagca

SEQ ID NO: 744805 - RNA, 19 nt, Homo sapiens
acaucuacaaucaguugac

SEQ ID NO: 744806 - RNA, 18 nt, Homo sapiens
acaucuccaggcuuucaa

SEQ ID NO: 744807 - RNA, 23 nt, Homo sapiens
acaucucugcaguuuuucccaag

SEQ ID NO: 744808 - RNA, 23 nt, Homo sapiens
acaucugccuuaaaaccaaagag

SEQ ID NO: 744809 - RNA, 16 nt, Homo sapiens
acaucugcuggugggu

SEQ ID NO: 744810 - RNA, 22 nt, Homo sapiens
acaucuggccuugaaaccaccu

SEQ ID NO: 744811 - RNA, 18 nt, Homo sapiens
acaucugggugcccugaa

SEQ ID NO: 744812 - RNA, 12 nt, Homo sapiens
acaucugucacg

SEQ ID NO: 744813 - RNA, 17 nt, Homo sapiens
acaucuuaaagcuaaaa

SEQ ID NO: 744814 - RNA, 13 nt, Homo sapiens
acaucuuccacca

SEQ ID NO: 744815 - RNA, 13 nt, Homo sapiens
acaucuucuaucu

SEQ ID NO: 744816 - RNA, 23 nt, Homo sapiens
acaucuucugccuuagucucagu

SEQ ID NO: 744817 - RNA, 18 nt, Homo sapiens
acaucuuggucagauuug

SEQ ID NO: 744818 - RNA, 13 nt, Homo sapiens
acaucuuuacuca

SEQ ID NO: 744819 - RNA, 17 nt, Homo sapiens
acaucuuuacucaggca

SEQ ID NO: 744820 - RNA, 16 nt, Homo sapiens
acaucuuuauugaaau

SEQ ID NO: 744821 - RNA, 11 nt, Homo sapiens
acaucuuucac

SEQ ID NO: 744822 - RNA, 18 nt, Homo sapiens
acaucuuuucuaaucaca

SEQ ID NO: 744823 - RNA, 22 nt, Homo sapiens
acaucuuuuggaaguuuugcua

SEQ ID NO: 744824 - RNA, 22 nt, Homo sapiens
acaugaaaauuuuugaguuaca

SEQ ID NO: 744825 - RNA, 14 nt, Homo sapiens
acaugacacugacc

SEQ ID NO: 744826 - RNA, 21 nt, Homo sapiens
acaugacuuauuaugcauaaa

SEQ ID NO: 744827 - RNA, 12 nt, Homo sapiens
acaugagcacac

SEQ ID NO: 744828 - RNA, 23 nt, Homo sapiens
acaugagggcugguguucauuaa

SEQ ID NO: 744829 - RNA, 23 nt, Homo sapiens
acaugauggggaaggaguacaaa

SEQ ID NO: 744830 - RNA, 18 nt, Homo sapiens
acaugauuguuugacaca

SEQ ID NO: 744831 - RNA, 23 nt, Homo sapiens
acaugcaaagauccccaaaacag

SEQ ID NO: 744832 - RNA, 14 nt, Homo sapiens
acaugcacugaccc

SEQ ID NO: 744833 - RNA, 10 nt, Homo sapiens
acaugccagu

SEQ ID NO: 744834 - RNA, 17 nt, Homo sapiens
acaugcccuguguggcu

SEQ ID NO: 744835 - RNA, 16 nt, Homo sapiens
acaugcuggugcauau

SEQ ID NO: 744836 - RNA, 17 nt, Homo sapiens
acauggaacgcuuucau

SEQ ID NO: 744837 - RNA, 20 nt, Homo sapiens
acauggagaaaucuacugaa

SEQ ID NO: 744838 - RNA, 19 nt, Homo sapiens
acauggccuaugcacauau

SEQ ID NO: 744839 - RNA, 21 nt, Homo sapiens
acauggccuaugcacauaugg

SEQ ID NO: 744840 - RNA, 18 nt, Homo sapiens
acauggcuguguuugcag

SEQ ID NO: 744841 - RNA, 21 nt, Homo sapiens
acauggucuaauuauuuacuc

SEQ ID NO: 744842 - RNA, 23 nt, Homo sapiens
acauggugaaaccucaucucuac

SEQ ID NO: 744843 - RNA, 21 nt, Homo sapiens
acaugguuuaaauaugaauga

SEQ ID NO: 744844 - RNA, 15 nt, Homo sapiens
acaugguuugacucu

SEQ ID NO: 744845 - RNA, 23 nt, Homo sapiens
acauguaaggccaaguacacuga

SEQ ID NO: 744846 - RNA, 21 nt, Homo sapiens
acauguaugcuauuacauaca

SEQ ID NO: 744847 - RNA, 14 nt, Homo sapiens
acauguauggacgu

SEQ ID NO: 744848 - RNA, 16 nt, Homo sapiens
acaugucaaucugucc

SEQ ID NO: 744849 - RNA, 21 nt, Homo sapiens
acaugucauguagguugucua

SEQ ID NO: 744850 - RNA, 16 nt, Homo sapiens
acaugucuccuacuga

SEQ ID NO: 744851 - RNA, 23 nt, Homo sapiens
acauguggugggacagggaccca

SEQ ID NO: 744852 - RNA, 18 nt, Homo sapiens
acauguuacugaccagca

SEQ ID NO: 744853 - RNA, 14 nt, Homo sapiens
acauguugccuugc

SEQ ID NO: 744854 - RNA, 18 nt, Homo sapiens
acauguuuaaauagccua

SEQ ID NO: 744855 - RNA, 21 nt, Homo sapiens
acauguuuguuucuguagaaa

SEQ ID NO: 744856 - RNA, 18 nt, Homo sapiens
acauuaaaaaaauuccau

SEQ ID NO: 744857 - RNA, 14 nt, Homo sapiens
acauuaaacacaaa

SEQ ID NO: 744858 - RNA, 15 nt, Homo sapiens
acauuaaaucacuug

SEQ ID NO: 744859 - RNA, 24 nt, Homo sapiens
acauuaaaucuaugaaguauauaa

SEQ ID NO: 744860 - RNA, 16 nt, Homo sapiens
acauuaacggugcuaa

SEQ ID NO: 744861 - RNA, 13 nt, Homo sapiens
acauuaaggacca

SEQ ID NO: 744862 - RNA, 13 nt, Homo sapiens
acauuaaugccug

SEQ ID NO: 744863 - RNA, 17 nt, Homo sapiens
acauuagcuaaaacugc

SEQ ID NO: 744864 - RNA, 20 nt, Homo sapiens
acauuauaaaaauugacaau

SEQ ID NO: 744865 - RNA, 22 nt, Homo sapiens
acauuaucgggagcagugucuu

SEQ ID NO: 744866 - RNA, 21 nt, Homo sapiens
acauuauguggcccucuggau

SEQ ID NO: 744867 - RNA, 13 nt, Homo sapiens
acauuaugugguu

SEQ ID NO: 744868 - RNA, 20 nt, Homo sapiens
acauuauuucuaguccaaaa

SEQ ID NO: 744869 - RNA, 18 nt, Homo sapiens
acauucaguucccaccau

SEQ ID NO: 744870 - RNA, 12 nt, Homo sapiens
acauuccaaacu

SEQ ID NO: 744871 - RNA, 17 nt, Homo sapiens
acauuccauuugaagca

SEQ ID NO: 744872 - RNA, 18 nt, Homo sapiens
acauuccccucccaccuc

SEQ ID NO: 744873 - RNA, 12 nt, Homo sapiens
acauuccuggcc

SEQ ID NO: 744874 - RNA, 20 nt, Homo sapiens
acauucuaaaggcuugauau

SEQ ID NO: 744875 - RNA, 14 nt, Homo sapiens
acauucucuuccca

SEQ ID NO: 744876 - RNA, 15 nt, Homo sapiens
acauucucuuugaua

SEQ ID NO: 744877 - RNA, 21 nt, Homo sapiens
acauucuuagcuguaacuuaa

SEQ ID NO: 744878 - RNA, 18 nt, Homo sapiens
acauucuuuaucuugaca

SEQ ID NO: 744879 - RNA, 19 nt, Homo sapiens
acauucuuuuucuguugaa

SEQ ID NO: 744880 - RNA, 23 nt, Homo sapiens
accuaggagggugugaguggcau

SEQ ID NO: 744881 - RNA, 15 nt, Homo sapiens
accuagggcacuuua

SEQ ID NO: 744882 - RNA, 22 nt, Homo sapiens
accuagggcacuuuaagucagu

SEQ ID NO: 744883 - RNA, 15 nt, Homo sapiens
accuauacauuauau

SEQ ID NO: 744884 - RNA, 19 nt, Homo sapiens
accuauuuccagaaauaca

SEQ ID NO: 744885 - RNA, 15 nt, Homo sapiens
accuauuugucaugu

SEQ ID NO: 744886 - RNA, 22 nt, Homo sapiens
accucaacauugcauggugcua

SEQ ID NO: 744887 - RNA, 17 nt, Homo sapiens
accucaaccuaugguau

SEQ ID NO: 744888 - RNA, 13 nt, Homo sapiens
accucaccugcug

SEQ ID NO: 744889 - RNA, 22 nt, Homo sapiens
accucaccugcuggggaccuca

SEQ ID NO: 744890 - RNA, 12 nt, Homo sapiens
accucacugggg

SEQ ID NO: 744891 - RNA, 20 nt, Homo sapiens
accucagccucccaaaaugc

SEQ ID NO: 744892 - RNA, 20 nt, Homo sapiens
accucagccuggccagacac

SEQ ID NO: 744893 - RNA, 16 nt, Homo sapiens
accucagcugcacauu

SEQ ID NO: 744894 - RNA, 16 nt, Homo sapiens
accucaggcagcucaa

SEQ ID NO: 744895 - RNA, 22 nt, Homo sapiens
accucagugguuagaagcaugu

SEQ ID NO: 744896 - RNA, 18 nt, Homo sapiens
accucaguuauuacaugu

SEQ ID NO: 744897 - RNA, 12 nt, Homo sapiens
accucaguuuua

SEQ ID NO: 744898 - RNA, 22 nt, Homo sapiens
accucaucagcugccuaacuua

SEQ ID NO: 744899 - RNA, 15 nt, Homo sapiens
accucaucucuacua

SEQ ID NO: 744900 - RNA, 16 nt, Homo sapiens
accucaucucuacuaa

SEQ ID NO: 744901 - RNA, 21 nt, Homo sapiens
accucaucuguggagcugcca

SEQ ID NO: 744902 - RNA, 17 nt, Homo sapiens
accuccaagcauuucau

SEQ ID NO: 744903 - RNA, 20 nt, Homo sapiens
accuccaagcauuucaugaa

SEQ ID NO: 744904 - RNA, 23 nt, Homo sapiens
accuccagcuaaacaccaacccc

SEQ ID NO: 744905 - RNA, 19 nt, Homo sapiens
accuccaggcuuucccacu

SEQ ID NO: 744906 - RNA, 15 nt, Homo sapiens
accuccauuucccaa

SEQ ID NO: 744907 - RNA, 12 nt, Homo sapiens
accucccaguga

SEQ ID NO: 744908 - RNA, 18 nt, Homo sapiens
accucccauuacuuugau

SEQ ID NO: 744909 - RNA, 16 nt, Homo sapiens
accucccgaagccacc

SEQ ID NO: 744910 - RNA, 20 nt, Homo sapiens
accuccuccacucacuccag

SEQ ID NO: 744911 - RNA, 16 nt, Homo sapiens
accuccuccucuggac

SEQ ID NO: 744912 - RNA, 20 nt, Homo sapiens
accuccuccucuggacaaag

SEQ ID NO: 744913 - RNA, 23 nt, Homo sapiens
accuccugaccugucaccgugag

SEQ ID NO: 744914 - RNA, 19 nt, Homo sapiens
accucgagcagaugaugcc

SEQ ID NO: 744915 - RNA, 23 nt, Homo sapiens
accucgccuguuggggaccucac

SEQ ID NO: 744916 - RNA, 19 nt, Homo sapiens
accucggccucccaaagug

SEQ ID NO: 744917 - RNA, 21 nt, Homo sapiens
accucggccucccaaagugcu

SEQ ID NO: 744918 - RNA, 21 nt, Homo sapiens
accucggugggcccagugggg

SEQ ID NO: 744919 - RNA, 19 nt, Homo sapiens
accucgucaagagcaugca

SEQ ID NO: 744920 - RNA, 22 nt, Homo sapiens
accucgucaagagcaugcacau

SEQ ID NO: 744921 - RNA, 17 nt, Homo sapiens
accucgugaucugccca

SEQ ID NO: 744922 - RNA, 14 nt, Homo sapiens
accucucaauuucu

SEQ ID NO: 744923 - RNA, 22 nt, Homo sapiens
accucuccuuucugugcauuca

SEQ ID NO: 744924 - RNA, 14 nt, Homo sapiens
accucugaccaaca

SEQ ID NO: 744925 - RNA, 10 nt, Homo sapiens
accucugaga

SEQ ID NO: 744926 - RNA, 19 nt, Homo sapiens
accucugauggcugaagaa

SEQ ID NO: 744927 - RNA, 20 nt, Homo sapiens
accucugccuccuaaguuca

SEQ ID NO: 744928 - RNA, 17 nt, Homo sapiens
accucuggacuggcuag

SEQ ID NO: 744929 - RNA, 20 nt, Homo sapiens
accucuucuaugcaagccuu

SEQ ID NO: 744930 - RNA, 21 nt, Homo sapiens
accucuugaaaauagaacaac

SEQ ID NO: 744931 - RNA, 15 nt, Homo sapiens
accucuuucaggguu

SEQ ID NO: 744932 - RNA, 20 nt, Homo sapiens
accucuuugucccagaguua

SEQ ID NO: 744933 - RNA, 19 nt, Homo sapiens
accugaaauuuauucacau

SEQ ID NO: 744934 - RNA, 18 nt, Homo sapiens
accugacaauggcagcua

SEQ ID NO: 744935 - RNA, 14 nt, Homo sapiens
accugacucuugca

SEQ ID NO: 744936 - RNA, 13 nt, Homo sapiens
accugagaaccuu

SEQ ID NO: 744937 - RNA, 13 nt, Homo sapiens
accugagcgcugu

SEQ ID NO: 744938 - RNA, 12 nt, Homo sapiens
accugaggucag

SEQ ID NO: 744939 - RNA, 13 nt, Homo sapiens
accugauccugga

SEQ ID NO: 744940 - RNA, 19 nt, Homo sapiens
accugauucccugugguga

SEQ ID NO: 744941 - RNA, 17 nt, Homo sapiens
accugauugaucacaca

SEQ ID NO: 744942 - RNA, 14 nt, Homo sapiens
accugcaagcagaa

SEQ ID NO: 744943 - RNA, 18 nt, Homo sapiens
accugcacuuaaggcacu

SEQ ID NO: 744944 - RNA, 17 nt, Homo sapiens
accugccagaggaugcu

SEQ ID NO: 744945 - RNA, 23 nt, Homo sapiens
accugcccugggccacacugacc

SEQ ID NO: 744946 - RNA, 13 nt, Homo sapiens
accugccucuucc

SEQ ID NO: 744947 - RNA, 12 nt, Homo sapiens
accugcucuccg

SEQ ID NO: 744948 - RNA, 16 nt, Homo sapiens
accugcugaagggcag

SEQ ID NO: 744949 - RNA, 19 nt, Homo sapiens
accugcugagggaccagcc

SEQ ID NO: 744950 - RNA, 20 nt, Homo sapiens
accugcugagggaccagcca

SEQ ID NO: 744951 - RNA, 18 nt, Homo sapiens
accugcuggggaccucac

SEQ ID NO: 744952 - RNA, 15 nt, Homo sapiens
accugcuguccugca

SEQ ID NO: 744953 - RNA, 17 nt, Homo sapiens
accugcugugaugacuu

SEQ ID NO: 744954 - RNA, 15 nt, Homo sapiens
accugcuucagugaa

SEQ ID NO: 744955 - RNA, 15 nt, Homo sapiens
accugcuuccuucag

SEQ ID NO: 744956 - RNA, 20 nt, Homo sapiens
accuggaagaacaggccucu

SEQ ID NO: 744957 - RNA, 17 nt, Homo sapiens
accuggaaucagugaag

SEQ ID NO: 744958 - RNA, 23 nt, Homo sapiens
accuggacggugcgcacaccgcc

SEQ ID NO: 744959 - RNA, 23 nt, Homo sapiens
accuggagcaucauaauggacuc

SEQ ID NO: 744960 - RNA, 21 nt, Homo sapiens
accuggcaacaaaaaguaaug

SEQ ID NO: 744961 - RNA, 19 nt, Homo sapiens
accuggcagcucuggacag

SEQ ID NO: 744962 - RNA, 17 nt, Homo sapiens
accuggcuuuuacuuua

SEQ ID NO: 744963 - RNA, 13 nt, Homo sapiens
accugggaaauca

SEQ ID NO: 744964 - RNA, 13 nt, Homo sapiens
accugggcaggga

SEQ ID NO: 744965 - RNA, 16 nt, Homo sapiens
accugggcauuguuga

SEQ ID NO: 744966 - RNA, 16 nt, Homo sapiens
accuggggagagccug

SEQ ID NO: 744967 - RNA, 18 nt, Homo sapiens
accuggggaugaagcuca

SEQ ID NO: 744968 - RNA, 13 nt, Homo sapiens
accuggguccuuu

SEQ ID NO: 744969 - RNA, 18 nt, Homo sapiens
accugguacugacccagg

SEQ ID NO: 744970 - RNA, 19 nt, Homo sapiens
accuggucugguugggcag

SEQ ID NO: 744971 - RNA, 21 nt, Homo sapiens
accuguaaucccagcacuuug

SEQ ID NO: 744972 - RNA, 14 nt, Homo sapiens
accuguacauucuu

SEQ ID NO: 744973 - RNA, 22 nt, Homo sapiens
accuguacauucuuccaucauc

SEQ ID NO: 744974 - RNA, 11 nt, Homo sapiens
accuguagucc

SEQ ID NO: 744975 - RNA, 13 nt, Homo sapiens
accuguaguccca

SEQ ID NO: 744976 - RNA, 20 nt, Homo sapiens
accuguugagacugauucag

SEQ ID NO: 744977 - RNA, 16 nt, Homo sapiens
accuguuucaccagug

SEQ ID NO: 744978 - RNA, 17 nt, Homo sapiens
accuguuuuauagaauu

SEQ ID NO: 744979 - RNA, 19 nt, Homo sapiens
accuguuuuuaagcuguuu

SEQ ID NO: 744980 - RNA, 14 nt, Homo sapiens
accuuagaaaucau

SEQ ID NO: 744981 - RNA, 23 nt, Homo sapiens
accuuauccauaggcgcaggugc

SEQ ID NO: 744982 - RNA, 17 nt, Homo sapiens
accuuauuguaccucuc

SEQ ID NO: 744983 - RNA, 15 nt, Homo sapiens
accuucaauacuuaa

SEQ ID NO: 744984 - RNA, 19 nt, Homo sapiens
accuucaggcagccagugu

SEQ ID NO: 744985 - RNA, 22 nt, Homo sapiens
accuucaugugauucacugccu

SEQ ID NO: 744986 - RNA, 14 nt, Homo sapiens
accuuccacccagu

SEQ ID NO: 744987 - RNA, 11 nt, Homo sapiens
accuuccccag

SEQ ID NO: 744988 - RNA, 14 nt, Homo sapiens
accuuccuucccug

SEQ ID NO: 744989 - RNA, 21 nt, Homo sapiens
accuugacuugaaaugcucuu

SEQ ID NO: 744990 - RNA, 12 nt, Homo sapiens
accuugagcaaa

SEQ ID NO: 744991 - RNA, 15 nt, Homo sapiens
accuugcuccugugu

SEQ ID NO: 744992 - RNA, 17 nt, Homo sapiens
accuuggcaccagacac

SEQ ID NO: 744993 - RNA, 22 nt, Homo sapiens
accuuggcaccagacacccagg

SEQ ID NO: 744994 - RNA, 20 nt, Homo sapiens
accuuggcccaggagcucug

SEQ ID NO: 744995 - RNA, 16 nt, Homo sapiens
accuuggggucccucc

SEQ ID NO: 744996 - RNA, 13 nt, Homo sapiens
accuuggugcuua

SEQ ID NO: 744997 - RNA, 19 nt, Homo sapiens
accuuguuggagccugcag

SEQ ID NO: 744998 - RNA, 15 nt, Homo sapiens
accuuuccagccaua

SEQ ID NO: 744999 - RNA, 23 nt, Homo sapiens
accuuuccaguuuauaagacugg

SEQ ID NO: 745000 - RNA, 22 nt, Homo sapiens
accuuucggcaaggacgguaac

SEQ ID NO: 745001 - RNA, 18 nt, Homo sapiens
accuuuggcugguagcag

SEQ ID NO: 745002 - RNA, 11 nt, Homo sapiens
accuuuguacg

SEQ ID NO: 745003 - RNA, 19 nt, Homo sapiens
accuuuucccugcaccacu

SEQ ID NO: 745004 - RNA, 20 nt, Homo sapiens
accuuuucccugcaccacuc

SEQ ID NO: 745005 - RNA, 22 nt, Homo sapiens
accuuuugaggagccccagcua

SEQ ID NO: 745006 - RNA, 13 nt, Homo sapiens
acgaaaucuaggu

SEQ ID NO: 745007 - RNA, 20 nt, Homo sapiens
acgaaaugcuaugacuguau

SEQ ID NO: 745008 - RNA, 15 nt, Homo sapiens
acgaacccaccugcu

SEQ ID NO: 745009 - RNA, 13 nt, Homo sapiens
acgacaacgauga

SEQ ID NO: 745010 - RNA, 23 nt, Homo sapiens
acgacagguggcaacaaugcccc

SEQ ID NO: 745011 - RNA, 23 nt, Homo sapiens
acgaccgccccaguuccuguggc

SEQ ID NO: 745012 - RNA, 19 nt, Homo sapiens
acgagacccccauccagcc

SEQ ID NO: 745013 - RNA, 22 nt, Homo sapiens
acgagcuagcuucugcaauguu

SEQ ID NO: 745014 - RNA, 19 nt, Homo sapiens
acgaggcaggggcucugcu

SEQ ID NO: 745015 - RNA, 14 nt, Homo sapiens
acgaggcucaaaaa

SEQ ID NO: 745016 - RNA, 16 nt, Homo sapiens
acgagggguggugcua

SEQ ID NO: 745017 - RNA, 14 nt, Homo sapiens
acgaggucuuguug

SEQ ID NO: 745018 - RNA, 22 nt, Homo sapiens
acgaguggccaguucauugugg

SEQ ID NO: 745019 - RNA, 23 nt, Homo sapiens
acgaucaaguuguugacugugau

SEQ ID NO: 745020 - RNA, 16 nt, Homo sapiens
acgaucuucuccacau

SEQ ID NO: 745021 - RNA, 17 nt, Homo sapiens
acgauucuuaacaauaa

SEQ ID NO: 745022 - RNA, 22 nt, Homo sapiens
acgauugaaaugaaaacucuau

SEQ ID NO: 745023 - RNA, 17 nt, Homo sapiens
acgauuucacuaggacu

SEQ ID NO: 745024 - RNA, 13 nt, Homo sapiens
acgauuugucagu

SEQ ID NO: 745025 - RNA, 17 nt, Homo sapiens
acgcaacccacguguaa

SEQ ID NO: 745026 - RNA, 16 nt, Homo sapiens
acgcacauaccuucau

SEQ ID NO: 745027 - RNA, 17 nt, Homo sapiens
acgcaugugugcugcag

SEQ ID NO: 745028 - RNA, 17 nt, Homo sapiens
acgcauucucguaucca

SEQ ID NO: 745029 - RNA, 19 nt, Homo sapiens
acgcauucucguauccaac

SEQ ID NO: 745030 - RNA, 23 nt, Homo sapiens
acgccugcaggcuggagacugga

SEQ ID NO: 745031 - RNA, 18 nt, Homo sapiens
acgccuguaaucccagca

SEQ ID NO: 745032 - RNA, 19 nt, Homo sapiens
acgccuguaguccuagcca

SEQ ID NO: 745033 - RNA, 16 nt, Homo sapiens
acgcgcgcgugcacac

SEQ ID NO: 745034 - RNA, 20 nt, Homo sapiens
acgcgguuccagauguggau

SEQ ID NO: 745035 - RNA, 17 nt, Homo sapiens
acgcuauccaguugcag

SEQ ID NO: 745036 - RNA, 20 nt, Homo sapiens
acgcucccccgcagucccca

SEQ ID NO: 745037 - RNA, 20 nt, Homo sapiens
acgcugauccauaaagacaa

SEQ ID NO: 745038 - RNA, 20 nt, Homo sapiens
acgcugcccugcaugcugcc

SEQ ID NO: 745039 - RNA, 21 nt, Homo sapiens
acgcugcugcaggacauuaau

SEQ ID NO: 745040 - RNA, 14 nt, Homo sapiens
acgcuugugacagu

SEQ ID NO: 745041 - RNA, 20 nt, Homo sapiens
acgcuuuuugggagaaugau

SEQ ID NO: 745042 - RNA, 16 nt, Homo sapiens
acggaccaaagcaaga

SEQ ID NO: 745043 - RNA, 20 nt, Homo sapiens
acggacuccagucugugugu

SEQ ID NO: 745044 - RNA, 20 nt, Homo sapiens
acggacugugcauacuuucc

SEQ ID NO: 745045 - RNA, 21 nt, Homo sapiens
acggagacuuucaaacauaua

SEQ ID NO: 745046 - RNA, 21 nt, Homo sapiens
acggagccccugaaagccuca

SEQ ID NO: 745047 - RNA, 21 nt, Homo sapiens
acggagccgcgggacagccaa

SEQ ID NO: 745048 - RNA, 14 nt, Homo sapiens
acggaggccugcga

SEQ ID NO: 745049 - RNA, 23 nt, Homo sapiens
acggaguccuguguuugugaguc

SEQ ID NO: 745050 - RNA, 20 nt, Homo sapiens
acggagucucacucugucac

SEQ ID NO: 745051 - RNA, 16 nt, Homo sapiens
acggagucuugcucug

SEQ ID NO: 745052 - RNA, 21 nt, Homo sapiens
acggaucugcugggcucugcc

SEQ ID NO: 745053 - RNA, 15 nt, Homo sapiens
acggauggugcaugg

SEQ ID NO: 745054 - RNA, 21 nt, Homo sapiens
acggcgugccuggacacugua

SEQ ID NO: 745055 - RNA, 17 nt, Homo sapiens
acggcugccccuuccac

SEQ ID NO: 745056 - RNA, 17 nt, Homo sapiens
acgggcaaucaugagca

SEQ ID NO: 745057 - RNA, 17 nt, Homo sapiens
acggggcucagcaaugc

SEQ ID NO: 745058 - RNA, 18 nt, Homo sapiens
acgggucugagacugaaa

SEQ ID NO: 745059 - RNA, 18 nt, Homo sapiens
acggucaguccaugucuc

SEQ ID NO: 745060 - RNA, 23 nt, Homo sapiens
acggugcccaaacaccagucacc

SEQ ID NO: 745061 - RNA, 22 nt, Homo sapiens
acgguggccuaggguacaggca

SEQ ID NO: 745062 - RNA, 20 nt, Homo sapiens
acgguggcucacgccuguaa

SEQ ID NO: 745063 - RNA, 21 nt, Homo sapiens
acgguuaagaaagcacuuaaa

SEQ ID NO: 745064 - RNA, 22 nt, Homo sapiens
acguagccugggcucacugugc

SEQ ID NO: 745065 - RNA, 14 nt, Homo sapiens
acgucaagucuccu

SEQ ID NO: 745066 - RNA, 13 nt, Homo sapiens
acgucacugauau

SEQ ID NO: 745067 - RNA, 20 nt, Homo sapiens
acgucaggagaggccagcug

SEQ ID NO: 745068 - RNA, 18 nt, Homo sapiens
acgucauguguuuugcca

SEQ ID NO: 745069 - RNA, 16 nt, Homo sapiens
acgucuggcucccugc

SEQ ID NO: 745070 - RNA, 17 nt, Homo sapiens
acgucuguggacugaau

SEQ ID NO: 745071 - RNA, 17 nt, Homo sapiens
acgugaaacagagugau

SEQ ID NO: 745072 - RNA, 15 nt, Homo sapiens
acgugacuguggcac

SEQ ID NO: 745073 - RNA, 18 nt, Homo sapiens
acgugcgugucucugcca

SEQ ID NO: 745074 - RNA, 12 nt, Homo sapiens
acguggccucuu

SEQ ID NO: 745075 - RNA, 18 nt, Homo sapiens
acguguauaguaucugua

SEQ ID NO: 745076 - RNA, 22 nt, Homo sapiens
acguuagauuugccguaccaau

SEQ ID NO: 745077 - RNA, 13 nt, Homo sapiens
acguuaugaugac

SEQ ID NO: 745078 - RNA, 19 nt, Homo sapiens
acguucagaggugcagcug

SEQ ID NO: 745079 - RNA, 21 nt, Homo sapiens
acguucuuggauccucagaac

SEQ ID NO: 745080 - RNA, 22 nt, Homo sapiens
acguugaggacuuuucgaccaa

SEQ ID NO: 745081 - RNA, 23 nt, Homo sapiens
acguugaucccagagagcagcuu

SEQ ID NO: 745082 - RNA, 22 nt, Homo sapiens
acguuggggcaacuacagcucu

SEQ ID NO: 745083 - RNA, 22 nt, Homo sapiens
acguuuauaaacagaaauggaa

SEQ ID NO: 745084 - RNA, 20 nt, Homo sapiens
acguuucugggcggccagug

SEQ ID NO: 745085 - RNA, 13 nt, Homo sapiens
acguuugucauuc

SEQ ID NO: 745086 - RNA, 23 nt, Homo sapiens
acguuuguccuuuuucacuuuga

SEQ ID NO: 745087 - RNA, 16 nt, Homo sapiens
acuaaaaaaaagauga

SEQ ID NO: 745088 - RNA, 17 nt, Homo sapiens
acuaaaaaguauugcau

SEQ ID NO: 745089 - RNA, 13 nt, Homo sapiens
acuaaaaauugug

SEQ ID NO: 745090 - RNA, 14 nt, Homo sapiens
acuaaacaguaaga

SEQ ID NO: 745091 - RNA, 12 nt, Homo sapiens
acuaaacuuuca

SEQ ID NO: 745092 - RNA, 18 nt, Homo sapiens
acuaaagacgguauuaaa

SEQ ID NO: 745093 - RNA, 20 nt, Homo sapiens
acuaaagcuauguuacaugg

SEQ ID NO: 745094 - RNA, 13 nt, Homo sapiens
acuaaaugaacau

SEQ ID NO: 745095 - RNA, 17 nt, Homo sapiens
acuaacagauaagcaag

SEQ ID NO: 745096 - RNA, 16 nt, Homo sapiens
acuaacccaaugccug

SEQ ID NO: 745097 - RNA, 12 nt, Homo sapiens
acuaaccuggua

SEQ ID NO: 745098 - RNA, 12 nt, Homo sapiens
acuaagcacaaa

SEQ ID NO: 745099 - RNA, 20 nt, Homo sapiens
acuaagcaguaagcuaucuu

SEQ ID NO: 745100 - RNA, 12 nt, Homo sapiens
acuaagcucuuu

SEQ ID NO: 745101 - RNA, 14 nt, Homo sapiens
acuaauacuacugu

SEQ ID NO: 745102 - RNA, 22 nt, Homo sapiens
acuaauagaauaaaggcaguuu

SEQ ID NO: 745103 - RNA, 13 nt, Homo sapiens
acuaaucaagaaa

SEQ ID NO: 745104 - RNA, 22 nt, Homo sapiens
acuaaucaagaaaaacaucuuu

SEQ ID NO: 745105 - RNA, 15 nt, Homo sapiens
acuaaugaggauugc

SEQ ID NO: 745106 - RNA, 16 nt, Homo sapiens
acuaaugauguuuucc

SEQ ID NO: 745107 - RNA, 17 nt, Homo sapiens
acuaauggaaauauuau

SEQ ID NO: 745108 - RNA, 18 nt, Homo sapiens
acuaauucuaauguggac

SEQ ID NO: 745109 - RNA, 12 nt, Homo sapiens
agcaugugccaa

SEQ ID NO: 745110 - RNA, 16 nt, Homo sapiens
agcauguuuucacuaa

SEQ ID NO: 745111 - RNA, 14 nt, Homo sapiens
agcauuacaguggg

SEQ ID NO: 745112 - RNA, 16 nt, Homo sapiens
agcauuacauuauuaa

SEQ ID NO: 745113 - RNA, 22 nt, Homo sapiens
agcauuagcuggcgcauauuaa

SEQ ID NO: 745114 - RNA, 19 nt, Homo sapiens
agcauucuugucacaauaa

SEQ ID NO: 745115 - RNA, 12 nt, Homo sapiens
agcauugcacuu

SEQ ID NO: 745116 - RNA, 19 nt, Homo sapiens
agcauugcuauuuaucuca

SEQ ID NO: 745117 - RNA, 14 nt, Homo sapiens
agcauugcuuucgu

SEQ ID NO: 745118 - RNA, 17 nt, Homo sapiens
agcauuguaaaugugcu

SEQ ID NO: 745119 - RNA, 17 nt, Homo sapiens
agcauuuaaccaaccua

SEQ ID NO: 745120 - RNA, 22 nt, Homo sapiens
agcauuuacagaaacgcaucca

SEQ ID NO: 745121 - RNA, 18 nt, Homo sapiens
agcauuuccaacaccaca

SEQ ID NO: 745122 - RNA, 21 nt, Homo sapiens
agcauuugauauacaugcuca

SEQ ID NO: 745123 - RNA, 13 nt, Homo sapiens
agcauuugcaaca

SEQ ID NO: 745124 - RNA, 15 nt, Homo sapiens
agcauuuucaaugau

SEQ ID NO: 745125 - RNA, 12 nt, Homo sapiens
agccaaacccac

SEQ ID NO: 745126 - RNA, 21 nt, Homo sapiens
agccaaacucugccagccaca

SEQ ID NO: 745127 - RNA, 12 nt, Homo sapiens
agccaaagggac

SEQ ID NO: 745128 - RNA, 23 nt, Homo sapiens
agccaaauaaaaucuauacauac

SEQ ID NO: 745129 - RNA, 15 nt, Homo sapiens
agccaaaugcaggga

SEQ ID NO: 745130 - RNA, 14 nt, Homo sapiens
agccaaauuuccag

SEQ ID NO: 745131 - RNA, 20 nt, Homo sapiens
agccaacacccugucuaaaa

SEQ ID NO: 745132 - RNA, 19 nt, Homo sapiens
agccaaccuuaaaccucuu

SEQ ID NO: 745133 - RNA, 16 nt, Homo sapiens
agccaacuuuaauugc

SEQ ID NO: 745134 - RNA, 15 nt, Homo sapiens
agccaagauugcacc

SEQ ID NO: 745135 - RNA, 19 nt, Homo sapiens
agccaagauugcgccauug

SEQ ID NO: 745136 - RNA, 13 nt, Homo sapiens
agccaagugcagg

SEQ ID NO: 745137 - RNA, 22 nt, Homo sapiens
agccaauagaguugggacaauu

SEQ ID NO: 745138 - RNA, 15 nt, Homo sapiens
agccaaugaacagcu

SEQ ID NO: 745139 - RNA, 17 nt, Homo sapiens
agccacaagucuuccag

SEQ ID NO: 745140 - RNA, 13 nt, Homo sapiens
agccacacugugg

SEQ ID NO: 745141 - RNA, 21 nt, Homo sapiens
agccacagccugacacagugc

SEQ ID NO: 745142 - RNA, 15 nt, Homo sapiens
agccacaggacccca

SEQ ID NO: 745143 - RNA, 11 nt, Homo sapiens
agccacaggcc

SEQ ID NO: 745144 - RNA, 20 nt, Homo sapiens
agccacaggccugagauuuc

SEQ ID NO: 745145 - RNA, 14 nt, Homo sapiens
agccaccaugccug

SEQ ID NO: 745146 - RNA, 18 nt, Homo sapiens
agccacccaagccugcug

SEQ ID NO: 745147 - RNA, 23 nt, Homo sapiens
agccaccgcgcccagccucaucu

SEQ ID NO: 745148 - RNA, 14 nt, Homo sapiens
agccaccgcugcca

SEQ ID NO: 745149 - RNA, 15 nt, Homo sapiens
agccacuaaaacaca

SEQ ID NO: 745150 - RNA, 12 nt, Homo sapiens
agccacugugcc

SEQ ID NO: 745151 - RNA, 15 nt, Homo sapiens
agccacuuucugcca

SEQ ID NO: 745152 - RNA, 18 nt, Homo sapiens
agccagaauucacuagga

SEQ ID NO: 745153 - RNA, 17 nt, Homo sapiens
agccagacuugcuuccu

SEQ ID NO: 745154 - RNA, 19 nt, Homo sapiens
agccagagccugucuuuca

SEQ ID NO: 745155 - RNA, 22 nt, Homo sapiens
agccagagcugugccugcucag

SEQ ID NO: 745156 - RNA, 19 nt, Homo sapiens
agccagagcuugaauucau

SEQ ID NO: 745157 - RNA, 16 nt, Homo sapiens
agccagcaaugauguc

SEQ ID NO: 745158 - RNA, 22 nt, Homo sapiens
agccagcauccccaacugcgac

SEQ ID NO: 745159 - RNA, 18 nt, Homo sapiens
agccaggaaguacuucca

SEQ ID NO: 745160 - RNA, 14 nt, Homo sapiens
agccaggaccaccu

SEQ ID NO: 745161 - RNA, 18 nt, Homo sapiens
agccaggaggccugcuag

SEQ ID NO: 745162 - RNA, 19 nt, Homo sapiens
agccaggcaugguggcaca

SEQ ID NO: 745163 - RNA, 18 nt, Homo sapiens
agccaggccaacagcacc

SEQ ID NO: 745164 - RNA, 19 nt, Homo sapiens
agccaggccaacagcaccu

SEQ ID NO: 745165 - RNA, 18 nt, Homo sapiens
agccaggccccaagccca

SEQ ID NO: 745166 - RNA, 17 nt, Homo sapiens
agccaggccugaccuca

SEQ ID NO: 745167 - RNA, 23 nt, Homo sapiens
agccaggccugggggcagccucu

SEQ ID NO: 745168 - RNA, 14 nt, Homo sapiens
agccaggcuccuac

SEQ ID NO: 745169 - RNA, 23 nt, Homo sapiens
agccaggcugagugagccacaga

SEQ ID NO: 745170 - RNA, 17 nt, Homo sapiens
agccagggcaacacagu

SEQ ID NO: 745171 - RNA, 21 nt, Homo sapiens
agccagucucagagaccagca

SEQ ID NO: 745172 - RNA, 12 nt, Homo sapiens
agccaguggcac

SEQ ID NO: 745173 - RNA, 23 nt, Homo sapiens
agccagugugacacugcuuuaaa

SEQ ID NO: 745174 - RNA, 22 nt, Homo sapiens
agccaguuggcuucuaagccaa

SEQ ID NO: 745175 - RNA, 18 nt, Homo sapiens
agccaguuguugccaacc

SEQ ID NO: 745176 - RNA, 18 nt, Homo sapiens
agccauaagaaagcacua

SEQ ID NO: 745177 - RNA, 21 nt, Homo sapiens
agccauauaaguuugaaggaa

SEQ ID NO: 745178 - RNA, 21 nt, Homo sapiens
agccauauaggcagcaccuga

SEQ ID NO: 745179 - RNA, 19 nt, Homo sapiens
agccauauuugauaguaua

SEQ ID NO: 745180 - RNA, 16 nt, Homo sapiens
agccaucauaacucac

SEQ ID NO: 745181 - RNA, 20 nt, Homo sapiens
agccaugaucgagccacugc

SEQ ID NO: 745182 - RNA, 18 nt, Homo sapiens
agccaugccucaugccac

SEQ ID NO: 745183 - RNA, 16 nt, Homo sapiens
agccaugccugagguc

SEQ ID NO: 745184 - RNA, 23 nt, Homo sapiens
agccauggcugggcgugcuagag

SEQ ID NO: 745185 - RNA, 11 nt, Homo sapiens
agccaugggcc

SEQ ID NO: 745186 - RNA, 18 nt, Homo sapiens
agccauucauguauguca

SEQ ID NO: 745187 - RNA, 15 nt, Homo sapiens
agcccaaaacccagg

SEQ ID NO: 745188 - RNA, 14 nt, Homo sapiens
agcccaaguucaug

SEQ ID NO: 745189 - RNA, 13 nt, Homo sapiens
agcccacauccca

SEQ ID NO: 745190 - RNA, 23 nt, Homo sapiens
agcccacauuggauucaucagca

SEQ ID NO: 745191 - RNA, 17 nt, Homo sapiens
agcccacccugcugcug

SEQ ID NO: 745192 - RNA, 16 nt, Homo sapiens
agcccacuguuaauau

SEQ ID NO: 745193 - RNA, 16 nt, Homo sapiens
agcccagacgcagcug

SEQ ID NO: 745194 - RNA, 16 nt, Homo sapiens
agcccagagacuuugu

SEQ ID NO: 745195 - RNA, 15 nt, Homo sapiens
agcccagagcccggu

SEQ ID NO: 745196 - RNA, 15 nt, Homo sapiens
agcccagcacuguga

SEQ ID NO: 745197 - RNA, 14 nt, Homo sapiens
agcccagccuggga

SEQ ID NO: 745198 - RNA, 15 nt, Homo sapiens
agcccagccugggag

SEQ ID NO: 745199 - RNA, 16 nt, Homo sapiens
agcccaggccagagug

SEQ ID NO: 745200 - RNA, 22 nt, Homo sapiens
agcccagggcuccugcacuuac

SEQ ID NO: 745201 - RNA, 23 nt, Homo sapiens
agcccaguaacugcaccaacgag

SEQ ID NO: 745202 - RNA, 16 nt, Homo sapiens
agcccagugcacugaa

SEQ ID NO: 745203 - RNA, 15 nt, Homo sapiens
agcccauaaggccag

SEQ ID NO: 745204 - RNA, 22 nt, Homo sapiens
agcccaugacguguuucuugaa

SEQ ID NO: 745205 - RNA, 14 nt, Homo sapiens
agcccauggcuuua

SEQ ID NO: 745206 - RNA, 22 nt, Homo sapiens
agcccauuuguguacacaguca

SEQ ID NO: 745207 - RNA, 14 nt, Homo sapiens
agccccacugccag

SEQ ID NO: 745208 - RNA, 17 nt, Homo sapiens
agccccagcuuccugug

SEQ ID NO: 745209 - RNA, 20 nt, Homo sapiens
agccccagugccaagcacag

SEQ ID NO: 745210 - RNA, 17 nt, Homo sapiens
agccccauccuguguua

SEQ ID NO: 745211 - RNA, 22 nt, Homo sapiens
agcccccagcuaagaaccugga

SEQ ID NO: 745212 - RNA, 23 nt, Homo sapiens
agccccggugugcggugcauaca

SEQ ID NO: 745213 - RNA, 14 nt, Homo sapiens
agccccuccaaagg

SEQ ID NO: 745214 - RNA, 22 nt, Homo sapiens
agccccuuacuaugaucucagg

SEQ ID NO: 745215 - RNA, 18 nt, Homo sapiens
agccccuuauuugcacuu

SEQ ID NO: 745216 - RNA, 14 nt, Homo sapiens
agcccgcuuggcca

SEQ ID NO: 745217 - RNA, 13 nt, Homo sapiens
agcccgucucagu

SEQ ID NO: 745218 - RNA, 22 nt, Homo sapiens
agcccuaacauagugucugcug

SEQ ID NO: 745219 - RNA, 19 nt, Homo sapiens
agcccuaaguggcugccuu

SEQ ID NO: 745220 - RNA, 16 nt, Homo sapiens
agcccuaauagcagaa

SEQ ID NO: 745221 - RNA, 19 nt, Homo sapiens
agcccuaauagcagaaaua

SEQ ID NO: 745222 - RNA, 21 nt, Homo sapiens
agcccucaccccugguucuca

SEQ ID NO: 745223 - RNA, 18 nt, Homo sapiens
agcccugaccccagugua

SEQ ID NO: 745224 - RNA, 18 nt, Homo sapiens
aggaagcaccccaugcca

SEQ ID NO: 745225 - RNA, 19 nt, Homo sapiens
aggaagccaggcugaguga

SEQ ID NO: 745226 - RNA, 14 nt, Homo sapiens
aggaagccagguga

SEQ ID NO: 745227 - RNA, 21 nt, Homo sapiens
aggaaggaaagaaagaaggaa

SEQ ID NO: 745228 - RNA, 13 nt, Homo sapiens
aggaaggacuuga

SEQ ID NO: 745229 - RNA, 15 nt, Homo sapiens
aggaaggcagcugcu

SEQ ID NO: 745230 - RNA, 23 nt, Homo sapiens
aggaagguagcccagcacuguga

SEQ ID NO: 745231 - RNA, 14 nt, Homo sapiens
aggaaguauggcaa

SEQ ID NO: 745232 - RNA, 15 nt, Homo sapiens
aggaaguauggcaaa

SEQ ID NO: 745233 - RNA, 22 nt, Homo sapiens
aggaagucauccagucuauuca

SEQ ID NO: 745234 - RNA, 14 nt, Homo sapiens
aggaauacauuugg

SEQ ID NO: 745235 - RNA, 20 nt, Homo sapiens
aggaauauagaaugaaagac

SEQ ID NO: 745236 - RNA, 20 nt, Homo sapiens
aggaauauaugugugccuau

SEQ ID NO: 745237 - RNA, 13 nt, Homo sapiens
aggaaucaagaag

SEQ ID NO: 745238 - RNA, 19 nt, Homo sapiens
aggaauccaaaagacaaaa

SEQ ID NO: 745239 - RNA, 17 nt, Homo sapiens
aggaauccccaacaugc

SEQ ID NO: 745240 - RNA, 19 nt, Homo sapiens
aggaauccuggauuuugcc

SEQ ID NO: 745241 - RNA, 21 nt, Homo sapiens
aggaauccuggcagcccagag

SEQ ID NO: 745242 - RNA, 22 nt, Homo sapiens
aggaaucggagcgaagcagaga

SEQ ID NO: 745243 - RNA, 12 nt, Homo sapiens
aggaaucucaga

SEQ ID NO: 745244 - RNA, 17 nt, Homo sapiens
aggaaugaagccuuagc

SEQ ID NO: 745245 - RNA, 18 nt, Homo sapiens
aggaauggugcguggcuu

SEQ ID NO: 745246 - RNA, 22 nt, Homo sapiens
aggaauuaugucguaagucacu

SEQ ID NO: 745247 - RNA, 22 nt, Homo sapiens
aggaauucuaaauaaauuuccc

SEQ ID NO: 745248 - RNA, 18 nt, Homo sapiens
aggaauugguaaggccuc

SEQ ID NO: 745249 - RNA, 19 nt, Homo sapiens
aggaauugucaaaugauga

SEQ ID NO: 745250 - RNA, 17 nt, Homo sapiens
aggaauuugcauuuagu

SEQ ID NO: 745251 - RNA, 17 nt, Homo sapiens
aggaauuuguacuucuu

SEQ ID NO: 745252 - RNA, 18 nt, Homo sapiens
aggaauuuugugugauug

SEQ ID NO: 745253 - RNA, 18 nt, Homo sapiens
aggacaagacacugagga

SEQ ID NO: 745254 - RNA, 17 nt, Homo sapiens
aggacaagggcucagag

SEQ ID NO: 745255 - RNA, 12 nt, Homo sapiens
aggacacagcac

SEQ ID NO: 745256 - RNA, 18 nt, Homo sapiens
aggacacaguggagccca

SEQ ID NO: 745257 - RNA, 16 nt, Homo sapiens
aggacaccagccuggu

SEQ ID NO: 745258 - RNA, 17 nt, Homo sapiens
aggacacucgcuugccg

SEQ ID NO: 745259 - RNA, 23 nt, Homo sapiens
aggacacuggugguucuacugac

SEQ ID NO: 745260 - RNA, 17 nt, Homo sapiens
aggacagaauguguucu

SEQ ID NO: 745261 - RNA, 18 nt, Homo sapiens
aggacaggacccucagga

SEQ ID NO: 745262 - RNA, 16 nt, Homo sapiens
aggaccaacauccagu

SEQ ID NO: 745263 - RNA, 14 nt, Homo sapiens
aggaccaagccaca

SEQ ID NO: 745264 - RNA, 19 nt, Homo sapiens
aggaccaauugacucucac

SEQ ID NO: 745265 - RNA, 21 nt, Homo sapiens
aggacccugaaggggccauga

SEQ ID NO: 745266 - RNA, 14 nt, Homo sapiens
aggacccugugagc

SEQ ID NO: 745267 - RNA, 14 nt, Homo sapiens
aggacccuucccuu

SEQ ID NO: 745268 - RNA, 22 nt, Homo sapiens
aggaccuggagauugugcucug

SEQ ID NO: 745269 - RNA, 15 nt, Homo sapiens
aggacgauuucuguc

SEQ ID NO: 745270 - RNA, 18 nt, Homo sapiens
aggacgguuaacuuguau

SEQ ID NO: 745271 - RNA, 16 nt, Homo sapiens
aggacgugggccucca

SEQ ID NO: 745272 - RNA, 14 nt, Homo sapiens
aggacuacaaccaa

SEQ ID NO: 745273 - RNA, 16 nt, Homo sapiens
aggacucaaaguuuca

SEQ ID NO: 745274 - RNA, 17 nt, Homo sapiens
aggacucacuagacuca

SEQ ID NO: 745275 - RNA, 19 nt, Homo sapiens
aggacucagugaucccugg

SEQ ID NO: 745276 - RNA, 19 nt, Homo sapiens
aggacucccuccucaccuc

SEQ ID NO: 745277 - RNA, 21 nt, Homo sapiens
aggacucuauuuuaaggacug

SEQ ID NO: 745278 - RNA, 12 nt, Homo sapiens
aggacugaacaa

SEQ ID NO: 745279 - RNA, 14 nt, Homo sapiens
aggacugaacucca

SEQ ID NO: 745280 - RNA, 18 nt, Homo sapiens
aggacugggucugaccug

SEQ ID NO: 745281 - RNA, 21 nt, Homo sapiens
aggacugggucugaccuggug

SEQ ID NO: 745282 - RNA, 20 nt, Homo sapiens
aggacuuaacggcuccagga

SEQ ID NO: 745283 - RNA, 21 nt, Homo sapiens
aggacuuccauuugcuuuguc

SEQ ID NO: 745284 - RNA, 19 nt, Homo sapiens
aggacuugugucucugugc

SEQ ID NO: 745285 - RNA, 17 nt, Homo sapiens
aggagaaaggggcccca

SEQ ID NO: 745286 - RNA, 21 nt, Homo sapiens
aggagaaccacuacaugcagc

SEQ ID NO: 745287 - RNA, 15 nt, Homo sapiens
aggagaagcacagcu

SEQ ID NO: 745288 - RNA, 18 nt, Homo sapiens
aggagaagcacagcuccu

SEQ ID NO: 745289 - RNA, 13 nt, Homo sapiens
aggagaaggugcc

SEQ ID NO: 745290 - RNA, 18 nt, Homo sapiens
aggagaaguauuccuguu

SEQ ID NO: 745291 - RNA, 16 nt, Homo sapiens
aggagaauagcagaga

SEQ ID NO: 745292 - RNA, 14 nt, Homo sapiens
aggagacauuggua

SEQ ID NO: 745293 - RNA, 16 nt, Homo sapiens
aggagaccagcucaga

SEQ ID NO: 745294 - RNA, 22 nt, Homo sapiens
aggagaccuacccuccacaggc

SEQ ID NO: 745295 - RNA, 15 nt, Homo sapiens
aggagacuagauugc

SEQ ID NO: 745296 - RNA, 22 nt, Homo sapiens
aggagacucaccucugccucaa

SEQ ID NO: 745297 - RNA, 12 nt, Homo sapiens
aggagagcaaga

SEQ ID NO: 745298 - RNA, 19 nt, Homo sapiens
aggagaggggaagggccag

SEQ ID NO: 745299 - RNA, 17 nt, Homo sapiens
aggagcaggcacgggug

SEQ ID NO: 745300 - RNA, 22 nt, Homo sapiens
aggagccaggccuugggcuccu

SEQ ID NO: 745301 - RNA, 10 nt, Homo sapiens
aggagccauu

SEQ ID NO: 745302 - RNA, 22 nt, Homo sapiens
aggagcccugaggaccucucag

SEQ ID NO: 745303 - RNA, 19 nt, Homo sapiens
aggagccuuuugcucucug

SEQ ID NO: 745304 - RNA, 23 nt, Homo sapiens
aggagcugauacuuugacagugu

SEQ ID NO: 745305 - RNA, 19 nt, Homo sapiens
aggagcugauuuccaggcc

SEQ ID NO: 745306 - RNA, 18 nt, Homo sapiens
aggagcuugcaagaagca

SEQ ID NO: 745307 - RNA, 17 nt, Homo sapiens
aggagcuugggugugcu

SEQ ID NO: 745308 - RNA, 13 nt, Homo sapiens
aggagcuuucuca

SEQ ID NO: 745309 - RNA, 18 nt, Homo sapiens
aggaggaauaaggggaag

SEQ ID NO: 745310 - RNA, 13 nt, Homo sapiens
aggaggaauuuac

SEQ ID NO: 745311 - RNA, 13 nt, Homo sapiens
aggaggaggacac

SEQ ID NO: 745312 - RNA, 21 nt, Homo sapiens
aggaggcccuggugucaggca

SEQ ID NO: 745313 - RNA, 21 nt, Homo sapiens
aggaggccuccacuccggauc

SEQ ID NO: 745314 - RNA, 20 nt, Homo sapiens
aggaggcucccgaggggaag

SEQ ID NO: 745315 - RNA, 23 nt, Homo sapiens
aggaggggucuggguacuucuug

SEQ ID NO: 745316 - RNA, 19 nt, Homo sapiens
aggagggugugaguggcau

SEQ ID NO: 745317 - RNA, 23 nt, Homo sapiens
aggagguccuuaggccucugaga

SEQ ID NO: 745318 - RNA, 23 nt, Homo sapiens
aggaggugcuaucgcaccacugu

SEQ ID NO: 745319 - RNA, 12 nt, Homo sapiens
aggagguucugg

SEQ ID NO: 745320 - RNA, 14 nt, Homo sapiens
aggaguaccuggac

SEQ ID NO: 745321 - RNA, 21 nt, Homo sapiens
aggagucccugccaucauguu

SEQ ID NO: 745322 - RNA, 20 nt, Homo sapiens
aggagucccugguucauuga

SEQ ID NO: 745323 - RNA, 21 nt, Homo sapiens
aggagucccugguucauugau

SEQ ID NO: 745324 - RNA, 14 nt, Homo sapiens
aggagucgggagca

SEQ ID NO: 745325 - RNA, 14 nt, Homo sapiens
aggagucugugcag

SEQ ID NO: 745326 - RNA, 19 nt, Homo sapiens
aggagugccaggaccagcc

SEQ ID NO: 745327 - RNA, 17 nt, Homo sapiens
aggagugugaccacuga

SEQ ID NO: 745328 - RNA, 19 nt, Homo sapiens
aggaguucauagaagggag

SEQ ID NO: 745329 - RNA, 13 nt, Homo sapiens
aggaguuccuuga

SEQ ID NO: 745330 - RNA, 17 nt, Homo sapiens
aggaguugccugacucc

SEQ ID NO: 745331 - RNA, 22 nt, Homo sapiens
aggaguuguuucugacccacug

SEQ ID NO: 745332 - RNA, 18 nt, Homo sapiens
aggaguuugagaccagcc

SEQ ID NO: 745333 - RNA, 12 nt, Homo sapiens
aggauaacacaa

SEQ ID NO: 745334 - RNA, 15 nt, Homo sapiens
aggauaagagggauu

SEQ ID NO: 745335 - RNA, 14 nt, Homo sapiens
aggauaucuuggcu

SEQ ID NO: 745336 - RNA, 23 nt, Homo sapiens
aggauauugguucuuccccucau

SEQ ID NO: 745337 - RNA, 14 nt, Homo sapiens
aggauauugucagu

SEQ ID NO: 745338 - RNA, 16 nt, Homo sapiens
agguguuucuuuccug

SEQ ID NO: 745339 - RNA, 13 nt, Homo sapiens
agguuacuaccua

SEQ ID NO: 745340 - RNA, 12 nt, Homo sapiens
agguuaucagug

SEQ ID NO: 745341 - RNA, 13 nt, Homo sapiens
agguuaugcacug

SEQ ID NO: 745342 - RNA, 23 nt, Homo sapiens
agguuauuuuccgccagaccuca

SEQ ID NO: 745343 - RNA, 10 nt, Homo sapiens
agguucaagc

SEQ ID NO: 745344 - RNA, 15 nt, Homo sapiens
agguucagccugaaa

SEQ ID NO: 745345 - RNA, 17 nt, Homo sapiens
agguucaggaagaccac

SEQ ID NO: 745346 - RNA, 12 nt, Homo sapiens
agguuccaguga

SEQ ID NO: 745347 - RNA, 17 nt, Homo sapiens
agguucccgacaccaga

SEQ ID NO: 745348 - RNA, 20 nt, Homo sapiens
agguuccuuaucugucacac

SEQ ID NO: 745349 - RNA, 17 nt, Homo sapiens
agguuccuuuuucaaaa

SEQ ID NO: 745350 - RNA, 17 nt, Homo sapiens
agguucgagucuugcuc

SEQ ID NO: 745351 - RNA, 19 nt, Homo sapiens
agguucuaaaguucuaaga

SEQ ID NO: 745352 - RNA, 20 nt, Homo sapiens
agguucuagguuucaaagau

SEQ ID NO: 745353 - RNA, 18 nt, Homo sapiens
agguucuuagugucacuu

SEQ ID NO: 745354 - RNA, 15 nt, Homo sapiens
agguucuugggauac

SEQ ID NO: 745355 - RNA, 14 nt, Homo sapiens
agguugaagccaag

SEQ ID NO: 745356 - RNA, 20 nt, Homo sapiens
agguugaggggcuccuggaa

SEQ ID NO: 745357 - RNA, 23 nt, Homo sapiens
agguugaggugcgcucaccucag

SEQ ID NO: 745358 - RNA, 16 nt, Homo sapiens
agguugcagcugcucu

SEQ ID NO: 745359 - RNA, 18 nt, Homo sapiens
agguugcagugagccaaa

SEQ ID NO: 745360 - RNA, 16 nt, Homo sapiens
agguugccugaaaaau

SEQ ID NO: 745361 - RNA, 20 nt, Homo sapiens
agguugcuauauaguaucua

SEQ ID NO: 745362 - RNA, 19 nt, Homo sapiens
agguuggagcccagggcau

SEQ ID NO: 745363 - RNA, 14 nt, Homo sapiens
agguuggagugcag

SEQ ID NO: 745364 - RNA, 20 nt, Homo sapiens
agguuggagugcaguggcgu

SEQ ID NO: 745365 - RNA, 19 nt, Homo sapiens
agguugggcuuccaugccu

SEQ ID NO: 745366 - RNA, 19 nt, Homo sapiens
agguuggugaauuucacaa

SEQ ID NO: 745367 - RNA, 22 nt, Homo sapiens
agguuggugaauuucacaagcu

SEQ ID NO: 745368 - RNA, 21 nt, Homo sapiens
agguuggugacugaaacauuc

SEQ ID NO: 745369 - RNA, 21 nt, Homo sapiens
agguugucuccaggccaugau

SEQ ID NO: 745370 - RNA, 14 nt, Homo sapiens
agguuuacauucau

SEQ ID NO: 745371 - RNA, 15 nt, Homo sapiens
agguuuacauuguca

SEQ ID NO: 745372 - RNA, 18 nt, Homo sapiens
agguuuauagaaagauag

SEQ ID NO: 745373 - RNA, 20 nt, Homo sapiens
agguuugagaccgaccagcc

SEQ ID NO: 745374 - RNA, 13 nt, Homo sapiens
agguuugcaaauu

SEQ ID NO: 745375 - RNA, 16 nt, Homo sapiens
agguuugccugugauu

SEQ ID NO: 745376 - RNA, 23 nt, Homo sapiens
agguuuuaaccgcacaugcacac

SEQ ID NO: 745377 - RNA, 17 nt, Homo sapiens
agguuuuguaaaacugu

SEQ ID NO: 745378 - RNA, 15 nt, Homo sapiens
agguuuuuacuguga

SEQ ID NO: 745379 - RNA, 22 nt, Homo sapiens
aguaaaacucccccccacccaa

SEQ ID NO: 745380 - RNA, 18 nt, Homo sapiens
aguaaaagcaaaaugaua

SEQ ID NO: 745381 - RNA, 21 nt, Homo sapiens
aguaaaauacuauugccucau

SEQ ID NO: 745382 - RNA, 21 nt, Homo sapiens
aguaaagccguuguuuacuua

SEQ ID NO: 745383 - RNA, 20 nt, Homo sapiens
aguaaaggccucaucuccuu

SEQ ID NO: 745384 - RNA, 17 nt, Homo sapiens
aguaaaggcugcugcua

SEQ ID NO: 745385 - RNA, 19 nt, Homo sapiens
aguaaaguauuuuugauua

SEQ ID NO: 745386 - RNA, 22 nt, Homo sapiens
aguaaauaaaaggacugugauu

SEQ ID NO: 745387 - RNA, 16 nt, Homo sapiens
aguaaauaacuggaaa

SEQ ID NO: 745388 - RNA, 17 nt, Homo sapiens
aguaaauauauauguca

SEQ ID NO: 745389 - RNA, 18 nt, Homo sapiens
aguaaauauauaugucaa

SEQ ID NO: 745390 - RNA, 13 nt, Homo sapiens
aguaaaugcgugc

SEQ ID NO: 745391 - RNA, 22 nt, Homo sapiens
aguaaaugcuagguuaauucca

SEQ ID NO: 745392 - RNA, 20 nt, Homo sapiens
aguaacaaauaaagugcagu

SEQ ID NO: 745393 - RNA, 15 nt, Homo sapiens
aguaacacaaacauc

SEQ ID NO: 745394 - RNA, 14 nt, Homo sapiens
aguaacacauuugg

SEQ ID NO: 745395 - RNA, 16 nt, Homo sapiens
aguaaccauuugcacu

SEQ ID NO: 745396 - RNA, 15 nt, Homo sapiens
aguaacuccccucag

SEQ ID NO: 745397 - RNA, 15 nt, Homo sapiens
aguaacugagauuac

SEQ ID NO: 745398 - RNA, 14 nt, Homo sapiens
aguaagaagaggag

SEQ ID NO: 745399 - RNA, 14 nt, Homo sapiens
aguaagauaucuca

SEQ ID NO: 745400 - RNA, 14 nt, Homo sapiens
aguaagaugcacug

SEQ ID NO: 745401 - RNA, 16 nt, Homo sapiens
aguaagaugcacugaa

SEQ ID NO: 745402 - RNA, 20 nt, Homo sapiens
aguaaguaccacucaggcca

SEQ ID NO: 745403 - RNA, 15 nt, Homo sapiens
aguaaguauuuccau

SEQ ID NO: 745404 - RNA, 17 nt, Homo sapiens
aguaaucaauacagaca

SEQ ID NO: 745405 - RNA, 19 nt, Homo sapiens
aguaaucaauacagacaag

SEQ ID NO: 745406 - RNA, 15 nt, Homo sapiens
aguaaugugucauau

SEQ ID NO: 745407 - RNA, 23 nt, Homo sapiens
aguaauuggucaugugaugcaag

SEQ ID NO: 745408 - RNA, 16 nt, Homo sapiens
aguaauuguauuguca

SEQ ID NO: 745409 - RNA, 16 nt, Homo sapiens
aguaauuucaguguaa

SEQ ID NO: 745410 - RNA, 15 nt, Homo sapiens
aguacaauaaucucu

SEQ ID NO: 745411 - RNA, 17 nt, Homo sapiens
aguacaucucuacuaaa

SEQ ID NO: 745412 - RNA, 18 nt, Homo sapiens
aguacaucucuacuaaaa

SEQ ID NO: 745413 - RNA, 17 nt, Homo sapiens
aguacauuuauacuaaa

SEQ ID NO: 745414 - RNA, 16 nt, Homo sapiens
aguacauuugcuuuaa

SEQ ID NO: 745415 - RNA, 19 nt, Homo sapiens
aguaccacacauauugcac

SEQ ID NO: 745416 - RNA, 17 nt, Homo sapiens
aguaccaccaagggauc

SEQ ID NO: 745417 - RNA, 22 nt, Homo sapiens
aguaccaccaagggaucugcca

SEQ ID NO: 745418 - RNA, 16 nt, Homo sapiens
aguaccagcuuuggua

SEQ ID NO: 745419 - RNA, 24 nt, Homo sapiens
aguaccaguauaagcaucugccau

SEQ ID NO: 745420 - RNA, 15 nt, Homo sapiens
aguacccaucuagua

SEQ ID NO: 745421 - RNA, 18 nt, Homo sapiens
aguaccuacugugugcca

SEQ ID NO: 745422 - RNA, 21 nt, Homo sapiens
aguacguguuauuuuuuucaa

SEQ ID NO: 745423 - RNA, 14 nt, Homo sapiens
aguacuaagcauuu

SEQ ID NO: 745424 - RNA, 17 nt, Homo sapiens
aguacugacuuucugau

SEQ ID NO: 745425 - RNA, 22 nt, Homo sapiens
aguacugcacccagcaguguca

SEQ ID NO: 745426 - RNA, 20 nt, Homo sapiens
aguacugccaauacugccaa

SEQ ID NO: 745427 - RNA, 18 nt, Homo sapiens
aguacuuauguugcacaa

SEQ ID NO: 745428 - RNA, 16 nt, Homo sapiens
aguagaaauuuuacaa

SEQ ID NO: 745429 - RNA, 19 nt, Homo sapiens
aguagagacgagguuucac

SEQ ID NO: 745430 - RNA, 18 nt, Homo sapiens
aguagagcaaaucuauga

SEQ ID NO: 745431 - RNA, 22 nt, Homo sapiens
aguagaucuauauuagaucaaa

SEQ ID NO: 745432 - RNA, 12 nt, Homo sapiens
aguagcaauuuc

SEQ ID NO: 745433 - RNA, 21 nt, Homo sapiens
aguagcagcagaggccagugg

SEQ ID NO: 745434 - RNA, 16 nt, Homo sapiens
aguagcauacauuuau

SEQ ID NO: 745435 - RNA, 16 nt, Homo sapiens
aguagccuucuucccu

SEQ ID NO: 745436 - RNA, 20 nt, Homo sapiens
aguagcugggauuacaggug

SEQ ID NO: 745437 - RNA, 21 nt, Homo sapiens
aguagcugggauuacaggugu

SEQ ID NO: 745438 - RNA, 17 nt, Homo sapiens
aguaggggcuacuguga

SEQ ID NO: 745439 - RNA, 18 nt, Homo sapiens
aguaggggcuacugugac

SEQ ID NO: 745440 - RNA, 16 nt, Homo sapiens
aguagucccugcacag

SEQ ID NO: 745441 - RNA, 19 nt, Homo sapiens
aguaguuuucaaaacacau

SEQ ID NO: 745442 - RNA, 15 nt, Homo sapiens
aguauaacaacuuug

SEQ ID NO: 745443 - RNA, 15 nt, Homo sapiens
aguauauaguauauu

SEQ ID NO: 745444 - RNA, 12 nt, Homo sapiens
aguauauguuaa

SEQ ID NO: 745445 - RNA, 21 nt, Homo sapiens
aguauauuuauagucacaaga

SEQ ID NO: 745446 - RNA, 14 nt, Homo sapiens
aguaucagcacuag

SEQ ID NO: 745447 - RNA, 19 nt, Homo sapiens
aguaucuaccuuuugcuac

SEQ ID NO: 745448 - RNA, 13 nt, Homo sapiens
aguaugccuuaag

SEQ ID NO: 745449 - RNA, 18 nt, Homo sapiens
aguaugccuuaagcagaa

SEQ ID NO: 745450 - RNA, 18 nt, Homo sapiens
aguauggcaugaacaucu

SEQ ID NO: 745451 - RNA, 18 nt, Homo sapiens
aguauggcuccuccauau

SEQ ID NO: 745452 - RNA, 20 nt, Homo sapiens
aguauggcuccuccauaucu

SEQ ID NO: 745453 - RNA, 19 nt, Homo sapiens
aguguacauguacauagua

SEQ ID NO: 745454 - RNA, 12 nt, Homo sapiens
aguguaccuccu

SEQ ID NO: 745455 - RNA, 20 nt, Homo sapiens
aguguagcauuggaucaaaa

SEQ ID NO: 745456 - RNA, 14 nt, Homo sapiens
agugucacugagcu

SEQ ID NO: 745457 - RNA, 12 nt, Homo sapiens
agugucacuuac

SEQ ID NO: 745458 - RNA, 18 nt, Homo sapiens
agugucccugagcagcuu

SEQ ID NO: 745459 - RNA, 22 nt, Homo sapiens
aguguccuaccacucuaaucaa

SEQ ID NO: 745460 - RNA, 20 nt, Homo sapiens
agugucuaauaaugcugaag

SEQ ID NO: 745461 - RNA, 17 nt, Homo sapiens
agugucuuagcauauuu

SEQ ID NO: 745462 - RNA, 22 nt, Homo sapiens
agugucuugagcucuaaaguag

SEQ ID NO: 745463 - RNA, 21 nt, Homo sapiens
agugugaacaaaagaugcucu

SEQ ID NO: 745464 - RNA, 14 nt, Homo sapiens
agugugaccacuga

SEQ ID NO: 745465 - RNA, 14 nt, Homo sapiens
agugugacuucccu

SEQ ID NO: 745466 - RNA, 22 nt, Homo sapiens
agugugaggcggcccugaccaa

SEQ ID NO: 745467 - RNA, 23 nt, Homo sapiens
agugugaguggcagccaugccuc

SEQ ID NO: 745468 - RNA, 19 nt, Homo sapiens
agugugauauacaaagugu

SEQ ID NO: 745469 - RNA, 14 nt, Homo sapiens
agugugaucccaag

SEQ ID NO: 745470 - RNA, 23 nt, Homo sapiens
aguguggcccagggaagccaaaa

SEQ ID NO: 745471 - RNA, 19 nt, Homo sapiens
aguguggcugcaucuugcu

SEQ ID NO: 745472 - RNA, 16 nt, Homo sapiens
agugugggggguccuu

SEQ ID NO: 745473 - RNA, 22 nt, Homo sapiens
agugugggugacagcaugguaa

SEQ ID NO: 745474 - RNA, 14 nt, Homo sapiens
aguguggucaagca

SEQ ID NO: 745475 - RNA, 14 nt, Homo sapiens
aguguggugugugg

SEQ ID NO: 745476 - RNA, 16 nt, Homo sapiens
agugugucugcugagu

SEQ ID NO: 745477 - RNA, 18 nt, Homo sapiens
agugugugcuuacaguaa

SEQ ID NO: 745478 - RNA, 17 nt, Homo sapiens
aguguguguaguuuuac

SEQ ID NO: 745479 - RNA, 23 nt, Homo sapiens
agugugugucuuuccucccugaa

SEQ ID NO: 745480 - RNA, 20 nt, Homo sapiens
aguguguuuaaauaaacaca

SEQ ID NO: 745481 - RNA, 19 nt, Homo sapiens
aguguuaagcguucaguga

SEQ ID NO: 745482 - RNA, 17 nt, Homo sapiens
aguguuaucagucauaa

SEQ ID NO: 745483 - RNA, 18 nt, Homo sapiens
aguguucacaacagugaa

SEQ ID NO: 745484 - RNA, 10 nt, Homo sapiens
aguguucucc

SEQ ID NO: 745485 - RNA, 15 nt, Homo sapiens
aguguucugcuccug

SEQ ID NO: 745486 - RNA, 22 nt, Homo sapiens
aguguugcccaggcuggucuca

SEQ ID NO: 745487 - RNA, 23 nt, Homo sapiens
aguguugcccaggcuggucucaa

SEQ ID NO: 745488 - RNA, 21 nt, Homo sapiens
aguguugcuuuaaauugugcc

SEQ ID NO: 745489 - RNA, 13 nt, Homo sapiens
aguguuguguuaa

SEQ ID NO: 745490 - RNA, 22 nt, Homo sapiens
aguguuuacaaggugacaaaug

SEQ ID NO: 745491 - RNA, 22 nt, Homo sapiens
aguguuuuagagagagaacuuu

SEQ ID NO: 745492 - RNA, 15 nt, Homo sapiens
aguuaaacagucagu

SEQ ID NO: 745493 - RNA, 18 nt, Homo sapiens
aguuaaagccacagaugg

SEQ ID NO: 745494 - RNA, 14 nt, Homo sapiens
aguuaaagguugcc

SEQ ID NO: 745495 - RNA, 20 nt, Homo sapiens
aguuaaagugaauaaccacu

SEQ ID NO: 745496 - RNA, 14 nt, Homo sapiens
aguuaacaaugaua

SEQ ID NO: 745497 - RNA, 15 nt, Homo sapiens
aguuaagaacaucaa

SEQ ID NO: 745498 - RNA, 13 nt, Homo sapiens
aguuaagaaccug

SEQ ID NO: 745499 - RNA, 14 nt, Homo sapiens
aguuaagaaccuga

SEQ ID NO: 745500 - RNA, 12 nt, Homo sapiens
aguuaagggaug

SEQ ID NO: 745501 - RNA, 16 nt, Homo sapiens
aguuaaggugugcaaa

SEQ ID NO: 745502 - RNA, 16 nt, Homo sapiens
aguuaaugagccauca

SEQ ID NO: 745503 - RNA, 13 nt, Homo sapiens
aguuacacuaaaa

SEQ ID NO: 745504 - RNA, 19 nt, Homo sapiens
aguuaccacauuacucugc

SEQ ID NO: 745505 - RNA, 21 nt, Homo sapiens
aguuacguuguguauggccug

SEQ ID NO: 745506 - RNA, 14 nt, Homo sapiens
aguuacugugguca

SEQ ID NO: 745507 - RNA, 20 nt, Homo sapiens
aguuagaauuauaucacuuc

SEQ ID NO: 745508 - RNA, 15 nt, Homo sapiens
aguuaggaacaugua

SEQ ID NO: 745509 - RNA, 13 nt, Homo sapiens
aguuaggugcuga

SEQ ID NO: 745510 - RNA, 16 nt, Homo sapiens
aguuagucaauccugu

SEQ ID NO: 745511 - RNA, 17 nt, Homo sapiens
aguuaguuuguauauau

SEQ ID NO: 745512 - RNA, 14 nt, Homo sapiens
aguuaucaaccauu

SEQ ID NO: 745513 - RNA, 20 nt, Homo sapiens
aguuaucuccagugcauuaa

SEQ ID NO: 745514 - RNA, 17 nt, Homo sapiens
aguuaugauguaaucuc

SEQ ID NO: 745515 - RNA, 18 nt, Homo sapiens
aguuaugauguaaucucu

SEQ ID NO: 745516 - RNA, 19 nt, Homo sapiens
aguuaugcugucauggucc

SEQ ID NO: 745517 - RNA, 19 nt, Homo sapiens
aguuauggcuauaggugcu

SEQ ID NO: 745518 - RNA, 12 nt, Homo sapiens
aguuauugcaca

SEQ ID NO: 745519 - RNA, 21 nt, Homo sapiens
aguuauuucaaaaauuugcau

SEQ ID NO: 745520 - RNA, 19 nt, Homo sapiens
aguuauuuguucauuauuu

SEQ ID NO: 745521 - RNA, 16 nt, Homo sapiens
aguucaacuuccaaag

SEQ ID NO: 745522 - RNA, 19 nt, Homo sapiens
aguucaauaaaugucuguu

SEQ ID NO: 745523 - RNA, 16 nt, Homo sapiens
aguucaccugcacuua

SEQ ID NO: 745524 - RNA, 17 nt, Homo sapiens
aguucaccugcacuuaa

SEQ ID NO: 745525 - RNA, 17 nt, Homo sapiens
aguucaggcagcacauc

SEQ ID NO: 745526 - RNA, 17 nt, Homo sapiens
aguucauauguaccaug

SEQ ID NO: 745527 - RNA, 19 nt, Homo sapiens
aguucaugcagcuguggca

SEQ ID NO: 745528 - RNA, 20 nt, Homo sapiens
aguuccaagagucuaaagau

SEQ ID NO: 745529 - RNA, 14 nt, Homo sapiens
aguuccaccaagaa

SEQ ID NO: 745530 - RNA, 17 nt, Homo sapiens
aguucccaccaucugau

SEQ ID NO: 745531 - RNA, 20 nt, Homo sapiens
aguuccuacuuuagccacug

SEQ ID NO: 745532 - RNA, 17 nt, Homo sapiens
aguuccuguaacaggug

SEQ ID NO: 745533 - RNA, 20 nt, Homo sapiens
aguuccuguaacaggugugg

SEQ ID NO: 745534 - RNA, 23 nt, Homo sapiens
aguuccuuaucccucucuucccc

SEQ ID NO: 745535 - RNA, 18 nt, Homo sapiens
aguucgaggcugcaguca

SEQ ID NO: 745536 - RNA, 16 nt, Homo sapiens
aguucuaagauucuga

SEQ ID NO: 745537 - RNA, 22 nt, Homo sapiens
aguucucagaacuguuggcugc

SEQ ID NO: 745538 - RNA, 23 nt, Homo sapiens
aguucucaucccucugucagggu

SEQ ID NO: 745539 - RNA, 22 nt, Homo sapiens
aguucuguauauagggcacaag

SEQ ID NO: 745540 - RNA, 18 nt, Homo sapiens
aguucuuugggccagaca

SEQ ID NO: 745541 - RNA, 16 nt, Homo sapiens
aguucuuuuaagccca

SEQ ID NO: 745542 - RNA, 19 nt, Homo sapiens
aguugaaaggccucaagaa

SEQ ID NO: 745543 - RNA, 17 nt, Homo sapiens
aguugaaauucuauucu

SEQ ID NO: 745544 - RNA, 18 nt, Homo sapiens
aguugaagcuaagauuua

SEQ ID NO: 745545 - RNA, 20 nt, Homo sapiens
aguugaagggaauacugugc

SEQ ID NO: 745546 - RNA, 21 nt, Homo sapiens
aguugagagggugcaguccag

SEQ ID NO: 745547 - RNA, 21 nt, Homo sapiens
aguugagucuccucucugaga

SEQ ID NO: 745548 - RNA, 19 nt, Homo sapiens
aguugaucuggaacccaga

SEQ ID NO: 745549 - RNA, 12 nt, Homo sapiens
aguugccaaagu

SEQ ID NO: 745550 - RNA, 11 nt, Homo sapiens
aguugccugac

SEQ ID NO: 745551 - RNA, 23 nt, Homo sapiens
aguugcgacggagagaaaaaaga

SEQ ID NO: 745552 - RNA, 21 nt, Homo sapiens
aguugcguggacucugcacau

SEQ ID NO: 745553 - RNA, 11 nt, Homo sapiens
aguugcucagg

SEQ ID NO: 745554 - RNA, 16 nt, Homo sapiens
aguugcugaugaacuc

SEQ ID NO: 745555 - RNA, 22 nt, Homo sapiens
aguuggaaccguguccagcaca

SEQ ID NO: 745556 - RNA, 11 nt, Homo sapiens
aguuggcagaa

SEQ ID NO: 745557 - RNA, 18 nt, Homo sapiens
aguuggcuucuaagccaa

SEQ ID NO: 745558 - RNA, 16 nt, Homo sapiens
aguugggagcacugga

SEQ ID NO: 745559 - RNA, 23 nt, Homo sapiens
aguugggggagggaagaccagaa

SEQ ID NO: 745560 - RNA, 23 nt, Homo sapiens
aguuggguuaauaccagcuuaaa

SEQ ID NO: 745561 - RNA, 15 nt, Homo sapiens
aguuggucaguauug

SEQ ID NO: 745562 - RNA, 16 nt, Homo sapiens
aguuggugacugggaa

SEQ ID NO: 745563 - RNA, 21 nt, Homo sapiens
aguuggugcuuuugagaacca

SEQ ID NO: 745564 - RNA, 17 nt, Homo sapiens
aguugguucacuucaaa

SEQ ID NO: 745565 - RNA, 21 nt, Homo sapiens
aguuguaacuuugccuucaca

SEQ ID NO: 745566 - RNA, 16 nt, Homo sapiens
aguuguacacugugua

SEQ ID NO: 745567 - RNA, 19 nt, Homo sapiens
augguguagaacacuaauu

SEQ ID NO: 745568 - RNA, 23 nt, Homo sapiens
augguguagaacacuaauucaua

SEQ ID NO: 745569 - RNA, 16 nt, Homo sapiens
augguguccauuuuau

SEQ ID NO: 745570 - RNA, 16 nt, Homo sapiens
auggugugaguccaaa

SEQ ID NO: 745571 - RNA, 14 nt, Homo sapiens
augguuaauacuau

SEQ ID NO: 745572 - RNA, 17 nt, Homo sapiens
augguuaauacuauuaa

SEQ ID NO: 745573 - RNA, 22 nt, Homo sapiens
augguuauuuaugcacuguggg

SEQ ID NO: 745574 - RNA, 17 nt, Homo sapiens
augguugauggaaaaua

SEQ ID NO: 745575 - RNA, 13 nt, Homo sapiens
augguugcagaua

SEQ ID NO: 745576 - RNA, 13 nt, Homo sapiens
augguuuguguca

SEQ ID NO: 745577 - RNA, 14 nt, Homo sapiens
augguuugugucaa

SEQ ID NO: 745578 - RNA, 14 nt, Homo sapiens
auguaaaacaagaa

SEQ ID NO: 745579 - RNA, 14 nt, Homo sapiens
auguaaaagcacau

SEQ ID NO: 745580 - RNA, 17 nt, Homo sapiens
auguaaacaaaccacag

SEQ ID NO: 745581 - RNA, 17 nt, Homo sapiens
auguaaacagugccugc

SEQ ID NO: 745582 - RNA, 16 nt, Homo sapiens
auguaaauugcaaaua

SEQ ID NO: 745583 - RNA, 23 nt, Homo sapiens
auguaacaucauaauuacauucc

SEQ ID NO: 745584 - RNA, 13 nt, Homo sapiens
auguaacugcauu

SEQ ID NO: 745585 - RNA, 14 nt, Homo sapiens
auguaagauuucau

SEQ ID NO: 745586 - RNA, 12 nt, Homo sapiens
auguaagccugg

SEQ ID NO: 745587 - RNA, 15 nt, Homo sapiens
auguaaguacuucca

SEQ ID NO: 745588 - RNA, 18 nt, Homo sapiens
auguaauaaaaagccucu

SEQ ID NO: 745589 - RNA, 19 nt, Homo sapiens
auguaauagugacagcaaa

SEQ ID NO: 745590 - RNA, 22 nt, Homo sapiens
auguaaucucucugcagcugcc

SEQ ID NO: 745591 - RNA, 20 nt, Homo sapiens
auguaaugaucauaagucua

SEQ ID NO: 745592 - RNA, 15 nt, Homo sapiens
auguaauuuaugcaa

SEQ ID NO: 745593 - RNA, 13 nt, Homo sapiens
auguacacuacca

SEQ ID NO: 745594 - RNA, 23 nt, Homo sapiens
auguacagacauacauuuaugca

SEQ ID NO: 745595 - RNA, 17 nt, Homo sapiens
auguacagggguaguuu

SEQ ID NO: 745596 - RNA, 15 nt, Homo sapiens
auguaccagcaucuc

SEQ ID NO: 745597 - RNA, 15 nt, Homo sapiens
auguaccugauguac

SEQ ID NO: 745598 - RNA, 23 nt, Homo sapiens
auguaccuucuuucacucuguca

SEQ ID NO: 745599 - RNA, 21 nt, Homo sapiens
auguacugaauuccauaauac

SEQ ID NO: 745600 - RNA, 21 nt, Homo sapiens
auguagccagcugugcacuuu

SEQ ID NO: 745601 - RNA, 13 nt, Homo sapiens
auguagcucagua

SEQ ID NO: 745602 - RNA, 18 nt, Homo sapiens
auguaggguaaggugccu

SEQ ID NO: 745603 - RNA, 19 nt, Homo sapiens
auguaggugauguuuccag

SEQ ID NO: 745604 - RNA, 12 nt, Homo sapiens
auguauacaaag

SEQ ID NO: 745605 - RNA, 22 nt, Homo sapiens
auguauauauauauaguaacua

SEQ ID NO: 745606 - RNA, 20 nt, Homo sapiens
auguaucaauauucacuuga

SEQ ID NO: 745607 - RNA, 18 nt, Homo sapiens
auguaucaaugaguaaca

SEQ ID NO: 745608 - RNA, 22 nt, Homo sapiens
auguaucuaguguguccuguga

SEQ ID NO: 745609 - RNA, 13 nt, Homo sapiens
auguauguacaau

SEQ ID NO: 745610 - RNA, 13 nt, Homo sapiens
auguaugucagaa

SEQ ID NO: 745611 - RNA, 19 nt, Homo sapiens
auguauuacaaauggugaa

SEQ ID NO: 745612 - RNA, 14 nt, Homo sapiens
auguauucaaguaa

SEQ ID NO: 745613 - RNA, 21 nt, Homo sapiens
auguauuuauuugggagaccg

SEQ ID NO: 745614 - RNA, 20 nt, Homo sapiens
auguauuuuaauaacauauc

SEQ ID NO: 745615 - RNA, 19 nt, Homo sapiens
auguauuuuagacuuccug

SEQ ID NO: 745616 - RNA, 18 nt, Homo sapiens
augucaacagagcaagga

SEQ ID NO: 745617 - RNA, 12 nt, Homo sapiens
augucacauuua

SEQ ID NO: 745618 - RNA, 13 nt, Homo sapiens
augucaccucagc

SEQ ID NO: 745619 - RNA, 14 nt, Homo sapiens
augucacuaaacaa

SEQ ID NO: 745620 - RNA, 19 nt, Homo sapiens
augucacuucccugcuuaa

SEQ ID NO: 745621 - RNA, 20 nt, Homo sapiens
augucacuucccugcuuaaa

SEQ ID NO: 745622 - RNA, 17 nt, Homo sapiens
augucagaagugcagaa

SEQ ID NO: 745623 - RNA, 14 nt, Homo sapiens
augucagacuggcu

SEQ ID NO: 745624 - RNA, 18 nt, Homo sapiens
augucagcagcucugaga

SEQ ID NO: 745625 - RNA, 15 nt, Homo sapiens
augucagucucucac

SEQ ID NO: 745626 - RNA, 22 nt, Homo sapiens
augucauagaaauauugacuca

SEQ ID NO: 745627 - RNA, 14 nt, Homo sapiens
augucaugucugug

SEQ ID NO: 745628 - RNA, 11 nt, Homo sapiens
auguccaaaga

SEQ ID NO: 745629 - RNA, 12 nt, Homo sapiens
auguccaaagag

SEQ ID NO: 745630 - RNA, 20 nt, Homo sapiens
auguccagcaccuugugccu

SEQ ID NO: 745631 - RNA, 13 nt, Homo sapiens
auguccauggugg

SEQ ID NO: 745632 - RNA, 17 nt, Homo sapiens
auguccauuuauaucau

SEQ ID NO: 745633 - RNA, 16 nt, Homo sapiens
auguccccugucccac

SEQ ID NO: 745634 - RNA, 23 nt, Homo sapiens
auguccggagagacagugacagc

SEQ ID NO: 745635 - RNA, 13 nt, Homo sapiens
auguccuggacac

SEQ ID NO: 745636 - RNA, 17 nt, Homo sapiens
augucgaugacuucauc

SEQ ID NO: 745637 - RNA, 14 nt, Homo sapiens
augucuacugcuug

SEQ ID NO: 745638 - RNA, 17 nt, Homo sapiens
augucuauaaucccagc

SEQ ID NO: 745639 - RNA, 15 nt, Homo sapiens
augucuauucagcuu

SEQ ID NO: 745640 - RNA, 22 nt, Homo sapiens
augucuccacuuucacccgcag

SEQ ID NO: 745641 - RNA, 14 nt, Homo sapiens
augucuccaucucu

SEQ ID NO: 745642 - RNA, 23 nt, Homo sapiens
augucuccuuugcucuugccaaa

SEQ ID NO: 745643 - RNA, 13 nt, Homo sapiens
augucucucauga

SEQ ID NO: 745644 - RNA, 17 nt, Homo sapiens
augucucuucugagcua

SEQ ID NO: 745645 - RNA, 14 nt, Homo sapiens
augucuggucuguc

SEQ ID NO: 745646 - RNA, 23 nt, Homo sapiens
augucugugggcaggaagugaag

SEQ ID NO: 745647 - RNA, 17 nt, Homo sapiens
augucuuguacaugugu

SEQ ID NO: 745648 - RNA, 22 nt, Homo sapiens
augucuuucucagaggacaaua

SEQ ID NO: 745649 - RNA, 22 nt, Homo sapiens
augugaaguguauaugauucuc

SEQ ID NO: 745650 - RNA, 18 nt, Homo sapiens
augugaaucgcaaggccu

SEQ ID NO: 745651 - RNA, 17 nt, Homo sapiens
augugacaugcccaagg

SEQ ID NO: 745652 - RNA, 17 nt, Homo sapiens
augugaccugugucacu

SEQ ID NO: 745653 - RNA, 19 nt, Homo sapiens
augugacugugacuuucaa

SEQ ID NO: 745654 - RNA, 16 nt, Homo sapiens
augugacuuaaaguca

SEQ ID NO: 745655 - RNA, 22 nt, Homo sapiens
augugacuugcgcuuaauccaa

SEQ ID NO: 745656 - RNA, 20 nt, Homo sapiens
augugagagauucugugauc

SEQ ID NO: 745657 - RNA, 19 nt, Homo sapiens
augugagcugucacugugg

SEQ ID NO: 745658 - RNA, 18 nt, Homo sapiens
augugagugccuuuugca

SEQ ID NO: 745659 - RNA, 13 nt, Homo sapiens
augugaucagcuu

SEQ ID NO: 745660 - RNA, 17 nt, Homo sapiens
augugaucagcuuucaa

SEQ ID NO: 745661 - RNA, 15 nt, Homo sapiens
augugcaaguuuauc

SEQ ID NO: 745662 - RNA, 15 nt, Homo sapiens
augugcaauaagauu

SEQ ID NO: 745663 - RNA, 16 nt, Homo sapiens
augugcaguacuuaau

SEQ ID NO: 745664 - RNA, 18 nt, Homo sapiens
augugcggggaucaucug

SEQ ID NO: 745665 - RNA, 15 nt, Homo sapiens
augugcgucucucuu

SEQ ID NO: 745666 - RNA, 18 nt, Homo sapiens
augugcuauacacacaca

SEQ ID NO: 745667 - RNA, 22 nt, Homo sapiens
augugcuauuggcccagcuuuu

SEQ ID NO: 745668 - RNA, 21 nt, Homo sapiens
augugcuggugaacacuguga

SEQ ID NO: 745669 - RNA, 15 nt, Homo sapiens
augugcuuugcugca

SEQ ID NO: 745670 - RNA, 19 nt, Homo sapiens
auguggaagaacugugaua

SEQ ID NO: 745671 - RNA, 14 nt, Homo sapiens
auguggcauguuca

SEQ ID NO: 745672 - RNA, 12 nt, Homo sapiens
auguggcccaac

SEQ ID NO: 745673 - RNA, 15 nt, Homo sapiens
auguggcccucugga

SEQ ID NO: 745674 - RNA, 18 nt, Homo sapiens
auguggccgaggacuuug

SEQ ID NO: 745675 - RNA, 22 nt, Homo sapiens
auguggccuaaaaaugcaacuu

SEQ ID NO: 745676 - RNA, 17 nt, Homo sapiens
auguggcucagugccuu

SEQ ID NO: 745677 - RNA, 20 nt, Homo sapiens
augugggaaaaaaagaaauu

SEQ ID NO: 745678 - RNA, 21 nt, Homo sapiens
auguggguagucauucuuaca

SEQ ID NO: 745679 - RNA, 14 nt, Homo sapiens
auguggguggagaa

SEQ ID NO: 745680 - RNA, 20 nt, Homo sapiens
auguggguggcuucuaguuu

SEQ ID NO: 745681 - RNA, 16 nt, Homo sapiens
augugguugcuuaauu

SEQ ID NO: 745682 - RNA, 18 nt, Homo sapiens
auugacgacaagugcuga

SEQ ID NO: 745683 - RNA, 19 nt, Homo sapiens
auugacgacaagugcugaa

SEQ ID NO: 745684 - RNA, 22 nt, Homo sapiens
auugacgacuucacacuaugga

SEQ ID NO: 745685 - RNA, 13 nt, Homo sapiens
auugacucugcau

SEQ ID NO: 745686 - RNA, 15 nt, Homo sapiens
auugacugaagcaca

SEQ ID NO: 745687 - RNA, 19 nt, Homo sapiens
auugagaaagaaacuaaua

SEQ ID NO: 745688 - RNA, 12 nt, Homo sapiens
auugagauacua

SEQ ID NO: 745689 - RNA, 19 nt, Homo sapiens
auugagauacuaucauuaa

SEQ ID NO: 745690 - RNA, 18 nt, Homo sapiens
auugagaucagcauucaa

SEQ ID NO: 745691 - RNA, 12 nt, Homo sapiens
auugagauucau

SEQ ID NO: 745692 - RNA, 15 nt, Homo sapiens
auugagcaguuagcu

SEQ ID NO: 745693 - RNA, 16 nt, Homo sapiens
auugagccaguggugc

SEQ ID NO: 745694 - RNA, 18 nt, Homo sapiens
auugaggaguugccugac

SEQ ID NO: 745695 - RNA, 19 nt, Homo sapiens
auugagggagcugggagac

SEQ ID NO: 745696 - RNA, 21 nt, Homo sapiens
auugaguuccaguugaaguua

SEQ ID NO: 745697 - RNA, 20 nt, Homo sapiens
auugaguucgaggacuacaa

SEQ ID NO: 745698 - RNA, 16 nt, Homo sapiens
auugaguuuaacaaua

SEQ ID NO: 745699 - RNA, 15 nt, Homo sapiens
auugauaaguucaua

SEQ ID NO: 745700 - RNA, 15 nt, Homo sapiens
auugauauaauuucc

SEQ ID NO: 745701 - RNA, 18 nt, Homo sapiens
auugauuagauaaagauu

SEQ ID NO: 745702 - RNA, 16 nt, Homo sapiens
auugauucagucuucu

SEQ ID NO: 745703 - RNA, 17 nt, Homo sapiens
auugauuuuuacuucaa

SEQ ID NO: 745704 - RNA, 22 nt, Homo sapiens
auugcaacucuuuuaagugccu

SEQ ID NO: 745705 - RNA, 20 nt, Homo sapiens
auugcaauaaccgcuugguu

SEQ ID NO: 745706 - RNA, 12 nt, Homo sapiens
auugcaaugccc

SEQ ID NO: 745707 - RNA, 20 nt, Homo sapiens
auugcacuuggccucaugcu

SEQ ID NO: 745708 - RNA, 19 nt, Homo sapiens
auugcacuuuuaaaccucu

SEQ ID NO: 745709 - RNA, 17 nt, Homo sapiens
auugcagauugaauaua

SEQ ID NO: 745710 - RNA, 14 nt, Homo sapiens
auugcauacuuugu

SEQ ID NO: 745711 - RNA, 16 nt, Homo sapiens
auugcauauuugcuau

SEQ ID NO: 745712 - RNA, 15 nt, Homo sapiens
auugcaugacaaacc

SEQ ID NO: 745713 - RNA, 23 nt, Homo sapiens
auugcaugcagugccggcugcca

SEQ ID NO: 745714 - RNA, 23 nt, Homo sapiens
auugcauuuuuauuaaagcauuu

SEQ ID NO: 745715 - RNA, 23 nt, Homo sapiens
auugccauagcugacuacaaauu

SEQ ID NO: 745716 - RNA, 12 nt, Homo sapiens
auugccaugugg

SEQ ID NO: 745717 - RNA, 22 nt, Homo sapiens
auugcccccucucacuuuagca

SEQ ID NO: 745718 - RNA, 21 nt, Homo sapiens
auugccccuggcuuugccucu

SEQ ID NO: 745719 - RNA, 22 nt, Homo sapiens
auugccccuggcuuugccucuu

SEQ ID NO: 745720 - RNA, 17 nt, Homo sapiens
auugcccgaaaccagag

SEQ ID NO: 745721 - RNA, 13 nt, Homo sapiens
auugccuguaaca

SEQ ID NO: 745722 - RNA, 22 nt, Homo sapiens
auugcuaaaaaauaaauaaaag

SEQ ID NO: 745723 - RNA, 16 nt, Homo sapiens
auugcuaauuuagaga

SEQ ID NO: 745724 - RNA, 19 nt, Homo sapiens
auugcugccaggcacuguu

SEQ ID NO: 745725 - RNA, 12 nt, Homo sapiens
auugcuggaaaa

SEQ ID NO: 745726 - RNA, 12 nt, Homo sapiens
auugcuuaccuu

SEQ ID NO: 745727 - RNA, 16 nt, Homo sapiens
auugcuuuauuuuggc

SEQ ID NO: 745728 - RNA, 15 nt, Homo sapiens
auugcuuugccaaaa

SEQ ID NO: 745729 - RNA, 13 nt, Homo sapiens
auugcuuugguca

SEQ ID NO: 745730 - RNA, 16 nt, Homo sapiens
auuggaaaguacuccc

SEQ ID NO: 745731 - RNA, 20 nt, Homo sapiens
auuggaagaagcacugaugg

SEQ ID NO: 745732 - RNA, 21 nt, Homo sapiens
auuggaauggaacuacuguac

SEQ ID NO: 745733 - RNA, 20 nt, Homo sapiens
auuggauaaaauaaaugcaa

SEQ ID NO: 745734 - RNA, 20 nt, Homo sapiens
auuggcaccuaauccaggca

SEQ ID NO: 745735 - RNA, 17 nt, Homo sapiens
auuggccuccaaacaca

SEQ ID NO: 745736 - RNA, 21 nt, Homo sapiens
auuggcuaugauggugacaug

SEQ ID NO: 745737 - RNA, 17 nt, Homo sapiens
auuggcucacacugaga

SEQ ID NO: 745738 - RNA, 20 nt, Homo sapiens
auuggcugguaacaguucau

SEQ ID NO: 745739 - RNA, 17 nt, Homo sapiens
auuggcuugaauuccau

SEQ ID NO: 745740 - RNA, 22 nt, Homo sapiens
auugggacccuccagugcugga

SEQ ID NO: 745741 - RNA, 20 nt, Homo sapiens
auugggcaugauaagccgag

SEQ ID NO: 745742 - RNA, 18 nt, Homo sapiens
auugggcugacaccuacc

SEQ ID NO: 745743 - RNA, 17 nt, Homo sapiens
auugggcuucaaucacu

SEQ ID NO: 745744 - RNA, 19 nt, Homo sapiens
auugggcuucaaucacugu

SEQ ID NO: 745745 - RNA, 19 nt, Homo sapiens
auuggguacccaguuaaau

SEQ ID NO: 745746 - RNA, 20 nt, Homo sapiens
auugguggcagauuuuacaa

SEQ ID NO: 745747 - RNA, 18 nt, Homo sapiens
auugguguugacauacau

SEQ ID NO: 745748 - RNA, 16 nt, Homo sapiens
auugguugcauccagg

SEQ ID NO: 745749 - RNA, 18 nt, Homo sapiens
auuguaaaaccccaucuc

SEQ ID NO: 745750 - RNA, 15 nt, Homo sapiens
auuguaaauacugga

SEQ ID NO: 745751 - RNA, 15 nt, Homo sapiens
auuguaguguucaaa

SEQ ID NO: 745752 - RNA, 21 nt, Homo sapiens
auuguaucaaguggcaugugc

SEQ ID NO: 745753 - RNA, 12 nt, Homo sapiens
auugucccugaa

SEQ ID NO: 745754 - RNA, 20 nt, Homo sapiens
auugucccugaaugcuccau

SEQ ID NO: 745755 - RNA, 22 nt, Homo sapiens
auugucgaaaagagucuuccaa

SEQ ID NO: 745756 - RNA, 16 nt, Homo sapiens
auugucgucuuuaugu

SEQ ID NO: 745757 - RNA, 18 nt, Homo sapiens
auugucucugugacugaa

SEQ ID NO: 745758 - RNA, 16 nt, Homo sapiens
auugucuguaaugaca

SEQ ID NO: 745759 - RNA, 14 nt, Homo sapiens
auugucugucuaca

SEQ ID NO: 745760 - RNA, 15 nt, Homo sapiens
auugugaccacugaa

SEQ ID NO: 745761 - RNA, 20 nt, Homo sapiens
auugugauuagacagaacac

SEQ ID NO: 745762 - RNA, 13 nt, Homo sapiens
auugugcugccau

SEQ ID NO: 745763 - RNA, 16 nt, Homo sapiens
auugugcuucgaguga

SEQ ID NO: 745764 - RNA, 15 nt, Homo sapiens
auuguggaugaugau

SEQ ID NO: 745765 - RNA, 23 nt, Homo sapiens
auuguggauuauaaaaaauguaa

SEQ ID NO: 745766 - RNA, 13 nt, Homo sapiens
auuguguacauag

SEQ ID NO: 745767 - RNA, 18 nt, Homo sapiens
auuguguauugaugcaau

SEQ ID NO: 745768 - RNA, 16 nt, Homo sapiens
auuguuaccucugagu

SEQ ID NO: 745769 - RNA, 18 nt, Homo sapiens
auuguucaaagcacagaa

SEQ ID NO: 745770 - RNA, 16 nt, Homo sapiens
auuguucaucaugaca

SEQ ID NO: 745771 - RNA, 12 nt, Homo sapiens
auuguuguguag

SEQ ID NO: 745772 - RNA, 13 nt, Homo sapiens
auuguuuaaucuu

SEQ ID NO: 745773 - RNA, 22 nt, Homo sapiens
auuguuuucaguguacauggaa

SEQ ID NO: 745774 - RNA, 16 nt, Homo sapiens
auuguuuuugaauuua

SEQ ID NO: 745775 - RNA, 18 nt, Homo sapiens
auuguuuuugcucaaggc

SEQ ID NO: 745776 - RNA, 18 nt, Homo sapiens
auuuaaaaaaagaacaua

SEQ ID NO: 745777 - RNA, 16 nt, Homo sapiens
auuuaaaaagugcuau

SEQ ID NO: 745778 - RNA, 18 nt, Homo sapiens
auuuaaaagcaucucagc

SEQ ID NO: 745779 - RNA, 18 nt, Homo sapiens
auuuaaaauaccacugua

SEQ ID NO: 745780 - RNA, 18 nt, Homo sapiens
auuuaaacaucaguauua

SEQ ID NO: 745781 - RNA, 21 nt, Homo sapiens
auuuaaagaaaauaaacacca

SEQ ID NO: 745782 - RNA, 20 nt, Homo sapiens
auuuaaagugaacacacaca

SEQ ID NO: 745783 - RNA, 13 nt, Homo sapiens
auuuaaaguggca

SEQ ID NO: 745784 - RNA, 18 nt, Homo sapiens
auuuaacaaugacaagau

SEQ ID NO: 745785 - RNA, 17 nt, Homo sapiens
auuuaacagucauuuaa

SEQ ID NO: 745786 - RNA, 21 nt, Homo sapiens
auuuaaccccuugguacugaa

SEQ ID NO: 745787 - RNA, 13 nt, Homo sapiens
auuuaacucauaa

SEQ ID NO: 745788 - RNA, 13 nt, Homo sapiens
auuuaaguauaua

SEQ ID NO: 745789 - RNA, 18 nt, Homo sapiens
auuuaagugacacagaca

SEQ ID NO: 745790 - RNA, 23 nt, Homo sapiens
auuuaauaaguacaacuaccuau

SEQ ID NO: 745791 - RNA, 19 nt, Homo sapiens
auuuaauaucuggcacugu

SEQ ID NO: 745792 - RNA, 20 nt, Homo sapiens
auuuaauaucuggcacuguu

SEQ ID NO: 745793 - RNA, 17 nt, Homo sapiens
auuuaaugcuuccaggg

SEQ ID NO: 745794 - RNA, 15 nt, Homo sapiens
auuuacaauuugaca

SEQ ID NO: 745795 - RNA, 20 nt, Homo sapiens
auuuacacuacauuguacaa

SEQ ID NO: 745796 - RNA, 12 nt, Homo sapiens
caaacgcuuauu

SEQ ID NO: 745797 - RNA, 23 nt, Homo sapiens
caaacucaguucgaccaaacuca

SEQ ID NO: 745798 - RNA, 11 nt, Homo sapiens
caaacuccucu

SEQ ID NO: 745799 - RNA, 15 nt, Homo sapiens
caaacuccugaccuc

SEQ ID NO: 745800 - RNA, 17 nt, Homo sapiens
caaacuccugaccucaa

SEQ ID NO: 745801 - RNA, 16 nt, Homo sapiens
caaacugcaaaccaug

SEQ ID NO: 745802 - RNA, 12 nt, Homo sapiens
caaacugcaaua

SEQ ID NO: 745803 - RNA, 12 nt, Homo sapiens
caaacugccuaa

SEQ ID NO: 745804 - RNA, 11 nt, Homo sapiens
caaacugccuu

SEQ ID NO: 745805 - RNA, 15 nt, Homo sapiens
caaacugcuucccuu

SEQ ID NO: 745806 - RNA, 14 nt, Homo sapiens
caaacuuacuauuu

SEQ ID NO: 745807 - RNA, 15 nt, Homo sapiens
caaacuugcuuuaug

SEQ ID NO: 745808 - RNA, 16 nt, Homo sapiens
caaacuuuguuuguca

SEQ ID NO: 745809 - RNA, 18 nt, Homo sapiens
caaacuuuguuugucaca

SEQ ID NO: 745810 - RNA, 20 nt, Homo sapiens
caaagaaaaauaacccuuug

SEQ ID NO: 745811 - RNA, 13 nt, Homo sapiens
caaagaaggcauu

SEQ ID NO: 745812 - RNA, 13 nt, Homo sapiens
caaagaauauucc

SEQ ID NO: 745813 - RNA, 14 nt, Homo sapiens
caaagaauauucca

SEQ ID NO: 745814 - RNA, 18 nt, Homo sapiens
caaagaaugggcuugaaa

SEQ ID NO: 745815 - RNA, 20 nt, Homo sapiens
caaagaaugggcuugaaaca

SEQ ID NO: 745816 - RNA, 15 nt, Homo sapiens
caaagaauuacagua

SEQ ID NO: 745817 - RNA, 23 nt, Homo sapiens
caaagacagagaagaccaaagca

SEQ ID NO: 745818 - RNA, 19 nt, Homo sapiens
caaagacaguauuuugaca

SEQ ID NO: 745819 - RNA, 20 nt, Homo sapiens
caaagacaguauuuugacaa

SEQ ID NO: 745820 - RNA, 19 nt, Homo sapiens
caaagacaugcuuuccauu

SEQ ID NO: 745821 - RNA, 14 nt, Homo sapiens
caaagacuguaaau

SEQ ID NO: 745822 - RNA, 13 nt, Homo sapiens
caaagacuguauu

SEQ ID NO: 745823 - RNA, 22 nt, Homo sapiens
caaagacuuaagcccagugcac

SEQ ID NO: 745824 - RNA, 16 nt, Homo sapiens
caaagagcaauauucc

SEQ ID NO: 745825 - RNA, 19 nt, Homo sapiens
caaagauaagguuauagua

SEQ ID NO: 745826 - RNA, 22 nt, Homo sapiens
caaagauaagguuauaguaaca

SEQ ID NO: 745827 - RNA, 17 nt, Homo sapiens
caaagauagauggcuga

SEQ ID NO: 745828 - RNA, 19 nt, Homo sapiens
caaagaucuuuuccagagu

SEQ ID NO: 745829 - RNA, 13 nt, Homo sapiens
caaagauguucau

SEQ ID NO: 745830 - RNA, 15 nt, Homo sapiens
caaagauguuuacau

SEQ ID NO: 745831 - RNA, 16 nt, Homo sapiens
caaagcaaggagauca

SEQ ID NO: 745832 - RNA, 18 nt, Homo sapiens
caaagcacaguuugaaca

SEQ ID NO: 745833 - RNA, 22 nt, Homo sapiens
caaagcaggaauugguggcaga

SEQ ID NO: 745834 - RNA, 19 nt, Homo sapiens
caaagcaguagucaaggag

SEQ ID NO: 745835 - RNA, 14 nt, Homo sapiens
caaagcaucccucu

SEQ ID NO: 745836 - RNA, 19 nt, Homo sapiens
caaagcauuuucauuucua

SEQ ID NO: 745837 - RNA, 18 nt, Homo sapiens
caaagccaaacucugcca

SEQ ID NO: 745838 - RNA, 17 nt, Homo sapiens
caaagccacuggaagga

SEQ ID NO: 745839 - RNA, 19 nt, Homo sapiens
caaagccacuggaaggagc

SEQ ID NO: 745840 - RNA, 15 nt, Homo sapiens
caaagcccaacugug

SEQ ID NO: 745841 - RNA, 21 nt, Homo sapiens
caaagcccuuauguuuaauca

SEQ ID NO: 745842 - RNA, 20 nt, Homo sapiens
caaagccuucauugccuuaa

SEQ ID NO: 745843 - RNA, 17 nt, Homo sapiens
caaagcgagcaagagaa

SEQ ID NO: 745844 - RNA, 22 nt, Homo sapiens
caaagcggucccugucccucua

SEQ ID NO: 745845 - RNA, 23 nt, Homo sapiens
caaagcguuucuuuacuucucac

SEQ ID NO: 745846 - RNA, 17 nt, Homo sapiens
caaagcugaauacauuc

SEQ ID NO: 745847 - RNA, 14 nt, Homo sapiens
caaagcugccuguc

SEQ ID NO: 745848 - RNA, 19 nt, Homo sapiens
caaagcuuuggcugagacc

SEQ ID NO: 745849 - RNA, 13 nt, Homo sapiens
caaaggaacacug

SEQ ID NO: 745850 - RNA, 16 nt, Homo sapiens
caaaggaacacugaca

SEQ ID NO: 745851 - RNA, 16 nt, Homo sapiens
caaaggaagacuugaa

SEQ ID NO: 745852 - RNA, 19 nt, Homo sapiens
caaaggagaaaaaaaaccu

SEQ ID NO: 745853 - RNA, 16 nt, Homo sapiens
caaaggagcuuucuca

SEQ ID NO: 745854 - RNA, 15 nt, Homo sapiens
caaaggagucaggac

SEQ ID NO: 745855 - RNA, 15 nt, Homo sapiens
caaaggauaugaacu

SEQ ID NO: 745856 - RNA, 16 nt, Homo sapiens
caaaggcgacaauaaa

SEQ ID NO: 745857 - RNA, 20 nt, Homo sapiens
caaagggagcagaacugaac

SEQ ID NO: 745858 - RNA, 17 nt, Homo sapiens
caaagggcucaagggug

SEQ ID NO: 745859 - RNA, 17 nt, Homo sapiens
caaaggugugcccugua

SEQ ID NO: 745860 - RNA, 14 nt, Homo sapiens
caaagguugcagug

SEQ ID NO: 745861 - RNA, 12 nt, Homo sapiens
caaaguaaaaaa

SEQ ID NO: 745862 - RNA, 17 nt, Homo sapiens
caaaguaaacaaaagau

SEQ ID NO: 745863 - RNA, 20 nt, Homo sapiens
caaaguagaggaauccaugu

SEQ ID NO: 745864 - RNA, 17 nt, Homo sapiens
caaagucacauccacaa

SEQ ID NO: 745865 - RNA, 14 nt, Homo sapiens
caaaguccaaaagu

SEQ ID NO: 745866 - RNA, 14 nt, Homo sapiens
caaagucguuucaa

SEQ ID NO: 745867 - RNA, 17 nt, Homo sapiens
caaagucguuucaacuc

SEQ ID NO: 745868 - RNA, 23 nt, Homo sapiens
caaagugccagagucuaggcuaa

SEQ ID NO: 745869 - RNA, 17 nt, Homo sapiens
caaagugcugagauuac

SEQ ID NO: 745870 - RNA, 16 nt, Homo sapiens
caaagugguacaggaa

SEQ ID NO: 745871 - RNA, 22 nt, Homo sapiens
caaaguuaaaagcaaacacuua

SEQ ID NO: 745872 - RNA, 16 nt, Homo sapiens
caaaguugaaaauuca

SEQ ID NO: 745873 - RNA, 12 nt, Homo sapiens
caaaguuugcaa

SEQ ID NO: 745874 - RNA, 15 nt, Homo sapiens
caaauaaaaacccaa

SEQ ID NO: 745875 - RNA, 13 nt, Homo sapiens
caaauaaaagcca

SEQ ID NO: 745876 - RNA, 13 nt, Homo sapiens
caaauaaaaucua

SEQ ID NO: 745877 - RNA, 21 nt, Homo sapiens
caaauaaagaccugagaaccu

SEQ ID NO: 745878 - RNA, 15 nt, Homo sapiens
caaauaaaguaccau

SEQ ID NO: 745879 - RNA, 15 nt, Homo sapiens
caaauaaagugcagu

SEQ ID NO: 745880 - RNA, 22 nt, Homo sapiens
caaauaaaugauuauauucaca

SEQ ID NO: 745881 - RNA, 13 nt, Homo sapiens
caaauaacagucu

SEQ ID NO: 745882 - RNA, 16 nt, Homo sapiens
caaauaacugaucuca

SEQ ID NO: 745883 - RNA, 23 nt, Homo sapiens
caaauaauuccauuccaguuuuu

SEQ ID NO: 745884 - RNA, 21 nt, Homo sapiens
caaauacaaucagcccagugc

SEQ ID NO: 745885 - RNA, 15 nt, Homo sapiens
caaauacacauuugc

SEQ ID NO: 745886 - RNA, 17 nt, Homo sapiens
caaauacacauuugcua

SEQ ID NO: 745887 - RNA, 13 nt, Homo sapiens
caaauagcaaaga

SEQ ID NO: 745888 - RNA, 15 nt, Homo sapiens
caaauaugcaaagca

SEQ ID NO: 745889 - RNA, 12 nt, Homo sapiens
caaauauuuccc

SEQ ID NO: 745890 - RNA, 17 nt, Homo sapiens
caaaucagucagugcaa

SEQ ID NO: 745891 - RNA, 16 nt, Homo sapiens
caaaucuaccacugua

SEQ ID NO: 745892 - RNA, 18 nt, Homo sapiens
caaaucuaccacuguaug

SEQ ID NO: 745893 - RNA, 13 nt, Homo sapiens
caaaucugaggga

SEQ ID NO: 745894 - RNA, 11 nt, Homo sapiens
caaaugaauuu

SEQ ID NO: 745895 - RNA, 17 nt, Homo sapiens
caaaugacaugcacuga

SEQ ID NO: 745896 - RNA, 20 nt, Homo sapiens
caaaugacaugcacugaccc

SEQ ID NO: 745897 - RNA, 16 nt, Homo sapiens
caaaugagagugguua

SEQ ID NO: 745898 - RNA, 23 nt, Homo sapiens
caaaugaugauuaugaguucccu

SEQ ID NO: 745899 - RNA, 20 nt, Homo sapiens
caaaugcaugcuucuucuca

SEQ ID NO: 745900 - RNA, 16 nt, Homo sapiens
caaaugcuauauugca

SEQ ID NO: 745901 - RNA, 16 nt, Homo sapiens
caaaugcuauugucag

SEQ ID NO: 745902 - RNA, 20 nt, Homo sapiens
caaauggacauaggacucaa

SEQ ID NO: 745903 - RNA, 17 nt, Homo sapiens
caaauggggccagaucc

SEQ ID NO: 745904 - RNA, 14 nt, Homo sapiens
caaaugggggaaaa

SEQ ID NO: 745905 - RNA, 22 nt, Homo sapiens
caaaugggggaaaaguuaguca

SEQ ID NO: 745906 - RNA, 19 nt, Homo sapiens
caaauguacagugguccuu

SEQ ID NO: 745907 - RNA, 14 nt, Homo sapiens
caaauguccuccag

SEQ ID NO: 745908 - RNA, 23 nt, Homo sapiens
caaaugugcuggucacccuucaa

SEQ ID NO: 745909 - RNA, 15 nt, Homo sapiens
caaauuaagaaucua

SEQ ID NO: 745910 - RNA, 14 nt, Homo sapiens
caaauuaucuucac

SEQ ID NO: 745911 - RNA, 23 nt, Homo sapiens
caaauucauuuuuuucacuggag

SEQ ID NO: 745912 - RNA, 23 nt, Homo sapiens
caauuauaucaguccucuuucaa

SEQ ID NO: 745913 - RNA, 18 nt, Homo sapiens
caauuauauuuauauuuc

SEQ ID NO: 745914 - RNA, 21 nt, Homo sapiens
caauucagaaaggaugcacag

SEQ ID NO: 745915 - RNA, 21 nt, Homo sapiens
caauuccaggcugagccauga

SEQ ID NO: 745916 - RNA, 20 nt, Homo sapiens
caauuccauuuccaguucau

SEQ ID NO: 745917 - RNA, 14 nt, Homo sapiens
caauuccugugauu

SEQ ID NO: 745918 - RNA, 12 nt, Homo sapiens
caauucugugac

SEQ ID NO: 745919 - RNA, 20 nt, Homo sapiens
caauucugugacauacauau

SEQ ID NO: 745920 - RNA, 20 nt, Homo sapiens
caauucuguuuuagguuaaa

SEQ ID NO: 745921 - RNA, 19 nt, Homo sapiens
caauugacucucacacuga

SEQ ID NO: 745922 - RNA, 20 nt, Homo sapiens
caauugagcaagaugcugau

SEQ ID NO: 745923 - RNA, 14 nt, Homo sapiens
caauugauacuuca

SEQ ID NO: 745924 - RNA, 15 nt, Homo sapiens
caauugcacugcugu

SEQ ID NO: 745925 - RNA, 18 nt, Homo sapiens
caauuggaauaaucacuu

SEQ ID NO: 745926 - RNA, 18 nt, Homo sapiens
caauuggcccaacacugu

SEQ ID NO: 745927 - RNA, 17 nt, Homo sapiens
caauugggcagaugugu

SEQ ID NO: 745928 - RNA, 15 nt, Homo sapiens
caauuguaacgacuu

SEQ ID NO: 745929 - RNA, 17 nt, Homo sapiens
caauugucgaaaagagu

SEQ ID NO: 745930 - RNA, 20 nt, Homo sapiens
caauugucuauuuaucuuuu

SEQ ID NO: 745931 - RNA, 21 nt, Homo sapiens
caauugucugccucagccucc

SEQ ID NO: 745932 - RNA, 16 nt, Homo sapiens
caauuucaagguucua

SEQ ID NO: 745933 - RNA, 23 nt, Homo sapiens
caauuucacgcuuuuaauucuca

SEQ ID NO: 745934 - RNA, 18 nt, Homo sapiens
caauuuccucuccacugc

SEQ ID NO: 745935 - RNA, 14 nt, Homo sapiens
caauuucuaaauac

SEQ ID NO: 745936 - RNA, 17 nt, Homo sapiens
caauuucuugguauuau

SEQ ID NO: 745937 - RNA, 18 nt, Homo sapiens
caauuucuuuuauguuaa

SEQ ID NO: 745938 - RNA, 22 nt, Homo sapiens
caauuugagccagagagcaucu

SEQ ID NO: 745939 - RNA, 21 nt, Homo sapiens
caauuugguaaaaaugcugcu

SEQ ID NO: 745940 - RNA, 19 nt, Homo sapiens
caauuuguaauugcuuaca

SEQ ID NO: 745941 - RNA, 19 nt, Homo sapiens
caauuuucuguaagagaaa

SEQ ID NO: 745942 - RNA, 24 nt, Homo sapiens
caauuuugaaaacucuaauugucc

SEQ ID NO: 745943 - RNA, 17 nt, Homo sapiens
caauuuuuaccacuucu

SEQ ID NO: 745944 - RNA, 20 nt, Homo sapiens
caauuuuucaagagcuccuu

SEQ ID NO: 745945 - RNA, 22 nt, Homo sapiens
cacaaaacaccaaagaauugua

SEQ ID NO: 745946 - RNA, 19 nt, Homo sapiens
cacaaaagcagauacuuga

SEQ ID NO: 745947 - RNA, 21 nt, Homo sapiens
cacaaaaguccacugaugcaa

SEQ ID NO: 745948 - RNA, 22 nt, Homo sapiens
cacaaaauccaugggcaguaug

SEQ ID NO: 745949 - RNA, 14 nt, Homo sapiens
cacaaacacaccuc

SEQ ID NO: 745950 - RNA, 13 nt, Homo sapiens
cacaaacauauaa

SEQ ID NO: 745951 - RNA, 13 nt, Homo sapiens
cacaaacccaagg

SEQ ID NO: 745952 - RNA, 16 nt, Homo sapiens
cacaaagcauuuucau

SEQ ID NO: 745953 - RNA, 16 nt, Homo sapiens
cacaaagguuaaguua

SEQ ID NO: 745954 - RNA, 21 nt, Homo sapiens
cacaaaguagaggaauccaug

SEQ ID NO: 745955 - RNA, 23 nt, Homo sapiens
cacaaaguaucuaacaaaaccaa

SEQ ID NO: 745956 - RNA, 14 nt, Homo sapiens
cacaaaucuuaacu

SEQ ID NO: 745957 - RNA, 15 nt, Homo sapiens
cacaacacacacacu

SEQ ID NO: 745958 - RNA, 16 nt, Homo sapiens
cacaaccacucauuca

SEQ ID NO: 745959 - RNA, 16 nt, Homo sapiens
cacaacccuguuuuau

SEQ ID NO: 745960 - RNA, 16 nt, Homo sapiens
cacaaccuuccagcuc

SEQ ID NO: 745961 - RNA, 19 nt, Homo sapiens
cacaaccuuccagcuccau

SEQ ID NO: 745962 - RNA, 13 nt, Homo sapiens
cacaacugacaca

SEQ ID NO: 745963 - RNA, 16 nt, Homo sapiens
cacaacugacacagga

SEQ ID NO: 745964 - RNA, 22 nt, Homo sapiens
cacaacuugagaagacauuuau

SEQ ID NO: 745965 - RNA, 20 nt, Homo sapiens
cacaagaagcugguggagca

SEQ ID NO: 745966 - RNA, 23 nt, Homo sapiens
cacaagaccaagguauacaucuu

SEQ ID NO: 745967 - RNA, 15 nt, Homo sapiens
cacaagagugaauuu

SEQ ID NO: 745968 - RNA, 20 nt, Homo sapiens
cacaagcagagugcacagcu

SEQ ID NO: 745969 - RNA, 13 nt, Homo sapiens
cacaagccagacc

SEQ ID NO: 745970 - RNA, 12 nt, Homo sapiens
cacaagcucaga

SEQ ID NO: 745971 - RNA, 16 nt, Homo sapiens
cacaaggaaaaggagg

SEQ ID NO: 745972 - RNA, 15 nt, Homo sapiens
cacaaggcugaccaa

SEQ ID NO: 745973 - RNA, 20 nt, Homo sapiens
cacaaggcugaccaagagag

SEQ ID NO: 745974 - RNA, 22 nt, Homo sapiens
cacaagguacaaaaucuugcau

SEQ ID NO: 745975 - RNA, 13 nt, Homo sapiens
cacaagucuucca

SEQ ID NO: 745976 - RNA, 14 nt, Homo sapiens
cacaagucuuccag

SEQ ID NO: 745977 - RNA, 13 nt, Homo sapiens
cacaauaugaaua

SEQ ID NO: 745978 - RNA, 19 nt, Homo sapiens
cacaauaugggcacuuuaa

SEQ ID NO: 745979 - RNA, 14 nt, Homo sapiens
cacaaugcugaaua

SEQ ID NO: 745980 - RNA, 20 nt, Homo sapiens
cacaaugucaugucugugau

SEQ ID NO: 745981 - RNA, 17 nt, Homo sapiens
cacacaaagacuccuug

SEQ ID NO: 745982 - RNA, 19 nt, Homo sapiens
cacacaacacugaugugac

SEQ ID NO: 745983 - RNA, 15 nt, Homo sapiens
cacacaacagcagau

SEQ ID NO: 745984 - RNA, 13 nt, Homo sapiens
cacacacacaaac

SEQ ID NO: 745985 - RNA, 13 nt, Homo sapiens
cacacacacacga

SEQ ID NO: 745986 - RNA, 10 nt, Homo sapiens
cacacacagu

SEQ ID NO: 745987 - RNA, 20 nt, Homo sapiens
cacacaccaaguaccaguau

SEQ ID NO: 745988 - RNA, 13 nt, Homo sapiens
cacacaccugccu

SEQ ID NO: 745989 - RNA, 19 nt, Homo sapiens
cacacacgaugcauuuaau

SEQ ID NO: 745990 - RNA, 20 nt, Homo sapiens
cacacacgugcgugcgagca

SEQ ID NO: 745991 - RNA, 21 nt, Homo sapiens
cacacagaaaaggcugcugug

SEQ ID NO: 745992 - RNA, 15 nt, Homo sapiens
cacacagacauauau

SEQ ID NO: 745993 - RNA, 22 nt, Homo sapiens
cacacagccuauaucaaacaug

SEQ ID NO: 745994 - RNA, 15 nt, Homo sapiens
cacacaguguuuuaa

SEQ ID NO: 745995 - RNA, 20 nt, Homo sapiens
cacacaguuauuuaaucaaa

SEQ ID NO: 745996 - RNA, 14 nt, Homo sapiens
cacacauauugcac

SEQ ID NO: 745997 - RNA, 22 nt, Homo sapiens
cacacauccacgcacaugcgac

SEQ ID NO: 745998 - RNA, 18 nt, Homo sapiens
cacacauuauuaccccac

SEQ ID NO: 745999 - RNA, 19 nt, Homo sapiens
cacaccaacagugugaagu

SEQ ID NO: 746000 - RNA, 14 nt, Homo sapiens
cacacccaugcaca

SEQ ID NO: 746001 - RNA, 15 nt, Homo sapiens
cacacccaugcacac

SEQ ID NO: 746002 - RNA, 22 nt, Homo sapiens
cacacccaugcacacucaugca

SEQ ID NO: 746003 - RNA, 16 nt, Homo sapiens
cacaccccaacacuuc

SEQ ID NO: 746004 - RNA, 12 nt, Homo sapiens
cacacccggcua

SEQ ID NO: 746005 - RNA, 14 nt, Homo sapiens
cacacccuaccuuc

SEQ ID NO: 746006 - RNA, 11 nt, Homo sapiens
cacaccugcag

SEQ ID NO: 746007 - RNA, 14 nt, Homo sapiens
cacaccugcagugc

SEQ ID NO: 746008 - RNA, 17 nt, Homo sapiens
cacaccugccgucuuca

SEQ ID NO: 746009 - RNA, 13 nt, Homo sapiens
cacaccuguaauc

SEQ ID NO: 746010 - RNA, 15 nt, Homo sapiens
cacaccuuccagggc

SEQ ID NO: 746011 - RNA, 16 nt, Homo sapiens
cacacgaguuccagac

SEQ ID NO: 746012 - RNA, 16 nt, Homo sapiens
cacacgauaaagggau

SEQ ID NO: 746013 - RNA, 14 nt, Homo sapiens
cacacguacuuaaa

SEQ ID NO: 746014 - RNA, 19 nt, Homo sapiens
cacacgucauguuucuuca

SEQ ID NO: 746015 - RNA, 23 nt, Homo sapiens
cacacguuuaaucccagcacuuu

SEQ ID NO: 746016 - RNA, 13 nt, Homo sapiens
cacacucaaggga

SEQ ID NO: 746017 - RNA, 15 nt, Homo sapiens
cacacucacagaugu

SEQ ID NO: 746018 - RNA, 16 nt, Homo sapiens
cacacuggaugugauu

SEQ ID NO: 746019 - RNA, 23 nt, Homo sapiens
cacacugguaaauguuaccucua

SEQ ID NO: 746020 - RNA, 16 nt, Homo sapiens
cacacuuaucuagcaa

SEQ ID NO: 746021 - RNA, 15 nt, Homo sapiens
cacacuucauuguaa

SEQ ID NO: 746022 - RNA, 20 nt, Homo sapiens
cacacuuggaugcaggguuu

SEQ ID NO: 746023 - RNA, 15 nt, Homo sapiens
cacacuuugaagcaa

SEQ ID NO: 746024 - RNA, 13 nt, Homo sapiens
cacacuuugccau

SEQ ID NO: 746025 - RNA, 16 nt, Homo sapiens
cacagaaaauaaggca

SEQ ID NO: 746026 - RNA, 13 nt, Homo sapiens
cacagaaacacug

SEQ ID NO: 746027 - RNA, 23 nt, Homo sapiens
cauacccuuacucugccagagua

SEQ ID NO: 746028 - RNA, 18 nt, Homo sapiens
cauaccucugaccaacag

SEQ ID NO: 746029 - RNA, 21 nt, Homo sapiens
cauaccuggcccugugccuug

SEQ ID NO: 746030 - RNA, 20 nt, Homo sapiens
cauaccuuuggauuuagugu

SEQ ID NO: 746031 - RNA, 19 nt, Homo sapiens
cauacgagagcagaggucu

SEQ ID NO: 746032 - RNA, 14 nt, Homo sapiens
cauacgucagcauu

SEQ ID NO: 746033 - RNA, 23 nt, Homo sapiens
cauacguggaaacaauccuguua

SEQ ID NO: 746034 - RNA, 22 nt, Homo sapiens
cauacgugugcaugugucuuua

SEQ ID NO: 746035 - RNA, 22 nt, Homo sapiens
cauacguguuaggaggcugcau

SEQ ID NO: 746036 - RNA, 23 nt, Homo sapiens
cauacuaguagucauacucccug

SEQ ID NO: 746037 - RNA, 23 nt, Homo sapiens
cauacuccgugaggcugcugcca

SEQ ID NO: 746038 - RNA, 22 nt, Homo sapiens
cauacucuguguaaucucugau

SEQ ID NO: 746039 - RNA, 10 nt, Homo sapiens
cauacugcug

SEQ ID NO: 746040 - RNA, 16 nt, Homo sapiens
cauagaaacaugacac

SEQ ID NO: 746041 - RNA, 16 nt, Homo sapiens
cauagaaauauugacu

SEQ ID NO: 746042 - RNA, 19 nt, Homo sapiens
cauagaaauuacacccaaa

SEQ ID NO: 746043 - RNA, 21 nt, Homo sapiens
cauagaaauuacacccaaaga

SEQ ID NO: 746044 - RNA, 20 nt, Homo sapiens
cauagaacugucccacaaaa

SEQ ID NO: 746045 - RNA, 14 nt, Homo sapiens
cauagaagagccaa

SEQ ID NO: 746046 - RNA, 23 nt, Homo sapiens
cauagagaucuauguacuguaau

SEQ ID NO: 746047 - RNA, 23 nt, Homo sapiens
cauagagcuuuuuaauagcacua

SEQ ID NO: 746048 - RNA, 17 nt, Homo sapiens
cauagagugaucuuucc

SEQ ID NO: 746049 - RNA, 18 nt, Homo sapiens
cauagauccccccacuga

SEQ ID NO: 746050 - RNA, 19 nt, Homo sapiens
cauagaugaaugaaacccu

SEQ ID NO: 746051 - RNA, 17 nt, Homo sapiens
cauagauuaauggcacu

SEQ ID NO: 746052 - RNA, 23 nt, Homo sapiens
cauagauuugcagcucaguagua

SEQ ID NO: 746053 - RNA, 18 nt, Homo sapiens
cauagcagaugguuucca

SEQ ID NO: 746054 - RNA, 14 nt, Homo sapiens
cauagccagcauuu

SEQ ID NO: 746055 - RNA, 18 nt, Homo sapiens
cauagcuugauaaagggc

SEQ ID NO: 746056 - RNA, 15 nt, Homo sapiens
cauagcuuugcacuu

SEQ ID NO: 746057 - RNA, 19 nt, Homo sapiens
cauaggaagggaucugaga

SEQ ID NO: 746058 - RNA, 16 nt, Homo sapiens
cauagguuacuaccua

SEQ ID NO: 746059 - RNA, 22 nt, Homo sapiens
cauagguuacuaccuauacaau

SEQ ID NO: 746060 - RNA, 13 nt, Homo sapiens
cauagucaauauu

SEQ ID NO: 746061 - RNA, 22 nt, Homo sapiens
cauagucacauggccuaugcac

SEQ ID NO: 746062 - RNA, 22 nt, Homo sapiens
cauagugaccaacauagugaaa

SEQ ID NO: 746063 - RNA, 22 nt, Homo sapiens
cauaguggguggauuuguugcc

SEQ ID NO: 746064 - RNA, 19 nt, Homo sapiens
cauaguguuaacugucagu

SEQ ID NO: 746065 - RNA, 14 nt, Homo sapiens
cauaguuugugaau

SEQ ID NO: 746066 - RNA, 20 nt, Homo sapiens
cauauaaauagaugauuuca

SEQ ID NO: 746067 - RNA, 17 nt, Homo sapiens
cauauaaauggaauuac

SEQ ID NO: 746068 - RNA, 16 nt, Homo sapiens
cauauaccaucuccag

SEQ ID NO: 746069 - RNA, 17 nt, Homo sapiens
cauauaggccagaguug

SEQ ID NO: 746070 - RNA, 19 nt, Homo sapiens
cauauauaaauucuaagcc

SEQ ID NO: 746071 - RNA, 16 nt, Homo sapiens
cauauauauguauaua

SEQ ID NO: 746072 - RNA, 14 nt, Homo sapiens
cauauauaugucag

SEQ ID NO: 746073 - RNA, 20 nt, Homo sapiens
cauauauauugaaaugcaaa

SEQ ID NO: 746074 - RNA, 15 nt, Homo sapiens
cauauaucaaaguga

SEQ ID NO: 746075 - RNA, 12 nt, Homo sapiens
cauauaucacua

SEQ ID NO: 746076 - RNA, 21 nt, Homo sapiens
cauauauguauauauaugcac

SEQ ID NO: 746077 - RNA, 24 nt, Homo sapiens
cauauauguauauauaugcacaua

SEQ ID NO: 746078 - RNA, 18 nt, Homo sapiens
cauauauuaaacauccac

SEQ ID NO: 746079 - RNA, 23 nt, Homo sapiens
cauauauuuauugaguaccuacu

SEQ ID NO: 746080 - RNA, 16 nt, Homo sapiens
cauaucaacuuaguca

SEQ ID NO: 746081 - RNA, 14 nt, Homo sapiens
cauaucagaacugu

SEQ ID NO: 746082 - RNA, 19 nt, Homo sapiens
cauauccaggcaccaggac

SEQ ID NO: 746083 - RNA, 15 nt, Homo sapiens
cauaucuacaguacu

SEQ ID NO: 746084 - RNA, 20 nt, Homo sapiens
cauaucuccuuccccuacac

SEQ ID NO: 746085 - RNA, 18 nt, Homo sapiens
cauaucuuaaaacuaaau

SEQ ID NO: 746086 - RNA, 18 nt, Homo sapiens
cauaugaaaaaaaugcau

SEQ ID NO: 746087 - RNA, 15 nt, Homo sapiens
cauauggacucugca

SEQ ID NO: 746088 - RNA, 16 nt, Homo sapiens
cauauguaaagcacau

SEQ ID NO: 746089 - RNA, 21 nt, Homo sapiens
cauauguauacaugugccaug

SEQ ID NO: 746090 - RNA, 13 nt, Homo sapiens
cauauuaagcacu

SEQ ID NO: 746091 - RNA, 17 nt, Homo sapiens
cauauuaagcacuuuaa

SEQ ID NO: 746092 - RNA, 12 nt, Homo sapiens
cauauuaucuca

SEQ ID NO: 746093 - RNA, 15 nt, Homo sapiens
cauauucagcauuug

SEQ ID NO: 746094 - RNA, 14 nt, Homo sapiens
cauauucauaugca

SEQ ID NO: 746095 - RNA, 17 nt, Homo sapiens
cauauucuguucacuug

SEQ ID NO: 746096 - RNA, 15 nt, Homo sapiens
cauauuggacugaua

SEQ ID NO: 746097 - RNA, 15 nt, Homo sapiens
cauauuuaacaugua

SEQ ID NO: 746098 - RNA, 13 nt, Homo sapiens
cauauuuacuucu

SEQ ID NO: 746099 - RNA, 19 nt, Homo sapiens
cauauuuauuuagaugcua

SEQ ID NO: 746100 - RNA, 18 nt, Homo sapiens
cauauuuuacugaucucu

SEQ ID NO: 746101 - RNA, 18 nt, Homo sapiens
cauauuuuuguagcacug

SEQ ID NO: 746102 - RNA, 21 nt, Homo sapiens
cauauuuuuguagcacugaca

SEQ ID NO: 746103 - RNA, 11 nt, Homo sapiens
caucaaaaaga

SEQ ID NO: 746104 - RNA, 18 nt, Homo sapiens
caucaaaucaucauuaau

SEQ ID NO: 746105 - RNA, 13 nt, Homo sapiens
caucaagcacuuc

SEQ ID NO: 746106 - RNA, 22 nt, Homo sapiens
caucaaggagaauguacuggcg

SEQ ID NO: 746107 - RNA, 20 nt, Homo sapiens
caucaagggagacaccagug

SEQ ID NO: 746108 - RNA, 12 nt, Homo sapiens
caucaaggucag

SEQ ID NO: 746109 - RNA, 22 nt, Homo sapiens
caucaauauuauauucaagaua

SEQ ID NO: 746110 - RNA, 12 nt, Homo sapiens
caucacaacauu

SEQ ID NO: 746111 - RNA, 13 nt, Homo sapiens
caucacagggugg

SEQ ID NO: 746112 - RNA, 14 nt, Homo sapiens
caucaccacuguau

SEQ ID NO: 746113 - RNA, 21 nt, Homo sapiens
caucacccucuuccugugauc

SEQ ID NO: 746114 - RNA, 15 nt, Homo sapiens
caucacguaccccac

SEQ ID NO: 746115 - RNA, 23 nt, Homo sapiens
caucacugaucuaagcaguggca

SEQ ID NO: 746116 - RNA, 17 nt, Homo sapiens
caucacuggacugcaug

SEQ ID NO: 746117 - RNA, 17 nt, Homo sapiens
caucacuucccuacaug

SEQ ID NO: 746118 - RNA, 17 nt, Homo sapiens
caucacuuuggacagaa

SEQ ID NO: 746119 - RNA, 18 nt, Homo sapiens
caucagcaagacuuuaua

SEQ ID NO: 746120 - RNA, 13 nt, Homo sapiens
caucagccugcuu

SEQ ID NO: 746121 - RNA, 19 nt, Homo sapiens
caucagcugaauucacuua

SEQ ID NO: 746122 - RNA, 20 nt, Homo sapiens
caucagcugcugaaacaaca

SEQ ID NO: 746123 - RNA, 15 nt, Homo sapiens
caucaggcaguguua

SEQ ID NO: 746124 - RNA, 11 nt, Homo sapiens
caucaguccau

SEQ ID NO: 746125 - RNA, 22 nt, Homo sapiens
caucauaacucacuaacaggga

SEQ ID NO: 746126 - RNA, 18 nt, Homo sapiens
caucaucaaaaacuuugg

SEQ ID NO: 746127 - RNA, 22 nt, Homo sapiens
caucaucaggaagccuguggug

SEQ ID NO: 746128 - RNA, 20 nt, Homo sapiens
caucauccuaagcuauucag

SEQ ID NO: 746129 - RNA, 19 nt, Homo sapiens
caucauccuccauugcucc

SEQ ID NO: 746130 - RNA, 12 nt, Homo sapiens
caucaucuaugg

SEQ ID NO: 746131 - RNA, 16 nt, Homo sapiens
caucaugggcuggaca

SEQ ID NO: 746132 - RNA, 16 nt, Homo sapiens
caucauuaaccaguaa

SEQ ID NO: 746133 - RNA, 23 nt, Homo sapiens
caucauuacugguaaagccucau

SEQ ID NO: 746134 - RNA, 15 nt, Homo sapiens
caucauuacuuauga

SEQ ID NO: 746135 - RNA, 15 nt, Homo sapiens
caucauuagaacaaa

SEQ ID NO: 746136 - RNA, 16 nt, Homo sapiens
caucauugcauaacag

SEQ ID NO: 746137 - RNA, 14 nt, Homo sapiens
caucauuuuacucu

SEQ ID NO: 746138 - RNA, 22 nt, Homo sapiens
caucauuuuacucuuaugauca

SEQ ID NO: 746139 - RNA, 18 nt, Homo sapiens
caucauuuugacagcauc

SEQ ID NO: 746140 - RNA, 12 nt, Homo sapiens
cauccaacacug

SEQ ID NO: 746141 - RNA, 21 nt, Homo sapiens
cauuuauuuacacucuugauu

SEQ ID NO: 746142 - RNA, 21 nt, Homo sapiens
cauuucaagacagauugugaa

SEQ ID NO: 746143 - RNA, 17 nt, Homo sapiens
cauuucaauuccuguga

SEQ ID NO: 746144 - RNA, 15 nt, Homo sapiens
cauuucacagccuuu

SEQ ID NO: 746145 - RNA, 21 nt, Homo sapiens
cauuucacagugcccaagagu

SEQ ID NO: 746146 - RNA, 20 nt, Homo sapiens
cauuucaccugugacaaagg

SEQ ID NO: 746147 - RNA, 15 nt, Homo sapiens
cauuucacucucaaa

SEQ ID NO: 746148 - RNA, 17 nt, Homo sapiens
cauuucagaaaugcugu

SEQ ID NO: 746149 - RNA, 17 nt, Homo sapiens
cauuucaggggucguca

SEQ ID NO: 746150 - RNA, 12 nt, Homo sapiens
cauuucauauaa

SEQ ID NO: 746151 - RNA, 20 nt, Homo sapiens
cauuuccaacaccacagaca

SEQ ID NO: 746152 - RNA, 21 nt, Homo sapiens
cauuuccccucccaauccucu

SEQ ID NO: 746153 - RNA, 15 nt, Homo sapiens
cauuucuaaaccaga

SEQ ID NO: 746154 - RNA, 13 nt, Homo sapiens
cauuucuauacuu

SEQ ID NO: 746155 - RNA, 21 nt, Homo sapiens
cauuucuauacuuuacaggaa

SEQ ID NO: 746156 - RNA, 22 nt, Homo sapiens
cauuucucaaaugcacaucuca

SEQ ID NO: 746157 - RNA, 15 nt, Homo sapiens
cauuucucagcaucg

SEQ ID NO: 746158 - RNA, 19 nt, Homo sapiens
cauuucucauaccuucccc

SEQ ID NO: 746159 - RNA, 23 nt, Homo sapiens
cauuucucuaacuccugccauuc

SEQ ID NO: 746160 - RNA, 12 nt, Homo sapiens
cauuucuuccca

SEQ ID NO: 746161 - RNA, 20 nt, Homo sapiens
cauuucuucuacucuugaga

SEQ ID NO: 746162 - RNA, 13 nt, Homo sapiens
cauuugaacaugu

SEQ ID NO: 746163 - RNA, 23 nt, Homo sapiens
cauuugaaugugugaauucaaua

SEQ ID NO: 746164 - RNA, 18 nt, Homo sapiens
cauuugagaaaugcauau

SEQ ID NO: 746165 - RNA, 15 nt, Homo sapiens
cauuugagcucauga

SEQ ID NO: 746166 - RNA, 19 nt, Homo sapiens
cauuugaggggaaaacacc

SEQ ID NO: 746167 - RNA, 14 nt, Homo sapiens
cauuugauggccac

SEQ ID NO: 746168 - RNA, 17 nt, Homo sapiens
cauuugcagaugcacau

SEQ ID NO: 746169 - RNA, 14 nt, Homo sapiens
cauuugcauuugcu

SEQ ID NO: 746170 - RNA, 15 nt, Homo sapiens
cauuugcauuugcuc

SEQ ID NO: 746171 - RNA, 14 nt, Homo sapiens
cauuugccaaguga

SEQ ID NO: 746172 - RNA, 15 nt, Homo sapiens
cauuugccugucaug

SEQ ID NO: 746173 - RNA, 19 nt, Homo sapiens
cauuugcgaaugguuccau

SEQ ID NO: 746174 - RNA, 16 nt, Homo sapiens
cauuugcguguaucua

SEQ ID NO: 746175 - RNA, 14 nt, Homo sapiens
cauuugcucuuuca

SEQ ID NO: 746176 - RNA, 16 nt, Homo sapiens
cauuuggaacaacaaa

SEQ ID NO: 746177 - RNA, 21 nt, Homo sapiens
cauuuguagcuuugcccauug

SEQ ID NO: 746178 - RNA, 18 nt, Homo sapiens
cauuuguauauuguggau

SEQ ID NO: 746179 - RNA, 19 nt, Homo sapiens
cauuuguauuuugugauga

SEQ ID NO: 746180 - RNA, 21 nt, Homo sapiens
cauuugucaguauuuuugccg

SEQ ID NO: 746181 - RNA, 16 nt, Homo sapiens
cauuugucucuacuuu

SEQ ID NO: 746182 - RNA, 14 nt, Homo sapiens
cauuuguuccauga

SEQ ID NO: 746183 - RNA, 21 nt, Homo sapiens
cauuuguuucccccacaguuu

SEQ ID NO: 746184 - RNA, 14 nt, Homo sapiens
cauuuguuuugcuu

SEQ ID NO: 746185 - RNA, 13 nt, Homo sapiens
cauuuuaaaaaca

SEQ ID NO: 746186 - RNA, 22 nt, Homo sapiens
cauuuuaaguuuguaguaaaag

SEQ ID NO: 746187 - RNA, 22 nt, Homo sapiens
cauuuuaauaucuuaugcuauu

SEQ ID NO: 746188 - RNA, 15 nt, Homo sapiens
cauuuuagugacugu

SEQ ID NO: 746189 - RNA, 20 nt, Homo sapiens
cauuuuauacccaaaacccu

SEQ ID NO: 746190 - RNA, 15 nt, Homo sapiens
cauuuuaucccaugg

SEQ ID NO: 746191 - RNA, 20 nt, Homo sapiens
cauuuuauuuuuucuugcaa

SEQ ID NO: 746192 - RNA, 15 nt, Homo sapiens
cauuuucauugauga

SEQ ID NO: 746193 - RNA, 20 nt, Homo sapiens
cauuuucccccacuacugca

SEQ ID NO: 746194 - RNA, 15 nt, Homo sapiens
cauuuugacacaaaa

SEQ ID NO: 746195 - RNA, 13 nt, Homo sapiens
cauuuugagcuga

SEQ ID NO: 746196 - RNA, 14 nt, Homo sapiens
cauuuugcaaaauu

SEQ ID NO: 746197 - RNA, 19 nt, Homo sapiens
cauuuugcaaaauuuccag

SEQ ID NO: 746198 - RNA, 17 nt, Homo sapiens
cauuuuuauguuauuac

SEQ ID NO: 746199 - RNA, 20 nt, Homo sapiens
cauuuuuauuaaagcauuuc

SEQ ID NO: 746200 - RNA, 15 nt, Homo sapiens
cauuuuucugaugau

SEQ ID NO: 746201 - RNA, 18 nt, Homo sapiens
ccaaaaacuaaaauucaa

SEQ ID NO: 746202 - RNA, 20 nt, Homo sapiens
ccaaaaagggauccguacau

SEQ ID NO: 746203 - RNA, 15 nt, Homo sapiens
ccaaaaauuacuuug

SEQ ID NO: 746204 - RNA, 13 nt, Homo sapiens
ccaaaacauuucu

SEQ ID NO: 746205 - RNA, 12 nt, Homo sapiens
ccaaaaccagaa

SEQ ID NO: 746206 - RNA, 18 nt, Homo sapiens
ccaaaacccugaagccau

SEQ ID NO: 746207 - RNA, 13 nt, Homo sapiens
ccaaaacucugua

SEQ ID NO: 746208 - RNA, 15 nt, Homo sapiens
ccaaaagcaguaaau

SEQ ID NO: 746209 - RNA, 13 nt, Homo sapiens
ccaaaaguuauua

SEQ ID NO: 746210 - RNA, 18 nt, Homo sapiens
ccaaaauauuaacauucu

SEQ ID NO: 746211 - RNA, 19 nt, Homo sapiens
ccaaaauauuaacauucuu

SEQ ID NO: 746212 - RNA, 13 nt, Homo sapiens
ccaaaaugcauuu

SEQ ID NO: 746213 - RNA, 15 nt, Homo sapiens
ccaaaauucauuucu

SEQ ID NO: 746214 - RNA, 13 nt, Homo sapiens
ccaaaauuugaug

SEQ ID NO: 746215 - RNA, 12 nt, Homo sapiens
ccaaacacuucu

SEQ ID NO: 746216 - RNA, 14 nt, Homo sapiens
ccaaacauuacaaa

SEQ ID NO: 746217 - RNA, 14 nt, Homo sapiens
ccaaaccuguaacc

SEQ ID NO: 746218 - RNA, 13 nt, Homo sapiens
ccaaacgcuuauu

SEQ ID NO: 746219 - RNA, 18 nt, Homo sapiens
ccaaacgcuuauugugua

SEQ ID NO: 746220 - RNA, 14 nt, Homo sapiens
ccaaacucugccag

SEQ ID NO: 746221 - RNA, 21 nt, Homo sapiens
ccaaagaccugccugugugcu

SEQ ID NO: 746222 - RNA, 22 nt, Homo sapiens
ccaaagaccugccugugugcuc

SEQ ID NO: 746223 - RNA, 21 nt, Homo sapiens
ccaaagagccuuuccaaagag

SEQ ID NO: 746224 - RNA, 15 nt, Homo sapiens
ccaaagcaaugugag

SEQ ID NO: 746225 - RNA, 11 nt, Homo sapiens
ccaaagcacuu

SEQ ID NO: 746226 - RNA, 15 nt, Homo sapiens
ccaaagcauggacua

SEQ ID NO: 746227 - RNA, 19 nt, Homo sapiens
ccaaagccacuggaaggag

SEQ ID NO: 746228 - RNA, 16 nt, Homo sapiens
ccaaagcucagacuug

SEQ ID NO: 746229 - RNA, 20 nt, Homo sapiens
ccaaaggaacacugacauca

SEQ ID NO: 746230 - RNA, 22 nt, Homo sapiens
ccaaaggggcugcuggggcaug

SEQ ID NO: 746231 - RNA, 15 nt, Homo sapiens
ccaaaguaacugaau

SEQ ID NO: 746232 - RNA, 20 nt, Homo sapiens
ccaaaguaucaggacgagaa

SEQ ID NO: 746233 - RNA, 23 nt, Homo sapiens
ccaaagucagaauugcucaaaga

SEQ ID NO: 746234 - RNA, 16 nt, Homo sapiens
ccaaagugucuuuuga

SEQ ID NO: 746235 - RNA, 18 nt, Homo sapiens
ccaaagugucuuuugaca

SEQ ID NO: 746236 - RNA, 17 nt, Homo sapiens
ccaaauaaaguaccauu

SEQ ID NO: 746237 - RNA, 12 nt, Homo sapiens
ccaaauagcaaa

SEQ ID NO: 746238 - RNA, 15 nt, Homo sapiens
ccaaaucagcugcua

SEQ ID NO: 746239 - RNA, 19 nt, Homo sapiens
ccaaaucugaccuaaaagu

SEQ ID NO: 746240 - RNA, 23 nt, Homo sapiens
ccaaaugaagauuuuuaggagug

SEQ ID NO: 746241 - RNA, 12 nt, Homo sapiens
ccaaaugagauc

SEQ ID NO: 746242 - RNA, 19 nt, Homo sapiens
ccaaaugaugccacuuccc

SEQ ID NO: 746243 - RNA, 14 nt, Homo sapiens
ccaaaugcagggag

SEQ ID NO: 746244 - RNA, 22 nt, Homo sapiens
ccaaauguucauccucauugcc

SEQ ID NO: 746245 - RNA, 13 nt, Homo sapiens
ccaaauguuccau

SEQ ID NO: 746246 - RNA, 17 nt, Homo sapiens
ccaaauuagugaaccaa

SEQ ID NO: 746247 - RNA, 12 nt, Homo sapiens
ccaaauugcagc

SEQ ID NO: 746248 - RNA, 14 nt, Homo sapiens
ccaaauugcagcuu

SEQ ID NO: 746249 - RNA, 19 nt, Homo sapiens
ccaaauuucauaccuauca

SEQ ID NO: 746250 - RNA, 23 nt, Homo sapiens
ccaaauuuccaguuuaaguaauu

SEQ ID NO: 746251 - RNA, 13 nt, Homo sapiens
ccaacaaaccauc

SEQ ID NO: 746252 - RNA, 13 nt, Homo sapiens
ccaacaacucugc

SEQ ID NO: 746253 - RNA, 12 nt, Homo sapiens
ccaacaauguug

SEQ ID NO: 746254 - RNA, 18 nt, Homo sapiens
ccaacacuuccagcauuu

SEQ ID NO: 746255 - RNA, 12 nt, Homo sapiens
ccaacagcacuu

SEQ ID NO: 746256 - RNA, 15 nt, Homo sapiens
ccaacagccagugug

SEQ ID NO: 746257 - RNA, 13 nt, Homo sapiens
ccaccauucccug

SEQ ID NO: 746258 - RNA, 16 nt, Homo sapiens
ccacccaaaagucaaa

SEQ ID NO: 746259 - RNA, 16 nt, Homo sapiens
ccacccaauuggccca

SEQ ID NO: 746260 - RNA, 13 nt, Homo sapiens
ccacccacaugug

SEQ ID NO: 746261 - RNA, 14 nt, Homo sapiens
ccacccccauggaa

SEQ ID NO: 746262 - RNA, 17 nt, Homo sapiens
ccaccccuaaagagaua

SEQ ID NO: 746263 - RNA, 22 nt, Homo sapiens
ccacccucauucuacugaaaag

SEQ ID NO: 746264 - RNA, 17 nt, Homo sapiens
ccacccuccaugcuccu

SEQ ID NO: 746265 - RNA, 13 nt, Homo sapiens
ccacccugcauuu

SEQ ID NO: 746266 - RNA, 13 nt, Homo sapiens
ccacccuggagac

SEQ ID NO: 746267 - RNA, 22 nt, Homo sapiens
ccacccuguuuaaagauuucaa

SEQ ID NO: 746268 - RNA, 13 nt, Homo sapiens
ccaccgcacucca

SEQ ID NO: 746269 - RNA, 21 nt, Homo sapiens
ccaccuaaaaacauuuacuga

SEQ ID NO: 746270 - RNA, 13 nt, Homo sapiens
ccaccuagacugu

SEQ ID NO: 746271 - RNA, 13 nt, Homo sapiens
ccaccucagggca

SEQ ID NO: 746272 - RNA, 16 nt, Homo sapiens
ccaccuccuccuccau

SEQ ID NO: 746273 - RNA, 20 nt, Homo sapiens
ccaccugacaauggcagcua

SEQ ID NO: 746274 - RNA, 17 nt, Homo sapiens
ccaccugcauugcucuc

SEQ ID NO: 746275 - RNA, 20 nt, Homo sapiens
ccaccugguacugacccagg

SEQ ID NO: 746276 - RNA, 15 nt, Homo sapiens
ccaccugugcccuca

SEQ ID NO: 746277 - RNA, 21 nt, Homo sapiens
ccaccugugcccucaccacca

SEQ ID NO: 746278 - RNA, 22 nt, Homo sapiens
ccaccuguuuucugaaacacac

SEQ ID NO: 746279 - RNA, 23 nt, Homo sapiens
ccaccuucuacgcaauugacaaa

SEQ ID NO: 746280 - RNA, 16 nt, Homo sapiens
ccacgaccuuugaaga

SEQ ID NO: 746281 - RNA, 23 nt, Homo sapiens
ccacgcagcacccuucucggaga

SEQ ID NO: 746282 - RNA, 17 nt, Homo sapiens
ccacgggggcaguguga

SEQ ID NO: 746283 - RNA, 12 nt, Homo sapiens
ccacgucuuccu

SEQ ID NO: 746284 - RNA, 12 nt, Homo sapiens
ccacgugcagua

SEQ ID NO: 746285 - RNA, 16 nt, Homo sapiens
ccacgugcaguaucuc

SEQ ID NO: 746286 - RNA, 20 nt, Homo sapiens
ccacguguccguccacccuu

SEQ ID NO: 746287 - RNA, 13 nt, Homo sapiens
ccacuaaaacaca

SEQ ID NO: 746288 - RNA, 12 nt, Homo sapiens
ccacuaaacuac

SEQ ID NO: 746289 - RNA, 12 nt, Homo sapiens
ccacuacuguag

SEQ ID NO: 746290 - RNA, 15 nt, Homo sapiens
ccacuacuguagaaa

SEQ ID NO: 746291 - RNA, 16 nt, Homo sapiens
ccacucaccagcccua

SEQ ID NO: 746292 - RNA, 13 nt, Homo sapiens
ccacucacuccag

SEQ ID NO: 746293 - RNA, 16 nt, Homo sapiens
ccacucagcucaccuc

SEQ ID NO: 746294 - RNA, 16 nt, Homo sapiens
ccacucauugucuuug

SEQ ID NO: 746295 - RNA, 16 nt, Homo sapiens
ccacuccagcucugag

SEQ ID NO: 746296 - RNA, 14 nt, Homo sapiens
ccacucccaaagcu

SEQ ID NO: 746297 - RNA, 17 nt, Homo sapiens
ccacucccaaagcucag

SEQ ID NO: 746298 - RNA, 16 nt, Homo sapiens
ccacucccuuugccag

SEQ ID NO: 746299 - RNA, 22 nt, Homo sapiens
ccacucgagugcccaaggagcc

SEQ ID NO: 746300 - RNA, 17 nt, Homo sapiens
ccacucggcaccucucc

SEQ ID NO: 746301 - RNA, 17 nt, Homo sapiens
ccacucucccaccuccu

SEQ ID NO: 746302 - RNA, 14 nt, Homo sapiens
ccacugcacuccag

SEQ ID NO: 746303 - RNA, 14 nt, Homo sapiens
ccacugccugggau

SEQ ID NO: 746304 - RNA, 17 nt, Homo sapiens
ccacugcuggcugcagc

SEQ ID NO: 746305 - RNA, 18 nt, Homo sapiens
ccacuggaaaaguguaau

SEQ ID NO: 746306 - RNA, 22 nt, Homo sapiens
ccacuggcccagggccaccucu

SEQ ID NO: 746307 - RNA, 21 nt, Homo sapiens
ccacugggacccgaggauuuc

SEQ ID NO: 746308 - RNA, 10 nt, Homo sapiens
ccacugggag

SEQ ID NO: 746309 - RNA, 16 nt, Homo sapiens
ccacuggguuacagaa

SEQ ID NO: 746310 - RNA, 13 nt, Homo sapiens
ccacuggucugua

SEQ ID NO: 746311 - RNA, 22 nt, Homo sapiens
ccacuggucuguagggauuuuu

SEQ ID NO: 746312 - RNA, 16 nt, Homo sapiens
ccacugucuagagcaa

SEQ ID NO: 746313 - RNA, 20 nt, Homo sapiens
ccacugugguggcaguggag

SEQ ID NO: 746314 - RNA, 16 nt, Homo sapiens
ccacuguguacugugg

SEQ ID NO: 746315 - RNA, 23 nt, Homo sapiens
ccacuguugguauuauauaauuc

SEQ ID NO: 746316 - RNA, 19 nt, Homo sapiens
ccacuuagaaauugcauuu

SEQ ID NO: 746317 - RNA, 20 nt, Homo sapiens
ccacuucuaagaaaagccua

SEQ ID NO: 746318 - RNA, 17 nt, Homo sapiens
ccacuucuccaugcugc

SEQ ID NO: 746319 - RNA, 16 nt, Homo sapiens
ccacuugaagcacuua

SEQ ID NO: 746320 - RNA, 16 nt, Homo sapiens
ccacuuguuugcacug

SEQ ID NO: 746321 - RNA, 18 nt, Homo sapiens
ccacuuugacuacaaaga

SEQ ID NO: 746322 - RNA, 19 nt, Homo sapiens
ccacuuugacuacaaagau

SEQ ID NO: 746323 - RNA, 21 nt, Homo sapiens
ccagaaaaccucuccugaccc

SEQ ID NO: 746324 - RNA, 16 nt, Homo sapiens
ccagaaacuacaugau

SEQ ID NO: 746325 - RNA, 13 nt, Homo sapiens
ccagaaacuuuaa

SEQ ID NO: 746326 - RNA, 13 nt, Homo sapiens
ccagaaaguuauu

SEQ ID NO: 746327 - RNA, 21 nt, Homo sapiens
ccagaaauaaagaucucagga

SEQ ID NO: 746328 - RNA, 21 nt, Homo sapiens
ccagaaaucuucaugcaauga

SEQ ID NO: 746329 - RNA, 20 nt, Homo sapiens
ccagaaauugugugugcaag

SEQ ID NO: 746330 - RNA, 20 nt, Homo sapiens
ccagaacaauggcuauucau

SEQ ID NO: 746331 - RNA, 16 nt, Homo sapiens
ccagaaccacacuuga

SEQ ID NO: 746332 - RNA, 12 nt, Homo sapiens
ccagaaccacua

SEQ ID NO: 746333 - RNA, 12 nt, Homo sapiens
ccagaacccaga

SEQ ID NO: 746334 - RNA, 18 nt, Homo sapiens
ccagaacuggacucagga

SEQ ID NO: 746335 - RNA, 18 nt, Homo sapiens
ccagaagaagagaagcug

SEQ ID NO: 746336 - RNA, 21 nt, Homo sapiens
ccagaagaauauucaggacuu

SEQ ID NO: 746337 - RNA, 15 nt, Homo sapiens
ccagaagcugggaaa

SEQ ID NO: 746338 - RNA, 18 nt, Homo sapiens
ccagaaguuacagaugag

SEQ ID NO: 746339 - RNA, 15 nt, Homo sapiens
ccagaaguuccucaa

SEQ ID NO: 746340 - RNA, 16 nt, Homo sapiens
ccagaaucuugacuuu

SEQ ID NO: 746341 - RNA, 19 nt, Homo sapiens
ccagaaugaaaacuguaaa

SEQ ID NO: 746342 - RNA, 18 nt, Homo sapiens
ccagaaugccuccugcag

SEQ ID NO: 746343 - RNA, 19 nt, Homo sapiens
ccagaaugcugcaggacuu

SEQ ID NO: 746344 - RNA, 18 nt, Homo sapiens
ccagaauguagcaucuga

SEQ ID NO: 746345 - RNA, 16 nt, Homo sapiens
ccagacaaaauuugag

SEQ ID NO: 746346 - RNA, 22 nt, Homo sapiens
ccagacacuggcguuacugcuu

SEQ ID NO: 746347 - RNA, 13 nt, Homo sapiens
ccagacagcuccc

SEQ ID NO: 746348 - RNA, 19 nt, Homo sapiens
ccagacauugauggggaca

SEQ ID NO: 746349 - RNA, 16 nt, Homo sapiens
ccagacauugcucuca

SEQ ID NO: 746350 - RNA, 22 nt, Homo sapiens
ccagacauuuacaaaguuguuu

SEQ ID NO: 746351 - RNA, 19 nt, Homo sapiens
ccagacauuuguuucugua

SEQ ID NO: 746352 - RNA, 19 nt, Homo sapiens
ccagacccaccacaccgca

SEQ ID NO: 746353 - RNA, 12 nt, Homo sapiens
ccagacccugaa

SEQ ID NO: 746354 - RNA, 19 nt, Homo sapiens
ccagacccugaagauuuca

SEQ ID NO: 746355 - RNA, 21 nt, Homo sapiens
ccagacuggaaugcagugaca

SEQ ID NO: 746356 - RNA, 24 nt, Homo sapiens
ccagagagcagcuucagugacaaa

SEQ ID NO: 746357 - RNA, 15 nt, Homo sapiens
ccagagccaccaaag

SEQ ID NO: 746358 - RNA, 22 nt, Homo sapiens
ccagagccaggggggugaggag

SEQ ID NO: 746359 - RNA, 17 nt, Homo sapiens
ccagagcccagcuccaa

SEQ ID NO: 746360 - RNA, 20 nt, Homo sapiens
ccagagcccuucacugccau

SEQ ID NO: 746361 - RNA, 20 nt, Homo sapiens
ccagagcggcuucaccugcg

SEQ ID NO: 746362 - RNA, 22 nt, Homo sapiens
ccagagcuggaaggcagggcag

SEQ ID NO: 746363 - RNA, 14 nt, Homo sapiens
ccagagcugugcca

SEQ ID NO: 746364 - RNA, 17 nt, Homo sapiens
ccagagcugugccagca

SEQ ID NO: 746365 - RNA, 23 nt, Homo sapiens
ccagagcuugugcuccucuugau

SEQ ID NO: 746366 - RNA, 16 nt, Homo sapiens
ccagaggaacaagcau

SEQ ID NO: 746367 - RNA, 14 nt, Homo sapiens
ccagaggacaaaag

SEQ ID NO: 746368 - RNA, 21 nt, Homo sapiens
ccagaggagccaccaguucuc

SEQ ID NO: 746369 - RNA, 15 nt, Homo sapiens
ccagaggauggugag

SEQ ID NO: 746370 - RNA, 15 nt, Homo sapiens
ccagaggcaguaacc

SEQ ID NO: 746371 - RNA, 19 nt, Homo sapiens
ccagaggcuauuauuuuca

SEQ ID NO: 746372 - RNA, 15 nt, Homo sapiens
ccccaugcacuguga

SEQ ID NO: 746373 - RNA, 23 nt, Homo sapiens
ccccauguaucucaguaccccau

SEQ ID NO: 746374 - RNA, 15 nt, Homo sapiens
ccccaugugccugca

SEQ ID NO: 746375 - RNA, 15 nt, Homo sapiens
cccccaaaguucaca

SEQ ID NO: 746376 - RNA, 16 nt, Homo sapiens
cccccaaaucaagcag

SEQ ID NO: 746377 - RNA, 21 nt, Homo sapiens
cccccaaugacacccaugcca

SEQ ID NO: 746378 - RNA, 14 nt, Homo sapiens
cccccagaggacuu

SEQ ID NO: 746379 - RNA, 19 nt, Homo sapiens
cccccaucuuuacaaagaa

SEQ ID NO: 746380 - RNA, 19 nt, Homo sapiens
cccccaugggcuguguccu

SEQ ID NO: 746381 - RNA, 15 nt, Homo sapiens
cccccugccagugcc

SEQ ID NO: 746382 - RNA, 13 nt, Homo sapiens
ccccgaguuuaaa

SEQ ID NO: 746383 - RNA, 18 nt, Homo sapiens
ccccuagagacagugaug

SEQ ID NO: 746384 - RNA, 18 nt, Homo sapiens
ccccucacucuguuuccu

SEQ ID NO: 746385 - RNA, 20 nt, Homo sapiens
ccccucauuguuuauuaaca

SEQ ID NO: 746386 - RNA, 21 nt, Homo sapiens
ccccuccccaaagccacugga

SEQ ID NO: 746387 - RNA, 15 nt, Homo sapiens
ccccuccugcugggc

SEQ ID NO: 746388 - RNA, 16 nt, Homo sapiens
ccccucguuagccuuc

SEQ ID NO: 746389 - RNA, 20 nt, Homo sapiens
ccccucucccagcccuggua

SEQ ID NO: 746390 - RNA, 22 nt, Homo sapiens
ccccugagaugguaugcacaau

SEQ ID NO: 746391 - RNA, 22 nt, Homo sapiens
ccccugagcaaugucugugcua

SEQ ID NO: 746392 - RNA, 19 nt, Homo sapiens
ccccugcaauguggugaca

SEQ ID NO: 746393 - RNA, 21 nt, Homo sapiens
ccccugcucaguaaagcacuu

SEQ ID NO: 746394 - RNA, 20 nt, Homo sapiens
ccccugcugucucucugggc

SEQ ID NO: 746395 - RNA, 14 nt, Homo sapiens
ccccuggcuuuuca

SEQ ID NO: 746396 - RNA, 23 nt, Homo sapiens
ccccuucccuguccuugcccuuu

SEQ ID NO: 746397 - RNA, 21 nt, Homo sapiens
ccccuuccuguguccauguga

SEQ ID NO: 746398 - RNA, 23 nt, Homo sapiens
ccccuucuccccugcacuguaaa

SEQ ID NO: 746399 - RNA, 16 nt, Homo sapiens
ccccuuguuguaaaaa

SEQ ID NO: 746400 - RNA, 20 nt, Homo sapiens
ccccuuguuguaaaaagccc

SEQ ID NO: 746401 - RNA, 14 nt, Homo sapiens
ccccuuucacuuac

SEQ ID NO: 746402 - RNA, 13 nt, Homo sapiens
cccgaaaccagag

SEQ ID NO: 746403 - RNA, 12 nt, Homo sapiens
cccgaagccacc

SEQ ID NO: 746404 - RNA, 16 nt, Homo sapiens
cccgacagugccaucc

SEQ ID NO: 746405 - RNA, 22 nt, Homo sapiens
cccgagaguggguguuggacag

SEQ ID NO: 746406 - RNA, 18 nt, Homo sapiens
cccgagcuguuaccauuc

SEQ ID NO: 746407 - RNA, 17 nt, Homo sapiens
cccgaguaacugagauu

SEQ ID NO: 746408 - RNA, 23 nt, Homo sapiens
cccgaucaucuuuccuguuccag

SEQ ID NO: 746409 - RNA, 18 nt, Homo sapiens
cccgcaguugugccaaag

SEQ ID NO: 746410 - RNA, 15 nt, Homo sapiens
cccgcaucaagguca

SEQ ID NO: 746411 - RNA, 23 nt, Homo sapiens
cccgcuauuaucagaucaugccc

SEQ ID NO: 746412 - RNA, 12 nt, Homo sapiens
cccgcucugcag

SEQ ID NO: 746413 - RNA, 20 nt, Homo sapiens
cccgcuuuuccuuucugcca

SEQ ID NO: 746414 - RNA, 14 nt, Homo sapiens
cccggaccucugga

SEQ ID NO: 746415 - RNA, 21 nt, Homo sapiens
cccggacucaccaacuugcca

SEQ ID NO: 746416 - RNA, 21 nt, Homo sapiens
cccgggccagggcugccccua

SEQ ID NO: 746417 - RNA, 21 nt, Homo sapiens
cccgguggcggccccagcacc

SEQ ID NO: 746418 - RNA, 22 nt, Homo sapiens
cccguaggcagccucucugcua

SEQ ID NO: 746419 - RNA, 21 nt, Homo sapiens
cccgucucuacuaaaaauaca

SEQ ID NO: 746420 - RNA, 21 nt, Homo sapiens
cccgugcacgguucaauggua

SEQ ID NO: 746421 - RNA, 13 nt, Homo sapiens
cccgugccaaaaa

SEQ ID NO: 746422 - RNA, 16 nt, Homo sapiens
cccgugggcaucucaa

SEQ ID NO: 746423 - RNA, 22 nt, Homo sapiens
cccguggucuccuugcacuuuc

SEQ ID NO: 746424 - RNA, 17 nt, Homo sapiens
cccuaaaauauuacaaa

SEQ ID NO: 746425 - RNA, 12 nt, Homo sapiens
cccuaaagggag

SEQ ID NO: 746426 - RNA, 18 nt, Homo sapiens
cccuaagcgcacauucau

SEQ ID NO: 746427 - RNA, 18 nt, Homo sapiens
cccuaaucccagcacuuu

SEQ ID NO: 746428 - RNA, 14 nt, Homo sapiens
cccuacacugugaa

SEQ ID NO: 746429 - RNA, 11 nt, Homo sapiens
cccuacaugga

SEQ ID NO: 746430 - RNA, 15 nt, Homo sapiens
cccuaccaugaaucc

SEQ ID NO: 746431 - RNA, 18 nt, Homo sapiens
cccuacuauucaguggcg

SEQ ID NO: 746432 - RNA, 15 nt, Homo sapiens
cccuacuccacugcc

SEQ ID NO: 746433 - RNA, 16 nt, Homo sapiens
cccuacuuucuggaag

SEQ ID NO: 746434 - RNA, 21 nt, Homo sapiens
cccuacuuucuggaaguggag

SEQ ID NO: 746435 - RNA, 19 nt, Homo sapiens
cccuagaaagcugcuguga

SEQ ID NO: 746436 - RNA, 20 nt, Homo sapiens
cccuagaugcacguggggcc

SEQ ID NO: 746437 - RNA, 16 nt, Homo sapiens
cccuagcccugguuag

SEQ ID NO: 746438 - RNA, 17 nt, Homo sapiens
cccuaggggacacuucc

SEQ ID NO: 746439 - RNA, 12 nt, Homo sapiens
cccuaucuccaa

SEQ ID NO: 746440 - RNA, 15 nt, Homo sapiens
cccuaugucucagga

SEQ ID NO: 746441 - RNA, 17 nt, Homo sapiens
cccuauuuauugacuuu

SEQ ID NO: 746442 - RNA, 23 nt, Homo sapiens
cccucacacuuugccauuugcuu

SEQ ID NO: 746443 - RNA, 15 nt, Homo sapiens
cccucacccaaaaga

SEQ ID NO: 746444 - RNA, 12 nt, Homo sapiens
cccucacccauc

SEQ ID NO: 746445 - RNA, 21 nt, Homo sapiens
cccucaccuuggcaccagaca

SEQ ID NO: 746446 - RNA, 21 nt, Homo sapiens
cccucacuaauugguacuuuu

SEQ ID NO: 746447 - RNA, 23 nt, Homo sapiens
cccucagaaacccuucagugcua

SEQ ID NO: 746448 - RNA, 14 nt, Homo sapiens
cccucagacauccc

SEQ ID NO: 746449 - RNA, 13 nt, Homo sapiens
cccucagacuuca

SEQ ID NO: 746450 - RNA, 15 nt, Homo sapiens
cccucaguuucccua

SEQ ID NO: 746451 - RNA, 18 nt, Homo sapiens
cccucauccuuuacauuu

SEQ ID NO: 746452 - RNA, 18 nt, Homo sapiens
cccucaugaaaacacaca

SEQ ID NO: 746453 - RNA, 18 nt, Homo sapiens
cccucaugaucauucuca

SEQ ID NO: 746454 - RNA, 17 nt, Homo sapiens
cccucauucuacugaaa

SEQ ID NO: 746455 - RNA, 14 nt, Homo sapiens
cccuccacuccuca

SEQ ID NO: 746456 - RNA, 18 nt, Homo sapiens
cccuccaggcccaucuca

SEQ ID NO: 746457 - RNA, 19 nt, Homo sapiens
cccuccauucauccuucca

SEQ ID NO: 746458 - RNA, 22 nt, Homo sapiens
cccucccagcccauugcugcca

SEQ ID NO: 746459 - RNA, 20 nt, Homo sapiens
cccuccccaaagccacugga

SEQ ID NO: 746460 - RNA, 15 nt, Homo sapiens
cccuccccugccauu

SEQ ID NO: 746461 - RNA, 18 nt, Homo sapiens
cccuccuggcucuugaua

SEQ ID NO: 746462 - RNA, 12 nt, Homo sapiens
cccuccuguaaa

SEQ ID NO: 746463 - RNA, 15 nt, Homo sapiens
cccuccuuggcuuua

SEQ ID NO: 746464 - RNA, 21 nt, Homo sapiens
cccuccuuggcuuuaugcaaa

SEQ ID NO: 746465 - RNA, 17 nt, Homo sapiens
cccuccuugggcacuuu

SEQ ID NO: 746466 - RNA, 21 nt, Homo sapiens
cccucgucaucaggugcauag

SEQ ID NO: 746467 - RNA, 17 nt, Homo sapiens
cccucgugcgcaucuca

SEQ ID NO: 746468 - RNA, 21 nt, Homo sapiens
cccucguggccagcccggcug

SEQ ID NO: 746469 - RNA, 19 nt, Homo sapiens
cccucuagaaauuuuucag

SEQ ID NO: 746470 - RNA, 13 nt, Homo sapiens
cccucucagugcc

SEQ ID NO: 746471 - RNA, 13 nt, Homo sapiens
cccucuccaaagg

SEQ ID NO: 746472 - RNA, 17 nt, Homo sapiens
cccucucccgccagacu

SEQ ID NO: 746473 - RNA, 22 nt, Homo sapiens
cccucuccuuccuuacccaaac

SEQ ID NO: 746474 - RNA, 13 nt, Homo sapiens
cccucucugccag

SEQ ID NO: 746475 - RNA, 21 nt, Homo sapiens
cccucucugcuccuucacugu

SEQ ID NO: 746476 - RNA, 14 nt, Homo sapiens
cccucucuugcacc

SEQ ID NO: 746477 - RNA, 14 nt, Homo sapiens
cccucugcaaagcu

SEQ ID NO: 746478 - RNA, 14 nt, Homo sapiens
cccucuucauggau

SEQ ID NO: 746479 - RNA, 16 nt, Homo sapiens
cccucuuccugugauc

SEQ ID NO: 746480 - RNA, 23 nt, Homo sapiens
cccucuuuucugaucugcaguuu

SEQ ID NO: 746481 - RNA, 14 nt, Homo sapiens
cccucuuuuggcca

SEQ ID NO: 746482 - RNA, 13 nt, Homo sapiens
cccugaauucuuc

SEQ ID NO: 746483 - RNA, 21 nt, Homo sapiens
cccugacaucuggaaucugga

SEQ ID NO: 746484 - RNA, 19 nt, Homo sapiens
cccugaccucacugugacc

SEQ ID NO: 746485 - RNA, 18 nt, Homo sapiens
cccugacgugcagccaca

SEQ ID NO: 746486 - RNA, 17 nt, Homo sapiens
ccucaaaaaaagccuuu

SEQ ID NO: 746487 - RNA, 18 nt, Homo sapiens
ccucaaaccagucacuuu

SEQ ID NO: 746488 - RNA, 18 nt, Homo sapiens
ccucaaagaagucggaau

SEQ ID NO: 746489 - RNA, 22 nt, Homo sapiens
ccucaaagaagucggaauguca

SEQ ID NO: 746490 - RNA, 20 nt, Homo sapiens
ccucaacuccaggauuuagg

SEQ ID NO: 746491 - RNA, 17 nt, Homo sapiens
ccucaagacucaccuca

SEQ ID NO: 746492 - RNA, 17 nt, Homo sapiens
ccucaagccccauuucc

SEQ ID NO: 746493 - RNA, 12 nt, Homo sapiens
ccucaaggacaa

SEQ ID NO: 746494 - RNA, 18 nt, Homo sapiens
ccucaagggccaggacuu

SEQ ID NO: 746495 - RNA, 13 nt, Homo sapiens
ccucaauucacau

SEQ ID NO: 746496 - RNA, 21 nt, Homo sapiens
ccucacaucuuucacacuucc

SEQ ID NO: 746497 - RNA, 16 nt, Homo sapiens
ccucaccauccagugg

SEQ ID NO: 746498 - RNA, 21 nt, Homo sapiens
ccucacccccagguguugcca

SEQ ID NO: 746499 - RNA, 11 nt, Homo sapiens
ccucaccugcu

SEQ ID NO: 746500 - RNA, 23 nt, Homo sapiens
ccucacugcuguagacauuugcu

SEQ ID NO: 746501 - RNA, 16 nt, Homo sapiens
ccucacuguccuguga

SEQ ID NO: 746502 - RNA, 14 nt, Homo sapiens
ccucacuguggaau

SEQ ID NO: 746503 - RNA, 14 nt, Homo sapiens
ccucagaaagggau

SEQ ID NO: 746504 - RNA, 13 nt, Homo sapiens
ccucagacauccc

SEQ ID NO: 746505 - RNA, 19 nt, Homo sapiens
ccucagacuucaagaccau

SEQ ID NO: 746506 - RNA, 14 nt, Homo sapiens
ccucagagggccau

SEQ ID NO: 746507 - RNA, 14 nt, Homo sapiens
ccucagccaugagg

SEQ ID NO: 746508 - RNA, 22 nt, Homo sapiens
ccucagccucccaaagugcugg

SEQ ID NO: 746509 - RNA, 21 nt, Homo sapiens
ccucagccuugaaaaacaagu

SEQ ID NO: 746510 - RNA, 15 nt, Homo sapiens
ccucagccuugccag

SEQ ID NO: 746511 - RNA, 19 nt, Homo sapiens
ccucagcgggggccuugaa

SEQ ID NO: 746512 - RNA, 18 nt, Homo sapiens
ccucagcugcacauuccu

SEQ ID NO: 746513 - RNA, 17 nt, Homo sapiens
ccucagcuucuucacag

SEQ ID NO: 746514 - RNA, 20 nt, Homo sapiens
ccucagggguuaagagcuca

SEQ ID NO: 746515 - RNA, 20 nt, Homo sapiens
ccucagguggccccaguuca

SEQ ID NO: 746516 - RNA, 17 nt, Homo sapiens
ccucaguagucccugca

SEQ ID NO: 746517 - RNA, 14 nt, Homo sapiens
ccucagugacauca

SEQ ID NO: 746518 - RNA, 14 nt, Homo sapiens
ccucagugagauaa

SEQ ID NO: 746519 - RNA, 13 nt, Homo sapiens
ccucagugccuuc

SEQ ID NO: 746520 - RNA, 18 nt, Homo sapiens
ccucaguggcucugggua

SEQ ID NO: 746521 - RNA, 21 nt, Homo sapiens
ccucaguguaccacuacuuag

SEQ ID NO: 746522 - RNA, 20 nt, Homo sapiens
ccucauauggcccaguguca

SEQ ID NO: 746523 - RNA, 14 nt, Homo sapiens
ccucauccaaaguu

SEQ ID NO: 746524 - RNA, 15 nt, Homo sapiens
ccucauccugagaga

SEQ ID NO: 746525 - RNA, 18 nt, Homo sapiens
ccucaucucucugcccaa

SEQ ID NO: 746526 - RNA, 18 nt, Homo sapiens
ccucauggcucuggcaca

SEQ ID NO: 746527 - RNA, 21 nt, Homo sapiens
ccuccaaagggcagugggugg

SEQ ID NO: 746528 - RNA, 16 nt, Homo sapiens
ccuccaaaggucugau

SEQ ID NO: 746529 - RNA, 22 nt, Homo sapiens
ccuccaacgccccuguggccaa

SEQ ID NO: 746530 - RNA, 13 nt, Homo sapiens
ccuccaagcauuu

SEQ ID NO: 746531 - RNA, 21 nt, Homo sapiens
ccuccaagccauucacuuccc

SEQ ID NO: 746532 - RNA, 12 nt, Homo sapiens
ccuccacagaga

SEQ ID NO: 746533 - RNA, 19 nt, Homo sapiens
ccuccacagcuaccucuuc

SEQ ID NO: 746534 - RNA, 18 nt, Homo sapiens
ccuccaccaugcacucac

SEQ ID NO: 746535 - RNA, 13 nt, Homo sapiens
ccuccaccugaua

SEQ ID NO: 746536 - RNA, 19 nt, Homo sapiens
ccuccacuccagcucugag

SEQ ID NO: 746537 - RNA, 18 nt, Homo sapiens
ccuccagaagcugcuccu

SEQ ID NO: 746538 - RNA, 14 nt, Homo sapiens
ccuccagcacacac

SEQ ID NO: 746539 - RNA, 20 nt, Homo sapiens
ccuccagccgcuggcaacaa

SEQ ID NO: 746540 - RNA, 17 nt, Homo sapiens
ccuccagcuucaggcag

SEQ ID NO: 746541 - RNA, 18 nt, Homo sapiens
ccuccagggugauuuuau

SEQ ID NO: 746542 - RNA, 16 nt, Homo sapiens
ccuccaugaacaucau

SEQ ID NO: 746543 - RNA, 23 nt, Homo sapiens
ccuccaugaacaucauggacuga

SEQ ID NO: 746544 - RNA, 11 nt, Homo sapiens
ccuccauuccu

SEQ ID NO: 746545 - RNA, 12 nt, Homo sapiens
ccuccauuugca

SEQ ID NO: 746546 - RNA, 20 nt, Homo sapiens
ccucccaaagugcugagauu

SEQ ID NO: 746547 - RNA, 15 nt, Homo sapiens
ccucccaaccccagg

SEQ ID NO: 746548 - RNA, 14 nt, Homo sapiens
ccucccaagguccu

SEQ ID NO: 746549 - RNA, 19 nt, Homo sapiens
ccucccaagguccucucag

SEQ ID NO: 746550 - RNA, 12 nt, Homo sapiens
ccucccacaauu

SEQ ID NO: 746551 - RNA, 18 nt, Homo sapiens
ccucccagaaugcugggu

SEQ ID NO: 746552 - RNA, 20 nt, Homo sapiens
ccucccauaauugcuuugcc

SEQ ID NO: 746553 - RNA, 15 nt, Homo sapiens
ccuccccacagugcc

SEQ ID NO: 746554 - RNA, 21 nt, Homo sapiens
ccuccccagcgccaucugugu

SEQ ID NO: 746555 - RNA, 16 nt, Homo sapiens
ccucccccaugggcug

SEQ ID NO: 746556 - RNA, 16 nt, Homo sapiens
ccucccccccaugcac

SEQ ID NO: 746557 - RNA, 11 nt, Homo sapiens
ccucccggggc

SEQ ID NO: 746558 - RNA, 16 nt, Homo sapiens
ccucccuccuggggaa

SEQ ID NO: 746559 - RNA, 22 nt, Homo sapiens
ccucccucucucuucugcucca

SEQ ID NO: 746560 - RNA, 20 nt, Homo sapiens
ccucccuguuccccagagaa

SEQ ID NO: 746561 - RNA, 15 nt, Homo sapiens
ccuccgccauucuca

SEQ ID NO: 746562 - RNA, 15 nt, Homo sapiens
ccuccgcccugccac

SEQ ID NO: 746563 - RNA, 16 nt, Homo sapiens
ccuccucaggcacaca

SEQ ID NO: 746564 - RNA, 13 nt, Homo sapiens
ccuccucauggca

SEQ ID NO: 746565 - RNA, 15 nt, Homo sapiens
ccuccuccugggcua

SEQ ID NO: 746566 - RNA, 19 nt, Homo sapiens
ccuccucggaucaccgaga

SEQ ID NO: 746567 - RNA, 21 nt, Homo sapiens
ccuccucucaguguuuuggac

SEQ ID NO: 746568 - RNA, 22 nt, Homo sapiens
ccuccugcuaacuccuagcuga

SEQ ID NO: 746569 - RNA, 19 nt, Homo sapiens
ccuccuggagcucuguggg

SEQ ID NO: 746570 - RNA, 19 nt, Homo sapiens
ccuccugggcuauauuccu

SEQ ID NO: 746571 - RNA, 20 nt, Homo sapiens
ccuccugugcuauuuguaca

SEQ ID NO: 746572 - RNA, 18 nt, Homo sapiens
ccuccuuccuugaccagc

SEQ ID NO: 746573 - RNA, 16 nt, Homo sapiens
ccuccuuggcuuuaug

SEQ ID NO: 746574 - RNA, 15 nt, Homo sapiens
ccuccuuggugccug

SEQ ID NO: 746575 - RNA, 13 nt, Homo sapiens
ccucgcaugacug

SEQ ID NO: 746576 - RNA, 16 nt, Homo sapiens
ccucgcaugacuguua

SEQ ID NO: 746577 - RNA, 19 nt, Homo sapiens
ccucgcugccagaugauug

SEQ ID NO: 746578 - RNA, 20 nt, Homo sapiens
ccucgggaagccccauccaa

SEQ ID NO: 746579 - RNA, 19 nt, Homo sapiens
ccucgggccccauccucau

SEQ ID NO: 746580 - RNA, 21 nt, Homo sapiens
ccucgggcgagucacugccuc

SEQ ID NO: 746581 - RNA, 17 nt, Homo sapiens
ccucgggugugcuaugg

SEQ ID NO: 746582 - RNA, 15 nt, Homo sapiens
ccucgguaucuggcu

SEQ ID NO: 746583 - RNA, 22 nt, Homo sapiens
ccucguuggaagaggaacagca

SEQ ID NO: 746584 - RNA, 19 nt, Homo sapiens
ccucuaacucacugccuag

SEQ ID NO: 746585 - RNA, 16 nt, Homo sapiens
ccucuacuuaaugaga

SEQ ID NO: 746586 - RNA, 15 nt, Homo sapiens
ccucuagaagccaag

SEQ ID NO: 746587 - RNA, 16 nt, Homo sapiens
ccucuagagucacuga

SEQ ID NO: 746588 - RNA, 19 nt, Homo sapiens
ccucucagaacauacugau

SEQ ID NO: 746589 - RNA, 22 nt, Homo sapiens
ccucucagauucuuaucuggca

SEQ ID NO: 746590 - RNA, 19 nt, Homo sapiens
ccucucagcugcugggacg

SEQ ID NO: 746591 - RNA, 21 nt, Homo sapiens
ccucucaguuguugaaacacu

SEQ ID NO: 746592 - RNA, 17 nt, Homo sapiens
ccucucaucaguguccu

SEQ ID NO: 746593 - RNA, 12 nt, Homo sapiens
ccucucauucca

SEQ ID NO: 746594 - RNA, 16 nt, Homo sapiens
ccucuccaguuugcac

SEQ ID NO: 746595 - RNA, 22 nt, Homo sapiens
ccucucccaaaaaacuacuucu

SEQ ID NO: 746596 - RNA, 17 nt, Homo sapiens
ccucuccuuugugacuu

SEQ ID NO: 746597 - RNA, 16 nt, Homo sapiens
ccucucggugcuccau

SEQ ID NO: 746598 - RNA, 19 nt, Homo sapiens
ccucucucuucugcuccac

SEQ ID NO: 746599 - RNA, 20 nt, Homo sapiens
ccucucugagucaaauccag

SEQ ID NO: 746600 - RNA, 22 nt, Homo sapiens
ccucucugagucaaauccagug

SEQ ID NO: 746601 - RNA, 17 nt, Homo sapiens
cuccccugcccuggucc

SEQ ID NO: 746602 - RNA, 18 nt, Homo sapiens
cucccgugggcaucucaa

SEQ ID NO: 746603 - RNA, 14 nt, Homo sapiens
cucccuaccuugcc

SEQ ID NO: 746604 - RNA, 17 nt, Homo sapiens
cucccuaggcugcccac

SEQ ID NO: 746605 - RNA, 16 nt, Homo sapiens
cucccucaaagcacac

SEQ ID NO: 746606 - RNA, 23 nt, Homo sapiens
cucccucagcuccgcaagcauca

SEQ ID NO: 746607 - RNA, 15 nt, Homo sapiens
cucccucagcucucu

SEQ ID NO: 746608 - RNA, 16 nt, Homo sapiens
cucccuccccagugca

SEQ ID NO: 746609 - RNA, 13 nt, Homo sapiens
cucccucucucug

SEQ ID NO: 746610 - RNA, 22 nt, Homo sapiens
cucccucucucuucugcuccac

SEQ ID NO: 746611 - RNA, 21 nt, Homo sapiens
cucccugaagccuuugcauuu

SEQ ID NO: 746612 - RNA, 18 nt, Homo sapiens
cucccugacccacugugc

SEQ ID NO: 746613 - RNA, 16 nt, Homo sapiens
cucccugcaagaaauc

SEQ ID NO: 746614 - RNA, 23 nt, Homo sapiens
cucccugcagaugccacccuagc

SEQ ID NO: 746615 - RNA, 12 nt, Homo sapiens
cucccugccacc

SEQ ID NO: 746616 - RNA, 17 nt, Homo sapiens
cucccugcugugccaug

SEQ ID NO: 746617 - RNA, 14 nt, Homo sapiens
cucccuggcacuga

SEQ ID NO: 746618 - RNA, 15 nt, Homo sapiens
cucccuggggaccag

SEQ ID NO: 746619 - RNA, 21 nt, Homo sapiens
cucccuggugccucugugcac

SEQ ID NO: 746620 - RNA, 20 nt, Homo sapiens
cucccuguagcucugccucc

SEQ ID NO: 746621 - RNA, 18 nt, Homo sapiens
cucccuguuuuaauucaa

SEQ ID NO: 746622 - RNA, 14 nt, Homo sapiens
cucccuguuuuagu

SEQ ID NO: 746623 - RNA, 14 nt, Homo sapiens
cucccuuugaugau

SEQ ID NO: 746624 - RNA, 20 nt, Homo sapiens
cuccgagaggugggccaguc

SEQ ID NO: 746625 - RNA, 19 nt, Homo sapiens
cuccgcagaccugcuguga

SEQ ID NO: 746626 - RNA, 23 nt, Homo sapiens
cuccggagaugaauaugagcuca

SEQ ID NO: 746627 - RNA, 18 nt, Homo sapiens
cuccgggcaaauggcuga

SEQ ID NO: 746628 - RNA, 12 nt, Homo sapiens
cuccggggagcg

SEQ ID NO: 746629 - RNA, 14 nt, Homo sapiens
cuccgucucaaaaa

SEQ ID NO: 746630 - RNA, 17 nt, Homo sapiens
cuccguguggacugugc

SEQ ID NO: 746631 - RNA, 14 nt, Homo sapiens
cuccuaaagcuuuu

SEQ ID NO: 746632 - RNA, 15 nt, Homo sapiens
cuccuaacaaaagaa

SEQ ID NO: 746633 - RNA, 19 nt, Homo sapiens
cuccucaccucaugcccac

SEQ ID NO: 746634 - RNA, 20 nt, Homo sapiens
cuccucacuguauccagguu

SEQ ID NO: 746635 - RNA, 19 nt, Homo sapiens
cuccucaggcacacagcua

SEQ ID NO: 746636 - RNA, 11 nt, Homo sapiens
cuccucaggcu

SEQ ID NO: 746637 - RNA, 18 nt, Homo sapiens
cuccucaguaaauguaca

SEQ ID NO: 746638 - RNA, 13 nt, Homo sapiens
cuccuccaugcag

SEQ ID NO: 746639 - RNA, 15 nt, Homo sapiens
cuccuccauucccua

SEQ ID NO: 746640 - RNA, 21 nt, Homo sapiens
cuccucccaggaacugggcca

SEQ ID NO: 746641 - RNA, 18 nt, Homo sapiens
cuccucccuaaugcucac

SEQ ID NO: 746642 - RNA, 22 nt, Homo sapiens
cuccuccuacccuuccagugcc

SEQ ID NO: 746643 - RNA, 19 nt, Homo sapiens
cuccuccuuuguuuaauaa

SEQ ID NO: 746644 - RNA, 14 nt, Homo sapiens
cuccucgcugccag

SEQ ID NO: 746645 - RNA, 14 nt, Homo sapiens
cuccucggagagca

SEQ ID NO: 746646 - RNA, 13 nt, Homo sapiens
cuccucggaggau

SEQ ID NO: 746647 - RNA, 21 nt, Homo sapiens
cuccucuaguaagaugcacug

SEQ ID NO: 746648 - RNA, 18 nt, Homo sapiens
cuccucugcagugccuug

SEQ ID NO: 746649 - RNA, 15 nt, Homo sapiens
cuccucugcccuuca

SEQ ID NO: 746650 - RNA, 13 nt, Homo sapiens
cuccucuguaaug

SEQ ID NO: 746651 - RNA, 16 nt, Homo sapiens
cuccucuucagaggag

SEQ ID NO: 746652 - RNA, 20 nt, Homo sapiens
cuccugaccucaggugaucc

SEQ ID NO: 746653 - RNA, 19 nt, Homo sapiens
cuccugaccucaggugauu

SEQ ID NO: 746654 - RNA, 23 nt, Homo sapiens
cuccugagauaauaaugaaggca

SEQ ID NO: 746655 - RNA, 20 nt, Homo sapiens
cuccugaguagaugggacua

SEQ ID NO: 746656 - RNA, 20 nt, Homo sapiens
cuccugaguagcugggacua

SEQ ID NO: 746657 - RNA, 13 nt, Homo sapiens
cuccugcagggau

SEQ ID NO: 746658 - RNA, 15 nt, Homo sapiens
cuccugcccaggaga

SEQ ID NO: 746659 - RNA, 12 nt, Homo sapiens
cuccugccugag

SEQ ID NO: 746660 - RNA, 14 nt, Homo sapiens
cuccuggaagcaca

SEQ ID NO: 746661 - RNA, 21 nt, Homo sapiens
cuccuggccucaagugaucug

SEQ ID NO: 746662 - RNA, 17 nt, Homo sapiens
cuccugggcuauauucc

SEQ ID NO: 746663 - RNA, 13 nt, Homo sapiens
cuccugggcucag

SEQ ID NO: 746664 - RNA, 14 nt, Homo sapiens
cuccuggucuguga

SEQ ID NO: 746665 - RNA, 20 nt, Homo sapiens
cuccuguagccacuggcaua

SEQ ID NO: 746666 - RNA, 14 nt, Homo sapiens
cuccugugcaacuu

SEQ ID NO: 746667 - RNA, 18 nt, Homo sapiens
cuccugugggagaucuuc

SEQ ID NO: 746668 - RNA, 20 nt, Homo sapiens
cuccugugggagaucuucac

SEQ ID NO: 746669 - RNA, 13 nt, Homo sapiens
cuccugugugugg

SEQ ID NO: 746670 - RNA, 13 nt, Homo sapiens
cuccuguuugcag

SEQ ID NO: 746671 - RNA, 23 nt, Homo sapiens
cuccuuauagacacuugcuccca

SEQ ID NO: 746672 - RNA, 13 nt, Homo sapiens
cuccuuccagacc

SEQ ID NO: 746673 - RNA, 21 nt, Homo sapiens
cuccuuccuagccuugcacuu

SEQ ID NO: 746674 - RNA, 23 nt, Homo sapiens
cuccuuccugucuuccugcauuc

SEQ ID NO: 746675 - RNA, 18 nt, Homo sapiens
cuccuuccuugaccagca

SEQ ID NO: 746676 - RNA, 23 nt, Homo sapiens
cuccuugaaguucguggaaggcu

SEQ ID NO: 746677 - RNA, 13 nt, Homo sapiens
cuccuuggcuuua

SEQ ID NO: 746678 - RNA, 20 nt, Homo sapiens
cuccuuggcuuuaugcaaau

SEQ ID NO: 746679 - RNA, 21 nt, Homo sapiens
cuccuugguaaauacaacaca

SEQ ID NO: 746680 - RNA, 16 nt, Homo sapiens
cuccuuugcaccugau

SEQ ID NO: 746681 - RNA, 15 nt, Homo sapiens
cuccuuuguucugua

SEQ ID NO: 746682 - RNA, 15 nt, Homo sapiens
cuccuuuugaccaaa

SEQ ID NO: 746683 - RNA, 18 nt, Homo sapiens
cuccuuuugaccaaauaa

SEQ ID NO: 746684 - RNA, 17 nt, Homo sapiens
cucgaaucucugugccu

SEQ ID NO: 746685 - RNA, 16 nt, Homo sapiens
cucgacggcacgcacu

SEQ ID NO: 746686 - RNA, 15 nt, Homo sapiens
cucgagacacaguga

SEQ ID NO: 746687 - RNA, 16 nt, Homo sapiens
cucgagcaguccugcc

SEQ ID NO: 746688 - RNA, 14 nt, Homo sapiens
cucgcacucuggug

SEQ ID NO: 746689 - RNA, 15 nt, Homo sapiens
cucgcagcaaagugu

SEQ ID NO: 746690 - RNA, 15 nt, Homo sapiens
cucgcaugacuguua

SEQ ID NO: 746691 - RNA, 16 nt, Homo sapiens
cucgccacgaacuagg

SEQ ID NO: 746692 - RNA, 14 nt, Homo sapiens
cucgcccgcccacu

SEQ ID NO: 746693 - RNA, 21 nt, Homo sapiens
cucgccuguuggggaccucac

SEQ ID NO: 746694 - RNA, 21 nt, Homo sapiens
cucggagggauggagaaagaa

SEQ ID NO: 746695 - RNA, 12 nt, Homo sapiens
cucggaugacac

SEQ ID NO: 746696 - RNA, 18 nt, Homo sapiens
cucggcaccuccccggcc

SEQ ID NO: 746697 - RNA, 17 nt, Homo sapiens
cucggccacgucccugc

SEQ ID NO: 746698 - RNA, 20 nt, Homo sapiens
cucgggcgagucacugccuc

SEQ ID NO: 746699 - RNA, 19 nt, Homo sapiens
cucgguauuaauccaaagc

SEQ ID NO: 746700 - RNA, 24 nt, Homo sapiens
cucgguggcauacagacuggggac

SEQ ID NO: 746701 - RNA, 14 nt, Homo sapiens
cucguccacagggg

SEQ ID NO: 746702 - RNA, 23 nt, Homo sapiens
cucguuuuaagaaacuagcagau

SEQ ID NO: 746703 - RNA, 15 nt, Homo sapiens
cucuaaaagaaaaag

SEQ ID NO: 746704 - RNA, 16 nt, Homo sapiens
cucuaaaauucuaguc

SEQ ID NO: 746705 - RNA, 20 nt, Homo sapiens
cucuaaagaaaaaugccugu

SEQ ID NO: 746706 - RNA, 17 nt, Homo sapiens
cucuaacaaacaagaga

SEQ ID NO: 746707 - RNA, 12 nt, Homo sapiens
cucuaacuucaa

SEQ ID NO: 746708 - RNA, 16 nt, Homo sapiens
cucuaagcacauucca

SEQ ID NO: 746709 - RNA, 17 nt, Homo sapiens
cucuaaugucugcagcu

SEQ ID NO: 746710 - RNA, 19 nt, Homo sapiens
cucuaauucggauuugcca

SEQ ID NO: 746711 - RNA, 17 nt, Homo sapiens
cucuacaaaaaccaaaa

SEQ ID NO: 746712 - RNA, 16 nt, Homo sapiens
cucuacagacuucucc

SEQ ID NO: 746713 - RNA, 17 nt, Homo sapiens
cucuaccccugcuccca

SEQ ID NO: 746714 - RNA, 20 nt, Homo sapiens
cucuacccuggcacuauaau

SEQ ID NO: 746715 - RNA, 14 nt, Homo sapiens
cucuacgugcuccu

SEQ ID NO: 746716 - RNA, 22 nt, Homo sapiens
cugauaaacauuaaacacugua

SEQ ID NO: 746717 - RNA, 14 nt, Homo sapiens
cugauaagcauuga

SEQ ID NO: 746718 - RNA, 17 nt, Homo sapiens
cugauaauaauugauca

SEQ ID NO: 746719 - RNA, 13 nt, Homo sapiens
cugauaaugcuca

SEQ ID NO: 746720 - RNA, 14 nt, Homo sapiens
cugauaaugcucac

SEQ ID NO: 746721 - RNA, 15 nt, Homo sapiens
cugauaaugcucacu

SEQ ID NO: 746722 - RNA, 14 nt, Homo sapiens
cugauacauuaaaa

SEQ ID NO: 746723 - RNA, 19 nt, Homo sapiens
cugauacuuugacaguguu

SEQ ID NO: 746724 - RNA, 16 nt, Homo sapiens
cugauagucaccugcu

SEQ ID NO: 746725 - RNA, 18 nt, Homo sapiens
cugauaugggacugagcc

SEQ ID NO: 746726 - RNA, 19 nt, Homo sapiens
cugauaugggacugagccu

SEQ ID NO: 746727 - RNA, 18 nt, Homo sapiens
cugauccagagcacagau

SEQ ID NO: 746728 - RNA, 19 nt, Homo sapiens
cugauccauuaucuauuua

SEQ ID NO: 746729 - RNA, 19 nt, Homo sapiens
cugaucuuauucuguggug

SEQ ID NO: 746730 - RNA, 13 nt, Homo sapiens
cugaugacuuuau

SEQ ID NO: 746731 - RNA, 19 nt, Homo sapiens
cugaugacuuuauccugag

SEQ ID NO: 746732 - RNA, 21 nt, Homo sapiens
cugaugacuuuauccugaguc

SEQ ID NO: 746733 - RNA, 22 nt, Homo sapiens
cugaugacuuuauccugagucc

SEQ ID NO: 746734 - RNA, 15 nt, Homo sapiens
cugaugauacaugca

SEQ ID NO: 746735 - RNA, 15 nt, Homo sapiens
cugaugcugccccuc

SEQ ID NO: 746736 - RNA, 14 nt, Homo sapiens
cugauggauuccaa

SEQ ID NO: 746737 - RNA, 18 nt, Homo sapiens
cugauggccuuaauuucc

SEQ ID NO: 746738 - RNA, 17 nt, Homo sapiens
cugauguuaaaauucca

SEQ ID NO: 746739 - RNA, 18 nt, Homo sapiens
cugauguuaaaauuccau

SEQ ID NO: 746740 - RNA, 16 nt, Homo sapiens
cugauuaccugccaau

SEQ ID NO: 746741 - RNA, 15 nt, Homo sapiens
cugauucacugcaug

SEQ ID NO: 746742 - RNA, 14 nt, Homo sapiens
cugauuuacauuca

SEQ ID NO: 746743 - RNA, 17 nt, Homo sapiens
cugauuuacuuaauuca

SEQ ID NO: 746744 - RNA, 16 nt, Homo sapiens
cugauuuauugaaauu

SEQ ID NO: 746745 - RNA, 17 nt, Homo sapiens
cugauuuuuagcuuuac

SEQ ID NO: 746746 - RNA, 16 nt, Homo sapiens
cugauuuuugucccag

SEQ ID NO: 746747 - RNA, 22 nt, Homo sapiens
cugcaaaggcgucugaaugugu

SEQ ID NO: 746748 - RNA, 13 nt, Homo sapiens
cugcaaaugcuau

SEQ ID NO: 746749 - RNA, 22 nt, Homo sapiens
cugcaaccaacuacaaccaagc

SEQ ID NO: 746750 - RNA, 12 nt, Homo sapiens
cugcaagacaga

SEQ ID NO: 746751 - RNA, 12 nt, Homo sapiens
cugcaagagcca

SEQ ID NO: 746752 - RNA, 17 nt, Homo sapiens
cugcaauaaaaugauau

SEQ ID NO: 746753 - RNA, 18 nt, Homo sapiens
cugcaauaugaauucaag

SEQ ID NO: 746754 - RNA, 16 nt, Homo sapiens
cugcacaaaagcagau

SEQ ID NO: 746755 - RNA, 13 nt, Homo sapiens
cugcacacagaau

SEQ ID NO: 746756 - RNA, 15 nt, Homo sapiens
cugcacacaggacag

SEQ ID NO: 746757 - RNA, 19 nt, Homo sapiens
cugcacacagugacuuccu

SEQ ID NO: 746758 - RNA, 21 nt, Homo sapiens
cugcacagauggauuugccug

SEQ ID NO: 746759 - RNA, 17 nt, Homo sapiens
cugcacaugucuuguac

SEQ ID NO: 746760 - RNA, 19 nt, Homo sapiens
cugcacaugucuuguacau

SEQ ID NO: 746761 - RNA, 13 nt, Homo sapiens
cugcacauuccug

SEQ ID NO: 746762 - RNA, 20 nt, Homo sapiens
cugcaccuacccacaugcac

SEQ ID NO: 746763 - RNA, 16 nt, Homo sapiens
cugcaccuacugagga

SEQ ID NO: 746764 - RNA, 20 nt, Homo sapiens
cugcaccugauuaguugaaa

SEQ ID NO: 746765 - RNA, 12 nt, Homo sapiens
cugcaccuguca

SEQ ID NO: 746766 - RNA, 21 nt, Homo sapiens
cugcaccuuuuugcaugauau

SEQ ID NO: 746767 - RNA, 20 nt, Homo sapiens
cugcacuaauuugauguuua

SEQ ID NO: 746768 - RNA, 20 nt, Homo sapiens
cugcacuccagccugggcaa

SEQ ID NO: 746769 - RNA, 18 nt, Homo sapiens
cugcacucccaccugaca

SEQ ID NO: 746770 - RNA, 12 nt, Homo sapiens
cugcacugcaua

SEQ ID NO: 746771 - RNA, 16 nt, Homo sapiens
cugcacugucugagaa

SEQ ID NO: 746772 - RNA, 15 nt, Homo sapiens
cugcagacgucugcc

SEQ ID NO: 746773 - RNA, 15 nt, Homo sapiens
cugcagagugcaaca

SEQ ID NO: 746774 - RNA, 13 nt, Homo sapiens
cugcagcaaacac

SEQ ID NO: 746775 - RNA, 17 nt, Homo sapiens
cugcagcagcagggaaa

SEQ ID NO: 746776 - RNA, 15 nt, Homo sapiens
cugcagcauguugcu

SEQ ID NO: 746777 - RNA, 18 nt, Homo sapiens
cugcagcccaaaacccag

SEQ ID NO: 746778 - RNA, 21 nt, Homo sapiens
cugcagccccgcgccuccuuc

SEQ ID NO: 746779 - RNA, 12 nt, Homo sapiens
cugcagccucac

SEQ ID NO: 746780 - RNA, 18 nt, Homo sapiens
cugcagggacuccaugcu

SEQ ID NO: 746781 - RNA, 11 nt, Homo sapiens
cugcagguguu

SEQ ID NO: 746782 - RNA, 20 nt, Homo sapiens
cugcaguaugggaucugaua

SEQ ID NO: 746783 - RNA, 21 nt, Homo sapiens
cugcagucaacaguucaaaga

SEQ ID NO: 746784 - RNA, 15 nt, Homo sapiens
cugcauacccgggca

SEQ ID NO: 746785 - RNA, 12 nt, Homo sapiens
cugcauaugaua

SEQ ID NO: 746786 - RNA, 18 nt, Homo sapiens
cugcaucccgauaccuca

SEQ ID NO: 746787 - RNA, 13 nt, Homo sapiens
cugcaucucaaaa

SEQ ID NO: 746788 - RNA, 16 nt, Homo sapiens
cugcaugcugaaacaa

SEQ ID NO: 746789 - RNA, 19 nt, Homo sapiens
cugcauggaccuaacauuc

SEQ ID NO: 746790 - RNA, 20 nt, Homo sapiens
cugcauguaccauuugcaug

SEQ ID NO: 746791 - RNA, 15 nt, Homo sapiens
cugcauguuacauaa

SEQ ID NO: 746792 - RNA, 16 nt, Homo sapiens
cugcauuuacacacac

SEQ ID NO: 746793 - RNA, 22 nt, Homo sapiens
cugcauuugccugucaugcgca

SEQ ID NO: 746794 - RNA, 14 nt, Homo sapiens
cugccaaacacauu

SEQ ID NO: 746795 - RNA, 14 nt, Homo sapiens
cugccaaccagagc

SEQ ID NO: 746796 - RNA, 23 nt, Homo sapiens
cugccaaggaaacccccagugua

SEQ ID NO: 746797 - RNA, 14 nt, Homo sapiens
cugccagagcuuug

SEQ ID NO: 746798 - RNA, 19 nt, Homo sapiens
cugccagcaggggugugau

SEQ ID NO: 746799 - RNA, 17 nt, Homo sapiens
cugccauccaugugcua

SEQ ID NO: 746800 - RNA, 21 nt, Homo sapiens
cugccauccaugugcuaguca

SEQ ID NO: 746801 - RNA, 17 nt, Homo sapiens
cugccaucuagccagcc

SEQ ID NO: 746802 - RNA, 17 nt, Homo sapiens
cugccaugccacugcca

SEQ ID NO: 746803 - RNA, 22 nt, Homo sapiens
cugccaugccuccccaaauugg

SEQ ID NO: 746804 - RNA, 19 nt, Homo sapiens
cugccaugguaaucagaaa

SEQ ID NO: 746805 - RNA, 13 nt, Homo sapiens
cugccauguacua

SEQ ID NO: 746806 - RNA, 17 nt, Homo sapiens
cugccauguugccccuu

SEQ ID NO: 746807 - RNA, 21 nt, Homo sapiens
cugccauuacagagguauuaa

SEQ ID NO: 746808 - RNA, 11 nt, Homo sapiens
cugccauuucc

SEQ ID NO: 746809 - RNA, 20 nt, Homo sapiens
cugcccaaacauaaagagaa

SEQ ID NO: 746810 - RNA, 13 nt, Homo sapiens
cugcccagugcaa

SEQ ID NO: 746811 - RNA, 14 nt, Homo sapiens
cugcccagugcaaa

SEQ ID NO: 746812 - RNA, 19 nt, Homo sapiens
cugcccagugcaaaccacu

SEQ ID NO: 746813 - RNA, 20 nt, Homo sapiens
cugccccaaacaaauaugca

SEQ ID NO: 746814 - RNA, 18 nt, Homo sapiens
cugccccaccccaccuca

SEQ ID NO: 746815 - RNA, 19 nt, Homo sapiens
cugccccacggcccuguca

SEQ ID NO: 746816 - RNA, 16 nt, Homo sapiens
cugccccuacccugga

SEQ ID NO: 746817 - RNA, 12 nt, Homo sapiens
cugccccucggg

SEQ ID NO: 746818 - RNA, 13 nt, Homo sapiens
cugccccuuccac

SEQ ID NO: 746819 - RNA, 21 nt, Homo sapiens
cugcccuccuuugccuuccac

SEQ ID NO: 746820 - RNA, 20 nt, Homo sapiens
cugcccucugggucccuccu

SEQ ID NO: 746821 - RNA, 20 nt, Homo sapiens
cugcccugcccccucggggg

SEQ ID NO: 746822 - RNA, 19 nt, Homo sapiens
cugcccuggguucuuccac

SEQ ID NO: 746823 - RNA, 18 nt, Homo sapiens
cugcccugguccagggaa

SEQ ID NO: 746824 - RNA, 17 nt, Homo sapiens
cugccgcccugcuccac

SEQ ID NO: 746825 - RNA, 15 nt, Homo sapiens
cugccgcuaccuccc

SEQ ID NO: 746826 - RNA, 21 nt, Homo sapiens
cugccggucgggcagccagca

SEQ ID NO: 746827 - RNA, 14 nt, Homo sapiens
cugccgucuucacu

SEQ ID NO: 746828 - RNA, 19 nt, Homo sapiens
cugccuaauaguaacuggu

SEQ ID NO: 746829 - RNA, 17 nt, Homo sapiens
cugccucagccucccaa

SEQ ID NO: 746830 - RNA, 17 nt, Homo sapiens
cugccucagggcccacc

SEQ ID NO: 746831 - RNA, 17 nt, Homo sapiens
cugccuccaccgagcca

SEQ ID NO: 746832 - RNA, 23 nt, Homo sapiens
cugccuccauucugaccauuuca

SEQ ID NO: 746833 - RNA, 15 nt, Homo sapiens
cugccucccuagcuu

SEQ ID NO: 746834 - RNA, 13 nt, Homo sapiens
cugccucugagau

SEQ ID NO: 746835 - RNA, 15 nt, Homo sapiens
cugccugaguuucca

SEQ ID NO: 746836 - RNA, 14 nt, Homo sapiens
cugccugcagagca

SEQ ID NO: 746837 - RNA, 17 nt, Homo sapiens
cugccugcaucuauucu

SEQ ID NO: 746838 - RNA, 18 nt, Homo sapiens
cugccuggccaggcccug

SEQ ID NO: 746839 - RNA, 20 nt, Homo sapiens
cugccuggcccccaaccuca

SEQ ID NO: 746840 - RNA, 20 nt, Homo sapiens
cugccuggggggcaggguua

SEQ ID NO: 746841 - RNA, 16 nt, Homo sapiens
cugccuguauuugaga

SEQ ID NO: 746842 - RNA, 20 nt, Homo sapiens
cugccuuccacaauucacua

SEQ ID NO: 746843 - RNA, 18 nt, Homo sapiens
cugccuugauuagacucc

SEQ ID NO: 746844 - RNA, 13 nt, Homo sapiens
cugccuugcaccu

SEQ ID NO: 746845 - RNA, 14 nt, Homo sapiens
cugccuugcugaca

SEQ ID NO: 746846 - RNA, 19 nt, Homo sapiens
cugccuuugcaccacggga

SEQ ID NO: 746847 - RNA, 15 nt, Homo sapiens
cugcgaggacaucaa

SEQ ID NO: 746848 - RNA, 16 nt, Homo sapiens
cugcgggacagaggac

SEQ ID NO: 746849 - RNA, 19 nt, Homo sapiens
cugcguguguauauuugua

SEQ ID NO: 746850 - RNA, 21 nt, Homo sapiens
cugcuaaagaaaggaacuaag

SEQ ID NO: 746851 - RNA, 14 nt, Homo sapiens
cugcuaaauaucac

SEQ ID NO: 746852 - RNA, 23 nt, Homo sapiens
cugcuaauaccucuuacuuugcu

SEQ ID NO: 746853 - RNA, 14 nt, Homo sapiens
cugcuaccaaaaca

SEQ ID NO: 746854 - RNA, 17 nt, Homo sapiens
cugcuagggaauaucaa

SEQ ID NO: 746855 - RNA, 14 nt, Homo sapiens
cugcuaugaccaug

SEQ ID NO: 746856 - RNA, 17 nt, Homo sapiens
cugcuaugaccaugaca

SEQ ID NO: 746857 - RNA, 19 nt, Homo sapiens
cugcuaugcuaaaccuccu

SEQ ID NO: 746858 - RNA, 13 nt, Homo sapiens
cugcucacuuuaa

SEQ ID NO: 746859 - RNA, 22 nt, Homo sapiens
cugcucagaaugccgcaugaca

SEQ ID NO: 746860 - RNA, 22 nt, Homo sapiens
cugcucagcgcgucucagcuca

SEQ ID NO: 746861 - RNA, 15 nt, Homo sapiens
cugcucauccaaagu

SEQ ID NO: 746862 - RNA, 14 nt, Homo sapiens
cugcuccaccacau

SEQ ID NO: 746863 - RNA, 14 nt, Homo sapiens
cugcuccaccagca

SEQ ID NO: 746864 - RNA, 22 nt, Homo sapiens
cugcuccaccagcagcauggca

SEQ ID NO: 746865 - RNA, 14 nt, Homo sapiens
cugcuccacugggu

SEQ ID NO: 746866 - RNA, 16 nt, Homo sapiens
cugcuccaucaccugg

SEQ ID NO: 746867 - RNA, 20 nt, Homo sapiens
cugcucccaccaccagugag

SEQ ID NO: 746868 - RNA, 13 nt, Homo sapiens
cugcucccauucc

SEQ ID NO: 746869 - RNA, 22 nt, Homo sapiens
cugcucccugacagcaccugaa

SEQ ID NO: 746870 - RNA, 21 nt, Homo sapiens
cugcucuagugggacagccca

SEQ ID NO: 746871 - RNA, 21 nt, Homo sapiens
cugcucugcuccugaagcccu

SEQ ID NO: 746872 - RNA, 22 nt, Homo sapiens
cugcucuuucucugccagugac

SEQ ID NO: 746873 - RNA, 14 nt, Homo sapiens
cugcugaagcugcu

SEQ ID NO: 746874 - RNA, 11 nt, Homo sapiens
cugcugaauaa

SEQ ID NO: 746875 - RNA, 23 nt, Homo sapiens
cugcugaccaauugugcugccau

SEQ ID NO: 746876 - RNA, 18 nt, Homo sapiens
cugcugagugcaccacuu

SEQ ID NO: 746877 - RNA, 15 nt, Homo sapiens
cugcugcaccuugua

SEQ ID NO: 746878 - RNA, 15 nt, Homo sapiens
cugcugcuaccagcg

SEQ ID NO: 746879 - RNA, 12 nt, Homo sapiens
cugcugcuggug

SEQ ID NO: 746880 - RNA, 20 nt, Homo sapiens
cugcugcuugaguugccuga

SEQ ID NO: 746881 - RNA, 18 nt, Homo sapiens
cugcuggaaggggcagca

SEQ ID NO: 746882 - RNA, 15 nt, Homo sapiens
cugcugggaccugcu

SEQ ID NO: 746883 - RNA, 11 nt, Homo sapiens
cugcugugaac

SEQ ID NO: 746884 - RNA, 13 nt, Homo sapiens
cugcuguuuccag

SEQ ID NO: 746885 - RNA, 15 nt, Homo sapiens
cugcuucaugggaaa

SEQ ID NO: 746886 - RNA, 17 nt, Homo sapiens
cugcuucccauugagua

SEQ ID NO: 746887 - RNA, 23 nt, Homo sapiens
cugcuuccugucccacuacugua

SEQ ID NO: 746888 - RNA, 15 nt, Homo sapiens
cugcuucugcacuuc

SEQ ID NO: 746889 - RNA, 17 nt, Homo sapiens
cugcuucuuuucacuuc

SEQ ID NO: 746890 - RNA, 22 nt, Homo sapiens
cugcuucuuuucacuucagagc

SEQ ID NO: 746891 - RNA, 16 nt, Homo sapiens
cugcuugaccaaagag

SEQ ID NO: 746892 - RNA, 23 nt, Homo sapiens
cugcuugccauucucuugcauug

SEQ ID NO: 746893 - RNA, 13 nt, Homo sapiens
cugcuugguuaaa

SEQ ID NO: 746894 - RNA, 13 nt, Homo sapiens
cugcuuguguuaa

SEQ ID NO: 746895 - RNA, 21 nt, Homo sapiens
cugcuuguucaaauacugugu

SEQ ID NO: 746896 - RNA, 18 nt, Homo sapiens
cugcuuuuugcuucuuga

SEQ ID NO: 746897 - RNA, 18 nt, Homo sapiens
cuggaaaaauuccagaag

SEQ ID NO: 746898 - RNA, 22 nt, Homo sapiens
cuggaaaacagaaaccauucua

SEQ ID NO: 746899 - RNA, 18 nt, Homo sapiens
cuggaaaacagaacacuu

SEQ ID NO: 746900 - RNA, 19 nt, Homo sapiens
cuggaaaauucuauggaau

SEQ ID NO: 746901 - RNA, 22 nt, Homo sapiens
cuggaaacugcucccaucauuc

SEQ ID NO: 746902 - RNA, 21 nt, Homo sapiens
cuggaacaccagcagcacugg

SEQ ID NO: 746903 - RNA, 22 nt, Homo sapiens
cuggaacaccagcagcacugga

SEQ ID NO: 746904 - RNA, 21 nt, Homo sapiens
cuggaacaugcuuuuacuuua

SEQ ID NO: 746905 - RNA, 12 nt, Homo sapiens
cuggaacccaga

SEQ ID NO: 746906 - RNA, 21 nt, Homo sapiens
cuggaacuuuuuagauuauuc

SEQ ID NO: 746907 - RNA, 14 nt, Homo sapiens
cuggaagaaccacu

SEQ ID NO: 746908 - RNA, 20 nt, Homo sapiens
cuggaagaagugagcagugu

SEQ ID NO: 746909 - RNA, 20 nt, Homo sapiens
cuggaagagccaaagaauau

SEQ ID NO: 746910 - RNA, 23 nt, Homo sapiens
cuggaagauauaacauucaguuc

SEQ ID NO: 746911 - RNA, 12 nt, Homo sapiens
cuggaagccaaa

SEQ ID NO: 746912 - RNA, 16 nt, Homo sapiens
cuggaaggagcacaua

SEQ ID NO: 746913 - RNA, 18 nt, Homo sapiens
cuggaagggaaaggggag

SEQ ID NO: 746914 - RNA, 14 nt, Homo sapiens
cuggaaggggccac

SEQ ID NO: 746915 - RNA, 18 nt, Homo sapiens
cuggaagggguccagccu

SEQ ID NO: 746916 - RNA, 18 nt, Homo sapiens
cuggaaggucugaucucc

SEQ ID NO: 746917 - RNA, 12 nt, Homo sapiens
cuggaaguagaa

SEQ ID NO: 746918 - RNA, 14 nt, Homo sapiens
cuggaauacaugaa

SEQ ID NO: 746919 - RNA, 18 nt, Homo sapiens
cuggaauauugugauucu

SEQ ID NO: 746920 - RNA, 15 nt, Homo sapiens
cuggaaucacauucu

SEQ ID NO: 746921 - RNA, 16 nt, Homo sapiens
cuggaauuacaaaacu

SEQ ID NO: 746922 - RNA, 12 nt, Homo sapiens
cuggaauucuuc

SEQ ID NO: 746923 - RNA, 18 nt, Homo sapiens
cuggaauucuucugcaac

SEQ ID NO: 746924 - RNA, 21 nt, Homo sapiens
cuggacaaagaaauuccccaa

SEQ ID NO: 746925 - RNA, 20 nt, Homo sapiens
cuggacacagcucuucauuc

SEQ ID NO: 746926 - RNA, 21 nt, Homo sapiens
cuggacaguaucccacaucca

SEQ ID NO: 746927 - RNA, 19 nt, Homo sapiens
cuggacauucucuuugaua

SEQ ID NO: 746928 - RNA, 15 nt, Homo sapiens
cuggaccagguccug

SEQ ID NO: 746929 - RNA, 20 nt, Homo sapiens
cuggaccgcugacugcacca

SEQ ID NO: 746930 - RNA, 20 nt, Homo sapiens
cuggaccugccuccugccug

SEQ ID NO: 746931 - RNA, 23 nt, Homo sapiens
cuggaccuuuucccuugcuguac

SEQ ID NO: 746932 - RNA, 18 nt, Homo sapiens
cuggagacaaggugcuaa

SEQ ID NO: 746933 - RNA, 13 nt, Homo sapiens
cuggagaguaauc

SEQ ID NO: 746934 - RNA, 16 nt, Homo sapiens
cuggagauugugcucu

SEQ ID NO: 746935 - RNA, 16 nt, Homo sapiens
cuggagcaauguugcu

SEQ ID NO: 746936 - RNA, 18 nt, Homo sapiens
cuggagcccacaaccuuc

SEQ ID NO: 746937 - RNA, 21 nt, Homo sapiens
cuggagcccgaggcaccagug

SEQ ID NO: 746938 - RNA, 15 nt, Homo sapiens
cuggaggaacacuug

SEQ ID NO: 746939 - RNA, 17 nt, Homo sapiens
cuggaggacggucaguc

SEQ ID NO: 746940 - RNA, 18 nt, Homo sapiens
cuggaggcacgcaccacu

SEQ ID NO: 746941 - RNA, 23 nt, Homo sapiens
cuggaggcccaguucacccugau

SEQ ID NO: 746942 - RNA, 18 nt, Homo sapiens
cuggaggccggaaucuca

SEQ ID NO: 746943 - RNA, 17 nt, Homo sapiens
cuggaggccuuccagcu

SEQ ID NO: 746944 - RNA, 16 nt, Homo sapiens
cuggagggggagcacc

SEQ ID NO: 746945 - RNA, 16 nt, Homo sapiens
cuggagugagcucugu

SEQ ID NO: 746946 - RNA, 12 nt, Homo sapiens
cuuaaacuucca

SEQ ID NO: 746947 - RNA, 17 nt, Homo sapiens
cuuaaacuugcaucacu

SEQ ID NO: 746948 - RNA, 19 nt, Homo sapiens
cuuaaagauuuaucaaauc

SEQ ID NO: 746949 - RNA, 20 nt, Homo sapiens
cuuaaagauuuucugcuuga

SEQ ID NO: 746950 - RNA, 17 nt, Homo sapiens
cuuaaagcugcugucac

SEQ ID NO: 746951 - RNA, 17 nt, Homo sapiens
cuuaaagggucuuauga

SEQ ID NO: 746952 - RNA, 23 nt, Homo sapiens
cuuaaauaauaaacaguggaaua

SEQ ID NO: 746953 - RNA, 14 nt, Homo sapiens
cuuaaauaugugaa

SEQ ID NO: 746954 - RNA, 21 nt, Homo sapiens
cuuaaauggaauuauuuugaa

SEQ ID NO: 746955 - RNA, 14 nt, Homo sapiens
cuuaacaaagccuu

SEQ ID NO: 746956 - RNA, 15 nt, Homo sapiens
cuuaacaagacuuuu

SEQ ID NO: 746957 - RNA, 18 nt, Homo sapiens
cuuaacuaauuugaaugu

SEQ ID NO: 746958 - RNA, 20 nt, Homo sapiens
cuuaacuauaaggugccuca

SEQ ID NO: 746959 - RNA, 21 nt, Homo sapiens
cuuaacuggucuccuugcuuc

SEQ ID NO: 746960 - RNA, 12 nt, Homo sapiens
cuuaagaacugu

SEQ ID NO: 746961 - RNA, 18 nt, Homo sapiens
cuuaagacagaguauccu

SEQ ID NO: 746962 - RNA, 16 nt, Homo sapiens
cuuaagagacacucca

SEQ ID NO: 746963 - RNA, 21 nt, Homo sapiens
cuuaagagacacuccaaaccu

SEQ ID NO: 746964 - RNA, 12 nt, Homo sapiens
cuuaagcaaagg

SEQ ID NO: 746965 - RNA, 20 nt, Homo sapiens
cuuaagggguaucauguaug

SEQ ID NO: 746966 - RNA, 13 nt, Homo sapiens
cuuaagugacaaa

SEQ ID NO: 746967 - RNA, 13 nt, Homo sapiens
cuuaauaaagguu

SEQ ID NO: 746968 - RNA, 20 nt, Homo sapiens
cuuaauaaauauuacaguga

SEQ ID NO: 746969 - RNA, 20 nt, Homo sapiens
cuuaauaaauccuugaauca

SEQ ID NO: 746970 - RNA, 19 nt, Homo sapiens
cuuaauagcuguaguuuuc

SEQ ID NO: 746971 - RNA, 21 nt, Homo sapiens
cuuaauagcuguaguuuuccc

SEQ ID NO: 746972 - RNA, 13 nt, Homo sapiens
cuuaaucuaaucu

SEQ ID NO: 746973 - RNA, 17 nt, Homo sapiens
cuuaaucuuauggggcc

SEQ ID NO: 746974 - RNA, 15 nt, Homo sapiens
cuuaaugacauuccc

SEQ ID NO: 746975 - RNA, 22 nt, Homo sapiens
cuuaauggaugggcagucauuu

SEQ ID NO: 746976 - RNA, 19 nt, Homo sapiens
cuuaaugucuuuaaaagua

SEQ ID NO: 746977 - RNA, 20 nt, Homo sapiens
cuuaauucuaagacuuuuga

SEQ ID NO: 746978 - RNA, 13 nt, Homo sapiens
cuuaauucucugc

SEQ ID NO: 746979 - RNA, 18 nt, Homo sapiens
cuuacaauugcacugcug

SEQ ID NO: 746980 - RNA, 19 nt, Homo sapiens
cuuacacugaggacugugg

SEQ ID NO: 746981 - RNA, 18 nt, Homo sapiens
cuuacacuuuaugcacaa

SEQ ID NO: 746982 - RNA, 16 nt, Homo sapiens
cuuacaucauguguug

SEQ ID NO: 746983 - RNA, 13 nt, Homo sapiens
cuuacucugagga

SEQ ID NO: 746984 - RNA, 17 nt, Homo sapiens
cuuacuuuggaauacau

SEQ ID NO: 746985 - RNA, 18 nt, Homo sapiens
cuuagaaaaggugauaaa

SEQ ID NO: 746986 - RNA, 16 nt, Homo sapiens
cuuagaagaaaagccu

SEQ ID NO: 746987 - RNA, 16 nt, Homo sapiens
cuuagaauaaugaagg

SEQ ID NO: 746988 - RNA, 13 nt, Homo sapiens
cuuagaccucagc

SEQ ID NO: 746989 - RNA, 15 nt, Homo sapiens
cuuagaguguagcug

SEQ ID NO: 746990 - RNA, 15 nt, Homo sapiens
cuuagauugaaucug

SEQ ID NO: 746991 - RNA, 18 nt, Homo sapiens
cuuagcaacucagagaaa

SEQ ID NO: 746992 - RNA, 16 nt, Homo sapiens
cuuagcaaggggcuca

SEQ ID NO: 746993 - RNA, 13 nt, Homo sapiens
cuuagcacacuca

SEQ ID NO: 746994 - RNA, 22 nt, Homo sapiens
cuuagcagcuaucucucaguga

SEQ ID NO: 746995 - RNA, 13 nt, Homo sapiens
cuuagcauguccc

SEQ ID NO: 746996 - RNA, 11 nt, Homo sapiens
cuuagcugccu

SEQ ID NO: 746997 - RNA, 13 nt, Homo sapiens
cuuagcugucacc

SEQ ID NO: 746998 - RNA, 18 nt, Homo sapiens
cuuagcugucucagagau

SEQ ID NO: 746999 - RNA, 23 nt, Homo sapiens
cuuaggacuaccagccauacaaa

SEQ ID NO: 747000 - RNA, 23 nt, Homo sapiens
cuuaggccuuccucucuccagau

SEQ ID NO: 747001 - RNA, 17 nt, Homo sapiens
cuuaguauuucucagga

SEQ ID NO: 747002 - RNA, 18 nt, Homo sapiens
cuuaguuguucaguugcc

SEQ ID NO: 747003 - RNA, 18 nt, Homo sapiens
cuuauaagaaagaucaaa

SEQ ID NO: 747004 - RNA, 19 nt, Homo sapiens
cuuauaagaaagaucaaag

SEQ ID NO: 747005 - RNA, 18 nt, Homo sapiens
cuuauaauuguucucaga

SEQ ID NO: 747006 - RNA, 18 nt, Homo sapiens
cuuauauaauaacaauug

SEQ ID NO: 747007 - RNA, 19 nt, Homo sapiens
cuuauaucauguaccucag

SEQ ID NO: 747008 - RNA, 23 nt, Homo sapiens
cuuauauugaagacaauuugaua

SEQ ID NO: 747009 - RNA, 14 nt, Homo sapiens
cuuauccacuuuga

SEQ ID NO: 747010 - RNA, 16 nt, Homo sapiens
cuuauccacuuugacu

SEQ ID NO: 747011 - RNA, 18 nt, Homo sapiens
cuuaucccucucuucccc

SEQ ID NO: 747012 - RNA, 21 nt, Homo sapiens
cuuauccuccaccgucuuucu

SEQ ID NO: 747013 - RNA, 19 nt, Homo sapiens
cuuaucucucaaaacaaua

SEQ ID NO: 747014 - RNA, 20 nt, Homo sapiens
cuuaucuguuuucuaccucc

SEQ ID NO: 747015 - RNA, 18 nt, Homo sapiens
cuuaucuuacaauauuga

SEQ ID NO: 747016 - RNA, 22 nt, Homo sapiens
cuuaucuuuuggagcaaauuga

SEQ ID NO: 747017 - RNA, 18 nt, Homo sapiens
cuuaugacugcaccaaca

SEQ ID NO: 747018 - RNA, 17 nt, Homo sapiens
cuuaugaucaccaugua

SEQ ID NO: 747019 - RNA, 13 nt, Homo sapiens
cuuaugauucaga

SEQ ID NO: 747020 - RNA, 15 nt, Homo sapiens
cuuauguauuuauga

SEQ ID NO: 747021 - RNA, 17 nt, Homo sapiens
cuuauguggaagaacug

SEQ ID NO: 747022 - RNA, 12 nt, Homo sapiens
cuuauguuauac

SEQ ID NO: 747023 - RNA, 17 nt, Homo sapiens
cuuauugcuguugcuua

SEQ ID NO: 747024 - RNA, 14 nt, Homo sapiens
cuuauuguaccucu

SEQ ID NO: 747025 - RNA, 15 nt, Homo sapiens
cuuauuuauaccuca

SEQ ID NO: 747026 - RNA, 15 nt, Homo sapiens
cuuauuuugcauucc

SEQ ID NO: 747027 - RNA, 18 nt, Homo sapiens
cuuauuuugcauuccaga

SEQ ID NO: 747028 - RNA, 14 nt, Homo sapiens
cuucaaaacugcca

SEQ ID NO: 747029 - RNA, 17 nt, Homo sapiens
cuucaaaacugccauua

SEQ ID NO: 747030 - RNA, 21 nt, Homo sapiens
cuucaaaauaaaaaguaauga

SEQ ID NO: 747031 - RNA, 18 nt, Homo sapiens
cuucaaagcaagcuggua

SEQ ID NO: 747032 - RNA, 22 nt, Homo sapiens
cuucaaaugucuaagguaguaa

SEQ ID NO: 747033 - RNA, 20 nt, Homo sapiens
cuucaaauguuuaaaccacu

SEQ ID NO: 747034 - RNA, 19 nt, Homo sapiens
cuucaacauuuacauguau

SEQ ID NO: 747035 - RNA, 24 nt, Homo sapiens
cuucaacugaaaaaaacauaucca

SEQ ID NO: 747036 - RNA, 18 nt, Homo sapiens
cuucaagagccucuggca

SEQ ID NO: 747037 - RNA, 14 nt, Homo sapiens
cuucaaguacuguu

SEQ ID NO: 747038 - RNA, 22 nt, Homo sapiens
cuucaaguauaacaacuuugaa

SEQ ID NO: 747039 - RNA, 22 nt, Homo sapiens
cuucaaugggcucuuccaacaa

SEQ ID NO: 747040 - RNA, 17 nt, Homo sapiens
cuucaauuuauuacuga

SEQ ID NO: 747041 - RNA, 14 nt, Homo sapiens
cuucacaacagauu

SEQ ID NO: 747042 - RNA, 20 nt, Homo sapiens
cuucacagaaaguucuuaaa

SEQ ID NO: 747043 - RNA, 13 nt, Homo sapiens
cuucacagaacac

SEQ ID NO: 747044 - RNA, 20 nt, Homo sapiens
cuucacaguagagccagcuu

SEQ ID NO: 747045 - RNA, 22 nt, Homo sapiens
cuucacauuuuacgacaaggau

SEQ ID NO: 747046 - RNA, 19 nt, Homo sapiens
cuucaccaggaccaguuca

SEQ ID NO: 747047 - RNA, 11 nt, Homo sapiens
cuucaccugcg

SEQ ID NO: 747048 - RNA, 19 nt, Homo sapiens
cuucacgggcaaucaugag

SEQ ID NO: 747049 - RNA, 13 nt, Homo sapiens
cuucacuauacaa

SEQ ID NO: 747050 - RNA, 11 nt, Homo sapiens
cuucacugaca

SEQ ID NO: 747051 - RNA, 14 nt, Homo sapiens
cuucacugccauga

SEQ ID NO: 747052 - RNA, 20 nt, Homo sapiens
cuucacugccaugauagcug

SEQ ID NO: 747053 - RNA, 22 nt, Homo sapiens
cuucagaaauucucugcgauua

SEQ ID NO: 747054 - RNA, 20 nt, Homo sapiens
cuucagaagacacugcaaag

SEQ ID NO: 747055 - RNA, 23 nt, Homo sapiens
cuucagagacuaucugauuuccu

SEQ ID NO: 747056 - RNA, 21 nt, Homo sapiens
cuucagaggauaaauaucaau

SEQ ID NO: 747057 - RNA, 19 nt, Homo sapiens
cuucagaguuuguguguau

SEQ ID NO: 747058 - RNA, 18 nt, Homo sapiens
cuucagauacaaacugca

SEQ ID NO: 747059 - RNA, 13 nt, Homo sapiens
cuucagaucugag

SEQ ID NO: 747060 - RNA, 16 nt, Homo sapiens
cuucagauuugccuua

SEQ ID NO: 747061 - RNA, 13 nt, Homo sapiens
cuucagcaaguua

SEQ ID NO: 747062 - RNA, 12 nt, Homo sapiens
cuucagcccacc

SEQ ID NO: 747063 - RNA, 17 nt, Homo sapiens
cuucagcccccaccagg

SEQ ID NO: 747064 - RNA, 22 nt, Homo sapiens
cuucagcccucaccccugguuc

SEQ ID NO: 747065 - RNA, 14 nt, Homo sapiens
cuucagguggaaaa

SEQ ID NO: 747066 - RNA, 18 nt, Homo sapiens
cuucaguccaacugucaa

SEQ ID NO: 747067 - RNA, 14 nt, Homo sapiens
cuucagucucuaua

SEQ ID NO: 747068 - RNA, 19 nt, Homo sapiens
cuucagucucuauaccaau

SEQ ID NO: 747069 - RNA, 16 nt, Homo sapiens
cuucagugggagaaaa

SEQ ID NO: 747070 - RNA, 16 nt, Homo sapiens
cuucaguguaauguga

SEQ ID NO: 747071 - RNA, 14 nt, Homo sapiens
cuucaguuaauucu

SEQ ID NO: 747072 - RNA, 15 nt, Homo sapiens
cuucaucccauucca

SEQ ID NO: 747073 - RNA, 19 nt, Homo sapiens
cuucaucugacuaugacau

SEQ ID NO: 747074 - RNA, 21 nt, Homo sapiens
cuucaucuggcaacaucuuua

SEQ ID NO: 747075 - RNA, 16 nt, Homo sapiens
cuucaugcccuucuga

SEQ ID NO: 747076 - RNA, 23 nt, Homo sapiens
cuucaugcuuuugcuugcaaugu

SEQ ID NO: 747077 - RNA, 21 nt, Homo sapiens
cuucaugugguucagugccuu

SEQ ID NO: 747078 - RNA, 24 nt, Homo sapiens
cuucauguuugccuucugcacaua

SEQ ID NO: 747079 - RNA, 13 nt, Homo sapiens
cuucauuaccuca

SEQ ID NO: 747080 - RNA, 23 nt, Homo sapiens
cuucauuagcuuugggugccuuu

SEQ ID NO: 747081 - RNA, 22 nt, Homo sapiens
cuucauucacuucgccauucau

SEQ ID NO: 747082 - RNA, 16 nt, Homo sapiens
cuucauuguaaaucac

SEQ ID NO: 747083 - RNA, 22 nt, Homo sapiens
cuucauuugacacaaagcuucu

SEQ ID NO: 747084 - RNA, 22 nt, Homo sapiens
cuuccaaccauuuaucuugaag

SEQ ID NO: 747085 - RNA, 20 nt, Homo sapiens
cuuccaacguggcccagaga

SEQ ID NO: 747086 - RNA, 13 nt, Homo sapiens
cuuccaccacaga

SEQ ID NO: 747087 - RNA, 19 nt, Homo sapiens
cuuccacccccaccaucca

SEQ ID NO: 747088 - RNA, 19 nt, Homo sapiens
cuuccaccucagucuccca

SEQ ID NO: 747089 - RNA, 18 nt, Homo sapiens
cuuccacucgaugaugcu

SEQ ID NO: 747090 - RNA, 15 nt, Homo sapiens
cuuccagaaacuaca

SEQ ID NO: 747091 - RNA, 19 nt, Homo sapiens
cuuccagcacccugcaaaa

SEQ ID NO: 747092 - RNA, 13 nt, Homo sapiens
cuuccagcuccug

SEQ ID NO: 747093 - RNA, 16 nt, Homo sapiens
cuuccagugaacauuc

SEQ ID NO: 747094 - RNA, 17 nt, Homo sapiens
cuuccaguuugcuugau

SEQ ID NO: 747095 - RNA, 16 nt, Homo sapiens
cuuccauaauguauaa

SEQ ID NO: 747096 - RNA, 21 nt, Homo sapiens
cuuccauaauuaugacaguua

SEQ ID NO: 747097 - RNA, 12 nt, Homo sapiens
cuuccaugagaa

SEQ ID NO: 747098 - RNA, 22 nt, Homo sapiens
cuuccauuuucccccacuacug

SEQ ID NO: 747099 - RNA, 20 nt, Homo sapiens
cuucccaccuacugcacuuu

SEQ ID NO: 747100 - RNA, 20 nt, Homo sapiens
cuucccaccucacagugaug

SEQ ID NO: 747101 - RNA, 19 nt, Homo sapiens
cuucccaggaucugcucca

SEQ ID NO: 747102 - RNA, 17 nt, Homo sapiens
cuucccaguucuugacc

SEQ ID NO: 747103 - RNA, 14 nt, Homo sapiens
cuucccauguccca

SEQ ID NO: 747104 - RNA, 12 nt, Homo sapiens
cuucccauuucu

SEQ ID NO: 747105 - RNA, 15 nt, Homo sapiens
cuucccauuucucua

SEQ ID NO: 747106 - RNA, 15 nt, Homo sapiens
cuuccccaacuuccc

SEQ ID NO: 747107 - RNA, 17 nt, Homo sapiens
cuuccccaacuucccua

SEQ ID NO: 747108 - RNA, 17 nt, Homo sapiens
cuuccccaaugcuccau

SEQ ID NO: 747109 - RNA, 15 nt, Homo sapiens
cuuccccagguccuu

SEQ ID NO: 747110 - RNA, 20 nt, Homo sapiens
cuucccccaugugccuguca

SEQ ID NO: 747111 - RNA, 21 nt, Homo sapiens
cuuccccucuuuuggccaaau

SEQ ID NO: 747112 - RNA, 14 nt, Homo sapiens
cuuccccugggcaa

SEQ ID NO: 747113 - RNA, 13 nt, Homo sapiens
cuuccccuugccc

SEQ ID NO: 747114 - RNA, 20 nt, Homo sapiens
cuucccggcgucccuaccuc

SEQ ID NO: 747115 - RNA, 16 nt, Homo sapiens
cuucccguuuccucuu

SEQ ID NO: 747116 - RNA, 14 nt, Homo sapiens
cuucccuaaugaag

SEQ ID NO: 747117 - RNA, 16 nt, Homo sapiens
cuucccucccuaucua

SEQ ID NO: 747118 - RNA, 13 nt, Homo sapiens
cuucccucgggga

SEQ ID NO: 747119 - RNA, 21 nt, Homo sapiens
cuucccucucugcagacuucc

SEQ ID NO: 747120 - RNA, 15 nt, Homo sapiens
cuucccugcauuaac

SEQ ID NO: 747121 - RNA, 17 nt, Homo sapiens
cuucccugccacuucaa

SEQ ID NO: 747122 - RNA, 18 nt, Homo sapiens
cuucccugggcugugcua

SEQ ID NO: 747123 - RNA, 13 nt, Homo sapiens
cuucccuucccag

SEQ ID NO: 747124 - RNA, 17 nt, Homo sapiens
cuucccuucucuucacu

SEQ ID NO: 747125 - RNA, 19 nt, Homo sapiens
cuucccuuuauuacaagaa

SEQ ID NO: 747126 - RNA, 20 nt, Homo sapiens
cuuccguggucagagugcca

SEQ ID NO: 747127 - RNA, 15 nt, Homo sapiens
cuuccuaaacccaau

SEQ ID NO: 747128 - RNA, 22 nt, Homo sapiens
cuuccuaaugucagaacagagu

SEQ ID NO: 747129 - RNA, 20 nt, Homo sapiens
cuuccuagggaucugaaauc

SEQ ID NO: 747130 - RNA, 12 nt, Homo sapiens
cuuccuagguca

SEQ ID NO: 747131 - RNA, 17 nt, Homo sapiens
cuuccucagccuccaaa

SEQ ID NO: 747132 - RNA, 21 nt, Homo sapiens
cuuccucccaacaagcagcug

SEQ ID NO: 747133 - RNA, 17 nt, Homo sapiens
cuuccuccucgcugcca

SEQ ID NO: 747134 - RNA, 16 nt, Homo sapiens
cuuccucuagaagcca

SEQ ID NO: 747135 - RNA, 22 nt, Homo sapiens
cuuccucucaagcuagccagag

SEQ ID NO: 747136 - RNA, 12 nt, Homo sapiens
cuuccucuccac

SEQ ID NO: 747137 - RNA, 15 nt, Homo sapiens
cuuccucuuagccuc

SEQ ID NO: 747138 - RNA, 13 nt, Homo sapiens
cuuccucuuugaa

SEQ ID NO: 747139 - RNA, 15 nt, Homo sapiens
cuuccuggaagcaga

SEQ ID NO: 747140 - RNA, 21 nt, Homo sapiens
cuuccuggguccuguucccua

SEQ ID NO: 747141 - RNA, 23 nt, Homo sapiens
cuuccuggguccuguucccuacc

SEQ ID NO: 747142 - RNA, 15 nt, Homo sapiens
cuuccugucugagua

SEQ ID NO: 747143 - RNA, 14 nt, Homo sapiens
cuuccugugaucca

SEQ ID NO: 747144 - RNA, 20 nt, Homo sapiens
cuuccuuaaagcauuugcaa

SEQ ID NO: 747145 - RNA, 12 nt, Homo sapiens
cuuccuucaggg

SEQ ID NO: 747146 - RNA, 22 nt, Homo sapiens
cuuccuucuuuaucuauagcaa

SEQ ID NO: 747147 - RNA, 19 nt, Homo sapiens
cuuccuuugucguguuucu

SEQ ID NO: 747148 - RNA, 17 nt, Homo sapiens
cuuccuuuuaacugcca

SEQ ID NO: 747149 - RNA, 13 nt, Homo sapiens
cuucuaaaacaau

SEQ ID NO: 747150 - RNA, 13 nt, Homo sapiens
cuucuaaaagcca

SEQ ID NO: 747151 - RNA, 14 nt, Homo sapiens
cuucuaacacaaaa

SEQ ID NO: 747152 - RNA, 15 nt, Homo sapiens
cuucuaacacaaaau

SEQ ID NO: 747153 - RNA, 13 nt, Homo sapiens
cuucuaagccaaa

SEQ ID NO: 747154 - RNA, 16 nt, Homo sapiens
cuucuacugcuaucua

SEQ ID NO: 747155 - RNA, 15 nt, Homo sapiens
cuucuagaaucucgu

SEQ ID NO: 747156 - RNA, 22 nt, Homo sapiens
cuucuaggauagcuaacuguaa

SEQ ID NO: 747157 - RNA, 19 nt, Homo sapiens
cuucuaggcccauuguccu

SEQ ID NO: 747158 - RNA, 18 nt, Homo sapiens
cuucuaggucacuucuca

SEQ ID NO: 747159 - RNA, 21 nt, Homo sapiens
cuucuaggucacuucucacaa

SEQ ID NO: 747160 - RNA, 22 nt, Homo sapiens
cuucuaggucacuucucacaau

SEQ ID NO: 747161 - RNA, 19 nt, Homo sapiens
cuucuauacccacccagaa

SEQ ID NO: 747162 - RNA, 19 nt, Homo sapiens
cuucuaugguugacauugu

SEQ ID NO: 747163 - RNA, 20 nt, Homo sapiens
cuucuaugguugacauugua

SEQ ID NO: 747164 - RNA, 17 nt, Homo sapiens
cuucuauguccaacaga

SEQ ID NO: 747165 - RNA, 18 nt, Homo sapiens
cuucuauuccauggcuaa

SEQ ID NO: 747166 - RNA, 17 nt, Homo sapiens
cuucuauuuaaugcuuc

SEQ ID NO: 747167 - RNA, 15 nt, Homo sapiens
cuucuauuucuugga

SEQ ID NO: 747168 - RNA, 19 nt, Homo sapiens
cuucucaaauuagcugcaa

SEQ ID NO: 747169 - RNA, 12 nt, Homo sapiens
cuucucaagacu

SEQ ID NO: 747170 - RNA, 17 nt, Homo sapiens
cuucucaaguucuaaga

SEQ ID NO: 747171 - RNA, 12 nt, Homo sapiens
cuucucagucuu

SEQ ID NO: 747172 - RNA, 21 nt, Homo sapiens
cuucuccccugcacuguaaaa

SEQ ID NO: 747173 - RNA, 16 nt, Homo sapiens
cuucuccuaugcauuu

SEQ ID NO: 747174 - RNA, 12 nt, Homo sapiens
cuucuccugacc

SEQ ID NO: 747175 - RNA, 16 nt, Homo sapiens
cuucucggagacccau

SEQ ID NO: 747176 - RNA, 22 nt, Homo sapiens
gacuuauuaugcauaaagccaa

SEQ ID NO: 747177 - RNA, 14 nt, Homo sapiens
gacuucaaugauag

SEQ ID NO: 747178 - RNA, 13 nt, Homo sapiens
gacuucacacugc

SEQ ID NO: 747179 - RNA, 14 nt, Homo sapiens
gacuucacuguaua

SEQ ID NO: 747180 - RNA, 13 nt, Homo sapiens
gacuucagugugu

SEQ ID NO: 747181 - RNA, 14 nt, Homo sapiens
gacuucaucuucaa

SEQ ID NO: 747182 - RNA, 17 nt, Homo sapiens
gacuuccaaacaacucu

SEQ ID NO: 747183 - RNA, 14 nt, Homo sapiens
gacuuccacuuugu

SEQ ID NO: 747184 - RNA, 11 nt, Homo sapiens
gacuuccugua

SEQ ID NO: 747185 - RNA, 17 nt, Homo sapiens
gacuucugccuggagac

SEQ ID NO: 747186 - RNA, 20 nt, Homo sapiens
gacuucuggagaaagcucau

SEQ ID NO: 747187 - RNA, 16 nt, Homo sapiens
gacuugaaaugcucuu

SEQ ID NO: 747188 - RNA, 16 nt, Homo sapiens
gacuugaagcacagag

SEQ ID NO: 747189 - RNA, 18 nt, Homo sapiens
gacuugaaugcacuuuug

SEQ ID NO: 747190 - RNA, 18 nt, Homo sapiens
gacuugauuagugccuuc

SEQ ID NO: 747191 - RNA, 15 nt, Homo sapiens
gacuuggagacuccu

SEQ ID NO: 747192 - RNA, 23 nt, Homo sapiens
gacuuguuuagagagccugucac

SEQ ID NO: 747193 - RNA, 20 nt, Homo sapiens
gacuuguuuuaugcucaggg

SEQ ID NO: 747194 - RNA, 15 nt, Homo sapiens
gacuuuaaaccaccu

SEQ ID NO: 747195 - RNA, 15 nt, Homo sapiens
gacuuuaagugaaag

SEQ ID NO: 747196 - RNA, 18 nt, Homo sapiens
gacuuuagagucuaagaa

SEQ ID NO: 747197 - RNA, 17 nt, Homo sapiens
gacuuuauguugaaaua

SEQ ID NO: 747198 - RNA, 23 nt, Homo sapiens
gacuuuauguuguaugauuccaa

SEQ ID NO: 747199 - RNA, 15 nt, Homo sapiens
gacuuucuguuacua

SEQ ID NO: 747200 - RNA, 15 nt, Homo sapiens
gacuuugaagaccag

SEQ ID NO: 747201 - RNA, 17 nt, Homo sapiens
gacuuugauagauuucu

SEQ ID NO: 747202 - RNA, 16 nt, Homo sapiens
gacuuugauugcacau

SEQ ID NO: 747203 - RNA, 17 nt, Homo sapiens
gacuuugguuugaccca

SEQ ID NO: 747204 - RNA, 18 nt, Homo sapiens
gacuuugugaguuagcau

SEQ ID NO: 747205 - RNA, 19 nt, Homo sapiens
gacuuuguguucauuucau

SEQ ID NO: 747206 - RNA, 18 nt, Homo sapiens
gacuuuuaaucagugaag

SEQ ID NO: 747207 - RNA, 17 nt, Homo sapiens
gacuuuuauaugcuuuu

SEQ ID NO: 747208 - RNA, 23 nt, Homo sapiens
gacuuuuuguacugaaaacaauu

SEQ ID NO: 747209 - RNA, 19 nt, Homo sapiens
gagaaaaaagaaguguccg

SEQ ID NO: 747210 - RNA, 21 nt, Homo sapiens
gagaaaaaugcuccccacagc

SEQ ID NO: 747211 - RNA, 14 nt, Homo sapiens
gagaaaagggaugg

SEQ ID NO: 747212 - RNA, 18 nt, Homo sapiens
gagaaaauccaggucaug

SEQ ID NO: 747213 - RNA, 13 nt, Homo sapiens
gagaaaccagcuu

SEQ ID NO: 747214 - RNA, 19 nt, Homo sapiens
gagaaaccgaggugcaaau

SEQ ID NO: 747215 - RNA, 13 nt, Homo sapiens
gagaaagcacuga

SEQ ID NO: 747216 - RNA, 23 nt, Homo sapiens
gagaaauacuuucaggcacuaag

SEQ ID NO: 747217 - RNA, 17 nt, Homo sapiens
gagaaauccuuccuaaa

SEQ ID NO: 747218 - RNA, 12 nt, Homo sapiens
gagaaaugcugc

SEQ ID NO: 747219 - RNA, 23 nt, Homo sapiens
gagaaaugcugcuagaaggaauu

SEQ ID NO: 747220 - RNA, 16 nt, Homo sapiens
gagaacuauccaaaac

SEQ ID NO: 747221 - RNA, 14 nt, Homo sapiens
gagaacucuuucau

SEQ ID NO: 747222 - RNA, 19 nt, Homo sapiens
gagaacugcauauguuucg

SEQ ID NO: 747223 - RNA, 18 nt, Homo sapiens
gagaacuggaaagacaua

SEQ ID NO: 747224 - RNA, 23 nt, Homo sapiens
gagaagaauuuucagaccccagc

SEQ ID NO: 747225 - RNA, 20 nt, Homo sapiens
gagaagagaugcugccauuu

SEQ ID NO: 747226 - RNA, 16 nt, Homo sapiens
gagaagcaauggguca

SEQ ID NO: 747227 - RNA, 14 nt, Homo sapiens
gagaagcacagcuc

SEQ ID NO: 747228 - RNA, 16 nt, Homo sapiens
gagaagcacagcuccu

SEQ ID NO: 747229 - RNA, 16 nt, Homo sapiens
gagaagcaggcagaua

SEQ ID NO: 747230 - RNA, 14 nt, Homo sapiens
gagaagcagugagc

SEQ ID NO: 747231 - RNA, 13 nt, Homo sapiens
gagaagccaaaag

SEQ ID NO: 747232 - RNA, 20 nt, Homo sapiens
gagaagccacaggccugaga

SEQ ID NO: 747233 - RNA, 20 nt, Homo sapiens
gagaagccuucagcuccagg

SEQ ID NO: 747234 - RNA, 13 nt, Homo sapiens
gagaagcuggaag

SEQ ID NO: 747235 - RNA, 12 nt, Homo sapiens
gagaagcuucua

SEQ ID NO: 747236 - RNA, 18 nt, Homo sapiens
gagaaggaaaagacugaa

SEQ ID NO: 747237 - RNA, 17 nt, Homo sapiens
gagaagggggcagaguc

SEQ ID NO: 747238 - RNA, 17 nt, Homo sapiens
gagaaguauacucuuga

SEQ ID NO: 747239 - RNA, 17 nt, Homo sapiens
gagaagucuaacgcuga

SEQ ID NO: 747240 - RNA, 22 nt, Homo sapiens
gagaagugauauggugaaggga

SEQ ID NO: 747241 - RNA, 17 nt, Homo sapiens
gagaaucacuugcacuc

SEQ ID NO: 747242 - RNA, 18 nt, Homo sapiens
gagaaucagaucauuuca

SEQ ID NO: 747243 - RNA, 16 nt, Homo sapiens
gagaauccauccaaag

SEQ ID NO: 747244 - RNA, 17 nt, Homo sapiens
gagaaucccuggcaaag

SEQ ID NO: 747245 - RNA, 15 nt, Homo sapiens
gagaaucugcugcau

SEQ ID NO: 747246 - RNA, 13 nt, Homo sapiens
gagaaugucagua

SEQ ID NO: 747247 - RNA, 22 nt, Homo sapiens
gagaauguguuucaaaaccaug

SEQ ID NO: 747248 - RNA, 12 nt, Homo sapiens
gagaauugagaa

SEQ ID NO: 747249 - RNA, 18 nt, Homo sapiens
gagaauugcuugaaccug

SEQ ID NO: 747250 - RNA, 14 nt, Homo sapiens
gagacaacagguaa

SEQ ID NO: 747251 - RNA, 13 nt, Homo sapiens
gagacaacaguac

SEQ ID NO: 747252 - RNA, 15 nt, Homo sapiens
gagacaaggugcuaa

SEQ ID NO: 747253 - RNA, 20 nt, Homo sapiens
gagacaccaaacugccaaaa

SEQ ID NO: 747254 - RNA, 23 nt, Homo sapiens
gagacaccaaacugccaaaaaca

SEQ ID NO: 747255 - RNA, 17 nt, Homo sapiens
gagacaccaguggugcg

SEQ ID NO: 747256 - RNA, 22 nt, Homo sapiens
gagacacccucuggggguccuc

SEQ ID NO: 747257 - RNA, 22 nt, Homo sapiens
gagacacuuugucuaguguauu

SEQ ID NO: 747258 - RNA, 14 nt, Homo sapiens
gagacagaaucuca

SEQ ID NO: 747259 - RNA, 16 nt, Homo sapiens
gagacagaccacuugc

SEQ ID NO: 747260 - RNA, 23 nt, Homo sapiens
gagacagauauacugggagaaau

SEQ ID NO: 747261 - RNA, 20 nt, Homo sapiens
gagacaggauuucacugugu

SEQ ID NO: 747262 - RNA, 15 nt, Homo sapiens
gagacaggcccaaga

SEQ ID NO: 747263 - RNA, 16 nt, Homo sapiens
gagacaggcccaagag

SEQ ID NO: 747264 - RNA, 15 nt, Homo sapiens
gagacauaggccaug

SEQ ID NO: 747265 - RNA, 16 nt, Homo sapiens
gagacccaacagcagu

SEQ ID NO: 747266 - RNA, 20 nt, Homo sapiens
gagacccaacagcagugauc

SEQ ID NO: 747267 - RNA, 22 nt, Homo sapiens
gagacccaccuucaagcagcug

SEQ ID NO: 747268 - RNA, 18 nt, Homo sapiens
gagacccuuuucucagga

SEQ ID NO: 747269 - RNA, 14 nt, Homo sapiens
gagaccgaggacac

SEQ ID NO: 747270 - RNA, 10 nt, Homo sapiens
gagaccucaa

SEQ ID NO: 747271 - RNA, 15 nt, Homo sapiens
gagacgcacacagcu

SEQ ID NO: 747272 - RNA, 18 nt, Homo sapiens
gagacgguuuccagggag

SEQ ID NO: 747273 - RNA, 13 nt, Homo sapiens
gagacucauuuca

SEQ ID NO: 747274 - RNA, 15 nt, Homo sapiens
gagacuccaccucaa

SEQ ID NO: 747275 - RNA, 14 nt, Homo sapiens
gagacuccaucuca

SEQ ID NO: 747276 - RNA, 12 nt, Homo sapiens
gagacucuaggg

SEQ ID NO: 747277 - RNA, 14 nt, Homo sapiens
gagacugcgggaug

SEQ ID NO: 747278 - RNA, 17 nt, Homo sapiens
gagacuggaccgcugac

SEQ ID NO: 747279 - RNA, 13 nt, Homo sapiens
gagacugggucuc

SEQ ID NO: 747280 - RNA, 13 nt, Homo sapiens
gagacuggugaca

SEQ ID NO: 747281 - RNA, 20 nt, Homo sapiens
gagacuucacgggcaaucau

SEQ ID NO: 747282 - RNA, 21 nt, Homo sapiens
gagagaacaacuacugugauc

SEQ ID NO: 747283 - RNA, 11 nt, Homo sapiens
gagagaccucu

SEQ ID NO: 747284 - RNA, 14 nt, Homo sapiens
gagagacugugagg

SEQ ID NO: 747285 - RNA, 22 nt, Homo sapiens
gagagauguuuggaaaccacag

SEQ ID NO: 747286 - RNA, 13 nt, Homo sapiens
gagagcagcagca

SEQ ID NO: 747287 - RNA, 13 nt, Homo sapiens
gagagcccuagaa

SEQ ID NO: 747288 - RNA, 12 nt, Homo sapiens
gagagccuuaac

SEQ ID NO: 747289 - RNA, 22 nt, Homo sapiens
gagagcucaggauggcucagac

SEQ ID NO: 747290 - RNA, 15 nt, Homo sapiens
gagaggaggggacca

SEQ ID NO: 747291 - RNA, 13 nt, Homo sapiens
gagaggcaggcau

SEQ ID NO: 747292 - RNA, 12 nt, Homo sapiens
gauagcaaguga

SEQ ID NO: 747293 - RNA, 23 nt, Homo sapiens
gauagcauggggccccuggccca

SEQ ID NO: 747294 - RNA, 14 nt, Homo sapiens
gauaggccuguggg

SEQ ID NO: 747295 - RNA, 15 nt, Homo sapiens
gauagggaacugggg

SEQ ID NO: 747296 - RNA, 20 nt, Homo sapiens
gauaguacuaagcauuucag

SEQ ID NO: 747297 - RNA, 16 nt, Homo sapiens
gauaguuaaaagacug

SEQ ID NO: 747298 - RNA, 18 nt, Homo sapiens
gauauaaaaauaauguca

SEQ ID NO: 747299 - RNA, 15 nt, Homo sapiens
gauauauacaaggug

SEQ ID NO: 747300 - RNA, 22 nt, Homo sapiens
gauauauauaugcuuggcuaac

SEQ ID NO: 747301 - RNA, 11 nt, Homo sapiens
gauaucuugga

SEQ ID NO: 747302 - RNA, 11 nt, Homo sapiens
gauaugcugcu

SEQ ID NO: 747303 - RNA, 13 nt, Homo sapiens
gauaugggacuga

SEQ ID NO: 747304 - RNA, 17 nt, Homo sapiens
gauauguucaacuggag

SEQ ID NO: 747305 - RNA, 20 nt, Homo sapiens
gauauuaagauucuugacuu

SEQ ID NO: 747306 - RNA, 18 nt, Homo sapiens
gauauucaggcuacucau

SEQ ID NO: 747307 - RNA, 20 nt, Homo sapiens
gauauucuguugcuuuacag

SEQ ID NO: 747308 - RNA, 17 nt, Homo sapiens
gauauugauuacuauca

SEQ ID NO: 747309 - RNA, 15 nt, Homo sapiens
gauauuguaagcauu

SEQ ID NO: 747310 - RNA, 16 nt, Homo sapiens
gauauuuaguaauauu

SEQ ID NO: 747311 - RNA, 15 nt, Homo sapiens
gauauuuccauuucu

SEQ ID NO: 747312 - RNA, 21 nt, Homo sapiens
gaucaaaauaaaaagugacac

SEQ ID NO: 747313 - RNA, 22 nt, Homo sapiens
gaucaaaauaaaaagugacaca

SEQ ID NO: 747314 - RNA, 18 nt, Homo sapiens
gaucaaagaaauucagaa

SEQ ID NO: 747315 - RNA, 17 nt, Homo sapiens
gaucaaauugugcagua

SEQ ID NO: 747316 - RNA, 20 nt, Homo sapiens
gaucaacaucuuuucuugcc

SEQ ID NO: 747317 - RNA, 18 nt, Homo sapiens
gaucaacauuuaugaccu

SEQ ID NO: 747318 - RNA, 18 nt, Homo sapiens
gaucaacgccucacugaa

SEQ ID NO: 747319 - RNA, 21 nt, Homo sapiens
gaucaauaaaugucagcauug

SEQ ID NO: 747320 - RNA, 13 nt, Homo sapiens
gaucacaccacug

SEQ ID NO: 747321 - RNA, 23 nt, Homo sapiens
gaucacagggccccagaaggcag

SEQ ID NO: 747322 - RNA, 20 nt, Homo sapiens
gaucacgccauuguacucca

SEQ ID NO: 747323 - RNA, 22 nt, Homo sapiens
gaucacgccauuguacuccagc

SEQ ID NO: 747324 - RNA, 21 nt, Homo sapiens
gaucacugccaaaaugguaca

SEQ ID NO: 747325 - RNA, 19 nt, Homo sapiens
gaucagcaaaccggggccu

SEQ ID NO: 747326 - RNA, 16 nt, Homo sapiens
gaucagcuaccaggca

SEQ ID NO: 747327 - RNA, 19 nt, Homo sapiens
gaucaguguuguugcucua

SEQ ID NO: 747328 - RNA, 20 nt, Homo sapiens
gaucaucacuuccuugcccc

SEQ ID NO: 747329 - RNA, 13 nt, Homo sapiens
gaucaucagucac

SEQ ID NO: 747330 - RNA, 22 nt, Homo sapiens
gaucaucgccagaggugcuuca

SEQ ID NO: 747331 - RNA, 19 nt, Homo sapiens
gaucaucuauguauucaag

SEQ ID NO: 747332 - RNA, 19 nt, Homo sapiens
gaucaucuuggaacugcau

SEQ ID NO: 747333 - RNA, 23 nt, Homo sapiens
gaucauuaucagccugugccacg

SEQ ID NO: 747334 - RNA, 17 nt, Homo sapiens
gaucauuuagauuuguu

SEQ ID NO: 747335 - RNA, 19 nt, Homo sapiens
gaucauuugagcucaggag

SEQ ID NO: 747336 - RNA, 21 nt, Homo sapiens
gaucauuuuuaacugauucuu

SEQ ID NO: 747337 - RNA, 23 nt, Homo sapiens
gauccaaaagaagcccccagcua

SEQ ID NO: 747338 - RNA, 21 nt, Homo sapiens
gauccaccugucucagccucc

SEQ ID NO: 747339 - RNA, 15 nt, Homo sapiens
gauccaguugcacua

SEQ ID NO: 747340 - RNA, 17 nt, Homo sapiens
gaucccagcuacucagg

SEQ ID NO: 747341 - RNA, 13 nt, Homo sapiens
gaucccagcucac

SEQ ID NO: 747342 - RNA, 16 nt, Homo sapiens
gaucccugcucucuga

SEQ ID NO: 747343 - RNA, 12 nt, Homo sapiens
gauccucacccg

SEQ ID NO: 747344 - RNA, 19 nt, Homo sapiens
gauccucacccgaaucucc

SEQ ID NO: 747345 - RNA, 19 nt, Homo sapiens
gauccuccaacagcuguca

SEQ ID NO: 747346 - RNA, 21 nt, Homo sapiens
gauccugcaccccagcauucc

SEQ ID NO: 747347 - RNA, 14 nt, Homo sapiens
gauccugcuccagc

SEQ ID NO: 747348 - RNA, 21 nt, Homo sapiens
gauccugcugaccucacuguc

SEQ ID NO: 747349 - RNA, 18 nt, Homo sapiens
gaucgaguguagcuguga

SEQ ID NO: 747350 - RNA, 22 nt, Homo sapiens
gaucgcaccacugcacuccagc

SEQ ID NO: 747351 - RNA, 21 nt, Homo sapiens
gaucgucccauccccacaucc

SEQ ID NO: 747352 - RNA, 20 nt, Homo sapiens
gaucgugccauugcacucca

SEQ ID NO: 747353 - RNA, 16 nt, Homo sapiens
gaucuaaaccaguccu

SEQ ID NO: 747354 - RNA, 19 nt, Homo sapiens
gaucuacacccaccagagu

SEQ ID NO: 747355 - RNA, 13 nt, Homo sapiens
gaucuaccagcau

SEQ ID NO: 747356 - RNA, 16 nt, Homo sapiens
gaucuaccugccucag

SEQ ID NO: 747357 - RNA, 13 nt, Homo sapiens
gaucucaaguaua

SEQ ID NO: 747358 - RNA, 20 nt, Homo sapiens
gaucucaggggucuuaccuu

SEQ ID NO: 747359 - RNA, 17 nt, Homo sapiens
gaucuccauauguuaca

SEQ ID NO: 747360 - RNA, 21 nt, Homo sapiens
gaucucuucuuuuggcuucca

SEQ ID NO: 747361 - RNA, 11 nt, Homo sapiens
gaucuggagaa

SEQ ID NO: 747362 - RNA, 16 nt, Homo sapiens
gaucuggcacacuccc

SEQ ID NO: 747363 - RNA, 22 nt, Homo sapiens
gaucuggggaggcaggcauucc

SEQ ID NO: 747364 - RNA, 17 nt, Homo sapiens
gaucuggucccuugcag

SEQ ID NO: 747365 - RNA, 11 nt, Homo sapiens
gaucugugguc

SEQ ID NO: 747366 - RNA, 13 nt, Homo sapiens
gaucuuagauucu

SEQ ID NO: 747367 - RNA, 16 nt, Homo sapiens
gaucuugagaaccuuu

SEQ ID NO: 747368 - RNA, 21 nt, Homo sapiens
gaucuugccugucuggcucag

SEQ ID NO: 747369 - RNA, 17 nt, Homo sapiens
gaucuuucuuuccaaaa

SEQ ID NO: 747370 - RNA, 17 nt, Homo sapiens
gaugaaagauucaguga

SEQ ID NO: 747371 - RNA, 22 nt, Homo sapiens
gaugaaaucugcuagaaaguua

SEQ ID NO: 747372 - RNA, 14 nt, Homo sapiens
gaugaacaucuaac

SEQ ID NO: 747373 - RNA, 21 nt, Homo sapiens
gaugaagauucuccugugcua

SEQ ID NO: 747374 - RNA, 17 nt, Homo sapiens
gaugaauaaaaugaagg

SEQ ID NO: 747375 - RNA, 18 nt, Homo sapiens
gaugacccuuuucaugau

SEQ ID NO: 747376 - RNA, 18 nt, Homo sapiens
gaugaccuacagugcugu

SEQ ID NO: 747377 - RNA, 18 nt, Homo sapiens
gaugacgacgacaacgau

SEQ ID NO: 747378 - RNA, 15 nt, Homo sapiens
gaugacucucuccaa

SEQ ID NO: 747379 - RNA, 21 nt, Homo sapiens
gaugagauuggcauggcuuua

SEQ ID NO: 747380 - RNA, 15 nt, Homo sapiens
gaugaggcacuggaa

SEQ ID NO: 747381 - RNA, 22 nt, Homo sapiens
gaugaguuucacuguacugcau

SEQ ID NO: 747382 - RNA, 14 nt, Homo sapiens
gaugauaaacacug

SEQ ID NO: 747383 - RNA, 15 nt, Homo sapiens
gaugauauucucacc

SEQ ID NO: 747384 - RNA, 21 nt, Homo sapiens
gaugaucaaaaccugugccag

SEQ ID NO: 747385 - RNA, 20 nt, Homo sapiens
gaugaucacugaucuuguca

SEQ ID NO: 747386 - RNA, 22 nt, Homo sapiens
gaugaucagaaaaauaauucca

SEQ ID NO: 747387 - RNA, 12 nt, Homo sapiens
gaugaugaaggg

SEQ ID NO: 747388 - RNA, 15 nt, Homo sapiens
gaugaugccucauga

SEQ ID NO: 747389 - RNA, 13 nt, Homo sapiens
gaugauuguucaa

SEQ ID NO: 747390 - RNA, 20 nt, Homo sapiens
gaugauuucaauagcuuugu

SEQ ID NO: 747391 - RNA, 19 nt, Homo sapiens
gaugauuucccuuaacuca

SEQ ID NO: 747392 - RNA, 18 nt, Homo sapiens
gaugcaauauaagcauaa

SEQ ID NO: 747393 - RNA, 18 nt, Homo sapiens
gaugcacagaugccaugg

SEQ ID NO: 747394 - RNA, 12 nt, Homo sapiens
gaugcacuacca

SEQ ID NO: 747395 - RNA, 20 nt, Homo sapiens
gaugcacuaccauugcuguu

SEQ ID NO: 747396 - RNA, 15 nt, Homo sapiens
gaugcagugcuucca

SEQ ID NO: 747397 - RNA, 15 nt, Homo sapiens
gaugcaugagcuccc

SEQ ID NO: 747398 - RNA, 22 nt, Homo sapiens
gaugccacuucccagaggcaga

SEQ ID NO: 747399 - RNA, 21 nt, Homo sapiens
gaugccacuucucacucacca

SEQ ID NO: 747400 - RNA, 22 nt, Homo sapiens
gaugccgagguaaaaguucuuu

SEQ ID NO: 747401 - RNA, 23 nt, Homo sapiens
gaugccgagguaaaaguucuuuu

SEQ ID NO: 747402 - RNA, 17 nt, Homo sapiens
gaugccuccccaagacu

SEQ ID NO: 747403 - RNA, 18 nt, Homo sapiens
gaugcgcacugcauucca

SEQ ID NO: 747404 - RNA, 23 nt, Homo sapiens
gaugcggaaggauugcaaugccc

SEQ ID NO: 747405 - RNA, 20 nt, Homo sapiens
gaugcgggacugcuggcaug

SEQ ID NO: 747406 - RNA, 14 nt, Homo sapiens
gcagaggucuccca

SEQ ID NO: 747407 - RNA, 15 nt, Homo sapiens
gcagagguugcagug

SEQ ID NO: 747408 - RNA, 19 nt, Homo sapiens
gcagaguugacaugagauu

SEQ ID NO: 747409 - RNA, 21 nt, Homo sapiens
gcagaguuuccaaaaccagaa

SEQ ID NO: 747410 - RNA, 14 nt, Homo sapiens
gcagauaacaaaau

SEQ ID NO: 747411 - RNA, 16 nt, Homo sapiens
gcagauaccuggugag

SEQ ID NO: 747412 - RNA, 14 nt, Homo sapiens
gcagaucugugcuc

SEQ ID NO: 747413 - RNA, 14 nt, Homo sapiens
gcagauuugcacug

SEQ ID NO: 747414 - RNA, 16 nt, Homo sapiens
gcagauuuuugcaaua

SEQ ID NO: 747415 - RNA, 23 nt, Homo sapiens
gcagcaagguggccacaguguca

SEQ ID NO: 747416 - RNA, 14 nt, Homo sapiens
gcagcacaccucag

SEQ ID NO: 747417 - RNA, 22 nt, Homo sapiens
gcagcacaugcgggcucgccca

SEQ ID NO: 747418 - RNA, 17 nt, Homo sapiens
gcagcaccugauucuca

SEQ ID NO: 747419 - RNA, 12 nt, Homo sapiens
gcagcacuggaa

SEQ ID NO: 747420 - RNA, 15 nt, Homo sapiens
gcagcagagaaccau

SEQ ID NO: 747421 - RNA, 16 nt, Homo sapiens
gcagcagccagcacca

SEQ ID NO: 747422 - RNA, 23 nt, Homo sapiens
gcagcagguaccagcacggcccu

SEQ ID NO: 747423 - RNA, 21 nt, Homo sapiens
gcagcaucuucaaacauguac

SEQ ID NO: 747424 - RNA, 14 nt, Homo sapiens
gcagccaacccggc

SEQ ID NO: 747425 - RNA, 20 nt, Homo sapiens
gcagccacuuucugccagca

SEQ ID NO: 747426 - RNA, 23 nt, Homo sapiens
gcagccagagcugugccugcuca

SEQ ID NO: 747427 - RNA, 15 nt, Homo sapiens
gcagccagcacccac

SEQ ID NO: 747428 - RNA, 17 nt, Homo sapiens
gcagccaggacaccggg

SEQ ID NO: 747429 - RNA, 14 nt, Homo sapiens
gcagcccagagacu

SEQ ID NO: 747430 - RNA, 20 nt, Homo sapiens
gcagcccggcgccaccaucc

SEQ ID NO: 747431 - RNA, 20 nt, Homo sapiens
gcagcccuaaggaucucuca

SEQ ID NO: 747432 - RNA, 13 nt, Homo sapiens
gcagccucaaaac

SEQ ID NO: 747433 - RNA, 19 nt, Homo sapiens
gcagccucaaaacggguca

SEQ ID NO: 747434 - RNA, 15 nt, Homo sapiens
gcagccucacuucua

SEQ ID NO: 747435 - RNA, 15 nt, Homo sapiens
gcagcuaaaaaugca

SEQ ID NO: 747436 - RNA, 19 nt, Homo sapiens
gcagcuaaaggaagugaau

SEQ ID NO: 747437 - RNA, 14 nt, Homo sapiens
gcagcuaagccaca

SEQ ID NO: 747438 - RNA, 22 nt, Homo sapiens
gcagcuaccagguguucuacac

SEQ ID NO: 747439 - RNA, 13 nt, Homo sapiens
gcagcuacuggaa

SEQ ID NO: 747440 - RNA, 18 nt, Homo sapiens
gcagcuaucucucaguga

SEQ ID NO: 747441 - RNA, 21 nt, Homo sapiens
gcagcucccauuucaucagca

SEQ ID NO: 747442 - RNA, 23 nt, Homo sapiens
gcagcucccauuucaucagcaag

SEQ ID NO: 747443 - RNA, 13 nt, Homo sapiens
gcagcucuacucu

SEQ ID NO: 747444 - RNA, 13 nt, Homo sapiens
gcagcucugugac

SEQ ID NO: 747445 - RNA, 13 nt, Homo sapiens
gcagcucuuggga

SEQ ID NO: 747446 - RNA, 21 nt, Homo sapiens
gcagcuggggagcagcugaga

SEQ ID NO: 747447 - RNA, 19 nt, Homo sapiens
gcagcugguggaagaccug

SEQ ID NO: 747448 - RNA, 17 nt, Homo sapiens
gcagcuguuucucauga

SEQ ID NO: 747449 - RNA, 20 nt, Homo sapiens
gcagcuucaccagagcauuu

SEQ ID NO: 747450 - RNA, 21 nt, Homo sapiens
gcagcuucaccagagcauuuc

SEQ ID NO: 747451 - RNA, 15 nt, Homo sapiens
gcagcuucagugaca

SEQ ID NO: 747452 - RNA, 9 nt, Homo sapiens
gcagcuuua

SEQ ID NO: 747453 - RNA, 21 nt, Homo sapiens
gcagcuuuagccaagugcagg

SEQ ID NO: 747454 - RNA, 21 nt, Homo sapiens
gcagcuuucaagcucaucugu

SEQ ID NO: 747455 - RNA, 15 nt, Homo sapiens
gcaggaagugucuag

SEQ ID NO: 747456 - RNA, 13 nt, Homo sapiens
gcaggaccgccau

SEQ ID NO: 747457 - RNA, 17 nt, Homo sapiens
gcaggaccuugggcaca

SEQ ID NO: 747458 - RNA, 21 nt, Homo sapiens
gcaggacuugagaagaccuca

SEQ ID NO: 747459 - RNA, 20 nt, Homo sapiens
gcaggagcagcugugcugca

SEQ ID NO: 747460 - RNA, 22 nt, Homo sapiens
gcaggagccugcagucacuggc

SEQ ID NO: 747461 - RNA, 22 nt, Homo sapiens
gcaggaggcccuugucguggga

SEQ ID NO: 747462 - RNA, 20 nt, Homo sapiens
gcaggauauuugcacuauuu

SEQ ID NO: 747463 - RNA, 15 nt, Homo sapiens
gcaggaugaugcugu

SEQ ID NO: 747464 - RNA, 24 nt, Homo sapiens
gcaggauuucuucacaccucuccu

SEQ ID NO: 747465 - RNA, 15 nt, Homo sapiens
gcaggcaauuucacc

SEQ ID NO: 747466 - RNA, 19 nt, Homo sapiens
gcaggcacaaaucuugggu

SEQ ID NO: 747467 - RNA, 15 nt, Homo sapiens
gcaggcguacagguu

SEQ ID NO: 747468 - RNA, 15 nt, Homo sapiens
gcaggcuacugucag

SEQ ID NO: 747469 - RNA, 21 nt, Homo sapiens
gcaggcuaugaaguugcaaug

SEQ ID NO: 747470 - RNA, 15 nt, Homo sapiens
gcaggcugggccaug

SEQ ID NO: 747471 - RNA, 18 nt, Homo sapiens
gcaggcugggccaugucc

SEQ ID NO: 747472 - RNA, 19 nt, Homo sapiens
gcaggcugggccaugucca

SEQ ID NO: 747473 - RNA, 22 nt, Homo sapiens
gcaggcuguggggcagcugagc

SEQ ID NO: 747474 - RNA, 21 nt, Homo sapiens
gcagggaagccccacuugaag

SEQ ID NO: 747475 - RNA, 16 nt, Homo sapiens
gcagggacuccaugcu

SEQ ID NO: 747476 - RNA, 18 nt, Homo sapiens
gcagggauuagguguuca

SEQ ID NO: 747477 - RNA, 14 nt, Homo sapiens
gcagggauucuucc

SEQ ID NO: 747478 - RNA, 23 nt, Homo sapiens
gcagggcaaaugacaugcacuga

SEQ ID NO: 747479 - RNA, 16 nt, Homo sapiens
gcaggggccuggagau

SEQ ID NO: 747480 - RNA, 23 nt, Homo sapiens
gcaggggcggguggaucaccuga

SEQ ID NO: 747481 - RNA, 15 nt, Homo sapiens
gcaggucugcaaggg

SEQ ID NO: 747482 - RNA, 12 nt, Homo sapiens
gcaggugcugcc

SEQ ID NO: 747483 - RNA, 16 nt, Homo sapiens
gcagguguucugcuga

SEQ ID NO: 747484 - RNA, 19 nt, Homo sapiens
gcagguguucuucauuacc

SEQ ID NO: 747485 - RNA, 22 nt, Homo sapiens
gcagguuccuuaucugucacac

SEQ ID NO: 747486 - RNA, 11 nt, Homo sapiens
gcagguugaga

SEQ ID NO: 747487 - RNA, 18 nt, Homo sapiens
gcaguaaaagaugaaguu

SEQ ID NO: 747488 - RNA, 16 nt, Homo sapiens
gcaguacagccgagac

SEQ ID NO: 747489 - RNA, 19 nt, Homo sapiens
gcaguagaaauaauaugca

SEQ ID NO: 747490 - RNA, 19 nt, Homo sapiens
gcaguaggggcuacuguga

SEQ ID NO: 747491 - RNA, 13 nt, Homo sapiens
gcaguaguuuuca

SEQ ID NO: 747492 - RNA, 20 nt, Homo sapiens
gcaguauguacuucagugca

SEQ ID NO: 747493 - RNA, 22 nt, Homo sapiens
gcaguauguacuucagugcacc

SEQ ID NO: 747494 - RNA, 17 nt, Homo sapiens
gcagucaacaguucaaa

SEQ ID NO: 747495 - RNA, 21 nt, Homo sapiens
gcagucagcccuuauggccaa

SEQ ID NO: 747496 - RNA, 22 nt, Homo sapiens
gcagucaggggucaggugucag

SEQ ID NO: 747497 - RNA, 22 nt, Homo sapiens
gcagucauggaggccaagaacu

SEQ ID NO: 747498 - RNA, 19 nt, Homo sapiens
gcagucccuccacauuucc

SEQ ID NO: 747499 - RNA, 19 nt, Homo sapiens
gcaguccgcagucuggccu

SEQ ID NO: 747500 - RNA, 20 nt, Homo sapiens
gcagucggugguaccugaga

SEQ ID NO: 747501 - RNA, 21 nt, Homo sapiens
gcagucggugguaccugagau

SEQ ID NO: 747502 - RNA, 17 nt, Homo sapiens
gcagucgugccuguguc

SEQ ID NO: 747503 - RNA, 23 nt, Homo sapiens
gcagugacgugcaccuguacuca

SEQ ID NO: 747504 - RNA, 13 nt, Homo sapiens
gcagugaugucac

SEQ ID NO: 747505 - RNA, 12 nt, Homo sapiens
gcagugcccuuu

SEQ ID NO: 747506 - RNA, 18 nt, Homo sapiens
gcagugcuguccaacaag

SEQ ID NO: 747507 - RNA, 18 nt, Homo sapiens
gcaguggaacaugcaagg

SEQ ID NO: 747508 - RNA, 17 nt, Homo sapiens
gcaguggcaucaucuca

SEQ ID NO: 747509 - RNA, 22 nt, Homo sapiens
gcaguggcaucaucucagcuca

SEQ ID NO: 747510 - RNA, 18 nt, Homo sapiens
gcaguggcaucugagugg

SEQ ID NO: 747511 - RNA, 21 nt, Homo sapiens
gcaguggcgugaucucagcuc

SEQ ID NO: 747512 - RNA, 17 nt, Homo sapiens
gcaguggcgugaucucg

SEQ ID NO: 747513 - RNA, 23 nt, Homo sapiens
gcaguggcuaguggggugaacag

SEQ ID NO: 747514 - RNA, 21 nt, Homo sapiens
gcaguguuucccguauugaca

SEQ ID NO: 747515 - RNA, 16 nt, Homo sapiens
gcaguuacaaauuaua

SEQ ID NO: 747516 - RNA, 21 nt, Homo sapiens
gcaguucccuccgcagaacac

SEQ ID NO: 747517 - RNA, 23 nt, Homo sapiens
gcaguucugaguguuuaauuuca

SEQ ID NO: 747518 - RNA, 19 nt, Homo sapiens
gcaguugaaaagacuccaa

SEQ ID NO: 747519 - RNA, 14 nt, Homo sapiens
gcaguugaguuucu

SEQ ID NO: 747520 - RNA, 21 nt, Homo sapiens
gcccugaccaaugugugaagu

SEQ ID NO: 747521 - RNA, 16 nt, Homo sapiens
gcccugaccuucuggg

SEQ ID NO: 747522 - RNA, 16 nt, Homo sapiens
gcccugcaccaugcug

SEQ ID NO: 747523 - RNA, 17 nt, Homo sapiens
gcccugcaccugugcag

SEQ ID NO: 747524 - RNA, 18 nt, Homo sapiens
gcccugcagggaguaccg

SEQ ID NO: 747525 - RNA, 16 nt, Homo sapiens
gcccugcugugggaga

SEQ ID NO: 747526 - RNA, 18 nt, Homo sapiens
gcccugggacaucaggag

SEQ ID NO: 747527 - RNA, 22 nt, Homo sapiens
gcccugggucuugccaugugcu

SEQ ID NO: 747528 - RNA, 17 nt, Homo sapiens
gcccugguguguuucca

SEQ ID NO: 747529 - RNA, 23 nt, Homo sapiens
gcccugucugaaggacacuuccu

SEQ ID NO: 747530 - RNA, 11 nt, Homo sapiens
gcccugugcac

SEQ ID NO: 747531 - RNA, 22 nt, Homo sapiens
gcccuuccucacagaguuaaau

SEQ ID NO: 747532 - RNA, 18 nt, Homo sapiens
gcccuuccucuccacugc

SEQ ID NO: 747533 - RNA, 15 nt, Homo sapiens
gcccuuggagcugcc

SEQ ID NO: 747534 - RNA, 19 nt, Homo sapiens
gcccuuggcuucugugaug

SEQ ID NO: 747535 - RNA, 23 nt, Homo sapiens
gcccuuuaacuuucagaggcaau

SEQ ID NO: 747536 - RNA, 20 nt, Homo sapiens
gcccuuucauggucugcuga

SEQ ID NO: 747537 - RNA, 18 nt, Homo sapiens
gccgaaaacaggagcaaa

SEQ ID NO: 747538 - RNA, 19 nt, Homo sapiens
gccgacugccugugaagug

SEQ ID NO: 747539 - RNA, 17 nt, Homo sapiens
gccgacuggcugugaga

SEQ ID NO: 747540 - RNA, 21 nt, Homo sapiens
gccgagaucacgccacugcac

SEQ ID NO: 747541 - RNA, 14 nt, Homo sapiens
gccgaggaggcauu

SEQ ID NO: 747542 - RNA, 23 nt, Homo sapiens
gccgaggggagagagggacucaa

SEQ ID NO: 747543 - RNA, 17 nt, Homo sapiens
gccgcagacgggcacag

SEQ ID NO: 747544 - RNA, 19 nt, Homo sapiens
gccgcauucccugagucac

SEQ ID NO: 747545 - RNA, 15 nt, Homo sapiens
gccgccuuaagcuga

SEQ ID NO: 747546 - RNA, 24 nt, Homo sapiens
gccgcgcccuuuccccgacgccca

SEQ ID NO: 747547 - RNA, 13 nt, Homo sapiens
gccgcgugacgga

SEQ ID NO: 747548 - RNA, 20 nt, Homo sapiens
gccggacgcaggugcugcgg

SEQ ID NO: 747549 - RNA, 17 nt, Homo sapiens
gccggcauggugccugg

SEQ ID NO: 747550 - RNA, 20 nt, Homo sapiens
gccggcuccaguuuccccau

SEQ ID NO: 747551 - RNA, 14 nt, Homo sapiens
gccgggaacagaga

SEQ ID NO: 747552 - RNA, 18 nt, Homo sapiens
gccgggcaugauggugca

SEQ ID NO: 747553 - RNA, 18 nt, Homo sapiens
gccgggcaugguggcaca

SEQ ID NO: 747554 - RNA, 14 nt, Homo sapiens
gccgggcgcagugg

SEQ ID NO: 747555 - RNA, 19 nt, Homo sapiens
gccgggugugguggcucac

SEQ ID NO: 747556 - RNA, 17 nt, Homo sapiens
gccgucagagcagugac

SEQ ID NO: 747557 - RNA, 18 nt, Homo sapiens
gccguggcuauaccuggg

SEQ ID NO: 747558 - RNA, 16 nt, Homo sapiens
gccuaaaucuccagug

SEQ ID NO: 747559 - RNA, 15 nt, Homo sapiens
gccuaagcggcuguu

SEQ ID NO: 747560 - RNA, 19 nt, Homo sapiens
gccuaaguccaguguuucu

SEQ ID NO: 747561 - RNA, 15 nt, Homo sapiens
gccuaauaguaacug

SEQ ID NO: 747562 - RNA, 14 nt, Homo sapiens
gccuaauuuaccaa

SEQ ID NO: 747563 - RNA, 15 nt, Homo sapiens
gccuacacacacagc

SEQ ID NO: 747564 - RNA, 21 nt, Homo sapiens
gccuacagucaucugccacca

SEQ ID NO: 747565 - RNA, 14 nt, Homo sapiens
gccuacuccaaaau

SEQ ID NO: 747566 - RNA, 21 nt, Homo sapiens
gccuacuuucacacuaagaaa

SEQ ID NO: 747567 - RNA, 19 nt, Homo sapiens
gccuagcaggcacaggaca

SEQ ID NO: 747568 - RNA, 21 nt, Homo sapiens
gccuaggaguugaguacagug

SEQ ID NO: 747569 - RNA, 19 nt, Homo sapiens
gccuaugcacauauggacu

SEQ ID NO: 747570 - RNA, 17 nt, Homo sapiens
gccuauucacuugcuga

SEQ ID NO: 747571 - RNA, 20 nt, Homo sapiens
gccuauuguuuguaaaacca

SEQ ID NO: 747572 - RNA, 14 nt, Homo sapiens
gccucaaacucaac

SEQ ID NO: 747573 - RNA, 16 nt, Homo sapiens
gccucaagaacaaaca

SEQ ID NO: 747574 - RNA, 19 nt, Homo sapiens
gccucaagaugaaggcaaa

SEQ ID NO: 747575 - RNA, 13 nt, Homo sapiens
gccucaaugccag

SEQ ID NO: 747576 - RNA, 17 nt, Homo sapiens
gccucacaccccagugg

SEQ ID NO: 747577 - RNA, 20 nt, Homo sapiens
gccucaccguccucacccau

SEQ ID NO: 747578 - RNA, 13 nt, Homo sapiens
gccucaccugcug

SEQ ID NO: 747579 - RNA, 21 nt, Homo sapiens
gccucaccugcuguccugcaa

SEQ ID NO: 747580 - RNA, 14 nt, Homo sapiens
gccucagcuucuca

SEQ ID NO: 747581 - RNA, 18 nt, Homo sapiens
gccucagcuucucaaagu

SEQ ID NO: 747582 - RNA, 22 nt, Homo sapiens
gccucaguuuuccuucuguuaa

SEQ ID NO: 747583 - RNA, 15 nt, Homo sapiens
gccucaucuccuuua

SEQ ID NO: 747584 - RNA, 13 nt, Homo sapiens
gccucaucuucaa

SEQ ID NO: 747585 - RNA, 21 nt, Homo sapiens
gccuccacagcgagggcagcu

SEQ ID NO: 747586 - RNA, 17 nt, Homo sapiens
gccuccaccagcaaggg

SEQ ID NO: 747587 - RNA, 10 nt, Homo sapiens
gccuccacuc

SEQ ID NO: 747588 - RNA, 16 nt, Homo sapiens
gccuccagccccaugu

SEQ ID NO: 747589 - RNA, 17 nt, Homo sapiens
gccuccagcuucaggca

SEQ ID NO: 747590 - RNA, 21 nt, Homo sapiens
gccuccagggcauugcucagc

SEQ ID NO: 747591 - RNA, 12 nt, Homo sapiens
gccuccaugccc

SEQ ID NO: 747592 - RNA, 13 nt, Homo sapiens
gccucccacaaga

SEQ ID NO: 747593 - RNA, 14 nt, Homo sapiens
gccucccacagugc

SEQ ID NO: 747594 - RNA, 15 nt, Homo sapiens
gccucccauguucaa

SEQ ID NO: 747595 - RNA, 17 nt, Homo sapiens
gccucccauguucaagc

SEQ ID NO: 747596 - RNA, 19 nt, Homo sapiens
gccuccccgugccaaaaau

SEQ ID NO: 747597 - RNA, 21 nt, Homo sapiens
gccuccccucuccuuccugug

SEQ ID NO: 747598 - RNA, 16 nt, Homo sapiens
gccucccgaaugaagc

SEQ ID NO: 747599 - RNA, 18 nt, Homo sapiens
gccucccugaagccuuug

SEQ ID NO: 747600 - RNA, 17 nt, Homo sapiens
gccuccgcugggcuuca

SEQ ID NO: 747601 - RNA, 13 nt, Homo sapiens
gccuccucaguga

SEQ ID NO: 747602 - RNA, 21 nt, Homo sapiens
gccuccucuguccagggcccu

SEQ ID NO: 747603 - RNA, 21 nt, Homo sapiens
gccuccuuuccccucccucag

SEQ ID NO: 747604 - RNA, 18 nt, Homo sapiens
gccucgggaccucaggug

SEQ ID NO: 747605 - RNA, 13 nt, Homo sapiens
gccucgugccagc

SEQ ID NO: 747606 - RNA, 22 nt, Homo sapiens
gccucucugccugggaugggcu

SEQ ID NO: 747607 - RNA, 17 nt, Homo sapiens
gccucucuuuuugggcu

SEQ ID NO: 747608 - RNA, 20 nt, Homo sapiens
gccucugcuccccugugaac

SEQ ID NO: 747609 - RNA, 18 nt, Homo sapiens
gccucuggaauugcucaa

SEQ ID NO: 747610 - RNA, 22 nt, Homo sapiens
gccucuuccgugacgucacugg

SEQ ID NO: 747611 - RNA, 20 nt, Homo sapiens
gccucuuccugcagccucac

SEQ ID NO: 747612 - RNA, 19 nt, Homo sapiens
gccucuucuuugugccuuu

SEQ ID NO: 747613 - RNA, 19 nt, Homo sapiens
gccucuuguguaacuaauu

SEQ ID NO: 747614 - RNA, 16 nt, Homo sapiens
gccugaacaugccccu

SEQ ID NO: 747615 - RNA, 12 nt, Homo sapiens
gccugaaccugg

SEQ ID NO: 747616 - RNA, 22 nt, Homo sapiens
gccugaaugucuuacugugauc

SEQ ID NO: 747617 - RNA, 16 nt, Homo sapiens
gccugacaaccacugg

SEQ ID NO: 747618 - RNA, 18 nt, Homo sapiens
gccugagaugcaggugau

SEQ ID NO: 747619 - RNA, 11 nt, Homo sapiens
gccugagcaac

SEQ ID NO: 747620 - RNA, 17 nt, Homo sapiens
gccugagccucugcuuc

SEQ ID NO: 747621 - RNA, 22 nt, Homo sapiens
gccugaggaggaggacacagca

SEQ ID NO: 747622 - RNA, 16 nt, Homo sapiens
gccugaggugugugcc

SEQ ID NO: 747623 - RNA, 23 nt, Homo sapiens
gccugaggugugugccacucaga

SEQ ID NO: 747624 - RNA, 17 nt, Homo sapiens
gccugagucagugcucu

SEQ ID NO: 747625 - RNA, 21 nt, Homo sapiens
gccugauggugcugcucaggc

SEQ ID NO: 747626 - RNA, 22 nt, Homo sapiens
gccugcaaacucacugcucaag

SEQ ID NO: 747627 - RNA, 21 nt, Homo sapiens
gccugcacagugaagugcugg

SEQ ID NO: 747628 - RNA, 11 nt, Homo sapiens
gccugcacugg

SEQ ID NO: 747629 - RNA, 16 nt, Homo sapiens
gccugcaucugugaaa

SEQ ID NO: 747630 - RNA, 13 nt, Homo sapiens
gccugcauucugc

SEQ ID NO: 747631 - RNA, 23 nt, Homo sapiens
gccugccccaaacaaauaugcaa

SEQ ID NO: 747632 - RNA, 22 nt, Homo sapiens
gccugccccccucaucucauuc

SEQ ID NO: 747633 - RNA, 19 nt, Homo sapiens
gccugcuguggacccuguc

SEQ ID NO: 747634 - RNA, 16 nt, Homo sapiens
gggcuuaccaggugag

SEQ ID NO: 747635 - RNA, 19 nt, Homo sapiens
gggcuuaccuguacacuga

SEQ ID NO: 747636 - RNA, 16 nt, Homo sapiens
gggcuuucuggggccu

SEQ ID NO: 747637 - RNA, 18 nt, Homo sapiens
ggggaagaguggucuuga

SEQ ID NO: 747638 - RNA, 13 nt, Homo sapiens
ggggacacuuccc

SEQ ID NO: 747639 - RNA, 19 nt, Homo sapiens
ggggaccaggaugacaccu

SEQ ID NO: 747640 - RNA, 17 nt, Homo sapiens
ggggacucagggaccgg

SEQ ID NO: 747641 - RNA, 20 nt, Homo sapiens
ggggagugugugugggguuu

SEQ ID NO: 747642 - RNA, 15 nt, Homo sapiens
ggggaucgaugugcu

SEQ ID NO: 747643 - RNA, 12 nt, Homo sapiens
ggggauuguaca

SEQ ID NO: 747644 - RNA, 21 nt, Homo sapiens
ggggcagccacaccacugcca

SEQ ID NO: 747645 - RNA, 15 nt, Homo sapiens
ggggcagcuucauga

SEQ ID NO: 747646 - RNA, 18 nt, Homo sapiens
ggggcaggcugggccaug

SEQ ID NO: 747647 - RNA, 13 nt, Homo sapiens
ggggcagggcagc

SEQ ID NO: 747648 - RNA, 13 nt, Homo sapiens
ggggcagugugag

SEQ ID NO: 747649 - RNA, 13 nt, Homo sapiens
ggggccacuuuca

SEQ ID NO: 747650 - RNA, 22 nt, Homo sapiens
ggggcccaaauucuuucagugg

SEQ ID NO: 747651 - RNA, 21 nt, Homo sapiens
ggggcuagaaaucuguugcua

SEQ ID NO: 747652 - RNA, 13 nt, Homo sapiens
ggggcucuucuca

SEQ ID NO: 747653 - RNA, 15 nt, Homo sapiens
ggggcugaggggcaa

SEQ ID NO: 747654 - RNA, 23 nt, Homo sapiens
ggggcugggcugggcgcgguggu

SEQ ID NO: 747655 - RNA, 22 nt, Homo sapiens
ggggcugucaccacgugcagua

SEQ ID NO: 747656 - RNA, 21 nt, Homo sapiens
gggggcggggcugucaccacg

SEQ ID NO: 747657 - RNA, 15 nt, Homo sapiens
gggggcuccacccca

SEQ ID NO: 747658 - RNA, 18 nt, Homo sapiens
gggguauaaaacuuuccu

SEQ ID NO: 747659 - RNA, 23 nt, Homo sapiens
gggguccuguuaacgucaucuca

SEQ ID NO: 747660 - RNA, 14 nt, Homo sapiens
ggggucugagcaug

SEQ ID NO: 747661 - RNA, 13 nt, Homo sapiens
gggguggagcaug

SEQ ID NO: 747662 - RNA, 14 nt, Homo sapiens
gggguuagaccacu

SEQ ID NO: 747663 - RNA, 17 nt, Homo sapiens
gggguuucuggggucca

SEQ ID NO: 747664 - RNA, 18 nt, Homo sapiens
gggguuuuguaaugacag

SEQ ID NO: 747665 - RNA, 21 nt, Homo sapiens
ggguacaagagaugggaugcu

SEQ ID NO: 747666 - RNA, 23 nt, Homo sapiens
ggguaccuucaggcagccagugu

SEQ ID NO: 747667 - RNA, 14 nt, Homo sapiens
ggguagacuuggag

SEQ ID NO: 747668 - RNA, 22 nt, Homo sapiens
ggguaggcgggaaggaggguua

SEQ ID NO: 747669 - RNA, 12 nt, Homo sapiens
ggguccaccaug

SEQ ID NO: 747670 - RNA, 23 nt, Homo sapiens
gggucccccugcuugucuucacc

SEQ ID NO: 747671 - RNA, 15 nt, Homo sapiens
gggucccuuaaagau

SEQ ID NO: 747672 - RNA, 17 nt, Homo sapiens
ggguccugccgguggga

SEQ ID NO: 747673 - RNA, 22 nt, Homo sapiens
gggucucucacuguugcagugg

SEQ ID NO: 747674 - RNA, 23 nt, Homo sapiens
gggucuugcggcugaagugucac

SEQ ID NO: 747675 - RNA, 16 nt, Homo sapiens
gggucuuugaacccuu

SEQ ID NO: 747676 - RNA, 20 nt, Homo sapiens
gggucuuugugagagugagc

SEQ ID NO: 747677 - RNA, 22 nt, Homo sapiens
gggugaccagccacucaaagga

SEQ ID NO: 747678 - RNA, 18 nt, Homo sapiens
gggugacccugaagugag

SEQ ID NO: 747679 - RNA, 17 nt, Homo sapiens
gggugcccucuccaaag

SEQ ID NO: 747680 - RNA, 19 nt, Homo sapiens
gggugcccucuccaaaggc

SEQ ID NO: 747681 - RNA, 22 nt, Homo sapiens
gggugccgcucucucugagggg

SEQ ID NO: 747682 - RNA, 14 nt, Homo sapiens
gggugccgcugucu

SEQ ID NO: 747683 - RNA, 18 nt, Homo sapiens
gggugccgcugucucuga

SEQ ID NO: 747684 - RNA, 13 nt, Homo sapiens
ggguggaugaucu

SEQ ID NO: 747685 - RNA, 20 nt, Homo sapiens
ggguggcacucaacucugag

SEQ ID NO: 747686 - RNA, 20 nt, Homo sapiens
gggugugggccaccagagaa

SEQ ID NO: 747687 - RNA, 20 nt, Homo sapiens
gggugugggucaaaccaaga

SEQ ID NO: 747688 - RNA, 17 nt, Homo sapiens
ggguguguguagccaag

SEQ ID NO: 747689 - RNA, 16 nt, Homo sapiens
ggguuacaaacugcaa

SEQ ID NO: 747690 - RNA, 14 nt, Homo sapiens
ggguucucacagug

SEQ ID NO: 747691 - RNA, 22 nt, Homo sapiens
ggguucuuauuuugcauuccag

SEQ ID NO: 747692 - RNA, 21 nt, Homo sapiens
ggguucuugagccagccaggc

SEQ ID NO: 747693 - RNA, 14 nt, Homo sapiens
ggguugaaagacau

SEQ ID NO: 747694 - RNA, 19 nt, Homo sapiens
ggguuggacuguaagggau

SEQ ID NO: 747695 - RNA, 17 nt, Homo sapiens
ggguuggugcacaguga

SEQ ID NO: 747696 - RNA, 22 nt, Homo sapiens
ggguuuaauagacugagucaga

SEQ ID NO: 747697 - RNA, 20 nt, Homo sapiens
ggguuucaccaucuuggcca

SEQ ID NO: 747698 - RNA, 13 nt, Homo sapiens
gguaaaacagggc

SEQ ID NO: 747699 - RNA, 15 nt, Homo sapiens
gguaaaggucugugg

SEQ ID NO: 747700 - RNA, 14 nt, Homo sapiens
gguaaaugguauga

SEQ ID NO: 747701 - RNA, 17 nt, Homo sapiens
gguaacuuggcugcauu

SEQ ID NO: 747702 - RNA, 23 nt, Homo sapiens
gguaacuuuuuuuuaaagcucau

SEQ ID NO: 747703 - RNA, 15 nt, Homo sapiens
gguaauagaauagca

SEQ ID NO: 747704 - RNA, 16 nt, Homo sapiens
gguacccagucaccuc

SEQ ID NO: 747705 - RNA, 17 nt, Homo sapiens
gguaccugcaagcagaa

SEQ ID NO: 747706 - RNA, 21 nt, Homo sapiens
gguacuauuuagauauaacac

SEQ ID NO: 747707 - RNA, 14 nt, Homo sapiens
gguacuuaaagcuu

SEQ ID NO: 747708 - RNA, 14 nt, Homo sapiens
gguagaaaggcagu

SEQ ID NO: 747709 - RNA, 19 nt, Homo sapiens
gguagagaugggguuucac

SEQ ID NO: 747710 - RNA, 22 nt, Homo sapiens
gguaggggcuuaaaagaaacua

SEQ ID NO: 747711 - RNA, 17 nt, Homo sapiens
gguaguauuacaccacc

SEQ ID NO: 747712 - RNA, 21 nt, Homo sapiens
gguauaaugguugacuggguu

SEQ ID NO: 747713 - RNA, 16 nt, Homo sapiens
gguauauacuuugaaa

SEQ ID NO: 747714 - RNA, 19 nt, Homo sapiens
gguaucaguugcaauaaua

SEQ ID NO: 747715 - RNA, 19 nt, Homo sapiens
gguaucugcugccucugaa

SEQ ID NO: 747716 - RNA, 20 nt, Homo sapiens
gguaucuguuuaacauuucc

SEQ ID NO: 747717 - RNA, 16 nt, Homo sapiens
gguauggcagaggugc

SEQ ID NO: 747718 - RNA, 21 nt, Homo sapiens
gguaugucugccauguugccc

SEQ ID NO: 747719 - RNA, 22 nt, Homo sapiens
gguauguguggaugaugcugcc

SEQ ID NO: 747720 - RNA, 20 nt, Homo sapiens
gguauguuuuaccaucugca

SEQ ID NO: 747721 - RNA, 19 nt, Homo sapiens
gguauuauucuguuuugca

SEQ ID NO: 747722 - RNA, 16 nt, Homo sapiens
ggucaaguaagaagac

SEQ ID NO: 747723 - RNA, 13 nt, Homo sapiens
ggucaaugcaguu

SEQ ID NO: 747724 - RNA, 13 nt, Homo sapiens
ggucacacucuca

SEQ ID NO: 747725 - RNA, 18 nt, Homo sapiens
ggucacccuucaacgcuc

SEQ ID NO: 747726 - RNA, 23 nt, Homo sapiens
ggucacuuaaagggucuuaugaa

SEQ ID NO: 747727 - RNA, 14 nt, Homo sapiens
ggucagaacauguu

SEQ ID NO: 747728 - RNA, 13 nt, Homo sapiens
ggucagagccacu

SEQ ID NO: 747729 - RNA, 14 nt, Homo sapiens
ggucagagugccac

SEQ ID NO: 747730 - RNA, 22 nt, Homo sapiens
ggucagccauuuuuaaugaucu

SEQ ID NO: 747731 - RNA, 21 nt, Homo sapiens
ggucagcuugaauguccccau

SEQ ID NO: 747732 - RNA, 22 nt, Homo sapiens
ggucaggcggggugcuguggug

SEQ ID NO: 747733 - RNA, 16 nt, Homo sapiens
ggucagucuuugcuca

SEQ ID NO: 747734 - RNA, 20 nt, Homo sapiens
ggucauauuaauauauuucc

SEQ ID NO: 747735 - RNA, 17 nt, Homo sapiens
ggucaugcuuuugccac

SEQ ID NO: 747736 - RNA, 15 nt, Homo sapiens
gguccaggaaggcag

SEQ ID NO: 747737 - RNA, 17 nt, Homo sapiens
ggucccaccuccauuug

SEQ ID NO: 747738 - RNA, 21 nt, Homo sapiens
gguccccccgagucuccggga

SEQ ID NO: 747739 - RNA, 23 nt, Homo sapiens
ggucccuaauucucuucgcugug

SEQ ID NO: 747740 - RNA, 14 nt, Homo sapiens
gguccuccuaucuc

SEQ ID NO: 747741 - RNA, 21 nt, Homo sapiens
gguccucuacuuaaugagaua

SEQ ID NO: 747742 - RNA, 17 nt, Homo sapiens
gguccucucugagucaa

SEQ ID NO: 747743 - RNA, 22 nt, Homo sapiens
gguccuggccuugugucacugg

SEQ ID NO: 747744 - RNA, 19 nt, Homo sapiens
gguccuucaaacaauguaa

SEQ ID NO: 747745 - RNA, 15 nt, Homo sapiens
gguccuuccuaccuc

SEQ ID NO: 747746 - RNA, 16 nt, Homo sapiens
ggucuaacacuggcau

SEQ ID NO: 747747 - RNA, 16 nt, Homo sapiens
ggucuaagguucagcc

SEQ ID NO: 747748 - RNA, 17 nt, Homo sapiens
guaucuucaaacuuuca

SEQ ID NO: 747749 - RNA, 15 nt, Homo sapiens
guaugaaugcagugg

SEQ ID NO: 747750 - RNA, 20 nt, Homo sapiens
guaugauggcaggagaauca

SEQ ID NO: 747751 - RNA, 21 nt, Homo sapiens
guaugcaaaccucaucuuucu

SEQ ID NO: 747752 - RNA, 18 nt, Homo sapiens
guaugcaacucugacguu

SEQ ID NO: 747753 - RNA, 15 nt, Homo sapiens
guaugcaaucuuaau

SEQ ID NO: 747754 - RNA, 19 nt, Homo sapiens
guaugcacaauuccaugac

SEQ ID NO: 747755 - RNA, 22 nt, Homo sapiens
guaugcagggagcacuguucac

SEQ ID NO: 747756 - RNA, 12 nt, Homo sapiens
guaugccaagug

SEQ ID NO: 747757 - RNA, 21 nt, Homo sapiens
guaugccuuaagcagaacaaa

SEQ ID NO: 747758 - RNA, 21 nt, Homo sapiens
guaugccuuuaaaucugugau

SEQ ID NO: 747759 - RNA, 16 nt, Homo sapiens
guaugcuuaagagaaa

SEQ ID NO: 747760 - RNA, 13 nt, Homo sapiens
guaugggaucuga

SEQ ID NO: 747761 - RNA, 21 nt, Homo sapiens
guauggggaggcaaguguggg

SEQ ID NO: 747762 - RNA, 16 nt, Homo sapiens
guauguauauauacac

SEQ ID NO: 747763 - RNA, 22 nt, Homo sapiens
guaugucuacacguaaguauaa

SEQ ID NO: 747764 - RNA, 20 nt, Homo sapiens
guaugucugucuacaggaaa

SEQ ID NO: 747765 - RNA, 15 nt, Homo sapiens
guaugugccaaagcu

SEQ ID NO: 747766 - RNA, 12 nt, Homo sapiens
guaugugcucuu

SEQ ID NO: 747767 - RNA, 16 nt, Homo sapiens
guaugugucacugcau

SEQ ID NO: 747768 - RNA, 14 nt, Homo sapiens
guauguguguauau

SEQ ID NO: 747769 - RNA, 15 nt, Homo sapiens
guauguuuguuucau

SEQ ID NO: 747770 - RNA, 16 nt, Homo sapiens
guauuaacuauuggua

SEQ ID NO: 747771 - RNA, 17 nt, Homo sapiens
guauuaagugugcuuau

SEQ ID NO: 747772 - RNA, 22 nt, Homo sapiens
guauuaauguguuaagugcagg

SEQ ID NO: 747773 - RNA, 12 nt, Homo sapiens
guauuacugcuu

SEQ ID NO: 747774 - RNA, 16 nt, Homo sapiens
guauuagcucacugaa

SEQ ID NO: 747775 - RNA, 17 nt, Homo sapiens
guauuauauaauucaag

SEQ ID NO: 747776 - RNA, 16 nt, Homo sapiens
guauuaugcuggaauu

SEQ ID NO: 747777 - RNA, 18 nt, Homo sapiens
guauuaugucucuucuga

SEQ ID NO: 747778 - RNA, 18 nt, Homo sapiens
guauuauucuguuuugca

SEQ ID NO: 747779 - RNA, 14 nt, Homo sapiens
guauuauuugcaca

SEQ ID NO: 747780 - RNA, 17 nt, Homo sapiens
guauucagcguacuuga

SEQ ID NO: 747781 - RNA, 13 nt, Homo sapiens
guauuccacuuag

SEQ ID NO: 747782 - RNA, 21 nt, Homo sapiens
guauucccacucaccagcccu

SEQ ID NO: 747783 - RNA, 18 nt, Homo sapiens
guauuccgauacaaagug

SEQ ID NO: 747784 - RNA, 16 nt, Homo sapiens
guauucuacagcagau

SEQ ID NO: 747785 - RNA, 21 nt, Homo sapiens
guauucucuaaaagcuuuaaa

SEQ ID NO: 747786 - RNA, 16 nt, Homo sapiens
guauucucuuccucau

SEQ ID NO: 747787 - RNA, 15 nt, Homo sapiens
guauucuuauuuaau

SEQ ID NO: 747788 - RNA, 21 nt, Homo sapiens
guauucuuuacuaaagauauc

SEQ ID NO: 747789 - RNA, 18 nt, Homo sapiens
guauugaaauguuugcau

SEQ ID NO: 747790 - RNA, 12 nt, Homo sapiens
guauugcaccuu

SEQ ID NO: 747791 - RNA, 13 nt, Homo sapiens
guauuucucagga

SEQ ID NO: 747792 - RNA, 20 nt, Homo sapiens
guauuugaaauaagaauuca

SEQ ID NO: 747793 - RNA, 21 nt, Homo sapiens
guauuuggaaauaaagucaga

SEQ ID NO: 747794 - RNA, 23 nt, Homo sapiens
guauuuuauuacaucuuucacau

SEQ ID NO: 747795 - RNA, 12 nt, Homo sapiens
guauuuugccag

SEQ ID NO: 747796 - RNA, 14 nt, Homo sapiens
guauuuugccagac

SEQ ID NO: 747797 - RNA, 16 nt, Homo sapiens
guauuuuuaguagaga

SEQ ID NO: 747798 - RNA, 13 nt, Homo sapiens
gucaaaaaucugu

SEQ ID NO: 747799 - RNA, 17 nt, Homo sapiens
gucaaaacaagacuccu

SEQ ID NO: 747800 - RNA, 11 nt, Homo sapiens
gucaaacugua

SEQ ID NO: 747801 - RNA, 13 nt, Homo sapiens
gucaaacuguaga

SEQ ID NO: 747802 - RNA, 21 nt, Homo sapiens
gucaaagaaggugcugauccu

SEQ ID NO: 747803 - RNA, 17 nt, Homo sapiens
gucaaauguuuccuuaa

SEQ ID NO: 747804 - RNA, 21 nt, Homo sapiens
gucaacaucuuuuacauucug

SEQ ID NO: 747805 - RNA, 16 nt, Homo sapiens
gucaacauuuccaaaa

SEQ ID NO: 747806 - RNA, 18 nt, Homo sapiens
gucaacuuauucuuugag

SEQ ID NO: 747807 - RNA, 19 nt, Homo sapiens
gucaacuuuugaccaaaaa

SEQ ID NO: 747808 - RNA, 18 nt, Homo sapiens
gucaagaaacagccagca

SEQ ID NO: 747809 - RNA, 23 nt, Homo sapiens
gucaagaagaaaaagguuugcau

SEQ ID NO: 747810 - RNA, 19 nt, Homo sapiens
gucaagacagugucauggu

SEQ ID NO: 747811 - RNA, 16 nt, Homo sapiens
gucaagcugcucugag

SEQ ID NO: 747812 - RNA, 12 nt, Homo sapiens
gucaaggaauaa

SEQ ID NO: 747813 - RNA, 20 nt, Homo sapiens
gucaaggcaguagaacucca

SEQ ID NO: 747814 - RNA, 18 nt, Homo sapiens
gucaauccccucauucag

SEQ ID NO: 747815 - RNA, 13 nt, Homo sapiens
gucaauccuguca

SEQ ID NO: 747816 - RNA, 15 nt, Homo sapiens
gucaauuguaacuaa

SEQ ID NO: 747817 - RNA, 22 nt, Homo sapiens
gucacaagggauuggcaauugu

SEQ ID NO: 747818 - RNA, 21 nt, Homo sapiens
gucacaauccuaacacauuau

SEQ ID NO: 747819 - RNA, 18 nt, Homo sapiens
gucacacgauaaagggau

SEQ ID NO: 747820 - RNA, 11 nt, Homo sapiens
gucacacuggu

SEQ ID NO: 747821 - RNA, 12 nt, Homo sapiens
gucacagacucg

SEQ ID NO: 747822 - RNA, 14 nt, Homo sapiens
gucacagaugaaga

SEQ ID NO: 747823 - RNA, 16 nt, Homo sapiens
gucacaucagcaauuu

SEQ ID NO: 747824 - RNA, 13 nt, Homo sapiens
gucacaugaccca

SEQ ID NO: 747825 - RNA, 23 nt, Homo sapiens
gucacaugcuagcagcugugaug

SEQ ID NO: 747826 - RNA, 19 nt, Homo sapiens
gucacauuuagcugugcuc

SEQ ID NO: 747827 - RNA, 15 nt, Homo sapiens
gucacccaaacacuu

SEQ ID NO: 747828 - RNA, 23 nt, Homo sapiens
gucacccaggcuggaaugcagug

SEQ ID NO: 747829 - RNA, 22 nt, Homo sapiens
gucacccagguuggagugcagu

SEQ ID NO: 747830 - RNA, 20 nt, Homo sapiens
gucacuaccuucaugcauag

SEQ ID NO: 747831 - RNA, 16 nt, Homo sapiens
gucacugauacacaga

SEQ ID NO: 747832 - RNA, 19 nt, Homo sapiens
gucacugcucuggacugug

SEQ ID NO: 747833 - RNA, 15 nt, Homo sapiens
gucacuucucacaau

SEQ ID NO: 747834 - RNA, 22 nt, Homo sapiens
gucacuuuuuaaaccacuguau

SEQ ID NO: 747835 - RNA, 20 nt, Homo sapiens
gucagaaaaaggaaaccaca

SEQ ID NO: 747836 - RNA, 22 nt, Homo sapiens
gucagacucuuggcuacaguga

SEQ ID NO: 747837 - RNA, 15 nt, Homo sapiens
gucagagagaccuca

SEQ ID NO: 747838 - RNA, 17 nt, Homo sapiens
gucagagggacugucag

SEQ ID NO: 747839 - RNA, 15 nt, Homo sapiens
gucagaguucugcuc

SEQ ID NO: 747840 - RNA, 17 nt, Homo sapiens
gucagaguucugcucua

SEQ ID NO: 747841 - RNA, 13 nt, Homo sapiens
gucagcaucugac

SEQ ID NO: 747842 - RNA, 14 nt, Homo sapiens
gucagcaucugacc

SEQ ID NO: 747843 - RNA, 12 nt, Homo sapiens
gucagcauguac

SEQ ID NO: 747844 - RNA, 18 nt, Homo sapiens
gucagcauguacuccccu

SEQ ID NO: 747845 - RNA, 20 nt, Homo sapiens
gucagcccaugugcaccugc

SEQ ID NO: 747846 - RNA, 15 nt, Homo sapiens
gucagccgguccaug

SEQ ID NO: 747847 - RNA, 18 nt, Homo sapiens
gucagcugcagccacuuu

SEQ ID NO: 747848 - RNA, 21 nt, Homo sapiens
gucaggacaagggcucagagg

SEQ ID NO: 747849 - RNA, 23 nt, Homo sapiens
gucaggaguucaagacuagccug

SEQ ID NO: 747850 - RNA, 15 nt, Homo sapiens
gucaggaugcacauu

SEQ ID NO: 747851 - RNA, 15 nt, Homo sapiens
gucaggauucuucaa

SEQ ID NO: 747852 - RNA, 22 nt, Homo sapiens
gucaggauucuucaaggagaau

SEQ ID NO: 747853 - RNA, 15 nt, Homo sapiens
gucaggcccagagaa

SEQ ID NO: 747854 - RNA, 15 nt, Homo sapiens
gucagggacagcagc

SEQ ID NO: 747855 - RNA, 19 nt, Homo sapiens
gucagggcccaagucccug

SEQ ID NO: 747856 - RNA, 16 nt, Homo sapiens
gucaguauuuuugccg

SEQ ID NO: 747857 - RNA, 15 nt, Homo sapiens
gucagugucguuuau

SEQ ID NO: 747858 - RNA, 18 nt, Homo sapiens
gucaguuugguugggcua

SEQ ID NO: 747859 - RNA, 18 nt, Homo sapiens
gucauaagcauuacuuua

SEQ ID NO: 747860 - RNA, 20 nt, Homo sapiens
gucauaaugguuuuuaacac

SEQ ID NO: 747861 - RNA, 10 nt, Homo sapiens
gucauagaaa

SEQ ID NO: 747862 - RNA, 21 nt, Homo sapiens
gucauauauuuuuugcuacuu

SEQ ID NO: 747863 - RNA, 14 nt, Homo sapiens
guggcucacuacug

SEQ ID NO: 747864 - RNA, 15 nt, Homo sapiens
guggcucacuacuga

SEQ ID NO: 747865 - RNA, 12 nt, Homo sapiens
guggcuccugug

SEQ ID NO: 747866 - RNA, 20 nt, Homo sapiens
guggcugaugcuuugaacau

SEQ ID NO: 747867 - RNA, 19 nt, Homo sapiens
guggcugcaccacuuccag

SEQ ID NO: 747868 - RNA, 22 nt, Homo sapiens
guggcugcugaaacucauuuga

SEQ ID NO: 747869 - RNA, 12 nt, Homo sapiens
guggcuggucuc

SEQ ID NO: 747870 - RNA, 18 nt, Homo sapiens
guggcuucuaguuugcaa

SEQ ID NO: 747871 - RNA, 20 nt, Homo sapiens
guggcuugguuuggucaugc

SEQ ID NO: 747872 - RNA, 16 nt, Homo sapiens
guggcuuuuuguucag

SEQ ID NO: 747873 - RNA, 23 nt, Homo sapiens
gugggaacggcugauguggacug

SEQ ID NO: 747874 - RNA, 21 nt, Homo sapiens
gugggaaugugguaguaccca

SEQ ID NO: 747875 - RNA, 13 nt, Homo sapiens
gugggacugagau

SEQ ID NO: 747876 - RNA, 17 nt, Homo sapiens
gugggagagacugugag

SEQ ID NO: 747877 - RNA, 20 nt, Homo sapiens
gugggauggggacauuugaa

SEQ ID NO: 747878 - RNA, 14 nt, Homo sapiens
gugggauuuugcaa

SEQ ID NO: 747879 - RNA, 13 nt, Homo sapiens
gugggcacuggug

SEQ ID NO: 747880 - RNA, 12 nt, Homo sapiens
gugggcaucuca

SEQ ID NO: 747881 - RNA, 20 nt, Homo sapiens
guggggggugacagugccuu

SEQ ID NO: 747882 - RNA, 23 nt, Homo sapiens
gugggggugccgcucucucugag

SEQ ID NO: 747883 - RNA, 12 nt, Homo sapiens
guggguaaucca

SEQ ID NO: 747884 - RNA, 15 nt, Homo sapiens
guggguaauuguaca

SEQ ID NO: 747885 - RNA, 18 nt, Homo sapiens
guggguacaaaaagucaa

SEQ ID NO: 747886 - RNA, 22 nt, Homo sapiens
gugggugccccccuugccagac

SEQ ID NO: 747887 - RNA, 23 nt, Homo sapiens
gugggugggagugugucugcuga

SEQ ID NO: 747888 - RNA, 16 nt, Homo sapiens
gugguaaauacuguga

SEQ ID NO: 747889 - RNA, 18 nt, Homo sapiens
gugguaauuuuuguacau

SEQ ID NO: 747890 - RNA, 13 nt, Homo sapiens
gugguacuggcaa

SEQ ID NO: 747891 - RNA, 21 nt, Homo sapiens
gugguagccaucaagcacuuc

SEQ ID NO: 747892 - RNA, 16 nt, Homo sapiens
gugguagguguuugaa

SEQ ID NO: 747893 - RNA, 20 nt, Homo sapiens
gugguauguaauuuaugcaa

SEQ ID NO: 747894 - RNA, 16 nt, Homo sapiens
gugguccccguuccac

SEQ ID NO: 747895 - RNA, 17 nt, Homo sapiens
gugguccuuccuaccuc

SEQ ID NO: 747896 - RNA, 22 nt, Homo sapiens
guggucuaagguucagccugaa

SEQ ID NO: 747897 - RNA, 16 nt, Homo sapiens
guggucuccuugcacu

SEQ ID NO: 747898 - RNA, 21 nt, Homo sapiens
guggugagccgagauugcacc

SEQ ID NO: 747899 - RNA, 23 nt, Homo sapiens
guggugagccgagauugcaccau

SEQ ID NO: 747900 - RNA, 17 nt, Homo sapiens
gugguggcuagagggaa

SEQ ID NO: 747901 - RNA, 15 nt, Homo sapiens
guggugggcagguga

SEQ ID NO: 747902 - RNA, 14 nt, Homo sapiens
gugguuccaugcag

SEQ ID NO: 747903 - RNA, 17 nt, Homo sapiens
gugguucuaucaggggu

SEQ ID NO: 747904 - RNA, 17 nt, Homo sapiens
gugguuucccaucucca

SEQ ID NO: 747905 - RNA, 12 nt, Homo sapiens
guguaacuuuca

SEQ ID NO: 747906 - RNA, 20 nt, Homo sapiens
guguaagaacaacuaccuga

SEQ ID NO: 747907 - RNA, 20 nt, Homo sapiens
guguaauggaaaccaaggaa

SEQ ID NO: 747908 - RNA, 12 nt, Homo sapiens
guguacaaugug

SEQ ID NO: 747909 - RNA, 14 nt, Homo sapiens
guguacagugaauu

SEQ ID NO: 747910 - RNA, 15 nt, Homo sapiens
guguagcuuugcucu

SEQ ID NO: 747911 - RNA, 12 nt, Homo sapiens
guguaggggcca

SEQ ID NO: 747912 - RNA, 19 nt, Homo sapiens
guguauauaaauacaugca

SEQ ID NO: 747913 - RNA, 23 nt, Homo sapiens
guguaugugagagauucugugau

SEQ ID NO: 747914 - RNA, 16 nt, Homo sapiens
gugucaagacauuucu

SEQ ID NO: 747915 - RNA, 12 nt, Homo sapiens
gugucacuggcu

SEQ ID NO: 747916 - RNA, 18 nt, Homo sapiens
gugucauaacuucauaga

SEQ ID NO: 747917 - RNA, 14 nt, Homo sapiens
gugucauaccagaa

SEQ ID NO: 747918 - RNA, 13 nt, Homo sapiens
gugucaucaggag

SEQ ID NO: 747919 - RNA, 18 nt, Homo sapiens
guguccccgaugcugacc

SEQ ID NO: 747920 - RNA, 21 nt, Homo sapiens
guguccccgaugcugaccuca

SEQ ID NO: 747921 - RNA, 21 nt, Homo sapiens
guguccccgcugcugugcaac

SEQ ID NO: 747922 - RNA, 14 nt, Homo sapiens
guguccucagggag

SEQ ID NO: 747923 - RNA, 21 nt, Homo sapiens
guguccuccccucaaggacaa

SEQ ID NO: 747924 - RNA, 12 nt, Homo sapiens
guguccugacca

SEQ ID NO: 747925 - RNA, 21 nt, Homo sapiens
gugucuacagacaagcauuuu

SEQ ID NO: 747926 - RNA, 15 nt, Homo sapiens
gugucuaggcuggaa

SEQ ID NO: 747927 - RNA, 19 nt, Homo sapiens
gugucuaguuugcauacuu

SEQ ID NO: 747928 - RNA, 18 nt, Homo sapiens
gugucuccagccuggcuc

SEQ ID NO: 747929 - RNA, 22 nt, Homo sapiens
gugucuggagcgcuucaguuca

SEQ ID NO: 747930 - RNA, 12 nt, Homo sapiens
gugucugucagc

SEQ ID NO: 747931 - RNA, 20 nt, Homo sapiens
gugucuguccuuuaugaucc

SEQ ID NO: 747932 - RNA, 14 nt, Homo sapiens
gugucugugcccuc

SEQ ID NO: 747933 - RNA, 17 nt, Homo sapiens
gugucuuacgugccacc

SEQ ID NO: 747934 - RNA, 15 nt, Homo sapiens
gugucuuaggguaga

SEQ ID NO: 747935 - RNA, 16 nt, Homo sapiens
gugucuuggcacuguu

SEQ ID NO: 747936 - RNA, 9 nt, Homo sapiens
gugugagug

SEQ ID NO: 747937 - RNA, 22 nt, Homo sapiens
gugugauuugaauucugugaua

SEQ ID NO: 747938 - RNA, 12 nt, Homo sapiens
gugugauuugcu

SEQ ID NO: 747939 - RNA, 22 nt, Homo sapiens
guguggcccagggaagccaaaa

SEQ ID NO: 747940 - RNA, 15 nt, Homo sapiens
guguggccugccuuc

SEQ ID NO: 747941 - RNA, 16 nt, Homo sapiens
gugugggaguguguaa

SEQ ID NO: 747942 - RNA, 14 nt, Homo sapiens
gugugggggguccu

SEQ ID NO: 747943 - RNA, 22 nt, Homo sapiens
guguggggugaggggagggagu

SEQ ID NO: 747944 - RNA, 19 nt, Homo sapiens
guguggugagaucaugcca

SEQ ID NO: 747945 - RNA, 20 nt, Homo sapiens
guguguaugugugugcaugu

SEQ ID NO: 747946 - RNA, 13 nt, Homo sapiens
gugugucagcuga

SEQ ID NO: 747947 - RNA, 13 nt, Homo sapiens
gugugugugcaug

SEQ ID NO: 747948 - RNA, 14 nt, Homo sapiens
guguguguguauau

SEQ ID NO: 747949 - RNA, 15 nt, Homo sapiens
guguguguguguaua

SEQ ID NO: 747950 - RNA, 22 nt, Homo sapiens
guguguuaaaugggacuggagu

SEQ ID NO: 747951 - RNA, 22 nt, Homo sapiens
guguuaauagggauuuuuucag

SEQ ID NO: 747952 - RNA, 17 nt, Homo sapiens
guguuaauuuugcuaac

SEQ ID NO: 747953 - RNA, 21 nt, Homo sapiens
guguuacgcacacguacuuaa

SEQ ID NO: 747954 - RNA, 15 nt, Homo sapiens
guguuaguucccaac

SEQ ID NO: 747955 - RNA, 18 nt, Homo sapiens
guguuauuauuuugcacu

SEQ ID NO: 747956 - RNA, 20 nt, Homo sapiens
guguuauuauuuugcacugu

SEQ ID NO: 747957 - RNA, 16 nt, Homo sapiens
guguuccuagaaugca

SEQ ID NO: 747958 - RNA, 19 nt, Homo sapiens
guguucuacacucaucuua

SEQ ID NO: 747959 - RNA, 19 nt, Homo sapiens
guguucuucauuaccucag

SEQ ID NO: 747960 - RNA, 22 nt, Homo sapiens
guguugggaccugcugcuccau

SEQ ID NO: 747961 - RNA, 21 nt, Homo sapiens
guguugugccccuucacucau

SEQ ID NO: 747962 - RNA, 22 nt, Homo sapiens
guguuuaaaacaugcacgguga

SEQ ID NO: 747963 - RNA, 22 nt, Homo sapiens
guguuucgcauuaagcacacac

SEQ ID NO: 747964 - RNA, 19 nt, Homo sapiens
guguuucuauugacuucaa

SEQ ID NO: 747965 - RNA, 17 nt, Homo sapiens
guguuugggaugaccag

SEQ ID NO: 747966 - RNA, 12 nt, Homo sapiens
guguuuugccau

SEQ ID NO: 747967 - RNA, 14 nt, Homo sapiens
guguuuugucagac

SEQ ID NO: 747968 - RNA, 16 nt, Homo sapiens
guguuuuuaacauguc

SEQ ID NO: 747969 - RNA, 22 nt, Homo sapiens
guguuuuuaauaaagacagggu

SEQ ID NO: 747970 - RNA, 14 nt, Homo sapiens
guuaaaaaguucau

SEQ ID NO: 747971 - RNA, 20 nt, Homo sapiens
guuaaaacuguacauuuaaa

SEQ ID NO: 747972 - RNA, 20 nt, Homo sapiens
guuaaauagaguauaugcac

SEQ ID NO: 747973 - RNA, 18 nt, Homo sapiens
guuaaauccuuugcuuca

SEQ ID NO: 747974 - RNA, 22 nt, Homo sapiens
guuaaauugaauaaaauacucu

SEQ ID NO: 747975 - RNA, 13 nt, Homo sapiens
guuaacaguuuuu

SEQ ID NO: 747976 - RNA, 12 nt, Homo sapiens
guuaacaucuca

SEQ ID NO: 747977 - RNA, 19 nt, Homo sapiens
guuaacugugaaauaccac

SEQ ID NO: 747978 - RNA, 23 nt, Homo sapiens
uaaaauaaaguauauauagaauc

SEQ ID NO: 747979 - RNA, 15 nt, Homo sapiens
uaaaauaaauuauua

SEQ ID NO: 747980 - RNA, 14 nt, Homo sapiens
uaaaauaaauuccu

SEQ ID NO: 747981 - RNA, 16 nt, Homo sapiens
uaaaauaagagauccu

SEQ ID NO: 747982 - RNA, 14 nt, Homo sapiens
uaaaauaauaacaa

SEQ ID NO: 747983 - RNA, 22 nt, Homo sapiens
uaaaauaauuauauaacuguau

SEQ ID NO: 747984 - RNA, 17 nt, Homo sapiens
uaaaauacaaacccaug

SEQ ID NO: 747985 - RNA, 16 nt, Homo sapiens
uaaaauacacacucaa

SEQ ID NO: 747986 - RNA, 22 nt, Homo sapiens
uaaaauagacuuacugcaguua

SEQ ID NO: 747987 - RNA, 19 nt, Homo sapiens
uaaaaucauuucugcauca

SEQ ID NO: 747988 - RNA, 18 nt, Homo sapiens
uaaaaucccaagucauuu

SEQ ID NO: 747989 - RNA, 12 nt, Homo sapiens
uaaaaucucaaa

SEQ ID NO: 747990 - RNA, 14 nt, Homo sapiens
uaaaaucuugucau

SEQ ID NO: 747991 - RNA, 18 nt, Homo sapiens
uaaaaugaacaucucuug

SEQ ID NO: 747992 - RNA, 22 nt, Homo sapiens
uaaaaugagaucguuguuuaca

SEQ ID NO: 747993 - RNA, 11 nt, Homo sapiens
uaaaauggagg

SEQ ID NO: 747994 - RNA, 20 nt, Homo sapiens
uaaaaugggaagacugagcu

SEQ ID NO: 747995 - RNA, 22 nt, Homo sapiens
uaaaauguauuuuagacuuccu

SEQ ID NO: 747996 - RNA, 18 nt, Homo sapiens
uaaaaugugaagugaaug

SEQ ID NO: 747997 - RNA, 15 nt, Homo sapiens
uaaaauuagcuugag

SEQ ID NO: 747998 - RNA, 18 nt, Homo sapiens
uaaaauuaugccauagca

SEQ ID NO: 747999 - RNA, 11 nt, Homo sapiens
uaaaauuccaa

SEQ ID NO: 748000 - RNA, 20 nt, Homo sapiens
uaaaauuccucuuacuguaa

SEQ ID NO: 748001 - RNA, 22 nt, Homo sapiens
uaaaauucugauguuucuguga

SEQ ID NO: 748002 - RNA, 14 nt, Homo sapiens
uaaaauugcacuuu

SEQ ID NO: 748003 - RNA, 23 nt, Homo sapiens
uaaaauugcuucuuuaccaagga

SEQ ID NO: 748004 - RNA, 18 nt, Homo sapiens
uaaaauuguuaauaugca

SEQ ID NO: 748005 - RNA, 23 nt, Homo sapiens
uaaaauuucguuguccaauuugu

SEQ ID NO: 748006 - RNA, 22 nt, Homo sapiens
uaaacacaaauagaacauucca

SEQ ID NO: 748007 - RNA, 22 nt, Homo sapiens
uaaacacaguccagacucaaac

SEQ ID NO: 748008 - RNA, 18 nt, Homo sapiens
uaaacagauggcacuuug

SEQ ID NO: 748009 - RNA, 21 nt, Homo sapiens
uaaacagcacaccugugucca

SEQ ID NO: 748010 - RNA, 11 nt, Homo sapiens
uaaacagugcc

SEQ ID NO: 748011 - RNA, 17 nt, Homo sapiens
uaaacaguggaauauaa

SEQ ID NO: 748012 - RNA, 18 nt, Homo sapiens
uaaacaguuuuuggcaaa

SEQ ID NO: 748013 - RNA, 17 nt, Homo sapiens
uaaacauguuuccacua

SEQ ID NO: 748014 - RNA, 23 nt, Homo sapiens
uaaacauuccuguugaugggaaa

SEQ ID NO: 748015 - RNA, 22 nt, Homo sapiens
uaaacauugguaagaaugagcu

SEQ ID NO: 748016 - RNA, 21 nt, Homo sapiens
uaaacauuugagagcuaacua

SEQ ID NO: 748017 - RNA, 19 nt, Homo sapiens
uaaacauuuugacacaaaa

SEQ ID NO: 748018 - RNA, 13 nt, Homo sapiens
uaaaccaacaaua

SEQ ID NO: 748019 - RNA, 18 nt, Homo sapiens
uaaaccacuaguugaugu

SEQ ID NO: 748020 - RNA, 16 nt, Homo sapiens
uaaacccagugcugcu

SEQ ID NO: 748021 - RNA, 16 nt, Homo sapiens
uaaaccugauuuacua

SEQ ID NO: 748022 - RNA, 13 nt, Homo sapiens
uaaacuaagagaa

SEQ ID NO: 748023 - RNA, 20 nt, Homo sapiens
uaaacuaagagaaacugugu

SEQ ID NO: 748024 - RNA, 15 nt, Homo sapiens
uaaacuacaaaguaa

SEQ ID NO: 748025 - RNA, 14 nt, Homo sapiens
uaaacuaguuucca

SEQ ID NO: 748026 - RNA, 17 nt, Homo sapiens
uaaacuaucuuggugaa

SEQ ID NO: 748027 - RNA, 17 nt, Homo sapiens
uaaacuaugaggacugc

SEQ ID NO: 748028 - RNA, 21 nt, Homo sapiens
uaaacucagaauauacccauc

SEQ ID NO: 748029 - RNA, 15 nt, Homo sapiens
uaaacucuguugcaa

SEQ ID NO: 748030 - RNA, 16 nt, Homo sapiens
uaaacugaaaauggac

SEQ ID NO: 748031 - RNA, 23 nt, Homo sapiens
uaaacuggaauccuuucacccgc

SEQ ID NO: 748032 - RNA, 18 nt, Homo sapiens
uaaacuguggguuuuccu

SEQ ID NO: 748033 - RNA, 11 nt, Homo sapiens
uaaacugugua

SEQ ID NO: 748034 - RNA, 12 nt, Homo sapiens
uaaacuguguau

SEQ ID NO: 748035 - RNA, 23 nt, Homo sapiens
uaaacuguuuucauguguugcaa

SEQ ID NO: 748036 - RNA, 22 nt, Homo sapiens
uaaacuucaccuacauuaucuc

SEQ ID NO: 748037 - RNA, 14 nt, Homo sapiens
uaaacuuguuugcu

SEQ ID NO: 748038 - RNA, 22 nt, Homo sapiens
uaaagaaccaucagcaucaccc

SEQ ID NO: 748039 - RNA, 19 nt, Homo sapiens
uaaagacaaaaaaaucacg

SEQ ID NO: 748040 - RNA, 17 nt, Homo sapiens
uaaagacccuccuauuc

SEQ ID NO: 748041 - RNA, 14 nt, Homo sapiens
uaaagaccuuccag

SEQ ID NO: 748042 - RNA, 14 nt, Homo sapiens
uaaagacucaaggu

SEQ ID NO: 748043 - RNA, 12 nt, Homo sapiens
uaaagacuguag

SEQ ID NO: 748044 - RNA, 18 nt, Homo sapiens
uaaagagagugagcauga

SEQ ID NO: 748045 - RNA, 14 nt, Homo sapiens
uaaagagcauggaa

SEQ ID NO: 748046 - RNA, 14 nt, Homo sapiens
uaaagaugguuuau

SEQ ID NO: 748047 - RNA, 12 nt, Homo sapiens
uaaagauuuauc

SEQ ID NO: 748048 - RNA, 16 nt, Homo sapiens
uaaagcaaacaugcaa

SEQ ID NO: 748049 - RNA, 13 nt, Homo sapiens
uaaagcagccagc

SEQ ID NO: 748050 - RNA, 15 nt, Homo sapiens
uaaagcauauuggug

SEQ ID NO: 748051 - RNA, 21 nt, Homo sapiens
uaaagccaacacccugucuaa

SEQ ID NO: 748052 - RNA, 14 nt, Homo sapiens
uaaagccuccucau

SEQ ID NO: 748053 - RNA, 18 nt, Homo sapiens
uaaagcguccucucagua

SEQ ID NO: 748054 - RNA, 21 nt, Homo sapiens
uaaagcguccucucaguaaug

SEQ ID NO: 748055 - RNA, 22 nt, Homo sapiens
uaaagcuaaggaccuuaagaca

SEQ ID NO: 748056 - RNA, 22 nt, Homo sapiens
uaaagcugccggcacagaacuu

SEQ ID NO: 748057 - RNA, 16 nt, Homo sapiens
uaaagcugcugucacu

SEQ ID NO: 748058 - RNA, 23 nt, Homo sapiens
uaaagcuguuauucuuguuauac

SEQ ID NO: 748059 - RNA, 19 nt, Homo sapiens
uaaaggaaaaucacaucuc

SEQ ID NO: 748060 - RNA, 23 nt, Homo sapiens
uaaaggaguaagaaccuugccug

SEQ ID NO: 748061 - RNA, 12 nt, Homo sapiens
uaaaggcagcug

SEQ ID NO: 748062 - RNA, 17 nt, Homo sapiens
uaaaggcagcugccucu

SEQ ID NO: 748063 - RNA, 21 nt, Homo sapiens
uaaaggcagcugccucugcuc

SEQ ID NO: 748064 - RNA, 15 nt, Homo sapiens
uaaaggcaguuuucu

SEQ ID NO: 748065 - RNA, 13 nt, Homo sapiens
uaaaggcaucuac

SEQ ID NO: 748066 - RNA, 19 nt, Homo sapiens
uaaaggcauuguccaaagu

SEQ ID NO: 748067 - RNA, 17 nt, Homo sapiens
uaaaggcugaagcuuuu

SEQ ID NO: 748068 - RNA, 23 nt, Homo sapiens
uaaaggcuugauauuuuccaaau

SEQ ID NO: 748069 - RNA, 20 nt, Homo sapiens
uaaagggcagggcccacgug

SEQ ID NO: 748070 - RNA, 24 nt, Homo sapiens
uaaagguaaaacaugcuggugaac

SEQ ID NO: 748071 - RNA, 22 nt, Homo sapiens
uaaagguccacaggucuagacu

SEQ ID NO: 748072 - RNA, 13 nt, Homo sapiens
uaaaguaccacac

SEQ ID NO: 748073 - RNA, 13 nt, Homo sapiens
uaaaguaccauua

SEQ ID NO: 748074 - RNA, 18 nt, Homo sapiens
uaaaguaguccugugaau

SEQ ID NO: 748075 - RNA, 16 nt, Homo sapiens
uaaaguauauauuuau

SEQ ID NO: 748076 - RNA, 15 nt, Homo sapiens
uaaaguauaugugca

SEQ ID NO: 748077 - RNA, 21 nt, Homo sapiens
uaaaguauauuuaacucauaa

SEQ ID NO: 748078 - RNA, 20 nt, Homo sapiens
uaaaguauguuauugcauaa

SEQ ID NO: 748079 - RNA, 21 nt, Homo sapiens
uaaaguauuauuuauuugaau

SEQ ID NO: 748080 - RNA, 22 nt, Homo sapiens
uaaaguauuuucuucucuguga

SEQ ID NO: 748081 - RNA, 11 nt, Homo sapiens
uaaaguggcag

SEQ ID NO: 748082 - RNA, 14 nt, Homo sapiens
uaaaguuacuugaa

SEQ ID NO: 748083 - RNA, 17 nt, Homo sapiens
uaaaguuuuauuugaau

SEQ ID NO: 748084 - RNA, 14 nt, Homo sapiens
uaaaguuuugcaac

SEQ ID NO: 748085 - RNA, 16 nt, Homo sapiens
uaaaguuuugcaacaa

SEQ ID NO: 748086 - RNA, 22 nt, Homo sapiens
uaaauaaaaauaaaaauucaua

SEQ ID NO: 748087 - RNA, 19 nt, Homo sapiens
uaaauaaaccucaaaaugu

SEQ ID NO: 748088 - RNA, 21 nt, Homo sapiens
uaaauaaacucaaugagcucu

SEQ ID NO: 748089 - RNA, 21 nt, Homo sapiens
uaaauaaagaagaaaauaacc

SEQ ID NO: 748090 - RNA, 21 nt, Homo sapiens
uaaauaaauguaucuuauuca

SEQ ID NO: 748091 - RNA, 19 nt, Homo sapiens
uaaauaacuggaaaacaga

SEQ ID NO: 748092 - RNA, 14 nt, Homo sapiens
uaugcaaaugccuc

SEQ ID NO: 748093 - RNA, 14 nt, Homo sapiens
uaugcaaauggaga

SEQ ID NO: 748094 - RNA, 21 nt, Homo sapiens
uaugcaagccuugcuagacag

SEQ ID NO: 748095 - RNA, 14 nt, Homo sapiens
uaugcacauaugga

SEQ ID NO: 748096 - RNA, 16 nt, Homo sapiens
uaugcagacaaccuca

SEQ ID NO: 748097 - RNA, 20 nt, Homo sapiens
uaugcagagccacagcugug

SEQ ID NO: 748098 - RNA, 19 nt, Homo sapiens
uaugcauggugccccagga

SEQ ID NO: 748099 - RNA, 17 nt, Homo sapiens
uaugccaauaaaguuug

SEQ ID NO: 748100 - RNA, 17 nt, Homo sapiens
uaugccacccugcaaua

SEQ ID NO: 748101 - RNA, 16 nt, Homo sapiens
uaugccagcucaccuu

SEQ ID NO: 748102 - RNA, 18 nt, Homo sapiens
uaugccauagcaagauug

SEQ ID NO: 748103 - RNA, 21 nt, Homo sapiens
uaugccauugggguaguugug

SEQ ID NO: 748104 - RNA, 23 nt, Homo sapiens
uaugcccggaccuccaucagagc

SEQ ID NO: 748105 - RNA, 14 nt, Homo sapiens
uaugccuucacuuu

SEQ ID NO: 748106 - RNA, 16 nt, Homo sapiens
uaugccuugaacuuau

SEQ ID NO: 748107 - RNA, 22 nt, Homo sapiens
uaugcgcuuaaauuaagauuau

SEQ ID NO: 748108 - RNA, 17 nt, Homo sapiens
uaugcgugugacagugu

SEQ ID NO: 748109 - RNA, 16 nt, Homo sapiens
uaugcuauuacauaca

SEQ ID NO: 748110 - RNA, 22 nt, Homo sapiens
uaugcucagggucaauuucuuu

SEQ ID NO: 748111 - RNA, 21 nt, Homo sapiens
uaugcucucgcaccuuuccaa

SEQ ID NO: 748112 - RNA, 21 nt, Homo sapiens
uaugcuguuauguccagaaau

SEQ ID NO: 748113 - RNA, 15 nt, Homo sapiens
uaugcuguugucuua

SEQ ID NO: 748114 - RNA, 16 nt, Homo sapiens
uaugcuuacugauaua

SEQ ID NO: 748115 - RNA, 19 nt, Homo sapiens
uaugcuuggcuaacuauau

SEQ ID NO: 748116 - RNA, 17 nt, Homo sapiens
uaugcuuuagaacuuuu

SEQ ID NO: 748117 - RNA, 20 nt, Homo sapiens
uaugcuuucccugaggaaug

SEQ ID NO: 748118 - RNA, 22 nt, Homo sapiens
uaugcuuuguagaguuuuguca

SEQ ID NO: 748119 - RNA, 23 nt, Homo sapiens
uauggaagaguuaaaacauuucu

SEQ ID NO: 748120 - RNA, 16 nt, Homo sapiens
uauggaauacaguguu

SEQ ID NO: 748121 - RNA, 19 nt, Homo sapiens
uauggaauuuugcaaagau

SEQ ID NO: 748122 - RNA, 20 nt, Homo sapiens
uauggacaguaaguccagua

SEQ ID NO: 748123 - RNA, 12 nt, Homo sapiens
uauggacucugc

SEQ ID NO: 748124 - RNA, 15 nt, Homo sapiens
uauggauaugcugcu

SEQ ID NO: 748125 - RNA, 18 nt, Homo sapiens
uauggaucgaucuacguc

SEQ ID NO: 748126 - RNA, 16 nt, Homo sapiens
uauggauuuaauacca

SEQ ID NO: 748127 - RNA, 15 nt, Homo sapiens
uauggcaaauagcca

SEQ ID NO: 748128 - RNA, 14 nt, Homo sapiens
uauggcaagugaua

SEQ ID NO: 748129 - RNA, 18 nt, Homo sapiens
uauggcagaggugcaaga

SEQ ID NO: 748130 - RNA, 16 nt, Homo sapiens
uauggcuccuccauau

SEQ ID NO: 748131 - RNA, 13 nt, Homo sapiens
uaugggaacaauu

SEQ ID NO: 748132 - RNA, 16 nt, Homo sapiens
uaugggcgugaaccac

SEQ ID NO: 748133 - RNA, 21 nt, Homo sapiens
uaugggcuuuguuaucuucca

SEQ ID NO: 748134 - RNA, 16 nt, Homo sapiens
uauggguugcauuugg

SEQ ID NO: 748135 - RNA, 18 nt, Homo sapiens
uauggguuggacaaccuc

SEQ ID NO: 748136 - RNA, 22 nt, Homo sapiens
uaugguaggaacugcugggcuu

SEQ ID NO: 748137 - RNA, 14 nt, Homo sapiens
uaugguauuacaaa

SEQ ID NO: 748138 - RNA, 15 nt, Homo sapiens
uaugguucucaggcc

SEQ ID NO: 748139 - RNA, 21 nt, Homo sapiens
uauguaaaaccaacaaaaaga

SEQ ID NO: 748140 - RNA, 21 nt, Homo sapiens
uauguaacagucaaauaucau

SEQ ID NO: 748141 - RNA, 16 nt, Homo sapiens
uauguagaugugcauu

SEQ ID NO: 748142 - RNA, 16 nt, Homo sapiens
uauguaguuuuguaca

SEQ ID NO: 748143 - RNA, 13 nt, Homo sapiens
uauguauauacau

SEQ ID NO: 748144 - RNA, 13 nt, Homo sapiens
uauguauauauac

SEQ ID NO: 748145 - RNA, 16 nt, Homo sapiens
uauguauuugcaguuc

SEQ ID NO: 748146 - RNA, 16 nt, Homo sapiens
uaugucaguuugcagu

SEQ ID NO: 748147 - RNA, 23 nt, Homo sapiens
uaugucgagagcuggccaaagag

SEQ ID NO: 748148 - RNA, 14 nt, Homo sapiens
uaugugacuuaaag

SEQ ID NO: 748149 - RNA, 21 nt, Homo sapiens
uaugugaucaauuuugacuua

SEQ ID NO: 748150 - RNA, 11 nt, Homo sapiens
uaugugcaaaa

SEQ ID NO: 748151 - RNA, 14 nt, Homo sapiens
uaugugcauuucaa

SEQ ID NO: 748152 - RNA, 13 nt, Homo sapiens
uaugugugccuuu

SEQ ID NO: 748153 - RNA, 19 nt, Homo sapiens
uauguuaaagcaucagaga

SEQ ID NO: 748154 - RNA, 17 nt, Homo sapiens
uauguuaagaguacuau

SEQ ID NO: 748155 - RNA, 14 nt, Homo sapiens
uauguucaaagacu

SEQ ID NO: 748156 - RNA, 20 nt, Homo sapiens
uauguucaaugcaaaguaaa

SEQ ID NO: 748157 - RNA, 19 nt, Homo sapiens
uauguucccagcagugggg

SEQ ID NO: 748158 - RNA, 16 nt, Homo sapiens
uauguucccucuuguc

SEQ ID NO: 748159 - RNA, 15 nt, Homo sapiens
uauguugaguguuca

SEQ ID NO: 748160 - RNA, 21 nt, Homo sapiens
uauguuuggaauaaagucaac

SEQ ID NO: 748161 - RNA, 21 nt, Homo sapiens
uauuaaaaagccugcauucug

SEQ ID NO: 748162 - RNA, 16 nt, Homo sapiens
uauuaaaacacagcuu

SEQ ID NO: 748163 - RNA, 13 nt, Homo sapiens
uauuaaacaaagu

SEQ ID NO: 748164 - RNA, 14 nt, Homo sapiens
uauuaaaugcauca

SEQ ID NO: 748165 - RNA, 19 nt, Homo sapiens
uauuaaauguugcuuuaac

SEQ ID NO: 748166 - RNA, 18 nt, Homo sapiens
uauuaagauucuugacuu

SEQ ID NO: 748167 - RNA, 15 nt, Homo sapiens
uauuaagauuuccaa

SEQ ID NO: 748168 - RNA, 23 nt, Homo sapiens
uauuaagauuuccaagugccaau

SEQ ID NO: 748169 - RNA, 19 nt, Homo sapiens
uauuaagugccugagacac

SEQ ID NO: 748170 - RNA, 16 nt, Homo sapiens
uauuaagugugcuuau

SEQ ID NO: 748171 - RNA, 17 nt, Homo sapiens
uauuaauaaagcauucu

SEQ ID NO: 748172 - RNA, 20 nt, Homo sapiens
uauuaauaguucaguguaug

SEQ ID NO: 748173 - RNA, 20 nt, Homo sapiens
uauuaauauauaguccagac

SEQ ID NO: 748174 - RNA, 17 nt, Homo sapiens
uauuaauauauuuccau

SEQ ID NO: 748175 - RNA, 23 nt, Homo sapiens
uauuaauaugaguuacugaaggu

SEQ ID NO: 748176 - RNA, 13 nt, Homo sapiens
uauuaaucaccuc

SEQ ID NO: 748177 - RNA, 22 nt, Homo sapiens
uauuaauugccuuugagguuau

SEQ ID NO: 748178 - RNA, 12 nt, Homo sapiens
uauuacaguguc

SEQ ID NO: 748179 - RNA, 18 nt, Homo sapiens
uauuacugaaaaugauuc

SEQ ID NO: 748180 - RNA, 20 nt, Homo sapiens
uauuacuuagguuauuuugc

SEQ ID NO: 748181 - RNA, 19 nt, Homo sapiens
uauuacuuugucuuuucaa

SEQ ID NO: 748182 - RNA, 21 nt, Homo sapiens
uauuagaucaaauaguugcau

SEQ ID NO: 748183 - RNA, 15 nt, Homo sapiens
uauuagccaacuguu

SEQ ID NO: 748184 - RNA, 22 nt, Homo sapiens
uauuagcucacugaaucuucac

SEQ ID NO: 748185 - RNA, 14 nt, Homo sapiens
uauuauaaacuaua

SEQ ID NO: 748186 - RNA, 13 nt, Homo sapiens
uauuauacucuaa

SEQ ID NO: 748187 - RNA, 18 nt, Homo sapiens
uauuauagcaacuuuaag

SEQ ID NO: 748188 - RNA, 18 nt, Homo sapiens
uauuauccuucuacuugu

SEQ ID NO: 748189 - RNA, 14 nt, Homo sapiens
uauuaugagcuaca

SEQ ID NO: 748190 - RNA, 16 nt, Homo sapiens
uauuauguuccucaag

SEQ ID NO: 748191 - RNA, 17 nt, Homo sapiens
uauuauucuucauaaca

SEQ ID NO: 748192 - RNA, 22 nt, Homo sapiens
uauuauuugacaacaauccaaa

SEQ ID NO: 748193 - RNA, 22 nt, Homo sapiens
uauuauuugcuuuucauguaga

SEQ ID NO: 748194 - RNA, 23 nt, Homo sapiens
uauuauuuuucgucucaauggua

SEQ ID NO: 748195 - RNA, 20 nt, Homo sapiens
uauucaaauuugugucauac

SEQ ID NO: 748196 - RNA, 13 nt, Homo sapiens
uauucaaguauuc

SEQ ID NO: 748197 - RNA, 13 nt, Homo sapiens
uauucaauggaaa

SEQ ID NO: 748198 - RNA, 20 nt, Homo sapiens
uauucaauggaaagcugcuu

SEQ ID NO: 748199 - RNA, 21 nt, Homo sapiens
uauucacaaccacucauucaa

SEQ ID NO: 748200 - RNA, 15 nt, Homo sapiens
uauucagcacuaaaa

SEQ ID NO: 748201 - RNA, 23 nt, Homo sapiens
uauucaggcuguuguuggcuuag

SEQ ID NO: 748202 - RNA, 12 nt, Homo sapiens
uauucaugccau

SEQ ID NO: 748203 - RNA, 19 nt, Homo sapiens
uauucauguucaugugauu

SEQ ID NO: 748204 - RNA, 21 nt, Homo sapiens
uauuccacuggcgcaucauau

SEQ ID NO: 748205 - RNA, 18 nt, Homo sapiens
uauucccaagcccaugag

SEQ ID NO: 748206 - RNA, 22 nt, Homo sapiens
ucaaaaauccuuaugcaugaaa

SEQ ID NO: 748207 - RNA, 14 nt, Homo sapiens
ucaaaacacucauc

SEQ ID NO: 748208 - RNA, 19 nt, Homo sapiens
ucaaaacagagaugugaua

SEQ ID NO: 748209 - RNA, 13 nt, Homo sapiens
ucaaaacugccau

SEQ ID NO: 748210 - RNA, 22 nt, Homo sapiens
ucaaaagaaccagacugugucu

SEQ ID NO: 748211 - RNA, 17 nt, Homo sapiens
ucaaaagagguuacuuu

SEQ ID NO: 748212 - RNA, 17 nt, Homo sapiens
ucaaaagccagauguga

SEQ ID NO: 748213 - RNA, 19 nt, Homo sapiens
ucaaaaguaaugcuucaau

SEQ ID NO: 748214 - RNA, 17 nt, Homo sapiens
ucaaaauaaaaaguaau

SEQ ID NO: 748215 - RNA, 17 nt, Homo sapiens
ucaaaauaaaaaugagg

SEQ ID NO: 748216 - RNA, 18 nt, Homo sapiens
ucaaaauaaaggcgcuaa

SEQ ID NO: 748217 - RNA, 15 nt, Homo sapiens
ucaaaauaaugaagu

SEQ ID NO: 748218 - RNA, 16 nt, Homo sapiens
ucaaaauauacauuca

SEQ ID NO: 748219 - RNA, 15 nt, Homo sapiens
ucaaaauccaaaaag

SEQ ID NO: 748220 - RNA, 13 nt, Homo sapiens
ucaaacacaguua

SEQ ID NO: 748221 - RNA, 12 nt, Homo sapiens
ucaaacauauau

SEQ ID NO: 748222 - RNA, 15 nt, Homo sapiens
ucaaacgaugugcaa

SEQ ID NO: 748223 - RNA, 17 nt, Homo sapiens
ucaaacuccugaccuca

SEQ ID NO: 748224 - RNA, 19 nt, Homo sapiens
ucaaacuccugaccucagg

SEQ ID NO: 748225 - RNA, 14 nt, Homo sapiens
ucaaacugccuugg

SEQ ID NO: 748226 - RNA, 12 nt, Homo sapiens
ucaaacugcucc

SEQ ID NO: 748227 - RNA, 23 nt, Homo sapiens
ucaaagaaguacuuuauugcaac

SEQ ID NO: 748228 - RNA, 21 nt, Homo sapiens
ucaaagaauuucuucagucca

SEQ ID NO: 748229 - RNA, 13 nt, Homo sapiens
ucaaagacagaga

SEQ ID NO: 748230 - RNA, 14 nt, Homo sapiens
ucaaagacuguauu

SEQ ID NO: 748231 - RNA, 18 nt, Homo sapiens
ucaaagauccagugcagu

SEQ ID NO: 748232 - RNA, 21 nt, Homo sapiens
ucaaagcacagaauuugucag

SEQ ID NO: 748233 - RNA, 17 nt, Homo sapiens
ucaaagcagaagucugg

SEQ ID NO: 748234 - RNA, 13 nt, Homo sapiens
ucaaagccuucuc

SEQ ID NO: 748235 - RNA, 23 nt, Homo sapiens
ucaaagcucuauuaagauuucca

SEQ ID NO: 748236 - RNA, 21 nt, Homo sapiens
ucaaagcuuuuuccagaggcu

SEQ ID NO: 748237 - RNA, 16 nt, Homo sapiens
ucaaaggagcuuucuc

SEQ ID NO: 748238 - RNA, 17 nt, Homo sapiens
ucaaaggagcuuucuca

SEQ ID NO: 748239 - RNA, 22 nt, Homo sapiens
ucaaaggcccucagugagauaa

SEQ ID NO: 748240 - RNA, 10 nt, Homo sapiens
ucaaagggaa

SEQ ID NO: 748241 - RNA, 14 nt, Homo sapiens
ucaaagggaaacuu

SEQ ID NO: 748242 - RNA, 20 nt, Homo sapiens
ucaaagggagagagugcuau

SEQ ID NO: 748243 - RNA, 18 nt, Homo sapiens
ucaaaguaaaacuugcug

SEQ ID NO: 748244 - RNA, 17 nt, Homo sapiens
ucaaaguacugggauua

SEQ ID NO: 748245 - RNA, 19 nt, Homo sapiens
ucaaagucaacauuugaga

SEQ ID NO: 748246 - RNA, 16 nt, Homo sapiens
ucaaaguguaacagau

SEQ ID NO: 748247 - RNA, 22 nt, Homo sapiens
ucaaaguguuuuucaagccugu

SEQ ID NO: 748248 - RNA, 13 nt, Homo sapiens
ucaaauaaacuca

SEQ ID NO: 748249 - RNA, 17 nt, Homo sapiens
ucaaauacacauuugcu

SEQ ID NO: 748250 - RNA, 18 nt, Homo sapiens
ucaaauacacauuugcua

SEQ ID NO: 748251 - RNA, 13 nt, Homo sapiens
ucaaauacugugu

SEQ ID NO: 748252 - RNA, 20 nt, Homo sapiens
ucaaauagaaccacuaugaa

SEQ ID NO: 748253 - RNA, 13 nt, Homo sapiens
ucaaauagcaaua

SEQ ID NO: 748254 - RNA, 13 nt, Homo sapiens
ucaaauagcauaa

SEQ ID NO: 748255 - RNA, 18 nt, Homo sapiens
ucaaauaguugcauagca

SEQ ID NO: 748256 - RNA, 16 nt, Homo sapiens
ucaaauauuccauucu

SEQ ID NO: 748257 - RNA, 13 nt, Homo sapiens
ucaaauauuucaa

SEQ ID NO: 748258 - RNA, 14 nt, Homo sapiens
ucaaaucagucagu

SEQ ID NO: 748259 - RNA, 21 nt, Homo sapiens
ucaaaugagccccuucauccg

SEQ ID NO: 748260 - RNA, 16 nt, Homo sapiens
ucaaaugcacaucuca

SEQ ID NO: 748261 - RNA, 15 nt, Homo sapiens
ucaaauggacuuuca

SEQ ID NO: 748262 - RNA, 18 nt, Homo sapiens
ucaaaugggcugcugcuu

SEQ ID NO: 748263 - RNA, 20 nt, Homo sapiens
ucaaauuaagauucucugcc

SEQ ID NO: 748264 - RNA, 22 nt, Homo sapiens
ucaaauuugugucauaccagaa

SEQ ID NO: 748265 - RNA, 14 nt, Homo sapiens
ucaacaacuuguga

SEQ ID NO: 748266 - RNA, 23 nt, Homo sapiens
ucaacaagauuuccuugugcaaa

SEQ ID NO: 748267 - RNA, 20 nt, Homo sapiens
ucaacaccaggagagcuucu

SEQ ID NO: 748268 - RNA, 22 nt, Homo sapiens
ucaacacuauuguaaucauuug

SEQ ID NO: 748269 - RNA, 12 nt, Homo sapiens
ucaacacuuaag

SEQ ID NO: 748270 - RNA, 20 nt, Homo sapiens
ucaacagaaacuaaaugaac

SEQ ID NO: 748271 - RNA, 22 nt, Homo sapiens
ucaacagagggaguuuaauaca

SEQ ID NO: 748272 - RNA, 13 nt, Homo sapiens
ucaacaguucaaa

SEQ ID NO: 748273 - RNA, 18 nt, Homo sapiens
ucaaccagagucacccag

SEQ ID NO: 748274 - RNA, 22 nt, Homo sapiens
ucaaccauaaaagaaguuucag

SEQ ID NO: 748275 - RNA, 17 nt, Homo sapiens
ucaaccgaugguccuca

SEQ ID NO: 748276 - RNA, 19 nt, Homo sapiens
ucaaccuucaucggcccac

SEQ ID NO: 748277 - RNA, 20 nt, Homo sapiens
ucaacgcucccagacgguca

SEQ ID NO: 748278 - RNA, 13 nt, Homo sapiens
ucaacgugcauuu

SEQ ID NO: 748279 - RNA, 17 nt, Homo sapiens
ucaacuaaguucaggga

SEQ ID NO: 748280 - RNA, 23 nt, Homo sapiens
ucaacucacugcaaccuccgccu

SEQ ID NO: 748281 - RNA, 11 nt, Homo sapiens
ucaacuccugg

SEQ ID NO: 748282 - RNA, 12 nt, Homo sapiens
ucaacucugauc

SEQ ID NO: 748283 - RNA, 16 nt, Homo sapiens
ucaacugccucucuuu

SEQ ID NO: 748284 - RNA, 15 nt, Homo sapiens
ucaacuguauaguuu

SEQ ID NO: 748285 - RNA, 16 nt, Homo sapiens
ucaacuuuugaccaaa

SEQ ID NO: 748286 - RNA, 16 nt, Homo sapiens
ucaagaaaacaacuuc

SEQ ID NO: 748287 - RNA, 20 nt, Homo sapiens
ucaagaaacagccagcaaga

SEQ ID NO: 748288 - RNA, 23 nt, Homo sapiens
ucaagaaaucccugagacagauu

SEQ ID NO: 748289 - RNA, 21 nt, Homo sapiens
ucaagaacgagaagcagcauu

SEQ ID NO: 748290 - RNA, 23 nt, Homo sapiens
ucaagaacgagaagcagcauuug

SEQ ID NO: 748291 - RNA, 13 nt, Homo sapiens
ucaagaagaggaa

SEQ ID NO: 748292 - RNA, 22 nt, Homo sapiens
ucaagaagcguuaugugcagua

SEQ ID NO: 748293 - RNA, 13 nt, Homo sapiens
ucaagacauuaaa

SEQ ID NO: 748294 - RNA, 20 nt, Homo sapiens
ucaagacggagaugcauggc

SEQ ID NO: 748295 - RNA, 11 nt, Homo sapiens
ucaagacuuua

SEQ ID NO: 748296 - RNA, 18 nt, Homo sapiens
ucaagagaucgagaccau

SEQ ID NO: 748297 - RNA, 23 nt, Homo sapiens
ucaagagaucuuucuuuccaaaa

SEQ ID NO: 748298 - RNA, 16 nt, Homo sapiens
ucaagagcaugcacau

SEQ ID NO: 748299 - RNA, 18 nt, Homo sapiens
ucaagaugagagaacugg

SEQ ID NO: 748300 - RNA, 23 nt, Homo sapiens
ucaagcagacauagaagagccaa

SEQ ID NO: 748301 - RNA, 19 nt, Homo sapiens
ucaagcagagaaaauaauu

SEQ ID NO: 748302 - RNA, 15 nt, Homo sapiens
ucaagcaggacccua

SEQ ID NO: 748303 - RNA, 22 nt, Homo sapiens
ucaagccagcccccuccagcuc

SEQ ID NO: 748304 - RNA, 19 nt, Homo sapiens
ucaagccaguacgugcuaa

SEQ ID NO: 748305 - RNA, 22 nt, Homo sapiens
ucaagcccugcagucacagcua

SEQ ID NO: 748306 - RNA, 14 nt, Homo sapiens
ucaagccugauuca

SEQ ID NO: 748307 - RNA, 15 nt, Homo sapiens
ucaagcuccccucac

SEQ ID NO: 748308 - RNA, 20 nt, Homo sapiens
ucaagcuggaagaagugagc

SEQ ID NO: 748309 - RNA, 17 nt, Homo sapiens
ucaagcuucacauuugc

SEQ ID NO: 748310 - RNA, 22 nt, Homo sapiens
ucaagcuuuuaaaaacuagagc

SEQ ID NO: 748311 - RNA, 22 nt, Homo sapiens
ucaaggauagaaguauaccuga

SEQ ID NO: 748312 - RNA, 14 nt, Homo sapiens
ucaaggcacucuag

SEQ ID NO: 748313 - RNA, 20 nt, Homo sapiens
ucaaggcaguagaacuccag

SEQ ID NO: 748314 - RNA, 15 nt, Homo sapiens
ucaaggcaucaugca

SEQ ID NO: 748315 - RNA, 18 nt, Homo sapiens
ucaaggcugcagugagcc

SEQ ID NO: 748316 - RNA, 15 nt, Homo sapiens
ucaagggaaaggcaa

SEQ ID NO: 748317 - RNA, 19 nt, Homo sapiens
ucaagggacaaguauuaau

SEQ ID NO: 748318 - RNA, 17 nt, Homo sapiens
ucaagggcuuacuauuu

SEQ ID NO: 748319 - RNA, 22 nt, Homo sapiens
ucaagguguuuugaaaugcaga

SEQ ID NO: 748320 - RNA, 17 nt, Homo sapiens
ucaagguucuaacccua

SEQ ID NO: 748321 - RNA, 15 nt, Homo sapiens
ucaggcacacagcua

SEQ ID NO: 748322 - RNA, 16 nt, Homo sapiens
ucaggcagcagugucu

SEQ ID NO: 748323 - RNA, 17 nt, Homo sapiens
ucaggccaacaagccaa

SEQ ID NO: 748324 - RNA, 18 nt, Homo sapiens
ucaggccauugucccuga

SEQ ID NO: 748325 - RNA, 13 nt, Homo sapiens
ucaggcccaggca

SEQ ID NO: 748326 - RNA, 19 nt, Homo sapiens
ucaggccccgggcuucccu

SEQ ID NO: 748327 - RNA, 18 nt, Homo sapiens
ucaggcguuucugaagug

SEQ ID NO: 748328 - RNA, 17 nt, Homo sapiens
ucagggaaaaggaguag

SEQ ID NO: 748329 - RNA, 20 nt, Homo sapiens
ucagggagaggucaccagcu

SEQ ID NO: 748330 - RNA, 16 nt, Homo sapiens
ucagggcagggcucau

SEQ ID NO: 748331 - RNA, 18 nt, Homo sapiens
ucagggcagggcucugau

SEQ ID NO: 748332 - RNA, 22 nt, Homo sapiens
ucagggccaggugcagaccuug

SEQ ID NO: 748333 - RNA, 15 nt, Homo sapiens
ucagggccaugccug

SEQ ID NO: 748334 - RNA, 19 nt, Homo sapiens
ucagggcccaagucccugu

SEQ ID NO: 748335 - RNA, 20 nt, Homo sapiens
ucagggggauaacuaccaga

SEQ ID NO: 748336 - RNA, 19 nt, Homo sapiens
ucagggguuaagagcucag

SEQ ID NO: 748337 - RNA, 21 nt, Homo sapiens
ucaggguccagacccugaaga

SEQ ID NO: 748338 - RNA, 19 nt, Homo sapiens
ucagggucuaagcaccuug

SEQ ID NO: 748339 - RNA, 17 nt, Homo sapiens
ucagguagacuuuuaau

SEQ ID NO: 748340 - RNA, 15 nt, Homo sapiens
ucaggugauucgccc

SEQ ID NO: 748341 - RNA, 13 nt, Homo sapiens
ucaggugugacuc

SEQ ID NO: 748342 - RNA, 17 nt, Homo sapiens
ucagguguuacuagaag

SEQ ID NO: 748343 - RNA, 16 nt, Homo sapiens
ucaguaaauaacugga

SEQ ID NO: 748344 - RNA, 19 nt, Homo sapiens
ucaguaaauagugucauau

SEQ ID NO: 748345 - RNA, 18 nt, Homo sapiens
ucaguaacugugcaucug

SEQ ID NO: 748346 - RNA, 15 nt, Homo sapiens
ucaguaauaacucua

SEQ ID NO: 748347 - RNA, 14 nt, Homo sapiens
ucaguaccccaugg

SEQ ID NO: 748348 - RNA, 19 nt, Homo sapiens
ucaguaguuugcauuucag

SEQ ID NO: 748349 - RNA, 14 nt, Homo sapiens
ucaguauacugugu

SEQ ID NO: 748350 - RNA, 18 nt, Homo sapiens
ucaguaucaguauuuaca

SEQ ID NO: 748351 - RNA, 22 nt, Homo sapiens
ucaguaucuucaagguuuggaa

SEQ ID NO: 748352 - RNA, 16 nt, Homo sapiens
ucaguauguccccaua

SEQ ID NO: 748353 - RNA, 20 nt, Homo sapiens
ucagucaacaacuuacacuu

SEQ ID NO: 748354 - RNA, 23 nt, Homo sapiens
ucagucacauggcaugguuuugu

SEQ ID NO: 748355 - RNA, 19 nt, Homo sapiens
ucagucagcaaacuccaca

SEQ ID NO: 748356 - RNA, 19 nt, Homo sapiens
ucagucauuuuuaaccucu

SEQ ID NO: 748357 - RNA, 15 nt, Homo sapiens
ucaguccaugucucg

SEQ ID NO: 748358 - RNA, 23 nt, Homo sapiens
ucagucccuauguauuugcaguu

SEQ ID NO: 748359 - RNA, 20 nt, Homo sapiens
ucaguccuaccuuugcugau

SEQ ID NO: 748360 - RNA, 16 nt, Homo sapiens
ucagucucacagagaa

SEQ ID NO: 748361 - RNA, 13 nt, Homo sapiens
ucagucugugaaa

SEQ ID NO: 748362 - RNA, 17 nt, Homo sapiens
ucagugaaaaauaauua

SEQ ID NO: 748363 - RNA, 20 nt, Homo sapiens
ucagugaaagccagauucaa

SEQ ID NO: 748364 - RNA, 16 nt, Homo sapiens
ucagugaaauaauuac

SEQ ID NO: 748365 - RNA, 17 nt, Homo sapiens
ucagugaagaugcugua

SEQ ID NO: 748366 - RNA, 13 nt, Homo sapiens
ucagugagccaug

SEQ ID NO: 748367 - RNA, 17 nt, Homo sapiens
ucagugaggagggaugu

SEQ ID NO: 748368 - RNA, 18 nt, Homo sapiens
ucagugcacuguauauag

SEQ ID NO: 748369 - RNA, 21 nt, Homo sapiens
ucagugccuacccaccuguga

SEQ ID NO: 748370 - RNA, 17 nt, Homo sapiens
ucagugccuucucucag

SEQ ID NO: 748371 - RNA, 16 nt, Homo sapiens
ucagugcucgagacac

SEQ ID NO: 748372 - RNA, 21 nt, Homo sapiens
ucaguggaauagaugucucaa

SEQ ID NO: 748373 - RNA, 19 nt, Homo sapiens
ucaguggagagauguuugg

SEQ ID NO: 748374 - RNA, 23 nt, Homo sapiens
ucagugggaaacaaacugucuaa

SEQ ID NO: 748375 - RNA, 22 nt, Homo sapiens
ucaguggggacaggaaggacca

SEQ ID NO: 748376 - RNA, 18 nt, Homo sapiens
ucaguguuucauauucau

SEQ ID NO: 748377 - RNA, 14 nt, Homo sapiens
ucaguuacuaagaa

SEQ ID NO: 748378 - RNA, 13 nt, Homo sapiens
ucaguuacucuga

SEQ ID NO: 748379 - RNA, 21 nt, Homo sapiens
ucaguucccccaguaccucca

SEQ ID NO: 748380 - RNA, 16 nt, Homo sapiens
ucaguugcauucauua

SEQ ID NO: 748381 - RNA, 19 nt, Homo sapiens
ucaguugugaauacauucu

SEQ ID NO: 748382 - RNA, 19 nt, Homo sapiens
ucaguuguuuaauaauuua

SEQ ID NO: 748383 - RNA, 21 nt, Homo sapiens
ucaguuuuacucugcugcaaa

SEQ ID NO: 748384 - RNA, 17 nt, Homo sapiens
ucauaaacuucagggau

SEQ ID NO: 748385 - RNA, 11 nt, Homo sapiens
ucauaaccaaa

SEQ ID NO: 748386 - RNA, 14 nt, Homo sapiens
ucauaaccaaagag

SEQ ID NO: 748387 - RNA, 21 nt, Homo sapiens
ucauaagaaugaauaauaauu

SEQ ID NO: 748388 - RNA, 15 nt, Homo sapiens
ucauaagggcacuga

SEQ ID NO: 748389 - RNA, 16 nt, Homo sapiens
ucauaaguuggaccag

SEQ ID NO: 748390 - RNA, 15 nt, Homo sapiens
ucauaaucacaaccc

SEQ ID NO: 748391 - RNA, 14 nt, Homo sapiens
ucauaauguauuau

SEQ ID NO: 748392 - RNA, 23 nt, Homo sapiens
ucauaauguggugauggcccuaa

SEQ ID NO: 748393 - RNA, 16 nt, Homo sapiens
ucauacacaugugcac

SEQ ID NO: 748394 - RNA, 17 nt, Homo sapiens
ucauacaggaaugaagc

SEQ ID NO: 748395 - RNA, 15 nt, Homo sapiens
ucauaccacuugaau

SEQ ID NO: 748396 - RNA, 22 nt, Homo sapiens
ucauaccacuugaauuuauuga

SEQ ID NO: 748397 - RNA, 15 nt, Homo sapiens
ucauacccaugcaca

SEQ ID NO: 748398 - RNA, 24 nt, Homo sapiens
ucauaccguguaccucaguucccu

SEQ ID NO: 748399 - RNA, 14 nt, Homo sapiens
ucauacuacugaaa

SEQ ID NO: 748400 - RNA, 22 nt, Homo sapiens
ucauacuccuuuuaagcaguga

SEQ ID NO: 748401 - RNA, 12 nt, Homo sapiens
ucauacuguaac

SEQ ID NO: 748402 - RNA, 16 nt, Homo sapiens
ucauagaggugagaaa

SEQ ID NO: 748403 - RNA, 13 nt, Homo sapiens
ucauagcauucac

SEQ ID NO: 748404 - RNA, 13 nt, Homo sapiens
ucauagccaaagc

SEQ ID NO: 748405 - RNA, 15 nt, Homo sapiens
ucauagcgaguuuuc

SEQ ID NO: 748406 - RNA, 14 nt, Homo sapiens
ucauagcugagauu

SEQ ID NO: 748407 - RNA, 20 nt, Homo sapiens
ucauaggauuaagcaguuua

SEQ ID NO: 748408 - RNA, 15 nt, Homo sapiens
ucauagggucucuuc

SEQ ID NO: 748409 - RNA, 13 nt, Homo sapiens
ucauauaccagca

SEQ ID NO: 748410 - RNA, 20 nt, Homo sapiens
ucauauaccagcaauauauc

SEQ ID NO: 748411 - RNA, 23 nt, Homo sapiens
ucauauauuuuuaccaucugcug

SEQ ID NO: 748412 - RNA, 16 nt, Homo sapiens
ucauaucaaaggguaa

SEQ ID NO: 748413 - RNA, 17 nt, Homo sapiens
ucauaucaacuuaguca

SEQ ID NO: 748414 - RNA, 19 nt, Homo sapiens
ucauaugacugauuacuca

SEQ ID NO: 748415 - RNA, 18 nt, Homo sapiens
ucauauggcccaguguca

SEQ ID NO: 748416 - RNA, 18 nt, Homo sapiens
ucauauuaauauauuucc

SEQ ID NO: 748417 - RNA, 15 nt, Homo sapiens
ucauauucauaugca

SEQ ID NO: 748418 - RNA, 15 nt, Homo sapiens
ucauauuuacugguc

SEQ ID NO: 748419 - RNA, 21 nt, Homo sapiens
ucauauuucuaccugagugaa

SEQ ID NO: 748420 - RNA, 19 nt, Homo sapiens
ucaucaaacauuugccaag

SEQ ID NO: 748421 - RNA, 20 nt, Homo sapiens
ucaucaaacauuugccaagu

SEQ ID NO: 748422 - RNA, 23 nt, Homo sapiens
ucaucaaagcagaagucuggcuu

SEQ ID NO: 748423 - RNA, 15 nt, Homo sapiens
ucaucaaucaaauaa

SEQ ID NO: 748424 - RNA, 20 nt, Homo sapiens
ucaucaauggggccagucag

SEQ ID NO: 748425 - RNA, 15 nt, Homo sapiens
ucaucacauucaggg

SEQ ID NO: 748426 - RNA, 20 nt, Homo sapiens
ucaucacauuucuaugccaa

SEQ ID NO: 748427 - RNA, 12 nt, Homo sapiens
ucaucaccaccc

SEQ ID NO: 748428 - RNA, 12 nt, Homo sapiens
ucaucacuguaa

SEQ ID NO: 748429 - RNA, 13 nt, Homo sapiens
ucaucacuguaaa

SEQ ID NO: 748430 - RNA, 13 nt, Homo sapiens
ucaucacuuugac

SEQ ID NO: 748431 - RNA, 19 nt, Homo sapiens
ucaucagcauuuggaccaa

SEQ ID NO: 748432 - RNA, 23 nt, Homo sapiens
ucaucagcuaucguuaguguauu

SEQ ID NO: 748433 - RNA, 14 nt, Homo sapiens
ucaucauccuacaa

SEQ ID NO: 748434 - RNA, 19 nt, Homo sapiens
ucaucauggaggucauaca

SEQ ID NO: 748435 - RNA, 22 nt, Homo sapiens
ucauccaaugcaggcuguuucc

SEQ ID NO: 748436 - RNA, 11 nt, Homo sapiens
uccccagcucc

SEQ ID NO: 748437 - RNA, 15 nt, Homo sapiens
uccccaggcauuugc

SEQ ID NO: 748438 - RNA, 18 nt, Homo sapiens
uccccaggggaaaaugaa

SEQ ID NO: 748439 - RNA, 17 nt, Homo sapiens
uccccaucauuacuggu

SEQ ID NO: 748440 - RNA, 23 nt, Homo sapiens
uccccauccccacccagucucau

SEQ ID NO: 748441 - RNA, 15 nt, Homo sapiens
ucccccaaacauguu

SEQ ID NO: 748442 - RNA, 14 nt, Homo sapiens
ucccccaaaguuca

SEQ ID NO: 748443 - RNA, 23 nt, Homo sapiens
ucccccaccgguccagcuggccu

SEQ ID NO: 748444 - RNA, 22 nt, Homo sapiens
ucccccuauuuauugacuuuga

SEQ ID NO: 748445 - RNA, 21 nt, Homo sapiens
ucccccucaauagaucuccag

SEQ ID NO: 748446 - RNA, 17 nt, Homo sapiens
ucccccugcuugucuuc

SEQ ID NO: 748447 - RNA, 22 nt, Homo sapiens
ucccccuggggcuucuccugac

SEQ ID NO: 748448 - RNA, 22 nt, Homo sapiens
uccccgagugccuagguuuugg

SEQ ID NO: 748449 - RNA, 14 nt, Homo sapiens
uccccggcaugaga

SEQ ID NO: 748450 - RNA, 14 nt, Homo sapiens
uccccgggggagga

SEQ ID NO: 748451 - RNA, 15 nt, Homo sapiens
uccccgggucucuca

SEQ ID NO: 748452 - RNA, 21 nt, Homo sapiens
uccccgugccaaaaaucuuuu

SEQ ID NO: 748453 - RNA, 20 nt, Homo sapiens
uccccguuccaccccaagag

SEQ ID NO: 748454 - RNA, 15 nt, Homo sapiens
uccccuaaaauaaca

SEQ ID NO: 748455 - RNA, 16 nt, Homo sapiens
uccccuauuaggcagg

SEQ ID NO: 748456 - RNA, 13 nt, Homo sapiens
uccccucaaccca

SEQ ID NO: 748457 - RNA, 14 nt, Homo sapiens
uccccucccagaug

SEQ ID NO: 748458 - RNA, 16 nt, Homo sapiens
uccccucccccaagau

SEQ ID NO: 748459 - RNA, 19 nt, Homo sapiens
uccccucccuggcucccau

SEQ ID NO: 748460 - RNA, 22 nt, Homo sapiens
uccccucccuggcucccaugac

SEQ ID NO: 748461 - RNA, 20 nt, Homo sapiens
uccccuccucagugacauca

SEQ ID NO: 748462 - RNA, 19 nt, Homo sapiens
uccccuccuuggcuuuaug

SEQ ID NO: 748463 - RNA, 18 nt, Homo sapiens
uccccuccuugggcacuu

SEQ ID NO: 748464 - RNA, 19 nt, Homo sapiens
uccccucucgcgcccagca

SEQ ID NO: 748465 - RNA, 22 nt, Homo sapiens
uccccugcccccuguacauuug

SEQ ID NO: 748466 - RNA, 17 nt, Homo sapiens
uccccugccucaccagc

SEQ ID NO: 748467 - RNA, 21 nt, Homo sapiens
uccccugcugaggcagugugg

SEQ ID NO: 748468 - RNA, 15 nt, Homo sapiens
uccccugucccacca

SEQ ID NO: 748469 - RNA, 16 nt, Homo sapiens
uccccuguugugugga

SEQ ID NO: 748470 - RNA, 18 nt, Homo sapiens
uccccuucucucaucucu

SEQ ID NO: 748471 - RNA, 23 nt, Homo sapiens
uccccuucucugugcaguagcau

SEQ ID NO: 748472 - RNA, 18 nt, Homo sapiens
uccccuuuguguagaaag

SEQ ID NO: 748473 - RNA, 13 nt, Homo sapiens
ucccgaagccacc

SEQ ID NO: 748474 - RNA, 13 nt, Homo sapiens
ucccgauaccuca

SEQ ID NO: 748475 - RNA, 21 nt, Homo sapiens
ucccgauucacccuguccaaa

SEQ ID NO: 748476 - RNA, 22 nt, Homo sapiens
ucccgcccuuccaugugccuuu

SEQ ID NO: 748477 - RNA, 20 nt, Homo sapiens
ucccggauuuuuguuaauau

SEQ ID NO: 748478 - RNA, 19 nt, Homo sapiens
ucccgggcuuaccagguga

SEQ ID NO: 748479 - RNA, 17 nt, Homo sapiens
ucccggggccagcacuu

SEQ ID NO: 748480 - RNA, 18 nt, Homo sapiens
ucccggggcuccacugaa

SEQ ID NO: 748481 - RNA, 17 nt, Homo sapiens
ucccgugggcaucucaa

SEQ ID NO: 748482 - RNA, 15 nt, Homo sapiens
ucccuaaaaauucca

SEQ ID NO: 748483 - RNA, 14 nt, Homo sapiens
ucccuaaauauaca

SEQ ID NO: 748484 - RNA, 18 nt, Homo sapiens
ucccuacccuaaccaagu

SEQ ID NO: 748485 - RNA, 21 nt, Homo sapiens
ucccuacccuggcccagauga

SEQ ID NO: 748486 - RNA, 12 nt, Homo sapiens
ucccuaccuccu

SEQ ID NO: 748487 - RNA, 22 nt, Homo sapiens
ucccuaggaaacucacacuccc

SEQ ID NO: 748488 - RNA, 19 nt, Homo sapiens
ucccuaggggacacuuccc

SEQ ID NO: 748489 - RNA, 19 nt, Homo sapiens
ucccuaucucgaacaugga

SEQ ID NO: 748490 - RNA, 15 nt, Homo sapiens
ucccucaaagcacac

SEQ ID NO: 748491 - RNA, 21 nt, Homo sapiens
ucccucaaagcacacgucaug

SEQ ID NO: 748492 - RNA, 11 nt, Homo sapiens
ucccucaggcc

SEQ ID NO: 748493 - RNA, 13 nt, Homo sapiens
ucccucagugaag

SEQ ID NO: 748494 - RNA, 14 nt, Homo sapiens
ucccuccaaagggc

SEQ ID NO: 748495 - RNA, 20 nt, Homo sapiens
ucccuccauucauccuucca

SEQ ID NO: 748496 - RNA, 16 nt, Homo sapiens
ucccuccccugccauu

SEQ ID NO: 748497 - RNA, 15 nt, Homo sapiens
ucccucucagugccu

SEQ ID NO: 748498 - RNA, 17 nt, Homo sapiens
ucccugaggauggguca

SEQ ID NO: 748499 - RNA, 16 nt, Homo sapiens
ucccugcacagugacu

SEQ ID NO: 748500 - RNA, 14 nt, Homo sapiens
ucccugccaccagg

SEQ ID NO: 748501 - RNA, 17 nt, Homo sapiens
ucccugccaccaggcac

SEQ ID NO: 748502 - RNA, 15 nt, Homo sapiens
ucccugcucuugcag

SEQ ID NO: 748503 - RNA, 21 nt, Homo sapiens
ucccuggcucccaugaccaua

SEQ ID NO: 748504 - RNA, 16 nt, Homo sapiens
ucccugggcugugcua

SEQ ID NO: 748505 - RNA, 13 nt, Homo sapiens
ucccugggggccu

SEQ ID NO: 748506 - RNA, 19 nt, Homo sapiens
ucccuggucccucguccac

SEQ ID NO: 748507 - RNA, 14 nt, Homo sapiens
ucccugguccuuca

SEQ ID NO: 748508 - RNA, 17 nt, Homo sapiens
ucccuggucucugccag

SEQ ID NO: 748509 - RNA, 19 nt, Homo sapiens
ucccugucauagagcugca

SEQ ID NO: 748510 - RNA, 20 nt, Homo sapiens
ucccugucccucuagugccu

SEQ ID NO: 748511 - RNA, 19 nt, Homo sapiens
ucccugucuccagcugccu

SEQ ID NO: 748512 - RNA, 22 nt, Homo sapiens
ucccugucugugucccagccac

SEQ ID NO: 748513 - RNA, 19 nt, Homo sapiens
ucccugugccagaccucaa

SEQ ID NO: 748514 - RNA, 21 nt, Homo sapiens
ucccuguguauucuagugaau

SEQ ID NO: 748515 - RNA, 20 nt, Homo sapiens
ucccuguuauuuuucugccc

SEQ ID NO: 748516 - RNA, 17 nt, Homo sapiens
ucccuguuuuaauucaa

SEQ ID NO: 748517 - RNA, 16 nt, Homo sapiens
ucccuuaaagauuuuc

SEQ ID NO: 748518 - RNA, 18 nt, Homo sapiens
ucccuuacagaggaccau

SEQ ID NO: 748519 - RNA, 17 nt, Homo sapiens
ucccuucaucuuccuca

SEQ ID NO: 748520 - RNA, 23 nt, Homo sapiens
ucccuucucuggucuccuugaga

SEQ ID NO: 748521 - RNA, 20 nt, Homo sapiens
ucccuugcuguaugcugauc

SEQ ID NO: 748522 - RNA, 19 nt, Homo sapiens
ucccuuggaaaucugccau

SEQ ID NO: 748523 - RNA, 19 nt, Homo sapiens
ucccuuuguugcacacuca

SEQ ID NO: 748524 - RNA, 12 nt, Homo sapiens
ucccuuuuacau

SEQ ID NO: 748525 - RNA, 14 nt, Homo sapiens
ucccuuuucccuua

SEQ ID NO: 748526 - RNA, 22 nt, Homo sapiens
ucccuuuugcuagagcugacag

SEQ ID NO: 748527 - RNA, 17 nt, Homo sapiens
uccgacgcugccucuca

SEQ ID NO: 748528 - RNA, 14 nt, Homo sapiens
uccgagccauguga

SEQ ID NO: 748529 - RNA, 23 nt, Homo sapiens
uccgcagaagcccugaugugucc

SEQ ID NO: 748530 - RNA, 14 nt, Homo sapiens
uccgccagaccuca

SEQ ID NO: 748531 - RNA, 15 nt, Homo sapiens
uccgccagaccucaa

SEQ ID NO: 748532 - RNA, 22 nt, Homo sapiens
uccgcugccuggaacaccagca

SEQ ID NO: 748533 - RNA, 21 nt, Homo sapiens
uccggagaugaauaugagcuc

SEQ ID NO: 748534 - RNA, 15 nt, Homo sapiens
uccggcagccuggau

SEQ ID NO: 748535 - RNA, 19 nt, Homo sapiens
uccggccuccugucccuca

SEQ ID NO: 748536 - RNA, 20 nt, Homo sapiens
uccggccuccugucccucau

SEQ ID NO: 748537 - RNA, 16 nt, Homo sapiens
uccggcgggauguuga

SEQ ID NO: 748538 - RNA, 20 nt, Homo sapiens
uccgggaacuuugcagcaua

SEQ ID NO: 748539 - RNA, 22 nt, Homo sapiens
uccgggagcggcuguugggcug

SEQ ID NO: 748540 - RNA, 15 nt, Homo sapiens
uccguagacuguuua

SEQ ID NO: 748541 - RNA, 16 nt, Homo sapiens
uccguaguucccugaa

SEQ ID NO: 748542 - RNA, 13 nt, Homo sapiens
uccgucucaaaaa

SEQ ID NO: 748543 - RNA, 15 nt, Homo sapiens
uccgugaauugcuuu

SEQ ID NO: 748544 - RNA, 18 nt, Homo sapiens
uccgugcuuaaccaaaga

SEQ ID NO: 748545 - RNA, 18 nt, Homo sapiens
uccuaaaaguguaagaaa

SEQ ID NO: 748546 - RNA, 21 nt, Homo sapiens
uccuaaagcuuuuauuuaaca

SEQ ID NO: 748547 - RNA, 18 nt, Homo sapiens
uccuaaauguaaucacga

SEQ ID NO: 748548 - RNA, 16 nt, Homo sapiens
uccuaaauuuuuacau

SEQ ID NO: 748549 - RNA, 20 nt, Homo sapiens
uccuaacaaguagcacccug

SEQ ID NO: 748550 - RNA, 16 nt, Homo sapiens
ucuaaaagauccuuuu

SEQ ID NO: 748551 - RNA, 12 nt, Homo sapiens
ucuaaaagccau

SEQ ID NO: 748552 - RNA, 17 nt, Homo sapiens
ucuaaaaguacugcauu

SEQ ID NO: 748553 - RNA, 15 nt, Homo sapiens
ucuaaaaucaugaaa

SEQ ID NO: 748554 - RNA, 17 nt, Homo sapiens
ucuaaaaucccuuucaa

SEQ ID NO: 748555 - RNA, 12 nt, Homo sapiens
ucuaaacuauca

SEQ ID NO: 748556 - RNA, 16 nt, Homo sapiens
ucuaaagaauguguuc

SEQ ID NO: 748557 - RNA, 20 nt, Homo sapiens
ucuaaagaauguguucuaaa

SEQ ID NO: 748558 - RNA, 20 nt, Homo sapiens
ucuaaagauggaaaaaccac

SEQ ID NO: 748559 - RNA, 18 nt, Homo sapiens
ucuaaagauggaguuucu

SEQ ID NO: 748560 - RNA, 13 nt, Homo sapiens
ucuaaaguucuaa

SEQ ID NO: 748561 - RNA, 21 nt, Homo sapiens
ucuaaauguggagaaacugua

SEQ ID NO: 748562 - RNA, 24 nt, Homo sapiens
ucuaaauuugaauguuaagcagau

SEQ ID NO: 748563 - RNA, 23 nt, Homo sapiens
ucuaacaccaacauaagguacua

SEQ ID NO: 748564 - RNA, 15 nt, Homo sapiens
ucuaacagcaaauaa

SEQ ID NO: 748565 - RNA, 21 nt, Homo sapiens
ucuaaccuugaaugcugccag

SEQ ID NO: 748566 - RNA, 20 nt, Homo sapiens
ucuaacuggacaugaaggaa

SEQ ID NO: 748567 - RNA, 21 nt, Homo sapiens
ucuaagaaaagccuaaucaca

SEQ ID NO: 748568 - RNA, 17 nt, Homo sapiens
ucuaagagagcugccau

SEQ ID NO: 748569 - RNA, 20 nt, Homo sapiens
ucuaagaucuuagauucucu

SEQ ID NO: 748570 - RNA, 14 nt, Homo sapiens
ucuaagauucuaaa

SEQ ID NO: 748571 - RNA, 14 nt, Homo sapiens
ucuaagauucuaau

SEQ ID NO: 748572 - RNA, 14 nt, Homo sapiens
ucuaagauucugau

SEQ ID NO: 748573 - RNA, 16 nt, Homo sapiens
ucuaagcaaugcaaau

SEQ ID NO: 748574 - RNA, 15 nt, Homo sapiens
ucuaagcacauucca

SEQ ID NO: 748575 - RNA, 16 nt, Homo sapiens
ucuaagcacauuccaa

SEQ ID NO: 748576 - RNA, 20 nt, Homo sapiens
ucuaagcauauucaaaaggg

SEQ ID NO: 748577 - RNA, 16 nt, Homo sapiens
ucuaagccaguuuuca

SEQ ID NO: 748578 - RNA, 21 nt, Homo sapiens
ucuaaguuuuaggguacaugu

SEQ ID NO: 748579 - RNA, 16 nt, Homo sapiens
ucuaauaaacuuuauu

SEQ ID NO: 748580 - RNA, 21 nt, Homo sapiens
ucuaaucaagaaaagaauuac

SEQ ID NO: 748581 - RNA, 17 nt, Homo sapiens
ucuaaucccagcacuuu

SEQ ID NO: 748582 - RNA, 20 nt, Homo sapiens
ucuaauuaauuguaaucuga

SEQ ID NO: 748583 - RNA, 16 nt, Homo sapiens
ucuaauuuuuaagaau

SEQ ID NO: 748584 - RNA, 14 nt, Homo sapiens
ucuacaaaggccau

SEQ ID NO: 748585 - RNA, 21 nt, Homo sapiens
ucuacaaucaguugacuuuaa

SEQ ID NO: 748586 - RNA, 16 nt, Homo sapiens
ucuacagcagcacugu

SEQ ID NO: 748587 - RNA, 20 nt, Homo sapiens
ucuacauagugacaugcaca

SEQ ID NO: 748588 - RNA, 11 nt, Homo sapiens
ucuacauucac

SEQ ID NO: 748589 - RNA, 15 nt, Homo sapiens
ucuacauuugagggc

SEQ ID NO: 748590 - RNA, 20 nt, Homo sapiens
ucuaccaacugucccuuugu

SEQ ID NO: 748591 - RNA, 18 nt, Homo sapiens
ucuaccaugaacagaaaa

SEQ ID NO: 748592 - RNA, 15 nt, Homo sapiens
ucuacccuggcacua

SEQ ID NO: 748593 - RNA, 13 nt, Homo sapiens
ucuaccucaggca

SEQ ID NO: 748594 - RNA, 20 nt, Homo sapiens
ucuaccucaggcagcucaag

SEQ ID NO: 748595 - RNA, 16 nt, Homo sapiens
ucuaccugacuccuga

SEQ ID NO: 748596 - RNA, 17 nt, Homo sapiens
ucuaccugcccccauca

SEQ ID NO: 748597 - RNA, 18 nt, Homo sapiens
ucuaccuuuucuggcaaa

SEQ ID NO: 748598 - RNA, 13 nt, Homo sapiens
ucuacgugcuccu

SEQ ID NO: 748599 - RNA, 17 nt, Homo sapiens
ucuacuaccacaaggaa

SEQ ID NO: 748600 - RNA, 15 nt, Homo sapiens
ucuacugaggugcua

SEQ ID NO: 748601 - RNA, 22 nt, Homo sapiens
ucuacugcuuuggauccugggu

SEQ ID NO: 748602 - RNA, 16 nt, Homo sapiens
ucuacuuaaugagaua

SEQ ID NO: 748603 - RNA, 15 nt, Homo sapiens
ucuagaagacuguca

SEQ ID NO: 748604 - RNA, 16 nt, Homo sapiens
ucuagaagagggguua

SEQ ID NO: 748605 - RNA, 22 nt, Homo sapiens
ucuagaauguggauuugauuca

SEQ ID NO: 748606 - RNA, 23 nt, Homo sapiens
ucuagacaagauauuguacauaa

SEQ ID NO: 748607 - RNA, 22 nt, Homo sapiens
ucuagacacugccacacagggu

SEQ ID NO: 748608 - RNA, 22 nt, Homo sapiens
ucuagacucaaaaccuggagau

SEQ ID NO: 748609 - RNA, 16 nt, Homo sapiens
ucuagagcagggauua

SEQ ID NO: 748610 - RNA, 20 nt, Homo sapiens
ucuagagcuuaaugcuacau

SEQ ID NO: 748611 - RNA, 22 nt, Homo sapiens
ucuagaggcaucaccugggacc

SEQ ID NO: 748612 - RNA, 18 nt, Homo sapiens
ucuagauuauaaacugac

SEQ ID NO: 748613 - RNA, 13 nt, Homo sapiens
ucuagcacacuuu

SEQ ID NO: 748614 - RNA, 12 nt, Homo sapiens
ucuagcauccuc

SEQ ID NO: 748615 - RNA, 14 nt, Homo sapiens
ucuagcauggcaua

SEQ ID NO: 748616 - RNA, 17 nt, Homo sapiens
ucuagcucuaguucaaa

SEQ ID NO: 748617 - RNA, 15 nt, Homo sapiens
ucuaggacugcagug

SEQ ID NO: 748618 - RNA, 13 nt, Homo sapiens
ucuaggcuaagca

SEQ ID NO: 748619 - RNA, 16 nt, Homo sapiens
ucuaggcuaagcacuu

SEQ ID NO: 748620 - RNA, 15 nt, Homo sapiens
ucuagggaaucugga

SEQ ID NO: 748621 - RNA, 16 nt, Homo sapiens
ucuagggccucuccag

SEQ ID NO: 748622 - RNA, 22 nt, Homo sapiens
ucuagggcuaguagaacuggau

SEQ ID NO: 748623 - RNA, 15 nt, Homo sapiens
ucuaggguuuuccaa

SEQ ID NO: 748624 - RNA, 16 nt, Homo sapiens
ucuaggucacuucuca

SEQ ID NO: 748625 - RNA, 22 nt, Homo sapiens
ucuaguccuauucuauugcagu

SEQ ID NO: 748626 - RNA, 18 nt, Homo sapiens
ucuagucucugauuugca

SEQ ID NO: 748627 - RNA, 19 nt, Homo sapiens
ucuaguggguugaccuuua

SEQ ID NO: 748628 - RNA, 18 nt, Homo sapiens
ucuagugucugacuuuug

SEQ ID NO: 748629 - RNA, 17 nt, Homo sapiens
ucuaguguguccuguga

SEQ ID NO: 748630 - RNA, 14 nt, Homo sapiens
ucuaguuugcaacu

SEQ ID NO: 748631 - RNA, 16 nt, Homo sapiens
ucuauaaaauacuggu

SEQ ID NO: 748632 - RNA, 13 nt, Homo sapiens
ucuauaaauucaa

SEQ ID NO: 748633 - RNA, 21 nt, Homo sapiens
ucuauaauggaaacauuuaca

SEQ ID NO: 748634 - RNA, 20 nt, Homo sapiens
ucuauacaaaaugauuuuga

SEQ ID NO: 748635 - RNA, 20 nt, Homo sapiens
ucuauacaaauuuucagaag

SEQ ID NO: 748636 - RNA, 13 nt, Homo sapiens
ucuauacaacagg

SEQ ID NO: 748637 - RNA, 20 nt, Homo sapiens
ucuauaccgcuucgacugga

SEQ ID NO: 748638 - RNA, 12 nt, Homo sapiens
ucuauacuuugu

SEQ ID NO: 748639 - RNA, 13 nt, Homo sapiens
ucuauagcagauu

SEQ ID NO: 748640 - RNA, 13 nt, Homo sapiens
ucuauaggcagcu

SEQ ID NO: 748641 - RNA, 21 nt, Homo sapiens
ucuauauaguuccuugccuua

SEQ ID NO: 748642 - RNA, 23 nt, Homo sapiens
ucuauaucucauuucauucucac

SEQ ID NO: 748643 - RNA, 18 nt, Homo sapiens
ucuauauuuuuguccaaa

SEQ ID NO: 748644 - RNA, 13 nt, Homo sapiens
ucuaucaucucag

SEQ ID NO: 748645 - RNA, 12 nt, Homo sapiens
ucuauccaaauc

SEQ ID NO: 748646 - RNA, 18 nt, Homo sapiens
ucuaugaguuggacuuca

SEQ ID NO: 748647 - RNA, 13 nt, Homo sapiens
ucuaugccuguau

SEQ ID NO: 748648 - RNA, 13 nt, Homo sapiens
ucuaugccuuuag

SEQ ID NO: 748649 - RNA, 23 nt, Homo sapiens
ucuaugcucucgcaccuuuccaa

SEQ ID NO: 748650 - RNA, 23 nt, Homo sapiens
ucuaugggguucguuaugccaaa

SEQ ID NO: 748651 - RNA, 18 nt, Homo sapiens
ucuauguagaacuguuca

SEQ ID NO: 748652 - RNA, 13 nt, Homo sapiens
ucuauguguacag

SEQ ID NO: 748653 - RNA, 20 nt, Homo sapiens
ucuauuaauaucaacucuga

SEQ ID NO: 748654 - RNA, 22 nt, Homo sapiens
ucuauucaggcuguuguuggcu

SEQ ID NO: 748655 - RNA, 20 nt, Homo sapiens
ucuauucuuuguaccaucug

SEQ ID NO: 748656 - RNA, 13 nt, Homo sapiens
ucuauugcugcuc

SEQ ID NO: 748657 - RNA, 14 nt, Homo sapiens
ucuauuuccacuga

SEQ ID NO: 748658 - RNA, 13 nt, Homo sapiens
ucuauuucuauga

SEQ ID NO: 748659 - RNA, 21 nt, Homo sapiens
ucuauuuuaguugguuuguau

SEQ ID NO: 748660 - RNA, 19 nt, Homo sapiens
ucuauuuuauuaugagcuu

SEQ ID NO: 748661 - RNA, 20 nt, Homo sapiens
ucuauuuuuaucaugaauuc

SEQ ID NO: 748662 - RNA, 16 nt, Homo sapiens
ucuauuuuugugugcu

SEQ ID NO: 748663 - RNA, 23 nt, Homo sapiens
ucucaaaaaaaaaaacaaacaaa

SEQ ID NO: 748664 - RNA, 13 nt, Homo sapiens
ucucaaaaauccu

SEQ ID NO: 748665 - RNA, 18 nt, Homo sapiens
ugauuuaccuauacauua

SEQ ID NO: 748666 - RNA, 16 nt, Homo sapiens
ugauuuaugaucacuu

SEQ ID NO: 748667 - RNA, 13 nt, Homo sapiens
ugauuucaagacc

SEQ ID NO: 748668 - RNA, 18 nt, Homo sapiens
ugauuucuacaacuggag

SEQ ID NO: 748669 - RNA, 22 nt, Homo sapiens
ugauuucuuauuauuauauguu

SEQ ID NO: 748670 - RNA, 18 nt, Homo sapiens
ugauuucuuucuuugcac

SEQ ID NO: 748671 - RNA, 12 nt, Homo sapiens
ugauuugcaaua

SEQ ID NO: 748672 - RNA, 15 nt, Homo sapiens
ugauuuguagcacug

SEQ ID NO: 748673 - RNA, 17 nt, Homo sapiens
ugauuuugagaaguaua

SEQ ID NO: 748674 - RNA, 14 nt, Homo sapiens
ugauuuuguaaaag

SEQ ID NO: 748675 - RNA, 14 nt, Homo sapiens
ugcaaaaguucuca

SEQ ID NO: 748676 - RNA, 22 nt, Homo sapiens
ugcaaaauuguuuucacuugua

SEQ ID NO: 748677 - RNA, 21 nt, Homo sapiens
ugcaaaggcgcagugcuucuc

SEQ ID NO: 748678 - RNA, 19 nt, Homo sapiens
ugcaaauacaaucagccca

SEQ ID NO: 748679 - RNA, 19 nt, Homo sapiens
ugcaaauacuguauauuca

SEQ ID NO: 748680 - RNA, 15 nt, Homo sapiens
ugcaaauauaaucca

SEQ ID NO: 748681 - RNA, 15 nt, Homo sapiens
ugcaaaugccuccaa

SEQ ID NO: 748682 - RNA, 18 nt, Homo sapiens
ugcaaaugcuauauugca

SEQ ID NO: 748683 - RNA, 18 nt, Homo sapiens
ugcaacagcuacagucua

SEQ ID NO: 748684 - RNA, 23 nt, Homo sapiens
ugcaaccgggcccucucucugcg

SEQ ID NO: 748685 - RNA, 17 nt, Homo sapiens
ugcaaccucugccuccc

SEQ ID NO: 748686 - RNA, 21 nt, Homo sapiens
ugcaacuaggaagagacacac

SEQ ID NO: 748687 - RNA, 21 nt, Homo sapiens
ugcaacucaaggacuuugcag

SEQ ID NO: 748688 - RNA, 16 nt, Homo sapiens
ugcaagggucccuuaa

SEQ ID NO: 748689 - RNA, 16 nt, Homo sapiens
ugcaaguauacuaggg

SEQ ID NO: 748690 - RNA, 19 nt, Homo sapiens
ugcaaguucauaggucucc

SEQ ID NO: 748691 - RNA, 14 nt, Homo sapiens
ugcaaguugaggac

SEQ ID NO: 748692 - RNA, 22 nt, Homo sapiens
ugcaauaaaucugacccagugc

SEQ ID NO: 748693 - RNA, 22 nt, Homo sapiens
ugcaauaaugacaaaugcccug

SEQ ID NO: 748694 - RNA, 18 nt, Homo sapiens
ugcaauaccaauguucua

SEQ ID NO: 748695 - RNA, 13 nt, Homo sapiens
ugcaauagauuac

SEQ ID NO: 748696 - RNA, 18 nt, Homo sapiens
ugcaauaggugugcguca

SEQ ID NO: 748697 - RNA, 19 nt, Homo sapiens
ugcaaucuucuacuuuaag

SEQ ID NO: 748698 - RNA, 17 nt, Homo sapiens
ugcaaugcuaucacugu

SEQ ID NO: 748699 - RNA, 15 nt, Homo sapiens
ugcaauguaagcaua

SEQ ID NO: 748700 - RNA, 14 nt, Homo sapiens
ugcaauugaccucu

SEQ ID NO: 748701 - RNA, 19 nt, Homo sapiens
ugcaauuggaauaaucacu

SEQ ID NO: 748702 - RNA, 22 nt, Homo sapiens
ugcaauuuuauuaaaugcauca

SEQ ID NO: 748703 - RNA, 14 nt, Homo sapiens
ugcacaaacaugaa

SEQ ID NO: 748704 - RNA, 19 nt, Homo sapiens
ugcacaacagaguaacuau

SEQ ID NO: 748705 - RNA, 14 nt, Homo sapiens
ugcacaagcacuau

SEQ ID NO: 748706 - RNA, 15 nt, Homo sapiens
ugcacaaugucaugu

SEQ ID NO: 748707 - RNA, 21 nt, Homo sapiens
ugcacacuccccugcacugga

SEQ ID NO: 748708 - RNA, 12 nt, Homo sapiens
ugcacacugagg

SEQ ID NO: 748709 - RNA, 14 nt, Homo sapiens
ugcacagcugcuug

SEQ ID NO: 748710 - RNA, 18 nt, Homo sapiens
ugcacagggggaggccau

SEQ ID NO: 748711 - RNA, 16 nt, Homo sapiens
ugcacaguagagcaaa

SEQ ID NO: 748712 - RNA, 16 nt, Homo sapiens
ugcacagugacuucug

SEQ ID NO: 748713 - RNA, 17 nt, Homo sapiens
ugcacagugugugacuu

SEQ ID NO: 748714 - RNA, 18 nt, Homo sapiens
ugcacagugugugacuua

SEQ ID NO: 748715 - RNA, 21 nt, Homo sapiens
ugcacauccgcgugugccugu

SEQ ID NO: 748716 - RNA, 13 nt, Homo sapiens
ugcacaucugcug

SEQ ID NO: 748717 - RNA, 21 nt, Homo sapiens
ugcacauuucuuugcauucca

SEQ ID NO: 748718 - RNA, 17 nt, Homo sapiens
ugcaccaaacugccuca

SEQ ID NO: 748719 - RNA, 17 nt, Homo sapiens
ugcaccaccaagccaag

SEQ ID NO: 748720 - RNA, 17 nt, Homo sapiens
ugcaccauugcacucua

SEQ ID NO: 748721 - RNA, 14 nt, Homo sapiens
ugcacccaccuguu

SEQ ID NO: 748722 - RNA, 17 nt, Homo sapiens
ugcaccccagcauucca

SEQ ID NO: 748723 - RNA, 14 nt, Homo sapiens
ugcaccccaugugg

SEQ ID NO: 748724 - RNA, 22 nt, Homo sapiens
ugcaccuacugcuuacuguugc

SEQ ID NO: 748725 - RNA, 13 nt, Homo sapiens
ugcaccuuugcac

SEQ ID NO: 748726 - RNA, 19 nt, Homo sapiens
ugcacgggagaauauacaa

SEQ ID NO: 748727 - RNA, 15 nt, Homo sapiens
ugcacgucuugcuau

SEQ ID NO: 748728 - RNA, 17 nt, Homo sapiens
ugcacgucuugcuauuu

SEQ ID NO: 748729 - RNA, 14 nt, Homo sapiens
ugcacuagccugug

SEQ ID NO: 748730 - RNA, 15 nt, Homo sapiens
ugcacuagccuguga

SEQ ID NO: 748731 - RNA, 14 nt, Homo sapiens
ugcacuccagccug

SEQ ID NO: 748732 - RNA, 22 nt, Homo sapiens
ugcacuccagccugggggacag

SEQ ID NO: 748733 - RNA, 18 nt, Homo sapiens
ugcacuccagucuggcaa

SEQ ID NO: 748734 - RNA, 10 nt, Homo sapiens
ugcacuccau

SEQ ID NO: 748735 - RNA, 15 nt, Homo sapiens
ugcacugucugagaa

SEQ ID NO: 748736 - RNA, 16 nt, Homo sapiens
ugcacuuaugauuuca

SEQ ID NO: 748737 - RNA, 18 nt, Homo sapiens
ugcacuuuuaaaccucuc

SEQ ID NO: 748738 - RNA, 20 nt, Homo sapiens
ugcacuuuuuuauaagagcu

SEQ ID NO: 748739 - RNA, 14 nt, Homo sapiens
ugcagaaacuacug

SEQ ID NO: 748740 - RNA, 16 nt, Homo sapiens
ugcagaaacuacugac

SEQ ID NO: 748741 - RNA, 12 nt, Homo sapiens
ugcagaagccaa

SEQ ID NO: 748742 - RNA, 17 nt, Homo sapiens
ugcagaaggaaagaagg

SEQ ID NO: 748743 - RNA, 19 nt, Homo sapiens
ugcagaagugguaggucag

SEQ ID NO: 748744 - RNA, 20 nt, Homo sapiens
ugcagaauucaaaagugauu

SEQ ID NO: 748745 - RNA, 15 nt, Homo sapiens
ugcagaccugucacc

SEQ ID NO: 748746 - RNA, 12 nt, Homo sapiens
ugcagacuguuc

SEQ ID NO: 748747 - RNA, 12 nt, Homo sapiens
ugcagacuuccc

SEQ ID NO: 748748 - RNA, 22 nt, Homo sapiens
ugcagagaaacuuaagcaaagg

SEQ ID NO: 748749 - RNA, 19 nt, Homo sapiens
ugcagagacucauuucaca

SEQ ID NO: 748750 - RNA, 14 nt, Homo sapiens
ugcagagagaucau

SEQ ID NO: 748751 - RNA, 16 nt, Homo sapiens
ugcagagaugacuguc

SEQ ID NO: 748752 - RNA, 14 nt, Homo sapiens
ugcagagcaggaaa

SEQ ID NO: 748753 - RNA, 17 nt, Homo sapiens
ugcagagcaggaaauga

SEQ ID NO: 748754 - RNA, 13 nt, Homo sapiens
ugcagagccacag

SEQ ID NO: 748755 - RNA, 12 nt, Homo sapiens
ugcagagucacu

SEQ ID NO: 748756 - RNA, 16 nt, Homo sapiens
ugcagagugcccagaa

SEQ ID NO: 748757 - RNA, 18 nt, Homo sapiens
ugcagagugcccagaacu

SEQ ID NO: 748758 - RNA, 15 nt, Homo sapiens
ugcagauaugggacu

SEQ ID NO: 748759 - RNA, 20 nt, Homo sapiens
ugcagauuuccaacuuuuau

SEQ ID NO: 748760 - RNA, 21 nt, Homo sapiens
ugcagcaaacacuccacccuc

SEQ ID NO: 748761 - RNA, 14 nt, Homo sapiens
ugcagcaccuccag

SEQ ID NO: 748762 - RNA, 15 nt, Homo sapiens
ugcagcacucuuauc

SEQ ID NO: 748763 - RNA, 12 nt, Homo sapiens
ugcagcauacca

SEQ ID NO: 748764 - RNA, 11 nt, Homo sapiens
ugcagccacac

SEQ ID NO: 748765 - RNA, 13 nt, Homo sapiens
ugcagccacuggc

SEQ ID NO: 748766 - RNA, 22 nt, Homo sapiens
ugcagccacuggcuuggaacac

SEQ ID NO: 748767 - RNA, 14 nt, Homo sapiens
ugcagccagccaca

SEQ ID NO: 748768 - RNA, 13 nt, Homo sapiens
ugcagccagcuca

SEQ ID NO: 748769 - RNA, 19 nt, Homo sapiens
ugcagcccagaauagcuuu

SEQ ID NO: 748770 - RNA, 14 nt, Homo sapiens
ugcagcccaugccc

SEQ ID NO: 748771 - RNA, 15 nt, Homo sapiens
ugcagcccaugccca

SEQ ID NO: 748772 - RNA, 16 nt, Homo sapiens
ugcagcccucuugccc

SEQ ID NO: 748773 - RNA, 17 nt, Homo sapiens
ugcagccuugacuucuc

SEQ ID NO: 748774 - RNA, 16 nt, Homo sapiens
ugcagcggcagagcaa

SEQ ID NO: 748775 - RNA, 13 nt, Homo sapiens
ugcagcugaugcc

SEQ ID NO: 748776 - RNA, 20 nt, Homo sapiens
ugcagcuggcccacugcugg

SEQ ID NO: 748777 - RNA, 21 nt, Homo sapiens
ugcaggacuccccaggagcac

SEQ ID NO: 748778 - RNA, 16 nt, Homo sapiens
ugcaggacuugagaag

SEQ ID NO: 748779 - RNA, 18 nt, Homo sapiens
ugcaggagcuaguucuca

SEQ ID NO: 748780 - RNA, 17 nt, Homo sapiens
ugcaggauuucuucaca

SEQ ID NO: 748781 - RNA, 18 nt, Homo sapiens
ugcugggcugggcccucu

SEQ ID NO: 748782 - RNA, 18 nt, Homo sapiens
ugcuggggaagacagugg

SEQ ID NO: 748783 - RNA, 15 nt, Homo sapiens
ugcuggucauggaau

SEQ ID NO: 748784 - RNA, 23 nt, Homo sapiens
ugcuggucccggggccagcacuu

SEQ ID NO: 748785 - RNA, 18 nt, Homo sapiens
ugcuggugagaggugcaa

SEQ ID NO: 748786 - RNA, 12 nt, Homo sapiens
ugcuggugcaca

SEQ ID NO: 748787 - RNA, 16 nt, Homo sapiens
ugcuggugccugccac

SEQ ID NO: 748788 - RNA, 22 nt, Homo sapiens
ugcugguuagguccaccugcua

SEQ ID NO: 748789 - RNA, 11 nt, Homo sapiens
ugcuguagaag

SEQ ID NO: 748790 - RNA, 15 nt, Homo sapiens
ugcuguauccaucca

SEQ ID NO: 748791 - RNA, 23 nt, Homo sapiens
ugcuguauugcccccaugggguc

SEQ ID NO: 748792 - RNA, 17 nt, Homo sapiens
ugcuguccacaugaccu

SEQ ID NO: 748793 - RNA, 19 nt, Homo sapiens
ugcuguccacaugaccucc

SEQ ID NO: 748794 - RNA, 20 nt, Homo sapiens
ugcuguccacaugaccucca

SEQ ID NO: 748795 - RNA, 17 nt, Homo sapiens
ugcugugccccaccacg

SEQ ID NO: 748796 - RNA, 19 nt, Homo sapiens
ugcugugccccaccacguc

SEQ ID NO: 748797 - RNA, 19 nt, Homo sapiens
ugcugugucuccucucaga

SEQ ID NO: 748798 - RNA, 23 nt, Homo sapiens
ugcugugucuccucucagaguga

SEQ ID NO: 748799 - RNA, 22 nt, Homo sapiens
ugcugugucuucauuuucauua

SEQ ID NO: 748800 - RNA, 20 nt, Homo sapiens
ugcugugugacccugggcaa

SEQ ID NO: 748801 - RNA, 21 nt, Homo sapiens
ugcuguuucacaauaccucau

SEQ ID NO: 748802 - RNA, 20 nt, Homo sapiens
ugcuguuuuuuuugcugcua

SEQ ID NO: 748803 - RNA, 21 nt, Homo sapiens
ugcuuaaaagguuaaauuuca

SEQ ID NO: 748804 - RNA, 20 nt, Homo sapiens
ugcuuaacuccccacugccu

SEQ ID NO: 748805 - RNA, 19 nt, Homo sapiens
ugcuuacccuucaccuuug

SEQ ID NO: 748806 - RNA, 19 nt, Homo sapiens
ugcuuaccucucagccuua

SEQ ID NO: 748807 - RNA, 23 nt, Homo sapiens
ugcuuagcuugagggugacuaug

SEQ ID NO: 748808 - RNA, 19 nt, Homo sapiens
ugcuuaggaugugugcaug

SEQ ID NO: 748809 - RNA, 16 nt, Homo sapiens
ugcuuaguauugacaa

SEQ ID NO: 748810 - RNA, 19 nt, Homo sapiens
ugcuuaguauugacacucu

SEQ ID NO: 748811 - RNA, 19 nt, Homo sapiens
ugcuucaaaaacauucuua

SEQ ID NO: 748812 - RNA, 22 nt, Homo sapiens
ugcuucacaguagagccagcuu

SEQ ID NO: 748813 - RNA, 14 nt, Homo sapiens
ugcuucagagcuca

SEQ ID NO: 748814 - RNA, 13 nt, Homo sapiens
ugcuucagugcag

SEQ ID NO: 748815 - RNA, 17 nt, Homo sapiens
ugcuucagugcagugaa

SEQ ID NO: 748816 - RNA, 21 nt, Homo sapiens
ugcuucauaaaugaagcagcu

SEQ ID NO: 748817 - RNA, 14 nt, Homo sapiens
ugcuucaucauucc

SEQ ID NO: 748818 - RNA, 17 nt, Homo sapiens
ugcuucauccaauguga

SEQ ID NO: 748819 - RNA, 16 nt, Homo sapiens
ugcuucauuccaaucu

SEQ ID NO: 748820 - RNA, 21 nt, Homo sapiens
ugcuucccagaggagcagcuc

SEQ ID NO: 748821 - RNA, 22 nt, Homo sapiens
ugcuucccagaggagcagcucu

SEQ ID NO: 748822 - RNA, 22 nt, Homo sapiens
ugcuucccgagugagcauggaa

SEQ ID NO: 748823 - RNA, 19 nt, Homo sapiens
ugcuuccucccaacaagca

SEQ ID NO: 748824 - RNA, 23 nt, Homo sapiens
ugcuuccucccaacaagcagcug

SEQ ID NO: 748825 - RNA, 16 nt, Homo sapiens
ugcuuccugacaauca

SEQ ID NO: 748826 - RNA, 20 nt, Homo sapiens
ugcuuccugucuuauccucc

SEQ ID NO: 748827 - RNA, 14 nt, Homo sapiens
ugcuucgaaguauu

SEQ ID NO: 748828 - RNA, 15 nt, Homo sapiens
ugcuucucaccacgg

SEQ ID NO: 748829 - RNA, 22 nt, Homo sapiens
ugcuucuccagccucagccucc

SEQ ID NO: 748830 - RNA, 22 nt, Homo sapiens
ugcuucuccuucaaaacacuca

SEQ ID NO: 748831 - RNA, 13 nt, Homo sapiens
ugcuucugcacac

SEQ ID NO: 748832 - RNA, 15 nt, Homo sapiens
ugcuucuuuaccaag

SEQ ID NO: 748833 - RNA, 14 nt, Homo sapiens
ugcuugaaccuggg

SEQ ID NO: 748834 - RNA, 15 nt, Homo sapiens
ugcuugaacuaggcu

SEQ ID NO: 748835 - RNA, 20 nt, Homo sapiens
ugcuugaacuuacaggugau

SEQ ID NO: 748836 - RNA, 14 nt, Homo sapiens
ugcuugaauugcaa

SEQ ID NO: 748837 - RNA, 16 nt, Homo sapiens
ugcuugacaacaucug

SEQ ID NO: 748838 - RNA, 17 nt, Homo sapiens
ugcuugacaacaucuga

SEQ ID NO: 748839 - RNA, 14 nt, Homo sapiens
ugcuuggauuuuga

SEQ ID NO: 748840 - RNA, 15 nt, Homo sapiens
ugcuugucaucugca

SEQ ID NO: 748841 - RNA, 12 nt, Homo sapiens
ugcuuguucccu

SEQ ID NO: 748842 - RNA, 18 nt, Homo sapiens
ugcuuguuuacagcacua

SEQ ID NO: 748843 - RNA, 20 nt, Homo sapiens
ugcuuuaaaucuuaagcaau

SEQ ID NO: 748844 - RNA, 16 nt, Homo sapiens
ugcuuuagaaguaaca

SEQ ID NO: 748845 - RNA, 15 nt, Homo sapiens
ugcuuucaauuacaa

SEQ ID NO: 748846 - RNA, 18 nt, Homo sapiens
ugcuuucccugaagcccu

SEQ ID NO: 748847 - RNA, 15 nt, Homo sapiens
ugcuuugcaaauuca

SEQ ID NO: 748848 - RNA, 14 nt, Homo sapiens
ugcuuugcugcuau

SEQ ID NO: 748849 - RNA, 17 nt, Homo sapiens
ugcuuugcugcuaugaa

SEQ ID NO: 748850 - RNA, 21 nt, Homo sapiens
ugcuuuuaaaugaccaaagau

SEQ ID NO: 748851 - RNA, 15 nt, Homo sapiens
ugcuuuuacuucucu

SEQ ID NO: 748852 - RNA, 14 nt, Homo sapiens
ugcuuuucauguag

SEQ ID NO: 748853 - RNA, 16 nt, Homo sapiens
ugcuuuucccauugcc

SEQ ID NO: 748854 - RNA, 18 nt, Homo sapiens
ugcuuuuccucaagcaau

SEQ ID NO: 748855 - RNA, 19 nt, Homo sapiens
ugcuuuucugccacuccau

SEQ ID NO: 748856 - RNA, 18 nt, Homo sapiens
ugcuuuuguuccaauguc

SEQ ID NO: 748857 - RNA, 21 nt, Homo sapiens
ugcuuuuguuuuccugcuggu

SEQ ID NO: 748858 - RNA, 15 nt, Homo sapiens
ugcuuuuucagccau

SEQ ID NO: 748859 - RNA, 18 nt, Homo sapiens
ugcuuuuugcguacacag

SEQ ID NO: 748860 - RNA, 13 nt, Homo sapiens
uggaaaaagccug

SEQ ID NO: 748861 - RNA, 17 nt, Homo sapiens
uggaaaaauacugccua

SEQ ID NO: 748862 - RNA, 19 nt, Homo sapiens
uggaaaaccuccuuuacca

SEQ ID NO: 748863 - RNA, 21 nt, Homo sapiens
uggaaaagaagaaacuuugcc

SEQ ID NO: 748864 - RNA, 18 nt, Homo sapiens
uggaaaagaggggcugga

SEQ ID NO: 748865 - RNA, 23 nt, Homo sapiens
uggaaaaugcugugugcugccau

SEQ ID NO: 748866 - RNA, 15 nt, Homo sapiens
uggaaacagcaugaa

SEQ ID NO: 748867 - RNA, 13 nt, Homo sapiens
uggaaaccacagu

SEQ ID NO: 748868 - RNA, 15 nt, Homo sapiens
uggaaaccguguaaa

SEQ ID NO: 748869 - RNA, 20 nt, Homo sapiens
uggaaaccucuggaggucau

SEQ ID NO: 748870 - RNA, 21 nt, Homo sapiens
uggaaaccuuccacccagugc

SEQ ID NO: 748871 - RNA, 20 nt, Homo sapiens
uggaaacgcaaaugaguauu

SEQ ID NO: 748872 - RNA, 13 nt, Homo sapiens
uggaaacuaagac

SEQ ID NO: 748873 - RNA, 17 nt, Homo sapiens
uggaaagaaaaagcaau

SEQ ID NO: 748874 - RNA, 17 nt, Homo sapiens
uggaaagaaucuaauag

SEQ ID NO: 748875 - RNA, 21 nt, Homo sapiens
uggaaagacaaacugcacagg

SEQ ID NO: 748876 - RNA, 19 nt, Homo sapiens
uggaaagcaucaccucagg

SEQ ID NO: 748877 - RNA, 16 nt, Homo sapiens
uggaaagcgccccuca

SEQ ID NO: 748878 - RNA, 19 nt, Homo sapiens
uggaaagcggcuagguuuu

SEQ ID NO: 748879 - RNA, 14 nt, Homo sapiens
uggaaagcugauga

SEQ ID NO: 748880 - RNA, 17 nt, Homo sapiens
uggaaaucauaccaguu

SEQ ID NO: 748881 - RNA, 21 nt, Homo sapiens
uggaaaucugccaugagcaca

SEQ ID NO: 748882 - RNA, 19 nt, Homo sapiens
uggaaaugcugacuuuuaa

SEQ ID NO: 748883 - RNA, 20 nt, Homo sapiens
uggaaaugguggugcuuuaa

SEQ ID NO: 748884 - RNA, 15 nt, Homo sapiens
uggaaauguauuuua

SEQ ID NO: 748885 - RNA, 13 nt, Homo sapiens
uggaacaccagca

SEQ ID NO: 748886 - RNA, 22 nt, Homo sapiens
uggaacaccagcagcacuggaa

SEQ ID NO: 748887 - RNA, 16 nt, Homo sapiens
uggaacaggcucagau

SEQ ID NO: 748888 - RNA, 18 nt, Homo sapiens
uggaacauauagaaugca

SEQ ID NO: 748889 - RNA, 20 nt, Homo sapiens
uggaacaugcaaggcacuga

SEQ ID NO: 748890 - RNA, 20 nt, Homo sapiens
uggaacaugcuuuuacuuua

SEQ ID NO: 748891 - RNA, 16 nt, Homo sapiens
uggaacauuugauauu

SEQ ID NO: 748892 - RNA, 22 nt, Homo sapiens
uggaacgcugccucagggccca

SEQ ID NO: 748893 - RNA, 15 nt, Homo sapiens
uggaacgugaacuca

SEQ ID NO: 748894 - RNA, 17 nt, Homo sapiens
uggaacuccuggccuuu

SEQ ID NO: 748895 - RNA, 19 nt, Homo sapiens
uggucauaaaauagaauaa

SEQ ID NO: 748896 - RNA, 21 nt, Homo sapiens
uggucauuggccgacaucaca

SEQ ID NO: 748897 - RNA, 13 nt, Homo sapiens
ugguccagcucuu

SEQ ID NO: 748898 - RNA, 19 nt, Homo sapiens
uggucccagaguggcugca

SEQ ID NO: 748899 - RNA, 19 nt, Homo sapiens
ugguccuggcugcacucuu

SEQ ID NO: 748900 - RNA, 19 nt, Homo sapiens
ugguccuggggaccauuca

SEQ ID NO: 748901 - RNA, 16 nt, Homo sapiens
uggucgagugacacac

SEQ ID NO: 748902 - RNA, 22 nt, Homo sapiens
uggucuaagguucagccugaaa

SEQ ID NO: 748903 - RNA, 22 nt, Homo sapiens
uggucucaaacuccugaccuca

SEQ ID NO: 748904 - RNA, 16 nt, Homo sapiens
uggucuccuugcacuu

SEQ ID NO: 748905 - RNA, 23 nt, Homo sapiens
uggucucgaacuccuggccucaa

SEQ ID NO: 748906 - RNA, 14 nt, Homo sapiens
uggucucuaucucc

SEQ ID NO: 748907 - RNA, 15 nt, Homo sapiens
uggucugccagaaua

SEQ ID NO: 748908 - RNA, 20 nt, Homo sapiens
uggucugcugaguaacaggu

SEQ ID NO: 748909 - RNA, 17 nt, Homo sapiens
uggucuugaucuccuga

SEQ ID NO: 748910 - RNA, 14 nt, Homo sapiens
uggugacaguccaa

SEQ ID NO: 748911 - RNA, 22 nt, Homo sapiens
uggugaccugcggcaguaugua

SEQ ID NO: 748912 - RNA, 17 nt, Homo sapiens
uggugacugaaacauuc

SEQ ID NO: 748913 - RNA, 14 nt, Homo sapiens
uggugacugggaaa

SEQ ID NO: 748914 - RNA, 19 nt, Homo sapiens
uggugagccgagauugcac

SEQ ID NO: 748915 - RNA, 14 nt, Homo sapiens
uggugaggcaauaa

SEQ ID NO: 748916 - RNA, 15 nt, Homo sapiens
uggugauaaguucca

SEQ ID NO: 748917 - RNA, 17 nt, Homo sapiens
uggugcaaguagcacau

SEQ ID NO: 748918 - RNA, 14 nt, Homo sapiens
uggugcaaguugag

SEQ ID NO: 748919 - RNA, 19 nt, Homo sapiens
uggugcacaaguaacacau

SEQ ID NO: 748920 - RNA, 20 nt, Homo sapiens
uggugcacaaguaacacauu

SEQ ID NO: 748921 - RNA, 21 nt, Homo sapiens
uggugcacaaguaacacauuu

SEQ ID NO: 748922 - RNA, 15 nt, Homo sapiens
uggugcauaggucug

SEQ ID NO: 748923 - RNA, 13 nt, Homo sapiens
uggugcaugccug

SEQ ID NO: 748924 - RNA, 21 nt, Homo sapiens
uggugcaugccuguagucuca

SEQ ID NO: 748925 - RNA, 14 nt, Homo sapiens
uggugccaaacaaa

SEQ ID NO: 748926 - RNA, 14 nt, Homo sapiens
uggugccaaaugaa

SEQ ID NO: 748927 - RNA, 19 nt, Homo sapiens
uggugccccaggaccagcu

SEQ ID NO: 748928 - RNA, 22 nt, Homo sapiens
uggugccccaggaccagcucag

SEQ ID NO: 748929 - RNA, 12 nt, Homo sapiens
uggugcccugga

SEQ ID NO: 748930 - RNA, 22 nt, Homo sapiens
uggugcguuuauaauuggcuua

SEQ ID NO: 748931 - RNA, 15 nt, Homo sapiens
uggugcuacagggaa

SEQ ID NO: 748932 - RNA, 17 nt, Homo sapiens
uggugcucaaugcaaau

SEQ ID NO: 748933 - RNA, 24 nt, Homo sapiens
ugguggaguguagccuccaccuga

SEQ ID NO: 748934 - RNA, 24 nt, Homo sapiens
ugguggcacaggaguguccucuuc

SEQ ID NO: 748935 - RNA, 13 nt, Homo sapiens
ugguggcacugag

SEQ ID NO: 748936 - RNA, 18 nt, Homo sapiens
ugguggcagauuuuacaa

SEQ ID NO: 748937 - RNA, 11 nt, Homo sapiens
ugguggcaugg

SEQ ID NO: 748938 - RNA, 21 nt, Homo sapiens
ugguggcucacaccuguaauc

SEQ ID NO: 748939 - RNA, 19 nt, Homo sapiens
ugguggcucaugccuguaa

SEQ ID NO: 748940 - RNA, 19 nt, Homo sapiens
ugguggguaauuguacaau

SEQ ID NO: 748941 - RNA, 12 nt, Homo sapiens
ugguggugcacc

SEQ ID NO: 748942 - RNA, 13 nt, Homo sapiens
uggugugaucucg

SEQ ID NO: 748943 - RNA, 16 nt, Homo sapiens
uggugugugccuguag

SEQ ID NO: 748944 - RNA, 21 nt, Homo sapiens
ugguuaaauuaacauugcaua

SEQ ID NO: 748945 - RNA, 18 nt, Homo sapiens
ugguuaccaccagccuuu

SEQ ID NO: 748946 - RNA, 19 nt, Homo sapiens
ugguuaccaccagccuuuc

SEQ ID NO: 748947 - RNA, 13 nt, Homo sapiens
ugguuaugaacuu

SEQ ID NO: 748948 - RNA, 22 nt, Homo sapiens
ugguucaauuucagaaguaaug

SEQ ID NO: 748949 - RNA, 14 nt, Homo sapiens
ugguucacugcaac

SEQ ID NO: 748950 - RNA, 16 nt, Homo sapiens
ugguucagugccuucc

SEQ ID NO: 748951 - RNA, 14 nt, Homo sapiens
ugguuccaaagaca

SEQ ID NO: 748952 - RNA, 17 nt, Homo sapiens
ugguuccucucuuggca

SEQ ID NO: 748953 - RNA, 17 nt, Homo sapiens
ugguucgugcugugcuc

SEQ ID NO: 748954 - RNA, 15 nt, Homo sapiens
ugguucucaucuuuc

SEQ ID NO: 748955 - RNA, 11 nt, Homo sapiens
ugguucugcuu

SEQ ID NO: 748956 - RNA, 14 nt, Homo sapiens
ugguugcuguccuc

SEQ ID NO: 748957 - RNA, 19 nt, Homo sapiens
ugguuggaagggaauagaa

SEQ ID NO: 748958 - RNA, 20 nt, Homo sapiens
ugguuggccgugguccagcu

SEQ ID NO: 748959 - RNA, 14 nt, Homo sapiens
ugguugugcugaua

SEQ ID NO: 748960 - RNA, 16 nt, Homo sapiens
ugguuguuguauugau

SEQ ID NO: 748961 - RNA, 13 nt, Homo sapiens
ugguuugacucag

SEQ ID NO: 748962 - RNA, 13 nt, Homo sapiens
ugguuugccaugu

SEQ ID NO: 748963 - RNA, 17 nt, Homo sapiens
ugguuugccaugucgcu

SEQ ID NO: 748964 - RNA, 20 nt, Homo sapiens
ugguuuguuauaucagggaa

SEQ ID NO: 748965 - RNA, 14 nt, Homo sapiens
ugguuuuauuucaa

SEQ ID NO: 748966 - RNA, 20 nt, Homo sapiens
ugguuuuauuucaaagggaa

SEQ ID NO: 748967 - RNA, 20 nt, Homo sapiens
ugguuuugacucaccugaaa

SEQ ID NO: 748968 - RNA, 13 nt, Homo sapiens
uguaaaaaaugga

SEQ ID NO: 748969 - RNA, 15 nt, Homo sapiens
uguaaaauguucucu

SEQ ID NO: 748970 - RNA, 23 nt, Homo sapiens
uguaaaauuuaaaucauauccua

SEQ ID NO: 748971 - RNA, 14 nt, Homo sapiens
uguaaacaaaccac

SEQ ID NO: 748972 - RNA, 15 nt, Homo sapiens
uguaaacaaaccaca

SEQ ID NO: 748973 - RNA, 15 nt, Homo sapiens
uguaaacacauguuc

SEQ ID NO: 748974 - RNA, 22 nt, Homo sapiens
uguaaacgacaagaauaauuca

SEQ ID NO: 748975 - RNA, 19 nt, Homo sapiens
uguaaacuacaaaguaaaa

SEQ ID NO: 748976 - RNA, 17 nt, Homo sapiens
uguaaacuuacuagcuu

SEQ ID NO: 748977 - RNA, 13 nt, Homo sapiens
uguaaagcuuuaa

SEQ ID NO: 748978 - RNA, 18 nt, Homo sapiens
uguaaaguuuuugcuucc

SEQ ID NO: 748979 - RNA, 18 nt, Homo sapiens
uguaaauacacauagcau

SEQ ID NO: 748980 - RNA, 11 nt, Homo sapiens
uguaaauugca

SEQ ID NO: 748981 - RNA, 18 nt, Homo sapiens
uguaaauuuaacugcaua

SEQ ID NO: 748982 - RNA, 16 nt, Homo sapiens
uguaaauuuaugugau

SEQ ID NO: 748983 - RNA, 14 nt, Homo sapiens
uguaacacuuguca

SEQ ID NO: 748984 - RNA, 15 nt, Homo sapiens
uguaacacuugucaa

SEQ ID NO: 748985 - RNA, 17 nt, Homo sapiens
uguaacccucacccaca

SEQ ID NO: 748986 - RNA, 23 nt, Homo sapiens
uguaacucaacuaacaaaaucaa

SEQ ID NO: 748987 - RNA, 22 nt, Homo sapiens
uguaacucacauucucuuccca

SEQ ID NO: 748988 - RNA, 17 nt, Homo sapiens
uguaacuuaacuauuaa

SEQ ID NO: 748989 - RNA, 20 nt, Homo sapiens
uguaacuuucauaccacuug

SEQ ID NO: 748990 - RNA, 19 nt, Homo sapiens
uguaagaacaacuaccuga

SEQ ID NO: 748991 - RNA, 18 nt, Homo sapiens
uguaagauuuuccauugu

SEQ ID NO: 748992 - RNA, 16 nt, Homo sapiens
uguaagauuuuuaccu

SEQ ID NO: 748993 - RNA, 14 nt, Homo sapiens
uguaagccaaguca

SEQ ID NO: 748994 - RNA, 22 nt, Homo sapiens
uguaagcccugcuuagcucauc

SEQ ID NO: 748995 - RNA, 19 nt, Homo sapiens
uguaagggcagugcccaug

SEQ ID NO: 748996 - RNA, 14 nt, Homo sapiens
uguaaggugcuaca

SEQ ID NO: 748997 - RNA, 15 nt, Homo sapiens
uguaaguacuuccac

SEQ ID NO: 748998 - RNA, 23 nt, Homo sapiens
uguaagucagccacugggacccg

SEQ ID NO: 748999 - RNA, 13 nt, Homo sapiens
uguaauaagcaau

SEQ ID NO: 749000 - RNA, 12 nt, Homo sapiens
uguaauaccaga

SEQ ID NO: 749001 - RNA, 18 nt, Homo sapiens
uguaauagccaaacccac

SEQ ID NO: 749002 - RNA, 16 nt, Homo sapiens
uguaauauaugauauu

SEQ ID NO: 749003 - RNA, 20 nt, Homo sapiens
uguaauauuguaaauacugg

SEQ ID NO: 749004 - RNA, 14 nt, Homo sapiens
uguaaucauauaau

SEQ ID NO: 749005 - RNA, 20 nt, Homo sapiens
uguaaucccaacauuuuggg

SEQ ID NO: 749006 - RNA, 16 nt, Homo sapiens
uguaaucccagcacuu

SEQ ID NO: 749007 - RNA, 12 nt, Homo sapiens
uguaaucucagc

SEQ ID NO: 749008 - RNA, 12 nt, Homo sapiens
uguaaugaucau

SEQ ID NO: 749009 - RNA, 12 nt, Homo sapiens
uguaaugcauag

SEQ ID NO: 749010 - RNA, 20 nt, Homo sapiens
uguguucuaagcaaugcaaa

SEQ ID NO: 749011 - RNA, 14 nt, Homo sapiens
uguguucucaguga

SEQ ID NO: 749012 - RNA, 18 nt, Homo sapiens
uguguucucuauugcugc

SEQ ID NO: 749013 - RNA, 22 nt, Homo sapiens
uguguucugucaccaacugaag

SEQ ID NO: 749014 - RNA, 12 nt, Homo sapiens
uguguuguucau

SEQ ID NO: 749015 - RNA, 19 nt, Homo sapiens
uguguuucuggagugauuc

SEQ ID NO: 749016 - RNA, 20 nt, Homo sapiens
uguguuuuaucuagucacau

SEQ ID NO: 749017 - RNA, 22 nt, Homo sapiens
uguguuuugaaugguguuguau

SEQ ID NO: 749018 - RNA, 20 nt, Homo sapiens
uguguuuuuaacaugucaau

SEQ ID NO: 749019 - RNA, 20 nt, Homo sapiens
uguguuuuuaauaaagacag

SEQ ID NO: 749020 - RNA, 16 nt, Homo sapiens
uguuaaaauggggaua

SEQ ID NO: 749021 - RNA, 19 nt, Homo sapiens
uguuaaaauguacacugga

SEQ ID NO: 749022 - RNA, 18 nt, Homo sapiens
uguuaacauggacaugau

SEQ ID NO: 749023 - RNA, 15 nt, Homo sapiens
uguuaauagacuuaa

SEQ ID NO: 749024 - RNA, 17 nt, Homo sapiens
uguuaauauuucuaaaa

SEQ ID NO: 749025 - RNA, 16 nt, Homo sapiens
uguuaauuacaccaua

SEQ ID NO: 749026 - RNA, 18 nt, Homo sapiens
uguuaauucagcacugau

SEQ ID NO: 749027 - RNA, 20 nt, Homo sapiens
uguuacaacuuguauuucca

SEQ ID NO: 749028 - RNA, 19 nt, Homo sapiens
uguuacacagcccaagagg

SEQ ID NO: 749029 - RNA, 20 nt, Homo sapiens
uguuacagcuuucugugcag

SEQ ID NO: 749030 - RNA, 15 nt, Homo sapiens
uguuaccauucacaa

SEQ ID NO: 749031 - RNA, 15 nt, Homo sapiens
uguuaccuccuauaa

SEQ ID NO: 749032 - RNA, 16 nt, Homo sapiens
uguuacuaaauccuuu

SEQ ID NO: 749033 - RNA, 18 nt, Homo sapiens
uguuacugccuaucagca

SEQ ID NO: 749034 - RNA, 20 nt, Homo sapiens
uguuacugcuuugcaaagac

SEQ ID NO: 749035 - RNA, 18 nt, Homo sapiens
uguuacuuuuaguucuau

SEQ ID NO: 749036 - RNA, 17 nt, Homo sapiens
uguuagacucuggucau

SEQ ID NO: 749037 - RNA, 17 nt, Homo sapiens
uguuagaucaaccucca

SEQ ID NO: 749038 - RNA, 17 nt, Homo sapiens
uguuauacacagcuuua

SEQ ID NO: 749039 - RNA, 15 nt, Homo sapiens
uguuaugaacaucca

SEQ ID NO: 749040 - RNA, 13 nt, Homo sapiens
uguuauguccaga

SEQ ID NO: 749041 - RNA, 17 nt, Homo sapiens
uguuaugugcaaguuua

SEQ ID NO: 749042 - RNA, 16 nt, Homo sapiens
uguuauguuugcacuu

SEQ ID NO: 749043 - RNA, 18 nt, Homo sapiens
uguuauguuugcacuuug

SEQ ID NO: 749044 - RNA, 19 nt, Homo sapiens
uguuauguuugcacuuugu

SEQ ID NO: 749045 - RNA, 18 nt, Homo sapiens
uguuauuauuuugcacug

SEQ ID NO: 749046 - RNA, 12 nt, Homo sapiens
uguuauucuugu

SEQ ID NO: 749047 - RNA, 15 nt, Homo sapiens
uguuauuuacacugg

SEQ ID NO: 749048 - RNA, 19 nt, Homo sapiens
uguuauuuacacuggucua

SEQ ID NO: 749049 - RNA, 14 nt, Homo sapiens
uguucaaugcuaga

SEQ ID NO: 749050 - RNA, 17 nt, Homo sapiens
uguucaauguuccauuc

SEQ ID NO: 749051 - RNA, 21 nt, Homo sapiens
uguucacaaacuaccucugga

SEQ ID NO: 749052 - RNA, 19 nt, Homo sapiens
uguucacaacagugaaaag

SEQ ID NO: 749053 - RNA, 15 nt, Homo sapiens
uguucacuguggcau

SEQ ID NO: 749054 - RNA, 15 nt, Homo sapiens
uguucagaugugcau

SEQ ID NO: 749055 - RNA, 12 nt, Homo sapiens
uguucagauuaa

SEQ ID NO: 749056 - RNA, 16 nt, Homo sapiens
uguucagggcugugau

SEQ ID NO: 749057 - RNA, 15 nt, Homo sapiens
uguucauacauauuu

SEQ ID NO: 749058 - RNA, 18 nt, Homo sapiens
uguucauauuuauugauu

SEQ ID NO: 749059 - RNA, 23 nt, Homo sapiens
uguuccaauuugacaaaacccac

SEQ ID NO: 749060 - RNA, 13 nt, Homo sapiens
uguuccccagaga

SEQ ID NO: 749061 - RNA, 21 nt, Homo sapiens
uguucccgacauaacauugua

SEQ ID NO: 749062 - RNA, 20 nt, Homo sapiens
uguucccuccccgaucaucu

SEQ ID NO: 749063 - RNA, 14 nt, Homo sapiens
uguucccugacucc

SEQ ID NO: 749064 - RNA, 19 nt, Homo sapiens
uguuccucuuggugucaua

SEQ ID NO: 749065 - RNA, 20 nt, Homo sapiens
uguuccugaaaauugcaaua

SEQ ID NO: 749066 - RNA, 17 nt, Homo sapiens
uguuccuggcugaugau

SEQ ID NO: 749067 - RNA, 21 nt, Homo sapiens
uguucuacaugaggacucaua

SEQ ID NO: 749068 - RNA, 14 nt, Homo sapiens
uguucuacugagaa

SEQ ID NO: 749069 - RNA, 15 nt, Homo sapiens
uguucuagcagugaa

SEQ ID NO: 749070 - RNA, 13 nt, Homo sapiens
uguucuauuuaac

SEQ ID NO: 749071 - RNA, 18 nt, Homo sapiens
uguucucagaaucccuua

SEQ ID NO: 749072 - RNA, 21 nt, Homo sapiens
uguucucagugaaauaacuac

SEQ ID NO: 749073 - RNA, 13 nt, Homo sapiens
uguucuccugucc

SEQ ID NO: 749074 - RNA, 18 nt, Homo sapiens
uguucucugcuugacaga

SEQ ID NO: 749075 - RNA, 23 nt, Homo sapiens
uguucucuuaugaucaccaugua

SEQ ID NO: 749076 - RNA, 23 nt, Homo sapiens
uguucugaauaauuucuuacuaa

SEQ ID NO: 749077 - RNA, 14 nt, Homo sapiens
uguucugcacugaa

SEQ ID NO: 749078 - RNA, 16 nt, Homo sapiens
uguucuggaagccaua

SEQ ID NO: 749079 - RNA, 15 nt, Homo sapiens
uguucugucuuccca

SEQ ID NO: 749080 - RNA, 18 nt, Homo sapiens
uguucuuacuguaacuac

SEQ ID NO: 749081 - RNA, 21 nt, Homo sapiens
uguucuuagguuuacugugaa

SEQ ID NO: 749082 - RNA, 13 nt, Homo sapiens
uguucuugcuacc

SEQ ID NO: 749083 - RNA, 15 nt, Homo sapiens
uguugaaacuuugaa

SEQ ID NO: 749084 - RNA, 15 nt, Homo sapiens
uguugaaauugucaa

SEQ ID NO: 749085 - RNA, 16 nt, Homo sapiens
uguugaaauugucaaa

SEQ ID NO: 749086 - RNA, 23 nt, Homo sapiens
uguugacagcaaaauguugaaga

SEQ ID NO: 749087 - RNA, 15 nt, Homo sapiens
uguugagauccagug

SEQ ID NO: 749088 - RNA, 19 nt, Homo sapiens
uguugagauccagugcagu

SEQ ID NO: 749089 - RNA, 16 nt, Homo sapiens
uguugaggcugucaca

SEQ ID NO: 749090 - RNA, 15 nt, Homo sapiens
uguugcaggcugugg

SEQ ID NO: 749091 - RNA, 21 nt, Homo sapiens
uguugcauuuacuuuuaauaa

SEQ ID NO: 749092 - RNA, 11 nt, Homo sapiens
uguugccaaau

SEQ ID NO: 749093 - RNA, 24 nt, Homo sapiens
uguugccacuggcaaauguaacug

SEQ ID NO: 749094 - RNA, 10 nt, Homo sapiens
uguugccagc

SEQ ID NO: 749095 - RNA, 15 nt, Homo sapiens
uguugccuugcauuu

SEQ ID NO: 749096 - RNA, 14 nt, Homo sapiens
uguugccuuuaugg

SEQ ID NO: 749097 - RNA, 21 nt, Homo sapiens
uguugcguucaaagaggugaa

SEQ ID NO: 749098 - RNA, 15 nt, Homo sapiens
uguugcugcuacugu

SEQ ID NO: 749099 - RNA, 19 nt, Homo sapiens
uguuggagguuaaggcaua

SEQ ID NO: 749100 - RNA, 16 nt, Homo sapiens
uguuggcauagcucug

SEQ ID NO: 749101 - RNA, 15 nt, Homo sapiens
uguuggccaggcuug

SEQ ID NO: 749102 - RNA, 20 nt, Homo sapiens
uguuggcuagacuagucuca

SEQ ID NO: 749103 - RNA, 20 nt, Homo sapiens
uguugguauuauauaauuca

SEQ ID NO: 749104 - RNA, 14 nt, Homo sapiens
uguuguacauuuca

SEQ ID NO: 749105 - RNA, 21 nt, Homo sapiens
uguuguacuuaaaugguaaua

SEQ ID NO: 749106 - RNA, 17 nt, Homo sapiens
uguuguagcucugguau

SEQ ID NO: 749107 - RNA, 13 nt, Homo sapiens
uguuguaugggga

SEQ ID NO: 749108 - RNA, 14 nt, Homo sapiens
uguuguauugauca

SEQ ID NO: 749109 - RNA, 20 nt, Homo sapiens
uguuguguauagaugcaaga

SEQ ID NO: 749110 - RNA, 16 nt, Homo sapiens
uguuguucugcucaau

SEQ ID NO: 749111 - RNA, 18 nt, Homo sapiens
uguuguugaggcugucac

SEQ ID NO: 749112 - RNA, 19 nt, Homo sapiens
uguuuaaauaaacacaguc

SEQ ID NO: 749113 - RNA, 19 nt, Homo sapiens
uguuuaagaaaaaauaaca

SEQ ID NO: 749114 - RNA, 14 nt, Homo sapiens
uguuuaauggguau

SEQ ID NO: 749115 - RNA, 17 nt, Homo sapiens
uguuuaauuguacucaa

SEQ ID NO: 749116 - RNA, 18 nt, Homo sapiens
uguuuacagacgugugca

SEQ ID NO: 749117 - RNA, 17 nt, Homo sapiens
uguuuacagcacuacuc

SEQ ID NO: 749118 - RNA, 21 nt, Homo sapiens
uguuuacuucucaccauuuga

SEQ ID NO: 749119 - RNA, 14 nt, Homo sapiens
uguuuauaauguua

SEQ ID NO: 749120 - RNA, 18 nt, Homo sapiens
uguuuaucucugagacag

SEQ ID NO: 749121 - RNA, 14 nt, Homo sapiens
uguuuaugagccag

SEQ ID NO: 749122 - RNA, 18 nt, Homo sapiens
uguuuauuuaaugcugug

SEQ ID NO: 749123 - RNA, 18 nt, Homo sapiens
uguuucaaaaaaucugac

SEQ ID NO: 749124 - RNA, 17 nt, Homo sapiens
uguuucaggaggcugga

SEQ ID NO: 749125 - RNA, 13 nt, Homo sapiens
uugggauuuuucu

SEQ ID NO: 749126 - RNA, 12 nt, Homo sapiens
uugggcauuuaa

SEQ ID NO: 749127 - RNA, 16 nt, Homo sapiens
uugggccagacaugcc

SEQ ID NO: 749128 - RNA, 21 nt, Homo sapiens
uugggccagugaacaggguaa

SEQ ID NO: 749129 - RNA, 20 nt, Homo sapiens
uugggccucccuggcacuga

SEQ ID NO: 749130 - RNA, 16 nt, Homo sapiens
uugggccuugcuaaau

SEQ ID NO: 749131 - RNA, 14 nt, Homo sapiens
uugggcucacuucu

SEQ ID NO: 749132 - RNA, 14 nt, Homo sapiens
uugggcuggaugau

SEQ ID NO: 749133 - RNA, 11 nt, Homo sapiens
uugggcuguga

SEQ ID NO: 749134 - RNA, 21 nt, Homo sapiens
uuggggaaaauggccaugcag

SEQ ID NO: 749135 - RNA, 16 nt, Homo sapiens
uuggggcagaccccag

SEQ ID NO: 749136 - RNA, 15 nt, Homo sapiens
uuggggccaccaaag

SEQ ID NO: 749137 - RNA, 18 nt, Homo sapiens
uugggucacgguggcagu

SEQ ID NO: 749138 - RNA, 16 nt, Homo sapiens
uugggugaccagccac

SEQ ID NO: 749139 - RNA, 13 nt, Homo sapiens
uugggugugcuga

SEQ ID NO: 749140 - RNA, 18 nt, Homo sapiens
uugggugugugguggauu

SEQ ID NO: 749141 - RNA, 22 nt, Homo sapiens
uugguaauaacuucucugugaa

SEQ ID NO: 749142 - RNA, 16 nt, Homo sapiens
uugguacuauggugug

SEQ ID NO: 749143 - RNA, 17 nt, Homo sapiens
uugguagaaggacugaa

SEQ ID NO: 749144 - RNA, 22 nt, Homo sapiens
uuggucagaaagauaagccagu

SEQ ID NO: 749145 - RNA, 14 nt, Homo sapiens
uugguccuuuacac

SEQ ID NO: 749146 - RNA, 21 nt, Homo sapiens
uuggucucacuacuugaccau

SEQ ID NO: 749147 - RNA, 23 nt, Homo sapiens
uuggucuguuuugccuucaccca

SEQ ID NO: 749148 - RNA, 23 nt, Homo sapiens
uuggugaaucgguuguucuuucc

SEQ ID NO: 749149 - RNA, 22 nt, Homo sapiens
uuggugaauuucacaagcuauu

SEQ ID NO: 749150 - RNA, 11 nt, Homo sapiens
uugguggcaug

SEQ ID NO: 749151 - RNA, 20 nt, Homo sapiens
uugguggcgcgcaccuguag

SEQ ID NO: 749152 - RNA, 15 nt, Homo sapiens
uugguugggggcucc

SEQ ID NO: 749153 - RNA, 18 nt, Homo sapiens
uugguuuaaagaaagugu

SEQ ID NO: 749154 - RNA, 14 nt, Homo sapiens
uugguuugacccag

SEQ ID NO: 749155 - RNA, 17 nt, Homo sapiens
uugguuugugugaucau

SEQ ID NO: 749156 - RNA, 21 nt, Homo sapiens
uugguuuuguuuucuucacua

SEQ ID NO: 749157 - RNA, 20 nt, Homo sapiens
uugguuuuuuguucuugcga

SEQ ID NO: 749158 - RNA, 22 nt, Homo sapiens
uuguaaaaagcccagcacuuga

SEQ ID NO: 749159 - RNA, 14 nt, Homo sapiens
uuguaaaacaaaga

SEQ ID NO: 749160 - RNA, 21 nt, Homo sapiens
uuguaaaagggaaagaaggcc

SEQ ID NO: 749161 - RNA, 20 nt, Homo sapiens
uuguaaaauauuuaugagaa

SEQ ID NO: 749162 - RNA, 21 nt, Homo sapiens
uuguaaauauucuacacaugu

SEQ ID NO: 749163 - RNA, 21 nt, Homo sapiens
uuguaacgacuucuccaucuc

SEQ ID NO: 749164 - RNA, 14 nt, Homo sapiens
uuguaacucuauga

SEQ ID NO: 749165 - RNA, 17 nt, Homo sapiens
uuguaagagugagcucu

SEQ ID NO: 749166 - RNA, 14 nt, Homo sapiens
uuguaauaagcaau

SEQ ID NO: 749167 - RNA, 15 nt, Homo sapiens
uuguaaucaagccuu

SEQ ID NO: 749168 - RNA, 15 nt, Homo sapiens
uuguacaauacuugc

SEQ ID NO: 749169 - RNA, 17 nt, Homo sapiens
uuguacaaugguuuauu

SEQ ID NO: 749170 - RNA, 16 nt, Homo sapiens
uuguacauaacuuaga

SEQ ID NO: 749171 - RNA, 14 nt, Homo sapiens
uuguaccauauaga

SEQ ID NO: 749172 - RNA, 16 nt, Homo sapiens
uuguaccgaugcagcu

SEQ ID NO: 749173 - RNA, 16 nt, Homo sapiens
uuguacguuuugcaca

SEQ ID NO: 749174 - RNA, 18 nt, Homo sapiens
uuguacuaaucugagauu

SEQ ID NO: 749175 - RNA, 19 nt, Homo sapiens
uuguagaaaugagccagaa

SEQ ID NO: 749176 - RNA, 19 nt, Homo sapiens
uuguagagauggggucuca

SEQ ID NO: 749177 - RNA, 21 nt, Homo sapiens
uuguagagauggggucucaca

SEQ ID NO: 749178 - RNA, 22 nt, Homo sapiens
uuguagagauggggucucacag

SEQ ID NO: 749179 - RNA, 17 nt, Homo sapiens
uuguagaguuuuuggaa

SEQ ID NO: 749180 - RNA, 14 nt, Homo sapiens
uuguagaugugauu

SEQ ID NO: 749181 - RNA, 13 nt, Homo sapiens
uuguagcacugag

SEQ ID NO: 749182 - RNA, 16 nt, Homo sapiens
uuguagcacugagggu

SEQ ID NO: 749183 - RNA, 22 nt, Homo sapiens
uuguagcacugaggguggcacu

SEQ ID NO: 749184 - RNA, 14 nt, Homo sapiens
uuguagccagguac

SEQ ID NO: 749185 - RNA, 24 nt, Homo sapiens
uuguauaaagcauuuguagcaauu

SEQ ID NO: 749186 - RNA, 21 nt, Homo sapiens
uuguauauuccaccauucaca

SEQ ID NO: 749187 - RNA, 17 nt, Homo sapiens
uuguaucaaagugugau

SEQ ID NO: 749188 - RNA, 15 nt, Homo sapiens
uuguaucaacacugu

SEQ ID NO: 749189 - RNA, 17 nt, Homo sapiens
uuguaugucuguguaug

SEQ ID NO: 749190 - RNA, 21 nt, Homo sapiens
uuguauguuaaagcaucagag

SEQ ID NO: 749191 - RNA, 20 nt, Homo sapiens
uuguauuaguauugugaaua

SEQ ID NO: 749192 - RNA, 22 nt, Homo sapiens
uuguauucaaauuugugucaua

SEQ ID NO: 749193 - RNA, 23 nt, Homo sapiens
uuguauugaaaacacuuaguaug

SEQ ID NO: 749194 - RNA, 13 nt, Homo sapiens
uuguauuguggaa

SEQ ID NO: 749195 - RNA, 17 nt, Homo sapiens
uuguauuuugugaugaa

SEQ ID NO: 749196 - RNA, 15 nt, Homo sapiens
uugucacacgauaaa

SEQ ID NO: 749197 - RNA, 15 nt, Homo sapiens
uugucaccagcaaca

SEQ ID NO: 749198 - RNA, 19 nt, Homo sapiens
uugucacuuuuuaugcuau

SEQ ID NO: 749199 - RNA, 12 nt, Homo sapiens
uugucagaauuu

SEQ ID NO: 749200 - RNA, 18 nt, Homo sapiens
uugucaguauuuuugccg

SEQ ID NO: 749201 - RNA, 16 nt, Homo sapiens
uugucauauacugcuu

SEQ ID NO: 749202 - RNA, 18 nt, Homo sapiens
uugucccccaacuugaga

SEQ ID NO: 749203 - RNA, 18 nt, Homo sapiens
uuguccugagauggaaaa

SEQ ID NO: 749204 - RNA, 16 nt, Homo sapiens
uuguccuucagccaaa

SEQ ID NO: 749205 - RNA, 20 nt, Homo sapiens
uuguccuuuuucacuuugaa

SEQ ID NO: 749206 - RNA, 16 nt, Homo sapiens
uugucgguuaccucug

SEQ ID NO: 749207 - RNA, 18 nt, Homo sapiens
uugucuaacuuuugugaa

SEQ ID NO: 749208 - RNA, 15 nt, Homo sapiens
uugucuaccauuugu

SEQ ID NO: 749209 - RNA, 20 nt, Homo sapiens
uugucucuagagcagggauu

SEQ ID NO: 749210 - RNA, 13 nt, Homo sapiens
uugucucugucac

SEQ ID NO: 749211 - RNA, 22 nt, Homo sapiens
uugucugucuccagcacccaga

SEQ ID NO: 749212 - RNA, 20 nt, Homo sapiens
uugucuguuuguuucaagaa

SEQ ID NO: 749213 - RNA, 15 nt, Homo sapiens
uugucuuauugcacc

SEQ ID NO: 749214 - RNA, 17 nt, Homo sapiens
uugugaaagacauguaa

SEQ ID NO: 749215 - RNA, 15 nt, Homo sapiens
uugugaauuugggua

SEQ ID NO: 749216 - RNA, 20 nt, Homo sapiens
uugugaccccuuucacuuac

SEQ ID NO: 749217 - RNA, 15 nt, Homo sapiens
uugugagccaccacg

SEQ ID NO: 749218 - RNA, 18 nt, Homo sapiens
uugugaguggauaaucag

SEQ ID NO: 749219 - RNA, 19 nt, Homo sapiens
uugugauuagacagaacac

SEQ ID NO: 749220 - RNA, 15 nt, Homo sapiens
uugugcaaagccaaa

SEQ ID NO: 749221 - RNA, 19 nt, Homo sapiens
uugugcaacggccaggguu

SEQ ID NO: 749222 - RNA, 24 nt, Homo sapiens
uugugcaggguguguacugcacaa

SEQ ID NO: 749223 - RNA, 15 nt, Homo sapiens
uugugccacuguacu

SEQ ID NO: 749224 - RNA, 21 nt, Homo sapiens
uugugcugcaccuggucauac

SEQ ID NO: 749225 - RNA, 18 nt, Homo sapiens
uuguggcuuuuaugcuuu

SEQ ID NO: 749226 - RNA, 18 nt, Homo sapiens
uuguguggaugaccacau

SEQ ID NO: 749227 - RNA, 20 nt, Homo sapiens
uuguguuccuggcugaugau

SEQ ID NO: 749228 - RNA, 13 nt, Homo sapiens
uuguguucucaaa

SEQ ID NO: 749229 - RNA, 23 nt, Homo sapiens
uuguguuuuuuuuuuaaauagac

SEQ ID NO: 749230 - RNA, 18 nt, Homo sapiens
uuguuaaaaugagcauug

SEQ ID NO: 749231 - RNA, 19 nt, Homo sapiens
uuguuaaaaugagcauuga

SEQ ID NO: 749232 - RNA, 15 nt, Homo sapiens
uuguuaaagauuuca

SEQ ID NO: 749233 - RNA, 23 nt, Homo sapiens
uuguuaaguccuuggcuugccau

SEQ ID NO: 749234 - RNA, 19 nt, Homo sapiens
uuguuacuguccacccuca

SEQ ID NO: 749235 - RNA, 21 nt, Homo sapiens
uuguuacuuuuaguucuauaa

SEQ ID NO: 749236 - RNA, 12 nt, Homo sapiens
uuguuauaccau

SEQ ID NO: 749237 - RNA, 13 nt, Homo sapiens
uuguuauuuacac

SEQ ID NO: 749238 - RNA, 19 nt, Homo sapiens
uuguuauuuacacuggucu

SEQ ID NO: 749239 - RNA, 21 nt, Homo sapiens
uuuccuaaauuuuuacaucaa

SEQ ID NO: 749240 - RNA, 20 nt, Homo sapiens
uuuccucacuuuauggaaga

SEQ ID NO: 749241 - RNA, 12 nt, Homo sapiens
uuuccucugcau

SEQ ID NO: 749242 - RNA, 16 nt, Homo sapiens
uuuccugauaacauua

SEQ ID NO: 749243 - RNA, 22 nt, Homo sapiens
uuuccuggaauugccagcugac

SEQ ID NO: 749244 - RNA, 20 nt, Homo sapiens
uuuccuggucagcauguacu

SEQ ID NO: 749245 - RNA, 17 nt, Homo sapiens
uuuccuggucccucacc

SEQ ID NO: 749246 - RNA, 20 nt, Homo sapiens
uuuccuguuugaaauaucau

SEQ ID NO: 749247 - RNA, 15 nt, Homo sapiens
uuuccuuaguuuucu

SEQ ID NO: 749248 - RNA, 12 nt, Homo sapiens
uuuccuuccaga

SEQ ID NO: 749249 - RNA, 14 nt, Homo sapiens
uuuccuucccaaua

SEQ ID NO: 749250 - RNA, 20 nt, Homo sapiens
uuuccuucggguuggcaaaa

SEQ ID NO: 749251 - RNA, 16 nt, Homo sapiens
uuuccuuuaugugaau

SEQ ID NO: 749252 - RNA, 17 nt, Homo sapiens
uuuccuuuaugugaauu

SEQ ID NO: 749253 - RNA, 16 nt, Homo sapiens
uuuccuuucugccacc

SEQ ID NO: 749254 - RNA, 22 nt, Homo sapiens
uuuccuuugucauuuccuuugu

SEQ ID NO: 749255 - RNA, 18 nt, Homo sapiens
uuuccuuuuugacacuga

SEQ ID NO: 749256 - RNA, 19 nt, Homo sapiens
uuucguuaacauugaccaa

SEQ ID NO: 749257 - RNA, 22 nt, Homo sapiens
uuucuaaaaagaaaaagagaua

SEQ ID NO: 749258 - RNA, 14 nt, Homo sapiens
uuucuaagauucua

SEQ ID NO: 749259 - RNA, 14 nt, Homo sapiens
uuucuacacugagg

SEQ ID NO: 749260 - RNA, 16 nt, Homo sapiens
uuucuaccuuuacuac

SEQ ID NO: 749261 - RNA, 15 nt, Homo sapiens
uuucuagaugacaua

SEQ ID NO: 749262 - RNA, 21 nt, Homo sapiens
uuucuaguuucuugugggcua

SEQ ID NO: 749263 - RNA, 18 nt, Homo sapiens
uuucuauuguuaaacaaa

SEQ ID NO: 749264 - RNA, 15 nt, Homo sapiens
uuucucaaacugagc

SEQ ID NO: 749265 - RNA, 22 nt, Homo sapiens
uuucucaaaggcccucagugag

SEQ ID NO: 749266 - RNA, 12 nt, Homo sapiens
uuucucacugaa

SEQ ID NO: 749267 - RNA, 13 nt, Homo sapiens
uuucucagacuca

SEQ ID NO: 749268 - RNA, 19 nt, Homo sapiens
uuucucagauggauugaua

SEQ ID NO: 749269 - RNA, 18 nt, Homo sapiens
uuucucauaucaacuuag

SEQ ID NO: 749270 - RNA, 20 nt, Homo sapiens
uuucuccucacuguauccag

SEQ ID NO: 749271 - RNA, 20 nt, Homo sapiens
uuucuccuugauaucauuca

SEQ ID NO: 749272 - RNA, 13 nt, Homo sapiens
uuucuccuuuuga

SEQ ID NO: 749273 - RNA, 22 nt, Homo sapiens
uuucuccuuuugaccaaauaaa

SEQ ID NO: 749274 - RNA, 18 nt, Homo sapiens
uuucucuaacuccugcca

SEQ ID NO: 749275 - RNA, 23 nt, Homo sapiens
uuucucugcuuacccuucaccuu

SEQ ID NO: 749276 - RNA, 19 nt, Homo sapiens
uuucucuguaaacuuccaa

SEQ ID NO: 749277 - RNA, 19 nt, Homo sapiens
uuucucuguuguaagaaua

SEQ ID NO: 749278 - RNA, 23 nt, Homo sapiens
uuucucuugcuggaacuguugaa

SEQ ID NO: 749279 - RNA, 21 nt, Homo sapiens
uuucucuuuagccuuccaaca

SEQ ID NO: 749280 - RNA, 11 nt, Homo sapiens
uuucugaaugg

SEQ ID NO: 749281 - RNA, 16 nt, Homo sapiens
uuucugaauugcacau

SEQ ID NO: 749282 - RNA, 22 nt, Homo sapiens
uuucugagaaagacuauucaaa

SEQ ID NO: 749283 - RNA, 13 nt, Homo sapiens
uuucugaguucuu

SEQ ID NO: 749284 - RNA, 16 nt, Homo sapiens
uuucugcagauggaaa

SEQ ID NO: 749285 - RNA, 14 nt, Homo sapiens
uuucugcagggaug

SEQ ID NO: 749286 - RNA, 14 nt, Homo sapiens
uuucugcgugugua

SEQ ID NO: 749287 - RNA, 22 nt, Homo sapiens
uuucugcuaaaaaguccuugau

SEQ ID NO: 749288 - RNA, 19 nt, Homo sapiens
uuucuggaaaguagaucuu

SEQ ID NO: 749289 - RNA, 18 nt, Homo sapiens
uuucuggaagauucuuac

SEQ ID NO: 749290 - RNA, 14 nt, Homo sapiens
uuucuggccaaaag

SEQ ID NO: 749291 - RNA, 20 nt, Homo sapiens
uuucuggccaaaagcaguaa

SEQ ID NO: 749292 - RNA, 17 nt, Homo sapiens
uuucuggccugccuucg

SEQ ID NO: 749293 - RNA, 16 nt, Homo sapiens
uuucugggcuacguga

SEQ ID NO: 749294 - RNA, 13 nt, Homo sapiens
uuucuggugccau

SEQ ID NO: 749295 - RNA, 20 nt, Homo sapiens
uuucuuaaagcaaagucacu

SEQ ID NO: 749296 - RNA, 16 nt, Homo sapiens
uuucuucaccaagugc

SEQ ID NO: 749297 - RNA, 22 nt, Homo sapiens
uuucuucagagagcuaaauuac

SEQ ID NO: 749298 - RNA, 22 nt, Homo sapiens
uuucuucuugugauugcugcca

SEQ ID NO: 749299 - RNA, 15 nt, Homo sapiens
uuucuuuacuccauc

SEQ ID NO: 749300 - RNA, 18 nt, Homo sapiens
uuucuuuagcaugcuaca

SEQ ID NO: 749301 - RNA, 13 nt, Homo sapiens
uuucuuuccucag

SEQ ID NO: 749302 - RNA, 13 nt, Homo sapiens
uuucuuucugcca

SEQ ID NO: 749303 - RNA, 17 nt, Homo sapiens
uuucuuugcaccaaaga

SEQ ID NO: 749304 - RNA, 13 nt, Homo sapiens
uuugaaagaugca

SEQ ID NO: 749305 - RNA, 21 nt, Homo sapiens
uuugaaauaaauuuuaauucg

SEQ ID NO: 749306 - RNA, 16 nt, Homo sapiens
uuugaacaaagcucaa

SEQ ID NO: 749307 - RNA, 14 nt, Homo sapiens
uuugaagaccaguc

SEQ ID NO: 749308 - RNA, 17 nt, Homo sapiens
uuugaagcagucuugcu

SEQ ID NO: 749309 - RNA, 19 nt, Homo sapiens
uuugaagcugcagugagcu

SEQ ID NO: 749310 - RNA, 13 nt, Homo sapiens
uuugaagucagag

SEQ ID NO: 749311 - RNA, 18 nt, Homo sapiens
uuugaaguggccagauga

SEQ ID NO: 749312 - RNA, 20 nt, Homo sapiens
uuugaaucugaaucagccag

SEQ ID NO: 749313 - RNA, 22 nt, Homo sapiens
uuugaaucuuucguagccuaaa

SEQ ID NO: 749314 - RNA, 22 nt, Homo sapiens
uuugaaugucacaaauugauca

SEQ ID NO: 749315 - RNA, 14 nt, Homo sapiens
uuugaaugugugaa

SEQ ID NO: 749316 - RNA, 23 nt, Homo sapiens
uuugaauuucaguaaacaaugaa

SEQ ID NO: 749317 - RNA, 20 nt, Homo sapiens
uuugaccaaauaaaguacca

SEQ ID NO: 749318 - RNA, 22 nt, Homo sapiens
uuugaccaaauaaaguaccauu

SEQ ID NO: 749319 - RNA, 21 nt, Homo sapiens
uuugacuacaaagauauuuca

SEQ ID NO: 749320 - RNA, 19 nt, Homo sapiens
uuugacuaugccgucuucu

SEQ ID NO: 749321 - RNA, 23 nt, Homo sapiens
uuugacuuugguuguguuuaaau

SEQ ID NO: 749322 - RNA, 14 nt, Homo sapiens
uuugagaaaugcau

SEQ ID NO: 749323 - RNA, 15 nt, Homo sapiens
uuugagaaaugcaua

SEQ ID NO: 749324 - RNA, 19 nt, Homo sapiens
uuugagaagaaaacaucua

SEQ ID NO: 749325 - RNA, 22 nt, Homo sapiens
uuugagaagaaaacaucuauuc

SEQ ID NO: 749326 - RNA, 15 nt, Homo sapiens
uuugagaagcucuga

SEQ ID NO: 749327 - RNA, 16 nt, Homo sapiens
uuugagaagcucugau

SEQ ID NO: 749328 - RNA, 13 nt, Homo sapiens
uuugagaauguuu

SEQ ID NO: 749329 - RNA, 16 nt, Homo sapiens
uuugagagacugccau

SEQ ID NO: 749330 - RNA, 22 nt, Homo sapiens
uuugaggacaagauaccaaggc

SEQ ID NO: 749331 - RNA, 20 nt, Homo sapiens
uuugaggaccccuuaaucuu

SEQ ID NO: 749332 - RNA, 15 nt, Homo sapiens
uuugagggugggggu

SEQ ID NO: 749333 - RNA, 23 nt, Homo sapiens
uuugagggugggggugcucucuc

SEQ ID NO: 749334 - RNA, 11 nt, Homo sapiens
uuugaguacag

SEQ ID NO: 749335 - RNA, 22 nt, Homo sapiens
uuugaguguuuauagaucacug

SEQ ID NO: 749336 - RNA, 16 nt, Homo sapiens
uuugauauccaugcca

SEQ ID NO: 749337 - RNA, 17 nt, Homo sapiens
uuugaucaagaaugcaa

SEQ ID NO: 749338 - RNA, 18 nt, Homo sapiens
uuugaucuuuuuauauuc

SEQ ID NO: 749339 - RNA, 16 nt, Homo sapiens
uuugauucagcaaaaa

SEQ ID NO: 749340 - RNA, 23 nt, Homo sapiens
uuugauugaggagcugcacugau

SEQ ID NO: 749341 - RNA, 21 nt, Homo sapiens
uuugcaaaauuuccaguaccu

SEQ ID NO: 749342 - RNA, 13 nt, Homo sapiens
uuugcaaacguuc

SEQ ID NO: 749343 - RNA, 23 nt, Homo sapiens
uuugcaaagaccuucgucuuuga

SEQ ID NO: 749344 - RNA, 19 nt, Homo sapiens
uuugcaaagauaugugggu

SEQ ID NO: 749345 - RNA, 19 nt, Homo sapiens
uuugcaaauucaagagccu

SEQ ID NO: 749346 - RNA, 21 nt, Homo sapiens
uuugcaaauucaagagccucc

SEQ ID NO: 749347 - RNA, 18 nt, Homo sapiens
uuugcacacuugugugug

SEQ ID NO: 749348 - RNA, 15 nt, Homo sapiens
uuugcacuuggcaaa

SEQ ID NO: 749349 - RNA, 20 nt, Homo sapiens
uuugcagaauuaacuauaac

SEQ ID NO: 749350 - RNA, 15 nt, Homo sapiens
uuugcagaugcacau

SEQ ID NO: 749351 - RNA, 19 nt, Homo sapiens
uuugcaggcucauagggaa

SEQ ID NO: 749352 - RNA, 15 nt, Homo sapiens
uuugcauguuuugua

SEQ ID NO: 749353 - RNA, 15 nt, Homo sapiens
aacuuuugugcuccc

SEQ ID NO: 749354 - RNA, 19 nt, Homo sapiens
aacuuuuuuuucucucuuu

SEQ ID NO: 749355 - RNA, 14 nt, Homo sapiens
aagaaaaaguacaa

SEQ ID NO: 749356 - RNA, 14 nt, Homo sapiens
aagaaaacaacuuc

SEQ ID NO: 749357 - RNA, 16 nt, Homo sapiens
aagaaaacacuguuau

SEQ ID NO: 749358 - RNA, 16 nt, Homo sapiens
aagaaaacaguacaga

SEQ ID NO: 749359 - RNA, 15 nt, Homo sapiens
aagaaaagcugccau

SEQ ID NO: 749360 - RNA, 13 nt, Homo sapiens
aagaaaaggacaa

SEQ ID NO: 749361 - RNA, 20 nt, Homo sapiens
aagaaaaggacaaauaucuu

SEQ ID NO: 749362 - RNA, 15 nt, Homo sapiens
aagaaaauaaauguc

SEQ ID NO: 749363 - RNA, 21 nt, Homo sapiens
aagaaaauguuacuucucuca

SEQ ID NO: 749364 - RNA, 21 nt, Homo sapiens
aagaaacacagcaacaaugac

SEQ ID NO: 749365 - RNA, 17 nt, Homo sapiens
aagaaacagaguggccu

SEQ ID NO: 749366 - RNA, 22 nt, Homo sapiens
aagaaacuuauuucucauauca

SEQ ID NO: 749367 - RNA, 13 nt, Homo sapiens
aagaaacuuuguu

SEQ ID NO: 749368 - RNA, 21 nt, Homo sapiens
aagaaagaaaccaagugcgcu

SEQ ID NO: 749369 - RNA, 15 nt, Homo sapiens
aagaaagacuuauca

SEQ ID NO: 749370 - RNA, 16 nt, Homo sapiens
aagaaagaucaaagac

SEQ ID NO: 749371 - RNA, 22 nt, Homo sapiens
aagaaagcaaugccaaucuuca

SEQ ID NO: 749372 - RNA, 20 nt, Homo sapiens
aagaaagcagaaaguucaac

SEQ ID NO: 749373 - RNA, 18 nt, Homo sapiens
aagaaaggccagcaaauu

SEQ ID NO: 749374 - RNA, 17 nt, Homo sapiens
aagaaauaacacuguga

SEQ ID NO: 749375 - RNA, 20 nt, Homo sapiens
aagaaauacucaugugcaau

SEQ ID NO: 749376 - RNA, 15 nt, Homo sapiens
aagaaaucuggccca

SEQ ID NO: 749377 - RNA, 19 nt, Homo sapiens
aagaaaucuggcccagggu

SEQ ID NO: 749378 - RNA, 22 nt, Homo sapiens
aagaaauuccauacuucucuca

SEQ ID NO: 749379 - RNA, 18 nt, Homo sapiens
aagaacaggccucuccau

SEQ ID NO: 749380 - RNA, 17 nt, Homo sapiens
aagaacauucuaccaaa

SEQ ID NO: 749381 - RNA, 19 nt, Homo sapiens
aagaaccacagcacuugag

SEQ ID NO: 749382 - RNA, 23 nt, Homo sapiens
aagaaccacucauugucuuugag

SEQ ID NO: 749383 - RNA, 16 nt, Homo sapiens
aagaaccagacugugu

SEQ ID NO: 749384 - RNA, 22 nt, Homo sapiens
aagaaccagagaggcucugaga

SEQ ID NO: 749385 - RNA, 16 nt, Homo sapiens
aagaaccgagcaauuu

SEQ ID NO: 749386 - RNA, 15 nt, Homo sapiens
aagaaccggacaaau

SEQ ID NO: 749387 - RNA, 14 nt, Homo sapiens
aagaacucucugga

SEQ ID NO: 749388 - RNA, 18 nt, Homo sapiens
aagaacucugggcugcua

SEQ ID NO: 749389 - RNA, 20 nt, Homo sapiens
aagaacugaaggcauaugca

SEQ ID NO: 749390 - RNA, 15 nt, Homo sapiens
aagaacuugcaauac

SEQ ID NO: 749391 - RNA, 20 nt, Homo sapiens
aagaagaauuggccaucuua

SEQ ID NO: 749392 - RNA, 15 nt, Homo sapiens
aagaagacacagaag

SEQ ID NO: 749393 - RNA, 13 nt, Homo sapiens
aagaagagaagcu

SEQ ID NO: 749394 - RNA, 18 nt, Homo sapiens
aagaagagacucuuugca

SEQ ID NO: 749395 - RNA, 16 nt, Homo sapiens
aagaagaguuucuccu

SEQ ID NO: 749396 - RNA, 20 nt, Homo sapiens
aagaagauagauccaauuaa

SEQ ID NO: 749397 - RNA, 12 nt, Homo sapiens
aagaagccacag

SEQ ID NO: 749398 - RNA, 15 nt, Homo sapiens
aagaagccacagacc

SEQ ID NO: 749399 - RNA, 20 nt, Homo sapiens
aagaagcuacugcaugaugu

SEQ ID NO: 749400 - RNA, 22 nt, Homo sapiens
aagaagcugcuguucuuagcaa

SEQ ID NO: 749401 - RNA, 23 nt, Homo sapiens
aagaagcugguggagcagagugu

SEQ ID NO: 749402 - RNA, 18 nt, Homo sapiens
aagaagcuuccacaaaau

SEQ ID NO: 749403 - RNA, 18 nt, Homo sapiens
aagaaggaacauugcaga

SEQ ID NO: 749404 - RNA, 19 nt, Homo sapiens
aagaaggaagaucuugaga

SEQ ID NO: 749405 - RNA, 19 nt, Homo sapiens
aagaaggacugaacuccau

SEQ ID NO: 749406 - RNA, 15 nt, Homo sapiens
aagaaggcaauauua

SEQ ID NO: 749407 - RNA, 11 nt, Homo sapiens
aagaaggcauu

SEQ ID NO: 749408 - RNA, 13 nt, Homo sapiens
aagaaguugcuaa

SEQ ID NO: 749409 - RNA, 22 nt, Homo sapiens
aagaauaaaaaagaaauccaua

SEQ ID NO: 749410 - RNA, 18 nt, Homo sapiens
aagaauaaaauauguagu

SEQ ID NO: 749411 - RNA, 17 nt, Homo sapiens
aagaauaaaauugcacu

SEQ ID NO: 749412 - RNA, 17 nt, Homo sapiens
aagaauaugacuuuuua

SEQ ID NO: 749413 - RNA, 16 nt, Homo sapiens
aagaaucagucuugca

SEQ ID NO: 749414 - RNA, 13 nt, Homo sapiens
aagaaucuaauag

SEQ ID NO: 749415 - RNA, 15 nt, Homo sapiens
aagaaugaauuucaa

SEQ ID NO: 749416 - RNA, 17 nt, Homo sapiens
aagaaugagacugaacu

SEQ ID NO: 749417 - RNA, 22 nt, Homo sapiens
aagaauguuucuggaauucuuc

SEQ ID NO: 749418 - RNA, 14 nt, Homo sapiens
aagaauuacuugug

SEQ ID NO: 749419 - RNA, 15 nt, Homo sapiens
aagaauuacuugugu

SEQ ID NO: 749420 - RNA, 23 nt, Homo sapiens
aagaauucaaacuggggccucca

SEQ ID NO: 749421 - RNA, 17 nt, Homo sapiens
aagaauugaacccagga

SEQ ID NO: 749422 - RNA, 15 nt, Homo sapiens
aagacaaacugcaca

SEQ ID NO: 749423 - RNA, 13 nt, Homo sapiens
aagacaacauaac

SEQ ID NO: 749424 - RNA, 16 nt, Homo sapiens
aagacaauuugauaca

SEQ ID NO: 749425 - RNA, 12 nt, Homo sapiens
aagacaccacca

SEQ ID NO: 749426 - RNA, 14 nt, Homo sapiens
aagacaucaaugaa

SEQ ID NO: 749427 - RNA, 15 nt, Homo sapiens
aagacaucaaugaaa

SEQ ID NO: 749428 - RNA, 16 nt, Homo sapiens
aagacauccugagcag

SEQ ID NO: 749429 - RNA, 22 nt, Homo sapiens
aagacauuuauaauacaaauaa

SEQ ID NO: 749430 - RNA, 23 nt, Homo sapiens
aagacauuuuuugcuauaaucau

SEQ ID NO: 749431 - RNA, 15 nt, Homo sapiens
aagaccaaaaugaca

SEQ ID NO: 749432 - RNA, 15 nt, Homo sapiens
aagaccaaagcauug

SEQ ID NO: 749433 - RNA, 18 nt, Homo sapiens
aagaccaagacacagauc

SEQ ID NO: 749434 - RNA, 13 nt, Homo sapiens
aagaccaccacuu

SEQ ID NO: 749435 - RNA, 16 nt, Homo sapiens
aagaccagccuggcca

SEQ ID NO: 749436 - RNA, 16 nt, Homo sapiens
aagaccagcuuugcag

SEQ ID NO: 749437 - RNA, 20 nt, Homo sapiens
aagaccaguccuguuugcag

SEQ ID NO: 749438 - RNA, 14 nt, Homo sapiens
aagaccccaucucu

SEQ ID NO: 749439 - RNA, 16 nt, Homo sapiens
aagacccccagcacuu

SEQ ID NO: 749440 - RNA, 14 nt, Homo sapiens
aagaccucuggcau

SEQ ID NO: 749441 - RNA, 20 nt, Homo sapiens
aagaccuggcagcucuggac

SEQ ID NO: 749442 - RNA, 17 nt, Homo sapiens
aagacggagaugcaugg

SEQ ID NO: 749443 - RNA, 18 nt, Homo sapiens
aagacuacuauacaaacu

SEQ ID NO: 749444 - RNA, 21 nt, Homo sapiens
aagacucaccucauccuuacc

SEQ ID NO: 749445 - RNA, 19 nt, Homo sapiens
aagacucaguaugcuuucc

SEQ ID NO: 749446 - RNA, 15 nt, Homo sapiens
aagacucauugcuua

SEQ ID NO: 749447 - RNA, 17 nt, Homo sapiens
aagacucugaccagaga

SEQ ID NO: 749448 - RNA, 16 nt, Homo sapiens
aagacucugccauuaa

SEQ ID NO: 749449 - RNA, 22 nt, Homo sapiens
aagacugaauuccaaacauggu

SEQ ID NO: 749450 - RNA, 16 nt, Homo sapiens
aagacugccagguggu

SEQ ID NO: 749451 - RNA, 20 nt, Homo sapiens
aagacuggaauauaauuuca

SEQ ID NO: 749452 - RNA, 16 nt, Homo sapiens
aagacuggcaguccaa

SEQ ID NO: 749453 - RNA, 22 nt, Homo sapiens
aagacuguggcugcuagcacuu

SEQ ID NO: 749454 - RNA, 23 nt, Homo sapiens
aagacuguuaaaugaaaccagaa

SEQ ID NO: 749455 - RNA, 14 nt, Homo sapiens
aagacuuaacuggu

SEQ ID NO: 749456 - RNA, 14 nt, Homo sapiens
aagacuucuugggu

SEQ ID NO: 749457 - RNA, 16 nt, Homo sapiens
aagacuuuauguaguu

SEQ ID NO: 749458 - RNA, 16 nt, Homo sapiens
aagacuuuguccccac

SEQ ID NO: 749459 - RNA, 16 nt, Homo sapiens
aagacuuuuauuaaua

SEQ ID NO: 749460 - RNA, 18 nt, Homo sapiens
aagagaaccgagcaaaga

SEQ ID NO: 749461 - RNA, 16 nt, Homo sapiens
aagagaagaaauagca

SEQ ID NO: 749462 - RNA, 16 nt, Homo sapiens
aagagaagagggccca

SEQ ID NO: 749463 - RNA, 18 nt, Homo sapiens
aagagaauuaagcccuaa

SEQ ID NO: 749464 - RNA, 13 nt, Homo sapiens
aagagaauucuau

SEQ ID NO: 749465 - RNA, 13 nt, Homo sapiens
aagagacacucca

SEQ ID NO: 749466 - RNA, 16 nt, Homo sapiens
aagagacuccgucuca

SEQ ID NO: 749467 - RNA, 14 nt, Homo sapiens
aagagacugggaag

SEQ ID NO: 749468 - RNA, 13 nt, Homo sapiens
aauaaauaauuaa

SEQ ID NO: 749469 - RNA, 16 nt, Homo sapiens
aauaaaucaaauauuc

SEQ ID NO: 749470 - RNA, 23 nt, Homo sapiens
aauaaaucguccucccaggccag

SEQ ID NO: 749471 - RNA, 16 nt, Homo sapiens
aauaaaucuaggaugu

SEQ ID NO: 749472 - RNA, 15 nt, Homo sapiens
aauaaaucuuuggaa

SEQ ID NO: 749473 - RNA, 14 nt, Homo sapiens
aauaaaugaguuag

SEQ ID NO: 749474 - RNA, 12 nt, Homo sapiens
aauaaaugugaa

SEQ ID NO: 749475 - RNA, 16 nt, Homo sapiens
aauaaaugugccuuca

SEQ ID NO: 749476 - RNA, 13 nt, Homo sapiens
aauaaauuguaaa

SEQ ID NO: 749477 - RNA, 16 nt, Homo sapiens
aauaaauuguguuucc

SEQ ID NO: 749478 - RNA, 21 nt, Homo sapiens
aauaaauuuuagugugccuuc

SEQ ID NO: 749479 - RNA, 14 nt, Homo sapiens
aauaacaaucacaa

SEQ ID NO: 749480 - RNA, 22 nt, Homo sapiens
aauaacacuguauuuuaaugua

SEQ ID NO: 749481 - RNA, 14 nt, Homo sapiens
aauaacaggcauuu

SEQ ID NO: 749482 - RNA, 13 nt, Homo sapiens
aauaacauguaau

SEQ ID NO: 749483 - RNA, 23 nt, Homo sapiens
aauaacgggcugcccucagcuca

SEQ ID NO: 749484 - RNA, 23 nt, Homo sapiens
aauaacuaccuuccacucuggaa

SEQ ID NO: 749485 - RNA, 21 nt, Homo sapiens
aauaacugaucucaaguauau

SEQ ID NO: 749486 - RNA, 16 nt, Homo sapiens
aauaacuggaaaaagu

SEQ ID NO: 749487 - RNA, 22 nt, Homo sapiens
aauaagacaagagaucuacaca

SEQ ID NO: 749488 - RNA, 17 nt, Homo sapiens
aauaagcaggacagagg

SEQ ID NO: 749489 - RNA, 18 nt, Homo sapiens
aauaaggagggacaugau

SEQ ID NO: 749490 - RNA, 13 nt, Homo sapiens
aauaaggcacaaa

SEQ ID NO: 749491 - RNA, 14 nt, Homo sapiens
aauaauaaacagug

SEQ ID NO: 749492 - RNA, 12 nt, Homo sapiens
aauaauaugcau

SEQ ID NO: 749493 - RNA, 17 nt, Homo sapiens
aauaaucauucuggaua

SEQ ID NO: 749494 - RNA, 17 nt, Homo sapiens
aauaaugaauacauuuc

SEQ ID NO: 749495 - RNA, 15 nt, Homo sapiens
aauaaugacauaaaa

SEQ ID NO: 749496 - RNA, 19 nt, Homo sapiens
aauaaugauuuucuugcca

SEQ ID NO: 749497 - RNA, 22 nt, Homo sapiens
aauaaugcuggauggccugagg

SEQ ID NO: 749498 - RNA, 16 nt, Homo sapiens
aauaauguacaucugg

SEQ ID NO: 749499 - RNA, 19 nt, Homo sapiens
aauaauguccuuucauuug

SEQ ID NO: 749500 - RNA, 22 nt, Homo sapiens
aauaauuaccaauaucuugcca

SEQ ID NO: 749501 - RNA, 15 nt, Homo sapiens
aauaauugauuucaa

SEQ ID NO: 749502 - RNA, 22 nt, Homo sapiens
aauaauuggcaugucuccucaa

SEQ ID NO: 749503 - RNA, 13 nt, Homo sapiens
aauacaaaaagca

SEQ ID NO: 749504 - RNA, 16 nt, Homo sapiens
aauacaacacaucuaa

SEQ ID NO: 749505 - RNA, 15 nt, Homo sapiens
aauacaagccuaugc

SEQ ID NO: 749506 - RNA, 15 nt, Homo sapiens
aauacaaguuucuga

SEQ ID NO: 749507 - RNA, 15 nt, Homo sapiens
aauacaauguacaau

SEQ ID NO: 749508 - RNA, 16 nt, Homo sapiens
aauacaauguacaauu

SEQ ID NO: 749509 - RNA, 14 nt, Homo sapiens
aauacacauuugcu

SEQ ID NO: 749510 - RNA, 23 nt, Homo sapiens
aauacagauagauauaugcucug

SEQ ID NO: 749511 - RNA, 15 nt, Homo sapiens
aauacagaucaucuu

SEQ ID NO: 749512 - RNA, 24 nt, Homo sapiens
aauacagcagugucaucagaagau

SEQ ID NO: 749513 - RNA, 22 nt, Homo sapiens
aauacaggaggcagacaaugac

SEQ ID NO: 749514 - RNA, 14 nt, Homo sapiens
aauacaguaagcau

SEQ ID NO: 749515 - RNA, 11 nt, Homo sapiens
aauacagugag

SEQ ID NO: 749516 - RNA, 20 nt, Homo sapiens
aauacagugagcucuagcaa

SEQ ID NO: 749517 - RNA, 21 nt, Homo sapiens
aauacaugaaaugucuggucu

SEQ ID NO: 749518 - RNA, 15 nt, Homo sapiens
aauacaugcaucuca

SEQ ID NO: 749519 - RNA, 22 nt, Homo sapiens
aauacauuucaauuauacuaaa

SEQ ID NO: 749520 - RNA, 19 nt, Homo sapiens
aauaccccuuuacuagaag

SEQ ID NO: 749521 - RNA, 17 nt, Homo sapiens
aauaccguguggcccaa

SEQ ID NO: 749522 - RNA, 19 nt, Homo sapiens
aauaccuucugaacuacac

SEQ ID NO: 749523 - RNA, 15 nt, Homo sapiens
aauaccuuggucuca

SEQ ID NO: 749524 - RNA, 16 nt, Homo sapiens
aauacggcuuuuccaa

SEQ ID NO: 749525 - RNA, 18 nt, Homo sapiens
aauacgguaaggauacuu

SEQ ID NO: 749526 - RNA, 22 nt, Homo sapiens
aauacgguaccuggcaauguuu

SEQ ID NO: 749527 - RNA, 14 nt, Homo sapiens
aauacucaccaaaa

SEQ ID NO: 749528 - RNA, 12 nt, Homo sapiens
aauacucugcag

SEQ ID NO: 749529 - RNA, 18 nt, Homo sapiens
aauacucugcagugauua

SEQ ID NO: 749530 - RNA, 19 nt, Homo sapiens
aauacucugcuauuucucu

SEQ ID NO: 749531 - RNA, 21 nt, Homo sapiens
aauacucuugaaauguagaau

SEQ ID NO: 749532 - RNA, 20 nt, Homo sapiens
aauacugauguuccuaguga

SEQ ID NO: 749533 - RNA, 14 nt, Homo sapiens
aauacugcucugaa

SEQ ID NO: 749534 - RNA, 21 nt, Homo sapiens
aauacuggacucaggaacuuu

SEQ ID NO: 749535 - RNA, 13 nt, Homo sapiens
aauacuguuucca

SEQ ID NO: 749536 - RNA, 17 nt, Homo sapiens
aauacuuaacacgugaa

SEQ ID NO: 749537 - RNA, 14 nt, Homo sapiens
aauacuuaacucaa

SEQ ID NO: 749538 - RNA, 21 nt, Homo sapiens
aauacuuaccgagucagacuu

SEQ ID NO: 749539 - RNA, 14 nt, Homo sapiens
aauacuuacuauaa

SEQ ID NO: 749540 - RNA, 14 nt, Homo sapiens
aauacuucucucuc

SEQ ID NO: 749541 - RNA, 21 nt, Homo sapiens
aauacuugaacucuguucccc

SEQ ID NO: 749542 - RNA, 22 nt, Homo sapiens
aauacuuuuuuuuuaaagccac

SEQ ID NO: 749543 - RNA, 12 nt, Homo sapiens
aauagaaaaagu

SEQ ID NO: 749544 - RNA, 21 nt, Homo sapiens
aauagaaacuacccaucucaa

SEQ ID NO: 749545 - RNA, 16 nt, Homo sapiens
aauagaaauaaauucc

SEQ ID NO: 749546 - RNA, 13 nt, Homo sapiens
aauagaacacagu

SEQ ID NO: 749547 - RNA, 21 nt, Homo sapiens
aauagaauauaauuaucggaa

SEQ ID NO: 749548 - RNA, 16 nt, Homo sapiens
aauagacaauuugcac

SEQ ID NO: 749549 - RNA, 15 nt, Homo sapiens
aauagagacuguaga

SEQ ID NO: 749550 - RNA, 23 nt, Homo sapiens
aauagaucaaaguccagcaggca

SEQ ID NO: 749551 - RNA, 14 nt, Homo sapiens
aauagaucuuuuca

SEQ ID NO: 749552 - RNA, 14 nt, Homo sapiens
aauagcacauaugg

SEQ ID NO: 749553 - RNA, 22 nt, Homo sapiens
aauagcauuguuuuugucaugu

SEQ ID NO: 749554 - RNA, 15 nt, Homo sapiens
aauagccucccugua

SEQ ID NO: 749555 - RNA, 14 nt, Homo sapiens
aauagcucuacugc

SEQ ID NO: 749556 - RNA, 18 nt, Homo sapiens
aauagcugccuucaagga

SEQ ID NO: 749557 - RNA, 19 nt, Homo sapiens
aauagcugccuucaaggac

SEQ ID NO: 749558 - RNA, 17 nt, Homo sapiens
aauaggaacaaucuuug

SEQ ID NO: 749559 - RNA, 23 nt, Homo sapiens
aauaggcggggcacgguggcuca

SEQ ID NO: 749560 - RNA, 14 nt, Homo sapiens
aauaguaaaugcuu

SEQ ID NO: 749561 - RNA, 13 nt, Homo sapiens
aauagucaauuuc

SEQ ID NO: 749562 - RNA, 14 nt, Homo sapiens
aauagucauuccaa

SEQ ID NO: 749563 - RNA, 21 nt, Homo sapiens
aauaguccaccucccauuacu

SEQ ID NO: 749564 - RNA, 14 nt, Homo sapiens
aauagucuucucaa

SEQ ID NO: 749565 - RNA, 21 nt, Homo sapiens
aauagugaauacuuacuauaa

SEQ ID NO: 749566 - RNA, 15 nt, Homo sapiens
aauagugccaggaaa

SEQ ID NO: 749567 - RNA, 17 nt, Homo sapiens
aauaguucuaaacuauc

SEQ ID NO: 749568 - RNA, 20 nt, Homo sapiens
aauauaaacaggaucucaaa

SEQ ID NO: 749569 - RNA, 20 nt, Homo sapiens
aauauaaaguugguucacuu

SEQ ID NO: 749570 - RNA, 16 nt, Homo sapiens
aauauaagaccucugg

SEQ ID NO: 749571 - RNA, 19 nt, Homo sapiens
aauauaauaugcacacagu

SEQ ID NO: 749572 - RNA, 14 nt, Homo sapiens
aauauacauucaaa

SEQ ID NO: 749573 - RNA, 14 nt, Homo sapiens
aauauagagaauuc

SEQ ID NO: 749574 - RNA, 22 nt, Homo sapiens
aauauagagggcuuaugauuca

SEQ ID NO: 749575 - RNA, 23 nt, Homo sapiens
aauauauauuaagugugccaaau

SEQ ID NO: 749576 - RNA, 16 nt, Homo sapiens
aauauaucuaccccag

SEQ ID NO: 749577 - RNA, 13 nt, Homo sapiens
aauauaugacuuc

SEQ ID NO: 749578 - RNA, 17 nt, Homo sapiens
aauauauuuccauuaaa

SEQ ID NO: 749579 - RNA, 19 nt, Homo sapiens
aauaucaacucugaagcua

SEQ ID NO: 749580 - RNA, 12 nt, Homo sapiens
aauaucaccuag

SEQ ID NO: 749581 - RNA, 15 nt, Homo sapiens
aauaucagacaagca

SEQ ID NO: 749582 - RNA, 23 nt, Homo sapiens
aauaucagugcucgagacacagu

SEQ ID NO: 749583 - RNA, 16 nt, Homo sapiens
acuugcuucucuagcu

SEQ ID NO: 749584 - RNA, 16 nt, Homo sapiens
acuuggacuuguccuc

SEQ ID NO: 749585 - RNA, 20 nt, Homo sapiens
acuuggagccccagugccaa

SEQ ID NO: 749586 - RNA, 21 nt, Homo sapiens
acuuggagccccagugccaag

SEQ ID NO: 749587 - RNA, 20 nt, Homo sapiens
acuugggaggcugagccagg

SEQ ID NO: 749588 - RNA, 23 nt, Homo sapiens
acuuggggaguuaagaccuggca

SEQ ID NO: 749589 - RNA, 17 nt, Homo sapiens
acuuggucuggcuuuaa

SEQ ID NO: 749590 - RNA, 22 nt, Homo sapiens
acuugguuuguuauaucaggga

SEQ ID NO: 749591 - RNA, 22 nt, Homo sapiens
acuugguuuuuggcucuuucag

SEQ ID NO: 749592 - RNA, 23 nt, Homo sapiens
acuuguaagaaaaugagacaaaa

SEQ ID NO: 749593 - RNA, 13 nt, Homo sapiens
acuuguacuaugu

SEQ ID NO: 749594 - RNA, 17 nt, Homo sapiens
acuugugauuggcugca

SEQ ID NO: 749595 - RNA, 22 nt, Homo sapiens
acuugugcugaucgugcuaaau

SEQ ID NO: 749596 - RNA, 22 nt, Homo sapiens
acuuguguauauuuuaaugaau

SEQ ID NO: 749597 - RNA, 12 nt, Homo sapiens
acuuguguuacu

SEQ ID NO: 749598 - RNA, 12 nt, Homo sapiens
acuuguuuauuc

SEQ ID NO: 749599 - RNA, 19 nt, Homo sapiens
acuuguuugcugugaacaa

SEQ ID NO: 749600 - RNA, 17 nt, Homo sapiens
acuuguuuuugcacaug

SEQ ID NO: 749601 - RNA, 15 nt, Homo sapiens
acuuuaauccaaaga

SEQ ID NO: 749602 - RNA, 21 nt, Homo sapiens
acuuuaaugaacuaacugaca

SEQ ID NO: 749603 - RNA, 20 nt, Homo sapiens
acuuuaauuauuguuauaca

SEQ ID NO: 749604 - RNA, 11 nt, Homo sapiens
acuuuagucuc

SEQ ID NO: 749605 - RNA, 15 nt, Homo sapiens
acuuuauaaauccag

SEQ ID NO: 749606 - RNA, 14 nt, Homo sapiens
acuuuauaguuguu

SEQ ID NO: 749607 - RNA, 17 nt, Homo sapiens
acuuuaucuauaucuca

SEQ ID NO: 749608 - RNA, 15 nt, Homo sapiens
acuuucaaacauaua

SEQ ID NO: 749609 - RNA, 14 nt, Homo sapiens
acuuucauaccacu

SEQ ID NO: 749610 - RNA, 23 nt, Homo sapiens
acuuuccaucucugccugucaau

SEQ ID NO: 749611 - RNA, 20 nt, Homo sapiens
acuuucccguuuuauuccag

SEQ ID NO: 749612 - RNA, 19 nt, Homo sapiens
acuuucccuugugucaaga

SEQ ID NO: 749613 - RNA, 14 nt, Homo sapiens
acuuuccugagcug

SEQ ID NO: 749614 - RNA, 11 nt, Homo sapiens
acuuuccugca

SEQ ID NO: 749615 - RNA, 21 nt, Homo sapiens
acuuucgaccgacuuucccca

SEQ ID NO: 749616 - RNA, 17 nt, Homo sapiens
acuuucucaguuuucau

SEQ ID NO: 749617 - RNA, 12 nt, Homo sapiens
acuuucugauua

SEQ ID NO: 749618 - RNA, 14 nt, Homo sapiens
acuuucugauuacu

SEQ ID NO: 749619 - RNA, 22 nt, Homo sapiens
acuuucugauuacuguccagcu

SEQ ID NO: 749620 - RNA, 20 nt, Homo sapiens
acuuucugauuggugauuca

SEQ ID NO: 749621 - RNA, 13 nt, Homo sapiens
acuuucugccagc

SEQ ID NO: 749622 - RNA, 20 nt, Homo sapiens
acuuucugugacgcagacag

SEQ ID NO: 749623 - RNA, 13 nt, Homo sapiens
acuuucuguuacu

SEQ ID NO: 749624 - RNA, 14 nt, Homo sapiens
acuuucuguuacua

SEQ ID NO: 749625 - RNA, 18 nt, Homo sapiens
acuuucuucucuuuccca

SEQ ID NO: 749626 - RNA, 19 nt, Homo sapiens
acuuucuucucuuucccaa

SEQ ID NO: 749627 - RNA, 15 nt, Homo sapiens
acuuucuugcaugaa

SEQ ID NO: 749628 - RNA, 19 nt, Homo sapiens
acuuugaagcaaauacaau

SEQ ID NO: 749629 - RNA, 16 nt, Homo sapiens
acuuugaaucugcaac

SEQ ID NO: 749630 - RNA, 15 nt, Homo sapiens
acuuugagaagcuga

SEQ ID NO: 749631 - RNA, 22 nt, Homo sapiens
acuuugauucugauaaugcuca

SEQ ID NO: 749632 - RNA, 13 nt, Homo sapiens
acuuugcagcaua

SEQ ID NO: 749633 - RNA, 15 nt, Homo sapiens
acuuuggcaacaucu

SEQ ID NO: 749634 - RNA, 17 nt, Homo sapiens
acuuugggauucuuucc

SEQ ID NO: 749635 - RNA, 22 nt, Homo sapiens
acuuugggcuuaguauuucuca

SEQ ID NO: 749636 - RNA, 16 nt, Homo sapiens
acuuuggguacuuaua

SEQ ID NO: 749637 - RNA, 15 nt, Homo sapiens
acuuuguaaauaagu

SEQ ID NO: 749638 - RNA, 14 nt, Homo sapiens
acuuuguaugucau

SEQ ID NO: 749639 - RNA, 19 nt, Homo sapiens
acuuuguauuaauguguua

SEQ ID NO: 749640 - RNA, 22 nt, Homo sapiens
acuuugucccguggcauuucaa

SEQ ID NO: 749641 - RNA, 15 nt, Homo sapiens
acuuuuaaaaugccc

SEQ ID NO: 749642 - RNA, 22 nt, Homo sapiens
acuuuuauggcucuaucuuuuc

SEQ ID NO: 749643 - RNA, 21 nt, Homo sapiens
acuuuucaagcugcugaagga

SEQ ID NO: 749644 - RNA, 13 nt, Homo sapiens
acuuuucaccaau

SEQ ID NO: 749645 - RNA, 23 nt, Homo sapiens
acuuuucaccaggggugcucacc

SEQ ID NO: 749646 - RNA, 16 nt, Homo sapiens
acuuuuccacauucca

SEQ ID NO: 749647 - RNA, 15 nt, Homo sapiens
acuuuucgacauauu

SEQ ID NO: 749648 - RNA, 20 nt, Homo sapiens
acuuuugugcuccccuuugc

SEQ ID NO: 749649 - RNA, 16 nt, Homo sapiens
acuuuuuagccaguga

SEQ ID NO: 749650 - RNA, 18 nt, Homo sapiens
acuuuuuuuaaacugugg

SEQ ID NO: 749651 - RNA, 18 nt, Homo sapiens
agaaaaaaaaaacacuug

SEQ ID NO: 749652 - RNA, 18 nt, Homo sapiens
agaaaaaaaagugucuca

SEQ ID NO: 749653 - RNA, 12 nt, Homo sapiens
agaaaaaagaga

SEQ ID NO: 749654 - RNA, 17 nt, Homo sapiens
agaaaaacaccgcuucu

SEQ ID NO: 749655 - RNA, 21 nt, Homo sapiens
agaaaaacaccgcuucugccu

SEQ ID NO: 749656 - RNA, 18 nt, Homo sapiens
agaaaaauagugaagacu

SEQ ID NO: 749657 - RNA, 17 nt, Homo sapiens
agaaaaauaucuuggcc

SEQ ID NO: 749658 - RNA, 13 nt, Homo sapiens
agaaaacaacuuc

SEQ ID NO: 749659 - RNA, 20 nt, Homo sapiens
agaaaacccuugggccagaa

SEQ ID NO: 749660 - RNA, 14 nt, Homo sapiens
agaaaacugugauu

SEQ ID NO: 749661 - RNA, 15 nt, Homo sapiens
agaaaagacucugac

SEQ ID NO: 749662 - RNA, 16 nt, Homo sapiens
agaaaagcugccauuu

SEQ ID NO: 749663 - RNA, 19 nt, Homo sapiens
agaaaagcugccauuuccc

SEQ ID NO: 749664 - RNA, 21 nt, Homo sapiens
agaaaauauuacuuauuuauc

SEQ ID NO: 749665 - RNA, 22 nt, Homo sapiens
agaaaauauuauguguuuccau

SEQ ID NO: 749666 - RNA, 21 nt, Homo sapiens
agaaaaucaucaagaagggcu

SEQ ID NO: 749667 - RNA, 22 nt, Homo sapiens
agaaaaugaucuuaauuuacuu

SEQ ID NO: 749668 - RNA, 22 nt, Homo sapiens
agaaaaugccucaauucacaua

SEQ ID NO: 749669 - RNA, 21 nt, Homo sapiens
agaaaauguuacuucucucau

SEQ ID NO: 749670 - RNA, 16 nt, Homo sapiens
agaaaauugcugugcc

SEQ ID NO: 749671 - RNA, 17 nt, Homo sapiens
agaaacaaagauguuau

SEQ ID NO: 749672 - RNA, 17 nt, Homo sapiens
agaaacaaauaauagca

SEQ ID NO: 749673 - RNA, 11 nt, Homo sapiens
agaaacacagg

SEQ ID NO: 749674 - RNA, 13 nt, Homo sapiens
agaaacacauaac

SEQ ID NO: 749675 - RNA, 21 nt, Homo sapiens
agaaacacugacuccugugga

SEQ ID NO: 749676 - RNA, 20 nt, Homo sapiens
agaaacagauaacaccaaac

SEQ ID NO: 749677 - RNA, 12 nt, Homo sapiens
agaaacaugaca

SEQ ID NO: 749678 - RNA, 16 nt, Homo sapiens
agaaacaugacacuga

SEQ ID NO: 749679 - RNA, 20 nt, Homo sapiens
agaaacaugacacugaccuu

SEQ ID NO: 749680 - RNA, 12 nt, Homo sapiens
agaaacccaagu

SEQ ID NO: 749681 - RNA, 20 nt, Homo sapiens
agaaacgagauuugccaaaa

SEQ ID NO: 749682 - RNA, 11 nt, Homo sapiens
agaaacuacug

SEQ ID NO: 749683 - RNA, 19 nt, Homo sapiens
agaaacucaaaaauauuug

SEQ ID NO: 749684 - RNA, 12 nt, Homo sapiens
agaaacucccau

SEQ ID NO: 749685 - RNA, 23 nt, Homo sapiens
agaaacuguguauagcuuaccug

SEQ ID NO: 749686 - RNA, 13 nt, Homo sapiens
agaaacuucccaa

SEQ ID NO: 749687 - RNA, 18 nt, Homo sapiens
agaaacuugugaagugga

SEQ ID NO: 749688 - RNA, 19 nt, Homo sapiens
agaaacuuuaagaacaaac

SEQ ID NO: 749689 - RNA, 19 nt, Homo sapiens
agaaacuuugaguacagau

SEQ ID NO: 749690 - RNA, 17 nt, Homo sapiens
agaaacuuugccucaag

SEQ ID NO: 749691 - RNA, 20 nt, Homo sapiens
agaaagaaaccaagugcgcu

SEQ ID NO: 749692 - RNA, 17 nt, Homo sapiens
agaaagaaguccuuucu

SEQ ID NO: 749693 - RNA, 19 nt, Homo sapiens
agaaagaauuggccaggca

SEQ ID NO: 749694 - RNA, 22 nt, Homo sapiens
agaaagacuugguugguagggu

SEQ ID NO: 749695 - RNA, 18 nt, Homo sapiens
agaaagauguuccaguga

SEQ ID NO: 749696 - RNA, 21 nt, Homo sapiens
agaaagauguuccagugagga

SEQ ID NO: 749697 - RNA, 19 nt, Homo sapiens
agacuuuuuuuuaacacuu

SEQ ID NO: 749698 - RNA, 20 nt, Homo sapiens
agagaaaccucuuuauccaa

SEQ ID NO: 749699 - RNA, 22 nt, Homo sapiens
agagaaacuagaaacaguuaaa

SEQ ID NO: 749700 - RNA, 14 nt, Homo sapiens
agagaaacuuugag

SEQ ID NO: 749701 - RNA, 12 nt, Homo sapiens
agagaaagggag

SEQ ID NO: 749702 - RNA, 16 nt, Homo sapiens
agagaaauacuuucag

SEQ ID NO: 749703 - RNA, 18 nt, Homo sapiens
agagaaauccuuccuaaa

SEQ ID NO: 749704 - RNA, 16 nt, Homo sapiens
agagaaccucagauca

SEQ ID NO: 749705 - RNA, 23 nt, Homo sapiens
agagaacuggaaagacauagcca

SEQ ID NO: 749706 - RNA, 22 nt, Homo sapiens
agagaagaccuugggccaagau

SEQ ID NO: 749707 - RNA, 16 nt, Homo sapiens
agagaagcaaguggcu

SEQ ID NO: 749708 - RNA, 15 nt, Homo sapiens
agagaauaccagugu

SEQ ID NO: 749709 - RNA, 16 nt, Homo sapiens
agagacaauacaguaa

SEQ ID NO: 749710 - RNA, 19 nt, Homo sapiens
agagacgguguuuugccau

SEQ ID NO: 749711 - RNA, 11 nt, Homo sapiens
agagacuucac

SEQ ID NO: 749712 - RNA, 12 nt, Homo sapiens
agagagaacuuu

SEQ ID NO: 749713 - RNA, 22 nt, Homo sapiens
agagagaacuuuucgacauauu

SEQ ID NO: 749714 - RNA, 18 nt, Homo sapiens
agagagaauagagcugcc

SEQ ID NO: 749715 - RNA, 14 nt, Homo sapiens
agagagagaacuuu

SEQ ID NO: 749716 - RNA, 13 nt, Homo sapiens
agagagccuuaac

SEQ ID NO: 749717 - RNA, 15 nt, Homo sapiens
agagaggcucugaga

SEQ ID NO: 749718 - RNA, 17 nt, Homo sapiens
agagagugaguacaugc

SEQ ID NO: 749719 - RNA, 13 nt, Homo sapiens
agagaguggcucc

SEQ ID NO: 749720 - RNA, 14 nt, Homo sapiens
agagauaaaugagc

SEQ ID NO: 749721 - RNA, 20 nt, Homo sapiens
agagaucaugaauuauauaa

SEQ ID NO: 749722 - RNA, 23 nt, Homo sapiens
agagauccagggaaugaugacaa

SEQ ID NO: 749723 - RNA, 15 nt, Homo sapiens
agagaucuauguacu

SEQ ID NO: 749724 - RNA, 15 nt, Homo sapiens
agagaugaaccacau

SEQ ID NO: 749725 - RNA, 21 nt, Homo sapiens
agagaugggguuucaccaugu

SEQ ID NO: 749726 - RNA, 17 nt, Homo sapiens
agagauuuggagcacuc

SEQ ID NO: 749727 - RNA, 16 nt, Homo sapiens
agagauuuggggcuaa

SEQ ID NO: 749728 - RNA, 19 nt, Homo sapiens
agagcaagaccccaucuca

SEQ ID NO: 749729 - RNA, 20 nt, Homo sapiens
agagcacacuuaugggccaa

SEQ ID NO: 749730 - RNA, 12 nt, Homo sapiens
agagcagcagca

SEQ ID NO: 749731 - RNA, 13 nt, Homo sapiens
agagcaggaaaug

SEQ ID NO: 749732 - RNA, 14 nt, Homo sapiens
agagcaggacucca

SEQ ID NO: 749733 - RNA, 18 nt, Homo sapiens
agagcaggccagcccgga

SEQ ID NO: 749734 - RNA, 17 nt, Homo sapiens
agagcagugagcagggu

SEQ ID NO: 749735 - RNA, 12 nt, Homo sapiens
agagcaucucuu

SEQ ID NO: 749736 - RNA, 15 nt, Homo sapiens
agagcaugaccugag

SEQ ID NO: 749737 - RNA, 17 nt, Homo sapiens
agagcaugauacaaauu

SEQ ID NO: 749738 - RNA, 15 nt, Homo sapiens
agagcaugcacaugc

SEQ ID NO: 749739 - RNA, 17 nt, Homo sapiens
agagccacagcugugca

SEQ ID NO: 749740 - RNA, 22 nt, Homo sapiens
agagccaccaaagucacaucca

SEQ ID NO: 749741 - RNA, 19 nt, Homo sapiens
agagccagcagcaaaaacu

SEQ ID NO: 749742 - RNA, 17 nt, Homo sapiens
agagccaggcuguugga

SEQ ID NO: 749743 - RNA, 11 nt, Homo sapiens
agagccaguga

SEQ ID NO: 749744 - RNA, 23 nt, Homo sapiens
agagccgccaaacauuccuccag

SEQ ID NO: 749745 - RNA, 18 nt, Homo sapiens
agagccucuggcaucucu

SEQ ID NO: 749746 - RNA, 13 nt, Homo sapiens
agagccucugggc

SEQ ID NO: 749747 - RNA, 17 nt, Homo sapiens
agagccugagucacugg

SEQ ID NO: 749748 - RNA, 17 nt, Homo sapiens
agagccuuuugugcaaa

SEQ ID NO: 749749 - RNA, 19 nt, Homo sapiens
agagcgagacuccaucucu

SEQ ID NO: 749750 - RNA, 18 nt, Homo sapiens
agagcgaggaaaggauuu

SEQ ID NO: 749751 - RNA, 17 nt, Homo sapiens
agagcgggacucugucc

SEQ ID NO: 749752 - RNA, 18 nt, Homo sapiens
agagcgucauguccuugg

SEQ ID NO: 749753 - RNA, 19 nt, Homo sapiens
agagcuacaugguggagca

SEQ ID NO: 749754 - RNA, 11 nt, Homo sapiens
agagcucuuaa

SEQ ID NO: 749755 - RNA, 23 nt, Homo sapiens
agagcugccugugccuuuugcca

SEQ ID NO: 749756 - RNA, 19 nt, Homo sapiens
agagcuggggagggagagc

SEQ ID NO: 749757 - RNA, 17 nt, Homo sapiens
agagcuucucugggcug

SEQ ID NO: 749758 - RNA, 15 nt, Homo sapiens
agagcuugucagcaa

SEQ ID NO: 749759 - RNA, 21 nt, Homo sapiens
agagcuugugcuccucuugau

SEQ ID NO: 749760 - RNA, 15 nt, Homo sapiens
agagcuuucaaguac

SEQ ID NO: 749761 - RNA, 22 nt, Homo sapiens
agagcuuuccuacuugcacucu

SEQ ID NO: 749762 - RNA, 23 nt, Homo sapiens
agagcuuugugcuugucauucca

SEQ ID NO: 749763 - RNA, 14 nt, Homo sapiens
agaggaaaaugccu

SEQ ID NO: 749764 - RNA, 14 nt, Homo sapiens
agaggaaagacagg

SEQ ID NO: 749765 - RNA, 21 nt, Homo sapiens
agaggaaaugucacagaagca

SEQ ID NO: 749766 - RNA, 13 nt, Homo sapiens
agaggaacaagca

SEQ ID NO: 749767 - RNA, 23 nt, Homo sapiens
agaggaacaagcaugucucucug

SEQ ID NO: 749768 - RNA, 13 nt, Homo sapiens
agaggaacagcac

SEQ ID NO: 749769 - RNA, 22 nt, Homo sapiens
agaggaauaacaucaccacugu

SEQ ID NO: 749770 - RNA, 15 nt, Homo sapiens
agaggaauccaugua

SEQ ID NO: 749771 - RNA, 13 nt, Homo sapiens
agaggaauccugg

SEQ ID NO: 749772 - RNA, 14 nt, Homo sapiens
agaggacaguauuu

SEQ ID NO: 749773 - RNA, 14 nt, Homo sapiens
agaggacgugggac

SEQ ID NO: 749774 - RNA, 22 nt, Homo sapiens
agaggacguguuacccacugcc

SEQ ID NO: 749775 - RNA, 13 nt, Homo sapiens
agaggacugagac

SEQ ID NO: 749776 - RNA, 20 nt, Homo sapiens
agaggacuggacgugcucag

SEQ ID NO: 749777 - RNA, 20 nt, Homo sapiens
agaggacuucuggcagggaa

SEQ ID NO: 749778 - RNA, 13 nt, Homo sapiens
agaggagcagggu

SEQ ID NO: 749779 - RNA, 19 nt, Homo sapiens
agaggagccaccaguucuc

SEQ ID NO: 749780 - RNA, 20 nt, Homo sapiens
agaggagccaccaguucuca

SEQ ID NO: 749781 - RNA, 12 nt, Homo sapiens
agaggagcucuc

SEQ ID NO: 749782 - RNA, 19 nt, Homo sapiens
agaggagggaggaggaaua

SEQ ID NO: 749783 - RNA, 23 nt, Homo sapiens
agaggaggggacccauguaaucc

SEQ ID NO: 749784 - RNA, 15 nt, Homo sapiens
agaggauuugcucug

SEQ ID NO: 749785 - RNA, 14 nt, Homo sapiens
agaggcaccaggaa

SEQ ID NO: 749786 - RNA, 23 nt, Homo sapiens
agaggccagcacauuaucuucau

SEQ ID NO: 749787 - RNA, 16 nt, Homo sapiens
agaggcccggugcagc

SEQ ID NO: 749788 - RNA, 22 nt, Homo sapiens
agaggcuaagaugagauuugcc

SEQ ID NO: 749789 - RNA, 21 nt, Homo sapiens
agaggcuaauucagugucaca

SEQ ID NO: 749790 - RNA, 18 nt, Homo sapiens
agaggcuacaaggacuua

SEQ ID NO: 749791 - RNA, 15 nt, Homo sapiens
agaggcuguucccac

SEQ ID NO: 749792 - RNA, 20 nt, Homo sapiens
agaggggaaaccaguguagc

SEQ ID NO: 749793 - RNA, 14 nt, Homo sapiens
agaggguggcugga

SEQ ID NO: 749794 - RNA, 19 nt, Homo sapiens
agagguauuccucucuuaa

SEQ ID NO: 749795 - RNA, 20 nt, Homo sapiens
agaggucaaggcugcaguga

SEQ ID NO: 749796 - RNA, 14 nt, Homo sapiens
agaggucaccagcu

SEQ ID NO: 749797 - RNA, 12 nt, Homo sapiens
agagguccucau

SEQ ID NO: 749798 - RNA, 14 nt, Homo sapiens
agaggucugugcug

SEQ ID NO: 749799 - RNA, 19 nt, Homo sapiens
agaggugcaagaccuaguc

SEQ ID NO: 749800 - RNA, 15 nt, Homo sapiens
agaggugcagcugga

SEQ ID NO: 749801 - RNA, 23 nt, Homo sapiens
agagguggagguugcagugagcc

SEQ ID NO: 749802 - RNA, 14 nt, Homo sapiens
agagguuaucugcc

SEQ ID NO: 749803 - RNA, 12 nt, Homo sapiens
agagguuugcuu

SEQ ID NO: 749804 - RNA, 16 nt, Homo sapiens
agaguaaaaacugaau

SEQ ID NO: 749805 - RNA, 16 nt, Homo sapiens
agaguauaugcacuuu

SEQ ID NO: 749806 - RNA, 16 nt, Homo sapiens
agaguauuaucacugc

SEQ ID NO: 749807 - RNA, 12 nt, Homo sapiens
agagucacugau

SEQ ID NO: 749808 - RNA, 21 nt, Homo sapiens
agagucagcucucugcccugu

SEQ ID NO: 749809 - RNA, 13 nt, Homo sapiens
agagucagcugcu

SEQ ID NO: 749810 - RNA, 21 nt, Homo sapiens
agagucuaggcuaagcacuuu

SEQ ID NO: 749811 - RNA, 15 nt, Homo sapiens
agagucuugcucugu

SEQ ID NO: 749812 - RNA, 18 nt, Homo sapiens
auaggcgcaggugcacag

SEQ ID NO: 749813 - RNA, 14 nt, Homo sapiens
auaggucacuccug

SEQ ID NO: 749814 - RNA, 13 nt, Homo sapiens
auaggucacuggc

SEQ ID NO: 749815 - RNA, 16 nt, Homo sapiens
auaggucuccaagacc

SEQ ID NO: 749816 - RNA, 13 nt, Homo sapiens
auaguaaaugccu

SEQ ID NO: 749817 - RNA, 15 nt, Homo sapiens
auaguaacaucaaag

SEQ ID NO: 749818 - RNA, 17 nt, Homo sapiens
auaguaacuacuuuuua

SEQ ID NO: 749819 - RNA, 16 nt, Homo sapiens
auaguacuaagcauuu

SEQ ID NO: 749820 - RNA, 17 nt, Homo sapiens
auaguagucucugugag

SEQ ID NO: 749821 - RNA, 18 nt, Homo sapiens
auagucaauuucuacuuc

SEQ ID NO: 749822 - RNA, 14 nt, Homo sapiens
auagucacaagagc

SEQ ID NO: 749823 - RNA, 13 nt, Homo sapiens
auaguccaaagac

SEQ ID NO: 749824 - RNA, 18 nt, Homo sapiens
auagucuuaacuggucuc

SEQ ID NO: 749825 - RNA, 19 nt, Homo sapiens
auagugaauggucucucuu

SEQ ID NO: 749826 - RNA, 23 nt, Homo sapiens
auagugauugauagaguguuauc

SEQ ID NO: 749827 - RNA, 21 nt, Homo sapiens
auagugggcaccccacugcaa

SEQ ID NO: 749828 - RNA, 17 nt, Homo sapiens
auaguguaagaacugua

SEQ ID NO: 749829 - RNA, 16 nt, Homo sapiens
auaguguuaacuguca

SEQ ID NO: 749830 - RNA, 18 nt, Homo sapiens
auaguuaauuauuucaac

SEQ ID NO: 749831 - RNA, 15 nt, Homo sapiens
auaguuaccuucaaa

SEQ ID NO: 749832 - RNA, 13 nt, Homo sapiens
auaguuacugugu

SEQ ID NO: 749833 - RNA, 18 nt, Homo sapiens
auaguucuaaacuaucaa

SEQ ID NO: 749834 - RNA, 21 nt, Homo sapiens
auaguucuagacauggagguu

SEQ ID NO: 749835 - RNA, 17 nt, Homo sapiens
auaguuugugaauccuu

SEQ ID NO: 749836 - RNA, 19 nt, Homo sapiens
auaguuuuucauuguacca

SEQ ID NO: 749837 - RNA, 17 nt, Homo sapiens
auauaaaaaaucuuuag

SEQ ID NO: 749838 - RNA, 20 nt, Homo sapiens
auauaaaaauaaugucauag

SEQ ID NO: 749839 - RNA, 13 nt, Homo sapiens
auauaaacauauu

SEQ ID NO: 749840 - RNA, 15 nt, Homo sapiens
auauaaagcacagau

SEQ ID NO: 749841 - RNA, 19 nt, Homo sapiens
auauaaaguaguccuguga

SEQ ID NO: 749842 - RNA, 16 nt, Homo sapiens
auauaaauacaugcac

SEQ ID NO: 749843 - RNA, 13 nt, Homo sapiens
auauaaaugggaa

SEQ ID NO: 749844 - RNA, 16 nt, Homo sapiens
auauaaauuuguguuc

SEQ ID NO: 749845 - RNA, 17 nt, Homo sapiens
auauaaauuuucccaaa

SEQ ID NO: 749846 - RNA, 20 nt, Homo sapiens
auauaaauuuuuugugauca

SEQ ID NO: 749847 - RNA, 18 nt, Homo sapiens
auauaacauucaguuccc

SEQ ID NO: 749848 - RNA, 16 nt, Homo sapiens
auauaagcugccauau

SEQ ID NO: 749849 - RNA, 16 nt, Homo sapiens
auauaaggaaagcaau

SEQ ID NO: 749850 - RNA, 19 nt, Homo sapiens
auauaaguuuacaccuuua

SEQ ID NO: 749851 - RNA, 14 nt, Homo sapiens
auauaauaugcaca

SEQ ID NO: 749852 - RNA, 13 nt, Homo sapiens
auauaauccacuu

SEQ ID NO: 749853 - RNA, 14 nt, Homo sapiens
auauaauccuguga

SEQ ID NO: 749854 - RNA, 21 nt, Homo sapiens
auauaaugcuugcaccucagg

SEQ ID NO: 749855 - RNA, 18 nt, Homo sapiens
auauaauucuuaugccau

SEQ ID NO: 749856 - RNA, 21 nt, Homo sapiens
auauaauuuccauagugugag

SEQ ID NO: 749857 - RNA, 19 nt, Homo sapiens
auauacagcaggugcucaa

SEQ ID NO: 749858 - RNA, 19 nt, Homo sapiens
auauacaguaacuuuaugu

SEQ ID NO: 749859 - RNA, 14 nt, Homo sapiens
auauacaugcucaa

SEQ ID NO: 749860 - RNA, 11 nt, Homo sapiens
auauaccaaau

SEQ ID NO: 749861 - RNA, 12 nt, Homo sapiens
auauaccaagcu

SEQ ID NO: 749862 - RNA, 22 nt, Homo sapiens
auauaccuggcuuuuacuuuau

SEQ ID NO: 749863 - RNA, 21 nt, Homo sapiens
auauacgcccuugagcuacuu

SEQ ID NO: 749864 - RNA, 23 nt, Homo sapiens
auauacuaaauguauuuuagacu

SEQ ID NO: 749865 - RNA, 17 nt, Homo sapiens
auauacuuuugugaaca

SEQ ID NO: 749866 - RNA, 22 nt, Homo sapiens
auauagagggcuuaugauucag

SEQ ID NO: 749867 - RNA, 19 nt, Homo sapiens
auauaggccagaguugcaa

SEQ ID NO: 749868 - RNA, 23 nt, Homo sapiens
auauaggcuucucacggcgacca

SEQ ID NO: 749869 - RNA, 22 nt, Homo sapiens
auauaguauauuuauacucuag

SEQ ID NO: 749870 - RNA, 14 nt, Homo sapiens
auauaguaucuacc

SEQ ID NO: 749871 - RNA, 14 nt, Homo sapiens
auauaguccagaca

SEQ ID NO: 749872 - RNA, 19 nt, Homo sapiens
auauagugcaauagugcaa

SEQ ID NO: 749873 - RNA, 16 nt, Homo sapiens
auauaguuauugcaca

SEQ ID NO: 749874 - RNA, 17 nt, Homo sapiens
auauauaaauaaucaca

SEQ ID NO: 749875 - RNA, 12 nt, Homo sapiens
auauauaugugu

SEQ ID NO: 749876 - RNA, 16 nt, Homo sapiens
auauaugcacuaugua

SEQ ID NO: 749877 - RNA, 13 nt, Homo sapiens
auauauggauaau

SEQ ID NO: 749878 - RNA, 19 nt, Homo sapiens
auauauuccgcacucaagg

SEQ ID NO: 749879 - RNA, 21 nt, Homo sapiens
auauauuuuugguugucaaua

SEQ ID NO: 749880 - RNA, 18 nt, Homo sapiens
auaucaaaucuaccacug

SEQ ID NO: 749881 - RNA, 13 nt, Homo sapiens
auaucacacaaua

SEQ ID NO: 749882 - RNA, 11 nt, Homo sapiens
auaucagggaa

SEQ ID NO: 749883 - RNA, 16 nt, Homo sapiens
auaucagucacuguuc

SEQ ID NO: 749884 - RNA, 16 nt, Homo sapiens
auaucauguaccucag

SEQ ID NO: 749885 - RNA, 16 nt, Homo sapiens
auauccaaaccaaaua

SEQ ID NO: 749886 - RNA, 14 nt, Homo sapiens
auauccaagacuua

SEQ ID NO: 749887 - RNA, 15 nt, Homo sapiens
auauccacaguacuc

SEQ ID NO: 749888 - RNA, 13 nt, Homo sapiens
auaucccuuccag

SEQ ID NO: 749889 - RNA, 18 nt, Homo sapiens
auauccuuucaagacaga

SEQ ID NO: 749890 - RNA, 23 nt, Homo sapiens
auauccuuuuacugcagaucaag

SEQ ID NO: 749891 - RNA, 13 nt, Homo sapiens
auaucgaucucuu

SEQ ID NO: 749892 - RNA, 19 nt, Homo sapiens
auaucgcuggccagcauua

SEQ ID NO: 749893 - RNA, 22 nt, Homo sapiens
auaucgcuggccagcauuauaa

SEQ ID NO: 749894 - RNA, 14 nt, Homo sapiens
auaucuacuguggu

SEQ ID NO: 749895 - RNA, 18 nt, Homo sapiens
auaucuggagccugaugu

SEQ ID NO: 749896 - RNA, 20 nt, Homo sapiens
auaucuuggacaaaucacau

SEQ ID NO: 749897 - RNA, 11 nt, Homo sapiens
auaucuuggcc

SEQ ID NO: 749898 - RNA, 20 nt, Homo sapiens
auaucuuuaugggcucuguu

SEQ ID NO: 749899 - RNA, 22 nt, Homo sapiens
auaucuuuuguaagacauuucc

SEQ ID NO: 749900 - RNA, 15 nt, Homo sapiens
auaugaaaaucucca

SEQ ID NO: 749901 - RNA, 21 nt, Homo sapiens
auaugaaaaucuccaucucaa

SEQ ID NO: 749902 - RNA, 21 nt, Homo sapiens
auaugaacaaacuaugaucac

SEQ ID NO: 749903 - RNA, 17 nt, Homo sapiens
auaugaagaccaaauga

SEQ ID NO: 749904 - RNA, 16 nt, Homo sapiens
auaugaaucugcucac

SEQ ID NO: 749905 - RNA, 13 nt, Homo sapiens
auaugacaagccu

SEQ ID NO: 749906 - RNA, 16 nt, Homo sapiens
auaugacccacacugc

SEQ ID NO: 749907 - RNA, 14 nt, Homo sapiens
auaugacugauuac

SEQ ID NO: 749908 - RNA, 15 nt, Homo sapiens
auaugaguuacugaa

SEQ ID NO: 749909 - RNA, 14 nt, Homo sapiens
auaugcaaagcacu

SEQ ID NO: 749910 - RNA, 16 nt, Homo sapiens
auaugcagccaaccaa

SEQ ID NO: 749911 - RNA, 19 nt, Homo sapiens
auaugcagccaaccaagau

SEQ ID NO: 749912 - RNA, 18 nt, Homo sapiens
auaugcugaacgcagaag

SEQ ID NO: 749913 - RNA, 17 nt, Homo sapiens
auauggacucugcacau

SEQ ID NO: 749914 - RNA, 18 nt, Homo sapiens
auauguaaagcacaucag

SEQ ID NO: 749915 - RNA, 17 nt, Homo sapiens
auauguaaguacuucca

SEQ ID NO: 749916 - RNA, 19 nt, Homo sapiens
auauguauacaugugccau

SEQ ID NO: 749917 - RNA, 18 nt, Homo sapiens
auauguauauacauauca

SEQ ID NO: 749918 - RNA, 15 nt, Homo sapiens
auauguauauauaug

SEQ ID NO: 749919 - RNA, 14 nt, Homo sapiens
auauguauuacaaa

SEQ ID NO: 749920 - RNA, 20 nt, Homo sapiens
auaugugaagaaaaauguau

SEQ ID NO: 749921 - RNA, 17 nt, Homo sapiens
auaugugcagucuugcu

SEQ ID NO: 749922 - RNA, 18 nt, Homo sapiens
auaugugcgucucucuuu

SEQ ID NO: 749923 - RNA, 16 nt, Homo sapiens
auauguguucauuaaa

SEQ ID NO: 749924 - RNA, 14 nt, Homo sapiens
auauguucaggaaa

SEQ ID NO: 749925 - RNA, 15 nt, Homo sapiens
auauguugcuauaau

SEQ ID NO: 749926 - RNA, 16 nt, Homo sapiens
auauguuuccaucacu

SEQ ID NO: 749927 - RNA, 22 nt, Homo sapiens
auauguuuuuaaagguggauuu

SEQ ID NO: 749928 - RNA, 20 nt, Homo sapiens
aucuggaacaacuuguagca

SEQ ID NO: 749929 - RNA, 19 nt, Homo sapiens
aucuggaacccagacucag

SEQ ID NO: 749930 - RNA, 20 nt, Homo sapiens
aucuggaagaagaugggcug

SEQ ID NO: 749931 - RNA, 22 nt, Homo sapiens
aucuggaaguaaccauuugcac

SEQ ID NO: 749932 - RNA, 20 nt, Homo sapiens
aucuggacauucgaggaauu

SEQ ID NO: 749933 - RNA, 23 nt, Homo sapiens
aucuggagaaccucauccagcuc

SEQ ID NO: 749934 - RNA, 20 nt, Homo sapiens
aucuggaguugaacagcaaa

SEQ ID NO: 749935 - RNA, 14 nt, Homo sapiens
aucuguaaauuuaa

SEQ ID NO: 749936 - RNA, 21 nt, Homo sapiens
aucuguaagagcuugcuccag

SEQ ID NO: 749937 - RNA, 13 nt, Homo sapiens
aucuguaccucug

SEQ ID NO: 749938 - RNA, 15 nt, Homo sapiens
aucuguaguaauuua

SEQ ID NO: 749939 - RNA, 14 nt, Homo sapiens
aucuguaucuugcc

SEQ ID NO: 749940 - RNA, 23 nt, Homo sapiens
aucugucauaagcauuacuuuau

SEQ ID NO: 749941 - RNA, 20 nt, Homo sapiens
aucuguccacauccccagag

SEQ ID NO: 749942 - RNA, 20 nt, Homo sapiens
aucuguccguucacaugugu

SEQ ID NO: 749943 - RNA, 15 nt, Homo sapiens
aucugugaacauguu

SEQ ID NO: 749944 - RNA, 16 nt, Homo sapiens
aucugugaacauguua

SEQ ID NO: 749945 - RNA, 23 nt, Homo sapiens
aucugugaggggcucucucauga

SEQ ID NO: 749946 - RNA, 17 nt, Homo sapiens
aucugugcaaauccuug

SEQ ID NO: 749947 - RNA, 22 nt, Homo sapiens
aucugugcaaauccuugauacu

SEQ ID NO: 749948 - RNA, 12 nt, Homo sapiens
aucugugcagua

SEQ ID NO: 749949 - RNA, 17 nt, Homo sapiens
aucugugccccaugccu

SEQ ID NO: 749950 - RNA, 13 nt, Homo sapiens
aucuguugcuaug

SEQ ID NO: 749951 - RNA, 20 nt, Homo sapiens
aucuguuugaucccuguuac

SEQ ID NO: 749952 - RNA, 15 nt, Homo sapiens
aucuguuuucuggaa

SEQ ID NO: 749953 - RNA, 15 nt, Homo sapiens
aucuguuuuuggaca

SEQ ID NO: 749954 - RNA, 13 nt, Homo sapiens
aucuuaacaaagc

SEQ ID NO: 749955 - RNA, 22 nt, Homo sapiens
aucuuaauuuuuuuuaauguac

SEQ ID NO: 749956 - RNA, 14 nt, Homo sapiens
aucuuacugaaggu

SEQ ID NO: 749957 - RNA, 15 nt, Homo sapiens
aucuuacuguaccug

SEQ ID NO: 749958 - RNA, 17 nt, Homo sapiens
aucuuagauguuucaca

SEQ ID NO: 749959 - RNA, 13 nt, Homo sapiens
aucuuaugcuauu

SEQ ID NO: 749960 - RNA, 22 nt, Homo sapiens
aucuuaugcuauuauucuguaa

SEQ ID NO: 749961 - RNA, 19 nt, Homo sapiens
aucuucaaaacugccauua

SEQ ID NO: 749962 - RNA, 21 nt, Homo sapiens
aucuucaaacuuucacuuuga

SEQ ID NO: 749963 - RNA, 14 nt, Homo sapiens
aucuucaaagccuu

SEQ ID NO: 749964 - RNA, 22 nt, Homo sapiens
aucuucaauuuauuacugaaaa

SEQ ID NO: 749965 - RNA, 21 nt, Homo sapiens
aucuucacacugguuugccag

SEQ ID NO: 749966 - RNA, 13 nt, Homo sapiens
aucuucaccucag

SEQ ID NO: 749967 - RNA, 23 nt, Homo sapiens
aucuucacuucuaaaugcauauc

SEQ ID NO: 749968 - RNA, 24 nt, Homo sapiens
aucuucagcucuuuuuguggauau

SEQ ID NO: 749969 - RNA, 18 nt, Homo sapiens
aucuucagcuugugcaca

SEQ ID NO: 749970 - RNA, 17 nt, Homo sapiens
aucuuccaaaugcaauu

SEQ ID NO: 749971 - RNA, 22 nt, Homo sapiens
aucuuccaaggguacuaaggaa

SEQ ID NO: 749972 - RNA, 15 nt, Homo sapiens
aucuuccaccagcac

SEQ ID NO: 749973 - RNA, 17 nt, Homo sapiens
aucuuccagaagcugua

SEQ ID NO: 749974 - RNA, 19 nt, Homo sapiens
aucuuccccaagagggacu

SEQ ID NO: 749975 - RNA, 18 nt, Homo sapiens
aucuucccuuuauuacaa

SEQ ID NO: 749976 - RNA, 17 nt, Homo sapiens
aucuucuaucauuccaa

SEQ ID NO: 749977 - RNA, 16 nt, Homo sapiens
aucuucucaaguucua

SEQ ID NO: 749978 - RNA, 15 nt, Homo sapiens
aucuucugccuuagu

SEQ ID NO: 749979 - RNA, 21 nt, Homo sapiens
aucuucugggagcaggaacaa

SEQ ID NO: 749980 - RNA, 21 nt, Homo sapiens
aucuucugugcccagcacagu

SEQ ID NO: 749981 - RNA, 17 nt, Homo sapiens
aucuugaauccuuccau

SEQ ID NO: 749982 - RNA, 15 nt, Homo sapiens
aucuugagagcugcu

SEQ ID NO: 749983 - RNA, 14 nt, Homo sapiens
aucuugaguauuua

SEQ ID NO: 749984 - RNA, 18 nt, Homo sapiens
aucuugccuccaggugca

SEQ ID NO: 749985 - RNA, 19 nt, Homo sapiens
aucuuggacugacauuuag

SEQ ID NO: 749986 - RNA, 23 nt, Homo sapiens
aucuuggccaggcuggucuugaa

SEQ ID NO: 749987 - RNA, 19 nt, Homo sapiens
aucuuguaaaggauauuaa

SEQ ID NO: 749988 - RNA, 14 nt, Homo sapiens
aucuugugcuucuu

SEQ ID NO: 749989 - RNA, 15 nt, Homo sapiens
aucuuguuuuuccac

SEQ ID NO: 749990 - RNA, 22 nt, Homo sapiens
aucuuguuuuuccacuacugcu

SEQ ID NO: 749991 - RNA, 22 nt, Homo sapiens
aucuuuaucaugaagcacauca

SEQ ID NO: 749992 - RNA, 15 nt, Homo sapiens
aucuuuaucuguucu

SEQ ID NO: 749993 - RNA, 22 nt, Homo sapiens
aucuuucacacuuccaccagcc

SEQ ID NO: 749994 - RNA, 12 nt, Homo sapiens
aucuuucaggaa

SEQ ID NO: 749995 - RNA, 10 nt, Homo sapiens
aucuuucuac

SEQ ID NO: 749996 - RNA, 15 nt, Homo sapiens
aucuuugacugaaaa

SEQ ID NO: 749997 - RNA, 14 nt, Homo sapiens
aucuuugcuguaua

SEQ ID NO: 749998 - RNA, 17 nt, Homo sapiens
aucuuuguauauuacau

SEQ ID NO: 749999 - RNA, 14 nt, Homo sapiens
aucuuugugcuuca

SEQ ID NO: 750000 - RNA, 23 nt, Homo sapiens
aucuuuuaguuuuaguugcagaa

SEQ ID NO: 750001 - RNA, 16 nt, Homo sapiens
aucuuuucauuaaaga

SEQ ID NO: 750002 - RNA, 19 nt, Homo sapiens
aucuuuuccagaguaugca

SEQ ID NO: 750003 - RNA, 19 nt, Homo sapiens
aucuuuucuagagacacau

SEQ ID NO: 750004 - RNA, 16 nt, Homo sapiens
aucuuuuuuagcauaa

SEQ ID NO: 750005 - RNA, 13 nt, Homo sapiens
augaaaaaauuag

SEQ ID NO: 750006 - RNA, 18 nt, Homo sapiens
augaaaaagauauaugaa

SEQ ID NO: 750007 - RNA, 13 nt, Homo sapiens
augaaaacauuca

SEQ ID NO: 750008 - RNA, 17 nt, Homo sapiens
augaaaacuaaggauuu

SEQ ID NO: 750009 - RNA, 18 nt, Homo sapiens
augaaaaucuccaucuca

SEQ ID NO: 750010 - RNA, 13 nt, Homo sapiens
augaaaaugucag

SEQ ID NO: 750011 - RNA, 22 nt, Homo sapiens
augaaaauuuuaaugcauuguu

SEQ ID NO: 750012 - RNA, 18 nt, Homo sapiens
augaaacaaauaaucaca

SEQ ID NO: 750013 - RNA, 16 nt, Homo sapiens
augaaaccagaaggau

SEQ ID NO: 750014 - RNA, 20 nt, Homo sapiens
augaaaccccguuucuacua

SEQ ID NO: 750015 - RNA, 22 nt, Homo sapiens
augaaaccuuauuuuuucccaa

SEQ ID NO: 750016 - RNA, 16 nt, Homo sapiens
augaaacgucaugugu

SEQ ID NO: 750017 - RNA, 14 nt, Homo sapiens
augaaaguggacaa

SEQ ID NO: 750018 - RNA, 15 nt, Homo sapiens
augaaauaaugcacu

SEQ ID NO: 750019 - RNA, 15 nt, Homo sapiens
augaaauaucuguau

SEQ ID NO: 750020 - RNA, 19 nt, Homo sapiens
augaaaucugcuagaaagu

SEQ ID NO: 750021 - RNA, 17 nt, Homo sapiens
augaaaugaaugucuga

SEQ ID NO: 750022 - RNA, 14 nt, Homo sapiens
augaaauuaacaca

SEQ ID NO: 750023 - RNA, 16 nt, Homo sapiens
augaaauuauuuguca

SEQ ID NO: 750024 - RNA, 16 nt, Homo sapiens
augaacauauucauga

SEQ ID NO: 750025 - RNA, 12 nt, Homo sapiens
augaacaucucu

SEQ ID NO: 750026 - RNA, 23 nt, Homo sapiens
augaaccacccagaguggcccaa

SEQ ID NO: 750027 - RNA, 19 nt, Homo sapiens
augaaccuucuuaacauca

SEQ ID NO: 750028 - RNA, 23 nt, Homo sapiens
augaacgauauguagcagaaagg

SEQ ID NO: 750029 - RNA, 20 nt, Homo sapiens
augaacuaacugacagcuuc

SEQ ID NO: 750030 - RNA, 14 nt, Homo sapiens
augaacuauugccu

SEQ ID NO: 750031 - RNA, 15 nt, Homo sapiens
augaacucuuaauca

SEQ ID NO: 750032 - RNA, 18 nt, Homo sapiens
augaagaaaaucacuuag

SEQ ID NO: 750033 - RNA, 15 nt, Homo sapiens
augaagaaaauugag

SEQ ID NO: 750034 - RNA, 22 nt, Homo sapiens
augaagaaguuggucaguauug

SEQ ID NO: 750035 - RNA, 16 nt, Homo sapiens
augaagauaaacuguu

SEQ ID NO: 750036 - RNA, 21 nt, Homo sapiens
augaagauucuccugugcuag

SEQ ID NO: 750037 - RNA, 23 nt, Homo sapiens
augaagauuuuuaggagugauua

SEQ ID NO: 750038 - RNA, 20 nt, Homo sapiens
augaagcaagccccacuuau

SEQ ID NO: 750039 - RNA, 14 nt, Homo sapiens
augaagcacaucaa

SEQ ID NO: 750040 - RNA, 22 nt, Homo sapiens
augaagcguugccauugaacuc

SEQ ID NO: 750041 - RNA, 20 nt, Homo sapiens
augaaguggaaaaaggagag

SEQ ID NO: 750042 - RNA, 21 nt, Homo sapiens
augcuguuaguaccuacauca

SEQ ID NO: 750043 - RNA, 12 nt, Homo sapiens
augcuuauuaga

SEQ ID NO: 750044 - RNA, 15 nt, Homo sapiens
augcuuccugacaau

SEQ ID NO: 750045 - RNA, 20 nt, Homo sapiens
augcuucuaaauaugaagga

SEQ ID NO: 750046 - RNA, 12 nt, Homo sapiens
augcuucuagcc

SEQ ID NO: 750047 - RNA, 22 nt, Homo sapiens
augcuucuauaauuuugccuuu

SEQ ID NO: 750048 - RNA, 13 nt, Homo sapiens
augcuucugagag

SEQ ID NO: 750049 - RNA, 22 nt, Homo sapiens
augcuucugagagcaaagggaa

SEQ ID NO: 750050 - RNA, 15 nt, Homo sapiens
augcuugcauuauau

SEQ ID NO: 750051 - RNA, 17 nt, Homo sapiens
augcuuggcuaacuaua

SEQ ID NO: 750052 - RNA, 21 nt, Homo sapiens
augcuuugaaagcuuauuuga

SEQ ID NO: 750053 - RNA, 17 nt, Homo sapiens
auggaaaagggagauuc

SEQ ID NO: 750054 - RNA, 19 nt, Homo sapiens
auggaaaauaaacaucagu

SEQ ID NO: 750055 - RNA, 20 nt, Homo sapiens
auggaaagacaaacugcaca

SEQ ID NO: 750056 - RNA, 23 nt, Homo sapiens
auggaaagguccugcuguggaaa

SEQ ID NO: 750057 - RNA, 16 nt, Homo sapiens
auggaacucucuccac

SEQ ID NO: 750058 - RNA, 14 nt, Homo sapiens
auggaacuguuggc

SEQ ID NO: 750059 - RNA, 22 nt, Homo sapiens
auggaagguucucugugcuccu

SEQ ID NO: 750060 - RNA, 16 nt, Homo sapiens
auggaauaucagaagu

SEQ ID NO: 750061 - RNA, 17 nt, Homo sapiens
auggacaacucaaugaa

SEQ ID NO: 750062 - RNA, 13 nt, Homo sapiens
auggacacuggug

SEQ ID NO: 750063 - RNA, 11 nt, Homo sapiens
auggacacuuu

SEQ ID NO: 750064 - RNA, 18 nt, Homo sapiens
auggaccacacuuugaga

SEQ ID NO: 750065 - RNA, 20 nt, Homo sapiens
auggacucugaaaaacauuc

SEQ ID NO: 750066 - RNA, 16 nt, Homo sapiens
auggacugcuucaucu

SEQ ID NO: 750067 - RNA, 20 nt, Homo sapiens
auggacuuccacugccaucc

SEQ ID NO: 750068 - RNA, 15 nt, Homo sapiens
auggacuuguauauu

SEQ ID NO: 750069 - RNA, 21 nt, Homo sapiens
auggacuugugauuggcugca

SEQ ID NO: 750070 - RNA, 13 nt, Homo sapiens
auggagaacccag

SEQ ID NO: 750071 - RNA, 22 nt, Homo sapiens
auggagaagcaccuuugcucuc

SEQ ID NO: 750072 - RNA, 12 nt, Homo sapiens
auggagaagcuc

SEQ ID NO: 750073 - RNA, 17 nt, Homo sapiens
auggagcaggacucuau

SEQ ID NO: 750074 - RNA, 18 nt, Homo sapiens
auggagccagcucugcau

SEQ ID NO: 750075 - RNA, 22 nt, Homo sapiens
auggaggccagugccagcaccu

SEQ ID NO: 750076 - RNA, 17 nt, Homo sapiens
auggaggccugcuucau

SEQ ID NO: 750077 - RNA, 19 nt, Homo sapiens
auggaggucauacaugcau

SEQ ID NO: 750078 - RNA, 16 nt, Homo sapiens
auggaguggcugccau

SEQ ID NO: 750079 - RNA, 19 nt, Homo sapiens
auggaguggcugccaugga

SEQ ID NO: 750080 - RNA, 14 nt, Homo sapiens
auggauagucuguc

SEQ ID NO: 750081 - RNA, 21 nt, Homo sapiens
auggaugggggaacucagauc

SEQ ID NO: 750082 - RNA, 15 nt, Homo sapiens
auggaugucuucuag

SEQ ID NO: 750083 - RNA, 20 nt, Homo sapiens
auggcaaaggaagguggaug

SEQ ID NO: 750084 - RNA, 17 nt, Homo sapiens
auggcaagugauaucac

SEQ ID NO: 750085 - RNA, 15 nt, Homo sapiens
auggcaccaaagcca

SEQ ID NO: 750086 - RNA, 21 nt, Homo sapiens
auggcacccuggaaccgggaa

SEQ ID NO: 750087 - RNA, 17 nt, Homo sapiens
auggcacucaggaaagu

SEQ ID NO: 750088 - RNA, 16 nt, Homo sapiens
auggcagaggugcaag

SEQ ID NO: 750089 - RNA, 14 nt, Homo sapiens
auggcagccuacuc

SEQ ID NO: 750090 - RNA, 21 nt, Homo sapiens
auggcaguccagccagcuccu

SEQ ID NO: 750091 - RNA, 18 nt, Homo sapiens
auggcauaaccugucuca

SEQ ID NO: 750092 - RNA, 22 nt, Homo sapiens
auggcauaggcugacuuuugca

SEQ ID NO: 750093 - RNA, 22 nt, Homo sapiens
auggcauauuuuucacauaucu

SEQ ID NO: 750094 - RNA, 14 nt, Homo sapiens
auggcauccaagac

SEQ ID NO: 750095 - RNA, 19 nt, Homo sapiens
auggcauuuggucucaggc

SEQ ID NO: 750096 - RNA, 18 nt, Homo sapiens
auggccaacucaacuuuc

SEQ ID NO: 750097 - RNA, 14 nt, Homo sapiens
auggccaacuuucu

SEQ ID NO: 750098 - RNA, 19 nt, Homo sapiens
auggccuggacugacugca

SEQ ID NO: 750099 - RNA, 13 nt, Homo sapiens
auggccuugucua

SEQ ID NO: 750100 - RNA, 13 nt, Homo sapiens
auggcgucugcuc

SEQ ID NO: 750101 - RNA, 15 nt, Homo sapiens
auggcuaaauacaau

SEQ ID NO: 750102 - RNA, 17 nt, Homo sapiens
auggcuccuccauaucu

SEQ ID NO: 750103 - RNA, 12 nt, Homo sapiens
auggcugagaug

SEQ ID NO: 750104 - RNA, 18 nt, Homo sapiens
auggcugcuccacugggu

SEQ ID NO: 750105 - RNA, 15 nt, Homo sapiens
auggcuggcacauug

SEQ ID NO: 750106 - RNA, 19 nt, Homo sapiens
auggcuggggccgcugggg

SEQ ID NO: 750107 - RNA, 16 nt, Homo sapiens
auggcuggguccuugg

SEQ ID NO: 750108 - RNA, 22 nt, Homo sapiens
auggcuuauuucuaugacaaau

SEQ ID NO: 750109 - RNA, 15 nt, Homo sapiens
auggcuuuaugcuag

SEQ ID NO: 750110 - RNA, 16 nt, Homo sapiens
augggaagacugagcu

SEQ ID NO: 750111 - RNA, 13 nt, Homo sapiens
augggacugagcc

SEQ ID NO: 750112 - RNA, 17 nt, Homo sapiens
augggacugaugucauc

SEQ ID NO: 750113 - RNA, 12 nt, Homo sapiens
augggaugaaug

SEQ ID NO: 750114 - RNA, 13 nt, Homo sapiens
augggaugaaugg

SEQ ID NO: 750115 - RNA, 17 nt, Homo sapiens
augggauucagugcuuc

SEQ ID NO: 750116 - RNA, 18 nt, Homo sapiens
augggcucaagucacuuu

SEQ ID NO: 750117 - RNA, 14 nt, Homo sapiens
augggcucuuccaa

SEQ ID NO: 750118 - RNA, 22 nt, Homo sapiens
auggggaagguuaucagugcuu

SEQ ID NO: 750119 - RNA, 16 nt, Homo sapiens
auggggacacagauca

SEQ ID NO: 750120 - RNA, 21 nt, Homo sapiens
auggggacacagaucauggua

SEQ ID NO: 750121 - RNA, 16 nt, Homo sapiens
auggggacgguguaug

SEQ ID NO: 750122 - RNA, 17 nt, Homo sapiens
auggggaggcagcagag

SEQ ID NO: 750123 - RNA, 14 nt, Homo sapiens
auggggcacccugg

SEQ ID NO: 750124 - RNA, 14 nt, Homo sapiens
auggggccaucucc

SEQ ID NO: 750125 - RNA, 17 nt, Homo sapiens
auggggucccugcugca

SEQ ID NO: 750126 - RNA, 23 nt, Homo sapiens
augggguucuggaaauccagaua

SEQ ID NO: 750127 - RNA, 18 nt, Homo sapiens
auggguccauuuugcccu

SEQ ID NO: 750128 - RNA, 18 nt, Homo sapiens
auggguggugaauucuga

SEQ ID NO: 750129 - RNA, 15 nt, Homo sapiens
auggguuaagagcuc

SEQ ID NO: 750130 - RNA, 14 nt, Homo sapiens
auggguuccagagg

SEQ ID NO: 750131 - RNA, 15 nt, Homo sapiens
auggguugcauuugg

SEQ ID NO: 750132 - RNA, 23 nt, Homo sapiens
auggguuucauauuucuuaucac

SEQ ID NO: 750133 - RNA, 16 nt, Homo sapiens
augguaaaaguuacuu

SEQ ID NO: 750134 - RNA, 17 nt, Homo sapiens
augguaaguugagaugu

SEQ ID NO: 750135 - RNA, 16 nt, Homo sapiens
augguaauuguugcua

SEQ ID NO: 750136 - RNA, 20 nt, Homo sapiens
augguagaaguuuggcugcu

SEQ ID NO: 750137 - RNA, 17 nt, Homo sapiens
augguaggggcuuaaaa

SEQ ID NO: 750138 - RNA, 13 nt, Homo sapiens
auggucaaugcag

SEQ ID NO: 750139 - RNA, 18 nt, Homo sapiens
auggucacaagcacaaag

SEQ ID NO: 750140 - RNA, 12 nt, Homo sapiens
augguccagaaa

SEQ ID NO: 750141 - RNA, 21 nt, Homo sapiens
augguccuggggcucugugca

SEQ ID NO: 750142 - RNA, 15 nt, Homo sapiens
auggucucgaucucc

SEQ ID NO: 750143 - RNA, 20 nt, Homo sapiens
auggugaaaccccaucucua

SEQ ID NO: 750144 - RNA, 20 nt, Homo sapiens
auggugaaacccccaucucu

SEQ ID NO: 750145 - RNA, 20 nt, Homo sapiens
auggugaaacuccaucucua

SEQ ID NO: 750146 - RNA, 14 nt, Homo sapiens
auggugauaaggga

SEQ ID NO: 750147 - RNA, 15 nt, Homo sapiens
auggugcacugagcu

SEQ ID NO: 750148 - RNA, 22 nt, Homo sapiens
auggugccccaggaccagcuca

SEQ ID NO: 750149 - RNA, 22 nt, Homo sapiens
auggugcguggcuucccugucc

SEQ ID NO: 750150 - RNA, 20 nt, Homo sapiens
auggugggagagacugugag

SEQ ID NO: 750151 - RNA, 21 nt, Homo sapiens
auggugggagagacugugagg

SEQ ID NO: 750152 - RNA, 17 nt, Homo sapiens
auggugggcacagaagu

SEQ ID NO: 750153 - RNA, 14 nt, Homo sapiens
augguggguacaaa

SEQ ID NO: 750154 - RNA, 15 nt, Homo sapiens
augguggguacaaaa

SEQ ID NO: 750155 - RNA, 17 nt, Homo sapiens
auggugguaacugauaa

SEQ ID NO: 750156 - RNA, 11 nt, Homo sapiens
augguggugca

SEQ ID NO: 750157 - RNA, 19 nt, Homo sapiens
cacagacaacaguugcaca

SEQ ID NO: 750158 - RNA, 19 nt, Homo sapiens
cacagacacuacauaucua

SEQ ID NO: 750159 - RNA, 22 nt, Homo sapiens
cacagacauuuugugugagacu

SEQ ID NO: 750160 - RNA, 19 nt, Homo sapiens
cacagaccccgggucuccu

SEQ ID NO: 750161 - RNA, 20 nt, Homo sapiens
cacagacgccuuacuggcaa

SEQ ID NO: 750162 - RNA, 16 nt, Homo sapiens
cacagacugcgauuug

SEQ ID NO: 750163 - RNA, 19 nt, Homo sapiens
cacagagcacgccugccau

SEQ ID NO: 750164 - RNA, 13 nt, Homo sapiens
cacagaggcugcc

SEQ ID NO: 750165 - RNA, 16 nt, Homo sapiens
cacagaguagaaacuc

SEQ ID NO: 750166 - RNA, 19 nt, Homo sapiens
cacagauuauguuccugcu

SEQ ID NO: 750167 - RNA, 19 nt, Homo sapiens
cacagauuuccucucuaaa

SEQ ID NO: 750168 - RNA, 15 nt, Homo sapiens
cacagcaacaaugac

SEQ ID NO: 750169 - RNA, 21 nt, Homo sapiens
cacagcaagucacuggccagu

SEQ ID NO: 750170 - RNA, 23 nt, Homo sapiens
cacagccaacgagacacauugcc

SEQ ID NO: 750171 - RNA, 22 nt, Homo sapiens
cacagcuacacagaucacagcu

SEQ ID NO: 750172 - RNA, 13 nt, Homo sapiens
cacagcugcauua

SEQ ID NO: 750173 - RNA, 19 nt, Homo sapiens
cacagcugcugcuggaaau

SEQ ID NO: 750174 - RNA, 17 nt, Homo sapiens
cacagcuucuccaagca

SEQ ID NO: 750175 - RNA, 13 nt, Homo sapiens
cacagcuuuauga

SEQ ID NO: 750176 - RNA, 18 nt, Homo sapiens
cacaggacaacuuuacaa

SEQ ID NO: 750177 - RNA, 23 nt, Homo sapiens
cacaggagauuccagucuacuug

SEQ ID NO: 750178 - RNA, 21 nt, Homo sapiens
cacagggagaauugaaacuga

SEQ ID NO: 750179 - RNA, 15 nt, Homo sapiens
cacaguaagucauuu

SEQ ID NO: 750180 - RNA, 13 nt, Homo sapiens
cacaguaauacuc

SEQ ID NO: 750181 - RNA, 20 nt, Homo sapiens
cacagucacugauguacaau

SEQ ID NO: 750182 - RNA, 15 nt, Homo sapiens
cacagugaauccaga

SEQ ID NO: 750183 - RNA, 20 nt, Homo sapiens
cacagugacuuccuggggau

SEQ ID NO: 750184 - RNA, 19 nt, Homo sapiens
cacagugacuucugagauc

SEQ ID NO: 750185 - RNA, 18 nt, Homo sapiens
cacagugaugaauguacu

SEQ ID NO: 750186 - RNA, 19 nt, Homo sapiens
cacagugaugaauguacua

SEQ ID NO: 750187 - RNA, 20 nt, Homo sapiens
cacagugcccaccugcucuu

SEQ ID NO: 750188 - RNA, 19 nt, Homo sapiens
cacaguguuuuuauugcuc

SEQ ID NO: 750189 - RNA, 23 nt, Homo sapiens
cacaguuuauuuuuauacuuuca

SEQ ID NO: 750190 - RNA, 19 nt, Homo sapiens
cacauaagcccaguucauc

SEQ ID NO: 750191 - RNA, 22 nt, Homo sapiens
cacauaagggagauuguauaca

SEQ ID NO: 750192 - RNA, 23 nt, Homo sapiens
cacauacauaagcagcauuucau

SEQ ID NO: 750193 - RNA, 12 nt, Homo sapiens
cacauaccuuca

SEQ ID NO: 750194 - RNA, 15 nt, Homo sapiens
cacauaccuucaugu

SEQ ID NO: 750195 - RNA, 22 nt, Homo sapiens
cacauacgggcuuuaauaguca

SEQ ID NO: 750196 - RNA, 21 nt, Homo sapiens
cacauagauuaauggcacuga

SEQ ID NO: 750197 - RNA, 22 nt, Homo sapiens
cacauagauuaauggcacugau

SEQ ID NO: 750198 - RNA, 22 nt, Homo sapiens
cacauauauauuacaagggaua

SEQ ID NO: 750199 - RNA, 13 nt, Homo sapiens
cacauaucuagua

SEQ ID NO: 750200 - RNA, 13 nt, Homo sapiens
cacauauggacuc

SEQ ID NO: 750201 - RNA, 16 nt, Homo sapiens
cacauauguaguauaa

SEQ ID NO: 750202 - RNA, 11 nt, Homo sapiens
cacaucaccuc

SEQ ID NO: 750203 - RNA, 22 nt, Homo sapiens
cacauccaaccccccaccugcc

SEQ ID NO: 750204 - RNA, 14 nt, Homo sapiens
cacauccaucagca

SEQ ID NO: 750205 - RNA, 17 nt, Homo sapiens
cacauccaucccuccau

SEQ ID NO: 750206 - RNA, 11 nt, Homo sapiens
cacaucuccag

SEQ ID NO: 750207 - RNA, 15 nt, Homo sapiens
cacaucucccagcca

SEQ ID NO: 750208 - RNA, 22 nt, Homo sapiens
cacaucugcaucacucauggaa

SEQ ID NO: 750209 - RNA, 17 nt, Homo sapiens
cacaugaaaccuacaca

SEQ ID NO: 750210 - RNA, 21 nt, Homo sapiens
cacaugaagguaaauaaaaag

SEQ ID NO: 750211 - RNA, 19 nt, Homo sapiens
cacaugacuuuuccauuga

SEQ ID NO: 750212 - RNA, 13 nt, Homo sapiens
cacaugcccauga

SEQ ID NO: 750213 - RNA, 12 nt, Homo sapiens
cacaugcuggug

SEQ ID NO: 750214 - RNA, 20 nt, Homo sapiens
cacaugcuggugcauauacg

SEQ ID NO: 750215 - RNA, 12 nt, Homo sapiens
cacaugcugucu

SEQ ID NO: 750216 - RNA, 18 nt, Homo sapiens
cacauggaacgcuuucau

SEQ ID NO: 750217 - RNA, 23 nt, Homo sapiens
cacauggaaucaaucuuuaacaa

SEQ ID NO: 750218 - RNA, 16 nt, Homo sapiens
cacauggccuaugcac

SEQ ID NO: 750219 - RNA, 18 nt, Homo sapiens
cacauggccuaugcacau

SEQ ID NO: 750220 - RNA, 19 nt, Homo sapiens
cacauggccuaugcacaua

SEQ ID NO: 750221 - RNA, 22 nt, Homo sapiens
cacaugucuuguacauguguag

SEQ ID NO: 750222 - RNA, 13 nt, Homo sapiens
cacaugugcacac

SEQ ID NO: 750223 - RNA, 22 nt, Homo sapiens
cacauguucuagguuucagcaa

SEQ ID NO: 750224 - RNA, 19 nt, Homo sapiens
cacauucaugugggcauuu

SEQ ID NO: 750225 - RNA, 18 nt, Homo sapiens
cacauucgggaccaauau

SEQ ID NO: 750226 - RNA, 19 nt, Homo sapiens
cacauucuaaaggcuugau

SEQ ID NO: 750227 - RNA, 22 nt, Homo sapiens
cacauugaagguauaugccaaa

SEQ ID NO: 750228 - RNA, 23 nt, Homo sapiens
cacauugauguaaggacuguaaa

SEQ ID NO: 750229 - RNA, 13 nt, Homo sapiens
cacauugccuucu

SEQ ID NO: 750230 - RNA, 19 nt, Homo sapiens
cacauuugcguguaucuaa

SEQ ID NO: 750231 - RNA, 19 nt, Homo sapiens
cacauuuuacgacaaggau

SEQ ID NO: 750232 - RNA, 19 nt, Homo sapiens
cacauuuuuaaaagaacaa

SEQ ID NO: 750233 - RNA, 23 nt, Homo sapiens
cacauuuuuauaaaaaugagugc

SEQ ID NO: 750234 - RNA, 15 nt, Homo sapiens
caccaaaacugcucc

SEQ ID NO: 750235 - RNA, 21 nt, Homo sapiens
caccaaacugcacacacagcu

SEQ ID NO: 750236 - RNA, 19 nt, Homo sapiens
caccaaagaauuguaggca

SEQ ID NO: 750237 - RNA, 13 nt, Homo sapiens
caccaaagcugcc

SEQ ID NO: 750238 - RNA, 18 nt, Homo sapiens
caccaaaucuauuugaaa

SEQ ID NO: 750239 - RNA, 20 nt, Homo sapiens
caccaaaugaugccacuucc

SEQ ID NO: 750240 - RNA, 21 nt, Homo sapiens
caccaacacugcucacagccu

SEQ ID NO: 750241 - RNA, 19 nt, Homo sapiens
caccaacucugcacuccau

SEQ ID NO: 750242 - RNA, 19 nt, Homo sapiens
caccaacugaaguggcuaa

SEQ ID NO: 750243 - RNA, 13 nt, Homo sapiens
caccaacuugcca

SEQ ID NO: 750244 - RNA, 22 nt, Homo sapiens
caccaaggaaacgcuaccucuc

SEQ ID NO: 750245 - RNA, 23 nt, Homo sapiens
caccaaggcugagacagugaauu

SEQ ID NO: 750246 - RNA, 20 nt, Homo sapiens
caccaagggaucugccauug

SEQ ID NO: 750247 - RNA, 13 nt, Homo sapiens
caccaagugcaau

SEQ ID NO: 750248 - RNA, 19 nt, Homo sapiens
caccaaugaaaacauguac

SEQ ID NO: 750249 - RNA, 12 nt, Homo sapiens
caccaaugagcc

SEQ ID NO: 750250 - RNA, 14 nt, Homo sapiens
caccacacacacac

SEQ ID NO: 750251 - RNA, 16 nt, Homo sapiens
caccacagacacacac

SEQ ID NO: 750252 - RNA, 17 nt, Homo sapiens
caccacagccagcaccu

SEQ ID NO: 750253 - RNA, 12 nt, Homo sapiens
caccaccaggag

SEQ ID NO: 750254 - RNA, 16 nt, Homo sapiens
caccaccuacacagga

SEQ ID NO: 750255 - RNA, 21 nt, Homo sapiens
caccaccucugugggcacugg

SEQ ID NO: 750256 - RNA, 19 nt, Homo sapiens
caccacugcucuccagccu

SEQ ID NO: 750257 - RNA, 19 nt, Homo sapiens
caccagaaauaucgcugau

SEQ ID NO: 750258 - RNA, 15 nt, Homo sapiens
caccagacacccagg

SEQ ID NO: 750259 - RNA, 15 nt, Homo sapiens
caccagaggcugcaa

SEQ ID NO: 750260 - RNA, 23 nt, Homo sapiens
caccagagggauaaaaacaauac

SEQ ID NO: 750261 - RNA, 17 nt, Homo sapiens
caccagccuaagaagcu

SEQ ID NO: 750262 - RNA, 18 nt, Homo sapiens
caccagcugcugcuggag

SEQ ID NO: 750263 - RNA, 23 nt, Homo sapiens
caccaggaaggaagcuguugcuu

SEQ ID NO: 750264 - RNA, 21 nt, Homo sapiens
caccaggagacagacagagaa

SEQ ID NO: 750265 - RNA, 19 nt, Homo sapiens
caccaggagcagcagccag

SEQ ID NO: 750266 - RNA, 16 nt, Homo sapiens
caccaggcacugccug

SEQ ID NO: 750267 - RNA, 13 nt, Homo sapiens
caccagggagcag

SEQ ID NO: 750268 - RNA, 20 nt, Homo sapiens
caccagucaccucgucuccc

SEQ ID NO: 750269 - RNA, 14 nt, Homo sapiens
caccauacccagcu

SEQ ID NO: 750270 - RNA, 15 nt, Homo sapiens
caccauacccagcua

SEQ ID NO: 750271 - RNA, 13 nt, Homo sapiens
cagcgcauguguc

SEQ ID NO: 750272 - RNA, 18 nt, Homo sapiens
cagcggcccugucaucca

SEQ ID NO: 750273 - RNA, 22 nt, Homo sapiens
cagcggcccugucauccagcuc

SEQ ID NO: 750274 - RNA, 22 nt, Homo sapiens
cagcgucacuccagugcucagc

SEQ ID NO: 750275 - RNA, 15 nt, Homo sapiens
cagcgucuugcucug

SEQ ID NO: 750276 - RNA, 17 nt, Homo sapiens
cagcgucuugcucuguu

SEQ ID NO: 750277 - RNA, 19 nt, Homo sapiens
cagcuaaggacauuuccca

SEQ ID NO: 750278 - RNA, 23 nt, Homo sapiens
cagcuacauuccucagcugccaa

SEQ ID NO: 750279 - RNA, 22 nt, Homo sapiens
cagcuacuugggaggcugagcc

SEQ ID NO: 750280 - RNA, 18 nt, Homo sapiens
cagcucaaugaccuggag

SEQ ID NO: 750281 - RNA, 17 nt, Homo sapiens
cagcucaccaacuacag

SEQ ID NO: 750282 - RNA, 16 nt, Homo sapiens
cagcucaccuuuuuau

SEQ ID NO: 750283 - RNA, 15 nt, Homo sapiens
cagcucacgucacac

SEQ ID NO: 750284 - RNA, 14 nt, Homo sapiens
cagcucagccagug

SEQ ID NO: 750285 - RNA, 20 nt, Homo sapiens
cagcucagcucuuuggauca

SEQ ID NO: 750286 - RNA, 17 nt, Homo sapiens
cagcucaguaguauaug

SEQ ID NO: 750287 - RNA, 18 nt, Homo sapiens
cagcuccaaccugcaaag

SEQ ID NO: 750288 - RNA, 14 nt, Homo sapiens
cagcuccagggcca

SEQ ID NO: 750289 - RNA, 14 nt, Homo sapiens
cagcucuccaauac

SEQ ID NO: 750290 - RNA, 23 nt, Homo sapiens
cagcucuccccaggcauuugcca

SEQ ID NO: 750291 - RNA, 21 nt, Homo sapiens
cagcugagaggcauccagaaa

SEQ ID NO: 750292 - RNA, 20 nt, Homo sapiens
cagcugaggccuugccuuga

SEQ ID NO: 750293 - RNA, 14 nt, Homo sapiens
cagcugaugggggu

SEQ ID NO: 750294 - RNA, 14 nt, Homo sapiens
cagcugcaccugcc

SEQ ID NO: 750295 - RNA, 20 nt, Homo sapiens
cagcugcagaccaugccaga

SEQ ID NO: 750296 - RNA, 20 nt, Homo sapiens
cagcugccucugccacugac

SEQ ID NO: 750297 - RNA, 19 nt, Homo sapiens
cagcugccucugcucccuc

SEQ ID NO: 750298 - RNA, 16 nt, Homo sapiens
cagcugcgcuugcuuu

SEQ ID NO: 750299 - RNA, 21 nt, Homo sapiens
cagcugcucccuggcauucaa

SEQ ID NO: 750300 - RNA, 14 nt, Homo sapiens
cagcugcugacacg

SEQ ID NO: 750301 - RNA, 15 nt, Homo sapiens
cagcugcugugcauu

SEQ ID NO: 750302 - RNA, 14 nt, Homo sapiens
cagcugggcagggu

SEQ ID NO: 750303 - RNA, 22 nt, Homo sapiens
cagcuggugucggcaucauacu

SEQ ID NO: 750304 - RNA, 22 nt, Homo sapiens
cagcuguaacccucacccacag

SEQ ID NO: 750305 - RNA, 14 nt, Homo sapiens
cagcuuagaguucu

SEQ ID NO: 750306 - RNA, 18 nt, Homo sapiens
cagcuuauagucuuccag

SEQ ID NO: 750307 - RNA, 22 nt, Homo sapiens
cagcuuauugugugcgcugccu

SEQ ID NO: 750308 - RNA, 23 nt, Homo sapiens
cagcuucaaaugcaaauucauca

SEQ ID NO: 750309 - RNA, 16 nt, Homo sapiens
cagcuucaacuuuucu

SEQ ID NO: 750310 - RNA, 20 nt, Homo sapiens
cagcuucaccagagcauuuc

SEQ ID NO: 750311 - RNA, 18 nt, Homo sapiens
cagcuuccugucaagcaa

SEQ ID NO: 750312 - RNA, 16 nt, Homo sapiens
cagcuuggcccuuucc

SEQ ID NO: 750313 - RNA, 16 nt, Homo sapiens
cagcuugguuccagga

SEQ ID NO: 750314 - RNA, 18 nt, Homo sapiens
cagcuuucaaagcauuua

SEQ ID NO: 750315 - RNA, 16 nt, Homo sapiens
cagcuuucugggaugu

SEQ ID NO: 750316 - RNA, 14 nt, Homo sapiens
cagcuuugcaguga

SEQ ID NO: 750317 - RNA, 21 nt, Homo sapiens
cagcuuuucccaagaugucaa

SEQ ID NO: 750318 - RNA, 14 nt, Homo sapiens
cagcuuuugcaacu

SEQ ID NO: 750319 - RNA, 23 nt, Homo sapiens
caggaaaaaaaaaaaucuaucca

SEQ ID NO: 750320 - RNA, 21 nt, Homo sapiens
caggaaaagguagcuuaccug

SEQ ID NO: 750321 - RNA, 23 nt, Homo sapiens
caggaaaaguugaugguauucau

SEQ ID NO: 750322 - RNA, 14 nt, Homo sapiens
caggaaaaugccag

SEQ ID NO: 750323 - RNA, 14 nt, Homo sapiens
caggaaacuagcuu

SEQ ID NO: 750324 - RNA, 19 nt, Homo sapiens
caggaaacuucgccagcug

SEQ ID NO: 750325 - RNA, 18 nt, Homo sapiens
caggaaauaacccacaaa

SEQ ID NO: 750326 - RNA, 23 nt, Homo sapiens
caggaaauauauaugugugugua

SEQ ID NO: 750327 - RNA, 17 nt, Homo sapiens
caggaacaaacagggcu

SEQ ID NO: 750328 - RNA, 12 nt, Homo sapiens
caggaagacaca

SEQ ID NO: 750329 - RNA, 13 nt, Homo sapiens
caggaagcucucu

SEQ ID NO: 750330 - RNA, 18 nt, Homo sapiens
caggaauccccaacaugc

SEQ ID NO: 750331 - RNA, 16 nt, Homo sapiens
caggaauguguggccu

SEQ ID NO: 750332 - RNA, 19 nt, Homo sapiens
caggaauuagagaagcuga

SEQ ID NO: 750333 - RNA, 17 nt, Homo sapiens
caggaauugucaaauga

SEQ ID NO: 750334 - RNA, 21 nt, Homo sapiens
caggacagaggauuugcucug

SEQ ID NO: 750335 - RNA, 18 nt, Homo sapiens
caggacagggaagggagc

SEQ ID NO: 750336 - RNA, 19 nt, Homo sapiens
caggacuauauuugggccu

SEQ ID NO: 750337 - RNA, 14 nt, Homo sapiens
caggacucagugau

SEQ ID NO: 750338 - RNA, 15 nt, Homo sapiens
caggacugugccuga

SEQ ID NO: 750339 - RNA, 22 nt, Homo sapiens
caggagaaagaugaaacugaaa

SEQ ID NO: 750340 - RNA, 16 nt, Homo sapiens
caggagaagugcuccc

SEQ ID NO: 750341 - RNA, 18 nt, Homo sapiens
caggagaaucacuugaac

SEQ ID NO: 750342 - RNA, 13 nt, Homo sapiens
caggagaaucgcu

SEQ ID NO: 750343 - RNA, 18 nt, Homo sapiens
caggagaauuacuugaac

SEQ ID NO: 750344 - RNA, 18 nt, Homo sapiens
caggagaccugauucccu

SEQ ID NO: 750345 - RNA, 23 nt, Homo sapiens
caggagagugcagaucugugcuc

SEQ ID NO: 750346 - RNA, 21 nt, Homo sapiens
caggagauuccagucuacuug

SEQ ID NO: 750347 - RNA, 18 nt, Homo sapiens
caggagcagcagccagca

SEQ ID NO: 750348 - RNA, 17 nt, Homo sapiens
caggagcaggcacgggu

SEQ ID NO: 750349 - RNA, 17 nt, Homo sapiens
caggagcauggggauaa

SEQ ID NO: 750350 - RNA, 19 nt, Homo sapiens
caggagcgccucguucucu

SEQ ID NO: 750351 - RNA, 18 nt, Homo sapiens
caggagcugauggcagcu

SEQ ID NO: 750352 - RNA, 21 nt, Homo sapiens
caggaggaucauuugagcuca

SEQ ID NO: 750353 - RNA, 18 nt, Homo sapiens
caggaggcagacaaugac

SEQ ID NO: 750354 - RNA, 21 nt, Homo sapiens
caggaggcugaggcaggagaa

SEQ ID NO: 750355 - RNA, 18 nt, Homo sapiens
caggaggcuuggaaagca

SEQ ID NO: 750356 - RNA, 16 nt, Homo sapiens
caggagggcccuaccu

SEQ ID NO: 750357 - RNA, 17 nt, Homo sapiens
caggaggucugguccga

SEQ ID NO: 750358 - RNA, 17 nt, Homo sapiens
caggaguaccuggaccu

SEQ ID NO: 750359 - RNA, 22 nt, Homo sapiens
caggagucuucagacccagaga

SEQ ID NO: 750360 - RNA, 12 nt, Homo sapiens
caggagugccag

SEQ ID NO: 750361 - RNA, 20 nt, Homo sapiens
caggagugccaggaccagcc

SEQ ID NO: 750362 - RNA, 19 nt, Homo sapiens
caggaguucaauaaauguc

SEQ ID NO: 750363 - RNA, 17 nt, Homo sapiens
caggauaagagggauua

SEQ ID NO: 750364 - RNA, 22 nt, Homo sapiens
caggauauuugcacuauuucca

SEQ ID NO: 750365 - RNA, 15 nt, Homo sapiens
caggaucugcuccaa

SEQ ID NO: 750366 - RNA, 13 nt, Homo sapiens
caggaugcccacc

SEQ ID NO: 750367 - RNA, 19 nt, Homo sapiens
caggaugggguucuggaaa

SEQ ID NO: 750368 - RNA, 12 nt, Homo sapiens
caggauggucau

SEQ ID NO: 750369 - RNA, 21 nt, Homo sapiens
caggauuuggcuaugacauga

SEQ ID NO: 750370 - RNA, 17 nt, Homo sapiens
caggcaaagugcugcug

SEQ ID NO: 750371 - RNA, 14 nt, Homo sapiens
caggcaacugaggc

SEQ ID NO: 750372 - RNA, 18 nt, Homo sapiens
caggcacacagcuacucu

SEQ ID NO: 750373 - RNA, 18 nt, Homo sapiens
caggcacuguucaucuca

SEQ ID NO: 750374 - RNA, 18 nt, Homo sapiens
caggcagagaaucauacu

SEQ ID NO: 750375 - RNA, 16 nt, Homo sapiens
caggcagauccaggac

SEQ ID NO: 750376 - RNA, 20 nt, Homo sapiens
caggcagaucugugccccau

SEQ ID NO: 750377 - RNA, 20 nt, Homo sapiens
caggcagucuuugcucagug

SEQ ID NO: 750378 - RNA, 17 nt, Homo sapiens
caggcaguuaggugcug

SEQ ID NO: 750379 - RNA, 21 nt, Homo sapiens
caggcaugaggaaucugggag

SEQ ID NO: 750380 - RNA, 22 nt, Homo sapiens
caggcaugugccacccacccaa

SEQ ID NO: 750381 - RNA, 14 nt, Homo sapiens
caggccacugggga

SEQ ID NO: 750382 - RNA, 15 nt, Homo sapiens
caggccagcuccuau

SEQ ID NO: 750383 - RNA, 14 nt, Homo sapiens
caggcccaagagau

SEQ ID NO: 750384 - RNA, 18 nt, Homo sapiens
caggcccuuccucuccac

SEQ ID NO: 750385 - RNA, 20 nt, Homo sapiens
caggcgccuauaaucccagc

SEQ ID NO: 750386 - RNA, 20 nt, Homo sapiens
caggcgugagccaccgcgcc

SEQ ID NO: 750387 - RNA, 13 nt, Homo sapiens
caggcgugaucca

SEQ ID NO: 750388 - RNA, 22 nt, Homo sapiens
caggcguuucugaagugcucuu

SEQ ID NO: 750389 - RNA, 16 nt, Homo sapiens
caggcucacucacaga

SEQ ID NO: 750390 - RNA, 15 nt, Homo sapiens
caggcucagaucuca

SEQ ID NO: 750391 - RNA, 16 nt, Homo sapiens
caggcucagaucucau

SEQ ID NO: 750392 - RNA, 21 nt, Homo sapiens
caggcugccucggacuccaug

SEQ ID NO: 750393 - RNA, 19 nt, Homo sapiens
caggcuggagugcaaugca

SEQ ID NO: 750394 - RNA, 20 nt, Homo sapiens
caggcuggagugcaguggca

SEQ ID NO: 750395 - RNA, 23 nt, Homo sapiens
caggcuggauacuaagcacaaag

SEQ ID NO: 750396 - RNA, 14 nt, Homo sapiens
caggcuggccaguc

SEQ ID NO: 750397 - RNA, 12 nt, Homo sapiens
caggcugggaac

SEQ ID NO: 750398 - RNA, 23 nt, Homo sapiens
caggcugggagcuggauaccugc

SEQ ID NO: 750399 - RNA, 14 nt, Homo sapiens
caggcugggccaug

SEQ ID NO: 750400 - RNA, 18 nt, Homo sapiens
caggcugggccaugucca

SEQ ID NO: 750401 - RNA, 13 nt, Homo sapiens
caggcuggucuca

SEQ ID NO: 750402 - RNA, 18 nt, Homo sapiens
caggcuguucugcacuga

SEQ ID NO: 750403 - RNA, 17 nt, Homo sapiens
caggcuugucacuagca

SEQ ID NO: 750404 - RNA, 22 nt, Homo sapiens
caggcuuguuaccaccaugcuc

SEQ ID NO: 750405 - RNA, 16 nt, Homo sapiens
cagggaagagggcagu

SEQ ID NO: 750406 - RNA, 16 nt, Homo sapiens
cagggacuccaugcug

SEQ ID NO: 750407 - RNA, 20 nt, Homo sapiens
cagggagaauugaaacugag

SEQ ID NO: 750408 - RNA, 21 nt, Homo sapiens
cagggagacugcaucucaaaa

SEQ ID NO: 750409 - RNA, 18 nt, Homo sapiens
cagggagcccccagagga

SEQ ID NO: 750410 - RNA, 17 nt, Homo sapiens
cagggagggcuguggug

SEQ ID NO: 750411 - RNA, 17 nt, Homo sapiens
cagggagugggagccaa

SEQ ID NO: 750412 - RNA, 18 nt, Homo sapiens
cagggauuaaccucugca

SEQ ID NO: 750413 - RNA, 20 nt, Homo sapiens
cagggauucuuccugcuuag

SEQ ID NO: 750414 - RNA, 24 nt, Homo sapiens
cagggauugauuuuaaaauguaca

SEQ ID NO: 750415 - RNA, 14 nt, Homo sapiens
cagggcaccagagg

SEQ ID NO: 750416 - RNA, 20 nt, Homo sapiens
cagggcagccucccccggcu

SEQ ID NO: 750417 - RNA, 15 nt, Homo sapiens
cagggcagggcucau

SEQ ID NO: 750418 - RNA, 17 nt, Homo sapiens
cagggcagggcucugau

SEQ ID NO: 750419 - RNA, 13 nt, Homo sapiens
cagggcauugcuc

SEQ ID NO: 750420 - RNA, 16 nt, Homo sapiens
cagggcauugcucagc

SEQ ID NO: 750421 - RNA, 19 nt, Homo sapiens
cagggccacagagcuacau

SEQ ID NO: 750422 - RNA, 13 nt, Homo sapiens
cagggccaugcag

SEQ ID NO: 750423 - RNA, 21 nt, Homo sapiens
cagggcccucccagcccauug

SEQ ID NO: 750424 - RNA, 21 nt, Homo sapiens
cagggcccugcagaggggaaa

SEQ ID NO: 750425 - RNA, 17 nt, Homo sapiens
cagggccucaguuucau

SEQ ID NO: 750426 - RNA, 18 nt, Homo sapiens
cagggccuggagccccau

SEQ ID NO: 750427 - RNA, 18 nt, Homo sapiens
cagggccuguaaucccag

SEQ ID NO: 750428 - RNA, 22 nt, Homo sapiens
cagggccuguaaucccagcauu

SEQ ID NO: 750429 - RNA, 21 nt, Homo sapiens
cagggcucagccuggugggcc

SEQ ID NO: 750430 - RNA, 21 nt, Homo sapiens
cagggcucgggagccauguca

SEQ ID NO: 750431 - RNA, 19 nt, Homo sapiens
cagggcugaggccucucau

SEQ ID NO: 750432 - RNA, 14 nt, Homo sapiens
cagggcugauacau

SEQ ID NO: 750433 - RNA, 20 nt, Homo sapiens
cagggcuggcuccucugccc

SEQ ID NO: 750434 - RNA, 14 nt, Homo sapiens
cagggcugucuucg

SEQ ID NO: 750435 - RNA, 13 nt, Homo sapiens
cagggcugugauc

SEQ ID NO: 750436 - RNA, 14 nt, Homo sapiens
cagggcugugaucg

SEQ ID NO: 750437 - RNA, 20 nt, Homo sapiens
cagggcuuuacuccguaaca

SEQ ID NO: 750438 - RNA, 14 nt, Homo sapiens
caggggacaaggga

SEQ ID NO: 750439 - RNA, 17 nt, Homo sapiens
caggggaccacaccucc

SEQ ID NO: 750440 - RNA, 15 nt, Homo sapiens
caggggccaaagcca

SEQ ID NO: 750441 - RNA, 16 nt, Homo sapiens
caggggccugcagaag

SEQ ID NO: 750442 - RNA, 13 nt, Homo sapiens
caggggcucugcu

SEQ ID NO: 750443 - RNA, 17 nt, Homo sapiens
caggggcuugcuuugca

SEQ ID NO: 750444 - RNA, 20 nt, Homo sapiens
cagggggugugucugcucag

SEQ ID NO: 750445 - RNA, 14 nt, Homo sapiens
cagggguacauucu

SEQ ID NO: 750446 - RNA, 18 nt, Homo sapiens
caggggucgucaccaccu

SEQ ID NO: 750447 - RNA, 18 nt, Homo sapiens
caggguagacuuggagcu

SEQ ID NO: 750448 - RNA, 18 nt, Homo sapiens
cagggucccucuguguau

SEQ ID NO: 750449 - RNA, 12 nt, Homo sapiens
cagggucugcuc

SEQ ID NO: 750450 - RNA, 20 nt, Homo sapiens
cagggugacccugaagugag

SEQ ID NO: 750451 - RNA, 22 nt, Homo sapiens
caggguggaugaucucaaucuc

SEQ ID NO: 750452 - RNA, 22 nt, Homo sapiens
caggguguuugcagcugugaga

SEQ ID NO: 750453 - RNA, 19 nt, Homo sapiens
cagguaaaugguaugauca

SEQ ID NO: 750454 - RNA, 20 nt, Homo sapiens
cagguaaaugguaugaucaa

SEQ ID NO: 750455 - RNA, 20 nt, Homo sapiens
cagguacagaaaacauguuu

SEQ ID NO: 750456 - RNA, 17 nt, Homo sapiens
cagguaccucuuucagg

SEQ ID NO: 750457 - RNA, 22 nt, Homo sapiens
cagguaggcccuuguccugcca

SEQ ID NO: 750458 - RNA, 21 nt, Homo sapiens
cagguaggucggcacuuggac

SEQ ID NO: 750459 - RNA, 19 nt, Homo sapiens
cagguauuuuuuuaaauca

SEQ ID NO: 750460 - RNA, 14 nt, Homo sapiens
caggucaacuucag

SEQ ID NO: 750461 - RNA, 17 nt, Homo sapiens
caggucaguuguaauaa

SEQ ID NO: 750462 - RNA, 22 nt, Homo sapiens
cagguccugcuccgcugccugg

SEQ ID NO: 750463 - RNA, 15 nt, Homo sapiens
caggugaaaauccau

SEQ ID NO: 750464 - RNA, 17 nt, Homo sapiens
caggugaccccuaggag

SEQ ID NO: 750465 - RNA, 17 nt, Homo sapiens
caggugaucuaccugcc

SEQ ID NO: 750466 - RNA, 20 nt, Homo sapiens
caggugauucgcccaccuca

SEQ ID NO: 750467 - RNA, 19 nt, Homo sapiens
caggugcaacagacuugaa

SEQ ID NO: 750468 - RNA, 19 nt, Homo sapiens
caggugcuacaacauguga

SEQ ID NO: 750469 - RNA, 15 nt, Homo sapiens
cagguggaaugugua

SEQ ID NO: 750470 - RNA, 20 nt, Homo sapiens
cagguggacacacaaggugc

SEQ ID NO: 750471 - RNA, 18 nt, Homo sapiens
cagguggacugacugugu

SEQ ID NO: 750472 - RNA, 19 nt, Homo sapiens
cagguggccagaagagcuu

SEQ ID NO: 750473 - RNA, 17 nt, Homo sapiens
cagguggccccaguuca

SEQ ID NO: 750474 - RNA, 20 nt, Homo sapiens
cagguggcccgguugaacuc

SEQ ID NO: 750475 - RNA, 22 nt, Homo sapiens
cagguggugaauuuuccaagaa

SEQ ID NO: 750476 - RNA, 15 nt, Homo sapiens
caggugucauaugac

SEQ ID NO: 750477 - RNA, 23 nt, Homo sapiens
caggugucgggggaaaugaacug

SEQ ID NO: 750478 - RNA, 18 nt, Homo sapiens
caggugugacucuagcaa

SEQ ID NO: 750479 - RNA, 14 nt, Homo sapiens
caggugugcagauu

SEQ ID NO: 750480 - RNA, 16 nt, Homo sapiens
cagguguuacuuacag

SEQ ID NO: 750481 - RNA, 20 nt, Homo sapiens
cagguguuacuuacaguccc

SEQ ID NO: 750482 - RNA, 22 nt, Homo sapiens
cagguguucuacacucaucuua

SEQ ID NO: 750483 - RNA, 21 nt, Homo sapiens
cagguguugggaccugcugcu

SEQ ID NO: 750484 - RNA, 16 nt, Homo sapiens
cagguuaaugcugaaa

SEQ ID NO: 750485 - RNA, 14 nt, Homo sapiens
cagguuagccuuug

SEQ ID NO: 750486 - RNA, 15 nt, Homo sapiens
cagguuagccuuugc

SEQ ID NO: 750487 - RNA, 22 nt, Homo sapiens
cagguucaagugcuucuccagc

SEQ ID NO: 750488 - RNA, 17 nt, Homo sapiens
cagguuccaucccgaaa

SEQ ID NO: 750489 - RNA, 16 nt, Homo sapiens
cagguucucaccucag

SEQ ID NO: 750490 - RNA, 17 nt, Homo sapiens
cagguuggagugcagug

SEQ ID NO: 750491 - RNA, 18 nt, Homo sapiens
cagguuggagugcagugg

SEQ ID NO: 750492 - RNA, 20 nt, Homo sapiens
cagguuuuguguuuugucau

SEQ ID NO: 750493 - RNA, 16 nt, Homo sapiens
caguaaaauacuauug

SEQ ID NO: 750494 - RNA, 17 nt, Homo sapiens
caguaaacaaauucuuu

SEQ ID NO: 750495 - RNA, 13 nt, Homo sapiens
caguaaacgggaa

SEQ ID NO: 750496 - RNA, 19 nt, Homo sapiens
caguaaacgggaacaugcc

SEQ ID NO: 750497 - RNA, 17 nt, Homo sapiens
caguaaagagauuaauu

SEQ ID NO: 750498 - RNA, 22 nt, Homo sapiens
caguaaagcacuugcaaccguc

SEQ ID NO: 750499 - RNA, 19 nt, Homo sapiens
caguaaauaacaggcauuu

SEQ ID NO: 750500 - RNA, 18 nt, Homo sapiens
caguaaauaacuggaaaa

SEQ ID NO: 750501 - RNA, 22 nt, Homo sapiens
caguaaauaacuggaaaacaga

SEQ ID NO: 750502 - RNA, 22 nt, Homo sapiens
caguaaaugcagacugcugcaa

SEQ ID NO: 750503 - RNA, 17 nt, Homo sapiens
caguaaccuagugaauu

SEQ ID NO: 750504 - RNA, 18 nt, Homo sapiens
caguaacuuuauguguaa

SEQ ID NO: 750505 - RNA, 13 nt, Homo sapiens
caguaauguguca

SEQ ID NO: 750506 - RNA, 22 nt, Homo sapiens
caguaauuccuguuacuuuaca

SEQ ID NO: 750507 - RNA, 20 nt, Homo sapiens
caguacacccaguugccaaa

SEQ ID NO: 750508 - RNA, 14 nt, Homo sapiens
caguacagaaggca

SEQ ID NO: 750509 - RNA, 13 nt, Homo sapiens
caguacaugggaa

SEQ ID NO: 750510 - RNA, 16 nt, Homo sapiens
caguacccucucagcu

SEQ ID NO: 750511 - RNA, 15 nt, Homo sapiens
caguaccuuguugca

SEQ ID NO: 750512 - RNA, 12 nt, Homo sapiens
caguacugggag

SEQ ID NO: 750513 - RNA, 21 nt, Homo sapiens
caguacuuguuucuaugcaga

SEQ ID NO: 750514 - RNA, 14 nt, Homo sapiens
caguagaacuccag

SEQ ID NO: 750515 - RNA, 19 nt, Homo sapiens
caguagagcaaaucuauga

SEQ ID NO: 750516 - RNA, 19 nt, Homo sapiens
caguagccguuugugguuu

SEQ ID NO: 750517 - RNA, 18 nt, Homo sapiens
caguaggaacuguacaug

SEQ ID NO: 750518 - RNA, 20 nt, Homo sapiens
caguaguagcgaacugcacu

SEQ ID NO: 750519 - RNA, 13 nt, Homo sapiens
caguagucccugc

SEQ ID NO: 750520 - RNA, 16 nt, Homo sapiens
caguagucccugcaca

SEQ ID NO: 750521 - RNA, 12 nt, Homo sapiens
caguaguggaaa

SEQ ID NO: 750522 - RNA, 15 nt, Homo sapiens
caguaucacaggcca

SEQ ID NO: 750523 - RNA, 23 nt, Homo sapiens
caguaucacgauuugcaggauuc

SEQ ID NO: 750524 - RNA, 15 nt, Homo sapiens
caguaucucuucagu

SEQ ID NO: 750525 - RNA, 22 nt, Homo sapiens
caguaucucuucagucucuaua

SEQ ID NO: 750526 - RNA, 14 nt, Homo sapiens
caguaugacauuuc

SEQ ID NO: 750527 - RNA, 12 nt, Homo sapiens
caguaugcacaa

SEQ ID NO: 750528 - RNA, 18 nt, Homo sapiens
caguauguuuguuucauu

SEQ ID NO: 750529 - RNA, 14 nt, Homo sapiens
caguauuaagugug

SEQ ID NO: 750530 - RNA, 14 nt, Homo sapiens
caguauuacagugu

SEQ ID NO: 750531 - RNA, 23 nt, Homo sapiens
caguauuuagaagccaacuauga

SEQ ID NO: 750532 - RNA, 20 nt, Homo sapiens
cagucacauggcaugguuuu

SEQ ID NO: 750533 - RNA, 16 nt, Homo sapiens
cagucacauugaugua

SEQ ID NO: 750534 - RNA, 21 nt, Homo sapiens
cagucacauugauguaaggac

SEQ ID NO: 750535 - RNA, 19 nt, Homo sapiens
cagucacugacaguuaaua

SEQ ID NO: 750536 - RNA, 19 nt, Homo sapiens
cagucagagauaacaucca

SEQ ID NO: 750537 - RNA, 16 nt, Homo sapiens
cagucagaugaggcaa

SEQ ID NO: 750538 - RNA, 20 nt, Homo sapiens
cagucagcgccagcacugua

SEQ ID NO: 750539 - RNA, 23 nt, Homo sapiens
cagucagcuguggggaacacagc

SEQ ID NO: 750540 - RNA, 16 nt, Homo sapiens
cagucaggaagacaca

SEQ ID NO: 750541 - RNA, 11 nt, Homo sapiens
cagucagggac

SEQ ID NO: 750542 - RNA, 21 nt, Homo sapiens
cagucauaacuaaauaaagcu

SEQ ID NO: 750543 - RNA, 14 nt, Homo sapiens
cagucaucuacuuu

SEQ ID NO: 750544 - RNA, 13 nt, Homo sapiens
cagucauuuugca

SEQ ID NO: 750545 - RNA, 13 nt, Homo sapiens
caguccaugucuc

SEQ ID NO: 750546 - RNA, 15 nt, Homo sapiens
cagucccaugaccuu

SEQ ID NO: 750547 - RNA, 15 nt, Homo sapiens
caguccccagcccuu

SEQ ID NO: 750548 - RNA, 18 nt, Homo sapiens
cagucccuggagcugucc

SEQ ID NO: 750549 - RNA, 23 nt, Homo sapiens
cagucccuuacacguaccucuca

SEQ ID NO: 750550 - RNA, 23 nt, Homo sapiens
caguccugggagaaccucaggcu

SEQ ID NO: 750551 - RNA, 17 nt, Homo sapiens
cagucggccccaucucu

SEQ ID NO: 750552 - RNA, 21 nt, Homo sapiens
cagucguacugauucuaaugg

SEQ ID NO: 750553 - RNA, 23 nt, Homo sapiens
cagucuacucuuucugcuuacaa

SEQ ID NO: 750554 - RNA, 14 nt, Homo sapiens
cagucuauucacag

SEQ ID NO: 750555 - RNA, 17 nt, Homo sapiens
cagucugcuucagugca

SEQ ID NO: 750556 - RNA, 21 nt, Homo sapiens
cagucugcuucagugcaguga

SEQ ID NO: 750557 - RNA, 15 nt, Homo sapiens
cagucuggagaaggu

SEQ ID NO: 750558 - RNA, 15 nt, Homo sapiens
cagucuggaugacag

SEQ ID NO: 750559 - RNA, 20 nt, Homo sapiens
cagucuguacagaaugcuau

SEQ ID NO: 750560 - RNA, 23 nt, Homo sapiens
cagucugugauccuuggugcugu

SEQ ID NO: 750561 - RNA, 12 nt, Homo sapiens
cagucuucuuca

SEQ ID NO: 750562 - RNA, 14 nt, Homo sapiens
cagucuuugcucag

SEQ ID NO: 750563 - RNA, 18 nt, Homo sapiens
cagugaaauaacuaccuu

SEQ ID NO: 750564 - RNA, 19 nt, Homo sapiens
cagugaagaugcaaucaga

SEQ ID NO: 750565 - RNA, 11 nt, Homo sapiens
cagugaaggcu

SEQ ID NO: 750566 - RNA, 13 nt, Homo sapiens
cagugaaggcuaa

SEQ ID NO: 750567 - RNA, 21 nt, Homo sapiens
gugccuagacuguuacuuugg

SEQ ID NO: 750568 - RNA, 18 nt, Homo sapiens
gugccuccccccagaccc

SEQ ID NO: 750569 - RNA, 12 nt, Homo sapiens
gugccugagaca

SEQ ID NO: 750570 - RNA, 21 nt, Homo sapiens
gugccugagcucugacagugu

SEQ ID NO: 750571 - RNA, 18 nt, Homo sapiens
gugccugccaccuucaag

SEQ ID NO: 750572 - RNA, 17 nt, Homo sapiens
gugccuucccagacacu

SEQ ID NO: 750573 - RNA, 16 nt, Homo sapiens
gugcgcgaugugacag

SEQ ID NO: 750574 - RNA, 15 nt, Homo sapiens
gugcggaucucugga

SEQ ID NO: 750575 - RNA, 13 nt, Homo sapiens
gugcgugucucug

SEQ ID NO: 750576 - RNA, 13 nt, Homo sapiens
gugcuaacauaaa

SEQ ID NO: 750577 - RNA, 21 nt, Homo sapiens
gugcuaauuuguuuuggauau

SEQ ID NO: 750578 - RNA, 18 nt, Homo sapiens
gugcuacaaaaacacagc

SEQ ID NO: 750579 - RNA, 17 nt, Homo sapiens
gugcuacaacaugugag

SEQ ID NO: 750580 - RNA, 20 nt, Homo sapiens
gugcuaucgcaccacugugu

SEQ ID NO: 750581 - RNA, 21 nt, Homo sapiens
gugcuauuaggaaauucugau

SEQ ID NO: 750582 - RNA, 22 nt, Homo sapiens
gugcucucagcuggcagugcaa

SEQ ID NO: 750583 - RNA, 21 nt, Homo sapiens
gugcugauccugcugaccuca

SEQ ID NO: 750584 - RNA, 14 nt, Homo sapiens
gugcugccauuuga

SEQ ID NO: 750585 - RNA, 15 nt, Homo sapiens
gugcuggaauuccac

SEQ ID NO: 750586 - RNA, 15 nt, Homo sapiens
gugcuggagacacuc

SEQ ID NO: 750587 - RNA, 18 nt, Homo sapiens
gugcuggcauuacaggug

SEQ ID NO: 750588 - RNA, 21 nt, Homo sapiens
gugcuggcauuacagguguga

SEQ ID NO: 750589 - RNA, 19 nt, Homo sapiens
gugcugggauuacagggau

SEQ ID NO: 750590 - RNA, 19 nt, Homo sapiens
gugcugggauuacaggugu

SEQ ID NO: 750591 - RNA, 16 nt, Homo sapiens
gugcugggcauuuuua

SEQ ID NO: 750592 - RNA, 19 nt, Homo sapiens
gugcuggugaacacuguga

SEQ ID NO: 750593 - RNA, 13 nt, Homo sapiens
gugcugugacucg

SEQ ID NO: 750594 - RNA, 15 nt, Homo sapiens
gugcuguugggauau

SEQ ID NO: 750595 - RNA, 15 nt, Homo sapiens
gugcuucacaguaga

SEQ ID NO: 750596 - RNA, 15 nt, Homo sapiens
gugcuucagccugag

SEQ ID NO: 750597 - RNA, 17 nt, Homo sapiens
gugcuucgacuacugcu

SEQ ID NO: 750598 - RNA, 23 nt, Homo sapiens
gugcuuguucuguccucuugccu

SEQ ID NO: 750599 - RNA, 16 nt, Homo sapiens
guggaaaguagcugcu

SEQ ID NO: 750600 - RNA, 18 nt, Homo sapiens
guggaaccaacacuaaca

SEQ ID NO: 750601 - RNA, 15 nt, Homo sapiens
guggaagaacuguga

SEQ ID NO: 750602 - RNA, 22 nt, Homo sapiens
guggaaguuaaagggcauuucc

SEQ ID NO: 750603 - RNA, 17 nt, Homo sapiens
guggaccacugcaugag

SEQ ID NO: 750604 - RNA, 19 nt, Homo sapiens
guggacugugcuggugcau

SEQ ID NO: 750605 - RNA, 18 nt, Homo sapiens
guggagaaagcacugacc

SEQ ID NO: 750606 - RNA, 19 nt, Homo sapiens
guggagcaugcaacacauc

SEQ ID NO: 750607 - RNA, 23 nt, Homo sapiens
guggaucaccugaggucaggagu

SEQ ID NO: 750608 - RNA, 14 nt, Homo sapiens
guggaugaucucaa

SEQ ID NO: 750609 - RNA, 15 nt, Homo sapiens
guggaugaugcugcc

SEQ ID NO: 750610 - RNA, 17 nt, Homo sapiens
guggauuccagugcaug

SEQ ID NO: 750611 - RNA, 11 nt, Homo sapiens
guggcaauggg

SEQ ID NO: 750612 - RNA, 13 nt, Homo sapiens
guggcacaggagu

SEQ ID NO: 750613 - RNA, 19 nt, Homo sapiens
guggcacgugccugugauc

SEQ ID NO: 750614 - RNA, 20 nt, Homo sapiens
guggcacucaacucugagcc

SEQ ID NO: 750615 - RNA, 14 nt, Homo sapiens
guggcagucgcagg

SEQ ID NO: 750616 - RNA, 16 nt, Homo sapiens
guggcaguggccaggc

SEQ ID NO: 750617 - RNA, 22 nt, Homo sapiens
guggcauaaauugcaucacugu

SEQ ID NO: 750618 - RNA, 14 nt, Homo sapiens
guggcaucaucuca

SEQ ID NO: 750619 - RNA, 14 nt, Homo sapiens
guggcaugugcugu

SEQ ID NO: 750620 - RNA, 22 nt, Homo sapiens
guggccaccaguaugacaguau

SEQ ID NO: 750621 - RNA, 14 nt, Homo sapiens
guggcccaacacaa

SEQ ID NO: 750622 - RNA, 13 nt, Homo sapiens
guggcccagagaa

SEQ ID NO: 750623 - RNA, 14 nt, Homo sapiens
guggcccucuggau

SEQ ID NO: 750624 - RNA, 15 nt, Homo sapiens
uuguaagacuuacaa

SEQ ID NO: 750625 - RNA, 23 nt, Homo sapiens
uuguaagucagccacugggaccc

SEQ ID NO: 750626 - RNA, 22 nt, Homo sapiens
uuguaauaaaggucuuugcaca

SEQ ID NO: 750627 - RNA, 19 nt, Homo sapiens
uuguaaugacagugcuaaa

SEQ ID NO: 750628 - RNA, 13 nt, Homo sapiens
uuguaaugcugca

SEQ ID NO: 750629 - RNA, 16 nt, Homo sapiens
uuguacagaauauuuc

SEQ ID NO: 750630 - RNA, 18 nt, Homo sapiens
uuguaccucuaaguacau

SEQ ID NO: 750631 - RNA, 17 nt, Homo sapiens
uuguacguuuugcacau

SEQ ID NO: 750632 - RNA, 18 nt, Homo sapiens
uuguacguuuugcacauu

SEQ ID NO: 750633 - RNA, 23 nt, Homo sapiens
uuguacucuuguuuuugcauaac

SEQ ID NO: 750634 - RNA, 17 nt, Homo sapiens
uuguacuguaauggagu

SEQ ID NO: 750635 - RNA, 17 nt, Homo sapiens
uuguacuucuguguuca

SEQ ID NO: 750636 - RNA, 23 nt, Homo sapiens
uuguagaaauuaacaaaugugcu

SEQ ID NO: 750637 - RNA, 15 nt, Homo sapiens
uuguagacuuccuuu

SEQ ID NO: 750638 - RNA, 19 nt, Homo sapiens
uuguagaguuuugucauuc

SEQ ID NO: 750639 - RNA, 18 nt, Homo sapiens
uuguaggagaaacuccca

SEQ ID NO: 750640 - RNA, 21 nt, Homo sapiens
uuguaggagaaacucccaugu

SEQ ID NO: 750641 - RNA, 22 nt, Homo sapiens
uuguaguauuuugggagcaaaa

SEQ ID NO: 750642 - RNA, 22 nt, Homo sapiens
uuguauaaacauaaacuguaug

SEQ ID NO: 750643 - RNA, 19 nt, Homo sapiens
uuguauauagaguggaauc

SEQ ID NO: 750644 - RNA, 19 nt, Homo sapiens
uuguaugucauuuccuuca

SEQ ID NO: 750645 - RNA, 20 nt, Homo sapiens
uuguauuaugugucacaugg

SEQ ID NO: 750646 - RNA, 20 nt, Homo sapiens
uuguauuuaccuucuaccuc

SEQ ID NO: 750647 - RNA, 18 nt, Homo sapiens
uuguauuuauuuccagac

SEQ ID NO: 750648 - RNA, 13 nt, Homo sapiens
uugucaaacugua

SEQ ID NO: 750649 - RNA, 20 nt, Homo sapiens
uugucaaagaaggugcugau

SEQ ID NO: 750650 - RNA, 19 nt, Homo sapiens
uugucagaaaccugcaggg

SEQ ID NO: 750651 - RNA, 18 nt, Homo sapiens
uugucagcugcagccacu

SEQ ID NO: 750652 - RNA, 13 nt, Homo sapiens
uugucauaccuuu

SEQ ID NO: 750653 - RNA, 18 nt, Homo sapiens
uugucauuuuuaauauua

SEQ ID NO: 750654 - RNA, 19 nt, Homo sapiens
uugucccguggcauuucaa

SEQ ID NO: 750655 - RNA, 15 nt, Homo sapiens
uuguccugcucucuu

SEQ ID NO: 750656 - RNA, 14 nt, Homo sapiens
uugucgcuauguga

SEQ ID NO: 750657 - RNA, 22 nt, Homo sapiens
uugucuacauuaaaucacuuga

SEQ ID NO: 750658 - RNA, 22 nt, Homo sapiens
uugucugaacuugcauugugau

SEQ ID NO: 750659 - RNA, 15 nt, Homo sapiens
uugucugagacagaa

SEQ ID NO: 750660 - RNA, 20 nt, Homo sapiens
uugucuguaaaaaauggagc

SEQ ID NO: 750661 - RNA, 22 nt, Homo sapiens
uugucugucaaauguuuccuua

SEQ ID NO: 750662 - RNA, 17 nt, Homo sapiens
uugucuucaaacuguga

SEQ ID NO: 750663 - RNA, 17 nt, Homo sapiens
uugucuugagacagggu

SEQ ID NO: 750664 - RNA, 18 nt, Homo sapiens
uugugaaagacauguaac

SEQ ID NO: 750665 - RNA, 23 nt, Homo sapiens
uugugaacccuagcugugucaga

SEQ ID NO: 750666 - RNA, 12 nt, Homo sapiens
uugugaacugga

SEQ ID NO: 750667 - RNA, 21 nt, Homo sapiens
uugugaacuuuuuguagggga

SEQ ID NO: 750668 - RNA, 21 nt, Homo sapiens
uugugaccacugaauucacuc

SEQ ID NO: 750669 - RNA, 19 nt, Homo sapiens
uugugaccccuuucacuua

SEQ ID NO: 750670 - RNA, 16 nt, Homo sapiens
uugugauguguccuga

SEQ ID NO: 750671 - RNA, 13 nt, Homo sapiens
uugugcaaacaug

SEQ ID NO: 750672 - RNA, 20 nt, Homo sapiens
uugugcacaagucuuuccag

SEQ ID NO: 750673 - RNA, 23 nt, Homo sapiens
uugugcaggguguguacugcaca

SEQ ID NO: 750674 - RNA, 23 nt, Homo sapiens
uugugcuauuaggaaauucugau

SEQ ID NO: 750675 - RNA, 21 nt, Homo sapiens
uugugcuucacaguagagcca

SEQ ID NO: 750676 - RNA, 19 nt, Homo sapiens
uugugguaacuugcugcuu

SEQ ID NO: 750677 - RNA, 19 nt, Homo sapiens
uugugguagugaugguugu

SEQ ID NO: 750678 - RNA, 14 nt, Homo sapiens
uuguggugcauuga

SEQ ID NO: 750679 - RNA, 14 nt, Homo sapiens
uugugguuaaucug

SEQ ID NO: 750680 - RNA, 21 nt, Homo sapiens
uuguguaaugaaaaugaauau

SEQ ID NO: 750681 - RNA, 23 nt, Homo sapiens
uuuacauguauuuaaaguagcau

SEQ ID NO: 750682 - RNA, 14 nt, Homo sapiens
uuuacauucaucaa

SEQ ID NO: 750683 - RNA, 15 nt, Homo sapiens
uuuacauucaucuca

SEQ ID NO: 750684 - RNA, 16 nt, Homo sapiens
uuuaccauuuguaaua

SEQ ID NO: 750685 - RNA, 20 nt, Homo sapiens
uuuacccuauacauccacag

SEQ ID NO: 750686 - RNA, 17 nt, Homo sapiens
uuuaccugagaccaguu

SEQ ID NO: 750687 - RNA, 17 nt, Homo sapiens
uuuaccugcugggaccu

SEQ ID NO: 750688 - RNA, 17 nt, Homo sapiens
uuuaccuuauguuuaau

SEQ ID NO: 750689 - RNA, 18 nt, Homo sapiens
uuuacuaucacacaugaa

SEQ ID NO: 750690 - RNA, 13 nt, Homo sapiens
uuuacuauuuuag

SEQ ID NO: 750691 - RNA, 22 nt, Homo sapiens
uuuacucagaggagcugcaaau

SEQ ID NO: 750692 - RNA, 11 nt, Homo sapiens
uuuacucugcu

SEQ ID NO: 750693 - RNA, 23 nt, Homo sapiens
uuuacugcucugagaauuguuga

SEQ ID NO: 750694 - RNA, 18 nt, Homo sapiens
uuuacuguuuuaauugua

SEQ ID NO: 750695 - RNA, 13 nt, Homo sapiens
uuuacuucuuuag

SEQ ID NO: 750696 - RNA, 17 nt, Homo sapiens
uuuacuuuuaaacugug

SEQ ID NO: 750697 - RNA, 16 nt, Homo sapiens
uuuagaaaaugcaguc

SEQ ID NO: 750698 - RNA, 16 nt, Homo sapiens
uuuagaaaugcaaaau

SEQ ID NO: 750699 - RNA, 13 nt, Homo sapiens
uuuagaaccagcc

SEQ ID NO: 750700 - RNA, 13 nt, Homo sapiens
uuuagagagccug

SEQ ID NO: 750701 - RNA, 18 nt, Homo sapiens
uuuagauuaaacaaacaa

SEQ ID NO: 750702 - RNA, 19 nt, Homo sapiens
uuuagauuaaacaaacaaa

SEQ ID NO: 750703 - RNA, 13 nt, Homo sapiens
uuuagauuguuaa

SEQ ID NO: 750704 - RNA, 13 nt, Homo sapiens
uuuagcagucaga

SEQ ID NO: 750705 - RNA, 19 nt, Homo sapiens
uuuagccacucaaagucaa

SEQ ID NO: 750706 - RNA, 12 nt, Homo sapiens
uuuagggagaac

SEQ ID NO: 750707 - RNA, 13 nt, Homo sapiens
uuuagggcagcuu

SEQ ID NO: 750708 - RNA, 21 nt, Homo sapiens
uuuaguaauauuuuacuuuga

SEQ ID NO: 750709 - RNA, 21 nt, Homo sapiens
uuuaguagagacgggguuuca

SEQ ID NO: 750710 - RNA, 23 nt, Homo sapiens
uuuagucaacaugccauaucuca

SEQ ID NO: 750711 - RNA, 13 nt, Homo sapiens
uuuaguuucauga

SEQ ID NO: 750712 - RNA, 20 nt, Homo sapiens
uuuaguuuuucccucaguga

SEQ ID NO: 750713 - RNA, 14 nt, Homo sapiens
uuuauaaacuacca

SEQ ID NO: 750714 - RNA, 19 nt, Homo sapiens
uuuauaaagauacuaaacc

SEQ ID NO: 750715 - RNA, 21 nt, Homo sapiens
uuuauaacuauuauauuauca

SEQ ID NO: 750716 - RNA, 14 nt, Homo sapiens
uuuauaauacccuu

SEQ ID NO: 750717 - RNA, 10 nt, Homo sapiens
uuuauacaau

SEQ ID NO: 750718 - RNA, 15 nt, Homo sapiens
uuuauacaauguucu

SEQ ID NO: 750719 - RNA, 22 nt, Homo sapiens
uuuauacucuagaacaugcaca

SEQ ID NO: 750720 - RNA, 15 nt, Homo sapiens
uuuauacuguuuacu

SEQ ID NO: 750721 - RNA, 15 nt, Homo sapiens
uuuauacuuugcaau

SEQ ID NO: 750722 - RNA, 16 nt, Homo sapiens
uuuauagaacaguuga

SEQ ID NO: 750723 - RNA, 19 nt, Homo sapiens
uuuauaggacgaaugccaa

SEQ ID NO: 750724 - RNA, 13 nt, Homo sapiens
uuuauauacuuag

SEQ ID NO: 750725 - RNA, 14 nt, Homo sapiens
uuuaucaaaggaga

SEQ ID NO: 750726 - RNA, 14 nt, Homo sapiens
uuuaucaaucagua

SEQ ID NO: 750727 - RNA, 12 nt, Homo sapiens
uuuaucacugaa

SEQ ID NO: 750728 - RNA, 19 nt, Homo sapiens
uuuaucaggcuuucucugg

SEQ ID NO: 750729 - RNA, 17 nt, Homo sapiens
uuuaucaugaagcacau

SEQ ID NO: 750730 - RNA, 17 nt, Homo sapiens
uuuauccaaaaugugua

SEQ ID NO: 750731 - RNA, 13 nt, Homo sapiens
uuuaucugugcaa

SEQ ID NO: 750732 - RNA, 17 nt, Homo sapiens
uuuaucuugucucuggg

SEQ ID NO: 750733 - RNA, 13 nt, Homo sapiens
uuuaugacucuua

SEQ ID NO: 750734 - RNA, 17 nt, Homo sapiens
uuuaugagaaacuuaaa

SEQ ID NO: 750735 - RNA, 12 nt, Homo sapiens
uuuaugcugcug

SEQ ID NO: 750736 - RNA, 22 nt, Homo sapiens
uuuauggaaaaugucaggccuu

SEQ ID NO: 750737 - RNA, 13 nt, Homo sapiens
uuuauggccucag

SEQ ID NO: 750738 - RNA, 17 nt, Homo sapiens
uuuauggcucacuauga

SEQ ID NO: 750739 - RNA, 19 nt, Homo sapiens
uuuauggcucacuaugaau

SEQ ID NO: 750740 - RNA, 19 nt, Homo sapiens
guuaagagaaugcuuugaa

SEQ ID NO: 750741 - RNA, 14 nt, Homo sapiens
guuaaggugugcaa

SEQ ID NO: 750742 - RNA, 18 nt, Homo sapiens
guuaauacuccagagaca

SEQ ID NO: 750743 - RNA, 12 nt, Homo sapiens
guuaaugucauu

SEQ ID NO: 750744 - RNA, 17 nt, Homo sapiens
guuaauguuauaucaua

SEQ ID NO: 750745 - RNA, 13 nt, Homo sapiens
guuaauguuuauu

SEQ ID NO: 750746 - RNA, 18 nt, Homo sapiens
guuaauuacaacugcuau

SEQ ID NO: 750747 - RNA, 14 nt, Homo sapiens
guuacaaguuuaua

SEQ ID NO: 750748 - RNA, 16 nt, Homo sapiens
guuacacagcccaaga

SEQ ID NO: 750749 - RNA, 21 nt, Homo sapiens
guuacagugaugcugugcuau

SEQ ID NO: 750750 - RNA, 17 nt, Homo sapiens
guuacauugucauuuau

SEQ ID NO: 750751 - RNA, 10 nt, Homo sapiens
guuacauuuc

SEQ ID NO: 750752 - RNA, 13 nt, Homo sapiens
guuaccacuacuu

SEQ ID NO: 750753 - RNA, 12 nt, Homo sapiens
guuaccauucac

SEQ ID NO: 750754 - RNA, 16 nt, Homo sapiens
guuaccauucacaaua

SEQ ID NO: 750755 - RNA, 13 nt, Homo sapiens
guuacccauucaa

SEQ ID NO: 750756 - RNA, 14 nt, Homo sapiens
guuacgaagacaaa

SEQ ID NO: 750757 - RNA, 19 nt, Homo sapiens
guuacuccauuacugugau

SEQ ID NO: 750758 - RNA, 21 nt, Homo sapiens
guuacugcuugaccaaagagc

SEQ ID NO: 750759 - RNA, 24 nt, Homo sapiens
guuacuggcuucucuugagucaca

SEQ ID NO: 750760 - RNA, 17 nt, Homo sapiens
guuacuguugcacugau

SEQ ID NO: 750761 - RNA, 12 nt, Homo sapiens
guuacuuuacag

SEQ ID NO: 750762 - RNA, 21 nt, Homo sapiens
guuagaaaauggacacugugc

SEQ ID NO: 750763 - RNA, 20 nt, Homo sapiens
guuaggaggugcagacacuu

SEQ ID NO: 750764 - RNA, 13 nt, Homo sapiens
guuaggaguuaau

SEQ ID NO: 750765 - RNA, 20 nt, Homo sapiens
guuaggcauuuccugcugaa

SEQ ID NO: 750766 - RNA, 15 nt, Homo sapiens
guuaggguguguguu

SEQ ID NO: 750767 - RNA, 23 nt, Homo sapiens
guuagucaauccugucauauaau

SEQ ID NO: 750768 - RNA, 21 nt, Homo sapiens
guuaguugugaaagaaagcug

SEQ ID NO: 750769 - RNA, 23 nt, Homo sapiens
guuaguugugaaagaaagcugag

SEQ ID NO: 750770 - RNA, 18 nt, Homo sapiens
guuauaaaucaaugucac

SEQ ID NO: 750771 - RNA, 23 nt, Homo sapiens
guuauaaaucaaugucacuuaaa

SEQ ID NO: 750772 - RNA, 18 nt, Homo sapiens
guuauaucauauguauau

SEQ ID NO: 750773 - RNA, 12 nt, Homo sapiens
guuaucaagcaa

SEQ ID NO: 750774 - RNA, 17 nt, Homo sapiens
guuaucagugcuucccg

SEQ ID NO: 750775 - RNA, 22 nt, Homo sapiens
guuauccugcuagcuguagaaa

SEQ ID NO: 750776 - RNA, 20 nt, Homo sapiens
guuaucugucugcauuuuaa

SEQ ID NO: 750777 - RNA, 13 nt, Homo sapiens
guuaugaacaaag

SEQ ID NO: 750778 - RNA, 20 nt, Homo sapiens
guuaugcauagcuuugcacu

SEQ ID NO: 750779 - RNA, 18 nt, Homo sapiens
guuauguguuuagaauca

SEQ ID NO: 750780 - RNA, 15 nt, Homo sapiens
guuauguucagucac

SEQ ID NO: 750781 - RNA, 15 nt, Homo sapiens
guuauguuugcacuu

SEQ ID NO: 750782 - RNA, 16 nt, Homo sapiens
guuauguuugcacuuu

SEQ ID NO: 750783 - RNA, 19 nt, Homo sapiens
guuauuaauuaauauucau

SEQ ID NO: 750784 - RNA, 14 nt, Homo sapiens
guuauuacuuguaa

SEQ ID NO: 750785 - RNA, 21 nt, Homo sapiens
guuauucauuuggugacugug

SEQ ID NO: 750786 - RNA, 19 nt, Homo sapiens
guuauugccucugaaaugc

SEQ ID NO: 750787 - RNA, 19 nt, Homo sapiens
guuauugcuggugcaaaga

SEQ ID NO: 750788 - RNA, 19 nt, Homo sapiens
guuauuuagggaacugcuu

SEQ ID NO: 750789 - RNA, 21 nt, Homo sapiens
guuauuucagcccccaucacc

SEQ ID NO: 750790 - RNA, 15 nt, Homo sapiens
guuauuuccugagaa

SEQ ID NO: 750791 - RNA, 22 nt, Homo sapiens
guuauuugaaaauuugauuuug

SEQ ID NO: 750792 - RNA, 23 nt, Homo sapiens
guuauuugaaaauuugauuuuga

SEQ ID NO: 750793 - RNA, 14 nt, Homo sapiens
guuauuuuccauuu

SEQ ID NO: 750794 - RNA, 19 nt, Homo sapiens
guuauuuugcuauuugccu

SEQ ID NO: 750795 - RNA, 20 nt, Homo sapiens
guucaaaaaacucuugauau

SEQ ID NO: 750796 - RNA, 15 nt, Homo sapiens
guugucgaacaguag

SEQ ID NO: 750797 - RNA, 19 nt, Homo sapiens
guugugccaaagugcauag

SEQ ID NO: 750798 - RNA, 16 nt, Homo sapiens
guuguggaugcuccag

SEQ ID NO: 750799 - RNA, 17 nt, Homo sapiens
guugugugucaugccag

SEQ ID NO: 750800 - RNA, 16 nt, Homo sapiens
guuguguugucacuaa

SEQ ID NO: 750801 - RNA, 20 nt, Homo sapiens
guuguuaaugaaaaugucag

SEQ ID NO: 750802 - RNA, 10 nt, Homo sapiens
guuguucauu

SEQ ID NO: 750803 - RNA, 23 nt, Homo sapiens
guuguucucuucuuuaaagggau

SEQ ID NO: 750804 - RNA, 23 nt, Homo sapiens
guuguucugcucaauacaucuca

SEQ ID NO: 750805 - RNA, 13 nt, Homo sapiens
guuguuuacuuaa

SEQ ID NO: 750806 - RNA, 11 nt, Homo sapiens
guuguuugcaa

SEQ ID NO: 750807 - RNA, 14 nt, Homo sapiens
guuuaaacccaagu

SEQ ID NO: 750808 - RNA, 20 nt, Homo sapiens
guuuaaagauuucaagaaga

SEQ ID NO: 750809 - RNA, 14 nt, Homo sapiens
guuuaaagucacau

SEQ ID NO: 750810 - RNA, 22 nt, Homo sapiens
guuuaaagucucaguuucuugc

SEQ ID NO: 750811 - RNA, 15 nt, Homo sapiens
guuuaaauagccuaa

SEQ ID NO: 750812 - RNA, 17 nt, Homo sapiens
guuuaaauaugaaugaa

SEQ ID NO: 750813 - RNA, 22 nt, Homo sapiens
guuuacaaguaaauaguuugaa

SEQ ID NO: 750814 - RNA, 21 nt, Homo sapiens
guuuacccaguauuccauuuu

SEQ ID NO: 750815 - RNA, 15 nt, Homo sapiens
guuuaccucuucuau

SEQ ID NO: 750816 - RNA, 19 nt, Homo sapiens
guuuaccucuucuaugcaa

SEQ ID NO: 750817 - RNA, 14 nt, Homo sapiens
guuuaccuuuuaau

SEQ ID NO: 750818 - RNA, 21 nt, Homo sapiens
guuuacuucaaauuaacucua

SEQ ID NO: 750819 - RNA, 20 nt, Homo sapiens
guuuaggaucaucucugcag

SEQ ID NO: 750820 - RNA, 17 nt, Homo sapiens
guuuauaucuccuuugu

SEQ ID NO: 750821 - RNA, 14 nt, Homo sapiens
guuuaucacacagu

SEQ ID NO: 750822 - RNA, 22 nt, Homo sapiens
guuuaucugugggaauguggua

SEQ ID NO: 750823 - RNA, 19 nt, Homo sapiens
guuuaugauauuucuugcu

SEQ ID NO: 750824 - RNA, 16 nt, Homo sapiens
guuuauuaacuacuga

SEQ ID NO: 750825 - RNA, 18 nt, Homo sapiens
guuuauuuccaucuguau

SEQ ID NO: 750826 - RNA, 22 nt, Homo sapiens
guuuauuuuagaggaacucuca

SEQ ID NO: 750827 - RNA, 19 nt, Homo sapiens
guuuauuuuuccacuauua

SEQ ID NO: 750828 - RNA, 17 nt, Homo sapiens
guuucaccguguuagcc

SEQ ID NO: 750829 - RNA, 23 nt, Homo sapiens
guuucacuacaaucgcuaccuga

SEQ ID NO: 750830 - RNA, 16 nt, Homo sapiens
guuucacuguacugca

SEQ ID NO: 750831 - RNA, 19 nt, Homo sapiens
guuucacuguguuagccag

SEQ ID NO: 750832 - RNA, 13 nt, Homo sapiens
guuuccaguggau

SEQ ID NO: 750833 - RNA, 17 nt, Homo sapiens
guuucccguauugacag

SEQ ID NO: 750834 - RNA, 20 nt, Homo sapiens
guuucccuccuuggauuucu

SEQ ID NO: 750835 - RNA, 12 nt, Homo sapiens
guuuccugguca

SEQ ID NO: 750836 - RNA, 17 nt, Homo sapiens
guuuccuucugacuuaa

SEQ ID NO: 750837 - RNA, 22 nt, Homo sapiens
guuucuaauaaagaaagcagcu

SEQ ID NO: 750838 - RNA, 20 nt, Homo sapiens
guuucuagcuagaaauauga

SEQ ID NO: 750839 - RNA, 18 nt, Homo sapiens
guuucucaaacugagcuu

SEQ ID NO: 750840 - RNA, 15 nt, Homo sapiens
guuucucugcuguca

SEQ ID NO: 750841 - RNA, 14 nt, Homo sapiens
guuucugcuucauu

SEQ ID NO: 750842 - RNA, 23 nt, Homo sapiens
guuucuggacauucucuuugaua

SEQ ID NO: 750843 - RNA, 17 nt, Homo sapiens
guuucugggcggccagu

SEQ ID NO: 750844 - RNA, 19 nt, Homo sapiens
guuucuggggaugucccag

SEQ ID NO: 750845 - RNA, 22 nt, Homo sapiens
guuucuguauacaacccuggca

SEQ ID NO: 750846 - RNA, 13 nt, Homo sapiens
guuucugugaaau

SEQ ID NO: 750847 - RNA, 24 nt, Homo sapiens
guuucuugccugaacuccugccau

SEQ ID NO: 750848 - RNA, 15 nt, Homo sapiens
guuucuugugggcua

SEQ ID NO: 750849 - RNA, 18 nt, Homo sapiens
guuugaaaauaugccugc

SEQ ID NO: 750850 - RNA, 22 nt, Homo sapiens
guuugaagaugccgcauuugga

SEQ ID NO: 750851 - RNA, 23 nt, Homo sapiens
guuugaaucuacauucacuuuuu

SEQ ID NO: 750852 - RNA, 22 nt, Homo sapiens
guuugacacaccauuauauuua

SEQ ID NO: 750853 - RNA, 18 nt, Homo sapiens
guuugacacgaagccuua

SEQ ID NO: 750854 - RNA, 15 nt, Homo sapiens
uuucucuguauagua

SEQ ID NO: 750855 - RNA, 18 nt, Homo sapiens
uuucucuugaagaacuga

SEQ ID NO: 750856 - RNA, 19 nt, Homo sapiens
uuucucuugaagaacugac

SEQ ID NO: 750857 - RNA, 12 nt, Homo sapiens
uuucugaacaau

SEQ ID NO: 750858 - RNA, 15 nt, Homo sapiens
uuucugaacucugac

SEQ ID NO: 750859 - RNA, 19 nt, Homo sapiens
uuucugaacuguuacaacu

SEQ ID NO: 750860 - RNA, 22 nt, Homo sapiens
uuucugauuagagugcaaaagu

SEQ ID NO: 750861 - RNA, 17 nt, Homo sapiens
uuucugcaaacaccaac

SEQ ID NO: 750862 - RNA, 17 nt, Homo sapiens
uuucugcauagagucuu

SEQ ID NO: 750863 - RNA, 18 nt, Homo sapiens
uuucuggaaaacugccuu

SEQ ID NO: 750864 - RNA, 15 nt, Homo sapiens
uuucuggccugccuu

SEQ ID NO: 750865 - RNA, 12 nt, Homo sapiens
uuucuggcucuu

SEQ ID NO: 750866 - RNA, 12 nt, Homo sapiens
uuucugggaccc

SEQ ID NO: 750867 - RNA, 23 nt, Homo sapiens
uuucuggggaaagacacugccug

SEQ ID NO: 750868 - RNA, 21 nt, Homo sapiens
uuucugggucuuuugcuacua

SEQ ID NO: 750869 - RNA, 23 nt, Homo sapiens
uuucuguaauguaaauaaacuau

SEQ ID NO: 750870 - RNA, 15 nt, Homo sapiens
uuucugugcagagau

SEQ ID NO: 750871 - RNA, 22 nt, Homo sapiens
uuucuguggucuuacugaucuu

SEQ ID NO: 750872 - RNA, 14 nt, Homo sapiens
uuucuuacauuagc

SEQ ID NO: 750873 - RNA, 15 nt, Homo sapiens
uuucuucagagacag

SEQ ID NO: 750874 - RNA, 16 nt, Homo sapiens
uuucuucaugcaauga

SEQ ID NO: 750875 - RNA, 12 nt, Homo sapiens
uuucuuccugca

SEQ ID NO: 750876 - RNA, 23 nt, Homo sapiens
uuucuucuacugcuaucuacuac

SEQ ID NO: 750877 - RNA, 22 nt, Homo sapiens
uuucuugaacauacuugguuuc

SEQ ID NO: 750878 - RNA, 22 nt, Homo sapiens
uuucuugcuggauuauugcuua

SEQ ID NO: 750879 - RNA, 19 nt, Homo sapiens
uuucuugcuuggaagccag

SEQ ID NO: 750880 - RNA, 17 nt, Homo sapiens
uuucuuggauuaccaau

SEQ ID NO: 750881 - RNA, 14 nt, Homo sapiens
uuucuuuaucauug

SEQ ID NO: 750882 - RNA, 14 nt, Homo sapiens
uuucuuuucacaua

SEQ ID NO: 750883 - RNA, 16 nt, Homo sapiens
uuucuuuuuacagcau

SEQ ID NO: 750884 - RNA, 22 nt, Homo sapiens
uuucuuuuuacuguugaacuua

SEQ ID NO: 750885 - RNA, 23 nt, Homo sapiens
uuugaaaaaugagagcuguaacu

SEQ ID NO: 750886 - RNA, 19 nt, Homo sapiens
uuugaaagcuuauuugaua

SEQ ID NO: 750887 - RNA, 14 nt, Homo sapiens
uuugaaaguauaau

SEQ ID NO: 750888 - RNA, 20 nt, Homo sapiens
uuugaaaucaaugcaagagu

SEQ ID NO: 750889 - RNA, 18 nt, Homo sapiens
uuugaaaugaauuccuca

SEQ ID NO: 750890 - RNA, 13 nt, Homo sapiens
uuugaaaugcacc

SEQ ID NO: 750891 - RNA, 13 nt, Homo sapiens
uuugaaaugucau

SEQ ID NO: 750892 - RNA, 16 nt, Homo sapiens
uuugaaccaacaucuu

SEQ ID NO: 750893 - RNA, 19 nt, Homo sapiens
uuugaacccuugcuugcaa

SEQ ID NO: 750894 - RNA, 20 nt, Homo sapiens
uuugaagcagucuugcucug

SEQ ID NO: 750895 - RNA, 14 nt, Homo sapiens
uuugaaggcuuuag

SEQ ID NO: 750896 - RNA, 17 nt, Homo sapiens
uuugaaucuacauucac

SEQ ID NO: 750897 - RNA, 19 nt, Homo sapiens
uuugaauggaaaacacaug

SEQ ID NO: 750898 - RNA, 21 nt, Homo sapiens
uuugaauguuaagcagaugga

SEQ ID NO: 750899 - RNA, 19 nt, Homo sapiens
uuugacaaaacccacuguu

SEQ ID NO: 750900 - RNA, 18 nt, Homo sapiens
uuugacaacaauccaaaa

SEQ ID NO: 750901 - RNA, 19 nt, Homo sapiens
uuugacaacaauccaaaaa

SEQ ID NO: 750902 - RNA, 14 nt, Homo sapiens
uuugacaaccauga

SEQ ID NO: 750903 - RNA, 17 nt, Homo sapiens
uuugaccuucagagcca

SEQ ID NO: 750904 - RNA, 18 nt, Homo sapiens
uuugagaaguucucagaa

SEQ ID NO: 750905 - RNA, 14 nt, Homo sapiens
uuugagaaugguua

SEQ ID NO: 750906 - RNA, 18 nt, Homo sapiens
uuugagacaaagucucac

SEQ ID NO: 750907 - RNA, 22 nt, Homo sapiens
uuugagacaacaguacauauaa

SEQ ID NO: 750908 - RNA, 17 nt, Homo sapiens
uuugagagaaauaugaa

SEQ ID NO: 750909 - RNA, 20 nt, Homo sapiens
uuugagauuaagaaugccag

SEQ ID NO: 750910 - RNA, 18 nt, Homo sapiens
cagaaucuccaucccuga

SEQ ID NO: 750911 - RNA, 18 nt, Homo sapiens
cagaaucugcuguugcca

SEQ ID NO: 750912 - RNA, 17 nt, Homo sapiens
cagaaugcuauuucacu

SEQ ID NO: 750913 - RNA, 18 nt, Homo sapiens
cagaauuaacuauaacaa

SEQ ID NO: 750914 - RNA, 14 nt, Homo sapiens
cagaauuaagugga

SEQ ID NO: 750915 - RNA, 12 nt, Homo sapiens
cagaauucccuu

SEQ ID NO: 750916 - RNA, 19 nt, Homo sapiens
cagaauucucccagcguua

SEQ ID NO: 750917 - RNA, 15 nt, Homo sapiens
cagaauugagaguga

SEQ ID NO: 750918 - RNA, 19 nt, Homo sapiens
cagaauuugauucguauga

SEQ ID NO: 750919 - RNA, 20 nt, Homo sapiens
cagaauuugauuuugaacuu

SEQ ID NO: 750920 - RNA, 15 nt, Homo sapiens
cagacaaaugugguu

SEQ ID NO: 750921 - RNA, 15 nt, Homo sapiens
cagacaagugacugu

SEQ ID NO: 750922 - RNA, 15 nt, Homo sapiens
cagacaccaugugca

SEQ ID NO: 750923 - RNA, 16 nt, Homo sapiens
cagacacuaaguuaua

SEQ ID NO: 750924 - RNA, 15 nt, Homo sapiens
cagacagauugcuga

SEQ ID NO: 750925 - RNA, 12 nt, Homo sapiens
cagacaggugug

SEQ ID NO: 750926 - RNA, 22 nt, Homo sapiens
cagacauacauuuaugcacauu

SEQ ID NO: 750927 - RNA, 17 nt, Homo sapiens
cagacauguggugggac

SEQ ID NO: 750928 - RNA, 13 nt, Homo sapiens
cagacauugcucu

SEQ ID NO: 750929 - RNA, 18 nt, Homo sapiens
cagacauuuucacuggaa

SEQ ID NO: 750930 - RNA, 16 nt, Homo sapiens
cagaccaccuuucaca

SEQ ID NO: 750931 - RNA, 18 nt, Homo sapiens
cagaccccacgcugacca

SEQ ID NO: 750932 - RNA, 20 nt, Homo sapiens
cagacccccacucucauucc

SEQ ID NO: 750933 - RNA, 20 nt, Homo sapiens
cagaccgugaccaucuuugu

SEQ ID NO: 750934 - RNA, 13 nt, Homo sapiens
cagaccucaugcc

SEQ ID NO: 750935 - RNA, 16 nt, Homo sapiens
cagaccugucgucucu

SEQ ID NO: 750936 - RNA, 20 nt, Homo sapiens
cagaccugugugugccucca

SEQ ID NO: 750937 - RNA, 23 nt, Homo sapiens
cagacggcggccaggcacagggc

SEQ ID NO: 750938 - RNA, 21 nt, Homo sapiens
cagacgggcacacagacugga

SEQ ID NO: 750939 - RNA, 16 nt, Homo sapiens
cagacgggcacagugg

SEQ ID NO: 750940 - RNA, 19 nt, Homo sapiens
cagacgggucugagacuga

SEQ ID NO: 750941 - RNA, 20 nt, Homo sapiens
cagacgggucugagacugaa

SEQ ID NO: 750942 - RNA, 17 nt, Homo sapiens
cagacgguucaccagcc

SEQ ID NO: 750943 - RNA, 14 nt, Homo sapiens
cagacucccauucc

SEQ ID NO: 750944 - RNA, 16 nt, Homo sapiens
cagacuccugugcaac

SEQ ID NO: 750945 - RNA, 18 nt, Homo sapiens
cagacuccugugcaacuu

SEQ ID NO: 750946 - RNA, 20 nt, Homo sapiens
cagacugaacucgcagggaa

SEQ ID NO: 750947 - RNA, 18 nt, Homo sapiens
cagacuggucuugaacuc

SEQ ID NO: 750948 - RNA, 16 nt, Homo sapiens
cagacuucaucuucaa

SEQ ID NO: 750949 - RNA, 15 nt, Homo sapiens
cagacuuccuugaga

SEQ ID NO: 750950 - RNA, 18 nt, Homo sapiens
cagacuugcacugaagcc

SEQ ID NO: 750951 - RNA, 21 nt, Homo sapiens
cagacuugccaggcucccuuu

SEQ ID NO: 750952 - RNA, 22 nt, Homo sapiens
cagacuuggacuaugauuaucu

SEQ ID NO: 750953 - RNA, 22 nt, Homo sapiens
cagacuuggcucagcucgggga

SEQ ID NO: 750954 - RNA, 15 nt, Homo sapiens
cagacuuuuguguaa

SEQ ID NO: 750955 - RNA, 21 nt, Homo sapiens
cagacuuuuguguaaaaagca

SEQ ID NO: 750956 - RNA, 19 nt, Homo sapiens
cagagaaauacuuucaggc

SEQ ID NO: 750957 - RNA, 11 nt, Homo sapiens
cagagaaccau

SEQ ID NO: 750958 - RNA, 23 nt, Homo sapiens
cagagaagcuccugcuacuuccc

SEQ ID NO: 750959 - RNA, 18 nt, Homo sapiens
cagagaauauauacauuc

SEQ ID NO: 750960 - RNA, 20 nt, Homo sapiens
cagagaauucucuuauccaa

SEQ ID NO: 750961 - RNA, 23 nt, Homo sapiens
cagagacacuuugucuaguguau

SEQ ID NO: 750962 - RNA, 16 nt, Homo sapiens
cagagacaggaaaauc

SEQ ID NO: 750963 - RNA, 16 nt, Homo sapiens
cagagaccauugcaau

SEQ ID NO: 750964 - RNA, 18 nt, Homo sapiens
cagagacccaagcugccu

SEQ ID NO: 750965 - RNA, 18 nt, Homo sapiens
cagagacccagaucucau

SEQ ID NO: 750966 - RNA, 21 nt, Homo sapiens
cagagaccuugccacacugaa

SEQ ID NO: 750967 - RNA, 14 nt, Homo sapiens
cagagacuaucuga

SEQ ID NO: 750968 - RNA, 16 nt, Homo sapiens
cagagacuaucugauu

SEQ ID NO: 750969 - RNA, 20 nt, Homo sapiens
cagagacuaucugauuuccu

SEQ ID NO: 750970 - RNA, 19 nt, Homo sapiens
cagagagacccgggaagga

SEQ ID NO: 750971 - RNA, 19 nt, Homo sapiens
cagagagaccucauccugc

SEQ ID NO: 750972 - RNA, 23 nt, Homo sapiens
cagagagcagcuucagugacaaa

SEQ ID NO: 750973 - RNA, 20 nt, Homo sapiens
cagagagguggggauccugc

SEQ ID NO: 750974 - RNA, 14 nt, Homo sapiens
cagagaugacuguc

SEQ ID NO: 750975 - RNA, 18 nt, Homo sapiens
cagagcaagacugucuca

SEQ ID NO: 750976 - RNA, 19 nt, Homo sapiens
cagagcaggcaauuucacc

SEQ ID NO: 750977 - RNA, 15 nt, Homo sapiens
cagagcauacaacag

SEQ ID NO: 750978 - RNA, 21 nt, Homo sapiens
cagagcauugcuauuuaucuc

SEQ ID NO: 750979 - RNA, 23 nt, Homo sapiens
cagagcauuuccaacaccacaga

SEQ ID NO: 750980 - RNA, 18 nt, Homo sapiens
cagagccaagcacugcuc

SEQ ID NO: 750981 - RNA, 11 nt, Homo sapiens
cagagccacag

SEQ ID NO: 750982 - RNA, 14 nt, Homo sapiens
cagagccagucuca

SEQ ID NO: 750983 - RNA, 19 nt, Homo sapiens
cagagccuucaagugccaa

SEQ ID NO: 750984 - RNA, 16 nt, Homo sapiens
cagagcgcacagggag

SEQ ID NO: 750985 - RNA, 23 nt, Homo sapiens
cagagcggaaggagggagcucug

SEQ ID NO: 750986 - RNA, 15 nt, Homo sapiens
cagagcuacugagac

SEQ ID NO: 750987 - RNA, 23 nt, Homo sapiens
cagagcucaagauucagacucca

SEQ ID NO: 750988 - RNA, 20 nt, Homo sapiens
cagagcucuggguugugcac

SEQ ID NO: 750989 - RNA, 21 nt, Homo sapiens
cagagcucuggguugugcaca

SEQ ID NO: 750990 - RNA, 15 nt, Homo sapiens
cagaggaacaagcau

SEQ ID NO: 750991 - RNA, 23 nt, Homo sapiens
cagaggaauaacaucaccacugu

SEQ ID NO: 750992 - RNA, 16 nt, Homo sapiens
cagaggaauccuggca

SEQ ID NO: 750993 - RNA, 13 nt, Homo sapiens
cagaggacaguau

SEQ ID NO: 750994 - RNA, 19 nt, Homo sapiens
cagaggacuuuauucggac

SEQ ID NO: 750995 - RNA, 19 nt, Homo sapiens
cagaggcaguaaccaugcc

SEQ ID NO: 750996 - RNA, 15 nt, Homo sapiens
cagaggccauggcag

SEQ ID NO: 750997 - RNA, 20 nt, Homo sapiens
cagaggcuaauucaguguca

SEQ ID NO: 750998 - RNA, 14 nt, Homo sapiens
cagagggacuguca

SEQ ID NO: 750999 - RNA, 14 nt, Homo sapiens
cagagggauaaaaa

SEQ ID NO: 751000 - RNA, 17 nt, Homo sapiens
cagagggcaguggcccu

SEQ ID NO: 751001 - RNA, 18 nt, Homo sapiens
cagagggccauugaacuc

SEQ ID NO: 751002 - RNA, 23 nt, Homo sapiens
cagagggccccgcccagugcagu

SEQ ID NO: 751003 - RNA, 17 nt, Homo sapiens
cagaggggcucagguca

SEQ ID NO: 751004 - RNA, 19 nt, Homo sapiens
cagaggguggcuggaguga

SEQ ID NO: 751005 - RNA, 14 nt, Homo sapiens
cagaggugcagcug

SEQ ID NO: 751006 - RNA, 16 nt, Homo sapiens
cagaggugcagcugga

SEQ ID NO: 751007 - RNA, 15 nt, Homo sapiens
cagaggugucaucca

SEQ ID NO: 751008 - RNA, 18 nt, Homo sapiens
cagagguuguagugagcc

SEQ ID NO: 751009 - RNA, 16 nt, Homo sapiens
cagagguuugcuuccu

SEQ ID NO: 751010 - RNA, 17 nt, Homo sapiens
cagagguuugcuuccuc

SEQ ID NO: 751011 - RNA, 13 nt, Homo sapiens
cagagucaucuga

SEQ ID NO: 751012 - RNA, 22 nt, Homo sapiens
cagagucugccccacauguggc

SEQ ID NO: 751013 - RNA, 19 nt, Homo sapiens
cagagucuucagagacuuc

SEQ ID NO: 751014 - RNA, 16 nt, Homo sapiens
cagagugagagacauc

SEQ ID NO: 751015 - RNA, 21 nt, Homo sapiens
cagagugagcaagggggccca

SEQ ID NO: 751016 - RNA, 22 nt, Homo sapiens
cagagugagcaagggggcccaa

SEQ ID NO: 751017 - RNA, 12 nt, Homo sapiens
cagagugcaacc

SEQ ID NO: 751018 - RNA, 13 nt, Homo sapiens
cagagugccacug

SEQ ID NO: 751019 - RNA, 24 nt, Homo sapiens
cagaguggaguugaaacugcuaua

SEQ ID NO: 751020 - RNA, 16 nt, Homo sapiens
cagaguggggagcucc

SEQ ID NO: 751021 - RNA, 23 nt, Homo sapiens
cagagugggucuuggaccagggc

SEQ ID NO: 751022 - RNA, 23 nt, Homo sapiens
cagaguuggggagauaaaggaac

SEQ ID NO: 751023 - RNA, 18 nt, Homo sapiens
cagaguuguacacugugu

SEQ ID NO: 751024 - RNA, 12 nt, Homo sapiens
cagcuucaugaa

SEQ ID NO: 751025 - RNA, 21 nt, Homo sapiens
cagcuucugauaaacacaauc

SEQ ID NO: 751026 - RNA, 23 nt, Homo sapiens
cagcuucuggggguagaucucaa

SEQ ID NO: 751027 - RNA, 17 nt, Homo sapiens
cagcuucuucacaggca

SEQ ID NO: 751028 - RNA, 21 nt, Homo sapiens
cagcuugagcugccucugaga

SEQ ID NO: 751029 - RNA, 16 nt, Homo sapiens
cagcuugcacauuugg

SEQ ID NO: 751030 - RNA, 22 nt, Homo sapiens
cagcuugggaauccugcuaaag

SEQ ID NO: 751031 - RNA, 20 nt, Homo sapiens
cagcuuuccucaucaggcca

SEQ ID NO: 751032 - RNA, 13 nt, Homo sapiens
cagcuuucuggga

SEQ ID NO: 751033 - RNA, 21 nt, Homo sapiens
cagcuuuuagaaaaugcaguc

SEQ ID NO: 751034 - RNA, 17 nt, Homo sapiens
caggaaaacaaaucacu

SEQ ID NO: 751035 - RNA, 13 nt, Homo sapiens
caggaaaagccau

SEQ ID NO: 751036 - RNA, 19 nt, Homo sapiens
caggaaaauguauugauuc

SEQ ID NO: 751037 - RNA, 14 nt, Homo sapiens
caggaaaccaacac

SEQ ID NO: 751038 - RNA, 20 nt, Homo sapiens
caggaaaccaacacccaaag

SEQ ID NO: 751039 - RNA, 22 nt, Homo sapiens
caggaaaccuuggccucugcua

SEQ ID NO: 751040 - RNA, 20 nt, Homo sapiens
caggaaaguuuacccaugaa

SEQ ID NO: 751041 - RNA, 15 nt, Homo sapiens
caggaacagaaggau

SEQ ID NO: 751042 - RNA, 14 nt, Homo sapiens
caggaagacugaca

SEQ ID NO: 751043 - RNA, 21 nt, Homo sapiens
caggaagcucagccuucuccu

SEQ ID NO: 751044 - RNA, 20 nt, Homo sapiens
caggaaggaacaaagacagg

SEQ ID NO: 751045 - RNA, 20 nt, Homo sapiens
caggaagggagaacuugaaa

SEQ ID NO: 751046 - RNA, 21 nt, Homo sapiens
caggaagggggccgacuccac

SEQ ID NO: 751047 - RNA, 15 nt, Homo sapiens
caggaagguagaaau

SEQ ID NO: 751048 - RNA, 22 nt, Homo sapiens
caggaagguagcccagcacugu

SEQ ID NO: 751049 - RNA, 19 nt, Homo sapiens
caggaauccccaacaugca

SEQ ID NO: 751050 - RNA, 18 nt, Homo sapiens
caggaauccuuacugaua

SEQ ID NO: 751051 - RNA, 19 nt, Homo sapiens
caggaauggcuugccuaag

SEQ ID NO: 751052 - RNA, 18 nt, Homo sapiens
caggacacacauggugag

SEQ ID NO: 751053 - RNA, 23 nt, Homo sapiens
caggacaccagccuggugcccau

SEQ ID NO: 751054 - RNA, 21 nt, Homo sapiens
caggacacgacuuguaaugaa

SEQ ID NO: 751055 - RNA, 16 nt, Homo sapiens
caggacagaugccaca

SEQ ID NO: 751056 - RNA, 19 nt, Homo sapiens
caggacagaugccacacaa

SEQ ID NO: 751057 - RNA, 12 nt, Homo sapiens
caggaccagcug

SEQ ID NO: 751058 - RNA, 16 nt, Homo sapiens
caggacuccccaggag

SEQ ID NO: 751059 - RNA, 18 nt, Homo sapiens
caggacuccccaggagca

SEQ ID NO: 751060 - RNA, 18 nt, Homo sapiens
caggacugugccugaaca

SEQ ID NO: 751061 - RNA, 11 nt, Homo sapiens
caggacugugu

SEQ ID NO: 751062 - RNA, 14 nt, Homo sapiens
caggagaagaacaa

SEQ ID NO: 751063 - RNA, 15 nt, Homo sapiens
caggagaagcucagc

SEQ ID NO: 751064 - RNA, 14 nt, Homo sapiens
caggagaagggaua

SEQ ID NO: 751065 - RNA, 15 nt, Homo sapiens
caggagaaucacuug

SEQ ID NO: 751066 - RNA, 19 nt, Homo sapiens
caggagaauggugugaacc

SEQ ID NO: 751067 - RNA, 14 nt, Homo sapiens
caggagaguagcaa

SEQ ID NO: 751068 - RNA, 18 nt, Homo sapiens
caggagagugugugggca

SEQ ID NO: 751069 - RNA, 21 nt, Homo sapiens
caggagcagcagccagcacca

SEQ ID NO: 751070 - RNA, 15 nt, Homo sapiens
caggagccaccagca

SEQ ID NO: 751071 - RNA, 20 nt, Homo sapiens
caggaggcagacaaugaccc

SEQ ID NO: 751072 - RNA, 21 nt, Homo sapiens
caggagggugacgcccagcuc

SEQ ID NO: 751073 - RNA, 23 nt, Homo sapiens
caggaggucugguccgagucuca

SEQ ID NO: 751074 - RNA, 20 nt, Homo sapiens
caggagguggagguugcagu

SEQ ID NO: 751075 - RNA, 22 nt, Homo sapiens
caggagguggagguugcaguga

SEQ ID NO: 751076 - RNA, 21 nt, Homo sapiens
caggaggugugauuccugaag

SEQ ID NO: 751077 - RNA, 20 nt, Homo sapiens
caggagguuguggaugcucc

SEQ ID NO: 751078 - RNA, 20 nt, Homo sapiens
caggagucugccacuuguca

SEQ ID NO: 751079 - RNA, 22 nt, Homo sapiens
caggaguguaguuggaucucua

SEQ ID NO: 751080 - RNA, 17 nt, Homo sapiens
caggaguucaagaccag

SEQ ID NO: 751081 - RNA, 16 nt, Homo sapiens
caggaguugugucuag

SEQ ID NO: 751082 - RNA, 19 nt, Homo sapiens
caggauaaaaggggaaaua

SEQ ID NO: 751083 - RNA, 13 nt, Homo sapiens
caggauauugaca

SEQ ID NO: 751084 - RNA, 13 nt, Homo sapiens
caggaugcacauu

SEQ ID NO: 751085 - RNA, 15 nt, Homo sapiens
caggaugcugugaua

SEQ ID NO: 751086 - RNA, 14 nt, Homo sapiens
caggauggugggca

SEQ ID NO: 751087 - RNA, 18 nt, Homo sapiens
caggauguguggcucauu

SEQ ID NO: 751088 - RNA, 15 nt, Homo sapiens
caggauguucaggga

SEQ ID NO: 751089 - RNA, 12 nt, Homo sapiens
caggauugaaaa

SEQ ID NO: 751090 - RNA, 15 nt, Homo sapiens
caggauugaucauuc

SEQ ID NO: 751091 - RNA, 24 nt, Homo sapiens
caggcaacgugcgugucucugcca

SEQ ID NO: 751092 - RNA, 17 nt, Homo sapiens
caggcaaggaugucuga

SEQ ID NO: 751093 - RNA, 12 nt, Homo sapiens
caggcacagggc

SEQ ID NO: 751094 - RNA, 17 nt, Homo sapiens
caggcacccucccaguu

SEQ ID NO: 751095 - RNA, 12 nt, Homo sapiens
caggcaccucac

SEQ ID NO: 751096 - RNA, 19 nt, Homo sapiens
caggcaccucuuccuugau

SEQ ID NO: 751097 - RNA, 23 nt, Homo sapiens
caggcacgaacccaccugcugag

SEQ ID NO: 751098 - RNA, 12 nt, Homo sapiens
caggcacgggug

SEQ ID NO: 751099 - RNA, 12 nt, Homo sapiens
caggcacuccaa

SEQ ID NO: 751100 - RNA, 19 nt, Homo sapiens
caggcacuccaaaccuguc

SEQ ID NO: 751101 - RNA, 14 nt, Homo sapiens
caggcacuccugga

SEQ ID NO: 751102 - RNA, 17 nt, Homo sapiens
caggcacuguucaucuc

SEQ ID NO: 751103 - RNA, 20 nt, Homo sapiens
caggcacuguucaucucagc

SEQ ID NO: 751104 - RNA, 17 nt, Homo sapiens
caggcagccucugucag

SEQ ID NO: 751105 - RNA, 15 nt, Homo sapiens
caggcagggucuguu

SEQ ID NO: 751106 - RNA, 19 nt, Homo sapiens
caggcagguuugccaguga

SEQ ID NO: 751107 - RNA, 19 nt, Homo sapiens
caggcaguuaggugcugaa

SEQ ID NO: 751108 - RNA, 17 nt, Homo sapiens
caggcauagaggcuucu

SEQ ID NO: 751109 - RNA, 18 nt, Homo sapiens
caggcauagaggcuucuc

SEQ ID NO: 751110 - RNA, 18 nt, Homo sapiens
caggcaugaaauucuucc

SEQ ID NO: 751111 - RNA, 13 nt, Homo sapiens
caggcaugcacaa

SEQ ID NO: 751112 - RNA, 12 nt, Homo sapiens
caggcaugggca

SEQ ID NO: 751113 - RNA, 19 nt, Homo sapiens
caggcauucagguugcuug

SEQ ID NO: 751114 - RNA, 23 nt, Homo sapiens
caggcauuugaggcugucgugag

SEQ ID NO: 751115 - RNA, 21 nt, Homo sapiens
caggccacccccauggaagca

SEQ ID NO: 751116 - RNA, 18 nt, Homo sapiens
caggccacuguggccaga

SEQ ID NO: 751117 - RNA, 16 nt, Homo sapiens
caggccagagugcagu

SEQ ID NO: 751118 - RNA, 16 nt, Homo sapiens
caggccagcaagcucu

SEQ ID NO: 751119 - RNA, 23 nt, Homo sapiens
caggccagggaaagcccguguca

SEQ ID NO: 751120 - RNA, 13 nt, Homo sapiens
caggccagguggg

SEQ ID NO: 751121 - RNA, 15 nt, Homo sapiens
caggccauacuuuac

SEQ ID NO: 751122 - RNA, 17 nt, Homo sapiens
caggccauacuuuacaa

SEQ ID NO: 751123 - RNA, 22 nt, Homo sapiens
caggcccuacuacccauuguuc

SEQ ID NO: 751124 - RNA, 13 nt, Homo sapiens
caggcccuagcuu

SEQ ID NO: 751125 - RNA, 22 nt, Homo sapiens
caggcccuggccuccccugcca

SEQ ID NO: 751126 - RNA, 12 nt, Homo sapiens
caggcccugugg

SEQ ID NO: 751127 - RNA, 18 nt, Homo sapiens
caggccgggguggagcau

SEQ ID NO: 751128 - RNA, 23 nt, Homo sapiens
caggccucucggugcuccaucuc

SEQ ID NO: 751129 - RNA, 19 nt, Homo sapiens
caggccuuaccgcucuguu

SEQ ID NO: 751130 - RNA, 19 nt, Homo sapiens
caggccuugggcuccugau

SEQ ID NO: 751131 - RNA, 15 nt, Homo sapiens
caggcgacaaaaucu

SEQ ID NO: 751132 - RNA, 20 nt, Homo sapiens
caggcgauccaccugucuca

SEQ ID NO: 751133 - RNA, 15 nt, Homo sapiens
caggcggggugggca

SEQ ID NO: 751134 - RNA, 15 nt, Homo sapiens
caggcgugguggcac

SEQ ID NO: 751135 - RNA, 14 nt, Homo sapiens
caggcuaaaugcac

SEQ ID NO: 751136 - RNA, 20 nt, Homo sapiens
caggcuauguauaaaauaca

SEQ ID NO: 751137 - RNA, 16 nt, Homo sapiens
caggcuccaggccuca

SEQ ID NO: 751138 - RNA, 23 nt, Homo sapiens
ccuggacaaggcuaacaucccac

SEQ ID NO: 751139 - RNA, 16 nt, Homo sapiens
ccuggacacaacacca

SEQ ID NO: 751140 - RNA, 17 nt, Homo sapiens
ccuggacacaacaccaa

SEQ ID NO: 751141 - RNA, 21 nt, Homo sapiens
ccuggacgcccccgcccgcac

SEQ ID NO: 751142 - RNA, 15 nt, Homo sapiens
ccuggacuuuccugc

SEQ ID NO: 751143 - RNA, 22 nt, Homo sapiens
ccuggagaagaauggcuuucaa

SEQ ID NO: 751144 - RNA, 18 nt, Homo sapiens
ccuggaggccgcagccaa

SEQ ID NO: 751145 - RNA, 19 nt, Homo sapiens
ccuggagggcuacagcauc

SEQ ID NO: 751146 - RNA, 23 nt, Homo sapiens
ccuggaucaguccuuugaucagu

SEQ ID NO: 751147 - RNA, 14 nt, Homo sapiens
ccuggauccagcac

SEQ ID NO: 751148 - RNA, 18 nt, Homo sapiens
ccuggaucccugcccuuc

SEQ ID NO: 751149 - RNA, 14 nt, Homo sapiens
ccuggaucuccuca

SEQ ID NO: 751150 - RNA, 19 nt, Homo sapiens
ccuggauguguggggcaug

SEQ ID NO: 751151 - RNA, 16 nt, Homo sapiens
ccuggcacaggacuga

SEQ ID NO: 751152 - RNA, 18 nt, Homo sapiens
ccuggcaccuguguucca

SEQ ID NO: 751153 - RNA, 18 nt, Homo sapiens
ccuggcagcaugacucag

SEQ ID NO: 751154 - RNA, 17 nt, Homo sapiens
ccuggcccagaugauau

SEQ ID NO: 751155 - RNA, 18 nt, Homo sapiens
ccuggcccagaugauaua

SEQ ID NO: 751156 - RNA, 18 nt, Homo sapiens
ccuggcccccaaccucag

SEQ ID NO: 751157 - RNA, 21 nt, Homo sapiens
ccuggccuggucccugguccu

SEQ ID NO: 751158 - RNA, 17 nt, Homo sapiens
ccuggcgaaaccccauc

SEQ ID NO: 751159 - RNA, 19 nt, Homo sapiens
ccuggcuaacacggugaaa

SEQ ID NO: 751160 - RNA, 13 nt, Homo sapiens
ccuggcugaugau

SEQ ID NO: 751161 - RNA, 13 nt, Homo sapiens
ccugggaacauca

SEQ ID NO: 751162 - RNA, 14 nt, Homo sapiens
ccugggacuuccau

SEQ ID NO: 751163 - RNA, 17 nt, Homo sapiens
ccugggauguaaaccau

SEQ ID NO: 751164 - RNA, 15 nt, Homo sapiens
ccugggauguccaca

SEQ ID NO: 751165 - RNA, 18 nt, Homo sapiens
ccugggcaaacagagcua

SEQ ID NO: 751166 - RNA, 16 nt, Homo sapiens
ccugggcaggugggag

SEQ ID NO: 751167 - RNA, 16 nt, Homo sapiens
ccugggcagugcuccu

SEQ ID NO: 751168 - RNA, 16 nt, Homo sapiens
ccugggcccuuccuau

SEQ ID NO: 751169 - RNA, 9 nt, Homo sapiens
ccugggcug

SEQ ID NO: 751170 - RNA, 22 nt, Homo sapiens
ccugggcugccgggaaccucau

SEQ ID NO: 751171 - RNA, 21 nt, Homo sapiens
ccugggcuucgucuacuccuu

SEQ ID NO: 751172 - RNA, 12 nt, Homo sapiens
ccuggggaccau

SEQ ID NO: 751173 - RNA, 21 nt, Homo sapiens
ccuggggccuggaccugccuc

SEQ ID NO: 751174 - RNA, 19 nt, Homo sapiens
ccuggggcuucuccugacc

SEQ ID NO: 751175 - RNA, 18 nt, Homo sapiens
ccugggggcuuuugccac

SEQ ID NO: 751176 - RNA, 18 nt, Homo sapiens
ccugggucacagagugag

SEQ ID NO: 751177 - RNA, 13 nt, Homo sapiens
ccugggugggugg

SEQ ID NO: 751178 - RNA, 14 nt, Homo sapiens
ccugguaccagagg

SEQ ID NO: 751179 - RNA, 20 nt, Homo sapiens
ccugguagaucaagcauuac

SEQ ID NO: 751180 - RNA, 15 nt, Homo sapiens
ccuggucagaaggcc

SEQ ID NO: 751181 - RNA, 18 nt, Homo sapiens
ccuggucccuuggagaca

SEQ ID NO: 751182 - RNA, 12 nt, Homo sapiens
ccuggugcucuu

SEQ ID NO: 751183 - RNA, 21 nt, Homo sapiens
ccugguggagaaagcacugac

SEQ ID NO: 751184 - RNA, 14 nt, Homo sapiens
ccugguggguggug

SEQ ID NO: 751185 - RNA, 23 nt, Homo sapiens
ccugguguaguuucuucauuuca

SEQ ID NO: 751186 - RNA, 18 nt, Homo sapiens
ccugguucccaccauucc

SEQ ID NO: 751187 - RNA, 20 nt, Homo sapiens
ccugguucugucuagacugg

SEQ ID NO: 751188 - RNA, 21 nt, Homo sapiens
ccuguaaacuuuaucacuuaa

SEQ ID NO: 751189 - RNA, 19 nt, Homo sapiens
ccuguaaucccaacacuuu

SEQ ID NO: 751190 - RNA, 18 nt, Homo sapiens
ccuguaaucucagcacuu

SEQ ID NO: 751191 - RNA, 15 nt, Homo sapiens
ccuguaauuccagcu

SEQ ID NO: 751192 - RNA, 12 nt, Homo sapiens
ccuguacccagc

SEQ ID NO: 751193 - RNA, 17 nt, Homo sapiens
ccuguagcagucacuga

SEQ ID NO: 751194 - RNA, 15 nt, Homo sapiens
ccuguagcucaguca

SEQ ID NO: 751195 - RNA, 22 nt, Homo sapiens
ccuguaggaagucauccugcca

SEQ ID NO: 751196 - RNA, 23 nt, Homo sapiens
ccuguaugguggaagcuggguga

SEQ ID NO: 751197 - RNA, 20 nt, Homo sapiens
ccugucaaguuaacaaggaa

SEQ ID NO: 751198 - RNA, 19 nt, Homo sapiens
ccugucacgccgggcucua

SEQ ID NO: 751199 - RNA, 13 nt, Homo sapiens
ccugucauauaau

SEQ ID NO: 751200 - RNA, 17 nt, Homo sapiens
ccugucauuuugcacug

SEQ ID NO: 751201 - RNA, 20 nt, Homo sapiens
ccugucauuuuuaacagcau

SEQ ID NO: 751202 - RNA, 16 nt, Homo sapiens
ccugucccauucuaga

SEQ ID NO: 751203 - RNA, 19 nt, Homo sapiens
ccuguccucccgagcuccu

SEQ ID NO: 751204 - RNA, 21 nt, Homo sapiens
ccugucgaaggggaggcacac

SEQ ID NO: 751205 - RNA, 13 nt, Homo sapiens
ccugucuacucau

SEQ ID NO: 751206 - RNA, 15 nt, Homo sapiens
ccugucucccaaaaa

SEQ ID NO: 751207 - RNA, 20 nt, Homo sapiens
ccugucuuccaaggagacca

SEQ ID NO: 751208 - RNA, 19 nt, Homo sapiens
ccugucuuggccucccaaa

SEQ ID NO: 751209 - RNA, 20 nt, Homo sapiens
ccugugaaaaagaaacugaa

SEQ ID NO: 751210 - RNA, 23 nt, Homo sapiens
ccugugaaacgucccacacuuug

SEQ ID NO: 751211 - RNA, 16 nt, Homo sapiens
ccugugagcagggauu

SEQ ID NO: 751212 - RNA, 13 nt, Homo sapiens
ccugugaggugca

SEQ ID NO: 751213 - RNA, 15 nt, Homo sapiens
ccugugauccaccca

SEQ ID NO: 751214 - RNA, 16 nt, Homo sapiens
ccugugcccaccaguu

SEQ ID NO: 751215 - RNA, 21 nt, Homo sapiens
ccugugcccacccgucuucaa

SEQ ID NO: 751216 - RNA, 17 nt, Homo sapiens
ccugugcccagcaugcc

SEQ ID NO: 751217 - RNA, 21 nt, Homo sapiens
ccugugcccucaccaccacac

SEQ ID NO: 751218 - RNA, 11 nt, Homo sapiens
ccugugccugg

SEQ ID NO: 751219 - RNA, 17 nt, Homo sapiens
ccugugcgucccagcug

SEQ ID NO: 751220 - RNA, 16 nt, Homo sapiens
ccuguggcagcugccc

SEQ ID NO: 751221 - RNA, 18 nt, Homo sapiens
ccuguggccaacugcaaa

SEQ ID NO: 751222 - RNA, 19 nt, Homo sapiens
ccuguggccaacugcaaaa

SEQ ID NO: 751223 - RNA, 14 nt, Homo sapiens
ccugugggaguaga

SEQ ID NO: 751224 - RNA, 18 nt, Homo sapiens
ccugugguuaacaucuca

SEQ ID NO: 751225 - RNA, 15 nt, Homo sapiens
ccuguguaacacuug

SEQ ID NO: 751226 - RNA, 14 nt, Homo sapiens
ccuguguacuuccc

SEQ ID NO: 751227 - RNA, 18 nt, Homo sapiens
ccugugugaacuauugag

SEQ ID NO: 751228 - RNA, 17 nt, Homo sapiens
ccugugugccauuuuaa

SEQ ID NO: 751229 - RNA, 18 nt, Homo sapiens
ccugugugggacugagau

SEQ ID NO: 751230 - RNA, 19 nt, Homo sapiens
ccuguguggucuccaugcu

SEQ ID NO: 751231 - RNA, 14 nt, Homo sapiens
ccuguguugcccag

SEQ ID NO: 751232 - RNA, 20 nt, Homo sapiens
ccuguuaaaauguacacugg

SEQ ID NO: 751233 - RNA, 19 nt, Homo sapiens
ccuguucagagcacucauu

SEQ ID NO: 751234 - RNA, 12 nt, Homo sapiens
ccuguuccccaa

SEQ ID NO: 751235 - RNA, 19 nt, Homo sapiens
ccuguuccccaaggacucu

SEQ ID NO: 751236 - RNA, 23 nt, Homo sapiens
ccuguuccccagagaaaggggag

SEQ ID NO: 751237 - RNA, 21 nt, Homo sapiens
ccuguugaagcucuggugaca

SEQ ID NO: 751238 - RNA, 23 nt, Homo sapiens
ccuguuggggaccucaccugcug

SEQ ID NO: 751239 - RNA, 17 nt, Homo sapiens
ccuguugguuagauuca

SEQ ID NO: 751240 - RNA, 21 nt, Homo sapiens
ccuguuucaccaguguuuuac

SEQ ID NO: 751241 - RNA, 16 nt, Homo sapiens
ccuguuucccacccag

SEQ ID NO: 751242 - RNA, 12 nt, Homo sapiens
ccuuaaauaugu

SEQ ID NO: 751243 - RNA, 14 nt, Homo sapiens
ccuuaacacacugg

SEQ ID NO: 751244 - RNA, 15 nt, Homo sapiens
ccuuaacacacuggc

SEQ ID NO: 751245 - RNA, 19 nt, Homo sapiens
ccuuaaccuuaaaauugau

SEQ ID NO: 751246 - RNA, 12 nt, Homo sapiens
ccuuaagccaac

SEQ ID NO: 751247 - RNA, 15 nt, Homo sapiens
ccuuaagccaguucc

SEQ ID NO: 751248 - RNA, 18 nt, Homo sapiens
ccuuaagggguaucaugu

SEQ ID NO: 751249 - RNA, 15 nt, Homo sapiens
ccuuaauaaauaugu

SEQ ID NO: 751250 - RNA, 23 nt, Homo sapiens
ccuuaaugauccguuccauugca

SEQ ID NO: 751251 - RNA, 18 nt, Homo sapiens
ccuuaauuuccuuuuuga

SEQ ID NO: 751252 - RNA, 14 nt, Homo sapiens
ccuuagagguccuc

SEQ ID NO: 751253 - RNA, 13 nt, Homo sapiens
cgugcacugugaa

SEQ ID NO: 751254 - RNA, 17 nt, Homo sapiens
cgugcaggacagcucuu

SEQ ID NO: 751255 - RNA, 18 nt, Homo sapiens
cgugcccgugugcauguc

SEQ ID NO: 751256 - RNA, 13 nt, Homo sapiens
cgugccugugauc

SEQ ID NO: 751257 - RNA, 15 nt, Homo sapiens
cgugcgagcacacac

SEQ ID NO: 751258 - RNA, 14 nt, Homo sapiens
cgugcucauugcua

SEQ ID NO: 751259 - RNA, 13 nt, Homo sapiens
cgugcugugcucu

SEQ ID NO: 751260 - RNA, 14 nt, Homo sapiens
cguggaaggcugua

SEQ ID NO: 751261 - RNA, 14 nt, Homo sapiens
cguggacucugcac

SEQ ID NO: 751262 - RNA, 22 nt, Homo sapiens
cguggacucugcacaugucuug

SEQ ID NO: 751263 - RNA, 23 nt, Homo sapiens
cgugggacaucuaguaggugcuu

SEQ ID NO: 751264 - RNA, 19 nt, Homo sapiens
cgugguagugcaagcugaa

SEQ ID NO: 751265 - RNA, 20 nt, Homo sapiens
cguggucagggcagggcuca

SEQ ID NO: 751266 - RNA, 15 nt, Homo sapiens
cgugguggcacacac

SEQ ID NO: 751267 - RNA, 17 nt, Homo sapiens
cguguauaguaucugua

SEQ ID NO: 751268 - RNA, 20 nt, Homo sapiens
cguguccagcacagaaggaa

SEQ ID NO: 751269 - RNA, 20 nt, Homo sapiens
cguguccucucccugccaag

SEQ ID NO: 751270 - RNA, 13 nt, Homo sapiens
cgugugaccucca

SEQ ID NO: 751271 - RNA, 18 nt, Homo sapiens
cguguuucugacucugag

SEQ ID NO: 751272 - RNA, 12 nt, Homo sapiens
cguuaccagaga

SEQ ID NO: 751273 - RNA, 17 nt, Homo sapiens
cguuauauuaaaacacu

SEQ ID NO: 751274 - RNA, 14 nt, Homo sapiens
cguuaugugcagua

SEQ ID NO: 751275 - RNA, 15 nt, Homo sapiens
cguucaauaagcauu

SEQ ID NO: 751276 - RNA, 18 nt, Homo sapiens
cguucagaggugcagcug

SEQ ID NO: 751277 - RNA, 17 nt, Homo sapiens
cguuccaccccaagaga

SEQ ID NO: 751278 - RNA, 19 nt, Homo sapiens
cguuccuuccgaugacagu

SEQ ID NO: 751279 - RNA, 20 nt, Homo sapiens
cguucucuucucucuucaau

SEQ ID NO: 751280 - RNA, 16 nt, Homo sapiens
cguucugcaagcauca

SEQ ID NO: 751281 - RNA, 13 nt, Homo sapiens
cguugaggaugag

SEQ ID NO: 751282 - RNA, 23 nt, Homo sapiens
cguuggagagcagcaggugcugu

SEQ ID NO: 751283 - RNA, 22 nt, Homo sapiens
cguuguuuugguuguacuuugg

SEQ ID NO: 751284 - RNA, 17 nt, Homo sapiens
cguuuagaaaaaacaau

SEQ ID NO: 751285 - RNA, 21 nt, Homo sapiens
cguuucauuuuuacaccaauu

SEQ ID NO: 751286 - RNA, 22 nt, Homo sapiens
cguuucuccaccuagacuguaa

SEQ ID NO: 751287 - RNA, 16 nt, Homo sapiens
cguuucugguggucug

SEQ ID NO: 751288 - RNA, 13 nt, Homo sapiens
cguuuuagugucu

SEQ ID NO: 751289 - RNA, 19 nt, Homo sapiens
cguuuuuuuaaauuagcaa

SEQ ID NO: 751290 - RNA, 18 nt, Homo sapiens
cuaaaaaacagaggccau

SEQ ID NO: 751291 - RNA, 16 nt, Homo sapiens
cuaaaaagaagccaca

SEQ ID NO: 751292 - RNA, 15 nt, Homo sapiens
cuaaaaaugcaacuu

SEQ ID NO: 751293 - RNA, 17 nt, Homo sapiens
cuaaaaaugguuaucau

SEQ ID NO: 751294 - RNA, 14 nt, Homo sapiens
cuaaaagcuuuaaa

SEQ ID NO: 751295 - RNA, 18 nt, Homo sapiens
cuaaaagcuuucaugucc

SEQ ID NO: 751296 - RNA, 21 nt, Homo sapiens
cuaaaaggugaccaaugaugg

SEQ ID NO: 751297 - RNA, 23 nt, Homo sapiens
cuaaaauuaaugcagauuucucu

SEQ ID NO: 751298 - RNA, 15 nt, Homo sapiens
cuaaaauucuagucu

SEQ ID NO: 751299 - RNA, 13 nt, Homo sapiens
cuaaaauucuguc

SEQ ID NO: 751300 - RNA, 18 nt, Homo sapiens
cuaaaccaaggacugagc

SEQ ID NO: 751301 - RNA, 15 nt, Homo sapiens
cuaaaccuuacaugu

SEQ ID NO: 751302 - RNA, 20 nt, Homo sapiens
cuaaacuucaccuacauuau

SEQ ID NO: 751303 - RNA, 16 nt, Homo sapiens
cuaaagaaaaaugccu

SEQ ID NO: 751304 - RNA, 20 nt, Homo sapiens
cuaaagagagaugaaccaca

SEQ ID NO: 751305 - RNA, 20 nt, Homo sapiens
cuaaagagugaaugccauuu

SEQ ID NO: 751306 - RNA, 16 nt, Homo sapiens
cuaaagauagaguaaa

SEQ ID NO: 751307 - RNA, 11 nt, Homo sapiens
cuaaagcacuu

SEQ ID NO: 751308 - RNA, 21 nt, Homo sapiens
cuaaagcagaggcaacacugg

SEQ ID NO: 751309 - RNA, 22 nt, Homo sapiens
cuaaagcuaggggcccacuaaa

SEQ ID NO: 751310 - RNA, 22 nt, Homo sapiens
cuaaaggaagaaauacauauuu

SEQ ID NO: 751311 - RNA, 18 nt, Homo sapiens
cuaaaggacucuccagcc

SEQ ID NO: 751312 - RNA, 17 nt, Homo sapiens
cuaaaggagauuuacac

SEQ ID NO: 751313 - RNA, 17 nt, Homo sapiens
cuaaagucauccauccu

SEQ ID NO: 751314 - RNA, 18 nt, Homo sapiens
cuaaaguuacaaacagac

SEQ ID NO: 751315 - RNA, 14 nt, Homo sapiens
cuaaaguucuaaga

SEQ ID NO: 751316 - RNA, 21 nt, Homo sapiens
cuaaaguuuugcaacaauaaa

SEQ ID NO: 751317 - RNA, 23 nt, Homo sapiens
cuaaauaaaaauauguaauuuca

SEQ ID NO: 751318 - RNA, 20 nt, Homo sapiens
cuaaauaauguuaucugugu

SEQ ID NO: 751319 - RNA, 13 nt, Homo sapiens
cuaaauaugaagg

SEQ ID NO: 751320 - RNA, 15 nt, Homo sapiens
cuaaaucacuuugag

SEQ ID NO: 751321 - RNA, 14 nt, Homo sapiens
cuaaauccaaagaa

SEQ ID NO: 751322 - RNA, 18 nt, Homo sapiens
cuaaaucugccuuuucau

SEQ ID NO: 751323 - RNA, 14 nt, Homo sapiens
cuaaaugaacuaau

SEQ ID NO: 751324 - RNA, 18 nt, Homo sapiens
cuaaaugaauguuuacac

SEQ ID NO: 751325 - RNA, 18 nt, Homo sapiens
cuaaaugagauacacuga

SEQ ID NO: 751326 - RNA, 12 nt, Homo sapiens
cuaaauguauuc

SEQ ID NO: 751327 - RNA, 17 nt, Homo sapiens
cuaaauuauaucuguga

SEQ ID NO: 751328 - RNA, 23 nt, Homo sapiens
cuaaauuauuuacugcaaaaaga

SEQ ID NO: 751329 - RNA, 20 nt, Homo sapiens
cuaaauucaaagaaguacuu

SEQ ID NO: 751330 - RNA, 22 nt, Homo sapiens
cuaaauuuaagcuuaagccaua

SEQ ID NO: 751331 - RNA, 16 nt, Homo sapiens
cuaaauuuaaugcugc

SEQ ID NO: 751332 - RNA, 18 nt, Homo sapiens
cuaaauuuuuacaucaaa

SEQ ID NO: 751333 - RNA, 17 nt, Homo sapiens
cuaacaauaauauuuca

SEQ ID NO: 751334 - RNA, 11 nt, Homo sapiens
cuaacacaaaa

SEQ ID NO: 751335 - RNA, 15 nt, Homo sapiens
cuaacaggccaaaga

SEQ ID NO: 751336 - RNA, 17 nt, Homo sapiens
cuaacagugaaaagaga

SEQ ID NO: 751337 - RNA, 14 nt, Homo sapiens
cuaacauagauuua

SEQ ID NO: 751338 - RNA, 14 nt, Homo sapiens
cuaacauagugucu

SEQ ID NO: 751339 - RNA, 17 nt, Homo sapiens
cuaaccagccuggucaa

SEQ ID NO: 751340 - RNA, 11 nt, Homo sapiens
cuaaccaucug

SEQ ID NO: 751341 - RNA, 20 nt, Homo sapiens
cuaacccaaugccugugaag

SEQ ID NO: 751342 - RNA, 18 nt, Homo sapiens
cuaacccucacaagcaug

SEQ ID NO: 751343 - RNA, 16 nt, Homo sapiens
cuaaccuugaaugcug

SEQ ID NO: 751344 - RNA, 15 nt, Homo sapiens
cuaacuagcauugua

SEQ ID NO: 751345 - RNA, 15 nt, Homo sapiens
cuaacuauauuugcu

SEQ ID NO: 751346 - RNA, 19 nt, Homo sapiens
cuaacuauauuugcuuuuu

SEQ ID NO: 751347 - RNA, 16 nt, Homo sapiens
cuaacuaucaaauaga

SEQ ID NO: 751348 - RNA, 15 nt, Homo sapiens
cuaacuccugccauu

SEQ ID NO: 751349 - RNA, 21 nt, Homo sapiens
cuaagaaaagccuaaucacag

SEQ ID NO: 751350 - RNA, 18 nt, Homo sapiens
cuaagaauucaaacuggg

SEQ ID NO: 751351 - RNA, 14 nt, Homo sapiens
cuaagacauauuca

SEQ ID NO: 751352 - RNA, 23 nt, Homo sapiens
cuaagacauauucagacaucaac

SEQ ID NO: 751353 - RNA, 14 nt, Homo sapiens
cuaagacccugugu

SEQ ID NO: 751354 - RNA, 15 nt, Homo sapiens
cuaagagugucacug

SEQ ID NO: 751355 - RNA, 14 nt, Homo sapiens
cuaagauggcuuuu

SEQ ID NO: 751356 - RNA, 18 nt, Homo sapiens
cuaagaugugauauucua

SEQ ID NO: 751357 - RNA, 20 nt, Homo sapiens
cuaagcaacuaggccuucag

SEQ ID NO: 751358 - RNA, 17 nt, Homo sapiens
cuaagcacaaagcccau

SEQ ID NO: 751359 - RNA, 15 nt, Homo sapiens
cuaagcacauuccaa

SEQ ID NO: 751360 - RNA, 13 nt, Homo sapiens
cuaagcacuuuau

SEQ ID NO: 751361 - RNA, 20 nt, Homo sapiens
cuaagccacauggcugggau

SEQ ID NO: 751362 - RNA, 20 nt, Homo sapiens
cuaagcugaguuaggugucu

SEQ ID NO: 751363 - RNA, 22 nt, Homo sapiens
cuaagcuggugccccacugaau

SEQ ID NO: 751364 - RNA, 20 nt, Homo sapiens
cuaaggaaguaucagcacua

SEQ ID NO: 751365 - RNA, 14 nt, Homo sapiens
cuaaggaucucuca

SEQ ID NO: 751366 - RNA, 20 nt, Homo sapiens
cuaaggcucuaugagucuag

SEQ ID NO: 751367 - RNA, 20 nt, Homo sapiens
cuaaggcucugagagucuag

SEQ ID NO: 751368 - RNA, 14 nt, Homo sapiens
cuauauaguaucua

SEQ ID NO: 751369 - RNA, 17 nt, Homo sapiens
cuauaucaaacaugcac

SEQ ID NO: 751370 - RNA, 21 nt, Homo sapiens
cuauaucauaacuauacuuga

SEQ ID NO: 751371 - RNA, 18 nt, Homo sapiens
cuauauuuagauuguuaa

SEQ ID NO: 751372 - RNA, 12 nt, Homo sapiens
cuauauuugcua

SEQ ID NO: 751373 - RNA, 12 nt, Homo sapiens
cuauauuugcuu

SEQ ID NO: 751374 - RNA, 21 nt, Homo sapiens
cuauauuugcuuuuugcuaac

SEQ ID NO: 751375 - RNA, 19 nt, Homo sapiens
cuaucaccucuuaugcaca

SEQ ID NO: 751376 - RNA, 16 nt, Homo sapiens
cuaucaguauugugaa

SEQ ID NO: 751377 - RNA, 17 nt, Homo sapiens
cuaucaguauugugaaa

SEQ ID NO: 751378 - RNA, 21 nt, Homo sapiens
cuaucauuguuggacauuugg

SEQ ID NO: 751379 - RNA, 19 nt, Homo sapiens
cuauccaaaacuaauuucc

SEQ ID NO: 751380 - RNA, 19 nt, Homo sapiens
cuauccagcagaucauuua

SEQ ID NO: 751381 - RNA, 15 nt, Homo sapiens
cuaucccucuccuaa

SEQ ID NO: 751382 - RNA, 18 nt, Homo sapiens
cuauccugauuccaaaua

SEQ ID NO: 751383 - RNA, 14 nt, Homo sapiens
cuaucuacuacaaa

SEQ ID NO: 751384 - RNA, 23 nt, Homo sapiens
cuaucuacuacaaacuucaaaga

SEQ ID NO: 751385 - RNA, 23 nt, Homo sapiens
cuaucuccugacagaaggugcca

SEQ ID NO: 751386 - RNA, 13 nt, Homo sapiens
cuaucugcaaaua

SEQ ID NO: 751387 - RNA, 20 nt, Homo sapiens
cuaucugcuguauauggaau

SEQ ID NO: 751388 - RNA, 22 nt, Homo sapiens
cuaucuuccagaaacuacauga

SEQ ID NO: 751389 - RNA, 20 nt, Homo sapiens
cuaugaaaacagcuaucuca

SEQ ID NO: 751390 - RNA, 18 nt, Homo sapiens
cuaugaaaucaacugaca

SEQ ID NO: 751391 - RNA, 21 nt, Homo sapiens
cuaugaaauuucaacuuuucc

SEQ ID NO: 751392 - RNA, 20 nt, Homo sapiens
cuaugaagcccacccagaaa

SEQ ID NO: 751393 - RNA, 17 nt, Homo sapiens
cuaugaauuuucaagua

SEQ ID NO: 751394 - RNA, 19 nt, Homo sapiens
cuaugauauuuucugugcc

SEQ ID NO: 751395 - RNA, 23 nt, Homo sapiens
cuaugaucacagugacuuuacag

SEQ ID NO: 751396 - RNA, 22 nt, Homo sapiens
cuaugcaacagcucucaccuac

SEQ ID NO: 751397 - RNA, 17 nt, Homo sapiens
cuaugcaagccuugcua

SEQ ID NO: 751398 - RNA, 23 nt, Homo sapiens
cuaugcaauuuuucaagagcucc

SEQ ID NO: 751399 - RNA, 17 nt, Homo sapiens
cuauguaauggugguca

SEQ ID NO: 751400 - RNA, 13 nt, Homo sapiens
cuauguacuuuaa

SEQ ID NO: 751401 - RNA, 18 nt, Homo sapiens
cuauguagcaauauauca

SEQ ID NO: 751402 - RNA, 16 nt, Homo sapiens
cuauguauguguaaaa

SEQ ID NO: 751403 - RNA, 14 nt, Homo sapiens
cuaugugauuacaa

SEQ ID NO: 751404 - RNA, 15 nt, Homo sapiens
cuaugugauuacaag

SEQ ID NO: 751405 - RNA, 21 nt, Homo sapiens
cuauuaaaagaauccaaauuc

SEQ ID NO: 751406 - RNA, 22 nt, Homo sapiens
cuauuaaaauucugauguuucu

SEQ ID NO: 751407 - RNA, 22 nt, Homo sapiens
cuauuaaagugcuaagguucua

SEQ ID NO: 751408 - RNA, 23 nt, Homo sapiens
cuauuaacuuuaauucucuuuca

SEQ ID NO: 751409 - RNA, 20 nt, Homo sapiens
cuauuaauaucaacucugaa

SEQ ID NO: 751410 - RNA, 13 nt, Homo sapiens
cuauuaauauuca

SEQ ID NO: 751411 - RNA, 16 nt, Homo sapiens
cuauuagagcauugaa

SEQ ID NO: 751412 - RNA, 23 nt, Homo sapiens
cuauuagagcugccugugccuuu

SEQ ID NO: 751413 - RNA, 18 nt, Homo sapiens
cuauuaggaaauucugau

SEQ ID NO: 751414 - RNA, 21 nt, Homo sapiens
cuauuauuuggagccugccaa

SEQ ID NO: 751415 - RNA, 22 nt, Homo sapiens
cuauuauuuggagccugccaag

SEQ ID NO: 751416 - RNA, 15 nt, Homo sapiens
cuauuccauauuaaa

SEQ ID NO: 751417 - RNA, 12 nt, Homo sapiens
cuauuccugcug

SEQ ID NO: 751418 - RNA, 13 nt, Homo sapiens
cuauucuauugca

SEQ ID NO: 751419 - RNA, 18 nt, Homo sapiens
cuauucugagaaaacaag

SEQ ID NO: 751420 - RNA, 19 nt, Homo sapiens
cuauugacaagucauuuua

SEQ ID NO: 751421 - RNA, 14 nt, Homo sapiens
cuauugucuguaau

SEQ ID NO: 751422 - RNA, 16 nt, Homo sapiens
cuauuguuaccucuga

SEQ ID NO: 751423 - RNA, 17 nt, Homo sapiens
cuauuuccacugaacaa

SEQ ID NO: 751424 - RNA, 16 nt, Homo sapiens
cuauuuccuaaaauca

SEQ ID NO: 751425 - RNA, 16 nt, Homo sapiens
cuauuucuccaaagcc

SEQ ID NO: 751426 - RNA, 19 nt, Homo sapiens
cuauuucuucuacugcuau

SEQ ID NO: 751427 - RNA, 20 nt, Homo sapiens
cuauuugagagcagaugcca

SEQ ID NO: 751428 - RNA, 21 nt, Homo sapiens
cuauuuucagagcaugauaca

SEQ ID NO: 751429 - RNA, 22 nt, Homo sapiens
cuauuuucagagcaugauacaa

SEQ ID NO: 751430 - RNA, 23 nt, Homo sapiens
cuauuuuggggucaaaugcuaga

SEQ ID NO: 751431 - RNA, 17 nt, Homo sapiens
cuauuuugugaagccau

SEQ ID NO: 751432 - RNA, 19 nt, Homo sapiens
cucaaaaacaaagaguauc

SEQ ID NO: 751433 - RNA, 22 nt, Homo sapiens
cucaaaacagagggcugcauuc

SEQ ID NO: 751434 - RNA, 18 nt, Homo sapiens
cucaaaacugcacuguca

SEQ ID NO: 751435 - RNA, 18 nt, Homo sapiens
cucaaaccaagcaaagga

SEQ ID NO: 751436 - RNA, 19 nt, Homo sapiens
cucaaacuccugaccucaa

SEQ ID NO: 751437 - RNA, 16 nt, Homo sapiens
cucaaacuuccaguca

SEQ ID NO: 751438 - RNA, 22 nt, Homo sapiens
cucaaagaagucggaaugucau

SEQ ID NO: 751439 - RNA, 12 nt, Homo sapiens
cucaaagcacac

SEQ ID NO: 751440 - RNA, 15 nt, Homo sapiens
cucaaaggagucagg

SEQ ID NO: 751441 - RNA, 13 nt, Homo sapiens
cucaaauauagua

SEQ ID NO: 751442 - RNA, 14 nt, Homo sapiens
cucaaaucuauuca

SEQ ID NO: 751443 - RNA, 23 nt, Homo sapiens
cucaaaucuauucagacaagcaa

SEQ ID NO: 751444 - RNA, 17 nt, Homo sapiens
cucaaaugauccuccca

SEQ ID NO: 751445 - RNA, 20 nt, Homo sapiens
cucaaauggggccagaucca

SEQ ID NO: 751446 - RNA, 21 nt, Homo sapiens
cucaaauguucuaaguuucua

SEQ ID NO: 751447 - RNA, 12 nt, Homo sapiens
cucaaccagagu

SEQ ID NO: 751448 - RNA, 21 nt, Homo sapiens
cucaacugccuacuccaaaau

SEQ ID NO: 751449 - RNA, 12 nt, Homo sapiens
cucaacuuuaag

SEQ ID NO: 751450 - RNA, 17 nt, Homo sapiens
cucaacuuuaagauaga

SEQ ID NO: 751451 - RNA, 14 nt, Homo sapiens
cucaagaaagcccu

SEQ ID NO: 751452 - RNA, 17 nt, Homo sapiens
cucaagaacgagaagca

SEQ ID NO: 751453 - RNA, 13 nt, Homo sapiens
cucaagacucacc

SEQ ID NO: 751454 - RNA, 16 nt, Homo sapiens
cucaagaugaaggcaa

SEQ ID NO: 751455 - RNA, 20 nt, Homo sapiens
cucaagccccauuuccucac

SEQ ID NO: 751456 - RNA, 16 nt, Homo sapiens
cucaagcccugcaguc

SEQ ID NO: 751457 - RNA, 19 nt, Homo sapiens
cucaagcccugcagucaca

SEQ ID NO: 751458 - RNA, 22 nt, Homo sapiens
cucaagcccugcagucacagcu

SEQ ID NO: 751459 - RNA, 17 nt, Homo sapiens
cucaaggaauuugcauu

SEQ ID NO: 751460 - RNA, 11 nt, Homo sapiens
cucaagggaaa

SEQ ID NO: 751461 - RNA, 21 nt, Homo sapiens
cucaaggguggcaggucacug

SEQ ID NO: 751462 - RNA, 17 nt, Homo sapiens
cucaagguuacugggag

SEQ ID NO: 751463 - RNA, 14 nt, Homo sapiens
cucaagguuuuagg

SEQ ID NO: 751464 - RNA, 20 nt, Homo sapiens
cucaaguauaugucauuuac

SEQ ID NO: 751465 - RNA, 19 nt, Homo sapiens
cucaagucuucccugauca

SEQ ID NO: 751466 - RNA, 14 nt, Homo sapiens
cucaagugucuuag

SEQ ID NO: 751467 - RNA, 16 nt, Homo sapiens
cucaaguuaggaggau

SEQ ID NO: 751468 - RNA, 19 nt, Homo sapiens
cucaauaaaugauucuuag

SEQ ID NO: 751469 - RNA, 19 nt, Homo sapiens
cucaaucccugaggacuga

SEQ ID NO: 751470 - RNA, 22 nt, Homo sapiens
cucaaucuccucucucuuuccu

SEQ ID NO: 751471 - RNA, 17 nt, Homo sapiens
cucaaugaauaauugua

SEQ ID NO: 751472 - RNA, 12 nt, Homo sapiens
cucaauucacau

SEQ ID NO: 751473 - RNA, 20 nt, Homo sapiens
cucaauuuugucuguacuca

SEQ ID NO: 751474 - RNA, 18 nt, Homo sapiens
cucacaaggaaaaggcca

SEQ ID NO: 751475 - RNA, 22 nt, Homo sapiens
cucacacaaauuaaaauacagc

SEQ ID NO: 751476 - RNA, 14 nt, Homo sapiens
cucacacacauaga

SEQ ID NO: 751477 - RNA, 14 nt, Homo sapiens
cucacaccaacagu

SEQ ID NO: 751478 - RNA, 19 nt, Homo sapiens
cucacaccuguaaucccaa

SEQ ID NO: 751479 - RNA, 13 nt, Homo sapiens
cucacacuggcca

SEQ ID NO: 751480 - RNA, 16 nt, Homo sapiens
cucacagaacuaugua

SEQ ID NO: 751481 - RNA, 12 nt, Homo sapiens
cucacagaccug

SEQ ID NO: 751482 - RNA, 23 nt, Homo sapiens
gaagagaauauuagcuuuacugu

SEQ ID NO: 751483 - RNA, 19 nt, Homo sapiens
gaagagaauguauucugua

SEQ ID NO: 751484 - RNA, 14 nt, Homo sapiens
gaagagauccuucu

SEQ ID NO: 751485 - RNA, 18 nt, Homo sapiens
gaagagauccuucuguaa

SEQ ID NO: 751486 - RNA, 15 nt, Homo sapiens
gaagagcaagggaca

SEQ ID NO: 751487 - RNA, 18 nt, Homo sapiens
gaagagcagcauuuccca

SEQ ID NO: 751488 - RNA, 21 nt, Homo sapiens
gaagagcuccccuccacagcu

SEQ ID NO: 751489 - RNA, 21 nt, Homo sapiens
gaagaggccaguaggagacac

SEQ ID NO: 751490 - RNA, 20 nt, Homo sapiens
gaagagggagaagcaugaaa

SEQ ID NO: 751491 - RNA, 22 nt, Homo sapiens
gaagaguggguuucacaaguga

SEQ ID NO: 751492 - RNA, 17 nt, Homo sapiens
gaagaguuauaaaguau

SEQ ID NO: 751493 - RNA, 19 nt, Homo sapiens
gaagaguuuacagacaaua

SEQ ID NO: 751494 - RNA, 13 nt, Homo sapiens
gaagauagaucca

SEQ ID NO: 751495 - RNA, 22 nt, Homo sapiens
gaagauauaacauucaguuccc

SEQ ID NO: 751496 - RNA, 21 nt, Homo sapiens
gaagaucaacgccucacugaa

SEQ ID NO: 751497 - RNA, 16 nt, Homo sapiens
gaagaucuaaacuuuu

SEQ ID NO: 751498 - RNA, 13 nt, Homo sapiens
gaagaucuugaga

SEQ ID NO: 751499 - RNA, 21 nt, Homo sapiens
gaagaucuuugugaggugagc

SEQ ID NO: 751500 - RNA, 23 nt, Homo sapiens
gaagaugacgaguaacuccccuc

SEQ ID NO: 751501 - RNA, 23 nt, Homo sapiens
gaagaugagccuugcagauaucu

SEQ ID NO: 751502 - RNA, 17 nt, Homo sapiens
gaagauguguaaacagg

SEQ ID NO: 751503 - RNA, 16 nt, Homo sapiens
gaagauuagaaacuac

SEQ ID NO: 751504 - RNA, 21 nt, Homo sapiens
gaagauugcgguuuacagcua

SEQ ID NO: 751505 - RNA, 23 nt, Homo sapiens
gaagauuguuggugaauuuucaa

SEQ ID NO: 751506 - RNA, 24 nt, Homo sapiens
gaagauuuuaugcugcuguuuaca

SEQ ID NO: 751507 - RNA, 23 nt, Homo sapiens
gaagauuuuuaggagugauuacu

SEQ ID NO: 751508 - RNA, 18 nt, Homo sapiens
gaagcaacagcuucagaa

SEQ ID NO: 751509 - RNA, 16 nt, Homo sapiens
gaagcaagugguggga

SEQ ID NO: 751510 - RNA, 18 nt, Homo sapiens
gaagcaaguuuucuucca

SEQ ID NO: 751511 - RNA, 16 nt, Homo sapiens
gaagcacagagggcua

SEQ ID NO: 751512 - RNA, 18 nt, Homo sapiens
gaagcacagaguggcuug

SEQ ID NO: 751513 - RNA, 17 nt, Homo sapiens
gaagcacagcagcaucu

SEQ ID NO: 751514 - RNA, 16 nt, Homo sapiens
gaagcaccccaugcca

SEQ ID NO: 751515 - RNA, 19 nt, Homo sapiens
gaagcacuacaccuugccu

SEQ ID NO: 751516 - RNA, 13 nt, Homo sapiens
gaagcacugccau

SEQ ID NO: 751517 - RNA, 15 nt, Homo sapiens
gaagcagaaauguac

SEQ ID NO: 751518 - RNA, 17 nt, Homo sapiens
gaagcagaaauguacuu

SEQ ID NO: 751519 - RNA, 19 nt, Homo sapiens
gaagcagagagguggagaa

SEQ ID NO: 751520 - RNA, 16 nt, Homo sapiens
gaagcagccucagagu

SEQ ID NO: 751521 - RNA, 20 nt, Homo sapiens
gaagcagguucuugauguca

SEQ ID NO: 751522 - RNA, 13 nt, Homo sapiens
gaagcaguauuuu

SEQ ID NO: 751523 - RNA, 17 nt, Homo sapiens
gaagcagucuugcucug

SEQ ID NO: 751524 - RNA, 15 nt, Homo sapiens
gaagcagugccuucc

SEQ ID NO: 751525 - RNA, 12 nt, Homo sapiens
gaagccaaagaa

SEQ ID NO: 751526 - RNA, 15 nt, Homo sapiens
gaagccaagugggau

SEQ ID NO: 751527 - RNA, 17 nt, Homo sapiens
gaagccagccacagacc

SEQ ID NO: 751528 - RNA, 18 nt, Homo sapiens
gaagccaggaauuuccca

SEQ ID NO: 751529 - RNA, 20 nt, Homo sapiens
gaagccaggugagaaaacca

SEQ ID NO: 751530 - RNA, 17 nt, Homo sapiens
gaagccagugggguccc

SEQ ID NO: 751531 - RNA, 23 nt, Homo sapiens
gaagccauguacucaaguaccac

SEQ ID NO: 751532 - RNA, 15 nt, Homo sapiens
gaagccccauccaac

SEQ ID NO: 751533 - RNA, 19 nt, Homo sapiens
gaagcccccucuuccuccc

SEQ ID NO: 751534 - RNA, 13 nt, Homo sapiens
gaagccuagggga

SEQ ID NO: 751535 - RNA, 14 nt, Homo sapiens
gaagcguugccauu

SEQ ID NO: 751536 - RNA, 15 nt, Homo sapiens
gaagcuacugcauga

SEQ ID NO: 751537 - RNA, 21 nt, Homo sapiens
gaagcucuggugacaccagcc

SEQ ID NO: 751538 - RNA, 20 nt, Homo sapiens
gaagcucuucucuccagugu

SEQ ID NO: 751539 - RNA, 19 nt, Homo sapiens
gaagcucuugugaacuguc

SEQ ID NO: 751540 - RNA, 20 nt, Homo sapiens
gaagcucuugugaacugucu

SEQ ID NO: 751541 - RNA, 13 nt, Homo sapiens
gaagcugcugacc

SEQ ID NO: 751542 - RNA, 16 nt, Homo sapiens
gaagcuggccugagag

SEQ ID NO: 751543 - RNA, 13 nt, Homo sapiens
gaagcuguugcua

SEQ ID NO: 751544 - RNA, 19 nt, Homo sapiens
gaagcuuaaaaucugugaa

SEQ ID NO: 751545 - RNA, 22 nt, Homo sapiens
gaaggaacagcaauggugucag

SEQ ID NO: 751546 - RNA, 22 nt, Homo sapiens
gaaggaacauugcagagcuaag

SEQ ID NO: 751547 - RNA, 19 nt, Homo sapiens
gaaggacacagugaugaau

SEQ ID NO: 751548 - RNA, 16 nt, Homo sapiens
gaaggacggugccaag

SEQ ID NO: 751549 - RNA, 18 nt, Homo sapiens
gaaggacugaacuccauc

SEQ ID NO: 751550 - RNA, 18 nt, Homo sapiens
gaaggacuugacugggga

SEQ ID NO: 751551 - RNA, 14 nt, Homo sapiens
gaaggagagcaaga

SEQ ID NO: 751552 - RNA, 22 nt, Homo sapiens
gaaggagcauaugauugcucca

SEQ ID NO: 751553 - RNA, 14 nt, Homo sapiens
gaaggagcuuucau

SEQ ID NO: 751554 - RNA, 16 nt, Homo sapiens
gaaggauaaagccacu

SEQ ID NO: 751555 - RNA, 13 nt, Homo sapiens
gaaggaugaauga

SEQ ID NO: 751556 - RNA, 13 nt, Homo sapiens
gaaggauuaccug

SEQ ID NO: 751557 - RNA, 14 nt, Homo sapiens
gaaggauugcaaug

SEQ ID NO: 751558 - RNA, 15 nt, Homo sapiens
gaaggauugcaaugc

SEQ ID NO: 751559 - RNA, 19 nt, Homo sapiens
gaaggcagagguugcagug

SEQ ID NO: 751560 - RNA, 18 nt, Homo sapiens
gaaggcaguggcagggga

SEQ ID NO: 751561 - RNA, 12 nt, Homo sapiens
gaaggccaagag

SEQ ID NO: 751562 - RNA, 22 nt, Homo sapiens
gaaggccagcccacacccagcu

SEQ ID NO: 751563 - RNA, 19 nt, Homo sapiens
gaaggcuucuuagcgcagu

SEQ ID NO: 751564 - RNA, 17 nt, Homo sapiens
gaagggaauugcucaga

SEQ ID NO: 751565 - RNA, 13 nt, Homo sapiens
gaagggaauuugg

SEQ ID NO: 751566 - RNA, 14 nt, Homo sapiens
gaagggacacagag

SEQ ID NO: 751567 - RNA, 16 nt, Homo sapiens
gaagggaggguggcca

SEQ ID NO: 751568 - RNA, 17 nt, Homo sapiens
gaagggcugaguggucu

SEQ ID NO: 751569 - RNA, 23 nt, Homo sapiens
gaaggguaccuugaacacugggg

SEQ ID NO: 751570 - RNA, 12 nt, Homo sapiens
gaaggguggaug

SEQ ID NO: 751571 - RNA, 23 nt, Homo sapiens
gaagguaacugauaaaccaaaau

SEQ ID NO: 751572 - RNA, 23 nt, Homo sapiens
gaagguagcccagcacugugaag

SEQ ID NO: 751573 - RNA, 21 nt, Homo sapiens
gaaggucccaccuccauuugc

SEQ ID NO: 751574 - RNA, 16 nt, Homo sapiens
gaaggucccucagaca

SEQ ID NO: 751575 - RNA, 22 nt, Homo sapiens
gaaggucucaggagaagggaua

SEQ ID NO: 751576 - RNA, 16 nt, Homo sapiens
gaagguucucugugcu

SEQ ID NO: 751577 - RNA, 23 nt, Homo sapiens
gaaguaacaaaagaagugacauc

SEQ ID NO: 751578 - RNA, 21 nt, Homo sapiens
gaaguacaaagguugcagugc

SEQ ID NO: 751579 - RNA, 19 nt, Homo sapiens
gaaguagauuaagagccau

SEQ ID NO: 751580 - RNA, 21 nt, Homo sapiens
gaaguagcucuggugaccuug

SEQ ID NO: 751581 - RNA, 14 nt, Homo sapiens
gaaguagcucuuuu

SEQ ID NO: 751582 - RNA, 16 nt, Homo sapiens
gaaguagcuucagagg

SEQ ID NO: 751583 - RNA, 17 nt, Homo sapiens
gaaguaggcauauauca

SEQ ID NO: 751584 - RNA, 18 nt, Homo sapiens
gaaguaggcauauaucac

SEQ ID NO: 751585 - RNA, 13 nt, Homo sapiens
gaaguagguguga

SEQ ID NO: 751586 - RNA, 14 nt, Homo sapiens
gaaguaugagggaa

SEQ ID NO: 751587 - RNA, 22 nt, Homo sapiens
gaaguaugagggaaaaugagua

SEQ ID NO: 751588 - RNA, 13 nt, Homo sapiens
gaagucacaucac

SEQ ID NO: 751589 - RNA, 21 nt, Homo sapiens
gaagucagaggagaugugguc

SEQ ID NO: 751590 - RNA, 21 nt, Homo sapiens
gaagucauccagucuauucac

SEQ ID NO: 751591 - RNA, 16 nt, Homo sapiens
gaagucaucucauucc

SEQ ID NO: 751592 - RNA, 18 nt, Homo sapiens
gaaguccccucuacuuua

SEQ ID NO: 751593 - RNA, 22 nt, Homo sapiens
gaagucgggcaugguggcucau

SEQ ID NO: 751594 - RNA, 15 nt, Homo sapiens
gaagucuccaugaag

SEQ ID NO: 751595 - RNA, 20 nt, Homo sapiens
gaagucucccugcacagccu

SEQ ID NO: 751596 - RNA, 21 nt, Homo sapiens
gacagcucccucugccugaac

SEQ ID NO: 751597 - RNA, 13 nt, Homo sapiens
gacagcucuccaa

SEQ ID NO: 751598 - RNA, 18 nt, Homo sapiens
gacagcucuguaucugcc

SEQ ID NO: 751599 - RNA, 14 nt, Homo sapiens
gacagcuucaugaa

SEQ ID NO: 751600 - RNA, 15 nt, Homo sapiens
gacagcuuucuggga

SEQ ID NO: 751601 - RNA, 22 nt, Homo sapiens
gacagcuuuucccaagauguca

SEQ ID NO: 751602 - RNA, 15 nt, Homo sapiens
gacaggaauacuuaa

SEQ ID NO: 751603 - RNA, 18 nt, Homo sapiens
gacaggauuucacugugu

SEQ ID NO: 751604 - RNA, 21 nt, Homo sapiens
gacaggcaugaaucacugugc

SEQ ID NO: 751605 - RNA, 23 nt, Homo sapiens
gacaggcccaagagaugaagagu

SEQ ID NO: 751606 - RNA, 16 nt, Homo sapiens
gacagggaaaggucag

SEQ ID NO: 751607 - RNA, 20 nt, Homo sapiens
gacaguccaaaccacuccac

SEQ ID NO: 751608 - RNA, 14 nt, Homo sapiens
gacaguccacaggg

SEQ ID NO: 751609 - RNA, 18 nt, Homo sapiens
gacaguccacaggggcca

SEQ ID NO: 751610 - RNA, 21 nt, Homo sapiens
gacagugaagcagcacuguga

SEQ ID NO: 751611 - RNA, 18 nt, Homo sapiens
gacagugaggcaggagaa

SEQ ID NO: 751612 - RNA, 19 nt, Homo sapiens
gacagugcccaugcaaugg

SEQ ID NO: 751613 - RNA, 17 nt, Homo sapiens
gacagugccucuuccag

SEQ ID NO: 751614 - RNA, 18 nt, Homo sapiens
gacaguguagcacucuac

SEQ ID NO: 751615 - RNA, 22 nt, Homo sapiens
gacaguuuguggcaucuugcca

SEQ ID NO: 751616 - RNA, 19 nt, Homo sapiens
gacauacauauuaucucau

SEQ ID NO: 751617 - RNA, 22 nt, Homo sapiens
gacauauacuaagauguucacu

SEQ ID NO: 751618 - RNA, 21 nt, Homo sapiens
gacaucaaagugguaaauacu

SEQ ID NO: 751619 - RNA, 20 nt, Homo sapiens
gacaucagccugcuucuucc

SEQ ID NO: 751620 - RNA, 12 nt, Homo sapiens
gacaucaucaag

SEQ ID NO: 751621 - RNA, 22 nt, Homo sapiens
gacaucgguguucuucuuccca

SEQ ID NO: 751622 - RNA, 14 nt, Homo sapiens
gacaugacauucuu

SEQ ID NO: 751623 - RNA, 14 nt, Homo sapiens
gacaugagucuuug

SEQ ID NO: 751624 - RNA, 15 nt, Homo sapiens
gacaugcacugaccc

SEQ ID NO: 751625 - RNA, 17 nt, Homo sapiens
gacauggaccuacugca

SEQ ID NO: 751626 - RNA, 14 nt, Homo sapiens
gacaugggccuccc

SEQ ID NO: 751627 - RNA, 16 nt, Homo sapiens
gacauguggggccagg

SEQ ID NO: 751628 - RNA, 17 nt, Homo sapiens
gacauguuuuuauaugu

SEQ ID NO: 751629 - RNA, 16 nt, Homo sapiens
gacauuacuuguuuua

SEQ ID NO: 751630 - RNA, 16 nt, Homo sapiens
gacauucaaggcauuu

SEQ ID NO: 751631 - RNA, 13 nt, Homo sapiens
gacauuccaccau

SEQ ID NO: 751632 - RNA, 20 nt, Homo sapiens
gacauucuggaaaagcaaaa

SEQ ID NO: 751633 - RNA, 19 nt, Homo sapiens
gacauugaccuauuuccag

SEQ ID NO: 751634 - RNA, 17 nt, Homo sapiens
gacauuguggacuguau

SEQ ID NO: 751635 - RNA, 17 nt, Homo sapiens
gacauuuauaauacaaa

SEQ ID NO: 751636 - RNA, 14 nt, Homo sapiens
gacauuuauucaaa

SEQ ID NO: 751637 - RNA, 17 nt, Homo sapiens
gacauuuugugacugaa

SEQ ID NO: 751638 - RNA, 10 nt, Homo sapiens
gaccaaagga

SEQ ID NO: 751639 - RNA, 15 nt, Homo sapiens
gaccaaaguuugcaa

SEQ ID NO: 751640 - RNA, 24 nt, Homo sapiens
gaccaaaugccugguaccagagga

SEQ ID NO: 751641 - RNA, 14 nt, Homo sapiens
gaccaauaccuccu

SEQ ID NO: 751642 - RNA, 20 nt, Homo sapiens
gaccaaucaucaacuaccau

SEQ ID NO: 751643 - RNA, 22 nt, Homo sapiens
gaccaauucaacccuuugcccc

SEQ ID NO: 751644 - RNA, 19 nt, Homo sapiens
gaccaauugugcugccauu

SEQ ID NO: 751645 - RNA, 20 nt, Homo sapiens
gaccaauugugcugccauuu

SEQ ID NO: 751646 - RNA, 18 nt, Homo sapiens
gaccacaccaaccaggcc

SEQ ID NO: 751647 - RNA, 12 nt, Homo sapiens
gaccacaccacu

SEQ ID NO: 751648 - RNA, 22 nt, Homo sapiens
gaccacagacgggcacacagac

SEQ ID NO: 751649 - RNA, 14 nt, Homo sapiens
gaccacaucuuuau

SEQ ID NO: 751650 - RNA, 15 nt, Homo sapiens
gaccaccacuucgaa

SEQ ID NO: 751651 - RNA, 18 nt, Homo sapiens
gaccaccuuuuugaguga

SEQ ID NO: 751652 - RNA, 21 nt, Homo sapiens
gaccacgcuuucuagcuguug

SEQ ID NO: 751653 - RNA, 11 nt, Homo sapiens
gaccacugucu

SEQ ID NO: 751654 - RNA, 23 nt, Homo sapiens
gaccacuuccaggggaaccugcc

SEQ ID NO: 751655 - RNA, 21 nt, Homo sapiens
gaccagaaugaaaacuguaaa

SEQ ID NO: 751656 - RNA, 13 nt, Homo sapiens
gaccagagaucga

SEQ ID NO: 751657 - RNA, 20 nt, Homo sapiens
gaccagaucagggacuugaa

SEQ ID NO: 751658 - RNA, 16 nt, Homo sapiens
gaccagccugggcaac

SEQ ID NO: 751659 - RNA, 21 nt, Homo sapiens
gaccagcucacguaaugcauu

SEQ ID NO: 751660 - RNA, 13 nt, Homo sapiens
gaccagcuuugca

SEQ ID NO: 751661 - RNA, 22 nt, Homo sapiens
gaccagugaaacuaugauccca

SEQ ID NO: 751662 - RNA, 18 nt, Homo sapiens
gaccaguggcuggucuca

SEQ ID NO: 751663 - RNA, 22 nt, Homo sapiens
gaccauccuggcuaacacguga

SEQ ID NO: 751664 - RNA, 15 nt, Homo sapiens
gaccaucuaccccuu

SEQ ID NO: 751665 - RNA, 13 nt, Homo sapiens
gaccaucugugac

SEQ ID NO: 751666 - RNA, 21 nt, Homo sapiens
gaccaugcucaucugcugguc

SEQ ID NO: 751667 - RNA, 16 nt, Homo sapiens
gaccauuucucagcau

SEQ ID NO: 751668 - RNA, 15 nt, Homo sapiens
gaccauuugacuguu

SEQ ID NO: 751669 - RNA, 22 nt, Homo sapiens
gaccauuugacuguucaaugau

SEQ ID NO: 751670 - RNA, 11 nt, Homo sapiens
gacccaagacc

SEQ ID NO: 751671 - RNA, 17 nt, Homo sapiens
gacccaagauaaaagaa

SEQ ID NO: 751672 - RNA, 15 nt, Homo sapiens
gacccacacuuccau

SEQ ID NO: 751673 - RNA, 20 nt, Homo sapiens
gacccacacuuccaugagaa

SEQ ID NO: 751674 - RNA, 19 nt, Homo sapiens
gacccaccuucaagcagcu

SEQ ID NO: 751675 - RNA, 23 nt, Homo sapiens
gacccacugaaaugaccaagaca

SEQ ID NO: 751676 - RNA, 15 nt, Homo sapiens
gacccaggaggccca

SEQ ID NO: 751677 - RNA, 23 nt, Homo sapiens
gacccaggggucagccuuaggaa

SEQ ID NO: 751678 - RNA, 20 nt, Homo sapiens
gacccaguggacucuuccac

SEQ ID NO: 751679 - RNA, 16 nt, Homo sapiens
gacccaucacuuugga

SEQ ID NO: 751680 - RNA, 17 nt, Homo sapiens
gaccccaaguuauccac

SEQ ID NO: 751681 - RNA, 17 nt, Homo sapiens
gaccccuacccacuucc

SEQ ID NO: 751682 - RNA, 15 nt, Homo sapiens
gaccccugaccucac

SEQ ID NO: 751683 - RNA, 18 nt, Homo sapiens
gaccccugacucaucauu

SEQ ID NO: 751684 - RNA, 18 nt, Homo sapiens
gaccccugucucccaaaa

SEQ ID NO: 751685 - RNA, 23 nt, Homo sapiens
gaccccuucccuguccuugcccu

SEQ ID NO: 751686 - RNA, 15 nt, Homo sapiens
gaccccuuucacuua

SEQ ID NO: 751687 - RNA, 14 nt, Homo sapiens
gacccggcggcccu

SEQ ID NO: 751688 - RNA, 14 nt, Homo sapiens
gacccuaaaucuga

SEQ ID NO: 751689 - RNA, 16 nt, Homo sapiens
gacccuccccuaguca

SEQ ID NO: 751690 - RNA, 13 nt, Homo sapiens
gacccucucagaa

SEQ ID NO: 751691 - RNA, 23 nt, Homo sapiens
gacccugaaaggaacacuggcuu

SEQ ID NO: 751692 - RNA, 17 nt, Homo sapiens
gacccugagaaggcaaa

SEQ ID NO: 751693 - RNA, 15 nt, Homo sapiens
gacccugcaagacca

SEQ ID NO: 751694 - RNA, 16 nt, Homo sapiens
gacccugcaagaccac

SEQ ID NO: 751695 - RNA, 16 nt, Homo sapiens
gacccuggucugagga

SEQ ID NO: 751696 - RNA, 23 nt, Homo sapiens
gacccuggugggcuguucagcuu

SEQ ID NO: 751697 - RNA, 16 nt, Homo sapiens
gacccugucucaaaaa

SEQ ID NO: 751698 - RNA, 12 nt, Homo sapiens
gacccuuuucau

SEQ ID NO: 751699 - RNA, 16 nt, Homo sapiens
gacccuuuucucagga

SEQ ID NO: 751700 - RNA, 12 nt, Homo sapiens
gaccgaggacac

SEQ ID NO: 751701 - RNA, 15 nt, Homo sapiens
gaccuaacauucgau

SEQ ID NO: 751702 - RNA, 22 nt, Homo sapiens
gaccuacagugcuguguacccu

SEQ ID NO: 751703 - RNA, 13 nt, Homo sapiens
gaccuacuguucu

SEQ ID NO: 751704 - RNA, 21 nt, Homo sapiens
gaccuaguccccuuuccucua

SEQ ID NO: 751705 - RNA, 15 nt, Homo sapiens
gaccucaagugaucu

SEQ ID NO: 751706 - RNA, 18 nt, Homo sapiens
gaccucaaguguccugaa

SEQ ID NO: 751707 - RNA, 19 nt, Homo sapiens
gaccucaaugaagcagaaa

SEQ ID NO: 751708 - RNA, 13 nt, Homo sapiens
gaccucacaguga

SEQ ID NO: 751709 - RNA, 14 nt, Homo sapiens
gaccucaccugcug

SEQ ID NO: 751710 - RNA, 14 nt, Homo sapiens
gaccucagccugug

SEQ ID NO: 751711 - RNA, 19 nt, Homo sapiens
ggaaacccaccucucugga

SEQ ID NO: 751712 - RNA, 19 nt, Homo sapiens
ggaaacuaguguacauuuc

SEQ ID NO: 751713 - RNA, 21 nt, Homo sapiens
ggaaacugcucccaucauucc

SEQ ID NO: 751714 - RNA, 20 nt, Homo sapiens
ggaaacuguaugaaugucug

SEQ ID NO: 751715 - RNA, 16 nt, Homo sapiens
ggaaagaaaugcccau

SEQ ID NO: 751716 - RNA, 16 nt, Homo sapiens
ggaaagcaucaccuca

SEQ ID NO: 751717 - RNA, 20 nt, Homo sapiens
ggaaaggaggcaugccucug

SEQ ID NO: 751718 - RNA, 21 nt, Homo sapiens
ggaaaggauuuuaccaaagca

SEQ ID NO: 751719 - RNA, 16 nt, Homo sapiens
ggaaagggagggaaua

SEQ ID NO: 751720 - RNA, 17 nt, Homo sapiens
ggaaagugauaugcauu

SEQ ID NO: 751721 - RNA, 23 nt, Homo sapiens
ggaaauaguaccuucaauacuua

SEQ ID NO: 751722 - RNA, 12 nt, Homo sapiens
ggaaaucuccuc

SEQ ID NO: 751723 - RNA, 21 nt, Homo sapiens
ggaaauguaacuugaagcagc

SEQ ID NO: 751724 - RNA, 12 nt, Homo sapiens
ggaaauucaaag

SEQ ID NO: 751725 - RNA, 20 nt, Homo sapiens
ggaaauuuuucagacuuuaa

SEQ ID NO: 751726 - RNA, 18 nt, Homo sapiens
ggaacagaaggaugaaug

SEQ ID NO: 751727 - RNA, 16 nt, Homo sapiens
ggaacaucacauuccu

SEQ ID NO: 751728 - RNA, 21 nt, Homo sapiens
ggaacaugacccagccugaaa

SEQ ID NO: 751729 - RNA, 15 nt, Homo sapiens
ggaacaugcguguga

SEQ ID NO: 751730 - RNA, 15 nt, Homo sapiens
ggaacauuugauauu

SEQ ID NO: 751731 - RNA, 14 nt, Homo sapiens
ggaacccagacuca

SEQ ID NO: 751732 - RNA, 15 nt, Homo sapiens
ggaacuaaagcaaau

SEQ ID NO: 751733 - RNA, 21 nt, Homo sapiens
ggaacuagagggauacacuga

SEQ ID NO: 751734 - RNA, 22 nt, Homo sapiens
ggaacuagagggauacacugaa

SEQ ID NO: 751735 - RNA, 21 nt, Homo sapiens
ggaacucuagaagaccaaaug

SEQ ID NO: 751736 - RNA, 14 nt, Homo sapiens
ggaacucuccuuug

SEQ ID NO: 751737 - RNA, 10 nt, Homo sapiens
ggaacuuccu

SEQ ID NO: 751738 - RNA, 19 nt, Homo sapiens
ggaagaaaagcugccauuu

SEQ ID NO: 751739 - RNA, 16 nt, Homo sapiens
ggaagaaccacugucu

SEQ ID NO: 751740 - RNA, 18 nt, Homo sapiens
ggaagaagauagauccaa

SEQ ID NO: 751741 - RNA, 18 nt, Homo sapiens
ggaagaaugaacacuccc

SEQ ID NO: 751742 - RNA, 12 nt, Homo sapiens
ggaagaccaaga

SEQ ID NO: 751743 - RNA, 14 nt, Homo sapiens
ggaagaccaagaca

SEQ ID NO: 751744 - RNA, 19 nt, Homo sapiens
ggaagacuagaggcuugca

SEQ ID NO: 751745 - RNA, 13 nt, Homo sapiens
ggaagacugacag

SEQ ID NO: 751746 - RNA, 18 nt, Homo sapiens
ggaagacuugaagcacag

SEQ ID NO: 751747 - RNA, 21 nt, Homo sapiens
ggaagagauaaacgaccaaac

SEQ ID NO: 751748 - RNA, 14 nt, Homo sapiens
ggaagagcaaggga

SEQ ID NO: 751749 - RNA, 23 nt, Homo sapiens
ggaagauauaacauucaguuccc

SEQ ID NO: 751750 - RNA, 20 nt, Homo sapiens
ggaagauccugaagcaguuc

SEQ ID NO: 751751 - RNA, 20 nt, Homo sapiens
ggaagaucuugagagcugcu

SEQ ID NO: 751752 - RNA, 14 nt, Homo sapiens
ggaagauggcauaa

SEQ ID NO: 751753 - RNA, 13 nt, Homo sapiens
ggaagccagguac

SEQ ID NO: 751754 - RNA, 16 nt, Homo sapiens
ggaagccccacuugaa

SEQ ID NO: 751755 - RNA, 17 nt, Homo sapiens
ggaagccccacuugaag

SEQ ID NO: 751756 - RNA, 17 nt, Homo sapiens
ggaagccggcggcccaa

SEQ ID NO: 751757 - RNA, 18 nt, Homo sapiens
ggaagcggcccuaaggga

SEQ ID NO: 751758 - RNA, 20 nt, Homo sapiens
ggaagcuaccagagcucuau

SEQ ID NO: 751759 - RNA, 15 nt, Homo sapiens
ggaagcucuaccgca

SEQ ID NO: 751760 - RNA, 19 nt, Homo sapiens
ggaagcucugaagucacau

SEQ ID NO: 751761 - RNA, 21 nt, Homo sapiens
ggaagcugggugagccaagga

SEQ ID NO: 751762 - RNA, 21 nt, Homo sapiens
ggaaggaacagcaaugguguc

SEQ ID NO: 751763 - RNA, 14 nt, Homo sapiens
ggaaggaaccagaa

SEQ ID NO: 751764 - RNA, 19 nt, Homo sapiens
ggaaggacuugacugggga

SEQ ID NO: 751765 - RNA, 17 nt, Homo sapiens
ggaaggagggagcugcu

SEQ ID NO: 751766 - RNA, 13 nt, Homo sapiens
ggaaggagggcac

SEQ ID NO: 751767 - RNA, 13 nt, Homo sapiens
ggaaggcucucgg

SEQ ID NO: 751768 - RNA, 11 nt, Homo sapiens
ggaagggucaa

SEQ ID NO: 751769 - RNA, 22 nt, Homo sapiens
ggaagguagcccagcacuguga

SEQ ID NO: 751770 - RNA, 13 nt, Homo sapiens
ggaaggugcugaa

SEQ ID NO: 751771 - RNA, 11 nt, Homo sapiens
ggaagucucca

SEQ ID NO: 751772 - RNA, 15 nt, Homo sapiens
ggaagucuccaugaa

SEQ ID NO: 751773 - RNA, 15 nt, Homo sapiens
ggaaguguaacagcu

SEQ ID NO: 751774 - RNA, 16 nt, Homo sapiens
ggaaguuaaagggcau

SEQ ID NO: 751775 - RNA, 12 nt, Homo sapiens
ggaaguucuccu

SEQ ID NO: 751776 - RNA, 12 nt, Homo sapiens
ggaaguuuucag

SEQ ID NO: 751777 - RNA, 16 nt, Homo sapiens
ggaaguuuuccuacac

SEQ ID NO: 751778 - RNA, 17 nt, Homo sapiens
ggaauaaaaaauacugu

SEQ ID NO: 751779 - RNA, 16 nt, Homo sapiens
ggaauaacuuuuacac

SEQ ID NO: 751780 - RNA, 15 nt, Homo sapiens
ggaauacugugcaua

SEQ ID NO: 751781 - RNA, 16 nt, Homo sapiens
ggaauagugaauacuu

SEQ ID NO: 751782 - RNA, 23 nt, Homo sapiens
ggaauagugcuugcuggccacaa

SEQ ID NO: 751783 - RNA, 14 nt, Homo sapiens
ggaauauacggaau

SEQ ID NO: 751784 - RNA, 14 nt, Homo sapiens
ggaaucaauuacuu

SEQ ID NO: 751785 - RNA, 13 nt, Homo sapiens
ggaaucagugaag

SEQ ID NO: 751786 - RNA, 20 nt, Homo sapiens
ggaauccaagccuccacagc

SEQ ID NO: 751787 - RNA, 21 nt, Homo sapiens
ggaauccuuggggagcacuug

SEQ ID NO: 751788 - RNA, 16 nt, Homo sapiens
ggaaucgaaguguuua

SEQ ID NO: 751789 - RNA, 14 nt, Homo sapiens
ggaaugaacugucc

SEQ ID NO: 751790 - RNA, 17 nt, Homo sapiens
ggaaugcaauccuuccc

SEQ ID NO: 751791 - RNA, 19 nt, Homo sapiens
ggaaugccgcugucucuga

SEQ ID NO: 751792 - RNA, 20 nt, Homo sapiens
ggaaugccgcugucucugag

SEQ ID NO: 751793 - RNA, 15 nt, Homo sapiens
ggaauggacauuucu

SEQ ID NO: 751794 - RNA, 23 nt, Homo sapiens
ggaauuacaaaacucagagaaau

SEQ ID NO: 751795 - RNA, 12 nt, Homo sapiens
ggaauucagugc

SEQ ID NO: 751796 - RNA, 20 nt, Homo sapiens
ggaauucuaaauaaauuucc

SEQ ID NO: 751797 - RNA, 16 nt, Homo sapiens
ggaauuuucucuccau

SEQ ID NO: 751798 - RNA, 18 nt, Homo sapiens
ggacaaaacacugugucc

SEQ ID NO: 751799 - RNA, 18 nt, Homo sapiens
ggacaaaccgagugcaau

SEQ ID NO: 751800 - RNA, 21 nt, Homo sapiens
ggacaaaccgagugcaaugaa

SEQ ID NO: 751801 - RNA, 20 nt, Homo sapiens
ggacaaagucuccagcccac

SEQ ID NO: 751802 - RNA, 21 nt, Homo sapiens
ggacaagaggguucacacagc

SEQ ID NO: 751803 - RNA, 14 nt, Homo sapiens
ggacacaacacaga

SEQ ID NO: 751804 - RNA, 14 nt, Homo sapiens
ggacacacaggcag

SEQ ID NO: 751805 - RNA, 14 nt, Homo sapiens
ggacacagugauga

SEQ ID NO: 751806 - RNA, 15 nt, Homo sapiens
ggacacaguggagcc

SEQ ID NO: 751807 - RNA, 22 nt, Homo sapiens
ggacaccauagugucacagaga

SEQ ID NO: 751808 - RNA, 22 nt, Homo sapiens
ggacacccugguucccaccauu

SEQ ID NO: 751809 - RNA, 16 nt, Homo sapiens
ggacacuaucacucau

SEQ ID NO: 751810 - RNA, 23 nt, Homo sapiens
ggacagaaagagacuccgucuca

SEQ ID NO: 751811 - RNA, 20 nt, Homo sapiens
ggacagaugaaugccgugga

SEQ ID NO: 751812 - RNA, 18 nt, Homo sapiens
ggacagccccacccuggu

SEQ ID NO: 751813 - RNA, 16 nt, Homo sapiens
ggacaguaucccacau

SEQ ID NO: 751814 - RNA, 21 nt, Homo sapiens
ggacauagccagcauuuuugc

SEQ ID NO: 751815 - RNA, 23 nt, Homo sapiens
ggacaucaaagugguaaauacug

SEQ ID NO: 751816 - RNA, 16 nt, Homo sapiens
ggacaucacagggugg

SEQ ID NO: 751817 - RNA, 14 nt, Homo sapiens
ggacaucauucugc

SEQ ID NO: 751818 - RNA, 22 nt, Homo sapiens
ggacaucuaguaggugcuugac

SEQ ID NO: 751819 - RNA, 16 nt, Homo sapiens
ggacaugcccugugug

SEQ ID NO: 751820 - RNA, 19 nt, Homo sapiens
ggacaugcuuuucugccac

SEQ ID NO: 751821 - RNA, 17 nt, Homo sapiens
ggacauuuaaaauucaa

SEQ ID NO: 751822 - RNA, 18 nt, Homo sapiens
ggaccaaaggguuuacuu

SEQ ID NO: 751823 - RNA, 18 nt, Homo sapiens
ggaccaagcagagcucac

SEQ ID NO: 751824 - RNA, 13 nt, Homo sapiens
ggaccacaccucc

SEQ ID NO: 751825 - RNA, 13 nt, Homo sapiens
ggaccacauuuua

SEQ ID NO: 751826 - RNA, 17 nt, Homo sapiens
ggccuuaacacacuggc

SEQ ID NO: 751827 - RNA, 17 nt, Homo sapiens
ggccuucugaacuccau

SEQ ID NO: 751828 - RNA, 16 nt, Homo sapiens
ggccuugcuaccucaa

SEQ ID NO: 751829 - RNA, 12 nt, Homo sapiens
ggccuuuacuag

SEQ ID NO: 751830 - RNA, 21 nt, Homo sapiens
ggcgaagcucaggcaaaaaca

SEQ ID NO: 751831 - RNA, 20 nt, Homo sapiens
ggcgacagagcgagacucca

SEQ ID NO: 751832 - RNA, 21 nt, Homo sapiens
ggcgaccuccuuucaucacac

SEQ ID NO: 751833 - RNA, 15 nt, Homo sapiens
ggcgagcacugugag

SEQ ID NO: 751834 - RNA, 22 nt, Homo sapiens
ggcgcccuuggcuucugugaug

SEQ ID NO: 751835 - RNA, 22 nt, Homo sapiens
ggcgcguuugugcauaucugcc

SEQ ID NO: 751836 - RNA, 23 nt, Homo sapiens
ggcgcguuugugcauaucugccu

SEQ ID NO: 751837 - RNA, 17 nt, Homo sapiens
ggcgcucucccuaccuu

SEQ ID NO: 751838 - RNA, 22 nt, Homo sapiens
ggcggcccuucugacuguuuau

SEQ ID NO: 751839 - RNA, 16 nt, Homo sapiens
ggcggcugugcaucag

SEQ ID NO: 751840 - RNA, 20 nt, Homo sapiens
ggcggguggaucacaagguc

SEQ ID NO: 751841 - RNA, 14 nt, Homo sapiens
ggcgucaccaucca

SEQ ID NO: 751842 - RNA, 16 nt, Homo sapiens
ggcgucccuaccuccu

SEQ ID NO: 751843 - RNA, 18 nt, Homo sapiens
ggcguggaggaggaggga

SEQ ID NO: 751844 - RNA, 16 nt, Homo sapiens
ggcguggggccaauac

SEQ ID NO: 751845 - RNA, 14 nt, Homo sapiens
ggcgugugugacac

SEQ ID NO: 751846 - RNA, 13 nt, Homo sapiens
ggcguuacugcuu

SEQ ID NO: 751847 - RNA, 22 nt, Homo sapiens
ggcguuacugcuugaccaaaga

SEQ ID NO: 751848 - RNA, 13 nt, Homo sapiens
ggcuaacauccca

SEQ ID NO: 751849 - RNA, 13 nt, Homo sapiens
ggcuaauucugca

SEQ ID NO: 751850 - RNA, 23 nt, Homo sapiens
ggcuaauuuaacaagaacuuuaa

SEQ ID NO: 751851 - RNA, 23 nt, Homo sapiens
ggcuaccucaccugggcagggau

SEQ ID NO: 751852 - RNA, 23 nt, Homo sapiens
ggcuacuaccuagggcacuuuaa

SEQ ID NO: 751853 - RNA, 14 nt, Homo sapiens
ggcuauagcacaca

SEQ ID NO: 751854 - RNA, 23 nt, Homo sapiens
ggcuaucaacauguuauucaaug

SEQ ID NO: 751855 - RNA, 17 nt, Homo sapiens
ggcuauggaggguccuc

SEQ ID NO: 751856 - RNA, 16 nt, Homo sapiens
ggcuauugaccaugug

SEQ ID NO: 751857 - RNA, 17 nt, Homo sapiens
ggcuauuuguguguaug

SEQ ID NO: 751858 - RNA, 17 nt, Homo sapiens
ggcuauuuucagaugaa

SEQ ID NO: 751859 - RNA, 15 nt, Homo sapiens
ggcucaacauugugu

SEQ ID NO: 751860 - RNA, 16 nt, Homo sapiens
ggcucaaggcugugca

SEQ ID NO: 751861 - RNA, 13 nt, Homo sapiens
ggcucacaguggg

SEQ ID NO: 751862 - RNA, 17 nt, Homo sapiens
ggcucacgccuguaauc

SEQ ID NO: 751863 - RNA, 14 nt, Homo sapiens
ggcucacucacaga

SEQ ID NO: 751864 - RNA, 17 nt, Homo sapiens
ggcucagacauguuuuc

SEQ ID NO: 751865 - RNA, 23 nt, Homo sapiens
ggcucagguuuugagaagccauc

SEQ ID NO: 751866 - RNA, 11 nt, Homo sapiens
ggcucaucucu

SEQ ID NO: 751867 - RNA, 13 nt, Homo sapiens
ggcucaugaccug

SEQ ID NO: 751868 - RNA, 13 nt, Homo sapiens
ggcucccaggaca

SEQ ID NO: 751869 - RNA, 13 nt, Homo sapiens
ggcucccaugacc

SEQ ID NO: 751870 - RNA, 18 nt, Homo sapiens
ggcuccucggacucugcu

SEQ ID NO: 751871 - RNA, 16 nt, Homo sapiens
ggcuccuggcugccag

SEQ ID NO: 751872 - RNA, 16 nt, Homo sapiens
ggcucguguauuuauu

SEQ ID NO: 751873 - RNA, 19 nt, Homo sapiens
ggcucuaauucacagugcu

SEQ ID NO: 751874 - RNA, 23 nt, Homo sapiens
ggcucuaucuuuuccuucaguga

SEQ ID NO: 751875 - RNA, 21 nt, Homo sapiens
ggcucucgcugcccuguggac

SEQ ID NO: 751876 - RNA, 15 nt, Homo sapiens
ggcucugcaggccac

SEQ ID NO: 751877 - RNA, 21 nt, Homo sapiens
ggcucugugcagucacuggag

SEQ ID NO: 751878 - RNA, 17 nt, Homo sapiens
ggcucuguuugugggac

SEQ ID NO: 751879 - RNA, 14 nt, Homo sapiens
ggcucuuccuugaa

SEQ ID NO: 751880 - RNA, 16 nt, Homo sapiens
ggcucuucucauuuca

SEQ ID NO: 751881 - RNA, 14 nt, Homo sapiens
ggcucuuucuaucc

SEQ ID NO: 751882 - RNA, 21 nt, Homo sapiens
ggcugaaaaugcaaagcugaa

SEQ ID NO: 751883 - RNA, 15 nt, Homo sapiens
ggcugaagugucaca

SEQ ID NO: 751884 - RNA, 19 nt, Homo sapiens
ggcugaauccgugguggca

SEQ ID NO: 751885 - RNA, 21 nt, Homo sapiens
ggcugacaccuaccaugcugc

SEQ ID NO: 751886 - RNA, 23 nt, Homo sapiens
ggcugaccccgguggcggcccca

SEQ ID NO: 751887 - RNA, 22 nt, Homo sapiens
ggcugaggcagcagacuggugu

SEQ ID NO: 751888 - RNA, 20 nt, Homo sapiens
ggcugaggccucucauucca

SEQ ID NO: 751889 - RNA, 18 nt, Homo sapiens
ggcugagugagccacaga

SEQ ID NO: 751890 - RNA, 10 nt, Homo sapiens
ggcugaugau

SEQ ID NO: 751891 - RNA, 13 nt, Homo sapiens
ggcugaugaucca

SEQ ID NO: 751892 - RNA, 21 nt, Homo sapiens
ggcugauuuguuugugauguu

SEQ ID NO: 751893 - RNA, 20 nt, Homo sapiens
ggcugcaugauguuugccca

SEQ ID NO: 751894 - RNA, 14 nt, Homo sapiens
ggcugccagccagg

SEQ ID NO: 751895 - RNA, 17 nt, Homo sapiens
ggcugccugcuguguua

SEQ ID NO: 751896 - RNA, 20 nt, Homo sapiens
ggcugcugaaacucauuuga

SEQ ID NO: 751897 - RNA, 15 nt, Homo sapiens
ggcugcuggggcaug

SEQ ID NO: 751898 - RNA, 12 nt, Homo sapiens
ggcugcugugaa

SEQ ID NO: 751899 - RNA, 16 nt, Homo sapiens
ggcugcuuuguucaau

SEQ ID NO: 751900 - RNA, 20 nt, Homo sapiens
ggcuggagugcaguggcaug

SEQ ID NO: 751901 - RNA, 14 nt, Homo sapiens
ggcuggccaaggug

SEQ ID NO: 751902 - RNA, 22 nt, Homo sapiens
ggcugggaacaacuucagucca

SEQ ID NO: 751903 - RNA, 21 nt, Homo sapiens
ggcugggaagacuauggugcu

SEQ ID NO: 751904 - RNA, 22 nt, Homo sapiens
ggcugggaauggggacacggug

SEQ ID NO: 751905 - RNA, 13 nt, Homo sapiens
ggcuggucacucu

SEQ ID NO: 751906 - RNA, 12 nt, Homo sapiens
ggcuggucucac

SEQ ID NO: 751907 - RNA, 12 nt, Homo sapiens
ggcugguguaug

SEQ ID NO: 751908 - RNA, 20 nt, Homo sapiens
ggcugguguaugcacagggu

SEQ ID NO: 751909 - RNA, 15 nt, Homo sapiens
ggcugguugcuguag

SEQ ID NO: 751910 - RNA, 22 nt, Homo sapiens
ggcugguuuuguaagaugcugg

SEQ ID NO: 751911 - RNA, 19 nt, Homo sapiens
ggcuguguuuccaucucaa

SEQ ID NO: 751912 - RNA, 21 nt, Homo sapiens
ggcuuagacuucgacucagga

SEQ ID NO: 751913 - RNA, 19 nt, Homo sapiens
ggcuuaguauuucucagga

SEQ ID NO: 751914 - RNA, 14 nt, Homo sapiens
ggcuucaccaucaa

SEQ ID NO: 751915 - RNA, 23 nt, Homo sapiens
ggcuucagcccccaccaggggaa

SEQ ID NO: 751916 - RNA, 23 nt, Homo sapiens
ggcuucaggugacgauuuagcug

SEQ ID NO: 751917 - RNA, 11 nt, Homo sapiens
ggcuucagugu

SEQ ID NO: 751918 - RNA, 23 nt, Homo sapiens
ggcuucaguuuuacucugcugca

SEQ ID NO: 751919 - RNA, 20 nt, Homo sapiens
ggcuucccucuucugugguc

SEQ ID NO: 751920 - RNA, 19 nt, Homo sapiens
ggcuuccucuagaagccaa

SEQ ID NO: 751921 - RNA, 16 nt, Homo sapiens
ggcuucgucuacuccu

SEQ ID NO: 751922 - RNA, 14 nt, Homo sapiens
ggcuucuaguuugc

SEQ ID NO: 751923 - RNA, 19 nt, Homo sapiens
ggcuucuauguccaacaga

SEQ ID NO: 751924 - RNA, 23 nt, Homo sapiens
ggcuucucucucuagcagcaccu

SEQ ID NO: 751925 - RNA, 20 nt, Homo sapiens
ggcuuuacaguguaaacugu

SEQ ID NO: 751926 - RNA, 14 nt, Homo sapiens
ggcuuuaugcaaau

SEQ ID NO: 751927 - RNA, 15 nt, Homo sapiens
ggcuuuaugcaaaua

SEQ ID NO: 751928 - RNA, 22 nt, Homo sapiens
ggcuuuaugcaaauacaaucag

SEQ ID NO: 751929 - RNA, 15 nt, Homo sapiens
ggcuuucacugcuga

SEQ ID NO: 751930 - RNA, 14 nt, Homo sapiens
ggcuuuccagcuua

SEQ ID NO: 751931 - RNA, 17 nt, Homo sapiens
ggcuuucccacuuccca

SEQ ID NO: 751932 - RNA, 23 nt, Homo sapiens
ggcuuucucuuccccuuccuguu

SEQ ID NO: 751933 - RNA, 21 nt, Homo sapiens
ggcuuuguugcuuccguucau

SEQ ID NO: 751934 - RNA, 15 nt, Homo sapiens
ggcuuuugauuuaua

SEQ ID NO: 751935 - RNA, 12 nt, Homo sapiens
ggcuuuugccac

SEQ ID NO: 751936 - RNA, 20 nt, Homo sapiens
gggaaacauagccucaccaa

SEQ ID NO: 751937 - RNA, 14 nt, Homo sapiens
gggaaacugggaaa

SEQ ID NO: 751938 - RNA, 22 nt, Homo sapiens
gggaaacuuagaucaucaguca

SEQ ID NO: 751939 - RNA, 13 nt, Homo sapiens
gggaaagaaggga

SEQ ID NO: 751940 - RNA, 15 nt, Homo sapiens
uaaaauucuagucuc

SEQ ID NO: 751941 - RNA, 13 nt, Homo sapiens
uaaaauucuguca

SEQ ID NO: 751942 - RNA, 22 nt, Homo sapiens
uaaaauuuagaguagguauuaa

SEQ ID NO: 751943 - RNA, 17 nt, Homo sapiens
uaaaauuuccacaagca

SEQ ID NO: 751944 - RNA, 16 nt, Homo sapiens
uaaaauuuugagauua

SEQ ID NO: 751945 - RNA, 17 nt, Homo sapiens
uaaacaaaaaacuauca

SEQ ID NO: 751946 - RNA, 15 nt, Homo sapiens
uaaacaaauucauau

SEQ ID NO: 751947 - RNA, 16 nt, Homo sapiens
uaaacaacuaccuccu

SEQ ID NO: 751948 - RNA, 20 nt, Homo sapiens
uaaacacaggcagguacugu

SEQ ID NO: 751949 - RNA, 16 nt, Homo sapiens
uaaacacuuaucuucu

SEQ ID NO: 751950 - RNA, 19 nt, Homo sapiens
uaaacagauggcacuuuga

SEQ ID NO: 751951 - RNA, 20 nt, Homo sapiens
uaaacagauggcacuuugaa

SEQ ID NO: 751952 - RNA, 18 nt, Homo sapiens
uaaacagccucuuuuuga

SEQ ID NO: 751953 - RNA, 18 nt, Homo sapiens
uaaacauuaauauuuacc

SEQ ID NO: 751954 - RNA, 22 nt, Homo sapiens
uaaacauuaauuuugugcauuc

SEQ ID NO: 751955 - RNA, 17 nt, Homo sapiens
uaaacauugaaguaaug

SEQ ID NO: 751956 - RNA, 20 nt, Homo sapiens
uaaacauuuuucacaucucu

SEQ ID NO: 751957 - RNA, 21 nt, Homo sapiens
uaaaccaaugaagaagacaaa

SEQ ID NO: 751958 - RNA, 13 nt, Homo sapiens
uaaaccacuaaaa

SEQ ID NO: 751959 - RNA, 16 nt, Homo sapiens
uaaaccagaggacaaa

SEQ ID NO: 751960 - RNA, 19 nt, Homo sapiens
uaaaccaguccuuagcaag

SEQ ID NO: 751961 - RNA, 14 nt, Homo sapiens
uaaacccaagugcu

SEQ ID NO: 751962 - RNA, 19 nt, Homo sapiens
uaaaccgcaugugaucucc

SEQ ID NO: 751963 - RNA, 19 nt, Homo sapiens
uaaaccuagaguuuuauca

SEQ ID NO: 751964 - RNA, 16 nt, Homo sapiens
uaaaccucaaaauguc

SEQ ID NO: 751965 - RNA, 15 nt, Homo sapiens
uaaacuaguuuccag

SEQ ID NO: 751966 - RNA, 16 nt, Homo sapiens
uaaacuauaaccucuc

SEQ ID NO: 751967 - RNA, 13 nt, Homo sapiens
uaaacucagaaua

SEQ ID NO: 751968 - RNA, 22 nt, Homo sapiens
uaaacucuguugcaagugcaau

SEQ ID NO: 751969 - RNA, 17 nt, Homo sapiens
uaaacugacuuuuuccc

SEQ ID NO: 751970 - RNA, 17 nt, Homo sapiens
uaaacuuacuagcuuua

SEQ ID NO: 751971 - RNA, 23 nt, Homo sapiens
uaaacuucaccuacauuaucuca

SEQ ID NO: 751972 - RNA, 22 nt, Homo sapiens
uaaacuugaguuggaguacuau

SEQ ID NO: 751973 - RNA, 13 nt, Homo sapiens
uaaacuugcauca

SEQ ID NO: 751974 - RNA, 16 nt, Homo sapiens
uaaacuugccuguuca

SEQ ID NO: 751975 - RNA, 20 nt, Homo sapiens
uaaagaaaaauaugauacuc

SEQ ID NO: 751976 - RNA, 16 nt, Homo sapiens
uaaagaaaaaugccug

SEQ ID NO: 751977 - RNA, 21 nt, Homo sapiens
uaaagaaaaguagguuuacau

SEQ ID NO: 751978 - RNA, 19 nt, Homo sapiens
uaaagaaaauaaacaccau

SEQ ID NO: 751979 - RNA, 20 nt, Homo sapiens
uaaagaaaauaaacaccauu

SEQ ID NO: 751980 - RNA, 15 nt, Homo sapiens
uaaagaagaacuugc

SEQ ID NO: 751981 - RNA, 12 nt, Homo sapiens
uaaagaauacac

SEQ ID NO: 751982 - RNA, 15 nt, Homo sapiens
uaaagacaaucacug

SEQ ID NO: 751983 - RNA, 23 nt, Homo sapiens
uaaagacagggucucacucucau

SEQ ID NO: 751984 - RNA, 14 nt, Homo sapiens
uaaagaccugagaa

SEQ ID NO: 751985 - RNA, 14 nt, Homo sapiens
uaaagacugugauu

SEQ ID NO: 751986 - RNA, 15 nt, Homo sapiens
uaaagauauuuccaa

SEQ ID NO: 751987 - RNA, 18 nt, Homo sapiens
uaaagaugaucuacucag

SEQ ID NO: 751988 - RNA, 13 nt, Homo sapiens
uaaagaugguuua

SEQ ID NO: 751989 - RNA, 22 nt, Homo sapiens
uaaagauuauaauaugugccuu

SEQ ID NO: 751990 - RNA, 23 nt, Homo sapiens
uaaagauuauaauaugugccuua

SEQ ID NO: 751991 - RNA, 15 nt, Homo sapiens
uaaagauuucuagua

SEQ ID NO: 751992 - RNA, 15 nt, Homo sapiens
uaaagcaaacaugca

SEQ ID NO: 751993 - RNA, 22 nt, Homo sapiens
uaaagcagacaggugugcagau

SEQ ID NO: 751994 - RNA, 18 nt, Homo sapiens
uaaagcauauuggugcua

SEQ ID NO: 751995 - RNA, 19 nt, Homo sapiens
uaaagcauauuggugcuag

SEQ ID NO: 751996 - RNA, 14 nt, Homo sapiens
uaaagcauccuccu

SEQ ID NO: 751997 - RNA, 17 nt, Homo sapiens
uaaagcaugaaauguga

SEQ ID NO: 751998 - RNA, 21 nt, Homo sapiens
uaaagcaugaaaugugaauuu

SEQ ID NO: 751999 - RNA, 16 nt, Homo sapiens
uaaagccaaauuucca

SEQ ID NO: 752000 - RNA, 15 nt, Homo sapiens
uaaagccucauuuga

SEQ ID NO: 752001 - RNA, 17 nt, Homo sapiens
uaaagcguccucucagu

SEQ ID NO: 752002 - RNA, 15 nt, Homo sapiens
uaaagcuacaacaaa

SEQ ID NO: 752003 - RNA, 17 nt, Homo sapiens
uaaagcuacaaucuguu

SEQ ID NO: 752004 - RNA, 13 nt, Homo sapiens
uaaagcucaaggu

SEQ ID NO: 752005 - RNA, 20 nt, Homo sapiens
uaaagcucauaaacugccaa

SEQ ID NO: 752006 - RNA, 18 nt, Homo sapiens
uaaagcuguuauucuugu

SEQ ID NO: 752007 - RNA, 23 nt, Homo sapiens
uaaaggaagcaaguuuucuucca

SEQ ID NO: 752008 - RNA, 13 nt, Homo sapiens
uaaaggauauuaa

SEQ ID NO: 752009 - RNA, 23 nt, Homo sapiens
uaaaggcaaugguuugugucaaa

SEQ ID NO: 752010 - RNA, 14 nt, Homo sapiens
uaaaggcagcugcc

SEQ ID NO: 752011 - RNA, 18 nt, Homo sapiens
uaaaggcagcugccucug

SEQ ID NO: 752012 - RNA, 17 nt, Homo sapiens
uaaaggcuaaaagggaa

SEQ ID NO: 752013 - RNA, 20 nt, Homo sapiens
uaaaggcugaagcuuuuugu

SEQ ID NO: 752014 - RNA, 16 nt, Homo sapiens
uaaagggucuuaugaa

SEQ ID NO: 752015 - RNA, 17 nt, Homo sapiens
uaaaggucccuuagccc

SEQ ID NO: 752016 - RNA, 16 nt, Homo sapiens
uaaaggugguccuucc

SEQ ID NO: 752017 - RNA, 23 nt, Homo sapiens
uaaaggugguccuuccuaccucu

SEQ ID NO: 752018 - RNA, 15 nt, Homo sapiens
uaaaguacaucucua

SEQ ID NO: 752019 - RNA, 22 nt, Homo sapiens
uaaaguaccacacauauugcac

SEQ ID NO: 752020 - RNA, 16 nt, Homo sapiens
uaaaguaugcauuauu

SEQ ID NO: 752021 - RNA, 22 nt, Homo sapiens
uaaaguauucaacaauuucaau

SEQ ID NO: 752022 - RNA, 15 nt, Homo sapiens
uaaagucaaaugcca

SEQ ID NO: 752023 - RNA, 16 nt, Homo sapiens
uaaagucaaaugccaa

SEQ ID NO: 752024 - RNA, 18 nt, Homo sapiens
uaaagucacuuccagugu

SEQ ID NO: 752025 - RNA, 21 nt, Homo sapiens
uaaagugaauaaccacuuaaa

SEQ ID NO: 752026 - RNA, 11 nt, Homo sapiens
uaaagugcagu

SEQ ID NO: 752027 - RNA, 22 nt, Homo sapiens
uaaaguuacuauucuguaucau

SEQ ID NO: 752028 - RNA, 16 nt, Homo sapiens
uaaaguuggugcaucu

SEQ ID NO: 752029 - RNA, 19 nt, Homo sapiens
uaaaguuucuugcauuuau

SEQ ID NO: 752030 - RNA, 21 nt, Homo sapiens
uaaaguuuuaggguacaguuu

SEQ ID NO: 752031 - RNA, 16 nt, Homo sapiens
uaaauaaaaauaugua

SEQ ID NO: 752032 - RNA, 21 nt, Homo sapiens
uaaauaaaauucauuucuaca

SEQ ID NO: 752033 - RNA, 11 nt, Homo sapiens
uaaauaaacua

SEQ ID NO: 752034 - RNA, 14 nt, Homo sapiens
uaaauaaacuaaua

SEQ ID NO: 752035 - RNA, 13 nt, Homo sapiens
uaaauaacaaaac

SEQ ID NO: 752036 - RNA, 20 nt, Homo sapiens
uaaauaacaaaacugugcca

SEQ ID NO: 752037 - RNA, 14 nt, Homo sapiens
uaaauaacaggcau

SEQ ID NO: 752038 - RNA, 17 nt, Homo sapiens
uaaauaaccuucaucaa

SEQ ID NO: 752039 - RNA, 18 nt, Homo sapiens
uaaauaagauucuaacgg

SEQ ID NO: 752040 - RNA, 22 nt, Homo sapiens
uaaauaauugcuccuauacuau

SEQ ID NO: 752041 - RNA, 20 nt, Homo sapiens
uaaauaauuucuacucuguc

SEQ ID NO: 752042 - RNA, 23 nt, Homo sapiens
uaaauacacaacacacacacucu

SEQ ID NO: 752043 - RNA, 19 nt, Homo sapiens
uaaauacuauuauuugcua

SEQ ID NO: 752044 - RNA, 19 nt, Homo sapiens
uaaauagaccucucaauuu

SEQ ID NO: 752045 - RNA, 15 nt, Homo sapiens
uaaauauaucuaccc

SEQ ID NO: 752046 - RNA, 17 nt, Homo sapiens
uaaauauguacacaagu

SEQ ID NO: 752047 - RNA, 15 nt, Homo sapiens
uaaauauuacaguga

SEQ ID NO: 752048 - RNA, 18 nt, Homo sapiens
uaaauauuuauguagaug

SEQ ID NO: 752049 - RNA, 17 nt, Homo sapiens
uaaauauuuuucaucaa

SEQ ID NO: 752050 - RNA, 21 nt, Homo sapiens
uaaauauuuuuuuaaccuaau

SEQ ID NO: 752051 - RNA, 13 nt, Homo sapiens
uaaaucauaaagu

SEQ ID NO: 752052 - RNA, 16 nt, Homo sapiens
uaaaucauuaagacaa

SEQ ID NO: 752053 - RNA, 23 nt, Homo sapiens
uaaaucauuaagacaacugaguu

SEQ ID NO: 752054 - RNA, 24 nt, Homo sapiens
cauaaugugcaaagucaucaaaga

SEQ ID NO: 752055 - RNA, 18 nt, Homo sapiens
cauaauucuaagucuucc

SEQ ID NO: 752056 - RNA, 17 nt, Homo sapiens
cauaauugcuuugccaa

SEQ ID NO: 752057 - RNA, 23 nt, Homo sapiens
cauacaaagcaguuuauuuuaga

SEQ ID NO: 752058 - RNA, 19 nt, Homo sapiens
cauacaauguauguacaau

SEQ ID NO: 752059 - RNA, 13 nt, Homo sapiens
cauacaauuccaa

SEQ ID NO: 752060 - RNA, 15 nt, Homo sapiens
cauacacacaugccc

SEQ ID NO: 752061 - RNA, 19 nt, Homo sapiens
cauacacacguuaccagac

SEQ ID NO: 752062 - RNA, 15 nt, Homo sapiens
cauacacugugaacu

SEQ ID NO: 752063 - RNA, 13 nt, Homo sapiens
cauacacuuuguu

SEQ ID NO: 752064 - RNA, 14 nt, Homo sapiens
cauacaucaagcca

SEQ ID NO: 752065 - RNA, 14 nt, Homo sapiens
cauacaugcauaca

SEQ ID NO: 752066 - RNA, 18 nt, Homo sapiens
cauacauuuaugcacauu

SEQ ID NO: 752067 - RNA, 16 nt, Homo sapiens
cauaccagaaagcucu

SEQ ID NO: 752068 - RNA, 17 nt, Homo sapiens
cauacccacacacccag

SEQ ID NO: 752069 - RNA, 12 nt, Homo sapiens
cauacccaugca

SEQ ID NO: 752070 - RNA, 18 nt, Homo sapiens
cauaccccggugugccug

SEQ ID NO: 752071 - RNA, 15 nt, Homo sapiens
cauaccucugaccaa

SEQ ID NO: 752072 - RNA, 14 nt, Homo sapiens
cauacgugugcaug

SEQ ID NO: 752073 - RNA, 15 nt, Homo sapiens
cauacgugugcaugu

SEQ ID NO: 752074 - RNA, 23 nt, Homo sapiens
cauacuacaguaacugugacuga

SEQ ID NO: 752075 - RNA, 16 nt, Homo sapiens
cauacuaggugccuuu

SEQ ID NO: 752076 - RNA, 14 nt, Homo sapiens
cauacucaagguga

SEQ ID NO: 752077 - RNA, 22 nt, Homo sapiens
cauacuccaacugaaauguuaa

SEQ ID NO: 752078 - RNA, 16 nt, Homo sapiens
cauacuccuuccauca

SEQ ID NO: 752079 - RNA, 17 nt, Homo sapiens
cauacucugcuuagaau

SEQ ID NO: 752080 - RNA, 17 nt, Homo sapiens
cauacuuugacaaggaa

SEQ ID NO: 752081 - RNA, 23 nt, Homo sapiens
cauagaaaauuggguguguauac

SEQ ID NO: 752082 - RNA, 17 nt, Homo sapiens
cauagaaacaugacacu

SEQ ID NO: 752083 - RNA, 18 nt, Homo sapiens
cauagaaaccacuagaaa

SEQ ID NO: 752084 - RNA, 20 nt, Homo sapiens
cauagagauagcuacagugu

SEQ ID NO: 752085 - RNA, 13 nt, Homo sapiens
cauagagaucuau

SEQ ID NO: 752086 - RNA, 22 nt, Homo sapiens
cauagagaucuauguacuguaa

SEQ ID NO: 752087 - RNA, 19 nt, Homo sapiens
cauagauccccccacugag

SEQ ID NO: 752088 - RNA, 19 nt, Homo sapiens
cauagcacugggcucugau

SEQ ID NO: 752089 - RNA, 19 nt, Homo sapiens
cauagcauagccagcauuc

SEQ ID NO: 752090 - RNA, 17 nt, Homo sapiens
cauagccucaccaaggu

SEQ ID NO: 752091 - RNA, 11 nt, Homo sapiens
cauagccucau

SEQ ID NO: 752092 - RNA, 19 nt, Homo sapiens
cauagccugccugaucccu

SEQ ID NO: 752093 - RNA, 20 nt, Homo sapiens
cauagcucaccaggacuguu

SEQ ID NO: 752094 - RNA, 15 nt, Homo sapiens
cauagcuuccaugag

SEQ ID NO: 752095 - RNA, 19 nt, Homo sapiens
cauaggacucaaaguuuca

SEQ ID NO: 752096 - RNA, 14 nt, Homo sapiens
cauaggccaugaaa

SEQ ID NO: 752097 - RNA, 18 nt, Homo sapiens
cauaggcgcaggugcaca

SEQ ID NO: 752098 - RNA, 19 nt, Homo sapiens
cauaggcgcaggugcacag

SEQ ID NO: 752099 - RNA, 16 nt, Homo sapiens
ucuugugaacugucuu

SEQ ID NO: 752100 - RNA, 18 nt, Homo sapiens
ucuuguguaauacuucau

SEQ ID NO: 752101 - RNA, 14 nt, Homo sapiens
ucuuguuaauguca

SEQ ID NO: 752102 - RNA, 16 nt, Homo sapiens
ucuuguuacugcugau

SEQ ID NO: 752103 - RNA, 15 nt, Homo sapiens
ucuuguucagauuaa

SEQ ID NO: 752104 - RNA, 17 nt, Homo sapiens
ucuuguuccccacugac

SEQ ID NO: 752105 - RNA, 18 nt, Homo sapiens
ucuuguuugucagcaucu

SEQ ID NO: 752106 - RNA, 17 nt, Homo sapiens
ucuuguuuuauauaccu

SEQ ID NO: 752107 - RNA, 22 nt, Homo sapiens
ucuuguuuuuuuuuuccacuua

SEQ ID NO: 752108 - RNA, 14 nt, Homo sapiens
ucuuuaaaggcauc

SEQ ID NO: 752109 - RNA, 21 nt, Homo sapiens
ucuuuaauguuguccaggaaa

SEQ ID NO: 752110 - RNA, 12 nt, Homo sapiens
ucuuuaccuccu

SEQ ID NO: 752111 - RNA, 15 nt, Homo sapiens
ucuuuacuuaucucu

SEQ ID NO: 752112 - RNA, 14 nt, Homo sapiens
ucuuuagaugccaa

SEQ ID NO: 752113 - RNA, 15 nt, Homo sapiens
ucuuuagaugccaaa

SEQ ID NO: 752114 - RNA, 19 nt, Homo sapiens
ucuuuaggagacuaaugga

SEQ ID NO: 752115 - RNA, 23 nt, Homo sapiens
ucuuuaguauaauugaccuacuu

SEQ ID NO: 752116 - RNA, 16 nt, Homo sapiens
ucuuuauacagcugua

SEQ ID NO: 752117 - RNA, 19 nt, Homo sapiens
ucuuuaucaugaagcacau

SEQ ID NO: 752118 - RNA, 16 nt, Homo sapiens
ucuuuaucauugcuaa

SEQ ID NO: 752119 - RNA, 15 nt, Homo sapiens
ucuuucacacuucca

SEQ ID NO: 752120 - RNA, 21 nt, Homo sapiens
ucuuucaccuuucccuaaaga

SEQ ID NO: 752121 - RNA, 18 nt, Homo sapiens
ucuuucaggacucuaccu

SEQ ID NO: 752122 - RNA, 18 nt, Homo sapiens
ucuuuccaaaacauuucu

SEQ ID NO: 752123 - RNA, 23 nt, Homo sapiens
ucuuuccaaaaggaacucuagaa

SEQ ID NO: 752124 - RNA, 22 nt, Homo sapiens
ucuuuccaggcuucccugacuu

SEQ ID NO: 752125 - RNA, 17 nt, Homo sapiens
ucuuuccauuaugauuc

SEQ ID NO: 752126 - RNA, 20 nt, Homo sapiens
ucuuucccuuuaucaguuug

SEQ ID NO: 752127 - RNA, 14 nt, Homo sapiens
ucuuuccuggcacu

SEQ ID NO: 752128 - RNA, 23 nt, Homo sapiens
ucuuuccuggcacuaacguugag

SEQ ID NO: 752129 - RNA, 14 nt, Homo sapiens
ucuuuccuguaaag

SEQ ID NO: 752130 - RNA, 17 nt, Homo sapiens
ucuuuccuuccuuccuc

SEQ ID NO: 752131 - RNA, 22 nt, Homo sapiens
ucuuucggggugcuccuguggg

SEQ ID NO: 752132 - RNA, 21 nt, Homo sapiens
ucuuucuauguagaacuguuc

SEQ ID NO: 752133 - RNA, 17 nt, Homo sapiens
ucuuucucugccaguga

SEQ ID NO: 752134 - RNA, 19 nt, Homo sapiens
ucuuucugaauugcacaug

SEQ ID NO: 752135 - RNA, 20 nt, Homo sapiens
ucuuucugauaaugcauuag

SEQ ID NO: 752136 - RNA, 15 nt, Homo sapiens
ucuuucugccaacuu

SEQ ID NO: 752137 - RNA, 18 nt, Homo sapiens
ucuuucugcuuacaaaga

SEQ ID NO: 752138 - RNA, 13 nt, Homo sapiens
ucuuucuuucugc

SEQ ID NO: 752139 - RNA, 23 nt, Homo sapiens
ucuuugacugaaaaaaaaaaaga

SEQ ID NO: 752140 - RNA, 15 nt, Homo sapiens
ucuuugcaccaaaga

SEQ ID NO: 752141 - RNA, 18 nt, Homo sapiens
ucuuugcauguaagcucu

SEQ ID NO: 752142 - RNA, 19 nt, Homo sapiens
ucuuugccucaacuccagg

SEQ ID NO: 752143 - RNA, 19 nt, Homo sapiens
ucuuugcuacugaaugugu

SEQ ID NO: 752144 - RNA, 22 nt, Homo sapiens
ucuuugcugccagccacuucau

SEQ ID NO: 752145 - RNA, 17 nt, Homo sapiens
ucuuuggaggcuuuuaa

SEQ ID NO: 752146 - RNA, 19 nt, Homo sapiens
ucuuuggaucagucuuugu

SEQ ID NO: 752147 - RNA, 15 nt, Homo sapiens
ucuuuggcgaccucc

SEQ ID NO: 752148 - RNA, 18 nt, Homo sapiens
ucuuuggguccauucaga

SEQ ID NO: 752149 - RNA, 17 nt, Homo sapiens
ucuuuguaaaacaaaga

SEQ ID NO: 752150 - RNA, 21 nt, Homo sapiens
ucuuuguaagaguggaaccaa

SEQ ID NO: 752151 - RNA, 19 nt, Homo sapiens
ucuuuguaugucuguuacc

SEQ ID NO: 752152 - RNA, 19 nt, Homo sapiens
ucuuugucaccacgugggg

SEQ ID NO: 752153 - RNA, 21 nt, Homo sapiens
ucuuugucaccacguggggcu

SEQ ID NO: 752154 - RNA, 15 nt, Homo sapiens
ucuuugucauaccuu

SEQ ID NO: 752155 - RNA, 14 nt, Homo sapiens
ucuuugucuugccc

SEQ ID NO: 752156 - RNA, 16 nt, Homo sapiens
ucuuuuaaacaggcaa

SEQ ID NO: 752157 - RNA, 16 nt, Homo sapiens
ucuuuuacauucugca

SEQ ID NO: 752158 - RNA, 15 nt, Homo sapiens
ucuuuucagcuuguu

SEQ ID NO: 752159 - RNA, 19 nt, Homo sapiens
ucuuuuccugaccaaucuu

SEQ ID NO: 752160 - RNA, 17 nt, Homo sapiens
ucuuuuccuucagugaa

SEQ ID NO: 752161 - RNA, 22 nt, Homo sapiens
ucuuuuugggcuuucauagugu

SEQ ID NO: 752162 - RNA, 17 nt, Homo sapiens
ucuuuuuuugagugaca

SEQ ID NO: 752163 - RNA, 17 nt, Homo sapiens
ugaaaaaaaaaagacaa

SEQ ID NO: 752164 - RNA, 18 nt, Homo sapiens
ugaaaaaaacauauccaa

SEQ ID NO: 752165 - RNA, 18 nt, Homo sapiens
ugaaaaaacaccuagcuu

SEQ ID NO: 752166 - RNA, 12 nt, Homo sapiens
ugaaaaaagccu

SEQ ID NO: 752167 - RNA, 17 nt, Homo sapiens
ugaaaaaauagauccaa

SEQ ID NO: 752168 - RNA, 18 nt, Homo sapiens
ugaaaaacaaaaauaaca

SEQ ID NO: 752169 - RNA, 16 nt, Homo sapiens
ugaaaaagauggaaug

SEQ ID NO: 752170 - RNA, 19 nt, Homo sapiens
ugaaaaaggaaugauauau

SEQ ID NO: 752171 - RNA, 12 nt, Homo sapiens
ugaaaaauacuu

SEQ ID NO: 752172 - RNA, 15 nt, Homo sapiens
ugaaaaaucauccaa

SEQ ID NO: 752173 - RNA, 14 nt, Homo sapiens
ugaaaaauguauau

SEQ ID NO: 752174 - RNA, 22 nt, Homo sapiens
ugaaaaauucucagucaguaau

SEQ ID NO: 752175 - RNA, 15 nt, Homo sapiens
ugaaaaccacaguca

SEQ ID NO: 752176 - RNA, 16 nt, Homo sapiens
ugaaaaccacagucag

SEQ ID NO: 752177 - RNA, 20 nt, Homo sapiens
ccaguucauugcacuuugau

SEQ ID NO: 752178 - RNA, 22 nt, Homo sapiens
ccaguuccucuuuugugcugcu

SEQ ID NO: 752179 - RNA, 14 nt, Homo sapiens
ccaguuguugccaa

SEQ ID NO: 752180 - RNA, 11 nt, Homo sapiens
ccaguuuauau

SEQ ID NO: 752181 - RNA, 11 nt, Homo sapiens
ccaguuugcac

SEQ ID NO: 752182 - RNA, 20 nt, Homo sapiens
ccauaaagacaaucacugcc

SEQ ID NO: 752183 - RNA, 14 nt, Homo sapiens
ccauaaaguacaaa

SEQ ID NO: 752184 - RNA, 14 nt, Homo sapiens
ccauaaauguguuc

SEQ ID NO: 752185 - RNA, 16 nt, Homo sapiens
ccauaaccacauuuaa

SEQ ID NO: 752186 - RNA, 18 nt, Homo sapiens
ccauaagaggaguaggcc

SEQ ID NO: 752187 - RNA, 22 nt, Homo sapiens
ccauaagccccucgcacucugg

SEQ ID NO: 752188 - RNA, 15 nt, Homo sapiens
ccauaaggccagaaa

SEQ ID NO: 752189 - RNA, 16 nt, Homo sapiens
ccauaauguugcuucu

SEQ ID NO: 752190 - RNA, 22 nt, Homo sapiens
ccauaauuauuauuuccagugu

SEQ ID NO: 752191 - RNA, 21 nt, Homo sapiens
ccauacauuauuucuucccag

SEQ ID NO: 752192 - RNA, 22 nt, Homo sapiens
ccauaguuacuguaaaaugcaa

SEQ ID NO: 752193 - RNA, 20 nt, Homo sapiens
ccauaucuacaguacuucca

SEQ ID NO: 752194 - RNA, 17 nt, Homo sapiens
ccauaucuucuguuuca

SEQ ID NO: 752195 - RNA, 18 nt, Homo sapiens
ccauauucagcauuugau

SEQ ID NO: 752196 - RNA, 20 nt, Homo sapiens
ccauauuguugaauguuuca

SEQ ID NO: 752197 - RNA, 19 nt, Homo sapiens
ccaucaaacauaauucucu

SEQ ID NO: 752198 - RNA, 13 nt, Homo sapiens
ccaucaauccuga

SEQ ID NO: 752199 - RNA, 23 nt, Homo sapiens
ccaucacuagaagaaaagcccau

SEQ ID NO: 752200 - RNA, 12 nt, Homo sapiens
ccaucacuggag

SEQ ID NO: 752201 - RNA, 17 nt, Homo sapiens
ccaucacugguugcacu

SEQ ID NO: 752202 - RNA, 22 nt, Homo sapiens
ccaucaggauccagucuggaaa

SEQ ID NO: 752203 - RNA, 19 nt, Homo sapiens
ccaucauccuuuguucuga

SEQ ID NO: 752204 - RNA, 21 nt, Homo sapiens
ccaucauuacugguaaagccu

SEQ ID NO: 752205 - RNA, 13 nt, Homo sapiens
ccauccaccaccu

SEQ ID NO: 752206 - RNA, 13 nt, Homo sapiens
ccauccaguuccu

SEQ ID NO: 752207 - RNA, 14 nt, Homo sapiens
ccauccauauacuu

SEQ ID NO: 752208 - RNA, 16 nt, Homo sapiens
ccauccccaggcaccu

SEQ ID NO: 752209 - RNA, 22 nt, Homo sapiens
ccaucccuuuuuuuacauuuca

SEQ ID NO: 752210 - RNA, 13 nt, Homo sapiens
ccauccuagucac

SEQ ID NO: 752211 - RNA, 11 nt, Homo sapiens
ccauccucacc

SEQ ID NO: 752212 - RNA, 21 nt, Homo sapiens
ccauccuccccagcgccaucu

SEQ ID NO: 752213 - RNA, 15 nt, Homo sapiens
ccauccugaaagcca

SEQ ID NO: 752214 - RNA, 11 nt, Homo sapiens
ugaaacugagu

SEQ ID NO: 752215 - RNA, 18 nt, Homo sapiens
ugaaacuggcacugaauu

SEQ ID NO: 752216 - RNA, 22 nt, Homo sapiens
ugaaacuuugagaucuaaaaau

SEQ ID NO: 752217 - RNA, 22 nt, Homo sapiens
ugaaagaaagcugagaagaaug

SEQ ID NO: 752218 - RNA, 21 nt, Homo sapiens
ugaaagaacauggacuuguau

SEQ ID NO: 752219 - RNA, 13 nt, Homo sapiens
ugaaagacaucaa

SEQ ID NO: 752220 - RNA, 14 nt, Homo sapiens
ugaaagaccuucuc

SEQ ID NO: 752221 - RNA, 14 nt, Homo sapiens
ugaaagauucagug

SEQ ID NO: 752222 - RNA, 22 nt, Homo sapiens
ugaaagcacaugaauaauuuca

SEQ ID NO: 752223 - RNA, 14 nt, Homo sapiens
ugaaagcagaugag

SEQ ID NO: 752224 - RNA, 20 nt, Homo sapiens
ugaaagccucacguauuuca

SEQ ID NO: 752225 - RNA, 20 nt, Homo sapiens
ugaaaggaacacuggcuuga

SEQ ID NO: 752226 - RNA, 21 nt, Homo sapiens
ugaaaggcaaacauuugaagg

SEQ ID NO: 752227 - RNA, 13 nt, Homo sapiens
ugaaaggcuuuga

SEQ ID NO: 752228 - RNA, 16 nt, Homo sapiens
ugaaaguggacaagga

SEQ ID NO: 752229 - RNA, 18 nt, Homo sapiens
ugaaauaccacaagccug

SEQ ID NO: 752230 - RNA, 23 nt, Homo sapiens
ugaaauaccuuuucucacaaaaa

SEQ ID NO: 752231 - RNA, 15 nt, Homo sapiens
ugaaauauaaucaga

SEQ ID NO: 752232 - RNA, 20 nt, Homo sapiens
ugaaauauaguaaacacuug

SEQ ID NO: 752233 - RNA, 14 nt, Homo sapiens
ugaaauaugcaucu

SEQ ID NO: 752234 - RNA, 20 nt, Homo sapiens
ugaaauccagugagcacuag

SEQ ID NO: 752235 - RNA, 19 nt, Homo sapiens
ugaaaucuuuaugugauau

SEQ ID NO: 752236 - RNA, 16 nt, Homo sapiens
ugaaaugaaagggaaa

SEQ ID NO: 752237 - RNA, 15 nt, Homo sapiens
ugaaaugaaugucug

SEQ ID NO: 752238 - RNA, 17 nt, Homo sapiens
ugaaaugaaugucugag

SEQ ID NO: 752239 - RNA, 16 nt, Homo sapiens
ugaaaugaccaagaca

SEQ ID NO: 752240 - RNA, 14 nt, Homo sapiens
ugaaaugauaugac

SEQ ID NO: 752241 - RNA, 19 nt, Homo sapiens
ugaaaugcuggcauuugca

SEQ ID NO: 752242 - RNA, 23 nt, Homo sapiens
ugaaaugggauuguuuuuuacuc

SEQ ID NO: 752243 - RNA, 23 nt, Homo sapiens
ugaaauguaugugcucuuagcaa

SEQ ID NO: 752244 - RNA, 18 nt, Homo sapiens
ugaaauguuagucauugu

SEQ ID NO: 752245 - RNA, 15 nt, Homo sapiens
ugaaauuaagcauuu

SEQ ID NO: 752246 - RNA, 21 nt, Homo sapiens
ugaaauucacccccuuuccug

SEQ ID NO: 752247 - RNA, 20 nt, Homo sapiens
ugaaauuuuaaccuaugaua

SEQ ID NO: 752248 - RNA, 21 nt, Homo sapiens
ugaacaaagugaggagaauga

SEQ ID NO: 752249 - RNA, 18 nt, Homo sapiens
ugaacacaauugauacuu

SEQ ID NO: 752250 - RNA, 17 nt, Homo sapiens
ugaacacuagccagaca

SEQ ID NO: 752251 - RNA, 11 nt, Homo sapiens
ugaacacuccc

SEQ ID NO: 752252 - RNA, 13 nt, Homo sapiens
ugaacacuggggg

SEQ ID NO: 752253 - RNA, 10 nt, Homo sapiens
ugaacacuug

SEQ ID NO: 752254 - RNA, 16 nt, Homo sapiens
ugaacacuugacaagg

SEQ ID NO: 752255 - RNA, 20 nt, Homo sapiens
ugaacagcucaccacugugc

SEQ ID NO: 752256 - RNA, 20 nt, Homo sapiens
ugaacaggggcugguauuau

SEQ ID NO: 752257 - RNA, 18 nt, Homo sapiens
ugaacauaaguaaucacu

SEQ ID NO: 752258 - RNA, 15 nt, Homo sapiens
ugaacauccuuccuu

SEQ ID NO: 752259 - RNA, 22 nt, Homo sapiens
ugaacauuaaaauauagagaca

SEQ ID NO: 752260 - RNA, 14 nt, Homo sapiens
ugaaccaacaucuu

SEQ ID NO: 752261 - RNA, 22 nt, Homo sapiens
ugaaccccuggccagcucugag

SEQ ID NO: 752262 - RNA, 22 nt, Homo sapiens
ugaacccgaggcugagaaucag

SEQ ID NO: 752263 - RNA, 15 nt, Homo sapiens
ugaacccuugugcuu

SEQ ID NO: 752264 - RNA, 14 nt, Homo sapiens
ugaaccgcacagcu

SEQ ID NO: 752265 - RNA, 20 nt, Homo sapiens
ugaaccugaggaugcaucuu

SEQ ID NO: 752266 - RNA, 16 nt, Homo sapiens
ugaaccuuccaucucg

SEQ ID NO: 752267 - RNA, 19 nt, Homo sapiens
ugaaccuuccaucucgcca

SEQ ID NO: 752268 - RNA, 16 nt, Homo sapiens
ugaacgagcagcccag

SEQ ID NO: 752269 - RNA, 19 nt, Homo sapiens
ugaacuagauugcaugcuu

SEQ ID NO: 752270 - RNA, 17 nt, Homo sapiens
ugaacuaggcugagcaa

SEQ ID NO: 752271 - RNA, 21 nt, Homo sapiens
ugaacuauuucuacacagugg

SEQ ID NO: 752272 - RNA, 13 nt, Homo sapiens
ugaacuccugcca

SEQ ID NO: 752273 - RNA, 21 nt, Homo sapiens
ugaacucugguggcacaggag

SEQ ID NO: 752274 - RNA, 15 nt, Homo sapiens
ugaacucuguaaaac

SEQ ID NO: 752275 - RNA, 18 nt, Homo sapiens
ugaacucuucaaucucuu

SEQ ID NO: 752276 - RNA, 14 nt, Homo sapiens
ugaacugacaauga

SEQ ID NO: 752277 - RNA, 14 nt, Homo sapiens
ugaacugagccuag

SEQ ID NO: 752278 - RNA, 12 nt, Homo sapiens
ugaacuggugaa

SEQ ID NO: 752279 - RNA, 15 nt, Homo sapiens
ugaacugucuuggcu

SEQ ID NO: 752280 - RNA, 22 nt, Homo sapiens
ugaacuguuagguucugaugac

SEQ ID NO: 752281 - RNA, 13 nt, Homo sapiens
ugaacuugccuua

SEQ ID NO: 752282 - RNA, 16 nt, Homo sapiens
ugaacuuuuguacuga

SEQ ID NO: 752283 - RNA, 21 nt, Homo sapiens
ugaacuuuuuaagaugaggca

SEQ ID NO: 752284 - RNA, 16 nt, Homo sapiens
ugaagaaaagaccuuu

SEQ ID NO: 752285 - RNA, 17 nt, Homo sapiens
ugaagaaaaguauugca

SEQ ID NO: 752286 - RNA, 14 nt, Homo sapiens
ugaagaaacuuccc

SEQ ID NO: 752287 - RNA, 19 nt, Homo sapiens
ugaagaacacagcaugugc

SEQ ID NO: 752288 - RNA, 22 nt, Homo sapiens
ugaagaacacagcaugugccaa

SEQ ID NO: 752289 - RNA, 22 nt, Homo sapiens
ugaagaacaguaacugccauca

SEQ ID NO: 752290 - RNA, 23 nt, Homo sapiens
ugaagaacugcaggcccuggccu

SEQ ID NO: 752291 - RNA, 22 nt, Homo sapiens
ugaagaacuggaaccccagcuu

SEQ ID NO: 752292 - RNA, 12 nt, Homo sapiens
cccaaacauguu

SEQ ID NO: 752293 - RNA, 23 nt, Homo sapiens
cccaaacauguuguacauuucac

SEQ ID NO: 752294 - RNA, 21 nt, Homo sapiens
cccaaagauagacagguccug

SEQ ID NO: 752295 - RNA, 13 nt, Homo sapiens
cccaaagcacuuu

SEQ ID NO: 752296 - RNA, 19 nt, Homo sapiens
cccaaaggaacacugacau

SEQ ID NO: 752297 - RNA, 16 nt, Homo sapiens
cccaaaguuguuguaa

SEQ ID NO: 752298 - RNA, 16 nt, Homo sapiens
cccaaccuucuuguca

SEQ ID NO: 752299 - RNA, 15 nt, Homo sapiens
cccaacgcacaggaa

SEQ ID NO: 752300 - RNA, 13 nt, Homo sapiens
cccaacgugguga

SEQ ID NO: 752301 - RNA, 23 nt, Homo sapiens
cccaacuaaaauuugaaguaguu

SEQ ID NO: 752302 - RNA, 22 nt, Homo sapiens
cccaagaaugagcuuacaaagu

SEQ ID NO: 752303 - RNA, 21 nt, Homo sapiens
cccaagacaugacauucuuag

SEQ ID NO: 752304 - RNA, 20 nt, Homo sapiens
cccaagauuuuuuauuugag

SEQ ID NO: 752305 - RNA, 22 nt, Homo sapiens
cccaagcugccucugggccaug

SEQ ID NO: 752306 - RNA, 18 nt, Homo sapiens
cccaaggugcugauguca

SEQ ID NO: 752307 - RNA, 22 nt, Homo sapiens
cccaagucccugucauuugaac

SEQ ID NO: 752308 - RNA, 15 nt, Homo sapiens
cccaaguccucauuu

SEQ ID NO: 752309 - RNA, 16 nt, Homo sapiens
cccaaguuauccaccu

SEQ ID NO: 752310 - RNA, 17 nt, Homo sapiens
cccaaguucaugcagcu

SEQ ID NO: 752311 - RNA, 18 nt, Homo sapiens
cccaauaaaagugacucu

SEQ ID NO: 752312 - RNA, 15 nt, Homo sapiens
cccaaucagcacuga

SEQ ID NO: 752313 - RNA, 22 nt, Homo sapiens
cccaaugaaagaagaguuccau

SEQ ID NO: 752314 - RNA, 17 nt, Homo sapiens
cccacaaccuuccagcu

SEQ ID NO: 752315 - RNA, 10 nt, Homo sapiens
cccacaccca

SEQ ID NO: 752316 - RNA, 19 nt, Homo sapiens
cccacaccccaacacuucc

SEQ ID NO: 752317 - RNA, 17 nt, Homo sapiens
cccacaccugcagugcc

SEQ ID NO: 752318 - RNA, 22 nt, Homo sapiens
cccacacgcccuccccagacuc

SEQ ID NO: 752319 - RNA, 14 nt, Homo sapiens
cccacagacugguu

SEQ ID NO: 752320 - RNA, 12 nt, Homo sapiens
cccacaguuuua

SEQ ID NO: 752321 - RNA, 19 nt, Homo sapiens
cccacauguguccauccca

SEQ ID NO: 752322 - RNA, 21 nt, Homo sapiens
cccaccaacucugcacuccau

SEQ ID NO: 752323 - RNA, 17 nt, Homo sapiens
cccaccaguuauuccuu

SEQ ID NO: 752324 - RNA, 12 nt, Homo sapiens
cccaccauuccc

SEQ ID NO: 752325 - RNA, 16 nt, Homo sapiens
cccacccacaugacuu

SEQ ID NO: 752326 - RNA, 17 nt, Homo sapiens
cccacccacaugugaca

SEQ ID NO: 752327 - RNA, 13 nt, Homo sapiens
cccacccagucuc

SEQ ID NO: 752328 - RNA, 22 nt, Homo sapiens
caagaaaagggcugacauuuuc

SEQ ID NO: 752329 - RNA, 22 nt, Homo sapiens
caagaaacaaauaauagcaaug

SEQ ID NO: 752330 - RNA, 15 nt, Homo sapiens
caagaaauagguuau

SEQ ID NO: 752331 - RNA, 18 nt, Homo sapiens
caagaaaucccugagaca

SEQ ID NO: 752332 - RNA, 23 nt, Homo sapiens
caagaacauuaucuuaguggaag

SEQ ID NO: 752333 - RNA, 19 nt, Homo sapiens
caagaacuugcaauaccaa

SEQ ID NO: 752334 - RNA, 21 nt, Homo sapiens
caagaagcguuaugugcagua

SEQ ID NO: 752335 - RNA, 17 nt, Homo sapiens
caagaaggaacaauaaa

SEQ ID NO: 752336 - RNA, 21 nt, Homo sapiens
caagaagucuugagaaaaaga

SEQ ID NO: 752337 - RNA, 19 nt, Homo sapiens
caagaauauuguauguuaa

SEQ ID NO: 752338 - RNA, 21 nt, Homo sapiens
caagaaucuagaagaugugua

SEQ ID NO: 752339 - RNA, 13 nt, Homo sapiens
caagaaugaaaca

SEQ ID NO: 752340 - RNA, 13 nt, Homo sapiens
caagaaugagcug

SEQ ID NO: 752341 - RNA, 12 nt, Homo sapiens
caagaaugccag

SEQ ID NO: 752342 - RNA, 19 nt, Homo sapiens
caagaauuaaguauuuucc

SEQ ID NO: 752343 - RNA, 20 nt, Homo sapiens
caagaauuaaguauuuuccu

SEQ ID NO: 752344 - RNA, 13 nt, Homo sapiens
caagaauuguuac

SEQ ID NO: 752345 - RNA, 18 nt, Homo sapiens
caagaauuguuaccuguc

SEQ ID NO: 752346 - RNA, 13 nt, Homo sapiens
caagacagugaag

SEQ ID NO: 752347 - RNA, 17 nt, Homo sapiens
caagacauuugcugaac

SEQ ID NO: 752348 - RNA, 21 nt, Homo sapiens
caagacccaggaggcccagcu

SEQ ID NO: 752349 - RNA, 17 nt, Homo sapiens
caagacggagaugcaug

SEQ ID NO: 752350 - RNA, 13 nt, Homo sapiens
caagacucuagag

SEQ ID NO: 752351 - RNA, 13 nt, Homo sapiens
caagacugaaaca

SEQ ID NO: 752352 - RNA, 19 nt, Homo sapiens
caagacuuagagcugggaa

SEQ ID NO: 752353 - RNA, 15 nt, Homo sapiens
caagagaugggacaa

SEQ ID NO: 752354 - RNA, 19 nt, Homo sapiens
caagagaugggacaagcag

SEQ ID NO: 752355 - RNA, 20 nt, Homo sapiens
caagagcgcaccauugcacu

SEQ ID NO: 752356 - RNA, 23 nt, Homo sapiens
caagaggaggacagaauucuccc

SEQ ID NO: 752357 - RNA, 16 nt, Homo sapiens
caagagggauaaaaca

SEQ ID NO: 752358 - RNA, 21 nt, Homo sapiens
caagaggggguggaggggugu

SEQ ID NO: 752359 - RNA, 15 nt, Homo sapiens
caagaggguggauca

SEQ ID NO: 752360 - RNA, 17 nt, Homo sapiens
caagagguacuguaaug

SEQ ID NO: 752361 - RNA, 22 nt, Homo sapiens
caagagguacuguaauggguaa

SEQ ID NO: 752362 - RNA, 15 nt, Homo sapiens
caagagugauugcag

SEQ ID NO: 752363 - RNA, 14 nt, Homo sapiens
caagaguuuuaaca

SEQ ID NO: 752364 - RNA, 14 nt, Homo sapiens
caagauaccaaggc

SEQ ID NO: 752365 - RNA, 13 nt, Homo sapiens
caagauccuuaau

SEQ ID NO: 752366 - RNA, 12 nt, Homo sapiens
caagaucuccaa

SEQ ID NO: 752367 - RNA, 17 nt, Homo sapiens
caagaugcgcacugcau

SEQ ID NO: 752368 - RNA, 21 nt, Homo sapiens
caagaugcgcacugcauucca

SEQ ID NO: 752369 - RNA, 15 nt, Homo sapiens
caagauggauggaaa

SEQ ID NO: 752370 - RNA, 19 nt, Homo sapiens
caagaugggacagcaacaa

SEQ ID NO: 752371 - RNA, 18 nt, Homo sapiens
caagaugugggcagugau

SEQ ID NO: 752372 - RNA, 20 nt, Homo sapiens
caagauucuagaugauuaaa

SEQ ID NO: 752373 - RNA, 16 nt, Homo sapiens
caagauugcaccacug

SEQ ID NO: 752374 - RNA, 21 nt, Homo sapiens
caagauugcgccauugcacuc

SEQ ID NO: 752375 - RNA, 22 nt, Homo sapiens
caagauuggucucccauaugca

SEQ ID NO: 752376 - RNA, 21 nt, Homo sapiens
caagcaaaaacaaaugggaaa

SEQ ID NO: 752377 - RNA, 24 nt, Homo sapiens
caagcaaaaccaaagaauauguag

SEQ ID NO: 752378 - RNA, 17 nt, Homo sapiens
caagcaaaaugcuuaca

SEQ ID NO: 752379 - RNA, 15 nt, Homo sapiens
caagcaaucaagaaa

SEQ ID NO: 752380 - RNA, 17 nt, Homo sapiens
caagcacaaagcucaag

SEQ ID NO: 752381 - RNA, 15 nt, Homo sapiens
caagcacacuggaau

SEQ ID NO: 752382 - RNA, 16 nt, Homo sapiens
cagugaauccagacca

SEQ ID NO: 752383 - RNA, 20 nt, Homo sapiens
cagugaaugugucuggaccu

SEQ ID NO: 752384 - RNA, 21 nt, Homo sapiens
cagugaauuaaauuuucacua

SEQ ID NO: 752385 - RNA, 14 nt, Homo sapiens
cagugacaacaucg

SEQ ID NO: 752386 - RNA, 15 nt, Homo sapiens
cagugaccacaccaa

SEQ ID NO: 752387 - RNA, 23 nt, Homo sapiens
cagugaccccugaccucacugug

SEQ ID NO: 752388 - RNA, 14 nt, Homo sapiens
cagugacuccugcu

SEQ ID NO: 752389 - RNA, 14 nt, Homo sapiens
cagugagauaucau

SEQ ID NO: 752390 - RNA, 19 nt, Homo sapiens
cagugagccaugaucaugc

SEQ ID NO: 752391 - RNA, 20 nt, Homo sapiens
cagugagccaugaucaugcc

SEQ ID NO: 752392 - RNA, 17 nt, Homo sapiens
cagugagucucuucaga

SEQ ID NO: 752393 - RNA, 21 nt, Homo sapiens
cagugaguggccccaccugug

SEQ ID NO: 752394 - RNA, 22 nt, Homo sapiens
cagugaucucagggcagacagc

SEQ ID NO: 752395 - RNA, 22 nt, Homo sapiens
cagugcacauuucauaguuuca

SEQ ID NO: 752396 - RNA, 17 nt, Homo sapiens
cagugcacugaaaguca

SEQ ID NO: 752397 - RNA, 16 nt, Homo sapiens
cagugcacuguauaua

SEQ ID NO: 752398 - RNA, 14 nt, Homo sapiens
cagugcaguuucuu

SEQ ID NO: 752399 - RNA, 15 nt, Homo sapiens
cagugccaccaucau

SEQ ID NO: 752400 - RNA, 20 nt, Homo sapiens
cagugccaccaucauagcuc

SEQ ID NO: 752401 - RNA, 18 nt, Homo sapiens
cagugccauggauuucca

SEQ ID NO: 752402 - RNA, 15 nt, Homo sapiens
cagugcccuacaaag

SEQ ID NO: 752403 - RNA, 10 nt, Homo sapiens
cagugccuuc

SEQ ID NO: 752404 - RNA, 16 nt, Homo sapiens
cagugcgguuccucau

SEQ ID NO: 752405 - RNA, 16 nt, Homo sapiens
cagugcugaauuuccc

SEQ ID NO: 752406 - RNA, 11 nt, Homo sapiens
cagugcuuccc

SEQ ID NO: 752407 - RNA, 22 nt, Homo sapiens
caguggaacaugcaaggcacug

SEQ ID NO: 752408 - RNA, 14 nt, Homo sapiens
caguggacaccagg

SEQ ID NO: 752409 - RNA, 14 nt, Homo sapiens
caguggacucuucc

SEQ ID NO: 752410 - RNA, 16 nt, Homo sapiens
caguggacucuuccac

SEQ ID NO: 752411 - RNA, 23 nt, Homo sapiens
caguggcggggggguuuugccua

SEQ ID NO: 752412 - RNA, 16 nt, Homo sapiens
caguggcgugaucucg

SEQ ID NO: 752413 - RNA, 16 nt, Homo sapiens
cagugguauccuguga

SEQ ID NO: 752414 - RNA, 17 nt, Homo sapiens
cagugguauccugugac

SEQ ID NO: 752415 - RNA, 15 nt, Homo sapiens
cagugguccuuuuca

SEQ ID NO: 752416 - RNA, 17 nt, Homo sapiens
caguguaaaucacggaa

SEQ ID NO: 752417 - RNA, 16 nt, Homo sapiens
caguguaauccagggg

SEQ ID NO: 752418 - RNA, 15 nt, Homo sapiens
caguguauaggaaga

SEQ ID NO: 752419 - RNA, 20 nt, Homo sapiens
caguguccauggacucagaa

SEQ ID NO: 752420 - RNA, 20 nt, Homo sapiens
caguguccuccccucaagga

SEQ ID NO: 752421 - RNA, 16 nt, Homo sapiens
cagugucuccaccuac

SEQ ID NO: 752422 - RNA, 18 nt, Homo sapiens
cagugucucgaugccaua

SEQ ID NO: 752423 - RNA, 13 nt, Homo sapiens
cagugucuuccau

SEQ ID NO: 752424 - RNA, 19 nt, Homo sapiens
cagugucuugagcucuaaa

SEQ ID NO: 752425 - RNA, 19 nt, Homo sapiens
caguguggcugaggccacc

SEQ ID NO: 752426 - RNA, 15 nt, Homo sapiens
caguguggucaagca

SEQ ID NO: 752427 - RNA, 14 nt, Homo sapiens
gaaucuucaccuca

SEQ ID NO: 752428 - RNA, 15 nt, Homo sapiens
gaaugaaagacugaa

SEQ ID NO: 752429 - RNA, 16 nt, Homo sapiens
gaaugaagguaauauu

SEQ ID NO: 752430 - RNA, 17 nt, Homo sapiens
gaaugaauacugggaau

SEQ ID NO: 752431 - RNA, 23 nt, Homo sapiens
gaaugaaucucaagauucaguag

SEQ ID NO: 752432 - RNA, 20 nt, Homo sapiens
gaaugaauuuaucuuuacca

SEQ ID NO: 752433 - RNA, 17 nt, Homo sapiens
gaaugaggcaauuucaa

SEQ ID NO: 752434 - RNA, 21 nt, Homo sapiens
gaaugauucacauccucucaa

SEQ ID NO: 752435 - RNA, 20 nt, Homo sapiens
gaaugauuuagguacgucaa

SEQ ID NO: 752436 - RNA, 22 nt, Homo sapiens
gaaugcaaaguagcaauuucca

SEQ ID NO: 752437 - RNA, 19 nt, Homo sapiens
gaaugcaaccaagucacac

SEQ ID NO: 752438 - RNA, 17 nt, Homo sapiens
gaaugcagaggucucca

SEQ ID NO: 752439 - RNA, 19 nt, Homo sapiens
gaaugccgcugucucugag

SEQ ID NO: 752440 - RNA, 20 nt, Homo sapiens
gaaugccucgcucccuucaa

SEQ ID NO: 752441 - RNA, 20 nt, Homo sapiens
gaaugcggccgcauucccug

SEQ ID NO: 752442 - RNA, 15 nt, Homo sapiens
gaaugcuuugccaua

SEQ ID NO: 752443 - RNA, 18 nt, Homo sapiens
gaauggagggcaacauuc

SEQ ID NO: 752444 - RNA, 22 nt, Homo sapiens
gaauggcccaguccucucccaa

SEQ ID NO: 752445 - RNA, 21 nt, Homo sapiens
gaauggcugcaccuuuuugca

SEQ ID NO: 752446 - RNA, 21 nt, Homo sapiens
gaaugggcuugaaacauuaua

SEQ ID NO: 752447 - RNA, 20 nt, Homo sapiens
gaaugguacaugucuuccau

SEQ ID NO: 752448 - RNA, 22 nt, Homo sapiens
gaaugguggaguguagccucca

SEQ ID NO: 752449 - RNA, 21 nt, Homo sapiens
gaaugguuguacguuuugcac

SEQ ID NO: 752450 - RNA, 23 nt, Homo sapiens
gaauguaaaacagagccauuccc

SEQ ID NO: 752451 - RNA, 15 nt, Homo sapiens
gaauguaauuggaau

SEQ ID NO: 752452 - RNA, 14 nt, Homo sapiens
gaauguacuggcga

SEQ ID NO: 752453 - RNA, 19 nt, Homo sapiens
gaaugucauagucuugaaa

SEQ ID NO: 752454 - RNA, 21 nt, Homo sapiens
gaaugugcucaugcauugcuu

SEQ ID NO: 752455 - RNA, 19 nt, Homo sapiens
gaaugugugggguauagaa

SEQ ID NO: 752456 - RNA, 13 nt, Homo sapiens
gaauuaacugcau

SEQ ID NO: 752457 - RNA, 14 nt, Homo sapiens
gaauuaagcccuaa

SEQ ID NO: 752458 - RNA, 21 nt, Homo sapiens
gaauuaggcuguaacuacuuu

SEQ ID NO: 752459 - RNA, 15 nt, Homo sapiens
gaauuauaaaggcca

SEQ ID NO: 752460 - RNA, 20 nt, Homo sapiens
gaauuauauucaaugcauuu

SEQ ID NO: 752461 - RNA, 15 nt, Homo sapiens
gaauuaucaucccaa

SEQ ID NO: 752462 - RNA, 20 nt, Homo sapiens
gaauuaucaugggaaaagac

SEQ ID NO: 752463 - RNA, 15 nt, Homo sapiens
gaauuaugucugcug

SEQ ID NO: 752464 - RNA, 20 nt, Homo sapiens
gaauuauuuaaacaaaaacu

SEQ ID NO: 752465 - RNA, 13 nt, Homo sapiens
gaauucaaacugg

SEQ ID NO: 752466 - RNA, 16 nt, Homo sapiens
gaauucuagugcugcu

SEQ ID NO: 752467 - RNA, 23 nt, Homo sapiens
gaauucucaagaccugaguauuu

SEQ ID NO: 752468 - RNA, 23 nt, Homo sapiens
gaauugagauaauaucugugagg

SEQ ID NO: 752469 - RNA, 13 nt, Homo sapiens
gaauugauuagga

SEQ ID NO: 752470 - RNA, 12 nt, Homo sapiens
gaauugcucaaa

SEQ ID NO: 752471 - RNA, 18 nt, Homo sapiens
gaauugcuggaugcauuu

SEQ ID NO: 752472 - RNA, 18 nt, Homo sapiens
gaauuggccgcugucacu

SEQ ID NO: 752473 - RNA, 17 nt, Homo sapiens
gaauuucacaagcuauu

SEQ ID NO: 752474 - RNA, 18 nt, Homo sapiens
gaauuucacaagcuauuu

SEQ ID NO: 752475 - RNA, 18 nt, Homo sapiens
gaauuuccucuauugaug

SEQ ID NO: 752476 - RNA, 13 nt, Homo sapiens
gaauuucuaagaa

SEQ ID NO: 752477 - RNA, 13 nt, Homo sapiens
gaauuuggaacaa

SEQ ID NO: 752478 - RNA, 21 nt, Homo sapiens
gaauuuuauauucuaagccag

SEQ ID NO: 752479 - RNA, 21 nt, Homo sapiens
gaauuuugggacuucuaccca

SEQ ID NO: 752480 - RNA, 20 nt, Homo sapiens
gaauuuuuacccaauuggau

SEQ ID NO: 752481 - RNA, 17 nt, Homo sapiens
gacaaaaauauuuacac

SEQ ID NO: 752482 - RNA, 13 nt, Homo sapiens
gacaaaacacagc

SEQ ID NO: 752483 - RNA, 16 nt, Homo sapiens
gacaaaauauuuccca

SEQ ID NO: 752484 - RNA, 18 nt, Homo sapiens
gacaaaauccaugaacaa

SEQ ID NO: 752485 - RNA, 12 nt, Homo sapiens
gacaaacacugc

SEQ ID NO: 752486 - RNA, 16 nt, Homo sapiens
gacaaaccgagugcaa

SEQ ID NO: 752487 - RNA, 19 nt, Homo sapiens
gacaaaccuuauggaaaag

SEQ ID NO: 752488 - RNA, 17 nt, Homo sapiens
gacaaagguuuuccucu

SEQ ID NO: 752489 - RNA, 21 nt, Homo sapiens
gacaaagguuuuccucuucua

SEQ ID NO: 752490 - RNA, 20 nt, Homo sapiens
gacaacaacgcggccaccau

SEQ ID NO: 752491 - RNA, 16 nt, Homo sapiens
gacaacaauccaaaaa

SEQ ID NO: 752492 - RNA, 17 nt, Homo sapiens
gacaacaauccaaaaaa

SEQ ID NO: 752493 - RNA, 18 nt, Homo sapiens
gacaacagaaaaacaauc

SEQ ID NO: 752494 - RNA, 12 nt, Homo sapiens
gacaacaucuga

SEQ ID NO: 752495 - RNA, 12 nt, Homo sapiens
gacaacauuucu

SEQ ID NO: 752496 - RNA, 21 nt, Homo sapiens
gacaacauuucucaaaugcac

SEQ ID NO: 752497 - RNA, 15 nt, Homo sapiens
gacaacgaugaugcu

SEQ ID NO: 752498 - RNA, 16 nt, Homo sapiens
gacaacgaugaugcuu

SEQ ID NO: 752499 - RNA, 13 nt, Homo sapiens
gacaacugugacu

SEQ ID NO: 752500 - RNA, 15 nt, Homo sapiens
gacaacuuagcucag

SEQ ID NO: 752501 - RNA, 21 nt, Homo sapiens
gacaagaauaauucaauuuua

SEQ ID NO: 752502 - RNA, 21 nt, Homo sapiens
gacaagaauuguuaccuguca

SEQ ID NO: 752503 - RNA, 22 nt, Homo sapiens
gacaagagaugggaaugaggug

SEQ ID NO: 752504 - RNA, 18 nt, Homo sapiens
gacaagagugagacucca

SEQ ID NO: 752505 - RNA, 15 nt, Homo sapiens
gacaagauaccaagg

SEQ ID NO: 752506 - RNA, 22 nt, Homo sapiens
gacaagcugacuuggcacuuaa

SEQ ID NO: 752507 - RNA, 17 nt, Homo sapiens
gacaaggaaaaucuaua

SEQ ID NO: 752508 - RNA, 21 nt, Homo sapiens
gacaaggagugugaccacuga

SEQ ID NO: 752509 - RNA, 13 nt, Homo sapiens
gacaaggcuccag

SEQ ID NO: 752510 - RNA, 12 nt, Homo sapiens
gacaagggauuu

SEQ ID NO: 752511 - RNA, 16 nt, Homo sapiens
gacaagggcugaccug

SEQ ID NO: 752512 - RNA, 23 nt, Homo sapiens
gacaagugggcagcauaaaguca

SEQ ID NO: 752513 - RNA, 18 nt, Homo sapiens
gacaauacaguaagcaua

SEQ ID NO: 752514 - RNA, 14 nt, Homo sapiens
gacaauacuggggu

SEQ ID NO: 752515 - RNA, 21 nt, Homo sapiens
gacaauauuccagaucuuuca

SEQ ID NO: 752516 - RNA, 14 nt, Homo sapiens
gacaaucacugcca

SEQ ID NO: 752517 - RNA, 18 nt, Homo sapiens
gacaaucacugccaaccc

SEQ ID NO: 752518 - RNA, 16 nt, Homo sapiens
gacaaugaugaugaua

SEQ ID NO: 752519 - RNA, 16 nt, Homo sapiens
gacaauuucauuccau

SEQ ID NO: 752520 - RNA, 21 nt, Homo sapiens
gacacaaucucggcucacuga

SEQ ID NO: 752521 - RNA, 16 nt, Homo sapiens
gacacacaaaucccau

SEQ ID NO: 752522 - RNA, 21 nt, Homo sapiens
gacacaccauuauauuuaauu

SEQ ID NO: 752523 - RNA, 17 nt, Homo sapiens
gacacagaagccuuuga

SEQ ID NO: 752524 - RNA, 21 nt, Homo sapiens
gacacagcagcuucaccagag

SEQ ID NO: 752525 - RNA, 22 nt, Homo sapiens
gacacagcgucccuagcaguga

SEQ ID NO: 752526 - RNA, 14 nt, Homo sapiens
gacacagcucuuca

SEQ ID NO: 752527 - RNA, 22 nt, Homo sapiens
gacacauacaugucacauuuag

SEQ ID NO: 752528 - RNA, 18 nt, Homo sapiens
gacacauagaaaacaauc

SEQ ID NO: 752529 - RNA, 19 nt, Homo sapiens
gacacauaugcaccuugug

SEQ ID NO: 752530 - RNA, 20 nt, Homo sapiens
gacacaucuauugcagagac

SEQ ID NO: 752531 - RNA, 20 nt, Homo sapiens
gacacauucaggaguuaaau

SEQ ID NO: 752532 - RNA, 12 nt, Homo sapiens
gacacauuggac

SEQ ID NO: 752533 - RNA, 21 nt, Homo sapiens
gacaccaaacugccaaaaaca

SEQ ID NO: 752534 - RNA, 15 nt, Homo sapiens
gacacccccugggau

SEQ ID NO: 752535 - RNA, 19 nt, Homo sapiens
gccuaacaugauuauuuga

SEQ ID NO: 752536 - RNA, 23 nt, Homo sapiens
gccuaauaguaacugguuaaaaa

SEQ ID NO: 752537 - RNA, 12 nt, Homo sapiens
gccuacauucac

SEQ ID NO: 752538 - RNA, 19 nt, Homo sapiens
gccuacuuaagagugcugu

SEQ ID NO: 752539 - RNA, 14 nt, Homo sapiens
gccuagaaauaucu

SEQ ID NO: 752540 - RNA, 15 nt, Homo sapiens
gccuagacuguuacu

SEQ ID NO: 752541 - RNA, 21 nt, Homo sapiens
gccuagcuccugccacaugga

SEQ ID NO: 752542 - RNA, 12 nt, Homo sapiens
gccuaggguaca

SEQ ID NO: 752543 - RNA, 18 nt, Homo sapiens
gccuaucuggaagccacc

SEQ ID NO: 752544 - RNA, 16 nt, Homo sapiens
gccuaugcacauaugg

SEQ ID NO: 752545 - RNA, 22 nt, Homo sapiens
gccuauuaucugucagcugcaa

SEQ ID NO: 752546 - RNA, 20 nt, Homo sapiens
gccucaagaacaaacacugc

SEQ ID NO: 752547 - RNA, 14 nt, Homo sapiens
gccucaauucacau

SEQ ID NO: 752548 - RNA, 19 nt, Homo sapiens
gccucaccguccucaccca

SEQ ID NO: 752549 - RNA, 20 nt, Homo sapiens
gccucaccuccucugugauu

SEQ ID NO: 752550 - RNA, 19 nt, Homo sapiens
gccucacuacucgagccca

SEQ ID NO: 752551 - RNA, 19 nt, Homo sapiens
gccucacugaaacauggcu

SEQ ID NO: 752552 - RNA, 13 nt, Homo sapiens
gccucagggccca

SEQ ID NO: 752553 - RNA, 11 nt, Homo sapiens
gccucaucucu

SEQ ID NO: 752554 - RNA, 12 nt, Homo sapiens
gccucauuugaa

SEQ ID NO: 752555 - RNA, 23 nt, Homo sapiens
gccuccaccccccagaaccuguc

SEQ ID NO: 752556 - RNA, 19 nt, Homo sapiens
gccuccaccgagccagcuu

SEQ ID NO: 752557 - RNA, 18 nt, Homo sapiens
gccuccaccgcugccuaa

SEQ ID NO: 752558 - RNA, 20 nt, Homo sapiens
gccuccaccuccuaggcuca

SEQ ID NO: 752559 - RNA, 11 nt, Homo sapiens
gccuccagggc

SEQ ID NO: 752560 - RNA, 20 nt, Homo sapiens
gccuccagggcauugcucag

SEQ ID NO: 752561 - RNA, 13 nt, Homo sapiens
gccuccauggcuc

SEQ ID NO: 752562 - RNA, 17 nt, Homo sapiens
gccucccaaagugcugg

SEQ ID NO: 752563 - RNA, 19 nt, Homo sapiens
gccucccacccccaucucu

SEQ ID NO: 752564 - RNA, 22 nt, Homo sapiens
gccuccccauuucccaucugca

SEQ ID NO: 752565 - RNA, 14 nt, Homo sapiens
gccucccccaaagc

SEQ ID NO: 752566 - RNA, 24 nt, Homo sapiens
gccucccucccugugccagaccuc

SEQ ID NO: 752567 - RNA, 22 nt, Homo sapiens
gccucccuggggaccaggagcu

SEQ ID NO: 752568 - RNA, 18 nt, Homo sapiens
gccucccuuguggcagca

SEQ ID NO: 752569 - RNA, 11 nt, Homo sapiens
gccuccucacc

SEQ ID NO: 752570 - RNA, 14 nt, Homo sapiens
gccuccucacccac

SEQ ID NO: 752571 - RNA, 17 nt, Homo sapiens
gccuccucagugaaggu

SEQ ID NO: 752572 - RNA, 16 nt, Homo sapiens
gccuccugucccucau

SEQ ID NO: 752573 - RNA, 15 nt, Homo sapiens
gccucgucauggcca

SEQ ID NO: 752574 - RNA, 17 nt, Homo sapiens
gccucuccuccacagcc

SEQ ID NO: 752575 - RNA, 17 nt, Homo sapiens
gccucugccugcauucu

SEQ ID NO: 752576 - RNA, 17 nt, Homo sapiens
gccucuggaaagcaaag

SEQ ID NO: 752577 - RNA, 19 nt, Homo sapiens
gccucugucaggccuucag

SEQ ID NO: 752578 - RNA, 13 nt, Homo sapiens
gccucugugcaca

SEQ ID NO: 752579 - RNA, 15 nt, Homo sapiens
gccucuuaccuuccc

SEQ ID NO: 752580 - RNA, 19 nt, Homo sapiens
gccucuuauuccaggagaa

SEQ ID NO: 752581 - RNA, 24 nt, Homo sapiens
gccucuuccagugaacauucccag

SEQ ID NO: 752582 - RNA, 17 nt, Homo sapiens
gccucuuccugcagccu

SEQ ID NO: 752583 - RNA, 14 nt, Homo sapiens
gccugaaccuucca

SEQ ID NO: 752584 - RNA, 19 nt, Homo sapiens
gccugaaccuuccaucucg

SEQ ID NO: 752585 - RNA, 21 nt, Homo sapiens
gccugaaugucuuacugugau

SEQ ID NO: 752586 - RNA, 15 nt, Homo sapiens
gccugacacauagaa

SEQ ID NO: 752587 - RNA, 19 nt, Homo sapiens
gccugaccucaagcaacca

SEQ ID NO: 752588 - RNA, 18 nt, Homo sapiens
gccugagcgaguguccag

SEQ ID NO: 752589 - RNA, 14 nt, Homo sapiens
gccugagcucugac

SEQ ID NO: 752590 - RNA, 22 nt, Homo sapiens
gccugaggcaauuagacacuuu

SEQ ID NO: 752591 - RNA, 14 nt, Homo sapiens
gccugaggcuguaa

SEQ ID NO: 752592 - RNA, 18 nt, Homo sapiens
gccugagucuccugugcc

SEQ ID NO: 752593 - RNA, 22 nt, Homo sapiens
gccugauacuuuagccaucaua

SEQ ID NO: 752594 - RNA, 14 nt, Homo sapiens
gccugaucuugccu

SEQ ID NO: 752595 - RNA, 21 nt, Homo sapiens
gccugcaaaaaugaaauccag

SEQ ID NO: 752596 - RNA, 13 nt, Homo sapiens
gccugcaagcuuc

SEQ ID NO: 752597 - RNA, 15 nt, Homo sapiens
gccugcacacaccug

SEQ ID NO: 752598 - RNA, 16 nt, Homo sapiens
gccugcacuaauuuga

SEQ ID NO: 752599 - RNA, 15 nt, Homo sapiens
gccugcauggagaag

SEQ ID NO: 752600 - RNA, 16 nt, Homo sapiens
gccugcauggagaagg

SEQ ID NO: 752601 - RNA, 18 nt, Homo sapiens
gccugcccaacgugguga

SEQ ID NO: 752602 - RNA, 18 nt, Homo sapiens
gccugccccccucaucuc

SEQ ID NO: 752603 - RNA, 17 nt, Homo sapiens
gccugcuggcuggcagu

SEQ ID NO: 752604 - RNA, 17 nt, Homo sapiens
gccuggaacaccagcag

SEQ ID NO: 752605 - RNA, 22 nt, Homo sapiens
gccuggacacuguaccgacuuu

SEQ ID NO: 752606 - RNA, 18 nt, Homo sapiens
gccuggagcuaauggcga

SEQ ID NO: 752607 - RNA, 15 nt, Homo sapiens
gccuggaggugggca

SEQ ID NO: 752608 - RNA, 19 nt, Homo sapiens
gccuggauuccagcaguga

SEQ ID NO: 752609 - RNA, 19 nt, Homo sapiens
gccuggcaagugggugaaa

SEQ ID NO: 752610 - RNA, 18 nt, Homo sapiens
gccuggcacaggacugau

SEQ ID NO: 752611 - RNA, 14 nt, Homo sapiens
gccuggcacaucag

SEQ ID NO: 752612 - RNA, 17 nt, Homo sapiens
gccuggccaacauggug

SEQ ID NO: 752613 - RNA, 17 nt, Homo sapiens
gccuggccagcacccca

SEQ ID NO: 752614 - RNA, 23 nt, Homo sapiens
gccuggcccauagaaacaugaca

SEQ ID NO: 752615 - RNA, 16 nt, Homo sapiens
gccuggcuccccacga

SEQ ID NO: 752616 - RNA, 15 nt, Homo sapiens
gccuggcuucuggag

SEQ ID NO: 752617 - RNA, 17 nt, Homo sapiens
gccugggaucuggcaca

SEQ ID NO: 752618 - RNA, 18 nt, Homo sapiens
gccugggcuguggacaga

SEQ ID NO: 752619 - RNA, 20 nt, Homo sapiens
gccuggggauguaaccaagc

SEQ ID NO: 752620 - RNA, 14 nt, Homo sapiens
gccuggggccucac

SEQ ID NO: 752621 - RNA, 14 nt, Homo sapiens
gccuggugcagugg

SEQ ID NO: 752622 - RNA, 22 nt, Homo sapiens
gccuucugggaagggagagggc

SEQ ID NO: 752623 - RNA, 12 nt, Homo sapiens
gccuucuuacaa

SEQ ID NO: 752624 - RNA, 18 nt, Homo sapiens
gccuucuuauugcuuuua

SEQ ID NO: 752625 - RNA, 16 nt, Homo sapiens
gccuugaaaccaccuu

SEQ ID NO: 752626 - RNA, 16 nt, Homo sapiens
gccuugagcccuggcu

SEQ ID NO: 752627 - RNA, 14 nt, Homo sapiens
gccuugcuuguuaa

SEQ ID NO: 752628 - RNA, 19 nt, Homo sapiens
gccuuggccuugcagcugg

SEQ ID NO: 752629 - RNA, 14 nt, Homo sapiens
gccuugggcugcuc

SEQ ID NO: 752630 - RNA, 18 nt, Homo sapiens
gccuuguaagacccuuau

SEQ ID NO: 752631 - RNA, 23 nt, Homo sapiens
gccuugucuucuuagcugucacc

SEQ ID NO: 752632 - RNA, 12 nt, Homo sapiens
gccuugugucac

SEQ ID NO: 752633 - RNA, 14 nt, Homo sapiens
gccuugugugucag

SEQ ID NO: 752634 - RNA, 18 nt, Homo sapiens
gccuuuaaaucugugaug

SEQ ID NO: 752635 - RNA, 18 nt, Homo sapiens
gccuuuacugcauagcag

SEQ ID NO: 752636 - RNA, 12 nt, Homo sapiens
gccuuuaucuca

SEQ ID NO: 752637 - RNA, 13 nt, Homo sapiens
gccuuucucccag

SEQ ID NO: 752638 - RNA, 15 nt, Homo sapiens
gccuuuucacugugu

SEQ ID NO: 752639 - RNA, 12 nt, Homo sapiens
gccuuuugcccg

SEQ ID NO: 752640 - RNA, 13 nt, Homo sapiens
gccuuuuuguaua

SEQ ID NO: 752641 - RNA, 22 nt, Homo sapiens
gccuuuuuuuuaaggagcaaaa

SEQ ID NO: 752642 - RNA, 15 nt, Homo sapiens
gcgaaaccccaucuc

SEQ ID NO: 752643 - RNA, 17 nt, Homo sapiens
gcgaccuccuuucauca

SEQ ID NO: 752644 - RNA, 16 nt, Homo sapiens
gcgagacuccgucuca

SEQ ID NO: 752645 - RNA, 21 nt, Homo sapiens
gcgagcacugugagcaccuga

SEQ ID NO: 752646 - RNA, 14 nt, Homo sapiens
gcgagucacugccu

SEQ ID NO: 752647 - RNA, 15 nt, Homo sapiens
gcgagucacugccuc

SEQ ID NO: 752648 - RNA, 17 nt, Homo sapiens
gcgaguucucuuuggaa

SEQ ID NO: 752649 - RNA, 18 nt, Homo sapiens
gcgaugaggggacauuuu

SEQ ID NO: 752650 - RNA, 21 nt, Homo sapiens
gcgauucuggauaaagccacu

SEQ ID NO: 752651 - RNA, 17 nt, Homo sapiens
gcgauugaaagggcaau

SEQ ID NO: 752652 - RNA, 16 nt, Homo sapiens
gcgcacaccgccagca

SEQ ID NO: 752653 - RNA, 21 nt, Homo sapiens
gcgcaccaaaacuauccugau

SEQ ID NO: 752654 - RNA, 17 nt, Homo sapiens
gcgcaguuguucagagc

SEQ ID NO: 752655 - RNA, 23 nt, Homo sapiens
gcgccaaauaaugucucugugag

SEQ ID NO: 752656 - RNA, 23 nt, Homo sapiens
gcgccccugccaccucccugacc

SEQ ID NO: 752657 - RNA, 20 nt, Homo sapiens
gcgccuccauggcucugcag

SEQ ID NO: 752658 - RNA, 16 nt, Homo sapiens
gcgccuggccagagcc

SEQ ID NO: 752659 - RNA, 16 nt, Homo sapiens
gcgccuguaauuccag

SEQ ID NO: 752660 - RNA, 19 nt, Homo sapiens
gcgccuguaauuccagcua

SEQ ID NO: 752661 - RNA, 17 nt, Homo sapiens
gcgcgaucucagcucac

SEQ ID NO: 752662 - RNA, 14 nt, Homo sapiens
gcgcgguggcucac

SEQ ID NO: 752663 - RNA, 22 nt, Homo sapiens
gcgcguuugugcauaucugccu

SEQ ID NO: 752664 - RNA, 14 nt, Homo sapiens
gcgcucgcccagca

SEQ ID NO: 752665 - RNA, 19 nt, Homo sapiens
gcgcucggcuccaccccag

SEQ ID NO: 752666 - RNA, 14 nt, Homo sapiens
gcgcucugccauuc

SEQ ID NO: 752667 - RNA, 14 nt, Homo sapiens
gcgcucuggugcug

SEQ ID NO: 752668 - RNA, 16 nt, Homo sapiens
gcgcugcugguguucu

SEQ ID NO: 752669 - RNA, 15 nt, Homo sapiens
gcgcuggacacucuc

SEQ ID NO: 752670 - RNA, 22 nt, Homo sapiens
gcgcuguggcucacgccuguaa

SEQ ID NO: 752671 - RNA, 20 nt, Homo sapiens
gcgcuguuuucucagcucca

SEQ ID NO: 752672 - RNA, 12 nt, Homo sapiens
gcggaagccaaa

SEQ ID NO: 752673 - RNA, 15 nt, Homo sapiens
gcggagagagccaag

SEQ ID NO: 752674 - RNA, 16 nt, Homo sapiens
gcggagcuugcaguga

SEQ ID NO: 752675 - RNA, 16 nt, Homo sapiens
gcggagguuccaguga

SEQ ID NO: 752676 - RNA, 18 nt, Homo sapiens
gcggccucguuccagugg

SEQ ID NO: 752677 - RNA, 13 nt, Homo sapiens
gcggccucuugcu

SEQ ID NO: 752678 - RNA, 15 nt, Homo sapiens
gcgggacagagggug

SEQ ID NO: 752679 - RNA, 16 nt, Homo sapiens
gcgggcauggcgugga

SEQ ID NO: 752680 - RNA, 21 nt, Homo sapiens
gcgggcgcucgcucaggugau

SEQ ID NO: 752681 - RNA, 16 nt, Homo sapiens
gcggggaucaucugcc

SEQ ID NO: 752682 - RNA, 23 nt, Homo sapiens
gcggucggggacuuuaccugcug

SEQ ID NO: 752683 - RNA, 14 nt, Homo sapiens
gcgguggaccaaag

SEQ ID NO: 752684 - RNA, 16 nt, Homo sapiens
gcguaguccgcuuucu

SEQ ID NO: 752685 - RNA, 17 nt, Homo sapiens
gcguaguccgcuuucuc

SEQ ID NO: 752686 - RNA, 23 nt, Homo sapiens
gcguccaauacacgcgugugcuc

SEQ ID NO: 752687 - RNA, 11 nt, Homo sapiens
gcgucuugccc

SEQ ID NO: 752688 - RNA, 19 nt, Homo sapiens
gcgugaccuugcaauguuc

SEQ ID NO: 752689 - RNA, 17 nt, Homo sapiens
gcgugacucacccaagc

SEQ ID NO: 752690 - RNA, 13 nt, Homo sapiens
gcgugagacccag

SEQ ID NO: 752691 - RNA, 20 nt, Homo sapiens
gcgugagccaccaugccugg

SEQ ID NO: 752692 - RNA, 18 nt, Homo sapiens
gcguggacucugcacaug

SEQ ID NO: 752693 - RNA, 20 nt, Homo sapiens
gcguggacucugcacauguc

SEQ ID NO: 752694 - RNA, 19 nt, Homo sapiens
gcguuaugugcaguacuua

SEQ ID NO: 752695 - RNA, 12 nt, Homo sapiens
gcguucaaagag

SEQ ID NO: 752696 - RNA, 21 nt, Homo sapiens
gcguuguuacaggaagucccu

SEQ ID NO: 752697 - RNA, 14 nt, Homo sapiens
gcuaaaaaagcaua

SEQ ID NO: 752698 - RNA, 20 nt, Homo sapiens
gcuaaaccaaggacugagca

SEQ ID NO: 752699 - RNA, 16 nt, Homo sapiens
gcuaaacugaugacuu

SEQ ID NO: 752700 - RNA, 13 nt, Homo sapiens
gcuaaagccagga

SEQ ID NO: 752701 - RNA, 11 nt, Homo sapiens
gcuaaaugcac

SEQ ID NO: 752702 - RNA, 12 nt, Homo sapiens
gcuaaauuccac

SEQ ID NO: 752703 - RNA, 20 nt, Homo sapiens
gcuaacuauauuugcuuuuu

SEQ ID NO: 752704 - RNA, 16 nt, Homo sapiens
gcuaacuggguuaaau

SEQ ID NO: 752705 - RNA, 15 nt, Homo sapiens
gcuaacugguuaaac

SEQ ID NO: 752706 - RNA, 13 nt, Homo sapiens
gcuaagaaccugg

SEQ ID NO: 752707 - RNA, 13 nt, Homo sapiens
ggccugcuccaga

SEQ ID NO: 752708 - RNA, 20 nt, Homo sapiens
ggccuggccagucuuccucu

SEQ ID NO: 752709 - RNA, 17 nt, Homo sapiens
ggccuggcccucacuca

SEQ ID NO: 752710 - RNA, 21 nt, Homo sapiens
ggccuguugaagaugcuugua

SEQ ID NO: 752711 - RNA, 13 nt, Homo sapiens
ggccuucauccuc

SEQ ID NO: 752712 - RNA, 19 nt, Homo sapiens
ggccuuccucucuccagau

SEQ ID NO: 752713 - RNA, 18 nt, Homo sapiens
ggccuucugggaacucuc

SEQ ID NO: 752714 - RNA, 16 nt, Homo sapiens
ggccuugugugaugau

SEQ ID NO: 752715 - RNA, 15 nt, Homo sapiens
ggccuugugugucag

SEQ ID NO: 752716 - RNA, 20 nt, Homo sapiens
ggcgacaguuuuccuucuca

SEQ ID NO: 752717 - RNA, 22 nt, Homo sapiens
ggcgaggccgccagacauacac

SEQ ID NO: 752718 - RNA, 15 nt, Homo sapiens
ggcgcaggugcacag

SEQ ID NO: 752719 - RNA, 13 nt, Homo sapiens
ggcgcagugcuuc

SEQ ID NO: 752720 - RNA, 15 nt, Homo sapiens
ggcgcaucauaugca

SEQ ID NO: 752721 - RNA, 14 nt, Homo sapiens
ggcgccuucucgga

SEQ ID NO: 752722 - RNA, 14 nt, Homo sapiens
ggcggaucaucuaa

SEQ ID NO: 752723 - RNA, 16 nt, Homo sapiens
ggcggcccacacccag

SEQ ID NO: 752724 - RNA, 14 nt, Homo sapiens
ggcggcccggccag

SEQ ID NO: 752725 - RNA, 17 nt, Homo sapiens
ggcggcccugaccaaug

SEQ ID NO: 752726 - RNA, 15 nt, Homo sapiens
ggcgguggaccaaag

SEQ ID NO: 752727 - RNA, 23 nt, Homo sapiens
ggcguagacuugacaacauccca

SEQ ID NO: 752728 - RNA, 15 nt, Homo sapiens
ggcgucggaaaugau

SEQ ID NO: 752729 - RNA, 13 nt, Homo sapiens
ggcgucuugccca

SEQ ID NO: 752730 - RNA, 17 nt, Homo sapiens
ggcgugagacccagugc

SEQ ID NO: 752731 - RNA, 18 nt, Homo sapiens
ggcgugcuccuuuucucu

SEQ ID NO: 752732 - RNA, 22 nt, Homo sapiens
ggcguggggccaauacccagac

SEQ ID NO: 752733 - RNA, 23 nt, Homo sapiens
ggcguuuggacccaguucaguga

SEQ ID NO: 752734 - RNA, 22 nt, Homo sapiens
ggcuaaaugcaccaagaaagcu

SEQ ID NO: 752735 - RNA, 13 nt, Homo sapiens
ggcuaaauggaag

SEQ ID NO: 752736 - RNA, 14 nt, Homo sapiens
ggcuaacacgguga

SEQ ID NO: 752737 - RNA, 23 nt, Homo sapiens
ggcuaauuuuuuguguuuuuaca

SEQ ID NO: 752738 - RNA, 17 nt, Homo sapiens
ggcuacacacaaaccag

SEQ ID NO: 752739 - RNA, 16 nt, Homo sapiens
ggcuacacucaucuga

SEQ ID NO: 752740 - RNA, 13 nt, Homo sapiens
ggcuaccuacaua

SEQ ID NO: 752741 - RNA, 17 nt, Homo sapiens
ggcuaccucaccugggc

SEQ ID NO: 752742 - RNA, 20 nt, Homo sapiens
ggcuacguuuugguucuaug

SEQ ID NO: 752743 - RNA, 13 nt, Homo sapiens
ggcuagauguuua

SEQ ID NO: 752744 - RNA, 13 nt, Homo sapiens
ggcuagggguccu

SEQ ID NO: 752745 - RNA, 15 nt, Homo sapiens
ggcuaguggggugaa

SEQ ID NO: 752746 - RNA, 16 nt, Homo sapiens
ggcuauaagugcucaa

SEQ ID NO: 752747 - RNA, 14 nt, Homo sapiens
ggcuauaccugggg

SEQ ID NO: 752748 - RNA, 16 nt, Homo sapiens
ggcuaucaacuuaaua

SEQ ID NO: 752749 - RNA, 16 nt, Homo sapiens
ggcuaucguuagugcu

SEQ ID NO: 752750 - RNA, 20 nt, Homo sapiens
ggcuauggaggguccuccuc

SEQ ID NO: 752751 - RNA, 14 nt, Homo sapiens
ggcuauuauuuauu

SEQ ID NO: 752752 - RNA, 21 nt, Homo sapiens
ggcuauuauuuauuguauuag

SEQ ID NO: 752753 - RNA, 14 nt, Homo sapiens
ggcuauugaagaug

SEQ ID NO: 752754 - RNA, 17 nt, Homo sapiens
ggcuauuuggacucagg

SEQ ID NO: 752755 - RNA, 20 nt, Homo sapiens
ggcucaagcaguccucccac

SEQ ID NO: 752756 - RNA, 14 nt, Homo sapiens
ggcucacacugaga

SEQ ID NO: 752757 - RNA, 13 nt, Homo sapiens
ggcucacacugug

SEQ ID NO: 752758 - RNA, 19 nt, Homo sapiens
ggcucacacugugcucaga

SEQ ID NO: 752759 - RNA, 14 nt, Homo sapiens
ggcucagaacaccc

SEQ ID NO: 752760 - RNA, 16 nt, Homo sapiens
ggcuccaaaucugccu

SEQ ID NO: 752761 - RNA, 14 nt, Homo sapiens
ggcuccaccccagg

SEQ ID NO: 752762 - RNA, 18 nt, Homo sapiens
ggcuccugagugucauga

SEQ ID NO: 752763 - RNA, 16 nt, Homo sapiens
ggcuccuggggcaaug

SEQ ID NO: 752764 - RNA, 21 nt, Homo sapiens
ggcuccuuggauguagucagu

SEQ ID NO: 752765 - RNA, 22 nt, Homo sapiens
ggcucgccaugccggggguuca

SEQ ID NO: 752766 - RNA, 19 nt, Homo sapiens
ggcucugugccuuggucuc

SEQ ID NO: 752767 - RNA, 19 nt, Homo sapiens
ggcucuuaugugugccuuu

SEQ ID NO: 752768 - RNA, 11 nt, Homo sapiens
ggcucuuccaa

SEQ ID NO: 752769 - RNA, 15 nt, Homo sapiens
ggcucuuucagagag

SEQ ID NO: 752770 - RNA, 15 nt, Homo sapiens
ggcugaaagaugacg

SEQ ID NO: 752771 - RNA, 19 nt, Homo sapiens
ggcugaauagcacagguga

SEQ ID NO: 752772 - RNA, 21 nt, Homo sapiens
ggcugaauccgugguggcacc

SEQ ID NO: 752773 - RNA, 14 nt, Homo sapiens
ggcugacaagggac

SEQ ID NO: 752774 - RNA, 12 nt, Homo sapiens
ggcugacaucug

SEQ ID NO: 752775 - RNA, 15 nt, Homo sapiens
ggcugaccaugcuca

SEQ ID NO: 752776 - RNA, 12 nt, Homo sapiens
gggcagggauga

SEQ ID NO: 752777 - RNA, 18 nt, Homo sapiens
gggcagggugagaagcua

SEQ ID NO: 752778 - RNA, 18 nt, Homo sapiens
gggcagucggcuccucaa

SEQ ID NO: 752779 - RNA, 21 nt, Homo sapiens
gggcaguguggccucuuggcu

SEQ ID NO: 752780 - RNA, 11 nt, Homo sapiens
gggcaucuccu

SEQ ID NO: 752781 - RNA, 18 nt, Homo sapiens
gggcaucugccccucccc

SEQ ID NO: 752782 - RNA, 16 nt, Homo sapiens
gggcauggguccaggg

SEQ ID NO: 752783 - RNA, 23 nt, Homo sapiens
gggcauguccuuuccaucugucc

SEQ ID NO: 752784 - RNA, 20 nt, Homo sapiens
gggccacaccugagcgcugu

SEQ ID NO: 752785 - RNA, 22 nt, Homo sapiens
gggccagcacuggaggggccca

SEQ ID NO: 752786 - RNA, 16 nt, Homo sapiens
gggccagggcccugca

SEQ ID NO: 752787 - RNA, 14 nt, Homo sapiens
gggcccaccuggcc

SEQ ID NO: 752788 - RNA, 17 nt, Homo sapiens
gggcccagcgcucuccu

SEQ ID NO: 752789 - RNA, 21 nt, Homo sapiens
gggcccagcugggcucugcca

SEQ ID NO: 752790 - RNA, 15 nt, Homo sapiens
gggccccaccaccua

SEQ ID NO: 752791 - RNA, 14 nt, Homo sapiens
gggccccauccuca

SEQ ID NO: 752792 - RNA, 15 nt, Homo sapiens
gggcccugcacagau

SEQ ID NO: 752793 - RNA, 22 nt, Homo sapiens
gggcccugccccaccccaucca

SEQ ID NO: 752794 - RNA, 15 nt, Homo sapiens
gggccgaauccccuc

SEQ ID NO: 752795 - RNA, 16 nt, Homo sapiens
gggccgcugggguccg

SEQ ID NO: 752796 - RNA, 16 nt, Homo sapiens
gggccggaaggaaugu

SEQ ID NO: 752797 - RNA, 23 nt, Homo sapiens
gggccucaggcucugcacagaca

SEQ ID NO: 752798 - RNA, 13 nt, Homo sapiens
gggccuccaugcc

SEQ ID NO: 752799 - RNA, 16 nt, Homo sapiens
gggccucgggaccuca

SEQ ID NO: 752800 - RNA, 16 nt, Homo sapiens
gggccugaccaaacag

SEQ ID NO: 752801 - RNA, 14 nt, Homo sapiens
gggccuggaccugc

SEQ ID NO: 752802 - RNA, 17 nt, Homo sapiens
gggccugggacuuccau

SEQ ID NO: 752803 - RNA, 21 nt, Homo sapiens
gggccugggacuuccaugccu

SEQ ID NO: 752804 - RNA, 21 nt, Homo sapiens
gggccuggggauguaaccaag

SEQ ID NO: 752805 - RNA, 15 nt, Homo sapiens
gggccuggggcuccu

SEQ ID NO: 752806 - RNA, 18 nt, Homo sapiens
gggccuguucucuuggcu

SEQ ID NO: 752807 - RNA, 21 nt, Homo sapiens
gggccuuuucugugccagaca

SEQ ID NO: 752808 - RNA, 18 nt, Homo sapiens
gggcgcucucccuaccuu

SEQ ID NO: 752809 - RNA, 23 nt, Homo sapiens
gggcuagagaaaucagcugcuau

SEQ ID NO: 752810 - RNA, 17 nt, Homo sapiens
gggcuaguagaacugga

SEQ ID NO: 752811 - RNA, 16 nt, Homo sapiens
gggcuagugacuugug

SEQ ID NO: 752812 - RNA, 22 nt, Homo sapiens
gggcucaaggaaaggggguccc

SEQ ID NO: 752813 - RNA, 22 nt, Homo sapiens
gggcucacucagccacccugag

SEQ ID NO: 752814 - RNA, 16 nt, Homo sapiens
gggcucagaguggggu

SEQ ID NO: 752815 - RNA, 14 nt, Homo sapiens
gggcucagccuggu

SEQ ID NO: 752816 - RNA, 15 nt, Homo sapiens
gggcuccuugcucca

SEQ ID NO: 752817 - RNA, 17 nt, Homo sapiens
gggcugaggccucucau

SEQ ID NO: 752818 - RNA, 19 nt, Homo sapiens
gggcugaguggucugacac

SEQ ID NO: 752819 - RNA, 18 nt, Homo sapiens
gggcugauuuucaucaaa

SEQ ID NO: 752820 - RNA, 15 nt, Homo sapiens
gggcugcccuggugc

SEQ ID NO: 752821 - RNA, 21 nt, Homo sapiens
gggcugccgggaaccucaucu

SEQ ID NO: 752822 - RNA, 23 nt, Homo sapiens
gggcuggaggcccaggcugggaa

SEQ ID NO: 752823 - RNA, 16 nt, Homo sapiens
gggcugggccaggucu

SEQ ID NO: 752824 - RNA, 16 nt, Homo sapiens
gggcugguugcuguag

SEQ ID NO: 752825 - RNA, 16 nt, Homo sapiens
ggcagcugccucugcu

SEQ ID NO: 752826 - RNA, 22 nt, Homo sapiens
ggcagcugcuauccccaucucc

SEQ ID NO: 752827 - RNA, 22 nt, Homo sapiens
ggcaggaaucuauccauugaac

SEQ ID NO: 752828 - RNA, 18 nt, Homo sapiens
ggcaggacacacauggug

SEQ ID NO: 752829 - RNA, 18 nt, Homo sapiens
ggcaggacugaguccccu

SEQ ID NO: 752830 - RNA, 13 nt, Homo sapiens
ggcaggagaagaa

SEQ ID NO: 752831 - RNA, 20 nt, Homo sapiens
ggcaggagaaucgcuugaac

SEQ ID NO: 752832 - RNA, 16 nt, Homo sapiens
ggcaggagccggcugc

SEQ ID NO: 752833 - RNA, 18 nt, Homo sapiens
ggcaggcugggccauguc

SEQ ID NO: 752834 - RNA, 21 nt, Homo sapiens
ggcaggcuuagagucaggcau

SEQ ID NO: 752835 - RNA, 20 nt, Homo sapiens
ggcagggagcugggcccgac

SEQ ID NO: 752836 - RNA, 16 nt, Homo sapiens
ggcagggaugauggca

SEQ ID NO: 752837 - RNA, 16 nt, Homo sapiens
ggcagggcaaaugaca

SEQ ID NO: 752838 - RNA, 16 nt, Homo sapiens
ggcagggggcaggccu

SEQ ID NO: 752839 - RNA, 22 nt, Homo sapiens
ggcagguaggucggcacuugga

SEQ ID NO: 752840 - RNA, 17 nt, Homo sapiens
ggcaggucuaguguucc

SEQ ID NO: 752841 - RNA, 17 nt, Homo sapiens
ggcaggugaauaugugg

SEQ ID NO: 752842 - RNA, 12 nt, Homo sapiens
ggcaggugcaga

SEQ ID NO: 752843 - RNA, 17 nt, Homo sapiens
ggcaggugccuguugaa

SEQ ID NO: 752844 - RNA, 23 nt, Homo sapiens
ggcaggugggcuggccuggcaca

SEQ ID NO: 752845 - RNA, 19 nt, Homo sapiens
ggcagguguugggaccugc

SEQ ID NO: 752846 - RNA, 14 nt, Homo sapiens
ggcagguuugccag

SEQ ID NO: 752847 - RNA, 16 nt, Homo sapiens
ggcaguagaacuccag

SEQ ID NO: 752848 - RNA, 19 nt, Homo sapiens
ggcaguccuggaaucacau

SEQ ID NO: 752849 - RNA, 20 nt, Homo sapiens
ggcaguggaagcaguuucag

SEQ ID NO: 752850 - RNA, 15 nt, Homo sapiens
ggcaguggcagggga

SEQ ID NO: 752851 - RNA, 22 nt, Homo sapiens
ggcaguggcccuccaccuuguu

SEQ ID NO: 752852 - RNA, 14 nt, Homo sapiens
ggcagugggaccca

SEQ ID NO: 752853 - RNA, 10 nt, Homo sapiens
ggcaguuuuu

SEQ ID NO: 752854 - RNA, 12 nt, Homo sapiens
ggcauacuuucu

SEQ ID NO: 752855 - RNA, 16 nt, Homo sapiens
ggcauaggccugggug

SEQ ID NO: 752856 - RNA, 18 nt, Homo sapiens
ggcaucaggaauugucaa

SEQ ID NO: 752857 - RNA, 19 nt, Homo sapiens
ggcaucgaccacaccagcc

SEQ ID NO: 752858 - RNA, 21 nt, Homo sapiens
ggcaucuccugugcaugggug

SEQ ID NO: 752859 - RNA, 21 nt, Homo sapiens
ggcaucugcucuagauucaua

SEQ ID NO: 752860 - RNA, 21 nt, Homo sapiens
ggcaucuuuucuagagacaca

SEQ ID NO: 752861 - RNA, 16 nt, Homo sapiens
ggcaugagacucagug

SEQ ID NO: 752862 - RNA, 13 nt, Homo sapiens
ggcaugauggugc

SEQ ID NO: 752863 - RNA, 18 nt, Homo sapiens
ggcauggccagguggcca

SEQ ID NO: 752864 - RNA, 15 nt, Homo sapiens
ggcauggcuggggug

SEQ ID NO: 752865 - RNA, 15 nt, Homo sapiens
ggcaugucugguuca

SEQ ID NO: 752866 - RNA, 21 nt, Homo sapiens
ggcauguggccuuuaucucaa

SEQ ID NO: 752867 - RNA, 13 nt, Homo sapiens
ggcaugugugccu

SEQ ID NO: 752868 - RNA, 12 nt, Homo sapiens
ggcauugcucag

SEQ ID NO: 752869 - RNA, 13 nt, Homo sapiens
ggcauugcucagc

SEQ ID NO: 752870 - RNA, 20 nt, Homo sapiens
ggcauugucuguaaugacaa

SEQ ID NO: 752871 - RNA, 23 nt, Homo sapiens
ggccaacauggugaaacccuguc

SEQ ID NO: 752872 - RNA, 14 nt, Homo sapiens
ggccaagaugcuaa

SEQ ID NO: 752873 - RNA, 14 nt, Homo sapiens
ggccaagguccugc

SEQ ID NO: 752874 - RNA, 19 nt, Homo sapiens
ggccaauaaauaugauguu

SEQ ID NO: 752875 - RNA, 22 nt, Homo sapiens
ggccaauaacuuuucaccaaug

SEQ ID NO: 752876 - RNA, 17 nt, Homo sapiens
ggccacagcaggacuga

SEQ ID NO: 752877 - RNA, 17 nt, Homo sapiens
ggccacauagaugcuga

SEQ ID NO: 752878 - RNA, 21 nt, Homo sapiens
ggccacauagaugcugaugga

SEQ ID NO: 752879 - RNA, 11 nt, Homo sapiens
ggccaccagag

SEQ ID NO: 752880 - RNA, 15 nt, Homo sapiens
ggccacccagccagg

SEQ ID NO: 752881 - RNA, 16 nt, Homo sapiens
ggccacccccauggaa

SEQ ID NO: 752882 - RNA, 23 nt, Homo sapiens
ggccacccccauggaagcaauaa

SEQ ID NO: 752883 - RNA, 19 nt, Homo sapiens
ggccacgggggcaguguga

SEQ ID NO: 752884 - RNA, 20 nt, Homo sapiens
ggccacuaggaggaaugugu

SEQ ID NO: 752885 - RNA, 12 nt, Homo sapiens
ggccagcacuuc

SEQ ID NO: 752886 - RNA, 19 nt, Homo sapiens
ggccagcauacuccgugag

SEQ ID NO: 752887 - RNA, 15 nt, Homo sapiens
ggccagcccggcugg

SEQ ID NO: 752888 - RNA, 16 nt, Homo sapiens
ggccagcccugcagcc

SEQ ID NO: 752889 - RNA, 22 nt, Homo sapiens
ggccagcgucuugcucuguuca

SEQ ID NO: 752890 - RNA, 20 nt, Homo sapiens
ggccaggaguuugagaccag

SEQ ID NO: 752891 - RNA, 15 nt, Homo sapiens
ggccaggcacagggc

SEQ ID NO: 752892 - RNA, 20 nt, Homo sapiens
ggccaggcacccccaaauca

SEQ ID NO: 752893 - RNA, 21 nt, Homo sapiens
ggccagggaaagcccguguca

SEQ ID NO: 752894 - RNA, 18 nt, Homo sapiens
ggccagggcagcaaggga

SEQ ID NO: 752895 - RNA, 13 nt, Homo sapiens
ggguggguggugg

SEQ ID NO: 752896 - RNA, 22 nt, Homo sapiens
gggugugggaagaccaaaggaa

SEQ ID NO: 752897 - RNA, 13 nt, Homo sapiens
ggguguguguagc

SEQ ID NO: 752898 - RNA, 15 nt, Homo sapiens
ggguuaagagcucac

SEQ ID NO: 752899 - RNA, 17 nt, Homo sapiens
ggguuagauguugccau

SEQ ID NO: 752900 - RNA, 16 nt, Homo sapiens
ggguuaggacucucca

SEQ ID NO: 752901 - RNA, 21 nt, Homo sapiens
ggguuaguuuacaaucagcca

SEQ ID NO: 752902 - RNA, 14 nt, Homo sapiens
ggguucaagugauu

SEQ ID NO: 752903 - RNA, 18 nt, Homo sapiens
ggguucaccauguugccc

SEQ ID NO: 752904 - RNA, 20 nt, Homo sapiens
ggguucaccauguugcccag

SEQ ID NO: 752905 - RNA, 21 nt, Homo sapiens
ggguucuuauuuugcauucca

SEQ ID NO: 752906 - RNA, 17 nt, Homo sapiens
ggguuggacaaccucau

SEQ ID NO: 752907 - RNA, 21 nt, Homo sapiens
ggguugggggacagccuucag

SEQ ID NO: 752908 - RNA, 19 nt, Homo sapiens
ggguugucgagaucucagg

SEQ ID NO: 752909 - RNA, 17 nt, Homo sapiens
ggguugugcacauuucu

SEQ ID NO: 752910 - RNA, 16 nt, Homo sapiens
ggguuuauagauguga

SEQ ID NO: 752911 - RNA, 21 nt, Homo sapiens
ggguuuguuuuucaaagccug

SEQ ID NO: 752912 - RNA, 22 nt, Homo sapiens
ggguuuuguggucaucuauucu

SEQ ID NO: 752913 - RNA, 23 nt, Homo sapiens
ggguuuuuguucuggaagccaua

SEQ ID NO: 752914 - RNA, 19 nt, Homo sapiens
gguaaaaacagcagcucau

SEQ ID NO: 752915 - RNA, 17 nt, Homo sapiens
gguaaaaccccaucucu

SEQ ID NO: 752916 - RNA, 11 nt, Homo sapiens
gguaaucagca

SEQ ID NO: 752917 - RNA, 14 nt, Homo sapiens
gguacagguauauu

SEQ ID NO: 752918 - RNA, 24 nt, Homo sapiens
gguacagguauauuuugacgucac

SEQ ID NO: 752919 - RNA, 16 nt, Homo sapiens
gguacccacugggaca

SEQ ID NO: 752920 - RNA, 21 nt, Homo sapiens
gguaccugcccucuauuuauu

SEQ ID NO: 752921 - RNA, 15 nt, Homo sapiens
gguacuacaaccaau

SEQ ID NO: 752922 - RNA, 16 nt, Homo sapiens
gguacuacaaccaauu

SEQ ID NO: 752923 - RNA, 20 nt, Homo sapiens
gguacuauuuagauauaaca

SEQ ID NO: 752924 - RNA, 13 nt, Homo sapiens
gguacuuauacua

SEQ ID NO: 752925 - RNA, 20 nt, Homo sapiens
gguagaaaaggcuagguaca

SEQ ID NO: 752926 - RNA, 21 nt, Homo sapiens
gguagaaggggaggacacugg

SEQ ID NO: 752927 - RNA, 16 nt, Homo sapiens
gguagagaaggagcag

SEQ ID NO: 752928 - RNA, 20 nt, Homo sapiens
gguagaggcugggggcucca

SEQ ID NO: 752929 - RNA, 15 nt, Homo sapiens
gguagauucgcuguc

SEQ ID NO: 752930 - RNA, 13 nt, Homo sapiens
gguagcaacugaa

SEQ ID NO: 752931 - RNA, 19 nt, Homo sapiens
gguagccaucaagcacuuc

SEQ ID NO: 752932 - RNA, 16 nt, Homo sapiens
gguagcuagaugccac

SEQ ID NO: 752933 - RNA, 19 nt, Homo sapiens
gguaggggcagggaggcaa

SEQ ID NO: 752934 - RNA, 23 nt, Homo sapiens
gguaguaaauaugaaacuagggu

SEQ ID NO: 752935 - RNA, 17 nt, Homo sapiens
gguaguccccuguugau

SEQ ID NO: 752936 - RNA, 14 nt, Homo sapiens
gguaguguucagua

SEQ ID NO: 752937 - RNA, 15 nt, Homo sapiens
gguaguuauucugcc

SEQ ID NO: 752938 - RNA, 15 nt, Homo sapiens
gguaguuguggcuuu

SEQ ID NO: 752939 - RNA, 20 nt, Homo sapiens
gguauaaugguugacugggu

SEQ ID NO: 752940 - RNA, 18 nt, Homo sapiens
gguauauaaauuuuccca

SEQ ID NO: 752941 - RNA, 16 nt, Homo sapiens
gguauccugcccagug

SEQ ID NO: 752942 - RNA, 13 nt, Homo sapiens
gguauggacaaaa

SEQ ID NO: 752943 - RNA, 20 nt, Homo sapiens
gguauggacaaaauugcaga

SEQ ID NO: 752944 - RNA, 14 nt, Homo sapiens
gguauguuuuacca

SEQ ID NO: 752945 - RNA, 17 nt, Homo sapiens
gguauuagcaaagcaaa

SEQ ID NO: 752946 - RNA, 15 nt, Homo sapiens
gguggaugaucucaa

SEQ ID NO: 752947 - RNA, 13 nt, Homo sapiens
gguggaugugaug

SEQ ID NO: 752948 - RNA, 18 nt, Homo sapiens
gguggcacacaccuguag

SEQ ID NO: 752949 - RNA, 18 nt, Homo sapiens
gguggcauacagacuggg

SEQ ID NO: 752950 - RNA, 20 nt, Homo sapiens
gguggcgggaauccuauuua

SEQ ID NO: 752951 - RNA, 18 nt, Homo sapiens
gguggcgguggaccaaag

SEQ ID NO: 752952 - RNA, 14 nt, Homo sapiens
gguggcucaugccu

SEQ ID NO: 752953 - RNA, 17 nt, Homo sapiens
gguggcugccucauuua

SEQ ID NO: 752954 - RNA, 14 nt, Homo sapiens
ggugggacagggac

SEQ ID NO: 752955 - RNA, 22 nt, Homo sapiens
ggugggcccccaaugacaccca

SEQ ID NO: 752956 - RNA, 19 nt, Homo sapiens
ggugggccuccucugucca

SEQ ID NO: 752957 - RNA, 14 nt, Homo sapiens
ggugggggagccag

SEQ ID NO: 752958 - RNA, 18 nt, Homo sapiens
gguggggggcauugagua

SEQ ID NO: 752959 - RNA, 12 nt, Homo sapiens
gguggggugcac

SEQ ID NO: 752960 - RNA, 22 nt, Homo sapiens
gguggucucuucuuggggccca

SEQ ID NO: 752961 - RNA, 20 nt, Homo sapiens
ggugucaggcagguuugcca

SEQ ID NO: 752962 - RNA, 21 nt, Homo sapiens
ggugucaguauccaggcuuug

SEQ ID NO: 752963 - RNA, 11 nt, Homo sapiens
ggugucauauu

SEQ ID NO: 752964 - RNA, 12 nt, Homo sapiens
gguguccauuuu

SEQ ID NO: 752965 - RNA, 14 nt, Homo sapiens
ggugugaacauguu

SEQ ID NO: 752966 - RNA, 15 nt, Homo sapiens
ggugugagcuucaga

SEQ ID NO: 752967 - RNA, 18 nt, Homo sapiens
ggugugggaagaccaaag

SEQ ID NO: 752968 - RNA, 18 nt, Homo sapiens
gguguguguucaccuuca

SEQ ID NO: 752969 - RNA, 13 nt, Homo sapiens
gguuaacuuguau

SEQ ID NO: 752970 - RNA, 12 nt, Homo sapiens
gguuaaguuaaa

SEQ ID NO: 752971 - RNA, 20 nt, Homo sapiens
gguuacaagaaacagccacu

SEQ ID NO: 752972 - RNA, 17 nt, Homo sapiens
gguuaccuuuguuccca

SEQ ID NO: 752973 - RNA, 20 nt, Homo sapiens
gguuaggauuuaacagucau

SEQ ID NO: 752974 - RNA, 19 nt, Homo sapiens
gguucaagcacacuggaau

SEQ ID NO: 752975 - RNA, 19 nt, Homo sapiens
gguucagcuaagcuaggaa

SEQ ID NO: 752976 - RNA, 22 nt, Homo sapiens
gguucccaagaguauccuaccc

SEQ ID NO: 752977 - RNA, 19 nt, Homo sapiens
gguucguucuguacuguua

SEQ ID NO: 752978 - RNA, 21 nt, Homo sapiens
gguucuacugacccaacuggg

SEQ ID NO: 752979 - RNA, 16 nt, Homo sapiens
gguucuuugcugcauu

SEQ ID NO: 752980 - RNA, 23 nt, Homo sapiens
gguugaaaaaauagauccaauca

SEQ ID NO: 752981 - RNA, 16 nt, Homo sapiens
gguugaucaguuaaaa

SEQ ID NO: 752982 - RNA, 14 nt, Homo sapiens
gguugaucuugcaa

SEQ ID NO: 752983 - RNA, 11 nt, Homo sapiens
gguugcaguga

SEQ ID NO: 752984 - RNA, 18 nt, Homo sapiens
gguugcagugaaccuaga

SEQ ID NO: 752985 - RNA, 13 nt, Homo sapiens
gguugcagugagc

SEQ ID NO: 752986 - RNA, 19 nt, Homo sapiens
gguugcagugagcugagau

SEQ ID NO: 752987 - RNA, 20 nt, Homo sapiens
gguuggagugcaguggcgug

SEQ ID NO: 752988 - RNA, 17 nt, Homo sapiens
gguugucagcugcagcc

SEQ ID NO: 752989 - RNA, 20 nt, Homo sapiens
gguugucagcugcagccacu

SEQ ID NO: 752990 - RNA, 16 nt, Homo sapiens
gguuuaggauuacuua

SEQ ID NO: 752991 - RNA, 19 nt, Homo sapiens
gguuucauguuaguuaccu

SEQ ID NO: 752992 - RNA, 19 nt, Homo sapiens
gguuuccuggcagccugcu

SEQ ID NO: 752993 - RNA, 14 nt, Homo sapiens
gguuucucuguaua

SEQ ID NO: 752994 - RNA, 15 nt, Homo sapiens
gguuucuggggucca

SEQ ID NO: 752995 - RNA, 20 nt, Homo sapiens
gguuucuuguuuaccaaaga

SEQ ID NO: 752996 - RNA, 12 nt, Homo sapiens
gguuugacaauu

SEQ ID NO: 752997 - RNA, 22 nt, Homo sapiens
gguuugagaauguuuuuagcug

SEQ ID NO: 752998 - RNA, 19 nt, Homo sapiens
gguuugagucccuccaaag

SEQ ID NO: 752999 - RNA, 22 nt, Homo sapiens
uaagagugauuagagcugcaua

SEQ ID NO: 753000 - RNA, 17 nt, Homo sapiens
uaagauauauacaugga

SEQ ID NO: 753001 - RNA, 20 nt, Homo sapiens
uaagauauucagaaguauau

SEQ ID NO: 753002 - RNA, 19 nt, Homo sapiens
uaagaucucgguuugccaa

SEQ ID NO: 753003 - RNA, 16 nt, Homo sapiens
uaagaugccagcauau

SEQ ID NO: 753004 - RNA, 19 nt, Homo sapiens
uaagauguccuccuugaua

SEQ ID NO: 753005 - RNA, 20 nt, Homo sapiens
uaagauguuuuaauauguau

SEQ ID NO: 753006 - RNA, 17 nt, Homo sapiens
uaagauuauagauucua

SEQ ID NO: 753007 - RNA, 23 nt, Homo sapiens
uaagauuauagauucuaaagauu

SEQ ID NO: 753008 - RNA, 13 nt, Homo sapiens
uaagauucuagau

SEQ ID NO: 753009 - RNA, 13 nt, Homo sapiens
uaagauucuugac

SEQ ID NO: 753010 - RNA, 14 nt, Homo sapiens
uaagauuuuccauu

SEQ ID NO: 753011 - RNA, 23 nt, Homo sapiens
uaagauuuuuuaaauugucauaa

SEQ ID NO: 753012 - RNA, 17 nt, Homo sapiens
uaagcaaacuuauuugc

SEQ ID NO: 753013 - RNA, 23 nt, Homo sapiens
uaagcagaaauccugcaaugaaa

SEQ ID NO: 753014 - RNA, 22 nt, Homo sapiens
uaagcaucaaauauuugugcaa

SEQ ID NO: 753015 - RNA, 18 nt, Homo sapiens
uaagcauugguuauucaa

SEQ ID NO: 753016 - RNA, 19 nt, Homo sapiens
uaagcccccucaacuacca

SEQ ID NO: 753017 - RNA, 15 nt, Homo sapiens
uaagccuuuccauaa

SEQ ID NO: 753018 - RNA, 20 nt, Homo sapiens
uaagcuagauacgaaaucag

SEQ ID NO: 753019 - RNA, 21 nt, Homo sapiens
uaagcuaucuucaaaugucua

SEQ ID NO: 753020 - RNA, 20 nt, Homo sapiens
uaagcucuacugaggugcua

SEQ ID NO: 753021 - RNA, 15 nt, Homo sapiens
uaagcuggagugcag

SEQ ID NO: 753022 - RNA, 16 nt, Homo sapiens
uaagcuggagugcagu

SEQ ID NO: 753023 - RNA, 18 nt, Homo sapiens
uaagcugggauaaucaca

SEQ ID NO: 753024 - RNA, 12 nt, Homo sapiens
uaagcugugauu

SEQ ID NO: 753025 - RNA, 16 nt, Homo sapiens
uaaggaaacgaugaaa

SEQ ID NO: 753026 - RNA, 18 nt, Homo sapiens
uaaggacaagacacugag

SEQ ID NO: 753027 - RNA, 15 nt, Homo sapiens
uaaggacauuuccca

SEQ ID NO: 753028 - RNA, 19 nt, Homo sapiens
uaaggagauagacggguug

SEQ ID NO: 753029 - RNA, 18 nt, Homo sapiens
uaaggcauguggccuuua

SEQ ID NO: 753030 - RNA, 23 nt, Homo sapiens
uaaggcauguggccuuuaucuca

SEQ ID NO: 753031 - RNA, 22 nt, Homo sapiens
uaaggcccagcaaucugcauuu

SEQ ID NO: 753032 - RNA, 12 nt, Homo sapiens
uaaggccugaau

SEQ ID NO: 753033 - RNA, 14 nt, Homo sapiens
uaagggaaacugcc

SEQ ID NO: 753034 - RNA, 22 nt, Homo sapiens
uaagggcagugcccauguguac

SEQ ID NO: 753035 - RNA, 15 nt, Homo sapiens
uaagggcuacuuaau

SEQ ID NO: 753036 - RNA, 15 nt, Homo sapiens
uaagguaugugcuau

SEQ ID NO: 753037 - RNA, 13 nt, Homo sapiens
uaaggugggucca

SEQ ID NO: 753038 - RNA, 18 nt, Homo sapiens
uaaguaaguuugauuuca

SEQ ID NO: 753039 - RNA, 20 nt, Homo sapiens
uaaguaaucacuaaugcuca

SEQ ID NO: 753040 - RNA, 19 nt, Homo sapiens
uaaguaaucaucuaaguca

SEQ ID NO: 753041 - RNA, 21 nt, Homo sapiens
uaaguaauugcauuucugcuc

SEQ ID NO: 753042 - RNA, 16 nt, Homo sapiens
uaaguacaacuaccua

SEQ ID NO: 753043 - RNA, 22 nt, Homo sapiens
uaaguacuauguaucaaugagu

SEQ ID NO: 753044 - RNA, 23 nt, Homo sapiens
uaaguacuauguaucaaugagua

SEQ ID NO: 753045 - RNA, 21 nt, Homo sapiens
uaaguacuugagacucuugaa

SEQ ID NO: 753046 - RNA, 16 nt, Homo sapiens
uaaguauaaacaguuu

SEQ ID NO: 753047 - RNA, 13 nt, Homo sapiens
uaaguaucagagg

SEQ ID NO: 753048 - RNA, 19 nt, Homo sapiens
uaaguaucuugugcuucuu

SEQ ID NO: 753049 - RNA, 21 nt, Homo sapiens
uaagucccgcauauacuuuaa

SEQ ID NO: 753050 - RNA, 13 nt, Homo sapiens
uaaguccuuccac

SEQ ID NO: 753051 - RNA, 15 nt, Homo sapiens
uaagucucugugaau

SEQ ID NO: 753052 - RNA, 12 nt, Homo sapiens
uaagucuuucau

SEQ ID NO: 753053 - RNA, 22 nt, Homo sapiens
uaagugaugagggccucugcau

SEQ ID NO: 753054 - RNA, 19 nt, Homo sapiens
uaagugaugugcugaauuu

SEQ ID NO: 753055 - RNA, 13 nt, Homo sapiens
uccugaaaguguu

SEQ ID NO: 753056 - RNA, 17 nt, Homo sapiens
uccugaagcugcuggag

SEQ ID NO: 753057 - RNA, 23 nt, Homo sapiens
uccugaauaaagcagacaggugu

SEQ ID NO: 753058 - RNA, 15 nt, Homo sapiens
uccugacaccugcuu

SEQ ID NO: 753059 - RNA, 14 nt, Homo sapiens
uccugacacuauuc

SEQ ID NO: 753060 - RNA, 18 nt, Homo sapiens
uccugaccucaaguaauc

SEQ ID NO: 753061 - RNA, 23 nt, Homo sapiens
uccugaccucaaguaauccaccu

SEQ ID NO: 753062 - RNA, 13 nt, Homo sapiens
uccugacugaaag

SEQ ID NO: 753063 - RNA, 20 nt, Homo sapiens
uccugagcagugccagcuuu

SEQ ID NO: 753064 - RNA, 16 nt, Homo sapiens
uccugaggagcccuga

SEQ ID NO: 753065 - RNA, 19 nt, Homo sapiens
uccugaggggcaucugccc

SEQ ID NO: 753066 - RNA, 17 nt, Homo sapiens
uccugauaaacauuaaa

SEQ ID NO: 753067 - RNA, 23 nt, Homo sapiens
uccugauaaacauuaaacacugu

SEQ ID NO: 753068 - RNA, 20 nt, Homo sapiens
uccugaucgccaaccuuucc

SEQ ID NO: 753069 - RNA, 14 nt, Homo sapiens
uccugaugacccag

SEQ ID NO: 753070 - RNA, 21 nt, Homo sapiens
uccugaugaggagaaaggggc

SEQ ID NO: 753071 - RNA, 19 nt, Homo sapiens
uccugauggagugugcaga

SEQ ID NO: 753072 - RNA, 21 nt, Homo sapiens
uccugauggcuggcaggcagu

SEQ ID NO: 753073 - RNA, 22 nt, Homo sapiens
uccugauuucuagaacccguga

SEQ ID NO: 753074 - RNA, 22 nt, Homo sapiens
uccugcaauaaaauaguagcau

SEQ ID NO: 753075 - RNA, 21 nt, Homo sapiens
uccugcagccuccuccugacc

SEQ ID NO: 753076 - RNA, 17 nt, Homo sapiens
uccugcauguucuguga

SEQ ID NO: 753077 - RNA, 15 nt, Homo sapiens
uccugccaacugauu

SEQ ID NO: 753078 - RNA, 16 nt, Homo sapiens
uccugccauagucuua

SEQ ID NO: 753079 - RNA, 22 nt, Homo sapiens
uccugcccugcccccucggggg

SEQ ID NO: 753080 - RNA, 11 nt, Homo sapiens
uccugcccuug

SEQ ID NO: 753081 - RNA, 19 nt, Homo sapiens
uccugccuaagguugucua

SEQ ID NO: 753082 - RNA, 23 nt, Homo sapiens
uccugcuacucuguuccuucaca

SEQ ID NO: 753083 - RNA, 17 nt, Homo sapiens
uccugcuucccuguuga

SEQ ID NO: 753084 - RNA, 21 nt, Homo sapiens
uccuggaaggacacagugaug

SEQ ID NO: 753085 - RNA, 14 nt, Homo sapiens
uccuggaauugcca

SEQ ID NO: 753086 - RNA, 20 nt, Homo sapiens
uccuggaccuugacagagca

SEQ ID NO: 753087 - RNA, 18 nt, Homo sapiens
uccuggagaaaagggaug

SEQ ID NO: 753088 - RNA, 15 nt, Homo sapiens
uccuggauucacuca

SEQ ID NO: 753089 - RNA, 13 nt, Homo sapiens
uccuggcacuaac

SEQ ID NO: 753090 - RNA, 21 nt, Homo sapiens
uccuggcagcccagagacuuu

SEQ ID NO: 753091 - RNA, 15 nt, Homo sapiens
uccuggccuggcaca

SEQ ID NO: 753092 - RNA, 18 nt, Homo sapiens
uccuggcuuuacagacaa

SEQ ID NO: 753093 - RNA, 21 nt, Homo sapiens
uccugggcauggguccagggc

SEQ ID NO: 753094 - RNA, 18 nt, Homo sapiens
uccugggcccaagugauc

SEQ ID NO: 753095 - RNA, 16 nt, Homo sapiens
uccuggguacugaaag

SEQ ID NO: 753096 - RNA, 14 nt, Homo sapiens
uccuggucugugaa

SEQ ID NO: 753097 - RNA, 22 nt, Homo sapiens
uccuggugccccccaccccugg

SEQ ID NO: 753098 - RNA, 20 nt, Homo sapiens
uccugguggauacuguagaa

SEQ ID NO: 753099 - RNA, 15 nt, Homo sapiens
uccuguaaauggugu

SEQ ID NO: 753100 - RNA, 19 nt, Homo sapiens
uccuguacauugugggaug

SEQ ID NO: 753101 - RNA, 21 nt, Homo sapiens
uccuguacuuuuuccagacac

SEQ ID NO: 753102 - RNA, 12 nt, Homo sapiens
uaauguacaaaa

SEQ ID NO: 753103 - RNA, 19 nt, Homo sapiens
uaauguauuuguuugcaau

SEQ ID NO: 753104 - RNA, 14 nt, Homo sapiens
uaaugucaauguua

SEQ ID NO: 753105 - RNA, 22 nt, Homo sapiens
uaaugucauagguaagaaacac

SEQ ID NO: 753106 - RNA, 17 nt, Homo sapiens
uaaugugcugagcauuu

SEQ ID NO: 753107 - RNA, 15 nt, Homo sapiens
uaauguuaauucagc

SEQ ID NO: 753108 - RNA, 20 nt, Homo sapiens
uaauguuaauucagcacuga

SEQ ID NO: 753109 - RNA, 15 nt, Homo sapiens
uaauguuauucauuu

SEQ ID NO: 753110 - RNA, 21 nt, Homo sapiens
uaauguugacuuuaauacucu

SEQ ID NO: 753111 - RNA, 20 nt, Homo sapiens
uaauguuguaauucaugcca

SEQ ID NO: 753112 - RNA, 23 nt, Homo sapiens
uaauguuuuuugccacagcuuuu

SEQ ID NO: 753113 - RNA, 17 nt, Homo sapiens
uaauuaaagaugguuua

SEQ ID NO: 753114 - RNA, 21 nt, Homo sapiens
uaauuaaauccaacuuucaca

SEQ ID NO: 753115 - RNA, 15 nt, Homo sapiens
uaauuaagggaaucc

SEQ ID NO: 753116 - RNA, 14 nt, Homo sapiens
uaauuaaguacaac

SEQ ID NO: 753117 - RNA, 12 nt, Homo sapiens
uaauuacauucc

SEQ ID NO: 753118 - RNA, 18 nt, Homo sapiens
uaauuacccacagaagga

SEQ ID NO: 753119 - RNA, 14 nt, Homo sapiens
uaauuacucuuuga

SEQ ID NO: 753120 - RNA, 17 nt, Homo sapiens
uaauuacucuuugaaca

SEQ ID NO: 753121 - RNA, 14 nt, Homo sapiens
uaauuacuucacua

SEQ ID NO: 753122 - RNA, 15 nt, Homo sapiens
uaauuagaccuaggc

SEQ ID NO: 753123 - RNA, 13 nt, Homo sapiens
uaauuaguuccag

SEQ ID NO: 753124 - RNA, 20 nt, Homo sapiens
uaauuaucgggaacaguguu

SEQ ID NO: 753125 - RNA, 19 nt, Homo sapiens
uaauuauuauuuccagugu

SEQ ID NO: 753126 - RNA, 18 nt, Homo sapiens
uaauuauugguauggaca

SEQ ID NO: 753127 - RNA, 13 nt, Homo sapiens
uaauuauuuacuc
